United States Patent 9,587,003 (MODIFIED POLYNUCLEOTIDES FOR THE PRODUCTION OF ONCOLOGY-RELATED PROTEINS AND PEPTIDES) - sequence listing, part 17

SEQ ID NO: 28984 - DNA, 1245 bp, Artificial Sequence
  Description of Artificial Sequence: Synthetic coding sequence
atggaagacatccaaacaaacgccgaacttaagtctacccaggagcaaagcgtgcctgctgagtcagccgctgtgttgaatgactactcccttaccaaatcccacgagatggaaaacgtggattctggagagggacccgcaaatgaggatgaagacataggtgacgacagcatgaaggtaaaggacgagtactccgaaagggacgagaacgtgctcaaaagcgaacctatgggcaacgctgaggaacccgagattccctacagttactcacgagaatacaacgaatacgaaaacataaaactcgagagacacgttgtgtcattcgactccagccggcctacgtcaggaaagatgaattgcgacgtgtgtggattgagctgcatcagcttcaatgtgctgatggtgcataaaagatcgcataccgccagtgcagaagccagacacattaaagccgagatgggatccgagcgggctctggtgttagaccggcttgcttccaacgtggcaaagagaaaatcttcaatgcctcaaaaattcatcggtgagaaacgacactgttttgacgttaattacaattcgagctacatgtatgagaaggaatccgagctcattcaaactcggatgatggatcaagcaatcaataatgctatctcttatttaggcgctgaagccttacggccactggtgcagactccgcctgcccctacaagtgaaatggtacccgtcattagttctatgtaccctatagcactcacaagggcagaaatgtccaacggagccccacaggaattggagaaaaaaagcatccacctgcctgaaaaatctgtcccctccgaaagaggtctctctccgaacaacagcgggcacgatagcaccgacacagactccaatcacgaggagaggcagaatcacatctatcagcagaatcacatggtgttgtcccgagcccgtaatgggatgcccctgctgaaggaggtgcccaggtcctatgaacttctgaaaccaccaccaatttgccccagagactccgtcaaagtaataaacaaagagggggaggtgatggacgtgtaccgatgtgatcactgcagggtgctgtttctagactacgttatgttcactatacatatgggctgccacggctttcgcgatcctttcgagtgcaacatgtgtggatatcgctcccacgatcgatacgagttttcttcgcacatcgctcggggtgaacatagggcattgcttaagtag

SEQ ID NO: 28985 - DNA, 1413 bp, Artificial Sequence
  Description of Artificial Sequence: Synthetic coding sequence
atggaggatatacagaccaatgcagaactgaagagcacacaggaacagagcgttccggctgagtctgcggcagttctgaatgactatagcctgacgaagtcacacgaaatggaaaatgtagattccggggaagggccagctaacgaagatgaggatatcggcgatgatagtatgaaggtgaaggacgaatactctgagcgggatgagaacgtcctgaaaagcgagcccatgggcaacgcagaagagcctgaaatcccatacagttacagcagggagtataatgaatacgagaatattaagctggaaagacacgtggtctccttcgactcctctcggcctacctcaggcaaaatgaactgcgacgtgtgtggactctcctgtatctcgttcaacgtcctaatggttcataagcgatcacataccggggaacgccctttccaatgcaaccaatgcggtgcttcattcacccagaaggggaatctactgcgacatatcaaattacacaccggggagaagccatttaagtgccatctttgtaattatgcatgccagaggcgagacgcgttaactgggcacctgagaacacactcagttgagaagccctacaaatgcgaattctgcgggcgttcctacaagcagagatcctctctcgaggaacataaggaacggtgccgaactttcctgcaatcaacagacccaggcgacactggcgagaaacgccattgcttcgacgtgaactacaattcctcttacatgtacgagaaagaaagcgagctgatccagactaggatgatggaccaggccattaataacgcaattagctacttgggggctgaagctctaagacctttagtacagactccgcctgcccctacctcagagatggttccggtgatctctagcatgtatcctatcgccctcacacgggctgagatgtccaacggtgccccacaggaactcgaaaagaaaagtatccacttgccagagaagagcgtgccatccgagcggggtcttagccccaataacagcgggcacgactcaaccgatactgatagtaaccatgaggaacggcagaatcatatctaccaacagaaccacatggtgctgagtcgcgctcggaatggaatgcctctcctgaaagaggttcctcgctcctacgaattactgaaacctcccccaatttgtccaagggactctgttaaggttatcaacaaggaaggcgaagtgatggatgtctaccggtgcgaccattgtcgtgtgcttttccttgactacgtaatgttcactatccacatggggtgtcacgggtttagggacccatttgaatgcaacatgtgtggctaccggtcccacgatagatatgagttttcgagtcatatcgctcgaggcgagcaccgggctctccttaagtag

SEQ ID NO: 28986 - DNA, 1413 bp, Artificial Sequence
  Description of Artificial Sequence: Synthetic coding sequence
atggaggacattcagactaatgctgaactcaagtccacgcaagaacagtctgtacccgctgaaagcgccgcagtcttaaacgattacagtctaacgaaatcacatgaaatggaaaatgtcgactcgggcgagggaccagcaaatgaggatgaggacatcggcgacgattcgatgaaggtgaaggacgaatattccgaacgcgacgagaacgtgttgaaatctgaaccgatgggcaacgccgaagaacccgaaatcccttattcttatagtcgcgagtataatgaatacgaaaacatcaaactcgagcgacacgtcgtgagtttcgactccagcaggcccacatccggcaaaatgaactgcgatgtctgcggtctatcctgtatctctttcaacgtgctgatggtgcacaagagatcacacaccggggagcgtcccttccagtgtaaccaatgtggcgctagcttcacgcagaagggaaacctgctgcgtcacatcaaattgcacactggtgagaaacctttcaaatgccacttatgcaactatgcttgtcagcgaagagacgctctgactggccacctgaggacccacagtgccagcgccgaagcccgtcacataaaggctgaaatgggtagtgaacgtgcactggtcctagatagattagcgtctaatgtggctaaaagaaaatcgagtatgccccagaagtttattggggagaagcggcactgttttgacgtcaattacaattcctcctatatgtatgagaaagagagcgaacttatccagactcggatgatggatcaggccattaacaatgccatctcgtacctgggcgcagaggcattgcggccactggtgcagacaccacctgcccctacctctgaaatggtgccagtcattagcagcatgtaccccatcgctctgacacgagctgagatgagcaacggcgctcctcaggaacttgagaaaaaatcaatacacctacctgagaaaagcgttccaagcgagcgcggactctctccaaataacagcgggcacgacagtaccgacacagactcaaatcatgaggagcgccagaatcatatttatcagcaaaaccacatggtcttgagccgcgctagaaatggcatgccgcttctcaaggaagtcccacggtcctatgaattactgaagccacccccaatttgcccaagggactctgtgaaagtgatcaataaggaaggcgaggtcatggacgtttacagatgtgatcactgccgggtgctttttttggactacgtgatgtttaccatacacatggggtgtcatggcttcagggatccgttcgagtgtaacatgtgtggataccgttcacatgatcggtacgagtttagcagtcacattgcacggggtgagcaccgggcattgttgaaatag

SEQ ID NO: 28987 - DNA, 1101 bp, Artificial Sequence
  Description of Artificial Sequence: Synthetic coding sequence
atggaagacatccagacaaatgccgaacttaagagcactcaggagcaatccgtaccggctgagtcagcagcagtcttgaatgactacagtctcaccaaaagtcatgagatggagaacgtcgatagcggagaaggtcctgcgaatgaagacgaggacataggcgttgagaagccttataagtgtgagttctgcggccgatcctacaagcagcgcagttcccttgaggagcataaggagcgctgtagaacttttctgcagagcacggacccaggcgatactgcttcggccgaggccagacacataaaagccgaaatgggcagcgagagggccctggtcctcgatagactggcaagtaatgtcgcaaagcgcaaaagtagcatgccccaaaaatttatcggtgagaaaagacactgtttcgatgtgaactacaattctagttacatgtatgaaaaggagtccgagttgatccagactagaatgatggatcaggccataaacaatgcaattagttatctaggagccgaggcgctccgcccactggtccagaccccaccggctcctaccagcgagatggtccccgtgatctcctctatgtatcccatcgctctgacacgcgctgagatgagcaatggtgccccacaggagttagaaaagaagtccattcacttgcctgaaaagagtgtgccaagcgagagggggctgagcccaaataactccggtcacgactccactgatacagatagtaaccacgaggagcgccagaaccacatatatcaacaaaaccatatggtgctatcacgcgctaggaatggcatgcccttactgaaagaagtgcccagaagctacgagctgctgaagcctccacctatttgccctcgtgactctgtcaaggtgattaacaaagagggagaagttatggatgtctacaggtgtgaccattgccgcgtgctttttctagattatgtgatgtttaccatccacatgggctgtcacggcttccgggaccccttcgaatgcaacatgtgtggatatcggagccacgaccggtatgagttttcttcacatattgccaggggagaacaccgcgctctgttgaaatag

SEQ ID NO: 28988 - DNA, 1128 bp, Artificial Sequence
  Description of Artificial Sequence: Synthetic coding sequence
atggaagacatccagactaacgctgagttgaaaagtacacaagaacagagtgtgccggcagagagcgccgcagtgctgaacgattacagcttgacaaagagccacgaaatggaaaacgtggactccggcgaaggcccagccaacgaggatgaggatataggcgacgattctatgaaagtcaaagacgaatacagtgagcgcgacgagaacgtcctcaagtcggagcccatggggaacgcagaggagcccgagattccttattcttatagccgagagtataacgagtacgaaaatatcaaattagagcggcacgtcgtgagcttcgacagcagtaggccaacctcaggaaagatgaattgtgatgtctgcggtctgtcctgtattagtttcaacgttctgatggttcacaaacggagtcataccggcgagaagagacactgcttcgacgtgaattacaatagtagttacatgtacgagaaagagtccgaactcatacagaccagaatgatggaccaggcaattaacaatgctatcagctatcttggcgctgaggcactaagaccactggtccagactccccctgccccaacatctgaaatggtgcccgtcattagttccatgtacccaattgcacttacccgggctgagatgtccaacggggctcctcaggagctggaaaaaaaaagcatccacctcccggaaaaatccgttccctctgaacgcggactctctcctaataatagtggtcacgacagcactgacacggactccaatcacgaggaacgtcagaaccatatttaccaacagaaccacatggtgctctccagggcaagaaacggaatgccacttcttaaagaagtccccagaagctacgaactgctgaagccgccaccgatttgccctagggatagcgtgaaggtcattaataaggaaggagaggtaatggacgtatacaggtgcgatcattgcagggtgctttttctcgattacgtgatgtttacaatacacatggggtgtcacggcttccgcgatccattcgaatgtaacatgtgcggttacagatctcacgataggtacgaattcagttcccacattgctcgcggagaacatcgcgcacttcttaagtag

SEQ ID NO: 28989 - DNA, 867 bp, Artificial Sequence
  Description of Artificial Sequence: Synthetic coding sequence
atggaggacattcagaccaatgccgagttaaaaagtacacaagaacagtctgtgcccgcagaatctgctgctgttttaaacgactactctctgaccaaaagccatgagatggagaacgtggacagcggagaagggccagcaaacgaagacgaagacattggtggcgaaaagaggcactgcttcgacgtgaattacaactccagttatatgtacgagaaagaatctgagctcatccagacaaggatgatggaccaggccataaacaatgccatctcttacttgggcgcagaggctcttaggcccttggttcagaccccgcctgcccctacttctgaaatggtcccagtgatttctagcatgtatccaattgccctgacaagggccgaaatgtccaatggcgcaccccaagaattagaaaagaagagtattcatctgcctgagaagagcgtgcccagcgagcgaggactctctccgaacaactcgggccacgatagtaccgacaccgactccaaccacgaggaacgacagaatcatatttaccagcagaatcatatggttctgagtcgggcacggaacggaatgcccctcctgaaggaagtccccagaagctacgagctcctgaagcctcctccaatctgtcctcgagatagtgtaaaggttatcaataaagagggagaggtcatggacgtttatcgctgcgatcactgccgggttctatttctcgactacgtaatgttcaccatacatatgggctgtcatgggttccgggatcctttcgagtgtaacatgtgcgggtacagatcccacgataggtacgagttttcctcacatatcgcgcgaggcgagcaccgagccctgctcaaatag

SEQ ID NO: 28990 - DNA, 1269 bp, Artificial Sequence
  Description of Artificial Sequence: Synthetic coding sequence
atggaggatatccagacgaatgccgaactgaagagcacacaagagcagagtgtgccagctgaatccgccgctgtgttgaacgattattctttgacaaaaagccacgagatggaaaacgtggactcaggcgagggacctgctaatgaagatgaggatatagggggagagcgtcccttccagtgtaaccaatgcggcgctagcttcacacagaaagggaatctgctgaggcatattaagctccacacgggggagaaaccttttaaatgtcacctgtgtaattacgcatgtcaacgacgcgacgcactgaccggtcacctcaggactcacagcgtggaaaagccctacaaatgcgagttctgtggcagatcatacaagcaaagatctagtctcgaggaacacaaagagcgctgtagaactttcttgcagtcgaccgacccgggtgatacagcctcagctgaagccagacacataaaagctgagatgggctcagagcgtgctctggttcttgatcggctggctagcaacgtggcgaagcgcaaatccagtatgccgcagaaatttattggggaaaaaaggcactgtttcgacgttaactacaacagcagctacatgtatgaaaaggagtcggaattaatccagacccggatgatggaccaggctatcaacaatgccatcagttacttgggggctgaagctctgcggcctttggttcagactcccccagcgccaacctccgagatggtgcccgtgatatcctcgatgtaccccattgctctgacgcgagcagagatgagtaacggggctccccaggagctggaaaaaaaaagcatccatttacccgaaaaaagcgtgccatcggaaagaggattaagcccaaacaactcaggacacgatagcaccgacaccgatagtaaccatgaggagaggcagaatcatatttaccagcagaaccacatggtgttgtcccgcgctagaaatgggatgccccttctcaaggaagtacctcggtcttacgaattattaaaaccaccccctatttgtccacgagatagcgttaaggtaatcaataaagagggagaggtcatggacgtgtatcggtgtgatcactgtagggttctgttcctggactatgtgatgtttacgattcacatgggctgtcacggcttccgggacccttttgagtgcaacatgtgtgggtatcgcagtcatgacaggtacgagttttcatcacatatagctagaggggaacacagagccctactgaagtag

SEQ ID NO: 28991 - DNA, 984 bp, Artificial Sequence
  Description of Artificial Sequence: Synthetic coding sequence
atggaagatatacagacaaacgcagaactaaaatcaacacaagagcagtccgtgcccgctgaatccgcagccgttctgaatgattattccctgactaagtctcacgagatggagaacgtcgattccggggagggtccggctaacgaagacgaggatataggggcttccgccgaggctagacacattaaagccgaaatggggagcgagcgcgctctggtcttggaccgcttggctagcaatgttgccaagagaaagtctagcatgccgcagaagtttattggagaaaagcggcattgctttgacgttaattataacagctcatacatgtacgagaaagagtcagaactcatacagacaagaatgatggaccaagcaattaataatgcaatcagttatctaggagccgaggctttacggccattggttcagaccccccctgcacccacttcagagatggttcccgtgataagctcgatgtatccaatcgctctgacccgggcagagatgtcaaatggcgctccccaggaactggagaagaagtccattcacctccccgaaaaatctgtgccgagtgagcgcggactgagtcccaacaattcaggccacgattccactgataccgatagtaaccatgaggagcggcagaaccatatttatcaacagaatcatatggtgctatctagggcacgcaatgggatgcccctgctgaaggaggtaccccgtagttacgagttactgaaacctcctcctatctgcccacgagattccgttaaagtgatcaataaggagggagaagtaatggatgtgtaccggtgcgaccactgcagggtcctgttcctggattacgtaatgtttacgattcacatgggctgccacggttttcgtgaccctttcgaatgtaacatgtgcgggtaccgctcccatgatcgttacgagtttagcagccacattgccaggggagaacacagggctctcctgaaatag

SEQ ID NO: 28992 - DNA, 1392 bp, Artificial Sequence
  Description of Artificial Sequence: Synthetic coding sequence
taacaggaacagagtgtgcctgcagatgactccatgaaagtcaaggatgaatattctgagcgggacgaaaatgtgctcaagtctgagcctatgggaaacgcagaggaaccagaaataccttactcctactcacgagagtataacgaatacgagaacattaagctggaaaggcatgtggtgtcatttgatagctcaaggcccacctctgggaagatgaactgtgatgtttgtgggcttagttgcatatcttttaacgtcttgatggtgcacaaacggagccataccggcgagagacctttccagtgcaatcagtgtggggcaagcttcacgcagaagggaaacctgctgcgccatataaagttgcatacaggcgagaagccgtttaaatgtcatctgtgtaattacgcgtgtcaacggcgtgatgcgctcacagggcatctcaggacccattcggttgagaagccatataagtgtgaattttgtggcagaagctacaagcaacggtcgagcctcgaggagcataaggagcgatgccgcactttccttcagagtacggacccaggagacaccgcatccgcggaggcaagacatattaaagcggagatggggagtgaaagggctcttgtcctggacaggctggcaagcaacgtggccaaacggaagagctccatgccccaaaaatttattggagagaaacgacactgctttgatgtgaattacaatagctcgtacatgtatgagaaggaaagcgagctcatccagacgagaatgatggatcaggcgataaataatgccatatcctatttgggagccgaggctcttcgaccactggtacaaaccccccctgcccctacatccgagatggtgcctgttataagcagtatgtacccaattgccctgactcgggctgagatgagtaatggagctccccaggagcttgaaaaaaagtcaattcatctgccggagaaatcagttccatctgaaagggggctgagtccaaataattccggccacgactctactgatactgacagcaaccacgaggaacgacagaatcatatttaccaacagaatcacatggtcttgtccagagcccgaaatggaatgccccttttgaaagaggtaccacggtcttatgagctgctgaagcctccccctatctgtccacgtgatagcgtgaaggtgattaataaggagggagaggtaatggacgtctatcgctgtgaccactgccgggttctctttctcgactacgtgatgtttacgatacatatgggctgccatggatttagggaccctttcgagtgcaacatgtgcggctaccgttctcatgatcgctatgaattctccagccacattgctaggggtgaacacagagctctgctgaagtag

SEQ ID NO: 28993 - DNA, 1275 bp, Artificial Sequence
  Description of Artificial Sequence: Synthetic coding sequence
tgacaggagcaaagcgtaccagccgatgacagtatgaaggtgaaagacgagtatagcgagcgggatgaaaacgtgctaaaatccgaaccaatgggaaacgccgaggagccagagatcccctatagctatagtcgtgagtacaacgagtatgagaacataaagctggaaaggcacgtggtttcattcgactccagcaggcctacctctggaaagatgaattgcgacgtctgcggcctctcgtgtatcagtttcaacgtcctgatggtacataaaagatctcacaccggcgaacgtcctttccagtgtaatcagtgtggagcgtcattcacacaaaagggaaatctcctccgccacattaaacttcacactggcgagaaaccattcaagtgccatctgtgtaattatgcctgccagcgcagagatgccctgaccggccacctgcgcacccactcagcttccgccgaggcacgacatatcaaggctgaaatgggatcagagcgagcgctggtcctggaccgactcgcctctaacgtggctaagaggaaatcatcgatgcctcagaaattcattggcgaaaaaaggcactgcttcgatgtgaattataactccagttacatgtacgaaaaggaatccgagcttattcagacacgcatgatggaccaagcaattaacaatgcaatatcttatttgggggcagaggcacttcgcccactagtgcagacaccaccggcacctaccagcgaaatggttcctgtaatcagctcaatgtatcctattgcccttacccgggcagagatgtccaatggtgccccacaggaactggagaaaaagtccatccatcttccagaaaaatcagtgccatctgaacgaggtctctcccccaataattccggacatgacagtacagacacggattctaaccacgaagagaggcagaatcacatttatcagcagaatcatatggtgctgtcccgggcaagaaatggcatgcctctccttaaggaagtacctcggagctatgaacttctgaagcccccacctatttgtcccagagattcagtcaaggtaatcaataaggagggagaggtgatggacgtctaccgctgcgaccattgccgcgtcctgtttctggattacgtaatgttcacaattcacatgggctgccacggcttccgcgacccgttcgaatgcaacatgtgcggctacagaagtcacgaccggtacgagttttccagtcatatcgcaagaggggaacatagagccctcttaaagtag

SEQ ID NO: 28994 - DNA, 1362 bp, Artificial Sequence
  Description of Artificial Sequence: Synthetic coding sequence
atggaagatatacagaccaacgcagagctgaaaagcacccaagagcagtccgtgccagctgagagcgcagcagtgctgaacgattatagcctgacaaaaagtcacgaaatggagaacgtggactctggggagggtcccgcaaacgaagacgaagacataggggatgacagcatgaaagtgaaagatgagtacagtgaacgggatgagaatgttcttaagtctgagcctatggggaatgccgaagagcctgagatcccttactcctactcaagggagtacaatgagtacgaaaacattaagctggagcgccatgtggtgtcctttgactcctcccgccctactagcggcaagatgaattgtgacgtctgcgggctatcttgtatcagctttaacgttttgatggtccacaaaaggtcccacactgtggaaaagccttataagtgcgaattttgtggacgctcatacaagcagcggtcttccttagaagaacacaaggagcgctgtaggaccttcctgcaatcaactgatcccggagacaccgcttctgccgaagcccgtcacattaaagctgaaatgggttcagagagagccctcgtcctggacagattggcatccaatgtcgcgaaacgtaaaagctccatgcctcagaagttcatcggggagaagcgccactgttttgatgtgaactataattcgagctatatgtacgagaaagagagtgagttgatccagacccgaatgatggaccaggctatcaataacgctataagttaccttggggctgaggccttgaggcccttagttcagacgccgcctgccccaacctcggaaatggtccctgtgatctctagcatgtatccgatcgcactgacacgcgcagaaatgtcaaatggcgcacctcaggagctggaaaagaagagcatccacctgccggaaaaaagtgtgccatcagagcgcggattgagtccaaataacagcgggcatgattctacagacacagatagcaaccacgaagagcgtcagaatcacatataccagcagaatcatatggtattatctcgcgcaaggaacggcatgccgctcctgaaggaggttcctcggtcatatgagctgcttaagcctcccccaatttgccccagggatagcgtcaaagtgattaacaaggaaggggaggtcatggacgtgtaccgctgcgaccactgccgggtcctgtttctagactacgtcatgtttacgattcatatgggttgccacggatttagagatccattcgagtgcaacatgtgtgggtacagatcccacgatcggtatgagttctctagccatatagctaggggagagcaccgcgctctactgaaatag

SEQ ID NO: 28995 - DNA, 1530 bp, Artificial Sequence
  Description of Artificial Sequence: Synthetic coding sequence
atggaagacatccagactaatgccgagttaaagagcacccaagagcaaagtgtgcccgcagagtctgctgccgtccttaatgactactcattgacaaagagccatgaaatggagaacgtggatagtggggagggtcccgctaatgaagacgaggatataggcgacgattccatgaaggtcaaagatgaatactccgagagggatgaaaacgtgcttaaaagcgaacctatgggcaacgctgaagaaccagagattccttactcatattctagggagtataatgagtacgagaacatcaaattggaaagacatgtggtcagctttgatagctctcgaccaacctcaggaaagatgaactgtgatgtgtgtggcctgtcctgcattagttttaatgtactgatggtccacaagcgaagccacacaggggaacgcccttttcagtgtaaccagtgtggtgctagttttacgcagaaggggaacctccttcggcatattaaattacacaccggagaaaaacccttcaagtgccacctctgcaactatgcatgtcagcgtcgggacgccttgactggacatctccgaacacactcagttgaaaagccatacaagtgtgagttttgtggacgttcgtacaagcagcgaagctctctggaggagcacaaagagagatgtcgtacttttctccagtccacagaccctggcgatactgcaagcgccgaggcccgacacattaaggctgagatggggtccgagcgggcactggtcctggataggcttgccagcaatgtggcaaaaaggaagtccagcatgccacagaagttcataggggagaagaggcactgttttgacgttaactacaactcaagttatatgtacgaaaaggaatccgaactgatccagaccaggatgatggatcaggctattaacaatgctatctcctaccttggcgctgaagctctcagaccactggtgcagacacctcccgcacccaccagcgagatggtgccggttatttcatcaatgtatcccatagcgctgacaagagccgaaatgtccaatggcgcaccccaagaactggaaaaaaaatccatacacctgcctgaaaagagcgtgccatcagaacggggtctgtcacctaacaattctggccatgactccactgataccgactcaaatcacgaggagcggcaaaaccacatttatcagcaaaatcacatggtgttaagtcgggcacgtaacggaatgcctttgctgaaggaagtgccccgtagctacgagctcctcaaacccccacccatctgtcctcgcgactcagtgaaggtcattaataaagagggggaggtgatggacgtgtacaggtgtgatcattgtcgggtcttattccttgattatgtcatgtttacaattcatatggggtgccacgggttcagagatcctttcgaatgcaacatgtgcgggtacagaagtcacgacagatacgagttttctagtcacatcgctaggggcgagcaccgtgcgctcttaaagtag

SEQ ID NO: 28996 - DNA, 1428 bp, Artificial Sequence
  Description of Artificial Sequence: Synthetic coding sequence
atggaggacatacagactaacgccgaattgaagagcacacaggaacagtcagtgccggctgatgacagtatgaaagttaaggatgaatattcagaacgagacgagaacgtgctgaaatctgaaccaatgggtaacgcagaagaacccgagatcccgtactcttacagccgggagtataacgagtacgagaatattaagctggagcggcacgtggtcagcttcgacagctccaggcccaccagcggcaaaatgaattgtgacgtctgcggactgagctgcatcagtttcaacgtgttgatggtgcacaagaggagccatacaggagagaggccctttcagtgtaaccagtgtggggcttcatttacccagaaggggaacctcctgaggcacataaagctccacaccggggaaaagccttttaaatgccatctgtgtaactacgcctgtcaacggagggatgccctgaccggccatttgcgtacccactctgtggagaagccgtataagtgtgaattctgtggcagatcatacaaacaacgctctagtcttgaggaacataaagagcgatgtcgaacatttctgcagagtactgaccctggagacaccgcatccgcagaagctcgccatatcaaagccgagatggggagcgagcgagcccttgtgcttgaccgtctcgcttctaacgtggctaaaaggaaatccagtatgccacagaaattcataggagaaaagagacattgcttcgacgtgaactacaattcttcttatatgtacgagaaggaaagcgagctcatccaaacccgcatgatggaccaggcaatcaacaacgcaatttcctatctaggagcggaagcactgaggcctctagtgcagactcctcctgcacccacctcagagatggtgccagtaatttcaagtatgtacccgattgccttgactagggcggaaatgtcaaacggcgctccacaagaactagagaagaaaagcatccatctgcccgaaaagtccgtcccttccgaaagaggcctgtccccgaacaactctggccacgatagtaccgatactgacagtaatcacgaggagcgccagaatcacatatatcagcaaaaccacatggtcctcagcagggctcgaaacggtatgcccctgctgaaggaagtgcctcgctcctatgaactcctcaagcctccacccatctgtcccagggactcagtcaaggtgataaacaaagagggggaggttatggatgtctaccgctgcgaccactgtcgagtgctattcctggattatgtgatgtttacgatccacatgggatgccacggattcagggacccattcgaatgcaacatgtgcgggtatcgttctcacgatcgatacgagttctctagtcatatcgccaggggcgagcaccgggctctgctaaagtag

SEQ ID NO: 28997 - DNA, 450 bp, Artificial Sequence
  Description of Artificial Sequence: Synthetic coding sequence
atgaaagtggcctccggttccactgctacagcagccgctggacccagctgtgcgcttaaagctggcaagactgccagtggcgcaggcgaggtagtgaggtgcctgtcagaacagtccgttgccatctcacgctgcgctggcggtgctggcgctcgtctcccagctctcctggacgaacaacaggtcaatgtactgctttatgatatgaacggatgttatagccgcttaaaggaactggtgcctacgctaccacaaaaccgaaaggtatccaaggtcgagatcctgcagcacgtgattgactatatccgcgatcttcagttggaattgaattccgaatcggaggttgggacccctggcggaaggggtctgccggtcagggccccactgtcgacgcttaacggggagattagtgccctaacagcggaagttaggagccgtagcgaccactag

SEQ ID NO: 28998 - DNA, 468 bp, Artificial Sequence
  Description of Artificial Sequence: Synthetic coding sequence
atgaaggtcgccagcgggagtaccgcaacggccgctgcaggcccatcatgtgccctgaaggcagggaagactgcctcaggggcaggcgaagtggttcggtgtctgtccgagcagtcagtcgctatttcccgctgcgctggaggcgcaggggcaagacttcctgccctactcgatgaacaacaagtgaacgtcctgttatatgacatgaatggctgctactcaagactgaaagagttggtgcctacattaccacaaaaccgtaaggtgtcaaaagtagaaattctccagcatgttatcgactacatacgcgatctccagttagagttgaattctgagagtgaggtcgggacccccggtgggagggggctgcccgtgagggcccctctgtcaaccttaaacggcgagatcagcgctctgaccgcagaggctgcctgcgtgccagcagatgacaggatcctttgtaggtag

SEQ ID NO: 28999 - DNA, 738 bp, Artificial Sequence
  Description of Artificial Sequence: Synthetic coding sequence
atggcggcaggtatgtatctggagcactacctggatagcatcgaaaatctgcccttcgagctgcagcgcaattttcaactgatgcgggatctggatcaaaggaccgaggatctcaaggctgaaatagacaagctggctacagagtacatgagctccgccagaagtttgagctcggaagagaagctcgcgctcctgaagcaaatccaggaagcttacggtaaatgtaaagaattcggtgatgataaggtgcagttggccatgcagacctacgagatggttgacaaacacatcagacggctagataccgacctcgcacgttttgaggccgatctgaaggagaagcaaatcgagagtagtgactacgacagttcctcctcaaaaggacggacccagaaagagaagaaggccgctagagctcgtagtaaaggcaagaactccgacgaggaagcccctaaaaccgcccagaagaagttgaaactggtgcggactagcccagagtatggaatgccttcagttacatttgggtcggtacatccctctgacgtgctggacatgcccgtagacccgaatgagccaacctattgcttatgtcaccaagtgtcttacggtgagatgatcggttgtgacaaccctgattgttctatcgaatggttccatttcgcctgcgtcggattgaccaccaaaccccgagggaaatggttttgtcccagatgctcccaggaacgcaagaaaaagtag

SEQ ID NO: 29000 - DNA, 840 bp, Artificial Sequence
  Description of Artificial Sequence: Synthetic coding sequence
atgctttctccagctaatggagaacagctccacctggtgaactacgtggaggattatctggattcaatcgagagtctcccttttgacctgcaaaggaatgtgtcattaatgcgtgagatcgatgcaaaataccaggagatccttaaggagctggacgagtgctacgagcggttttctagggagaccgatggggcacagaaacgcagaatgctccattgcgttcagcgcgctctcatccgaagtcaggagcttggtgatgaaaaaatccaaatcgtgagtcaaatggtggagctggtggagaataggaccaggcaggtggatagtcatgtggaactgtttgaggcgcagcaggagctgggggacacggcaggcaattcagggaaagccggagctgacagaccaaagggtgaagccgctgcccaagcagacaaacctaatagtaaaagatcaaggaggcaacgaaataatgaaaatagagaaaatgcttcctcaaatcatgatcacgatgacggagcgagcggaaccccgaaagaaaaaaaggctaaaacctcgaaaaagaagaagaggtctaaggcaaaagccgagcgagaagcatcccccgcagacctccccattgatcctaacgaacctacctattgtctgtgtaatcaggtctcatatggagaaatgataggatgtgacaacgatgagtgtcctattgagtggtttcatttctcttgcgtggggctgaatcacaaacccaaaggcaaatggtactgtcctaaatgccgaggggagaacgaaaagaccatggacaaggccctggaaaaaagcaagaaggagcgcgcatataaccggtag

SEQ ID NO: 29001 - DNA, 708 bp, Artificial Sequence
  Description of Artificial Sequence: Synthetic coding sequence
atggagatattgaaagaactcgatgaatgctacgaaaggttctcccgggaaacagacggcgctcagaaacgcaggatgttgcactgtgttcaaagggcattgattcgtagtcaagaactcggagatgagaaaattcaaatcgtaagccagatggtggagctcgttgagaaccgtacacgccaagttgatagccacgtagagctgttcgaggctcaacaagagttaggtgacacggcgggaaacagcggtaaggccggtgcagaccgcccaaagggggaagcggcagcccaggcggacaagcccaattcaaaacgtagtcgtaggcagaggaataacgagaacagagagaacgcttctagcaatcatgaccatgacgatggcgcttctggcacaccaaaggagaaaaaagcaaaaacatctaaaaagaagaagcgttctaaggccaaggcggagcgcgaggcaagtcccgctgacctgccgattgaccccaacgaacctacctattgcttatgcaaccaagtgagctatggagaaatgataggatgcgacaatgatgagtgtccgatagaatggtttcacttctcttgcgtcggccttaaccacaagcccaaggggaaatggtactgtcctaaatgccgcggtgaaaatgaaaaaacaatggataaagccttggaaaaaagcaagaaagaaagagcatataaccggtag

SEQ ID NO: 29002 - DNA, 1269 bp, Artificial Sequence
  Description of Artificial Sequence: Synthetic coding sequence
atgagcttcgtggagtgcccctaccactcgcccgctgagaggttggtggccgaagctgacgaaggaggtccttcagctatcaccggaatgggactttgtttccggtgtctgctgttttccttctccggaagatctggggtggagggaggccgtgttgatctaaatgtgtttggttcactgggattgcagccttggatcggaagctcccgatgctggggaggaccttgctcatccgcacttcgatgtggctggttctcaagctggccaccaccatccaagagtgccattcctataggaggcggatccaggggcgctggacgggtgtccagatggcccccaccccactggctcgaggcatggagggtctcacccctgcccctctcgcccttaagccctgctactttcggccgagggttcatcgccgtcgccgtgattccgggtctgtgggccagggggcgtggctgcagttctgaccggttacccagacctgccggtccagcccgtaggcagtttcaagccgctagcctgctcactcgtggatggggcagagcctggccctggaaacagattctgaaagaactggatgagtgttatgagcgtttcagccgggaaacagatggagctcaaaagcgacgcatgctccattgcgtccagcgtgctctgatcaggtcccaggagctcggcgatgaaaaaatccaaattgtgagccagatggtggagttggttgagaaccgtacccgacaggttgattcgcacgtagagctgtttgaagcccagcaagagctgggggatacggccggaaactccggcaaagctggcgctgaccgacctaaaggagaagcggctgcacaggcggacaagccaaactccaaacggagccgcagacaaaggaacaacgaaaacagggaaaatgcgtccagtaatcacgaccacgatgacggcgctagcggtacccctaaagagaaaaaggccaaaacctcaaagaagaagaaaagaagtaaggctaaggcggagcgcgaagcatcacccgctgatctgccgattgaccctaatgagcccacgtactgtttgtgtaatcaggtttcttacggtgagatgatcgggtgtgataacgatgaatgtcccattgagtggtttcatttcagctgtgtgggactgaaccacaagcccaagggcaagtggtactgtcctaagtgtcgtggggaaaatgagaagaccatggacaaggcgttagagaagtctaaaaaagaacgagcttacaatagatag

SEQ ID NO: 29003 - DNA, 633 bp, Artificial Sequence
  Description of Artificial Sequence: Synthetic coding sequence
atgttacactgcgtccagcgcgcattgatcagaagccaggagctaggggacgagaagatacagatagtgtcccagatggtggagctggtggaaaatcggaccaggcaagttgatagccatgttgaactgttcgaggcccagcaggaactgggcgatactgccggtaattcagggaaggctggggctgaccgccctaagggagaagctgccgctcaggctgataagcccaactctaagcgctctagaagacagaggaataatgagaatcgcgaaaatgcttcatctaatcacgaccacgatgatggggcaagcggaacacctaaggaaaagaaggctaaaactagtaagaaaaagaaaagaagtaaagccaaagctgaacgtgaagcctccccggcagacctacctatcgatcctaacgaaccaacttactgtctgtgtaaccaggtctcctatggtgaaatgatcggatgcgacaatgacgagtgtcccatcgaatggtttcatttctcttgtgtgggcctgaatcataaaccaaagggcaagtggtactgcccgaagtgcaggggtgagaatgaaaaaacaatggacaaagctctcgagaagtcaaaaaaagagcgggcatacaaccgttag

SEQ ID NO: 29004 - DNA, 747 bp, Artificial Sequence
  Description of Artificial Sequence: Synthetic coding sequence
atggctgcgggaatgtatctggagcattaccttgattccatagagaatcttccctttgagttacagcgcaatttccagttgatgcgggacttggatcagagaacggaggatttgaaggcggaaatagacaaactggcgactgaatatatgagttctgcccgtagcttatcctccgaggaaaagctggcattgttgaagcagatacaagaagcatacggcaaatgcaaagagtttggagacgataaggtccagttggctatgcaaacgtatgaaatggtagacaaacacatacgtcgcctcgacactgacctcgcacgatttgaggccgatctgaaggagaaacagatcgagtctagtgactacgactctagttcctccaagggcaaaaagtctcgaacccagaaggagaagaaagccgctcgggctagatccaaaggcaagaacagtgacgaggaggcgcctaagacagcccagaagaaactcaagctagtcagaacctcccccgagtacggcatgccctctgtgacattcgggtcagtgcatccatccgacgtcctcgacatgccagtggacccaaacgaaccaacttactgcctgtgtcaccaggtttcttatggcgagatgataggatgcgacaatcctgactgttcaatagagtggtttcatttcgcgtgcgtgggtctaactacgaaacccagaggcaaatggttttgccccaggtgctcccaggagagaaagaaaaagtag

SEQ ID NO: 29005 - DNA, 750 bp, Artificial Sequence
  Description of Artificial Sequence: Synthetic coding sequence
atggctgctggcatgtacttagagcattacttggacagcatcgagaatctaccttttgagctgcagaggaatttccagctgatgagggacctggatcagcggacagaggacttgaaggcagagatcgacaagttggctacagagtacatgagctctgcaaggagtctgtcctcggaagagaaactggcgcttctcaaacaaatccaagaggcctacggtaaatgcaaagaatttggggacgacaaggtacagctggcgatgcagacctacgaaatggttgataagcacattaggcggctcgatacagatttagcaagatttgaggctgacctgaaggagaagcagattgagagcagtgactacgactccagttcatcaaaaggcaagaagaaggggagaacgcaaaaggagaagaaagcagctagggcaaggtccaaaggtaagaatagtgatgaagaagctcccaagactgcccagaagaaactgaaactggttaggacaagcccagaatatggaatgccgtccgttacatttggatctgttcacccaagtgatgtactggatatgcccgtggatccaaacgaaccgacatactgtctgtgtcaccaggtgtcttacggcgagatgatcgggtgtgacaaccccgattgctctattgagtggttccacttcgcgtgcgtagggctaaccactaaaccacggggaaagtggttttgccctaggtgctctcaggagcgaaagaagaagtag

SEQ ID NO: 29006 - DNA, 741 bp, Artificial Sequence
  Description of Artificial Sequence: Synthetic coding sequence
atggccgctggcatgtatttggaacattacctggactctatcgagaacctgcctttcgagctacagcgcaattttcagttaatgagagacctggaccagaggacagaagacctgaaggccgaaatcgataagttggccacggaatatatgagttccgcaaggtcgctttcttctgaagagaaactcgccttactcaaacagatacaagaagcctatgggaagtgcaaggaattcggagacgacaaagtccagttagcgatgcagacgtatgaaatggtggacaaacacatacgacggctagacaccgacttggctaggttcgaagccgacttgaaggagaagcagatagaaagttcagactatgactcctctagctcaaaggaagggcgtacacaaaaagagaaaaaagcagcgagagctcggagtaaagggaagaactctgacgaggaggctccgaaaaccgcacagaagaagttaaaacttgtgcggaccagccctgaatacgggatgccatctgtgacctttggatctgtgcacccttctgatgtcctggatatgcctgtggaccccaatgaacctacatattgcctttgtcatcaggtttcctatggggagatgattgggtgtgacaatcccgattgtagcattgagtggttccattttgcctgcgtaggtctcacgactaagccgaggggaaagtggttttgtcctagatgcagtcaggagcgcaagaagaaatag

SEQ ID NO: 29007 - DNA, 540 bp, Artificial Sequence
  Description of Artificial Sequence: Synthetic coding sequence
atggccgcaggcatgtatttggaacattatctagatagcatcgaaaatttaccgtttgaactacagcgcaattttcagctgatgcgggacctcgaccagcggacagaggacctgaaagccgaaatagacaaattggctactgagtacatgagctcggcgagaagtttgtcctccgaggagaagttagcattactgaagcagatccaggaagcgtacggcaagtgtaaagagtttggcgacgacaaagtgcagctggcaatgcagacatacgagatggtggacaaacacattcgacggctggacactgacctggcacgatttgaggcggatttaaaagaaaaacagatcgaatcttccgactatgacagttcctcttccaagggaaaaaagaaaggtaggacccagaaagaaaagaaagccgcacgcgcacgcagcaaggggaaaaacagcgacgaggaggcgcctaaaacggcccagaagaaattgaaactggtacgcactgtacctctgtctggaagcattctgccggtgtggggatag

SEQ ID NO: 29008 - DNA, 678 bp, Artificial Sequence
  Description of Artificial Sequence: Synthetic coding sequence
atggcggcaggaatgtatctggaacattacctggataatctcaaagctgagatcgataagttagcaactgagtacatgtcctccgcacgttccctgagttcagaggagaaactggcgttactcaagcagattcaagaagcgtatggtaagtgtaaagagttcggggatgataaagtccagctagctatgcagacctacgaaatggtcgataagcatattagaaggctcgatactgatctggcgagattcgaagcagatcttaaggaaaaacaaattgagtcctccgattatgatagctcgtcaagcaaaggtaaaaaaaaaggccgtacccaaaaggaaaaaaaggcagctcgggctcgaagcaaaggaaaaaattccgacgaggaggctcccaaaaccgcacagaaaaagctgaagctagtgaggacgtccccagaatacggtatgccctcggtcacgtttggcagcgtgcaccccagcgacgtcctggacatgcctgtggatcctaacgagcccacgtactgcctctgccatcaagtctcctatggggagatgatcggatgcgacaatcccgactgtagtatcgagtggtttcacttcgcatgcgtgggactgaccacaaagccacgtggaaagtggttttgcccaagatgctcccaggagcgtaagaagaagtag

SEQ ID NO: 29009 - DNA, 3729 bp, Artificial Sequence
  Description of Artificial Sequence: Synthetic coding sequence
atggcgtcgccccctgagtctgacggcttctctgacgttcgcaaagtcgggtacttgaggaagccaaagtccatgcataagcggttcttcgttctgcgcgctgcctctgaagccggtggtcccgctcgactggagtattatgagaatgaaaagaaatggcgccataaatctagtgcccctaagaggagtatacccttagaaagttgctttaacatcaataaacgggcagacagcaagaacaaacacctggtagctctttatacgcgcgacgaacacttcgctattgcggctgattctgaggccgagcaggactcctggtaccaggcacttctccagctgcacaatcgggctaagggccatcacgacggagcggcagcgctgggggctggagggggaggaggctcatgcagcggatcatcagggctcggcgaagcgggagaagacttgagctatggcgatgtcccgcctggccctgcctttaaggaggtctggcaggttatcctgaaacccaagggattaggccagaccaagaatctcatcggtatctataggttgtgcctgacctcgaagacaattagttttgtgaagctcaactctgaggcagctgccgtggtgctgcagcttatgaatatcaggagatgcgggcacagcgaaaacttcttttttattgaggtcggcaggagtgcagtgaccgggccaggtgaattttggatgcaggtggacgactctgtggtggctcagaacatgcatgagaccattttagaggctatgcgagccatgtcagatgagttcagacccagatccaagagccagtcctcttccaactgctcaaacccgatttccgtaccattaagacgtcaccacttaaacaaccccccaccatcccaagtaggcctaacaagaagatctagaactgagtctattacagccaccagtcccgcttccatggtggggggaaagcctggctccttccgcgtgagggccagcagcgatggagaggggaccatgagtcgacccgcttcagtggatggcagtcccgtgtccccatctaccaacaggacccacgcgcatcggcataggggcagcgcacggctgcacccgccactgaaccactctaggtctattcctatgccggctagtagatgttctccctcagcaacctcaccggtttcactcagttcttcatccaccagcggacatgggtccacatccgactgcctgttcccacgcagatcctcggccagtgtcagcggaagtcctagcgacggtgggttcatttcttcagacgagtacggttcgtctccttgcgatttccggtcgagttttcgatcagttacaccagacagtttgggacacaccccccctgctcgcggtgaagaagagctcagtaattacatctgcatgggaggcaagggaccctccactttgaccgcgccaaatgggcattatatactgagtcgtggcggaaatgggcaccggtgtacccctggaactggactaggaaccagccctgctctggcaggtgatgaggcagcctcagccgcagacctcgacaataggtttcgcaaacgcacccatagcgccggaacctcccccaccatcacccaccaaaaaaccccatctcagtcgagtgttgccagcatagaagaatataccgagatgatgcccgcatatccgcctgggggaggatccggagggcgtttgcctggccacagacatagcgcattcgtccccaccagaagctaccctgaggaaggcctcgaaatgcatcctctggaacgcagagggggacaccataggccggatagctctaccctgcacaccgacgatggatatatgcccatgagtcccggagtagcacccgtcccttctggtaggaaaggttccggtgactatatgccgatgagcccgaagtctgtgagcgcccctcagcagataattaatcccattcgcagacacccgcagcgtgtcgatcccaacggatacatgatgatgtctcccagtgggggatgttcgccagatattggcggtggcccatcctcatcttctagtagtagtaatgcagttccatctggcacctcctatggcaagctctggaccaatggagtgggtggacaccactctcatgtcctgcctcacccgaagccccctgtcgaatcatcaggagggaaactgctcccgtgcacgggggactatatgaacatgtccccagtgggcgactcaaacactagctctccctcagactgctattacgggccagaagatccacagcacaaacctgtgttgtcctactacagtttgcccaggtccttcaaacacacccagaggcccggagaacccgaggagggagctcgtcatcaacatctgaggctatccacctcttccgggagactcctctacgctgccaccgcagatgactcctcatctagcacctcatcagactctcttgggggaggctattgcggcgcacggctggaaccttctcttccacacccacatcatcaggtgctccagccccacctgcctaggaaggtggataccgctgcgcagaccaatagtcgcctggccagacccactcggctgagcctaggcgatcctaaggcgagcacgttgcctcgggctagggagcaacaacagcagcagcagcctctgctacatccacccgaaccaaagtctcctggagaatatgtgaacattgaatttggatccgatcagtccgggtatctgagcggacccgtcgcttttcactcttcaccgagcgtgcgctgcccgtcccagctgcagccagctcccagagaagaagaaacaggtacggaagagtacatgaagatggacctcggtcctggacgtagagccgcatggcaggagtccacaggtgtggagatgggtaggcttgggcctgccccacccggagcggcatctatctgtaggcccacaagagccgtcccctctagcagaggcgactatatgactatgcagatgtcttgccctcgccagagttacgtggacacatctcccgctgccccagtctcctacgcggacatgcgaacgggcatcgccgctgaagaggtctccttaccacgcgctacgatggccgctgctagttcttccagcgccgcaagcgccagtcctaccggtccccagggagccgctgaactggccgcacactcaagtttactgggtggaccacaaggaccaggcggaatgtctgccttcaccagggtgaacctgtcgccaaatcgtaatcaaagcgctaaagtaattcgagcggatccccagggttgtagacggagacattctagcgaaacattcagctccacgccatccgccactagggtcgggaataccgttccgttcggcgcaggcgctgccgtagggggtggaggcggatcctcgtccagcagtgaggatgttaaacgtcactcctccgcgtctttcgaaaatgtgtggttaaggcccggtgagctgggcggagctcctaaggagcctgcaaaactctgtggtgcggctggcggtctggagaacggactgaactacatcgacctggatttagtgaaggattttaagcagtgtcctcaagaatgtacacccgaaccccagcctcccccaccacctccacctcaccagcctctggggtctggcgaaagctcttcaacacgcaggtcctctgaggacttaagcgcatatgccagcatctcttttcagaaacagccagaggatcgccagtag

SEQ ID NO: 29010 - DNA, 588 bp, Artificial Sequence
  Description of Artificial Sequence: Synthetic coding sequence
atgggtaaaatctcaagtctgcctactcagttattcaaatgctgcttttgtgactttcttaaagttaagatgcatacaatgtcttctagccacctgttttacctggcgctgtgtctccttacgttcactagctctgctaccgcgggacctgagactctgtgcggagccgagctggtagacgcattgcaattcgtctgcggggatcggggattctacttcaacaaaccaacaggttatggaagttctagtcgcagagccccacaaaccggaattgtggacgaatgctgctttcggagctgcgatctcaggagactggagatgtattgtgcacctctgaaacctgccaagagcgccaggagtgtcagggcacaacgacataccgatatgccgaagacccagaagtaccagcccccatctacaaataagaatactaagtctcagcgaagaaagggctggcctaaaacacacccgggaggggaacagaaggaaggaacagaggcgtccctgcagatccgcggtaagaagaaggagcagcgacgggaaatcggatctaggaatgccgaatgccgcggtaagaaaggaaaatag

SEQ ID NO: 29011 - DNA, 462 bp, Artificial Sequence
  Description of Artificial Sequence: Synthetic coding sequence
atgggaaaaatatcctctctccctacacagctgttcaagtgctgcttctgtgactttcttaaagtgaagatgcatactatgtcctcttctcatctgttttatctcgcactgtgtctgctaaccttcacgtcttcagccactgccggtccagaaactctgtgcggtgctgagctggtggatgccctccagttcgtgtgtggagaccgcggattttattttaacaagccaactggctacggatcgagctctcggcgagccccacagacagggatagtggacgagtgttgttttcgatcctgcgacctgcggagactggaaatgtattgtgccccactgaagccagccaaaagcgctaggagtgtccgggctcagcgacacacagacatgccgaagacccagaaggaggttcacctgaaaaacgcatctcgaggcagcgccggtaataagaactaccgaatgtag

SEQ ID NO: 29012 - DNA, 477 bp, Artificial Sequence
  Description of Artificial Sequence: Synthetic coding sequence
atgggtaaaatttcttccctacctacccagctgttcaagtgctgcttttgtgactttcttaaagtgaaaatgcacactatgtcatcttctcacctcttttacttggccttgtgtctgcttacattcacaagctctgccactgcaggcccagaaaccctttgcggtgctgaactggtggacgccttgcagtttgtctgtggtgaccgcggtttttactttaacaagcccacaggctacggaagctccagccgcagagcaccacagacagggatagttgatgagtgttgctttcggagttgcgaccttcgaagacttgaaatgtactgcgccccactgaagcccgctaaaagcgccagatccgtcagggcgcagcggcatacagatatgcctaagacgcagaaatatcagcccccttccacaaataagaacaccaagagtcagcgaaggaaaggaagcaccttcgaggaacgcaagtag

SEQ ID NO: 29013 - DNA, 420 bp, Artificial Sequence
  Description of Artificial Sequence: Synthetic coding sequence
ctaaaagtgaaaatgcatactatgtcgtcctcacatctgttttatctggccctctgtttgcttacttttacctcgtctgctactgcaggcccagagacgctgtgcggcgcagaactggtcgacgcacttcaatttgtatgtggtgaccggggtttctattttaataagcccacagggtatggaagtagtagtagacgggcacctcagacaggcattgtggatgagtgttgcttccgatcatgcgacttgaggcggctagaaatgtactgtgcacccctcaaaccagccaaatcggcaaggagcgttagggcccaaagacatacggatatgcccaaaacgcaaaagtatcaaccgccaagtactaacaagaataccaagtctcagcgacggaaggggagcactttcgaggaacggaagtag

SEQ ID NO: 29014 - DNA, 414 bp, Artificial Sequence
  Description of Artificial Sequence: Synthetic coding sequence
atgattacccccacagtgaagatgcacacaatgagttcgtcgcacttattctacttggctctctgcttacttactttcacctctagcgccaccgcgggtcctgagacgctgtgcggcgcagagctcgttgatgctcttcagtttgtttgtggggaccggggattttattttaacaaacctaccggatatggcagcagttctcggagagccccacagacaggcatcgtggatgagtgctgcttccgtagctgcgacctgcgcaggctagaaatgtactgtgcaccgttgaaacccgctaagagcgcacgcagcgttcgcgctcaacggcacacagatatgccaaaaacacagaaggaagtacacctgaaaaatgcgagcagaggtagtgcgggaaacaagaactaccggatgtag

SEQ ID NO: 29015 - DNA, 477 bp, Artificial Sequence
  Description of Artificial Sequence: Synthetic coding sequence
atgggaaagatttcttccctgccgacccagctgtttaagtgttgcttttgcgactttttaaaagtgaagatgcatacaatgagcagcagccacctgttttaccttgccttatgtttgctcacatttacgtcttccgctaccgccggtcccgagactctctgcggggcagaattggttgatgcactccagttcgtttgtggtgatcgtggattttactttaataaaccaacagggtacggatccagctctcggagagcaccacaaacaggtattgttgacgagtgttgcttccgttcttgcgacctccgcaggctagagatgtattgcgctcccttgaaacctgctaagtctgctcggtctgtccgcgctcaaaggcataccgacatgcctaaaacccagaagtatcagcccccttccaccaacaaaaacacgaaatctcagcggcgaaaaggttcaactttcgaagaaaggaaatag

SEQ ID NO: 29016 - DNA, 4103 bp, Artificial Sequence
  Description of Artificial Sequence: Synthetic coding sequence
atgaaaagcggcagcggaggcggttctcccacaagcctctgggggttattatttctgtcggccgctctgtctctctggccaaccagcggtgaaatatgtgggcctggtatcgacattaggaatgattaccaacagcttaaaagactcgaaaactgtacagtaatagaaggatacttacatattctgttgattagcaaggctgaggactacagaagctaccgttttccaaagctgacggtgatcaccgaatacctactccttttccgagtggcaggacttgagtccctgggggatctgttccccaaccttactgttattagagggtggaaactgttttacaattacgccctcgtgattttcgaaatgacaaacctgaaagatatcggcctgtacaacttaagaaatatcactcgcggtgccataaggattgaaaaaaacgcagatctctgttacctgagcactgtcgattggagcctaatcctcgacgccgtgtccaataattacatcgtgggtaacaagccgccaaaggagtgcggggacctgtgtccaggaacaatggaagaaaagcccatgtgcgagaagactaccatcaataatgaatataattatcgttgctggaccacaaaccggtgccagaagatgtgtcctagcacttgcggcaaaagggcgtgcactgagaacaatgaatgctgccaccctgaatgcctgggcagctgctcagcaccagataacgatacagcttgtgtcgcttgcagacactactattacgccggtgtgtgcgttcccgcttgtccccctaacacctaccggttcgaaggatggaggtgcgtggacagggacttttgtgctaacatccttagtgctgaatcctcagactccgaaggatttgtgatccacgatggagagtgtatgcaggaatgtccaagcggcttcatccgcaatggttcccagtctatgtactgtataccttgcgagggcccatgcccgaaggtatgcgaggaagaaaaaaaaacgaaaactattgactcggtgacatccgcccagatgctgcagggttgcaccatcttcaaaggcaacctgttgatcaacatccggagaggcaacaatatcgcttccgagttagaaaactttatgggcctcatcgaagtcgtcactgggtacgtcaagattagacactcccacgccctggtcagcctcagttttttgaaaaatctgagactcatccttggcgaggaacaattagagggtaattattctttctatgtcctggataatcaaaacctacaacagctgtgggactgggaccacagaaacctcaccattaaagccggaaagatgtattttgccttcaacccgaagctctgcgtctcagaaatctaccgcatggaggaagttacaggaacaaagggcagacagtccaaaggcgacataaatacgagaaataatggcgaaagggcatcttgcgaatcggacgttctccactttacaagcaccaccacaagtaagaacaggatcataattacctggcacaggtatcggccaccagattatagggatcttatttccttcactgtttactacaaggaagcacccttcaagaatgtgactgaatatgacggccaggatgcatgtgggtccaattcatggaacatggtggacgtagatctgccgcctaataaggacgttgagcctgggatcctgttgcacggcctgaaaccgtggacccagtacgcagtgtacgtgaaagccgttaccctgaccatggtggaaaatgaccatataagaggcgcaaagtctgaaatcctctacatcagaaccaatgcctcagtccccagcattcccctggatgtgctctccgcttcaaacagctcgtcacaactgatcgtgaagtggaatccgccaagtctcccaaacggaaacctctcctactacatcgtccgctggcagagacagcctcaagatggatatctgtacaggcataactactgctctaaagataaaatccctattagaaaatacgccgacggcactattgacattgaagaggtgacggagaatcccaagacagaggtctgcggaggtgaaaaggggccatgctgcgcctgcccaaaaacagaggcagaaaagcaggccgagaaagaagaagctgaataccggaaggtctttgaaaattttttacacaattctattttcgttccgcgtcccgagcggaagcggagagatgtgatgcaggtggccaacaccactatgtccagtcggtctagaaacaccactgccgctgacacatacaacatcaccgaccccgaggagctggagactgaataccccttttttgaatctagagtggataataaagaacgtaccgtgatatctaatctgagaccattcactctttatcggatcgatattcattcctgtaaccacgaagcggaaaagttggggtgctccgcatccaatttcgtgtttgcacgaacaatgcccgcagaaggggctgatgatattccaggtcccgttacctgggagccaagaccggagaattcaatattcttaaaatggcccgagcctgagaaccccaacggtctgatcctaatgtatgagatcaaatacggaagtcaggtcgaggatcagagggagtgcgtgagtcgccaggagtatcggaaatacgggggagctaaactgaataggctcaaccctggcaactacacggctaggatacaggccacaagcctttcaggcaatgggagttggactgatcccgtctttttttatgtgcaggcaaaaacaggatatgaaaattttattcacctcatcatagcgctgccagtagcggtgttgcttattgttggcggtctagtcatcatgctgtacgtctttcatagaaagaggaacaatagccggctgggaaatggcgtcctatatgcctcagttaatcctgagtactttagcgcagctgatgtgtacgtgcccgacgagtgggaagtggcaagggagaaaatcacaatgtccagagagttgggacagggatcattcggcatggtgtatgagggggtggccaagggtgttgtgaaagacgaacctgagaccagagtggccattaaaacagtgaatgaggctgcctctatgcgggaacggattgaattcctgaacgaggcctctgtgatgaaggagttcaactgccaccacgttgttcgccttctcggtgttgttagccaggggcagcctacactcgtaatcatggagctgatgacacgcggagaccttaaaagctaccttcggtcacttcgccctgaaatggaaaataatccagttctggcgcctccttctcttagtaagatgatacagatggccggagagatcgccgatgggatggcatacctcaatgctaataaatttgtccaccgggatctcgctgcgaggaattgcatggtggcagaggattttaccgtgaaaattggcgatttcggtatgacgagagatatctatgaaactgactattacagaaagggcggtaaggggctcctgccagtcagatggatgtcaccagagagcttgaaagatggagtttttactacatatagtgatgtatggagttttggcgtggtactgtgggaaattgcgaccctcgccgagcagccatatcagggactgtctaatgaacaagtgctgcggtttgttatggaggggggtctgcttgataagccagacaattgtccagatatgctattcgaactgatgcgcatgtgctggcagtataaccctaagatgcggccatcatttttagaaatcatttcgagtattaaggaagagatggaacccggattcagagaggtgagcttctattattccgaagagaacaaacttcccgagccagaagagctcgatcttgaacctgaaaatatggagagtgtgcctttggatccatctgcctcctcctcgtccttacccctgcctgaccgacattccggtcacaaggccgagaatggccctggacccggagtgcttgtcctgcgcgctagcttcgacgaaagacagccctatgctcatatgaatggaggcagaaaaaatgaacgggcactgcctctgccccagtccagcacgtgtta

SEQ ID NO: 29017 - DNA, 543 bp, Artificial Sequence
  Description of Artificial Sequence: Synthetic coding sequence
atggggatcccaatgggcaagagtatgttagtactgctgaccttcctggcttttgcctcctgctgtatagcggcttacagaccaagtgagaccctttgtggcggtgagctcgtggacaccttacagttcgtgtgtggcgaccggggtttttacttctcgaggccagcaagcagagtatctcgacgctccaggggtatcgttgaggagtgctgcttcagatcctgcgatctggctctgctggagacctattgcgccactccagcaaagtccgaacgagacgtgtctacgccacctactgttttgcctgacaactttccacgctacccagttgggaaattttttcaatatgatacatggaagcagtccacacaacgactgcgtcgaggcctgcctgcactgctcagagccaggcggggacacgtgctggcaaaggagctggaagcatttcgcgaggcaaagaggcaccgcccattgattgccctgcccacacaggacccggcacacgggggtgctccgccagaaatggcgagcaaccggaaatag

SEQ ID NO: 29018 - DNA, 543 bp, Artificial Sequence
  Description of Artificial Sequence: Synthetic coding sequence
atgggcattccaatggggaagtccatgctggtcttactcacgttcctggcttttgcctcttgctgcattgcagcttacagacccagtgagaccctatgcggcggtgaactggtcgacaccttgcagtttgtgtgcggggacagaggcttttattttagtaggccagcctctcgggtcagccgccgtagtagaggaatcgtcgaagaatgctgcttcaggagttgcgacctggctttgttggaaacctactgtgctacccccgcaaaaagcgaaagagatgtgagcaccccccctacggttttgcccgataacttccctcgctatccggttggcaagtttttccagtacgacacttggaaacagtccacacagcgtctgcgacggggactgccggctctgctgagggctaggcggggacacgttcttgccaaagagctggaggcattccgggaagccaagcggcacaggccccttattgccctgcctacacaggatccagctcacgggggtgcgccaccagagatggccagcaaccgtaagtag

SEQ ID NO: 29019 - DNA, 552 bp, Artificial Sequence
  Description of Artificial Sequence: Synthetic coding sequence
atgggcattccaatggggaagagtatgcttgtcttactcacctttctggccttcgccagttgctgtattgctgcgtacagaccaagcgaaaccctgtgcggaggggaactagtcgatacgctgcagtttgtatgcggcgatcggggattctacttccggctccccggacgcccagcatcgcgagttagccgcaggagtagggggatcgttgaggaatgttgcttccgctcttgtgacttagcactgctagaaacctactgcgccactcctgccaagtccgaacgggatgtgtccacaccccctacagtactgccagataacttcccacgctaccctgtagggaaattttttcagtacgacacctggaagcagtctacccagcgtctccgaagggggctacctgctctgttaagagcacgacgcggacatgtgctggctaaggagctggaggccttcagggaggcaaagcggcatcgccctctcattgctctcccgacccaggatccagctcacgggggagcccctcccgaaatggctagcaatcgcaagtag

SEQ ID NO: 29020 - DNA, 552 bp, Artificial Sequence
  Description of Artificial Sequence: Synthetic coding sequence
atgggtatccccatggggaaaagtatgctggtgttgctaaccttccttgcattcgcgtcttgctgcatcgccgcataccgccctagcgagactctttgtggtggtgagttggtcgacactctgcaatttgtgtgtggggatagagggttttactttcggctcccgggacggccagcttccagagtttcacggagaagtagaggtatcgtcgaagagtgctgcttccggtcttgtgacctggctttgttagagacgtattgtgccacccccgcaaagagcgagagggacgtcagcacgccaccaacagtgctccctgataattttccgaggtaccccgttggcaaattcttccagtatgatacttggaagcaatcaactcagagactccgccgtggactgccagccctactccgagcacggcgtggtcacgtgctcgccaaggagctggaggcctttagggaggcaaagcgacataggccgctgatcgccctccctacacaggatcccgcacacgggggagcccctcccgaaatggcctcgaatcgaaagtag

SEQ ID NO: 29021 - DNA, 543 bp, Artificial Sequence
  Description of Artificial Sequence: Synthetic coding sequence
atgggcatcccaatgggcaaatccatgctggtgttgcttacatttctagcattcgcttcttgctgtatcgctgcctacaggccgtctgaaactttatgtggcggtgagctggtggacaccctgcagtttgtctgcggggataggggcttctactttagtaggcccgcttcacgcgtgagtagaagaagtcgcggtatcgtcgaggagtgctgctttagaagctgcgacttagccttgctggagacttactgcgctacaccagccaaatctgaaagagacgtctccaccccacctaccgttctccctgacaatttcccacgctatcccgtggggaagtttttccagtatgatacttggaaacagtctacccaaaggttgagacgtggacttcccgcacttctccgcgctcgcaggggccacgttctggcaaaagaacttgaagcatttcgtgaggctaagcggcaccgaccactcattgcccttccgacacaggatccagcccatggcggagctcctccggagatggcgagtaatcgcaagtag

SEQ ID NO: 29022 - DNA, 552 bp, Artificial Sequence
  Description of Artificial Sequence: Synthetic coding sequence
atgggcatccctatgggtaaaagtatgttagtgctgcttacttttctggcgtttgccagctgctgcattgccgcttaccgaccaagcgagacactgtgtggaggggaactcgtcgatacactacaattcgtgtgcggggaccgagggttttactttaggttacctggacgaccagcttcacgagtgtccaggaggtcccggggtatagtcgaggagtgctgttttaggtcttgcgacttggcactcctggagacatattgcgcaacccccgcaaagtcagaacgggatgtgtccacacccccaacagtgttgcctgataacttcccccgatatcccgtcggaaagttcttccagtatgatacgtggaagcagtctacacagcgactgcgcagggggctgcctgcactgctgagggcccgtcgcggtcatgtactcgccaaggaacttgaagccttcagagaggctaaaagacatagacctctgatcgccctgccaactcaggaccccgcacatggcggtgctccccctgagatggcctctaatcgaaagtag

SEQ ID NO: 29023 - DNA, 543 bp, Artificial Sequence
  Description of Artificial Sequence: Synthetic coding sequence
atgggtatccctatgggaaagtcaatgctggtcttgctgactttcctggcctttgcctcttgttgcatcgccgcataccgaccatcggaaacgctctgtgggggagaactggtggatacactgcaatttgtgtgcggggacaggggattttacttttcaagacccgcttcaagagtcagcaggcgcagcaggggcatcgtcgaggaatgttgtttccgttcttgcgacctggcattattggaaacttattgcgcaacaccagctaagtccgaaagagatgtaagcacacccccaacagttctccccgacaactttccgcgttatcccgtaggcaaattttttcaatatgacacttggaagcagtccacacagcgactgcgacggggacttccggctctcttacgggctagacggggtcacgtgcttgccaaagaactggaagctttccgagaggctaagcggcaccgtccacttatcgcactgccaacccaggaccctgctcatggtggagcaccacctgagatggcatccaatagaaaatag

SEQ ID NO: 29024 - DNA, 552 bp, Artificial Sequence
  Description of Artificial Sequence: Synthetic coding sequence
atggggatcccgatgggaaaaagcatgctcgtgttacttacattcctcgcctttgcttcttgttgtatagccgcatacaggcccagtgagacactttgtggcggtgagcttgtggacacattgcagttcgtatgcggggaccgagggttttacttccggttacctgggaggcctgcctctcgcgtgtcccggagatctcggggaattgttgaggaatgttgctttaggtcttgcgatctcgccctcttggaaacctattgcgccacgcccgctaaatcagagagagacgtgagtactcctccaacagtactgcctgacaatttccctaggtatccagtcgggaagtttttccaatacgacacctggaaacaatctactcagagactgagaagaggccttcccgcacttttgagggcgaggcgcggacacgtgctagcaaaagaactagaagccttccgtgaagctaagcgccatagacccttgattgctctccccacacaagatcctgctcatggcggagcccctcctgagatggcttctaaccgaaaatag

SEQ ID NO: 29025 - DNA, 543 bp, Artificial Sequence
  Description of Artificial Sequence: Synthetic coding sequence
atgggcatacctatgggaaagtccatgctggtactcctcacctttctggcatttgcgagctgttgcatcgcggcatatcggccatcggagacattgtgtggcggagagctggtggacacactccagttcgtgtgtggagatcgcggattttatttcagccgtcccgctagccgagtgtcaagaaggagccggggaatcgtggaggagtgttgttttaggtcgtgcgatctggccctgctggaaacatactgtgccacccctgccaagagtgagagggacgtgtctacccctccaacggttttgccagacaatttcccccgatatccagttgggaagtttttccaatatgacacctggaagcaaagtactcaacgcttacgacgaggactgccagccctccttcgggcaagacgcggtcatgtcctcgcgaaagagttggaggcctttagggaggcaaagcgacacagacccttaatagccctgccgacacaggatcccgcacacgggggagcaccccctgaaatggcctctaacagaaagtag

SEQ ID NO: 29026 - DNA, 543 bp, Artificial Sequence
  Description of Artificial Sequence: Synthetic coding sequence
atgggcattcccatgggcaagagtatgctggtactcctgacttttctggctttcgctagttgctgtattgctgcataccgacccagtgagaccctctgtggtggggaactcgtagataccctgcagtttgtgtgtggtgatagaggattttattttagccgacccgcttcccgggtctcgcgtaggtcccgtgggatcgtggaagaatgctgcttccgctcttgtgacctggccctgctcgagacctattgtgcgacaccagcgaaatctgagcgggatgtgagcactccccctacagtgttgcccgataatttccctcgctacccagtcggtaagttctttcagtacgatacctggaaacagtcaacccagcgcctgagacgcggtcttccagccttgttaagggccaggaggggccacgttttagcaaaggagctcgaagctttcagagaggccaaacgccataggcctctgattgctctgccaacccaggatcccgctcacggtggagcgccacctgaaatggcatctaacagaaaatag

SEQ ID NO: 29027 - DNA, 711 bp, Artificial Sequence
  Description of Artificial Sequence: Synthetic coding sequence
atggtctccccagatcctcagatcatagtagtagcaccggaaaccgagctggcatcaatgcaagtccagcgtacagaggatggtgtgacaatcattcaaatcttttgggtaggacggaaaggcgaactcctgcgaaggactccagtatcctccgcaatgcaaacacccatggggattcccatgggaaaaagcatgctggtcctgttgactttcttggcatttgccagctgttgtatcgctgcctataggccatccgagacactttgcggcggtgaattggttgacactctgcaattcgtgtgtggagaccgcggtttttacttcagccgcccagcttcccgtgtgagccgcaggtctcgaggtattgttgaggagtgttgcttcagatcttgtgacctagcgctgttagagacatattgcgcaacccccgcaaaaagcgagcgcgatgtctccacaccccctacggtgctgcccgataacttccctcgttacccagtgggaaaattttttcagtatgacacatggaaacaatcaacacagcgcttgcgacgcggtctgcctgctctactgcgagcacggaggggtcacgttctcgcaaaggagctggaagccttcagagaggctaaaagacaccggcctcttatagcactccccacccaggaccccgctcacggcggagctccccctgagatggcctctaaccgcaaatag

SEQ ID NO: 29028 - DNA, 876 bp, Artificial Sequence
  Description of Artificial Sequence: Synthetic coding sequence
atgcaacgagccagaccgacattgtgggctgccgctctgacgctgttggtcctgctccgcggaccaccggtggctagggctggcgcatcctcagcgggtttgggtcccgtggtccgctgcgagccctgcgacgcgagggctctagcgcagtgcgctcctcccccagcagtctgcgccgagctggtgagagagcccggttgtggatgctgcttaacttgcgccctgtcagagggacagccatgtggcatttataccgaacggtgtggctctggacttcgctgtcagccgtccccagacgaagccagacctctccaagctcttctggacggtaggggcttgtgcgtgaacgctagcgccgtttcgcgactgcgggcatacctactcccggcaccaccagcaccaggaaatgcctccgaatccgaagaggaccggtctgcgggatccgtggagtctccctcagtcagcagcacccaccgagtctccgaccccaaattccatcctctgcattcaaagatcattattattaagaagggccacgccaaggatagtcagagatataaggtggactacgaatcacagagcacggacactcaaaactttagctcagagtcaaaaagggagacagagtacggtccatgccgaagagaaatggaggacactcttaatcacctaaagtttctgaatgtgctgagccccagaggcgttcacattcccaactgcgacaaaaaaggcttctataagaaaaagcagtgcagacccagcaagggtagaaagcgtggtttctgttggtgcgtggacaagtatggacaacctttaccaggctatacaacaaagggtaaagaagatgtccactgctactctatgcaatccaaatag

SEQ ID NO: 29029 - DNA, 894 bp, Artificial Sequence
  Description of Artificial Sequence: Synthetic coding sequence
atgcagagggctagaccgacgctgtgggctgccgcactgacccttctggtactgttaagaggccctccggtagcacgtgccggagccagcagcgcaggtctcggacccgttgtccgatgcgagccatgtgatgcacgggctctggcccaatgcgctcccccacccgctgtgtgcgctgagctggtgagagagccaggatgcgggtgctgcctgacatgcgccctctcagaagggcagccgtgtggcatctacacagaacgatgcggatccggactcagatgccagccttcgcctgacgaagcacgtcctctacaggctctcttggacggtcgcggtctgtgtgtgaacgctagcgctgtgagccgcttgcgcgcatatctactccccgcacctcccgctcccggagaaccgcctgcaccaggaaacgcttcagagagcgaagaggaccgcagtgccggtagtgtggagagcccttcagtgtcttccactcatagggtgagcgacccgaagtttcaccctctccactccaagatcattattattaagaaggggcacgctaaagacagccaacgttacaaagttgactatgaaagccagtctacagacactcagaacttttcatctgaaagcaaacgagaaacggaatacggaccctgccgaagggaaatggaggatactctgaaccatctcaaattcttgaacgtgctgtcccccagaggcgtgcacattccgaattgcgacaagaaagggttctacaaaaaaaaacagtgccgtccttccaaaggcaggaagaggggattctgctggtgcgtcgataagtatgggcagcccctccccggatacaccaccaaaggcaaggaggatgtgcactgctactcgatgcagagtaagtag

SEQ ID NO: 29030 - DNA, 585 bp, Artificial Sequence
  Description of Artificial Sequence: Synthetic coding sequence
atgcaaagggcgcgacccctccaagccctcctggatggacggggactttgtgtgaatgcatcagccgtgagccgattgagagcctacctcctgcctgctccgccagcccctgggaacgcatcagagtccgaagaagacagatccgcagggagtgtagaatctcctagcgtctcaagtactcaccgggtatcagatcccaagttccatcctcttcactctaagatcatcattattaagaagggacacgcgaaagactcacaacgttacaaggtggactatgagtcacaaagtaccgacacccagaacttctcctccgaatccaagcgcgagacagagtacgggccttgccgcagagagatggaagataccttgaaccaccttaaattcctcaatgtgctgtctccaaggggtgttcatattcccaactgcgacaagaaaggattttacaagaagaaacaatgtaggccgagcaaaggtaggaagcggggtttctgttggtgcgtggataagtatggacagcccctccctggttacaccacaaagggtaaagaagacgtgcattgctacagcatgcaatctaagtag

SEQ ID NO: 29031 - DNA, 462 bp, Artificial Sequence
  Description of Artificial Sequence: Synthetic coding sequence
tagagcgaagaagatcgtagcgcgggatctgtcgagagcccctctgtgtcgagcacccatcgggtaagtgatcctaagttccatccccttcattccaaaattatcatcattaagaagggacacgctaaagactcacagcggtataaggtggactacgagtcacagtctaccgatacccagaatttcagctcagaaagtaaaagggaaaccgaatatggaccctgcaggagagagatggaggacaccctcaaccacctgaaattcctgaacgtcctatcccccagaggtgtgcatatccctaactgtgataaaaaaggtttttacaagaaaaagcagtgtcgtccgagtaaaggacggaaaagaggtttttgctggtgcgtagacaagtatggacagcccttgccgggatataccactaagggtaaagaagacgtacactgttatagcatgcagtccaaatag

SEQ ID NO: 29032 - DNA, 432 bp, Artificial Sequence
  Description of Artificial Sequence: Synthetic coding sequence
taggagtcacctagtgtgagcagtactcatcgagtgtcagatcccaagttccaccctctgcactcaaaaatcataattataaagaaggggcatgccaaggattcacaacggtataaagtggattatgaatcccagtctaccgacacacagaacttctccagcgagtccaaaagagagacagaatacggtccctgtcgcagagagatggaggataccttaaatcaccttaaatttctgaacgtgctgtcgcccaggggagttcatatccctaactgcgacaagaaaggcttctacaaaaagaagcaatgtaggccatcaaaggggagaaagcggggattctgttggtgtgtggataagtatggccaaccccttccaggctacacaacaaaaggcaaagaggacgttcactgctactcgatgcagtctaagtag

SEQ ID NO: 29033 - DNA, 792 bp, Artificial Sequence
  Description of Artificial Sequence: Synthetic coding sequence
atgcagcgcgcaagaccaaccctgtgggctgcctgtgagccatgcgacgccagagctctagcccagtgcgcgcctcctcctgccgtgtgtgctgaactagtgcgcgaacctgggtgtggctgctgccttacctgtgccttgtctgaggggcagccatgtggaatctacaccgagcgatgtggatccggcctgcgatgtcagccttccccggatgaggcaagaccactacaggccctgctggatggcagaggcctgtgtgtgaacgctagcgctgtgagccgcctaagggcttatctcctgccagcacctccggctcctggcaatgcctcagaaagcgaggaagatcgcagcgctggaagcgttgaatcgccatccgttagcagtactcatagagtcagcgaccctaaattccaccctttgcactctaagatcataatcattaaaaagggacacgcaaaagactcccagaggtacaaggttgattacgagtctcagtctactgacacccagaacttttcctctgagtcaaaaagggaaacggaatacggaccatgtaggcgcgagatggaggacaccctgaaccatctgaagtttctgaatgttttaagccccagaggggtgcacatccccaactgtgataagaaaggtttctataaaaagaagcagtgccgcccaagcaagggtcggaagagggggttttgttggtgcgttgacaaatatgggcagccacttcccggatacacaaccaagggaaaggaggatgtgcactgctattcaatgcagtctaagtag

SEQ ID NO: 29034 - DNA, 834 bp, Artificial Sequence
  Description of Artificial Sequence: Synthetic coding sequence
atgcgcgcactgaggctcggggcagaagatcagcctctgcccgcatggattccacagctgcgggcagtttattgccggccaattccagccaggcccgcttgtcaagctgcttgtccgggatgtagaaggcacgcagctggtgccacacacgcacttggcaggtgtgctgattccgccggagccgctccacgggctgccggaggtgcaggctggcgggagctagggggattgggaagtaggggagcacttcgggctgtaagacatctccaccgtgccctcctggacgggcgtggcctttgtgtgaacgcgagcgccgtctctagactgcgggcttatctgttgccggcacctccagcaccaggcaacgcttcagagagcgaagaggaccgttcagcagggtctgtggaatctccttccgtgtcctcgacccacagagtgtccgatcccaagtttcaccccctgcactctaagataattatcatcaaaaaaggacatgccaaggactcccagagatataaggtggattacgaatcccaaagcacagatacgcagaacttttcctccgagagtaaacgggagacagaatatggcccttgtaggcgggaaatggaggacacactgaatcacctgaaattcctgaatgttctgagccctcggggtgtccatattccaaattgcgacaagaaaggtttttacaagaaaaagcaatgccgaccctctaaaggcagaaagcgagggttttgttggtgtgtcgacaaatatgggcagccgctgcccggttacaccacgaaaggtaaggaagacgttcactgttattccatgcagtccaaatag

SEQ ID NO: 29035 - DNA, 570 bp, Artificial Sequence
  Description of Artificial Sequence: Synthetic coding sequence
atgcagagggctcgccctacactctgggccgcagcccttacgctcctcgatggacggggtctttgcgcttacttgctccctgcaccacctgctcctgggaatgccagtgagagtgaggaggacagatcagccggttctgttgagagcccttctgtcagtagtactcaccgggttagcgatcccaagtttcatcccctccattcaaagatcatcataattaagaaggggcacgctaaagactctcagagatataaagtggactacgaatcgcagtctacagatactcagaattttagcagcgaatccaagagggaaaccgaatatggaccctgccgaagagaaatggaagacactctgaaccaccttaagttccttaacgtgctatcacctagaggcgtgcatatcccaaactgtgacaagaaaggtttctataaaaagaagcagtgcagaccctcaaaaggtagaaagcggggtttttgctggtgtgtggataagtacggccagcccctgcccggatatacaactaaggggaaagaagacgtgcattgctactctatgcaatctaagtag

SEQ ID NO: 29036 - DNA, 807 bp, Artificial Sequence
  Description of Artificial Sequence: Synthetic coding sequence
atgcagcgcgctcgacccacactatgggcagcggcactgactttactggttctgttacgtggtccccctgtggcacgggcaggtgcgtcttccgccggtctcgggcctgtggtgaggcgggaacctgggtgcgggtgctgcctgacatgtgctctatccgagggccagccctgcggaatttatactgagaggtgcggttccggcctgcggtgtcagccgtcgccagacgaggcacgcccactacaggcgctgcttgatggccgagggctctgtgttaacgctagtgccgtgtctcgactaagagcctacttattgcctgcccctcctgcccctgggaatgcctccgaatcggaagaagatcggagtgcaggctctgtagagtcaccctcagttagctctacgcacagagttagcgacccaaagtttcaccctctgcacagcaagattatcatcatcaagaaggggcacgctaaggatagtcagagatataaggtcgactacgaatcccagtcaaccgacacacagaactttagctcagagtcgaagagagagactgagtatggcccatgccgcagagaaatggaggataccctgaatcacttgaagttcctgaacgtgcttagccccagaggtgtgcacattcccaactgtgacaagaaaggcttttacaagaagaaacagtgtaggccctccaagggaagaaagcgtggattctgttggtgtgtcgataagtacggtcagcccctgccgggttatactaccaaaggcaaagaggacgtgcactgctattcgatgcagagcaagtag

SEQ ID NO: 29037 - DNA, 978 bp, Artificial Sequence
  Description of Artificial Sequence: Synthetic coding sequence
atgcttccccgtgtgggttgtcctgcgctgcctctcccaccacctccgctcctgcccctcctgctgctattgttgggagcctcaggcggaggcggaggagcgagggcagaggtcctgttccggtgtcccccatgcaccccagagcggctggcggcatgtggaccacctcctgtcgctccccctgccgcagtggccgcagtagctgggggtgctcgaatgccttgcgcagagctggtcagggagcctgggtgtgggtgctgttccgtttgcgctaggttagagggggaggcttgcggtgtatatactcccagatgcggtcagggactaaggtgctaccctcatcccggttcggagttgccgctgcaagctctcgttatgggagagggaacatgtgagaagcggagagatgctgagtatggggcaagccccgaacaggtggccgacaatggcgatgatcactccgaagggggtctagttgagaaccacgtggacagcaccatgaacatgctgggcggtggcggtagtgccggtcggaaacccctcaaaagcggcatgaaagaattagcagtgtttagggagaaggtcacagaacagcatcggcagatgggcaaaggcggtaagcaccacctgggactggaagagcccaaaaagcttaggccgcctccggctaggactccttgccagcaagagctggatcaagtcctcgaacgaatatcaactatgagactgcccgacgagagaggcccactggaacacctgtacagcctgcacattcccaattgtgataaacatggtctgtataatctcaaacagtgtaagatgtccctgaatggacagcggggtgagtgctggtgcgtgaacccaaataccggaaagctcatacaaggcgctcccacaatccgcggtgatcccgaatgccacctgttttacaatgagcaacaagaagctaggggcgtgcacactcagagaatgcaatag

SEQ ID NO: 29038 - DNA, 3099 bp, Artificial Sequence
  Description of Artificial Sequence: Synthetic coding sequence
atggcgtgggaagccagaagagagcccggacccagacgagctgcagtgcgcgaaacagtcatgctcctcctgtgcctgggggttccgactggcaggccatataacgtggatactgagtcagccctgctttatcagggcccacacaatacgctgttcggttactcagttgttctgcattctcatggggctaataggtggctgctggtgggggcacccacggccaactggctggcaaatgcaagtgtcatcaacccgggtgctatttaccgatgccgaataggcaaaaacccagggcagacctgcgagcaactgcaacttggatctccaaatggagaaccctgtggtaagacttgcctggaagagagagacaaccagtggcttggcgttaccctttcacggcagccaggcgaaaatgggtcaatagtgacctgtggccacagatggaaaaacattttttatataaagaatgaaaataagcttcccaccggtgggtgctatggcgtgcccccagatctcagaacggagctgagcaaaagaatagcaccctgctaccaggattatgtgaaaaagtttggggaaaactttgccagctgccaggctggaattagtagtttttacaccaaagacctgatcgtaatgggcgcaccaggtagtagctactggaccggcagcttgtttgtctacaacatcactacgaacaaatacaaggctttccttgataagcagaatcaggtgaaattcggaagctaccttggctatagcgtcggcgcaggccatttcagatcccagcataccacggaagtcgttggcggagcacctcagcacgagcagatcgggaaggcctatattttctccatagacgaaaaggaactgaacattttgcacgaaatgaaaggtaaaaagctgggcagctacttcggcgcaagcgtgtgtgctgttgacctaaatgccgacggtttctcggatttgctggtaggcgctcccatgcagtctacaattcgtgaggaagggagggtgtttgtatatatcaattctggttctggggctgttatgaatgctatggaaactaacctcgtgggctctgataaatacgccgctcggttcggcgaatcaattgttaatctcggtgacattgacaacgatggcttcgaggacgttgccattggcgctcctcaggaagacgatctgcagggggctatctatatctacaacggacgcgcagacggaatttccagtacattcagccagcgcatcgagggattacagatatccaaatccctgtctatgtttggccagagcatctcgggacagatcgacgctgacaacaacgggtatgtggatgttgcagtgggggcttttaggtctgacagtgccgtgttactcagaacaagaccagtggtcatcgtggatgcatctctttcccaccctgagagtgtcaacaggacaaagttcgactgtgtggagaatgggtggccgtcagtatgtattgatcttacattgtgtttctcatacaaaggaaaagaggtgcccggatatattgtgcttttctataatatgtctcttgacgtcaataggaaggcagagtctcctcctagattctatttctcttccaacggtacctctgacgtgatcacaggttctatccaggtctcatctagggaggctaactgtcggacacaccaggcttttatgcgcaaggacgtgagggacatcctcacaccaatccagatcgaggccgcttaccacttaggccctcacgtgatttccaagaggagcacagaggagttccctcctttgcagcccatactacaacagaagaaagagaaggatataatgaaaaagactattaacttcgctaggttttgcgctcacgagaactgtagcgctgacctgcaggtgagtgcgaaaattggttttttgaagccacatgagaataagacttacctcgccgtgggcagtatgaagacactgatgttgaacgtctctttgttcaatgcaggagatgacgcttacgaaacaacgctacatgtgaagttaccagttggattatattttatcaaaatcctcgaactggaggaaaagcagatcaactgcgaggttacggacaatagtggtgtcgtgcagctggactgctctattgggtatatctatgtcgaccacctgtctcgcattgatattagttttctcctggatgtgtcttccctatccagggctgaggaggacctcagcattactgtgcacgccacctgcgaaaatgaggaagagatggataatcttaaacattctcgcgtcacagtggcgataccgcttaagtatgaggtgaagttgaccgtgcatggattcgtcaatcccacctcatttgtgtacggatccaatgacgagaatgagcccgaaacttgcatggtagagaaaatgaacctcaccttccacgtcataaacacaggcaacagtatggcgcctaacgtctctgtggagattatggtcccaaactcattctctccacaaaccgataaactgttcaatattttggacgtccagacgactacgggggaatgccatttcgagaactaccagagggtatgcgctttagagcagcagaaatcggccatgcagaccctgaagggcatcgtgaggtttctgtctaaaacggataaacgcttactctactgtatcaaggcggatccccattgtctcaattttctgtgcaattttggcaaaatggaatctggaaaggaagcgagtgtccacatccaattagaaggcaggccgagtatccttgaaatggacgagacttctgcccttaaattcgagatccgcgcaacaggcttccctgagcctaatcctcgggtgatcgaactgaataaagacgaaaacgtggcgcacgtgctgctcgaaggcttacaccatcaaaggccaaagcggtatttcacgatagtgataatatcctcctctttactccttggactgatcgtactgctgctgatcagttatgttatgtggaaggctgggttcttcaaacggcaatataagagcattctgcaggaagagaatcggcgagattcatggtcatatattaactctaagtcaaacgacgattag

SEQ ID NO: 29039 - DNA, 1854 bp, Artificial Sequence
  Description of Artificial Sequence: Synthetic coding sequence
atggcttgggaggctaggcgggagcccggtcccaggagagccgcagtgcgagagacggtgatgctgctcctgtgtttaggtgtccccactggccgtccctacaatgtggacactgagtccgccctcctgtaccagggacctcataacaccctatttggctactctgtggtgttgcactcccatggtgcaaaccgttggttgctggtgggagcacccaccgctaactggttggctaatgcttccgttatcaatcctggagccatctaccggtgtcggattgggaaaaatcctggacagacctgtgagcagttgcagcttggatcaccaaatggggagccgtgcgggaagacatgcctcgaggaacgagacaaccagtggctcggcgtaacactgtcacgtcagccgggagaaaacggctccatcgttacctgcggccataggtggaagaacattttttacattaagaacgagaataagctgcctactgggggttgctacggagtaccccctgaccttcgcacagaactgtccaagcggatagctccgtgctatcaagactatgtcaagaagtttggcgaaaactttgccagctgccaggccggtatctcatccttctacacaaaagatctgatcgttatgggggcacctgggagcagctactggacaggaagcctcttcgtctataacattaccacaaataagtacaaggcctttctcgataagcaaaaccaggtgaaattcggaagttacctcggctacagtgtgggtgccggacatttcaggtctcaacacacaacagaggtggtaggtggggctccacagcacgaacagatcgggaaggcttatattttctccatcgacgaaaaggaactgaatatcctgcacgagatgaagggtaagaaactggggtcatatttcggtgctagcgtgtgcgctgttgacctcaatgctgatggcttcagcgatctgcttgtgggcgctccaatgcaatctaccatcagggaggagggcagggtgtttgtctatattaactctgggagtggtgcagtgatgaatgctatggagacaaacctggtgggaagtgacaaatacgccgctcgttttggcgaaagtattgtgaatctgggggacatcgataatgatggcttcgaggacgtggccataggcgctccacaggaagacgacctgcaaggtgctatttatatttacaacggcagagcagacggaatctccagcactttttctcagcgtatagaagggctgcagatttccaagtcactctctatgtttggccagtccatctcgggtcagatcgacgccgacaataacggctacgtggacgtagccgtgggtgccttcaggagtgattccgcagttttgctaaggaccaggcccgtggttatcgtggatgcttcactgtcgcaccctgaatccgtaaacagaaccaagttcgattgtgtcgagaatggttggccctcagtttgtattgacctgactttgtgcttcagttacaagggcaaggaagtgcccggatatattgtgctgttttataacatgagtctggatgtgaaccggaaggcagaaagcccccctagattctacttctcgtctaacggtaccagtgacgtgatcacaggaagcatccaggtgtcctccagagaggccaactgtcgcacccatcaagctttcatgaggaaagacgtgcgtgatattttaacgccgatccagatagaggctgcttatcatttgggtccccatgtcatcagcaaaagaagcacagaagaattcccgcctctgcagccaattctgcagcaaaagaaggagaaggatatcatgaaaaaaacaaaaaaatag

SEQ ID NO: 29040 - DNA, 3150 bp, Artificial Sequence
  Description of Artificial Sequence: Synthetic coding sequence
atgggttctcgaacccccgaatcacctctgcatgccgtacagctcaggtgggggcctaggcgaagaccgccattactccccttgctcctcttgctgctgccccctccacccagagtgggcggattcaatctcgatgcagaggccccagcagttctgtccgggccacccggttcgttcttcgggttctcggtagagttttaccgtccgggtacagacggcgtgtctgtgctagttggagcaccaaaagccaacacctcgcagcctggtgtgctgcagggcggagccgtgtacctctgcccatggggcgcttcaccaacccagtgtaccccaatagagtttgatagcaaaggcagccgcctgctcgaatcatctctcagtagctcagaaggcgaagaacccgtggagtacaaaagtctgcagtggttcggggcaacggtcagggcacatggcagttccattttagcttgcgcccctttgtacagctggcgtaccgagaaggaacccttgtcagatccggtgggcacgtgctacctctcaactgacaattttacgcggattttggaatatgccccatgtcggagtgactttagttgggccgcaggccagggctattgccaaggcggattcagcgccgagtttaccaagacgggacgcgtggtgttaggtggacccggatcatacttctggcagggtcagatcctatctgcaacacaagagcagatcgctgagagctattatccagagtatcttatcaatctcgtccagggtcaactccagactagacaagctagttcaatttatgacgattcttacctaggctacagcgtggctgtgggggagttctccggcgacgacacggaagacttcgtagccggtgtccccaaaggaaacctcacctacggatatgtgacaatcctgaacggaagtgatattcgatctctgtacaacttctcaggggagcagatggcatcttattttggctacgcggtggctgccactgacgttaatggagatgggctcgacgaccttctcgttggtgcccctctactcatggatcgcacccccgacggtagacctcaggaggtgggacgggtctacgtctatctgcaacatccggctggcattgaaccgacccccactttgaccctcacaggccacgatgagttcggccgttttggcagcagcctcacaccactgggcgacctggaccaggatgggtataatgacgtggccatcggtgccccattcggcggagagacgcagcagggtgtggtgttcgtctttcctggcggtccaggaggtcttggatcgaaaccatcacaagttctccaaccactgtgggccgctagtcacacacctgacttctttggtagcgcacttcgcggtggaagggacctggatggaaatggctaccccgaccttatcgttgggtcttttggagtcgataaagcggtcgtgtatcggggaagaccaattgtgtccgcctccgcaagcctgacgatctttccagccatgtttaatcctgaagaacggtcatgctccctcgagggaaatccagtggcctgcataaaccttagtttctgtcttaatgcctcgggaaagcacgtggctgacagcatcggctttaccgtggagttacaactcgactggcagaaacagaagggcggagtgcgcagggcgctgttcctagcttctcggcaggcgacgctgacacaaacactcttgattcagaacggagccagagaggattgcagagagatgaaaatatacttgagaaacgagtctgagtttagagataagctatctcccatacatatcgccctcaactttagcttggatccgcaggccccagttgacagccacggcctgcgtcccgctcttcattatcagagcaaatcccgcatcgaggataaggcgcagatactgctggactgcggggaggataatatctgtgtgccggacttgcagcttgaggtctttggagagcagaaccatgtctatctgggcgataaaaatgcactcaacctcacttttcacgcacagaacgtgggggagggtggggcttacgaagccgagctgcgcgtcaccgctccccctgaagctgagtatagcggcctcgtgcgtcaccctggtaactttagtagcctgtcctgcgattatttcgccgtgaaccagtcgaggctgctcgtgtgcgatttgggcaatcccatgaaagccggagccagtctttggggaggtttgcgctttaccgtgccccatctgcgcgacactaagaaaaccatacaatttgactttcaaatcctcagtaaaaatctcaataactcccaaagtgatgttgtcagcttccggctttccgtggaggctcaggcacaggtgaccctgaacggcgtaagcaagcctgaggctgtgctgttccctgtgagcgactggcacccacgtgatcagccccagaaagaggaggatttaggtccagccgtgcaccacgtgtatgaactgatcaaccaagggccttcatccatttcacagggagtgttggagctgtcctgtccacaggccttggagggacaacagctcttgtacgttacgcgggttactggactgaactgtacaaccaaccacccgattaaccctaagggcctggagttggatcccgagggcagtctccatcaccagcagaaaagggaggctcccagtcgcagctccgcctcttctggtcctcagatactcaagtgtccagaggccgagtgcttccgattgcggtgtgagctgggacccctgcaccagcaggagagccagagcctccagctgcactttcgcgtgtgggccaagacattccttcagcgggaacatcagccgttttcactgcagtgcgaagccgtatataaggcacttaaaatgccataccggattctcccaaggcagctcccacaaaaagagcggcaggtggccaccgctgtgcagtggaccaaggcggaaggcagctacggagtaccgctttggatcatcattctcgcaattctctttggcctgctgctattgggcctcctgatctatatcctgtataaactcgggtttttcaaaaggtccctgccatacgggaccgccatggaaaaggcccaactcaagccgcctgctacgtctgacgcctag

SEQ ID NO: 29041 - DNA, 3393 bp, Artificial Sequence
  Description of Artificial Sequence: Synthetic coding sequence
atggctgccgctggacagttatgtctgctgtatctgagtgccggattgctctccagactgggcgcagcgtttaacttggacacgcgggaggataacgtgatcagaaagtatggcgaccccggaagtctattcgggttttcgctcgccatgcactggcaattacagcctgaggacaagcggctattactggtgggcgcacctcgggcagaggccctgcctctacagcgcgctaaccgtacagggggactttattcatgtgacatcactgccagaggtccatgtaccaggatcgagtttgataatgatgccgatccaacatccgagtccaaggaggatcagtggatgggagttactgtgcagagccaggggccaggtgggaaggtagtgacctgtgcccacagatacgaaaagagacaacacgtgaacaccaaacaggagtcgagagacattttcgggaggtgctatgttctatcccaaaacttaagaattgaggatgacatggacggaggagactggtccttttgtgacgggagactgcggggacacgagaaatttggctcatgccagcagggcgttgctgccactttcaccaaagactttcactacattgtttttggggcaccagggacttacaattggaaggggattgttagagtggagcaaaagaacaacacattcttcgacatgaacatttttgaagatggcccttacgaagtcgggggtgaaacagagcatgacgaatctctagttcccgttccagcaaatagttaccttggcctactgtttcttacaagcgtttcctacaccgacccagatcagttcgtgtataagacacgcccacctagagagcaaccagacacatttccagatgtgatgatgaacagctatctgggtttcagcctcgattccggaaagggcatcgtcagtaaggacgagatcactttcgttagcggagcacctagagccaaccatagcggtgcggtggtgttgctgaaacgggacatgaaatcagctcacttgcttccagaacatatcttcgatggcgagggtctggcatcgtcatttggatacgacgttgcagtcgtggacttaaacaaggacggctggcaagacatagtaatcggggcaccacagtacttcgatcgagatggggaagtgggcggtgccgtgtacgtgtatatgaatcagcaagggagatggaataacgtcaaaccgattagactaaatggcacaaaagactctatgtttggaatagccgtgaagaacattggagatatcaatcaagacggatacccagacattgctgttggcgcaccttacgacgatctgggcaaggtgtttatttatcatgggagcgcaaatgggataaatactaagcccacacaggtcctgaaagggatctcaccctatttcggttatagcattgcagggaatatggatttagaccgtaactcttatccagatgtggccgtagggtccctgagcgattctgttacaatctttaggagcagacccgtcatcaatattcaaaaaacaatcactgtgacaccaaaccgcatcgacttacgtcagaagaccgcttgcggcgcaccaagcggcatctgcctccaagtcaaaagctgcttcgaatatacagctaaccccgcagggtataatccatctatctccatcgttgggacactggaggctgaaaaagagaggcgtaagtccggactgtcttccagagtccagtttcgtaatcaggggtccgaaccgaaatacacccaggagctgactctgaaacgtcagaagcagaaagtctgcatggaggaaaccctgtggctacaggacaatatccgcgataaactgagaccgattccaatcactgcctccgttgagatccaggagcccagttctcggagaagggtcaattccctccctgaagtgttgcctattctgaactctgacgaacccaaaactgcccatatagatgtccactttctcaaagaaggttgtggtgacgacaacgtctgcaatagtaatctgaaactggagtataagttttgcaccagggagggaaaccaggacaagttttcctaccttccaatccagaagggtgtgcctgagttagtgttgaaagaccagaaagatattgcgttggaaatcactgtaacaaatagtccgtccaatcctaggaacccgacaaaagatggcgacgatgcccatgaagcgaaactcatcgccacattcccagacactctcacatattcagcttacagggaacttagggccttccctgagaaacaactgagttgtgtggccaatcagaatgggagtcaagccgattgtgagctcggcaaccctttcaagaggaatagtaatgtcaccttttatctggtcctgtctactacggaagtgacatttgatacgcccgatctcgacatcaatctgaagctcgaaacaacttcaaatcaggataacctcgcccctatcacagctaaagcgaaggtggtcatcgagctacttctatctgttagcggcgttgccaagccatcccaggtgtatttcggaggcactgtggtgggagaacaagctatgaagtctgaggacgaggttggctcactgatagaatacgagtttcgcgtgatcaatctcgggaaacctctgaccaacttgggtactgctacactgaatatacagtggccgaaggaaatctccaacgggaagtggctgctctatctggtgaaggtggagagcaagggcctggagaaagttacgtgtgagccccagaaggaaattaattccttaaatctgacagagtcccacaatagtaggaagaagagggagataaccgagaaacagatcgatgacaatcgaaaattctccctgtttgccgagagaaaataccagaccctgaactgtagcgtaaacgtaaactgtgtcaatattaggtgcccgttgcggggactggacagtaaggccagcctcatcctgcggtcgcgcctgtggaacagcacattccttgaggagtattcaaaactcaactacctcgacatactcatgcgtgctttcattgacgtgacagcagccgcagagaatatcaggctgcccaacgccggaacacaggtgcgggtaaccgtttttccaagcaaaactgtagctcagtactctggtgtcccatggtggatcatcctcgtggctattcttgccggaatactgatgctggccctgttagtgttcatactgtggaagtgcggcttcttcaagaggtccagatacgatgactctgttcctagataccacgcagttcgcatacggaaagaggagcgagagatcaaagacgagaagtatattgataatctggagaagaaacagtggattaccaaatggaatgagaacgaatcatatagttag

SEQ ID NO: 29042 - DNA, 3222 bp, Artificial Sequence
  Description of Artificial Sequence: Synthetic coding sequence
atggccgcagcaggccagctatgtttattatatttgtcagcagggctactctccaggctgggcgcagccttcaacctggacactcgggaggacaatgttatccggaagtacggtgacccaggctctctgttcgggtttagtcttgccatgcattggcagctgcagcctgaagacaaaaggttgcttcttgtgggagctcctcgagctgaagcactgcccctacagcgcgctaacaggactggcggattatactcttgcgatataacagccagggggccttgtacaaggattgagtttgataatgacgccgatcctacaagtgagtcaaaggaggatcagtggatgggcgttaccgtacaaagccagggacctgggggtaaggttgtgacctgcgctcataggtacgagaagcgccagcacgtgaacaccaagcaggaatccagagacatctttggcagatgctacgtgctgtctcagaatctccgaattgaggatgacatggacggtggagactggtctttttgcgacggcaggctacgcggtcatgaaaaatttgggagctgtcagcagggggtcgccgctacattcaccaaagactttcattatattgtgttcggtgcacccggtacatataactggaaaggtattgtccgcgtggaacagaaaaataacactttctttgacatgaacatctttgaggatgggccatatgaggttggtggagagaccgaacatgatgaatccctcgtaccggtgccagcaaactcctatctggggttcagtctcgatagcggcaaaggaattgtctccaaggacgaaattaccttcgtgtcgggggctcctcgagccaatcatagtggggctgtggtgctgctcaagagggatatgaagtcggcacatttgctgcccgagcacatctttgacggggaggggctggcctcttccttcggatacgacgtcgctgtcgtggatcttaataaagacggttggcaggacatcgttattggcgctccacaatactttgatcgcgatggcgaggtagggggagcggtttacgtctatatgaaccaacagggacgttggaacaatgtcaagcctatccgactgaatgggacgaaagattctatgtttggcatagccgtcaaaaatattggagatataaatcaggacggctatccggacatcgctgttggtgctccttacgacgatctaggcaaggtcttcatctaccacggctccgcaaacggtattaacacgaaacctacccaggtcctgaagggcatctctccttatttcggttactcaattgccggaaacatggatttggaccgcaacagctaccctgacgtggcagtcggctccttatcagatagcgtgactatttttcgcagcaggcccgtgatcaatatccagaaaaccatcacggtgaccccaaatcgtatcgaccttcgacaaaagacagcatgcggggctccttcagggatttgtttacaggtgaagtcttgcttcgagtacaccgcgaatcctgctggctacaacccttctatatctatagtgggaacactggaggcagagaaggaacgtagaaaaagcgggctgagctcgcgggtgcagttccgaaaccaggggtcagaacccaagtatactcaagaactcacactcaagcgccagaaacagaaggtatgcatggaggaaaccctatggctgcaggacaatattagagacaaactgcggcctatccctattaccgccagcgtggaaattcaagagccaagttcaaggagacgcgttaacagccttcctgaagtcctgccaattctgaactctgacgagcccaaaactgcgcacatcgacgtccacttcctgaaggagggttgcggggatgacaatgtttgtaattcgaacttaaagctggagtacaaattttgtacgcgcgaagggaaccaggataaattttcctatctgcccattcaaaagggggtgcctgaacttgtccttaaggatcagaaagacatagcacttgagattactgtgacaaatagtcctagtaacccacgcaaccccacgaaagacggcgacgatgcacacgaagctaagctaatcgccaccttccctgacactctgacttactccgcctacagagaactccgggcttttcctgagaaacagctgagctgcgtggctaatcagaacggatctcaggccgactgtgagctgggaaatccgttcaagcggaactctaacgtgaccttttacttggttctcagcacgaccgaagttacctttgatactccagacctggatattaatctgaagttggaaactaccagtaatcaggataatctcgctccaatcacagcaaaggctaaggtagtgattgaattgctactgtcagtctccggagtcgctaagccatctcaagtgtactttggtggcaccgtggtaggcgagcaagccatgaaaagcgaggacgaagtagggtctctcattgagtacgaatttcgtgttattaacttggggaaacctctgaccaaccttgggacagccaccctgaacatacaatggccaaaagagatttctaatggaaagtggctgttgtatttggttaaggtcgaaagcaaaggattagaaaaggttacctgtgaaccacaaaaggagatcaattctctaaatttgactgagagccataactctaggaagaaacgcgagattacagaaaagcaaattgacgacaaccgcaaattcagcctgtttgccgagaggaaataccagaccctgaattgttcagtcaatgtcaattgcgtgaatatcaggtgtccattgagaggcttggactcgaaggctagcctcattctgagatctagactttggaacagcacttttctcgaagaatacagcaagctcaactaccttgacatattgatgcgtgccttcattgacgtgactgccgcagccgaaaacatccgcttgcctaacgcagggactcaggtgcgtgtgacagtctttccctccaagactgtggcacagtactcaggtgttccgtggtggataatactcgtggcgatcttggcaggcatcctcatgttagcccttttagttttcatcttgtggaagtgcggtttctttaaacgcaataaaaaggatcactacgacgccacttatcacaaggcggagattcacgcgcaacctagcgacaaggagagactgacctcggacgcttag

SEQ ID NO: 29043 - DNA, 3207 bp, Artificial Sequence
  Description of Artificial Sequence: Synthetic coding sequence
atggccgcagccggacagttgtgcctgctttacctgagcgcgggacttctttctcggctcggagccgctttcaacctggacactagagaggataacgtgatcagaaagtacggagatcccggaagcttattcggattctcacttgccatgcactggcaattacagccggaagataagcgactgctgttggtaggcgcacccagagcagaggctttaccgctccagagggctaataggacaggcggactgtatagctgcgatatcacagcgaggggtccatgtacgagaatcgaatttgataatgatgcagatcctacttctgaatccaaggaggatcagtggatgggggtgaccgtgcagagccagggtcccggaggaaaagtagtcacttgcgcacaccgctatgagaagaggcagcatgttaatacgaaacaggagtcccgagacatcttcggcagatgctatgtgctgtctcagaatcttcggatcgaggatgatatggacggaggtgactggtcgttttgcgacggcagactgcggggacatgagaaattcggctcctgccagcaaggagtggcagccacatttaccaaagacttccactatatagtgttcggcgcaccgggtacttataattggaaggggcttttgttccttacgtccgtctcttacaccgatcccgaccagttcgtttacaaaacgcgaccgcctcgagaacagcccgacacattcccagacgttatgatgaactcatacctcggattttcgctggacagcggaaaaggaatcgtttctaaggacgagataaccttcgtttccggagcacctcgagctaatcactccggtgccgtggtgctcctgaagagagacatgaagtcagcgcatcttctccctgaacacatcttcgatggtgagggactcgcgtcaagtttcggctatgacgtcgctgtagtcgatctgaataaggatggatggcaggacatcgtgattggtgctcctcagtatttcgaccgggacggtgaggtgggcggtgccgtctacgtgtacatgaaccagcagggtcgttggaacaacgtgaaaccaattcgtctgaacggcaccaaggactctatgtttggaatcgccgttaagaatatcggggatatcaaccaggacggctaccctgacatcgctgtgggcgctccctacgacgacctggggaaagttttcatttatcacggcagcgccaatgggattaataccaagcctactcaggtcctgaaggggatctccccttatttcggctacagcatcgccggtaacatggacctggaccgcaatagttaccctgatgtggctgtcggttccctgagtgactccgtgacaatttttaggtcccgacctgttatcaacattcaaaaaactatcaccgtcacaccaaatcgcattgacctgcggcagaagactgcctgcggggcaccgagtggcatatgtcttcaggtaaagtcatgtttcgaatacacggctaatcccgcaggatataaccctagcatctccatagtgggaaccctcgaagccgaaaaagaaagaaggaagtccggcctgagcagccgcgtccagttccgcaatcagggctctgaacccaaatacacccaagaattaactctgaaaaggcagaagcagaaggtgtgcatggaagaaacactttggctgcaggacaacattcgggacaagctgaggccaatcccaattaccgccagcgtggagatccaggagcctagcagcagacgcagagttaacagtcttccagaagtgctgcccattctgaattcagacgagccgaaaactgcgcatatcgatgtgcacttcctgaaggaaggatgcggtgacgacaacgtgtgcaactccaacttgaaacttgagtacaaattctgtacccgagagggaaatcaggataagttttcataccttccaatccagaaaggggtcccagaacttgttctgaaagatcagaaagacatcgcactggagatcaccgtcacaaacagcccttccaacccaagaaacccgaccaaggacggggatgatgcccatgaggcaaaactgatcgccactttcccagacactttgacgtattcagcatatagggaactgagagcttttcctgaaaagcagctgagttgtgtggccaaccagaatggtagccaagccgactgcgaactgggaaaccccttcaagagaaattcgaatgtgacgttttatctcgtgctaagcaccacggaagtcacgtttgatacacccgatctggacattaaccttaaacttgaaacaacatccaaccaggacaacctcgcccctatcactgctaaggcaaaggtcgtgatcgaactcctgctgtccgtgtctggagttgccaaaccaagccaggtgtactttggaggcacggtcgtgggtgagcaggctatgaaaagcgaggatgaggtgggatctctaatcgaatatgagttcagggtgatcaatttaggaaaacccctgaccaacctggggacagctaccctcaatatccagtggcctaaggaaataagcaacggaaaatggttactgtatctggtcaaagtagaatcaaaaggattggagaaagtgacatgcgaaccgcagaaagaaatcaatagcctgaacctcacagagtcccataatagccgcaagaagcgggaaatcacggaaaagcagattgacgacaaccgcaagttcagtctgtttgcagaaaggaaataccagaccctgaactgtagcgtcaacgtgaactgtgtcaacatcaggtgccccttacgcggattagactcaaaggctagccttattctgagaagcagactctggaactccacatttttagaggaatactcaaaactgaactacctggatatcttaatgcgggcattcatagatgtgaccgctgccgcagagaacattaggctcccaaatgctggcactcaggttagagtgactgtgttcccttccaaaacagtggcccaatacagcggggtgccctggtggatcattttggttgccatactggctggcatactcatgttagccctgttggtgtttatcttgtggaagtgtgggttctttaagcggaacaaaaaagatcattatgacgcaacataccataaagctgaaattcacgcccagccttcagacaaggaacggcttacgtcggacgcctag

SEQ ID NO: 29044 - DNA, 3339 bp, Artificial Sequence
  Description of Artificial Sequence: Synthetic coding sequence
atggcggcagcaggacagctctgtctcctctacttgagtgccggacttctgagtcgtctgggcgcagcgttcaacctcgacacacgagaggataatgtcattcggaagtacggcgatccgggatccctattcggcttctctctcgcaatgcattggcaactgcagcccgaagacaaaaggctgctactggttggagcgccaagagcggaggccttaccactgcagagagctaatcggacaggaggactgtatagctgcgatatcaccgcaaggggcccttgtacaagaatcgaatttgacaatgatgccgatccaacctcggaaagcaaggaagaccagtggatgggcgtgacggtgcagtctcaggggcctgggggaaaggtggtaacgtgcgctcatagatacgaaaagaggcagcatgtcaacactaaacaagaatccagagacatttttggaagatgctatgtcctgtctcagaacctgcggattgaggacgacatggacggaggggattggtctttttgcgatggacgccttagaggtcacgagaaatttggatcgtgccaacagggggtcgctgcaacgttcaccaaggacttccattatattgttttcggggctcctggcacctataactggaaggggatagtcagggtggaacagaagaacaacacctttttcgacatgaatatcttcgaggacggtccttacgaggtggggggagagacagagcatgatgaatcactggtgccagtgccggctaattcctatctcggactactgtttcttacctcagtgtcctacactgatccagaccagttcgtgtataagactcgccctcctcgggagcagcctgacacctttcccgacgtcatgatgaattcttacctcggcttctcactcgactccggaaagggcatcgtgtcaaaagacgagatcacttttgtatccggagcgccaagagctaatcattctggagcagtagttttgttaaagcgagacatgaaatccgcccacctgctcccagaacacatcttcgatggagaaggcctagcttcaagttttggatatgacgtggccgtggtggacttgaacaaggacgggtggcaagacatagtaattggcgctccacagtatttcgaccgggatggcgaagtcgggggagctgtgtatgtttacatgaaccagcagggacggtggaacaacgtgaaacccatccggttaaatggtacaaaggatagcatgttcggcattgccgtgaagaatattggggacattaatcaggacgggtaccctgacatcgccgtgggggctccctacgacgatttagggaaggtgtttatctatcatgggtccgctaatggaattaatacaaaaccgactcaggtgcttaaagggatttcgccatatttcggctactccattgcaggtaatatggacctggatagaaactcttatccggacgtcgccgtcggcagtctgtctgatagcgtcaccattttccgcagtaggcccgtgatcaatatccagaagactatcacagtgacacctaatagaatcgacctcaggcagaagactgcctgcggcgcaccaagcggcatttgtttgcaggtgaagagttgctttgagtacacagcaaatcccgcaggatacaacccttctatttcaatcgttggcacactcgaggctgagaaagaacggagaaaaagtggactatctagccgagtgcagtttcggaaccagggctctgaaccaaaatatacccaagagctgaccttgaagagacagaagcagaaggtgtgtatggaagagactctatggttgcaggacaacatccgggataagttgaggccaattccaatcacagcatcggtggaaatccaggagcccagcagtaggaggagggtcaatagtttacctgaagtgcttccaatacttaattctgatgagcctaaaacagctcatatcgacgtccattttctgaaggaggggtgcggcgatgacaacgtttgtaattcgaacttgaagctggagtataagttctgcacacgtgagggtaaccaagataagtttagctatttacctattcaaaaaggagtaccggagctggtgttgaaggatcagaaagacattgccctcgagataaccgtgacaaattcacccagcaatccacggaacccaactaaggacggagacgatgcgcacgaggccaaactgattgctacttttcctgacactttaacctatagtgcctaccgggaattgagggcctttcccgagaagcagctgagttgtgtcgctaaccagaacggctctcaggccgactgcgaactcgggaatccctttaagcgaaatagcaacgtaacattttacctggtgctgtcaaccactgaggtgacctttgacacacccgatctggatatcaacctgaaactggagactaccagtaatcaggataatctggcccctatcactgctaaggctaaggtggttatagaactacttctgagtgtgtccggtgtggctaagccaagccaggtgtacttcggaggaactgtggtgggagaacaggctatgaagtccgaagacgaagtggggtctctaattgagtacgagttcagagtcattaaccttgggaagccactaacaaatctcggaacagcgacccttaacattcagtggcctaaggaaatatccaacggaaagtggctcctgtacttagtgaaagtagaaagtaaagggctagagaaggtgacttgcgagccgcaaaaagagattaactctctgaacctaacagagtcccataatagcaggaagaagcgagagattaccgagaaacaaatcgacgataaccgcaagttctcacttttcgccgaaaggaagtatcagacactgaactgtagcgttaacgtgaactgtgttaacatccggtgtccgctaaggggccttgacagcaaggcatcattgattctgagaagccggctgtggaactcaaccttcttagaagagtacagtaaactgaattacctggacattctgatgcgggctttcattgacgtgacggcagcagcggaaaatatcaggttaccaaacgctggaacccaggtcagagtgacagtgttcccttcaaaaaccgtggctcagtatagcggtgttccttggtggatcatcctcgtggcaattctcgctggaattttaatgttggccttactagtgttcattttgtggaaatgtggtttctttaagcgcaacaagaaggaccactacgacgctacttatcacaaggcggagatacatgcccagccatctgataaggaacgtctaacaagcgatgcctag

SEQ ID NO: 29045 - DNA, 3276 bp, Artificial Sequence
  Description of Artificial Sequence: Synthetic coding sequence
atggccgcagctggccaattgtgcttgctgtatttgtcagctggactgctgtcccgattaggtgccgctttcaacctcgacacgagagaggacaatgtaatcaggaagtatggtgatcccggttcccttttcggcttcagcctggccatgcattggcagctccagcctgaagataaacgcttactgctggtgggagcacctcgggcagaagctttgcctctgcagcgagccaatcgtacggggggactctactcttgtgatattacagcacgtggtccgtgtacccggattgaattcgacaacgatgcagatcctactagcgaaagcaaagaggaccagtggatgggtgtgaccgtccagtcacagggtcctggtgggaaggtggtcacttgcgcgcacagatacgagaagagacaacacgtcaatactaagcaggagagcagagacatcttcggtcgatgctatgtcctgagtcaaaatttgcgcatcgaagacgacatggatgggggagactggtcattctgcgacgggaggctgcggggacatgagaaattcgggtcctgtcagcagggcgtagctgccactttcactaaggactttcactatatcgtgtttggcgcaccaggcacctataactggaagggcatcgtgagagtggaacaaaaaaataacacgttttttgatatgaacattttcgaggacggaccttacgaagtcggcggagagaccgagcacgatgagagcttggtcccagtccctgccaatagttatctgggctttagcctggattccggtaaaggcattgtctctaaagatgagatcaccttcgtgtctggcgctcctcgcgctaatcattcaggcgctgtggtcctgctcaaaagagatatgaaatccgcccacctactacctgaacacatctttgatggagagggtctcgcctcctcattcggatacgatgtggctgtggtggaccttaacaaagacgggtggcaagacatagtgataggtgcgccacagtatttcgaccgggatggtgaagtgggtggcgctgtttatgtgtacatgaaccagcaggggagatggaacaatgttaaaccgatcaggctgaatggaacaaaggattccatgtttggcatcgcggttaagaatatcggcgacataaaccaagatggatatcctgacatcgcagtcggggctccttacgatgatctgggcaaggtctttatctaccatggcagcgctaatggcattaacacaaagcccacccaggtgctgaagggtatctccccatattttggctacagcatcgctggaaatatggaccttgacaggaacagttacccggatgtcgcagtcggctccttgtctgatagtgtgacaatattcaggagccggcctgtcatcaacatccagaaaactattacagtgacacctaatcgcattgacttgcgtcagaagacagcctgtggggctccctccgggatttgtctgcaagtgaaatcttgttttgagtacaccgcaaacccggcaggctacaacccatcaatcagcatcgtggggaccctagaggccgaaaaggaacgcagaaagagcggactctcatcacgcgtgcagttccgaaaccagggcagtgaacctaagtatacacaggaactcacattgaagcgacagaaacagaaggtctgcatggaggagaccctgtggttgcaggacaatataagggacaaactgcggccaattcctattaccgcttccgtcgagattcaggagccatcatccagacggagggtaaacagtttacccgaagtgctccctatactgaatagcgatgagccgaagaccgctcatattgacgtgcactttctgaaagaagggtgcggcgatgacaacgtctgcaactccaatcttaagctcgagtataaattttgtactagggagggtaatcaggataagttttcgtatctgccaattcagaagggagtgcctgagctcgtcctcaaagaccagaaggatatcgctctcgagatcaccgtgaccaattcgccaagcaatccgcgtaatcccacaaaggacggcgacgatgcacacgaagccaaactaatcgccacatttcccgatactctgacgtactccgcctatagagaattgagagcgtttcctgagaagcaactgtcttgtgttgcgaatcagaacggctcacaggcagactgcgagctcggaaaccccttcaagcgcaatagcaacgttacattctatttagtgctgtctactacggaggttacgttcgacacacccgacctagatattaacctcaaacttgaaacaacttccaaccaggataacctggctcccattacagctaaggctaaagtggtgatcgagcttttgctgtccgtcagcggcgttgcgaagccatctcaggtttattttggcggtacagtggtcggggagcaggccatgaaatcggaggatgaagtcggatcgctgattgagtacgaatttcgcgtaatcaaccttggcaaaccgctgaccaaccttggtaccgccaccttaaatatacaatggcccaaggaaatctcgaacggaaagtggcttctgtacctcgtgaaagttgagtccaagggcctcgaaaaggtgacgtgcgaaccccaaaaggaaatcaattctctgaacctgactgagtcccacaatagtcgcaagaagcgcgaaataacggaaaaacagatcgatgacaatcgcaagttcagtctctttgcggagagaaaatatcagactctcaattgctcggtcaacgtgaattgtgtgaatatcaggtgccccctcagaggtctggacagcaaagcttccctgatcttgagatctcgcctgtggaactcaacattcttggaggaatactccaagctgaattatttggacatcctgatgcgcgcatttatcgatgtcactgcggctgctgagaacatccggctgcctaatgccggtacccaggtgagagtgactgtctttccgtcaaagacagtggcccagtatagcggagtcccctggtggattatcctggtcgcaatcctcgcgggaatacttatgctggcactccttgtctttatactgtggaaatgtggctttttcaagcggtcccgctatgacgattcagtgccacgataccacgccgtccggattcgtaaagaggaacgcgagatcaaagatgagaagtatatagacaatttggagaagaaacagtggattactaagtggaacgaaaatgagagttattcttag

SEQ ID NO: 29046 - DNA, 2865 bp, Artificial Sequence
  Description of Artificial Sequence: Synthetic coding sequence
atgggggtgaccgtccagtcacagggacctggaggcaaggtggtcacatgcgcccatagatatgaaaagagacagcatgtgaacacaaagcaggaatcccgcgatatcttcgggagatgctacgtgctctcccaaaacctgaggatcgaggacgacatggacggaggagactggtctttttgtgacggaagactgcgtggccacgaaaagtttggatcttgccagcaaggcgttgctgcgaccttcactaaggattttcactacattgtgttcggcgcacccggtacctacaattggaaggggctactcttcctgaccagcgtttcttacacagacccggatcagttcgtgtacaagacccggccacctcgcgaacagcctgacactttcccggacgtcatgatgaactcgtatctaggatttagcctggactctgggaagggaatcgtctctaaagatgaaattacattcgttagtggcgctcctagagctaaccactccggcgcagtggtgctactcaagagagacatgaaatctgctcacctgctgccagagcacatattcgacggggaggggcttgcaagcagcttcggttacgacgtcgccgtggttgacctcaataaggatggatggcaggacatcgtaattggggctccacaatattttgaccgagacggagaagtaggaggcgcagtgtacgtatatatgaaccagcagggacggtggaacaacgtaaaacctattcggctcaacggtacaaaggatagtatgttcggtattgccgtcaagaacattggagatattaatcaggatggctacccggacattgcagtgggcgctccttacgatgacttgggcaaggtatttatttaccacggaagcgccaatgggatcaatactaaaccaactcaggtgctgaaggggattagcccgtactttggatacagtattgccggtaatatggatctggataggaattcatatcctgatgtagccgtgggcagccttagcgactctgttaccatctttcgcagccgtcctgtgatcaatattcagaaaaccatcacagtgaccccgaaccggatagatctgaggcagaaaaccgcctgcggagcccctagcggtatctgcctccaagtgaagtcctgcttcgagtataccgcgaaccccgctggatataatccgtccatcagcattgtgggaactctcgaggccgaaaaagaaaggagaaaatctggcttgtcttcccgagtgcagttccgtaaccaggggagcgagcccaaatatacacaagagctgacgttaaaacgccagaagcagaaagtgtgcatggaggagaccctctggctgcaggataacatccgcgacaagcttcggcctattcccatcacagcaagtgtcgagatccaggagccctcttctagacgcagggttaattctttacctgaagtactgccaatcctgaatagtgatgaacctaaaactgcacacatcgacgttcattttctcaaggagggctgtggtgacgataacgtctgtaatagtaatctgaaactcgagtataagttttgcacacgggaaggaaatcaggacaagtttagttacctgcccatccaaaagggggtgcccgaattagtgctcaaggatcaaaaagacatcgccctcgaaataaccgttaccaactccccaagcaatcccagaaatcctacaaaagatggcgacgacgcccacgaggctaaattgattgccacatttcctgatactttgacctacagcgcctaccgagagcttagggcgtttccagagaagcagctttcctgcgtcgcgaatcaaaatggttcccaggctgactgcgagctcggaaatccgttcaagagaaattcgaatgtaaccttctatcttgtgctctccacaaccgaggtgacgtttgatacgccagacctagacatcaatctaaaactggaaacgaccagcaatcaggacaatttagctcccataacagctaaagcgaaggttgtgatcgaactcctcctctccgtgagcggagtggccaagccctcccaggtatactttgggggtacagtggttggggaacaagctatgaagtccgaagatgaagtgggaagcctgatcgaatacgagtttcgcgtgatcaatcttgggaagccattgactaacctggggaccgctactctgaacattcagtggccaaaagagatttccaatggtaagtggctgctgtatctcgtaaaggtggaatcaaaggggctagagaaggtgacctgcgaacctcagaaggagataaattctctgaatctgacagagagccacaatagcaggaagaaacgcgaaatcacagaaaaacagatcgatgacaataggaagttcagtctctttgccgagcggaagtaccagacactgaattgcagcgtgaacgtgaattgtgtaaatatacgttgccctctaaggggactcgacagtaaagcttctctgatactgaggagcaggttgtggaattccaccttcctggaggagtacagcaaactcaactacctggacattctgatgcgggcttttatcgatgttacagcggcagccgagaatattcgcttgccaaatgcaggcacccaggtccgagttaccgtttttccatccaaaaccgtggctcagtacagtggcgtgccatggtggatcattctagtcgccattctagccggtatcttaatgttagcactcctggtgttcatcctgtggaaatgtggcttttttaaaaggaacaaaaaggaccattatgacgcgacttatcacaaggcagaaattcatgcccagccttctgacaaggaacgcctgacgtcagacgcttag

SEQ ID NO: 29047 - DNA, 3393 bp, Artificial Sequence
  Description of Artificial Sequence: Synthetic coding sequence
atggccgctgccggacagctgtgtctactgtatctttctgccggacttttgtccaggctgggcgcagcttttaacctcgataccagggaggacaatgttattagaaagtatggtgacccgggatccttgttcggtttctcacttgccatgcattggcagctgcagcctgaggacaagagattactgctggtcggtgctccgcgagccgaagcacttccactgcagagagcgaacagaaccgggggtctctatagctgtgacattactgctcgcggaccgtgcaccagaatcgaattcgataacgatgccgaccctacatccgagtccaaggaggatcagtggatgggagtcacagtccaatcccagggaccaggagggaaggttgtgacatgcgcacaccgatacgagaaaagacagcatgtcaataccaagcaagaatccagagacattttcgggagatgttacgttttgtctcaaaacctgcgcatagaggacgatatggatggcggagactggagtttttgtgatggcagactgcgcggtcacgagaaatttggaagttgtcagcagggggtggcagccacttttacgaaagatttccattacattgttttcggcgctcctgggacttacaattggaaggggatcgtgcgagttgagcagaaaaataatacgttttttgacatgaatatcttcgaagacggaccctacgaagtcggtggcgaaaccgagcatgatgagagtctggtacccgttccagccaattcctacttgggacttttattcctcacgagtgtgagttacacggatcccgatcagtttgtttacaagaccaggccaccaagggagcaaccagacaccttccccgatgtcatgatgaacagctatctgggcttctctctggactcaggcaaaggcattgtgagtaaggacgaaataacttttgtatctggggctcccagggctaaccactccggcgctgtggtgctgctgaaacgggacatgaaatctgcccacctactgcccgagcatatcttcgacggagaaggactggcatcatcttttggttatgacgtagccgtggtggatctgaacaaggacggctggcaggatatcgtgattggggcaccccagtactttgatagggatggggaggtcggcggagccgtgtatgtctacatgaaccagcaaggacggtggaacaacgttaaacccatcaggttaaacgggaccaaagattcaatgttcgggatcgccgtaaaaaacatcggcgacatcaaccaagacggctatcccgatatcgccgtaggcgcaccatacgacgatctgggtaaagtcttcatttaccacggtagcgctaatggcatcaacaccaaaccaacccaggtgctgaagggtatcagtccatatttcggctacagcatcgctggcaacatggaccttgaccggaacagttatccagacgttgccgtgggttctttatctgacagcgtgacaattttccgctcacgacccgtcatcaacattcagaaaacaattacagtaaccccaaatcgcattgatttaaggcagaagacagcgtgtggggctcctagcggcatttgtctacaggtgaagagctgttttgagtataccgccaaccccgctgggtacaaccctagcattagtatcgtggggactctggaggccgagaaggagcgcaggaaatccgggttgtcaagtcgggttcagttcaggaaccagggaagcgaacctaagtacacacaggaattgaccctcaaaagacagaagcagaaggtgtgcatggaggaaaccctctggttgcaggacaatattagggataagctgagaccaattcccatcacagcatccgtggagattcaggagcccagcagcaggagacgcgtaaacagcttgccagaggttcttcccatcttaaattccgacgagcctaaaacggcacacattgacgtgcacttcctcaaggagggatgcggagatgacaacgtctgcaactcaaacctgaaacttgaatataaattctgtacgagagaaggaaatcaggataagttcagctatctccccatacaaaaaggagtgccagagcttgtcctcaaagatcagaaggatatcgctcttgagatcaccgttactaacagcccatcaaatcccagaaaccctacaaaagacggcgatgatgctcatgaagccaagctcattgctacgtttccagataccctgacatacagcgcatatagggagctaagagccttccccgaaaagcagctgtcatgcgtcgctaaccaaaatggctcccaagccgactgtgagttaggaaacccatttaaacgcaactcaaatgtcacgttctatctggtgctgtctacaaccgaggtcacattcgacactcctgatctggacatcaatcttaaattggagacaacgagtaatcaggataacttggctcccatcaccgctaaggcaaaagttgtgatcgaactgctcttatctgtgtctggcgtggccaagcccagccaggtatactttggaggcactgtcgttggtgaacaggccatgaaatccgaggacgaagtcggttctctgatcgagtatgaattcagagtgattaaccttggaaaaccccttactaacttaggcacggcaaccctgaatatccaatggcccaaagaaatcagcaatggtaagtggctgctctatttggtgaaggtggagtctaaggggctggagaaagtgacgtgcgaaccacagaaggagattaacagccttaatctaacggaatctcacaacagtaggaaaaaacgcgaaatcaccgagaagcaaatagatgacaaccgcaagttcagcctatttgcggaaagaaaataccagactttgaactgctctgttaacgttaactgcgtaaacatcagatgcccacttcgcggtttggactccaaggcgtcccttattttgaggagtagactgtggaattcgactttcttagaggagtatagcaaactcaattacctcgacattctgatgagggcattcatcgatgtaacagctgctgcggaaaacatcaggctacctaacgccggtacacaagtccgtgtgactgtgttcccgagcaagacagtcgcgcagtactcaggcgtaccctggtggatcatcctggtggctatcctggccggtatcctgatgttagccttgctcgtgttcatcctttggaaatgtgggttctttaagagatcgagatacgatgactcggtgccaaggtaccatgcagtacgaattcgcaaggaggaacgggaaataaaggacgaaaaatacattgacaacctcgagaagaagcagtggattaccaagtggaatgaaaatgagtcttactcatag

SEQ ID NO: 29048 - DNA, 3261 bp, Artificial Sequence
  Description of Artificial Sequence: Synthetic coding sequence
atggcagctgcaggccaactgtgccttctttatctgtcggctggattattaagtcgacttggcgcagcctttaacttggacactcgggaggacaatgttatacggaagtatggagatcccggatccctctttggcttctccctggccatgcactggcagctgcagccagaagataagcggttattgttggttggcgctcctcgggcagaggccctgccactccagcgcgcaaataggactgggggtttgtatagctgtgacataaccgcccgaggcccttgtacacgcatcgagttcgataatgacgccgaccctacctctgagtcgaaagaagaccagtggatgggcgtcacggtgcaaagtcagggccctggaggaaaggtggtcacgtgcgcacatcgttatgaaaagagacaacacgtgaacacaaaacaggagagtagggatatcttcggtagatgttacgtactcagccagaatcttcgcatcgaagacgatatggacggcggagattggagcttttgtgacggaaggttgcggggtcacgagaagttcggatcttgtcagcaaggggtagcggctacctttacgaaggactttcattatattgttttcggcgcacctggtacctataattggaagggacttcttttccttacctccgtctcatatactgaccccgaccagtttgtttacaagacacgcccaccgagagaacagcccgacaccttccccgacgtgatgatgaatagctatctgggattcagcctggatagcggtaaaggtattgtcagcaaagacgagattaccttcgttagtggtgcccctagagctaatcactctggggctgtggtactcttaaaacgtgacatgaaaagcgcccatttgttacccgagcacattttcgatggtgaagggctggccagcagctttggctacgacgtcgccgttgtggatttgaacaaagatggatggcaggacatcgtgattggcgctccgcagtacttcgatcgagatggtgaagtaggcggtgctgtctatgtgtacatgaaccagcaaggcagatggaataatgtcaagccaatcagattgaatggaacgaaggattcgatgtttggaatcgcggttaagaatattggcgatattaatcaggatggctacccggatatagccgtcggtgcaccttatgacgacttgggaaaggtgttcatttaccacggtagtgctaatggtataaacaccaagcctacgcaggtacttaaaggcatctccccttacttcgggtacagcattgccggaaacatggacttagatcgaaacagttaccctgatgtggcagtgggcagcctttcagacagcgtgaccatttttcgatcacgacccgtcattaacatccagaagacgataaccgtgactcccaatagaattgatctgaggcaaaaaaccgcatgcggggctccatctggtatctgcctgcaggtcaagtcctgcttcgagtataccgccaaccctgctggctataacccctctatttcgattgtcggcaccctggaagctgagaaggagcggcgaaagagcggtctgagcagtagagtccagttccgcaatcagggctccgagcccaagtacacacaggagttgactctgaaaaggcagaagcagaaggtctgcatggaggagactctgtggcttcaggataatattagagataagctgcgaccgattcctattacagcctctgttgaaatccaagaacccagtagtagaagaagggtgaactctcttccagaggtcttgcccatcctgaattctgatgagcccaaaaccgctcacattgatgttcattttctcaaagagggttgcggggacgacaatgtgtgcaactcaaacctcaaactggaatacaagttctgcactagagagggcaaccaggacaagttctcgtacttgcccatccagaagggagtgcctgagctggtgcttaaagatcaaaaggatattgctctggaaataactgtgacaaactccccttctaacccacgcaaccccacaaaggacggggatgatgctcatgaggcaaaactgatagccacgtttcccgatactttaacctactctgcctacagggagctgagagctttcccagagaagcagctttcctgcgttgctaaccagaatggttcccaggcggactgtgaactgggaaatcccttcaaacggaattcaaacgtcaccttctatttggttctctccaccactgaggtgacgttcgacacccctgacttggacattaatttgaagttagaaacaacttccaatcaggataaccttgcccctatcaccgccaaagccaaggtggtgatcgagctcctgctcagcgtgtctggtgtggcaaaaccaagccaggtttatttcggtggtacagtcgtcggggaacaggctatgaagagcgaggacgaagtcggtagtcttattgagtacgagttccgggtgatcaacctgggcaaaccactaacaaacctggggaccgctaccctgaacatccaatggcctaaagagatctcaaacggaaagtggctcctttatctcgtcaaggttgagtcgaagggcctggaaaaggtgacctgcgaacctcagaaggagatcaactcacttaatctgaccgaatcccataacagccggaagaagcgggaaatcaccgaaaaacaaatcgacgacaatcgcaagttttcacttttcgccgagcggaagtatcagaccctgaattgcagtgttaatgtgaattgtgtaaacatcaggtgccccctccgaggcctagactccaaagccagccttattcttaggagcagactctggaattccactttcttggaagagtatagcaagctgaattatcttgacattctgatgagagcatttatcgatgtgaccgcagccgcagagaatattaggctgcctaacgccggtacccaggtgcgggtgacggtgttcccctcaaaaacagtcgctcagtactccggcgttccttggtggatcatcttggtggctatcctggccggaattctaatgttggctttgcttgtcttcatactttggaagtgcggcttcttcaaacgctccagatatgatgactctgtacccagatatcacgccgttcgaatccggaaggaagagagagagatcaaggacgaaaagtatatcgataatctggaaaagaagcaatggattactaaatggaatgagaatgagagttatagctag

SEQ ID NO: 29049 - DNA, 3414 bp, Artificial Sequence
  Description of Artificial Sequence: Synthetic coding sequence
atggcaggcgctagatcaagagacccttggggtgcatccggaatatgctacctattcgggtcgctgttggtggaactgctgttctctagagctgtcgctttcaacctggatgtaatgggcgcattgagaaaagagggtgaacccggaagtctcttcgggttttcggtcgccctacatcgacagctgcagcctcggccacagagctggctactggtcggcgctcctcaggcgctggccctgccaggccaacaggcgaatcgcacaggtgggcttttcgcctgccccctctcactcgaggagacagactgttatcgggtggacatcgatcaaggcgctgatatgcaaaaggaatcaaaggagaatcagtggctcggtgtctccgtgcggagccaaggaccagggggtaagatcgtaacctgtgcccatcgctatgaagccagacagcgcgttgaccagatccttgaaacacgagatatgatagggcgatgcttcgtactgagccaggacttggcaataagagatgaactggacggcggagaatggaaattttgtgagggccgtccacagggacatgagcagtttggcttttgccagcagggtactgccgcagctttttcgcctgattctcattaccttttgtttggcgcacctgggacatacaattggaaggggttactcttcgtaactaacattgactcttctgatcctgatcagctggtatacaaaactcttgaccccgctgatagactgcccggtccggctggcgatcttgctctaaactcctacctgggtttttccattgatagcggcaagggtttagtccgcgctgaggagctgtctttcgtcgctggggcaccaagggctaaccataagggtgcagttgttattctacgcaaggactcagctagcagactggtgccagaggtgatgctcagcggcgaaaggctgacctctggttttggatacagcctggccgtggcagatttgaactccgatggctggcctgatctgattgtgggcgctccatatttctttgaacgacaagaagaactgggaggcgctgtgtatgtgtacctcaaccagggaggacattgggccggaatctcaccattacggctctgcggcagccctgatagcatgttcggaataagcctggctgtgctgggtgacttaaaccaggatggcttccccgacatcgcggtcggcgctcccttcgatggagacggtaaggttttcatatatcatggcagctccctgggagtcgtcgcaaaacccagccaggtcttggagggggaagcagtggggattaagagtttcggatactctttatccggctctctggacatggatggcaatcagtaccccgatctgctcgttggcagtctcgcagatacagctgtgctctttcgggctagacctattctgcacgtgagccatgaggtatccatcgccccacgatccatcgacctggaacagcccaattgtgccggaggtcattcagtttgtgtggacctgcgcgtctgctttagttacatcgcagtcccctcatcttactctcccacggtcgcactggattacgtgctagacgccgacactgataggcgactgcggggacaggtaccaagggtaactttcttatccagaaatctggaagagccaaaacatcaggcttcaggcacggtgtggctgaagcatcaacacgaccgggtgtgcggagatgccatgtttcagttgcaagaaaacgtgaaggataagcttagagccatagtggtgaccctgtcgtacagcctgcagacgccacgcttacgcagacaggccccaggacaggggctgcccccagtcgcgcctatcctaaatgcacatcagccttccacccagagagcagagatccattttctgaagcaggggtgtggtgaggataaaatatgccagtcaaatctccaactcgttcgcgcaagattctgtacgcgtgtgtccgatactgagttccagcccctgccaatggatgttgatggcaccaccgccttatttgccttgtctggacaaccagttattggactggaactgatggtcactaacctgccctcggatcccgcacagccgcaagctgacggcgatgacgcccacgaggcccagctgctagttatgttgcctgactcgttgcactattctggcgttcgcgctctggacccagccgagaaacccctctgcctatccaatgagaatgcctctcacgtggagtgcgaactcgggaaccctatgaagaggggagcacaggtgaccttttatttgatcctgagtactagcggcatcagcatcgaaaccacagaactcgaggtggaattgctactcgcaactatcagtgaacaggagctgcaccccgtttcagcaagagccagggtgtttatcgagctgccccttagtatagccggtatggctatcccgcagcagctgttcttcagcggagttgtgcgaggggagcgggcaatgcagtctgaaagggacgtgggaagtaaggtgaaatatgaggtcactgtgagcaaccagggtcaaagcctcagaacattgggctccgcgttcctgaacataatgtggccacatgagatagcgaatggcaaatggcttctttatcccatgcaagtggagctggagggaggtcaaggccctggacagaaaggtctatgctcacctcgtcccaatattctgcatctggatgtggacagtcgggaccgtcgacgcagggagttggagcccccagaacagcaggaaccgggagagcgacaggagccttctatgagctggtggccggtgtcctcagctgagaagaaaaaaaacattacattggactgcgcacgtggcacagctaattgcgtggtttttagttgtcccttgtattcctttgatcgtgctgccgtgctccatgtttggggtcgcttgtggaatagtaccttcctagaggaatacagcgcggtgaagagtttggaagtgatagtcagagcaaacatcactgtgaaaagctccatcaaaaatctgatgctcagggatgcctctaccgtgattccagtgatggtgtatcttgaccctatggccgtcgtcgcagaaggggtcccctggtgggttatcctgttggcggtgttggctggattgttggtgctcgccctcctcgtcctgttgctgtggaagatggggttcttcaaaagagccaagcaccctgaagccactgtgccccagtaccatgcagttaagatcccgcgtgaggaccgccagcaattcaaagaagagaaaaccggcactatactgagaaataactggggctcccctcgtcgggaaggccctgatgcgcaccccattttggccgcagacggtcacccagagctgggtccggatggtcatcctgggccaggcaccgcctag

SEQ ID NO: 29050 - DNA, 3489 bp, Artificial Sequence
  Description of Artificial Sequence: Synthetic coding sequence
atggctggagccaggtctagggatccctggggggcatcaggaatctgctacctgtttggcagcctcctggtggaattgttatttagtagggctgtggcctttaacctggacgtgatgggagcgctccggaaggaaggagagcctggcagcttgtttggcttttccgtggctctgcatcgccaattgcagcccagaccacagtcgtggcttctggtgggcgcacctcaagcccttgccctgcctggccagcaggcaaatcggaccggaggcctgtttgcttgcccccttagccttgaggagactgactgctatcgtgttgacattgaccagggtgcagacatgcagaaagagtctaaagagaaccagtggttgggagtcagcgtgaggagtcaagggccaggcggaaagatcgtgacatgcgcccatcgctatgaggcacggcaaagggtcgaccagatcctggagacaagagacatgattggaaggtgcttcgttctgtctcaggacttggccattcgggatgaactcgacgggggtgaatggaagttttgcgaaggaagacctcagggccacgagcaatttggtttttgtcagcaagggaccgctgccgcttttagtcctgattcccactacctactctttggcgcacctggtacttataattggaaaggtacagctcgggtggagctatgcgcacaagggtccgcagatttagcccacctcgatgacgggccttacgaggccggtggggaaaaggaacaggatcctagactcattccagtgccagccaactcctacttcggcctcctgtttgtgaccaacatcgattcatctgatccggatcagctcgtgtataaaactctcgaccccgctgaccgactgcccggacctgccggagatctggcactgaacagctatctgggcttcagcattgacagtggaaaaggactcgtgcgggctgaggaactcagcttcgtagctggcgcaccacgcgcaaatcataaaggtgccgtggtgatccttcggaaagatagcgcttctcgcctggtccccgaggtgatgctgtctggtgaaaggctcacatcaggattcggctactccctggccgtggcagatctcaacagcgatggatggccagacttgatcgttggcgctccttatttctttgaaaggcaggaagaactcggtggggctgtatatgtgtaccttaaccagggtggacactgggcaggtatttctccactcaggttgtgcggatccccggatagcatgttcggaatcagcctcgccgttctgggcgatctgaatcaggatggcttcccagatatcgccgtgggcgctccctttgatggagacggcaaggtgtttatttaccacggcagcagcttaggcgttgtggctaagccaagccaggtactggaaggtgaggcggtcgggattaagagcttcggctacagcctctctggcagcctcgatatggatggcaatcagtaccctgacctgctggtgggtagtctggctgacaccgcggtcctctttcgcgcacgcccaatacttcacgtgtctcatgaagtctctatcgcaccccgatctattgatctcgaacagcccaactgcgcgggtggccatagcgtatgtgttgacctccgcgtctgtttcagctatatcgcagtcccatcaagttactctccaaccgtcgctcttgattatgtgttggacgcggacacagacaggcggttgagaggccaggtgcctcgagttacatttctctctcgaaacctggaagagcccaagcaccaggccagcggcacagtctggctcaagcaccaacacgacagggtgtgtggcgatgctatgttccagctacaggagaacgtgaaggacaaattacgcgctatagtcgtcactttgtcttactccctacaaacccccagactgaggcggcaggctccgggacaaggcttaccgccagtcgctccgattctcaatgctcaccagccgagcacccaaagagccgagattcattttctcaaacaggggtgcggagaggacaagatttgccagagtaatctccagctcgtacgggcacggttctgcactcgcgtgtcagatactgaatttcagcctcttcccatggacgtggacgggacgactgcattgtttgccttgagcgggcaaccagttattggactggaacttatggtcactaatttaccctccgatcctgcccaaccacaggcagatggggacgatgcacatgaggctcagctccttgttatgctgccagatagtttgcactatagcggcgtgcgtgccctcgatcccgctgagaaaccgttatgtttgagcaacgagaatgcttcacacgttgagtgtgagcttgggaaccctatgaagcgtggtgctcaggtgacgttttatcttatcctgtcgactagtggaataagtattgaaaccacagagcttgaggttgaactacttttggccaccatttcagagcaagagctgcaccctgtttcagccagggcccgagtattcatcgaactgccgctgagcatagcaggcatggcaatcccacagcaactctttttctcgggtgtggtccgaggagaaagggcgatgcagtctgaacgagacgtgggtagtaaagtgaaatacgaggttacagtgtccaaccagggacaatccctcagaaccctgggctccgctttcctcaatatcatgtggcctcatgaaatcgctaatgggaaatggctactctacccgatgcaagtggagttagaggggggacaggggccaggtcaaaagggactttgcagcccacgacccaacattcttcatctggatgtggactctcgcgacagacggaggagggagctcgagcctcctgagcaacaggagcctggagagaggcaggagccctctatgtcatggtggccggtttcttctgcagaaaaaaaaaaaaatataaccctagattgtgccagggggaccgccaactgcgtggtgtttagctgtcccctttattcctttgatcgtgccgcagttctccacgtgtggggacgactttggaatagcacctttttggaggaatacagcgcagtgaaaagcttggaggtaatagtgcgcgcaaacatcacagtcaagtcttccatcaagaacctgatgctgcgtgacgctagcacggtgattccggtaatggtatacctcgatccaatggccgtggtggccgagggcgtgccctggtgggtgatcttactggctgttctggccggactgctcgtcctagcgctcctggtacttcttctgtggaaatgcggcttttttcacaggagtagccagtccagctcatttccaactaattatcacagagcctgtcttgcggtccagccatccgcgatggaagttgggggtcccggaactgtggggtgggacagtagtaatgggaggagtacgcctcgtcccccatgtccctcaactatgagatag

SEQ ID NO: 29051 - DNA, 2976 bp, Artificial Sequence
  Description of Artificial Sequence: Synthetic coding sequence
atggccggagctcggtcgcgggacccctggggagcatctggcatctgctatctgttcggatccttactggtcgagttactgttcagtcgagcggtcgctttcaacttagacgtaatgggagcccttcgaaaagagggagagcctggctccctgtttggtttttcagtggcgctgcacagacagcttcaacccaggccccagagttggctgcttgttggggctccccaggcgctcgcgctgcctggacaacaagcgaacaggacaggcggtctcttcgcctgtccactttccctagaagaaacagactgctatcgagtcgatattgaccaaggagccgacatgcagaaggaatccaaggaaaaccagtggctgggtgtgagcgtgaggagccagggaccaggagggaagatagtaacatgcgcacaccgctacgaagctcgtcagagggtggaccagattctggaaacccgtgatatgattggcagatgcttcgtgctctcccaggacctcgccattcgggatgagctcgacggaggtgaatggaaattctgcgagggaagacctcagggtcacgaacagtttggcttctgtcagcagggaaccgcagcagctttttctcctgattcacactacttgctcttcggtgcacccggaacgtacaactggaagggaactgcaagggtggagctgtgcgcacagggctcagcggacttggcccaccttgatgacggcccttacgaagccggtggtgagaaggagcaggatcccaggctcatcccggtaccggctaatagctactttggcctattgtttgttactaacattgactctagcgaccctgaccagctggtctacaaaaccctggatccagcagatcgtctgcctggccctgccggagacctggctctgaacagctatctcggtttctcaattgactccggcaaaggactcgtgagagctgaagagttgtccttcgttgccggagcacctcgtgctaatcacaagggggctgtcgtgattctgcggaaagattctgcttcacggctggtgcctgaggtcatgctgagcggagagcgcttgaccagtggcttcggatactctctggccgtggccgacctcaacagcgatggctggcccgacctgatcgttggggcaccatacttctttgaaagacaggaagagcttggaggcgcagtgtatgtgtacctgaatcaggggggacattgggccggaatttcacctctgcgcctgtgcggtagccctgattccatgttcggcattagcttggccgtgctgggagatctgaatcaagatggcttcccggatatcgccgttggcgctccttttgatggggacggtaaagtgtttatctaccatggcagctctcttggcgtggtggccaaaccatcccaggtactggagggagaggccgtgggaatcaagagcttcggatactctctctccggaagccttgacatggacggaaaccaatacccagacctgctggtgggctctttggccgacactgccgtattattcagagctagacccattctccacgtgtcccacgaagttagtatcgcaccccgttcaattgatcttgagcaaccaaactgcgccggtggacactccgtctgcgttgatctccgggtgtgcttcagctacatcgcagtgccatcgtcttacagcccgactgtggcgcttgattacgtcctggacgccgataccgatcgcagacttagggggcaggtgcctagggtgacattcctgagcaggaacctcgaggagccaaaacatcaggcactggaccctgccgaaaagccgctgtgcctatctaatgaaaatgcctcccatgtcgagtgtgagttgggtaaccccatgaagcggggagctcaagtcactttctacctgatcctatccacaagcggtatcagtatagagactacagaactggaagttgagctcctcctggctaccatctccgaacaggaactgcaccccgtgtcagcacgggcacgagtgtttatcgagctgccactctccattgccggaatggccattccccagcagcttttctttagtggggtggtccgaggggaacgcgcaatgcagagcgagcgcgacgtaggaagtaaagtgaaatacgaggtgaccgtctccaatcaaggtcagtctcttcggacactcgggagcgcttttttaaatatcatgtggccccacgaaatcgccaatgggaagtggctactgtaccctatgcaggttgagctggagggaggacagggaccagggcagaagggcctttgttcccccaggccaaacatcctccacttggacgttgattcaagggatcgaagacgtcgtgaactggagccccctgagcagcaggagcccggtgagagacaggagccctccatgtcctggtggccggtatcttctgcagagaaaaaaaaaaacataaccctcgattgtgcaagaggcacggctaattgtgttgtgtttagttgtccattatatagttttgatcgagccgcagtgctgcacgtgtggggacggttatggaacagcacattcttggaagagtactctgccgtcaaatcccttgaggtgatcgtgcgagccaacatcaccgttaagtctagtatcaagaacctcatgctcagagacgcaagcacagtgattcctgtgatggtgtacctcgatcctatggccgtggtggccgagggggtaccatggtgggtgattcttcttgccgtcctggccggactgcttgttctagccttactcgtgctgttgctgtggaagtgcggcttcttccacagatcaagccagtcttcctcattccctaccaattaccatcgagcttgcctggcggtgcagccttccgctatggaagtgggcggtcccggtacggtcggatgggattcttctaacgggagaagtacaccgagaccaccttgccccagcaccatgcgttag

SEQ ID NO: 29052 - DNA, 3357 bp, Artificial Sequence
  Description of Artificial Sequence: Synthetic coding sequence
atggccggtgccaggtctcgcgacccttggggagcctccgggatctgttacctgttcgggtccctcctagtcgaactactctttagtagggcagttgccttcaacctcgacgttatgggagcgctccgtaaggaaggtgagcccggatccctgtttggtttcagcgtggcattacatcgacagttgcagcccagacctcagtcctggctgctggttggtgcgccacaagcccttgctctgcccggacagcaagccaatagaaccggcggattgtttgcttgtcctctgagcctggaggaaacagactgttatagagtggacatcgaccagggagctgacatgcagaaagagtcaaaagagaaccaatggctgggggtgagcgtcagatctcaaggcccaggcggtaagatagtcacatgtgcccaccgatacgaggctcgccagcgtgtcgaccagatcttggagacccgcgacatgatcgggcgatgctttgtactttctcaggaccttgctattagggacgagcttgacggaggcgaatggaagttttgtgagggcagaccacaagggcacgagcagtttggcttctgccagcaagggacagccgctgcctttagccccgacagccactacctgctgtttggggctcctggaacttacaattggaagggacttttgttcgtgacaaatatcgattcctcggaccccgatcagctggtttataagacactggacccagccgaccgcctcccgggtccagctggcgatctggcccttaatagctacctcggattcagtatcgattccggcaaagggcttgtgcgcgctgaggagctgagctttgtggctggggcacccagagctaaccataagggtgccgtggtcattcttcgcaaagactctgcctcgagactggtgcctgaagtgatgctctccggagagcgtctgacctccggattcgggtattcccttgccgtcgccgatctcaatagcgacggctggccagacctcatcgtcggcgctccctacttctttgaacgccaagaagaactgggtggagcggtatacgtgtatttgaaccagggaggacattgggcaggcatcagtcctctgcggttatgcgggtcaccagattccatgtttgggattagccttgccgtactgggggacctcaaccaagatggctttcccgacatagctgtcggagcaccgtttgatggagacggcaaagtgttcatctaccatggcagcagcctgggcgtggtcgcgaaaccttcccaggtgcttgaaggagaggcggtcggaattaaaagtttcggttatagcctttctggatctctggatatggatgggaaccagtatcccgatctcctcgtgggatctttagctgacacagccgtactgttcagagctcgtcctatcctgcatgtatcacatgaggtgtcaatcgcgcctcgaagtatcgatctggagcagcctaactgcgctgggggtcacagcgtgtgcgtggacttgagagtctgttttagttacatagccgttccctcctcctacagccctaccgtcgcattagactacgtattggacgccgatacagaccggagactgcgcggacaagtccctcgcgttacattcttatccagaaatcttgaggaacctaagcaccaggcttcagggacagtttggctgaagcaccaacatgaccgggtctgtggagacgccatgttccagttacaggaaaatgtaaaagacaagttgcgtgccatagttgtgacactatcttacagcctccagactcctcgcctgcgccgacaggcaccgggtcagggactaccccctgtggctcccatattgaatgcgcatcaaccgtccacgcaacgggctgaaatccacttcctcaaacagggctgcggtgaagacaagatctgtcagagcaatctccagttagtgagagccaggttttgtacccgtgtctccgacactgagtttcagcccctgccaatggacgtggacggtaccactgcactgtttgctctgtcgggtcagccagttattgggctggagctgatggtgaccaacctcccaagtgaccctgctcagccacaagctgacggcgacgatgctcacgaagcccagctcttggttatgctgcctgactcactccattatagtggagtcagggcgttggacccggctgagaagcccctttgtctgagtaatgaaaatgcctcacacgtggagtgtgaactcggcaatcccatgaaaaggggggcacaggtaacattctatcttatcctgtctacgagtggcatcagtatagagacaacagaactggaagtcgagctgctcctagcaacaatctcagaacaagagctgcatcctgtcagtgcccgagcgagggtgttcattgagttacctcttagcatagctgggatggcgataccccaacagcttttcttttcaggcgtggtgcgtggtgagcgtgcgatgcagtcagaacgggacgtggggagtaaggtaaaatatgaggtgactgtctctaaccagggacagtccctgcgtaccttggggagcgccttcctcaacattatgtggcctcacgaaattgctaatggcaagtggttgctgtatcctatgcaggtcgaactagaaggagggcagggccctggccagaaaggcttatgcagtccacgccctaatattctgcacctcgatgtggactcaagggacagacggagaagagagctggaacctccagaacagcaggagcctggcgagaggcaggagccatccatgtcctggtggcctgtaagttccgccgaaaagaagaagaatattaccctggactgtgcacgaggaactgctaactgtgttgtctttagctgccccctctactcctttgatagagctgcggtgctccacgtttggggcaggttgtggaatagtaccttcttggaagagtactctgccgtgaagtccctcgaagtgatcgtccgcgcaaacatcactgtgaagtcgtcaattaagaatcttatgttgagagacgcaagcaccgtaatccctgttatggtctatctcgatccaatggctgttgtggctgagggcgttccatggtgggtgatcctgctagctgtgctggctgggctgctcgtgctggcattactggtgcttctgctgtggaaatgtggtttctttcatcgctctagccagagcagcagctttcctactaactatcatcgcgcttgcctcgccgtccagccctcggccatggaagtgggaggtccaggaacggtgggttgggactcaagcaacgggagatctactccacgcccaccgtgtcccagtactatgcgctag

SEQ ID NO: 29053 - DNA, 3369 bp, Artificial Sequence
  Description of Artificial Sequence: Synthetic coding sequence
atggcaggtgctcgctcacgagacccgtggggagcctcaggcatttgttatctatttggcagcctgcttgtggagctgcttttttctcgcgcagtggccttcaatctggacgtgatgggagcactgcgcaaagagggcgaacctggatctttgttcggcttttcagtcgctctccaccgccaacttcagccgcgacctcagtcttggttgctcgttggggctccccaggcgctggctcttccaggtcagcaggccaatagaaccggcggactattcgcatgtccactctccctggaagagacagattgctatcgggtcgatatcgaccagggcgctgacatgcagaaagagagcaaggaaaaccagtggctcggggtgagcgtgaggagccagggacccggaggcaagattgtgacttgcgcacacaggtacgaagctcggcagcgcgttgaccagatcctggagacgcgcgatatgattgggagatgctttgtgctttctcaagatttggcaatccgggatgaactggatggaggagaatggaaattctgtgaaggtcgaccccagggacacgagcagtttggcttttgccagcagggtactgccgctgctttttctcccgattcccattacctgctttttggggctcctggaacctacaattggaaaggaaccgccagagttgaattatgcgcacaaggatccgctgatctggctcatctcgatgacggcccttacgaggctggaggagaaaaagagcaggaccctcgtttgatccccgtcccggctaacagttacttcggattttcaatcgacagcggcaaaggccttgtcagagctgaggagttatcatttgtggcaggcgcaccaagggcgaaccacaagggagccgtcgtgatccttagaaaagactcggctagcaggctcgtaccagaagttatgttgtccggggagaggcttacctccggattcgggtatagtctggcggttgctgatctgaactcagatggatggccggatcttattgtgggcgcaccttatttttttgagaggcaggaggaactggggggtgcagtatacgtttacttgaatcagggcggacattgggctggaatcagtcccctccggttatgcggctctccagacagtatgttcggcatatcgctcgctgtgttaggagacctgaaccaggacggcttccctgatatagctgtgggcgcaccttttgacggcgacggcaaagtgttcatctaccacggcagctccctgggcgttgtagcaaaaccctctcaggtgctcgagggggaagcagtagggattaagtccttcgggtactccctctccggcagcctggacatggatgggaaccagtaccccgaccttctcgtaggtagcctcgccgataccgccgtgttgttcagagcaagacctattctgcacgtcagccatgaggtgagcattgcgccacgtagtattgacctggagcagccaaactgtgccggaggacatagtgtgtgcgtggacctcagagtctgtttttcatatatcgcggttccctcctcttattcacccaccgttgccttagactatgttttggatgctgacacagatagaaggctccggggacaggtgccacgcgtcacgtttctctcacgaaatctagaggaaccaaagcaccaagctagcggcactgtgtggctgaaacatcagcacgaccgcgtgtgtggcgatgctatgttccagttgcaggagaacgtaaaagacaaattgcgggctatcgtagtcaccctttcttattccctccagacaccaaggcttcgcagacaggctccaggtcaaggactgcctccggtggccccaatccttaatgctcaccagcctagcactcagcgcgcagagatccactttctgaagcagggctgcggggaggataaaatctgtcagtcaaatttacagctagtgcgagcgcgattctgcacacgagtcagcgataccgagttccaaccactgcccatggatgtagatggcacaacagccctcttcgcgctttcgggacaacccgtgattggcctggaattaatggtgaccaacctgcccagcgaccccgctcagcctcaggccgacggagatgatgctcatgaagcccagctgcttgtgatgctgccagactccctgcactattcgggggtccgggctttagaccccgcagaaaaacctctatgtctgtccaacgagaacgcatctcacgttgaatgcgaactcggaaatcctatgaaacgcggagctcaagtgaccttctatttaatattgagcacgtccggaataagcattgaaacgacagagctggaggttgaactgctgttggccaccatttccgagcaggaactacacccagtctccgcaagggccagagttttcattgagcttcctctgagcatcgccggtatggcgatcccccaacaattgttttttagtggtgtagtgcgtggcgagcgagccatgcaaagtgagcgtgacgtcggtagtaaagtgaagtatgaagtcacagtgagcaaccaggggcagtccctgagaactctcggcagtgccttcttgaacatcatgtggccacacgaaattgctaacggaaagtggctgctctatcctatgcaggtggagctggagggcggtcagggacctggacaaaagggcctttgcagtcctcgacctaatatcttgcatctggacgttgactccagggacaggcgacgaagagagctggagcccccagaacagcaggaacctggcgagaggcaggagcctagtatgtcctggtggcccgtcagcagcgccgaaaagaagaaaaacatcaccctggactgtgcacggggaaccgctaattgcgtagtttttagctgcccactatactcttttgacagggctgcggtgcttcatgtgtggggaagattatggaattcgactttcttggaggagtactccgccgttaaaagtcttgaagttattgtcagggctaacattacagtcaagtcgagcatcaaaaacctgatgcttcgtgacgccagtacagtaattcccgttatggtgtacctggaccctatggccgtggtggcggagggagtcccttggtgggtgatacttctcgccgtactcgcgggattactggtccttgcacttctcgtgcttctgctgtggaagtgtgggtttttccacaggtctagccagagcagctcatttcctacgaattatcatcgtgcttgtctggccgtgcagccttctgccatggaggtcggaggccctgggaccgtcgggtgggattcatcaaatgggagaagtactcccaggcccccttgtcccagcacgatgcgctag

SEQ ID NO: 29054 - DNA, 3135 bp, Artificial Sequence
  Description of Artificial Sequence: Synthetic coding sequence
atggctccattcgccaccccaatggtccaggccctcacaaccacccgcattcagaggcaggccgaaggtttccagtgttggcgcgaatgcggcaccagacggagcccttttgagggcaaggaaacttgcgctcatagatacgaagccagacagcgagtagaccagatcctcgaaacaagagatatgatcggccgatgtttcgtcctatcacaagacctggccattcgagatgaactggatggcggagaatggaaattctgtgagggccgaccacagggccacgagcagttcggattctgtcagcagggtacggctgctgcattctccccagactcacactatctcctgttcggggctccgggaacatacaattggaaggggactgcccgtgtggagctgtgcgcacagggctccgccgatctagcccacctcgatgacggaccctacgaagcgggtggggagaaagaacaggacccacgtcttattccagtccctgccaactcctactttggtttttccatcgattccgggaaagggttagtccgggctgaagaattgtcgttcgtggccggagctcctcgcgcaaaccacaagggcgctgtcgtcattctcaggaaagactcagcatcccgccttgttcctgaggtcatgctgtccggtgagcgcctcacaagtgggtttggatactctctggcagtagccgatctgaactcagatggatggccagacctgatagtgggagccccatacttctttgagcggcaggaggagctgggtggcgcagtgtatgtctaccttaatcagggcggacattgggccggtatctctcccttacgtctgtgtgggagtccagacagcatgttcggaataagcctggctgtcctgggggatctgaatcaggacggtttccctgatattgccgtgggtgctccttttgacggtgacggcaaagtctttatctaccacggctcttcgctgggagttgttgccaagccatcacaggtattagagggggaagcggttggaattaaaagcttcggctatagtctgagtgggtcactagatatggatggtaatcaatatcccgacctgttagtcggttctcttgctgatactgcagtcctatttagagcccgtccaattctgcacgtgagccacgaggtttctattgcccctcggtctatcgatttggagcagccaaattgcgcaggcggacattccgtatgcgtggatctcagagtttgttttagttatattgccgtccctagctcctattcgcccacagttgcgcttgattacgtgcttgatgccgacactgataggagactgaggggccaagtcccacgtgtcacttttctctctcgcaatttggaagagccaaaacatcaggcaagcggtactgtatggctgaagcaccagcatgaccgggtctgcggtgacgcaatgttccaactccaggagaatgtgaaagataaactgagggcgattgtggtaacactttcctactcgctccagactcccaggctgaggcgtcaagcacccggtcaggggctgcctcccgtggcacctatcttgaacgcccatcagcccagcactcaaagggccgaaattcattttctgaagcaaggatgcggagaggataagatatgtcagagcaacctccagctggtgcgcgctcggttctgcacacgcgtgtctgatacagaatttcagcccttacccatggacgtggacggtaccacagccctattcgccctgagcggtcaacccgtaatcggcctagagttgatggtcacgaacctgccttctgaccccgctcagccacaggctgacggtgatgacgcacatgaagctcagctcctggtaatgctccccgactcactgcactacagtggagtgagggccttggatcctgccgagaagccactttgcctttccaacgaaaatgcttcacacgtcgaatgcgagctcggcaatccgatgaaaagaggagcccaggtgaccttctacctgatcctaagcactagtgggatatctatcgagacaacagagctcgaagtagagctcctgctcgcaacaatctcagagcaggagttgcaccccgtgagcgcccgtgcccgtgtgtttatcgaactccctcttagtattgcaggcatggccatccctcagcagctctttttcagcggcgtggttagaggggagcgagcaatgcaatcggagcgggatgtggggtccaaggtcaagtatgaagtgacagtctcgaaccaaggtcaatctttgcgaactttgggaagcgcgtttctgaatattatgtggccacatgaaatcgccaatggaaaatggttgttgtatccaatgcaggttgagcttgaaggcggacaggggcctggtcagaaaggcttatgttcccccagacctaacatcctgcacctagacgttgattcacgggatcggaggaggcgagaactcgagcctccagaacaacaagagcctggtgaacgccaggagccgtccatgtcatggtggcctgtgtcctctgcggagaaaaaaaagaatattaccctggactgcgccagaggcacagctaactgcgtcgtcttttcctgcccattatacagtttcgatagggcggctgttttgcatgtgtggggtcgattgtggaactctacattcctcgaagagtattccgctgtaaagtctcttgaagtgattgtcagggctaatattactgtaaaatcttctattaaaaatctcatgctgagggacgcaagcacagtcatccctgttatggtatatctggacccgatggcagtcgtggcggaaggagtgccgtggtgggtcattctcctggctgtgctggcagggctgttggtgttggcccttctcgttctgctcttatggaagatgggtttcttcaaaagggccaaacaccctgaggcaaccgtccctcaataccatgctgttaaaatcccgagggaagacagacaacaattcaaggaggaaaaaacaggcacaattctgagaaacaattggggcagcccacggagggaaggaccggacgcccaccccattctcgccgctgacggccacccggaactaggaccggacgggcatccgggacccggtaccgcatag

SEQ ID NO: 29055 - DNA, 3426 bp, Artificial Sequence
  Description of Artificial Sequence: Synthetic coding sequence
atggctggcgctcggagccgcgacccctggggagcttccgggatctgttacctgttcgggagcctactcgtggagttacttttctctcgggctgtagccttcaatctggatgtcatgggggctttgcgcaaagaaggggagccagggtcactgtttggtttttcagtggctctgcatcgacagctacagcccagaccccagtcttggctgctagtgggcgctccacaggctctcgcactccctggacagcaggccaatagaactggaggactcttcgcttgtcccttgtctctggaagagaccgactgctatcgagtcgacatcgatcagggggctgacatgcagaaagagagtaaggagaaccaatggctcggagtctccgtaagaagtcaagggccagggggtaagattgtgacgtgcgcccatagatacgaggctagacaacgggtggatcaaatccttgaaactagggatatgattggcagatgcttcgtcctctcacaggatcttgctattcgggacgaattggatggaggggagtggaagttttgcgaagggaggccgcaggggcatgagcaatttggattctgtcagcagggcactgcagcagccttctctcccgactcgcactatctgctgtttggggctcccggaacttataactggaaaggaaccgcccgagtcgagctttgcgcccagggctcagccgacctagcgcacctggatgacggcccatacgaagctggcggagagaaggagcaagatccacgactaatccccgtgccggctaatagctactttggattcagtatcgactccgggaagggattggtccgggctgaggagttatcgttcgttgcaggtgcacctcgcgctaaccacaaaggcgctgtggtgattctcaggaaggattctgcctctcgtttagtgccggaggtcatgctctcaggagaaagactcacgtccggcttcggatactccctggctgttgccgacctgaactccgatggctggccagacttgatcgtcggcgctccatatttttttgagcggcaggaagagctgggaggagcagtgtatgtgtatctgaaccaggggggtcactgggctggcattagtcccctccggttgtgcggcagccctgatagtatgtttggtatctcactggcagttctcggggatctgaatcaggacggcttcccagatatcgccgttggcgctcctttcgacggcgatgggaaggtgttcatttaccatggtagttccctcggtgtggtagctaagccctcccaggtcctcgagggagaggctgttggaatcaaatcgtttggctactccctctccggttccctggatatggatggaaaccagtaccccgaccttctggttggctctctagccgatactgcagtgctattccgagcgaggcccatccttcacgtgagtcacgaagtaagtatcgccccacgctccatcgacttggagcaacccaattgcgccggtggtcatagcgtgtgcgtggacttgcgggtatgcttctcttacatcgccgtccccagttcctattcccccacagtggcgcttgactatgtcctcgacgctgatacagacaggcggctgagagggcaagttccgagagtcacctttctctccaggaacctcgaagagccaaaacaccaggccagtggcactgtgtggttgaagcaccagcacgatagggtgtgcggagatgctatgtttcagctacaggaaaatgtgaaggacaagctaagagcaatcgtggtgacactgtcatactctctgcagacaccaagacttaggcggcaggcaccgggacagggcctgccaccagtggccccaatcctgaatgctcaccagccaagcacacagagagcagagatccactttcttaagcagggatgtggagaagacaagatctgtcaaagcaacctgcagctcgtgcgtgctaggttttgcacaagggtctcagacaccgagtttcagcccctgccaatggacgtcgacgggacaactgctctctttgcactgtctggccagcccgtgattggtctcgaactcatggtcaccaacctgccatcagaccccgcacaaccacaggccgacggggatgatgcacatgaggcccagctgttggtaatgctgcccgattctctacactactccggcgtccgagccctggacccggctgagaagcccttatgtctgtctaacgagaacgcttcacatgtagagtgcgaactagggaacccaatgaaacggggagcacaggtgacattctacctaattttgtcgacgtcagggatctcaatagagactactgagctggaagtggagctgctgctggccacaatttctgagcaagagctccaccctgtgtcagccagggcaagggtgtttatcgagcttcccttatcgatagcgggaatggcaatcccacagcagttgttcttcagtggtgttgttagaggagagcgagcaatgcagagcgaacgcgatgttgggagtaaagtgaaatacgaagtgacagtcagcaaccagggacagtctctaagaaccctaggttctgctttcttaaacatcatgtggcctcatgaaatcgctaatggaaagtggctgctgtacccaatgcaggtggagctcgagggaggtcagggcccaggacaaaaaggcctgtgctcccctagaccaaatatactgcatcttgatgttgacagtcgggaccggagaaggagagaactcgagcccccagagcaacaggaaccaggggagcgccaggaaccgagcatgagctggtggcctgtcagtagcgcagaaaagaaaaagaacataactcttgactgcgccagggggacagcaaattgcgtcgtgttttcttgtccactctactcattcgacagagcggcagtcctccatgtgtggggacggctctggaacagtaccttccttgaggaatactctgcggtcaaaagcttggaagttatcgtcagggctaacattactgtcaaaagcagtattaaaaatctgatgctgcgcgatgccagcaccgtgataccagtgatggtctacctggatccgatggctgtagttgccgagggtgtgccctggtgggtgatcctattagccgtgctggctggcctgctggttttggctttgcttgtcttgctgctttggaaaatgggttttttcaagagggccaagcatcccgaagctaccgttccacaataccacgcagtcaaaatcccaagggaagataggcaacaattcaaagaagaaaagacaggtaccatactccgaaacaactggggcagtcctcgtcgtgagggccctgatgcccacccaattctcgctgctgacggccatccagagctgggcccagacggacaccccggacctgggacagcctag

SEQ ID NO: 29056 - DNA, 3546 bp, Artificial Sequence
  Description of Artificial Sequence: Synthetic coding sequence
atggccggagctcgaagccgtgatccgtggggtgcgtctgggatttgctatctgttcggctccctgctggtcgaactgcttttctctcgggctgtcgcctttaacctggatgttatgggagccctgcggaaggagggtgagcctgggagcttattcggcttcagtgtggcactgcacaggcagttgcagccaaggcctcagtcttggctgttggtaggtgcgcctcaggctctggctctgcctgggcagcaggcgaataggacagggggactttttgcatgccccctgtctctcgaggagacagactgctatcgggtcgacatcgatcaaggcgctgacatgcaaaaggaatccaaggagaatcaatggctgggtgtgtcagtgaggtcccagggccctggcggaaaaattgtcacctgtgcacaccgctatgaggccaggcagcgggtcgatcagattctcgaaactcgggatatgattgggcgttgctttgttctttctcaagatctggctattcgcgatgaactcgacggaggtgagtggaagttctgtgagggtcggccacagggtcacgaacagtttggtttttgccagcaaggaaccgcggcagctttttctcccgactcacactatctgctgttcggggcacccggaacctacaattggaagggaaccgcacgggttgagctttgtgctcagggttctgccgacctggctcacctggatgacggtccctacgaagccggtggcgagaaagagcaagatcccagacttattcccgtcccagccaattcctacttcgggttgctctttgtgaccaatatagacagctccgacccggatcagttggtctacaagactctagaccctgcggatcggttgccaggacccgcaggggatctcgcactgaactcatatctaggcttcagcatcgatagcggcaaggggctggtgcgagcggaggagttaagcttcgtcgccggtgctcccagggccaaccacaagggcgctgtcgttatcctgcgaaaagatagtgcgtcacgccttgtccctgaggtgatgctatccggtgagaggctcacctccggcttcgggtatagcctggccgttgctgatttaaattctgatggctggccggatctgatcgtgggggcaccatattttttcgaaaggcaggaggaactggggggtgcggtgtatgtgtacctgaatcaggggggtcactgggccggaatctcaccactaaggttgtgtgggtccccagacagtatgtttggaataagtctggccgttctcggagatttgaaccaggacggctttcccgatattgcagttggcgctccatttgacggagatggcaaagtctttatttaccatggttcgagcctcggggtcgtggccaagccaagccaggtgctggagggagaagcagtgggcattaaatcttttggctacagtctctctggatcactcgatatggacgggaatcagtacccggacctcctggttggcagcttggcagacaccgcagtgctcttcagggctcgcccaatactgcatgtatcccacgaggtgagcatagctccgagaagtattgacctggagcagcccaactgtgcgggtggacattcagtgtgtgtggacctgcgcgtgtgtttcagctacatcgccgtgccttctagttattctccaacagtagcacttgattacgtgctggacgcggacacagacaggaggctgagaggccaagtcccgagagtgacctttctctctagaaatctcgaggagcccaagcaccaagcctccgggactgtttggctcaagcatcagcacgacagagtgtgcggagatgccatgtttcaattacaggagaatgtgaaggacaagctgcgggctattgttgtgactctctcctacagtctgcagacgccccgactcaggaggcaggcgcctggacaaggcctgccacccgtggcaccgatattgaatgcacaccaaccatcaacgcaacgcgctgagatccacttcctcaagcagggttgcggcgaagacaagatctgccagagcaacttgcagcttgtccgggctagattctgtacaagagtgtccgatacagaattccaacccttgccgatggacgtcgatggtacgaccgcgttgttcgccttaagcggccaacccgtcatcggactggaactcatggtgacaaatctcccctccgatccggcacagccacaggcggatggggacgatgcacatgaagcccagctccttgtgatgttgccggactccttacactattctggcgttcgagcgctggaccccgctgagaaaccgttgtgtctatcaaatgagaacgcctcgcacgtggagtgtgaactcggaaaccccatgaaacgcggagctcaggttacgttttatctcattttgtcaactagcggaatctctattgaaacgacagagctggaagttgagctcctgctggccaccatcagtgagcaagaactccacccggtgagtgcaagggctcgcgtgttcatcgaacttccgttgagtattgctggtatggctattcctcaacagctgttctttagtggtgtagttcggggagagcgcgctatgcaaagcgaaagagacgtgggaagcaaagtgaaatacgaggtgactgtgagcaatcaggggcagtctctcaggacgctaggctccgcctttttaaatattatgtggccacatgagattgccaatggcaagtggctgctttacccaatgcaagtggagctggagggtgggcagggccctggacaaaaagggctttgcagcccacgccctaacatcttacatctggatgttgactccagagacaggagacgcagggaattggagccccctgagcaacaggagccgggtgagaggcaagagccgtctatgagctggtggcccgtctcatcagctgagaagaaaaaaaatataactttagattgcgccagaggcacagccaactgtgtcgtcttctcttgtcccttgtatagctttgatcgggctgcagtgttgcacgtctggggcagattatggaattcaacttttctagaagagtactctgcagtgaagagcctggaggttatcgtgcgagcaaatatcactgtgaaatccagcattaaaaatctgatgctgcgtgatgccagtactgtaatacccgtgatggtttacctagaccctatggcagtcgttgcggagggagtgccctggtgggtgattctgctcgccgtactggccggactacttgtacttgctctcctcgtcttgcttctgtggaaaatgggttttttcaagagggccaagcacccagaggccaccgtgccgcagtatcacgcagttaagattccacgcgaggaccgacagcagttcaaagaagagaagaccggcacgattcttagaaacaattggggcagtccccgtcgcgaagggccagatgcccaccccatcttggcagctgacggtcatccagagcttggccctgacggtcatccgggacccggtactgcatag

SEQ ID NO: 29057 - DNA, 3147 bp, Artificial Sequence
  Description of Artificial Sequence: Synthetic coding sequence
atggcattccctcccagacgacgccttagactcggtccaaggggattaccgcttcttctgagtggcctgcttctccctctgtgccgcgcattcaatttggacgtcgactctcccgctgagtattcaggtcccgagggctcctatttcggcttcgcagtggattttttcgtaccctctgcctcctctcgcatgttcctcctggtgggggcaccaaaggcgaacaccacacaacctggtattgtggaaggtgggcaggtgcttaagtgcgattggtcctccacccggcgatgccagccaatcgaattcgacgctactggtaatcgcgattatgctaaggacgaccccctagaattcaaatctcaccaatggttcggcgctagcgtgcgttctaaacaagataagatcctggcttgtgcgccactgtaccactggaggaccgagatgaagcaagagcgtgaacccgttggtacttgttttctgcaggatggtacaaaaaccgtcgagtacgcaccatgcaggtcacaggatatcgatgcggatgggcagggtttttgccagggtggattcagtattgacttcacaaaagcagaccgagtactgctcggaggtcccggatctttctactggcagggccaactcatcagcgaccaggtggcagaaatagtgagcaagtacgatccaaatgtctactctatcaagtacaacaaccagctggctacacggacggctcaggcgatctttgatgactcctacttgggttattccgttgctgtcggggacttcaacggggatgggatcgacgactttgtttctggcgtgcccagggcagccagaaccctgggcatggtctacatatatgacgggaaaaatatgagctccctgtacaattttactggcgagcagatggctgcttacttcgggttctccgtggcggcaaccgatatcaatggcgatgactacgcagatgtatttataggcgcaccattgttcatggatagaggctctgacgggaagctgcaggaggtcggccaggtttctgtctccctccaacgtgcctctggggattttcagactacaaagctgaacggttttgaggtgttcgcacgctttgggagtgctattgctccactgggggacctggatcaagatgggttcaacgacatcgccatcgccgctccttatggaggcgaagataaaaaggggatagtgtatatctttaacggaagaagtaccggtctgaacgccgtgccgtctcagatactcgaagggcagtgggcagcgcgatccatgccaccttctttcggatattccatgaagggggcaactgatatagacaagaatggctacccggatctcattgtcggggcattcggagtcgaccgagctattctgtaccgggcacggcctgtcattacagtgaatgccggattagaggtgtacccctccatccttaatcaagacaacaagacgtgctcactgcccggaaccgcacttaaggttagctgctttaatgtgcgcttctgtctgaaagcggatggaaaaggcgttctaccccgaaagcttaacttccaggtagaactgttgttagataaattgaagcagaagggagccattcggagggctctctttctgtactcacggtccccttctcattccaagaatatgacaatcagtaggggtggactgatgcagtgcgaagaactgattgcctacctcagggatgagagcgaatttcgggataagctgacgcctattacaattttcatggaatatcgcctggactatcgaactgccgctgataccactggcctccagcctattctgaaccaatttacccctgcaaatatctctcgccaggctcatatcttactggactgtggagaggataacgtgtgtaagccaaagctcgaagtgagtgtcgactcagatcagaagaagatctacattggggacgacaacccgttgactctcattgtcaaagctcagaaccaaggggagggggcttatgaggcggagctgattgtgtcaattcctctgcaagcggattttattggtgtggtaagaaataatgaggctctggcacggctatcctgcgcattcaaaaccgaaaaccagacaaggcaggtcgtatgcgacctcggcaacccgatgaaggcaggcacacagcttctggccggattgagattttccgttcatcaacaatctgagatggatacgtccgttaagtttgatctgcagattcagtcatccaatttgttcgacaaagtatcaccagttgtgtcccataaggtggatctggccgtactggctgctgtggagataaggggggtttcctcacccgaccacgtctttctgcctatccctaactgggagcacaaggagaacccagaaacagaggaagacgtcggtcctgttgtccagcacatttacgagctcaggaataatggtccctcttcctttagcaaagccatgctacacctccagtggccatacaagtacaacaataatacactgttatacattttgcattacgacatcgacggacccatgaactgtacctctgatatggagattaaccccctgcgcattaagatctcctccctgcagaccacggagaagaatgacactgtcgctgggcagggggagcgagaccatctgattaccaaacgtgatctcgcccttagcgagggcgatattcatactctcggatgcggagttgcgcagtgcctcaagatagtctgccaggtgggtcggctagatagaggcaaatccgcaattctatacgtgaagagtctgctctggactgaaacctttatgaataaagaaaaccagaatcattcttatagcctcaagtcttccgctagctttaatgtaatagaatttccatacaagaatctgccgatagaagatatcacgaatagtactctcgtgactactaatgttacgtggggtattcagcccgctcctatgccagtgcccgtgtgggttataatactggctgtgcttgcgggactgctcttgttagcggtgctggtattcgtcatgtatcgaatggggttctttaagagagtaagaccaccccaagaagagcaggagagagagcagctgcagccccacgagaacggcgagggcaactcagagacatag

SEQ ID NO: 29058 - DNA, 3039 bp, Artificial Sequence
  Description of Artificial Sequence: Synthetic coding sequence
atggccttccctccgaggaggcgcctgcgtttggggccacgtggattgcccctgctgttaagtggcctgctccttccactctgtcgtgctttcaacctggatgtcgactctcccgcagaatatagtggcccagagggcagctattttggcttcgccgtggacttctttgttccttctgcctcatctcgaatgttcctcctggtgggcgctccaaaggcaaatacaactcagcccggtatagtcgagggtgggcaagtgctgaaatgtgactggtcctccacaagacgctgccagccaatcgagttcgacgccacaggtaaccgcgactacgctaaggatgatcctcttgaattcaaatcgcaccagtggttcggtgcaagtgtcaggtcaaaacaagataaaattcttgcatgtgcccctctgtatcattggaggacggagatgaagcaggaaagggagccggttggcacctgttttctgcaggatggaacaaagacagtggagtacgccccatgtagatctagacagttgatcagcgatcaagtggccgaaatcgttagtaagtacgatcctaacgtgtactcaatcaaatacaataaccagctcgctactcgaacggctcaggctatctttgatgacagctacctgggctatagtgttgccgtgggagacttcaatggggatggcatagacgatttcgtgtctggggtgccgagggcggcaagaaccctgggaatggtatacatatacgacggaaagaacatgtcaagtctctacaatttcacaggagaacagatggcagcatacttcgggttctctgtagccgctaccgacataaacggcgacgactatgctgatgtcttcatcggcgcaccattgttcatggacaggggatcggatggtaagctgcaagaggtggggcaggtgagcgtttccctgcaacgagcaagcggagactttcagaccaccaaactgaacggctttgaggtgttcgcgaggtttggctctgcaatcgctccgctgggtgatttggatcaggacggttttaatgacatcgccatcgcggcaccttacgggggtgaagataaaaaggggattgtctacatctttaatgggaggagtaccggcctaaatgccgtcccctcgcagatattggaaggacagtgggctgcaagatcgatgcccccatcttttgggtattcgatgaaaggagccactgacatagataagaacgggtatcccgatctgatcgtgggcgcattcggggtggaccgagccatactgtatagggcgcgacccgttatcacagtgaacgcgggactggaggtgtatcctagtatactcaatcaggataacaaaacgtgttccttacctggaaccgcactaaaggtttcatgctttaacgtacgattctgtctcaaagctgacggaaagggcgtgctgcctaggaagctaaacttccaagtcgaactgctgctggataagctcaaacagaagggcgctatccgcagagccctgtttttatacagccgttcccccagtcactcgaagaatatgacaatcagtcgcggtggacttatgcagtgtgaggagctgatagcctatctgcgcgacgagtccgaattcagggataagctgactcccattactatttttatggaataccgtttggactaccggactgccgctgataccaccggcctgcagccaatacttaatcagtttaccccagcaaatatcagcagacaggcccatatccttctcgattgcggcgaagacaacgtgtgcaagcccaaattagaagtgtccgtggatagcgatcagaagaaaatttacattggtgacgataatcctctcactctgatcgtgaaggcccagaatcagggagaaggggcttatgaagctgagctgattgtcagcattccactgcaagctgatttcataggagtcgtaagaaacaacgaagctttggccaggttgtcctgcgcattcaagaccgagaaccagacgcgccaagtagtgtgtgacctgggcaatcctatgaaggccggaacacagctactggctggtctaaggttctccgttcaccagcagagcgagatggatacaagtgttaagttcgacctgcaaatccagagctcgaatctgtttgacaaggtctctccagtcgtgagccacaaggttgacttggccgtccttgctgcagtggaaatcagaggggtctcctccccagatcacgtatttctgcctattccgaactgggaacacaaggagaaccctgaaacagaggaggacgtaggaccggtcgtccagcacatctacgagctgagaaacaacgggccatcctctttttccaaagcaatgctgcacctccagtggccctataaatataacaacaatactttattgtacatactgcattatgacattgacgggccaatgaattgcactagtgacatggagatcaatcctctgagaatcaagatttccagtcttcagacaactgaaaaaaacgacaccgtggcgggtcagggagaacgcgatcatttgatcactaagcgggacctcgcattgagcgaaggcgacatccacactctgggatgcggggttgcccagtgcctgaaaatagtgtgccaggttggcaggctggaccggggaaaaagtgcaatactgtacgtgaagtcactgctgtggaccgagacgtttatgaacaaagagaaccagaatcacagctacagccttaaaagtagcgcttctttcaatgtgattgaatttccttacaagaatttgcctatcgaggatattaccaatagtaccctggtcacgaccaacgtgacctggggaattcaaccagcccctatgcccgtgccagtgtgggtgattatcctcgcagtattggcaggactgctcttgctcgctgttctggtgtttgtgatgtaccgcatgggttttttcaaaagagtcagacctccgcaagaagagcaggaaagggagcagctgcagccacatgagaacggagagggtaacagcgaaacctag

SEQ ID NO: 29059 - DNA, 3009 bp, Artificial Sequence
  Description of Artificial Sequence: Synthetic coding sequence
atgctgctgggaacgttgctccttatactctatatcttgatgctttgtcgcatgtttctgttggtcggagcgcctaaagccaataccacacagcctgggatcgtggaaggagggcaagttctgaaatgcgactggagtagcacacgtcgctgtcaacctatcgagtttgacgcgactggcaaccgcgactacgcgaaagacgaccctcttgaatttaaaagccaccagtggttcggcgcttctgttcggagtaagcaagacaaaatccttgcgtgtgcacctctctaccattggcgaacagagatgaaacaggaacgggagccggtaggaacttgtttcctgcaggacgggaccaaaaccgtcgagtacgctccttgcagaagtcaggacatagatgccgacggtcaggggttctgccaagggggtttcagtatcgattttactaaggcagaccgagtgctgctgggcggtcccggtagcttctactggcagggacagctgatcagtgaccaggtggccgaaatcgtctccaagtacgaccccaatgtgtattctatcaaatataacaatcagttagcgacgcggaccgcccaagccattttcgatgacagctatttggggtattccgtcgctgtgggcgattttaatggcgacggtattgatgacttcgtgtcaggggttcccagggccgcaagaaccctgggtatggtctatatctacgacggcaagaacatgagctccctgtataacttcaccggggagcaaatggcagcttactttgggttctcagtcgccgctaccgacatcaacggtgacgactatgctgacgtgtttatcggtgcccctctctttatggaccgaggcagcgacggtaagctgcaggaagttggacaggtctctgttagtttgcagcgtgcaagcggagattttcagaccacgaagctgaatggattcgaagtgttcgcaaggttcggaagcgctattgctcctttgggggacctggaccaggacggattcaatgacatagcaattgccgcaccctacgggggtgaagacaagaaggggattgtgtatatcttcaatggtcgaagcactggactgaatgccgtgcccagccagatccttgaggggcaatgggcagctagaagtatgccgcctagtttcggatactccatgaaaggcgctacagacatcgataaaaatggttacccagatctgatcgtaggcgcatttggcgttgatagggccatactctacagggccaggccagtcatcacagttaacgcagggctggaagtgtacccatctatactaaaccaggacaacaaaacttgtagcctgcccggaaccgcactgaaggtatcttgcttcaacgtccgtttctgcttgaaggccgatggtaagggcgtgctgcccagaaaactcaactttcaggtggagctgctgttggataaactaaaacagaagggcgctattaggagggccctcttcctctattctagatcaccatcccactcaaagaacatgacgatttctcgcggtgggctgatgcaatgtgaagagctgattgcttacctccgtgatgagagcgagtttagagataaactcactccaatcacaatattcatggaatacagactagattacagaaccgccgctgataccacgggactgcaacctattctcaaccagttcactcctgcaaatatttctcggcaggcccatattcttctggattgtggtgaagacaatgtctgtaaacctaagttagaggtgtctgtggattctgaccagaagaaaatctacatcggagacgataaccctctgaccctgatagtcaaggcacagaatcaaggtgaaggagcctacgaggctgaactgatagtctcaataccgctccaggccgacttcattggagtggtccggaacaacgaggccttagcccgtttgtcttgcgcctttaaaactgagaatcaaacgcggcaggtggtgtgcgatctgggcaatccaatgaaggcgggaacccaacttctcgcaggcctgagattttcggtccatcaacagtccgagatggacacgtcagtgaagtttgacctgcagatacagtcgagcaacttgtttgataaggtgagcccagtcgtatcgcacaaagtggacctggcagtgcttgccgctgttgagatcaggggtgtatcttctccggaccacgtgtttttacccattcccaattgggagcacaaggaaaatcctgagacggaagaagacgtaggtcctgtcgtccagcatatctacgagttaagaaataacggcccaagctcctttagcaaagcaatgttgcacttacagtggccttataagtacaacaacaacacactgctgtacatacttcactacgacatagatggacccatgaattgtaccagtgatatggagatcaacccgcttcggattaaaatcagctctctccagactaccgagaaaaacgatacagttgctggccaaggcgagcgggatcatctcatcacgaaaagggacttagctcttagcgagggagacatccacacattagggtgcggggtagctcagtgcttaaaaattgtttgtcaagtgggcaggttggaccgaggtaaaagcgccattctctatgtaaaaagcctcctgtggaccgagacattcatgaacaaggagaaccaaaatcacagctattctctgaagtcctcggcctcgtttaacgttatagagtttccctacaagaacctccctattgaagatatcacaaactccaccctggtgacgactaacgtgacctggggaatccagcccgctccaatgccggtacctgtgtgggtaataattctggctgtgttggccggtctcctgctattagcggttctagtgtttgttatgtaccgcatgggttttttcaagcgcgtgcgccctccgcaagaggaacaggaaagagaacagctgcagccacacgagaatggtgagggcaattctgagacctag

SEQ ID NO: 29060 - DNA, 1449 bp, Artificial Sequence
  Description of Artificial Sequence: Synthetic coding sequence
atggcttttccaccccgtaggcggctgcgcctggggccacgtggactgcccctgctactgtctggactgctgttgccactttgtcgggcatttaatctggacgtggatagccctgccgagtacagcggacccgaggggtcctactttgggtttgcggtggacttctttgttccttccgcctcctccaggatgttcctattggtgggggctccgaaagccaacactacccagccgggaattgtcgaaggcggacaagtgttgaaatgcgactggtcctctactaggaggtgtcagcccattgagttcgacgcaaccgggaaccgtgactatgccaaggacgatccactggaattcaagtcccaccagtggtttggcgcttctgtgcgttcgaagcaggacaaaatcctcgcgtgcgcaccactgtatcattggcgcaccgagatgaagcaggaacgggaacctgtagggacatgcttcctccaggatggaaccaagacggtggagtatgccccttgtcggagccaggacatcgatgctgatggccaagggttctgtcaggggggattctctatcgattttacgaaagcagatcgggtcctgttaggcggacctggctccttctactggcaggggcagttgatctctgaccaggttgctgagatagtaagcaagtacgaccctaacgtctattctattaagtacaataatcagttggcaacccgcacagcccaggccattttcgatgactcctacctgggatattctgtggcagtgggagactttaatggagatggtattgacgatttcgtttcaggcgttcctcgtgccgctcgaacccttggcatggtatatatctatgacggtaagaacatgtcttcgctctacaactttactggtgagcagatggccgcatacttcggattcagtgtcgctgccacagatatcaatggggacgactacgctgatgtcttcattggagcacctttgttcatggatcggggaagcgacggtaaactgcaagaagttgggcaggtgtcagtcagtctgcagcgcgcatctggcgacttccagacgactaaacttaatggattcgaagtgttcgcaagatttggcagcgctattgcgcctttaggcgacttggaccaggacggatttaatgatatcgctatcgccgcaccctacggaggggaagataagaagggtattgtctacatctttaacggtcgctccaccgggctgaatgctgttcctagtcaaattctcgagggccaatgggcggctcggagcatgccacctagttttggctactcaatgaagggcgcaaccgacattgataaaaatgggtacccggatctgatcgtgggagcgtttggtgtcgacagggccattttgtatcgcgctagacctgtaattcccatttttgtccagctgcaccatgtggtgcactag

SEQ ID NO: 29061 - DNA, 2397 bp, Artificial Sequence
  Description of Artificial Sequence: Synthetic coding sequence
atgaacttacagcctatattttggatcgggctgatttcctcagtttgctgcgtgtttgcccagacagatgagaacaggtgtcttaaagcaaatgctaaatcctgtggggaatgcatccaggctggaccaaattgtggctggtgtactaatagcactttcttacaagaaggtatgcccacaagcgccagatgcgatgatctggaggctctcaagaaaaaaggttgtcccccagacgacatcgagaaccctaggggatcaaaggacatcaagaaaaataagaacgtgaccaatcgtagcaaagggacagccgaaaagctcaagccagaagacataacccagattcagcctcagcagcttgtcctcagactccgctccggtgagccacagaccttcactctgaaattcaagcgagctgaggactacccgatcgatctgtactatttgatggacctgagttactccatgaaagatgacctggaaaatgtgaaatctcttgggacagaccttatgaatgagatgcgacggatcacatccgactttcggatcggtttcgggtcctttgtcgaaaagacagtcatgccctatatttcaacaaccccagcaaaacttcgtaacccttgcacttctgagcagaattgtacctcccccttttcttataagaacgtgctcagccttacgaacaaaggtgaagtttttaacgagttagtgggaaagcagaggatctctggaaacctggacagcccagagggcggatttgatgccatcatgcaagtggctgtctgtgggtccctcatcgggtggcgtaacgtcactagattacttgtgttttctaccgatgcaggatttcatttcgctggcgatggcaagcttggcggaatcgtactgccgaatgacggtcagtgtcacctagaaaataacatgtatactatgagtcattattatgactaccctagcatcgctcatttggtgcagaagcttagtgagaacaacatccagactatctttgcggtaactgaggaattccagccagtgtacaaagaacttaagaaccttatccccaagagtgccgtggggacgttgtctgccaactcttcaaacgtgatccaactcataattgatgcatataatagcctctcctccgaagtgattctggagaacggcaagctgagtgagggggtaaccattagctacaagagttactgtaagaatggcgtgaacggcacgggggaaaatggcagaaaatgtagtaacattagtattggcgacgaggtacagttcgaaatctccattacatcaaataaatgtcccaagaaggattcagactcttttaagattcgacctctggggttcacagaggaagtggaagtaatcctccagtacatctgcgagtgcgagtgccaatcagaagggattcctgagtctccaaaatgccacgagggcaatgggacctttgagtgcggtgcgtgccggtgcaatgaagggagggtgggacgccactgtgagtgctctaccgacgaggtgaacagcgaagatatggacgcctactgcagaaaggagaactccagtgagatctgttccaataacggtgagtgcgtttgtggccagtgtgtgtgtcgcaaaagggacaacacaaatgaaatctatagcgggaaattctgtgagtgcgacaattttaattgcgaccgcagcaacggcctaatatgcggcggaaatggcgtctgcaagtgccgcgtttgcgagtgcaaccctaactacacaggtagtgcctgtgactgctctctcgatacatctacatgtgaagcctctaacggacagatttgcaatggcagggggatttgtgaatgtggggtttgtaagtgtacagaccctaagtttcaaggacagacctgtgaaatgtgtcagacctgcctgggagtatgcgccgagcataaggagtgtgtgcagtgccgagcctttaataagggtgagaaaaaagatacatgtacccaagagtgttcctattttaatataacaaaggtggagagccgggacaaactgcctcagccagttcaaccagaccccgtgtcacactgcaaagagaaagatgtggacgattgttggttctatttcacttattcggtgaatggcaataacgaagtgatggtacacgtcgtggaaaaccctgagtgcccgaccggcccagatattataccaatcgttgctggggtggtggctggaatagtgctgatcggattagccctattactcatttggaaactgctgatgatcatccatgaccgacgagaatttgccaaattcgagaaggagaagatgaacgccaagtgggacacaggagagaaccctatctataaaagcgcagtaaccacggtggtgaaccctaagtatgaagggaaatag

SEQ ID NO: 29062 - DNA, 2478 bp, Artificial Sequence
  Description of Artificial Sequence: Synthetic coding sequence
atgaatctccagcccatcttttggattggactcatctcctccgtctgttgcgtttttgcccagaccgacgaaaatcggtgtttgaaagccaacgcaaaaagttgcggcgaatgtattcaagctggtccaaactgtggttggtgcacaaattctaccttcttgcaggagggaatgcccacttccgccaggtgcgacgacctggaggcgttgaagaaaaaggggtgtcctcctgatgatatcgagaacccaaggggttctaaggatatcaagaagaacaaaaacgtgacgaaccgcagcaaaggtacagcagagaaactgaaacccgaggatatcacccagatccaaccacagcagcttgtcctgagactgcgatctggggagcctcagacctttacactgaagtttaaacgtgcggaagactatcccatagatttgtattacctgatggatctgtcttattcaatgaaggacgacttagaaaatgtcaaaagtcttggcactgaccttatgaatgaaatgagacgaataacgagcgattttcgcatcggtttcgggagcttcgtagaaaagacggttatgccttacatctccactaccccagcaaagctccggaatccttgcacctcagagcagaattgtactagcccttttagttacaagaacgtgctcagtttgacaaataaaggagaggtctttaacgaactggttggaaagcagagaatttccgggaacttggattcccccgagggcggattcgatgccatcatgcaagtcgcagtctgtgggtccttaattggctggcgtaatgtaacacgcctgctcgtgttctctactgacgccggttttcactttgctggggatgggaaacttggaggtatcgtgttaccaaatgacggacagtgtcacctggagaacaacatgtatacaatgagtcactactacgactatcccagcatcgcccacctggtccagaagctttctgagaacaacattcagactatcttcgccgtcaccgaggagtttcagccagtctataaggagttgaaaaatctcattccaaagtcagcagtgggcacgctttcggctaattcctctaatgtgatacagctaattatcgacgcttataattccctgtccagtgaggtgatactggagaatggcaagctttccgaaggggtaaccatttcgtataaatcatactgcaaaaacggagtgaacggaactggagagaacggtagaaagtgttccaatatcagtatcggggatgaggtccaattcgaaatctcaattacgtccaataaatgccccaaaaaggactctgactcatttaaaatccggcctttgggtttcaccgaggaggtggaagttatattgcagtatatttgtgaatgtgagtgccagagtgagggcattcctgagagtccaaagtgtcacgagggaaacggcactttcgagtgtggagcctgtcgctgcaacgagggacgggttggtaggcactgtgagtgctctaccgacgaagtcaattcagaagatatggatgcttactgtcgcaaggagaatagtagtgaaatttgctccaacaacggggaatgcgtgtgcggacagtgtgtgtgtcggaagagggacaataccaacgagatctacagcggcaagttttgtgagtgcgacaactttaactgcgacaggtctaacgggctgatctgcggtggcaatggcgtctgtaagtgtcgggtgtgcgaatgcaatccaaactacacaggctcggcctgtgactgctcccttgacacctctacatgcgaagcaagcaatgggcagatttgtaatggtagaggcatctgcgaatgtggtgtatgtaaatgcacagatcctaaattccaaggacaaacgtgcgaaatgtgccagacttgcttgggagtgtgcgcagaacataaagagtgtgtccagtgccgcgcatttaataagggcgagaagaaggacacgtgcacccaagagtgcagttacttcaacataaccaaggtggagagccgagacaagcttccgcagccagtacagcctgaccccgtgagccactgcaaggaaaaggacgttgacgattgttggttctatttcacgtattcagtgaacggcaataatgaagtgatggtccatgtcgtcgaaaatcctgagtgtcccacgggaccagacattatacccatcgtagccggagtggtcgcagggatcgtcctcatcggcctggcactcctcctgatttggaagttactgatgattattcacgataggagggaatttgcaaagtttgaaaaggagaagatgaatgccaaatgggacacctccctgtccgtcgcccaacccggtgtgcagtggtgcgatatcagcagtctgcagcctctgacgtcacgcttccagcagttctcctgcctgagtctgccgagtacttgggactaccgggtaaaaatactgttcattagagttccttag

SEQ ID NO: 29063 - DNA, 2397 bp, Artificial Sequence
  Description of Artificial Sequence: Synthetic coding sequence
atgaatctgcagccgatcttctggatcggccttatctcatccgtatgctgtgtgtttgcgcaaaccgatgagaaccgttgcttgaaggccaacgctaagagttgtggagaatgcatccaagccggaccaaattgcggctggtgtaccaactccacgttcctgcaggagggcatgcctacgtctgctcgctgcgatgacctggaggctctaaaaaaaaaggggtgtccaccggacgacattgagaaccccagaggcagcaaggatattaagaagaacaagaacgttaccaaccgcagcaaaggtacagccgagaagctgaagccagaggatatcacgcagatccagccgcaacagcttgtgctgcggcttcggtctggtgagcctcagactttcaccctgaagttcaagagggctgaggattatccgattgatctgtactacctgatggacttatcgtactccatgaaggatgacctggagaatgttaagagtctggggacagatctcatgaatgagatgaggcgcatcacttcagatttcaggattgggttcggcagttttgtagagaaaacagtgatgccatatatctccactactcctgcgaagcttagaaatccctgtacttcagaacagaattgcacttctcccttcagctacaaaaatgtactcagcttaacaaacaagggagaggtctttaatgaactcgtggggaagcagcgcatttccgggaacctggacagccctgaaggtggcttcgacgccatcatgcaagtcgccgtgtgcggctcactgatcggttggcggaatgtcacacgcctgctggtgttcagcaccgacgctggattccactttgcgggagatggcaaacttggcggaatcgttctccccaacgacggccaatgtcacctggagaataacatgtacactatgtcccattactatgattacccttccattgcgcatctggtgcagaaattgagtgagaataacattcagaccattttcgctgtgacagaggagtttcagcctgtttacaaagagcttaaaaacctaatcccgaaaagcgcggtgggcaccctgagcgctaattcatccaatgtgatccagttgataatagatgcgtacaattctctgtcatccgaagtgattttggaaaacggcaagctttccgaaggggtgaccatttcttacaagtcatactgcaaaaatggtgtgaacggaaccggggagaacggaagaaagtgcagcaacatctcaataggagatgaggtgcaatttgagatatccatcacttccaacaagtgccctaagaaggattccgactcctttaagatcaggcccctaggctttacagaggaagtggaggtgatattgcaatatatctgtgaatgcgagtgtcagtctgaaggaataccggaaagcccaaagtgccacgagggtaatggcacattcgagtgtggcgcttgcagatgtaatgaaggccgtgtagggcgtcactgcgaatgctccaccgatgaggtcaattccgaggacatggacgcatattgtcgtaaagaaaattcttctgaaatatgtagcaacaatggggagtgtgtgtgcggtcagtgtgtttgcaggaaacgcgacaataccaacgagatatacagtggaaaattctgcgagtgtgataatttcaattgcgaccgttcaaatggactgatctgtggaggtaacggggtgtgcaagtgcagagtctgcgagtgcaatcccaactatactggcagcgcgtgcgattgcagcctggacacgagcacttgcgaggcctccaatggacagatttgtaatggacgaggtatatgtgagtgcggtgtctgcaagtgtacagatcccaaatttcaggggcaaacctgcgaaatgtgccagacctgcctgggggtgtgcgctgagcacaaagagtgcgtgcagtgtcgtgcttttaataaaggcgagaagaaagacacctgtacacaagagtgtagctatttcaacattacaaaggttgaatcaagggacaagctcccccagcctgtccaaccagatcccgtttcacattgtaaagaaaaggatgtcgatgattgttggttttactttacttattcagttaacgggaataacgaagtcatggtgcatgttgtggagaatccagagtgcccaaccgggccagatatcatccccatagtggcgggagtggtggctggaatcgtcttgataggattagctctgctgctcatctggaaactattgatgattatccacgaccggagggagttcgcaaaatttgagaaagaaaagatgaatgctaagtgggatacaggtgagaatccaatctacaagtctgcagtgactaccgtggtgaatcctaaatatgaaggaaaatag

SEQ ID NO: 29064 - DNA, 150 bp, Artificial Sequence
  Description of Artificial Sequence: Synthetic coding sequence
atgaatctgcagcccattttctggatcggcctaatctcctccgtctgctgtgtgtttgcacaaacagatgaaaataggtgtctcaaggcaaatgctaaatcttgcggggagtgcatccaggcaggtcctaactgtggttggtgtacgtag

SEQ ID NO: 29065 - DNA, 270 bp, Artificial Sequence
  Description of Artificial Sequence: Synthetic coding sequence
atgaatctccaacccattttttggatcgggttgatctcttccgtgtgctgtgtgttcgctcaaacagacgaaaaccgctgtctcaaggccaatgctaaatcctgcggtgagtgcattcaggctggccctaattgtgggtggtgcacaaactccactttcctccaagaaggtatgccaacctccgcaagatgtgacgaccttgaggcattaaaaaagaagggttgcccacccgatgatatcgagaatcctcgcggatcaaaggatatctag

SEQ ID NO: 29066 - DNA, 2406 bp, Artificial Sequence
  Description of Artificial Sequence: Synthetic coding sequence
atgaatctacaaccaatcttctggataggattgattagctctgtgtgctgcgtgttcgcacaaacggatgagaatcggtgcctgaaggcgaacgcaaaatcttgcggggagtgtatccaggctggacccaattgtggctggtgcacaaacagcacctttcttcaggaaggcatgcccactagcgctaggtgcgacgatctggaagcacttaagaagaagggatgtccccctgacgatatcgaaaatccgaggggttccaaagacatcaaaaaaaataagaacgtcacaaatagaagcaagggaacagcagagaaactgaaaccggaggatataactcagatccagcctcaacaactggtcctgcggctgaggagcggagagccacaaaccttcacccttaaatttaaacgggcagaggattatccaattgatttatactacctgatggatctttcttactcaatgaaagacgacctcgagaacgtgaaatcacttggcaccgatcttatgaacgagatgagaaggattactagtgattttagaataggcttcgggtctttcgtcgagaagactgtcatgccatacatttccactacacctgcaaaactgcggaatccatgtacttctgaacagaactgcacatcaccattctcatataagaatgtgctgtctctaactaacaaaggtgaggtgttcaacgagcttgtcgggaaacagcggatctctgggaaccttgacagccccgaaggcggttttgacgcaatcatgcaggtcgcagtctgtggcagcctcattggctggagaaacgtgacccgacttctggtgttctcaaccgacgccggattccacttcgctggggacggtaaattgggaggtattgttctacccaacgacgggcaatgtcaccttgaaaataacatgtataccatgtctcattactatgattaccccagcatcgcacatttggtgcaaaaacttagtgaaaacaatatccagacaatattcgcagtgaccgaggagttccagcctgtatacaaagagcttaaaaacctgattcccaagtctgcggtaggaaccctttccgccaatagctccaatgtgatccagttgatcattgatgcctacaattccctctcttcagaggtgatcctggaaaacgggaagctgtcagaaggcgtgaccatctcttataaaagctactgtaagaacggagtcaacgggaccggagagaatggcagaaaatgcagtaatatttcaatcggtgacgaggtccagttcgaaatctctatcacttcaaacaagtgtcccaagaaagactccgactccttcaaaattcgcccattgggtttcacagaagaggtcgaagtgatactccaatacatctgcgaatgtgagtgccagtcggagggcatccctgaatctcccaaatgccacgagggaaatggcaccttcgagtgcggggcttgtaggtgcaacgaaggcagggtggggcgacattgtgagtgttctactgacgaggtgaactccgaggacatggatgcatactgcaggaaggagaacagcagcgagatctgctccaataatggtgagtgtgtgtgcggacagtgcgtctgccgtaaacgggataacaccaacgaaatctattcaggcaagttctgtgagtgcgacaattttaactgcgatcgaagtaatggccttatttgcggcggaaatggcgtgtgtaagtgtcgagtgtgcgaatgcaatcctaactacaccggatccgcttgcgactgtagtcttgacacttccacgtgtgaggcatctaatgggcagatatgcaacggcagggggatatgtgagtgcggcgtttgtaagtgcaccgacccaaaattccaaggacagacgtgtgagatgtgccagacttgcctcggggtgtgcgccgagcataaggaatgtgtccaatgccgagccttcaataagggtgagaagaaagacacttgtacgcaagaatgctcgtattttaatatcacaaaggtggaatccagggataaactgccgcagcccgttcaacctgaccctgttagtcattgtaaagagaaggatgttgatgattgctggttctattttacatattcagtaaacggcaataacgaagttatggtccatgtggtggaaaaccctgaatgtcctaccggccctgatattattcctattgtcgcaggagtcgtggccggtatcgtcctcatcgggttggctctgctgctgatctggaagctgttgatgatcattcatgataggcgcgaattcgcaaaatttgagaaagagaagatgaacgctaaatgggatacccaggagaacccaatttataaaagcccgatcaataactttaaaaatcccaactacgggagaaaagctgggctgtag

SEQ ID NO: 29067 - DNA, 411 bp, Artificial Sequence
  Description of Artificial Sequence: Synthetic coding sequence
atgaacctgcaacctattttttggattgggctgattagcagcgtgtgttgtgtttttgcacagaccgatgaaaaccgctgcctgaaggccaacgcaaagtcttgcggcgagtgcatccaggccggacctaattgcggttggtgcacaaacagcacatttctgcaggagggcatgccgacatcagcgcgatgcgacgatctggaggctctcaaaaagaaaggatgcccccctgatgacatcgagaacccccgaggaagcaaggatataaagaagaacaaaaatgttacgaatagatcaaagggcacggctgagaagttaaagcccgaggatatcacccagattcagccgcagcagttagtgctacggctgagatccggggaacctcagacattcacattaaagttcaagtag

SEQ ID NO: 29068 - DNA, 378 bp, Artificial Sequence
  Description of Artificial Sequence: Synthetic coding sequence
atgaacctacaaccaatcttctggattggtctgatctcctcggtgtgttgtgtcttcgctcagactgacgagaataggtgcctgaaggccaacgcgaagtcatgcggagaatgtatccaggcaggacccaattgcggctggtgcacaaactcaaccttcttgcaggaaggtatgcccacctccgcgcgatgtgacgatctagaggctttgaagaagaagggctgtccgccagatgatattgagaaccctaggggctctaaggacatcaagaagaacaagaatgtgacgaatcggagtaaaggcacggccgaaaagctgaagcccgaggacatcacacaaatccagccacaacagttagtgctgaggctaaggtcctag

SEQ ID NO: 29069 - DNA, 492 bp, Artificial Sequence
  Description of Artificial Sequence: Synthetic coding sequence
atgaacttacagcccatcttttggataggcctgataagtagcgtgtgctgcgtgtttgcgcaaactgacgaaaatagatgcctgaaggctaatgccaaatcctgcggcgaatgtatccaggctggtcccaattgcggctggtgtaccaattccacatttttgcaggaggggatgccaacctccgctcgctgtgacgacttggaagcgctcaagaagaaaggatgcccaccagatgatatcgaaaatccccgtggctccaaagacattaagaagaataagaatgtgactaaccggagtaagggaaccgcggagaagcttaagcctgaagacatcacacaaatacaaccccagcagctcgtgctgcggctgaggtctggggaaccccagacattcactctgaaattcaagcgcgcagaggattacccaattgatctgtattaccttatggacctgagctatagtatgaaggatgacttggagaatgtcaaatag

SEQ ID NO: 29070 - DNA, 459 bp, Artificial Sequence
  Description of Artificial Sequence: Synthetic coding sequence
atgaacctgcagcctattttctggatcggcctgatttcctcagtttgctgcgtctttgcccagacagacgaaaacaggtgtctgaaagccaatgccaaatcctgcggtgagtgcattcaggcaggtcccaactgcggttggtgcactaactctgtgtcgaagacctttctgcaggagggcatgccgacttcagctcgttgtgacgacctcgaggccctgaagaaaaaaggctgcccacccgacgatattgaaaatcccaggggaagcaaggatataaagaagaacaaaaacgtgacaaaccggagcaaagggacggcagagaaactgaaacctgaagacatcacccagatccaacctcaacagctggtcttgcgcttgagaagcggtgagccccaaacatttacactgaagttcaaaagagcagaggactatcctatcgatctatattacctgatgtag

SEQ ID NO: 29071 - DNA, 315 bp, Artificial Sequence
  Description of Artificial Sequence: Synthetic coding sequence
atgaacctacaacctattttctggattggtctcatctcatctgtgtgctgtgttttcgcgcaaacagacgagaatagatgccttaaggccaatgctaaatcatgcggggagtgcatccaggctggtccaaactgtgggtggtgcacaaactccacgtttcttcaggaagggatgcccacctccgcaagatgcgacgacctcgaggccctgaaaaaaaagggatgcccccctgacgatatcgaaaatccaaggggcagtaaggacattaaaaagaacaaaaatgtgacaaacaggagcaagggtaccgctgagtag

SEQ ID NO: 29072 - DNA, 432 bp, Artificial Sequence
  Description of Artificial Sequence: Synthetic coding sequence
atgaatctgcagcccatcttctggatcggcctgatttcatcagtgtgttgcgtgttcgcacagaccgacgagaaccgctgcctgaaagcaaatgctaagtcatgcggcgaatgtatccaggccggtccaaactgtggatggtgtactaatagtacattcctgcaggaaggcatgccaactagtgctagatgcgatgatctggaggctctcaagaaaaaaggatgcccccctgatgacatcgagaatcctcgcggatccaaggatatcaaaaagaataagaacgtcaccaacagatcgaagggaaccgctgagaaactaaagcccgaggatatcacacagatccagccgcagcagctggtgctgagattgagaagtggtgagccgcagacttttaccctaaagtttaaaagagctgaggattacccaatatag

SEQ ID NO: 29073 - DNA, 2310 bp, Artificial Sequence
  Description of Artificial Sequence: Synthetic coding sequence
atgctcgggttgcgcccaccccttctggcactggtgggcctcctgtccttagggtgcgtactgtctcaagagtgtacaaagtttaaggtttctagctgccgcgagtgcattgagagcggcccaggctgcacctggtgtcagaagctgaactttaccggacctggtgatcccgattccattaggtgtgatacaagaccccaactgctaatgcggggatgtgcggctgacgatataatggatcccacttcccttgctgaaactcaggaagaccacaacggcggacagaaacaactgtcacctcagaaagtgacactatatctcaggcctggacaggcagccgcattcaatgttaccttccggagggccaaggggtacccaattgatttatattatctcatggatctgagctactcgatgctagacgacttgcggaacgttaaaaagttagggggagatctccttcgcgcactaaacgaaattacagagagcggaagaatcggctttggcagctttgtggataagacagtgctgccattcgtgaatacacacccagacaaactccgaaacccgtgtccaaataaggaaaaggaatgtcagccaccatttgctttcaggcacgtgctgaagctgacaaacaatagcaatcagttccagactgaagtggggaagcagttaatttcgggcaatttagatgcccctgagggaggactggatgccatgatgcaagtggcagcgtgccctgaagagataggatggcgtaacgtcactagattattggtgtttgctactgacgatgggtttcatttcgctggtgatggcaaattgggggctattctcacgccaaacgatggccgttgtcatctcgaggacaatttgtacaagcggtcgaatgaattcgattatccctctgtcggccagctggcccacaagcttgcagaaaataatatccagccaattttcgccgttacatcaaggatggtcaagacatatgaaaagctgaccgaaattatcccaaaatccgcggttggagagcttagcgaggattcttcaaacgtagtccagctgatcaagaacgcatacaataagctctcttcaagagtgttcctggaccacaacgcactgcctgacactctgaaggtcacctatgatagcttttgcagcaacggtgtaactcacaggaaccagccacgtggcgactgtgacggcgtgcaaataaacgtgccaattacattccaagtgaaggtgactgccactgagtgcatccaagaacagtcgtttgtgatccgagcacttggcttcacagatatcgtgactgtgcaggtactgccccagtgtgaatgcagatgcagggatcagtctcgggatcggtccttgtgtcacggaaagggattcctggagtgcggcatctgcagatgcgatacagggtatattggaaagaactgcgagtgccagacacagggcaggagctcccaggagctggaaggctcttgcaggaaagacaacaatagtatcatctgcagtggcttaggggattgtgtctgtgggcagtgcctttgccacacttcagatgtaccagggaagttgatatacgggcagtactgtgagtgcgatacgattaattgcgaaagatataatggtcaggtttgcggaggtcctggccgtggcctttgtttttgcggtaaatgtaggtgccatcctggcttcgagggcagtgcttgtcagtgtgagcggaccactgagggttgtttgaatcccaggagagtggaatgcagtggccgagggagatgccggtgtaacgtttgcgagtgccactcgggttatcagttacccctctgtcaggaatgccccggttgtcctagcccttgtggtaagtacataagctgtgccgagtgcctgaagtttgagaaaggccctttcggcaaaaattgtagcgcggcttgcccaggcctccagctttccaacaatcccgtaaaaggacggacctgcaaagagcgtgactcagagggctgttgggttgcctacacgctagaacagcaggacggaatggatcggtacttgatttatgtggatgagtcccgggagtgtgtcgcaggaccgaacatagccgcaattgtcggcggaacggtggcaggtattgtgctgatcggaatcctgctgttggtgatatggaaggcactcatccatctatccgatctaagggagtatcgcaggttcgaaaaggagaagttgaagtcccagtggaataacgacaaccccctgttcaagtccgcaacaactaccgtcatgaatcctaagtttgcggaatcttag

SEQ ID NO: 29074 - DNA, 969 bp, Artificial Sequence
  Description of Artificial Sequence: Synthetic coding sequence
gggagattagggaaggatcttgccacaggcgtgctgtctcaggagtgtacaaaattcaaagtcagctcttgcagagaatgtatcgaatctggaccgggttgtacctggtgccaaaagctgaatttcaccggacctggcgatcccgactcgatcaggtgtgatacaaggcctcagctcttaatgagggggtgcgccgcagatgacattatggaccccacaagcctcgcagagacccaggaggaccacaatggcggacagaagcagctgagcccccagaaagttaccttatatctcagacccggacaagctgctgccttcaatgtgacatttaggcgggctaaaggataccctatcgacttgtattatctcatggacctgtcctatagtatgctcgacgacctgcgtaacgtgaaaaaactgggcggtgatctcctgcgcgcactgaatgagatcaccgagagcggaaggataggtttcggctcgttcgttgataagacagtgctcccattcgtgaacactcacccagacaagcttaggaacccttgtcctaacaaggaaaaggagtgccagccgccatttgctttccggcacgttctgaagctgaccaacaacagcaaccagttccagaccgaggttgggaagcagttgatttcaggcaatttggatgcccctgagggcggactggacgccatgatgcaggtagctgcctgtcctgaggagattggatggaggaacgtgaccaggctgctcgtgtttgccacagatgatggatttcatttcgccggtgacggcaagctgggcgcaattcttacaccaaacgacggaagatgccacctggaagacaacctgtacaaaagatcaaatgagtttgattatccttccgtgggacagctggctcataaactggcagaaaataatatccaacctattttcgccgtcacgtcgcgaatggtgaagacatacgagtag

SEQ ID NO: 29075 - DNA, 2310 bp, Artificial Sequence
  Description of Artificial Sequence: Synthetic coding sequence
atgttaggcctcagacccccactgctagccctggtggggctcttgtctctgggctgtgtgctttcacaggagtgtactaagttcaaggtatcctcatgtcgcgagtgtatcgagtctggtcctggctgtacatggtgccagaagcttaacttcacaggcccaggtgaccctgattctatacgctgtgatacccggccacagctactcatgcgcggatgtgctgctgatgacatcatggaccctaccagccttgctgagactcaggaagatcacaacggtgggcagaagcagctgagccctcagaaggtcacattgtacctccgtcccggacaggctgcagcttttaacgtcacttttcggagggctaagggctacccaatcgacctgtactacctgatggacctgtcttacagtatgctggacgacttacggaacgtgaaaaaattaggtggagatctgctacgggcactcaacgaaattactgagagcgggaggattggcttcggaagcttcgtcgacaaaacggtcctgccattcgtgaatacccacccagacaagttaaggaatccatgccccaataaagagaaggaatgccagcctccctttgccttcagacacgtgctgaagctgacaaataacagcaatcagttccagactgaggtcggcaagcagctaatatccggaaatctggacgccccagagggcggattggacgccatgatgcaggtggccgcatgccctgaggagatcggctggcgaaacgtcacaagattgcttgtgtttgccaccgatgatggattccatttcgccggagatgggaagctgggcgctattctgacccccaacgacggacggtgccatttggaggacaatttgtacaagcgcagtaatgaattcgactatccaagcgttggacaacttgctcacaaactggccgagaacaatattcagcccatctttgccgtcaccagtagaatggtcaagacatatgagaagctgactgagattatcccaaaaagtgcggtgggcgaactgtctgaggattcatctaacgtggtacagctcattaagaacgcctacaataagctgagtagtagagtgttccttgaccataatgcgctgcccgacaccctgaaggtgacatacgactccttttgctccaatggtgtaacacaccgcaaccagccccgtggcgattgcgatggggttcaaataaatgtcccaatcacttttcaagtgaaggtcaccgctacagagtgcatccaagagcagtctttcgtgattcgcgcactcggtttcacggacatcgtaaccgtccaggttctccctcaatgcgaatgcagatgtagggaccagtctcgcgatcggtctctgtgtcacgggaagggttttctggagtgcgggatctgtaggtgtgataccggttatataggcaagaactgcgagtgccaaacgcaaggcaggtcctcacaggaactcgaggggagctgtaggaaagacaataacagcatcatctgctccggcctgggcgattgcgtttgtgggcagtgcctttgtcatacttctgacgtgccaggaaaattaatatacgggcagtactgcgagtgtgataccataaattgcgaacgctataacggtcaggtatgcggtgggccagggagggggctgtgcttttgcggaaagtgcaggtgccacccaggcttcgaagggtcggcatgccagtgcgaaagaaccactgagggatgcctgaatcccaggagggtggagtgcagcgggcgagggcgttgtcggtgcaatgtgtgcgagtgtcacagcggatatcagttaccactttgccaggagtgccccggatgtccatcaccctgtggtaagtacatctcctgcgcagaatgtctgaagttcgagaaagggccatttgggaaaaactgctctgctgcctgcccaggactgcaactttctaacaatcccgtcaaggggaggacatgcaaagagcgtgatagcgaaggttgctgggttgcctacacgcttgagcaacaagacggtatggacaggtatctgatctacgtagacgagtccagagaatgtgtggctggcccaaatatcgctgcaatagttggtggcactgtggcgggtatcgttctgatcgggatactcctgttggttatttggaaggccctgatccatctgagtgacttacgagagtatcggaggttcgagaaagagaaactgaaatcccaatggaataatgataatcctcttttcaaaagtgcaaccacaacggtcatgaaccctaaatttgcggagagctag

SEQ ID NO: 29076 - DNA, 2310 bp, Artificial Sequence
  Description of Artificial Sequence: Synthetic coding sequence
atgctagggttgcggccacccctgcttgcacttgtaggcctgttgtcacttgggtgcgtcctgtcccaggagtgcactaaatttaaagtgtcatcttgccgcgaatgcattgaatctggtcccggatgtacttggtgccagaagttaaatttcacagggccaggcgatcccgacagtattaggtgcgacaccagaccccagctgctgatgagaggctgtgcggctgatgacattatggacccaacctctctcgccgaaacacaggaggatcacaacggaggacagaagcaactctcccctcaaaaggtgacgctctatctgcgcccagggcaagcagcggcatttaatgttacattcaggcgcgctaagggctatcccatcgacctctattaccttatggacttatcctacagcatgttagatgacctgcgcaacgtgaagaagttgggaggggatctgttgagggccctgaacgagatcacggagtctgggcgtatcggttttggttcttttgtggacaagaccgtgctgccattcgtgaatacccatcccgataaattgcgtaatccctgccctaataaagagaaagaatgccaaccccctttcgccttccgtcatgtcctgaagctgacaaataactcgaaccagtttcagacggaggttggcaaacagttgatctcggggaatctggatgccccagagggtgggctggacgctatgatgcaggtggccgcttgtcccgaggagattgggtggaggaatgtcactaggctgctcgtgttcgcaaccgacgacgggtttcacttcgcaggtgatggcaaactgggtgctatcctaactcctaacgatgggagatgccacttggaggataatctctataaaaggtccaacgaatttgattatcccagtgttggacagttggctcacaaattggctgagaacaacatccagccaattttcgcggttacttccaggatggtcaagacctacgaaaaattaaccgagatcatccccaagtctgccgtgggagagctgagcgaagatagcagtaatgtggtgcagttgatcaagaatgcgtacaacaagctcagctccagggtgttcctggaccacaacgctttgccagacactctgaaggttacctacgactcattctgtagcaacggcgtgacacacagaaaccagcctaggggtgactgcgatggagtgcagataaacgttccaatcacgtttcaggtcaaagtcacagccactgaatgtatccaagaacagtcctttgtgattcgcgcattgggcttcacagatatcgtcacagtccaggtgctgccacagtgcgaatgtagatgtcgtgaccaatcccgcgatcggtcactgtgccacggaaagggttttctggagtgcggaatctgcagatgtgatacagggtacatcggaaaaaactgtgagtgtcagacccagggtcgctcttctcaagagcttgagggatcttgccgcaaagacaataatagcattatctgctcaggtttgggggactgcgtgtgcggccagtgtctctgtcacacctcagacgtgcctggtaagctaatctatggccagtattgtgaatgtgatactatcaactgtgagcggtacaatggtcaagtttgtggcggtccaggcagaggattatgtttttgcggaaaatgtcgctgccacccaggcttcgagggaagcgcctgccagtgcgagcgcacgactgaagggtgtctaaacccgaggcgggtcgagtgttcaggcaggggacgctgccggtgcaacgtgtgtgagtgccatagtgggtaccagctgcccctgtgtcaggagtgtcctggctgcccatcaccatgtggcaagtatatctcgtgcgctgagtgtttgaaatttgaaaaaggacctttcggcaaaaattgcagcgccgcatgcccaggcctgcaattgtctaataatcctgtgaagggccgaacctgcaaagagagggactcggaggggtgttgggtggcatacaccttggagcagcaggatggtatggatcgctacctgatatacgtggatgagtcacgggagtgtgtcgcaggacccaatattgccgcaatcgtgggtggtaccgtggctgggatcgtcttgatcggcatccttctgttagtgatctggaaagctttgatccatttgtctgacctgcgcgagtaccggagatttgagaaggagaagctaaagagccagtggaacaacgataacccgctgttcaagagcgcgactactacagtgatgaaccccaaattcgctgagtcatag

SEQ ID NO: 29077 - DNA, 2310 bp, Artificial Sequence
  Description of Artificial Sequence: Synthetic coding sequence
atgcttgggctacggcctccactgctagcccttgttggattgctgtcactcggatgcgttttgagccaggaatgcactaaattcaaggtctccagctgtcgcgaatgtatcgaaagcgggccagggtgtacatggtgccaaaagctgaactttacagggcctggcgaccccgactccatccggtgtgatactcggccacagctgttaatgcgtgggtgtgccgctgacgacattatggaccccacatctctcgctgaaactcaagaggatcataatgggggacagaagcaattgtcccctcagaaggttaccctttatctcaggcctggtcaggccgctgcatttaatgttacttttcggagagcaaaagggtatccgatcgacctgtattacctgatggaccttagttattcaatgcttgatgatctgaggaatgttaagaagctagggggagaccttctccgcgctttaaacgagattaccgaatccgggagaataggctttggttcatttgtggacaagaccgtgctaccctttgtcaacactcaccctgataaactgagaaatccttgcccaaataaggagaaggagtgtcaaccgccatttgcgtttaggcacgtgctgaagttaactaacaacagcaaccagtttcagaccgaggtgggaaagcaacttatttccggaaacctcgacgcacccgaagggggactggacgcaatgatgcaagtcgctgcttgccccgaagaaataggatggcggaacgttacacgcttgctggtgttcgcaacagacgatggtttccattttgcgggagatgggaaactcggggctattcttacccctaacgatgggagatgccatctggaggataacctgtataagcgctcaaatgagttcgactacccaagtgtggggcagctcgcgcataaactggcagagaacaacatccagcccattttcgcagttacgtcgcgcatggtcaagacctacgagaagctgacggaaattatccctaaatccgcagtgggagaactgtctgaggattccagtaacgtcgtgcaactcataaaaaacgcttataataagctgtcatcgcgcgtttttcttgaccataacgcgctgccagacacattgaaggtcacttatgactctttttgcagtaacggagtgacccacaggaatcaacccaggggggactgtgatggcgttcagattaacgtccccatcaccttccaggtaaaagtgaccgcaacggaatgcatccaagagcagtcttttgttattcgagccctggggtttaccgatattgtgactgtccaggtcctgccccagtgtgagtgtcgatgtcgtgaccagtccagagatcgcagtctatgccacggaaaggggtttctggaatgcggcatttgccgttgtgatactgggtacatcggcaaaaattgcgaatgccaaacacagggtagaagctcccaggaactggaaggcagctgcagaaaagataacaatagcattatttgtagcggcctgggggattgtgtatgtggccagtgcctgtgtcacacaagcgacgtccctgggaaactgatttatggacagtattgtgaatgcgatacaatcaattgcgagcgatataacggacaggtctgcggcggaccaggccgtggcctgtgtttttgtgggaaatgtcgatgccacccaggcttcgagggctccgcctgccagtgcgagcggactacagagggatgtctcaacccacggagggtggagtgtagtggccgtggcaggtgcagatgtaatgtttgtgaatgtcacagcgggtatcagctgccgctatgccaggagtgtcctgggtgtccatctccctgtgggaaatatatctcctgtgctgagtgcctaaaattcgagaaaggaccctttggaaagaactgtagtgctgcctgtccaggactacagttaagcaataaccctgtaaaaggcagaacttgcaaagagcgtgactccgaagggtgttgggtggcctatactctcgaacaacaagatggcatggatcgatatctgatctatgtggacgagagtagagagtgtgtcgcaggtccaaacatcgcagccatcgtgggcggtaccgttgcaggcatcgtgctgataggcattcttcttctggtgatctggaaagcccttatccatttgagcgacttgcgggagtacagacgcttcgaaaaggagaaactgaagtcccaatggaacaacgacaacccactgtttaagtcggccactacgactgtaatgaaccctaaatttgcagagagttag

SEQ ID NO: 29078 - DNA, 2310 bp, Artificial Sequence
  Description of Artificial Sequence: Synthetic coding sequence
atgctagggctccggccaccactccttgccctcgttgggctgttgtcgctcggatgtgtgctatctcaggagtgcacaaagtttaaagttagttcctgccgcgagtgcatcgagtccggcccaggctgcacttggtgccaaaaacttaactttaccggtcccggagaccccgattccatacgttgtgatacccggcctcagctcctcatgagggggtgtgctgccgacgacattatggaccctacttctcttgccgagacacaggaagaccacaacgggggacagaagcagctgtcacctcagaaggtcactttatatctgcgccctgggcaggccgcagcttttaatgtaacctttagacgcgctaaggggtatccaattgatctatactatctgatggatctctcctactcgatgctggacgacttacggaatgtaaagaaactgggcggagatcttctgagggcactcaacgagattacagagtcaggaagaatagggtttggaagcttcgtcgataagacagtgctgcctttcgtgaatacacacccggacaagttgcgcaatccctgtcccaataaggaaaaggaatgccagccgccattcgctttcaggcacgttctcaagctgaccaacaactctaatcagttccagaccgaggtgggcaagcaattaatttcagggaaccttgacgcccctgagggaggccttgacgcaatgatgcaggtggctgcttgccccgaagagatcggatggaggaacgtcacacgccttcttgtttttgctactgacgacgggttccacttcgccggtgacggaaagctcggggctattctcacgccaaatgatgggaggtgtcatctggaggacaacttgtataagcggagtaacgaatttgattaccctagcgtggggcagttggcccacaaactggccgaaaataatatccagccaatctttgccgtgaccagccgaatggtcaaaacctatgaaaaacttacagaaatcatacctaaaagcgcagtgggagaactctcagaagactcgtcgaatgtggttcaattgattaagaacgcgtacaataaactgtccagcagggtattcttggaccataatgccttgcctgatacactcaaggtgacgtacgattccttttgctccaacggcgtgactcaccgtaatcaacccagaggagattgcgatggggttcaaattaacgtgcctatcacattccaggttaaagtcacggctacagaatgcattcaggaacagagtttcgtgatccgtgccctaggcttcaccgacatcgtgaccgttcaagtgttgccgcagtgcgagtgtcggtgtcgcgaccaatcacgcgatcggtccctgtgccacgggaaaggcttcctggaatgtgggatctgtcgctgcgataccggctatatcggcaaaaactgtgaatgccagactcagggtcgctcctctcaggagctcgaaggcagctgcaggaaagataataactccattatttgctccggactcggggactgtgtctgtggtcagtgtctctgtcacacatccgacgtgccagggaaactcatttatggccagtactgtgagtgcgataccattaactgcgagagatacaacggccaggtgtgcggaggaccaggaaggggactttgcttctgcggcaaatgtcggtgtcaccccggattcgaaggcagcgcttgccagtgtgagcggacaacagagggttgtctgaacccaagacgcgtggagtgctctggaaggggtcggtgccggtgtaatgtgtgtgaatgccattccggataccagctgcccttgtgccaggaatgcccaggctgccccagtccttgtgggaagtacatctcctgcgccgagtgccttaagttcgaaaagggacccttcgggaagaattgttcagctgcctgccctggtctccaactctctaataatcccgtgaagggccgaacttgtaaagagcgcgattctgaaggctgttgggttgcctacacgctggaacagcaagacgggatggataggtacttaatatatgtggatgagagtcgagagtgtgttgctggtccaaacattgccgcaatagttgggggaaccgtcgcgggaattgtgctaatcggaatcttattgcttgtgatttggaaggccctgattcaccttagtgacttgagggaatatcggcgatttgagaaagagaaattgaaatcgcagtggaataacgataatccactgtttaaaagcgctaccacaaccgttatgaacccgaaatttgctgagtcttag

SEQ ID NO: 29079 - DNA, 363 bp, Artificial Sequence
  Description of Artificial Sequence: Synthetic coding sequence
atgttgggcctacgaccgcctctactcgcgctagtaggcctgctttcgctggggtgtgtgctctcccaggagtgcacaaaatttaaggttagttcatgtcgagagtgcatcgagagtggccctgggtgcacttggtgccagaagttgaacttcacgggtccgggagaccctgatagtattcgttgcgatactagaccccagctgttgatgagaggctgcgccgcagatgacattatggacccgacaagcctggcagagacacaggaagaccacaacggcggtcaaaagcagctgtcaccccagaaggtgaccctatatttgcgacctggacaggctgcagcctttaacgttaccttccgatag

SEQ ID NO: 29080 - DNA, 213 bp, Artificial Sequence
  Description of Artificial Sequence: Synthetic coding sequence
atgctcggattgagaccaccactgctagctttggttggactgctctctctgggatgcgtgttgtcccaggagtgcaccaaatttaaagtgtcctcctgccgagagtgcattgagagtggtcccggatgtacatggtgccagaaactaaacttcactggaccaggggaccctgactctataaggtgcgatacaagaccacagttattgatgtag

SEQ ID NO: 29081 - DNA, 150 bp, Artificial Sequence
  Description of Artificial Sequence: Synthetic coding sequence
atgcttggccttcggcctcctctgctcgccctggtgggcttgctgtctctaggatgcgtcctcagccaagaatgtaccaagttcaaggtcagctcttgtcgagaatgcatcgagtcgggcccaggatgcacatggtgtcagaagctgtag

SEQ ID NO: 29082 - DNA, 483 bp, Artificial Sequence
  Description of Artificial Sequence: Synthetic coding sequence
atgctgggcttgaggccccctctgctcgcattagtgggcctcttatctctgggctgtgtcctgagtcaggaatgcaccaaattcaaagtgagctcttgccgcgagtgcatcgaatctgggcctggatgcacatggtgccagaaacttaacttcacaggacctggtgatcctgactccatcaggtgtgacacacgacctcagctactgatgcggggatgcgccgcagacgatatcatggatccaacttccctggcggagacacaggaggaccataatggcggtcagaagcaactgagcccacagaaagtcacactgtacctgcggccagggcaagctgctgctttcaatgtcacgttcagacgcgcaaaaggatatcccatagatctctattatctgatggatctctcttattccatgctggatgacctccgtaacgtcaaaaaactcgggggagatttgctgcgggcacttaacgagatatag

SEQ ID NO: 29083 - DNA, 501 bp, Artificial Sequence
  Description of Artificial Sequence: Synthetic coding sequence
atgttggggttacggcctcctctgctggcgctggttggactattatctctgggatgcgttctatcccaagaatgtacaaagttcaaagtgtcctcgtgtagggagtgcatcgagagtgggcctgggtgcacttggtgccagaaattaaattttacaggtccaggtgacccggattctatccggtgcgacacaagacctcagttactgatgcggggatgtgccgctgacgatataatggatcccacgtccctggctgagacgcaggaggatcacaatgggggacagaagcaattatcccctcagaaggtgaccttgtatcttagacctggccaagctgcggcttttaacgtgaccttcaggcgtgcgaaagggtacccaatcgacctctattacttaatggacctgagctacagcatgctggatgacctccgtaatgttaagaaattgggaggagacttgctgagggccctgaatgagattaccgagtctgggagaatctag

SEQ ID NO: 29084 - DNA, 1137 bp, Artificial Sequence
  Description of Artificial Sequence: Synthetic coding sequence
atgttgggactgcgccctcccctcttggctcttgtcggcctcctctcgttagggtgtgtgctgtcacaggaatgtaccaagtttaaggtgtctagctgccgcgagtgcatcgagtctggacccggatgcacatggtgccaaaagctcaatttcaccggcccaggagatcccgatagcattaggtgcgatacaaggccccagcttctgatgaggggctgcgctgctgatgacatcatggatcccacctctttagccgaaactcaagaagatcacaacggaggccaaaagcagctgtctcctcagaaggtgaccctctacctccgacctggattcgggtcctttgtggataaaaccgtgctgccctttgtgaatacccatccagacaagctgcggaatccttgtcccaacaaagaaaaggaatgtcaacccccattcgccttcagacatgtgttgaagttgacaaacaacagtaatcagtttcagactgaagtcggcaaacaattgattagcggaaacctggacgctcctgagggcggattagatgccatgatgcaggtggctgcatgccctgaggaaatcggctggcgaaatgtaacacgtctccttgtgtttgcgactgacgatggattccactttgctggggacggcaagcttggggcaatactgactccaaatgacggcagatgccatcttgaagataatctttataagagatccaacgagttcgattacccttcagttggtcagcttgcccacaaactggcagagaataacatccagcccatttttgccgtgactagtaggatggtaaagacctacgaaaagctgacagaaattatccctaagagtgccgtcggggagctttctgaggatagttccaatgttgtccagctcatcaaaaatgcttacaacaagctctcatctagagtcttccttgatcataatgctctccctgacactttgaaggtcacctatgatagcttttgtagcaacggggtgactcaccggaatcagcctaggggcgactgtgatggtgtccagatcaatgtccccataacctttcaagtgaaggttacagcaaccgaatgtatccaagagcaaagctttgtaatcggccgatgggctagtaggacatag

SEQ ID NO: 29085 - DNA, 2367 bp, Artificial Sequence
  Description of Artificial Sequence: Synthetic coding sequence
atgagggctagacctagaccccgtcccctgtgggccacagtactagccctgggagcacttgcgggagtgggggtgggagggcctaatatatgcacgacaagaggtgtaagcagttgtcagcaatgtctggcagtgtcccccatgtgcgcctggtgctcagatgaggccctcccgcttggctcaccgaggtgcgatctcaaggagaacctgttaaaggacaactgcgcgccagagagcattgagtttcccgtgagcgaagccagagtgttggaagaccgtcccctgtcagacaagggctccggcgatagctctcaggtgacacaagtgtcaccccagagaatagccttgcggctgcgaccagacgactcaaagaattttagcatccaggttaggcaagtcgaagactatcctgtagatatctactatctgatggacctgtcatattcaatgaaggacgatctctggtccatccagaacctgggcacaaaactagctactcagatgagaaagctgactagtaatctgcgcattgggtttggagccttcgtggacaaaccagtgagcccatacatgtacatttcacctcccgaggcactggagaatccatgctatgacatgaagaccacctgcctcccgatgttcggatataagcacgttttgacactcactgaccaggtaacaagatttaatgaggaagtcaaaaagcagtccgtcagccgaaatagagatgcccctgagggcggatttgatgcaataatgcaggcaactgtttgcgatgagaagataggatggagaaatgacgcctcgcatttgcttgtgttcactaccgacgctaagacacacatcgccctcgacgggcgattggctgggattgtgcaacccaatgacggacagtgtcacgtcggatctgacaaccactattctgcctccaccaccatggattatccatccctgggtttaatgacagagaagctctctcagaagaacattaacctgatctttgccgtcacagagaatgtcgtcaatctgtaccagaattacagtgagctcattcctggtaccactgtaggcgtgctgagcatggacagtagcaacgtgctgcaactgatcgtcgacgcttacggaaaaattaggtccaaggtggaactggaggtgagagatctgcctgaggaactgtcccttagctttaatgcaacctgcctcaataatgaggtgattccaggcctgaagtcatgcatgggcctcaaaattggcgacaccgtcagctttagtattgaagcaaaggtacggggatgtccacaggagaaggaaaaatccttcaccattaaacccgtgggctttaaggactcactgatcgttcaagtaaccttcgactgcgactgtgcttgccaggctcaggcggagcccaacagtcacaggtgtaataacggaaatggtaccttcgagtgcggagtgtgccggtgcggccctggttggcttgggtcgcaatgcgagtgttccgaggaagactacagacctagtcagcaggacgagtgtagtccacgggagggccagcctgtgtgttcccagagaggcgagtgcctctgcggccagtgtgtttgtcattctagcgactttggcaagattacaggcaagtactgcgaatgtgatgatttcagttgtgtgcggtacaaaggggaaatgtgttcaggtcatggacagtgtagttgtggagactgcctgtgcgactcggactggaccggctattactgtaattgcactacccggacagacacttgtatgagctcaaatggtctgttgtgctccggaagagggaagtgtgaatgcggatcatgtgtatgcattcagccgggaagttacggagatacatgcgagaagtgccctacatgtcctgatgcatgtacattcaagaaagagtgtgtggagtgtaaaaagtttgatcgcggtgctctccacgatgaaaacacatgcaaccgatactgccgggacgagatagaatctgtgaaggaactcaaggacaccggaaaggatgctgtcaactgcacctacaaaaacgaagatgactgtgtcgttcggttccaatactatgaggacagctctggtaaatctatcctgtatgtcgtggaggaacctgaatgccccaagggacccgacatattggtggtacttctctcagtcatgggcgcaattcttctgattgggctggcggcactgctcatttggaagctgctgattaccatccacgacagaaaagagtttgctaagtttgaggaagagagggctagggccaagtgggatactgccaacaacccactctacaaagaagccaccagcacgttcaccaacataacatacaggggaacatag

SEQ ID NO: 29086 - DNA, 2256 bp, Artificial Sequence
  Description of Artificial Sequence: Synthetic coding sequence
atgtgcgcctggtgtagtgatgaagcgttgcctctcggtagtccacggtgtgacctcaaggaaaaccttctgaaggacaactgcgcccctgaatcaatcgaattccccgttagcgaagctagggtcttagaggaccgacctttgtccgataagggatccggggactcaagccaggttactcaggtgagcccccagcgtattgccttaaggctgcgaccagacgatagtaaaaatttttcgatccaagtgcgccaggtcgaggattacccagtagatatatactacctcatggatctgtcgtatagtatgaaagatgacctatggagcatccagaatcttggcacaaaactcgccacacagatgagaaaactaacgtcaaacctgaggatcgggttcggcgctttcgtggataaacctgtgtccccttatatgtatatttccccccctgaggccctcgaaaatccatgctacgatatgaagaccacctgcttgccaatgtttggctacaagcacgtgctgacactcactgatcaggtgactcggttcaacgaagaagtgaagaaacagtccgtaagtagaaaccgcgatgccccagaggggggtttcgatgctattatgcaagctactgtctgcgacgaaaaaataggatggagaaatgacgccagccacctgctggtgtttaccacggacgccaaaacacatatcgccctggacggacgtctggccggaatcgtgcagccaaatgacggccagtgccatgtgggctctgataatcactacagcgccagcacgaccatggattatccttccctggggcttatgaccgagaaattgtcccagaagaatatcaatcttatattcgctgtgactgagaatgtagttaatttgtatcagaactactcagaactcattccaggcacaaccgtaggggtactttccatggatagcagcaatgtcttacaacttatcgtggacgcttacggcaagatcaggtccaaggtggaactagaagtccgggaccttcccgaagaactgtcactgagcttcaatgcaacctgtctgaacaacgaggtgatccccggtctaaagagttgcatggggctgaaaatcggcgataccgtgtcattcagtatagaagccaaggtgagaggatgtccccaagaaaaagagaaatctttcacaattaagcccgttggttttaaagactctttgatcgtacaggtgaccttcgactgcgattgcgcatgtcaggcgcaggctgagcctaactcgcataggtgtaataatggaaacggcacctttgaatgtggggtttgcaggtgtggtccaggctggttgggtagtcagtgcgaatgctccgaagaagattatcgtccttcccagcaggatgagtgctcaccgagagaagggcaaccggtgtgcagtcaaagaggagaatgtctgtgtggtcagtgcgtgtgccatagctccgacttcggcaagatcaccggcaaatactgcgagtgtgatgacttcagctgcgtccgttataagggcgagatgtgcagcggtcatgggcaatgtagctgtggcgactgcctgtgcgactccgactggaccgggtactactgcaattgcactacaagaactgatacttgcatgtcatcgaatgggcttctctgttcagggagaggaaaatgcgagtgcggctcctgcgtttgcatacagccagggagttatggcgatacttgcgagaagtgccccacctgtccagacgcttgcaccttcaagaaggaatgcgtcgagtgcaaaaagttcgatagaggggcactgcatgacgagaatacctgtaacaggtactgtcgcgacgagattgagtctgtgaaagaactaaaagacaccggtaaggatgcggtgaactgtacgtataaaaacgaagacgattgtgtggtccggttccaatattatgaagactcctcaggcaagtccatcttgtatgtggtggaggagcccgagtgtccaaagggtcctgatatattggtcgtactgctgagcgtgatgggcgcaattctcctcatcgggctagccgctcttctgatttggaagttgctgatcaccattcacgacaggaaagaatttgccaagtttgaagaagaacgggctagagccaagtgggacaccgagatacttttgtattattgctccttcattttggtgcatcagtccctcgagtccctgaggacagaatttacctccaaacagaaggacggaaactag

SEQ ID NO: 29087 - DNA, 2367 bp, Artificial Sequence
  Description of Artificial Sequence: Synthetic coding sequence
atgcgcgctcggccacgtccaaggccactttgggccacggtactcgccctgggggcattagccggagttggggtgggcggacccaatatctgcaccacccgcggtgtgagctcgtgtcagcaatgtctcgctgtatctcccatgtgtgcctggtgtagcgatgaggccctgcccctgggatctcccaggtgcgatctgaaggaaaacctgttaaaggataattgtgcacccgaatctatcgaattcccagtgtctgaggccagggttttggaagatagaccactgagtgataaaggctcgggcgattccagccaggttacacaagtgtctcctcaaagaatagcactgaggctgcggcctgacgatagcaaaaacttctctatccaggtccgacaagtggaggattaccctgtagatatctactaccttatggacttaagttattctatgaaggacgatctgtggtctattcagaatctgggcacaaaactggccactcagatgcgcaagctgacatccaacctcagaatcggcttcggcgcattcgtggacaagcccgtgtccccctacatgtacatcagccctccagaagctctggaaaacccttgctacgacatgaagaccacgtgtctcccaatgtttggatacaaacatgtgcttacactgactgatcaggtgactcggttcaatgaggaggtgaagaagcagagtgtgtctcgcaatagggatgcaccagagggcggttttgatgccattatgcaggcaaccgtatgtgatgagaaaataggctggaggaacgacgcctctcacctgctcgtgttcacgacagatgcaaagacacatatagccttagatggcaggctagctggtatagtgcagcccaatgatgggcagtgtcacgtaggttcggataaccactacagtgcatccacaacaatggattacccatccttagggctaatgaccgagaagctgagccagaagaatatcaatcttatcttcgctgtgacagaaaatgtggtgaatctatatcagaactactctgagctgatccccggaaccactgttggcgtgctaagcatggacagcagcaatgttttgcagttaattgtggacgcttacggcaaaattagatccaaagttgagttggaagtgcgtgaccttcctgaggaattaagtctgtcctttaatgcaacttgcctgaataatgaggtaatcccagggcttaaatcatgtatgggattgaagatcggagacacggtctctttcagcatcgaggctaaagtgagaggctgtccacaggagaaggagaagtcatttaccatcaaacctgtagggttcaaggattctttaattgtacaagtcactttcgattgcgattgtgcctgtcaggcccaggcagaaccaaacagccaccgatgcaacaatggcaatggtacctttgagtgcggtgtttgccgatgtggccctggatggttaggtagccagtgcgaatgttcagaggaagactacagaccaagccagcaggacgagtgttctcctcgtgaaggccaaccggtgtgcagtcagaggggagaatgcctctgtggccaatgtgtctgtcactctagcgattttggaaagatcacaggcaaatactgtgaatgcgacgatttctcctgcgtacggtataagggggagatgtgcagtgggcatggccagtgtagttgtggggactgtctgtgcgactctgactggacggggtattactgcaactgtaccacgcggacagacacctgcatgagttcgaatgggctcctctgctctggcagggggaagtgcgagtgtgggagctgtgtctgcattcagccaggatcatatggggatacttgtgaaaagtgccctacgtgtcccgacgcttgtacgttcaaaaaagaatgcgtggaatgcaaaaagtttgaccggggagcccttcacgatgagaatacctgcaaccggtactgcagagatgagatcgaatctgttaaggaactcaaagatacagggaaggatgcggtgaattgtacctacaagaacgaagatgattgcgtcgtccggtttcagtattacgaagactcaagtggtaagtcaattctgtacgtggtcgaagagccggaatgcccaaaaggtcctgatatactcgtagtgctgctgagtgtgatgggcgcaatcttactcatcggcctggctgccttactcatatggaagctgctcattactatccatgaccgcaaggaatttgccaaatttgaagaagagcgcgcacgggcaaagtgggacactgccaacaaccctctttacaaggaggctacctccacattcacaaatattacatatagggggacgtag

SEQ ID NO: 29088 - DNA, 1359 bp, Artificial Sequence
  Description of Artificial Sequence: Synthetic coding sequence
atggatgacattttcacccagtgccgggagggcaatgctgtggcagtgagactgtggttggacaataccgagaacgatttaaatcagggtgacgaccatggttttagccctctgcactgggcctgccgagaggggaggagtgcggttgtcgaaatgctgataatgaggggtgctcgcatcaatgtgatgaatcgcggtgacgacactccgctccacttggccgctagtcacgggcatcgggatattgtgcagaaactcctgcagtacaaagcagatattaacgccgttaacgaacacgggaatgtgcccttgcattatgcctgcttctggggccaagaccaggtggctgaggatctggtggccaatggagccctggtgtctatctgcaataagtatggcgagatgcctgtggacaaagccaaggctccactgagagagcttctgcgggagagagctgaaaaaatgggccagaatctcaatagaattccttacaaagacacattctggaaaggaaccacccggacccggccaagaaacggaactctaaataaacacagcgggatagacttcaagcagctgaacttcctgaccaaactcaacgagaaccacagtggggagctttggaaaggacggtggcaagggaatgatatcgtcgtcaaggtgctcaaggtacgcgactggagtacgcgtaagtcaagagatttcaacgaagagtgccctcgcctgcgcatattttcacatccaaacgtcctgccagtgttgggcgcatgccagtccccccctgccccacacccgacgctcatcactcactggatgccgtatgggtcgctatataatgtgcttcacgagggaaccaatttcgttgtggaccagtctcaggcggtcaaatttgctctggacatggcaagaggtatggccttcttgcatactcttgagcccctgataccaaggcatgccctgaactcacgcagcgtcatgatcgacgaggacatgaccgccaggatcagcatggcagatgtgaagttctctttccagtgtccaggcagaatgtatgccccagcttgggtcgcccctgaggccctgcaaaaaaaacccgaagacacgaatcgacgctccgcggacatgtggagcttcgcggtgctgctgtgggagttagtgactcgcgaagttcctttcgctgacctttctaacatggagattgggatgaaggtggctctagaggggctgcggcctactatcccgcctggcatcagcccacacgtgtgtaagctgatgaagatctgtatgaacgaagaccccgcaaagagaccgaaatttgatatgatagtgccgatcctggaaaagatgcaggataaatag

SEQ ID NO: 29089 - DNA, 1359 bp, Artificial Sequence
  Description of Artificial Sequence: Synthetic coding sequence
atggatgacatttttacccagtgccgtgaggggaacgcggtggctgtgcggctgtggcttgataatacggagaacgacctaaatcagggtgatgaccatggcttttcacccttgcattgggcttgtagggaaggcaggagcgccgtcgtcgaaatgctcattatgcgcggagccagaatcaacgtgatgaatcgcggagatgacactccgcttcaccttgctgcctcgcacggccatagggatatcgtacagaagctccttcagtataaggccgatattaacgccgtgaatgaacatggcaacgtgcctcttcactatgcatgcttctggggtcaggatcaagttgcggaagatctcgtggccaacggagctctggtttcaatatgtaacaaatacggggagatgccggtcgataaagccaaggctccgctgcgcgaacttctaagagagcgcgctgagaagatgggccaaaacttgaatcgaataccatacaaagatacattttggaaagggacaaccaggacgaggcctcgcaacggcacactcaataagcacagcggcatagactttaaacaactgaactttctcaccaagctcaatgaaaatcacagcggtgagctttggaaggggcgatggcaaggtaatgacatcgtggttaaagtcctcaaagtgagagactggtctacccgaaaatcccgggacttcaatgaagagtgccccagactgaggattttctctcaccctaacgttctcccggtcctgggagcttgtcagtcacccccagcccctcacccaacattgattactcattggatgccctatggatctctgtataatgtgctccacgagggcaccaatttcgtggtggaccagtcacaagcagttaaattcgccttggacatggcccgaggaatggcctttcttcataccttggaacccttaattccacgccacgccctcaattccagaagtgtcatgatcgatgaggatatgactgccagaatctcaatggctgacgtaaagttctcttttcagtgtccaggccgaatgtacgccccagcatgggttgctccggaagccctgcaaaagaagccggaagatactaatcgacggtccgccgacatgtggtccttcgccgtcttgttgtgggagctcgtcacacgcgaggtgcccttcgccgacttgtctaacatggaaattggaatgaaggtggccctggaagggttacgacccactattcccccagggatctcaccgcacgtctgtaaattaatgaaaatctgtatgaatgaggaccccgctaagaggcccaaatttgacatgattgtgcctattcttgaaaagatgcaagacaagtag

SEQ ID NO: 29090 - DNA, 1359 bp, Artificial Sequence
  Description of Artificial Sequence: Synthetic coding sequence
atggatgacatttttactcagtgtagagaaggcaatgctgtcgcggttcgcttgtggctggataacacagagaatgacctaaatcagggggacgaccatggattctccccgcttcactgggcttgtagggaagggcgaagcgctgtcgttgagatgctcatcatgcggggagctcgcataaatgtgatgaatagaggcgatgatacgccgcttcacctcgcagcaagccacggtcatcgtgacatagtccaaaagctgcttcagtataaagctgatatcaatgcagtgaacgaacatggtaatgtcccattgcattacgcttgtttttggggccaggatcaggttgctgaggacctggtggcaaacggtgccctggttagtatctgtaataagtatggtgagatgcctgtggataaagcaaaggcacctctgcgtgagctcctcagagagcgcgctgagaaaatggggcagaatctcaatcgcataccgtacaaggacaccttctggaagggcacaacccggacacgccctagaaacggtactctcaacaagcactcaggtatcgatttcaagcagttgaacttccttacaaagttgaatgagaaccatagcggcgagctgtggaaaggtcgatggcaagggaatgacatcgtcgtgaaggtgctgaaggtgagggattggagtactaggaaatctcgggatttcaatgaagagtgcccacggctgaggattttctctcatccaaatgtgcttccagtgctgggtgcctgccagagccctccggctccacaccccacgcttatcacgcattggatgccctatggttccctgtacaacgttttacacgaagggaccaattttgtggtggaccagagtcaggctgtgaagttcgctctggacatggcccgaggtatggccttcctgcacacattggagccccttatccctaggcacgccctgaatagtcgctccgtgatgatcgacgaggatatgaccgcacggatctccatggctgacgtcaagttctcttttcaatgccctggcaggatgtacgccccagcctgggtggctcccgaggccctccagaaaaaaccggaggataccaatcgtcgctctgctgatatgtggtcgttcgcggtgcttctttgggagctggtcactcgagaagtgcctttcgctgatttatcaaatatggaaataggaatgaaagttgccctggaaggattacggccaacgattcccccaggaatatctcctcatgtgtgtaaattgatgaagatctgcatgaacgaagatccagctaagagacctaagttcgacatgattgtgcccatcctggaaaaaatgcaggacaagtag

SEQ ID NO: 29091 - DNA, 957 bp, Artificial Sequence
  Description of Artificial Sequence: Synthetic coding sequence
atgcccgtggataaggccaaggcacctctgcgcgagctgctaagggagagggctgaaaagatgggtcagaatttaaaccgaatcccttacaaagacacgttctggaaaggcacgaccagaactagaccgagaaacggaacactaaacaaacacagcggcatcgactttaagcagctcaattttttaactaagcttaacgagaaccacagcggagagttatggaaaggacgctggcagggcaacgatatagtagtgaaggtgctcaaggtgagggactggtcaacgcgcaagtcacgagattttaatgaagaatgtccgaggctccggatattttctcatccgaacgtgctcccagttctgggggcatgccagagtcccccagcgcctcatccaactttaatcacccattggatgccatacggctcgctatataatgtactccatgagggcacaaactttgtggtggatcaaagtcaggcagtgaagttcgccctggatatggcacggggtatggcgtttctgcacactctggagccattaatcccacggcacgccttgaattctagatccgttatgattgacgaagatatgaccgccagaatctcaatggccgatgtcaaatttagctttcaatgtccgggacgcatgtatgctccagcctgggtggcccctgaagcattgcaaaaaaagccagaggacacaaatcgaagatccgccgacatgtggtccttcgccgttctgctatgggagctcgtgactcgcgaggtgcccttcgccgatcttagcaatatggagataggcatgaaagtggctttggagggactccgcccaactatccctcccggaattagccctcacgtgtgcaagctgatgaagatctgtatgaacgaagaccccgctaagcggcctaagttcgacatgattgtccctattttggagaagatgcaggacaaatag

SEQ ID NO: 29092 - DNA, 978 bp, Artificial Sequence
  Description of Artificial Sequence: Synthetic coding sequence
atgcctatcacaaggatgcgcatgcgcccatggctggaaatgcagataaattcaaaccagattcctggtctcatttggatcaacaaggaggagatgatttttcagattccttggaagcacgctgctaagcatggatgggacataaataaggacgcttgtttgtttagatcatgggctattcatacgggacgatacaaagcgggagaaaaggaacccgaccctaaaacatggaaggcaaactttaggtgcgctatgaatagtctaccagatattgaggaagtcaaagatcagagcaggaacaaggggtcctccgccgtgcgggtctatcgtatgcttccccctctgactaagaatcagcgaaaggaacgcaagtctaaaagctcccgggatgctaaaagcaaggccaaaaggaaatcctgcggtgactcttctcccgatactttttcagatggattatccagttcaactctccccgatgatcacagctcctacacagtacctggatatatgcaggacctcgaggttgagcaggccttaacccccgctttgagtccatgcgcagtgtcgtccacgctccctgattggcatattcctgtggaagtagtccctgattccactagtgatctgtataacttccaggtgagtcccatgcccagtacatccgaggcgactaccgacgaggatgaagaaggcaagctgcctgaggacattatgaaacttttggagcagtccgagtggcaacctacaaacgtggacgggaaggggtatctgttaaatgaaccgggtgtacagcctacctcggtttatggggacttctcctgcaaggaggaacctgaaatcgactcgcccggaggcgacatcggattgtctctgcagcgcgtgttcaccgatctgaaaaatatggatgcgacctggcttgactcccttctgacccccgttaggctgccttccatccaagctatcccatgcgctccctag

SEQ ID NO: 29093 - DNA, 978 bp, Artificial Sequence
  Description of Artificial Sequence: Synthetic coding sequence
atgccgattaccaggatgcgtatgcgcccttggctggagatgcagattaattctaatcagatcccgggattgatttggataaacaaagaggaaatgattttccagatcccatggaagcacgctgctaaacatgggtgggatatcaataaagacgcctgtcttttcaggtcttgggcgatccataccggcagatataaagccggtgagaaagaacctgaccctaaaacttggaaagctaatttccgttgcgctatgaattctctcccggacatcgaggaggttaaagaccaatcaaggaataagggctcttctgccgtgcgtgtctaccgaatgctgcctccccttacaaaaaaccagcggaaggaacggaaatctaagtcctcacgcgatgctaagagcaaagcaaagcggaagagttgtggcgactccagtcctgacactttctctgatggactgtcaagttcaactctccccgacgatcacagttcctacacggtcccaggctacatgcaggaccttgaggtcgagcaggctcttactcctgcactttcaccttgcgcggtgtcaagcacattgcctgattggcatatccccgtggaggtcgtgccagactcgacatctgacctttataatttccaggtaagccccatgccctcaacttccgaggcaacgaccgacgaagacgaggaaggcaaattacccgaggatattatgaagctcctggaacagtctgagtggcagccaacgaacgtggacgggaagggatacctgttgaacgagccaggcgtacagcctacctccgtgtacggagatttctcttgtaaagaggagcctgaaatcgatagtccagggggagacattggactcagcctacagcgcgtgttcacagatttaaagaatatggacgccacttggctggattctctcctgactccagtgcgcctgccctccattcaagctatcccctgcgccccttag

SEQ ID NO: 29094 - DNA, 579 bp, Artificial Sequence
  Description of Artificial Sequence: Synthetic coding sequence
atgccaattacacgaatgagaatgcgaccctggcttgaaatgcagattaactctaaccagatccccggactgatctggataaataaagaagaaatgattttccagattccctggaagcacgccgcaaagcacggttgggatatcaacaaggacgcttgcctcttcagatcgtgggcaattcacacggggagatataaggctggcgagaaagagcccgatccgaagacctggaaagccaattttcgctgcgccatgaactccctgccagacatcgaagaggtcaaagaccaatcccgaaacaagggatcctcagctgtcagggtctacaggatgctgccaccattaacaaagaaccagcggaaagagcggaagtccaaatcatcaagagatgctaaaagcaaggcaaagagaaaatcctgcggcgatagctctccggataccttttcggacggcctgtcttcctctaccctccccgacgaccactcaagctatacagtgccaggctatatgcaggacctggaggttgaacaggctttgacaccggcactgtccccttgcgcagtttcaagcaccctctag

SEQ ID NO: 29095 - DNA, 1356 bp, Artificial Sequence
  Description of Artificial Sequence: Synthetic coding sequence
atgaatttggaggggggagggaggggcggtgagtttggcatgtctgccgtctcatgcggaaacggaaaactcagacagtggctgatcgatcagatagattcaggtaagtatcccggactagtttgggagaacgaggagaaatctatattcagaataccatggaagcacgccggtaaacaggattacaaccgcgaagaggatgcagccctatttaaagcctgggccctgttcaaaggcaaatttcgagaggggattgataaacctgacccgccaacgtggaaaacaaggctgcggtgcgcgctaaataagtccaatgacttcgaagagctggtcgaaaggagccagcttgatattagtgatccttacaaagtttaccggattgtcccagagggcgctaagaagggggcaaaacaattgacccttgaggatccacagatgtccatgtcccacccttatactatgaccaccccgtacccctccttaccagctcaacaggtgcacaactacatgatgccgccactagaccggtcctggagagattatgttcccgaccagccacatcccgagattccttatcagtgcccgatgacattcggacccaggggacaccattggcagggccctgcctgcgaaaatggatgccaagtgacagggactttttacgcttgtgcaccacctgaatcacaggcccctggggtgcccaccgagccgtcaatcaggagcgctgaagcactagctttctccgactgccgcctgcacatttgcctctactaccgcgagattctcgtgaaggagctgaccacatctagccccgaaggttgcaggatatcacacggccacacatatgacgcatccaatctggaccaggtgttatttccttaccccgaagataacggccagcgcaaaaacattgagaaactgctcagccatcttgagcgtggagtcgtgctctggatggcacccgacggtctctacgctaaacggctctgccagagccgtatttactgggatggccctctggcgttgtgtaacgacaggcctaacaagctggaacgcgaccagacctgtaaattgttcgacacacagcagtttctatcggaactccaagcattcgctcaccacggtagatccctgccaagattccaggtgaccctgtgctttggtgaggagtttcctgacccccagaggcaaaggaagttgatcaccgcacacgtggagccactgctggcaaggcaattatactattttgcccagcagaattcgggccactttctgcgcggttacgatctccctgagcatatcagtaacccggaagattatcaccgctctatcaggcattcttctatacaagagtag

SEQ ID NO: 29096 - DNA, 1443 bp, Artificial Sequence
  Description of Artificial Sequence: Synthetic coding sequence
ctggggcctacggccgctctcagctctgaaagtagggctagagccgcacaggcagggggtggtcctagggcccgtgccaggactcggggtatgaatctggaaggaggcggaagaggtggcgagttcgggatgtccgctgtttcatgcgggaatgggaaacttagacaatggctgatcgatcagatcgatagcggaaagtacccaggcctggtttgggagaacgaagagaagtctattttcagaatcccatggaagcacgctggcaagcaggactataacagagaggaggatgctgccttatttaaggcctgggccctctttaagggcaaatttcgagaaggaatcgataaacccgacccccctacctggaagaccaggttgcgatgtgcacttaataagtccaacgactttgaggaactcgttgagagatctcagttggacatctccgatccatacaaagtgtacagaattgtgccggagggcgctaagaaaggcgctaagcagcttaccttggaggacccacagatgtccatgagccatccttacactatgactacaccatacccctcactgcccgctcaggtgcataactatatgatgccgccactggatagaagctggagggactatgtgccagaccagcctcaccccgagattccgtaccagtgcccaatgacctttggccctagagggcatcactggcaggggccagcttgtgaaaacggatgtcaggtgactggcacgttctatgcttgtgccccacccgagtcccaggctcccggagtgcctacagaacctagcattcggagtgccgaggcattggctttcagcgattgcaggctccatatatgcctctactaccgcgaaattctcgtcaaggaactcaccacttcaagccctgagggttgccggatctctcacgggcacacctacgacgcgtccaatcttgaccaggtactgttcccctaccctgaggacaacggacagaggaaaaacatcgagaaactgctgtcacatctggagagaggggttgtcctgtggatggcccctgacggattgtacgccaagaggttgtgccaaagccggatctattgggatgggcctttagccctgtgtaatgacaggcctaacaagctggaacgcgatcagacttgtaaactgtttgatacccaacagttcctctccgagcttcaggcctttgcgcatcacggcagatcactccccagatttcaggtcactttatgttttggggaggagttcccagacccacagcggcagcggaagctcattacagcacacgtggaacccctgctggcaaggcaactgtattacttcgcacagcaaaactcgggacactttctcagagggtatgacttgcccgaacacatttcgaaccctgaggactatcatcggagcatcaggcatagtagcatccaggaatag

SEQ ID NO: 29097 - DNA, 1497 bp, Artificial Sequence
  Description of Artificial Sequence: Synthetic coding sequence
atgaatcagtctatacctgtcgcgcctacccctcctcggcgagtgcgtctcaaaccgtggttggttgctcaggtaaatagttgtcagtaccccggtctgcaatgggttaacggtgaaaaaaagctcttttgcatcccctggcgtcacgcgacgcggcacgggccatctcaagatggagacaacaccatatttaaagcatgggcgaaagagactgggaagtacacggagggagtggacgaagctgatcccgctaagtggaaagctaatctgagatgtgctctgaacaagtcaagagattttagactgatttatgatgggcctagagatatgcctccacagccctataagatttacgaggtctgcagtaacggccctgccccaactgattcccaaccacccgaagattattccttcggcgctggagaggaggaagaagaggaagaggaacttcagaggatgctgccctctctgagtctgacagaagacgtgaagtggcccccaactctgcagcccccaaccttgcggcctcctacgctgcaaccccctaccttacagcctcctgtcgtcctcggccctccagctccagatccgagtcccctggctcccccaccaggcaaccctgctgggtttcgcgaattgctctctgaggttttggagccgggtccactgcctgcatctctgcctccggctggtgaacagctgctgcctgatctgctcataagcccccacatgctccctcttacagatctggaaatcaagtttcagtatcgtggcaggccaccaagagccctgacgatctcaaacccacacggctgccgcctgttttattcacagctagaagcgacccaagagcaggtggaactgttcgggcctatctctcttgaacaggttcggtttccctcccctgaggacatccccagcgataaacagcggttttatacaaaccagctcctggatgtcctagaccgagggctgattctgcagctgcaagggcaagacctttatgcaattcgcttgtgtcagtgtaaggtcttctggagtgggccttgcgcttctgcgcacgactcttgtcccaatccgatacagagagaagtgaagaccaaactgttctccctcgagcacttcctgaatgagcttattctgttccagaaaggccagactaacacaccgccacctttcgagatttttttttgctttggggaggaatggcccgacaggaaaccacgcgaaaagaagctcattacagttcaagtcgtgccggtggcagcccgtcttcttctcgagatgtttagtggcgaactgagctggtctgccgactctataaggctccagatcagcaaccctgacctgaaggacaggatggtggagcagttcaaggagctgcaccacatctggcaaagtcagcaacggctccagcccgttgcccaggctccaccgggtgctggcctcggagtcggacaaggaccctggcccatgcatcccgcaggtatgcaatag

SEQ ID NO: 29098 - DNA, 1545 bp, Artificial Sequence
  Description of Artificial Sequence: Synthetic coding sequence
atgaaccagagcattcccgtggcccctacaccaccacgaagggttagattgaagccttggctcgtggcacaggtgaatagctgccagtatcccggactgcagtgggtgaatggggagaagaaactcttttgcataccttggagacatgccacacggcatgggccttctcaagatggagacaatactatttttaaggcttgggcaaaggagacggggaaatatacggaaggagttgatgaggccgatccagcaaaatggaaagcgaatctgcgctgcgccctgaacaagtcccgggactttcgtctgatttacgatggcccaagggacatgcccccacagccctataaaatctatgaagtctgcagcaacggacctgcaccgactgactctcaacctcccgaagattattcttttggcgcaggggaggaggaggaggaggaggaggagctgcaacggatgctgccgtccctgtcgctgactgatgctgtgcagtcaggaccccatatgactccctacagcttgctcaaagaagacgtgaaatggcctcctacactccagccacctactctccggcctcctacgttgcaaccccctacactgcagcctccagtcgtgttaggccctcccgctcccgaccctagtcctcttgctcctccacctggcaaccccgctggctttagagaattgctttctgaagtactggaaccgggtccgctgcccgcatcactgccccctgctggcgagcaattactccccgacttgctgatcagccctcatatgttgcctctcacggacctggaaatcaagttccagtaccgcggacgccctcctcgagctcttaccatatccaatccgcacggttgcaggcttttttacagtcagcttgaggccacgcaggaacaggtcgaactgtttggcccaataagtctagaacaggtccgtttcccttcccccgaagacattccatccgacaaacaacgattttatactaaccaactgctcgacgttttggatcgtggtttaatcctccagctgcagggccaggatttatacgccatccgattatgccagtgcaaagtattctggtcaggaccatgcgctagcgcacatgatagttgcccgaatccgatacaaagggaggtgaaaactaaactgttcagcctcgaacactttctcaatgagctgatcctgtttcaaaaaggtcaaacgaatacaccaccaccttttgagattttcttttgcttcggcgaggagtggcctgacaggaaacctagggagaaaaagctgatcacagttcaagttgttcccgtggctgccagactgctgctcgaaatgttttctggcgagttgtcatggagcgccgacagtattcgactgcagatctccaaccctgacctgaaagatagaatggtggaacagttcaaagaactccaccacatttggcagtctcagcaacgcctccaaccagttgctcaggctcctcctggcgctggcctcggggtcgggcagggaccctggcccatgcaccccgctggaatgcagtag

SEQ ID NO: 29099 - DNA, 1497 bp, Artificial Sequence
  Description of Artificial Sequence: Synthetic coding sequence
atgaaccagtcgataccagtggcgcctacacccccaaggagagtgcggctgaaaccatggttagtggcacaggtgaactcctgccagtatcccggtttgcaatgggttaatggagagaaaaaactgttctgcatcccctggcggcacgcgactcggcacggccctagtcaagatggtgacaacaccatctttaaggcatgggctaaggagaccggcaagtacacagagggtgttgacgaagctgaccccgcaaagtggaaggctaacttgaggtgcgcccttaacaagtcccgcgattttcggctgatctatgacggtcccagggacatgcctcctcagccttataaaatttacgaggtgtgttcaaatggacccgctcccaccgattctcagccacctgaggattacagtttcggggcaggagaagaggaagaagaggaagaggagttgcagcgcatgcttccctcactgagtctgacggaggatgtaaaatggccccctactttacaacctccgacccttcggccacctactcttcagccccctacactacagcccccagttgtgttgggtccccctgctccagaccctagcccattggctccacctcctggtaaccccgctggatttagggagttgttgtccgaggttcttgagccaggcccactgcccgcatcgctgcctccagcaggcgagcagctgcttccggatctgctgatatctccccacatgcttcctctgacggacctggagatcaagttccaatataggggacgccctcctcgggctctaaccatttccaaccctcacggttgccgcctgttctactctcagcttgaggccacacaggaacaagtggaactttttgggcctatcagtcttgaacaggtacgctttccctcccccgaggacatccccagcgataaacagcggttctacaccaatcagcttcttgacgtgcttgaccggggtctgattctgcagctccaggggcaagatctgtacgccattagactttgccagtgtaaggtgttttggagcggcccatgcgccagtgcccacgatagttgtccgaacccgatccagcgggaggtgaaaactaaattgtttagtctggagcatttcctgaatgaactaatacttttccaaaaagggcagaccaacacaccccctccgttcgaaattttcttctgttttggcgaggaatggccagatcggaaaccacgcgaaaaaaagttaattaccgtgcaggtggtgcccgttgccgcacggctgctactggaaatgttctcgggggagctgtcttggagtgccgatagcataaggcttcagatctccaaccctgacttgaaagatagaatggtcgagcagttcaaggaattgcaccacatatggcagtcacagcagagattacagcctgttgcccaggctcctccaggggctgggctgggagtggggcagggcccatggcccatgcatccagccggaatgcagtag

SEQ ID NO: 29100 - DNA, 1467 bp, Artificial Sequence
  Description of Artificial Sequence: Synthetic coding sequence
atgaaccagagcattcctgttgcacctactcccccacgcagggtgcgtttaaaaccttggcttgttgcgcaggtgaatagctgccagtatccaggtctccagtgggtgaatggggagaaaaagctgttctgcattccatggcggcacgcgacacggcacgggccatctcaggatggggacaataccatcttcaaggcatgggccaaagagaccggcaagtacacagagggagtagacgaggcagatcctgccaagtggaaagctaatctccgttgcgcattaaacaaaagccgcgacttccgcctcatctatgatgggcctcgcgacatgccaccccagccttacaaaatttatgaggtgtgtagcaacggccctgcacccaccgattctcagccccctgaggattactcttttggggcaggcgaagaggaggaggaggaagaggagctgcagcgtatgctgccttctctttcactgaccgaggatgtgaagtggccaccaacccttcagcctccaacactgcagcctccagttgtattgggccctcccgcacccgatcctagccccctggccccaccgccaggaaacccagctggttttagggagcttttatcggaggtcctggagcctggaccccttccagccagtctcccacctgctggggaacagttacttccagacttactcatctccccccacatgcttcccctgacagacctagaaattaagttccagtaccgcggacgacctccacgtgcgctgaccatctcaaacccgcatggatgcaggcttttctactcacagctagaagccacccaagagcaggtggagctgttcggacccatatcgttagaacaggtgagatttccctctccagaggacattccgagcgacaagcagagattttacaccaaccagctgttagatgttctcgaccggggacttatcctacagttacaggggcaagacctctatgccatccgcctgtgccagtgcaaagtattttggtccggtccatgtgcctccgctcacgatagctgtcctaaccctattcaaagggaggtaaagaccaaactgttctcgctcgaacattttttaaatgaactcatcctttttcaaaagggtcagactaatactccccctccatttgaaatttttttttgcttcggggaagagtggccagaccggaaacctcgagagaaaaaattaatcacagtgcaggtggttcctgtggctgccaggctgttgttagagatgttctcaggtgagctgtcatggtctgccgattcaatacggctgcagattagcaatccagatctcaaagacaggatggtcgaacaatttaaagagctgcaccacatctggcagtcacagcagcgcctgcaacctgtggcacaggcaccacccggagcagggctcggggttggccaaggcccttggccaatgcaccctgctggcatgcagtag

SEQ ID NO: 29101 - DNA, 684 bp, Artificial Sequence
  Description of Artificial Sequence: Synthetic coding sequence
atgaatcagtccatacccgtggctccaacccctcccagaagagtcagattaaaaccctggctagttgcacaagtgaacagctgccaatatcctggccttcagtgggtgaacggcgaaaagaagctgttttgtattccttggaggcacgccactcgccacggaccaagtcaggatggcgacaatacaatcttcaaagcttgggctaaagaaactggtaagtacacggaaggcgtggacgaagccgatcctgccaagtggaaggctaaccttagatgtgcactaaacaaatcaagagacttccgtctaatctacgacggtccacgggacatgccccctcaaccatacaaaatttacgaagtgtgtagcaatgggccagctcccacagacagccagcctcctgaggactattctttcggcgcaggcgaggaggaggaggaggaagaagaacggatgtcatctggccgacctctgtgcagtagacctttgtgcgggcgtctgttatgcagccggcctctctgctcccgtccgtggtgttgggtccctctgctgcaaactcccgctccctggttactgccgttagctactcttctggcctcaggctcttttagtctcaggagttggagcctgggcccatgtctgcctgcttgccctttgcaggccaacagctcctgccagacgtgctag

SEQ ID NO: 29102 - DNA, 474 bp, Artificial Sequence
  Description of Artificial Sequence: Synthetic coding sequence
atgaaccagtctatccccgtggcgccaacaccgccacgcagggtgcgattgaaaccatggctggttgcccaggtaaatagctgccaatatcctggcctgcagtgggtgaacggcgaaaaaaagctgttctgtataccatggagacatgcgacccgtcacggcccttcacaggacggagacaacaccatattcaaagcttgggctaaagagacggggaagtataccgagggcgtggatgaggcggatccggctaaatggaaagccaatctgcgctgtgccttgaataagtctagggacttccggcttatatacgatgggccacgggacatgccgccacagccctataagatctacgaagtatgctccaatgggccagcccctacagattctcagccacctgaagattacagtttcggtgctggggaggaggaagaggaagaagaagagatgcagtgtagtctagccccaacctag

SEQ ID NO: 29103 - DNA, 321 bp, Artificial Sequence
  Description of Artificial Sequence: Synthetic coding sequence
atgaatcagtccatcccggtggcccctactccccctcgaagagtgagattgaagccctggcttgtggcacaagtcaatagttgccagtaccctgggctgcagtgggtcaatggcgagaagaagttgttttgtatcccatggaggcacgccacaagacatggcccttcacaggacggggacaacactatattcaaggcctgggccaaggagaccggtaagtacaccgagggtgtggacgaggcagaccccgctaaatggaaggccaatctgcgctgcgcactgaataagtctagggatttccgtctcatttacgatggttag

SEQ ID NO: 29104 - DNA, 180 bp, Artificial Sequence
  Description of Artificial Sequence: Synthetic coding sequence
atgaaccagtccatacccgtagcacccactccacctagacgggtgagactgaagccttggctggtcgctcaagtcaatagctgccagtatcccggacttcagtgggttaacggagagaagaagctcttctgcatcccttggaggcacgccacgagacatggacctagccaggatgggtag

SEQ ID NO: 29105 - DNA, 1497 bp, Artificial Sequence
  Description of Artificial Sequence: Synthetic coding sequence
atgaatcagtctatccctgtggccccaacaccgcctcggagggtccggttaaaaccctggctggtggcacaagtcaatagctgtcagtatcccggtctccaatgggtcaacggggaaaagaagttattctgtatcccttggcgccatgctacccgacacggtccgagccaggacggcgataacaccatcttcaaggcctgggccaaggaaacaggcaagtatacggaaggcgtggatgaagccgatcctgcgaagtggaaggccaacctgagatgcgcattgaataaatccagggatttccgtttgatctacgacggcccaagagatatgcccccacagccatataagatctacgaggtttgttctaacggacctgcccctacagacagtcagccacccgaagactattctttcggggctggagaggaggaagaagaagaggaagaattgcagaggatgctaccttccctgagcctcacagaggatgttaagtggcccccaacgctgcagccaccgaccctgcgaccacctaccttgcagccacccaccctgcaaccaccagtggtattaggccctcctgcacctgatccttcgccccttgctccaccaccgggtaacccggcaggttttagggagctgctttccgaagtccttgagcctggtcccctgccagcatcactgcccccagccggagagcaactgctgccggatctcctgatctccccccacatgttgcccctgaccgacctagagataaagtttcagtatcgagggaggccccctcgagctctaacaatcagtaatcctcatggatgtagactgttttattctcagctggaagcgacccaggagcaggtcgagttatttggccctatctcgttggaacaggtgcggttcccaagccctgaggacattccttctgacaagcagagattttatacaaaccagctgttagatgtgctcgacagaggactaatcctgcagcttcagggacaggatctctatgccattcgcctgtgtcagtgcaaggtgttctggagtggcccatgtgcctctgcacacgatagctgccctaatcccattcaacgagaagtgaaaacaaagctctttagccttgagcactttctaaatgagctcatcctgtttcagaaaggccagacaaacacgccaccaccgtttgaaatttttttttgtttcggcgaggaatggcctgataggaagcccagagaaaaaaagctgatcactgtccaggtcgtgccagtggccgctcggcttctcctggagatgttctccggggaattaagctggtccgccgacagtatcaggctgcagataagtaatccagatttgaaagacaggatggtcgagcagtttaaagaacttcaccatatctggcaaagccagcagcggctccagcctgtcgcccaggcacccccaggtgcaggcttgggcgtgggacagggaccctggcccatgcatcccgcagggatgcagtag

SEQ ID NO: 29106 - DNA, 426 bp, Artificial Sequence
  Description of Artificial Sequence: Synthetic coding sequence
atgaaccagtccatccccgtagctccgacaccaccgcgacgcgttcgcctgaagccctggctagtggcccaagttaatagctgtcagtatcccggacttcagtgggtgaatggggaaaagaaattattctgcataccctggagacacgcgactcgacatgggccttcgcaggacggggataataccatcttcaaagcctgggcaaaagaaacagggaaatacaccgaaggtgtagatgaggccgaccctgccaaatggaaggctaatctgagatgcgcgcttaataagagtagagatttcagattaatctacgatggaccgagagacatgccccctcaaccatacaaaatctacgaggtatgttccaacggaccggctccaaccgacagtcagcccccagaggattatagctttggcgcagggtag

SEQ ID NO: 29107 - DNA, 459 bp, Artificial Sequence
  Description of Artificial Sequence: Synthetic coding sequence
atgaatcaatccataccagtggcaccaacacccccacgacgtgtgcgcctcaagccctggttggtcgcgcaggtgaattcttgtcaataccccggactacagtgggttaatggcgagaagaaattgttttgcataccctggcgtcacgcgaccagacacggaccctcccaagatggagataacactattttcaaggcatgggctaaagagactgggaagtatactgagggggttgatgaggccgatcctgcgaaatggaaagccaacctcaggtgcgccttaaacaaaagcagagatttccgcctaatctacgacggcccaagggatatgcccccacaaccctataaaatatatgaagtttgctccaatggccctgcgcctaccgatagccagccacccgaggactacagtttcggcgcaggagaggaagaagaagaagaagaagaggtcagtgtgtag

SEQ ID NO: 29108 - DNA, 1239 bp, Artificial Sequence
  Description of Artificial Sequence: Synthetic coding sequence
atgaatcagagtattcccgttgccccaacccccccacgcagggttcgccttaaaccatggcttgtcgcccaagtcaacagttgccaatatcctggactacagtgggtcaacggagaaaagaagctcttctgcattccatggaggcacgccacacgccatggcccaagccaggatggggacaataccatcttcaaagcctgggctaaagaaactgggaaatacaccgagggcgtcgatgaggccgatcctgcaaagtggaaggccaatctacgctgcgcacttaataaaagccgggattttcgtttgatctatgatgggcctcgggacatgcctcctcagccttacaagatctatgaagtctgctctaatggacctgcacccaccgactcacaaccacccgaagattacagctttggtgctggcgaagaagaagaggaggaggaagagcttcagagaatgctcccatccctgtcactaactgtgactgatcttgaaatcaagtttcagtatagaggcaggccccctcgcgcattaacgatatccaacccccatggttgtagactgttctactcacagctggaagccactcaagaacaggtcgaactcttcggtccaattagcctggaacaggtccggtttccttctccagaagatatcccttccgataagcagaggttttatacgaaccagctgctggacgtgttggaccgtggcctaatcctgcagctccagggccaggacctgtatgccatccgcctatgtcagtgcaaagtgttttggagcggtccatgcgcttccgcccatgactcgtgtccgaatccgatccaaagagaggtgaaaactaaactgtttagcctggaacacttcttgaatgagctgatcctcttccagaagggccaaactaacacaccgccacccttcgaaatttttttttgctttggcgaggaatggcctgacagaaaacctagagaaaaaaaactgataacagtgcaggttgttcccgtggcggctcgcctgctgctggagatgttctccggcgaactatcttggtctgccgacagcataagactgcagatctcgaaccccgacctgaaggaccggatggttgaacaatttaaggaactacaccatatctggcagtcgcagcaaagactgcagccggtggcgcaggcaccacctggcgctggtctgggcgtaggccagggaccctggcccatgcaccccgctggcatgcaatag

SEQ ID NO: 29109 - DNA, 570 bp, Artificial Sequence
  Description of Artificial Sequence: Synthetic coding sequence
atggcatctccttttgccctgctgatggtccttgtggtgctgtcatgtaagagttcatgctcgttaggctgtgacctgcccgagactcatagcctggacaacagaagaacactgatgctgcttgcgcaaatgagcaggatatcacccagttcttgcctgatggacaggcacgacttcggatttccacaggaagagtttgatgggaatcagtttcagaaggcccctgccatctcagtgctccacgagctgatacagcaaatctttaatctctttactacaaaggattcatccgcggcatgggacgaagatctactcgacaaattttgtactgaattataccagcaactgaacgacctggaggcttgtgtaatgcaagaagagcgcgtcggtgagactccgctgatgaacgcggactctatcttggcagtcaaaaagtattttcggaggatcacgctatacctcaccgaaaagaagtatagcccctgcgcctgggaggtggtcagagcagaaattatgcggtctttgtcactcagcaccaaccttcaggaaagacttcgaagaaaggagtag

SEQ ID NO: 29110 - DNA, 516 bp, Artificial Sequence
  Description of Artificial Sequence: Synthetic coding sequence
atgctggttaactttatcctccgatgcggcctgttgttagttacgctgtccctggcgattgccaagcacaagcaaagctcttttactaagagctgctatcctagggggaccttgtcacaagctgtggatgctttgtacattaaggccgcttggctgaaagctactatccctgaggaccgaataaagaatatacggctgctaaagaaaaagaccaaaaagcagtttatgaagaactgtcagtttcaggaacagctgctctcattttttatggaagacgtgtttggacaacttcagctgcaaggttgcaaaaagatccggtttgtggaggacttccacagcctgcggcagaagctgtcccactgcatcagttgtgctagcagcgcgagagagatgaagtccataacaaggatgaaaagaatcttttacaggatcggcaacaaaggcatttataaggccatctcagagttagacatccttctgtcttggattaaaaagttactcgagtcgtcgcagtag

SEQ ID NO: 29111 - DNA, 543 bp, Artificial Sequence
  Description of Artificial Sequence: Synthetic coding sequence
atggccttggcagacctgtacgaggagggcggagggggtgggggagaaggagaggacaacgcagatagcaaggaaacaatttgtcgcccttctgggaggaaatccagcaagatgcaagcttttcggatctgggacgtcaatcagaagaccttctatttgcgcaacaatcagctcgtcgcaggttatctgcaggggcctaacgtgaatcttgaagaaaagatcgacgtggtacccattgaaccacacgcattgttcctgggaatccatgggggtaagatgtgcctcagctgcgtaaaatcaggagacgagacgcggctccagttagaggccgttaatattaccgatctatcggagaatcggaaacaggacaagaggtttgcattcattcggagcgacagtgggccaacgacatcctttgagagtgccgcatgtcccggttggtttctttgcaccgctatggaagccgaccagccagtgtccctgacgaacatgcctgatgagggtgttatggtgactaagttttacttccaagaagatgagtag

SEQ ID NO: 29112 - DNA, 480 bp, Artificial Sequence
  Description of Artificial Sequence: Synthetic coding sequence
atggcgttggagacaatatgtagaccttcagggagaaagagctccaagatgcaggcgttcagaatctgggatgtcaaccagaagacgttttacctgagaaataaccagctggttgccggatacctccagggcccaaacgtgaacctagaggagaaaatcgacgtggtcccgatcgaacctcacgcgctctttctgggtatacacggtgggaaaatgtgtctctcatgcgtgaaaagcggagatgaaacacgcctgcagcttgaagccgttaacatcacagacctgagcgagaatagaaagcaggacaagcgatttgcttttatcagatcagacagcggccctaccacctcatttgagagtgcagcttgtccaggctggttcctatgcaccgctatggaggctgaccagcctgtgtcacttacgaatatgccagatgagggcgtgatggttactaaattttacttccaggaggacgagtag

SEQ ID NO: 29113 - DNA, 534 bp, Artificial Sequence
  Description of Artificial Sequence: Synthetic coding sequence
atggaaatttgccgcggtcttcgcagtcacttgatcaccctgttgctcttcctctttcattccgagacgatttgccgcccttcaggacggaagtcaagcaaaatgcaggccttccgcatatgggacgtcaatcagaagaccttctatctcaggaataatcagttggtcgcagggtacctacaaggaccaaatgtcaaccttgaggagaaaatcgatgtggttccaatagaaccacacgcgttatttctgggaattcacggtggcaagatgtgtctgagttgcgtaaagagcggcgatgaaactcgccttcagctcgaggcagtgaacatcaccgatctatctgagaaccggaagcaagataaacggttcgcgtttattcggtccgattccggtcccactacaagctttgagagcgcagcgtgcccgggatggttcctgtgtacagcaatggaggccgaccaaccagtatcattgaccaacatgcccgatgagggggtgatggtaactaaattttacttccaggaggacgagtag

SEQ ID NO: 29114 - DNA, 432 bp, Artificial Sequence
  Description of Artificial Sequence: Synthetic coding sequence
atgcaggctttccgaatctgggatgtgaatcagaagaccttctacctgaggaacaatcagctcgtggcgggataccttcagggacccaacgtaaacctggaagagaaaattgatgtggtccccattgagccacacgcgttgttcctcggaatacacggaggaaaaatgtgcctctcttgcgtgaaaagcggggacgaaaccaggctgcagctcgaggcggtgaacataaccgacctgtccgagaatagaaagcaagataaacggttcgcctttatacgatccgacagtgggccaacaaccagtttcgagagcgctgcctgcccaggatggttcctctgcactgcaatggaggcggatcaacccgtgagtttaacaaacatgcctgacgaaggggtgatggttactaaattttatttccaggaagatgagtag

SEQ ID NO: 29115 - DNA, 1470 bp, Artificial Sequence
  Description of Artificial Sequence: Synthetic coding sequence
atggagccaggcctggagcacgcccttcggcgaacccccagctggtctagcttaggcggttccgagcaccaggaaatgagtttcctggagcaggagaacagttcaagctggcctagtcctgccgtaacgtcgtccagcgagaggatacgagggaaacggagggcaaaagcccttcgctggacacggcagaagagtgtggaagagggcgaacccccaggacagggcgaggggcctaggagcaggcccgctgcagagtccactggacttgaggcaaccttcccaaaaaccacccctctagcacaggcagatccagctggcgtggggactcctccaacgggctgggattgccttccatcagactgtactgccagtgctgctggaagtagcacagacgatgtggaactggctactgagtttccagccaccgaggcctgggagtgcgaactggagggtctgttggaagagcggccagcgttatgcttaagcccccaggccccttttccaaaactcgggtgggacgacgagctaagaaaaccgggtgcccagatctatatgaggtttatgcaggagcacacttgctacgacgccatggccacctctagtaaattggtgatattcgataccatgctagagattaagaaagccttctttgccctggttgccaacggggtccgcgcagcacccctgtgggattctaagaagcagtcgtttgtggggatgttaactatcaccgacttcatccttgtactgcatcgatactatcggtccccgcttgtgcagatctacgagatagagcagcacaagatagagacttggcgggaaatctatttacagggctgcttcaagcctctggtctccatttccccaaatgactccttgtttgaagccgtttataccttaattaagaacagaattcacagactccccgtgttagacccagtgtctggcaatgttctgcacatcctgacccacaaacgcctcctgaagttcctgcatattttcggctcattgctccctagacccagtttcctttaccgtacgattcaagacctaggtatcggcacattccgagatctggcagtcgtgctggagacagcgccaatcctgaccgctctagatatttttgtcgatcggagggtgagcgctctccctgtggtgaatgaatgcggccaagtcgttggtctgtacagccggtttgatgtgatccatctggctgcacagcaaacatacaaccacctagacatgagtgtaggggaggcacttagacagaggaccctgtgcctcgagggagtcttatcgtgccagccccacgaaagtctgggagaggtgatcgaccgcatcgctcgggagcaagtacacaggcttgtcctcgtggacgaaacccagcacctgttaggcgtggtaagcctttcggatatcctccaagctctggtgctctctcctgcgggaatagacgccctgggagcgtag

SEQ ID NO: 29116 - DNA, 1710 bp, Artificial Sequence
  Description of Artificial Sequence: Synthetic coding sequence
atgaaggtgctccttcggcttatttgttttattgctctgctcatctccagtcttgaagcggataaatgtaaggaacgcgaggagaaaattatactggtatcttctgccaacgagattgacgtcagaccctgccctctaaatcctaatgagcacaaaggaaccatcacctggtataaagacgatagcaaaacacctgtgagcaccgagcaggcatcacgcatccatcagcataaagagaagttgtggtttgtgcccgcaaaggtggaagacagcggtcattattattgtgtagttcggaactccagctattgtctcaggattaagattagcgccaaattcgtagagaacgagccaaatctctgctataacgcacaagcaattttcaagcagaaattgcctgtagctggcgacggtggcttagtgtgtccttatatggaatttttcaagaatgagaataacgagctgccaaagttgcagtggtataaggactgtaagccactcctactggataacattcatttttcgggagtcaaggatagactcattgtgatgaacgtcgcagagaaacatcggggtaactatacgtgtcatgcctcctacacatatcttgggaaacagtatccgattacgagggtcatagagttcatcaccctcgaggaaaataagcccaccaggcctgtcatcgtttcacccgctaacgaaaccatggaggtcgacttgggctcccagatacaactgatatgtaacgtaaccggacagcttagcgacatagcgtattggaaatggaacggctctgtgatcgacgaggatgatcccgtgctaggtgaggactactacagcgtggagaatcctgcaaataaaagaagatctaccctgataacagtgttaaatatctcagaaatcgaaagtcgattctataaacatccgtttacgtgcttcgcaaagaatacacacggcatagatgccgcttatatacagctcatttaccctgtcacaaacttccagaaacacatgattggtatttgcgtgaccttaactgtcatcattgtgtgctcagtctttatctataaaatttttaagatcgacatcgttctttggtatcgcgactcgtgctatgattttctccccattaaagcttcagatggaaaaacatacgatgcttacatactgtacccaaagacagttggggagggctccacgtctgattgcgacatttttgtgttcaaagtgctgccggaagttctggagaaacagtgcggatacaaactttttatctatgggagggatgactatgttggcgaagatattgtggaagtgatcaatgagaacgtaaagaagagccgcaggctgataatcatccttgtgcgcgagacatccggcttttcttggctcggcggaagcagtgaagagcagatcgccatgtataacgcacttgtgcaggacggcattaaagtggtgttactggaattggagaaaattcaggactacgagaagatgcccgagagtattaagtttatcaaacagaaacatggtgctatccgctggtccggggactttactcagggtcctcagagtgccaagacccgattttggaaaaatgtgcgataccacatgcccgtgcagaggcgaagtccctcctctaagcatcagttgctttctccagccaccaaggagaagctacagagggaggctcatgttcctctcggctag

SEQ ID NO: 29117 - DNA, 549 bp, Artificial Sequence
  Description of Artificial Sequence: Synthetic coding sequence
atgaaagtccttctgcgactgatttgttttattgcactgctaatctcatcacttgaagcagataagtgcaaggagcgggaggaaaaaatcatcctggtgagcagtgcaaatgaaatcgatgtcaggccatgtcccctaaatccaaacgagcacaaaggcacaatcacctggtacaaagatgattccaaaacacctgtcagcaccgaacaagcttcccgaattcatcagcacaaagagaaactttggtttgtgccagccaaggtcgaagattctggccattactattgtgttgtgcgaaacagtagttattgcctaaggattaagatttccgcaaagttcgtggagaatgagccaaacctgtgctataacgcccaggccatctttaagcagaagctgcccgtcgctggagacggtggcctggtatgcccctacatggagttcttcaagaacgagaataatgagttgccaaagttgcagtggtacaaagattgtaagccactgctcctggataatattcactttagtggagtaaaagatcgcctcatttag

SEQ ID NO: 29118 - DNA, 345 bp, Artificial Sequence
  Description of Artificial Sequence: Synthetic coding sequence
atgaaggtcctcctgcggttgatttgcttcatcgctctgctgatctcaagcttggaggccgataagtgtaaggagcgcgaagagaagataatcctggtttcatctgccaatgagatagatgtgagaccgtgccccctgaatcccaatgagcacaaggggacaatcacgtggtataaagacgactccaaaacacccgtttccaccgagcaggcaagccgaatacaccagcataaggagaagctatggttcgtccccgcaaaagtggaggactccgggcactattattgcgtggttagaaattcttcctactgcctccggatcaaaatttcagcgaagtttgtttag

SEQ ID NO: 29119 - DNA, 321 bp, Artificial Sequence
  Description of Artificial Sequence: Synthetic coding sequence
atgaaggtgttgttaaggctcatctgcttcatcgctctcttaatttcgagtcttgaggctgacaagtgtaaggagcgcgaagaaaaaatcattctcgtaagcagtgccaacgagatcgacgtgcggccatgtccgcttaaccccaacgagcataaagggacgattacctggtacaaagacgactccaaaacacctgtgtctaccgagcaagcaagccggattcatcagcacaaagaaaaactttggtttgtgcccgcaaaagtggaggatagtgggcactattattgcgtagtgagaaacagcagctattgtttaaggtag

SEQ ID NO: 29120 - DNA, 243 bp, Artificial Sequence
  Description of Artificial Sequence: Synthetic coding sequence
atgaaagtgctgctgagattgatttgctttattgccctgctgatcagctcacttgaggccgacaaatgcaaggagcgcgaagaaaagatcatattggtctcttccgccaatgagattgatgtgcgaccttgccctctcaatccgaacgagcataaggggaccatcacctggtacaaggacgatagtaagacaccagtgtccaccgagcaggccagccgcatccaccaacacaaagagaagtag

SEQ ID NO: 29121 - DNA, 810 bp, Artificial Sequence
  Description of Artificial Sequence: Synthetic coding sequence
atggcagaggtgcctgaacttgcgagcgagatgatggcatactattcaggcaacgaggatgacctgtttttcgaggctgatggcccaaagcagatgaaatgcagttttcaagacctcgacctgtgtcccctagacggaggaattcagcttcgaatttccgatcaccattactccaagggcttcaggcaggcagcctctgtcgttgtagccatggacaaacttcggaagatgctcgtgccctgcccccagaccttccaggagaacgatttatccacattttttccctttatctttgaggaggagccaatctttttcgacacatgggataacgaagcttacgtccatgatgcccctgtaaggtctctgaactgcaccctgcgtgactctcagcagaagtccttagtaatgtccggcccttatgagctcaaggccttgcatctgcaaggccaggacatggagcagcaggtagtcttcagtatgagtttcgtacagggagaagaatcaaacgataagatccccgtggcattagggctgaaagagaagaatctttacctctcctgcgtgctgaaggatgacaaaccgaccctccagttggaatcagtagatcccaaaaactacccaaaaaaaaagatggagaagcgcttcgtgttcaacaagatcgagatcaataataagctcgagttcgagtctgcacagttccccaattggtatattagcacatctcaagcggaaaatatgcctgtgtttctgggaggaaccaaggggggtcaggatataacagactttactatgcagttcgtgtcatcatag

SEQ ID NO: 29122 - DNA, 336 bp, Artificial Sequence
  Description of Artificial Sequence: Synthetic coding sequence
atggctgaagttcccgagctggccagcgagatgatggcttactacagtggaaacgaggacgaccttttttttgaagccgacggtcctaagcagatgaaatgcagcttccaggatctggacctctgtccgttggatgggggaatccagcttagaatctctgaccatcattactcgaaaggcttccgccaagcggcttcagtggttgtcgctatggataaattgagaaagatgttagtgccatgtccacaaacatttcaggagaacgacctcagcacttttttcccttttatttttgaagaagaaccgatcttcttcgatacatgggacaatgagtag

SEQ ID NO: 29123 - DNA, 432 bp, Artificial Sequence
  Description of Artificial Sequence: Synthetic coding sequence
atggcagaggtgccagagctggcttcagaaatgatggcctactacagcggcaacgaggacgatcttttcttcgaagccgacggtcccaagcaaatgaaatgtagttttcaggacctcgacctgtgtccactggacggcggaatccaacttcgcatcagcgaccaccactatagtaagggtttccgacaagctgcctctgttgtggtggccatggacaaacttcgaaaaatgctggtcccatgcccgcagacttttcaagaaaacgacctcagcacttttttcccgttcatcttcgaggaggagcctatcttttttgacacctgggacaatgaggcttatgtgcatgatgccccagtgcggtccttgaactgtactctgcgtgacagtcagcagaagtctttggtgatgagcggaccttatgaactgaagtag

SEQ ID NO: 29124 - DNA, 378 bp, Artificial Sequence
  Description of Artificial Sequence: Synthetic coding sequence
atggccgaagtgcccgagctggcctccgagatgatggcttactattcggggaatgaggatgacctgttctttgaggcagacggtcctaaacaaatgaaatgctcttttcaggatctggatctctgcccactggacggtggcattcaactccgcatctcggaccaccactacagcaaggggttccgccaggctgcatctgtggtggtggcgatggataaactccgtaaaatgctggtgccctgtccacagacctttcaagaaaacgatttatctaccttctttccatttatcttcgaggaagagcctatcttcttcgacacatgggataatgaggcctatgtgcatgatgccccagtgcgtagtctgaattgcacgtag

SEQ ID NO: 29125 - DNA, 762 bp, Artificial Sequence
  Description of Artificial Sequence: Synthetic coding sequence
atgtggccacccggaagtgcctcacagcccccaccctcgccagcagccgcaaccggcctccatcctgccgcaagacccgtctccttacagtgtagattgtccatgtgtcctgccaggtcgctgctgctagttgccacactggtactattagaccacctgtcactggcccgaaatctcccagtagccacgccagaccctggcatgtttccttgtttacatcacagccagaatctgcttcgcgcagtatccaatatgctacagaaggctaggcagacactagaattctacccatgcactagtgaggaaatcgaccatgaagacattaccaaggacaaaacctcaacagtcgaagcgtgtctgcctttagaactgacaaaaaatgaatcctgcctcaactcaagagaaacctcatttatcaccaatggaagttgtcttgccagcaggaaaacttccttcatgatggccttgtgtctttctagtatctatgaagacttgaagatgtaccaggtggagttcaaaacaatgaacgcaaaactgttgatggacccaaagcgccagatatttctggaccagaacatgctcgccgttatcgatgaactgatgcaggccttaaactttaatagcgagaccgtgcctcagaagtcatccctagaggagcctgacttttataagactaaaattaagttatgcatcctcctgcatgccttccgcatcagggcagtgacgattgaccgcgtcatgagttacttgaacgcctcgtag

SEQ ID NO: 29126 - DNA, 720 bp, Artificial Sequence
  Description of Artificial Sequence: Synthetic coding sequence
atgtggccccctggttccgcttcccaaccacccccatctcctgcagccgctactggtctacaccccgctgcccgaccggtgagcttacagtgccggctgagcatgtgcccagccaggtctctcctactggtggccacactcgtgctgctggaccatttatccctggcgaggaacttaccagtggcaacacctgatcctggcatgtttccctgcctgcaccactcccagaacttgctaagagccgtttcgaatatgctgcagaaagccagacaaaccctcgagttttacccatgcacaagcgaggagatcgatcacgaagatatcaccaaggacaaaacttcaaccgtagaagcctgtctccctctggaacttaccaaaaacggctcctgcctcgcgagccgtaaaacttcctttatgatggccctatgcctcagtagtatttacgaggatcttaagatgtatcaggtggagttcaagactatgaacgctaaacttctcatggatccgaaaagacagattttccttgaccagaacatgctcgcagtgattgacgagctcatgcaggccttaaactttaactccgaaactgttccgcagaaatcctcactcgaggaaccagatttctataaaacaaaaattaagctttgcattctgctgcacgcatttcggatccgtgccgtgactatcgaccgagtgatgtcctacctcaacgcctcatag

SEQ ID NO: 29127 - DNA, 648 bp, Artificial Sequence
  Description of Artificial Sequence: Synthetic coding sequence
atgtggccacctggatccgccagccagccacctccttcacccgctgccgctactggcctccatccggcagccagaccagtgtccctgcagtgtcggctttcaatgtgtccagccagaagtctgctcctcgtcgctacgctcgtcctgctcgatcatctgtccttggcacggaatttgccagtggctacacctgatcctgggatgttcccatgtctgcatcacagccagaacctgttgcgagctgtttccaacatgttgcagaaaaatgaatcatgcctcaactcacgagaaacgagcttcataacaaacggaagttgcctggcgtcaaggaagacatctttcatgatggccttgtgcctgtctagtatttacgaggacctgaaaatgtaccaggtggaattcaaaacaatgaacgcaaagttactgatggaccctaagagacagatcttcctcgaccagaacatgcttgcagtgatcgatgagttaatgcaggctctgaatttcaattctgagaccgtgccccaaaaatcatccctggaggagcctgacttttataagaccaagatcaaactttgtatattgcttcacgcattccggatccgcgcagtgaccattgatcgcgtgatgtcttacctgaatgcctcatag

SEQ ID NO: 29128 - DNA, 489 bp, Artificial Sequence
  Description of Artificial Sequence: Synthetic coding sequence
atgcgtatctcaaagcctcaccttagatctataagcattcagtgctacctatgtctcctgctgaatagccatttcctgactgaggctggcatccacgtttttatactgggctgtttctctgccggactgcccaagaccgaggcgaactgggtgaacgtcatctctgacctcaaaaagatcgaagacctcattcagagtatgcatatcgatgcaaccttgtacacagagagtgacgtacacccaagttgtaaagtgaccgccatgaaatgcttcctcctcgagttacaggtcatatctctagagtcaggggacgccagtatccacgatactgtggagaatctcattatccttgccaataactccttgagttcgaacggtaatgtgactgagagtgggtgcaaggaatgtgaggagctggaggagaagaatattaaggagtttctgcaatcgttcgtccatatcgtgcagatgttcatcaataccagctag

SEQ ID NO: 29129 - DNA, 489 bp, Artificial Sequence
  Description of Artificial Sequence: Synthetic coding sequence
atgagaatctcgaagccccacttgcggagcatctcaatccaatgttatctgtgcctgcttctcaatagtcattttttgaccgaggccggaattcatgtctttatactggggtgcttcagtgcaggactgcccaaaacagaagccaattgggtcaatgttattagtgatctgaaaaaaatcgaagacctgatccaatctatgcacatcgatgcaactctgtatacggagtcagatgttcacccatcgtgcaaagttacagctatgaaatgctttctcttggagctgcaggtaatcagcctggaatctggggacgccagcatccacgacaccgtggagaacctgattattctggccaacaacagcctctcctcaaacggaaatgtcaccgagagcggttgcaaggagtgcgaagagcttgaggaaaagaacatcaaagaatttctccagagctttgtccacatcgtccagatgttcattaacacatcctag

SEQ ID NO: 29130 - DNA, 408 bp, Artificial Sequence
  Description of Artificial Sequence: Synthetic coding sequence
atggtgctcggcaccatcgacctgtgtagctgcttttctgccggactgcccaaaactgaagcaaattgggtaaatgtgattagtgacctcaaaaaaattgaagacctgatacagagtatgcacattgacgcaactctgtacactgaatccgacgtgcatcctagctgtaaagtcaccgccatgaagtgctttttgctggagctccaggtcatttccctggaaagtggagacgcttccattcacgacacggtcgaaaacctcatcatattggctaacaatagtctgtcaagtaacggaaacgtgacagaatctgggtgcaaggaatgtgaggagcttgaagagaagaacattaaagagttcctgcagtctttcgtgcatattgtgcagatgtttatcaatacatcatag

SEQ ID NO: 29131 - DNA, 408 bp, Artificial Sequence
  Description of Artificial Sequence: Synthetic coding sequence
atggttctggggactatagatctgtgctcttgcttctccgccggtctccccaagacggaggccaattgggttaacgtaatctctgacctcaaaaagatagaggatctgatacagtctatgcatatagatgcaactctgtatactgaaagtgacgtccaccctagctgcaaagttaccgctatgaagtgctttcttctggaactccaggtgatctccctggaatcaggcgacgctagcatccatgacactgtagagaatctgatcatattggccaataattcattgtcatctaacggcaacgtgacggagtccggctgtaaagaatgcgaggaactggaggagaaaaacataaaggagttcctccagtcttttgtgcacattgtccagatgtttatcaacacatcgtag

SEQ ID NO: 29132 - DNA, 408 bp, Artificial Sequence
  Description of Artificial Sequence: Synthetic coding sequence
atggtgttgggaacgatcgatctgtgctcttgtttctcagctggtctgccgaaaactgaagcaaattgggtaaacgtgatctccgacttgaaaaagattgaagaccttatccagagcatgcatatcgatgccacattgtacacggagtccgatgtgcaccctagttgcaaagtaacagccatgaagtgttttctcctagaactgcaagtgatctctctggaaagcggggatgcttccattcacgatacagtggagaatctgatcatcctggcaaataactctctgtcaagtaatggcaatgtgaccgaaagcgggtgcaaagaatgcgaggagctggaagagaaaaatattaaggagttccttcagtccttcgttcatattgtgcagatgtttatcaacaccagttag

SEQ ID NO: 29133 - DNA, 489 bp, Artificial Sequence
  Description of Artificial Sequence: Synthetic coding sequence
atgcgcatctctaagccacacctgcgcagtatatcgattcagtgttacttatgcctccttctcaacagccactttctcaccgaagcaggtatccacgtgttcattcttggctgctttagtgccggattgcctaagactgaggcaaactgggtgaatgttatctcagatctcaaaaagattgaagatctgattcagtccatgcacatcgacgctactctgtacaccgaatcggatgtgcaccccagctgcaaggtgacagccatgaagtgcttcctcctggagctgcaggtgattagtctcgagagtggcgatgcctcaattcacgatacagtggagaacctgatcatcctggccaacaacagcctttccagtaacggaaacgttacagaaagtggctgcaaggaatgtgaggagttagaagagaagaacatcaaggaattcctgcagtcatttgttcacattgtgcagatgtttattaacacttcttag

SEQ ID NO: 29134 - DNA, 582 bp, Artificial Sequence
  Description of Artificial Sequence: Synthetic coding sequence
atggcagccgagcctgtggaagacaattgcatcaattttgtagccatgaagttcattgacaacacgttatatttcatcgccgaagacgatgagaacctcgagtctgactatttcggcaaattggagtccaaactttcagttataaggaacctgaatgaccaagttctgtttatcgaccaggggaatagacccttgtttgaagacatgacggattctgactgcagggacaatgccccaaggactattttcattatctcgatgtacaaggattcccaaccccgagggatggccgtgacgatttctgttaaatgtgagaagattagtactctctcatgtgaaaacaaaattattagttttaaagaaatgaacccccctgacaatatcaaggatacaaaatctgacattattttctttcagagatccgtgccgggacacgataacaagatgcagtttgaatcaagcagctacgagggctacttcctggcctgcgagaaagagcgtgacctctttaagctgattctgaaaaaggaggatgaattgggcgatagatccataatgtttaccgtgcagaatgaagactag

SEQ ID NO: 29135 - DNA, 570 bp, Artificial Sequence
  Description of Artificial Sequence: Synthetic coding sequence
atggctgcggaacccgtagaagacaattgtattaacttcgtggctatgaaatttatagacaacaccctgtatttcatcgagaatttggagtccgactacttcggcaaattggagagcaagctgtctgtgattcggaacctcaacgatcaggtgctttttatcgatcagggtaatcgtcctctctttgaggatatgacagatagcgactgcagagacaacgctccacgcacgatttttatcatttctatgtataaagattcacaacctagaggaatggcagtgactataagtgtgaaatgtgaaaagataagtaccttgtcatgcgaaaataaaatcatctcatttaaggaaatgaaccccccagacaacatcaaggacactaaaagtgatattatcttttttcagaggtccgtgccaggtcacgataacaagatgcagtttgagtcctcttcttacgagggctatttcctggcttgtgaaaaagaaagagatttgtttaaactaattctaaaaaaggaggacgaacttggagacagaagcatcatgttcaccgttcagaacgaggattag

SEQ ID NO: 29136 - DNA, 582 bp, Artificial Sequence
  Description of Artificial Sequence: Synthetic coding sequence
atggcagccgaaccggtagaagacaattgcattaattttgtggcaatgaagttcattgacaacacactatattttattgcagaagatgacgagaatctggagtccgactatttcggtaaactggaaagcaaactatcagtcatccggaacttgaatgatcaggtcctgtttatagaccagggcaatcgacctttgttcgaggacatgaccgacagcgattgtagagacaacgcaccacgcaccatcttcataatctcgatgtataaagactcccagccccgaggtatggccgtcacaatctctgtcaagtgtgaaaagatatctacattgagttgcgagaataagatcattagcttcaaagagatgaatcctcctgataatataaaagataccaaatccgacatcattttttttcagaggtccgtgcctggccacgataacaagatgcaatttgaatcctcctcttacgaggggtacttcctcgcttgcgagaaggagcgtgacttattcaaactgattcttaaaaaggaagacgaactgggggacaggtcaatcatgtttacagtccagaacgaggactag

SEQ ID NO: 29137 - DNA, 1782 bp, Artificial Sequence
  Description of Artificial Sequence: Synthetic coding sequence
atggagacccctccactcccacctgcgtgtaccaaacagggacaccagaaacccctcgacagcaaggatgacaatacggagaagcattgccccgttaccgttaacccatggcatatgaaaaaggcgtttaaagtgatgaacgagttacgatcacagaatctcttgtgcgatgtgacgattgtggctgaggacatggaaatcagcgcccatcgcgtcgtcctagctgcttgctcaccttacttccacgccatgtttaccggcgagatgtcagaaagtcgcgcaaaaagggtccgcattaaggaggttgacggttggactctccggatgctcatcgactatgtgtacactgccgagatccaagtaaccgaggagaatgttcaggtccttcttcccgctgccggactcttacaactgcaggatgtaaagaaaacatgctgcgagttccttgagtcccaactgcacccagtgaactgtctgggaatacgtgccttcgccgacatgcatgcttgtactgacctgctgaataaagccaacacctacgccgagcagcatttcgccgatgtcgtgctgtcggaggagttcctgaatctcgggattgaacaggtgtgtagcctgatttccagtgataagctgacaattagctcggaggaaaaagttttcgaggctgttattgcttgggtcaatcatgacaaagacgttcgccaggaatttatggctagactcatggagcatgtccgcctacccctgctgcccagagagtacttagtgcagagggtagaggaagaggctctcgtgaagaacagcagtgcctgtaaagattacctgatcgaagctatgaagtaccacctgttaccaacagagcagaggatcttgatgaagtcggtgagaacacggttgagaacacctatgaatttgcctaaactaatggtggttgtgggcggtcaggctcccaaggctatccgtagcgtggaatgctatgattttaaggaagagcgctggcatcaggtcgctgagctgccgtcacggaggtgtagagccggtatggtgtacatggctggtctggtgttcgcggtggggggtttcaacgggagtttgcgagtgcgaactgttgacagctacgatccagtgaaagaccagtggacatccgtggccaacatgagagaccggaggagcaccctcggtgccgcagtcctaaatgggctgctgtatgcggtagggggattcgatggcagcaccggactgtcctccgtggaggcctacaacatcaagagcaatgagtggtttcacgtggctccaatgaacactagacgatccagtgttggggtgggcgtggtgggcggactgctgtacgcagtcgggggatacgacggagcttctaggcagtgtctatcaacagtagagtgttacaatgccaccactaatgagtggacctacattgcagagatgtccactcgcagaagcggcgcaggagtgggggtacttaacaatctgctgtacgctgtgggcggacatgatggccctttagttcgcaagtccgttgaagtgtatgatccgactactaatgcctggagacaggttgccgatatgaatatgtgcaggaggaatgctggggtctgcgccgtcaatggcctactgtacgtggtgggaggcgatgacgggtcttgtaatctggcaagcgtggagtactataatcctaccacagacaagtggactgtggtgagctcgtgcatgtccacaggcagatcctacgcgggagtgacggttatcgacaagcccttatag

SEQ ID NO: 29138 - DNA, 1131 bp, Artificial Sequence
  Description of Artificial Sequence: Synthetic coding sequence
atgaaagagaatgtcgctagtgccactgtttttacgctgctgctgtttttaaacacttgtctcctcaatggtcagcttcctccgggaaagccagagatttttaagtgtcgctcccctaacaaggaaaccttcacatgttggtggagaccaggcaccgacggagggttacctactaactacagcctcacataccaccgggagggagagacactgatgcacgaatgtcctgactacatcaccgggggacccaatagttgtcacttcggcaagcagtacaccagtatgtggagaacttacatcatgatggttaacgctacaaaccagatggggtccagcttctctgatgagctctacgtggacgtgacctacattgtccagccagaccctccccttgagctggcagtggaagtgaagcagccagaagacaggaagccctacctatggatcaagtggagtccacctacgctgatcgatttaaagaccggatggtttactctgctatatgagattcgactcaagccagagaaagcagccgaatgggaaatacatttcgcagggcagcagaccgagttcaaaatattgagcctccatcctggccagaaatatcttgtccaggtgcgatgcaaacccgaccatgggtactggagcgcgtggtctcccgcaacatttattcagattccgtccgactttacaatgaacgacacgacagtgtggatctctgttgcggttctcagcgcagtcatctgcctgataatagtctgggctgtcgccctcaagggctatagtatggtgacttgtatctttcctccagtaccgggtccaaagatcaagggctttgacgcccacctgcttgagaagggaaagtccgaggaactgctctctgcactcggctgccaagatttcccacccacatcagattatgaggatcttctggtggaatatctggaggtggatgattctgaggaccaacaccttatgtccgtgcattccaaggagcacccaagtcagggcgatcccctgatgcttggagcttctcattacaagaacctgaaaagctacaggccgaggaagattagtagtcaaggccgtctggctgtttttaccaaggctacactcacaacagtccagtag

SEQ ID NO: 29139 - DNA, 414 bp, Artificial Sequence
  Description of Artificial Sequence: Synthetic coding sequence
atgggcctgacgagccagctcctaccaccccttttttttctgcttgcctgtgccggaaattttgtgcatgggcacaagtgtgacatcactctgcaggagattatcaaaactctgaactctctgacagaacagaagaatactaccgaaaaggaaacattttgtcgtgcagccacagtgctacgacagttctacagccaccacgagaaggacactcggtgcctgggcgctactgctcagcaattccataggcacaagcagctgatcaggtttctcaaaaggctggataggaacctgtggggtttagctggactgaattcatgccccgtcaaggaagccaaccagtcaaccttggaaaacttcctggagagattgaagacaatcatgagggagaagtactccaaatgttctagctag

SEQ ID NO: 29140 - DNA, 639 bp, Artificial Sequence
  Description of Artificial Sequence: Synthetic coding sequence
atgaatagtttttccacatcggcatttggacctgtggccttcagcctgggcctgctccttgtcctccctgccgcattccccgctcccgtgcctccaggggaggactctaaagatgtggcggctccccataggcagcccctgacatcatccgagcgcatcgacaagcagatccggtacatcctggatgggatatctgcattgcgaaaggagacatgtaataagagcaacatgtgtgaatcatccaaagaggctctggccgagaacaatctgaacctccctaaaatggccgaaaaggacggttgttttcagtcaggctttaatgaagaaacctgcttagtgaagataatcaccggactgctggaatttgaagtttatctggagtacctgcagaatcggtttgaaagctctgaggaacaggcgagagctgtgcagatgagtaccaaggttcttatacagttcctgcagaaaaaagcgaaaaatttagacgcgattaccacacccgaccccacgaccaatgccagcctgttgacaaaactccaggcccagaaccagtggctccaggacatgacaacgcacctgatactccggagctttaaagaatttcttcaatcgtcactccgggcacttcgacaaatgtag

SEQ ID NO: 29141 - DNA, 369 bp, Artificial Sequence
  Description of Artificial Sequence: Synthetic coding sequence
atgtgtgaatcctctaaggaggcactggccgaaaataacctgaatctccccaagatggctgaaaaagacgggtgctttcagtccggttttaatgaagagacttgtctggtaaaaataattacgggcttgctcgaattcgaggtatatctggaatacctgcaaaaccggtttgaaagtagcgaggagcaggccagagctgtacagatgtccactaaggtcctgatccaattcctccagaagaaggtgggtgtaagtagcttcccccagttaggggttggtgaggacagattaaaggattccgtacttgacaatagcgggatgcagtgtcattttcagaagaggaggctgcatgttaataagcgtgtatag

SEQ ID NO: 29142 - DNA, 639 bp, Artificial Sequence
  Description of Artificial Sequence: Synthetic coding sequence
atgaatagcttctccaccagcgcttttggtcctgtggccttttcactcggcctgctgttggttttgccggcagcctttcccgctccagtgcctcctggagaagacagcaaggacgtggccgcacctcataggcaaccgttaacgagttcggagcggatagacaaacagatacgttatatactcgatggcatttcggctctacggaaggagacctgcaacaaaagcaatatgtgcgaaagttcaaaggaagccctggcagaaaataacttgaatctccccaagatggccgaaaaagatggctgttttcaatcaggattcaacgaagagacctgcctggttaaaatcatcaccggtctgctagaatttgaggtttacctggagtacctacagaacagatttgagtcttccgaagagcaagccagggcggtgcagatgtccactaaggtgttaatccagtttttacagaagaaagcaaaaaacctggatgcaataactacccccgacccaacaacaaacgccagccttttaaccaagttacaggcccagaatcagtggctgcaggacatgacgacacacctgattttacgcagttttaaagagtttctgcagagttcgctgagggccctgcgccagatgtag

SEQ ID NO: 29143 - DNA, 597 bp, Artificial Sequence
  Description of Artificial Sequence: Synthetic coding sequence
atgaactccttctctacaagcgccttcggaccggtcgccttctctttaggattgctcctggtgttgcccgcagccttccctgctccagtcccaccaggcgaggacagcaaggacgtggcagccccacatagacagcccctcacttcatctgagcggatagacaagcagatccggtatatcctggatggaatttccgctcttcggaaggagacgtgtaacaaaagcaacatgtgtgaatcctcgaaagaggccctggccgagaacaatctgaacctgcccaaaatggcagaaaaggatggctgttttcaaagcggcttcaatgaagagacttgtttggtgaagatcatcaccggcctgctggagttcgaagtatatctcgagtatcttcagaacaggtttgagtcctccgaggaacaggcccgtgctgttcaaatgtctacaaaggtgctcatacaattcctacagaaaaaggtgggcgtgtcctccttcccccaactgggcgttggcgaagataggcttaaagactccgtcctggacaattccggcatgcaatgtcattttcagaagagacgcctccacgtcaacaaaagggtgtag

SEQ ID NO: 29144 - DNA, 759 bp, Artificial Sequence
  Description of Artificial Sequence: Synthetic coding sequence
atgaactccttctcaaccagcaagtgccgaaagtccctcgcactggaattgcctgctgcggtggaaccgtgtgtaagggagggatgtgtggcacaaggaggtctagccggtggtcagcagcagagacaggccccatcatgtgctgtcagtagtccactgcggagcctaccctcgggtactggggcttttggccctgtagccttttcccttgggctgttactcgtccttcctgccgcttttcctgctcctgtgcccccaggtgaggacagcaaggatgtagccgctccacatagacagccactgaccagcagtgagcgtatcgataagcagatccggtacattttggatggaatcagtgcccttcgcaaggagacatgcaacaaaagtaacatgtgtgaaagttccaaagaggcactagctgagaacaaccttaacctgcccaaaatggcagagaaggatggctgtttccagtccggcttcaatgaggagacctgtcttgttaagatcataacaggccttttggaatttgaagtgtaccttgagtatttacagaataggttcgagtcgagcgaggaacaggctcgggcagtgcagatgtcgacaaaggtgcttattcagtttttgcagaagaaagtgggcgtgtcttccttcccccagttgggggttggagaagaccgtcttaaagatagtgttctggacaactctgggatgcagtgtcacttccagaaaaggagactgcacgtgaacaagcgcgtatag

SEQ ID NO: 29145 - DNA, 459 bp, Artificial Sequence
  Description of Artificial Sequence: Synthetic coding sequence
atgaactcctttagcacctctgcttttgggccagtagccttttcccttgggctgctccttgtcctacccgcagcctttccagctccagtccctcccggtgaggacagtaaggacgtggccgctcctcataggcaacctctcacaagtagcgagaggattgataagcagattcgctatatcctcgatggtatcagtgccttgcgcaaggaaacctgtaataagagcaacatgtgcgagagttccaaagaagccctcgcagagaataaccttaaccttcccaagatggcagagaaagacggttgcttccaaagtggcttcaacgaagagacctgtctggtgaaaataattaccgggctgctggaattcgaggtgtacctggagtatctgcagaacaggtttgaatcatctgaggagcaggcacgcgctgtgcagatgtcaaccaaagttctaattcagtag

SEQ ID NO: 29146 - DNA, 300 bp, Artificial Sequence
  Description of Artificial Sequence: Synthetic coding sequence
atgacatccaagttggctgtggcactgttagctgccttcctcatttccgctgctctgtgtgagggtgctgtgttacctagaagtgccaaggaattacgatgtcagtgcattaaaacatacagcaagcctttccaccccaaattcatcaaagaactgcgagtgatagaatcaggtcctcactgcgcaaacaccgagattattgtgaagctgtccgatggcagggaactctgcctagatccaaaagaaaactgggttcagagggttgttgaaaaatttttgaagagagcggaaaactcttag

SEQ ID NO: 29147 - DNA, 2139 bp, Artificial Sequence
  Description of Artificial Sequence: Synthetic coding sequence
atggccggaggaccagggccaggcgaacccgcagccccaggggctcagcatttcttgtacgaggtcccaccttgggtaatgtgcagattttacaaggtaatggacgcattggaaccagctgactggtgccagttcgccgctctgatagtccgggatcagacggagctgcgactttgtgaaagatcaggacagaggacagcatctgttctctggccgtggataaaccgcaatgctcgggttgccgatctggtgcatatcttaactcacttacagttgctccgtgctcgcgacatcataaccgcctggcatcccccagcaccacttccaagtcctgggaccactgccccaagacctagctcgattcccgctcctgctgaagctgaagcctggagccccaggaagttgccatcttccgcaagtaccttcctgtctccagccttccctggtagccagacccattctggccctgagttaggactagttccaagccctgcatcgctatggccacctccaccgtccccagctcctagtagtactaaacccggtcctgaatctagcgtgtccctgttgcagggggctcgcccatttccattctgctggcccctatgcgagatatccagaggcacccacaatttttcagaggaacttaaaattggagagggcggtttcggctgcgtgtaccgcgctgtgatgcggaacacggtgtatgctgtgaagaggctgaaggagaacgcagaccttgaatggacggcggtcaagcagtcatttctgacagaagtcgagcaactgtccagatttcgacaccccaacattgtagactttgctggatattgtgcacaaaacggcttctactgccttgtgtacgggttcctgcctaacggcagcctagaggaccgcttgcactgtcagacgcaggcctgtcccccacttagctggccccagcgactggacatcctgctagggacagctcgcgctattcagttcctgcatcaggattcgcctagcttaatccatggagatatcaagtccagcaacgtcctgttggacgaacgcttaacacccaagctaggtgattttggcttggccagatttagcaggttcgccggaagttcaccatcgcagtcctctatggtggcaagaacccaaaccgtgagaggaactctcgcatacctcccagaagagtacatcaagaccgggcgactggccgtggatacagataccttttcttttggtgtcgtcgtgctggagaccctcgcgggacagcgcgctgtgaagacccacggtgccagaaccaagtacctaaaagacctagtggaagaagaagctgaggaggctggagtggccctgagaagcactcaatccacactgcaggcaggcttagccgctgacgcctgggctgccccaatagccatgcagatctacaagaaacacctcgaccccagacccggtccctgtccgccagaactgggactaggcctgggacagctcgcatgctgctgcttgcacagacgcgcaaagcggagaccgcctatgacccaagtgtacgaacgtctggagaagctccaggccgtggttgccggtgttcccggtcactcagaagcggcttcctgcatccccccaagccctcaggagaactcatacgtgagcagcacaggcagagctcattcaggggctgctccatggcagcctctagcggcaccttccggggctagtgctcaggctgctgaacaactgcagcgcggtcccaatcaaccagtggaaagtgacgaatcactgggaggactgtcggctgcactgcgcagttggcacctgacccctagctgtcccttggacccagcaccactgagagaagccggatgcccgcaaggggataccgcaggcgagtcctcatggggctccggccctgggtcccggccaaccgcagtagaggggttagccctgggatcctctgcgtcctccagctcagagccccctcagatcatcattaatcccgcacgccagaaaatggtgcaaaaactggcactgtacgaggacggcgctctagactccctgcaattgctgagctcaagcagcctacccggattgggcctggagcaagatcggcaggggcctgaggaaagtgacgaatttcagagctag

SEQ ID NO: 29148 - DNA, 2082 bp, Artificial Sequence
  Description of Artificial Sequence: Synthetic coding sequence
atggcaggagggccaggcccaggcgaacccgctgcccctggggcacagcacttcctctatgaggtccccccatgggtgatgtgcagattctacaaagttatggatgccctggagccagccgattggtgccagtttgggggatggcgcagggcagcaggcggaagggaggctcgtggtctgcttgccccaactccagacgccccacgtcctgcagcagcactcatcgtccgagaccagacggaacttaggctgtgcgagcggtccggacagcgcacagctagcgtactgtggccttggatcaaccgtaatgcccgagtcgccgacttggtccatatactgacccacctgcagcttctgcgcgctagggacatcattactgcgtggcatccccctgctccactgccctcgcccggtaccacagcacctaggccatcatcgatccctgcccctgccgaggcagaggcatggtcaccacgtaaactgccttcctccgcaagtactttcctcagcccagcctttcccggatcgcaaacccactcaggacctgagttagggctggttccatccccagcctctctgtggcctcctccccctagccctgcaccctcttctactaagccaggccctgaatcatctgttagccttctgcagggtgctaggccttttccattctgttggcccctgtgcgagatcagccggggaacacataacttcagcgaagagctcaagatcggcgaaggagggttcggctgcgtgtaccgagccgttatgcgcaatacagtgtatgccgtaaaaaggctgaaggaaaatgccgatttagaatggaccgccgttaagcaaagtttcctgactgaggtggaacaattgagtcggttccgccatcctaacattgtggactttgccggttattgcgcccagaatggcttttactgtctcgtgtacgggtttcttccaaatggtagcctcgaggacagactgcactgccagacccaagcgtgccctccgctgtcctggcctcagaggttagatattctgttaggaacagcccgagcaattcagttcctgcatcaggattcacctagcttaattcacggagacatcaagtctagcaacgtactgttggatgagaggttgacacctaaactgggggatttcggacttgcgagattttcccggtttgccggtagtagcccgagtcaatcttcaatggttgcgagaactcagactgtgcggggaaccctggcctacctgccagaggagtacatcaagactggacggctcgctgtggacaccgatacgttcagctttggagtggtcgttctggagactctggccggtcagcgcgcagtgaaaacccacggagcacgtacaaaatatctgaaggacctcgttgaggaggaggcggaggaagccggtgtggcactcagaagtacccagagtacactccaggccggtctggctgcggatgcttgggcagctcctatcgcgatgcagatctataaaaagcatctaggacaactggcctgttgctgcctgcacagacgtgctaagcggaggcctcccatgacccaggagaatagctatgttagttcgacggggcgtgcacactccggcgcagctccttggcagcccctcgcagcaccctcaggggcatctgcacaagcagccgagcagcttcaacgcggtccgaaccagcctgtcgagtctgacgagtcactcggcggactgtctgccgcactgaggtcctggcacctgacccctagttgccctttggaccccgctcctttgagagaggccggttgcccgcagggagatactgctggtgagagttcatgggggagtggaccagggagccgtcccaccgctgtcgaggggttggctctcggcagttcggcctcctccagttctgaaccaccacagatcatcatcaacccagccaggcagaagatggtgcagaagctagcactttatgaggacggcgctcttgactcactacagctgctgagttccagcagcttgccagggcttggactggagcaggaccgtcagggaccggaagagagcgacgagttccaatcctag

SEQ ID NO: 29149 - DNA, 2049 bp, Artificial Sequence
  Description of Artificial Sequence: Synthetic coding sequence
atggcgggagggccaggcccaggggagcccgctgcccctggggcacagcacttcctgtatgaagtgccaccttgggtcatgtgccgcttttacaaagtcatggatgccctcgagcctgctgattggtgccagttcgccgcactaattgttcgtgaccagaccgaactgcgcttgtgcgagcgcagcggacagagaacagcttccgtgctgtggccttggataaacaggaacgccagagtggccgatcttgtgcatatcctgacacacctacagttgctgagggccagggatatcatcaccgcctggcatccccctgcaccacttccttcccccggtactactgcaccacgtccgagttccattccagcccctgctgaggccgaggcatggtctccacggaagctgccctcatccgccagcacatttctgtctcccgcattccccggttctcagacacattccggacctgagcttggactagtgccctcgcctgctagcctatggcctcctccaccttctcctgcgccatccagtacaaagcctggccctgaatcctcggtgagtttactgcaaggtgccagaccctttccgttttgttggccactgtgcgaaatctcacgcggtacccataatttcagcgaggagctgaagattggtgagggcggttttggctgcgtttatagagccgtcatgcgcaacacggtgtacgcagtgaagaggctgaaagaaaacgccgacctcgaatggaccgcggtgaaacaaagcttccttacagaggtggaacaattatcccgctttaggcaccctaacatcgtggattttgccggatactgcgcgcagaatggcttctattgtctggtttatgggtttcttcctaacggcagtctcgaggatcgtttacactgtcagacgcaggcttgtcccccattgagctggcctcagcgcttagatatcctgctcggcaccgcaagagcaattcagttccttcaccaggacagcccgtcacttatccacggcgatatcaagtcgagcaatgtacttcttgacgagcggctgactcccaagttgggggactttggtctggccaggtttagccgctttgcagggtcgagcccgagccagagcagcatggtcgctcgtacccagacagtgagaggcacactggcttacttgcctgaagaatacattaagactgggagactcgcggttgacacggacaccttcagtttcggtgttgtggtactagagaccctggccggtcagagggccgtgaagacacacggagcgaggaccaaatatcttaaagaccttgtcgaagaggaagccgaagaagccggagtggcacttagaagcacccaaagcaccttacaagcgggactggcagctgatgcatgggcagcacccatcgctatgcagatttacaagaagcatctcgacccccgacccggaccctgtccacccgagctcggcctgggcttgggccaacttgcatgttgttgcctacacaggcgtgccaaaaggcgtccaccaatgacacaagaaaactcgtacgtatcttccacggggagggcccactcaggtgccgctccatggcaacccttagctgcgccatcaggtgcttcagcccaggccgcagagcaactgcagagggggcctaaccagcctgtggagagtgacgaaagtctcggaggcttgagcgcggcactccgctcatggcatctgaccccctcatgtcccctggaccccgctcctttacgcgaggcaggctgcccacagggcgatacagccggagaaagctcttggggtagcggccctggctcccgtccgacagcagtggagggcctggcactagggagttccgcctcctctagcagcgagcccccacagatcataataaaccccgctcgccagaagatggtccagaagttggcactgtatgaggacggcgctctggattcactgcagctcttaagttcctccagcctgccaggcctcggacttgagcaagatcggcaggggccagaggagtccgatgagtttcagagttag

SEQ ID NO: 29150 - DNA, 2127 bp, Artificial Sequence
  Description of Artificial Sequence: Synthetic coding sequence
atggctggtggccctggacccggagaaccggcagcccctggcgctcagcactttttgtacgaagtgcccccttgggtcatgtgccgcttctataaagtaatggacgctttggaacctgccgactggtgccaattcggcggttggaggagagctgccggaggccgagaggccagaggactcctggcgcctacccccgatgctcctcggccagctgctgccctcattgttcgagatcaaacggaacttagactgtgcgagcgctcaggacagcgcaccgcttcagtgttgtggccctggattaaccgaaatgctcgggtggcagacctggtccacatcctcacacatctgcagcttctgcgggcacgagacataataacagcatggcaccctccagcccctttgccttcaccaggtaccacggcccctagaccaagttccatccctgctccagcggaagcagaagcttggtccccacggaagttgccaagttcagcttcaaccttcctcagccctgcctttccaggcagtcagacccactccggtccagaactgggcctcgtgcccagcccggctagcctgtggcccccacctccttcccctgcaccgtctagcaccaagccgggacccgagtcttcggtgagtctgttgcagggtgccagaccatttcctttttgctggcctctgtgtgaaattagccggggaacacacaattttagcgaggaactgaagattggtgaggggggattcggatgcgtgtacagagccgttatgagaaacacagtgtacgcggtgaagaggctcaaagaaaacgcagaccttgaatggacagcggtaaagcaaagttttctgaccgaagttgaacagctgtctcgtttcagacatcctaacatagtggacttcgccggttattgtgcccagaacgggttttactgtctcgtctatggcttcctccctaatggatcactggaggaccgcttacactgccagactcaagcttgtcccccactgtcctggccgcagagactagacattctgctcgggacagctcgtgctatccagttccttcaccaggattccccatccctcatccacggcgacattaagagtagtaacgtgctgctagatgaaagactgactccgaaactgggtgattttggtcttgctagattttcaaggtttgcgggatccagtccctcccagtccagtatggtcgctcgcacccagaccgtgcggggaaccctggcctacctgccggaggagtacattaagacgggcagactagctgtggataccgacaccttcagctttggcgtggtcgtgctggaaacactggccggtcagcgagccgtgaagacccatggggctcgcactaagtatttaaaagacttggttgaagaggaagctgaggaggccggagtcgccctcaggagcacccagtccacattgcaagcgggacttgcagccgacgcatgggcggctcccatcgccatgcagatctataaaaagcatttggaccctagacctggaccctgcccgcctgagctcgggctggggctgggacagttagcttgttgttgccttcatcgaagggcaaagagacggcctcccatgacacaggagaactcatacgtcagctcaaccggcagggcccactcaggcgctgctccatggcaaccgctagctgcccctagcggcgcaagcgcgcaagcagctgaacaacttcagcgcggtcccaatcagcccgtggaatctgacgagtctttaggtggactaagcgcggctctcaggtcatggcacttgaccccgtcctgcccgctggatcccgcacctctccgggaagccggatgccctcaaggggacacagccggagagtcctcatggggatctgggccaggttcacgacctaccgcagtggagggtctggcactaggctcttctgcatctagcagctccgagccccctcagattattattaatcctgccagacagaaaatggtgcaaaagctggcgctgtacgaagatggagctctggactccctgcagctgctgagtagtagctctctcccaggactgggattggagcaggaccgacaggggcctgaagagagcgacgaattccaatcttag

SEQ ID NO: 29151 - DNA, 1902 bp, Artificial Sequence
  Description of Artificial Sequence: Synthetic coding sequence
atggccggtggccctgggccaggcgagcccgctgcccctggggctcagcacttcctctacgaggtaccaccttgggtaatgtgtaggttttacaaagtgatggacgccctcgaacccgcagactggtgccaatttgctgccctgattgtacgggatcagacagagctccgcctgtgcgaacgaagcgggcagcggacagctagcgtactttggccctggatcaatagaaatgctcgcgtagctgacctggtccatatcttaacacatctgcagctcctgcgcgcaagggacattatcacagcatggcatccccctgcaccccttcctagtcccggaacgaccgcacccagaccatcaagcattcctgcacctgccgaggccgaggcctggtcgccacgcaaactgccctcatcagcctcaaccttcctgagtccagcatttccgggtagtcagacccacagcggcccagagctgggcctcgtgccctcgcccgctagtctgtggcctccaccaccatcccccgcaccgagttcaacaaagcccggacctgaatcctccgtttcactcctgcagggcgctaggccttttcctttttgttggcctctgtgcgagatctcccgagggacccataatttcagcgaggagctcaaaatcggagagggcggttttgggtgcgtttatcgggcagtgatgaggaatactgtttacgccgtgaaaagactgaaggagaacgccgatctagaatggacagcggtgaagcagtctttcctgactgaagtggaacagctcagtcgcttccggcaccctaacatcgttgattttgcaggctactgtgcccagaacggattctattgtttggtctacggttttctgcctaacggaagccttgaagataggttgcattgtcagacccaggcatgcccccctcttagttggcctcagcggctggatatcttactgggtacagcccgagccatccagtttctacaccaggattcaccaagtttgattcatggcgacatcaagtcctccaacgttctgttggacgagcgtctgactccaaaattaggggattttggccttgccagattttcacggtttgcgggaagtagtccgtcccagtcctcaatggtcgccagaactcaaacagttaggggaacgctggcatacctgccagaagaatacattaagactgggaggctggccgtggatacagacacattttccttcggcgtggtggtgctcgagacccttgcgggacaacgagctgtgaagactcacggagcgagaacgaagtacctcgtatatgaacggctcgagaagttgcaagctgtcgtcgcgggagtcccaggccactctgaggcagcctcatgtattccgcctagccctcaagaaaattcatatgtgagctccaccggcagagcacactccggagccgctccttggcagccgcttgcggctccttctggtgcctctgcccaggccgctgagcagctgcagcgcggacccaatcagccagttgaatcagatgagtccctgggcggactgtccgcagcgctgcgctcctggcacctgacaccctcgtgccctctggatcccgctcctctgcgtgaggccggttgtccacagggggacacagccggagaaagttcatggggctccggacctggcagtcgaccaaccgccgtcgaaggcctggccttgggctcaagcgcgtcttcttcttccgaaccaccacagattatcatcaacccagccaggcaaaaaatggtccagaagctagctctgtatgaggacggcgctctcgactctcttcagctgctgagctcgagctcactcccaggtttggggttggagcaggatcgccaaggcccagaggagtcagatgagtttcagtcatag

SEQ ID NO: 29152 - DNA, 1245 bp, Artificial Sequence
  Description of Artificial Sequence: Synthetic coding sequence
atgagcaaaaagattagcggcggatctgttgtagagatgcagggggatgagatgacccggataatctgggagctgataaaagagaagcttatcttcccatatgttgaactcgacctacactcttacgatctgggcatcgaaaacagggacgctacaaatgatcaggtgacaaaggacgctgctgaggcgattaagaaacataacgttggcgtgaaatgcgctacaattacccccgatgagaaacgggttgaagagttcaagctgaagcagatgtggaagagcccgaatggtaccatacggaacatcttagggggaacagtgttcagagaagccatcatttgcaaaaacataccaaggttggtgtcaggctgggtgaagccaatcattataggcaggcacgcatacggcgatcaatacagggcaaccgattttgtcgtccccggacctgggaaagttgagattacatatactccaagcgacggtacccagaaggtcacttacctggtccacaatttcgaagaaggagggggagtcgctatgggcatgtacaaccaagacaaaagtattgaagacttcgcccactcttccttccagatggccctgtcaaaaggatggcctctttatctcagcaccaagaacacaatactgaagaagtacgatggcagatttaaagatatatttcaggagatctatgataagcagtataaaagccaatttgaggcccagaagatctggtatgaacacaggttaatcgacgacatggtggcccaggctatgaagagtgaaggcggtttcatttgggcttgtaagaattacgatggggacgtgcagtccgactctgtcgcccagggttacgggtccctgggaatgatgaccagcgttttagtgtgtccggacggaaaaactgtcgaagccgaagccgcacacggaactgttactcgccactacagaatgtatcaaaaggggcaggaaacctctaccaatcccattgcatcaatttttgcctggacccgtggacttgctcaccgcgctaagctggacaacaacaaagagctggctttcttcgctaatgccctggaggaggtttcaatcgaaaccatagaagctggatttatgaccaaagatttggctgcctgcattaaaggcctgcccaacgtgcaacggtctgactacctgaacacattcgagttcatggataaattaggagaaaacctcaagatcaaactggcccaagctaaattgtag

SEQ ID NO: 29153 - DNA, 474 bp, Artificial Sequence
  Description of Artificial Sequence: Synthetic coding sequence
atgagtaagaaaatcagcgggggtagcgtggttgaaatgcagggggacgagatgacgcgcattatctgggaacttatcaaggaaaagttgatctttccctatgtagaactggacctgcattcctacgacctcgggatcgaaaatcgcgacgcaacaaatgaccaggtgaccaaggacgcagccgaagcaattaaaaagcacaacgttggagtgaaatgcgcgacaattacacctgatgaaaagcgtgtcgaggagttcaagcttaagcagatgtggaaaagccctaatggtaccatcaggaacatactaggaggcaccgtgtttcgtgaagccattatctgtaagaacattcctagactggtctcaggctgggtcaagcccatcatcatcggtagacatgcgtatggcgatcagtacagggccactgacttcgttgttccaggccctggaaaggtggaaattacatacacttag

SEQ ID NO: 29154 - DNA, 1245 bp, Artificial Sequence
  Description of Artificial Sequence: Synthetic coding sequence
atgtcaaaaaagatcagcggaggcagcgtggttgagatgcagggtgacgagatgaccagaattatatgggagctcattaaagagaagctcatttttccctatgtggaattggacctgcatagttatgacctcggtatcgaaaacagagacgctactaatgaccaggtcacaaaggacgccgctgaggccatcaagaagcacaatgtgggtgtcaagtgcgcaacaatcacccctgacgagaagcgtgtggaggagtttaagctgaagcaaatgtggaagagtcccaacggcactattcgcaacatactgggaggcactgtgttcagggaggccattatctgcaagaacatcccccgtctcgttagtggctgggtcaaacccatcattattgggaggcatgcatacggtgatcagtaccgcgcaactgatttcgtagtgcccggaccaggcaaggtcgaaataacatatactccaagtgatggaacgcaaaaagtcacctacttagtccacaactttgaagagggcggaggggtcgcgatgggtatgtataatcaggataagagtattgaggattttgcccacagtagctttcagatggcactaagtaaagggtggccactctacctctctacaaagaacactatattgaaaaaatacgatggtcggtttaaagatatcttccaggagatctatgacaagcagtataaaagtcagtttgaagcccagaagatttggtacgagcacaggctgatcgacgacatggtcgcccaggccatgaagtcggaggggggtttcatctgggcctgcaaaaactatgatggtgacgtgcagtctgactccgtagctcagggctacgggtccctaggcatgatgacttcggttttagtgtgccccgacgggaaaacagtggaggccgaggctgcccatggcactgttaccaggcattaccggatgtatcagaaaggccaagaaacatctactaatcctattgctagcatcttcgcctggacccgcggacttgcccatcgggctaagcttgacaataacaaagaattagctttctttgcaaacgccttggaggaggtctctatcgagacgattgaggctggctttatgactaaggacctggccgcatgcatcaaaggactgcccaacgtgcagcgttctgactatctcaacacgtttgagttcatggacaaactgggagagaacctcaagatcaagctcgcgcaagcaaagttgtag

SEQ ID NO: 29155 - DNA, 225 bp, Artificial Sequence
  Description of Artificial Sequence: Synthetic coding sequence
atgtcgaaaaagatttctgggggatcagttgtcgagatgcagggcgacgagatgacacggatcatttgggagctcataaaggagaaactgatatttccatatgtggaactggatctgcacagttacgatctgggcatagagaaccgcgacgccacaaatgaccaagtgactaaagatgctgccgaggccatcaaaaaacataacgtgggcgtgaagtgtgcgtag

SEQ ID NO: 29156 - DNA, 1245 bp, Artificial Sequence
  Description of Artificial Sequence: Synthetic coding sequence
atgagcaagaaaatttctggcggtagcgtggtggagatgcagggtgatgagatgacaagaatcatatgggaacttatcaaggaaaagcttatctttccgtacgtggagctggatctgcatagctatgatctgggtatcgagaacagggacgccacaaacgatcaggtgacgaaggacgccgctgaggccatcaagaagcataatgtcggggtaaagtgcgccactattacgcccgatgaaaagcgtgttgaggagtttaaacttaagcagatgtggaaaagtcctaacggaactatcaggaacatcctcgggggtaccgtgttccgggaggcgatcatctgcaaaaacatcccaaggctggtcagtggctgggtcaaaccaatcatcatcggccgacacgcttacggggaccaatatcgggctacagacttcgtggtgcctggtcccggaaaggtggaaataacctacacgccctctgatggcacccagaaggtgacctacttggtccacaactttgaggaggggggaggggtcgccatggggatgtacaaccaggataaatcaatcgaagattttgcccactccagcttccagatggccttaagtaaaggctggcctctatacctaagtactaaaaacacaatattgaagaagtacgatggaagatttaaggacatcttccaagaaatttatgataaacagtacaaaagccagttcgaagcccaaaagatatggtatgaacatagactcatagatgatatggtagctcaggccatgaagtctgagggtggtttcatttgggcctgtaaaaattacgatggggacgtgcaaagcgactccgtcgcccagggatacgggtcactgggaatgatgacatcggtcttagtttgcccagacgggaagactgtggaggccgaggctgcgcacgggacagtcaccaggcactatcgaatgtaccagaagggccaagagacctccacaaatcccatcgcttcgattttcgcctggacaagaggcctggcccatagggcgaaactggacaacaacaaagaattagcattctttgcgaacgcactggaagaggtgtcgatcgagacgatcgaggccggattcatgaccaaggatctggcggcttgcattaaggggctacccaacgtccagaggagcgattatcttaacacgttcgagttcatggacaagctcggcgagaacttaaagatcaaactcgcgcaggccaaattgtag

SEQ ID NO: 29157 - DNA, 189 bp, Artificial Sequence
  Description of Artificial Sequence: Synthetic coding sequence
atgagcaaaaagattagcggcggttccgtcgtcgaaatgcagggggacgagatgaccaggataatctgggaactgatcaaagaaaaactaatattcccatacgtggagctggacctccattcttacgatctgggcattgagaatagggacgctacaaacgatcaggtaaccaaggatgctgccgagtag

SEQ ID NO: 29158 - DNA, 1359 bp, Artificial Sequence
  Description of Artificial Sequence: Synthetic coding sequence
atggccggttacctgcgcgtggtgagatctctttgtcgcgcaagcggttcccggccagcttgggcccctgcagccttaaccgccccaaccagtcaagaacagcccagacgccattacgctgacaaacggatcaaggtagctaagcccgtggtggagatggatggagatgaaatgacgcgaatcatttggcagtttataaaagaaaaactaattctgcctcacgtggatattcagcttaaatattttgacttaggactcccgaatcgcgaccagacagacgaccaggtaaccatagactccgccctcgctacacagaagtattctgtggctgtaaagtgtgccacaatcacccctgacgaggctcgtgtagaagaatttaagcttaagaagatgtggaaaagtccaaatgggaccatccggaatatactggggggtaccgtgttccgggaacctatcatatgtaagaatatacctaggctcgtccccggttggactaaacctatcacgatcgggagacatgcccacggcgaccagtataaagccacagatttcgtcgctgatcgggctggaacatttaagatggtgttcactcccaaggacggttccggggttaaggagtgggaggtctataattttcccgctggcggagtggggatgggaatgtataacacagacgaaagcatctctggctttgcacacagctgcttccagtacgcaattcagaaaaagtggcctctctacatgtccacaaagaatactattctcaaggcatacgatgggaggttcaaagatatctttcaggaaatctttgataaacactacaaaactgattttgacaaaaataaaatttggtatgagcaccggctaatcgatgacatggtggcccaggtgctcaagagctccggagggtttgtttgggcttgcaaaaattatgatggggatgtgcagtctgatatcctggctcaagggtttggatccttgggactgatgacgagcgtgctggtgtgtcctgacggcaagacaattgaggcagaggctgcccatggaacggtgaccagacactatagagaacatcagaagggcagaccaacctctacaaatcccattgcctcaatctttgcctggactcgcggtctggaacataggggaaaactggacggaaatcaagacctcattcggtttgctcagatgctagagaaagtctgtgttgagaccgtcgagtccggagcgatgactaaagaccttgccggatgcatccacgggctctcaaatgtgaagctcaacgaacattttctgaacactactgattttctggacacaattaaatcaaacctggacagagctctggggagacagtag

SEQ ID NO: 29159 - DNA, 969 bp, Artificial Sequence
  Description of Artificial Sequence: Synthetic coding sequence
atgtggaaatctccaaatggcacaatccgcaacatcttaggcggtaccgttttccgcgagcccatcatctgtaagaacatccccaggctcgtgccaggttggacgaaacctattacaattggaaggcacgctcatggcgatcagtacaaggcgaccgatttcgtagctgatcgcgcaggcacattcaagatggtgttcacaccaaaggacggctctggagtcaaagaatgggaggtctataacttcccagctggcggagtggggatgggaatgtataacaccgatgaatcaataagcgggttcgctcatagttgcttccagtacgctatccagaagaaatggcccctctacatgagcactaaaaataccattctaaaagcttatgatgggaggttcaaagacatattccaggaaattttcgataagcactataaaacagatttcgataagaacaaaatttggtatgagcatcggttgatcgacgatatggtggctcaagtcctcaaaagctcagggggttttgtgtgggcctgcaagaactatgacggcgatgtccaatccgacattctggcccaggggttcggcagcctggggctgatgacatctgtcctcgtttgtcctgacggcaagacaatagaggccgaagccgcacacggtactgtcactcggcactatcgcgagcatcagaagggtcggcctactagcaccaatccgattgccagcatcttcgcctggactagagggctggagcaccggggaaaacttgacggaaatcaggatctgattcgatttgcccagatgctggagaaagtttgcgtggaaactgtggagagtggcgctatgacaaaagacttagctggatgtatacacgggctctctaatgttaagttgaacgaacactttttgaatactaccgacttccttgacactattaaatctaatctcgaccgggcactcggcagacagtag

SEQ ID NO: 29160 - DNA, 1203 bp, Artificial Sequence
  Description of Artificial Sequence: Synthetic coding sequence
atggacggcgacgagatgacacgcattatatggcagtttattaaggagaagctcatcctccctcacgtcgatattcagctgaagtattttgatctgggtctgcctaacagggaccagactgacgatcaggtgaccattgactctgcattagccacccaaaaatatagtgttgctgtgaagtgcgccactatcacaccagacgaagcaagagtcgaggagtttaagttgaagaaaatgtggaagagcccaaatgggactatacggaatatactggggggaactgtgtttcgggagcctatcatttgcaagaatattccaagactggtgcccggatggaccaagccaattaccatcggccgacacgcgcatggggaccagtacaaggctactgacttcgtggccgaccgtgcaggcacttttaagatggtctttacccccaaggacggctctggcgtcaaggagtgggaagtttacaacttccctgctggtggcgtgggaatgggcatgtataataccgacgaatctatctcggggttcgcacattcgtgctttcagtacgctatccagaagaagtggccactatacatgagtacgaagaataccatacttaaagcctacgacggacgcttcaaagacatcttccaggaaattttcgacaaacactacaagacagacttcgataagaataagatttggtacgaacatcggctcatagacgatatggttgcccaggtgctcaagtcatcaggaggcttcgtctgggcttgtaagaactatgacggagacgtgcagagcgacatcctcgctcagggttttgggtctctcgggctcatgacatctgtgctcgtgtgcccagacgggaaaactatcgaagcagaagcagcccatggcactgtgaccaggcactaccgagagcatcagaagggcaggcctactagcacgaaccccatagcgagcatcttcgcttggacccggggtttggaacatagagggaagttggacggaaatcaggacctgattcggtttgcacagatgctggaaaaggtctgcgtggagacagtggagagtggcgctatgacaaaagatttggcgggatgcatacacggactgtctaacgtcaaacttaatgaacactttctcaatactacagactttctcgacacgataaaaagtaatcttgacagggcccttggacggcagtag

SEQ ID NO: 29161 - DNA, 3657 bp, Artificial Sequence
  Description of Artificial Sequence: Synthetic coding sequence
atgcgctccccacggacccgaggcagatccggacgacctctgtccctcttactagctttgttgtgtgctctccgggctaaggtgtgcggtgcctctggtcagttcgaacttgaaattctgagcatgcagaatgtgaacggtgagttgcaaaatggtaattgttgcggtggtgcacgtaatcccggtgatcgtaagtgcacccgcgatgaatgcgatacatactttaaggtctgtcttaaggaatatcagagccgggtgactgcagggggtccttgttcttttggttctggctctacgccggtgattggcggtaacacctttaatctgaaggcctcacggggaaatgatcgaaacaggatcgtgctcccattctccttcgcctggcctcgtagttacacactgttagtcgaagcatgggacagttctaatgacactgttcagccggactcaattattgagaaggccagccattccggcatgattaacccctctaggcagtggcaaacactgaaacagaacaccggcgtcgcgcactttgagtaccagataagggttacatgtgacgactattattacggattcggctgcaacaaattttgcaggccccgagatgacttcttcggacactatgcctgcgatcagaatgggaacaagacttgcatggagggctggatgggcccagagtgcaatagggctatctgccgccaggggtgctctccgaagcacgggagctgcaaactgcctggagactgcagatgtcaatatggctggcaaggtctctactgcgataaatgtatcccgcaccctgggtgcgtgcatggcatttgcaacgagccttggcaatgtctgtgtgaaactaattggggtggtcaactgtgcgacaaggatctcaattattgtggtactcatcagccgtgccttaacggaggtacctgttcaaatacaggccctgataagtaccagtgttcgtgccctgaaggctactctggacctaattgcgagattgcggagcatgcctgcctttcagacccatgccacaaccgaggttcatgtaaagagacctcactgggatttgagtgcgagtgctccccagggtggaccgggcctacctgcagtacgaacatagatgattgctcccctaataactgttcccatggaggcacatgtcaggacctggttaacggctttaagtgcgtgtgccctccccaatggacagggaaaacttgtcagttggatgccaatgagtgcgaggctaagccatgtgtgaacgctaaaagctgcaagaacttgatcgcctcatattattgcgattgcttgccagggtggatgggtcaaaactgtgacatcaatatcaacgactgtctcggacagtgccaaaacgatgcctcctgcagggacctggtcaacggataccgatgtatttgtccgccagggtacgctggcgaccactgcgagcgcgacatcgacgaatgtgcctccaacccctgcctgaatggcggacattgtcagaacgaaatcaacagattccaatgtctgtgtcccaccgggttctccggcaacttgtgccaacttgacatcgactactgtgagccaaatccctgccagaacggtgctcagtgctataacagggcttccgactatttttgtaagtgccccgaggattacgagggaaaaaactgcagccatctgaaagatcattgtcgaacaactccctgcgaggttattgattcctgcactgtggccatggctagcaatgacacccctgagggggtcaggtacatttcgtccaacgtgtgcggccctcatgggaagtgcaagagccagtccggcggaaaattcacttgcgattgtaataaaggatttaccggaacctattgccatgaaaacatcaacgattgcgagtccaacccctgcaggaacggaggcacctgcatcgacggcgtgaactcctataaatgcatatgttccgacggttgggagggggcttattgtgaaaccaatatcaacgactgctcacagaatccttgtcacaatggagggacatgtcgcgacctggtgaacgacttctattgcgactgtaaaaacggctggaagggaaagacgtgtcacagccgggattcccagtgcgacgaagctacgtgtaacaacggaggcacttgctacgatgagggcgacgcttttaagtgtatgtgtcctgggggttgggagggtactacttgtaacattgccagaaactctagttgcctgccaaacccgtgccacaatggtggaacttgcgtagttaacggtgagtcctttacttgcgtgtgtaaggaggggtgggagggtccaatttgtgctcagaacactaacgactgctctcctcatccatgctacaatagcgggacctgcgttgacggggataactggtacagatgcgaatgcgctcccggatttgctgggcctgactgccgaatcaacattaacgaatgccagtccagcccctgtgcattcggagcaacttgtgtggacgagattaatggctataggtgcgtatgccccccagggcacagtggagctaaatgtcaggaagtgtctggccgaccgtgcatcacaatgggcagtgttatccccgatggtgcaaaatgggacgacgactgtaatacatgtcagtgtctgaatgggaggattgcttgttcaaaagtctggtgtgggcctcgcccttgtctgctccataagggccactccgaatgccccagcggacagtcatgcatcccaatcctggatgaccagtgtttcgtgcacccatgcacgggagtaggcgaatgccggtcaagctcactccaacccgttaaaacgaaatgcacatcagattcatattatcaagacaactgtgcaaacatcacattcacatttaataaagagatgatgagtccaggcctgacaacggagcatatatgttctgagctgcgaaaccttaatatattaaagaacgtgtcagctgaatactctatttacattgcctgtgaaccatcgccatcagcgaacaatgagatccatgtggccatcagcgcggaagacattagggatgatgggaatcccatcaaagagatcacggataagatcattgatctggtttcgaaaagggacggtaatagttctcttattgctgccgtggctgaagttagggtccaacgtaggccactgaaaaaccggacagacttcttagtcccactgttgtcatcggtgctcaccgtcgcctggatctgctgcctcgtaactgccttttattggtgtttaaggaaaagacgaaaaccgggatcacatacccactctgcaagcgaagataatacaaccaataacgtcagggaacaactaaaccaaatcaaaaacccaattgaaaaacatggtgccaatactgtgcccatcaaggactacgagaataagaattctaagatgagcaagataaggacccacaactccgaggtggaagaggatgatatggacaagcaccagcagaaggctcgcttcgccaaacaaccagcttatacactcgttgaccgcgaggaaaagcctcccaatggaacgccaaccaagcatcccaattggacaaacaaacaggacaatagggacctagagagtgcccagtccctgaaccgcatggaatacattgtctag

SEQ ID NO: 29162 - DNA, 3180 bp, Artificial Sequence
  Description of Artificial Sequence: Synthetic coding sequence
atgattaacccaagcagacagtggcaaaccttgaagcagaacacaggtgtggcacacttcgaataccaaattagggttacttgcgacgactattattatggtttcgggtgcaacaagttctgcaggcctagggatgatttcttcggccactatgcatgcgatcagaacgggaacaaaacatgcatggaggggtggatggggccagagtgcaatagagctatttgtaggcaaggttgcagccccaagcacggctcgtgcaagctgccaggtgattgtcgttgccaatatggctggcagggactgtactgtgacaagtgtatcccacacccagggtgtgttcacggcatttgcaacgaaccatggcagtgtctgtgcgaaaccaattggggcggacaactctgtgataaggatctcaactattgtgggacacaccagccatgtctcaacggcggaacttgttctaacacgggacctgataagtaccagtgttcctgccctgaagggtatagcggcccaaactgtgagatagccgaacacgcgtgcctttcagacccatgtcacaatcgcggatcctgcaaagaaaccagcctcggattcgaatgcgagtgctccccgggttggacaggccctacgtgttctaccaacatcgatgactgctcccctaacaactgcagccacgggggaacctgccaggacctggtcaacggttttaaatgcgtgtgcccaccccagtggacgggcaaaacctgccagctggacgccaacgaatgtgaagccaagccctgcgtgaacgcgaagtcgtgcaaaaacctgatcgccagctactattgtgactgtctccccggttggatgggccagaattgcgatataaacatcaatgattgcctgggccagtgccagaacgatgcgtcttgcagggacctcgtgaacgggtaccgctgcatttgtcctcctggctatgccggagaccattgcgaaagggacatcgatgagtgtgcgagtaacccctgtctgaacggcggacattgtcagaacgagattaatcgcttccaatgtctttgccccaccggatttagtggcaatctctgccagctcgacattgactattgtgaaccgaacccatgccaaaatggcgcacaatgttacaatcgagccagtgactacttctgtaagtgtcctgaggactatgaaggaaaaaactgctcccacttgaaagatcattgtagaaccacaccttgcgaagtgattgactcctgcacagtggcaatggcctcgaatgacaccccagaaggagtgcgctacatctccagcaatgtctgtggtccccatgggaagtgcaagtcgcagtctggcggtaagttcacctgtgattgcaacaagggattcactggcacgtactgccatgagaatataaacgattgcgagtcaaacccttgcagaaacggcggaacgtgtatcgatggcgtgaactcctacaaatgtatttgcagtgacggctgggagggcgcatactgtgagaccaatatcaacgactgctctcagaacccttgtcacaacgggggaacctgccgtgacctcgtgaatgacttttactgtgattgtaagaacgggtggaaaggcaagacttgtcatagcagggactcccaatgcgacgaggccacttgcaataatggagggacctgctacgatgagggagacgcattcaagtgcatgtgtcctggaggatgggaaggaacaacgtgtaatatcgccagaaattccagctgccttcccaatccttgccataatggagggacctgcgtggttaacggagaatccttcacatgcgtctgcaaggagggctgggagggtccaatctgtgcccagaacacaaacgactgcagccctcacccttgctataattctggtacctgtgtggacggggacaattggtacaggtgcgaatgcgcacccggttttgcgggacccgactgtcgaatcaacataaatgaatgtcagagctctccatgtgcttttggagccacatgtgtggacgagattaacggttatcggtgcgtatgccccccagggcattccggcgctaaatgtcaagaagtcagtggcagaccatgtattaccatggggtctgtgatacccgacggcgctaaatgggatgatgactgcaatacatgtcagtgcctgaatggtcgcatcgcatgctcaaaggtttggtgtgggcctcgcccttgcctgttgcacaaaggacacagtgagtgcccatcagggcagtcctgtatccctatcttggacgatcagtgttttgtgcacccctgtactggggtaggagagtgtaggtcctcctctctccaaccggtgaagacaaagtgcacctcggacagctattaccaagataattgtgcaaacattacttttactttcaataaagagatgatgtcaccaggcctgacgacggaacacatttgctctgagctaagaaacttgaacattctgaaaaatgtgagcgctgaatactctatctacattgcctgcgagcctagcccaagcgctaataacgagattcatgtggccatctcagcggaagacatccgagatgacggtaatcccattaaggagatcaccgataagattatagatcttgtgtctaaacgagacgggaatagctctctgattgccgctgtggcagaggtaagggtccaaaggcggccactaaagaaccgcaccgattttctagtgcctttactgtccagcgtgctgaccgttgcatggatttgctgccttgtgacagccttttattggtgtctgcgcaaacgcaggaagccaggctcacacacccacagcgcttccgaagacaatacaaccaacaatgtgagagagcagcttaaccagatcaagaacccgatagaaaagcacggtgccaataccgtgcccatcaaggattacgaaaataaaaattctaaaatgagcaaaattcgcactcataactcagaggttgaagaggatgatatggataagcatcagcaaaaagcaaggttcgccaagcagccagcctataccctggtggacagggaggaaaaacctccaaacggaaccccgactaaacacccaaactggacaaacaagcaagataatcgggatctcgaatctgctcaatccctgaacagaatggaatatatcgtctag

SEQ ID NO: 29163 - DNA, 3399 bp, Artificial Sequence
  Description of Artificial Sequence: Synthetic coding sequence
atgggtatggcatgtctaactatgacagagatggagggtacatccacaagttcgatctaccaaaacggagatatctcggggaacgctaacagcatgaagcaaatcgatcccgttctgcaggtctatctttaccacagtctgggcaaaagcgaagccgattaccttacttttccatctggagagtatgtggccgaagaaatttgcatcgcagctagtaaggcgtgcggaatcactccagtctaccataacatgtttgccctgatgtctgagacggaaaggatctggtacccccctaaccatgtctttcatatcgatgagagcaccagacacaacgtcttgtatagaattcgcttctacttccccagatggtactgcagcggaagcaatcgggcttacaggcatggcatatcccgcggagctgaggctcccctgctcgatgattttgtcatgtcgtatcttttcgctcaatggagacacgacttcgtgcacggctggatcaaggtccctgtaacacatgagacacaggaagagtgcctcggcatggctgtgctggatatgatgcggatcgcaaaggagaacgatcaaacacctctcgcgatctataactccattagctataaaactttcttacccaaatgtatacgtgctaagatacaggactatcacattttgactcggaaaagaatcaggtatagattccgacggtttattcagcaattctcccaatgcaaagctacagcacgtaacctcaagttgaaatatttaataaatttggaaacactgcagagtgcattttatactgaaaagtttgaggttaaggagcctggttctggtccatctggcgaggaaattttcgcaactatcatcatcaccggcaacggaggaatccagtggagccggggtaagcacaaggagtctgagactcttacggagcaggatttgcagctttactgtgactttcctaacattattgatgtttctatcaaacaagcgaaccaggagggttccaatgaatcaagagttgtaactatacacaagcaagacggcaaaaatctggagatcgagctatctagtttgagggaagctctgtcatttgtgtcattgatagatggttactaccgactgaccgcagacgctcaccattatctttgtaaagaagtcgcccctccagccgttctagagaacattcaatctaactgtcacggccctatatccatggatttcgctatctctaaattgaaaaaggctgggaaccagacaggcctttatgtgctccggtgcagccctaaagacttcaataagtactttcttacttttgcagtggaacgcgaaaacgtcatagaatataaacactgtctcattaccaagaacgagaatgaggagtataatctttccggaacaaagaaaaatttttccagcttaaaagatctattaaattgttaccagatggaaactgtgaggagtgacaatatcattttccagtttaccaagtgttgtccccctaaaccaaaggacaagtctaatctgctggtgtttcggaccaatggcgtatcagacgtgcctacctccccgacactgcagcgccctacacatatgaatcagatggtgtttcataaaatcagaaatgaggatctgatctttaatgagagcttggggcagggaacttttacgaaaatatttaagggcgtgcggagagaagtaggcgattacggccagctccatgagactgaggtcctgctgaaggtcctcgacaaggcacataggaactacagtgagtcattctttgaggccgctagcatgatgtccaaactgtctcacaaacatctcgtgttaaattacggcgtgtgcgtgtgtggggacgaaaatatcctggtgcaggagtttgtgaagttcgggagtctggacacttatctgaaaaaaaacaagaactgcatcaacatactttggaaattagaggttgccaaacagctcgcctgggctatgcacttcctggaggagaacacccttatccatggtaatgtatgcgcaaagaatattctgctgatccgggaagaggataggaaaacgggcaatcccccattcatcaaactgtccgatcctggaatctccatcacggtcctccccaaagacatcctgcaagagaggatcccctgggttcctccagagtgtatagagaaccctaagaacctgaacttggcaaccgacaagtggtctttcggaacaacactatgggagatttgctctggtggcgataagccactcagcgctctcgactctcagcgcaagctccagttttatgaggacaggcatcagctgcctgcccctaagtgggctgaactcgcaaatctgatcaacaattgcatggattatgagcccgacttccgaccatcattccgcgctattataagagacctgaatagcctgttcacccccgactatgagttgttgactgagaacgacatgttgccaaatatgcgaatcggggctttagggttctcgggggcatttgaggaccgtgacccaacccagtttgaagagcgccacttgaagtttttgcagcaactgggaaaggggaactttggctctgtggaaatgtgtcgttatgaccctttgcaggataataccggcgaggtagtggctgttaaaaaattgcagcacagcaccgaagagcacctccgggattttgaacgagaaatcgagatcctcaaatcattgcagcatgataacatcgtgaagtacaaaggcgtctgctactccgccggaagacgaaacctcaaactgatcatggaatatctcccgtatggctctcttcgggattacttgcagaagcacaaggaacgtatcgaccatattaaattgctgcagtacacaagccagatatgtaaaggtatggagtacctcggcaccaaacggtacatccaccgcgacctggccaccagaaacatcctcgttgaaaacgagaatcgggtcaagattggcgattttggcctgaccaaagtcctcccgcaggacaaagaatattacaaagtcaaagagccgggtgagagccccatcttctggtatgctcctgagtcccttaccgagtctaaattttccgttgccagtgacgtgtggtcgtttggggtggtcctgtatgagctgttcacctacatcgagaaatctaagtccccacctgctgaattcatgcggatgattggcaacgataagcagggccaaatgattgtgttccatcttatcgaattgttgaaaaacaacggcagattaccacgacccgatggttgtcccgacgagatctacatgattatgaccgagtgttggaataacaatgtgaaccagaggccatcatttagagacctggcccttcgggtggaccagatcagggacaacatggcgggatag

SEQ ID NO: 29164 - DNA, 3399 bp, Artificial Sequence
  Description of Artificial Sequence: Synthetic coding sequence
atgggcatggcttgtctgaccatgacggagatggagggcacctccacctcttctatttatcagaacggtgacatctcggggaatgccaacagtatgaagcagatcgatcccgttctgcaggtgtacctgtatcatagccttggaaaaagtgaagctgactacctgacgttccccagcggtgagtacgtcgctgaggagatttgcatcgcggctagtaaagcatgtgggattactcctgtttaccacaacatgttcgccttgatgagtgagactgagcgaatttggtatccacctaaccacgttttccacatcgacgagagcacgagacataacgtgctctacaggataagattttactttccgaggtggtattgctctggctccaatcgggcatataggcacgggatttcacgaggagcagaagcacctctgctggacgattttgtcatgtcctacctgttcgcccaatggaggcatgactttgtgcacggctggattaaggtcccagttacacacgaaactcaggaagagtgtctggggatggcggtgttagacatgatgaggatcgcgaaggagaacgatcagacccccttagccatctataactcaatatcgtataagacttttctgccgaagtgcattcgcgcaaagattcaggactaccatatcctcacacggaaacgcatccgctacaggttccggagattcattcaacagttttcccagtgcaaggcgacagccaggaatctcaaattgaaatacctgattaatctggagacacttcaaagcgccttttataccgaaaagtttgaggtgaaagaacctgggtctggcccaagcggcgaagagatttttgccacaataattatcacaggcaatgggggtattcaatggagccgcggaaagcacaaggagagcgagactctgacagagcaggacttgcagctgtactgcgattttccgaacataattgacgtgtcaattaaacaggcaaatcaggaagggagtaacgagtctcgagtggtcacgatccataagcaggacggcaagaacctagagatagagctatcatccttgcgggaggccctgagcttcgtttcccttattgatggttattaccgactgacggctgatgcccatcactacctgtgtaaagaggtggcgccaccggcagtgttagaaaacattcaatctaattgccacggaccaattagcatggactttgccatatcaaagctgaagaaggcgggtaaccagacaggtttgtacgttctgcgctgctccccaaaagatttcaataagtatttcctcacgtttgccgtggaaagagaaaatgtaattgaatacaagcactgcctaatcactaaaaacgagaacgaagagtacaatctttcaggcacgaaaaagaacttttccagcctgaaggatctcctgaattgctatcagatggagacagtgcgcagtgataatataatctttcagtttactaagtgctgcccccctaaacctaaggataagtccaacttactggtgttcaggacgaacggggtgtcagatgtccctacatctccaactctgcagaggcctacccacatgaatcagatggtgtttcacaagatcagaaatgaggacctgatctttaatgagagccttgggcaggggacctttaccaagattttcaagggagtgaggagggaagtaggcgattatggtcaacttcatgagacagaggttctgctcaaggtgctcgataaagcacatcggaattattctgaatctttctttgaggctgcttctatgatgagcaaactgtcccacaagcatctggtgctgaattatggcgtgtgtgtgtgcggtgacgagaacattctggtgcaagaatttgtgaagttcggctcactcgatacatacctgaagaaaaacaaaaactgtataaacatcctatggaaactcgaggtggccaagcagcttgcttgggcaatgcactttctggaagaaaacactctcatccacggaaacgtctgtgccaagaatatactgcttatcagagaggaggataggaagacaggcaatcctcccttcatcaagctgtccgatcccggaatcagcatcactgtgctccccaaagacatactccaagagagaattccatgggttccacccgagtgcatcgaaaacccgaaaaatctgaacctggccactgacaagtggagttttgggacgactctctgggagatatgttctggaggggataagccactctcagctttagactcccagcgtaaattacagttttacgaggatcgccatcagctgcctgctccgaagtgggctgaactcgctaatctgattaacaattgtatggattacgaaccagactttcggccttccttccgcgctatcatacgggacctcaactcactctttacccctgattacgagctcctgacagagaacgacatgctcccaaacatgcgcatcggcgctctggggttctcaggcgcttttgaggatagagacccgactcagtttgaagagcgacaccttaaattcttgcagcagttggggaagggaaacttcggttccgtcgagatgtgtcggtatgatcccctgcaggataataccggggaagtcgtggctgttaaaaagctacaacacagcactgaagagcacctccgagactttgaacgggaaatcgagattctgaagtccctacaacacgacaacattgtgaagtataaaggggtgtgctactccgcgggacgcaggaatttaaagctgataatggagtacctgccttatggatctctacgagactatctgcagaagcacaaggagagaatcgatcatattaagttgctgcagtacacatcacagatttgcaaaggcatggaatacttgggaactaaacgctacattcatcgagacttagctactcgaaacatactggtggagaatgaaaatcgcgtaaaaattggtgactttggtcttacaaaagttctgcctcaggacaaggaatattacaaagtcaaggagcccggtgaaagccccatcttttggtacgcaccagagagcctgacagagagtaaattttccgtggcctcagatgtgtggtcctttggggtagtgttatacgagctgttcacatatatcgaaaagtctaaatcgcctcccgctgaatttatgcggatgatcgggaacgacaagcaggggcaaatgattgtatttcatctgatcgagctacttaagaacaatggcagactccctagacctgatggttgcccagacgagatttatatgataatgaccgagtgctggaataacaatgttaaccagcgacctagttttcgcgatttggcactgagagtggaccagatcagagataatatggctggctag

SEQ ID NO: 29165 - DNA, 2952 bp, Artificial Sequence
  Description of Artificial Sequence: Synthetic coding sequence
atgtcatatctgtttgcccaatggcgccatgacttcgtgcacgggtggatcaaagtacccgtcacccacgagacccaggaggagtgtctgggcatggccgtcctggacatgatgcgcatcgccaaggagaatgatcagacacctctcgcaatctacaattcaataagctataagacatttttgccgaaatgtattagagccaaaatccaggattatcatatcttaaccaggaaaaggatcagatatcggttccgtcggtttattcagcagttctcccagtgcaaggcgacagccaggaacctgaagttaaaatatctgattaatctggagaccctacagtccgcattttacacggagaaattcgaggttaaagagcccggatcaggtccaagcggggaggaaatcttcgctaccattatcattacgggcaacgggggaatccagtggtcacgcggaaagcataaagagtcagagaccctaaccgaacaagatctgcagttgtattgcgactttccgaatatcattgatgtgtccatcaagcaggccaaccaggagggtagtaatgaatcacgcgtcgtgacaatccacaaacaagacggaaaaaacctggaaattgaactcagcagcctgagggaagctctgagttttgtctctctgattgatggatactatagattaaccgccgacgcccaccactatttatgcaaggaagttgcaccccctgctgttctcgagaatattcagtctaactgccatggacctatttcaatggacttcgccatcagcaaacttaagaaagcgggaaaccagactggtctgtatgtgctgcggtgttcccccaaggattttaacaagtacttcctcacgttcgcggtagaaagggagaatgtgatcgaatataagcattgtctgataaccaaaaacgaaaacgaggaatataacctctcaggcacgaagaagaatttcagtagcctgaaggatctcctgaattgctaccaaatggagacagtcagatccgataacattatatttcagttcactaaatgctgtccacctaagcccaaagataagagcaaccttctggtctttcggaccaatggtgtgagcgatgtgcccacatcacccacactccagcgccctacacatatgaatcagatggttttccacaaaatccgcaacgaggaccttattttcaatgagtcactgggccaggggaccttcaccaaaatctttaaaggtgttcgcagagaagtcggcgactatggacagctccacgaaaccgaggtgttgttaaaggtgttggataaggcgcacaggaactattccgaatccttttttgaggccgcatcaatgatgagcaagctcagtcacaagcacctggttcttaactacggagtatgcgtgtgcggtgatgagaacatcttagtgcaagagtttgtgaaatttgggtccctcgacacatatcttaaaaagaataaaaattgtattaatatcctgtggaagctggaagtggccaaacaactggcctgggcgatgcacttcctggaagagaatacgctgatacacggcaatgtctgcgccaaaaatattctgctcatccgggaagaggatcgaaaaacgggcaatcctccttttatcaaactctccgaccccggtatttctatcacagttttgccaaaggatattctacaagaacggatcccttgggtgccaccagagtgtatcgagaacccgaagaatctaaacctggcgaccgacaagtggagcttcggaacaactctgtgggaaatctgttccggcggagacaagccgttgagcgcgttagattcacaacggaaactccaattttacgaggacagacaccagcttcccgctcctaagtgggccgagctggcaaatctaatcaataactgcatggattatgagcctgatttcaggccaagcttcagagcaatcatccgggaccttaactccttattcaccccagactacgaactgctgacagaaaacgatatgctccctaacatgcgaatcggagcactcggctttagcggggcttttgaggaccgcgatcctactcagtttgaggagcgccatttaaagtttttacagcagttgggaaaaggtaattttggaagcgtggagatgtgtcgctatgacccgcttcaggacaataccggggaggttgtggctgtcaagaaattacagcactctaccgaagaacacctaagagacttcgaacgggaaatcgagatcttgaaaagcctgcagcacgacaacatcgttaaatataagggagtctgctactctgccggtaggcgaaatcttaagcttatcatggagtacctgccttacggcagcctaagggattacctccaaaagcataaggagcggattgaccatattaagcttcttcagtacacctctcagatttgtaagggaatggagtatttaggcaccaaacgttatattcatagagatctggctacaaggaatatcctggtcgagaatgaaaaccgagttaaaattggggattttggcttgacgaaggttctacctcaggacaaagagtattacaaggtcaaggagccaggagagtccccgatcttctggtatgcacctgagagcctcaccgaaagcaaattttctgtggccagtgacgtatggtctttcggagtggtcctgtacgagctgttcacctacatcgagaaatctaagtcgcctccggctgaatttatgcgcatgattgggaacgataagcaggggcagatgatagtgtttcacctcatcgagctcctcaagaataatggcaggctgcccaggccggacgggtgtcctgatgaaatatacatgattatgacagaatgttggaataacaacgtgaaccagagacctagttttcgcgatctcgccctccgggtcgatcaaatacgggacaatatggccggatag

SEQ ID NO: 29166 - DNA, 732 bp, Artificial Sequence
  Description of Artificial Sequence: Synthetic coding sequence
atgactggcatcgcagccgcatcttttttcagtaacacctgccggttcggcggatgtggcctccacttccccactctggcagacctgatcgagcatatagaagacaatcacatagacactgaccccagggtacttgaaaaacaggagttgcagcagcccacatatgtagccctgtcttacataaaccgcttcatgaccgacgcagcgcgacgggaacaagaaagtctgaagaaaaagatacagccaaagcttagcctgaccttatcttcgtccgtcagccggggaaacgtctctaccccacctagacactctagtggaagtttaactccacctgtgacccccccaatcacaccgagttcatctttccggtcatcaactccgaccggaagtgaatatgacgaggaggaggtggactacgaagaatctgattccgatgaatcatggacaacggagagcgcgatctcgtctgaggccatcctgtcctctatgtgcatgaacgggggtgaggagaagccttttgcatgccctgttccgggatgcaagaagcggtataagaatgtaaacggcatcaaataccacgccaagaatggccaccggactcagatccgggtgcggaaaccgtttaaatgccggtgcggtaaaagctacaaaaccgcccagggccttcggcaccatacaatcaattttcacccgcctgtaagcgccgaaattattcggaaaatgcagcagtag

SEQ ID NO: 29167 - DNA, 1044 bp, Artificial Sequence
  Description of Artificial Sequence: Synthetic coding sequence
atgtgtactaaaatggagcagcctttttatcacgatgactcctacacagcaaccggctacgggagagcccctggaggcctgtcgctgcacgactacaagctgttaaagccgtctcttgccgtcaatctagccgatccttacaggtccttaaaagcccctggagcgcgaggacctgggcctgagggcggaggtggaggatcatacttttctggtcaagggtccgatactggtgcctctctgaaactcgcctcttccgaactggaaaggctaatcgttccaaacagcaacggagtaattaccactactccaaccccaccaggtcaatacttctaccctcggggaggaggatcaggcggaggtgccggtggcgcaggcggaggagttacagaggagcaggaaggtttcgctgatggattcgttaaagcactggacgacctccacaagatgaaccatgtgacccctcccaacgtatccctgggtgccaccgggggtcctccggcaggaccaggtggcgtctatgctggccctgaacctccaccggtgtataccaacctgtcttcctactcaccagcttccgcatccagtggcggagccggagccgctgtcgggactggaagttcctatcccactactactatatcttacttgccccatgcccctccatttgcaggaggccatccagcccagctggggttggggagaggggcatccacatttaaagaggagccgcaaactgtcccagaagccagaagtcgggacgccacccctcctgtgagcccaatcaatatggaggatcaggagcggattaaagtggagagaaagcgactcaggaacaggctcgccgctaccaagtgccgaaaaagaaagctcgagaggatagctcgcctggaagacaaggttaagaccctgaaggccgaaaacgccggtctgagctccaccgcaggcctcttgagggaacaggtcgcccagcttaaacagaaggtgatgacgcatgtgtccaacggctgtcagcttctccttggcgtcaaagggcacgctttttag

SEQ ID NO: 29168 - DNA, 996 bp, Artificial Sequence
  Description of Artificial Sequence: Synthetic coding sequence
atgactgccaaaatggagaccaccttttacgatgacgcactgaatgcttccttcctgccgagcgagagcggaccttacgggtactcaaatcctaaaatactgaaacagtccatgacgttaaatttggcagatccggtggggtcccttaagccacaccttagagcgaaaaattccgacctactgacctccccagacgtggggcttctgaagctcgcctctcccgagctcgagagactgatcatccagtcgagtaacggccacataacaacgacgcccacacctacacagttcctgtgtcctaaaaacgtaaccgacgagcaagagggcttcgcagaagggttcgtacgtgctcttgctgagcttcacagccaaaacactctccctagtgtgaccagtgctgcacagcctgtaaacggggcaggaatggtcgcacctgcagtcgcgagcgtagctgggggatcgggctctggtggattcagcgcttctctccattcggagccccctgtttatgccaacttgagcaattttaatccgggagcgttgtccagcggaggcggtgcaccatcttacggtgcagccggacttgcctttccggctcaacctcaacagcaacaacagcccccacaccaccttccccaacagatgccagtgcagcatcctcgcctccaggccctaaaggaggagccccagacagtccccgaaatgccgggagagacaccgcctttatcacctatcgatatggaatcccaagagcgtattaaagccgagcgcaagaggatgcggaaccgcatagccgcatcgaaatgtcggaagagaaagttggaaaggatcgccaggctggaagagaaggtgaaaactctgaaggcacaaaactccgagctggcatccactgcgaatatgctcagggaacaggtggctcagctcaagcaaaaagtgatgaaccatgtcaactcaggatgccagttgatgctgacacaacagctgcagaccttttag

SEQ ID NO: 29169 - DNA, 831 bp, Artificial Sequence
  Description of Artificial Sequence: Synthetic coding sequence
atgagggccccacacctacatttgtccgcagcttccggagcaagagcactcgcgaaactgctgccactgctcatggctcagctgtgggccgctgaggcagctcttttacctcagaatgatacgcgcctggacccagaggcatacggctctccctgcgctcggggtagtcagccctggcaggtcagtcttttcaatggactgtcatttcactgtgctggtgtgttagttgaccagtcatgggtacttacagccgctcactgcggtaacaaacctttgtgggcacgggtaggagacgaccatcttctcttacttcagggggaacagctgaggcgaactaccaggtctgttgtgcaccctaagtaccaccaggggtctggaccaatccttcccaggaggacggatgagcatgacctgatgcttcttaagttggcaaggccagtagttttagggccacgtgtgagggccctgcagctaccatatcgatgtgcccagcccggtgatcagtgtcaagttgccggttgggggacaaccgccgctcgcagggtgaagtacaacaaggggcttacctgttcaagcatcaccatactgtcccccaaagaatgcgaagtgttttaccccggtgtggtcaccaacaacatgatctgtgctggcctggaccgcggtcaagacccctgtcaatctgacagcgggggtcctctggtctgtgatgaaacactacagggaatactgagctggggagtatatccatgcggatccgcccagcaccctgccgtatacactcaaatatgtaagtatatgtcgtggataaacaaagtgatcaggtccaactag

SEQ ID NO: 29170 - DNA, 831 bp, Artificial Sequence
  Description of Artificial Sequence: Synthetic coding sequence
atgagagctcctcatcttcatctttccgctgcttccggcgcaagggcattggctaagctcctccctctgctcatggctcagttgtgggccgctgaggctgccttgttgccgcagaacgatacccgcttggatcctgaggcctatggctcgccctgcgcgcgagggtctcagccctggcaagtctcgcttttcaatggcttgtccttccactgcgcaggcgtgctagttgatcagagttgggtgctgaccgcagcccattgtgggaacaagcccttatgggccagggtgggcgatgaccaccttctgctgttgcaaggagaacaacttaggcgaactacaaggagtgtggtgcatcccaaatatcaccagggctctggcccaatccttcccaggcggaccgatgagcacgacctgatgctgctgaaactggcccgtcccgtagttctgggtccgagagttcgtgctctccagctcccctatcggtgtgcccaacctggggatcagtgtcaagtggccggatggggtactacagccgcaaggagggtgaagtacaataaaggtctaacttgtagtagtattacaatcctttctccgaaagaatgtgaagtcttctaccccggtgtcgttaccaataacatgatctgtgccggtctcgatcgtggacaagacccttgtcagtccgactccgggggaccgctggtctgcgacgaaacgctccaggggattctctcctggggggtatatccgtgcggatcagcacagcatcctgccgtgtacacacagatatgtaaatatatgagctggattaacaaagtgattcgcagtaactag

SEQ ID NO: 29171 - DNA, 831 bp, Artificial Sequence
  Description of Artificial Sequence: Synthetic coding sequence
atgagggcaccccacctccacctgagcgctgctagcggtgcgagagccctggctaagttactgcccctgctaatggcccagttgtgggccgctgaagcagcccttctgccccagaatgatacccggctggacccagaagcctatggcagtccgtgtgctagaggcagccagccatggcaggtgtctcttttcaacggtctcagctttcactgcgctggcgtgctggttgaccaaagttgggtcctgacggccgcacactgcggcaacaagcccctctgggccagggtcggagatgaccatctgctgttactccaaggcgagcagcttcggaggaccacacggtctgtggtgcatcctaaatatcatcagggtagtggccctatcctccctcggaggactgatgaacacgacctgatgttgctgaagctggcacggcctgtggtgcttggcccaagagtccgtgctctccagcttccctacagatgcgcgcagcccggagatcaatgtcaggtcgcaggctggggaactacagccgctcgtcgcgtaaagtataataaagggctgacatgcagcagcattactattctgagtcctaaggagtgcgaagtgttctaccctggggtcgtgactaataacatgatttgtgctggactggatagaggccaggacccttgtcagagtgactcgggaggaccattagtgtgcgatgagacgctccagggaatccttagctggggggtctacccctgcggcagtgcccagcacccagccgtatacacacagatctgcaagtacatgtcttggataaacaaggtgatcaggtcgaactag

SEQ ID NO: 29172 - DNA, 657 bp, Artificial Sequence
  Description of Artificial Sequence: Synthetic coding sequence
atgtgggtcccggttgttttccttacactgtcagtcacttggatcggggctgctccgctgatcttgtctcggatcgtgggcggttgggagtgtgaaaagcacagtcaaccgtggcaggtgttggtggcctcgcgaggacgggcagtttgcggaggcgttctggttcatcctcagtgggtcctcactgcagctcactgcattcggaagccaggagacgattcatcccacgatttgatgctgctgcgtctgtcagagccagcggagctgacagacgccgtgaaggtcatggatctgccgactcaggagcccgctctgggcaccacctgctatgcctcaggatggggctcaatcgagcccgaagaatttttgacacccaagaaactgcaatgcgtggacctccacgtgatttctaatgacgtatgcgcgcaggtgcacccacaaaaggttactaagtttatgctgtgtgcaggccgatggaccggaggcaaatctacttgctcaggggacagcggagggccactggtctgcaatggggtgctccaggggattacctcatggggaagcgagccttgcgcactgccagagcggccatctttgtatacaaaggtggtgcactatcgcaagtggattaaggacactatcgtggccaacccttag

SEQ ID NO: 29173 - DNA, 1590 bp, Artificial Sequence
  Description of Artificial Sequence: Synthetic coding sequence
atgagcactaatgagaatgccaacactcctgccgctagacttcacagattcaagaacaaaggcaaagactctaccgaaatgcggaggaggagaatcgaagtcaatgtcgagctgaggaaagccaaaaaagacgatcagatgctcaagcggagaaatgtgagttcatttcccgatgatgctacttctccattgcaggaaaacagaaataaccagggaacagttaattggtccgtggacgacattgtaaaaggcattaactcaagtaatgtagagaatcagctgcaggcaacacaggcggcaaggaagctgctgtctcgcgagaaacagccccctattgataatatcattagggctgggcttatccccaagtttgtgagtttcctgggaagaaccgactgttctcccatccagttcgagagtgcatgggcgcttacgaacatcgccagtggaaccagcgagcagacaaaggcggtggttgacggcggagccatcccagccttcataagcctccttgccagcccccacgcccatataagtgagcaggctgtgtgggctttaggaaatattgccggtgacgggtctgttttccgtgacttagtcattaagtacggtgccgtggatcctctgctggctctcttggccgtgcccgacatgagttctctggcatgcggctacctgcggaatcttacatggacgctatccaatctctgtaggaataagaatccagctcctcccattgacgcagtggagcagatcttacccacacttgtgcgcctcctccaccacgacgatcccgaggtattggccgatacttgttgggccatttcttatctaactgatggcccaaatgagcgaattggaatggtggtgaaaactggcgtggtgccacagctggtgaaactgctgggagcatccgaactaccaatagtcactcccgcactgagagcgattggtaatatcgtgactggaactgacgagcagactcaggttgtcattgacgccggagctctggcagtgttccctagtctcctgaccaaccccaaaacaaatatccagaaagaagccacctggaccatgagcaacattactgccggacggcaagaccagatacagcaagtcgtcaatcatggcctggtaccctttttagtttccgtgctgagtaaagcagattttaagacccagaaagaggcagtgtgggctgtgacaaactacacttctgggggaacagtagaacaaatcgtgtatctggtgcattgtgggatcatcgaacccctgatgaacctcctcaccgccaaagacaccaagattattttggtgatactagacgcaatcagtaacatcttccaggccgctgaaaagctcggggagactgagaagctttccattatgatcgaagagtgtggcggactagacaaaatcgaagccttacagaatcacgaaaacgaaagcgtgtacaaagccagtctgagtctgattgaaaaatacttttctgtggaggaggaagaggaccaaaatgtggttcccgaaactacatccgaagggtacacgttccaggtgcaggacggagctcctggcacgtttaatttctag

SEQ ID NO: 29174 - DNA, 1590 bp, Artificial Sequence
  Description of Artificial Sequence: Synthetic coding sequence
atgtccacaaacgaaaacgctaatactccagcggcacgcttgcataggtttaaaaacaagggtaaggattccactgagatgagacgtaggcgaatagaagtgaacgtggagctacgcaaagcaaagaaagacgaccagatgctcaaacgaaggaacgtgtcttctttcccggacgacgcaacctctccacttcaagaaaatcgcaacaaccagggaacagtgaattggagtgtggacgacatcgtcaaaggcatcaatagttcgaacgtggagaaccaattacaggccacgcaggcggctcggaaactgctttcccgtgagaagcaaccgcctatcgacaatatcatacgcgcagggctgatccccaagtttgtgagctttttaggaaggacagattgcagccctatccaatttgagtctgcttgggccctgacaaatattgccagcggaacttctgagcagactaaagcagtcgtggacgggggagccattcccgcttttatctctctattggcttcaccacacgcccacatttctgagcaggccgtctgggctttaggaaacattgccggagacggctcagtgttccgcgacttagtaattaagtatggagccgttgatccacttctggcccttctcgcagtgccagatatgtctagccttgcctgcggttatctgcgcaacctgacctggaccctgtcaaacttgtgccgcaataagaatccagccccacctatcgatgcagtggaacaaattctcccgactttagtgaggttgttgcaccacgatgaccccgaagttctggccgacacctgctgggcaatctcatatctgacggatgggcctaatgaaagaatcggcatggtggtgaagacaggtgtggtgccacagctcgtgaagttactaggagcctctgagctccctatcgtcacaccagctctccgggcaataggcaacatagtgacggggaccgatgagcagactcaagtagtgatcgacgctggggcactggctgtattccctagcttgctgaccaatccaaaaacgaacatccagaaagaagccacatggaccatgagcaatatcacggccggtaggcaggaccagatccagcaggttgtgaaccacggcctggtgccatttctggtcagtgtgctcagcaaagccgactttaaaacccaaaaagaagcagtctgggcggtgacgaattatacgagcggcggaacagtcgagcagattgtatatctggtgcactgtggcatcattgagcctctcatgaatctcctgactgctaaagacaccaagattattcttgtcatattagatgcgatttccaacatctttcaggccgctgaaaagctaggcgagacagaaaagctgtccataatgatagaagaatgtgggggtctcgacaaaattgaggcactccagaatcacgaaaatgagtcagtgtataaggctagcctgtcattgatcgagaagtatttttccgtcgaggaggaggaagatcagaacgtcgtgccggaaaccaccagtgagggatatacttttcaagtgcaggacggggctcccggaacgttcaacttttag

SEQ ID NO: 29175 - DNA, 1968 bp, Artificial Sequence
  Description of Artificial Sequence: Synthetic coding sequence
atgcctctgaagtggaagacctcatcgccagccatttggaaattcccagtgcccgtgctaaaaacgagtagatctacaccactgagtccagcttacatctcactggtggaagaagaggaccagcacatgaagctgtccctcggtggctcagagatggggctgtcctcgcatcttcagagttccaaggcaggcccaactagaattttcacctcaaacacacattcatcagtggtgttgcagggattcgatcagctccgcctggaaggactgctgtgtgacgtcaccctgatgcccggtgacacagacgacgcctttccagtgcacagggttatgatggcttctgcttctgattactttaaggcaatgttcacaggcggtatgaaggaacaggacctgatgtgcattaagctccatggcgtcagtaaggtcggcttgaggaagattatcgacttcatctacaccgccaaactgagcctcaatatggacaacctgcaagacaccctggaagcagcttcatttctgcagatccttcccgtgctggacttttgtaaagtatttctcatctcaggcgtaacacttgacaactgcgtcgaggtcggcaggattgccaatacctacaatctcactgaggtggataagtatgtgaacagtttcgtcctcaaaaacttccccgctcttttgagtaccggagaatttctcaaactgccgttcgagcggctggcttttgtattgtcctctaactctctgaagcattgcaccgaacttgagctgtttaaggcaacctgtcggtggctccgccttgaagagcctcgaatggactttgctgcaaagctgatgaaaaacatccggtttcctctaatgactccccaggaactgatcaactacgtccagaccgtggactttatgcggactgacaatacttgcgtgaacttactgctggaggccagcaactaccagatgatgccatacatgcagcctgtgatgcaaagcgatcgcaccgccatacggtctgatacaacccatctagtgacactgggcggtgtgcttcggcagcagctggtagtcagcaaggagctccgcatgtacgacgagaaagcccatgagtggaagtcccttgctcccatggacgcacccaggtatcagcacggaattgctgtaattggaaactttctgtatgtagtaggagggcagagtaactatgacactaaagggaagacagcagtggacactgtgttcaggttcgaccctagatacaataagtggatgcaagtggcctcccttaacgaaaaacggacctttttccacctgagtgctttgaaaggctatctttacgctgtcggcggtaggaatgctgccggagagctgccaactgtcgaatgctacaatccccgaaccaacgagtggacatacgttgcgaagatgtcagagcctcactatggacacgctggtactgtctacggcggagtgatgtacatctctggcggaatcacgcacgacacatttcaaaaggagttgatgtgtttcgaccccgatactgacaaatggattcagaaagctcccatgacgactgtgaggggactgcattgtatgtgtacagtcggcgagcggctgtacgtaattgggggtaaccactttaggggaaccagtgattacgatgatgtgttaagctgcgagtactattccccgatccttgatcagtggaccccaattgccgcaatgctccgtggccaatccgacgtaggagttgctgtgtttgagaataagatatatgtagtcggagggtattcatggaataataggtgcatggttgaaatcgtgcaaaaatatgatccagacaaggacgagtggcataaggtttttgatctgcccgaaagtttaggcggaatcagggcctgcacccttacagtcttccccccagaggagactacccctagccccagccgtgagagccccctttctgccccatag

SEQ ID NO: 29176 - DNA, 1815 bp, Artificial Sequence
  Description of Artificial Sequence: Synthetic coding sequence
atggggctcagctcccatcttcaatctagtaaggccggacctactcggatcttcacatcgaacactcattcgagcgttgtgctgcaggggtttgatcagctgcggctggagggtcttttgtgcgacgtgactctgatgccaggcgataccgacgatgctttccccgtgcacagagtaatgatggctagcgcaagtgactactttaaggccatgttcacaggtggaatgaaggaacaggacttaatgtgcatcaagttgcacggggtatccaaggtggggttaaggaagatcatcgatttcatctacacagctaagttatctttaaacatggataacctgcaggacaccctggaggccgctagcttcctccaaattttgcccgtgctggatttttgcaaagtcttcctcatttctggagtgactctggacaactgtgtggaggttggtagaatagccaatacatataatctgaccgaagtggacaagtatgtgaattcttttgtcctgaaaaacttccctgccttgttgtccactggagaattcctaaaacttcctttcgagaggctcgcctttgttctatcatctaattccctgaagcattgtactgaactggaactctttaaggcaacatgtaggtggctccggcttgaggagcccagaatggatttcgccgctaaattgatgaagaacattcgattccccctcatgacaccacaggagttaatcaactatgtacagaccgtggacttcatgcgaactgacaatacttgcgtcaaccttttactggaggctagcaactaccaaatgatgccatacatgcaacctgtcatgcagtccgacaggaccgcaattcggagcgataccactcatctggttacactgggcggtgttctgcggcaacagctggtcgtaagcaaagagctaagaatgtatgatgagaaggctcatgagtggaagtcactcgctcctatggatgcgcctagatatcagcatgggatcgctgtcatcggcaactttctctacgtggtgggcggtcaaagcaattatgacacaaagggaaaaacagccgtggacactgtctttagatttgaccctcgctataataaatggatgcaggtcgccagcttgaacgaaaagcgaactttcttccacttgtcagccttgaagggatatctgtatgccgtgggcggtcggaatgcagccggagaattgcctacagtggagtgctataatccccgtaccaatgagtggacctatgtggccaagatgagtgagccgcattacgggcatgccggaaccgtgtatggcggtgtcatgtatatctcaggcggaatcacccatgacacatttcagaaagaacttatgtgcttcgatccagatacagataagtggattcagaaagccccaatgactacagtgcgcggtctgcattgtatgtgtaccgtgggcgagcgcctatacgtgattgggggaaatcactttagaggaacaagcgactatgacgatgtccttagctgcgagtactatagccccattttagatcaatggacgcctattgcagctatgctccggggtcagagcgatgtgggcgtcgcggtgtttgagaataagatctatgtggtgggtggttacagttggaataaccgctgcatggttgagatcgttcagaagtacgaccccgacaaagatgaatggcataaggtgttcgacctgccagagagtctgggaggcatacgagcgtgtaccctgaccgtttttcctcctgaagagacaactccttctcctagtcgcgaatcacctctatccgctccctag

SEQ ID NO: 29177 - DNA, 1815 bp, Artificial Sequence
  Description of Artificial Sequence: Synthetic coding sequence
atgggattgagtagccatttgcaatccagcaaagctggacctacacggattttcacgagcaacacccacagcagcgttgtccttcagggcttcgatcagctccgcctagaaggcctactgtgcgatgtgacactgatgcctggcgataccgacgatgccttcccggtgcacagagttatgatggccagcgctagcgattactttaaagcaatgttcaccgggggaatgaaagagcaggaccttatgtgtataaaactccacggtgtatccaaagttgggctgcgaaagatcatcgacttcatttataccgctaaattatcattaaacatggacaacctgcaggacactctggaggccgcttcttttctacagattctgccagttctcgacttctgcaaagtctttctcatctctggtgtgactctagacaactgtgtggaagttggcagaatcgcgaatacatacaatctgaccgaggtcgacaaatatgtgaatagtttcgtcctgaaaaattttccagctttgctgagcacaggggaattcctgaagctgcctttcgaaaggctcgcctttgtactgagttccaattcgctcaagcactgcacggagctggagctgttcaaggcaacttgtagatggctgcggctggaagagcctcgtatggacttcgctgcaaagctgatgaagaacatccggttcccattaatgacccctcaggaacttatcaactacgtccagacagtggatttcatgcggaccgacaacacctgcgtgaatttgttgcttgaagcgtctaattatcaaatgatgccatatatgcagcctgtcatgcagtccgatcgcacggccattaggtctgatacgacccatctcgtcacactcggcggagtcctccgtcagcagctcgtggtctcaaaggagcttcgcatgtacgatgaaaaggcacatgagtggaagagcttagcgcctatggacgcaccgaggtatcagcacggcatagctgttatcgggaatttcctgtacgtcgtcgggggtcaatctaactatgacaccaagggcaagaccgccgtcgacacagttttccggtttgaccctaggtataacaaatggatgcaggtggccagtcttaacgagaagcggacattcttccacttgtctgcgctcaaggggtacctatatgccgtgggaggtcggaacgccgcaggggagctccccactgtagaatgttacaaccctagaactaacgagtggacctacgttgctaagatgtcagagcctcactacgggcacgcgggaacagtgtacggcggtgtcatgtacattagcggtggaatcacacacgataccttccaaaaagaactgatgtgctttgatccagatacggataagtggatacagaaagcgccaatgacgactgtacgaggcctccattgcatgtgtacagttggtgagcggttgtacgtgatcggtgggaaccattttaggggaacctcagactacgatgatgtgttgagttgcgaatattattcacctatccttgatcagtggacccccatagctgccatgctgcgtggacagtctgatgtgggggtggccgtcttcgaaaataaaatttacgtcgttggtggctattcctggaataatcgctgtatggttgaaatcgtgcagaagtacgacccagacaaagatgagtggcataaggtgtttgacctgcccgaaagcctcggtggaatccgcgcttgcaccctaacagtcttcccccctgaggaaaccaccccttctccctccagggagtcccctttgagtgccccttag

SEQ ID NO: 29178 - DNA, 1815 bp, Artificial Sequence
  Description of Artificial Sequence: Synthetic coding sequence
atgggtctgtccagccatctacagagttcaaaagctggccctacaaggatctttacatccaatacacacagcagcgtggtgcttcaggggtttgaccaactgcgccttgagggacttctttgtgatgtgactctgatgccaggggacacagacgatgcttttcctgtgcacagagtgatgatggctagtgcctctgattattttaaagccatgttcaccggcggaatgaaggaacaagatctgatgtgtattaagctccacggggtgtctaaggtcggactgaggaagattatagatttcatctataccgccaaactgtcattaaatatggacaatctccaagacaccttggaggccgctagcttcctccagatactccccgtgctcgatttctgcaaggtatttctgatcagtggcgtaactctggataactgcgtggaggtcggtcggatcgctaacacttacaacctcactgaggtggacaaatatgtgaactccttcgtgctaaagaacttccccgctcttctgagcacgggcgaatttttgaaactgccattcgagaggctggcatttgtgttgtcaagcaattcccttaagcactgcaccgagctggaattgtttaaggccacatgtagatggcttcggcttgaggagcccagaatggactttgcagcaaagctaatgaaaaacattcgcttccctcttatgacccctcaggagctgatcaactacgtccagacagttgattttatgaggacagacaacacttgtgtgaatttgctgttggaagcgtcaaactaccagatgatgccctatatgcagccagtgatgcagagtgaccgaacggccatcaggtccgacacaacccatctggttacattgggaggtgtccttcgccaacagcttgttgtgtccaaggagctgcggatgtatgacgagaaagcgcacgaatggaaaagcttggccccaatggacgcccctaggtatcaacatggcattgcagttattggaaatttcctgtatgttgtaggagggcagtctaattacgataccaaaggtaagacagccgtggatacagtgttccgctttgatcccaggtacaataagtggatgcaggtcgcaagcctaaatgagaaaaggacatttttccatctttcggctctcaagggctatctttatgcagtcggcggacggaacgcagccggtgaactgcctacagtcgaatgctataacccgaggaccaatgaatggacatacgtggccaagatgtcagagcctcactacggccacgcgggaaccgtttacggaggggtgatgtacatctccggaggcatcacgcacgatactttccaaaaggagcttatgtgttttgaccccgatacagacaagtggattcagaaagcgccaatgacgaccgtgcgtgggctgcactgtatgtgtactgtcggcgaacgcctttacgtgataggtggaaaccactttcggggtacatccgattacgacgacgtgctgagttgtgaatattactccccgattttagatcagtggacgcccatcgctgccatgctccgaggacagtctgatgtgggcgtggctgtgtttgagaacaagatctacgtcgttggcggttatagttggaacaaccgctgtatggtcgaaatagtacagaaatatgaccccgataaggatgagtggcacaaggtgttcgaccttcctgaatccctcggtgggataagggcttgtactttgaccgtgttcccacccgaggagacaacaccctctcctagcagagagtcccccctgtcggccccttag

SEQ ID NO: 29179 - DNA, 1815 bp, Artificial Sequence
  Description of Artificial Sequence: Synthetic coding sequence
atgggcctgagctctcatttacagagcagtaaggccggacccaccaggatctttacaagcaacactcattccagcgtggtgctgcagggatttgaccagctgcgactcgagggcctgctgtgcgacgtcactctgatgcctggcgacaccgacgatgcgttcccagtgcaccgagtgatgatggccagcgcttccgactacttcaaagctatgttcactggcggaatgaaagagcaggatctcatgtgcatcaaactgcacggtgtctcaaaagtgggcctgcgtaagattattgattttatctacacggctaagttgtctctaaatatggataatctgcaggacacactggaggccgcaagttttctccagattctccccgtgttggacttctgcaaagtgtttcttatctctggagtgaccctcgacaactgcgtcgaagttgggcgtattgccaacacatacaacctgaccgaggtggacaagtatgtgaatagttttgttttaaagaattttccagcccttctttctacaggcgagttcctaaagctgccattcgaacggttagccttcgtactcagtagcaacagcctcaaacactgtacagagttagaactcttcaaggccacgtgtaggtggctacgcctcgaggaaccccgtatggatttcgctgcgaagctgatgaagaatatacgtttccccctgatgaccccccaggaactgatcaattacgtccaaacagtcgacttcatgagaaccgacaacacctgcgtcaacctcctgctcgaagcctccaattaccaaatgatgccttatatgcagcctgtcatgcagagcgaccggacagccatccgcagtgacacaacccacctggtcacactagggggagtgctccggcagcagcttgtcgtgtcaaaggagcttaggatgtatgacgaaaaggcacacgaatggaagagtctggcccctatggatgccccaaggtaccaacatggcatcgctgtaataggcaactttctgtacgtggtcggaggacagtccaattatgacactaaagggaaaaccgccgtggacaccgtgttcagatttgatcctagatataataagtggatgcaggtcgccagccttaatgagaagcggacattcttccatttaagcgcgctcaagggctatctttacgccgtggggggaaggaacgctgcaggcgagctgcccacagtggagtgttacaatccccgaacaaacgagtggacctacgtcgccaagatgagcgagccacattacggacatgcaggtacagtctatgggggagtcatgtatatttctggcggaatcacgcatgacacctttcagaaggaactgatgtgctttgatccggatactgacaagtggatacagaaggcccctatgaccacagttagaggactccactgcatgtgtacagtcggcgaacgcctatatgttatcggtgggaatcacttccgcggtacctctgattatgatgacgtgctgtcatgtgagtattactcaccaatattggaccaatggactccaatagccgcaatgcttcgaggccagagcgacgtgggcgtcgcagtcttcgaaaacaagatctacgtggtaggaggctatagctggaataaccgctgtatggtggagattgtacagaagtatgacccagacaaggacgaatggcataaagtctttgaccttcctgagtctctgggcggaattcgtgcatgcactcttacagtctttccacctgaggagactacaccatctccttcccgcgaatcaccgctgagcgctccatag

SEQ ID NO: 29180 - DNA, 117 bp, Artificial Sequence
  Description of Artificial Sequence: Synthetic coding sequence
atgggcctgtcaagtcatcttcagtcctccaaggcgggtcctaccaggatctttacctcaaacacccactcatccgtagtgctgcagggattcgatcaattgaggctagagggatag

SEQ ID NO: 29181 - DNA, 1815 bp, Artificial Sequence
  Description of Artificial Sequence: Synthetic coding sequence
atggggctgagctcccatcttcagtcctcgaaggcaggccctacacgaatctttacatccaatacgcacagttccgtggtgctccaggggtttgaccaactacgccttgaagggctcctctgcgatgtgactctgatgcctggggataccgacgacgcattccccgtgcatagggttatgatggcatcagcgtctgattactttaaggccatgtttactggaggtatgaaagagcaggacttaatgtgcatcaaactacacggagtgagcaaagtcggcttacgcaagatcatcgattttatttataccgccaaactgtcattgaatatggacaatcttcaggatacattagaagctgcttccttcctacagatactacccgttctggatttttgtaaagtatttctgatatctggggtaactctggataattgtgtggaggtgggacggattgcgaatacctataacctcactgaggtggacaaatatgtaaacagcttcgtgctaaaaaatttccccgcacttcttagtacgggcgaatttttgaaactgccgtttgaacgcctcgcattcgtgttgtcctctaactccctcaagcactgtacagagctcgaattgtttaaggctacatgtcgatggttgcggctcgaagaacctcgcatggacttcgccgctaagttgatgaagaacatccggttcccactgatgactccacaggagctgataaattacgtccagactgttgacttcatgcggacagataacacttgtgtaaatttgctgctcgaggcaagcaactaccagatgatgccctatatgcaaccagtcatgcagtctgacagaaccgcgatccgttctgatacaacacacttagtgaccctgggtggcgtgctgaggcaacagttggtggtcagcaaggaactgaggatgtacgacgagaaggctcatgaatggaaatccctggctccgatggatgcgcctaggtaccaacatggtatcgctgtcataggaaattttctgtacgttgtaggcggtcagtctaattatgacaccaaaggaaagaccgctgtggataccgtgtttaggtttgacccaaggtacaataagtggatgcaggttgccagcctcaatgagaagagaaccttctttcatctgagcgccctcaaaggttatttgtacgccgtgggagggcgaaacgccgctggcgagcttcccaccgtcgaatgttacaatccccgtacaaacgagtggacatacgtcgcgaaaatgtctgagccacactacgggcacgctggcaccgtatacgggggtgtgatgtacatatccgggggtattactcatgacacatttcaaaaggagcttatgtgcttcgacccggataccgacaaatggatccagaaggctcccatgactactgttaggggcctccactgcatgtgcacagtcggcgaacggctgtacgtgatcggcggtaaccacttccgtggaacctctgattacgacgacgttctgagctgtgaatattatagccctatccttgaccagtggacaccaatcgctgcaatgctgcgaggccagagtgacgtgggcgtcgctgtgtttgagaataaaatttatgtagttggcggatactcctggaacaatcgctgcatggttgagatagtccaaaagtatgatccagataaagatgagtggcataaggtgttcgacctacctgagagcctgggaggaattagagcttgcaccctgacggtgtttcccccagaggagacaacgccatcgccttcccgagaatcccccctaagtgctccctag

SEQ ID NO: 29182 - DNA, 1977 bp, Artificial Sequence
  Description of Artificial Sequence: Synthetic coding sequence
atgatgcgggttcagacactgcgtgagaagtgggcctactggcggaggaggcagttatcccttaaacaggctgattttaaggatattttcaagaaatccaccagtggatcacttgtcgaggaggaagaccagcatatgaaattatcacttggaggatcggaaatggggctgtcatcacacctgcagtcgagcaaagccggaccgacaaggatctttactagtaacacccattctagtgtcgtcctgcagggattcgaccagctgcgactggagggtctgctgtgtgacgtcaccctcatgccaggcgatacagacgacgcctttcctgtgcatagggtcatgatggccagtgcatccgattactttaaagctatgtttacagggggaatgaaggagcaggatttgatgtgtatcaagctccatggggtctctaaggtgggcctcagaaagatcatcgattttatctataccgctaaactctctctcaacatggataacctgcaggataccctggaggcagcttcatttcttcaaatcttaccagtgctggatttttgtaaagttttccttatttcaggcgttaccctcgataattgtgtggaggtgggcaggatagccaatacttacaacctgaccgaggtggacaaatacgtgaatagcttcgtgttaaagaactttccagccctgctgagcacgggagagttccttaaattgccatttgagcgactggcctttgtgctctcctcaaacagcctcaagcactgtaccgagctcgagctgttcaaggccacatgtagatggttgagacttgaggaaccccgtatggattttgccgcaaaactgatgaaaaatattcggtttccattgatgacccctcaggaactgatcaactatgttcagacggtggatttcatgcggaccgataatacctgtgtgaacttgctgctcgaagcttctaactaccaaatgatgccatacatgcagccagtgatgcaaagtgatcgcacagccattagatctgacactacccacctcgttaccctggggggtgtgcttaggcagcagctggtcgtcagcaaggaattaaggatgtacgacgagaaggcacacgagtggaaatcactggccccaatggatgccccaagatatcagcacggaattgctgtaattggcaactttctatacgtggttggcggacagagtaattatgataccaagggcaagaccgctgtggacacagtgtttcgatttgatcctaggtacaacaagtggatgcaagtcgctagcttaaacgaaaaacgaaccttctttcacctcagcgccctgaaaggctatctgtacgcagtagggggaaggaatgcagcaggcgagctgccaactgtagagtgctataatccgagaactaacgaatggacttacgtggcaaagatgagtgaaccccactatggccacgcaggcacagtgtacggtggcgtcatgtatatctccggaggtatcacccacgatacattccagaaggagctgatgtgctttgatccggataccgataagtggatccagaaggccccaatgactaccgtccggggattgcactgcatgtgcacagtgggggagaggctgtacgtcatcggcggaaaccacttcagaggaacaagtgattatgatgacgttcttagttgtgaatactactctccaatccttgaccagtggactcccatcgccgctatgttgcggggtcagagtgacgtgggcgtcgctgttttcgagaataaaatctacgtggtgggcggttacagctggaacaatcgctgtatggtagagattgttcagaaatacgatcccgacaaggacgagtggcacaaggtctttgatctgcccgaaagtctcggtggtataagagcgtgcacccttaccgtttttccacccgaagaaactacaccgtccccatctcgtgagtcaccacttagcgctccttag

SEQ ID NO: 29183 - DNA, 1920 bp, Artificial Sequence
  Description of Artificial Sequence: Synthetic coding sequence
atggatcacctgcaccggggtgagcttgtggcagccattctaaggaataggtctctggtggaagaagaggaccagcatatgaaactgagtctgggaggtagtgagatggggctgtcaagtcatctgcagtcgagcaaggcagggccaacgcggatctttacttcaaacacgcactcaagtgtggttttacagggatttgaccagctcaggctagagggactgctgtgcgatgtaactcttatgcccggagatacagacgacgcattcccagtccacagagtgatgatggcttccgcttctgattactttaaagccatgttcactgggggaatgaaagagcaggatttgatgtgtatcaagcttcatggagtgtcaaaagttggactgcgcaagattattgatttcatttataccgcaaaactgtctttgaatatggataatttgcaagatactcttgaggctgcaagttttctgcagattctgcccgtcttggacttttgcaaagtgtttttgatctctggtgtgacgctggataattgcgtggaagttgggagaattgcaaacacatacaatctgactgaagttgacaagtacgtcaacagtttcgtgcttaagaattttcccgctcttctgtctaccggcgaattcctgaagctgccctttgagaggctggctttcgtgttgtcgtccaatagcctgaagcactgcactgagctcgaactgtttaaggcgacctgccgctggctgaggcttgaagagcctcgcatggactttgcggcaaagctcatgaagaacattcgcttcccccttatgacgccccaagagctgataaactatgtgcagactgtggacttcatgaggactgataatacctgcgtgaatcttcttttagaggccagtaactaccagatgatgccatacatgcagcccgtgatgcagtctgaccggacagccatccgctctgataccacacatttagttaccctcggaggagttctcaggcaacagctggtcgtgagcaaagagctccgaatgtatgatgagaaggctcatgagtggaagagcctagctccaatggacgcgccaagataccagcacggcatagcagtgatcggcaacttcttgtatgtggtcggaggacagagcaattacgatacaaagggtaagactgcagtggatacggtcttccggttcgatcctagatacaacaagtggatgcaggtcgctagcctgaatgaaaaacggactttttttcacctgtcagccctcaaaggatacctgtacgcagttggcggacgtaacgctgctggcgagttacccacagtggagtgctataacccacggaccaacgagtggacctacgtcgctaagatgagcgagccacactatggccacgccggtactgtctacggcggagttatgtacatatctggcggaattactcacgatacttttcaaaaagaactcatgtgctttgaccccgatacggacaagtggatacaaaaagcccctatgaccactgtccgcggactccactgtatgtgcacagtcggcgaacgactctacgttattggtggcaatcacttcaggggtacatctgattatgatgacgtactcagctgtgagtattactctccaattctggatcagtggacgcctattgcagcaatgcttcggggtcagtccgacgtgggtgtcgcagtgttcgaaaacaaaatttatgtagtcggtggatattcatggaataatagatgcatggttgaaattgtgcagaagtatgacccagacaaggatgagtggcacaaagtgtttgacttgcctgaaagcctgggaggaattcgtgcgtgtaccctgaccgtgttccccccagaagagactactccctctccatctcgggaatcgcctctgagtgccccatag

SEQ ID NO: 29184 - DNA, 1920 bp, Artificial Sequence
  Description of Artificial Sequence: Synthetic coding sequence
atggatcacctgcaccggggagagctagtcgccgctatcctgcgcaatagaagtctcgttgaggaggaggaccagcacatgaagctgtcactgggaggctctgagatgggcctgtcttcacatctacagagctctaaggctggacccacacgcattttcacaagcaacacacactcatcagtagtgctgcaggggtttgaccagcttcggctggagggtcttctgtgtgatgtcacgctcatgcccggagacacagacgatgcgttcccggtccacagagtcatgatggccagtgcttctgattatttcaaggctatgttcacagggggtatgaaagagcaggacctgatgtgtatcaaacttcacggcgtctcaaaggttgggctgagaaaaattattgacttcatctacacagccaagctttccctcaatatggataatcttcaagacactcttgaggctgccagcttccttcagatcttaccggttctggacttttgcaaagtgttcctgatctccggagtgacactggataactgtgtggaggtgggacggattgcaaacacgtacaacctcactgaagtggataagtatgtcaactcattcgtgctgaagaactttcctgcattgctgtccactggcgagtttctaaagcttccattcgaacggcttgcctttgtccttagctcaaatagcttgaaacattgtaccgagttggagctgttcaaggccacatgtcggtggctccggctggaagagccccgtatggattttgctgctaagttgatgaaaaacattcgctttccgctgatgacaccacaggaactgattaactatgtccaaacagtggactttatgcgcactgataatacctgcgtgaatttgctcctggaagcgagcaactatcagatgatgccttatatgcagcctgtaatgcagtcggaccgtacagcaatccgcagcgacacaactcacttagtgactctgggtggcgttctgcgtcagcagctcgtggtctctaaagaacttagaatgtatgacgagaaggctcacgagtggaagagtctggccccaatggacgcgcctagatatcagcatgggattgctgtaattggcaatttcctgtatgtggtcggaggacagtccaattacgacaccaaggggaagactgcagttgacacagtgttccggtttgatccaaggtacaacaagtggatgcaggtcgctagtctcaatgagaaaaggaccttctttcacttaagcgcactcaaggggtacctgtacgctgtcgggggaagaaacgccgcaggcgaactcccaacggttgaatgttacaatccaaggaccaatgaatggacctacgttgccaaaatgagcgaacctcactacggacacgccggaactgtctatggaggagtgatgtacattagtggtgggatcacccatgatacttttcagaaagagctcatgtgcttcgatcccgatacagataagtggatacagaaggccccaatgactactgtgcgcggactgcactgcatgtgtacggttggagaaaggttatatgttatcgggggaaatcatttccgaggtacttccgattatgacgatgtattgtcgtgtgagtattactctcctatcctcgatcagtggacaccgatcgccgcaatgttacggggtcagagcgacgtgggtgttgccgtgttcgaaaacaaaatatacgtcgtgggcggatatagctggaacaatcgatgtatggtggagatcgttcagaagtatgaccctgacaaagatgagtggcacaaagtgttcgatttacccgaaagcctcgggggtatacgcgcttgtacgctaaccgtgtttccaccggaggagacaactcccagccccagtagagaatctccactgtccgcaccttag

SEQ ID NO: 29185 - DNA, 1842 bp, Artificial Sequence
  Description of Artificial Sequence: Synthetic coding sequence
atgaagctttctctggggggtagtgagatgggtcttagcagccacttgcaatcatccaaagcaggcccaacacggattttcacatcaaacacccacagttccgtggtgctgcaaggattcgaccagctccggttagaaggcctcctttgtgacgtgacactgatgcctggcgatacagatgacgcattccccgtgcatcgagtgatgatggcctccgcgagcgactactttaaagcaatgttcaccgggggaatgaaggagcaagacctgatgtgtatcaagctgcatggcgttagcaaggtggggctacgcaagattatcgattttatttacaccgccaagttatcactgaacatggacaacctgcaggataccctcgaggccgcatctttcctgcaaatcctcccggtgctcgatttctgcaaagtattcctgatttctggggtcactctggataattgcgtcgaagtgggtcgcatcgctaacacctacaacttaaccgaagttgacaagtacgtgaattcctttgtgctgaaaaatttccccgcactactgagcaccggggaatttctgaagttgcccttcgagcgtctggcctttgtcctgtcaagtaatagcctgaagcactgcactgagctggaattgttcaaagccacctgccggtggctgcggctggaggagccgaggatggattttgctgcaaaactgatgaaaaatattagattcccactcatgacacctcaggaacttattaattacgtgcagactgttgatttcatgagaactgacaacacatgtgtcaatctgctgcttgaagcaagtaactatcagatgatgccctatatgcagccagtaatgcagagcgaccgaacagcaatacgcagcgacaccacacatttggtgactctggggggagtcctccgccaacagctggttgtgtcgaaggagctccggatgtacgatgaaaaggcccatgagtggaagtcgctggcacctatggatgctccgagataccagcatggcatcgcagtgatcggaaatttcctgtatgtcgtaggcggacaaagcaattacgacacgaaggggaaaacagctgtcgacacggtgttccggtttgaccccaggtacaataagtggatgcaagtggctagcctgaacgaaaaacgtacattcttccatctctctgcacttaagggctatttgtatgccgtcggcggtcgcaacgcagcaggggaactgcccactgtagaatgttacaatcccagaacaaatgaatggacatacgtggccaagatgtccgagcctcattatggtcatgctggaaccgtgtacggcggagttatgtatatctccggcggaattactcacgatacgttccagaaggagctcatgtgcttcgacccagacactgataagtggatccagaaagctccgatgaccaccgtgcggggtcttcactgcatgtgcaccgtcggagagagactttacgtgattggtggaaatcactttcgcggtactagtgactacgacgatgtgctctcatgcgaatattactcccccattctcgatcaatggacccccatcgctgctatgttgcgtggacagtccgatgtcggagtagcggtatttgagaacaagatttatgtggtaggaggatatagttggaacaatagatgcatggtggagattgtgcagaagtatgaccccgacaaagacgagtggcacaaagtcttcgacttaccagagtcactcggtggcatccgggcatgcactttgaccgtgtttccgcctgaagagaccacacccagcccttcacgtgaatcgcctctgtccgccccatag

SEQ ID NO: 29186 - DNA, 1419 bp, Artificial Sequence
  Description of Artificial Sequence: Synthetic coding sequence
atgactacctgctctcggcagttcacttctagctcaagtatgaaaggatcgtgtggaatcggagggggtataggagggggatctagccgcatcagctcggtgctggcaggtgggagctgtagagccccaagtacatatggtgggggtctgtccgtgagtagcagcaggttctcttctgggggtgcatgcggcctgggaggcggttacgggggagggttctcaagctcatccagtagcttcggaagcggttttggcggaggttacggcggtgggcttggtgcgggtctgggtggtgggtttgggggaggttttgctggaggggatgggctactcgtaggctcagagaaggtgaccatgcaaaatcttaatgacagactagcgtcttacctggataaagtgagagcgttggaagaagcgaacgctgatcttgaagtgaaaatcagagactggtatcagcgtcagagacccgcagagatcaaagattattctccctatttcaagactatagaagatctccgcaataagatcttgactgcgacagtcgacaacgcaaacgtgctattgcaaatcgataatgctcggctggccgcagatgacttccgaaccaaatatgagacggaactcaacctgaggatgtcagtggaagctgacataaatggcttgcggcgtgtgctggatgaattgaccctagctagggccgatctggagatgcaaattgagagtttgaaagaggagctggcctatttaaaaaagaaccatgaagaggaaatgaacgcgttacggggacaggtcggcggtgatgtcaatgtagaaatggatgctgcaccaggtgttgacctgagtcgcatcctcaatgaaatgagggatcaatacgagaaaatggcagagaagaaccgtaaagacgccgaggagtggttctttaccaagactgaggaactcaatagggaggtggcaacgaactccgagctcgtgcagagcgggaaaagcgaaatcagcgaattgaggaggaccatgcagaacctggaaatcgagcttcagtcacagctctctatgaaggcctcccttgaaaactccctggaagagactaagggcagatattgcatgcagctggcgcagatccaggagatgatcgggagcgttgaggaacagttggcgcagctgcggtgtgaaatggaacagcagaatcaggagtataagatcttgcttgatgtgaagacaaggctagagcaagagatcgcaacataccggagattgttggagggtgaggacgctcatctgagctccagccagttctcaagcggcagccagtctagcagagacgtgacctcttctagcagacaaatccgaaccaaggtaatggacgtccatgatgggaaggtggtgagcactcacgaacaggtactaagaacaaaaaattag

SEQ ID NO: 29187 - DNA, 1293 bp, Artificial Sequence
  Description of Artificial Sequence: Synthetic coding sequence
atgagtttcaccactagaagtactttctccacaaactaccggagtcttggctccgtgcaagcccctagctacggagctcggccagtcagtagtgcagctagcgtttacgcaggagctggcggttccggttcgcgtattagtgtgagccgcagcacctcatttcgcggaggaatgggatccggcggtctcgccaccggtatcgctggcggactcgccggaatggggggtatccaaaatgagaaagaaaccatgcaaagtctgaacgacagactggctagctatttggaccgggtgcggagcctggagactgaaaatagacggctggaatcaaagatcagggagcacctggaaaagaagggtccacaggtgcgtgactggtctcactactttaaaataattgaggacttaagagcccagattttcgctaataccgtggacaacgccagaatcgttctccagatagacaatgctaggcttgcggctgatgatttcagggtcaaatacgagaccgaactcgccatgaggcagtcagtggagaacgacattcatgggctacgaaaggtaattgacgacacaaacataacgcgactgcaactggaaacggaaatagaggccctgaaagaagaattgttgttcatgaagaagaaccacgaggaggaggtaaaggggctccaggcccagatcgcctccagtggcctcactgtggaggtcgacgcccctaaaagtcaggatctcgctaaaatcatggccgacattcgagcccaatacgacgagctcgcacggaagaaccgggaagaactcgacaaatattggtcacagcagatagaagagtccacaaccgtggtgactacacagtcggcagaagtgggcgcagcagaaactacactcacagagctccggaggactgtgcaatctttggaaatcgacttggattccatgagaaatcttaaagccagtctagagaattccctgcgagaagtggaggcgcgatatgctctgcagatggaacagctgaacgggatcctactacacctagagtctgaactggcacagaccagagcagagggacagaggcaggcccaggagtatgaagccctcctgaatatcaaggtaaaactcgaggccgaaatcgcaacatacagaagactcctggaggacggggaggatttcaacctgggcgatgcccttgattccagtaattcgatgcagactattcagaagacgacgaccagacgcattgtggacggcaaggtcgtgtcggaaaccaacgatacaaaagttctgcggcattag

SEQ ID NO: 29188 - DNA, 1293 bp, Artificial Sequence
  Description of Artificial Sequence: Synthetic coding sequence
atgtcttttaccacgcggagcactttctcaactaactatcggtcactgggatctgtgcaggccccatcatacggtgcacggcctgtgagttccgccgctagcgtgtacgccggagcaggcggatctggctcccggatctcagttagcaggagtacttctttcagaggcggtatgggtagcggcggactcgctactggtattgcgggtggactggcgggaatgggcggaattcaaaatgagaaagagactatgcagtcattgaatgatcgtctagccagctatctggatagagtgaggagtctggaaactgagaatcgcagacttgagagcaaaattcgcgaacacctcgaaaaaaaaggccctcaagttcgtgattggtcccactacttcaaaatcattgaggacctccgcgcacagatcttcgccaacactgtcgacaacgctaggatagtccttcagatcgacaatgccaggctggccgctgatgattttcgagtgaaatacgagacagagctagctatgaggcagtccgtcgaaaatgatatacacggtctgaggaaggtaattgatgacacgaacatcactagactgcagttagagaccgaaatcgaggctctgaaggaagaattgctgttcatgaaaaagaaccacgaagaagaggtgaagggactacaggctcaaatcgcttctagcggtctgaccgtggaggtcgatgcgccaaaaagtcaggatctggccaaaatcatggccgacatcagggcacagtacgatgaactcgctcgaaaaaatagagaagagctcgataaatactggagccagcagatcgaagagagcactaccgtggttacgacacagagtgctgaagttggcgctgctgagacaacccttacagaactgagacggaccgtgcagtccctcgaaatcgacctggactcgatgagaaacctcaaggcctccctcgagaattcattaagagaggtggaagcaagatacgcgctgcagatggagcagctgaacggtattctcctgcaccttgaatctgagctggctcagacacgcgctgaaggacagcggcaagcccaagaatacgaagccctacttaatatcaaggtgaaactcgaggccgagattgctacctaccgaaggttgctggaggacggagaagacttcaacttgggagatgcgctggacagctccaattctatgcaaacaattcaaaaaacgaccacccgaagaatagtggatggcaaggtagtgtcagaaacgaacgacaccaaggtcctgaggcactag

SEQ ID NO: 29189 - DNA, 1203 bp, Artificial Sequence
  Description of Artificial Sequence: Synthetic coding sequence
atgacctcttacagttaccgacagtcttctgcgactagctcctttggaggactcggcggaggatctgtcaggttcggacctggcgtagcatttagggccccatccattcatggtggtagcggtggaaggggcgtctctgtaagcagcgccagatttgtgtcctcctcatctagcggagcctatgggggtggctacggtggtgtgctgactgcatctgatgggctcctggcaggtaacgaaaagctgaccatgcagaacctcaatgaccggttggcaagctatttggacaaagtgcgcgctcttgaggcggctaatggagaactggaagtgaaaatccgtgactggtaccagaagcaggggcctgggccttccagagattatagtcactactacactaccattcaggatttgagggacaagatacttggtgcaacaatcgaaaacagtaggatagtgctgcaaattgataacgccaggcttgcggcagacgatttccgtactaagtttgagacggagcaggctctgcgcatgagtgtcgaggcggacattaatggattgagacgagtcttagatgaactcaccctggcccgtacagacctggaaatgcagatagaaggcttgaaggaggaactggcgtacctaaaaaagaatcatgaggaagagatctcaactcttagaggccaagttggcggacaggtgtccgttgaagtcgactccgcaccaggtactgatctcgccaaaatactgtcagatatgcgaagtcagtatgaggttatggcggagcaaaacaggaaggacgcagaggcctggtttacctctcggacagaggagttgaatcgggaggtggccggtcatacagaacagctgcagatgagcagaagcgaagttaccgacctcagaaggactctgcagggcttagagatcgagcttcaatctcagctatctatgaaagccgctctggaggatacgctggctgagaccgaagcacgctttggcgctcaactggcgcatatccaagccctgatcagcggcatcgaggctcagctcggcgacgtacgagctgatagcgagaggcaaaaccaggaataccagagattaatggacattaaatcgcgactagagcaggagatcgccacctatcgctcactcctcgaaggccaagaagatcactataacaacctgtcggccagtaaggtcctctag

SEQ ID NO: 29190 - DNA, 591 bp, Artificial Sequence
  Description of Artificial Sequence: Synthetic coding sequence
atgacatcatatagctaccgtcagtccagcgctacgtcgtctttcggtggcctggggggaggttcagtgagatttggacccggtgtagcctttcgagccccttctatacacggcggtagtggtggccgaggggtctccgtgtcttccgctagatttgtaagctcatcaagctctggggcatacggtggaggctacggcggagttctcaccgctagcgatggactgctggccggaaatgagaaattgacaatgcagaatctgaacgacagactcgcctcttatttggacaaagttcgagccctggaggctgctaacggtgagctcgagatcttaggcgctaccattgagaatagccgcattgtgctgcagatagacaatgccagactggccgcagacgatttccgaacaaagttcgagaccgaacaagcgttgcgcatgagtgtagaggcggacatcaacggcctgagaagggttctggacgaattgaccctcgcccgtactgatctggaaatgcaaattgaaggtctcaaggaggagctggcgtacctgaagaaaaatcatgaggaggaaataagtacccttcgaggctag

SEQ ID NO: 29191 - DNA, 1773 bp, Artificial Sequence
  Description of Artificial Sequence: Synthetic coding sequence
atgtctagacagtcaagtgtgagtttccggtccggcggttcccggtccttttcaaccgcttcagccatcacgccctcggtgtccaggacatccttcacgtctgtcagccgaagcggcggaggaggcggaggcggatttggacgggtcagcctagcgggagcatgcggggtggggggatatggctccagatctctgtacaacctggggggttccaaacgcatttccatcagcacctctggaggctctttccggaatcgctttggggctggcgcaggaggcggatacgggttcggcggaggcgctggcagcggcttcggctttggcggaggggctgggggtggtttcggtctcggcggtggagccggatttggtgggggtttcggagggccaggctttccagtctgccctccgggtggcatacaagaagttaccgtgaatcaatccctgctcacgcctctgaatttgcagatcgacccctctatccaaagagtgaggactgaggagagggagcagatcaaaaccttaaataataaattcgccagcttcatagacaaggtcagattcttagagcaacagaacaaggtgcttgacacaaagtggacactcctgcaggagcaaggtacaaaaaccgttcggcagaacctcgaacccctattcgagcaatatattaataatctcagacggcaactggactctattgtcggtgagcgtggtcgactggattctgagctgagaaacatgcaggatctggtggaggacttcaagaacaagtatgaagacgagatcaacaaacgcaccacagctgaaaatgaatttgtgatgctgaagaaagatgtcgatgccgcatacatgaacaaggtggagcttgaagccaaagtggatgctctgatggatgagatcaatttcatgaaaatgttcttcgacgccgagctgtcccagatgcagacacacgtcagtgacaccagcgtcgtgctttcaatggacaacaaccgtaatctggatcttgactctatcattgccgaagtgaaggcccagtatgaggagatcgcgaatagaagcagaacagaggccgaaagctggtatcagacgaaatatgaggagttacagcagacggccggaagacacggtgacgacctgaggaatacgaagcatgaaataagcgagatgaatcgaatgatccagagactgcgggcagagattgacaacgtgaaaaaacagtgtgccaatttacaaaatgctatcgctgacgccgaacaacgcggagagctggccctgaaagatgcacgcaataaactagccgaactcgaagaggcgcttcagaaggcaaagcaggacatggcgagattattacgggagtatcaggagttaatgaacacaaagctagcgttggacgtggaaatcgcaacatataggaagctgcttgagggtgaggaatgccgcctgtccggagaaggggtgggtcctgtcaacatctctgtggtgacttcttctgtctcttctggctacggctcaggttcaggctacggaggcggactgggaggcggactggggggtggcctggggggaggactggcaggtggctcttccggatcatattacagctccagcagtggcggagtaggcctgggagggggtttatccgtcggaggcagcgggttcagcgccagctcagggagaggactgggagtgggcttcggctcaggcggaggtagctcttcatccgtaaagtttgtctcaacaactagctcgtctcggaagtcttttaaatcctag

SEQ ID NO: 29192 - DNA, 1668 bp, Artificial Sequence
  Description of Artificial Sequence: Synthetic coding sequence
atgagcaggcagagcagcgtctcttttagatccgggggatcccggtccttctccactgcatctgccattacgccctcagtcagtaggacatctttcacctcggtttctaggtcgggtggcggaggaggcggagggttcggaagagtgtctctagcaggggcttgtggtgttggcggatacggattcggcggtggagccggaagcgggtttggattcggcggaggcgctggcggaggatttgggctcggcggaggggcagggttcggcggaggcttcggcggacctggcttccctgtatgcccaccgggaggcatccaggaggtgactgtgaatcagagtttactcacccccctcaatcttcaaattgacccatctattcagcgggttcgaactgaagagagagagcaaataaaaacactcaacaataagtttgccagctttatcgataaggtgcgattcttagaacagcagaataaggtgctggacactaagtggacgctgctgcaggagcaaggaactaaaaccgtgcgccagaatcttgagcccttgttcgagcagtacatcaacaacttgcgtaggcagctggattccattgtgggagaaagaggacggttagactcagagctgcggaatatgcaggacttagtggaagatttcaagaacaagtatgaggatgaaatcaacaaaagaaccacggctgagaacgagttcgtaatgttaaaaaaagacgtggatgctgcatatatgaataaggtcgaacttgaggctaaggtggacgcactcatggatgaaatcaacttcatgaaaatgttcttcgacgcagagctaagccagatgcagacccacgtgtccgatacatctgttgtgcttagtatggataacaaccgcaatttggatttagactcaattattgcagaagtgaaggctcagtatgaggagattgccaacaggtcacgcacagaggcagaatcctggtaccagaccaagtatgaggagcttcaacaaacggccggaaggcatggagatgacctgagaaacacaaaacatgagatctctgaaatgaaccgtatgattcaacgtctacgggctgagattgataacgttaagaagcagtgtgccaacctgcagaatgctatcgcggatgctgagcagaggggcgaattagccctgaaagatgcccgaaacaagctggcagagctcgaggaagcacttcaaaaagcaaagcaggacatggcgagactgctcagggagtaccaagagttgatgaacacaaaactcgccctcgacgtggaaatagccacttatagaaagcttttagagggggaagagtgccggctgagtggcgaaggagtgggcccagttaatatctctgtcgtgacatccagcgtttcttcaggatacggatcaggaagcggttatggcggaggactcggagggggactcggcggaggcttaggcggtggtcttgccggtggatcaagcgggtcctactacagctcttctagtggaggggtgggactgggagggggtctcagcgtcggcggaagtggctttagcgccagctccgggaggggacttggcgtggggttcggcagtggcggaggaagctcatcatccgtaaagttcgtctctaccactagcagtagtcgcaaatcattcaaatcatag

SEQ ID NO: 29193 - DNA, 399 bp, Artificial Sequence
  Description of Artificial Sequence: Synthetic coding sequence
atgtcaagacagagcagcgtgtctttccgctcagggggttctagaagtttctcaaccgcctccgcaatcacaccctccgttagtcggaccagttttacgagtgtgtcaagaagcgggggaggaggtggcggtggatttggtcgtgtctctctggcgggtgcttgtggggtaggagggtacggctcgcggagcctgtacaacctggggggtagcaagaggatttcaattagcacctcaggaggaagctttagaaatcgttttggggcaggcgcaggcggaggctatgggtttggcggaggcgctggtagcgggttcgggttcggcggtggcgcagggggtggattcggactcggagggggtgccggatttggcggtggctttggtggtcctggtttctag

SEQ ID NO: 29194 - DNA, 1410 bp, Artificial Sequence
  Description of Artificial Sequence: Synthetic coding sequence
atgagtattcatttctcatcccctgttttcactagtcgaagcgcagcgttttccggcaggggcgcacaggtacgactgagctcggccagaccaggaggattaggaagttcctctttgtacggtctaggggcttctaggccccgagtcgcggttaggtccgcctatggaggccctgttggcgcaggcatcagagaagtgacaattaaccagagtcttctcgcacctctccgtcttgacgcggatccatccttacagagggtcagacaggaggaatccgagcaaatcaaaacactgaacaataaattcgcttcattcatcgacaaggtccgatttcttgagcagcagaacaaattactggagacaaagtggacgttgttgcaagaacagaagtctgctaagagcagccgtctcccggatatctttgaagcccagattgctgggcttagagggcaactggaagcgttacaagttgatggtggcagactggaggccgagctgcgtagcatgcaggatgtggtggaggattttaagaacaagtacgaagacgagataaatcatagaaccgcggctgaaaacgagttcgtggtcctgaaaaaagatgtggacgctgcctacatgagtaaggtggagctggaagccaaagtggacgccctgaacgatgagattaatttcctgcgaacactgaacgaaaccgaactcactgagcttcagtcccaaatttccgacacatctgtggttctatctatggataacagtagatcgctggatttagatgggatcatcgctgaagtcaaagctcagtacgaggagatggcgaaatgctccagagccgaggcagaggcttggtaccaaacgaagttcgaaaccctgcaggcgcaggccggaaaacacggggatgatctgagaaatacacgaaatgagatttcagaaatgaatagagcaatccagcgcttacaggctgagatagacaacataaaaaatcaacgcgctaagctcgaagccgctatagccgaggccgaagagcggggagagctggccttaaaagacgcccgtgccaagcaagaagagctggaggctgccctccagcgtggcaagcaggatatggcacggcaactgagggaataccaagagcttatgtcagtcaagctggctttggatattgaaatcgctacttatagaaagttgctggaaggagaagaaagtagactggctggcgacggtgtgggagccgtgaacattagtgtgatgaattcaactggcggaagctcttccggtggtggcatagggttgacccttgggggaaccatgggatccaatgcgctctcattctcgagttcagcaggccctgggctgcttaaggcttattcaatacggaccgcctctgcctctcggcgttcagccagggactag

SEQ ID NO: 29195 - DNA, 1338 bp, Artificial Sequence
  Description of Artificial Sequence: Synthetic coding sequence
atgtctatccacttctcaagccctgtgttcaccagccgctccgctgctttctcgggacgcggtgcccaagtgaggttaagttctgcgagaccaggaggcctcggaagctcatcactttatggcctgggcgcatcccgtccacgggtagccccactcaggctagatgctgacccttcactccaacgcgtacggcaagaagagagcgaacagatcaaaactctgaacaacaaattcgcgtctttcatcgataaagtcaggtttcttgagcagcagaacaaattgctggagacgaagtggacgctcctgcaggaacaaaaaagtgctaaatccagcagactaccagatattttcgaagcgcagattgctggccttcgtggacagcttgaggccctgcaggtggacggcggaaggttggaggccgagctgagaagtatgcaggacgtagtggaagactttaaaaaccggtatgaagatgagattaaccacaggacagcagctgaaaacgagtttgttgttttaaaaaaagacgtcgacgcagcatatatgtcaaaagtagagttagaagcgaaggtcgatgcgttgaatgacgagattaacttcctccgcacccttaacgagactgagcttaccgagctgcaatcacagatctccgacacctctgtggtcctcagtatggacaattcgcgctctctagaccttgatgggatcatcgctgaggtcaaggctcaatatgaggagatggctaagtgttctcgggcagaagccgaggcttggtaccagacgaagtttgaaaccttacaggcccaggctggaaagcatggcgatgacttaagaaacacaagaaatgaaatatccgaaatgaaccgggctattcagcgtctccaggccgagatcgataacattaaaaatcagagggctaagcttgaagccgctattgctgaagccgaggaacggggtgagctggccctcaaggatgccagagcaaagcaggaagagctggaggccgctctgcaacgtggcaaacaggatatggcacgccagctgagagagtatcaagagctgatgagcgtgaagttggcattggacatcgaaatcgccacctatagaaaactgctggagggagaggaatctcgattggctggtgacggtgtcggggcagtcaatataagtgttatgaacagtactggtggcagtagcagtggtggaggcattggcctgaccttgggcggaactatgggaagcaacgcattatcgttctctagctccgctggacctggacttctgaaagcctacagcatacgcaccgcttctgccagtcgtcgctccgcaagggattag

SEQ ID NO: 29196 - DNA, 1212 bp, Artificial Sequence
  Description of Artificial Sequence: Synthetic coding sequence
atgagcatacacttctccagtcctgtgtttacatcgcggagtgccgcattttcaggaagaggtgcgcaagtgcggttatcatcagccaggcccggtggactgggtagctcatcattatacgggctaggcgcatcacgccctcgggtggctgtgcgatccgcttacggcggtccggtgggggctggcatacgcgaagttaccatcaaccagagcctcctggctcctttaaggctcgacgcggacccatcgctgcagagagtgaggcaggaggagtctgagcagatcaaaacactcaataacaaattcgcatcgttcattgacaaagtaaggttcctcgaacagcagaataaactactggagacaaaatggactctgctgcaagaacagaagtccgctaaatctagccgcctcccagacatctttgaagcacagattgccggtttgcgcggacagctagaggctctccaggtagacgggggtcggttggaggcggagcttcggagcatgcaggatgtggtcgaggatttcaaaaacaaatatgaagacgaaattaatcaccgcactgcggctgaaaatgaattcgtagtcttgaagaaagacgtggatgccgcttacatgtccaaagttgagctcgaagcaaaagttgacgccctgaacgacgaaattaattttctcagaaccttgaacgagactgagatccacgtgcttcagtctcacatcagcgatactagcgtggttgtaaagctcgataacagtcaggatctgaacatggactgtattattgccgaaattaaagcccagtacgacgacatcgtgacatgctcctgggctaaggctgagtcttggtaccacggatgtctggaaatgaaggcgacagtcatttggcatggagagaccgtcggttgcaccaaggaggagattaaggagttaacgcatatgatccagcggctgatggccaaggtagaaaacgcaaagtgtcagaacagcaagctggaagtcgaagtgacacagagtgagcagcagggggaggtcgctctgtctgacaatagatgcaagttggtggagctggaagggactatgcagaaggccaggcaataccaggaggtaatgaattccaaactgggactgaatgtgaaagcggcttcatcttgccatctgctggacggggaggaacagagattgtgcgacggtatcagtgctgtgaacatttag

SEQ ID NO: 29197 - DNA, 1452 bp, Artificial Sequence
  Description of Artificial Sequence: Synthetic coding sequence
atgtccatccgggtgacacaaaaatcttacaaagtctccacctccggacctcgcgctttctcctcaagaagctatacaagcggccctgggtcgcggatttcctcctcatcattttccagagtcggctccagtaatttcaggggcggactaggagggggttacgggggagcctcaggaatgggcggaatcacagctgtaacagtgaatcagtccctcctctcaccactggtgttagaagtagacccaaatatccaggctgtgcggacacaggagaaggagcagattaagacgctcaataataagttcgcctcattcatcgataaggtgcggttcttggagcagcagaataaaatgcttgagaccaaatggagcctgctccagcagcagaaaacagctaggagcaatatggataatatgtttgaatcatatatcaataacctccgtagacagctggagaccctgggccaggaaaagctgaaactggaggccgagttagggaatatgcaaggtctcgtggaggactttaaaaacaagtacgaggatgaaatcaacaagcgaacagaaatggaaaacgagttcgtgctgataaagaaagacgtagacgaagcttatatgaataaagtggagctcgagtctcgcctagaaggcctgacagatgagataaattttctgcgtcagctgtacgaagaggaaataagagagttgcagtcccaaatcagcgacacttccgtggttttatcaatggataatagccggagcctggacatggactccattatcgcagaggtgaaagctcagtatgaagacatcgctaaccgaagtcgagctgaagcagaaagcatgtatcagatcaagtatgaggaactacaaagcctcgcaggcaagcatggggatgatctcagaaggaccaaaaccgaaatatcggaaatgaataggaatattagcagacttcaagctgagatcgaaggcctgaagggccagagggcatccctggaggcagcaatcgcagatgctgagcagcgcggtgagctcgccatcaaagacgccaacgctaaactgtctgagctggaagcagccctgcagcgtgctaagcaggatatggcccgacaactccgggaataccaggaattgatgaatgtgaaactggcactagatattgagatcgctacctacaggaagttgttggagggggaggaatccagacttgagagcggtatgcagaatatgtccattcacactaagaccacttccggatacgccggaggcctgagctccgcttacgggggtcttacaagccccggtctgagctactccctgggctcaagttttggctctggcgcaggctcttctagtttctcaaggactagctcatcgagggctgtggtggtaaagaaaattgagaccagagacgggaaattagtgtccgagtccagcgacgttctgccaaagtag

SEQ ID NO: 29198 - DNA, 822 bp, Artificial Sequence
  Description of Artificial Sequence: Synthetic coding sequence
atgtctataagggtgacacaaaagagctataaagtcagcacgagcggtcccagagccttctcttccaggtcatacacttctggaccgggttcgaggattagttcatcctcttttagtagagttggaagcagtaattttcgtgggggtttaggtggtggctacggtggggcttccggcatgggcggaattaccgctgttactgtgaaccaatcactcctcagcccactggtgctggaggttgacccaaatattcaggccgtaagaacacaggaaaaggaacaaatcaagaccttgaataataagtttgcctcattcatagataaagtgaggtttctcgaacagcagaacaagatgctcgaaacaaagtggtctctgctgcaacagcagaaaacggcacgtagcaatatggataatatgttcgagtcatacatcaacaatctgcgcaggcagcttgaaacgctgggacaggagaagctgaagctcgaagccgaattgggtaatatgcagggcttggtggaggactttaagaataagtatgaagatgagattaacaagcgaaccgagatggagaatgagtttgtgcttatcaagaaagacgtggacgaggcgtatatgaataaagtcgagctagaaagtcgcctcgagggcctgaccgatgagattaacttcttgcggcaactgtatgaggaggagattcgcgagctgcagtcacagatatccgacacttccgtagtgctgtccatggataattcacggtcgctagacatggacagcatcatcgccgaggttaaggctcaatatgaagatatcgcaaaccggtag

SEQ ID NO: 29199 - DNA, 1452 bp, Artificial Sequence
  Description of Artificial Sequence: Synthetic coding sequence
atgtcgatccgcgtgacccaaaagtcatataaggtcagtacttccgggcctagggcctttagcagccgctcatacacatccggcccagggtccagaatcagtagttcatcgtttagtcgtgtgggaagcagcaatttcagaggcggattggggggtgggtatggcggtgcttctggtatgggcggtattaccgccgttacagtgaatcagtctctcctctctcctttggtcctggaagtggaccccaatatccaggcagtacggactcaggagaaggagcagatcaaaactctgaataacaaattcgccagcttcatcgataaagttagatttttagaacagcagaacaaaatgctggagacaaaatggtcactgctccagcagcagaagacggcccgaagcaacatggataatatgtttgaatcttacatcaacaacttgcggagacaactagaaaccctgggccaagagaaactcaagctcgaggctgaattgggcaatatgcaggggctggtggaggactttaaaaacaagtatgaggacgaaataaataaaaggaccgaaatggagaatgagttcgtgctgatcaagaaagatgtagacgaagcttacatgaacaaggttgaactagagtcccgcctcgaaggcctgactgatgagattaattttctacgtcagctgtacgaggaagagatacgggaacttcaatcccagatcagcgatacctctgtggtactttctatggataatagccggagcctcgatatggacagcattatagccgaagtgaaggcacagtacgaggacatagctaaccgatcacgcgctgaggctgagagtatgtatcagatcaagtatgaagaactccagagcctggcaggcaaacatggagacgatctgcgtaggacaaaaaccgagatctctgagatgaaccggaatatctcccggctacaagcagaaattgaaggacttaaggggcaacgtgcttctcttgaggccgctattgctgatgccgaacaacgcggagagctcgccattaaggacgccaatgcaaagctgagcgaattggaggccgcattacagcgcgctaagcaggatatggcacggcagctccgcgagtaccaagaactgatgaacgttaaattggctcttgatatcgagattgctacatacaggaaattgctcgaaggcgaagaatctcgtctcgaaagtggtatgcagaatatgtctatccacaccaagactacaagcggctatgcagggggactgtcgagcgcctacggtggcctcacttcacctggattatcctactccttgggtagtagcttcgggtccggtgcaggttcaagtagttttagtaggacgtcatcctcccgggctgtggtggtgaagaagatagagacacgcgacggaaagctcgtgtctgaatcttccgacgttctgcccaaatag

SEQ ID NO: 29200 - DNA, 534 bp, Artificial Sequence
  Description of Artificial Sequence: Synthetic coding sequence
atgagtatccgggtgacgcagaagtcctacaaggtcagcacctccggccctagggctttctcctccaggtcctatacctctggtcccggatctagaatctcttcatccagcttttcccgggtgggcagctcgaacttccgaggtggtctaggtggcggttatggaggcgcttccggtatgggcggtatcacagctgtgacagtgaatcagtccctgttgagccccctggtgcttgaagtggaccccaatatacaagccgtgcgtacccaggagaaggaacaaattaagaccttgaacaataagttcgcctctttcattgataaagtgcggtttctggaacaacagaacaagatgttggaaacgaaatggtcgcttctccagcagcagaagaccgcacgatcgaatatggacaatatgttcgaaagctacatcaacaaccttcgtcgtcaactggagacactgggccaggagaagctgaagcttgaagccgaactggggaatatgcaagggctcgtggaagacttcaagaactag

SEQ ID NO: 29201 - DNA, 1536 bp, Artificial Sequence
  Description of Artificial Sequence: Synthetic coding sequence
atgaacggagtctcttggtcacaggacctgcaggagggtatcagtgcctggtttggccctcccgctagtactcccgcatctacaatgagtatccgcgtcactcagaagagctataaggttagtacctcagggcctcgcgcattttcatcccgctcatacacatctggtccaggctctaggatcagctctagttcttttagtcgcgttgggtcctcaaactttcgcggtggtttaggcggagggtatggaggagccagtggcatgggtggcatcacagcggtaacggtaaaccagtctctgttatcaccactcgtgctggaagtcgatccaaacatccaggcagtccggactcaggagaaagagcagattaagacgttaaacaataaatttgcatcctttatcgacaaggtgaggtttttggagcagcagaacaagatgctcgagacaaagtggtccttgctccaacagcaaaagacagccaggtccaacatggacaacatgtttgagtcgtatatcaataacctgcggaggcagttagagacgctaggacaagaaaagctgaaattagaggcagagctaggtaatatgcaagggctggtggaagacttcaagaataagtatgaggacgagattaacaagaggaccgagatggagaacgagtttgtgctgatcaaaaaagatgtggatgaggcctacatgaacaaggtggaattggagagtaggttggaaggattgacagacgaaatcaatttcctgcggcagctctacgaggaggaaattcgcgaattgcagagccagatatccgacacctctgtggttttatcaatggacaacagcaggtctctggacatggatagcataatagccgaggtgaaggcccaatacgaggacatcgcaaataggtctcgagcagaagccgaatccatgtaccagattaagtacgaggagctacagagcctggcagggaaacatggggatgacctgcggagaacgaaaacggaaatctccgaaatgaaccgaaatatttctcgcttgcaggccgaaattgagggcctgaaaggacaaagggccagcctagaagctgccattgctgatgcagagcagcggggtgaactggccattaaggacgccaacgctaaactcagcgagctagaggctgccttgcagcgggctaagcaggacatggcgagacagctaagggaataccaggagctaatgaacgtgaagctagcactggacattgagattgccacctatcggaagctgcttgagggagaagagtctaggctggaatcaggaatgcagaacatgtctatccacacaaagactacaagtggctatgcgggtgggttgagctctgcttacggtggcctcaccagcccaggcctcagttatagtctgggaagctcattcgggtcaggagcaggttctagtagttttagtcggacgagttcctcgagagcagtagtggtgaagaaaattgaaaccagagacgggaagctcgtctctgagtccagcgacgtgcttcctaagtag

SEQ ID NO: 29202 - DNA, 1452 bp, Artificial Sequence
  Description of Artificial Sequence: Synthetic coding sequence
atgtccatccgagtgacccagaagtcctacaaggtatcaacgtctggccctcgtgcatttagctcaagatcttatacttccggtccaggctcccgcataagctctagttccttctcccgtgtgggatcatctaacttccggggtggtctaggaggcggatacggaggcgcttcaggaatggggggaatcactgcagtgaccgttaatcagtctctgctctcacccctggtgctggaggtggaccccaacattcaggccgtgcgcacacaggagaaagaacaaatcaaaactctgaataacaagttcgccagtttcattgataaagtcagattccttgagcaacagaacaagatgcttgaaaccaaatggtccctgctgcagcagcagaaaacagccaggtctaatatggacaacatgttcgagagctatatcaacaatctgcggaggcagctcgagactcttggacaagagaagctgaagctcgaggctgaactcggaaatatgcaggggttggttgaggactttaaaaacaagtacgaggatgagatcaataagcggactgagatggagaacgagtttgtcctgattaaaaaggacgtggacgaggcttatatgaacaaagtcgagttagagtctcgcctggagggcctcactgatgaaatcaacttcctccgacagctttatgaagaggagattcgcgaactccagagccagatcagcgatacaagcgtcgtattgagtatggataattcgcggagtttggacatggattcaattatagccgaggtaaaggcacaatacgaagatatcgcgaataggagtcgcgcagaggcagagagcatgtatcagattaaatatgaggaacttcagagcctggcaggcaaacacggtgatgacctcagacgcactaaaacagagattagcgagatgaataggaacattagtcgcttgcaggctgagatcgaagggttgaaagggcagagggccagcttggaagccgcaatcgccgatgctgaacaacggggagagcttgccatcaaggacgctaatgcaaaactcagcgaactggaagccgcactgcaacgtgccaagcaagacatggctcggcaactgcgtgaatatcaagaattgatgaacgtgaagctggcactggacattgaaattgcgacataccgtaagttgttggaaggggaggaatctaggctcgagagcggaatgcagaacatgtctattcacactaagaccacttccggctatgcaggtgggctgagttcggcctatggtggtctgaccagccctggcttgagttattccttgggctcaagctttggctccggcgcaggatcctctagtttctcccgaacctcctcatctcgggcagttgtggtgaagaagatcgaaacccgcgacggcaagctggttagcgagtcctccgacgtcctgcctaagtag

SEQ ID NO: 29203 - DNA, 4071 bp, Artificial Sequence
  Description of Artificial Sequence: Synthetic coding sequence
atgcaaagcaaagtgctcttggctgtcgccttatggctctgcgtggaaaccagggccgcaagtgtaggcctgcccagcgtttcactggacctccctaggctgagcattcagaaagacatactgacaatcaaagcaaatacaacattacagatcacatgcagaggccagcgcgacttggactggctgtggcccaataatcagtctggaagcgagcaacgcgtggaagttacggagtgctcagacgggctcttctgtaagacccttactatccccaaagtaatcggaaacgacacaggggcatataagtgcttctatagagagaccgatctcgcttccgtgatctacgtgtatgtgcaggattaccgcagcccatttatcgccagcgtgtcagatcaacatggagtggtgtacatcaccgaaaataagaacaagacggtggtcattccttgcctcggtagcatctctaatctcaacgtgtctctgtgcgcgcgataccccgaaaaaaggttcgtgcccgatggtaacagaatttcctgggatagtaagaagggttttactattccctcttacatgatctcttatgccggaatggtgttttgtgaggccaaaataaacgatgagagctaccagagcattatgtatatcgtcgtggtcgtgggttaccggatctacgatgttgttctgtccccgtcgcacggtattgagttaagcgtgggggagaagcttgtgttaaattgcacagccagaaccgagctaaacgtggggattgatttcaattgggagtaccctagctccaaacaccagcacaagaagctcgtcaatagggatctgaagactcagtctggatccgagatgaaaaagttcttatctaccttgacaatcgacggtgtgacccgatctgatcagggcttgtacacatgcgctgcctccagcgggcttatgaccaaaaagaattctacatttgtcagagtgcacgaaaaacccttcgtagcatttggatccggaatggaatctctggtggaagctacggtgggcgagcgggtcaggatcccagcaaaatacctggggtacccgccaccagagattaagtggtacaagaacggcatcccactggagtctaatcataccattaaggctggccacgtgttaacaattatggaggtttccgaacgagacacagggaactacacggttatcctgactaacccaatctcaaaagaaaagcagtctcacgtggtgagtctcgtggtgtacgtgcctccacagatcggagagaagtctctgatatcgccggtcgatagctatcagtacggaactacccagacgttgacgtgcaccgtgtatgccatcccccctccccaccacatccattggtattggcagctcgaggaggaatgtgctaacgagcccagccaggccgtgagtgttacaaatccgtatccctgcgaggagtggagatctgtcgaagactttcagggcggaaataagattgaagtcaataaaaaccagttcgcattgatcgaaggaaaaaacaagacagtgtctacactcgtcattcaggctgccaatgtcagcgccttatacaagtgcgaggccgtgaacaaggtgggtcggggtgagagggtgatcagttttcacgtcacaaggggtccagagatcaccctccagcccgacatgcagcctaccgagcaagagtcagtatccctgtggtgtaccgccgaccgcagcacattcgagaatctgacttggtataagttgggaccacagcctctccccatccatgttggtgagctgccgacacctgtttgcaagaatctcgacactctctggaagctgaacgcgacaatgtttagcaattctacaaatgacatcctcatcatggagctgaaaaacgctagcctgcaagatcaaggggactatgtttgcctggcacaggatcggaagacgaagaagcgtcattgcgttgttcggcagctcacagtactggaacgtgttgccccaacaatcactggaaatctcgagaatcagaccaccagtattggggagtctatcgaggtcagttgtactgcatcaggcaatccgcctccacaaattatgtggttcaaggataacgagactctggtcgaggacagtgggattgtgctgaaagatggaaataggaatctgactattcgtagggtcaggaaagaagacgagggtttatatacttgtcaagcttgttccgttcttggctgcgcaaaggtggaggccttcttcattatcgaaggggctcaggagaagacgaacctggagataattatccttgtcggcacagccgtgattgccatgttcttttggctgctgctggtgattatcttgaggacagtaaagagggccaacggaggcgagctgaagaccggctatctgtccatcgttatggatcctgacgagttgcccttggatgagcactgtgagcgcctgccatatgatgcaagtaaatgggaatttcccagagacaggttaaagctcggcaagcctctggggaggggcgcttttggccaggtcattgaggcagatgcgtttggaattgacaaaactgctacctgccgcaccgttgccgtgaaaatgctcaaagagggcgcaacccacagcgagcatagggctctgatgagcgaattgaagatcctgattcatatcggacaccatctaaatgtggtaaatctcctcggagcctgtactaaacctggagggccactcatggtaatagttgagttttgcaaatttggcaacctaagcacttatcttcggtcaaagcgtaacgaatttgttccatacaagacaaagggagctcgcttccgccaaggaaaagattacgttggagccatcccagtcgacctgaagcgacgtcttgacagcatcacatcatcacaatcctctgctagcagtggatttgttgaggagaagtcgctctcagatgtagaggaagaagaagctcccgaggacctctacaaggactttcttaccttagagcacctgatctgctatagttttcaggtcgcgaagggaatggagttcctggcctcaaggaagtgtatccatagagacctcgccgcacggaatatactgttatcagagaagaatgtggtcaaaatctgcgatttcggcctcgccagggacatatacaaggatcccgattacgtccggaaaggggacgcacggcttcctttaaaatggatggctccggaaacgatcttcgatcgcgtgtacaccattcagtccgacgtgtggtcctttggcgtgcttttgtgggaaatcttttctcttggcgcttccccatacccgggagtgaagattgatgaagagttctgtaggcggctgaaggaaggtaccaggatgcgcgctcccgattacaccacccccgaaatgtaccagactatgcttgactgctggcacggagaaccctcccagcgccctaccttttcagaactggtggagcacctcggtaacctactccaggcaaacgcgcagcaggacggcaaagattacatcgtgctaccgattagcgaaaccctgtcaatggaagaggacagtggtctatccctgcccacctccccggtaagttgcatggaagaggaagaagtgtgcgatcctaaattccactacgacaataccgccggtatctcccagtatctccagaactctaagagaaagagtcgccctgtttctgtaaagacctttgaagacatcccactagaagaaccagaggtgaaagtcattccggatgacaaccagacagattccgggatggtgctggcgagcgaggagctgaagacactggaagatcggacgaagctatcccccagttttggaggcatggtgcccagcaaatcccgcgaatccgtggcgtctgaagggtcgaaccaaacatctggctaccagagcggctaccacagtgatgacaccgacaccaccgtttacagctcggaggaggccgaactgcttaagctgattgaaattggagtccagacagggtcgaccgcccagatcctgcagccggactctggaaccacccttagctcccccccagtctag

SEQ ID NO: 29204 - DNA, 6629 bp, Artificial Sequence
  Description of Artificial Sequence: Synthetic coding sequence
atgtggaacgatatcgagctgttgactaatgacgacacgggatccggctatttaagtgtcggtagcaggaaggagcatggaacagctctgtaccaagttgatctgctggttaaaatctccagcgaaaaggcctctttgaacccgaaaatccaggcgtgttctctctctgacggttttatcatagtggcagaccagagtgtaatactactggactccatttgcagatccttacagttgcacctcgtctttgacacagaggtggatgtggttgggctttgccaggaaggaaaatttcttctggtcggagagagatccggtaatctgcacctgatccacgtcacttcaaagcagaccctcctaacaaatgcgttcgttcagaaagctaacgacgaaaaccgtagaacataccagaaccttgtaattgaaaaagatggcagcaacgaaggaacctattatatgctcctgctgacctactcaggtttcttttgcatcaccaaccttcagctgctgaagattcagcaggctatcgagaacgtggacttctcgacagccaagaagctgcagggccaaattaagtccagtttcattagtacagagaactatcatacactggggtgtttaagcttggtggctggcgaccttgcatccgaggtgccagtcattatcggtggaacaggcaactgtgcattttctaagtgggaacccgattcttctaagaaaggaatgacagtgaaaaatttgattgacgcagaaattatcaagggcgcaaagaaattccagctgatcgataatcttctgttcgtgctggacacagacaacgttctctctctgtgggatatttacacactaacaccagtttggaactggccttccttgcatgttgaggagttcctgttgacaaccgaagcagactcaccatcttccgtgacctggcaaggcatcaccaatcttaaactgattgctctcactgcgtccgcaaacaagaagatgaaaaacctaatggtatacagtctccctactatggagattctttacagccttgaggtgtcaagcgtcagtagcctcgtgcagaccgggatcagcaccgatactatctatcttttagaaggagtttgcaaaaacgatcccaagctcagtgaagacagcgtgtctgtcctggtactgaggtgcctgacagaggccttgccagaaaaccgtctgagtaggttgctacataaacatcgcttcgccgaggctgagtcctttgctatccagtttgggctggatgtggagttggtatataaagtgaagagcaaccacatattagagaagttagcactttccagtgtggacgcttccgaacaaaccgaatggcagcaactggtcgatgatgccaaagaaaatctccacaagatccaagacgatgaatttgttgttaattattgccttaaagctcaatggatcacgtacgagacaacccaggaaatgctgaactacgccaagacgaggttgctgaagaaagaagacaagactgctctgatttatagcgatgggctgaaagaagtactgagagcacatgcaaaactaacaaccttctacggggctttcggcccagagaaattcagtggatccagctggatcgagtttctgaataacgaggatgatttgaaggacattttcctgcagcttaaggagggcaatcttgtttgtgcccaatatctctggctacggcaccgggctaatttcgaatcccgatttgacgtgaaaatgctcgaatctctcttgaattctatgtctgctagcgtgtctctgcagaagctctgcccatggtttaaaaacgatgtgatccctttcgtgaggcggacagtccctgagggtcagattatccttgctaaatggcttgagcaggccgcacgaaaccttgagctgacagacaaagctaactggcctgaaaatgggctccaactggctgaaatctttttcaccgcggaaaaaacagacgagctgggacttgcatcaagttggcactggatctcactgaaggactaccagaacactgaggaagtgtgtcagctccggacactcgttaataacctgagagagctgataaccctccacaggaagtacaactgtaagctggccctgagcgactttgaaaaagagaacacaaccaccatcgtcttcaggatgttcgacaaggtgttggcgccagaactgattccatccattctggagaaattcattcgagtgtatatgcgcgagcacgatttacaggaggaggaactgttgctgctgtatatcgaggacttgctcaaccgctgcagcagcaagagcacctctctatttgaaactgcctgggaagcgaaggccatggctgtgattgcgtgtctgagcgatacggatctcatctttgatgctgtcctgaagataatgtacgcagctgtggtgccatggagtgctgctgttgaacagctcgtcaaacaacacctcgagatggaccaccccaaggtgaaactgctccaggaaagctacaaactcatggaaatgaagaaactgctccgaggctacggtataagagaggtcaaccttctgaataaggagattatgcgggtggtgcgctacattcttaaacaggacgtgccaagctccctcgaagacgcactcaaggtagcccaggcattcatgttgagtgatgacgaaatttattccctgcgcatcatcgatcttatcgaccgggagcagggggaggactgcctgctgctgctgaagtctctgcccccagccgaagcagaaaaaactgccgaacgagttatcatttgggcacggctggctctgcaggaggaacccgatcactcaaaagagggtaaggcttggcgaatgagcgtggctaaaacatctgtcgacatcctgaagatcctgtgtgacattcagaaggacaacttgcagaagaaagatgaatgcgaggagatgctgaaactttttaaagaggtcgcctccttacaggagaacttcgaggtgttcctctcttttgaggactactctaattccagtctggtcgccgacttgcgggaacaacatatcaaggcccacgaagtcgcccaggcaaagcacaaaccgggatcaacaccagagccgatcgctgcagaagtacgatcacccagtatggagtccaaattacaccggcaggcactggccctacagatgtccaaacaggaactcgaggccgagcttacactgcgtgccctgaaagatggcaatattaaaacggctctgaaaaagtgttctgatctgttcaaataccactgtaatgctgataccggcaagctactgtttctcacctgccagaaattatgccagatgctggccgacaacgtgcccgttacagtcccagtgggacttaatttgccaagtatgatccatgatctcgcatcccaggcagccaccatatgctccccggactttttgttggacgctctcgagctctgcaagcataccttgatggctgtggagctgagcaggcagtgccaaatggatgactgtgggatcctcatgaaagcctcattcggaactcacaaggatccctacgaggagtggtcttattctgattttttctctgaggatggaatcgtcctcgagtcccagatggtcttaccagtaatctacgagttaattagcagcctggtcccacttgcagaatctaagagatacccccttgagagtacctcactgccttactgtagtttgaacgaaggcgatgggcttgtgctgcccgtaatcaattccatctctgcactgttgcagaacctgcaggagtctagtcaatgggagctagcattaaggtttgtggtcggctctttcggcacttgtcttcaacactccgtatccaactttatgaatgccaccctgagtgagaagctgttcggagaaacaactttggtgaaaagtagacatgtcgtaatggagctaaaggaaaaagcagtaatttttatcagagaaaacgcaacaactctgctccacaaagttttcaactgccggttggtggaccttgatctggcactgggatactgtacattactgcctcagaaagatgttttcgaaaatctttggaagttgatcgataaggcttggcagaattatgataagatattagccatatctctggtggggtccgaactagcctccctgtaccaggagatcgaaatggggctgaaatttagggagctctccaccgacgctcagtggggcatacggctgggtaagctcgggatttccttccagcccgtgtttaggcagcatttcctgaccaagaaggaccttattaaagcccttgtggaaaatatcgatatggatacctcattgatcttggagtactgtagtacttttcagctggattgcgacgccgtcctgcagctgtttattgaaaccctgctgcacaatacaaatgcgggacaggggcaaggagacgccagcatggacagcgcaaagcgcaggcacccaaaactcctggccaaggccctggagatggtgcctctccttacttcaacaaaggatctggtgatctccctttccggcatactgcacaagctggacccctacgattacgaaatgatcgaggtggttttaaaggtaatcgaacgcgctgacgagaaaataactaacatcaatattaatcaggccctcagtatcctgaaacacttaaagagttatcggagaatctccccccctgtcgaccttgaataccaatacatgctggaacacgtcatcacactccccagcgctgcgcagacaaggttgccctttcacctgatttttttcggaaccgcccagaacttttggaagatcctgagcacagagctgtccgaagaatcattccccacactgctgctcatcagcaagctgatgaaattttcactcgatacactatacgtaagcaccgctaagcacgtgttcgagaaaaagctaaagcctaagctgcttaaattaacacaagcaaagtcttctactctcatcaacaaggaaattacaaaaattacacagaccattgagtcatgcctgctgagcattgtcaacccagaatgggccgtagccattgccatctctttagcccaggacattccggagggctcgttcaaaatatcggctctgaagttctgcctgtacctggcggagaggtggttgcagaatataccgtctcaggacgaaaagcgagaaaaggccgaagccctcctgaaaaaacttcacatccagtataggcgctctgggacggaggctgttctgatcgctcacaaactgaatacagaggaatatttacgcgtgattgggaagccagcccacttaatcgtctcactgtatgagcacccaagcattaaccaaaggattcagaactcatcaggaaccgactacccggatattcacgccgcagctaaagaaatcgccgaagtgaatgagattaacctggagaaggtgtgggatatgttgctggaaaagtggctgtgtcctagtaccaaaccaggagagaaaccttccgaactcttcgagctgcaggaggacgaagctctgagacgagtgcaatacctcctgctgagcagacccatcgactactcctcaagaatgctgtttgttttcgccacctccactaccaccaccttggggatgcaccagttaaccttcgcgcatagaacccgcgctcttcagtgcctcttctatttagctgataaggaaaccattgagtccttgtttaaaaaaccaatcgaagaggtgaagtcatatttgcgatgcatcaccttcctggcttcatttgagactctgaatatcccaattacttacgagctgttttgttccagcccaaaggaaggtatgatcaaaggtctgtggaaaaatcatagtcatgagtccatggctgtgagattagtgaccgaactttgtttggagtacaagatctacgacctgcaactctggaatggattgctgcagaaacttctgggcttcaatatgatcccttatctgagaaaggtgctaaaagcaatttcttctattcatagtctatggcaggtgccttacttctctaaagcgtggcagagggttattcaaatcccattactcagcgcatcatgcccattgtccccagaccagctgtcagactgttcagagagtctgattgctgtgcttgagtgtccagtgagcggcgacctcgatcttatcggtgtggctcgacagtatatccagctggagctgcccgctttcgcgctcgcgtgtctcatgttaatgccacatagtgaaaaacgtcaccagcagattaaaaactttttaggatcctgtgatccacaagtgatactcaagcagcttgaggaacatatgaataccggacagcttgcaggcttttcacaccagattaggtctctcattctcaacaacatcattaataaaaaagagttcgggatactcgcaaaaactaaatactttcagatgttgaagatgcatgccatgaatactaacaacattacagaattagttaactacctcgccaacgacctgtccctggacgaagcttcggtattaatcactgagtatagcaagcattgtgggaagccagtcccccctgataccgcaccctgtgaaatcctgaaaatgttcctgtctgggctgtcata

SEQ ID NO: 29205 - DNA, 1332 bp, Artificial Sequence
  Description of Artificial Sequence: Synthetic coding sequence
atgcttgagcacgttataactttaccctcagcagcacaaacacgcctgccattccacctgatcttctttggaactgcacaaaatttttggaaaatcttgtctaccgaattgtccgaggagtcattcccaactctcctgctaatcagcaagctgatgaaattttctcttgataccctctacgtgtcaacagcaaaacacgtgttcgagaagaaactcaagccaaagcttttgaaacttactcaggcaaaatcgtctactctcatcaataaggagatcacaaagatcactcagaccatagagtcttgtcttctaagcatcgtaaatccagagtgggctgtcgctatcgctatcagcctagcacaggacatccccgaagggagttttaagatctccgccctgaaattttgcctttatctggccgagagatggctccagaacatcccgtctcaggacgagaaaagagagaaagcagaagcacttctgaaaaagttacatatccaatatcgccgatccggcacggaggcagtgctgatagcgcataaactgaatactgaagagtacctcagggtgatcggcaaaccagcacacctgattgtgtccctgtacgagcaccctagcatcaatcagcggatccagaattcttccgggaccgactatcctgatatccacgctgccgcaaaagagattgcagaggtgaatgagatcaacctcgagaaagtctgggacatgctcttagagaagtggctttgcccatccaccaagccaggcgagaagccaagtgagctgttcgaactccaagaggatgaggccttgagaagggtgcagtaccttttgttatctcggccaatcgattatagttccaggatgctgttcgttttcgccactagcaccacgacgacactaggaatgcaccagctgaccttcgcgcaccgtacaagggctctgcagtgcctgttctacctcgctgacaaagagacgatagagtctctgttcaagaaacctatagaagaagtgaagtcatatttgcgctgcatcaccttcctggcatctttcgagacgctgaacattcccatcacatacgagctgttctgctcttcccctaaagagggcatgatcaaagggttatggaagaaccactcgcacgaatctatggcagtgagactcgtcaccgaactgtgtctggagtataaaatttatgacttgcagctgtggaacggcctactacagaagctgctgggcttcaacatgataccctacttgcgcaaggtgctgaaagccatctcatctatccattcactttggcagaggtggagatcatgttatgtcgcgtag

SEQ ID NO: 29206 - DNA, 417 bp, Artificial Sequence
  Description of Artificial Sequence: Synthetic coding sequence
atgaattcgctggtatcttggcagctgctgctgtttttgtgcgcaacacacttcggcgaacccctggagaaggtagctagcgtggggaactcaagacccactggccaacagcttgagtctctggggctgctcgctccaggtgagcagtcccttccctgtacagagcggaaacctgcagcaacagctcgcctatcacgtcgcggtacgtctctgtctcctccccctgaaagttccggaagtccacagcagcccggattatcggccccacattcccgtcaaatccccgcaccccaaggcgctgtgctcgtccagcgggagaaagacctgccaaactataattggaactcctttggtcttagatttggaaagagagaagcggcacctggaaaccatggacggagcgcaggccgaggttag

SEQ ID NO: 29207 - DNA, 771 bp, Artificial Sequence
  Description of Artificial Sequence: Synthetic coding sequence
atggcccacaggccgccttcaccagcactagcaagcgttttgcttgcactgctgctgtccggcgcagcccgtgcggctgagattgtgggtgggcacgaagcacagccccactcacgaccatacatggctagtctgcagatgagaggtaaccctggaagccatttttgtggaggaaccctcatacatccaagttttgttctcacagccgctcactgtctgagggacatccctcagcgcctcgtaaacgtcgttcttggagcccataatgtgcggacgcaggaaccaactcagcagcacttcagcgtcgctcaggtctttcttaacaattatgacgctgagaacaagctcaatgacgtacttttgattcagttgtcatctcccgcaaacctaagtgccagtgtggccactgtgcagctgccgcagcaggatcagcccgtacctcatggcactcagtgtctagcaatgggctggggacgggtcggtgctcatgaccccccagcccaggttctgcaggagttaaacgtaactgtcgtgacttttttttgtaggcctcataatatctgcacattcgtgccgaggaggaaggccggtatttgcttcggagattccggtgggccactcatttgtgatggcattatccagggaattgactcctttgtgatatggggttgcgcgaccagactttttcctgattttttcaccagggtcgctctgtacgttgactggatacggagcacactgagacgcgtagaggcgaaaggtcgtccctag

SEQ ID NO: 29208 - DNA, 2937 bp, Artificial Sequence
  Description of Artificial Sequence: Synthetic coding sequence
atggcacacacgacgaaagtcaacggtagcgcatccgggaaagctggcgacattttgtccggtgaccaggacaaggaacagaaggatccatactttgtggaaaccccctacgggtaccaactggaccttgattttctgaaatatgtcgacgacatccagaagggaaacaccataaagaggttgaatatacaaaagagaaggaagccctcggtcccttgtcccgagccaaggactacgtctggtcagcagggtatttggacctctacagagtcattgtcaagttctaactcggacgacaataaacagtgtcccaattttcttattgcaagatcccaggtgacaagtacacctatctcaaagccacccccacctctcgagacatcactgccgttccttacaatcccagaaaataggcaattgcccccaccctccccacagctgcccaagcacaacttgcacgtcactaagacattgatggagacccgccgtaggttggaacaggaacgcgctaccatgcagatgaccccgggtgaatttcggaggccccgtctcgccagttttgggggaatgggcactacgagtagcctcccctctttcgtggggtcgggtaaccacaatcccgctaagcatcagctgcagaacgggtaccagggtaatggggattacggttcctatgcaccagctgcccctactacatcttctatggggtccagcatacgccatagccccctttcttccggcatcagcaccccagtcacaaacgtgtcaccaatgcacctacagcacatcagggaacagatggctatcgcgctgaagcgcctcaaagagctggaagagcaggtccggaccatacccgtgctccaggtgaagatctccgttcttcaggaggagaagagacagctcgtgtcacagttaaaaaaccaacgcgctgcctcccagattaacgtgtgcggagtcaggaagcgcagctattctgctggaaatgcatctcagctagaacagctgagtcgggcacggagaagcggcggagagctctacatagattatgaggaggaggagatggagaccgtcgagcagtctacgcagagaatcaaggaatttcggcaactaactgccgacatgcaggcattggagcagaaaatccaggactctagttgtgaggccagtagcgagcttcgagagaatggggaatgccgctctgtggctgttggggctgaagagaacatgaacgacattgtagtctaccaccggggatcacgcagttgtaaggacgctgctgtgggcaccctagtagaaatgcgcaattgtggtgtgtccgtgactgaggcaatgctcggcgtcatgacagaagccgacaaggagatagagctgcagcaacagacaattgaatccctgaaagaaaaaatttaccggctagaagtgcagctgcgtgaaacaacccacgatcgagaaatgacaaagctaaagcaggagctgcaggccgctggaagcagaaagaaagtcgataaggcgaccatggctcagcccctggtgtttagcaaggtagttgaagccgtggtgcaaacgagggatcagatggtgggatctcacatggatttagttgatacttgtgttggtacctccgttgagaccaattccgtgggtatatcttgccagcctgagtgtaaaaacaaagtcgtcggacccgagctgcctatgaattggtggatagttaaggaacgcgtggagatgcatgacaggtgtgccggtcgcagtgttgagatgtgtgataagagcgtctccgtggaggtttccgtctgcgaaacggggagtaacacagaggagtccgttaacgatctcacattgctcaagaccaatctaaaccttaaggaggtccgcagtatcgggtgtggagactgcagtgtggatgtcaccgtttgtagtcccaaagaatgcgcctcacgtggcgtcaatactgaggctgtgtcacaggtcgaagctgccgtgatggctgttcctagaaccgcagaccaggatacatccaccgatttggagcaggtgcaccagttcaccaacactgaaactgccacgttaatcgaatcttgtactaatacgtgcctgtctaccctggataagcagacctcgacacagaccgtggaaaccagaaccgtggctgttggcgaaggcagggtgaaggatatcaattccagcacgaagacaaggagcatcggagtgggcaccctattgtctgggcatagcggctttgaccgaccatctgctgtcaaaacgaaagagtctggcgtgggccagatcaatattaatgataattaccttgtcggcttaaagatgcgcacaattgcctgcggacctccacaactgaccgtaggactaaccgcgtccagaagaagtgtgggagtgggtgatgaccccgtgggcgagagccttgagaaccctcagccccaggccccactgggaatgatgacaggactcgatcattatatagaaaggatccagaaattgttagcggagcagcagactctgctcgctgagaactattccgaactggccgaggccttcggagagccacactctcagatgggttctctgaattcccagctgattagcacccttagcagcattaacagcgttatgaagagcgccagcacagaggagttaagaaatcccgatttccaaaagacatcactcggaaagataacggggaattatctcggttacacttgtaagtgtgggggattacagagcggcagccctttaagctctcagacctcccagccagaacaggaagtgggtacaagtgagggcaagcctatttcctccctggatgccttccccacacaagaagggactctctctcctgtaaacctgactgacgatcagatcgccgcaggcctgtatgggaatttctcgcactcccaatctctggctagcgggttctag

SEQ ID NO: 29209 - DNA, 831 bp, Artificial Sequence
  Description of Artificial Sequence: Synthetic coding sequence
atgctctcagcgtgtaatctgctgaagaataccattaatgatcctaaggccctcacatctaaagacatgaggttttgcctgaacactctccagcacgagtggttccgggtcagcagccaaaaaagtgctatcccagctatggttggcgactacatcgccgcatttgaagccattagcccagacgtccttagatacgtgatcaacctagcggatggcaacggcaacacggcgctgcattacagcgtgtctcattctaacttcgaaattgtgaagctccttcttgacgccgatgtgtgtaacgtcgatcaccagaacaaggccggatacaccccgatcatgctggccgcattggccgcagtggaagctgagaaggacatgaggatcgtggaagagctcttcgggtgcggggatgtgaacgctaaagcctcgcaggctggccagacagcactaatgttggctgtgtctcacggcaggatcgacatggtgaaagggctcctggcttgtggagccgatgtaaatatccaggatgacgaaggcagcacagctcttatgtgtgcctccgagcatggacacgtggaaattgtgaaactgttgttagcccagcctggatgcaacggccatctggaggataatgacggctcaacagctctttccatcgcgttggaggctggccacaaggatatcgctgttctcctttacgcccatgtcaacttcgcaaaggcacagtctcctgttagcgtagtgcatcttgcttttgtgaatcggttgaaaagcaccaggttggtggacccactcccacctggcatagacggacggcagattttgtgttag

SEQ ID NO: 29210 - DNA, 993 bp, Artificial Sequence
  Description of Artificial Sequence: Synthetic coding sequence
atggctgaggggcatcacgccgtcaatatcgagggacttaaatccgccagggttgaagatgaaatgcaggtgcaagaatgcgaacccgagaaggtggaaatccgggaaaggtacgagctctctgaaaagatgctgtccgcatgcaatttgctgaagaacacaatcaacgaccccaaagcactgacctcgaaggatatgggccaagtgcagtggctgacacctatgatacccactctaagggaagctgatgccggtggcagtcacgagcgcttctgtctcaatacactgcagcacgagtggttccgtgtgtcttcccaaaagtctgccatccccgctatggttggcgactacatcgcagcctttgaggccatctcaccggacgtactccggtatgtgatcaatcttgctgatggtaatggaaacactgctctgcattacagcgtttcccactcaaattttgaaatagtcaagctgctgctagacgccgacgtttgcaatgttgatcaccagaacaaagctggttacacacctatcatgttggctgctctcgcagccgtggaagccgagaaagatatgcgtattgtggaggagttgttcggatgcggcgacgtcaacgcaaaagcttcccaggcaggacagaccgcccttatgcttgccgtgagtcatggacgaattgacatggtgaaaggcctcctggcctgcggtgcagacgttaacattcaagatgacgagggcagtactgcgctgatgtgtgcctctgagcacggacacgtggaaattgtcaaacttctcctcgctcaacctggatgcaacgggcacttagaagacaacgacggcagcaccgccctgtcaatagcactggaggctggccacaaagacatcgccgtgctgctgtacgctcatgtgaattttgcaaaggcccaatccccgggtactcctaggttgggcagaaaaacctcgcctggccctacccatcgcggtagttttgactag

SEQ ID NO: 29211 - DNA, 3585 bp, Artificial Sequence
  Description of Artificial Sequence: Synthetic coding sequence
atggagactcgcagaaggctggagcaagaacgggctaccatgcagatgacacccggtgagttcaggaggcccaggctggcaagttttggaggcatgggaacaacctcgtccctccccagttttgtaggctctggtaaccataaccccgcaaaacatcagctgcagaatggctatcagggcaacggcgactatgggtcatacgcccctgccgcaccaacaaccagcagcatgggatcctcgatcaggcactcgcctctgtctagtggcatctccacccccgtcaccaacgtgagccctatgcatcttcaacatatacgcgagcagatggcgattgcccttaaacggctaaaggagctcgaggaacaagttcgcaccatccctgttcttcaggtaaaaattagtgtgctccaggaggaaaagcggcagctagtctcacagcttaagaaccagcgggctgcctcccagattaacgtttgcggggtaaggaaacgttcatatagtgctggcaacgcctcacagctcgagcagttaagtcgagcccgtcggagtgggggtgaactatatatcgactatgaagaggaggagatggaaaccgtcgaacagtccacccagcggatcaaagaattccgccagttgacagccgacatgcaggccctggagcaaaagattcaagattcctcgtgcgaggcatcgtccgagctgcgagagaacggggagtgcaggagtgttgccgttggagccgaagagaatatgaacgacatcgtcgtttatcaccgcggatcccggagttgcaaagacgccgcagtcgggaccttggtcgaaatgaggaattgcggcgtctccgtcaccgaggcaatgctaggggtgatgaccgaagcagacaaggagatagagctgcaacaacagacgattgaatcccttaaggaaaaaatttaccggttggaggttcagctgagggaaaccacccacgacagagaaatgacaaaactgaaacaagaactccaagccgctggctcccgaaaaaaagtggataaagcgactatggcccagcccctcgtgttcagcaaagtagtggaggctgtagtccaaacaagagaccaaatggttggctctcatatggacctagtagatacatgcgtgggaacttccgtagagaccaattcagtcggcataagctgccagcccgagtgtaagaacaaggtggttggacccgaactgcccatgaactggtggattgtgaaagagagggttgagatgcacgatagatgtgcaggccgtagcgtggaaatgtgcgacaagagtgtgtccgtggaggtctctgtgtgtgagacagggagtaataccgaagaaagcgtcaatgatctcacactactcaagacaaacctgaacctgaaggaggtacggtctatcggatgcggcgactgttcagtggacgtaaccgtgtgctctcctaaagagtgtgcctcccgcggtgtgaatacggaggcagtgtcccaagttgaagcagctgtaatggcagtaccaagaaccgccgatcaggacactagcaccgatctggaacaagtacaccaattcacaaataccgagacagccaccctgatagaatcctgtaccaatacgtgtttgtcaacactagataagcaaacctcaacacagacagtggagacgagaacggtagctgttggagaaggcagagtcaaagatattaactcaagcacaaagacccggtccataggggtcggcactctcctgagtggccattccgggttcgacaggccaagcgcagttaagaccaaagaatctggcgtggggcaaatcaacataaacgacaattatttagttggattgaagatgaggaccatcgcgtgtggcccaccacagctgactgtgggtctaacagcaagtcgtagatcagtcggggtgggcgacgatcccgtgggcgagtcgctcgagaacccccagccccaggctcctctgggcatgatgactggcctcgatcattatattgagaggatccagaaattgttggccgaacaacagaccctgttggcagagaattattctgagctggcggaggctttcggagaaccccattcgcagatggggagcctgaatagccaactgattagtactctaagctcaatcaattccgttatgaagagtgcctctactgaagagctcagaaaccctgatttccagaaaacatccctaggcaagatcaccgggaactatttgggctacacctgtaagtgtggcggtttacaatccggctcccccctgtctagccagacatcccagccagaacaggaagtaggcacctctgagggcaagcctatttcttccctggacgcttttccgacccaagagggaacgctctccccagtcaaccttacagacgatcagattgccgctgggctctacgcctgtacaaataatgagagcaccttgaaaagtataatgaaaaaaaaggacgggaataaggacagcaatggcgcaaaaaagaacctccagttcgtggggattaatggcggatacgaaactaccagctcagacgactcttcctccgacgagtccagttctagcgaatccgacgacgaatgcgatgtgatcgaatatccattggaagaggaagaggaagaggaggacgaggatacccgcggtatggccgaggggcaccacgctgtgaacattgagggactgaagagtgcacgggtggaagacgagatgcaggtccaggaatgcgaacctgaaaaggttgagataagggagagatacgaactgagcgagaaaatgctgagtgcatgcaacctgctgaaaaatactattaatgatcctaaggccctaacgagtaaggatatgcggttttgtctaaacactctccagcatgaatggttcagagtgagctcacagaagtccgccatcccagcgatggtcggagactacatcgccgcatttgaagcgatctccccagatgtgctgcggtacgtcattaacctggctgacggtaacggaaatactgcgttacactactcagtcagccatagcaacttcgagattgtaaagctgttactcgacgctgatgtgtgtaacgtggaccaccagaataaggcaggctatacaccaatcatgctggctgcactggccgctgtagaagccgaaaaagacatgcggattgtggaggagctgtttgggtgcggtgacgtcaatgccaaggccagtcaagccggtcagacggccctgatgctggctgtaagccacggacgcatagatatggttaagggactcctggcttgcggcgctgacgtaaacatccaggacgatgaagggagtaccgcgttgatgtgcgcatccgagcatggacacgtcgagatcgtgaagctgcttctggcacagcctggatgtaatggtcatctggaggacaatgacggcagtaccgcactgtccatcgcactggaggctggccacaaagatatagccgtgctgttatatgcccacgtcaacttcgccaaagcccagagccccggaacccctcgtctcgggagaaagacgtccccaggacctacacatcgcggatcgttcgattag

SEQ ID NO: 29212 - DNA, 4059 bp, Artificial Sequence
  Description of Artificial Sequence: Synthetic coding sequence
atggcccacacaaccaaggttaacggtagcgcctctgggaaggccggtgacatcttatctggggatcaagataaagagcaaaaggatccttacttcgtggagaccccctacggctaccagctggacctcgattttctaaagtatgtcgacgatatccagaagggcaacaccatcaagcgtcttaatatccaaaagcggaggaaacctagcgttccctgcccggaacctaggactacttctgggcagcagggcatctggacttctacagagtctcttagctctagcaactccgacgataataaacaatgtcctaactttctgattgccaggtcccaggtaacctcaacacctatatctaagccgcctcccccactcgaaacaagcttgcctttcctgactattccagagaatcgccaactcccacccccatccccacaactgcccaagcataatctgcacgtgactaagactctgatggagactaggcgacggttggagcaggagagggctaccatgcaaatgacgccaggtgagtttagaagacccaggttggcatcatttggcggtatgggcacaacaagttctttaccatccttcgtcgggagtggaaaccacaatcctgctaaacaccaattgcagaatgggtatcaaggcaacggggactatggctcttatgcccctgctgctccgaccacgtccagcatggggagcagcatccgccattcaccgcttagttcaggcataagcacacccgttactaacgtcagtcctatgcacctgcagcacatacgcgaacaaatggccatagctctgaagcgactcaaggaattggaagagcaggtgagaacaattcctgtgcttcaagtgaagatcagcgtcctgcaggaagagaagcggcagcttgtctcccagttgaaaaaccagagggctgcttctcagattaatgtgtgcggggtgcgtaaaagatcttattcagctggcaacgcctctcagctggagcaactctcaagagctcgtagatccggaggggaattatacattgattatgaggaggaagaaatggaaaccgtggagcaatcgactcaacggattaaagaattcaggcagttgactgcagacatgcaggccttagaacagaagatacaggattcaagttgcgaagccagctctgagttaagggagaacggagaatgcagatctgtggccgtcggtgccgaagaaaatatgaacgacatcgtggtttaccacagggggtcccgctcctgtaaagacgccgcagtgggtacgctcgtagaaatgcgcaactgcggggtttctgtcacagaggccatgctaggtgtgatgaccgaggcagataaggagatcgaactgcaacagcagactattgagagtctaaaggagaagatctacagactggaggttcagctaagggagactacacatgatagagagatgacgaagctgaaacaggagctgcaggcggctggtagcaggaaaaaggtggataaagccactatggcccagccactggtctttagcaaagtcgtggaggccgtagtccaaacgcgtgatcagatggtgggtagccacatggatctagtagatacttgcgtggggacctcggttgagaccaattccgttggtatcagctgtcagcctgaatgcaaaaataaggtcgtcgggcctgagctacccatgaactggtggatcgtgaaagaaagggtggaaatgcatgatagatgcgccggaagatccgtagagatgtgcgacaaaagcgtgtctgttgaagtaagcgtctgcgaaaccggcagtaatactgaagaatcagtgaatgatcttacccttctgaagactaacctcaacctgaaagaggtgcggagtatcggctgcggagactgctctgttgatgtgacagtgtgttcccctaaggagtgcgctagtcggggagtcaacaccgaagcggtgagtcaggttgaagccgctgttatggccgtccccaggacagcagatcaggacacttcaaccgacctggagcaggtgcatcagttcacgaacactgagactgccactctgatcgagagctgtaccaacacatgtttgtccaccttggacaaacagacatcaacccaaactgtggagacacgaaccgtggctgtaggcgaaggtcgggtgaaggacattaactcgtccactaagaccagaagcattggggtaggtaccttgctgagcgggcactccggatttgaccgaccctcagcggtcaagaccaaggagtcaggagtcggacagataaacatcaatgacaactacctggtggggctaaaaatgcgcaccatagcttgcggccctcctcaacttaccgtgggcctgaccgcctcgcggaggtccgtgggtgtgggcgacgaccctgtgggcgagtcactggagaatccccagccacaggcacctctggggatgatgaccgggctggaccattacattgagaggatacaaaaactgctggcagagcaacagacattgctggccgaaaactatagtgagctcgctgaagccttcggtgaaccccacagtcagatgggttcgttgaactcccagcttatttcgaccctatctagtattaactcagtaatgaagtcagcatccacagaggagctgcggaatcccgattttcagaaaacatctctcggaaagattacaggcaactatctggggtacacgtgtaagtgtgggggactgcagagcggctcacccctgtccagtcagacctcccaaccagaacaggaagtgggtacttcggaaggcaaacctatttctagcctagatgctttccccacccaggaggggactctcagtcctgtcaacctgaccgatgatcagattgcagctggtctgtatgcttgcaccaacaacgaatccacacttaagagcattatgaagaagaaggacgggaacaaagacagtaacggagcaaaaaagaacctgcaattcgtgggaatcaacggcggttacgagaccacgagctcggacgattccagcagtgacgaaagcagtagctcagagtcagatgatgagtgcgacgttattgagtatccactcgaagaggaggaggaggaagaggatgaggataccaggggaatggccgaaggccatcacgcggtgaacatcgagggcttaaagagtgcgagggtagaggacgaaatgcaagtgcaagagtgcgagccagaaaaggtagagattcgtgagcggtatgaactgagtgagaaaatgctgtctgcatgcaatttgctcaagaatacaatcaacgaccccaaggctcttacgagcaaggatatgcgcttttgtctcaacacactccagcacgagtggttcagggtcagctctcagaaaagcgcaatcccggcaatggtgggggactacatagccgcattcgaagctataagccccgacgttctgcggtatgtgatcaatctcgcagacggaaatggaaataccgcactgcactacagcgtgtcccactcgaacttcgaaatcgtaaaattgttgttagatgccgatgtgtgcaatgttgatcaccagaacaaggccggatacacacccattatgctggctgcacttgccgctgtcgaagcagagaaagacatgcggattgtggaagaactattcgggtgcggcgacgtcaatgctaaagcatcccaggccggacagacggcccttatgctcgccgtctctcatggtcggattgatatggtcaaaggattgctcgcatgtggcgctgacgtcaatatccaagatgacgagggatctaccgcacttatgtgcgcctcagagcatgggcatgtggagatcgtgaaactgctgctggcacaaccaggctgcaacggccatcttgaggataatgacggatccactgctttatctattgcgctggaggccggacataaagacatagctgtcctcctgtacgcccatgtcaatttcgctaaagcgcaaagtccagggaccccaaggcttggcagaaaaactagcccaggcccaacccatcgagggtcgttcgattag

SEQ ID NO: 29213 - DNA, 4059 bp, Artificial Sequence
  Description of Artificial Sequence: Synthetic coding sequence
atggcgcataccaccaaagtaaacggcagcgcctccggcaaagccggagatatcctgagcggggaccaggacaaagaacagaaagatccatacttcgtcgagactccgtacggatatcagctggacctagactttcttaagtacgtggatgacatccaaaaggggaacactatcaagcgactgaatatacagaaacgcagaaagccttccgtgccctgcccggaaccgagaacaacttctggacaacaaggcatctggacttccaccgaaagccttagctcatccaattctgatgacaataagcagtgccccaactttctgatagccaggagccaggttacaagcacacctataagcaaacctccgccacctcttgagacttcactcccgtttctgaccattccagaaaacagacagcttccccctcccagccctcagttgcccaagcataacctccacgtgacaaagaccttaatggagaccagaagacgcctagagcaggagcgcgctacgatgcagatgacacctggagagtttcgcaggccgcgtctggcctctttcgggggtatgggaacgaccagctcactccctagctttgtcgggtccggtaatcataacccagccaaacatcaacttcagaacggctaccaggggaacggcgactacggaagctatgcccctgctgctcccaccacctcaagcatgggcagtagcattcggcatagtcccctgagttccggcatctcaacgcccgtaactaatgtgagccctatgcaccttcagcatataagagagcagatggccattgcccttaaaagactgaaggagctcgaagagcaggtacgcacaataccagttctgcaggtgaagatatcagtcttgcaggaagagaaaaggcagctggtgtctcagctaaagaatcagagagccgcatcacaaatcaacgtatgcggagtgaggaagagatcatactcggccggaaacgccagtcagctagagcagctctcccgggcacggcgaagcggcggagaattgtacatcgattacgaggaagaagagatggaaacggtcgaacagtcaacccagagaattaaggaattcagacagctgacagctgacatgcaggccctcgaacagaagatccaggacagtagctgcgaggcaagctctgaactgagggagaacggcgaatgccgttccgtggcagttggtgccgaagagaacatgaatgacatagtggtgtaccatcgaggatcacgtagttgcaaagacgctgctgtgggcacattggtagagatgcgaaattgcggcgtttctgtgactgaggctatgctcggcgtcatgacagaggcagacaaggagattgaactccagcaacagactattgagtcccttaaggaaaagatttacagattggaagtgcagctgcgggagaccacgcatgatcgcgaaatgacaaagttaaagcaagagctgcaggccgctggctcccgcaagaaagtggacaaagccaccatggcgcagcccttggttttttcgaaggtcgtagaggcggttgtacagacccgtgaccagatggtcggcagccacatggacctggtggatacatgtgtggggacatctgtagagaccaattccgtgggtattagctgtcaacccgaatgtaaaaataaggtcgtcggcccagaactgccaatgaactggtggatagtaaaggaacgagtggaaatgcacgaccggtgtgccggacgatccgtagagatgtgtgataaatctgtcagtgttgaagttagcgtatgcgagactgggagcaataccgaggagtccgttaatgacctgaccctgttaaaaaccaacctgaacctcaaggaagttaggagtatagggtgtggagattgcagcgtggatgtgaccgtgtgtagtcccaaagagtgcgcaagcagaggagtcaataccgaagcagtatctcaagtagaagccgctgtgatggcggtccctcggaccgccgaccaagacaccagtaccgatctggagcaggtgcaccaatttaccaacactgagacagcgaccctcatcgagagctgcaccaacacatgcctatcaacgctggataagcagacatccacccagaccgtggaaacacgcaccgtagccgtcggagagggccgtgtcaaggacatcaatagtagcacaaagacacggtccattggtgtagggacactcctgagcggtcattctggatttgaccggccatcggccgtgaagactaaagagtctggagtcgggcagattaacattaatgacaactaccttgtgggactcaagatgcgtacaatcgcttgcgggcctccccagctaaccgtcggcctgacagcttccagaagaagcgtcggggtcggggacgaccctgttggagagagtctggagaacccccaaccacaggccccacttgggatgatgacgggtctcgatcactacattgaaagaatacagaaactcttggctgagcagcagacactgcttgctgaaaactactccgagttggccgaggctttcggtgagccccactctcaaatgggtagcctcaatagtcagctgattagcaccctttcaagcattaacagcgttatgaagtctgcatccactgaagaactgaggaatcccgacttccagaaaacttcactcggcaagattaccgggaattacttgggatatacatgtaagtgcggcggactccaatccggaagtcctctgagttcacagacaagccagcccgaacaagaagtgggtacttctgagggcaagccgatatccagtctggacgccttcccaacccaggagggtacactgtcccccgttaatctaaccgatgatcagattgcagccggactttatgcatgcaccaacaatgagtcgacactaaagtcaattatgaagaaaaaagacgggaataaggactctaatggagcaaagaagaatctgcagtttgtcggcattaacggaggatatgagactacctcatccgatgacagcagctcagatgagtcaagcagttctgagtcagacgacgagtgcgacgttatcgaatatcctctggaagaggaagaggaggaggaggacgaagacacacgtggcatggctgagggacaccatgccgtaaatatagagggtctgaagagcgccagagtcgaagatgagatgcaggtgcaagagtgcgagcctgaaaaggtcgaaattcgtgaacgttatgaactgagtgagaaaatgctgtctgcgtgcaacctactgaagaacaccatcaacgatcctaaagcgctgactagtaaggatatgaggttttgcctcaacactctccagcatgaatggttccgggtgtcctcacagaagtctgccattcctgctatggtgggcgactatatcgccgcattcgaagcaatctcacctgacgtgttgaggtatgtaataaacctggctgacggaaacggtaatacggccctgcattacagcgtgtctcacagcaacttcgagattgtgaaactgctgctggacgctgacgtatgcaatgtggaccaccaaaataaggctggatatactcccattatgttggccgcactagcagccgtcgaagcagaaaaagacatgcggattgttgaggagttgtttgggtgcggagacgtaaatgccaaggcctcacaggcagggcagacagccctgatgctggctgtgtctcacggcagaattgatatggttaaagggttactcgcttgcggcgcagacgtaaacatccaggatgacgaagggtccaccgcacttatgtgtgccagtgagcatggccatgtggagattgtgaaattgctattggcacagccaggatgcaacggacacctggaggacaatgacggatctacggctctatcaattgcactggaagccggtcacaaggatattgctgtgttattgtatgctcacgtgaactttgccaaggcccaaagccccggaacccccagactcggtagaaagaccagtccagggccaacccatagaggtagctttgactag

SEQ ID NO: 29214 - DNA, 1197 bp, Artificial Sequence
  Description of Artificial Sequence: Synthetic coding sequence
atgaagaaaaaggatggaaacaaagacagtaacggcgctaaaaagaacttgcagtttgtaggcatcaacggtgggtatgagaccaccagtagcgacgatagctccagtgacgagtcttcctcttccgagagcgacgatgagtgtgacgtcatcgagtatccacttgaagaggaagaagaggaggaggatgaggatacaagagggatggccgagggccaccatgccgtcaacatagagggcctgaaatccgctcgtgtcgaagacgaaatgcaggtgcaagagtgtgagcctgagaaggtcgagatccgggagaggtatgaactgagcgagaaaatgctgtctgcttgtaacctcctcaaaaatacaattaatgaccccaaagccctgacctctaaggatatgggtcaggtacaatggctcacaccgatgatccctaccctgcgggaggccgacgccggtggctcccatgagcggttttgtttgaatacattgcaacatgagtggttccgggtgtccagtcagaaaagcgctatccccgcaatggtcggggattatattgccgctttcgaagcgatatcgcccgacgtcctccggtacgttatcaacctcgctgacggtaatgggaacacagcactgcactattctgtcagccacagtaacttcgagatcgtgaaactactgttggacgccgatgtctgtaatgtcgaccaccaaaacaaagctggatatacccctatcatgttagcggcattggcagccgtggaggctgagaaggatatgagaattgtggaggaactgttcggatgcggagatgttaacgcaaaggcctcacaggccggacagactgcacttatgctcgccgtcagtcacggtcgaattgacatggtgaagggcctgctcgcttgtggggcagatgtcaacatacaggatgatgaaggctccacagccttgatgtgcgcctcagaacacggccacgttgaaattgtgaagctcctgctggcccagcctgggtgtaacggacatctggaagataatgatggttctacggccctctccatcgccttggaggcagggcacaaggacatagcagtgctcctgtatgctcacgtgaactttgcaaaggcacagtccccgggtacgcctaggctggggagaaaaacctctcccggacctacccatagagggtcttttgattag

SEQ ID NO: 29215 - DNA, 2211 bp, Artificial Sequence
  Description of Artificial Sequence: Synthetic coding sequence
atggggaacccagaaaatatcgaagacgcttatgtggcagtgatcagaccaaaaaatacggcttcattaaattctcgagagtatagggcaaagtcctatgaaattttgctgcacgaggtcccaattgagggccagaaaaaaaagagaaaaaaggttctgttggagacaaagctgcaaggaaactctgagattactcagggcatactggactatgtggtggaaacaacaaagcccatttccccagctaaccagggcatccgcggaaaacgcgtggtcctaatgaaaaagtttccactagacggggagaagatgggcagagaggccagcctgtttatagttccttccgtggtgaaggacaatacgaagtacacctacacacccggttgcccaatcttttactgtttgcaagacataatgagagtatgcagtgagtcaagcacacactttgcaacactcacagctcggatgctgattgccttagacaagtggctggacgagagacacgctcagtcccactttattcccgctctgttccgcccttcccctctggaacgcatcaagacaaacgtgattaatcctgcatatgcaaccgagtcaggtcagactgaaaactcccttcacatgggttactccgcccttgaaatcaaaagtaagatgctggccctcgaaaaagccgatacctgtatatacaaccctttattcggaagcgacctgcagtataccaatcgggtagacaaagtggtaattaacccctacttcggcctgggcgcacccgactactcgaagatacaaattccaaaacaagagaagtggcagaggtcaatgtcctccgtaacagaggacaaagagcggcagtgggtcgatgatttccccctacacagaagtgcctgtgaaggggatagtgaacttttatcacgcttactgtcagagcgtttttcggttaaccaactagattcagaccactgggccccaatccactatgcctgctggtacggaaaagttgaagccactaggattctgctcgaaaagggcaaatgcaaccccaacctgctgaacggccagttgagttcgccgctgcattttgcggcaggtgggggtcacgccgaaattgtgcagattttactgaaccaccccgagacagacaggcatattactgaccagcagggacgctctcctctgaatatctgcgaggaaaataagcagaacaactgggaagaggccgctaagctgctgaaggaggccatcaacaagccatacgagaaggtgcggatctacaggatggacggaagctatagatccgtcgaacttaagcacggtaataataccactgtccaacagatcatggaagggatgcgtttgtcccaagaaacacagcagtacttcacaatctggatttgcagtgagaacttgtccttacagctcaagccatatcataaaccactccagcatgtgcgcgattggcccgaaatcctggccgagttaactaatctcgacccacagcgcgaaaccccacagctgtttcttcggagggacgtgagactgcctctcgaagttgaaaagcagatcgaagacccccttgccatcctgatcctgttcgacgaggccaggtataacctcctcaagggattttacacagcacctgatgctaaattaatcactctggcgtccttactcctgcagatcgtttacggtaactatgagagcaaaaagcacaaacagggattcctcaatgaagagaatctcaaatccatagtgcctgtaacaaagctgaagagtaaggcaccgcactggacaaatcgaatcctccacgagtataaaaatctctcaacttctgaaggagtgagcaaggagatgcatcacctgcagagaatgttcctgcagaattgctgggagataccaacatacggagccgcattctttaccgggcagatctttaccaaggcatcacctagtaaccacaaagtaattccagtgtacgtgggagttaacatcaaggggctgcacctgctgaacatggaaaccaaggcactcctgataagcctgaagtacgggtgcttcatgtggcagctcggcgataccgacacgtgttttcaaatccactcgatggaaaacaagatgtcgtttatcgtccataccaagcaagccggtctggtagtcaagctgctgatgaaactgaacgggcagctgatgccgacagagcgcaactcctag

SEQ ID NO: 29216 - DNA, 2067 bp, Artificial Sequence
  Description of Artificial Sequence: Synthetic coding sequence
atgggaaatccagaaaacattgaagacgcatacgtggccgtcattcgccctaaaaacacggcatcacttaactcacgcgaatatagagcaaaaagctacgaaatacttctccatgaggtgcccattgagggccagaagaagaaacgtaaaaaagtgttgctggaaacaaaattgcagggaaattcagaaattacacaggggattctggactatgtagttgagacgactaaacctataagcccggctaatcagggcatcaggggcaagcgggtggttctgatgaaaaaattccctctcgacggcgaaaagatgggacgggaagcctcgctgtttattgtaccatctgttgtcaaagacaatactaagtacacctataccccagggtgtccaatcttctactgtctacaagatattatgagagtctgcagtgaatcttctacgcactttgccacattaaccgctagaatgttgatcgctctggataaatggctcgatgaacggcacgcccaaagtcacttcatcccggcattattccggccatctcctcttgagaggattaagaccaatgtcatcaaccccgcttacgctaccgaaagcggccaaactgaaaatagcctgcatatgggctactctgccctcgaaattaagtccaaaatgttggccctggagaaagctgacacctgtatctataatcccctctttggatcagacctgcagtatacaaaccgagtggataaggttgtcattaacccctacttcggattgggtgctcctgactatagcaagatccaaatcccaaagcaagagaagtggcagcgttcgatgtcatcggtgaccgaagacaaatacggtaaggtggaggccaccagaattctcctagaaaagggaaaatgcaatcctaatttattgaacgggcaactatccagccccctccattttgcagccggaggcggtcacgccgagatcgtgcaaatactgctaaaccaccctgagaccgaccgacacataactgaccagcagggccgatcccctcttaatatctgtgaagagaataaacaaaataactgggaagaggccgcaaagctattgaaggaagccatcaataaaccctatgaaaaggttcgtatctaccgaatggatggaagctacaggtccgtcgagttgaaacacgggaacaatacaacggtgcaacagattatggagggaatgcggctatcgcaggaaacacagcaatactttacaatttggatttgtagtgaaaatctctccctgcagcttaagccataccataaaccattgcagcatgttagagactggcccgagatcctggccgagcttaccaacctagatccccagcgcgaaactcctcagctgtttctccggcgtgatgtccgcctcccccttgaggtagagaagcaaatcgaggaccctcttgccattctgattcttttcgacgaggcgagatacaatttattgaaaggcttttatactgcacctgatgctaagctgatcactctagcaagcctactcctccagattgtttacgggaattacgaatccaaaaagcacaagcagggatttctgaacgaagagaatctcaagtctatcgtgcccgtcaccaagctcaaatctaaggccccacactggaccaaccggatcctgcacgagtacaagaatttgtccacctctgagggcgtttccaaagaaatgcaccacctgcaaagaatgtttctgcagaactgttgggaaattccaacgtatggcgctgcttttttcacaggtcagatcttcacgaaggcctctcccagtaaccataaagttattcccgtgtatgtgggtgtcaatatcaagggcttgcacctcctcaatatggagacaaaggcactcttgatttccttaaagtatggttgcttcatgtggcaacttggcgacaccgatacctgctttcagattcattctatggagaataagatgtcttttatcgttcacacgaagcaggcaggacttgtggtaaagttgctcatgaagttaaacggccagctgatgccaaccgagcggaactcttag

SEQ ID NO: 29217 - DNA, 2211 bp, Artificial Sequence
  Description of Artificial Sequence: Synthetic coding sequence
atgggcaaccctgagaacattgaagacgcatatgttgccgtcatccgacccaaaaacaccgcctccctcaatagccgcgaatacagagctaagtcctacgagatccttctccacgaagtgccgatagagggccagaagaaaaagcggaaaaaagtgctgcttgaaacgaaactccaggggaacagtgagatcactcagggtatactcgactacgtcgtggagaccaccaagcctatcagcccggctaaccagggcatacgagggaagcgcgttgttctaatgaagaagttccctctggatggagagaagatggggagggaggcctcactgttcatagtgcctagtgtggttaaggataatactaaatacacgtatacacccggttgccctatcttctactgtctgcaggatatcatgcgggtttgttccgagtctagtacccatttcgcaaccttgacggcgcgaatgctgatcgctctagataaatggcttgacgagaggcatgctcagtctcatttcattcccgctctgttccgccctagtccccttgagcggatcaaaacaaatgtcattaacccagcttacgctaccgagagtgggcaaacggagaactctctgcacatgggctatagtgcattggaaatcaaaagtaagatgctggccctcgagaaggcagacacatgcatttataatccactttttggcagcgatctacaatataccaaccgtgtcgacaaggtggtcatcaacccctacttcgggctgggcgcacccgattattccaaaatacagattcccaagcaagagaaatggcaaaggagcatgtctagcgtgaccgaggataaagagaggcagtgggtggatgattttccgctccaccggtcagcttgcgagggcgacagtgaactactgagtagactgctgtctgaaaggttcagtgttaaccagttggactcggaccattgggcccctatccattatgcatgttggtatgggaaagtggaagcaacaagaatacttttagagaaaggcaagtgcaatccaaatttattgaatggccaactctcttcccctttgcattttgccgctggcggaggacacgcggaaatagtgcagatccttctgaatcatccggagacagatcgccatattacagaccaacagggcagaagccctctgaatatttgcgaggagaataagcagaacaactgggaagaggccgctaaactgctcaaagaggctatcaacaagccatatgagaaggttcggatctacagaatggacgggagctaccgtagcgtggagctaaagcatgggaataatacaaccgtccagcagatcatggaagggatgcggctctcacaagagacccagcagtattttaccatatggatctgttctgaaaatctgtcactccagctgaaaccataccataagccattgcagcatgtcagggattggcctgagattctcgccgagctgacaaatcttgaccctcagcgtgagaccccccagttatttctacgaagggacgttaggcttcctctggaggtggaaaagcagattgaggaccccctggccattctcatcctgtttgacgaagccaggtataatttgcttaagggtttttacacagcacctgacgctaagctcattactctagctagtctacttcttcaaatcgtgtatgggaactatgaaagcaaaaaacacaaacaggggttcttaaacgaagagaacctaaagtctatcgttcctgtcacaaagctgaagtcaaaggcaccgcactggacgaatcgaatcctccacgagtataaaaacctgagcactagcgaaggggtgtctaaagagatgcatcatctgcagcgtatgttcttgcaaaactgttgggaaatcccaacttacggggcagccttcttcactggacagatcttcacgaaagcttcgccaagcaaccacaaggtgatccctgtgtacgttggcgtcaacatcaaaggtctgcacctgctgaatatggaaacaaaagcattgcttatcagcctcaagtacggatgctttatgtggcaactcggggacactgatacgtgttttcaaattcactccatggaaaataagatgagcttcatcgttcataccaagcaggccggactggtggttaaactgctgatgaagctgaatgggcagttaatgcctactgaacgcaatagctag

SEQ ID NO: 29218 - DNA, 2211 bp, Artificial Sequence
  Description of Artificial Sequence: Synthetic coding sequence
atgggcaatcccgagaacatcgaggacgcctacgtcgcagttattcgtcctaagaataccgcgtccctgaattcccgcgaatatagggctaagtcgtatgaaattctcttgcacgaggtgcccatagagggacagaagaaaaagcggaagaaagtgctgctcgagactaagctgcagggcaattcggaaattactcaaggcatcctagattatgtggtggagacaacaaaaccgattagtcctgcaaaccaggggattcggggtaaacgggtcgtgctgatgaagaagtttcctcttgacggcgagaagatgggcagggaggcatctctttttattgtgccctctgtagtgaaggataataccaagtatacttataccccgggatgccccattttttactgcctgcaagacatcatgcgagtgtgctcggaatcatccacacattttgcgaccctgactgccaggatgctaatcgccctcgataaatggctggacgagcgacatgcccaaagtcactttatccccgctcttttcaggccttcgcccctagagcgcattaaaacaaacgtcatcaatcccgcatacgctactgagagtgggcaaactgagaactcccttcatatgggatacagcgcgctggaaataaagtccaaaatgttggcgctagagaaagcagacacctgtatctacaatcctttgttcgggtcagacctccagtatacaaatcgagtagacaaggtggtgattaacccctactttgggcttggtgcaccggattactctaaaatccagatccctaaacaggaaaaatggcagcgctccatgagttccgtgaccgaggataaggagcgccagtgggttgacgattttcccttacaccgaagtgcttgcgagggcgacagcgagctactgagtagattacttagtgagagattttctgtcaatcagttagacagcgaccactgggctcccatccactacgcgtgctggtacggcaaagtggaggctactagaatcttactcgagaaaggaaagtgcaacccgaacttgctaaacggacagctttcttcgcccctccattttgccgcagggggtgggcatgctgaaattgtgcagatcctgttgaaccacccagaaacagatcgccatatcaccgatcagcaggggagatcacctttgaatatctgtgaagagaataagcagaacaattgggaggaagcagctaagctgttaaaggaggccatcaacaagccatatgaaaaagtccgtatctaccgcatggatggcagctacagatccgtggagctaaaacatggaaacaacaccacagtacagcaaatcatggagggaatgagactgagccaggaaacacagcagtatttcacaatttggatctgctccgagaatctatcattacagctgaagccataccacaaacccctccagcacgtgcgcgattggcccgagattctagccgaactgactaatttggacccccagcgagagacccctcagctgttcctgcgtcgggacgtgcggctccccttggaggtcgagaagcagatcgaggaccctcttgcaatcctcatactctttgacgaggcaaggtacaacctgctcaagggcttttacactgcacccgacgccaagcttataacacttgccagcttgttactgcagatcgtctacgggaattatgagtccaagaaacacaagcaaggcttccttaacgaagaaaacctaaagagtatcgtcccagtgacaaaactgaagtcgaaggcccctcattggacaaatcgaatcttacacgaatataaaaaccttagcacctctgaaggggtgtctaaggagatgcaccacttacagaggatgtttctgcagaattgttgggagatccctacatatggggcagcttttttcaccgggcagatcttcaccaaagccagtccctccaaccacaaagtaattccggtgtatgtaggcgtgaatattaaaggactccacctcctgaacatggagacgaaggccctgctcatttcactgaagtacggatgcttcatgtggcaactcggagacactgacacctgttttcagatccactctatggagaataaaatgtctttcatcgtgcatacgaaacaagcgggattggtcgtcaagctactaatgaaattaaatggccagctcatgcctacagagcgtaacagttag

SEQ ID NO: 29219 - DNA, 2211 bp, Artificial Sequence
  Description of Artificial Sequence: Synthetic coding sequence
atgggtaatcctgagaatatcgaggacgcctacgtagcagttattaggccaaaaaatactgcatcactgaactccagggaatatagggctaagtcttatgaaatccttctgcacgaagtgcctatcgaagggcagaaaaagaaaaggaaaaaggtccttttggagacgaagctccaagggaattcggagattacccagggtatcctggattatgtggtggaaacaacgaagcctatttccccagcaaatcaaggaatcaggggtaagcgggtcgtcctaatgaagaagttcccactcgatggagagaagatgggcagagaagcttctctcttcatcgtgccaagcgtggtgaaggataatacaaaatatacatatacacccggatgtccaatcttttactgcttgcaagatattatgagagtatgctccgaatcatctacccacttcgccacccttactgcccgtatgctgatcgccctagacaagtggctggacgagcggcatgcccagagccactttatccctgcactctttcgacccagtccactggaacgcatcaagaccaatgtgatcaaccctgcctatgctacagagtccggtcagactgagaactcccttcacatgggttactcagcccttgagatcaagtccaaaatgctagcactggaaaaagcagatacatgcatctataaccccctttttggctctgatctgcaatatactaaccgggtagataaggtagtcataaacccgtatttcggcctgggcgcaccggattactccaagatacagattcccaagcaggagaaatggcaaaggtctatgtcctcagtgactgaggataaggaacggcaatgggttgacgacttccccctccatcgaagtgcttgtgaaggtgacagcgagctgctttctcgtctgctgtccgaacgtttcagtgtgaaccagctggacagcgatcattgggcccctatacactatgcatgctggtacggtaaggtggaggctacaagaatcttgctggagaagggtaaatgcaaccctaatctgctaaacggccagctgtcctctcccctgcacttcgctgccggaggagggcacgctgaaattgtgcagatccttctgaaccaccccgagaccgatcgccacatcactgaccaacagggacggtctccactgaatatctgtgaggagaacaaacagaacaactgggaggaggcggctaaactgctcaaggaggccatcaataagccttatgaaaaggttaggatttacaggatggatggctcttacaggtctgttgagctcaagcacgggaataacacgacagttcagcagattatggaagggatgagactcagtcaggagacgcagcaatactttaccatatggatatgcagcgagaatctgtccttacagctaaagccctaccacaaacctttgcagcacgtcagagattggcctgagattctggcggaactgaccaatttggatccacagagagagacaccccagctatttttgagaagagatgtgagactaccgctggaggtagagaaacagatagaggacccccttgccattctgatcctgtttgatgaagcacgctacaatctgctgaagggtttctatacggctccagatgccaagcttataacccttgcatctctcctgctgcaaatcgtctacggcaactatgaatctaaaaaacacaaacagggctttctgaacgaagaaaacctcaaatctatcgtgcccgttacaaagcttaagagcaaggcaccacattggaccaacaggatactccacgaatacaaaaacttgagtactagtgaaggcgtgagcaaagaaatgcatcacctccaacggatgttcctccagaactgctgggagattcctacctatggagccgcattctttaccgggcagatctttacaaaggcttccccatccaaccacaaggtgattccagtgtatgtcggggtgaacattaaagggctccatttgctcaatatggagacaaaggcgctgctcatttccctaaagtacggatgctttatgtggcaactgggggatacagacacatgcttccagattcacagtatggagaataaaatgtctttcattgttcacactaagcaggccggactggtggtgaagctgttaatgaaattgaatggacaactcatgccaaccgaaaggaatagctag

SEQ ID NO: 29220 - DNA, 210 bp, Artificial Sequence
  Description of Artificial Sequence: Synthetic coding sequence
atgggaaaccctgagaatattgaagatgcgtatgtggccgtgataaggccgaagaatacagcttcactgaattctagagagtatagggccaagtcttatgaaattctgcttcacgaggtgcctatcgaaggacaaaagaagaaaagaaagaaggtccttctggagaccaaactgcagggcaactcagagatcacccagggcatcctttag

SEQ ID NO: 29221 - DNA, 1698 bp, Artificial Sequence
  Description of Artificial Sequence: Synthetic coding sequence
atgggaaatcctgaaaatattgaagacgcttatgtggccgttatcagaccaaaaaacaccgcctcactgaatagccgcgaatatcgggcaaaatcctacgaaattctgctccatgaggtacccattgaggggcagaaaaagaaaagaaaaaaagtgctgctcgagacaaagctgcagggcaatagcgaaatcacccagggaatcctggattacgtggtggaaacaactaaacccatatcccctgccaaccaaggaattagaggtaaaagagtggtactcatgaaaaaatttcctttagacggcgagaaaatgggccgtgaggcttcgttgttcatcgtacccagcgtcgtgaaagataacaccaagtatacatatacgcccggttgcccaatattctattgtcttcaggacatcatgcgggtatgttcagagtcctctacccattttgctactttgactgcccgaatgctcatagctctggacaagtggttggatgagcgacacgcccaaagtcacttcattcctgcactgtttcgtccaagcccattagaaagaatcaaaaccaacgtcattaatcctgcctacgccacagaatcaggccaaaccgagaacagtttgcacatgggatattccgctctcgagatcaaatccaagatgctggcactggagaaagcggatacatgcatatataacccactgtttgggagcgatcttcagtacaccaatcgtgtagacaaagtggttataaatccctactttggtttgggcgctcctgattactcgaagatccagatccccaagcaagaaaagtggcagcggagcatgtcttctgtgacggaggataaggagcgccaatgggtggacgactttcccctccacagatcagcctgcgagggagactctgagttgctctcgaggttactgtccgaacggtttagcgtcaaccagcttgatagcgatcattgggcaccgattcattatgcctgttggtatggaaaggtggaggccaccaggatcctcttggaaaaaggcaagtgcaacccgaacctgttaaatggtcagttatcctctcccctgcattttgcagcagggggaggtcacgctgagattgttcagattcttttgaaccaccctgaaacagaccgccatattacagatcagcagggcagaagccccctgaacatctgtgaagagaacaagcagaataattgggaagaggctgccaagctgctgaaggaggcaattaataagccttacgagaaggtgcggatttatcgtatggatggaagctataggagtgtcgagctgaagcacggcaacaacaccacggtgcagcagattatggaagggatgagactgagtcaagagactcagcaatattttactatttggatttgtagcgagaatttatccctccagctcaagccctaccataagcctctgcagcacgtccgcgactggcccgaaatattggcagagctgacaaacctggacccacagagggagaccccccaactcttccttagacgggacgttcgcctcccacttgaagtcgagaagcaaatcgaagatcctttggctatcctgatcttgttcgatgaagctcgatataacctccttaagggcttttacactgcacctgatgctaaattgattactttggcttcccttttactgcaatctctctggaagttgtag

SEQ ID NO: 29222 - DNA, 78 bp, Artificial Sequence
  Description of Artificial Sequence: Synthetic coding sequence
atgggaaacccggagaacatcgaggacgcttacgtggctgtgattcgtccaaagaatacagcttctctgaattcatag

SEQ ID NO: 29223 - DNA, 39 bp, Artificial Sequence
  Description of Artificial Sequence: Synthetic coding sequence
atgggtaatcctgagaacatcgaggatgcctatgtctag

SEQ ID NO: 29224 - DNA, 117 bp, Artificial Sequence
  Description of Artificial Sequence: Synthetic coding sequence
atgggcaatcctgaaaatatcgaagacgcctacgtggctgtgatcaggcctaaaaatacagcctccctcaattcacgggaatatcgggctaaaagctatgaaatcttactacattag

SEQ ID NO: 29225 - DNA, 297 bp, Artificial Sequence
  Description of Artificial Sequence: Synthetic coding sequence
atgggcaatccagaaaacatcgaggacgcatacgtcgccgtgatccgcccaaagaacaccgcgtctctgaattctagagagtaccgtgctaagtcctatgaaattctcctacacgaggttccgatcgagggacagaaaaagaagcggaagaaggtactgcttgagactaagctccaggggaacagcgaaatcactcagggcattcttgactatgtagtggaaactacaaagccgatctctcctgcaaatcaaggaattaggggaaaaagggtagtgctcatgaagaaattcccttag

SEQ ID NO: 29226 - DNA, 555 bp, Artificial Sequence
  Description of Artificial Sequence: Synthetic coding sequence
atggggaatcctgagaacatagaagacgcatatgtggccgtgatccgcccaaaaaacacggcctctctgaactctagagagtaccgggcaaagagctatgagatactcttgcatgaagtgccaattgaaggtcaaaagaagaaaagaaagaaggtcctcctggaaacaaagctgcagggcaacagcgaaatcacccaggggatcctcgattacgttgtcgaaactaccaagccaatcagccccgcaaatcagggaataaggggcaaaagagtcgttcttatgaaaaaattcccactggacggagagaaaatgggtagagaggctagcctgttcatcgtcccaagcgtggtcaaagataataccaagtacacatatactcctggatgcccaattttctactgtcttcaagacattatgagagtgtgctccgagtcctcgactcacttcgctacattaaccgccaggatgttgatcgccttagataagtggctcgacgaacggcacgcccagagccatttcattccagccctttttagaccgtccccattagagtag

SEQ ID NO: 29227 - DNA, 339 bp, Artificial Sequence
  Description of Artificial Sequence: Synthetic coding sequence
atgggtaaccccgaaaacattgaagatgcatatgtcgcagtgattcggccaaagaacaccgcatcattaaatagcagggagtaccgtgcaaaatcatacgagattctgctgcacgaggtcccaatagagggccaaaaaaagaaacgcaaaaaggtgctgctggaaaccaagttgcaggggaacagcgagattacccaggggatcctggattacgtggtcgagactactaaacctatctctcccgctaaccaaggaattaggggcaagcgtgtggtgctgatgaaaaagtttccactcgatggagaaaaaatgggcagagaagcatcgctgtttatatag

SEQ ID NO: 29228 - DNA, 105 bp, Artificial Sequence
  Description of Artificial Sequence: Synthetic coding sequence
atgggaaacccagagaacatcgaagacgcttacgtggctgtcattagacccaaaaacaccgcttcgctgaactctcgggagtaccgagcgaagtcatacgagtag

SEQ ID NO: 29229 - DNA, 177 bp, Artificial Sequence
  Description of Artificial Sequence: Synthetic coding sequence
atgggaaatccagaaaatatcgaggatgcctacgtggcagtgataaggcccaagaacacagcatctttgaactccagagagtatcgtgccaaatcgtacgaaatcctgctccatgaggttcccatcgagggccagaagaaaaagaggaaaaaagtcttgcttgagaccaaactttag

SEQ ID NO: 29230 - DNA, 489 bp, Artificial Sequence
  Description of Artificial Sequence: Synthetic coding sequence
atgggtaaccctgagaatattgaagatgcctatgttgcagttattcgacctaaaaacaccgcaagcctcaactcaagagagtacagagcaaaaagttatgagattttgctccatgaggtgcccattgaagggcagaagaagaaacgcaagaaggttctcctcgaaacgaaactacagggaaactcagagattacccagggcatcctggactacgttgttgagaccactaagccgatatccccggctaatcagggaatcaggggcaaacgggtcgttctcatgaaaaagttccctctcgacggagaaaagatggggagggaagcctcccttttcattgtaccttctgtagtgaaagacaatactaagtacacatacactccgggatgcccgatcttctactgcttgcaagacataatgagggtgtgtagcgagagctcaacccacttcgccaccctgaccgctagaatgctcattgctctggacaagtag

SEQ ID NO: 29231 - DNA, 732 bp, Artificial Sequence
  Description of Artificial Sequence: Synthetic coding sequence
atgggaaatccagaaaatatcgaggatgcctacgtcgcggtaatccgtcctaaaaatactgcaagtctcaatagtagagagtacagagccaaaagttacgaaatcctcctacacgaagttcccattgaggggcagaaaaagaagagaaagaaagttctcctggagacaaaacttcaggggaactctgaaatcacccaagggatcctcgactacgtcgttgaaaccactaagcctatctctcctgccaaccagggcattaggggaaaacgcgtggtccttatgaaaaaattcccgctggatggcgagaagatggggagggaggcctcactgttcattgttccttccgtggtgaaggataataccaaatatacatacacccctggctgtcctatcttctattgtttgcaagacatcatgcgggtgtgctcagaaagcagtacacacttcgcaacccttacagctaggatgctcattgcccttgataagtggctcgatgaaaggcacgcccagtctcattttattccagctctattcagaccctcccctctcgagaggattaagactaacgtgattaaccctgcctatgccacagaatccgggcaaaccgaaaattccctacacatggggtatagcgccctggagatcaagtccaagatgctggcactggagaaagccgacacctgcatttataatcctttgttcggtagtgatctgcagtacacaaatcgctag

SEQ ID NO: 29232 - DNA, 198 bp, Artificial Sequence
  Description of Artificial Sequence: Synthetic coding sequence
atgggtaaccctgagaatatagaggacgcctatgtggccgtgatccgcccaaagaatacagcgtccttgaacagccgcgagtaccgtgccaaaagttacgaaatcctgctccacgaggtgccaattgaagggcagaaaaaaaaaagaaaaaaagtacttctggagaccaaactgcaggggaatagtgaaatcacatag

SEQ ID NO: 29233 - DNA, 1089 bp, Artificial Sequence
  Description of Artificial Sequence: Synthetic coding sequence
atggcaacggctgagaccgctcttccaagcatttctacgctgacggcactgggcccattcccggatacccaggacgatttcttaaaatggtggaggtcggaagaggcccaggacatggggcctggaccccctgaccctaccgaaccccctctacatgtcaagtccgaagatcagcccggagaggaagaggatgacgagaggggtgccgatgccacctgggacctagatctcctcctgactaacttctctgggcctgagcctgggggagctccgcagacctgtgcactcgccccttcggaagcttcaggagcccagtatccccctccccctgagacacttggagcctatgcaggcggaccaggactcgtggcaggcctgctgggcagtgaggaccactcaggttgggtgagacccgcattgagggcgagagcccctgatgccttcgtggggcctgctctcgcccctgcccctgctcccgagccaaaagctctcgctctgcaacccgtgtatccgggaccgggagcaggctcttctggcggatactttccccgaacgggactctctgtaccggctgcctcaggtgccccttacggcttattgtcagggtaccctgccatgtaccccgctccccagtatcagggccatttccagctgtttcgcggactccaaggcccagcaccaggcccagccacttctccctcattcctgagttgcctcggtccgggtaccgtcggcaccgggctaggtggaacagccgaggaccccggagtgatagcggagacagctccctccaagcgcggtcgcagaagctgggcgcgtaagagacaggcggcacatacctgtgcccaccctggttgcggcaagagctacactaagtccagccatctgaaagcccacctgcgaacacacacgggcgaaaagccgtatgcttgtacttgggaaggttgcggatggcgctttgctcgatctgatgagctgacacgccattacaggaagcatacaggtcagcggcctttccgatgccagctgtgtccgagagccttttctagatccgaccacctggcgctgcacatgaaaaggcatctctag

SEQ ID NO: 29234 - DNA, 999 bp, Artificial Sequence
  Description of Artificial Sequence: Synthetic coding sequence
atggccactctgaaggaccagctcatttacaacctcctgaaagaagaacagacaccccagaacaaaattacagtcgtgggtgtcggagctgtgggcatggcctgcgctatttcgatccttatgaaagatctggccgacgagttggcactcgttgacgtaattgaggacaaactgaagggggaaatgatggatcttcaacatggctctctctttctcaggaccccgaagatcgtaagtggaaaggattataatgtaactgctaattccaaactcgtcataattaccgcaggcgctaggcaacaggagggtgagtcccgtctgaaccttgttcaacggaacgtaaacattttcaaattcatcataccaaatgtcgttaagtatagcccgaattgcaaattactcatcgtgtccaacccggtggacattctgacctatgtggcgtggaaaataagcggctttccaaagaatagagtaattggatcaggctgcaacctggacagcgccaggttccgatacctgatgggcgagcggctgggggtgcatcccctgtcttgccatgggtgggtcttgggcgaacacggcgactcaagcgtgccagtttggagtggtatgaatgtggcgggagtctctttaaaaacactacatccagacctaggcacagacaaggataaagagcagtggaaggaggtccacaaacaggttgtcgaatcggcctatgaagtaatcaaactcaaaggatatacctcctgggcgattggtctctctgtggctgacctagccgagagcataatgaagaacctgagaagagtgcacccggtgagtactatgatcaaaggcttgtacgggatcaaggacgacgtgttcctgtctgtaccctgtatcctgggtcagaacggcatttccgacctcgtaaaggttacgttaacgagtgaagaagaagctcgtctgaagaagtctgctgatacattatggggcatacagaaagagctacaattttag

SEQ ID NO: 29235 - DNA, 825 bp, Artificial Sequence
  Description of Artificial Sequence: Synthetic coding sequence
atggcaacactgaaggaccagttgatttacaacctactaaaggaagagcagaccccacagaacaaaatcaccgtcgtgggagttggcgcagttggaatggcctgtgctatctcaattctgatgaaagacttggccgatgaattagcattggtggacgtcattgaagataagcttaagggcgagatgatggacctccaacacgggtcactattcctgcggactcctaaaatcgtaagcggaaaagactacaacgtgactgctaattctaaactggtgattattaccgcaggcgcaagacagcaagaaggcgaaagccgattgaatctcgttcagaggaatgtaaacatcttcaagtttataatcccaaatgtggtgaagtattctcccaactgcaaactgctgattgtgtcgaaccccgtggatattctcacttacgtagcctggaaaatcagcggatttccgaagaatcgagtgattggatcaggctgtaatctagactctgcccgttttaggtatctgatgggagagaggcttggagttcaccccctatcctgtcacgggtgggtcctgggtgagcatggggatagttcggtccccgtgtggtccggcatgaacgtggcaggcgtatccctaaagactcttcaccccgatcttggcactgataaggataaggaacaatggaaagagtgtagatacacactgggggaccctaaaggcgcagccatactgaagtcgtcagacgtgattagttttcactgtcttgggtataatcggattctggggggagggtgcgcctgctgcccattctatctaatttgtgattag

SEQ ID NO: 29236 - DNA, 999 bp, Artificial Sequence
  Description of Artificial Sequence: Synthetic coding sequence
atggcaactttaaaggaccagctgatttacaacctgctgaaggaggagcagacaccacagaataagatcactgtggtaggcgtgggagccgtagggatggcttgtgctatatcaatcctcatgaaggacctggcagacgagttggccctggtagacgtcatcgaggacaagctgaagggcgaaatgatggacttgcagcacggcagtctattcctgagaacacctaagattgtgtcgggcaaagattacaacgtcactgctaatagtaaactcgttattataaccgctggcgctcgccagcaggaaggagagtcccgactgaacctcgtacaacgaaatgtgaatatattcaagtttattattccaaacgtggttaagtacagccctaactgtaaactgcttattgtaagtaatccggtggacatcttaacatatgttgcctggaagataagcggttttccaaaaaatagagttataggatctggttgcaaccttgactcagccagattcagatacctaatgggcgagcgcctgggcgtccatccactgtcgtgtcatggttgggtgctcggcgagcatggtgactctagcgttcctgtgtggtccggtatgaacgtcgccggtgtatctctgaagacactgcaccctgatctgggcacagacaaagataaagagcagtggaaggaggttcacaaacaagtggtggaaagcgcttatgaggtgattaaactcaagggctatacgtcatgggcaatcggactctcggtggcggatttggctgaaagcatcatgaagaacctgagaagagtgcacccagtctccacgatgataaaaggtttgtatggcatcaaggatgacgtcttccttagcgtaccgtgcatcctaggacaaaatgggatcagcgatctggtgaaagtgacccttacctccgaggaggaggccaggctgaaaaaatcagctgatacactatggggcatccagaaagagctgcaattctag

SEQ ID NO: 29237 - DNA, 825 bp, Artificial Sequence
  Description of Artificial Sequence: Synthetic coding sequence
atggcgacattgaaagaccagctgatatacaatctgttgaaggaggagcagaccccacagaacaagatcaccgtcgtcggcgtgggggctgtcggcatggcttgtgctatttctattctgatgaaggatctggcagacgaactggccttagttgacgtgattgaggataagcttaagggagaaatgatggatcttcaacacggaagcctctttttacgcaccccgaagatcgtgtccgggaaagtagatatcctgacttacgtggcatggaaaatttctggcttcccaaagaacagagtgattggttcaggctgcaatctggactccgcccgatttagatacctgatgggcgaacggttgggcgtgcacccactatcctgtcacgggtgggtgctgggagagcacggagactctagtgtccctgtttggagcggaatgaacgtcgcgggtgtgtccctgaaaacgctgcaccccgacttaggtactgataaggataaagagcagtggaaggaggtgcacaagcaagtggtggagtcagcctatgaagtgattaagttaaagggttacacctcgtgggctattggtttgtccgtggctgatctagccgagtctataatgaaaaacctgcggagagtgcatccagtgtctactatgatcaagggcctgtacggaataaaagacgatgtgtttctttctgttccgtgtatcctgggtcagaacgggatctcagatttggtgaaggtgacattgacgagcgaagaagaggcccgactgaagaagagtgctgatacactgtggggaatccagaaggagctgcagttctag

SEQ ID NO: 29238 - DNA, 918 bp, Artificial Sequence
  Description of Artificial Sequence: Synthetic coding sequence
atggcgacactcaaagaccagctgatatacaatctcctgaaggaggaacaaaccccccaaaataaaatcacggtagtaggagtcggggcagttggcatggcatgtgctattagcattcttatgaaagacttagctgatgaactggcaattgtgtccggaaaggattacaacgtgaccgctaactccaagcttgtgataatcaccgctggcgcacgtcagcaggagggagagagtcggctcaacctggtgcagaggaacgtcaatattttcaagttcattataccaaacgtggttaagtacagtcctaattgtaaactgctcattgtgtcgaacccggtggatattctcacatacgtggcctggaaaatctcaggcttccccaaaaatagagtgatcggcagcggttgtaaccttgacagcgccaggtttagatatttaatgggcgagcgtctcggcgtgcaccccctcagctgccacggctgggttctgggggagcatggggactcatccgtgcccgtgtggagcggcatgaatgtggcaggagtgagtttgaagacactccaccccgacctgggcactgacaaagataaagagcagtggaaagaggttcacaagcaggtggtcgaatcagcctacgaggtgatcaagttaaaaggatacacatcctgggcgatcggcctgagtgtggctgacttggccgaatcgataatgaagaacctccgccgtgtccaccccgtctctacaatgatcaagggcttatacggaattaaagatgacgtatttctgagcgtcccttgtatcttgggacagaatgggatcagtgatttagtgaaggtgaccctgacgagcgaggaggaagccagactgaagaaatccgccgatacattgtggggaattcagaaggagctgcagttttag

SEQ ID NO: 29239 - DNA, 435 bp, Artificial Sequence
  Description of Artificial Sequence: Synthetic coding sequence
atggccaccctgaaggaccagcttatctataacctgctcaaagaagagcagaccccccaaaacaaaataactgtggtaggtgttggggctgtgggcatggcctgcgccatatcaatccttatgaaggaccttgcagatgagctggctttggttgacgtgatcgaggacaagctgaagggagagatgatggatctgcagcacggaagcctctttctgcgtacgcctaaaattgtttctggcaaggactataatgtgacggccaactcgaaactcgtcatcattacggccggagctaggcagcaggagggcgagagcagattaaacctggtgcaaagaaacgttaacatttttaaatttatcattcctaatgtcgtgaaatactccccaaactgcaagttattaattgtgtccaaccccggtgaggcgtttgactag

SEQ ID NO: 29240 - DNA, 345 bp, Artificial Sequence
  Description of Artificial Sequence: Synthetic coding sequence
atggccactctgaaggatcagcttatttataacctgctgaaagaggagcaaacgccccagaacaaaatcacagtggtcggggtgggagccgtgggtatggcgtgtgcaatttctatcctcatgaaagacctggcggatgaattagctctggtagatgtcatcgaggataagctcaaaggcgagatgatggatttacagcacggtagcctatttctgcgcacaccaaagattgttagcgggaaagattataacgtgaccgccaactctaagttggtcatcattaccgccggtgccaggcaacaagaaggtgaatcccgcctgaacttagtacagcgcaatgtgtag

SEQ ID NO: 29241 - DNA, 219 bp, Artificial Sequence
  Description of Artificial Sequence: Synthetic coding sequence
atggccaccctgaaagaccagttaatttataacctgcttaaggaggagcagacaccacagaataaaataactgtggtaggcgtgggtgcggtgggaatggcttgcgctataagcatattaatgaaggacctggccgacgagcttgccctcgtggatgtgatcgaggataagctgaaaggggaaatgatggacttgcagcatggttccctattcttgtag

SEQ ID NO: 29242 - DNA, 1086 bp, Artificial Sequence
  Description of Artificial Sequence: Synthetic coding sequence
atgggcgagccgtctgggggttacacctatacccagaccagtatctttctgttccacgccaaaatcccattcgggtccaaatccaacatggcaacactgaaagaccagctaatctacaatctcctgaaagaagaacagacaccacagaacaaaattactgtggtcggcgtcggagccgtgggcatggcgtgtgccattagcatcctgatgaaagatctggcggacgagctggcacttgtcgacgtgatagaggacaaactgaagggcgaaatgatggatttacagcatggatctctttttttgaggacccctaaaatcgtgtcaggaaaagattataacgtcacggctaatagcaaactggtgattataacagccggtgcgagacagcaggagggggaaagtcggttgaacctcgtgcagcgtaacgtgaacatcttcaagtttattattcctaacgttgtgaagtattcccctaattgcaagctgctcattgtgtcaaatccggtggacattttgacgtacgtggcttggaagatcagcggtttcccgaagaatcgagtgattgggtccgggtgcaacttggatagtgccaggtttcgctacctgatgggagagcgcttgggagtccacccgctgagttgccatggctgggttcttggcgagcatggcgactcatctgtgcccgtctggtcaggcatgaacgtggcaggcgtgagtctcaagactctgcatccggacctcggaacggataaggataaagagcagtggaaggaggtgcataaacaggtagtagagtccgcatacgaggtgatcaagctgaagggttacacgtcctgggcgatcgggctgagcgtagcggacctcgctgaatcaatcatgaagaacttgcggagagtgcacccagtgagcacgatgattaagggattatacggaatcaaggacgatgtgttcctctccgtcccatgtattctcggtcagaatggcatttctgacctcgtcaaagtcaccttgacctcagaagaggaagcccgtctcaagaagtccgccgataccctgtggggtatacagaaggaactgcaattctag

SEQ ID NO: 29243 - DNA, 999 bp, Artificial Sequence
  Description of Artificial Sequence: Synthetic coding sequence
atggcaactctcaaagatcagctcatttataatctgctgaaggaggagcagacccctcaaaacaaaatcactgtcgttggcgtcggcgctgtgggcatggcatgtgcaattagcatactcatgaaagatttagccgacgagctggcattggtggacgtgatcgaggacaagctgaaaggcgagatgatggatttacagcatggtagcctgttcctcagaaccccaaaaatagtgtccggaaaggattataacgtgacagctaacagtaagttagtcattattacagccggagctagacagcaggagggcgagtctaggctgaatctcgtccaacgcaatgtgaatatatttaagttcatcatcccaaacgtggtgaaatatagccctaactgcaagttacttatcgtttccaaccccgtcgacatattgacttacgtggcttggaagataagcgggttccctaagaatagagttatcgggagcgggtgcaatttagacagtgctaggtttagatatttgatgggagaaaggcttggagttcaccctctgagctgccacggctgggtcctaggggagcatggcgattcttccgttcccgtctggtctggcatgaatgtggccggtgtgtccctcaagacactccacccagatctgggcaccgacaaagacaaggaacagtggaaagaagtccacaaacaggtggtcgagtcagcttatgaggtcattaagctgaagggctacacaagttgggcgattggtctgtctgtggccgacctggccgaatccataatgaagaacctgcgtagagttcaccccgtgagtactatgataaagggcctgtatggtatcaaagatgatgtgtttctcagcgttccttgtatccttggccaaaatggaattagtgacctagtgaaagtgacattgacatcggaagaagaagccagactcaaaaagtctgcggatactttgtggggaatccagaaagagttacaattctag

SEQ ID NO: 29244 - DNA, 474 bp, Artificial Sequence
  Description of Artificial Sequence: Synthetic coding sequence
atggcaacccttaaggatcagctcatctataatcttctgaaggaagagcagactccccaaaataagattaccgtggtgggtgtgggagctgttgggatggcctgcgcgattagcattctcatgaaggatctcgctgacgaactagcactcgtggacgttatcgaagataagctcaagggtgagatgatggatctccaacatgggtcactatttctgcgtactcccaagatcgtgtccgggaaagattacaatgtcaccgcgaacagcaagttggttattatcactgcaggagccaggcagcaagaaggcgagtcaaggctcaatctcgtgcagcgcaacgtgaatatttttaagtttattataccaaatgtggtcaagtactctcctaattgtaaactgctgatcgtgagcaacccagtggacatactgacttacgtagcctggaagatctctggattccctaagaacagatag

SEQ ID NO: 29245 - DNA, 804 bp, Artificial Sequence
  Description of Artificial Sequence: Synthetic coding sequence
atgggctctgcctgtataaaggtgactaagtattttttatttttatttaatctgatttttttcattctgggcgcagtcatattaggtttcggggtgtggatactcgccgataagtcgtctttcatctccgtgctgcagacctcttctagtagcctccgcatgggcgcatatgtttttatcggcgtgggagccgttaccatgctaatgggcttcctcggatgcatcggcgctgtaaatgaagtgcgttgtctgctgggcctgtacttcgcatttttgttgttgatattgatcgctcaggttacggccggagctctgttttactttaatatggggaaactgaagcaagagatgggcggaattgttactgagttaatcagagactacaactcatcccgtgaggatagtctgcaggatgcctgggactacgtccaggcgcaagtcaaatgctgtggctgggtgagcttctacaactggactgacaacgctgagctcatgaaccgacctgaggtcacatacccatgttcgtgtgaggttaagggtgaagaagacaatagtttgtctgtacgcaaagggttttgcgaagcacccggaaataggactcagagtggtaaccacccagaggactggcccgtatatcaggagggatgtatggaaaaggtccaggcatggttacaggaaaacctgggcattattctgggggtgggtgttggggtggcaataattgagctgcttgggatggtgttgtcaatttgtctctgccgacacgtacattccgaggactattccaaagtgcctaaatattag

SEQ ID NO: 29246 - DNA, 3393 bp, Artificial Sequence
  Description of Artificial Sequence: Synthetic coding sequence
atgaaacgcagcgagaaacccgaggggtacagacaaatgcgccctaagacttttccagcttctaattatactgtgtcatctcgccagatgcttcaggagatcagagaaagtcttcggaaccttagtaagccctccgatgcagccaaagctgaacacaatatgagcaagatgtcgaccgaggaccccaggcaagtgcgcaatccgccaaagtttggtacacaccacaaggccctccaggagataaggaacagtctgctgccatttgctaatgagacgaattcctctcgatctacttcagaagtcaatccccagatgctgcaggatctgcaggcagctggctttgatgaggacatggttatccaggctttgcagaagactaataatcgatctatagaggctgccatcgagttcatcagtaagatgtcttaccaagacccacggcgtgaacagatggctgcagccgcagctcgaccaattaacgcatctatgaagcccggaaatgttcaacagagtgtaaaccgaaaacaatcatggaaaggttctaaggagtctctggttcctcaacggcatgggcctccgctcggtgagtctgtggcttatcatagcgaaagcccaaattcccagaccgatgtcgggagaccactttccggatcaggcatcagtgcattcgtgcaggctcatccatcgaacgggcagagggtgaatcctccacctccgccacaggtcagatccgtgactccaccgccacccccacgcggacagacccctccgccaagaggaactaccccgccacctccttcctgggagccgaattctcaaaccaaacggtacagcggtaacatggaatacgtcatcagccgaatctcccctgtgccccctggcgcatggcaggagggctacccccctccgccactcaatacatcacctatgaaccctccaaatcagggccaacgcggaatctcgtctgtaccagtgggtcgtcagcccattattatgcagagcagcagtaagtttaactttccatcgggtagaccgggaatgcaaaatggtaccggccagaccgactttatgatccatcagaacgtggtccctgccggaaccgtgaatcgccagccacctccaccgtacccactgactgcggctaatggccagtctccgtccgcccttcaaaccggcggttccgcagccccaagtagctatacgaatgggtccataccccaaagcatgatggtgcctaacaggaattcccataacatggaactctacaatatatctgtgccaggactgcagacaaactggcctcagagtagcagtgcccctgcccagagctcaccgagttcaggccacgagattccaacatggcagcccaacatacctgtacgcagtaactcattcaataaccccctcggcaatcgggctagccattccgccaactcgcagccttccgccactacggtgaccgcaattacaccggctccaatccagcagccagtcaaaagtatgcgcgttctgaaacctgagctgcagaccgcccttgccccaacacaccctagctggataccccagccaatccagactgttcagccctctcccttccccgaaggcaccgcttccaatgtgaccgtgatgcctcctgttgccgaggctcccaattaccaagggccacctcctccataccctaaacatttactgcaccaaaaccccagtgtaccaccgtacgagagcatttccaagccaagtaaggaggaccagccaagcttgccaaaggaagacgaatctgagaagagttacgaaaatgtagacagcggggataaggaaaaaaagcagatcacaacttcacctatcacagtacggaagaataagaaggacgaagagaggcgagaatctagaatacagtcgtatagcccgcaggcctttaagttcttcatggaacagcacgttgagaacgtgctaaagtcacatcagcagcgtctgcatcgcaaaaaacagcttgagaatgagatgatgcgggtagggctgtcacaggatgcacaggaccagatgcgaaaaatgctgtgtcagaaagaatcgaactatatccggttgaaaagagctaaaatggacaagagcatgttcgttaaaatcaagactctgggcattggcgctttcggcgaggtctgcctggcgagaaaggtcgacaccaaagccttgtacgccacaaaaacgttacggaagaaggacgtgctcctgagaaaccaagtggcgcatgttaaggccgaaagggatatcctggcagaagccgataacgaatgggtggtgagactctattactcctttcaggacaaggacaatttgtattttgtgatggactacattcctggcggtgatatgatgagtttgctcataaggatggggatcttcccagagtctctggctcggttctatattgcagaattgacatgtgccgtggagagcgtgcataagatgggctttatacatagggatatcaaacctgacaatattctaattgatagagatggccacattaaactcaccgacttcggtctgtgcaccggctttcggtggacacacgattctaaatactaccaatccggggatcacccacggcaggatagtatggacttctctaacgaatggggagatccttcttcttgtcgctgcggggacaggctcaaaccactggaacgccgtgcagccagacagcatcaacgctgcctagctcatagcctcgtcggtacaccaaattatattgccccagaagtcctcttgagaacaggctatactcagctttgcgactggtggtctgtgggagtaattctgttcgagatgttggttgggcaacccccttttctggctcagactccactcgagacacaaatgaaagtgatcaattggcagacctcactgcacattcctcctcaggccaagctgagtccagaagcctccgacttgattatcaaattgtgtcggggaccagaagaccgcctgggtaagaacggagccgatgagattaaagcccatcctttctttaaaactattgatttctcctcagatctccggcagcaatcggcttcttacattccgaaaatcacacatcccaccgacacatcaaacttcgaccccgtggatcctgataagttgtggagcgacgacaatgaggaggagaacgtgaacgatacccttaacggctggtacaagaacggcaaacatcctgaacacgccttttatgagtttacctttcggcgattttttgatgacaatggctacccatataactaccctaaaccaattgaatatgaatatatcaattctcagggaagcgaacagcagagtgacgaggatgaccagaacaccgggtcagagatcaaaaaccgggatttggtgtacgtgtag

SEQ ID NO: 29247 - DNA, 2073 bp, Artificial Sequence
  Description of Artificial Sequence: Synthetic coding sequence
atgaagcggtccgagaagccggaaggatatcggcagatgcgaccaaagaccttccctgcaagtaattataccgtgagctcacgtcagatgctgcaggagataagagagagccttagaaacctgagtaaaccttccgacgccgcaaaggctgaacataatatgagtaagatgtcaaccgaggatcctcgccaggtaaggaatcccccaaaatttgggacgcatcacaaggctctccaggagatccggaattccttgctcccattcgccaatgaaaccaacagcagccggagtacgagtgaagtcaatccacagatgctccaagacctgcaggctgctggttttgacgaggatatggtgatccaggcgctgcaaaagaccaacaacaggtccattgaggctgccatcgagtttatctctaagatgagctaccaggaccccaggagagaacagatggcggcagcagccgctcggcctattaacgctagtatgaagcccggtaacgtgcagcaatccgtaaacaggaagcagtcctggaagggatccaaagagtcactcgtccctcagagacacgggccaccactgggggagagcgtggcttaccatagcgagtccccaaatagccagactgacgtcggtcgacctctgtcagggagtggcatatctgcttttgtgcaagcccacccctccaatggtcagcgcgtgaatcccccaccacctccacaggtcagaagcgtcacaccgccaccaccaccacgaggacagacacccccacccaggggaaccacaccaccccctcctagctgggagccaaatagtcagacgaagagatactcagggaacatggagtacgtgatcagtcggataagcccagtgcccccaggagcctggcaggaagggtacccaccgcctcctttaaacacctctcctatgaacccacccaatcagggccagagaggaatttcatccgtaccggtggggcgtcagcccatcattatgcagtcatcctccaaattcaacttcccgtctggacggcctggtatgcagaatgggaccggccagactgatttcatgatccatcagaacgtcgtccctgctggtacagtgaatcgtcagcctcccccaccttatccactaactgcagccaacggtcagagtccctcagctctgcagaccgggggaagcgctgctcccagttcttacaccaacggctctattcctcagtccatgatggtcccaaaccggaacagtcataatatggaactgtataacataagtgtgcctggcctccaaaccaactggccccagtcctctagcgccccagctcagtctagccccagctctggccatgagatccccacgtggcagccaaatataccggttaggtcgaactcctttaataacccgctcgggaatcgggctagtcactctgctaactcccagccttctgcgactactgttacggctattacccctgctcctatccaacaacccgtgaagagcatgcgagttcttaaacctgaactgcagactgctctggctcccactcatccaagctggattccgcagcctatccagacagtacagccatccccctttcctgaaggcacagcctcaaacgtgaccgtaatgcctccagtggccgaggccccaaattaccagggccctccgccaccatatcctaagcatctcctgcatcagaaccctagcgttcctccctacgagtcaattagcaagcctagcaaggaagaccagccaagcctcccaaaagaagacgagtctgagaagtcatatgagaatgtggactcgggcgacaaggaaaagaaacagataacgacatcaccaatcactgtgcgcaaaaacaagaaagatgaggaaagacgcgagtccaggattcaatcgtattcaccacaggccttcaaatttttcatggaacagcacgtggaaaatgtgctcaagagccatcagcagaggctccatcggaagaagcagctggagaacgaaatgatgagagtcaagcctttcaagatgtcgatctttatcctcaatcatctttttgcatggtgcctcttttag

SEQ ID NO: 29248 - DNA, 3393 bp, Artificial Sequence
  Description of Artificial Sequence: Synthetic coding sequence
atgaaacgtagcgagaaacctgaagggtacaggcaaatgcggccaaaaacatttcctgccagtaattatacggtttcctcaagacagatgctgcaggagatacgcgaaagtctccgcaacctgtccaagccatccgacgccgcaaaggcagagcataatatgtctaagatgtcaacagaggaccccagacaagttcggaatccgcctaaattcggcacacaccacaaggcccttcaagaaatccggaactccctcctcccgttcgctaacgagacgaattcatcacgttcgacttccgaagttaatcctcagatgctgcaagacttacaggctgccggattcgatgaagatatggtgattcaggctttgcagaagacaaacaaccgtagcatcgaggctgctatagagtttattagtaaaatgtcctaccaggatccccgacgggaacagatggctgccgctgccgctaggcccattaatgcctctatgaagcctggcaacgttcaacaatcagttaacaggaagcagagctggaaagggtcaaaagagtctcttgtgccccagagacatggacccccactcggcgaatcagtcgcttatcactctgaaagccctaattcacagactgatgtcgggagaccactcagtgggagcgggatctctgcatttgtccaggctcacccatctaacggccagcgcgtgaacccgccacccccaccccaggtgagatccgtgaccccaccgccacccccacgaggacagactccccctcctcgcggaacaacacctccacccccaagttgggaacctaacagccagacaaagcgatactctgggaacatggagtatgttatctctcgcatctccccagtaccaccaggcgcatggcaagagggataccccccaccccctctgaacactagtcctatgaaccccccaaaccagggtcaacgtggaattagcagtgtgcctgttggtcgccagccaatcatcatgcagagctcttccaagttcaacttccctagtgggagacctgggatgcagaacggcacaggccaaacggactttatgattcatcaaaacgtggtgcccgctggcactgtgaaccgacagcctccacctccctacccattgactgcagcaaatggccagtctccaagcgccttgcagacagggggaagcgccgctccttcctcatacacgaatggtagcatcccgcagagcatgatggttcctaacagaaacagccacaatatggagctatataacatcagcgtccccggtctccagacaaactggccccaaagtagcagcgcacccgctcagagtagccccagttcgggacacgaaatcccaacctggcagcctaatattcctgttagatcaaactcctttaacaatccgttaggaaaccgggcttctcacagtgcaaactcacagcctagtgcaactacggtcactgccattaccccggcaccaattcagcagcccgttaaatcaatgcgcgttttgaaacccgaactccagacagcattggctccaacccatcccagctggattccccagcctattcagaccgttcagccttctccctttcctgaggggaccgctagtaacgtgactgtaatgccgcctgtcgcagaggcacccaactatcagggcccaccgccaccataccccaagcacctgttgcaccagaatccttcagtgcccccatatgagagtatcagtaaaccatctaaggaggatcaaccaagtctcccaaaagaagatgagtctgaaaagtcgtatgaaaatgtggactccggggacaaggaaaaaaaacagattaccacgtctcctatcacagtgaggaagaacaagaaagacgaggagcggcgtgaatcgcggatccagagctactctcctcaggcattcaaattctttatggagcagcatgtggagaatgtcctcaagtcacatcagcagagacttcatcggaagaaacagctcgaaaacgagatgatgagagtgggtctctcccaggatgcacaagaccagatgagaaaaatgctgtgtcagaaggagtccaattacataagactcaagagggccaaaatggataaatccatgtttgtaaagatcaaaaccctaggaataggggctttcggggaagtctgtctggcacgcaaggtggacaccaaagcactgtacgcgacgaagactttgcgtaagaaggacgtgctcctgaggaatcaggtggcacacgtgaaggcggaacgcgacattttggccgaggccgacaatgagtgggtggtccgcttgtattacagttttcaggacaaggacaatctttactttgtaatggactatatacctgggggtgacatgatgagtcttctgattaggatgggaattttccccgaaagcctagcaaggttttatatcgccgagctgacatgtgctgttgagtcggtgcataaaatgggctttattcatagggatatcaagcccgataacatccttatcgacagagacggccatatcaaacttacggactttgggttatgtactgggtttcgatggacccatgacagcaaatactatcagagcggagatcaccccagacaggatagcatggacttttctaacgaatggggagatccctcctcttgtagatgtggtgaccgcctgaaaccattagaacggcgagcagccagacagcatcagaggtgcttagctcattctttggttggaacacccaactatattgcaccagaggtgctcttaagaaccggctatacccaactgtgcgactggtggagtgttggcgtcatactgtttgaaatgctggtaggccaaccccctttccttgcacaaacacctctcgaaactcagatgaaggtgataaattggcaaacatcactccacatccctcctcaggccaagctgtccccagaggcatcggatcttatcatcaagttatgcagaggacccgaggaccgcctagggaagaatggagcagacgaaatcaaggcgcacccctttttcaagaccattgacttctcttccgatctccgccaacagtcagcttcctatattcctaagataacccacccgactgatacctctaattttgatccagtcgatcccgacaaactgtggtcggatgataatgaggaggagaatgttaatgacacgctcaatggttggtacaaaaatggcaagcaccctgaacacgcgttctacgaatttacatttagaaggttttttgatgataacggctatccgtacaattatccgaagccaatcgaatacgagtacattaactctcagggcagtgagcagcaatcggacgaagacgaccagaataccggcagcgagattaagaatcgagatttggtgtacgtctag

SEQ ID NO: 29249 - DNA, 3267 bp, Artificial Sequence
  Description of Artificial Sequence: Synthetic coding sequence
atgagacccaagaccttccccgcaacaacctatagtggtaatagccggcagaggctacaagagatacgtgagggacttaaacagcctagtaagagttctgtccaagggctgcccgctggacctaattccgacacaagtttggacgcaaaggtgcttggcagtaaagacgcgacaaggcagcagcagcagatgcgggctacccccaagttcgggccataccagaaggcattgcgcgagattcgctattccctgctcccttttgccaacgagtccggaacctcggcggctgcagaagtaaacaggcagatgttacaggagctggtgaacgccggatgcgaccaagaaatggctggccgagccctgaaacagactggatcgagaagtatagaggccgcactggagtacatctccaagatggggtacctagatccgagaaatgaacaaattgtgcgggtgatcaagcagacctccccagggaagggactaatgcctactccagtcacacgcagacctagcttcgaaggcactggcgactcctttgctagttaccaccagctctctggtacaccgtatgaagggccatcatttggtgccgatggtcctaccgcgctggaggagatgccaagaccttatgtcgactatcttttccctggagtgggccctcacgggcctgggcaccagcaccagcatcccccaaaggggtacggcgcttcggtggaagctgctggcgcacacttcccccttcagggcgcacattatggacgccctcatctgctggtccccggagaaccactggggtatggtgtgcagcggagcccttcattccagagcaaaacaccacccgagacgggtggctatgccagtctgccgacgaaagggcagggaggccctccaggggcagggcttgcgttccctcctccagccgcaggactttatgtgccccaccctcaccataaacaggcgggtcctgctgcgcatcagttgcacgtgctgggaagcaggtcccaagtcttcgctagcgattcccctccccagagcctccttacgccaagcaggaattcattgaatgttgatctctatgagttgggaagtacctccgtgcagcagtggcctgcggctacattggcgcgtcgggactcacttcagaaaccgggactggaggcaccaccgagggctcatgtggcctttagacctgactgtcctgtgccaagtagaaccaacagctttaattcccaccagccacgccctgggcctcccggtaaggcagagccttcactccccgctccaaataccgtgacagcggtgaccgctgcgcacattctgcatccagtgaagtcagtgcgagtcttgcgacccgagccacaaacagccgtggggccatcacaccccgcttgggtgccagccccagcacccgcaccagcccctgcgcctgcaccggctgcagagggattggatgctaaggaggaacacgccctggccctgggaggagctggcgcatttcctttggacgtcgagtatggcggacctgaccggcgatgtccccctccaccttatcccaagcacctactgcttcggagcaagtcagagcagtacgaccttgactccctttgcgcagggatggaacaatccttgagggccggtcccaacgagccagagggaggggataagtctcgcaaaagtgctaaaggggataaaggagggaaggacaaaaaacagatccagaccagtccagtgcccgtccgaaagaattccagagatgaagagaaacgagaaagccgtatcaaatcttatagtccttacgcctttaaattcttcatggaacagcacgtggaaaacgtgattaagacatatcagcagaaggtgaatcggcgtctgcagctggagcaggaaatggcaaaagctggcttgtgtgaagctgaacaggagcaaatgcgcaagatcctgtaccagaaagaaagtaattacaaccgtttgaaaagagctaagatggataaaagcatgtttgtaaagatcaagaccctcgggattggggcatttggcgaggtttgtttggcctgcaaggttgatacccatgccttgtatgccatgaagaccctaagaaagaaagatgtgctgaatcgcaaccaggtcgcacatgtgaaagctgagcgcgatatactcgccgaagcagataacgaatgggttgtgaaactgtactacagctttcaggataaagactccctctacttcgtgatggattacattccagggggtgacatgatgagcctattaattaggatggaggtgttccccgagcatctggcgagattttatatcgccgaactcaccctcgccattgaatctgtacataagatgggctttattcatcgcgatatcaagccagataacattctgattgacctcgatgggcacataaaattaaccgacttcgggttgtgcactggattccggtggactcacaattcaaagtactaccagaaagggtcgcacgttcgccaggattccatggagccgtctgacttgtgggacgatgtctcgaactgcagatgtggagaccgcctgaagaccctggaacagagggcacgcaagcagcatcaacggtgtttggctcatagcctcgttggtactcccaattacatcgcccctgaggtcctgttgagaaaaggctacactcagctatgcgactggtggtccgtgggcgttatcttattcgagatgctggtggggcaacccccatttctggcgccaaccccaaccgagactcagttgaaagtcatcaattgggagaacactctgcacatccccgcacaggttaagctgagtccagaggcaagagacctcatcactaaactgtgctgctcagccgaccatagactgggaagaaacggcgctgacgatctgaaggctcaccctttcttcagcgcgattgacttttcatccgacattagaaagcagccagccccatatgttccaactatcagccatcctatggacacgtcaaactttgaccctgtggatgaagagagcccctggaatgacgcctccgaaggctccaccaaggcatgggacacactgacaagccccaacaataaacaccccgagcatgctttttacgaatttacgttcaggcggttcttcgacgacaacgggtatccattccggtgtcccaagccgagtggggctgaagcctcgcaggcagagtcgtcagacctagagagttccgacctggtcgatcagacagaaggctgccagccagtttatgtttag

SEQ ID NO: 29250 - DNA, 3267 bp, Artificial Sequence
  Description of Artificial Sequence: Synthetic coding sequence
atgcgcccaaaaacctttccagcaactacttactctgggaatagccgccagagactgcaagagatacgggagggccttaagcagccaagcaaaagctcagtacaggggctgccggctggtccaaactcagatacatccctggatgcaaaggtccttggctcaaaggacgctacccggcagcagcagcagatgcgcgctacccctaaatttggcccataccagaaggcattgcgcgaaatcaggtactccctgttaccattcgcaaatgaatcaggtacttcagcagcagctgaagtgaaccgccagatgctgcaagagctggtcaatgccggatgcgaccaagagatggctggcagagctctgaagcaaaccggtagccgttctatcgaggccgcactcgagtacatctctaagatgggatacctcgatccccgaaacgagcagattgtgagagtcattaaacaaacatcaccgggtaaaggactgatgcccacccctgtgacacgcagacctagcttcgagggcacaggagatagttttgcaagttaccaccaactctctggcaccccatacgagggaccgagctttggcgcagatggccctaccgcacttgaagagatgccaaggccttatgtggactacctctttccaggggtcgggccacatgggccaggtcaccaacaccagcacccgccaaaagggtacggggcatcagtggaggccgcaggggcacactttcctcttcagggagctcattacggcagaccacatctgctcgtccccggtgagcctttggggtacggagtgcagcggtcaccctcctttcagtctaaaacaccacccgaaaccgggggatacgcttccctgcctaccaaagggcagggaggcccacctggcgctggactcgccttcccacctccagcggctggattgtacgtcccccatccccaccataagcaggcaggcccagcggctcaccagttgcacgtcttgggatccagatcgcaagtgttcgcatccgattccccacctcagtccctgttaacccctagcagaaacagtcttaacgtggatctttacgaactgggctccactagtgtgcagcagtggcccgcagctaccttggctagacgagatagcctgcagaagccaggactagaggccccacccagggcccacgtcgcttttcggcctgattgtccagtgccatctcggaccaatagttttaattcccatcagcccaggcctgggccaccgggtaaagctgaaccttcgctgcctgctccaaatacagtgaccgcggtcactgctgcccatatactgcaccccgtgaagtccgtccgcgtgttgcggccagaacctcaaacggcagttggaccctcccaccctgcctgggtgccagcgccagccccagccccagcacccgctcctgcccctgccgcagaaggcctggatgccaaagaggagcatgccctggccctggggggtgccggagcctttcctctggatgtagaatacggtggacctgacagacgatgtccacctccaccttacccgaagcatttgttactgcgttctaagagtgagcaatacgacctcgatagcctgtgtgctggtatggagcagtctttaagggctggcccaaacgagccagagggaggagataagagcagaaagagtgcaaagggggacaaaggcggaaaagacaagaaacagatccaaacatctccggttccagtgcggaaaaacagcagagatgaagaaaaacgtgagtccagaatcaagagctactcaccatacgcctttaagtttttcatggaacaacatgtggaaaacgtgatcaagacctaccagcagaaagttaataggagattgcaattggagcaggagatggccaaggccggtctgtgcgaggctgagcaagagcagatgcgcaaaatcctgtaccagaaagagtccaactataatcgccttaagagagctaaaatggacaagtccatgttcgtgaaaatcaagaccttaggaatcggggctttcggtgaggtgtgtctggcatgcaaggtggacacccacgccctgtatgcgatgaagaccttacgaaagaaggatgtgctaaatcgcaatcaggttgcacatgtgaaagctgaacgcgacatccttgctgaagctgacaatgagtgggtggtcaaactgtactactctttccaagacaaagattctctctattttgtcatggattatatacctgggggtgacatgatgtccctgttgattcggatggaggtgttccctgagcacttagccagattttatatcgcagagttaaccctggcgattgaatcagtgcataagatgggctttatccaccgggacatcaaaccagacaacatactgatcgatctggacggacatatcaaattaaccgattttggtctatgcactggatttcgttggacccataatagcaaatactaccagaagggctcccacgttaggcaggactctatggaaccatctgatctgtgggacgatgtgagcaactgcaggtgcggtgatagattgaaaaccctggagcagagggccagaaagcaacaccaacggtgccttgcccattcactggtcggcacccctaactatatcgcgccagaggttttgctccggaaaggttacacccagttgtgcgattggtggtcagttggggtgatcctgtttgagatgctggttgggcagccacctttcttagccccaactccaaccgaaacccagctcaaggtcatcaattgggaaaacaccttacacattcctgcccaggtgaagttaagcccagaggctagagatcttatcactaagttatgctgtagtgccgatcatcgactggggaggaacggtgctgatgaccttaaagcccacccgttcttttctgcaatcgatttttcttccgacatccgcaaacagccagccccatatgtgccaactatttcacacccaatggacacctccaactttgaccccgtagatgaagaatcaccatggaacgacgcatctgagggtagtactaaagcctgggataccttgacatcccctaacaataaacaccccgagcatgcattctacgagtttacgtttagacgcttctttgatgacaacggttacccttttagatgccccaaaccttctggtgcggaagctagccaggctgagagtagcgacctggagagctcggatctagtagatcagaccgaaggctgccaacccgtgtacgtctag

SEQ ID NO: 29251 - DNA, 972 bp, Artificial Sequence
  Description of Artificial Sequence: Synthetic coding sequence
atggcctatgtgcctgcacctggatatcagcccacttacaatccgaccctgccctactatcagcctatccctgggggattaaatgtgggtatgagcgtgtatatacaaggagtggcttcggaacatatgaaacggtttttcgtaaactttgtggtcggccaggatcctggctcagacgtggcttttcacttcaaccctcggtttgatggatgggacaaagtggtgttcaacacgctgcagggaggtaagtggggctctgaggaacgaaagaggagcatgcccttcaagaagggagccgcattcgagttggtcttcattgtgctggctgagcactacaaggtcgtcgtgaatggaaatcccttctacgagtacgggcataggctcccattgcagatggtgacccatttacaagtcgacggagacctgcagctgcagtctatcaactttatagggggtcagccactgaggccccagggtccaccaatgatgccgccataccccggtcccggacattgccatcagcagctaaactccttaccaacaatggaaggccctcccaccttcaatccaccagtcccctatttcggccgattacagggcggtctaaccgcgagacggactatcatcataaaagggtacgtcccccctaccggcaagtccttcgctatcaatttcaaagtggggagtagcggcgatatcgctctccacatcaatccgaggatgggtaacggtaccgtagtgagaaattcgttgttgaatgggtcctgggggagcgaggagaaaaaaataacacacaacccttttggtccaggccagttttttgatctctccatccgttgtggcctggaccgctttaaggtgtatgccaatggtcaacacctgttcgattttgcccacagactgtcagccttccagcgcgtggacaccctcgagatacaaggggacgtcacactgtcatacgtgcagatctag

SEQ ID NO: 29252 - DNA, 1530 bp, Artificial Sequence
  Description of Artificial Sequence: Synthetic coding sequence
atgaacaacgaagaagacctgttgcaggaggacagcacacgcgatgaagggaatgagactgaagccaatagtatgaatacattacgaaggacacgcaaaaaagtcacaaaaccctacgtctgttctacagaggtgggcgaaacagacatgagtaatagtaatgactgcatgagagatagttcccaaatacttactcccccacaactgagtagccgaatgaagcacatacgacaggcaatggccaaaaatcggctccaattcgtgcgatttgaggccacagatttacatggagtttcacggagcaagacaatcccagctcactttttccaagagaaagtctcccacggcgtttgcatgcccaggggctacctggaggtgatacccaaccctaaggacaacgagatgaacaacatacgcgctacctgttttaacagtgatatcgtgctgatgcctgagctgtccacctttagggtattaccctgggccgaccggaccgcccgagtcatttgtgatacctttacagtgactggggagcccttgctcacctccccaaggtatatcgcaaagagacagctgagccacctgcaggcttcaggctttagtttgttgtcagccttcatctacgatttctgcatcttcggtgtacccgagattttaaacagcaagattatttcattcccggcactgacattcttgaacaatcacgatcagccctttatgcaagagcttgtcgatgggctctatcatacaggggcaaacgttgaatctttcagctctagtactaggcccggtcagatggagatttcatttcttccagagttcgggattagctcagccgataatgcatttactctcaggaccggcgttaaggaggttgcaagaaagtacaattacattgcttctttctttatcgaaacgggattttgcgattcagggatcctgagccactcactctgggatgtggaccggaaaaaaaacatgttctgcagcacaagcggcacagagcagttaacgattactggaaaaaaatggctggcgggtttgctcaaacattcggcagcattaagttgtctgatggctccttcagtttcatgcaggaagagatactccaaggatcggaaggacctcaagaagagcgtgcccactacatggggatataatgataacagctgtatttttaacatcaaatgtcacggtgagaagggaacaaggattgagaataaactcgggagcgctacggcaaatccctatctcgtgctggctgctacggtggcagctgggctggacgggctgcatagtagcaacgaagtactggcgggtccggatgaatctaccgacttctaccaggttgagccgtccgaaatccccctgaaactggaagacgctctcgtggctctagaagaggatcagtgtctgcggcaggcgctgggggaaacatttatccgctactttgtggcaatgaagaagtacgagttagagaatgaggagatcgccgctgaaagaaataagtttctggaatacttcatctag

SEQ ID NO: 29253 - DNA, 627 bp, Artificial Sequence
  Description of Artificial Sequence: Synthetic coding sequence
atgaacaacgaggaagacttgttgcaggaggatagcactagggacgaagggaatgaaacagaagccaatagcatgaataccttgaggcggaccaggaagaaagtaaccaagccctatgtgtgctcgaccgaggtcggggagacggatatgagcaactctaatgactgcatgagggacagcagccagattttaaccccacctcagcttagcagcagaatgaagcacatccggcaggctatggcaaagaaccggttgcagttcgttcggttcgaggcgactgaccttcacggagtgtccaggagcaagaccattcctgcacatttctttcaggagaaggtttcccatggagtatgtatgccacgtggttacctcgaagtgatccccaaccccaaggacaacgagatgaacaacatacgtgccacctgctttaactcggatattgtcttaatgccggaattatccacctttcgagttctcccctgggcggatcgaactgcacgcgtaatctgcgatacattcaccgtgaccgtgagtggaatgtctattgggcgaaagacgtgtagtgccgctctgctggaactatcctcatcgcggtccctggggaagaatggttggcaagacagttag

SEQ ID NO: 29254 - DNA, 504 bp, Artificial Sequence
  Description of Artificial Sequence: Synthetic coding sequence
atgcactggggaacactgtgtggatttttgtggttgtggccatatttgttttacgtccaggccgtccctattcagaaggtgcaagacgacacaaagaccctgataaagaccatcgtcacccgcattaacgacattagtcatacccagagtgtgagcagtaagcaaaaagttacgggcttggatttcatccccggactccacccgatcctcactttatccaaaatggatcagacgttggccgtttatcaacaaattttaacctccatgcctagtagaaacgtgattcaaattagcaatgatcttgagaatctgagagacctcctgcacgttctggccttttccaagtcctgccacttgccctgggcgagcggcctcgagacgctcgacagtctgggcggagtactcgaggcttcgggatattccactgaagtagtcgccctgtctcggctccagggcagcctgcaggacatgctttggcagctggatctgagccctgggtgttag

SEQ ID NO: 29255 - DNA, 1791 bp, Artificial Sequence
  Description of Artificial Sequence: Synthetic coding sequence
atgggcagcgtctccagcctgattagtgggcactcgttccactccaaacactgccgggcatctcaatataaactcaggaaatcctcccacttgaagaagctcaaccgttactccgacgggctcctgcggtttggatttagtcaggattctggccacggaaaatcatctagcaagatggggaagtctgaggacttcttttacattaaggtgtcgcagaaggctcgagggagccatcatccagattacacagcactatcttccggtgacctaggaggacaggcaggagtggatttcgacccatctactccccctaagctcatgcctttctctaaccagttagaaatggggtctgaaaagggggcagtccggcctaccgccttcaagccagtgctccccagaagtggcgctattctccactcctcacccgagtcggcatcacaccagctccatcctgctccccctgacaaacccaaagaacaggaacttaaaccaggactatgtagtggcgctttgtccgatagcggaaggaactccatgagctccctaccgactcactctaccagttcatcataccaactcgatcccctggtgacccctgtcgggccaacgtctcgttttggtggctcagctcacaatattacccaaggcattgtgctccaggattccaatatgatgtctttgaaggcactgtccttctcagacgggggtagcaagcttggtcactcaaacaaggccgataagggccctagttgcgtcaggagcccaattagcacagacgagtgcagcatacaggaactggagcagaaactcctggaacgggagggagcgttacaaaaactccagcggtcctttgaagagaaggagttggcatcttccttggcatacgaggagcgaccacgcagatgtcgagatgagctggagggtcccgaaccgaagggtgggaataagctgaagcaggccagccagaaatcacagcgcgcacagcaagtgctgcatttacaagtccttcaattgcagcaggaaaagcgtcagcttcggcaagaattagaaagtcttatgaaagaacaagatctgcttgagacaaaactgcggtcctatgagagagagaaaacctccttcggacctgcgctggaggaaacacagtgggaggtctgccagaagtcgggagagatatcactgctgaagcagcagctgaaggaatcacagaccgaagtgaacgccaaggcttctgaaattctcggcctcaaggcccaactgaaggacacccggggaaagttggaaggactggagctccgcacgcaagacctggaaggggctctgcggaccaagggcctggagctggaggtatgcgagaacgaactgcagaggaaaaaaaacgaggccgaactgctcagagagaaggtgaatctcctggaacaggagttgcaggaactcagagcccaggctgcactggcgagggacatggggccacccacctttcctgaggatgtcccagccctacagcgggagctggagcgccttcgagcggaactccgagaggaaaggcaggggcacgatcagatgagctccggttttcagcacgagagactggtgtggaaggaggagaaggagaaagtgattcagtatcagaagcagctccaacagtcatacgtggccatgtaccaaaggaaccaaaggctcgagaaagccctgcagcaattggctcggggagattcagccggagagccgctggaagtggatctggaaggggcagatatcccatatgaagacatcatcgctacagaaatctag

SEQ ID NO: 29256 - DNA, 231 bp, Artificial Sequence
  Description of Artificial Sequence: Synthetic coding sequence
atgggttccgtgagctccctgatctcaggtcattccttccatagcaagcattgtcgggcttctcagtacaagttacggaagtcctcccatttgaaaaagttaaaccgttacagcgatggactgctgcgcttcggattttcccaggatagcgggcacgggaaggctatgacccggtgtcctcgtgcctctagtatgtctggctcctgtgggcgtaggcgtcggaggcggtag

SEQ ID NO: 29257 - DNA, 1722 bp, Artificial Sequence
  Description of Artificial Sequence: Synthetic coding sequence
atgggcagcgttagcagcctgatctcgggccattccttccactcaaaacactgtcgcgcatctcagtataagctccgcaagagcagccacttgaaaaaacttaacagatacagtgacggcctgctccggtttggtttcagtcaggactccgggcacggcaaaagttcctcaaagatgggaaagagcgaggatttcttctacatcaaagttagccagaaggccagaggatcgcatcatcccgattatacagctttaagttccggagatctgggcggtcaggctggagtggattttgacccttccacgcctcccaagctgatgccattcagcaatcagctagagatgggcagtgaaaaaggagctgtcagaccgaccgcattcaagccagtacttcccaggagtggggcaatcttacattcttctcccgaatcagctagtcatcagctgcatccggcaccccctgataaaccgaaggagcaggagctgaaaccgggtctgtgcagtggtgccttaagcgactctggtagaaacagcatgagtagtttacctacacattccactagctcatcgtaccagttggaccccctggtaacacccgttggaccaaccagcaggttcgggggaagcgcgcacaacatcacacagggcatcgtcctccaggactctaacatgatgtcccttaaagcgttaagcttctcagacggagggagtaagctggggcacagcaacaaagcagataaggggccaagctgtgtgaggagtcctatatcaaccgatgaatgttcaattcaggaattagagcagaagctgctggaacgggaaggggcactgcaaaaactgcagagatctttcgaggagaaggaactggcgtcgtctcttgcatacgaggagagacctcgaaggtgcagagacgaactcgaaggaccagaaccgaaggggggaaacaagctgaagcaggcgtcccagaaatctcagcgagcgcagcaagttctccaccttcaggtgctgcagctacagcaggaaaagcgccagctgcgccaggagctggagtctctgatgaaggaacaggacctacttgagacgaaacttcggagttacgaaagggaaaagacgtcattcggaccagccctcgaagagactcaatgggaggtttgccagaaatctggcgagatctcactattgaaacagcaacttaaggaatcacagacagaagtgaacgctaaagccagcgaaatcttggggcttaaggcccagctaaaggacacacggggaaaactggaggggctggagctgaggacacaggacctggagggcgcattgcgcaccaagggtctggaactggaagtctgcgagaatgaattacagagaaagaagaacgaggccgagctgctccgtgagaaagtgaacttactcgagcaggagctgcaagagcttagggcccaagccgctctggcacgtgacatgggcccacccacattcccagaagacgtgccagccctgcaaagagaactggagagactcgtttggaaggaagagaaggagaaagtgattcaatatcagaagcagcttcagcagagctatgttgccatgtaccaacgcaaccaacgcctggaaaaagctctgcagcaacttgcgcgtggcgacagcgccggagaaccgttggaggtggatcttgagggggcagacattccctatgaagatattatcgctacggaaatatag

SEQ ID NO: 29258 - DNA, 1791 bp, Artificial Sequence
  Description of Artificial Sequence: Synthetic coding sequence
atggggtccgtgtctagtctgatcagtgggcactcgtttcactcaaaacattgtagggctagtcagtacaaattaagaaagagctcacacctgaaaaagctcaatcgttatagtgatggcctgctacggttcggcttctcacaggattccggacacggaaagagttccagtaagatggggaaatccgaagacttcttttacatcaaggtgagtcaaaaggccaggggctctcatcacccagattataccgcccttagtagtggagacctcgggggacaggctggggtggacttcgacccgtctacgcctcctaagctgatgcctttctccaaccagctggagatggggtcagagaagggagccgtgaggcccactgcattcaagcccgtcctgcccagatccggggctattctgcatagttcccctgaaagcgcgagccatcaactgcatccagcgcctcccgacaagccgaaggaacaggaacttaaacccggtctgtgctccggcgcactgtcagactccggaaggaacagtatgtcatcactgcccacgcactccacttcatcaagttaccagcttgacccacttgtaacccccgtgggcccaacatctcggtttgggggaagcgcacacaatatcacacaggggattgtgctgcaggatagcaacatgatgtctctcaaagccctatctttttctgacggcggatctaagctgggccactccaacaaggctgataaaggaccctcatgcgtccgctcccccatttctactgatgagtgcagtattcaggagctggagcagaaactgctcgagagagagggtgctctacagaaactgcaacgttcctttgaagagaaggagctagcgtcttctctggcatacgaagagagacctaggaggtgccgggacgaactggagggccctgagccgaagggcggaaataagctgaagcaggcctcgcaaaaatcccaaagggcccagcaggtgctgcacctgcaagtacttcagttgcagcaagaaaagcgacagttgcggcaggaactggagtccttgatgaaggagcaggatctgctcgaaacaaagcttagatcctatgagagagagaagaccagtttcggccctgccttggaggagacacagtgggaagtctgccagaaaagcggcgagataagcttactgaaacagcagctcaaggagtctcagacggaagttaacgcaaaagccagcgaaatcctggggttaaaggcacagctgaaggacaccagaggtaaattagagggccttgagctccgaacccaggacctagaaggggctcttcgtacgaagggactggagcttgaagtgtgtgaaaacgaactccaacgcaagaaaaacgaggcggagcttctgcgtgagaaggtcaatttgctggaacaggagctacaggagttgagggctcaggccgctctcgcacgggatatgggacccccaacatttccagaagatgtgcctgctctgcaaagggagctcgagaggcttagggccgagttacgcgaggagaggcagggccacgaccagatgtcatctgggttccaacacgagagactggtctggaaagaggaaaaggaaaaggttatccagtaccaaaagcagctccagcagagttacgtggcaatgtatcagcgtaaccagaggctggaaaaagctcttcagcaactggcccgtggagactcggccggagagccccttgaggtagatctagagggtgctgacataccatacgaggatatcattgccacagagatctag

SEQ ID NO: 29259 - DNA, 1614 bp, Artificial Sequence
  Description of Artificial Sequence: Synthetic coding sequence
atgggaagcgtgagcagcctcatatccggccatagttttcacagcaaacattgtcgggcaagtcagtacaagctacggaagtcttcacatctgaaaaagttaaaccgctacagcgacggactgctgcgttttgggttcagccaagacagcggccacggcaagagctcttctaagatggggaagtcagaggactttttttacattaaagtatcacagaaagccaggggcagccaccaccctgattataccgctctgtctagtggtgatctagggggacaggccggtgtggacttcgaccctagtactccacctaaactgatgccattttccaatcaactggagatgggctccgagaagggggcagtgcggcctaccgcgtttaagcctgtgcttcccagaagcggggctatcctacacagcagccccgagtctgccagtcatcagctccatcctgctccacccgataagcctaaagaacaggaactcaaaccaggcttgtgttccggagctctctctgacagcggacgcaattctatgtcctctctgcccacccactccacttcctccagctatcagctggatccactggtcacacctgtggggcctacaagccggttcggtgggagtgcccataacatcacccagggcatcgtcctgcaggatagcaacatgatgagcttgaaagcactttctttttccgacgggggatccaagctcgggcactctaacaaggccgacaaggggccatcctgcgtgcggagtccaatcagtaccgatgagtgttctatacaggagttagagcagaaacttctggagagagaaggagctctccagaagttacagaggtccttcgaagaaaaggagttagcctcttccctagcatacgaagaacgcccaagaagatgcagggacgagctggaggggcctgaacctaagggaggtaacaaactgaagcaggcctcccaaaagagccagcgggcacaacaagtgctacacctgcaggttctccaacttcagcaggagaaacggcaacttaggcaggagttggagagtctgatgaaggaacaggacctgctcgaaactaaactccggagctatgaaagggagaaaacctcattcggcccagcgctggaagagacccagtgggaagtttgtcaaaagtcaggagaaataagtctcctcaagcagcaactgaaggagtctcaaaccgaggtcaacgcaaaagcatctgagattcttggacttaaagctcagctcaaggatacacgtggtaagctcgaagggctcgaactacgcactcaagatcttgaaggcgctttacggacgaaaggtctcgaactagaggtgtgcgagaacgaactccagcgcaaaaaaaatgaggcagagctactgcgggaaaaacacgagagactggtttggaaggaggagaaggaaaaggtgatccagtatcagaagcagcttcagcagtcatacgtcgctatgtaccagaggaatcaaaggttagagaaggccctgcagcagctcgcacggggtgacagtgctggagagcctctcgaagtggacctagagggcgctgatatcccctatgaggatattatagctacagagatctag

SEQ ID NO: 29260 - DNA, 1005 bp, Artificial Sequence
  Description of Artificial Sequence: Synthetic coding sequence
atgacagagaattccgataaagtccctatcgctttggtgggcccagacgacgtggaattttgttcccctcccgcatacgccaccctcaccgtcaagccatcttcaccggcacgcctgttgaaagtgggcgctgtggtattaataagtggagccgtgctacttctttttggcgctattggcgctttctacttctggaaagggagtgattcacatatctataatgtgcattatacaatgtcaataaacggcaaactccaagacggctctatggagattgacgctggaaacaatttagaaacctttaagatgggttcaggcgcagaggaagctatcgcagtaaatgacttccaaaacggtatcacaggcatacggttcgctggaggtgagaagtgttatataaaggctcaggtgaaagccaggattccagaagtaggggcagtcaccaaacagtccatctccagtaaattagaaggaaaaattatgccagtaaaatacgaggaaaacagcctcatctgggtcgcagttgatcagccagtgaaggacaactctttcctttcaagtaaggttttggagttgtgcggcgaccttcccattttctggctgaagccaacctatcctaaggagattcaacgcgagagaagggaggtggtgagaaagattgtgccaactacgaccaagcgaccccattccggacctcgctcaaaccctggagctgggagattgaataatgagacccggccatccgttcaggaggattcccaggctttcaatccagataacccctatcaccaacaagagggggaatcaatgacgttcgacccccgactggaccatgagggcatttgctgtatcgagtgccggaggagctatacacattgccagaagatttgcgagccgctcgggggatactatccttggccttacaattaccagggctgtcgatcagcatgtagggtaatcatgccctgcagctggtgggttgcccgaattttgggaatggtctag

SEQ ID NO: 29261 - DNA, 390 bp, Artificial Sequence
  Description of Artificial Sequence: Synthetic coding sequence
atgtcaatcaatgggaagctacaggacggctcgatggaaatcgatgctggtaataatctggagacgttcaagatgggtagtggggcagaggaagccatcgcagtgaatgacttccagaatggtatcacaggtatccggtttgccggaggcgagaagtgttatataaaagctcaggtgaaggcacgcatcccagaggtcggcgctgtcactaaacagtctatctcttccaaactggaaggcaaaatcatgcctgtcaagtacgaagagaattccctgatttgggtcgctgtggaccagcccgtcaaagataattcgtttctttccagtaaagtgctcgagctctgcggcgacttgcccatcttctggctgaagccgacatatccaaagtag

SEQ ID NO: 29262 - DNA, 1002 bp, Artificial Sequence
  Description of Artificial Sequence: Synthetic coding sequence
atgactgagaactccgacaaggtgccaatcgctttagtcggccctgacgatgtcgagttctgctctcccccagcctatgcgacgctgactgtaaagccatcctcccccgctcggctcctcaaagttggggcagtggtactcatctccggcgcagtgttgctgctattcggagccataggagccttctatttctggaagggctctgacagtcacatctataacgtacattacacgatgagcatcaacggcaagctccaggatggctcaatggaaatcgacgcgggtaataatcttgaaacctttaagatgggctctggcgctgaggaagccattgcagtgaacgattttcagaacgggataactggaatcagattcgcaggaggtgagaagtgttatatcaaagcacaagtgaaagctaggatcccagaggttggtgccgtcactaagcagtccatctcaagtaagttagaaggtaaaataatgcccgtgaaatacgaagagaactctctgatctgggtggcggtcgaccagccagtaaaggataattcttttctgagctccaaagtcctcgagttgtgtggggatctacccattttttggcttaagccaacatacccaaaagagatccagagagagaggcgcgaagtggtcaggaaaatcgtccccaccactacgaagagacctcattctgggcctagatcaaatcccggagctggtcgccttaataacgaaactcggccatcagttcaggaggacagtcaggcattcaatcctgataacccctatcaccaggagggcgagagtatgacattcgacccacggctggatcacgaaggcatctgctgtatcgagtgccggaggtcatatacccattgccagaagatctgcgagcccctggggggatattacccgtggccgtacaattaccaggggtgtcgttcagcctgccgcgtaatcatgccttgcagctggtgggtcgccaggattctgggcatggtctag

SEQ ID NO: 29263 - DNA, 408 bp, Artificial Sequence
  Description of Artificial Sequence: Synthetic coding sequence
atgaatgaagtgataatttacaacgtgttgctgctgcggaccatttcatgtatatccgagacctatggccactatctcattcactgtcccagcaaaatcagtcccgaattgcttaaaaaggagtcgattactaactcgtacgcccatttccagatctataacgtgcattacactatgagtatcaacggaaaactgcaggacggatcaatggaaatcgacgcaggcaataacctcgaaacgtttaagatgggctctggcgcagaggaggctatcgccgtgaacgatttccagaatgtcagtatttttcacgccttcagagagttcaatcaggccagcctcagagactttagtaacagccgccgatctagcgtatctcatactcaccctaacggcaattgttctttgtag

SEQ ID NO: 29264 - DNA, 2760 bp, Artificial Sequence
  Description of Artificial Sequence: Synthetic coding sequence
atgcagcgtagtattatgtccttttttcatccaaagaaagagggaaaggctaagaaacccgagaaagaggcttctaattcctccagggagacagagccaccaccgaaggcggctctaaaggagtggaacggcgtcgtgtccgaatctgactctcccgtaaagaggcccggtcggaaggccgcacgagtcctagggtccgaaggcgaagaggaggatgaagcactctctcctgcaaaggggcagaaacccgctctcgattgcagccaggtgtccccccctagacctgcgacctcacctgaaaacaatgcttcactgtcagatacctcaccgatggattcttcccctagcggtattccaaagaggaggactgcaagaaagcagctccccaaaaggaccatccaagaagtactggaagagcagtcagaggacgaagaccgcgaagccaaaagaaagaaagaggaagaggaggaagaaactcccaaggaatcactaacagaggctgaggtggctacagagaaagagggcgaagacggagaccagcccacaaccccccctaagcccctcaaaacttccaaggcggagacgcccaccgagagtgtctcggaacccgaagtagccactaagcaagagctgcaggaggaggaggaacagactaagccgccacgtcgagctccgaagacactgagttcattcttcacgccacggaagcctgcagtgaagaaggaagtgaaggaggaggaacctggagctcctggcaaggaaggtgccgcagaggggcctctagatccgtcgggatacaatcccgctaaaaacaactatcacccagtggaagacgcttgctggaagcctggccagaaggtgccgtacctcgctgtggccagaactttcgagaagatcgaagaagtgtccgcccgacttcggatggtggagacgctgtccaatctcctgagatcagtggtggcgctctccccccctgacctgctgcctgtgctctacctgtccctcaatcacctgggcccaccacaacaagggctagaactcggggtcggagatggggtgctgctgaaggcagtggcacaggccacaggaagacaattggagtccgttagagccgaagctgccgaaaagggcgatgtgggtctggtagcagaaaacagtagatccactcagagattaatgctgccaccaccccctctgactgcctcgggggtatttagcaagtttcgtgacattgcccgactcacgggctctgcttcaacggcaaaaaagatcgatataataaaaggcctgttcgtggcatgccgtcacagcgaagcaagatttatcgcaaggagcttgtccgggcgattgagactgggactcgccgaacagtctgtgttggccgcactctcacaggcagtgtccctgaccccacctggccaggagttccctcctgctatggtggatgcagggaagggcaaaaccgcagaggctcggaaaacttggctggaggaacagggcatgatccttaaacagacattctgcgaagttccagatctcgatagaatcatccccgtgctcctggaacacggcctggaaaggctgcctgaacattgtaagctgtctcctggaatcccccttaaaccgatgctggcccacccaactcggggaataagtgaagtgcttaagcgctttgaggaggcggctttcacctgcgagtacaagtatgatggccagagggctcagattcacgcactggaagggggagaggtcaagatttttagccggaatcaggaggataacacagggaagtatcctgatatcatcagcagaataccgaaaattaaactgccgtccgtgactagcttcatcctggataccgaggctgtagcatgggatagggagaaaaagcagatccagccttttcaggtgctcacgacgaggaaacggaaggaggtcgacgcgtccgagatccaggtgcaagtctgtctgtacgccttcgacctcatttatcttaatggagagagtctagtgcgggagcccctttcaaggcggagacaattgttacgtgagaactttgtggagactgagggcgagttcgtctttgcgacaagcttagacaccaaagatatcgagcagattgccgagttcctcgaacaatctgtgaaagacagctgtgagggtttgatggttaagacgctggatgtagacgcaacatacgaaatcgccaagcggtctcacaattggctgaagcttaagaaggactacttagatggggtcggcgatacattagacttggtggtcattggagcctacctggggaggggcaaacgggctggtcggtatggaggattccttcttgccagctatgatgaagatagtgaagagcttcaagctatttgtaagcttggaacgggatttagtgatgaagagctggaagagcaccaccagtctctgaaagcactcgttctaccaagtcctaggccctatgtccggatagacggggcagtcattccagaccattggcttgatccttccgctgtctgggaggttaaatgtgcagatctgtctctcagccctatctacccagccgcacgcggtttggtggattctgataagggcatctccctgcggttcccccgattcatccgggttcgcgaggataagcagcctgaacaggctacaacgtccgctcaggtagcttgcctataccgcaagcagtcccagattcagaatcaacagggagaggattccgggtccgatccagaggatacctattag

SEQ ID NO: 29265 - DNA, 2667 bp, Artificial Sequence
  Description of Artificial Sequence: Synthetic coding sequence
atgcagcgatcgataatggccgcattgaaggagtggaatggcgtcgtgtcggaatcagatagtccagtgaagaggcccggtcgcaaggccgctcgggtgcttggcagtgaaggagaggaagaagacgaggctctgtccccagccaagggtcagaagcccgctttagattgtagtcaggtctctcctcccaggccggcaacgtccccagaaaataatgcgtccctttcggatacaagccctatggattcctctccttctggcataccaaaacgaaggaccgctaggaaacagcttcccaagaggacaatccaggaggtgctggaggagcagtctgaagatgaggaccgcgaagcgaaaagaaaaaaagaagaagaagaggagacaccaaaagagtctctgacggaggctgaagtcgctaccgaaaaggaaggagaggatggggaccagcccactacccctcctaagcctttaaaaacatcaaaagcggagacacccacggagtccgtaagtgagcctgaagtcgccacaaagcaggagcttcaggaggaagaagaacagacgaaacctcccaggcgcgctcctaagaccctcagtagcttctttacacccagaaaaccagccgtcaagaaggaggtgaaagaggaagagcctggcgcacctggtaaggaaggagctgccgaaggtccccttgatccaagcggttacaaccccgcaaagaataattaccatcccgtcgaggatgcttgttggaaacctggccagaaagtgccatacttggccgtagcaagaacattcgagaagattgaagaggtgagtgctagactgcgaatggtggagacattgtctaatttactccgaagcgtcgtagctctaagtcctcctgatctgctgcccgtattgtacctctcccttaaccatttaggcccaccccagcagggtctagaactgggagtcggcgacggggtccttcttaaggccgtggcccaggccacgggtcgccagctggaaagcgtccgggcagaagccgcagagaaaggagatgtgggtctggtggcggagaacagcagaagcacccagcgtttgatgctccccccacctcccttgaccgcatccggggtcttcagcaagtttcgcgatattgccaggctgaccgggtccgcgtcgactgcaaaaaaaatcgatattataaaaggtttgttcgtggcttgccgtcactctgaggcaaggtttatcgcacgctccctgagcggccgtctgcggctggggctagccgagcaatccgtgttggcggcactgtcgcaggccgtgtctctcaccccacccggacaggagtttccccctgcaatggtagacgctgggaaggggaaaacggctgaggctaggaaaacctggctggaagagcagggaatgatcctcaagcagacgttttgcgaggttcctgacctggacaggattattccagtactcctggagcatggattggagcgtctgcctgaacactgcaaattatcacctggaatccccttaaaaccgatgctcgcccacccaactaggggaatatctgaagtcctgaaacgttttgaggaagcagcttttacctgtgagtacaagtacgatggacagagggctcagattcacgctttagagggcggagaggttaagatatttagccgtaatcaggaagacaacacaggcaagtacccagatatcatatcgcgaatccctaaaataaagctccccagtgttacatcttttatattggacacagaggccgtggcttgggatagagagaagaagcagattcagccgtttcaggttctaaccaccaggaagagaaaggaggtggacgcctcagaaattcaggtgcaggtatgtctatatgctttcgacttaatttacctcaacggggaatcattggtgcgggaaccgcttagcaggcgacgtcagttgctccgggagaacttcgtcgaaaccgaaggggagttcgtgttcgctacgtctttggataccaaagatatagagcagatagcggagtttctggaacaaagtgtgaaggattcttgcgagggtctgatggttaaaacactagacgttgacgcaacatacgaaatagctaagcgttcacacaactggctcaaattgaagaaagactatctcgacggcgttggggataccctggacctggtcgtgattggagcttatctgggcagggggaagagggcagggagatacggcggtttcttactggccagttacgacgaggattccgaggaactgcaggcaatttgcaagctaggaacaggcttttccgatgaggaattggaagagcaccaccagtctctgaaggctctggtactcccttcccccaggccctatgtacggattgatggagctgtgattccggatcactggctggacccgtctgccgtctgggaagtcaaatgcgccgatctttccctttcaccaatctaccctgcagcccgaggtctcgtggatagcgacaaaggcatttcattacgattcccgcgttttatccgagtgcgagaggataaacagcccgagcaggccacaacctccgcccaggtagcatgcctgtacaggaagcaatcccagattcagaatcagcagggagaggattcaggctctgatccagaggatacctattag

SEQ ID NO: 29266 - DNA, 2556 bp, Artificial Sequence
  Description of Artificial Sequence: Synthetic coding sequence
atgcagaggtctatcatgtccttttttcatcccaaaaaagagggtaaggccaagaagccagaaaaggaagcgtcaaatagttcacgggagaccgagccgccacctaaggcggctttaaaggagtggaacggggtcgttagcgaatcagatagccctgtaaagcggccagggaggaaagcagccagggttttagggtcggagggagaagaggaggatgaggcgctgtcgcctgccaaagggcaaaagcctgcactcgattgttcacaggtcagccctcccagaccggctactagtccagaaaataacgcatcactttctgacacctcgccgatggattctagtccatcaggcatcccaaagaggcgaacagaagccgagactcccacagagtccgtgagtgagccggaggtcgccaccaagcaggaactccaggaagaggaagagcagacaaaaccccctcgcagagcccctaaaactcttagtagctttttcacgccacgaaaaccagccgtaaaaaaagaggtcaaagaggaagagccaggagcccctggaaaagagggcgcagccgaaggaccactcgatcctagcgggtataatcctgccaaaaacaactaccatcccgtagaagatgcgtgttggaagcccggacagaaggtgccttatttggctgtggcaagaacctttgaaaagattgaggaggtgagtgcgcgtttgcgtatggtggagactctgtccaacttgcttagaagcgtggtagctctgagcccccctgacctattgcctgtgctctacctgagtctgaatcatctggggcctccgcagcagggacttgagctgggcgtcggggatggtgtgttacttaaggccgtggcacaagctacaggtaggcagctggagtccgtcagggccgaagctgccgaaaagggcgatgtaggcctggtcgcggagaacagtcgctctacccagagactgatgttacccccaccacctctcaccgcctctggagtcttttcaaagtttcgggacattgcacgccttactggcagcgccagcaccgcgaagaaaattgatattatcaagggactatttgtggcctgcagacattcagaggcaagatttattgcgcgttctctgagcggacgcttgaggctaggtttggcagagcagtcagttcttgccgcattatctcaggctgtaagccttaccccaccaggacaggaatttccgcctgcaatggtggatgctgggaaaggaaagacggccgaggcccgaaagacttggttggaggaacagggtatgatcttgaaacagacattttgcgaagtgcctgatcttgataggataatccccgtcctgctggagcacgggctggagcgcctccccgaacactgtaagttgtccccaggaattcctttgaaacccatgctggcccaccctacacgcggaatctccgaagtgctgaagcgcttcgaggaggctgcttttacgtgtgagtataaatatgatggacagagggctcagattcatgctcttgagggcggagaagtcaaaattttctctcgcaatcaagaagataacacaggtaagtatcccgacatcatttcaagaatacccaagattaaactcccctccgtgacgagctttattcttgacacagaggctgttgcttgggacagagagaaaaaacagatccaacccttccaggtcctgactacaaggaagcggaaagaagtcgacgcctcagaaatccaagtgcaggtctgcctctatgcatttgacctgatttaccttaacggcgagtctttggttagagagcccctctctcggagacggcaactgctcagagaaaacttcgtcgagaccgaaggggaattcgtcttcgcaaccagtttggatactaaggatatcgaacagatagcggagttcctggagcagtctgtgaaggatagttgcgagggtctgatggtgaagaccctggatgtagacgctacctacgaaattgccaagcgatctcacaactggctcaaactcaaaaaggattatttggatggtgtcggtgacaccctggatctggtggtcattggcgcatacctgggcagaggaaaaagagctggccgatacggaggattcttgctggcctcatacgatgaagactccgaagagctccaggccatttgtaaattaggcactggattcagtgatgaggagctggaggagcatcatcagagtctgaaagccctggtgcttccttcaccccgtccgtatgtccggatagatggagccgtaatacccgaccactggctcgaccccagtgcagtgtgggaagttaagtgtgctgatctatctctcagccctatctatcctgctgcacgaggtttagttgactcggataaagggatctccctcaggtttccaagattcatccgagttcgggaagataaacagcccgagcaagccacaacatcagcacaagtcgcttgcttataccgtaagcagtcccagattcaaaaccaacaaggcgaggactctggcagcgaccccgaggacacatattag

SEQ ID NO: 29267 - DNA, 1248 bp, Artificial Sequence
  Description of Artificial Sequence: Synthetic coding sequence
atgcaacggtccataatgagcttctttcatccgaagaaggagggcaaggcaaaaaaaccagagaaggaggcaagcaatagttcgcgcgaaactgagccaccacctaaggcggcactgaaagaatggaatggagttgtcagcgaatccgactctcctgtgaagcggcctgggaggaaggccgcacgggtgttgggtagcgaaggggaggaggaggatgaagccctttctcctgctaagggccagaagcctgccctggactgttcgcaggtgagccctcccagaccggcaacatctcccgagaataatgcctccttatccgacacctcccccatggattcttctcctagcggcatccctaagcggcgtacggaagaggaaactcccaaggagtcactgaccgaggccgaggtcgctaccgagaaagaaggtgaggatggagaccagccaactactccccctaagccattgaaaacatcaaaggccgagaccccaaccgagtctgtatccgaaccagaagtagccaccaaacaggaacttcaagaagaggaggagcagactaaacctcctcgacgcgctcccaaaacgctcagctctttcttcacccctcgaaagcccgctgtaaaaaaggaggtcaaggaagaggagcccggtgccccaggaaaagaaggagctgcagagggtccactggacccgagcggctacaatcccgcaaagaacaactaccatcctgtggaggacgcctgctggaaacctgggcaaaaggtcccctacctggccgtcgctcgtacattcgaaaagatcgaggaggtcagcgccaggcttagaatggtggagacactttctaacctgctgagatcagtcgtggctctctctccccctgatctgctaccagtgctttatctgagcctaaatcacctcgggcctccacagcagggtttagaactgggggtgggcgatggagtgttgctgaaggccgtcgcccaggccacaggccgagaaagacgtgagaccaggtcacataactgccaccctcggcacccacaccctcggagtccactaaaagtcggctcttggtccccatctggcttgcggcagccacgcaaagccacatggggatggtggcctaggaccgccgctgctccgagggggtcctgctgccatcatctgaggtcattgcccccaggctcttcagcgagttccgcgacaagtccaggctcccttgccgtgctacctcagcctcgccgatag

SEQ ID NO: 29268 - DNA, 2499 bp, Artificial Sequence
  Description of Artificial Sequence: Synthetic coding sequence
gtgtgttgccccggatccggtgcccgtgatcagcggaaagcccgtctaacagatgaagagaaatgctggactggcagggaaaattctgacgcaaacatgcaacgatcgatcatgtctttttttcatcccaagaaggaggggaaggccaagaaaccagagaaagaggcctctaactcctcacgcgaaacggagcccccaccgaaggcagcgctgaaggagtggaacggggtcgtgtccgagagcgatagtcccgtaaaacggcctgggaggaaggccgctagagtcttggggtcagagggtgaggaggaagatgaggccctgtctccagctaaaggacaaaaacctgcattagactgttcccaggtgtctcccccaagacctgccacctccccagaaaataacgccagcctaagtgacacaagccctatggattcgtccccatcaggaatccctaaacgccgaacagcaagaaagcagcttccaaaacgcaccattcaggaggtactggaggaacaaagcgaggatgaggaccgagaagctaagcgaaagaaggaagaagaggaagagactcctaaagagagcctgacagaggctgaagtcgcaactgagaaagagggcgaggatggagaccagccaactaccccgccaaagccactaaaaacaagtaaggcagaaacccctacagaatctgtcagcgaaccagaagtggctacaaaacaggaactccaggaagaggaagagcaaactaaacccccaagacgcgctcctaaaactctttctagctttttcacgccacgaaaacctgccgtcaaaaaggaagtgaaggaggaagagccaggagctccgggtaaggaaggtgccgcagagggacctctggatcctagcggctataacccagccaagaacaattaccacccagtggaagacgcctgttggaaaccagggcagaaagtgccatatcttgcggtggccagaacttttgaaaagatcgaggaggtgagtgcgaggctcaggatggtagaaacattgtcaaatttactgcgcagtgtcgtcgccctcagccctccggatctgctcccagtgctgtatctaagcctgaaccacttggggcctccccagcagggattggagctgggcgtgggagacggcgtgttactgaaggccgtagcacaggccaccgggaggcaactcgaatccgttcgagctgaggctgcggaaaagggcgacgtgggactagtggccgaaaattcccgtagtactcagcgcctcatgctaccacctcctcccctgaccgcgtcaggtgttttctctaaatttagggatattgctagactgaccggttccgctagcacagctaagaaaattgacatcattaagggcctttttgtggcatgcagacactccgaagcaaggttcattgctaggtcactctctgggagactccggcttggcctggccgagcagtccgtgctggctgccctgagtcaggcagttagtttgacgccacctgggcaagaatttcccccagccatggtcgacgccggtaaaggaaagacagctgaggcccgtaaaacttggctggaggagcagggaatgatcttgaaacagactttctgtgaggtacctgaccttgatcgaatcatccctgtgctgctggaacatgggctcgagcgcctgccagagcactgtaagctcagccccggtatccctctgaaaccgatgcttgctcacccaacgagaggtatctcggaggtgctgaagcggtttgaagaagcagcatttacctgtgagtacaaatatgacgggcagagagctcagattcacgctttggaaggcggtgaagtgaagattttctctaggaaccaggaggataataccggaaagtaccccgacatcattagcaggattcctaaaattaagctgcccagtgttacttccttcatactggacaccgaagcagtcgcctgggacagagaaaaaaaacagattcaaccattccaagtgttgacaactaggaagcgcaaggaggtcgatgcaagcgagatccaggtgcaagtttgtttatacgcttttgatctgatctacctgaacggggaatccctggtgagagagccactcagcaggcgtaggcagttgctgagggagaatttcgtcgaaacagaaggcgaatttgtctttgccacgtccttagatacaaaggatattgagcagattgccgagtttctagagcaatccgtgaaggattcctgcgagggtttaatggtcaaaacattagacgtggatgcgacttacgaaatcgccaagaggtcccacaactggctgaagttaaaaaaagattatctggacggcgtcggcgacactctggatctcgtcgtgatcggcgcttacctcggacgcggaaaacgcgctggccgatacggcggatttctgctcgctagctacgatgaggattcagaagagctgcaggcaatttgcaaggtactcggtaactgggggtag

SEQ ID NO: 29269 - DNA, 2850 bp, Artificial Sequence
  Description of Artificial Sequence: Synthetic coding sequence
atgtcacttgcatttaagattttcttccctcagaccctgcgagcgctgtcccggaaggagctgtgtctgttccgtaaacatcactggcgggacgtaaggcagttctcacagtggtccgagacagacctgctccatgggcacccacttttcctgcgcaggaaacctgtcctatcattccaggggagccaccttcggagtcgagccacttatcttgtgttcctgccgggtcttcatgtgggattatgtagtggcccttgcgagatggcggagcagcggttctgcgtagattatgctaaacgaggcaccgccggttgcaagaaatgcaaagagaagatagtgaaaggggtctgtcgcatcggaaaagtggtcccaaacccttttagcgagtctgggggtgacatgaaggagtggtaccatataaagtgtatgtttgaaaagttagagagggctcgggctaccacaaagaagatcgaggatctgactgagctggagggctgggaggagctggaggacaacgaaaaagaacagataacacaacacatagctgacctgagcagcaaagctgccggaacccccaaaaagaaagccgtggttcaggccaagctgactacgacgggacaggtgacatcccctgtgaaaggcgctagcttcgtcacctccaccaatcctcgcaagttctcagggttctcggctaaaccaaacaacagtggtgaggctcctagcagcccgaccccaaagagaagcctcagttcctcaaaatgcgatcccaggcacaaggattgtttgctgcgggaatttcggaaactgtgcgccatggtagccgacaaccccagctacaacaccaaaacccagattatacaggattttcttcggaagggctcggccggtgatggcttccatggtgacgtgtacctgaccgtcaaactgctgctgcctggcgtgatcaaaactgtctacaatctcaacgacaaacagatcgtgaaattgttcagccgcatcttcaactgcaaccctgatgacatggccagagacctagaacagggcgacgtgagcgaaaccattcgcgtcttctttgagcaatcaaaatccttccccccagcagctaaatcgcttttaaccatacaagaagtagacgaattcctgctgagactgtctaagctgactaaggaggacgaacagcagcaggctttacaggacatcgcatcccggtgtaccgcaaatgacttaaagtgcataattcggcttattaagcacgacctgaagatgaattctggtgccaaacatgtactggacgccctcgatccgaatgcctacgaagctttcaaggcctcaagaaatctccaagatgtcgtagaaagagttttgcacaacgcacaggaagttgagaaggaacccggacaacgcagagcactgagcgtacaggcctccctcatgacgcccgtgcagccaatgttggctgaggcctgcaagagcgtcgagtacgctatgaaaaaatgccccaatggtatgtttagcgaaatcaaatacgatggagagcgcgtgcaggttcataagaacggtgatcatttttcatacttctctcgcagcttaaagcctgtcctaccccacaaggttgcccactttaaggactacatcccacaggctttccctggcggacattcaatgattttggacagcgaggtcctgttgatcgataataagaccggtaagccgctgccatttggcacgctgggcgtgcacaaaaaggcggcttttcaggacgccaatgtgtgcctgttcgtcttcgattgtatttattttaatgacgtaagccttatggatcggcctctgtgcgagcggcgtaagtttctgcatgacaatatggtggaaatacctaaccgtattatgttctcagaaatgaagcgtgtcactaaagccctggatcttgctgacatgattacgcgggttattcaggagggactggagggtctggtcctcaaggatgtgaaaggtacatatgagccgggtaagcgccactggttaaaagtgaagaaggattatttaaacgaaggcgcaatggctgacactgccgacctcgtcgttttaggggcattctacggccagggaagcaagggaggcatgatgagcatatttctgatgggctgctatgaccctggtagccaaaagtggtgtaccgttaccaaatgtgctgggggtcacgatgacgctactttggccaggctgcagaacgaattggacatggtcaagatctctaaagacccctctaaaattccctcctggcttaaagtgaacaaaatctactatccggacttcattgtgccagatcccaaaaaagctgcggtctgggagatcaccggggcagagttctccaagtctgaggcgcacaccgctgatggcattagcatccgctttcccagatgcacgcgtatcagagatgataaggactggaagtcagccactaacctaccacagctgaaagaactatatcagttgtccaaggaaaaggctgacttcaccgtcgtggccggagacgagggttccagcacaactggaggcagctctgaagagaacaaaggaccctcgggatccgccgtgagccggaaagccccttcaaagccatccgcttccacgaagaaggccgagggtaagctctctaactccaacagcaaggacggcaacatgcagacagcaaaaccatccgctatgaaggtgggggaaaaacttgccacaaagtcaagccctgtgaaggtgggagagaaacggaaagcagctgatgagactctctgccagactaagagacgaccagcctcagaacagcgaggcaggactgtgcccgcaggacggaggtag

SEQ ID NO: 29270 - DNA, 3030 bp, Artificial Sequence
  Description of Artificial Sequence: Synthetic coding sequence
atgagtcttgcctttaaaattttcttccctcagacacttagggctttgtcccgaaaggagctctgcctttttagaaagcatcattggcgggatgtgcgacagttttctcagtggtctgaaaccgaccttctccatgggcatcccctcttccttcggagaaagcccgtcctatcctttcagggctcccacctgagaagtcgggctacctatctggtctttctcccaggcctgcatgtgggactgtgctccggcccatgtgaaatggcagagcagcggttttgtgtggactatgccaagcgcggaacagctggctgcaagaaatgtaaggagaaaatagtgaagggcgtgtgccgtatcggcaaagttgtgcctaaccctttttccgaaagtggcggagatatgaaagagtggtatcacatcaaatgcatgttcgaaaagctggagagagcccgagccaccacaaaaaagatagaggatctgaccgaattagaggggtgggaggaacttgaggacaatgagaaggagcaaatcacccaacatattgccgatcttagctccaaggccgcaggcactcccaagaagaaagcagttgttcaggctaagctaaccactaccggccaggtgactagccccgtgaagggggcatccttcgtcacctccactaaccccaggaaattttctggttttagcgctaaaccaaataactccggagaggccccatcaagccctacccccaagagatctctttccagctcgaaatgcgaccctcgccacaaagattgcctgctgagagaatttcgtaaactgtgtgctatggttgccgacaatccaagctacaacactaagacccaaatcatccaggacttccttagaaagggcagcgctggggatggcttccacggggacgtctacttgacagtcaagctgttattgccgggagtgataaaaactgtctacaacctgaacgataaacagattgtaaaactgttctctcgtatattcaactgtaatccagacgacatggctagggatttggagcagggcgatgtctccgagacaattcgggtgttcttcgagcagagcaagtcattccctcccgctgctaaatcactcttaacaatccaggaagtggatgagttcctcctgcggctgagtaagttgacgaaggaagacgaacagcaacaagccctgcaggatatcgcgtctcggtgcaccgcaaacgacctgaaatgtattattcgcctgatcaagcatgaccttaagatgaattctggggcaaagcatgtattggacgctcttgatccgaatgcgtatgaggcctttaaggcatcacgcaatcttcaagatgttgtggaaagggtacttcataacgctcaggaggtcgaaaaagagccgggacagcggagagccctgtcggtgcaggccagtcttatgactcctgtgcagccaatgctcgccgaagcctgtaagagcgtggagtacgccatgaagaagtgcccaaacgggatgttctcggagatcaaatacgatggagaaagagtgcaggtgcacaagaatggcgatcatttcagctattttagtaggtcgttgaaaccagtactccctcacaaagtggcacatttcaaggactacatcccgcaagcctttcccggaggccacagtatgatcctggacagtgaagtgctgctgatcgacaataagacaggtaaaccattgccgttcggaacattaggcgtgcacaaaaaggctgcctttcaggatgctaacgtctgcctgtttgtgtttgactgtatttatttcaatgatgtcagcctgatggaccgcccattatgcgaacgtagaaaattcttgcacgacaatatggtagagatccccaaccgcatcatgttctccgaaatgaagcgggttacaaaagccttggaccttgccgacatgattacccgtgtcatccaggaaggcttggaaggcctggtgctgaaggatgtgaaagggacatatgagcccggaaagagacactggctgaaggtcaagaaggactatctgaatgagggcgctatggctgatacagctgacctggtagtgctaggggctttctatgggcagggtagtaagggcggaatgatgtcgatcttcttaatgggctgctatgacccaggcagccagaagtggtgcactgtgactaaatgcgcgggaggacacgatgatgcaactctcgcacggttacagaatgagcttgatatggtcaagatatccaaagatcctagcaaaataccttcctggcttaaggtgaataagatttactaccccgacttcattgttccagatcccaaaaaagctgcagtgtgggagattacaggcgcagagtttagtaaaagcgaggcccacaccgccgacggcatttcaataagattcccgagatgcacaaggatccgagatgacaaagactggaaatccgccaccaacctccctcagctgaaagaactttatcagctgtccaaagagaaggccgatttcacggtcgtggctggggacgagggcagtagtacaacagggggatcctctgaagagaataagggtccctctgggtccgctgtttctaggaaagctccctccaagccttcagcctccaccaaaaaggccgagggcaaactgtctaatagcaatagcaaagatgggaatatgcagactgctaagccttccgctatgaaggtgggcgagaaacttgccaccaagtcatcccccgtgaaggtcggcgagaaacgaaaagccgcagatgagacgctttgccagacaaaagtcctgctcgacatattcaccggagtgcggctctacctgcctccgtctactccggacttcagtaggcttcgtcggtacttcgtggcattcgacggagatcttgtccaagaattcgacatgacttcagctactcacgtgctgggctctcgggacaagaatcctgccgctcaacaggtcagccccgagtggatatgggcatgtattagaaaacggagactcgttgccccatgctag

SEQ ID NO: 29271 - DNA, 2736 bp, Artificial Sequence
  Description of Artificial Sequence: Synthetic coding sequence
atggcagcgagccagacgtcccaaactgtggcctcccacgtacccttcgctgatctgtgctccacgctcgaacggatacagaaatccaaaggccgtgccgagaaaatcaggcatttccgagagtttctagactcatggcgaaagttccatgatgccctgcataaaaaccacaaagacgtaactgattctttttatccagccatgagattgatcctgcctcagttggagagggaacgaatggcatacggcattaaagaaactatgctggcaaaactttatatcgagctactgaatctgcctagagacggcaaggatgcacttaaattactgaattaccgtacaccaaccgggactcacggcgatgccggagacttcgctatgattgcttactttgtgcttaaacctagatgtctgcagaagggctcgctaacgattcagcaggtcaacgacctcctggactctatcgcttccaataacagcgccaaacggaaggatttgattaagaagtcactgcttcagctcataacacaatctagcgccttagaacagaagtggctcataagaatgattatcaaagatctgaagctgggcgtgtcccagcaaacgattttctccgtgttccacaacgacgccgcagagctccataatgtcacgaccgatttagaaaaagtgtgcagacaactgcacgatccctccgttggcctctcggatatcagcatcactctgttctcagcctttaagccgatgctggctgccatcgccgacatcgaacatatcgagaaagatatgaaacatcagagcttttatatcgagactaagctggacggcgagcggatgcaaatgcacaaggacggtgacgtgtacaagtattttagtcggaacgggtataactacacagatcagttcggagcatcccccactgagggttccctgacacccttcatccataacgcttttaaggcggacatccaaatctgtatcttggacggcgagatgatggcgtacaaccctaacacacagaccttcatgcagaagggtactaaattcgatattaaacgcatggtcgaggatagcgaccttcagacctgctactgtgtgtttgacgtactgatggtgaacaacaagaagctagggcatgagaccttgcggaaacgctacgaaattctctcctctatctttactccgatccccggacgaatcgaaattgttcagaagacgcaagctcacactaagaatgaagtcattgacgccctgaacgaagctatagacaagcgggaggagggcatcatggttaagcagcctctgagtatttacaagcccgataaacgaggggagggttggctcaagattaaaccggaatacgtctcaggcctaatggacgaactcgacattttgattgtcgggggttactggggcaagggttccagaggagggatgatgagccactttctgtgcgccgtggcagaaaaacccccaccgggagaaaagccaagcgtcttccatactctgtctagggtaggttctggatgcaccatgaaggagctctacgacttaggtcttaagctcgccaagtattggaagccctttcacagaaaggcccctccctcctcaatcctgtgcggaaccgagaaacctgaagtctacatcgaaccctgtaacagtgttattgtgcagattaaagcagctgaaatcgtgccgagcgacatgtacaaaaccggttgtaccttgagattccctagaatagaaaaaatcagggatgataaagaatggcacgagtgtatgactctggacgacctcgaacagctccggggaaaggcatctggcaaactggcctccaagcacctgtacattggtggcgatgatgagccccaggagaagaaaaggaaagccgctcctaaaatgaagaaggtcattggcataatcgaacatttgaaggccccaaatctgacaaatgtcaacaaaatctcaaatatatttgaagacgtggaattctgcgtgatgagcggcacggactcccaacccaagccggacctggaaaatcgcatcgcggagtttggtggctatatcgttcaaaatcccggaccggatacatattgtgtgattgccggatccgaaaatataagagtcaagaatattatcttatcaaataagcacgacgttgttaagcccgcatggttattagaatgttttaaaacaaaatctttcgttccctggcagcctcggtttatgatccacatgtgtcctagtacaaaagagcattttgcccgtgagtacgactgttatggagatagttacttcatcgacacagacctgaaccagttgaaggaagtcttctctggaatcaaaaacagtaacgagcagactcctgaagagatggcaagcctgatcgccgacctcgaatatagatacagttgggattgtagcccgctctcaatgttcaggaggcacacagtgtacctggattcttatgccgtgatcaacgatctttctacgaagaatgaagggaccagactcgcgatcaaggccttggaactccgtttccacggagccaaggttgtcagttgtttggctgagggagtgagccacgtgattatcggcgaggaccatagccgcgtcgcagattttaaagcctttaggcgaacatttaagcgaaagtttaagatcctgaaagaatcctgggtcactgattcgatcgacaagtgtgagctgcaggaggagaaccaatatctgatttag

SEQ ID NO: 29272 - DNA, 2736 bp, Artificial Sequence
  Description of Artificial Sequence: Synthetic coding sequence
atggccgcatcccaaacttcccagaccgttgccagtcatgtaccatttgctgacctgtgctcaacactggagcggatccagaaatcgaaaggcagggcggaaaaaatccgccattttcgtgaattcttggactcctggagaaagtttcatgacgcactccacaagaaccacaaagatgtgaccgactcattttatcccgctatgcgcctaatcctcccccaactggagcgagaaagaatggcgtacggtattaaagaaaccatgctagccaagctgtacatcgagctcctgaatctgccaagggatggcaaggacgctttaaagctgctgaattacaggaccccaaccggcacccatggtgatgctggggatttcgcaatgattgcatactttgtattgaagccaagatgtctgcagaagggtagtctcaccattcaacaagttaacgacttgctggactcaattgcttctaataattccgctaagagaaaagatctgattaaaaaatcccttcttcagctgatcactcaatcctctgcgctcgaacagaagtggctgatccggatgattatcaaggaccttaaactcggagtctcacagcagactattttttcagtttttcataacgatgcggctgaactgcacaatgtgaccacagacctggagaaagtctgcagacagctgcatgacccctcagtgggactgtcagacatcagcatcactctgttctcagctttcaagcctatgcttgcagctattgctgacatcgagcacatcgaaaaagacatgaagcatcaatctttctatatcgaaaccaaacttgacggtgagaggatgcagatgcataaggacggagacgtttataagtactttagccgcaatggctacaattatactgatcagtttggagcctcacctactgagggatctttgacccctttcattcacaatgccttcaaagctgatatacagatatgtatattagatggcgagatgatggcctacaatcccaatactcagacatttatgcagaagggaactaagttcgacatcaaaagaatggtggaagactccgacctgcagacgtgctattgcgtgtttgacgtgttgatggtcaacaacaagaagttaggacacgaaacccttagaaagagatacgagatattgagtagcatttttaccccaatccccggacggatcgagattgtgcagaagacgcaggctcataccaagaatgaggtcattgacgctctgaatgaggccattgacaagagagaggaaggaatcatggtgaagcaacccttaagtatctataagccagataagcggggagaggggtggcttaaaattaagccagaatatgtaagcggcctgatggatgagctcgatattctgatagtgggcggttattggggtaaaggttctcggggagggatgatgagccattttctgtgcgcagtcgccgaaaagccaccccctggagagaagccttcggtcttccatacactgagccgcgtcggatccgggtgtactatgaaggagctctacgatctgggccttaaacttgcaaagtactggaagccttttcatcgcaaagcaccgccttcttcaattttatgtggcaccgagaaaccagaagtttatattgaaccttgcaatagcgtgatcgtgcagattaaagccgctgagatcgtgccttcggacatgtataaaaccggatgtaccctgcgttttcctcgtattgaaaagattagagacgacaaggaatggcacgaatgcatgacactggacgatttagaacaactccggggaaaggcctccggtaagctagcgagtaagcacctctatattggcggagatgatgaaccccaggaaaaaaaacggaaggccgctcccaagatgaagaaggttatcggaattatcgagcacttgaaagctcccaatctcaccaacgtaaacaagatatctaacattttcgaagatgtcgagttctgcgtgatgtccggtactgacagtcaaccaaagcccgacctggagaatagaattgccgagttcggagggtatattgttcagaaccctggacctgatacctactgtgtgattgcgggaagtgagaacatccgtgtcaaaaatataatcctctccaataagcatgacgtggtgaaaccagcctggctgcttgagtgttttaaaacaaaatcttttgtgccctggcagccgaggtttatgattcatatgtgtcccagtacaaaagagcattttgctagagaatacgactgttatggggatagctactttatcgacaccgacctgaaccaactgaaagaagtgttcagtggaattaaaaactctaacgagcaaacccccgaggagatggcctctctcattgccgacctggagtataggtattcctgggactgctccccattatccatgttccgtagacataccgtgtacctggattcatatgccgttataaacgacttgagtactaaaaatgaaggcacccggctggctatcaaggctcttgagctcagatttcacggggcaaaagtggtaagctgtttagccgaaggtgtatctcatgtcattattggcgaggatcattcacgggttgccgacttcaaagcgtttagacgaacatttaaaagaaagttcaaaatcctgaaggagtcgtgggtcactgacagtattgacaagtgcgaactgcaagaggaaaaccagtacctaatttag

SEQ ID NO: 29273 - DNA, 2736 bp, Artificial Sequence
  Description of Artificial Sequence: Synthetic coding sequence
atggcagcaagtcaaacttcacaaaccgttgcatctcacgtgcctttcgctgacctgtgtagcacccttgaacgcatccagaaatctaagggacgggctgagaaaatcagacactttcgcgagtttctggattcatggagaaagttccatgacgcccttcataagaatcataaggacgtgacggatagcttctatcccgcaatgaggctcattttgccacagctggagcgtgagcgcatggcttatggaataaaagagacgatgctggcaaagttgtatatcgagttgcttaacctaccaagagatgggaaggatgccctgaagctgctgaattacaggacgcccactggtacgcatggcgacgccggtgattttgcgatgattgcttacttcgtacttaaaccaagatgcctgcaaaaaggaagcctgactatccagcaagttaatgatctgttggactccattgctagcaataactccgccaaacgcaaagacctgatcaaaaaaagtctgcttcagctgattacacagagttcagcactggagcaaaagtggctaattagaatgataataaaagacctgaagctgggggtctcacagcagacaatctttagcgtcttccataacgacgccgcagagctccacaacgtcaccacggatctggagaaagtttgccgtcagctacatgacccttcagtcggtctatcagacattagtataaccctgttttctgcatttaagccgatgttggcggctatcgccgacatcgagcacatcgagaaggacatgaagcaccagagtttttatatcgagaccaaattagatggcgaaaggatgcagatgcataaggatggggatgtttacaagtatttttccagaaatggatacaactacacagatcagtttggcgcaagtcccaccgaaggctccctgactcctttcattcacaacgcttttaaagctgatatccagatatgtatactggatggagaaatgatggcgtacaatccgaacacccagaccttcatgcagaaaggaacgaaatttgatatcaaaagaatggtggaagatagtgacttacagacctgttactgtgtcttcgatgtgttaatggtcaataacaagaagttgggacatgagactttgcgcaagcggtatgagatcctgtcctcaatctttaccccaatccctggtaggatcgagattgtgcagaaaacccaagcccatactaagaacgaggtgattgacgcacttaatgaagcaatagacaagcgggaagagggcatcatggtgaagcagcccctctctatttataagccagacaagagaggggaaggctggctcaagatcaaacccgagtacgttagtggcctgatggatgagctcgatatacttatcgtggggggatactggggcaaggggtctcgcggaggcatgatgagccatttcctgtgcgctgtggcagagaaaccccctcccggagaaaagccctcagtgtttcacacgctttcgcgcgtaggtagcgggtgcacgatgaaggaactgtacgatctcggcctgaagttggccaagtactggaagccgttccaccggaaagctccaccatccagtatcctgtgcgggacagagaaaccggaagtgtacattgagccgtgtaatagtgtgatcgtgcagataaaggccgctgagattgttccaagcgacatgtataaaactgggtgtactctgaggtttcctcgcatcgagaaaatccgggatgacaaggagtggcacgaatgcatgacactcgatgacttggaacaactccgcggaaaggccagtggcaaactggcctccaagcacctgtatatagggggtgatgacgagccccaggaaaaaaaaaggaaagccgcacccaagatgaaaaaagtgatcggcattatcgaacacctgaaagcccctaatctgaccaacgtgaataaaatctcaaatatttttgaagatgtcgagttctgtgtgatgtccggcactgattcacagccgaaacctgatcttgaaaatcggattgccgagttcggaggctacatcgtgcagaatcccggaccagacacatactgcgtgatcgctggctctgagaacattcgagttaagaatataattctttccaataaacacgatgtagtgaaaccagcctggctcctcgaatgtttcaaaaccaaatcattcgttccttggcagccccgattcatgatccatatgtgtccgtctacaaaggagcattttgcaagggagtatgattgttacggcgactcttactttattgacacagacctgaatcagctgaaagaggttttttccgggataaaaaatagcaacgagcagacccctgaggaaatggcctccctgatcgccgatctggagtaccgctattcctgggactgcagccccttaagcatgttcagacggcacacagtatacctggactcttacgccgtgatcaacgacctctctaccaagaatgaaggaacgcgcctggcaatcaaagcacttgagctccgcttccatggagcaaaggtggtcagctgcctcgccgagggcgtgtcacatgttataatcggtgaagaccatagccgggtcgcggattttaaggctttccgacggaccttcaagagaaaatttaagatcctgaaggagagctgggtgacagactcaatagataagtgcgagctgcaagaggagaaccagtaccttatctag

SEQ ID NO: 29274 - DNA, 1944 bp, Artificial Sequence
  Description of Artificial Sequence: Synthetic coding sequence
atgaggctgacgctgctctgttgcacttggagagaggaacgtatgggggaggaaggttcggagctgcctgtgtgtgcatcctgcggacagcggatctacgacgggcagtacctccaggcactcaatgctgattggcacgcggattgcttcaggtgctgtgattgttctgcttctctctctcaccagtactacgaaaaagatgggcagctgttttgtaagaaagactactgggcgaggtatggggagtcatgtcacggttgcagtgagcagattactaaaggcctggtgatggtggcgggtgagcttaagtaccaccctgaatgtttcatctgcctgacatgcgggaccttcattggggatggggacacttacactctggtggagcactcaaaactttattgcgggcactgttattaccaaacggtggtaactccagtaatcgagcagatcctgcccgacagtccgggaagtcacctgcctcacactgtgacactggtgtccattcccgcttcgagtcacggaaagaggggactgagtgtgagcatagatcccccacatgggccacctggatgcggaaccgagcactcccacacagttagggtacagggagtcgatcccggatgcatgagcccggatgttaagaactcaattcacgtgggtgacagaatccttgagatcaacggtacccccatccgaaacgttccactggacgagatcgatctgctgattcaggaaacttctcgtctcttacagctgactctagaacatgacccacatgacacccttgggcatggcctggggcctgagacatctccgctgagttctcccgcttacacgcccagcggtgaagccggatccagcgcgaggcagaaacctgtactgcgcagctgttccattgaccgctctcctggcgcaggctccctcggatcccctgctagccaacgaaaagacctgggcagatcagaaagtcttcgcgtggtatgcaggccacacaggatttttcgaccaagtgaccttatacatggggaggttctgggtaaggggtgttttggccaggcgattaaggtgacacatcgggaaaccggtgaggtgatggtcatgaaggagcttattcgcttcgatgaggaaacccagcggacgtttttgaaggaggtgaaagtgatgcggtgtctggaacacccaaacgtgctcaagttcattggcgtgctgtataaggacaagcgcttgaattttattacggagtacataaagggcggaactttgcgcggtataatcaaatctatggactcgcaatacccctggtctcaacgggttagcttcgctaaggatattgccagcggcatggcttacctacactctatgaacattattcacagggacctcaactcacacaactgtctggtgagggagaacaagaatgtggtagtggcagactttggcctagcgcgactgatggtggatgagaagacgcagcctgaagggctaaggtcattgaagaagcctgatcgcaagaaaagatacacggtggttggaaacccctattggatggcccctgagatgatcaacggcaggtcttacgacgaaaaagtcgatgtgttctctttcgggattgttctgtgcgaaataattggcagagttaatgccgacccagattatctgccgagaacaatggactttgggctgaacgtgcgcggtttcttggaccgatactgcccacctaactgtcctccgtccttcttccccataaccgtcaggtgctgtgacctggaccccgagaagaggccctcttttgtgaaactggaacactggctggagactttgcgcatgcacctcgccggtcacctcccgctggggcctcagttggagcaactcgacagggggttttgggagacctacagacgcggagaaagcgggcttcccgcacatcctgaagtgcctgactag

SEQ ID NO: 29275 - DNA, 1944 bp, Artificial Sequence
  Description of Artificial Sequence: Synthetic coding sequence
atgcgcctaaccctcctgtgctgcacatggagggaggaaaggatgggagaagagggtagtgaactgcccgtgtgcgccagttgcgggcagcgcatttatgatgggcagtatctgcaggccctgaatgcagactggcacgccgactgttttaggtgttgtgattgctctgctagcctctcccaccagtactatgagaaagatgggcagctcttctgtaaaaaggactactgggccagatacggcgagtcgtgccacggatgttctgagcaaattacaaagggcctggtaatggttgctggcgaactcaaatatcaccctgagtgttttatctgtctgacatgcgggacttttatcggcgacggggacacctataccctggtggagcattctaagctgtattgtggccattgttactaccagacggtggtgaccccggtgattgagcaaatactccctgactctcccggatctcatttgccacataccgtcacactggtttccattccagctagtagtcacggtaagcgaggcctgtccgtgtcaatcgatccaccacacggacctccagggtgcggcaccgagcattctcacaccgtccgagtgcagggggtggaccctggatgtatgtctcccgatgtgaaaaatagcatccatgtcggggaccggattctagaaatcaacggtactcctattaggaacgtccctctcgatgaaatcgatctgctcatacaggaaactagccgccttctgcagctcacattagagcatgatcctcacgacaccctcggacacggactgggcccagagacctctcctctatccagtcccgcatacacaccctcaggtgaggcaggtagcagcgcccgacagaagccggtgcttaggtcttgttcgatcgaccggtctcccggagcgggttcactgggttctcctgcttcccagaggaaggatctcggtcgcagcgaaagtttacgggtggtctgtcggccacaccgtatatttcggcctagcgacctgatccacggcgaagtacttggcaagggttgttttggccaggctattaaagttacacatcgggaaaccggtgaagttatggtcatgaaagagttaatcaggtttgacgaagagacacagcgaacgtttcttaaggaagtcaaggtgatgaggtgcctcgagcatccaaatgtgctcaagttcatcggcgtgctgtacaaagataagagactgaatttcataaccgagtatataaaaggcggtacattgagagggattattaagtcaatggattcccagtacccatggtctcagcgagtcagcttcgctaaggacatcgcctctggaatggcttatctgcattcgatgaacattattcacagggatctcaatagccataactgcctggtaagggagaacaagaacgtggtcgtagccgactttggtctggcgcgactgatggtagacgaaaagacacagcctgaaggactgaggtctctgaagaagccggacagaaagaaaagatatacagtggttggcaatccctactggatggcaccagaaatgatcaatggcaggtcctatgacgaaaaagtggacgtgttctccttcgggattgttctctgtgagatcattggacgcgtgaatgctgatccagattatctgccgaggacaatggacttcggccttaacgtgcgcggattccttgatagatattgtccacccaactgcccaccctccttctttcctattacagtaaggtgttgcgatctggatcctgagaaacgacctagcttcgtcaagctggagcactggctcgaaactcttaggatgcacttggccggtcaccttccgttgggccctcaacttgaacagttggatcggggtttttgggagacttatcggagaggggagtcgggactgccagcccaccccgaggtgccagactag

SEQ ID NO: 29276 - DNA, 1842 bp, Artificial Sequence
  Description of Artificial Sequence: Synthetic coding sequence
atgctgctggcttcggcccctaggagacgccgtttcttgcagagagccaagtgttgtgattgttcggcttccttgtctcaccagtactatgaaaaagacggccagctcttctgtaagaaagactactgggcgcgatatggggagtcctgccatggctgctccgagcaaataacgaaaggtttagtgatggtggccggagaattaaagtatcaccccgaatgtttcatatgcctcacttgtggcacatttatcggtgatggggacacttataccctagtggagcacagtaagctttattgtggccactgctactaccagacagtcgtcactcccgtaatcgagcagatcctgccagactcgccaggttcccaccttccccataccgtgactctagtgtccatcccggcttcatcacacggtaaaaggggacttagtgtgtccatcgatcctccacacggccctcctgggtgtgggaccgagcactcccatacggtgcgggtgcagggtgtagaccccggatgtatgtcacccgatgtgaaaaattccatacacgtgggagaccgcatactggagatcaatgggaccccaatcagaaacgtgcctctggacgaaatcgatcttctgatacaagaaacctctagattactgcaactgacactggagcacgaccctcatgatactttggggcatggccttggcccagaaacaagcccattgtcctctccagcttacacgccatctggcgaagcaggttcctccgccagacaaaagcccgtgctgcgctcctgttcaatcgaccgcagtccgggtgctggatctctcgggtccccagcgagccagcgtaaggaccttggaagatccgagtcactgagggtcgtttgcagacctcaccgaatcttccgccctagtgatttaatccatggagaggtgctgggcaagggctgtttcggacaggctatcaaagttactcaccgagagacgggagaggtgatggtgatgaaagagctgatacgcttcgacgaagaaacacagcgcactttcctgaaggaggtgaaggtgatgaggtgtctcgagcaccctaatgtcctgaagttcatcggtgtgctgtataaggacaaacgcctgaacttcataaccgaatatataaaagggggtaccctccgcggaatcataaagagtatggatagtcagtatccttggagccaacgggtctctttcgcgaaggacattgcatccggaatggcttatctgcatagcatgaacataattcaccgcgacctgaatagtcacaattgcttggtacgcgaaaacaaaaatgttgtagtggcagatttcggtctcgcgagactgatggtcgatgagaagactcagcctgagggtctgcggagcctgaagaagcctgacagaaaaaagcggtacacagtggtgggcaatccctattggatggccccagagatgatcaacggccgtagctacgatgagaaagtggacgtcttctcttttggaattgtgctgtgcgagatcattggtcgcgttaacgctgaccctgattacctgcccagaactatggacttcggactgaacgtacggggatttctggatcggtattgccccccaaattgccccccttccttcttcccaattaccgtccgctgttgcgacctggaccccgagaaaagaccatcttttgtcaagctcgagcactggctggagaccctcaggatgcacctggctggccatctgccattgggccctcagttggagcaacttgaccgaggcttttgggagacttatcgtcgtggagaaagcggcctccctgcccatcccgaggtgcctgattag

SEQ ID NO: 29277 - DNA, 471 bp, Artificial Sequence
  Description of Artificial Sequence: Synthetic coding sequence
atgatggtcttggataaagaggacggggttccaatgttgtctgtgcaacccaaaggtaaacaaaaagggtgtgcgggttgtaacagaaaaatcaaagataggtatctactgaaagccttggacaaatattggcacgaagactgccttaagtgtgcgtgctgtgattgccgcctaggcgaggtcggaagtacactgtatactaaagcaaatctgatcctctgccgccgtgattacctccggctcttcggtaccacaggtaattgtgcagcatgtagcaaactcatacccgcatttgagatggttatgcgtgccagggacaacgtgtatcacctggattgcttcgcttgccagctgtgtaatcagaggttctgcgtcggcgacaagttttttcttaaaaacaacatgattctctgtcagatggattacgaagagggacagctaaacggcacctttgagtcccaggtccaatag

SEQ ID NO: 29278 - DNA, 468 bp, Artificial Sequence
  Description of Artificial Sequence: Synthetic coding sequence
atggtcctcgaccaggaagatggcgttcctatgctgagcgtccagcctaagggcaaacaaaaggggtgcgcgggatgcaacaggaagattaaggatcggtaccttctgaaggctctcgataaatattggcacgaagattgtctgaagtgcgcctgttgtgattgtaggctcggagaagttggctccacactatataccaaggctaatctcatactgtgtagacgggactaccttaggctgtttgggactacagggaactgtgctgcttgcagtaagcttataccagcattcgagatggtgatgcgagccagggacaacgtctatcatctggactgtttcgcctgccagttgtgtaatcaacgattctgtgtcggcgacaaattttttttgaagaacaatatgatactgtgccagatggactatgaagaaggccagctgaatggcactttcgagtcccaggtgcagtag

SEQ ID NO: 29279 - DNA, 684 bp, Artificial Sequence
  Description of Artificial Sequence: Synthetic coding sequence
atggagggcagtgcagttacagtattagaacggggtggggcatcctcccccgctgaacgaagatccaagcgtcgtcgtagatccggaggcgatggcggaggaggcggaggtgctagagccccagagggtgttcgagcaccggctgcagggcaaccaagggccactaagggtgcacctccgcctccaggaacgcctcccccttcaccaatgtcaagtgccattgaaagaaagagcttggaccctagcgaggagccagtggatgaggtgctgcaaattccaccaagccttttaacctgtggcggatgtcagcagaacattggcgataggtactttttaaaagccattgatcagtattggcatgaggattgtctatcttgtgacttgtgcggatgtagactgggtgaggtcggaagacgactgtactacaaactcggacgtaagctgtgtcgcagagactatctacgcctatttgggcaggacggcctctgtgctagctgcgataagcggattcgagcctatgagatgactatgcgcgtcaaggataaagtgtaccacctcgagtgcttcaagtgtgctgcgtgccagaaacacttctgtgttggagaccgatacctgcttattaactccgatattgtgtgtgagcaggatatctacgaatggactaaaatcaatggcatgatctag

SEQ ID NO: 29280 - DNA, 477 bp, Artificial Sequence
  Description of Artificial Sequence: Synthetic coding sequence
atgtcaagcgcaatcgagcggaagtctctcgacccttctgaggaaccggtggacgaagtcctgcagatcccaccaagcttgctgacatgcggcggatgtcagcaaaatatcggagacagatattttcttaaggccatagatcagtactggcatgaggactgcctgtcttgtgacttatgcggatgccgactgggggaggtcggccgacggttgtattacaagttgggtcgcaagttatgccgaagggattatctaagattgtttgggcaagatgggctgtgcgctagttgtgacaagcggattagagcatatgagatgaccatgcgcgtgaaggataaagtgtaccatctcgaatgttttaagtgtgccgcttgccagaaacatttttgtgttggcgaccggtatttgctgatcaattctgacattgtgtgtgaacaggatatttacgagtggaccaagatcaatggtatgatctag

SEQ ID NO: 29281 - DNA, 1677 bp, Artificial Sequence
  Description of Artificial Sequence: Synthetic coding sequence
atgcacaggggcggtcagccactaaaaaaaagaagggggagcttcaaaatggccgagctggaccaactgcccgacgagtcatcaagcgccaaggcactagtgtctttgaaggagggctccttatctaacacttggaatgagaaatactcttcccttcagaagactcctgtgtggaaaggtagaaatacgtcaagcgctgtcgaaatgcccttcaggaactcaaagcggtccaggttgtttagcgatgaggatgacagacagatcaacacaaggagcccaaaacggaaccagcgtgtagccatggtccctcagaaatttaccgccacaatgtccacccccgacaagaaggcatctcagaagatcggatttagattgcgcaacctgcttaagctaccaaaggcacataaatggtgcatatatgagtggttctattccaacattgacaaaccactgtttgagggcgacaacgatttttgcgtgtgcctaaaagagtccttccctaacctgaagacacggaaacttaccagagtagaatggggaaagatccggcgtttaatgggaaagcctcgccgatgtagtagcgctttcttcgaggaggagaggtcggcgctgaagcaaaaacgccagaagatcaggctattgcagcagcgcaaggtggccgacgtctctcagtttaaggaccttccagacgagatcccattgcctctggtgattggtacaaaagttacagcgagattgcgcggtgtacacgatgggttgtttactggacagatagacgcagtcgacaccctaaacgcgacctaccgcgtaacgttcgacagaaccgggctaggtacacacaccatccctgactacgaagtgctgagcaatgagccccacgagacaatgccgatcgcggcttttggtcagaaacagaggccctctcggttcttcatgacccctcctcgcctacactatacaccaccactccagtcccctattatcgacaacgatccgcttttgggccagtctccttggcgctccaagatctcaggtagcgatacagaaaccctcggcggatttcctgttgaatttctcatccaagtgaccagactgtccaagatccttatgattaagaaggaacatatcaagaagctgcgggaaatgaacaccgaggctgagaaactaaaatcatacagtatgccgatctcaattgagttccagcgccgttatgcaaccatcgtgcttgaactggagcagctgaacaaagacctcaataaggtgctgcacaaggttcagcagtattgctatgagttggctccggaccagggattacagcctgcagaccaaccgaccgatatgcgtcgtcggtgtgaggaggaagcacaggagatcgtgcgacatgccaactcaagcacaggtcaaccatgcgtcgaaaacgaaaatttaactgatctgatctcaagactaactgccattctcctccaaatcaagtgtctagccgaaggtggagacctcaactctttcgaatttaaatctttaaccgacagcctaaatgatattaagtccacaatcgacgcatctaacatttcctgcttccagaataatgtggagatccacgtcgcccatatccagagcggcttgtcccagatgggaaatctacatgccttcgctgctaataacaccaatagagactag

SEQ ID NO: 29282 - DNA, 1524 bp, Artificial Sequence
  Description of Artificial Sequence: Synthetic coding sequence
atggctgaactcgatcaacttcccgacgagtccagctcagccaaggcgttggtgtctcttaaggagggaagcctgtctaacacctggaacgagaagtatagctcactgcagaaaacgccggtgtggaaagggaggaatactagttccgccgtggagatgaaattcaccgccaccatgtccactcccgataagaaggcttcacagaaaattggatttaggttgaggaatctcctgaagcttcccaaggctcacaagtggtgcatttatgagtggttttactctaatatcgacaagcctctcttcgagggagataacgacttctgtgtgtgtctgaaggagtcattccctaacctgaaaaccaggaagttaactcgcgtggagtggggcaaaatcagaaggctgatggggaagccacggcgatgtagcagcgctttcttcgaggaggagcgcagcgcactgaaacagaagaggcagaagatccggctgttacaacagcgtaaagtagcggacgttagccagtttaaagacttgccggacgagattcccctgcctctggtcatcggcaccaaagtaaccgctcgtcttagaggggtgcacgatgggctgtttaccggacagattgatgcggtggatacgctcaatgcaacttacagggtgaccttcgaccggacaggtctcggaactcatacaattccagactacgaggtgttatcaaacgagccacacgagacaatgcccattgctgccttcgggcagaaacagagacccagcaggtttttcatgacaccacccagattacactacactccacccttacagagccctattattgataatgatcctttgttggggcagtcgccttggagatccaagatttccggtagcgatacagagaccctgggaggattccccgtggagtttctgattcaggtgactcgcctcagcaaaattctaatgattaaaaaagagcacatcaagaaactcagggagatgaacactgaagccgaaaagctgaagagctactctatgccgatttcaattgaattccagcgcagatacgctactattgtgctcgagctcgaacaactcaataaagacttgaacaaggtcttacataaagttcaacagtactgttacgagttggcgcctgatcagggactccagcccgcagaccagcccacagatatgaggcggcgatgcgaggaggaggcgcaggagatcgtgagacatgccaatagcagcactggacaaccgtgtgtagaaaatgaaaacctaacagatctgatcagtaggttgaccgcaatcctgctgcagatcaaatgtctcgccgagggcggtgatctcaacagtttcgaattcaagagcctcacagacagtcttaatgatattaaaagtaccatcgatgcgtccaacatttcttgcttccagaataatgttgaaatccatgtagcacacattcagagcggcctgagccaaatgggaaatcttcacgcttttgcagctaacaacactaacagggattag

SEQ ID NO: 29283 - DNA, 1572 bp, Artificial Sequence
  Description of Artificial Sequence: Synthetic coding sequence
atgcggcctaggaccgagggattcttccctcccgcaggggctagcctacccttttccactcgcaataagcagcccgcagtgccagccgctgccgctcgtgccgctgagcacgcccctggcgctggtcctgggagggacagtggcgcagggactgctccccctgcgctcaggagacgggcatcgccctgcggcttgcttcccccattcctgcctcccggtagcgctggcggaggcggagggggagcaaggcgtggaccacccagcgcagctcctcccccaagagcgggtgcagggggtgcaggcccagcctccgcgtccaggggcggatcatccgccgctcgtcgaagagggcaacgtgctccccactcaaatctgcccaggaaggactctctccggcctacaatgcaccgtgggggacagcccctgaaaaaacggagggggtcttttaaaatggctgagttagaccaacttccggatgaatcatcgtcggccaaagcgttggtgtcactgaaagaaggtagcttgagcaacacttggaacgaaaaatacagcagccttcagaaaactcctgtgtggaaaggacggaataccagttccgccgtggagatgccttttcggaatagtaagaggtccaggttgttctccgacgaggacgatcgacagattaatacacggtcacccaaaaggaatcaaagagttgctatggtaccgcagaagttcacagccaccatgtcaaccccggacaagaaagcctcccagaaaatcggttttaggcttcggaaccttttgaaactgccaaaagcccacaagtggtgtatttatgagtggttctactccaacattgataaacctctgtttgaaggtgacaatgacttctgtgtttgcctaaaggagtcattccctaatctcaagacgcggaaattgaccagggttgagtggggaaagatacgaaggctgatgggtaaacctcggcgatgttcttcagccttctttgaggaagagcgctccgcgctgaaacagaaacgacaaaaaatccgcctcctgcagcagcggaaggtcgcagacgtgagccagttcaaagacctgcctgacgaaattccgctgccattggttatcggaacaaaagtcaccgcccgactgcgaggagtgcatgacggcctgtttactggtcaaattgacgcagtagacactctaaacgctacgtaccgagtgacctttgaccggactggcttgggcacacatacgattcctgattatgaggttttgtccaatgaaccgcatgagacgatgccaatagccgctttcggacagaagcaaagaccgtcaagatttttcatgaccccaccgcgactccattatacccctccccttcagagccctataatagacaatgatccactgctgggacaaagtccatggcgaagtaagatcagtggtagcgacacagaaacactcggagggtttcctgtggaattcctgattcaggtgaccagactttctaaaatcctgatgataaaagggacctaccaggaaatcaaggggaatgagcaccgttctaggaaaattggctag

SEQ ID NO: 29284 - DNA, 1842 bp, Artificial Sequence
  Description of Artificial Sequence: Synthetic coding sequence
gaaaccgccgaacagaatagctccctcgcagtgggcctcaacgatcagttacatgacctgagcagaagcaggagtcccgctgcccgttcctctgccagcaatatccgagagcggagggctcgcatcgctagaggacggtgggaccgtgtgcctgatgtcgcaacaagaagaggcctgctgcggccagcggtgagtgggaaggtccgcggacgccgtagaccctccaatgtcggcttcggtaattgttcctccgctaaagccttagtttcattgaaggaaggctctctcagcaacacttggaacgagaagtattcttccctgcagaaaactccagtgtggaaaggaaggaacacatcttcagcagtggagatgccgtttcggaattctaaacggagcaggctttttagtgacgaggatgacagacagatcaacacaaggtctcccaaacgcaaccagcgtgtggcgatggtgccgcaaaagttcaccgcgactatgtccacgccggacaaaaaagcctcgcaaaagattggctttcgcctgcgtaatcttctcaaactcccaaaagcgcacaagtggtgcatttacgaatggttttattctaatatagacaagcccctcttcgagggtgataacgatttttgcgtgtgcttaaaggagtcatttcccaacctcaagacacgtaaactgacacgcgtcgaatggggtaaaatccgtcgcttgatgggcaagccccgtcggtgcagcagcgcttttttcgaagaagagcgctcagcccttaagcaaaagaggcagaagatccgccttctgcagcagcgcaaggtagccgacgtttcccagttcaaggatttgccagacgagataccgctaccactcgtgatcggcaccaaggtaacagcgcgtttacgcggtgtgcacgatgggctgtttacagggcagatcgatgccgtggataccttaaacgccacatacagagttacatttgataggaccgggctgggaacacacactatccctgattatgaagtgttgagtaatgagccacatgagactatgcctatcgctgccttcggtcaaaaacaaaggccttcccggttttttatgacccctccgagactgcactatactcccccattgcaatcacccattatcgataatgacccactgttgggccagtcgccttggaggtctaagattagtgggagcgataccgagacgctcgggggattcccggtagaatttttgattcaagttaccaggttgtccaagattctgatgattaaaaaagaacacattaagaagcttagagaaatgaataccgaggccgagaaactgaaatcctattctatgcctatttctatagagttccaaagacgatacgccaccatcgtcttggaactggaacagcttaataaggacttgaataaagtcctgcataaggtgcagcagtactgttacgaactggccccagatcaaggactacagcccgctgaccagcccactgatatgcgcaggagatgtgaggaggaggcccaggagattgtgcggcacgcaaattctagcacaggacagccctgcgttgagaacgaaaacctgacggacttgatctctcggctcaccgcaattctgctgcagattaaatgcctggcagaggggggtgatctgaactcttttgaattcaaaagcctcacagattcactcaacgatattaaatccactatcgacgccagtaatataagctgctttcaaaataacgtcgagatccacgtcgcacacattcagagcggtcttagccaaatgggcaacctgcacgctttcgccgcaaataacacaaaccgagattag

SEQ ID NO: 29285 - DNA, 13800 bp, Artificial Sequence
  Description of Artificial Sequence: Synthetic coding sequence
atgtcggagtttctgctggcgctcctgactctgtcgggcctgttacctattgcaagggtgctgacggtgggcgctgaccgcgatcagcagctttgcgaccccggagagttcctgtgtcatgatcacgtcacctgtgttagccagagctggttgtgcgacggagaccccgattgtcctgacgactctgacgagtccctggacacatgtccagaggaggtggagattaagtgcccgctgaaccatattgcatgccttggaaccaataagtgcgttcacctgagccagctctgcaacggggtcttggattgcccagacgggtacgacgaaggggttcattgccaagagttgttatctaactgccaacagttgaactgccagtataagtgcaccatggtgcgcaattcaacacgctgttattgcgaagacggattcgagataactgaagatggcaggagttgtaaggaccaggacgagtgtgcagtgtacggcacctgtagccagacttgccgaaatactcacggttcgtatacatgttcctgcgtagaaggatacctaatgcagcccgacaatcggtcatgcaaggccaaaattgaaccgactgaccgacccccaatcctgctgatcgcaaattttgagaccatcgaagtattctatttgaatgggagtaaaatggccacgctcagctcagtgaacgggaatgagattcatactttggacttcatctacaatgaggatatgatctgttggatagaatcccgagagtcctccaaccagctgaagtgcatccagattaccaaagccggtgggctgacagacgagtggaccatcaacatcctgcagtccttccacaacgtgcaacaaatggccattgactggttgacccggaatctctactttgtggaccatgtgggggacagaatatttgtatgtaattccaacggctcagtatgcgtgaccctcatagatctggaactgcacaatccaaaggcaattgccgtggacccaattgctggcaagctgttcttcaccgattatggcaatgtagctaaggtcgagcgctgcgacatggatgggatgaatcggactcgaatcattgacagcaaaacggaacagccagccgctctcgctctcgacctagtgaataaacttgtttattgggtggatctgtacctcgattatgtgggcgtggtggattatcaggggaagaatcgccatactgtgatccagggccgacaggtgaggcacctctacggcatcactgtctttgaagattatctgtatgctactaattctgacaactacaacatagttaggatcaatagattcaacggaacggacatacatagcttgatcaaaattgaaaatgcctggggcattcgaatttaccagaaacgaacccagccaaccgttagatctcacgcctgtgaggtcgatccctatggaatgcctgggggttgctctcatatctgccttctgtcgtcttcttacaaaacccggacatgtcggtgccggactggattcaacctgggcagcgatggcagatcatgtaagcggccaaaaaatgaacttttcctcttttacgggaaaggacgcccaggcattgtcaggggaatggacctgaatactaagatcgcagacgagtatatgatacctattgaaaatctggttaaccctcgggctttggacttccacgccgagactaattatatctatttcgccgatactactagctttctgatcggtaggcagaagatcgacgggactgaaagagagacgattttaaaagacgacttagataatgtagagggaatcgctgttgactggatcgggaataatctgtattggactaacgacggacaccggaagaccatcaatgtggccagattagaaaaagccagccaatctaggaaaacgctgctggagggagagatgagccaccccagaggcatcgtggtggaccctgttaatggttggatgtattggacagattgggaggaggacgagattgacgattccgttggcagaatagagaaagcttggatggacggctttaatcggcaaatctttgtcacttctaagatgctgtggccaaacgggctgaccttagactttcacacaaacacactatattggtgcgacgcctactacgaccacatcgagaaagtgttcctcaatggaacgcatcggaaaattgtttacagcggacgtgagctcaatcacccttttggacttagccatcatggaaattacgtcttttggaccgattatatgaatggatctatatttcagttggacctgattacttccgaggtgaccttacttagacatgaacggccaccattatttggcctgcaaatttatgacccaaggaaacagcagggagataatatgtgccgcgtgaacaacgggggttgcagtaccctttgcctcgccattcctggaggcagggtctgcgcttgtgcagacaatcaattgttagacgagaatggaacgacctgcacgttcaaccctggtgaggccctgccccatatctgcaaggccggtgagtttaggtgcaagaatcgccattgtatccaggccagatggaaatgcgatggggacgatgactgtttagacggcagtgacgaagactcagttaattgctttaatcacagctgtcccgacgatcagttcaagtgtcaaaacaacaggtgtatcccgaagcggtggctctgtgatggggcaaatgactgcggttccaatgaggacgagagcaaccaaacctgtaccgcacgcacctgccaggtcgatcagttctcctgcggaaatggccgatgtatcccccgagcatggctgtgcgacagagaggatgactgtggggatcagacagacgaaatggccagctgtgagttcccaacctgtgaacctctgactcaattcgtgtgcaagtccgggagatgtatctcttcaaagtggcactgtgacagcgacgacgattgcggggacggatccgatgaagtcggttgtgtgcacagttgcttcgataaccagtttagatgctcgtccggcagatgtatccccggacactgggcctgcgacggagacaacgattgcggcgacttcagtgatgaagcccaaattaattgtactaaagaggaaatccactctcccgctggctgtaacggtaatgagttccagtgtcaccccgacggcaattgcgtcccagatctctggcgatgcgacggagagaaagactgcgaggatggtagtgacgagaaagggtgtaatggcactatccgcctctgcgaccataagacaaaattctcttgttggagcactggcaggtgtatcaacaaagcttgggtctgtgatggcgacatcgattgtgaggatcaaagcgacgaagacgactgcgattcctttctctgtggacccccaaaacacccatgcgccaacgataccagcgtatgtcttcagcctgaaaaactctgtaatgggaagaaggattgccccgacggatctgacgaagggtacctgtgcgatgaatgttccctgaacaacggcggatgctctaatcactgtagtgtcgttcctggccgaggtatcgtttgtagctgtcccgagggtctgcagctgaacaaagacaataagacttgtgagatcgtggactattgttcgaaccacctaaagtgcagccaagtgtgcgagcagcacaaacacaccgtgaagtgctcttgttacgaagggtggaaattggatgtcgacggtgagagttgcacatcagtggaccctttcgaggccttcattatcttctctattaggcacgaaattcgcagaatcgacttacacaagcgcgattatagtctcctagtaccagggctgaggaacactatcgctcttgactttcattttaatcaatccttactttactggaccgatgtggtagaggacaggatttataggggaaaactgtctgagagtggtggcgtcagcgccattgaagtggtggtggaacacggcctagcaacgcctgaggggttgactgtggattggattgctgggaacatctactggattgacagtaatctggaccagatcgaggtggccaagctggacggctccctccggaccaccttaatcgcgggagcaatggagcaccctagggctatagcattggacccacgctatggcattcttttctggaccgactgggacgccaatttcccacgaattgagagtgctagcatgagtggggctgggagaaagacaatatacaaggacatgaaaacaggggcttggcccaatgggctgaccgtcgatcactttgaaaagcgcatcgtttggactgacgcccgatccgacgctatttacagcgccttatacgacggcactaatatgatcgaaattatccggggacacgagtacctgagccacccctttgctgtgtcactgtacggctcagaggtttactggaccgattggcgcacaaacacattaagcaaagctaacaagtggacgggacaaaatgtgagtgtaattcagaaaacctctgcccagccattcgatctacagatctaccacccctctcgccagccacaggctcctaacccgtgtgctgctaatgacggtaaggggccttgtagccatatgtgcttaatcaatcataacagatcagcggcttgcgcatgcccccacctgatgaagttgtccagtgataaaaagacctgttacgagatgaagaaattcttgctgtacgcaaggcggtctgagataaggggtgtggacattgacaacccatacttcaattttatcactgccttcactgtgcccgacattgacgacgttacggtgatagacttcgatgcatctgaggaacggctgtattggactgacatcaagacccagacaattaagagagccttcattaacggtacaggtctagagaccgtaattagccgcgacatccagtcaataaggggactggcagtggattgggtgtcgcgcaatctgtattggatcagtagtgagtttgatgagacccaaattaacgtcgccaggcttgatggctcattaaagactagtatcattcacggaattgacaaacctcagtgcctcgcagctcatccagtgagggggaagctgtactggacagatggaaacactattaacatggcgaatatggatgggagcaactctaaaatcctattccaaaaccagaaagaaccagtcggcctgtctattgactatgtcgaaaacaaactctattggatctctagtgggaatggaaccattaaccggtgtaatttggatggagggaatctggaggtcatcgaatcgatgaaagaagaactcacgaaagctacagcactgacaatcatggacaagaagctttggtgggctgaccagaatctagcgcaattgggaacatgcagcaagcgtgatggacgcaacccaacaattctgcggaataagacatctggagttgtgcatatgaaagtgtacgataaggaggctcagcaggggtccaattcctgtcaacttaacaatggaggatgttcccagctttgccttcccacttcagaaaccacccggacttgcatgtgtaccgtgggatactacctgcagaaaaataggatgtcctgccagggaattgagtccttcctgatgtattccgtacatgagggcatccggggtatacccctcgagccaagcgacaagatggacgccctcatgcccattagcggtacaagctttgcagtgggtatcgacttccacgctgaaaacgatactatctattggaccgacatgggcttcaacaaaattagtagagcaaagcgggatcagacctggaaagaagacatcatcactaacggcctcggacgggtcgaaggcatagccgtggattggatagctgggaatatctactggactgaccacgggttcaatcttatcgaggttgccaggttgaatggctcttttagatatgttataattagccagggactcgaccagcctcggtcaatagctgtgcaccctgagaaaggcttactgttctggacagaatggggtcagatgccctgcattggtaaagcgcgtttagacgggtcagagaaggttgtcctggtgtctatggggattgcgtggcctaacggcatctccatcgattacgaggagaacaagctctactggtgtgacgctcgaacagataagatcgaacggatcgatctggaaactgggggaaacagggaaatggtgctgtcaggctctaacgtcgacatgtttagcgtagcagtctttggtgcatacatatactggtcagaccgggcacacgcaaacggtagtgttcgcaggggccacaaaaatgacgctacggaaacaataactatgaggaccgggctgggcgtgaatctcaaggaagtcaaaatctttaaccgggtgcgggaaaagggaactaatgtgtgtgcgagagacaacggcggatgtaagcagttatgcctgtaccggggtaacagccgtcgtacatgcgcatgcgcacacggttatctagccgaggatggcgtaacgtgtttacgccatgagggctacctcctatattcgggacgaaccatattgaaatccatccatctgtccgacgagactaatctcaattctccaattagaccatatgagaaccctcggtatttcaaaaatgtgatagccctggcatttgattataatcaacgcagaaaaggaacaaaccggatcttttatagcgatgctcactttggcaacatacagctcattaaggacaattgggaggaccgccaagttatagtcgaaaacgtgggcagcgttgaaggccttgcctaccatcgggcatgggataccctgtactggacatcctccactactagcagtatcacccggcataccgtggaccagacccgtcccggtgcgttcgatcgcgaggccgtcatcacgatgtcagaagacgaccatcctcatgtgttggcgctagatgagtgccaaaatctgatgttttggaccaattggaacgaacagcacccgagtatcatgcgctcgaccctgaccgggaagaacgctcaggttgttgtctccaccgatattctgaccccaaatggcctgactatcgactatagagccgaaaaattgtacttttcagatgggtctcttggaaagatagagaggtgcgagtacgatggctcccaacggcacgtcattgtaaaatccgggccaggaacttttctctcactggccgtatatgacaactatattttctggtcagactggggaagaagagcaatactgagatccaataaatataccggcggtgatactaagattctaagatctgacattcctcaccaacccatgggtattattgctgtcgccaacgatactaacagttgcgagttatccccctgcgccctgctgaacggcggatgtcacgatctctgcttgctaacacctaatggaagagtgaactgctcttgcaggggagaccgaatccttctcgaggataatagatgcgtgacaaagaatagcagttgtaatgcgtactctgagtttgagtgcggtaatggggagtgtatcgactatcagctcacctgcgacgggatccctcattgtaaagataagagcgatgaaaagcttttatactgcgagaatcgctcttgtcgcaggggcttcaagccatgttacaaccggagatgcattccccacggtaagctgtgcgatggagagaacgattgtggggacaatagcgacgagctggattgtaaggtttcaacctgtgcaaccgtggaattcaggtgtgccgatgggacctgtattcctaggagtgcacgttgtaatcagaacatcgactgcgcggatgctagtgacgagaaaaattgcaataacaccgactgcacacacttttacaaactcggtgtaaaaaccaccggctttatacgatgcaatagtacaagcctgtgtgtccttccgacctggatatgcgacggttcaaatgactgtggcgattactcagatgagttaaagtgtccagtgcagaataagcacaagtgtgaagagaactacttctcttgtccatcaggacgctgcatcctcaatacttggatttgtgatgggcaaaaggattgtgaagatggacgcgacgaattccactgtgacagtagctgtagctggaatcagtttgcttgcagtgctcagaaatgcatcagtaagcactggatttgcgacggagaagacgattgcggcgatggcttagacgaatcagacagcatttgtggggctataacatgtgctgcggatatgttctcttgtcaagggtccagggcttgcgtgccgaggcactggctatgtgacggcgaacgtgactgtcccgacggctctgatgagctctccacagcaggatgcgctcctaataatacttgcgacgagaacgcgttcatgtgccacaataaggtctgcataccaaaacagtttgtgtgcgatcatgatgacgattgtggagacggctcagatgagtctccacagtgcgggtatagacagtgcggaacagaggaatttagttgtgccgacggcagatgtctgttgaacactcagtggcagtgtgatggagattttgattgtcccgaccacagcgatgaagcacctctgaatccaaagtgcaagtccgccgagcagtcctgtaactcaagtttctttatgtgtaaaaacggcagatgcattccctccggtgggctgtgcgacaataaggacgattgcggcgacgggagcgacgaacgcaattgccatattaacgagtgcctgtcaaaaaaggtcagcggctgttcccaggattgtcaggatctacccgtgtcatataaatgtaagtgctggccaggttttcagttgaaggacgatggtaagacttgcgtggatatcgacgaatgctcgtcaggatttccttgttcccaacagtgtataaacacatatgggacctataaatgcctttgcacggatggctacgaaatccagccggataaccctaacgggtgcaagtccttatccgatgaggagccttttctgatactcgcagatcatcacgaaattcggaagatatctactgatgggtccaactacaccctgctgaaacaggggctgaacaatgtcatagctatcgacttcgattaccgggaggagtttatatactggattgactcatcccgtcctaacggaagcaggattaacagaatgtgccttaacggatcggacattaaggttgtgcataacaccgcagtccccaatgctctggcagtggactggatcggcaagaatctctattggtctgacacagagaaaagaataatcgaagtatctaaactaaacggattgtatcccacgatactggtcagtaagcgcctgaaattcccacgagatttatccctggacccacaggctgggtatctgtactggatcgactgttgcgaatatccacacatcggtcgggtgggcatggatggaactaaccaatcagtcgtgattgagacgaaaatcagtcgacccatggctcttaccatagactatgtgaatagacgcctctactgggcagacgagaaccatattgagtttagcaacatggatgggtcccatcgccacaaagtgccgaatcaagatattccgggagtaattgccctcacattgtttgaggattacatatactggacggacggaaagacgaaatccctctcaagggcacacaagactagcggcgctgataggctgagcctcatctattcgtggcacgcaataacagatattcaagtgtaccattcttaccgacagcctgatgtttcaaagcacctgtgtatgattaacaatggaggatgttctcacctctgcctgctcgccccaggaaagacgcacacctgtgcttgccctaccaacttttacctggccgctgacaataggacctgtctcagcaattgtacagcgtcccagtttcgctgtaagacagacaaatgcataccattctggtggaaatgcgatactgttgatgactgtggagatgggtctgacgagcccgacgactgtcctgagttccgctgccagcccggacggttccagtgtggcacaggcctgtgtgctctcccagccttcatctgcgacggagagaatgattgcggggataactccgatgagctcaattgcgatactcacgtttgtttgtcgggacagtttaaatgtaccaagaatcagaaatgcattccagttaacctcagatgtaatggacaggatgactgtggtgatgaggaggatgagagggattgccccgaaaatagttgtagccctgactactttcagtgtaaaactacaaaacactgtatatctaaactgtgggtctgcgacgaggaccctgactgcgcagatgcctccgacgaggcaaactgtgacaagaagacatgtggtcctcatgagttccaatgtaagaacaacaattgtatccccgaccactggcgctgcgactctcagaatgactgcagcgacaactcggacgaggagaactgcaagccccagacatgtacactcaaggattttctctgtgcaaatggtgactgtgttagttcacgtttctggtgcgacggcgatttcgactgcgcagatgggtcagatgaaagaaactgcgaaactagttgcagcaaggatcagtttcggtgctcaaacggtcagtgtatcccagctaagtggaagtgcgatggacacgaggactgtaaatatggcgaggatgagaagtcctgcgagcctgccagccccacttgtagctcgagggagtatatatgcgcatccgacgggtgcatttcagccagcctgaagtgtaatggggaatatgactgcgctgatgggtccgacgaaatggactgtgtaacagaatgtaaagaagatcagtttagatgcaagaacaaagctcactgcatacctattaggtggctgtgtgacgggatccatgactgtgtggacggaagtgacgaagagaattgcgaacgtggaggcaatatttgccgtgcagatgaatttctgtgcaacaactcactgtgcaagctgcatttctgggtttgtgacggtgaggacgattgcggtgacaactccgacgaggctccagacatgtgtgttaagtttctatgtccgtccacccgcccacatcgatgccgcaacaacaggatttgtctccagtctgaacagatgtgcaacggcattgatgagtgtggcgataattctgatgaagatcactgcggtgggaaactgacgtataaggcgcgaccttgtaaaaaggatgaatttgcttgcagtaataaaaagtgtatcccaatggacttgcagtgtgaccggcttgatgattgcggcgatggctcagatgaacaggggtgtcgtattgccccaactgagtacacttgcgaggataacgtgaacccatgtggcgacgatgcatattgcaatcaaattaaaacaagcgtgttctgcagatgtaagccgggatttcaaagaaacatgaagaaccgccagtgtgaggacttaaatgaatgcctggtgttcggcacctgcagtcaccagtgcatcaacgtcgaggggtcctacaagtgcgtctgcgatcagaactttcaagagcgcaataacacgtgcatagctgagggcagtgaggatcaggtactgtatatagccaatgacacagacatcctgggtttcatttatccctttaattattctggcgaccaccagcaaatttctcacattgagcataattcaaggattactggcatggacgtttactaccagagggatatgatcatatggagtacacagtttaatccaggcggaatattctacaagcgtatacatgggagagagaagaggcaggccaactccggattgatctgccctgagttcaagcgccctcgtgacattgccgtcgactgggtggcgggaaatatatactggactgatcactctcgtatgcactggttttcatattataccacacactggacttctctgcggtattccatcaacgtggggcagctcaacggtcccaattgcactcggctgctgactaacatggcaggcgagccatacgcgatcgctgtgaatcctaagcggggaatgatgtattggaccgtggtaggcgaccactcacacatcgaggaggcagccatggatggcacactgaggcgtatactcgtacaaaagaacctgcagaggcccaccgggcttgccgtcgactacttctccgaacgcatttactgggccgatttcgagctgtcgattatcgggtcggtgctctatgacgggtcaaatagtgtggtatctgtaagttccaaacaggggttattgcatccgcatcggatagacatattcgaagactacatctacggtgccggaccaaagaatggcgtgttccgcgtgcagaaattcggccatggatcagtagagtatctggcactgaacatagacaaaaccaagggggtgctcatctcccaccggtacaagcagctggacctgcctaacccttgcctggacctcgcgtgcgaatttttgtgtttgttgaatccgtctggggctacctgcgtttgtccggagggaaagtacctgatcaacgggacttgcaatgatgactcgctgcttgacgactcctgtaaactgacatgtgagaatggaggcagatgcattttgaatgagaaaggtgacttgaggtgccactgttggccttcctactctggagagcggtgtgaggtcaatcactgcagcaattactgccagaacggagggacttgcgttccctcggttctcggaagacctacttgttcctgtgcattagggttcaccggtccaaactgtggaaaaacagtttgtgaggatttttgtcagaatggtggaacttgcattgttactgcagggaatcagccatattgccattgccagccagagtacacaggggaccgttgtcagtattacgtctgccatcactactgtgtgaattcagagtcctgcaccataggagacgatgggagtgtcgaatgtgtgtgcccgacgagatatgagggtcctaagtgcgaggtcgataaatgcgtgcgctgtcatgggggacattgtattatcaacaaggactctgaagacatcttctgtaattgcaccaacggcaagattgcgagcagctgtcaactttgcgatggctactgttataacggtggtacctgccagctggatcctgagacgaacgtgcctgtgtgcctctgcagcacaaattggtcagggactcagtgtgagcgcccagccccaaaaagctccaagagtgaccatatctccacccgcagtattgccatcatagttccgctggtgctgctggtcaccctgatcacaactcttgtaattggcctagtgttgtgtaagcggaagcgaagaacgaagacaattaggagacagccgatcatcaacggaggcattaatgtggagatcggaaatcctagctataatatgtatgaagtggatcacgaccacaatgacgggggtctgctggacccgggttttatgatcgaccccaccaaggcgagatacatcggaggagggcctagtgcctttaaactgcctcacaccgcaccccctatatacctcaactctgaccttaaaggccctctcaccgcaggtcccaccaattattcgaatccagtgtatgcgaaactctacatggacggtcagaactgtagaaatagcctcgggagtgtggatgagcgaaaggaactgctgccgaaaaaaatcgaaatcggaatacgggagacggtagcctaa

SEQ ID NO: 29286 - DNA, 2349 bp, Artificial Sequence
  Description of Artificial Sequence: Synthetic coding sequence
atgagcgagtttctgctggccctcttgaccctttcaggtttattgcctatcgctcgagtgttgacagtgggcgctgacagagaccagcagctttgcgaccccggagaatttctgtgtcatgaccatgtgacctgtgtcagccagtcctggctgtgcgacggcgatccggattgccccgatgattccgacgagtctcttgacacctcacgcacatgccaggtggaccagttctcctgtggcaacggtagatgtatcccgagagcttggctgtgcgaccgggaggacgactgtggagatcagacagacgagatggcaagttgcgagttcccaacctgcgagccgctgacccagttcgtttgcaagtcaggcagatgcatttccagcaagtggcactgtgactccgacgacgattgcggcgatggatccgacgaggtgggttgcgtgcatagttgctttgataaccagttccgttgttcaagcggtcgatgcattcccggacattgggcgtgtgatggggataacgattgtggcgatttctcagatgaggcgcagattaattgcacgaaggaagagatccacagcccagctggttgcaacggcaacgaatttcaatgccatcctgacggaaactgtgttccggatctctggaggtgcgatggagagaaagactgcgaggatggaagcgacgagaagggctgcaatggtacaattcggttgtgcgaccacaaaaccaagtttagctgctggtcaaccggaaggtgtataaataaagcctgggtgtgcgacggcgacattgactgcgaggatcaatccgacgaagatgattgtgatagcttcctgtgcgggcctcccaagcacccatgcgcaaatgatacttctgtctgcctgcagcctgaaaaactgtgcaacggcaagaaggactgcccagatgggtcagacgaagggtatctgtgcgacgagtgttccttaaacaacggcggatgctctaaccattgcagcgtagtgcctggtcgagggatcgtctgtagttgccccgaaggactgcaactgaacaaagataataaaacctgtgaaatagtagattactgcagcaatcatcttaagtgttctcaagtttgtgagcaacacaagcacaccgtgaagtgttcctgttatgaagggtggaagttagatgtggacggagagagctgtacttcagtggaccccttcgaagccttcataatctttagtattaggcacgaaatacgcaggatcgatctgcacaagcgcgactactctctcctggttcctggtttgcgaaacaccatagcactcgactttcactttaatcagagcttgctttactggaccgacgtggtggaggacaggatatatcggggaaaattaagcgaatcggggggtgtttccgcgatagaagtggtggtggagcatggactcgccacccctgaaggactgactgttgattggattgccggaaacatctactggattgattcgaatctcgaccagattgaggtggccaagttggatggctctctacgaactaccttgatagccggagctatggagcaccccagggctatcgccctggaccctagatacggaattctgttctggacggattgggatgctaattttcctaggattgaatctgcctcgatgtcaggagccggacgtaaaactatatacaaggacatgaaaacgggcgcatggccaaatggtctgactgtggaccatttcgagaaacggattgtctggactgatgctcggtcagacgccatttatagcgctctgtacgatggaactaatatgatcgaaattataaggggccatgagtatctgtcccacccatttgccgtgtcactctatggctcggaggtgtattggacagattggcggaccaatacactgtctaaagccaataaatggactggacagaacgtgtctgtgatacagaagaccagtgcacagcctttcgatctccagatatatcacccatctaggcagccccaggcccctaatccttgtgcagctaatgacggaaagggaccctgtagccacatgtgcctgattaatcataataggagtgccgcttgtgcctgtccccacctgatgaaactgagtagcgacaaaaagacatgctatgagatgaaaaaatttctcctctacgctagacggagtgagatacggggtgttgacatcgataacccgtatttcaatttcattaccgcatttactgtacccgacatcgacgatgttacagtgattgatttcgatgcctccgaggaaaggttatattggaccgatattaagacgcagacgatcaagcgggcatttatcaacgggtag

SEQ ID NO: 29287 - DNA, 13614 bp, Artificial Sequence
  Description of Artificial Sequence: Synthetic coding sequence
tttttacatagcggccctgaagaggtggagattaagtgccccctgaaccacatagcatgcctaggcacaaacaaatgcgttcacttaagtcagctctgtaacggggttttggactgccccgatggctacgatgaaggggtacattgtcagggtgaaagtatatgccagcaactgaactgcacaatgtataagtataaatgcactatggtacgcaatagcaccagatgctactgcgaggacggatttgagatcaccgaagatggaaggtcttgtaaggaccaggacgaatgcgcggtctacggaacctgtagtcagacctgccggaacactcatggatcctacacatgcagctgtgttgaaggctatcttatgcaaccagataacaggagctgcaaagccaagatagaacctactgaccggcctcctatattgctcattgcaaattttgagactatcgaagtgttttacctgaacggatcaaagatggcgaccctttctagcgtgaacggtaatgagattcacacgctcgattttatttataacgaggacatgatctgctggatcgaatctagggagtcaagtaaccagctgaagtgtattcaaatcacaaaagctggaggattgacggatgaatggactatcaatatattgcagtccttccataatgtacagcagatggccatcgattggctcacccgtaacctgtactttgtggatcacgtcggtgaccggatatttgtctgcaacagtaatgggtctgtttgcgtgacgctcatagacctggaattacataatcctaaagccatcgccgttgaccccatcgctggtaaactgttctttacagattatggaaacgttgccaaagttgagagatgtgatatggacggtatgaatcgtacacggatcatcgatagcaagacagaacagcctgccgcattggccctagacttggtaaataagctggtctattgggtcgatttatacttggattacgtcggggtcgtggattaccagggcaagaataggcacaccgtcattcagggacgccaggtgagacacctgtacggcattactgtgtttgaggactacctgtacgccactaatagtgacaactataatatcgtgaggatcaatcggttcaacgggaccgacatacattccctgattaaaatcgaaaacgcgtggggcattcggatctaccagaagaggacccaacctacagttcggtctcacgcgtgtgaagtcgacccatacgggatgcccggagggtgctctcatatctgcctgctgtcaagcagctacaagacgcggacgtgcaggtgtcgaactggattcaatctcggttccgacggacgttcttgtaagaggccgaaaaatgagctcttcctattttacggtaagggccgacccggtatagtgcgcggaatggacctgaacacgaagatagcagacgagtatatgattcccattgagaacctcgtgaatcccagagctctagatttccacgcagagaccaattacatttactttgctgataccacttcctttcttattggcaggcagaagattgacggcacagagagagagactattttgaaggatgacctggacaacgtcgaaggaatcgctgtggattggatcgggaataatctttactggaccaacgacggacacaggaaaacaattaacgttgcaaggttagaaaaggcgtcgcagtctagaaaaaccctgctggaaggcgaaatgtcacaccccaggggaatcgtggtggatccagtcaacggatggatgtactggactgactgggaagaggatgaaatcgatgattctgtcgggaggattgaaaaagcttggatggacggatttaaccgccagatctttgtcacttcaaagatgctctggccaaatggtttaactctcgatttccatactaacaccttgtactggtgcgacgcttattatgatcatattgagaaagtattcctgaatggtacccatcggaagatcgtctactctggccgtgaattgaatcaccccttcggactgagccaccacgggaactatgtcttttggacagactatatgaacggcagtattttccagttggacctgattacatccgaagtgacactcctgagacatgaaaggcccccacttttcggcctgcagatctacgacccaagaaagcaacagggggacaatatgtgtagggtgaacaacggagggtgtagcactctctgcctggctatcccaggaggtagagtatgtgcctgtgctgacaaccagctgctggatgaaaacggtacgacctgtacattcaatcccggtgaagccctgcctcacatttgcaaagctggtgaattcagatgcaaaaacaggcactgcatccaggccagatggaaatgtgacggagacgacgattgtctagatggaagtgacgaagatagcgtgaactgttttaatcacagttgtccagatgatcaattcaagtgtcaaaataatcgctgtattcctaagagatggctctgtgatggggctaacgactgcggttccaacgaggacgagtctaaccaaacctgcactgcacgcacatgtcaggtcgatcagttttcatgtggaaatggacgttgcatcccccgagcgtggctctgcgatcgcgaagatgactgcggggatcagacagatgaaatggccagctgtgaatttccgacatgcgagccactgactcagtttgtgtgcaagtctgggaggtgcatatcaagtaaatggcattgcgactctgacgacgactgtggagacggtagcgatgaggtaggatgtgtgcatagctgtttcgataaccagtttagatgtagcagcggacgatgtatacctggccactgggcatgtgatggagataacgattgtggcgatttcagcgatgaagcgcagattaattgtacaaaggaggagatacatagcccagccggatgtaacggtaacgaattccagtgccaccccgatgggaactgcgtcccagacctttggcggtgtgacggggaaaaggactgtgaggacggttctgacgagaaaggctgtaacggtaccatccgcctgtgtgaccataagaccaagtttagctgctggagcacggggaggtgcattaacaaggcttgggtgtgtgatggggacatagattgcgaggaccaatccgacgaagatgattgcgactcctttttgtgcgggccaccaaagcacccatgcgctaacgatacctctgtgtgcttgcagcctgaaaaactgtgtaacggaaaaaaggactgcccagatggctccgatgagggatatctgtgcgacgagtgctccttaaacaatgggggttgcagtaatcattgtagcgtggtgcctggacgcggtattgtatgctcgtgtcctgagggcctgcaattaaataaggacaataaaacctgtgagattgtcgattattgttctaaccacttgaagtgttcgcaggtctgtgagcagcacaagcacaccgtgaagtgtagctgctatgagggatggaagttggatgtcgatggagagtcttgtacttcggtcgacccttttgaggccttcattatcttctcaattcgccacgagatacggagaattgacttgcacaagcgagattattctttgctcgtacctggtttacgcaatacaattgctcttgacttccactttaaccagtcattgctctactggaccgacgtagtcgaggatcgcatttaccgcggaaagctgtccgagtccggcggtgtgagcgcgatagaggtggttgttgaacacgggctagccacgccggaaggcctgaccgtggactggattgcaggtaacatctactggatcgatagcaacctagaccagattgaggtggccaagctagatggatcattacgcaccacattgatcgctggcgcaatggaacaccctagagccatcgcactggatccacgttacggcatcctgttttggactgactgggatgcgaatttccctaggattgaatccgcctctatgtctggagccggtcggaaaacaatatataaggatatgaaaactggcgcatggccaaacggcctgaccgtcgaccattttgagaagagaatcgtgtggacagatgcgaggtcagacgcaatctattccgctctgtacgatggtaccaacatgatcgaaatcatacgagggcacgagtaccttagtcatcctttcgccgtgtcactgtatggtagtgaggtgtattggacagattggagaacaaacactttatccaaggcaaataaatggacagggcagaatgtttcagtgatccagaaaactagtgctcaaccatttgacctgcagatttatcatccttcaaggcagcctcaggcacccaatccttgcgcagctaatgacggaaaaggcccatgctcccatatgtgcctgatcaatcacaacagatctgccgcatgcgcttgtcctcatctaatgaagctgtcttcggacaaaaagacctgttatgaaatgaaaaagttcctcctctacgcccgtaggtcagagatccgcggtgttgatattgacaacccctactttaattttatcaccgcatttacggtaccagacattgatgatgtgacagttatcgacttcgacgcctccgaagaacggctgtattggacggacattaaaacgcagacaatcaagcgagcatttatcaacggcactggattggagaccgttattagcagggacattcagtccataagaggcctggctgttgattgggtgtcccgcaacctgtactggatttcaagcgagtttgatgagactcagataaacgtcgccagactggacggctctctgaaaacgtctatcattcatggaatcgacaagcctcagtgcctggccgctcaccccgtgagaggaaaactgtattggaccgacggcaacaccatcaacatggctaatatggatggatctaactcaaagatcctgtttcagaaccagaaagaaccagtgggtttgtcgattgactatgttgagaataaactgtactggatctcttctggcaatggaacgattaatcgctgtaacttagatggcggtaatctggaggtgattgagtccatgaaggaggagctgacaaaagctaccgctttgaccattatggataagaagctgtggtgggccgatcaaaacttggcgcagttggggacatgctcgaagcgggatgggaggaaccctaccattctgaggaataaaacaagcggcgtggtgcatatgaaggtgtacgacaaagaggctcagcagggaagtaactcttgccagcttaacaatggagggtgcagccagctttgcctgcctaccagcgagaccacgagaacttgtatgtgcaccgttggatactacctgcagaagaatcgtatgagctgccagggtatcgagtcgttcctgatgtacagcgtacatgaaggcatccggggtatcccactagaacctagtgataaaatggatgccctgatgcccattagcggaacctccttcgccgtcgggattgacttccacgccgagaacgataccatctactggacagatatggggtttaacaagatctctcgcgctaagcgggaccagacctggaaggaggatatcattacaaacggactgggccgagtggagggtatagccgtcgactggatagctggaaacatctactggactgaccatggattcaacttgatagaggtggccaggctcaacggttccttcagatatgtcatcatcagtcaaggactggatcagcctcggagtattgccgtccacccagaaaagggcctgctcttctggacagaatggggccaaatgccttgcataggcaaagctagactggacggaagcgagaaggtcgtgttggtatcgatggggatcgcgtggcccaatggcatatcaatagactacgaagaaaataaactctactggtgtgacgcgaggacagataagattgaacggatcgatttggaaacaggcggaaacagggaaatggtgctgtcaggttcaaacgtggatatgtttagtgtggccgtgtttggcgcatatatctattggagcgaccgggcacacgctaatgggtccgtacggcgaggacacaagaacgatgccaccgaaactatcacgatgaggactggtctgggggttaatctaaaggaggtgaaaatcttcaacagagtaagggagaaaggcactaatgtatgtgccagagataatggcggatgcaagcaactgtgcctgtaccgtggcaactcccgacggacctgcgcttgcgctcatggttatctcgctgaagacggggtgacctgcttgcgccacgaaggttacctgctgtattccggtcgaactattctgaaaagcattcacttaagtgatgagaccaatctgaactcacctataaggccttatgagaacccacgctactttaaaaacgtgatcgccctcgctttcgactacaaccagcggcgtaaaggcactaacaggattttttacagcgacgctcattttggcaatatccagttaatcaaagacaactgggaggatcggcaggtgatagtggagaacgtgggcagcgtcgaggggctcgcttatcatcgcgcttgggacaccctttactggactagctcaaccaccagcagtattacccgtcacaccgtggaccagaccagaccaggggcttttgaccgggaagctgtgattaccatgtccgaagacgaccacccacacgtgctagctttggatgagtgccagaacttgatgttctggactaactggaacgagcagcatccatccatcatgcgctcaacactgactggcaaaaatgcacaggtcgtcgtgtctacagacattctgaccccgaatggactgaccattgactatcgggctgaaaaactttatttttctgatggatcattgggcaagattgagagatgtgaatatgatggcagccagcggcacgtgattgtgaaaagtggccctggtactttcctgtcactcgctgtctatgacaactacattttctggtcagactggggcaggagggctattctacggagtaataagtataccggcggagatacaaaaatcttgcggtcagacatcccccaccagccgatggggattatcgccgtagcgaatgataccaactcctgcgaactgtcaccgtgcgcgctcttgaatgggggatgtcacgatctgtgcttgctcactccaaacggaagagtcaactgcagctgtaggggggaccgcattctgctggaggataatagatgtgtcacgaagaactcttcttgtaacgcgtacagtgagttcgagtgcgggaacggtgagtgtatcgactaccaattgacatgcgatggaatcccccattgtaaagacaaaagcgacgagaaattgctctattgtgagaaccgatcctgtcggagaggcttcaaaccctgttacaatcggagatgcataccgcacggaaaactgtgcgatggagagaatgattgtggagacaattcagacgagctcgattgtaaggtcagcacctgcgccaccgtggagttccgctgtgcggacggcacctgtatccccagaagtgccagatgtaaccagaacattgattgtgccgacgcttctgacgagaaaaactgcaacaatactgattgcacacacttctacaagttgggcgtgaagaccaccggcttcatcaggtgtaattccacatccctgtgcgtgttgcctacctggatttgcgacggaagcaacgactgcggtgattattccgatgaactcaaatgtcccgttcagaataagcacaagtgcgaagaaaattacttctcttgcccgagcggaagatgcatcttaaacacatggatttgcgatgggcagaaagactgcgaggacggaagagatgaatttcattgcgacagcagttgcagctggaatcaattcgcatgctcagctcagaaatgcatctctaagcactggatctgtgacggcgaagatgattgcggtgatggtctcgacgagtccgattctatttgcggcgcaatcacatgcgccgctgatatgttctcttgccagggatcacgggcttgcgtgccgaggcattggctgtgcgacggagaacgtgattgtccagatgggagcgatgaactgagcacagcaggttgcgcgcctaataatacctgtgatgaaaacgctttcatgtgtcacaacaaagtgtgtatccccaaacagtttgtatgcgatcacgatgacgactgtggcgatggatccgacgaaagtccgcaatgcggctacaggcagtgcgggaccgaagagttttcttgcgcagatggtagatgcctgctgaacactcagtggcagtgcgatggcgacttcgattgtcccgaccactccgacgaagcccctcttaatcccaaatgtaagagcgctgagcagagctgtaactcaagtttctttatgtgcaagaacggacgctgcatccccagcggtggtctatgcgataataaagatgactgcggggacggaagtgatgagcgcaattgccatattaatgaatgtctttccaaaaaggtgagcgggtgctctcaggattgtcaggatcttcccgtctcttacaaatgcaaatgttggccaggattccaactgaaagacgatgggaagacgtgtgtggatatcgacgagtgctccagtggttttccctgcagtcagcagtgcattaacacttatgggacgtacaagtgcctttgcaccgatggctacgaaatacagcccgacaaccctaacggatgcaagtctctgagcgacgaggagcccttccttattctcgccgaccaccacgagatacggaaaatttccacagatggctcgaactacactcttttaaagcaaggactcaataatgtcatcgcaattgactttgattatagggaggagtttatctattggattgattcatctaggcctaatggtagccgcatcaataggatgtgcttaaacgggtccgacattaaagtggtccacaacactgccgttcccaacgctctggctgtcgattggattggcaaaaacttgtactggtccgacaccgagaagcgcatcatagaggtctctaagctcaatggcctctacccaacaattctcgtgagcaagcgcttaaaattcccacgagatctgtcactggatccccaggctggatacctgtattggatcgattgttgtgagtatccccacatcgggagagttggtatggacgggacaaaccagtcggttgtgatagaaaccaagatcagtagacccatggccttaaccatcgactatgtgaacaggaggctgtattgggccgacgagaaccatattgagttctcaaatatggacgggtcccaccgccacaaagtgcccaaccaagacataccgggtgtgatcgcattgacactgttcgaggactatatctattggactgatgggaagactaagtccctgtcacgcgctcataaaacaagtggcgcagatcggctatcgctaatctattcctggcatgccattacagatattcaagtgtaccactcctatcgccaaccagacgtgtcaaagcacctgtgtatgataaacaacggtggctgcagtcacttgtgtctgttagcacccggaaagactcacacctgcgcatgcccgacaaacttttatctggccgctgacaacagaacgtgcctatcaaattgtacagcttcacaattcaggtgtaaaaccgataagtgtatccccttttggtggaagtgcgatacagttgacgactgcggggatggttccgatgagcccgatgactgcccagaattccgttgccagccgggacgttttcaatgcggaaccggactgtgcgcactgcctgccttcatctgcgatggggagaatgactgcggcgacaacagcgacgagctcaactgcgacacccatgtgtgcctcagcggccaattcaagtgcacgaaaaatcagaaatgtatccctgttaatttgcgttgcaatgggcaggacgattgtggtgacgaggaagatgaacgggattgcccggagaactcatgtagtccagattacttccagtgtaaaacaaccaaacactgcatttccaagttgtgggtttgcgacgaagacccagattgtgctgacgcctctgacgaagccaattgtgataaaaagacttgtggtccacacgagtttcagtgcaagaacaataattgcatacccgaccactggcgttgcgactcacagaacgactgctcagacaattccgatgaggaaaattgcaaaccccagacatgtaccctgaaggacttcctgtgcgctaacggagattgcgtgtcgtcgaggttttggtgcgacggggacttcgattgcgcagacggcagcgacgagcgcaattgcgagacatcatgttctaaggaccagtttcggtgctccaatggacaatgcatacccgctaaatggaagtgtgatgggcacgaggattgtaagtatggagaagatgaaaaaagttgcgaacccgcttctcccacgtgctctagcagggaatatatctgcgcatccgatgggtgtatatcagcaagcctcaagtgcaacggcgaatatgactgcgccgatggttcagacgaaatggattgcgtgactgaatgtaaggaggatcaatttcggtgcaaaaataaggcgcattgtatccccattagatggctgtgcgacggtatccatgattgcgtcgacggatctgatgaggaaaactgcgaacggggaggtaacatatgcagggctgacgagttcctgtgcaacaactcactgtgcaaactacatttctgggtgtgcgatggagaggacgattgcggtgacaattccgacgaggcgccagatatgtgtgttaaattcttgtgtcctagcacgcggccacatcgctgtcggaacaatagaatttgtcttcagtctgagcagatgtgtaatgggattgatgaatgcggagacaatagtgacgaggatcactgtggaggtaagctgacgtataaggcacggccttgcaagaaagatgaatttgcctgttccaataaaaaatgcattcctatggaccttcagtgcgaccgattggatgattgtggagacggctcagatgagcagggctgccgcatcgcgcctactgagtatacatgcgaagataacgtgaacccctgcggagatgacgcatattgcaatcaaattaagacgtccgttttttgcagatgtaagccaggcttccagcggaacatgaagaaccggcagtgtgaggatctgaatgaatgcctcgtttttggaacgtgctcccatcagtgtattaacgtggaggggtcctacaagtgcgtctgtgaccagaatttccaagaaagaaataatacctgcatcgccgagggtagcgaggatcaagtgctgtacatcgctaacgatacagacatcctcggctttatttaccccttcaattattctggtgatcaccagcagatcagccatatcgagcacaattcaaggatcaccggcatggacgtgtattatcagagggatatgatcatctggtccacccaatttaaccccggaggcattttctacaaaagaatccacgggagggagaagcggcaagcaaattccggcttgatctgtcctgaattcaaacggcctcgcgacatagctgtcgactgggtggctgggaatatttattggaccgaccatagccggatgcactggttctcatattacaccacccactggaccagcctacggtacagcatcaatgtgggtcagctcaacggcccaaactgcacaaggcttctgacgaatatggccggagagccctacgccatcgctgtgaatcctaagaggggcatgatgtattggacagtggttggcgaccattcacacatagaagaagctgcgatggatggtaccctgagacgcatcctggtgcagaaaaatctgcagagacccacagggcttgccgtcgattacttttcagaaaggatctattgggccgactttgagctcagcattattgggagcgtactgtatgacggctctaactccgtagtcagcgtttcctcaaagcagggccttctccacccccatcgaattgatatctttgaggattatatctacggagctggacccaaaaatggggtatttcgcgtgcagaaatttgggcatgggtcggttgagtatcttgccctcaacatcgacaagactaaaggcgtgctcatctcgcacaggtacaagcaactggatctgccaaacccgtgcctggatcttgcctgcgaattcttatgcctcctcaacccttccggcgcaacttgcgtgtgtcccgagggaaagtacctgataaatggcacttgcaacgatgacagcttgcttgacgattcctgcaagctgacctgcgagaatggcggacggtgcatactgaatgaaaagggggacctgcggtgccactgctggcccagttattccggagagaggtgcgaagtcaaccattgctccaattattgccaaaacggaggaacgtgcgtgccctctgtgctcggacgccctacctgttcctgtgctctgggatttaccggccctaactgtggcaaaaccgtctgcgaggacttctgtcaaaacggcggaacctgcattgtcacagctggtaaccagccatactgccactgccagccagaatacaccggcgaccggtgtcaatactatgtgtgccatcactactgcgttaactctgaaagctgtacgatcggagacgacgggtctgtcgaatgcgtatgtcctactcgctacgaaggtccaaagtgcgaagtagataaatgcgtcagatgtcatgggggtcactgtattatcaataaggactccgaagatattttctgcaactgcaccaacgggaaaatcgcctcctcttgtcaactgtgtgatgggtattgctataacgggggaacatgccagctggaccccgagactaatgtccctgtttgcctgtgcagcacgaactggtctggcactcagtgcgaaagacccgcacctaagtcttcaaagtccgaccatatcagtacccgatcaattgccatcatcgttcctctagttcttctcgtgaccctcattaccaccctggtgattggcttagtcttgtgcaagcgaaaacgtcgcacgaagaccatacgcaggcagcctattatcaacggcggtatcaacgtagaaataggtaatccctcctacaacatgtacgaggtagatcacgatcacaacgatggaggcctgttggacccagggttcatgattgatcctacgaaggctcgatatatcgggggagggcctagtgcattcaaattaccacacacagcccctcccatttacctgaactcggatctgaaaggcccactcaccgcaggacccaccaactacagcaaccccgtgtatgccaagctgtacatggacggccagaactgccgcaactctctaggcagtgttgatgaaagaaaggaactattacctaaaaagatcgagataggtattcgcgagacagtggcctaa

SEQ ID NO: 29288 - DNA, 843 bp, Artificial Sequence
  Description of Artificial Sequence: Synthetic coding sequence
atgtgtcccccacaggcacaagcagaggttggcccaacaatgaccgaaaaagctgaaatggtttgcgccccatcccccgcacctgcaccccctcccaagcccgctagccccggacccccacaagtcgaagaggtggggcatagaggcggttcatcgccgcctcggctgccacctggtgttcccgtcatctctctcggccactcaaggccacctggagttgccatgcctacaaccgaactcgggacgctgaggccacccctcctccagttatccacattgggtaccgcccctccaactctcgcgctgcattatcaccctcacccttttttaaattcagtatatatcggccctgccggaccattttccatttttccctcaagcaggctcaaacggcgtccctcacactgcgagctggatctcgccgaaggccaccagccgcagaaggttgcacgtcgcgttttcaccaactcccgtgagcggtggcgccagcaaaatgtcaacggcgcttttgctgaattgagaaagctcttacccactcacccaccagataggaaactcagcaagaatgaagtcctccgactggccatgaagtacattggtttcctggtgaggctactgcgcgatcaggccgcagccctcgcagccggaccaaccccacccggaccacgcaaacggcctgtccatagagtccccgacgacggtgctagacgtggatcgggacgtcgtgctgaggcggctgcccgttcccagccagcccctcctgcagacccggatgggagcccgggaggtgctgcacggcctatcaaaatggaacagaccgctttgagccccgaagtcagatag

SEQ ID NO: 29289 - DNA, 1620 bp, Artificial Sequence
  Description of Artificial Sequence: Synthetic coding sequence
atgggctgcggctgcagttctcatcctgaggatgattggatggagaacattgacgtctgtgaaaactgtcactaccctatcgtccctcttgacgggaaggggacgcttctcattaggaacggatccgaggtccgcgatcccttagtaacatacgagggctcaaaccctcccgcatcccctctgcaggacaacctggttatcgctctgcactcttacgaaccttcacacgatggcgaccttgggtttgaaaaaggcgaacagttaagaatccttgagcagagcggagaatggtggaaggcccaatctctgaccactggtcaagaaggcttcattccctttaactttgtcgcaaaggccaacagtctggagccagagccatggtttttcaaaaatctgagcaggaaagacgcagagcgacagttgctcgcccctggcaacactcatggatcttttctgattcgcgagtctgagagtacagccggaagctttagtctgagcgtccgcgattttgaccaaaatcagggcgaggtcgttaagcattacaagatacgcaaccttgacaatggcggattttacatctctccccgtatcacatttccaggcttgcatgaattggtgagacattatacaaatgcttccgacggactctgcaccagactcagtcgcccatgtcagacccaaaaacctcagaaaccatggtgggaagacgaatgggaagtcccgcgtgagaccctgaagctcgtggagcggctgggcgcagggcaattcggggaagtgtggatgggatattataatgggcacaccaaggtagccgtgaagagtttaaaacaaggctcaatgagcccagacgctttcctcgctgaagccaacctgatgaagcagttgcagcatcagcgactcgtgcggctctacgctgtggtaacccaggaaccgatttacatcattacagagtatatggagaatgataccctgctggattctcagttggaggagaaaggtctgggtgccagcccgtgggggaatctggggcagcagctgcttctcctccccacagggagcctcgtggatttcctcaaaactccttctggaatcaaactgaccattaataaactgctcgacatggctgcccagatagcagagggcatggctttcatcgaggagaggaactatattcatagggacctgcgggcagccaatatcctggtttccgacactttgagctgcaaaatcgccgactttgggcttgcgagattgattgaggataatgagtatactgctcgcgaaggcgctaaattccccattaagtggactgcgcctgaggccattaattacgggacatttaccattaaaagcgatgtatggtcatttggcatcctgctgacagagattgtgacacatggaagaatcccttacccgggtatgacgaatcccgaggtgatccagaatctcgaaagggggtacaggatggtccgaccagataactgcccagaagaattgtatcagttaatgaggctgtgctggaaagagcgacctgaggataggccaacatttgactatttgcgttccgtcctggaagacttcttcaccgccacagaagggcagtaccagccgcagccatag

SEQ ID NO: 29290 - DNA, 1530 bp, Artificial Sequence
  Description of Artificial Sequence: Synthetic coding sequence
atggggtgcggatgcagctcacaccccgaagacgactggatggagaatattgacgtctgcgaaaactgtcactatcccatcgtccctctggatgggaagggcacactcttaatcagaaacgggtcagaagtccgggatcctttggtcacatacgaggggtcgaacccaccggctagtccactgcaagacaatttggtgatcgcattacatagttacgaacctagccacgacggcgacctgggctttgagaagggcgagcaattacggattctggaacaatctggcgagtggtggaaggcccagtccctcactacaggacaggaggggttcatccccttcaacttcgttgccaaggctaattcccttgaacctgaaccttggttctttaaaaatctcagcaggaaggatgctgagcggcaacttctggccccaggtaacactcacgggtcattcctgattcgcgaatccgagagcacagccggaagcttctccctgagcgtgagagatttcgaccagaaccaaggcgaggtggtcaagcactacaaaatccgaaatcttgacaatggaggattttatatttctcccaggataacctttcccggattgcatgagctggtgagacactacacgaatgcctcagacggactctgtacccggctgagtcggccttgtcagacccagaaacctcagaaaccgtggtgggaggacgagtgggaagtacccagggagaccctcaagctagtggagcgcctgggggcaggacagttcggtgaggtttggatgggctactataacgggcacactaaggtagccgtgaagtcactcaaacagggatcaatgtcccccgacgcatttctggccgaggcgaatctgatgaagcagttgcagcatcagcggctcgtacgcctgtatgcggtggttactcaggagcctatctacattattactgaatacatggagaatgggagtctcgttgacttcctgaaaactcccagtggaatcaagttgacgatcaataagctgcttgatatggcagcccagattgcagaaggcatggcttttattgaagaacggaactacattcaccgagatcttagggcggcaaatattcttgtaagtgatacattatcttgtaaaatcgctgattttggcctagctagactcatcgaggataatgaatacactgctcgcgagggggcaaagttccctatcaagtggacagcccctgaagccatcaactacgggacctttactatcaagagcgatgtctggagcttcgggatcctactgactgaaatcgtgacccatgggagaataccctaccccggaatgaccaatcctgaagtcattcagaacctggaaagaggctatcgtatggtgagaccagacaattgtccagaggagctttaccagctgatgcgcctctgttggaaagagcggccagaagatagaccgaccttcgactaccttaggtccgtgcttgaggacttcttcactgccactgaaggtcaataccagccacagccgtag

SEQ ID NO: 29291 - DNA, 1551 bp, Artificial Sequence
  Description of Artificial Sequence: Synthetic coding sequence
atggggtgtggatgttcgtcacatccagaggacgactggatggagaacatcgacgtttgtgaaaactgtcactaccccatcgtgcccctggacggcaaaggaacactactgatccgcaacggcagtgaagtgagagatcccctggttacttacgaagggtcaaatcctccggcttctccattacagggggaccccagacagcagggactgaaagacaaggcctgcggatctctggccgtggggttccacctgagtcctacatattttctgcccggactggcttttctggtgccccatcctgttacccctgggtttctgccaatccctgcgagattctcactgatgccacttgtgtttaccgacaacctagtgattgctctccattcgtatgaaccatctcatgatggggatttaggctttgagaagggggaacagctgcgcatcctggaacaatcaggagaatggtggaaagcccaaagtctcacaacaggccaagaaggatttattccttttaatttcgtcgccaaggccaacagtctagagccggaaccctggttttttaagaatctgtccagaaaagacgcggaacgccagctcctcgcgcctgggaacacccacggcagctttctgatcagagagtcagaaagcactgccggatcgttctccctgagtgtgcgcgattttgaccagaaccagggcgaggttgtcaagcactataagatcagaaatctggataatgggggattctatatcagtccacgtattacattccctggattgcatgaattggtccggcattacactaggtactacaatgggcacactaaagtagcagtgaagtcgctaaagcaggggtctatgtcccccgatgcgtttctggcggaagctaaccttatgaaacagctgcaacaccaacgtcttgtgcgcctctatgcagtggtgacacaggagccgatctacatcatcactgagtatatggaaaatggctcccttgttgatttcctaaagacgcctagtggaattaaactcaccatcaacaagctgctcgatatggccgctcaaattgcggaaggaatggcattcatcgaagagaggaattacattcaccgggacttgcgagcagccaacatactcgtgagcgatactctctcatgtaaaatcgctgattttggcctggctcggttgatcgaggacaacgaatacacagcaagggagggcgcaaagtttccaattaaatggaccgcacctgaagcgatcaactacgggaccttcactattaaaagcgatgtgtggtcgttcgggattctgctcaccgaaattgtgacacatgggaggataccgtatccgggaatgactaaccccgaggtcattcagaatttagagaggggatacagaatggtgagacccgataactgcccagaggagctctaccaattgatgcggctctgttggaaagaaaggcccgaagaccggccaaccttcgattatctccgaagcgtcctcgaggatttcttcactgcaacagagggccagtaccagccgcagccttag

SEQ ID NO: 29292 - DNA, 750 bp, Artificial Sequence
  Description of Artificial Sequence: Synthetic coding sequence
atgggttactataatggtcacaccaaggtggccgtgaagtctctgaaacagggtagcatgtctccagatgctttcctggcagaggcgaatttaatgaagcagcttcagcatcaaagactcgtccggctgtacgcggtcgtcactcaagagccgatctacataataacagaatacatggaaaacggatcactcgtcgacttcttgaagaccccttccggaatcaagctcacgattaacaagttactagacatggccgctcaaatcgcggaggggatggcctttattgaagagagaaactacatacacagagacctacgggcagccaacatactcgtgtctgataccctcagttgcaagatcgccgatttcggactagctagactgattgaggataacgagtatactgctagagagggcgcaaaattccctataaaatggactgcaccagaagcaatcaattacggtacctttactataaagtccgatgtgtggtcttttggcatactcctgactgaaatagtcacccacggtcggattccttaccccggaatgacaaatcctgaggttattcaaaacttagagaggggttacagaatggtccgccctgataactgccctgaagaactgtaccagctgatgcgactctgctggaaagagcggcctgaggacagacctaccttcgactatctgcgttctgtgctggaggactttttcaccgctaccgagggccagtatcagccccagccttag

SEQ ID NO: 29293 - DNA, 1611 bp, Artificial Sequence
  Description of Artificial Sequence: Synthetic coding sequence
atgggaattcccggttcacataatttgcgctatttttggaactttcccggtcaggggcctataatcagcgatgtcggtggagcggacttgggaggcgcaccctctgcccctagctctattccttcgggtaccatggggtgcggttgttccagccatcccgaagacgattggatggagaacatagacgtttgtgagaattgtcactatccaatcgtccccctggacggcaagggcacgctgttgatacgcaacggctccgaagtacgagaccccctggtgacttatgagggctctaatccgccagcatctcccctgcaagacaatctggtcatcgcactgcactcctacgagcccagccacgatggggacttgggatttgagaaaggggagcagctcaggatcttggaacagtccggagagtggtggaaagcacagtccctcaccactggccaagaaggttttattcccttcaactttgtcgctaaagcaaacagtttggaacccgaaccttggttttttaagaacctctcaaggaaggacgctgagcggcagctgctcgcaccaggcaatacgcatgggtctttcctgattagggaaagtgaaagtactgccggatctttcagcctttccgtccgggacttcgatcaaaaccagggagaggtggttaagcactacaagatccgaaacctagacaacggtggattctatataagcccaagaatcacttttcctggcctccacgagcttgtccggcactatacaaacgcctcagatgggctctgtactcgactcagcaggccgtgtcaaacccagaaaccccagaagccgtggtgggaagacgaatgggaggtgccacgagaaacgctcaagctggtcgaaaggcttggagcgggacaatttggggaagtgtggatggggtactataacgggcacacaaaagtagcggtgaagtctcttaagcaaggttcaatgtcacctgacgcgttcctggcagaagccaacttgatgaaacagctccagcatcagaggctcgtccgcctgtatgccgttgtaactcaggagccgatctacattatcacggagtatatggagaatgggtcactggtcgatttccttaaaactccctcaggaattaaactcactatcaataaattattggatatggctgcccagatagccgagggtatggccttcatagaggaaaggaactacattcacagggacttgagagctgccaacattctggtctcagacacactgagttgtaagatagccgatttcgggctagcacggctcattgaagacaatgaatacacagccagagaaggagctaagtttcctataaagtggactgcgcctgaggctattaattatggtacattcacccacggcagaataccttatccaggcatgaccaaccctgaagtaattcagaatctggaacggggataccgtatggtgagacctgataattgcccagaagaactctaccaactgatgcggttatgttggaaggagcgccctgaagataggcctacttttgattaccttcggtccgtgctcgaggacttctttaccgcaaccgaagggcagtatcaaccccagccctag

SEQ ID NO: 29294 - DNA, 1200 bp, Artificial Sequence
  Description of Artificial Sequence: Synthetic coding sequence
atgccccaactcagcggagggggtgggggtggtggtggagaccctgagctttgtgctaccgacgaaatgataccctttaaggatgagggtgatccccagaaagaaaaaatcttcgccgaaatctcacatcccgaggaagaaggtgatcttgcggatatcaagagctcactcgtgaacgaaagcgaaattattcctgcatctaacggccatgaagtcgctcgccaagctcagacctcccaggaaccctatcatgacaaggcaagggaacatcctgatgacggtaaacatcccgacgggggactgtacaacaaaggtccgtcatattcaagttattcggggtacattatgatgcctaatatgaataatgatccatacatgtctaacgggagtctatctcccccaatcccacggacaagtaataaagtccccgttgtgcagccaagtcatgccgtccatcccctcaccccccttataacctacagcgatgagcacttcagtcctggttcacatccctcccacatcccgtcagacgtgaactcaaagcagggtatgagcagacacccgcctgcacctgatatacccactttctaccccctcagccccggtggggtcggtcagataacccctccactcgggtggcagggccagcctgtctaccctatcaccggagggttcagacagccgtatccatcttcactatctgtggatacatcaatgtcgagattttcccatcacatgattcccggaccacctggccctcatacgaccggtatacctcacccggctattgtgacacctcaggtgaagcaggagcatcctcacactgatagcgatctaatgcacgtgaagcctcagcatgaacagcgaaaggagcaggagcccaaacggccacacattaagaagccactgaatgccttcatgctatatatgaaagagatgcgagctaatgtcgtggccgagtgtactctgaaggagtcagcagcaattaatcaaatccttggaaggaggtggcacgcgctgtcgcgtgaggaacaagctaagtattatgagctcgccagaaaagaaaggcagttacatatgcaactctatcccggttggtcagctcgggataattatggcaagaagaagaaacggaagagagagaagctgcaggagtcagcttccgggaccggccctcggatgacagccgcttacatctag

SEQ ID NO: 29295 - DNA, 1161 bp, Artificial Sequence
  Description of Artificial Sequence: Synthetic coding sequence
atgccacaattatcgggaggagggggaggcggtgggggagacccggaattatgtgcaacagacgaaatgatccccttcaaagacgaaggagacccacagaaggagaagatctttgccgagatctctcatcccgaggaggaaggagacctcgccgacatcaagagcagtctggttaacgagtcagagatcatacccgcatcaaatgggcatgaagtagcccgacaggcccagaccagccaagagccgtaccacgacaaggcgagggagcatcccgacgacggaaagcaccccgatgggggattgtacaacaaagggccatcttactctagttatagtggatacattatgatgcccaatatgaataatgacccctatatgtccaacggctctctcagtccacctattccccgaacttccaacaaagtaccggttgtacagccctcccatgccgtccatccgctgactcccctgatcacatactcagacgagcatttctccccagggagccatccctcgcacatacccagtgacgtgaacagtaaacaggggatgtccagacaccctcctgcccctgatatccccactttctacccactgagtcccggtggggtggggcagataaccccaccactgggctggttctcacatcacatgatccccggtcctcctggccctcatacaacaggcatcccccatcctgcaatcgtaacaccgcaggttaaacaggagcaccctcacaccgatagtgacctgatgcacgttaagccacagcacgaacagcgaaaagaacaggagccgaagagaccacacatcaagaaacctctgaacgccttcatgttatatatgaaggagatgcgcgcaaacgtggttgcagaatgcactttgaaggaaagcgccgctataaaccagatcctaggacgcaggtggcacgccctgtcccgcgaggagcaggccaaatactatgagcttgcccgaaaagagcgccagttacatatgcagctctacccaggttggtctgcgagagacaattatgggaagaagaagaagcgaaagagagagaaacttcaagagtcagccagcggtggtaaacgttccagctttcccacgtgtaaggccaaagccgctaccccgggacctctgctggagatggaggcttgctag

SEQ ID NO: 29296 - DNA, 1116 bp, Artificial Sequence
  Description of Artificial Sequence: Synthetic coding sequence
atgccacagctctccgggggaggcggagggggaggcggagatccagaactctgcgccactgacgaaatgatcccatttaaagacgagggtgacccgcaaaaggagaaaatctttgctgagatctctcaccctgaagaagaaggagatctggcggatataaaaagttctctcgttaacgaatcggaaatcattccagcgagtaacggacacgaagttgcgcgacaggcccagacatctcaggaaccatatcacgataaggctcgggagcacccggacgacggcaaacacccagacggagggttatacaacaaaggaccctcttacagctcctactctggatatatcatgatgcccaatatgaataatgacccctacatgagcaacggatcattgagcccgccaataccacgaactagtaacaaagtccccgttgtgcagccgtctcatgcagttcaccctctaacccctctgattacttactcagacgagcacttttcacccggatcccatccgtcgcatatcccgagcgatgtcaattctaagcagggtatgagcagacatcctcccgctccagacataccgaccttctatccgctgtccccgggaggtgtcgggcagattacccctcctctggggtggttttctcaccacatgatcccagggcctcccggaccacacactacaggtattccccacccagcgatcgtgacaccccaggtgaaacaggagcatcctcataccgattctgaccttatgcacgtgaagcctcaacacgagcagaggaaagagcaggaacctaaacggcctcacatcaaaaaacccctgaacgcctttatgctgtatatgaaggagatgagagctaatgtggtcgccgagtgcactctgaaggagtctgccgctataaatcaaattctgggacgccgttggcacgccctaagccgagaggaacaggctaagtactacgaattggctcgtaaggagaggcagttgcatatgcagctgtatcctggttggtctgcgagggataattacggcaagaagaaaaagcggaagcgggagaagctacaagaatccgctagcggaactggtcccagaatgacagcagcatacatctag

SEQ ID NO: 29297 - DNA, 912 bp, Artificial Sequence
  Description of Artificial Sequence: Synthetic coding sequence
atggccgaggtggcgaggcaggcccagacgtcgcaggagccctatcatgacaaagcaagggagcatccagatgatgggaagcatccggatggcggattgtataataagggaccttcatactctagctacagcggatatataatgatgccaaacatgaacaacgatccttacatgagtaacggttctctgagtcctcctataccaaggactagcaacaaggtccccgtggtacagccctctcacgccgtccacccattgacccccctaattacatactcggatgagcacttctctcccggttcacacccgtctcacatcccttctgatgtgaactccaagcaaggcatgtctcggcacccacccgcacctgatatcccaactttctatcctctgagccctggcggagtgggacagataacccctccgctcgggtggttctcacatcacatgattcctggtccccctgggcctcacactaccgggatcccgcatcctgcaattgtgacaccccaggttaagcaggaacatcctcacacggattccgacctaatgcacgtgaaaccacagcatgagcaacggaaggaacaggagccaaagagaccccacattaagaaaccattgaatgcattcatgctctacatgaaggaaatgcgagccaacgtcgtggcggagtgcacgctgaaggagtctgccgctatcaatcagattcttgggagaaggtggcatgcactgtcaagagaagaacaggcgaagtattatgaactagctcggaaggagcggcagctgcacatgcagctatatccagggtggagtgctcgagataattacggcaagaagaagaaacgcaagagggagaagctccaggagagcgcatcaggaacaggcccacgaatgactgcagcctacatatag

SEQ ID NO: 29298 - DNA, 1500 bp, Artificial Sequence
  Description of Artificial Sequence: Synthetic coding sequence
atgaatgacgacccgagcatggaggagaatggtgtggagcgggtgtgccccgaaagcctgttgcagagcagagagtattcttccttgccgcttccgaggcatactagtagcacggacggtaccatcacctcatctgacccaggtttggagattcttaacatggcgtcctgcgacttggacagaaatagcttgtgcaagaaggaagaagatacacgctctgcctcaccaactattgaagcacagggaacatcacccgcacatgacaacatcgccttccaggactcaacttctaaagacaagaccattcttaacctggaagctaaggaagaacccgagacaattgaagaacataagaaagagcacgctagtggagacagcgtggtcagccccctcccagtgaccaccgtgaaaagtgtgaacctgaggcagtccgaaaacacctccgctaatgagaaggaagttgaggctgaattccttcgattgagcctgggctttaaatgtgattggttcactcttgagaaacgggtgaagttggaggagcgttcacgcgatctggccgaggaaaaccttaagaaggagatcaccaattgcctcaagttgttggaaagcctgaccccgttatgcgaagacgacaaccaggctcaggaaatcattaagaaactcgaaaagagcatcaagttcctgtcccagtgcgcagcacgcgtggcatctagagcagaaatgttaggcgcaattaatcaggagagccgagtctctaaagccgtggaagtgatgatacaacacgtggaaaacctgaaacgtatgtatgcaaaggagcacgccgagctggaagaactgaagcaggtcctcctgcaaaatgaacgctctttcaatcctttagaagacgacgacgactgccagattaaaaaaagaagtgcgtcattgaacagcaagccttcctccctccgacgtgtgactatagcttcactccctcgtaatatcggcaatgccggtatggtggccggaatggagaacaatgatcggttctcccgaagaagctccagttggcggatactcggctctaaacagtctgaacaccggcctagcctccccagatttattagcacatactcatgggccgacgcagaggaagaaaagtgtgagctgaagaccaaggatgactccgaaccaagtggggaagagaccgttgagcgaactcggaagccgtccctcagcgagaaaaaaaacaacccatcaaagtgggacgtatctagcgtgtatgatactatcgcttcatgggctacaaatctgaagtcaagtattaggaaggccaataaagcactgtggcttagcattgccttcattgtgttgttcgccgctctcatgtcattccttaccggccagctctttcagaaaagcgtggatgcggctcccacacaacaggaagattcttggacgagtctagagcatatactctggccgtttactaggttgagacacaacgggccaccgcctgtttag

SEQ ID NO: 29299 - DNA, 1500 bp, Artificial Sequence
  Description of Artificial Sequence: Synthetic coding sequence
atgaacgacgatccgtctatggaggaaaacggcgtggaaagggtgtgcccagagtctctcctgcagagtcgcgaatactctagtctacctctaccacgtcacactagctcaacggatgggactatcacctcaagcgatccgggtctggagattctgaatatggcctcctgtgacttagatagaaacagcttgtgtaagaaggaggaggacacaaggtctgccagccctacaatcgaggctcaagggacaagccccgcacacgacaacattgcatttcaagacagtacttccaaagataagaccatcctcaacctggaagccaaggaggagcctgagactattgaggagcataagaaggaacatgcctccggagattctgtcgtgtcgcctttgcctgtgactaccgtcaagtccgtaaacttgcggcaatcagagaacaccagtgccaatgaaaaggaggtcgaagctgagtttcttcggctatcactgggttttaaatgtgattggtttactttggagaaaagggtgaaacttgaggaacgatctcgcgacctggccgaggagaacctgaaaaaggagatcacgaattgcctcaaacttcttgagtcactgactcccttgtgcgaagatgacaatcaggcacaggaaattataaagaagctggagaagagtattaaatttctttcccagtgtgccgctcgggtggcttcaagggcggaaatgttgggcgctattaatcaggagagccgagtgtctaaggcagttgaggtgatgattcaacatgtcgaaaacctgaagcgcatgtatgcaaaagaacacgccgagctcgaagagctgaagcaggtattgttacaaaacgagaggtctttcaatcccctcgaagacgacgacgactgccagattaagaaaagatccgctagtctgaattcaaagccttcctccctgcgcagagtgaccatcgcttctctgcctcgaaatatcggaaacgcaggaatggtggccggtatggaaaataatgacaggtttagccggcgaagctctagctggcgcattctcggttccaagcagagtgagcacagaccaagcttacccagatttatcagcacctactcatgggccgacgcagaggaggagaaatgcgagctgaaaacaaaagacgactcagagccctcgggggaggagactgtggaaaggactaggaagcccagtctgtccgagaagaagaataaccccagcaagtgggacgtgagcagtgtttacgataccatcgcatcctgggccaccaatctaaaaagctcgatccgcaaagctaataaggctctctggttgagtatcgcctttattgttctattcgctgcgctgatgtcctttctcaccgggcaactgttccagaagtctgtagacgctgctcctacccaacaggaagactcttggacatccctcgagcacattctgtggcctttcacacgcctgcggcataacgggcctcctcctgtttag

SEQ ID NO: 29300 - DNA, 1500 bp, Artificial Sequence
  Description of Artificial Sequence: Synthetic coding sequence
atgaatgatgatccctctatggaagagaacggcgtcgagagggtgtgtcccgaaagcctgctccagagtagggaatacagttcattgcctctgccaagacacacatcttcaacagatggcacaattacaagctcagaccccggactagagatcttaaacatggctagctgtgatctggaccgcaatagcctgtgcaagaaagaggaagacacacgcagcgcatcccccactattgaagcccaaggcacctctcctgcgcacgacaatatagccttccaggattcaacgtccaaagacaaaacaatcctgaaccttgaagccaaggaggagcctgagacaattgaagaacacaaaaaagaacatgcctctggagattcggtcgtttcacctttacccgtgactacagtcaagagcgtcaatttgcgtcaatcggagaatacatccgcgaatgagaaggaggtggaggcagagtttcttcggttgtcactgggtttcaagtgcgattggttcaccctggaaaaacgggttaaactagaagagaggtcacgcgacctggccgaggagaacctgaaaaaggaaattactaactgcctgaaactacttgagtcactcacacccctgtgtgaagacgataaccaagcacaagaaatcatcaagaaactagagaagagcatcaagttccttagtcagtgcgccgcacgtgtggcgagccgagcggaaatgttgggcgctataaatcaggagagtcgggtgtcaaaggccgtcgaggtcatgatccaacacgtggaaaacttgaaaagaatgtacgctaaggagcatgccgagctggaagagcttaagcaggtgcttctgcagaatgaacgctccttcaacccactggaggatgacgatgactgtcagattaaaaaacggagcgcctctctgaacagcaagccatcctctctccgaagggttacaatcgcttccctgccaaggaatatagggaacgcaggtatggtggcagggatggaaaataacgatcgcttctccaggcggtctagtagctggcgaatcttggggagtaaacagtccgaacataggccttcattacctagatttatatcaacctactcttgggccgacgcagaggaggagaagtgcgagctgaaaactaaagacgattccgagcctagcggcgaagagaccgtcgaacggacgaggaagccgtccctaagcgaaaagaagaataatccatctaagtgggatgtatcctccgtctacgataccatcgccagctgggctacgaacctcaaatcctcaatccggaaggccaacaaagctctgtggctgtctatcgccttcatcgtgttgttcgctgctctcatgtcattcctgacaggacagctgtttcagaaaagcgtggacgcagcccctacgcagcaggaggactcctggacctccttagaacacattctgtggccttttacgcgattaaggcacaacggcccaccccctgtgtag

SEQ ID NO: 29301 - DNA, 234 bp, Artificial Sequence
  Description of Artificial Sequence: Synthetic coding sequence
atgaatgatgatccgagcatggaagaaaacggggtggagcgcgtctgtccagagtcattactgcagtctcgggagtacagcagcctgcccctacccagacacacctcttctaccgatggtactatcaccagcagcgatccaggtctcgaaatactgaacatggcaagttgtgacctagatcgtaattccctgtgcaagaaagaagaggatactaggtctgcctctcccacttag

SEQ ID NO: 29302 - DNA, 27 bp, Artificial Sequence
  Description of Artificial Sequence: Synthetic coding sequence
atgaacgacgacccgtcaatggaatag

SEQ ID NO: 29303 - DNA, 618 bp, Artificial Sequence
  Description of Artificial Sequence: Synthetic coding sequence
atgacacctcccgagcgcctgttcttgccacgggtacgtggtacaaccttgcacctattgttgctggggctgctgttggttctcttgccaggtgctcagggtctacccggagtagggctaaccccttccgctgcgcaaactgccaggcagcatccaaagatgcacctcgctcatagtaccctcaaacccgcagcccacttaatcggtgacccttccaaacagaactccctgctgtggcgggcaaacactgatcgagcttttcttcaagatgggttcagcctgtcaaataatagtctgctggtgcccacatctggcatctatttcgtctatagtcaggtggtgtttagtgggaaagcgtacagtcctaaagctacatcaagtccactgtacctagcccacgaggtacagctgttctcgagccagtacccatttcacgtacctctgttgtcctcacaaaagatggtgtaccccggtttacaggaaccctggctgcacagtatgtatcacggcgcagccttccagctgacacagggcgatcagctttcaacccacaccgacggaatcccccatctcgtcctgagccctagcacggtgtttttcggcgctttcgcactttag

SEQ ID NO: 29304 - DNA, 618 bp, Artificial Sequence
  Description of Artificial Sequence: Synthetic coding sequence
atgacgcctccggagcgattgtttcttcctcgggtgcggggaaccacacttcatctgctgctgttaggcctcctactagttctcctaccaggagcccaggggctaccaggggtcggtttaacaccctctgctgctcagactgcacggcagcatccgaaaatgcatctggcccattctacattgaaaccagccgcacaccttattggcgatccttccaaacaaaactccctgctgtggagggccaatacggatcgggcttttctccaagacggcttttccctgagcaacaacagcttactcgttccaactagtggaatctactttgtctacagccaggtggttttctcaggcaaagcttattcccccaaagcaacctcctctcctttatacctggcccacgaggtacaactgttctccagccaatatcctttccacgtcccactcctgtctagccagaagatggtgtatcctggtctccaggagccatggttacactcaatgtaccatggagccgcattccagctgacccagggcgatcagctgagcacccacacagatgggataccccacttggtcttgtcaccgtcaactgtctttttcggcgcattcgcactttag

SEQ ID NO: 29305 - DNA, 417 bp, Artificial Sequence
  Description of Artificial Sequence: Synthetic coding sequence
atgactccaccggaaagattatttttgcccagggtgcgtggcacaactctgcacctactcttgctgggccttctgcttgtgctgctccccggagcccagggcctgcccggtgtgggactgacacctagcgccgcacaaacagctcgacagcacccaaagatgcacctcgctcactcaactttgaagcccgcagcccatctcattggtgatccttccaagcaaaactcccttctctggcgcgctaataccgaccgagccttcctgcaggacgggttttctttgtcaaacaatagtctcctggtgcctacctcagggatttatttcgtgtacagtcaggggtccagcccacccctcctctggccatttcagcagctgaagtccagtttgataaagagccctgaactatcgaaaaagtag

SEQ ID NO: 29306 - DNA, 2010 bp, Artificial Sequence
  Description of Artificial Sequence: Synthetic coding sequence
atggaaggtaacaagctggaggaacaggacagcagccctcctcagagtaccccagggctgatgaagggcaacaagcgcgaggaacagggactgggaccagagcctgcagccccacaacagcctacagccgaggaggaagccctgattgagttccaccggtcctatagagaactgttcgagtttttttgcaataacaccactattcacggcgcaatccggctagtatgtagtcaacataaccgcatgaagacggccttttgggccgttctctggctctgcacattcggcatgatgtattggcagtttggcttgctatttggcgaatatttcagttaccccgtttcgctcaacattaacctgaatagcgacaaacttgtcttccccgcagtcacgatctgcactctcaacccttatcgttaccctgaaatcaaggaggagctggaagaacttgaccgcattaccgagcagaccttgttcgatctgtataagtactcctcattcactacattggtagctggcagcagaagccgaagagatctgcgtggaacacttccacatcctctgcagagactgagagtcccaccgcctcctcacggtgccagacgggctcggagcgtcgcttcgagtctccgtgataataaccctcaggtcgactggaaagattggaagattgggttccagctgtgcaaccagaataagtccgattgtttttaccagacttactcttccggagttgacgccgtcagagagtggtataggttccactacataaacatcttaagccgattacctgaaaccttgcctagcctcgaagaggatacgttgggtaattttatctttgcatgtcgcttcaatcaggtcagctgtaaccaggcaaattatagtcactttcaccacccaatgtacggcaactgttacacattcaatgacaaaaacaactctaatctctggatgtctagcatgccgggaatcaacaatgggctgtcactgatgttgcgagccgaacagaacgattttataccccttctgagcaccgtcaccggggcaagagtgatggtgcatggccaggatgagcctgccttcatggatgatgggggttttaacttgcgccctggcgttgagacgtccatttcaatgagaaaggagaccctggacagactggggggtgattatggcgactgcactaagaacggctctgatgttcctgtcgagaatctgtacccctcaaaatacacgcagcaagtttgcattcactcctgtttccaagagagcatgatcaaagaatgcggctgcgcttatattttctatcccagaccacagaatgtagagtactgtgactatcggaagcactcttcgtggggctattgctactataagctccaagtggacttttcaagcgaccacctggggtgttttaccaaatgccggaagccttgttctgtgacatcttatcagctgagcgctggctatagccggtggcctagtgttacttcccaggagtgggtgtttcaaatgttgtctcgacagaacaattatacggtgaataataagaggaatggcgtcgccaaagtgaacatatttttcaaggaattgaattacaaaaccaattcggagtccccctcagtgaccatggtcacccttcttagcaatctcgggagccagtggtctctgtggtttggctcgtcagtgctgtccgttgtcgagatggctgagctggtgtttgatcttctggtcatcatgtttctaatgctgttgcggcgatttcggagtcgctactggtcgccaggcagaggtggcaggggcgcacaggaagtggcgtctacactggcttccagcccaccatcccatttttgcccacacccaatgagcctgtccctgtcccaacctggaccagcgccatcccccgctttgactgctccgccaccggcttacgccacgttagggcctagaccaagccccggagggagcgcgggagctagttcctcaacgtgcccccttggcggtccatag

SEQ ID NO: 29307 - DNA, 987 bp, Artificial Sequence
  Description of Artificial Sequence: Synthetic coding sequence
atggggctcgaagaaatcgccccttgtaccagtaaaagaaagactcagtgtcggtgccagccaggcatgttctgcgcagcttgggcgctggaatgtacacactgtgagcttctctcggattgcccaccagggaccgaggcggaactgaaggatgaagtgggcaaagggaataaccactgtgtgccgtgcaaagcaggacactttcagaacacatctagccccagtgctcgatgtcagccacacaccaggtgcgagaatcagggactggttgaagccgcaccaggtaccgcacaatcagataccacctgtaaaaatccactcgaacctctaccaccagagatgtctggcacaatgctgatgctggcggtgctactgcctcttgcattcttcctcctcctggcaaccgtgttttcctgtatctggaaatcacatccttcactctgtcggaagctgggctctctcctgaaacgtaggcctcagggggaggggcctaatcccgtagcaggctcttgggagcctcccaaggcccacccctacttccctgacctcgtgcaacccctgctgccgatcagtggagatgttagcccggtgagtacaggtcttcccgcagctcctgtcctggaggccggagtgccacagcagcagagtcccctcgacctcacccgagagcctcaactggaacctggcgagcagtctcaggtcgcccatggaaccaatggcatccacgttacagggggatcaatgaccatcacggggaacatctatatatataacggtcccgtgctggggggtccccctggccctggcgatcttccagcaacgccagaacctccatatccaatacctgaagagggagaccctggaccgccaggtttgagcactccacaccaggaggacggtaaagcctggcatttggcggaaaccgagcattgtggagccacccctagtaaccgtggaccgaggaatcaattcattacacacgactag

SEQ ID NO: 29308 - DNA, 1725 bp, Artificial Sequence
  Description of Artificial Sequence: Synthetic coding sequence
atggctctcgcccgtgggagcaggcagctaggtgcacttgtctggggggcatgcctgtgtgtcctggtccacggacagcaagcacaaccaggccaggggtctgacccggcaagatggagacagctcattcaatgggagaataatggacaggtctatagcctactgaattccggtagcgaatatgtgccagctggtccacagcgtagcgagtctagtagccgggtgctgctagctggcgcaccacaagcccaacagaggagatcacacggcagcccacggaggcgacaggcgcctagtttgccattgcccggtcgagtgggcagcgacacagtcagaggacaagcaagacaccctttcgggttcggccaagtgcccgataattggcgcgaggtggccgttggcgactcaaccggtatggccagagccagaacgtccgtgtcccaacagagacatggaggcagcgccagttctgtgtctgcaagtgcatttgctagcacctaccgccagcaaccctcttatccccagcagttcccgtacccacaggctccattcgtgagccaatacgagaattatgaccccgcatcacggacatacgaccagggcttcgtgtattaccggcctgcaggagggggtgtcggcgctggagctgcagctgttgccagcgccggagtaatctacccctatcagccacgcgctagatatgaggaatacggcggaggcgaggagctgccagagtatcctccacaagggttttatccagcacccgaacgtccctatgtgccaccccctccaccacctccagacggcctggacagaagatactctcattcgctgtacagtgagggaacacctggtttcgagcaagcctaccctgaccctggccctgaagctgcgcaggctcatggtggggatccgagactgggctggtatccaccttacgccaatccccctcccgaagcttatggccctccccgtgcactggaacccccatatcttcctgtacgctcctcagatactccacctcctggaggagaacgcaatggtgctcagcaagggagactcagtgtggggtcagtctatcggccaaaccagaacggacggggtctacccgacctagtgcccgaccctaactacgtccaggcctccacctatgttcagcgtgcacacctgtactctctccggtgcgcggcagaggaaaaatgcctggcctcgacggcttacgccccagaggccacagattatgacgtcagggtcctactgcgtttcccacagcgtgtgaaaaatcagggtacagctgatttcctcccgaatcgacctaggcacacctgggagtggcattcctgccaccaacattatcactctatggatgagtttagccattatgacctcttggatgcagccacgggcaagaaggtggccgaagggcacaaagccagcttttgcctggaggattccacctgtgacttcggtaacctaaaaaggtacgcgtgtacgtcccatactcagggtctctctccagggtgctatgacacatataacgccgatattgactgccagtggattgatattactgatgtacagccaggcaattacatcttgaaagttcacgttaatcctaagtacatcgtgttggagtcggactttacaaataacgttgtaagatgtaacatccactacaccggacgctacgtctcagctaccaactgcaaaattgtgcagtcatag

SEQ ID NO: 29309 - DNA, 1311 bp, Artificial Sequence
  Description of Artificial Sequence: Synthetic coding sequence
atggctcgcgctcggacttctgtgagccagcaaaggcatgggggttctgcttctagcgtatccgctagcgcgttcgcaagtacatatagacagcagccctcgtacccccaacagtttccgtacccgcaggcacctttcgtctctcagtatgaaaattatgatccagcttctcgcacctatgaccagggattcgtgtactatcgcccagccggtgggggtgtcggcgctggagcggctgccgtcgcctccgcaggtgtgatatatccgtaccagccgcgtgctcgatatgaggagtacggtggcggagaggagctgcctgaatatccacctcaggggttctaccccgcaccggagcgaccttacgtgcctcccccacccccacctcctgatggactcgatcgcagatactctcattcactctactctgagggcaccccaggtttcgaacaggcttatccagaccctggtcccgaggccgctcaagcccacggtggtgatcccaggcttggatggtatcccccttatgcaaatcccccacccgaagcttatggtccccctagggccctggagcctccctacctgccagtgcgctcctctgacacaccacctccaggtggagagcgtaatggagcccaacagggacgactctcagtgggctctgtgtatagaccgaaccaaaatggaagagggcttcccgatctagtacctgaccccaactacgtacaggccagcacctatgtgcagcgcgcacatctctactccctcagatgcgcggctgaggagaagtgcctggcctcaactgcatatgctccagaggccaccgattacgacgtgagggtgctcctgagattcccgcaacgggtgaaaaaccaagggactgccgatttcctaccgaatcggccacggcatacctgggagtggcactcctgtcaccagcactaccactcaatggatgaattctctcattatgacttgttagacgctgctacggggaagaaagtagcggaagggcataaagcttcattctgcctagaggacagtacctgtgattttgggaacctgaagagatatgcctgcacctcccatactcagggcctgtcccctggttgttatgatacttacaacgctgacatcgattgccagtggattgatattaccgatgtccagccagggaattacatactgaaagtgcatgtgaatcctaagtatatcgtcttggagtctgacttcacaaacaatgtggtgaggtgcaatatccactataccggaaggtatgtatcggccaccaattgcaaaatagtccaaagttag

SEQ ID NO: 29310 - DNA, 636 bp, Artificial Sequence
  Description of Artificial Sequence: Synthetic coding sequence
atgaccaccctgacgagacaggacctgaacttcggtcaggtggttgctgacgtgctctgcgaattccttgaagtggcggtacacttaatcctgtacgtgagagaggtgtatccagtgggtatcttccagaaacggaagaaatacaatgtgccggtacaaatgagctgtcatcccgagctgaaccaatatatccaggataccctgcactgtgtcaaacctcttcttgagaagaatgatgtggaaaaggtggtcgtggtgattctcgacaaggaacacagacccgttgaaaagtttgtatttgagataacccagccgccattgctgagtatctctagcgattctctgcttagccacgtggagcaactcctgagagcattcatcctcaagatttctgtgtgcgacgctgtcctggaccacaatcctcccggatgcacttttactgtgctggttcacactcgggaggcagccacacgcaacatggagaagatccaggtcattaaggacttcccctggatactggccgatgaacaggatgtgcatatgcatgatccaagactgatcccgttgaagaccatgactagtgatattttgaagatgcaactttacgtagaggagagggctcataagggctcctag

SEQ ID NO: 29311 - DNA, 318 bp, Artificial Sequence
  Description of Artificial Sequence: Synthetic coding sequence
atgaccacgctcacaagacaggatctcaacttcggacaagtcgtggcggacgtcctgtgcgagtttctggaagtggcggttcacctaatactctatgtccgagaagtctaccccgtgggcatcttccagaagagaaagaaatacaacgttcccgtgcagatgtcatgccacccagagttgaatcaatatatccaagacactcttcactgcgtgaagcctcttctggaaaaggtgcgagtgcactgggcgccacagccttcccatccgatgctgacccctgtaccagtctgctcccagagcaacagcggcatgggatag

SEQ ID NO: 29312 - DNA, 531 bp, Artificial Sequence
  Description of Artificial Sequence: Synthetic coding sequence
atgaccactctaacccgccaggacctgaattttggccaggtggtggcggacgtcttatgtgaattcctcgaggtggccgtacatttgatcctgtacgtcagggaggtgtatcccgtcggaatcttccagaaaagaaaaaaatacaacgtacccgttcagaatgatgtggagaaggttgttgtggtgatcttggataaagaacacaggcccgtagagaagtttgtctttgaaatcacccagcctcccctcctctcaatcagttctgatagtctgctcagccatgtggaacaactcctccgcgcatttattttgaaaatttcggtgtgcgatgcagtgctggaccacaatccgcctggggtgagcacaccacaccccctcttcccttggcactttcatgggtacctgggccttgtgtgtgtgcctaggtctatgttcggctgcagcgagacccacctgttcctgactttgagggtacacctgctttgggaagccagcctgatagattccacttggctgcccagtccatactag

SEQ ID NO: 29313 - DNA, 636 bp, Artificial Sequence
  Description of Artificial Sequence: Synthetic coding sequence
atgactacgttgacaaggcaggatttgaactttgggcaggttgttgcagacgttctatgcgaatttctggaggtcgcagtgcacttgatactgtatgttagagaagtctaccccgttggcatctttcaaaagcgcaaaaagtacaatgttcctgtccagatgtcttgtcatccagagctcaaccagtacatccaggacacgctgcactgcgtgaagcccctgctggaaaaaaatgatgtggaaaaggtggtggtagtcatcctcgacaaggagcaccgacccgtcgagaagttcgtgtttgagatcacccagccaccactgctgtctatctcatcagacagcttgctttctcacgttgagcagcttttgcgggctttcattctcaagatcagcgtgtgcgacgctgtgctcgatcataatccaccgggttgtaccttcacagtccttgtgcataccagggaggctgctacgcggaacatggaaaaaattcaagtgataaaggattttccatggatcctagcagacgaacaggacgtccatatgcacgatccaagacttattcccttgaagacgatgacaagcgatattctcaagatgcagctttacgtagaggaacgcgctcacaagggctcatag

SEQ ID NO: 29314 - DNA, 675 bp, Artificial Sequence
  Description of Artificial Sequence: Synthetic coding sequence
atgaccactttaacacgccaagacctaaatttcggccaggtcgtcgcggacgtgctgtgcgaattcctggaggtggcggtccacctcattctgtatgtcagggaggtatatccagtcgggatcttccagaaacggaagaagtataatgtgcctgtgcagatgagctgccatccagaattgaaccagtacattcaggacacactgcactgcgttaagcccctcctggagaagaacgacgtggaaaaagtggtggtggtcatcctcgataaggaacacagacccgtggaaaaattcgtgtttgaaatcactcaaccgcctctgctgtccatacgatgggccgcacctgccccaagaccactcgcaggcatttctagcgattccttactgagccacgtcgagcagctgctacgggcatttatactgaagatttctgtgtgcgatgctgtgcttgatcacaaccctcccggatgcacattcaccgttttagtgcatacacgggaagccgctacacgcaatatggagaaaatccaagtgataaaggattttccttggatcctggctgatgagcaggatgtccatatgcatgatccacgcttaattcccctgaaaactatgacatctgacattcttaagatgcagttatatgtcgaagaacgggcacataagggctcatag

SEQ ID NO: 29315 - DNA, 675 bp, Artificial Sequence
  Description of Artificial Sequence: Synthetic coding sequence
atgacaaccctgactcgtcaggacctcaatttcgggcaggtggtagccgacgtactgtgcgagttcctggaggtcgccgtccacctgatcctctacgtccgcgaagtataccccgtgggcatattccaaaaaaggaagaagtataatgtgcccgtccaaatgagttgccacccagagcttaaccagtatattcaggacacactccattgcgtaaaacctctgctggagaagaacgacgttgaaaaggtggtcgtggtgatcttggacaaagagcatcgacccgtggagaagtttgtgtttgaaatcactcagccgcctctactgtctatccgctgggccgcacctgcgcctcggcctcttgccggtatttcatcagacagtctactgagccatgtggaacaattgctgcgagccttcattctgaagatctcggtgtgcgacgcagtgcttgatcataatccccctggatgcacatttaccgttctggtgcacacacgcgaggcggcaactagaaatatggaaaagatccaggtcattaaagacttcccatggattcttgccgacgaacaggacgtgcatatgcatgatccacgcttgatcccgctgaagaccatgacatctgatatattaaagatgcaactctacgttgaagagcgcgcacacaagggtagttag

SEQ ID NO: 29316 - DNA, 636 bp, Artificial Sequence
  Description of Artificial Sequence: Synthetic coding sequence
atgaccacactaacccggcaggatctgaacttcggccaagtggtggctgatgttctgtgcgagtttctggaagtggcggtccacttaatcctgtacgtccgggaagtctacccagttgggatttttcagaagagaaagaagtacaacgtgcccgtccagatgtcttgccacccggaattgaaccaatacatacaagacacacttcattgtgtcaagccactccttgagaagaacgatgtcgagaaggtggttgtggtgattctggataaggagcatagaccggtggaaaagttcgtctttgagataacacagccccctctcttgtccatttcctccgattctctcctgtcccatgttgaacaacttctgagggccttcatactgaaaatcagtgtttgtgacgccgttcttgaccataatccaccaggctgtacatttactgtgttggtgcatacacgtgaggccgctacccgcaatatggagaagatacaagttattaaggatttcccgtggattctggcagacgaacaggatgtgcacatgcacgacccaagactgatccctctgaagaccatgacatctgacatactcaagatgcagttgtatgttgaggagcgcgcacataaggggagctag

SEQ ID NO: 29317 - DNA, 597 bp, Artificial Sequence
  Description of Artificial Sequence: Synthetic coding sequence
atgaccaccctcacccgccaggacctcaacttcggacagggaagagaagccggaccagcagggcctggggctggggcatccgggcctgccggatttttagagagagctactgggctgtgtccacccgcagtagttgccgacgtgctgtgtgagttcttagaggttgccgtccacttgattctatatgtgagagaagtctacccagttggaattttccagaagcggaaaaagtacaatgtgcccgtgcagatgtcgtgccacccggagcttaaccagtacatccaggataccctccattgcgtgaaaccgctcctggagaaaaatgatgtggagaaagtcgtggtggttatcttggacaaagagcatagacccgtcgaaaagttcgtcttcgagatcactcagccacccttactgagcatctcatctgatagcttattgagccacgtggaacagctgttgcgggcttttatcttaaaaatttcagtctgcgacgccgtcctagaccataatccacctgggtgcaccttcacggtgctagtgcacacaagagaagctgctacccggaacatggagaagattcaggtgatcaaggtatag

SEQ ID NO: 29318 - DNA, 504 bp, Artificial Sequence
  Description of Artificial Sequence: Synthetic coding sequence
atgaccactttgacgcggcaggatctgaactttggacaggtagtagccgacgtcttgtgcgagttcctagaggttgctgtgcacctcatcctgtatgtccgggaggtgtaccctgttggtatctttcagaaacgaaagaaatataacgtaccggtccagatgagttgtcatcccgaactgaatcagtacattcaagacaccctacattgcgtcaagccgttactggagaagaacgatgtggaaaaggtcgttgtggtgatattggacaaggaacacagacccgtggaaaaattcgtctttgagattactcagcctcccctccttagcatctcctccgactctctgctgtcacacgtcgagcagttactgagggcgttcatactcaaaatatccgtatgcgacgcggtactggaccacaatccccctgggtgtaccttcacagtgctcgtacacacaagagaggctgcaactaggaatatggagaaaatccaagtgattaagtag

SEQ ID NO: 29319 - DNA, 3159 bp, Artificial Sequence
  Description of Artificial Sequence: Synthetic coding sequence
atggcaggaatggattccgggaacctgaaaaccgccaggttgtggcgagatgcagcactccgtgcccgaaagttacgctcaaatctccgtcaacttactctgacagctgccggagcgtgtcccggtgccggtgcagatgccctcgagtcccccgcatctccccagttggtgctcccagcgaacctgggcgacatcgaagctttaaacctgggcaataacggtctggaagaggttcccgagggtttggggagcgccttgggctctctgcgggtccttgtactcagaaggaaccgcttcgcgagactgcctccagccgtggcggaacttggccaccatctcactgaattagacgtgagccataaccggcttaccgcgctcggggctgaggtagttagcgcactaagagagcttcgtaagctaaacctgagtcataaccagctgccggctctacctgcccagcttggcgcactggcacatctggaggaactggacgtctcattcaaccggctcgcccatctcccggactctctttcttgtctttcccgcctccgcacccttgacgtcgaccacaatcagctgaccgccttcccaagacagcttttgcagttagtggcactcgaggagctcgatgtttcttccaatcgtcttcggggattgcccgaagatatctccgctctccgagctctaaaaattttgtggctttctggggctgaattaggcaccctccctgctggcttctgtgagctcgcctcactggagagcctgatgctggataataacgggctgcaggccttacctgcccagttttcttgtctgcaaagactgaagatgctgaatttgagctctaatttgtttgaggagttccccgcagctctgctccccctggccggtctcgaagagctttacttatcaaggaatcagctgacctctgttccgagtctgatctctggcttagggcgtctgctaactttatggttggataacaatcgaattcgatacttgccagacagtatcgtcgagttaaccggacttgaagagctcgttttacagggaaaccagattgccgtccttcccgatcatttcggacagcttagcagagtgggcctgtggaagatcaaggataacccgctcatccaaccaccttatgaagtgtgtatgaaggggatcccttacatcgctgcctaccagaaagaattagctcactcgcaaccagctgtgcagcccaggctgaaactccttttgatggggcacaaggcagccggaaaaactcttttgcgccactgcctgacagaggaaagggtcgagggatgccctgggggtggagacaaagaaaaatgctacccccctagcccgccacccgtgagcaagggcatcgaagttacttcttggactgcggacgcttccagagggctgcgcttcattgtctacgatctggctggcgacgagagctatgaggtcattcagcctttttttttgtctcccggtgcactctatgtactagtggtgaatcttgcgacatatgaacccaggcattttcccacaacagtcgggagtttcttacacagagtgggagcaagggtacctcatgctgtggtctgcattgttgggactcacgccgacttgtgtggcgagcgggagctcgaagaaaaatgcctggatatccatcgtcagatcgcacttcaggaaaagcacgacgccgaaggtttgtctaggctggctaaagtggtggacgaggccctggctcgcgactttgaactaaggagtgcaagcccccacgccgcatattatggcgtttcggacaaaaatctgagaaggcgtaaggctcactttcagtacctattaaaccacagactgcaaattctaagccccgttctgcccgtttcgtgccgtgatccgagacacctgcggagacttcgagataagctgttaagcgttgcagaacacagggagatctttccaaacctgcatcgcgtgttgcccaggtcatggcaggtgctggaagagctccactttcaaccccctcaggcccagaggctgtggctgagctggtgggacagcgcgagactggggctacaggccggtctgactgaagataggctccaatcggctctcagttacctccacgagagcggaaaactcttatattttgaggactctcctgcactgaaggagcacgttttccacaacctgacacggctgattgatatccttaacgtcttctttcagagggacccgtccctcttgctccataaactcctgcttggcactagtggcgaaggtaaagctgagggagagtcttcccccccaatggctaggagcacccccagtcaggagctgttgcgcgcaactcaactgcaccaatacgtggagggattcctcctgcacggtctgctacccgcacacgtgatcaggctcttgctcaagcctcacgttcaggctcagcaggatctccagctgctgctggaattgctggagaagatgggactctgttattgtctgaataagcccaagggaaagcctcttaatggcagtacggcttggtacaaatttccctgttacgtccagaacgaggtgcctcatgcggaggcatggattaacgggacaaatctcgcagggcagagtttcgttgctgaacagcttcagattgaatatagttttccctttacttttccactgggactgtttgcgagatacagtgtacagatcaattcccacgtggtgcataggtcagatggaaagttccagatattcgcttaccgcggaaaggtgccagtggtggtgtcatatcggccagcccgaggcgtgctgcaaccagacactttgagcattgctagtcatgcgtcactcccgaatatttggaccgcctggcaggcaatcactccactcgtcgaagaactcaacgtcttactccaagagtggcccggactccactataccgtgcatatcctgtgcagtaagtgcctgaagaggggctcaccgaacccccacgcgttccccggagagctcttatcacaaccacgcccagaaggagtggccgagatcatctgccccaaaaatgggtccgagagagtgaacgtcgccctagtgtatccacctacacctactgttatttctccctgctcgaagaagaacgtgggtgagaaacaccgaaaccagtag

SEQ ID NO: 29320 - DNA, 549 bp, Artificial Sequence
  Description of Artificial Sequence: Synthetic coding sequence
atgggtaagggtaggtttgacgaaaaggaaaacgtgagtaactgtatccagttgaaaacctccgtgattaaaggcatcaagaatcaacttatagagcagtttcccggaatcgaaccctggctgaaccagatcatgcccaaaaaggatcctgtcaaaatcgtcaggtgtcacgagcacattgagatcttgacggtgaatggcgaactcctgttcttccgccagcgcgagggacctttctatcctactttgcggctgcttcataagtatcctttcattcttccacaccagcaggtcgataagggagctattaagttcgtgctgtcaggggcaaacatcatgtgtcctggacttacctcgccaggggctaaattgtatcccgctgccgttgacacaatcgtcgcaattatggccgaggggaagcaacacgctctctgcgttggtgttatgaagatgagtgcagaagatattgagaaagtcaataaggggatcgggattgagaatatacactatctcaacgacggtctttggcacatgaagacatataaatag

SEQ ID NO: 29321 - DNA, 546 bp, Artificial Sequence
  Description of Artificial Sequence: Synthetic coding sequence
atgttcaaaaagttcgatgagaaagagaacgtttctaactgcatccagttgaagacttctgtaattaagggtattaagaatcagttgattgagcagtttcctggtatagaaccctggctgaaccagatcatgcctaagaaggatccggtgaaaatcgttaggtgccacgagcatatcgaaatattgacagtaaacggagaacttctgttttttaggcaaagggaaggaccattctaccctacgctgcgactgttgcacaagtatcctttcatcctcccccatcagcaggtggataagggagctatcaagttcgtgctgtctggcgcaaacattatgtgcccaggactgacatcacccggagccaaactgtatccggctgccgtcgacaccattgtagctattatggccgaggggaagcagcatgctttgtgcgtgggagtgatgaaaatgtctgcggaggatattgagaaggtaaataaggggattggtatcgaaaacattcactatctgaacgacggcctctggcacatgaagacctataaatag

SEQ ID NO: 29322 - DNA, 2226 bp, Artificial Sequence
  Description of Artificial Sequence: Synthetic coding sequence
atggccctgttcaccccatggaagctgtcatctcaaaaactgggattttttcttgtcacttttggcttcatctggggcatgatgctgctacatttcacaattcagcagaggacacagcccgaatctagcagtatgctgcgggaacagattctcgacctgtctaagcgttatataaaagctttagctgaggagaataggaacgtggttgacggaccttatgctggggtcatgactgcttacgatttgaaaaagaccctggcagtgctcctggataacatccttcagcggattggcaagttagaaagtaaagtggataacctggttgtgaacgggacaggaactaattcaacgaacagcacgacagccgtgcctagcctggttgcgctggaaaaaatcaatgtggctgacattattaatggggctcaggaaaagtgtgtgctgcctcccatggatggctatccccattgcgaggggaaaatcaagtggatgaaggacatgtggaggtcagacccgtgctatgccgattatggcgttgatgggtctacctgctcttttttcatctacctttccgaggtggagaactggtgcccccacctgccatggcgggctaagaatccgtatgaagaagcagaccacaattcactcgccgagatacgcacagatttcaatattttgtattctatgatgaagaagcatgaggaatttaggtggatgcgtctgaggattagaaggatggctgacgcatggatccaagcaatcaagtctctggccgagaagcagaatcttgaaaaacggaagagaaagaaggtattggtccatctgggcttgctgacaaaagaatcaggatttaaaattgctgaaaccgcattttcaggcggacctctgggtgaacttgttcaatggtctgatcttatcactagcctgtatttgctgggtcacgatatccggatttcggcttccctggcagaattgaaggaaattatgaaaaaggtagtcgggaaccggagcggctgccctacagtcggggatagaatcgtggagctgatctacattgacatcgtaggcctggcccaatttaagaagactctcggaccatcatgggtgcattatcagtgtatgctccgtgtgctggactcatttgggactgaacctgaattcaatcatgctaactacgctcaaagcaagggacataagacaccatggggcaagtggaatctgaaccctcagcagttttacacgatgtttccgcacacccctgataacagttttctcggcttcgtggtggagcagcatctgaacagctccgacatccaccacatcaacgagattaaaaggcagaaccagagtcttgtttacggcaaagtggattccttttggaagaacaaaaagatctacttggacataattcacacctacatggaagtgcacgcgaccgtctatgggagttctacgaaaaacataccgagttatgttaaaaatcacggcatccttagcggcagggacctgcagtttttactccgcgagaccaaactctttgtgggactgggattcccctatgaaggacctgcacctttggaagcaatcgccaacgggtgcgctttcttaaatcccaagttcaacccaccgaaatcatcaaagaataccgacttcttcattggcaaaccaaccctgcgggagcttacatcgcaacacccctatgctgaggttttcattgggcgaccccatgtgtggaccgttgaccttaataatcaggaggaggtggaggacgctgtaaaggcgatcttaaaccagaaaatcgaaccctatatgccatatgagttcacctgtgaggggatgttacagcgcatcaacgctttcatcgagaaacaagatttttgccacggtcaagtgatgtggcctccactctcagcccttcaagtcaaacttgccgagcccggacaatcctgtaagcaagtttgccaagaaagtcaacttatttgtgagccatcatttttccagcatctcaataaggataaggatatgctaaaatacaaggtgacctgccagtccagtgaattggccaaggatattctggtaccttctttcgatcccaaaaacaagcactgcgtgtttcaaggggatctgctccttttcagctgtgccggagcccacccccgtcaccagcgtgtctgtccttgcagagacttcatcaaaggtcaggtggccctctgcaaagattgtctgtag

SEQ ID NO: 29323 - DNA, 2226 bp, Artificial Sequence
  Description of Artificial Sequence: Synthetic coding sequence
atggcactgttcactccctggaagctgtcatctcagaaactcggcttcttcctggttacctttggatttatttggggaatgatgttactccacttcactatacaacaacgcacacagccagagagctcttccatgttaagagagcagatcctggatttatccaagcggtatattaaggcactcgctgaggagaatcgtaacgtggtggacggcccatatgcaggagtgatgacggcctacgacctgaagaaaaccctggccgtccttctcgacaacatactgcaacggattggaaagctggagtccaaggtagacaaccttgttgtcaacggcaccggtacgaactccaccaactccacaacagcagtacctagccttgtggccttagagaagatcaatgtggctgatatcattaatggcgctcaggagaaatgtgtcctgccccctatggatggctaccctcactgcgagggtaaaatcaaatggatgaaagacatgtggagatcagatccgtgttatgctgactatggggtcgatgggagtacttgcagtttcttcatctacctttccgaggttgaaaattggtgtccccacctgccgtggcgcgcaaaaaatccttatgaagaggctgaccacaactcacttgcagaaattcgcaccgactttaatatcctatactcaatgatgaaaaaacatgaggaatttaggtggatgagactgcgtatacgccgtatggctgatgcctggatccaagctatcaaatcactagcagagaaacaaaatctggaaaaaaggaagaggaagaaggtgctggttcacctgggcctccttaccaaagaaagtgggtttaagatagccgaaaccgcattctctggcggaccactcggggaattggtacaatggagcgatctcatcacaagtctgtatctgctcggccatgacatccgaattagtgcttccctggctgagctaaaagaaattatgaagaaggtggttgggaatcggtcgggatgccctaccgtgggggataggatcgttgaactaatctatattgatattgtaggcctcgcgcagttcaagaaaaccctcggaccttcttgggtgcattatcaatgtatgctccgcgtcttagacagcttcgggaccgagccagaattcaaccacgcaaattatgcccagtcaaaaggacacaaaactccatgggggaagtggaacctgaaccctcaacagttttatacaatgttcccccacacacctgataacagcttcctgggctttgtggtggagcagcatctgaattctagtgatatacaccacatcaacgaaatcaagcggcaaaaccagtcattggtttatggaaaagtggattcattctggaagaacaagaaaatatatctagatatcatccacacttacatggaggtccacgccactgtttatggctctagtaccaagaacattcccagttatgtgaagaaccacggaatattaagtgggcgagacctccaatttctgcttagggagacgaagctgtttgtcgggcttggtttcccttatgagggccctgctccactggaagccatcgcaaatggctgcgcattcctgaacccaaaatttaatcccccaaagagcagcaaaaatacagatttttttatcggaaaaccaacacttagagaactgacttcacagcacccttacgccgaagtgtttattggaagaccgcacgtgtggactgtcgatttgaacaaccaggaggaagtcgaggatgccgtgaaggctattctgaatcagaagatagagccttatatgccgtacgagttcacgtgtgagggcatgctccaaaggataaatgccttcatagagaaacaagacttctgccacgggcaggtgatgtggcccccactcagcgcccttcaagtcaagcttgcagagccaggacagtcatgcaagcaggtctgccaggagtcccagctcatctgtgagccttcatttttccagcacctgaacaaagacaaagacatgttgaaatacaaggtgacttgtcagtcttcagaactggcaaaagacattctagtgcccagtttcgacccaaaaaacaaacattgtgtcttccaaggcgacttgctcctgttcagttgtgcaggtgcacatccaaggcaccagcgggtatgcccctgccgagactttatcaagggtcaggtggccttatgcaaggattgcctgtag

SEQ ID NO: 29324 - DNA, 1410 bp, Artificial Sequence
  Description of Artificial Sequence: Synthetic coding sequence
atgcactcttttcccccactgttgctcctgctattttggggagtggtgtcccattcctttccggctacgctagaaacccaggaacaagacgtagacctcgtgcagaagtacctagagaagtattataatcttaagaacgacggcagacaggtagagaaacgaagaaatagcgggccagtagtagaaaagctaaagcagatgcaggagtttttcgggctgaaagtgaccggcaaacctgacgcagagacccttaaagtgatgaagcaaccaaggtgcggcgtcccagacgttgcccagtttgtgctgactgaaggaaacccccgttgggagcagacacacttgacatatagaattgaaaattatacgccagacctgcctcgcgcagacgtagatcacgccatcgagaaggcgtttcaactctggtcaaacgtgacccctctgacgtttacgaaggtaagcgaggggcaggctgatatcatgatatcctttgtaagaggagatcacagggataattcgcctttcgatggccctggcggtaatttggcacacgctttccagcccggtcccggaattggtggcgatgctcacttcgatgaagacgagaggtggaccaataatttccgcgagtacaacctgcacagagtggccgctcacgagctgggacacagcctggggctgtcgcactccaccgacatcggcgctcttatgtacccgagctatacattttcaggcgatgtccagctggcacaggatgatatcgacgggatacaagccatctacggcaggagtcaaaaccctgtgcagcccatcgggccacagactcctaaggcctgtgacagtaaactcacttttgatgccattaccacaatcagaggcgaggttatgttttttaaggacaggttttacatgagaacaaatcctttctaccctgaggtggagctgaacttcatttctgttttctggcctcagctacccaatggtctggaggccgcttacgaattcgccgacagggatgaggtcaggtttttcaagggaaataagtactgggcagtgcagggtcagaacgtgcttcacggctatcctaaggacatatattcttctttcggctttcctagaaccgtgaagcacatagatgcagccctgtctgaagagaatactggcaaaacctattttttcgttgccaataaatactggaggtatgatgagtacaaaaggagcatggaccccggttacccgaagatgatcgctcacgatttcccaggtattggacacaaagtagacgcggtcttcatgaaggacggctttttttactttttccacgggacacgccaatacaagtttgatccaaaaaccaagagaattctgactctgcaaaaggctaactcatggtttaactgcaggaaaaattag

SEQ ID NO: 29325 - DNA, 1431 bp, Artificial Sequence
  Description of Artificial Sequence: Synthetic coding sequence
atgatgcatctcgcctttctggtcttactgtgccttcctgtttgcagtgcctatcccctcagtggggcagctaaggaggaggactctaacaaagacctggcgcagcagtacctggaaaaatactacaacctcgaaaaagatgtgaagcagttcaggcgaaaggacagtaacctgatagtcaagaagatccaaggtatgcaaaaattccttggcttagaagtgaccggcaaactggatacagataccctggaggtcatgaggaagcccaggtgtggagtgcccgacgttggtcatttttcttcgttccctgggatgcccaaatggcgcaagacacatttgacctatcgcattgttaattatacgccagatttaccacgagatgcagtggattctgccattgagaaggctctgaaagtctgggaggaggtgactcctttgacgttctcacggttgtatgagggtgaagccgacatcatgatctcatttgctgtcaaggagcacggggatttttactctttcgatgggccagggcactccctggcgcacgcatatcctcctggccctgggctgtacggcgacatccactttgacgatgacgaaaagtggaccgaggacgctagtggcactaatctgtttctggtagccgctcacgagttaggccatagccttgggctttttcattctgccaataccgaagccctcatgtatccactgtacaactcctttactgagctcgctcagtttagattgagtcaggacgatgtgaacggtatacagagtctgtatggaccccctcccgcttccactgaggagcctctagttcccacaaagagtgtaccttctggatccgagatgcctgcaaagtgcgaccccgcactctcattcgacgctattagtaccctcagaggtgagtacttgtttttcaaggatcgctacttctggagacggagtcattggaatccggagcctgagtttcacctgatcagcgccttctggcccagcttgcccagctacttagatgcagcatatgaagtgaactcccgagacaccgtatttatctttaaaggcaatgagttctgggccattcgcggaaatgaggtacaggctggctaccccaggggcatacataccctgggattccctcctacgatccgaaaaatagatgctgcagtctcagataaggaaaagaagaagacctatttttttgcagctgataagtattggcgtttcgatgagaactcccagtctatggagcagggcttccctaggttgattgctgatgattttcctggggtggagcccaaggttgatgccgtcctccaggcattcggcttcttttacttcttcagtggatctagccagttcgagtttgaccctaacgccaggatggttacacacattctgaaaagtaactcctggttacactgttag

SEQ ID NO: 29326 - DNA, 930 bp, Artificial Sequence
  Description of Artificial Sequence: Synthetic coding sequence
atgcctcgacactgtagcgcggcagggtgctgcacgagggacactcgagagaccaggaatagaggaataagtttccaccggctaccaaagaaagacaatcctcgtcgtggactctggctcgctaactgtcagcgcctcgacccgagcggccagggtctttgggatcctgcgtccgagtacatatatttttgctcaaagcactttgaggaggactgtttcgagctggtgggcatttctgggtaccacagactgaaggaaggcgctgtacccaccatcttcgagtcctttagtaagctcaggcgaacaactaaaacgaagggtcacagttatcctcccggacctgctgaagtctcaaggctgaggcggtgtagaaaacggtgtagcgaaggcagaggcccaactactccattctcaccaccaccgcctgcggatgtaacttgctttcctgtggaagaagccagcgcgccagctacgctgccagcgagcccggcaggcaggttggagcccggtttgagctccccattctccgatctgctgggcccactgggcgcacaggctgacgaggccggatgttctgcgcagccttctcccgagagacagccgagccccttggagcctagacctgtgtctccatccgcttacatgctgcggctgcctccgccagcaggcgcttatatccaaaacgagcactcctaccaggtggggtcagcactcctctggaagaggcgcgctgaagccgcactcgacgctttggataaggcacagcgtcagcttcaggcatgtaagcgcagggaacaacgccttagactgcgactgacgaaactccagcaagagcgagcaagagagaagcgcgctcaggctgatgccaggcagaccttaaaagaacatgttcaggactttgcgatgcagctctcaagttcaatggcctag

SEQ ID NO: 29327 - DNA, 1416 bp, Artificial Sequence
  Description of Artificial Sequence: Synthetic coding sequence
atgcatcccggtgtgcttgcggcattcctgttcctgagctggactcattgccgcgcattgcccttgccatcgggtggggacgaggacgacctaagtgaagaggatctgcagttcgcggaacgttatttgagaagctactatcatcccaccaatttagccggtatccttaaggagaatgcagcttcctccatgaccgaacgactcagagaaatgcagagcttctttggcttagaggtcacgggcaaactagacgacaatacgctggacgtgatgaaaaaacctagatgcggagtgcccgacgtgggggagtacaacgtatttccgaggaccttgaagtggagcaagatgaacctaacctaccgaattgtaaattacacacccgatatgacccactcagaagtggagaaagcatttaagaaagcattcaaagtctggtcagacgtcacgcccctgaattttacccggcttcacgacggaatagctgacattatgatcagctttggaatcaaggaacacggtgacttttacccgtttgacggaccgtccgggctattggcacatgccttcccgccagggcctaattatggaggcgacgctcatttcgacgacgatgaaacttggacatcgtcttccaagggctacaacctgtttctggttgcagcacacgagttcggacattctcttggattggaccattcaaaggaccccggagcactcatgtttccaatttatacctacacaggaaagtcccactttatgctgccggatgacgacgttcagggtatacaatccctctacggaccgggagacgaggaccctaaccccaagcaccctaagactcccgataaatgcgaccccagtctgtccctggacgctatcactagtctaaggggggagactatgattttcaaagataggtttttctggaggctccaccctcagcaagtcgatgctgagttgtttctcacaaaatccttttggccagaattacccaataggatagatgctgcctacgaacaccccagccacgatctcatatttatcttccgagggaggaagttctgggcactcaacggatacgacatcctagaaggctaccctaagaagattagcgaactcgggttgcccaaggaggtaaaaaagatcagcgccgcagtgcatttcgaggacacaggcaagactctgctgttcagcggtaatcaagtgtggaggtatgacgacacaaaccatatcatggacaaggattaccccagactcatagaagaagatttccctggcataggtgacaaagtggatgcggtgtacgagaagaatggctatatttattttttcaacgggcctattcagttcgagtactccatatggtccaaccggatcgtgcgggtgatgcctgctaactctatcctgtggtgctag

SEQ ID NO: 29328 - DNA, 1470 bp, Artificial Sequence
  Description of Artificial Sequence: Synthetic coding sequence
atgcatccaggagttttagcggctttcctttttctgagctggacacactgcagagcactcccactcccaagtggaggcgatgaggatgatttgagtgaggaagacctacagttcgccgagcggtatctgcgaagttactatcatcccactaatctggcgggtatccttaaggaaaacgccgcttcttctatgaccgaaaggctgcgcgaaatgcaaagcttttttggcttagaggtaacggggaagcttgatgataacacgctggatgtcatgaaaaaacctcgatgcggggtgcccgacgtaggtgagtataacgtgttccctcgcacactgaagtggtctaaaatgaatctgacctaccggatagtgaattacacccctgacatgacacacagcgaagtcgagaaagcttttaagaaggcttttaaagtctggagtgacgtgacgcccctgaacttcacacgtctgcacgacgggatagcggatatcatgatatccttcggcattaaagagcatggggatttctatccttttgacgggcctagtgggctgctcgcacacgccttccctcccggtcccaattatggaggcgacgctcactttgacgatgacgaaacttggacatcttccagtaagggatacaaccttttcctggtggccgctcacgagttcggccattctttgggactggatcattcgaaggatccaggggctctgatgttccccatttatacatacacaggcaagagtcatttcatgttgccagacgacgacgtccagggcatccagtctctgtatggacccggagacgaggaccccaacccgaaacacccaaaaacgcctgacaaatgtgacccttccctgagcctcgatgccataacttccctgcgtggagaaaccatgatctttaaagaccggtttttctggagattgcatccccagcaggtcgacgctgagttgtttctgacaaagtccttctggcctgaactgcctaaccgtatagatgccgcatatgagcatccctcccacgacctgatctttatcttccgcggtaggaaattttgggcactgaacggatatgacatcctggaaggctaccctaaaaagattagcgagctgggcttacctaaggaagttaaaaaaatcagcgcagccgtccatttcgaggataccggaaaaacactactcttctcagggaatcaggtttggcgttatgacgacaccaatcatataatggataaagattatcctcgactcatcgaggaggattttcccggaattggtgacaaggtggacgcggtgtatgagaaaaatgagagccatagtgttacccaagctggcgtgcactgtcgaaatctatctagtctgcagccgccaccacccggattcaagagattttcttgcctgagcctttggtcatcctgggactatagactttacctgttctttcagcggacccatacagtctag

SEQ ID NO: 29329 - DNA, 1152 bp, Artificial Sequence
  Description of Artificial Sequence: Synthetic coding sequence
atgcaccccggagttctcgcagccttcctatttctgtcctggactcattgtagggcactcccactgccgtctggaggcgacgaggatgacctcagtgaggaagaccttcagttcgcagaacgctacctgagaagctattatcaccctaccaatctggccggaattctgaaagaaaatgcagcgtctagcatgaccgagaggctgcgcgagatgcagagcttctttgggcttgaggtgacaggaaagctggacgacaatactttggatgtgatgaagaagccacggtgcggcgtgcctgatgtgggcgaatataatgtcttccccagaacccttaagtggtcgaaaatgaatctgacctatcgaatcgttaactacaccccagacatgacccactcagaggtggagaaggcatttaagaaagcgttcaaagtgtggagcgatgtgacgccactgaacttcacaaggctgcatgatgggatcgctgacattatgattagtttcggtatcaaggaacacggggacttctatcctttcgatggcccttcaggacttctcgctcacgccttccctccgggacctaactacggcggagacgcacattttgatgacgacgaaacctggaccagctcctctaagggatacaatttgttcctcgttgccgctcacgagttcggtcatagcctcgggttggaccactctaaagacccgggtgctttgatgtttcctatctacacatataccgggaaatctcatttcatgctgcccgatgatgatgtgcaagggattcagagcctgtacggcccaggcgacgaagatcctaatccaaagcaccccaaaactcctgataagtgcgatccatcattatccctggatgctattacctctctgcgcggagaaaccatgatcttcaaggataggttcttctggagactccacccccagcaggttgacgccgagctgtttctcacaaaaagcttctggcctgagctgcctaaccgcattgatgccgcttacgaacacccaagccacgacctgatttttattttccggggaagaaaattttgggcactgaatgggtacgacatactcgagggttaccccaagaagatcagcgagttgggtctcccgaaggaagtgaataagctgcagtag

SEQ ID NO: 29330 - DNA, 1749 bp, Artificial Sequence
  Description of Artificial Sequence: Synthetic coding sequence
atgagtccggctccgaggccaccaaggtgcctcttgctgccactcttgaccctggggactgcgctcgcttccctaggatccgcccagtcatcttcattctcccccgaggcatggcttcagcagtatggataccttccacctggagacctccggacgcatacacagaggtcgccccaaagtctttccgctgcaatcgctgccatgcagaaattctacggcctccaggtgaccggtaaggctgacgctgacactatgaaagccatgaggcggcctaggtgtggtgtgcccgataagttcggcgcagagataaaagcaaatgttaggagaaaaagatacgccattcaaggcttaaagtggcaacataatgagatcactttctgtatccagaactatacacctaaggttggcgaatatgccacttatgaggcgatccggaaagctttccgcgtatgggagagtgccactcctctcaggtttcgagaggtgccctatgcttacattagagaagggcatgaaaagcaagctgacatcatgatttttttcgctgaaggcttccatggcgactccactcccttcgacggcgagggtgggtttctggctcatgcatatttccctggtccgaatattggcggagacactcatttcgactccgcagaaccctggaccgtgaggaacgaagatcttaatggcaacgacatcttcctggtagccgtgcatgagcttggccacgccctgggcctcgagcattcgtccgatccttctgctattatggccccattctatcagtggatggacacggagaatttcgtgctgccggacgacgaccggaggggaatccagcagttgtatggcggagagagtggttttcccaccaagatgcctccccagcctagaaccactagcagaccaagcgtgcccgacaagccaaagaatcccacatatggccctaatatttgcgacggcaacttcgacactgtggcaatgctccggggagaaatgtttgtgtttaaggagcggtggttctggcgcgtcaggaataaccaggtcatggacggctaccctatgccaatcggacagttctggcggggactgcccgcttccattaatacagcctacgagagaaaggatggcaaatttgtgtttttcaaaggagataaacattgggtcttcgacgaggcttccttggaacctgggtatccaaaacacatcaaagaactgggcagaggtctccccactgataaaatcgacgctgccctgttttggatgccaaatggaaagacttatttcttcagggggaataaatactacaggttcaatgaggagctgcgtgccgtcgatagcgaatacccgaagaatatcaaggtgtgggaaggaattccagaatccccacgaggaagctttatgggctctgacgaggtgtttacctacttttacaagggaaataagtattggaagtttaataatcagaaactaaaagttgaaccgggttatccgaagtcagctctacgggactggatggggtgcccatctggcggaaggcctgatgagggcacagaagaagagacggaggtcataatcattgaagtggatgaagagggtggcggtgcggtgagcgccgctgcagtggtgcttcctgtgctcctcctgttattagtgcttgctgtcggcctcgccgtctttttcttcaggcgccacgggactcctagaagactactctattgccaaaggtccctgctagataaggtgtag

SEQ ID NO: 29331 - DNA, 2052 bp, Artificial Sequence
  Description of Artificial Sequence: Synthetic coding sequence
atggccagcggcccagggtcccaggagagggagggactgctgatcgtgaaactggaggaagactgtgcctggagtcaagaactgccacctcctgatcctggcccaagccccgaggcttctcatttgcggtttcggcgtttccggtttcaagaggccgctggccctagagaggcattgtcaaggttgcaagaactatgccatggatggctaagaccagagatgcgaacaaaggagcagattctggagttactggtattggagcagttcctgacaattcttcctcaggaaatccagtcacgggtgcaggaactccatcccgaaagtggcgaggaggctgttaccctggtcgaagacatgcaacgagagctcggccgactgcggcagcaggtgactaaccacggccgtggtacggaggtcctgctggaggagccactccccctcgaaactgccagggagtcaccgagtttcaagcttgagcctatggaaactgagaggtctccgggtcctaggttacaagaactgcttggaccgagtcctcagcgggatccacaggcagtcaaggaacgagctctgtccgccccttggctgagtctctttccccctgaaggaaacatggaggacaaagagatgactggtccacagctgcccgaatcgctagaagatgttgccatgtatatcagtcaagaggagtgggggcatcaagacccttccaagagggcgctgagcagagacactgtccaggaaagctatgaaaatgtagacagcctggaaagccacatcccatcccaagaggttccgggaacccaggtcggtcaggggggaaaactgtgggatcccagcgtgcagtcatgtaaggaaggactgagcccaaggggacccgcacccggagaggaaaagttcgaaaatctggaaggtgttccgtccgtttgtagcgagaatatccaccctcaggttttgctcccggaccaggcacgtggcgaagtgccttggtctcccgagctagggagaccacacgaccgaagtcagggcgattgggcccctccaccagaaggcggtatggaacaggccctcgctggtgctagttctggcagggaactgggccgacccaaggaactgcagcccaagaagctccacttgtgcccgctatgtggcaaaaacttttctaacaatagcaacttgatccgccatcaacggatccacgcagccgagagactttgtatgggggtggattgtacagagattttcgggggtaaccctcgcttcctaagcttgcaccgcgctcaccttggagaagaggcccacaaatgtctggaatgcggcaagtgtttctctcaaaacacccaccttacccgccaccagcgaacccatacgggcgaaaagccctatcagtgtaacatctgcggtaaatgcttttcctgtaattctaatctgcaccgacatcagcgaacgcacacgggggaaaaaccatacaagtgtccagagtgcggggaaatcttcgcacatagctccaatctgttgcgtcaccagcgtatccacaccggagagcgaccttataagtgtcccgagtgcgggaagagtttcagccgcagtagccatctcgtcatccacgaaagaacacacgaacgagaacggttatacccattcagcgaatgcggagaggctgtctccgactccaccccattcctgaccaatcatggcgcacataaggccgaaaagaaactgttcgaatgtctgacttgtggcaaatcctttcgccagggcatgcacctcacacgccatcagcgcacacatactggggagaaaccctacaaatgcacactttgtggggagaactttagccaccgaagcaatctgatccggcaccagcgaatacataccggagaaaagccctatacatgccatgaatgcggcgatagcttcagtcattcctcaaatcggattcgtcacctcagaactcacaccggcgagcggccttacaagtgctcggagtgcggagagagtttcagcagatcttccagattgatgtctcaccaacgaacacacactggctag

SEQ ID NO: 29332 - DNA, 1755 bp, Artificial Sequence
  Description of Artificial Sequence: Synthetic coding sequence
atgcaaaaatttttcggactcccccaaactggcgacctggaccagaatactattgaaacaatgaggaaaccgagatgtggcaaccctgacgtcgctaactacaacttctttcccagaaagcccaagtgggataagaaccaaattacttacagaatcattggatacacaccggacttagacccagagactgttgacgacgcctttgccagggccttccaggtctggagtgacgttactccattacgcttctccagaatccatgatggcgaggccgatataatgattaactttggcaggtgggagcacggcgatgggtatccctttgatggtaaggacggattattggcacacgcatttgctcccggaaccggtgtgggcggagactcccactttgatgatgatgaactgtggacgctaggcgaaggccaagtggtaagagtgaagtacggaaacgccgacggagagtattgtaagttcccctttttgtttaacggcaaagaatataactcgtgcaccgacacaggcagatcagacgggtttctgtggtgctccaccacgtacaacttcgaaaaagatgggaaatatggtttctgcccacatgaggccctattcactatgggcggtaatgcagagggacagccgtgtaagttcccattccgtttccaaggcacctcctatgattcctgtactactgaaggacgtacagatgggtaccgctggtgtggcaccaccgaggattacgatagagataaaaagtacgggttctgtcctgaaactgcgatgtcaaccgtcggaggcaatagtgagggcgcaccttgcgtgttccccttcacctttctggggaataagtacgagtcttgtacttcggccggtaggtctgatggaaaaatgtggtgcgctacaactgcaaactatgatgacgatagaaagtggggcttctgtcctgatcagggatactccctgttcctcgttgccgctcatgaatttggccacgctatgggtttagagcactcacaagatccgggtgcgctgatggccccaatctacacttatacaaagaactttcgactcagtcaggatgacatcaagggcatccaggagctatatggtgcgagccccgacattgacttgggtactggacccactcctacactgggccctgtgacccccgagatctgtaagcaggacatcgtgttcgatggcattgcccagatccgaggtgaaatcttcttcttcaaagaccggttcatctggcgcacagttaccccacgtgacaagccaatgggacctcttctcgtggcgaccttttggcccgaactcccagaaaagatcgatgctgtgtatgaggcccctcaggaggaaaaggcagtgttctttgccggtaatgagtattggatttattcggcttccactctggagaggggctaccctaagccactaacctccctggggctcccccctgacgttcagcgggtcgacgccgctttcaactggtccaagaacaaaaagacctatatctttgctggagacaagttctggcggtataatgaggttaaaaaaaagatggatccaggctttcctaaactaattgcagatgcatggaatgctataccagataatcttgatgcagtggttgacttgcagggtgggggacatagctatttcttcaaaggcgcttattacctgaagttagagaaccagtccctgaaatctgttaaattcggaagtattaaatccgattggctcggctgttag

SEQ ID NO: 29333 - DNA, 1434 bp, Artificial Sequence
  Description of Artificial Sequence: Synthetic coding sequence
atgaagtcactcccaatcctcctgcttctctgcgtggccgtatgtagtgcttatccacttgatggggcagctagaggagaggatacaagtatgaatttggtgcagaaatatttggaaaactactatgacctaaagaaggatgttaaacaatttgtgcgcagaaaagatagcggacctgtggtgaagaagattcgagagatgcagaagttcttagggcttgaggtcaccggaaagctcgacagcgataccctcgaagtaatgcgaaaacctagatgtggcgtccctgatgtcgggcactttcgaactttccccggtatccccaagtggagaaaaacccaccttacatatcggattgtgaactatacgccagacctgccaaaagatgcagtggactcagccgtggaaaaggctctgaaagtgtgggaggaggtcacccctctgacgttcagcagattgtacgagggtgaagctgatattatgatatccttcgcggtccgcgagcatggcgatttttaccccttcgatggcccaggcaacgtcctagcacatgcgtacgctcctggacccggtatcaacggcgatgcccattttgacgatgatgaacagtggacaaaagataccacaggaaccaaccttttcttagtagctgcccatgaaattggccattcactgggtctgtttcactcagcgaacaccgaggccctgatgtaccctctgtatcattctctgaccgatctgactcggttccggctgtcccaggatgacattaacggaattcagagcctgtacggcccaccccctgattctcctgaaacaccactggttcccacggagccagtgccaccagagccgggtacgcctgccaattgtgatccagccctgtcatttgatgccgttagtacattaagaggtgaaatcctgatcttcaaggataggcatttctggagaaaatctctgaggaagctcgagccagaattgcatctcatcagctctttctggccctcactcccttctggcgtcgatgctgcctacgaggtgactagtaaggacctggtgtttatcttcaagggcaatcagttttgggcgattcggggaaatgaagtcagagcgggttacccacgaggcattcacactctgggcttcccgcctactgtcagaaagatagacgccgcaatttccgacaaagagaaaaataaaacatattttttcgtggaggacaagtattggcggttcgatgagaagaggaatagcatggagcctggattccccaaacagattgctgaagattttcccggtatcgattctaagattgacgctgtgttcgaagagttcggattcttctattttttcacggggtctagccagctggaatttgatccgaatgctaaaaaagtcacccacaccctgaagtccaattcatggttgaactgctag

SEQ ID NO: 29334 - DNA, 804 bp, Artificial Sequence
  Description of Artificial Sequence: Synthetic coding sequence
atgagactgacagtgttgtgcgcagtgtgcctattacccggtagcctggctctcccattacctcaggaagcaggtggcatgtccgagctccagtgggagcaagcacaggattatttgaagagattttacttgtatgatagtgagacaaagaatgctaatagtcttgaagccaaactgaaagagatgcagaagttctttggcttacccattacaggcatgctgaattccagggtgatcgaaattatgcagaagccaagatgtggagtgcccgatgtggccgagtattccctcttccccaattccccaaagtggaccagcaaggtggtgacctaccggatcgtttcttacactagggacttgcctcatatcacagttgatcgcctcgtgtccaaagcccttaatatgtggggaaaagaaatccctctccattttcgtaaagttgtttgggggacggcagatatcatgatcggatttgcaagaggggcacatggagactcataccctttcgatggcccaggaaatactctggcgcacgccttcgcacctgggactgggctcggcggtgacgcccatttcgatgaagacgagagatggaccgatggaagttcccttggtataaatttcctatacgcagcaactcatgagcttgggcactccctgggaatgggtcatagcagtgatcctaacgccgtgatgtacccaacgtatggtaatggtgacccacagaatttcaagttgtcccaggatgacataaagggaatccagaaactgtatgggaaaagatcaaattccagaaagaaatag

SEQ ID NO: 29335 - DNA, 2124 bp, Artificial Sequence
  Description of Artificial Sequence: Synthetic coding sequence
atgtctctttggcagccgctagtcctcgttctactggtgctgggttgctgttttgcggcaccccgacaaagacaaagtacgctcgtactttttcctggggacctacgtacgaacctcaccgaccgtcagttggccgaggagtacctgtacagatacggctatactagagtcgctgagatgcggggtgagagtaaaagcctgggacccgctctcctattactccagaagcagctgtcactgccagagaccggggagctggacagtgccaccctgaaagctatgcgtacaccgagatgtggggttccagatctcggtagattccagacctttgagggagacctgaagtggcatcaccacaatattacttattggatacagaactacagcgaagacctgcccagggccgtgattgacgatgcattcgcgagggccttcgccctgtggagtgcagtgactcctctcactttcacccgggtgtactccagagacgcggatattgtgatccaatttggagtggccgaacatggggatggttatccctttgacggcaaggatggcctgttggcacacgctttcccgcctggccctggcatacagggtgatgctcactttgatgatgatgagctgtggagtctgggcaagggcgtggtagtgccgactcggtttggcaacgctgatggcgcagcttgtcacttccccttcatcttcgaaggccgttcgtacagcgcctgcaccactgatgggaggagtgacggtttgccatggtgcagcacgacagccaactacgataccgacgatagattcgggttttgtcccagcgaacgattgtacactcaggacgggaacgccgatggaaagccatgtcaatttccgtttattttccagggtcagagctattcagcttgcactacagatggccgaagcgacggctatcgctggtgcgccacaaccgctaactacgaccgagataagctttttggcttctgccctaccagggcggacagtactgtgatggggggaaattccgccggtgaattatgcgtgtttccgttcaccttccttggtaaggaatacagcacttgtacgtccgaggggagaggagacgggagattatggtgcgcaacgacctcaaatttcgattcagataagaagtggggcttctgccccgatcaggggtacagccttttcctggttgctgcgcacgagttcggacacgccctgggtctggaccattcatccgttccagaggcccttatgtacccaatgtatcggttcacggaggggcctccattgcacaaagatgacgtcaacggcatacggcatctctacgggcctaggcctgaaccagagcctcggcctcccactacgaccacaccccagccaaccgctccgccaactgtttgcccaaccgggccaccaactgttcatccctctgaaagacctaccgctgggcctacggggccaccatctgccggaccaaccggccctcccacagccggacccagcaccgcaaccacagtgcccttgtcaccagtcgacgacgcctgcaacgtcaatatttttgatgccattgctgaaattggaaatcagctttacctctttaaggatggaaaatattggcggttctccgagggtagggggagccgccctcagggaccattcttgatagccgataagtggcctgccctcccgaggaaacttgactctgtgttcgaagagaggttgagcaagaagctgttctttttttccggccgtcaggtttgggtctacaccggcgcttcagtcctgggcccacgtcggcttgacaaactgggattaggggcagacgtggcccaagtcaccggagcgttgcgatcaggcagaggcaaaatgctgctgttctctggcagaaggttgtggcgattcgatgtgaaagcccaaatggtggacccgaggagcgctagcgaagtagacagaatgttccctggagtgcccctggatactcacgatgtgttccagtacagagagaaggcatacttttgccaagaccggttttactggagggtaagttctcgatccgagctgaaccaggtcgatcaagtcggctacgtgacatacgacattctccaatgtcccgaggactag

SEQ ID NO: 29336 - DNA, 834 bp, Artificial Sequence
  Description of Artificial Sequence: Synthetic coding sequence
atgggaggtaactccgccggagagctatgtgtctttccttttaccttcctcggtaaagagtactctaacttcgatagtgataagaagtgggggttctgcccggaccaaggttattcgctttttctcgtggccgctcacgaattcgggcacgccctgggactggaccacagtagcgttcccgaggcacttatgtaccccatgtaccgatttaccgagggcccaccactgcacaaagacgatgttaacgggatcagacatttgtatggccctcggcctgagcccgaaccaaggcccccaacaaccacaaccccgcagcctactgcgccacccactgtgtgcccaacaggcccaccaaccgttcatccccctttcctgatcgcagacaagtggcctgctcttccccgtaagctggattccgtgttcgaggaaagactgagcaagaagcttttctttttttctggtcggcaggtttgggtttacacaggtgccagcgtgttaggtccgaggagattggataagctgggactgggcgctgacgtcgcccaggtgacaggggctctcagaagcggacgcggaaagatgctgctctttagtggcagacggctgtggcgatttgatgtgaaagcccagatggtggacccgaggtctgcttctgaggtggacaggatgttccccggagtcccactggatacacacgacgtgtttcagtatcgtgaaaaggcctatttctgccaagaccgattctattggagagtaagtagcagatccgaactgaaccaggtcgaccaggtggggtacgtgacctacgatatcctacagtgcccagaggattag

SEQ ID NO: 29337 - DNA, 324 bp, Artificial Sequence
  Description of Artificial Sequence: Synthetic coding sequence
atggccggagaggacgtgggagcccctccggatcatctttgggtgcatcaagaggggatctacagggatgagtaccagaggacatgggtggcagttgtggaagaagagacctcgtttctccgagccagagttcagcaaatccaggtgcctttgggcgacgctgccaggccctcccatctgctcaccagccagcttcctctgatgtggcagctttacccggaagaaagatatatggataacaactcgagactgtggcagatccagcaccatttgatggtacgtggggtccaggaattactcctgaagctgctgcctgatgactag

SEQ ID NO: 29338 - DNA, 324 bp, Artificial Sequence
  Description of Artificial Sequence: Synthetic coding sequence
atggctggcgaagacgtgggcgctcctcctgaccacctgtgggtacaccaagaaggtatttatagggatgagtaccagaggacctgggttgccgttgtcgaggaggagacctctttcctacgggctcgcgtgcaacagattcaggtgcctcttggagatgccgctcggcctagtcaccttctgactagccaattgcctctgatgtggcagctgtatcctgaggagaggtacatggacaacaactctcggttgtggcagatccagcatcacctgatggtacgcggagtgcaggagctattacttaagttactccctgacgattag

SEQ ID NO: 29339 - DNA, 1329 bp, Artificial Sequence
  Description of Artificial Sequence: Synthetic coding sequence
atggtgcgttcacgccagatgtgtaataccaatatgtctgtcccgacggatggcgcagtcaccacttctcagatccctgccagcgaacaggaaactctggtgcgcccaaagcccctactcttaaaactgctgaagtctgttggagcacagaaggatacgtacactatgaaagaggtactgttctacctaggccagtatatcatgaccaaaagattgtacgacgagaagcaacagcatatcgtgtattgttccaatgatctgctgggggatctcttcggtgttccctccttttcagttaaggagcatcggaaaatttacaccatgatttataggaacctggtcgtagtcaaccagcaggaggaaaacagcgatgaactaagtggtgagaggcagcggaaacgtcataagagtgactctatcagtctgtcattcgacgaaagcctggcactctgcgtgatccgcgaaatctgctgcgagaggtcatcatctagcgaaagcacgggaacaccgagcaatcctgacctcgacgccggagtctcggagcactctggcgactggttggaccaagactctgtgagcgaccagttcagcgtcgaatttgaggtggagagtctggactccgaagattatagtctgtctgaggaggggcaggaactgagcgatgaagatgatgaagtgtatcaagtgaccgtttaccaagctggcgaatctgatacagactcattcgaagaggaccccgaaatttccctggccgactactggaaatgcactagttgtaatgagatgaaccctccgctcccatcacactgcaataggtgttgggccctccgggagaattggctcccagaggacaaggggaaggacaaaggcgagatctctgaaaaggcaaaattggagaattcaacccaggcagaggagggttttgatgtgcccgattgcaagaagactatcgtcaatgactcaagagaaagttgcgtagaagagaacgatgataagatcactcaggcctctcaatcccaggaaagcgaggattattcacagccctctacgtcatcctcaatcatctattcgtcgcaggaggacgtcaaggagtttgagagggaggagacacaagataaggaggaaagtgtcgaatcctccttacctctcaacgctattgagccatgtgtcatctgccaggggaggcccaagaacgggtgtatcgtgcatggaaagaccggccatctgatggcctgcttcacatgtgccaagaaactaaagaagcgcaacaaaccatgtccagtatgcaggcagcccatccaaatgatagtgctgacatattttccgtag

SEQ ID NO: 29340 - DNA, 1311 bp, Artificial Sequence
  Description of Artificial Sequence: Synthetic coding sequence
atgtgtaacacaaacatgagcgtgcctaccgatggcgctgtcacaactagtcaaatccccgcaagtgaacaggaaaccctggtgcgcccaaaacccctgctgctcaaattgctgaagagtgtcggggcacagaaagatacgtacacgatgaaagaggtgttattctatcttggacagtacattatgaccaaacgtctatacgatgaaaaacagcaacatatcgtgtactgtagcaacgacctcctgggagacctttttggcgttcccagtttctccgttaaagagcatcggaagatttacactatgatttatcgtaacttggtggtcgttaatcaacaggaagaaaatagcgatgagctctctggggaacgacagcggaaaagacataaaagcgactccatatccctttcctttgatgagagtttagcactgtgcgtgattagagagatctgttgtgagagaagctcgtctagcgaatctaccggcactccaagtaatccggacctggatgcaggcgtgagtgagcacagtggagactggttggatcaggatagcgtcagtgaccaattctccgtagaatttgaggttgagtcactcgattcagaggactatagtctttccgaagagggccaggaactttcagacgaggatgacgaggtgtaccaggttaccgtgtatcaggccggtgagagcgacactgactccttcgaggaagaccccgaaatctccctcgccgactactggaaatgcacgagttgcaacgagatgaacccaccgctgccctcacattgtaaccgttgctgggctctgcgtgaaaactggctgcctgaagacaaaggtaaagacaagggagagatttcagagaaagcaaagctcgaaaactctacccaagctgaggaggggttcgatgtacctgattgcaagaagacaatagtgaatgactctcgggagagctgtgtagaagagaatgacgataagattactcaagcgtcccagagccaggaaagtgaagactatagtcagcctagcacaagttctagtataatttacagtagccaggaggatgtgaaagaatttgaacgggaagaaacacaggacaaggaagaatccgtcgagtcttctctgcccctaaacgctatcgaaccctgcgtgatttgccagggacgccctaaaaatggatgtatagtgcacgggaaaacagggcacctcatggcttgttttacatgcgcaaaaaagttgaagaaaaggaataagccatgccctgtgtgcaggcaaccaatccagatgatagtcctgacctacttcccatag

SEQ ID NO: 29341 - DNA, 966 bp, Artificial Sequence
  Description of Artificial Sequence: Synthetic coding sequence
atgtgcaacacaaatatgagcgtgcccacagatggtgctgtcaccacttctcagattcccgcaagcgagcaagaaaccctggtgcgcccaaaacctctgctgctgaagctgttgaagtcagtaggcgcacagaaagacacttataccatgaaagaggatctggatgcaggagtttcagagcactccggagactggctggatcaggattctgttagcgaccaatttagcgtagagttcgaagtcgaatctttggactccgaggattattctctttccgaagagggccaagaattaagcgacgaggatgatgaagtctatcaggttactgtttatcaagcaggagagagcgacaccgattcattcgaagaggaccctgagatttcactggcagattactggaaatgcacctcctgcaatgaaatgaaccctccactgccaagtcactgcaaccggtgctgggccctcagggaaaactggcttccagaagacaagggcaaggacaaaggcgaaatctccgaaaaagctaaactagagaacagcacacaggcggaagaggggtttgatgtcccagattgtaagaaaaccatcgtgaacgattcaagggagagttgcgtcgaagagaacgacgacaagataactcaggcatcgcaaagtcaggagtcggaagactattcccaaccgagtacgagttcttctatcatttactcatctcaggaggacgtgaaggagtttgagcgcgaggagacacaagacaaagaggaatccgtagagtccagtctacccctgaacgctatcgagccttgtgtgatctgtcagggacgcccaaaaaatggttgtatcgttcacgggaagactggacacctgatggcttgtttcacctgcgccaaaaaactgaaaaagaggaacaagccttgtcccgtgtgtcgccagcctatccagatgatcgtgttaacctattttccatag

SEQ ID NO: 29342 - DNA, 1359 bp, Artificial Sequence
  Description of Artificial Sequence: Synthetic coding sequence
atggtgcggtctcgacaaatgtgcaataccaacatgagcgtaccgactgacggtgcagtaacaactagccagatccctgctagcgagcaagagaccttggtgcgtcctaaacccctgttactcaagctgttgaaatctgtgggggctcaaaaggacacatatacgatgaaagaaaagatttacaccatgatctatagaaatctggtagtcgtgaatcaacaagaatcatctgacagcgggaccagcgtgagcgaaaacagatgccatctggagggcggaagcgatcagaaagatttggtgcaggaactccaagaggagaaacccagcagttcccaccttgtgtcaagaccttccacatcctctcgacgaagagctatatctgaaacggaggagaattccgacgagttatcaggcgagaggcagcggaaacgccacaaatccgacagcatctcgctgtccttcgacgaatccctggcactctgtgtcatccgggaaatctgttgtgagcgttcatcttcatccgagtcaaccgggacacccagcaatcccgacctggacgcaggtgtgtctgagcattccggggattggctggaccaggactctgtcagcgaccagttcagtgttgagttcgaagtagaatcacttgattccgaggattacagcttaagtgaagagggacaggaattatctgacgaggatgacgaagtgtatcaggtcacagtttaccaagctggcgaatcggacacggattcgtttgaagaggatcccgagatctctctggcggactattggaagtgtacgagttgcaatgaaatgaatccacctcttcctagtcattgcaatcggtgctgggcactgagagaaaattggctgcctgaggacaagggaaaggacaagggtgaaatttctgaaaaggcaaagctcgaaaacagcacacaggctgaagagggttttgatgtccccgattgcaaaaaaactatagtcaacgattcaagagaaagttgtgttgaagagaatgatgataagattacccaggcgagccagtcccaagagtccgaggattacagtcagccctcgacctctagtagcattatttattcatcccaggaggatgtgaaagagtttgagagagaggaaactcaggacaaagaggagagcgtggaatcctcactcccactcaatgccatcgagccctgcgtgatttgtcagggtcgacccaaaaatgggtgtattgttcatggcaaaaccggacatctgatggcgtgcttcacatgcgccaagaagttaaagaagcgaaacaaaccctgccccgtttgtcggcagccaattcaaatgattgtcctcacttactttccctag

SEQ ID NO: 29343 - DNA, 771 bp, Artificial Sequence
  Description of Artificial Sequence: Synthetic coding sequence
atgtgcaacactaatatgtctgttccaacagacggcgctgtcacaaccagtcagatacctgccagcgagcaagaaaccctcgtccgccctaaacctttattactcaagcttctgaagtcagtcggcgcacagaaggacacctacaccatgaaggaagtgctattctatctcgggcaatacataatgacaaaaaggctctatgatgagaagcaacagcacatagtgtattgtagcaacgatctgctaggcgacctcttcggggtgccctcgttttccgttaaggagcaccgaaaaatctacacaatgatttacagaaacctcgttgtggttaatcagcaagaaagcagtgattccggtacctcagtgagcgagaaccgctgtcacttagagggtggcagtgatcagaaggatttggttcaagagctccaggaggaaaaacccagctcttcccatcttgtaagccgaccttccacatcaagcagaaggcgagctattagcgaaacggaggaaaactccgatgagctgtctggcgagagacaacgtaaacggcacaagagtgacagcatcagtttgagcttcgatgagtccttggccctttgtgtgatcagagaaatatgttgtgaacgatcatcctcctctgagtctacaggcaccccctctaaccctgatctcttgctgggagtgtatcaggtcacagtttaccaggctggggaatcagatactgattctttcgaagaagatcctgagatctctcttgcccactacctgtag

SEQ ID NO: 29344 - DNA, 798 bp, Artificial Sequence
  Description of Artificial Sequence: Synthetic coding sequence
atgagcgtgccaacggatggagccgtcaccacttctcagataccggcttctgaacaggagacactggacctcgatgcaggggtatctgagcacagtggtgattggcttgaccaggactccgtctctgaccagttctccgtggaatttgaggtcgaaagcctggattcggaagactacagcttgtcagaagagggacaggaactctccgatgaggacgacgaagactattggaagtgtactagctgcaacgagatgaacccccctttgcctagccattgcaatagatgttgggcactgcgcgaaaactggctgcccgaagataaaggcaaggataaaggggagataagcgaaaaagctaagctggaaaattccactcaggccgaggaggggtttgacgttcccgactgcaagaaaacaatcgtgaatgattcacgcgaaagttgtgtggaggagaacgatgataaaatcacccaagcatcccaaagccaggaaagtgaagattacagtcaaccctcgacttcaagctcgatcatttatagcagccaggaggatgtaaaagagtttgagcgggaggaaactcaggataaggaagagtctgtggaaagcagcctgcctttgaatgccatcgagccctgtgtcatatgtcagggcagacccaagaacggatgtatcgtgcacgggaagactggccaccttatggcctgctttacttgcgcaaaaaaactgaaaaagcggaataagccctgccccgtgtgcaggcaaccgattcagatgattgtgctgacctactttccttag

SEQ ID NO: 29345 - DNA, 1401 bp, Artificial Sequence
  Description of Artificial Sequence: Synthetic coding sequence
atgtgtaataccaatatgtcagtgcctactgatggtgccgtgaccacatctcaaatccctgcatcagaacaggaaacacttgttctgttttacctgggacagtatattatgaccaaaagactgtatgatgagaaacagcagcacatagtgtactgttccaatgatcttctcggcgacctttttggggtgccgagctttagtgtgaaggaacatcgcaaaatttataccatgatttaccgcaacttggtggtggtgaaccagcaggagtcatcagattctggaacctccgtttccgagaataggtgccatctcgaaggaggctctgaccaaaaagatcttgtacaggagctccaggaggagaaaccctcttcgtcccacctggtctctaggcccagcacatcgagcaggcggagggccattagtgaaaccgaggaaaactctgacgagctctctggcgagagacagaggaagaggcataagtcggattccatctccttgtcattcgacgaaagtctggcgttatgtgtcattcgcgagatctgttgcgagcggtcttccagctccgagtcgaccggaacaccttctaatccagacttagatgctggtgtttccgaacactcaggggattggcttgaccaagacagtgtctcagaccagttctccgtcgaatttgaggtggagagtctggacagcgaggactactccctgagcgaggagggccaggaactcagcgatgaagatgacgaggtctaccaggtgaccgtgtaccaggccggagagtctgacaccgattcgttcgaagaggacccagaaatcagcctcgctgattactggaagtgtacatcttgtaacgagatgaaccctcctctgccttcccactgcaacaggtgctgggccctacgggagaattggcttccagaggacaagggaaaagacaaaggggaaatctcagagaaggcgaagctggaaaacagcacacaggcagaagaggggtttgatgtacccgattgcaaaaaaactattgtcaacgatagccgcgaaagctgtgtcgaggagaatgacgacaagataacacaggcctctcagagccaggaatctgaggattatagtcaaccctccacgtcatcatctatcatctatagcagtcaagaggatgtaaaggaatttgaacgtgaagaaactcaggataaagaagagtcagtggaatcctctctgcctcttaacgccatagagccctgcgtgatttgccagggtcggccaaaaaacggctgtattgtgcacgggaaaacagggcatctaatggcatgctttacatgcgcaaaaaagttgaagaaacggaacaaaccctgtcccgtctgtaggcagcctatacagatgatcgttcttacgtatttcccctag

SEQ ID NO: 29346 - DNA, 966 bp, Artificial Sequence
  Description of Artificial Sequence: Synthetic coding sequence
atgtgcaacaccaacatgtctgtccccactgacggagctgtaacaacttcgcagatccccgcttctgagcaggaaaccctggtgcgccctaagccgctgctgttaaagcttctcaaaagtgttggggcacaaaaggacacctataccatgaaggaggatctggatgctggcgtttcagaacacagtggagattggttggaccaagactcggtgagcgaccagtttagcgtggaattcgaggtggaaagcctggattctgaggactactctctgagcgaggagggccaagagctttcggacgaagatgacgaggtataccaggtgacggtgtatcaggctggtgaatccgatactgattctttcgaggaggaccctgaaatcagtctggccgactactggaagtgtacctcttgcaacgaaatgaaccccccactgccttcccattgcaataggtgttgggccttgcgtgagaattggctcccagaagataaaggaaaggataaaggtgaaatctccgaaaaagccaagctggagaactcgacacaggcagaagagggatttgacgttcctgattgcaagaagacaatcgtcaatgactctcgcgagagctgcgtggaagaaaacgacgacaaaatcacccaggccagccagtcacaggagtccgaagattacagtcagccttccacgtcctcctcgatcatttactcctctcaggaggatgtcaaagagttcgagcgcgaagagacacaggacaaagaagaatcagtggagagctccctcccactgaatgctatagagccatgtgtcatctgtcaaggcaggccgaagaacggttgtattgtgcatggcaaaacaggccatctcatggcctgcttcacttgtgccaaaaagttaaagaagcgtaataagccatgccccgtgtgtagacaacccatacagatgatcgtcctgacctatttcccatag

SEQ ID NO: 29347 - DNA, 480 bp, Artificial Sequence
  Description of Artificial Sequence: Synthetic coding sequence
atgtgtaacacgaatatgtccgtaccaaccgacggcgctgtaaccacttctcaaatccctgcctcagagcaggagaccctggtcaggcctaagcctctgcttctcaaactcttaaagtctgtgggggcacagaaggatacatacaccatgaaagaggacctcgacgccggtgtgagcgaacattcaggtgattggctggatcaggactctgtgtccgaccaattttcagtcgaatttgaagtggagagcctcgatagcgaggattattcactgagtgaggaaggacaagaactttcagacgaggacgatgaagtgtaccaggtcacagtgtaccaggcaggcgagtcagacaccgattctttcgaagaagacccagagatttctcttgccgattattggaaatgcctgaagaaaagaaataaaccttgcccagtctgtcggcagccaatacagatgattgttctgacatacttcccttag

SEQ ID NO: 29348 - DNA, 891 bp, Artificial Sequence
  Description of Artificial Sequence: Synthetic coding sequence
atgtgcaacactaatatgagcgtccccacagatggagctgtgacaacctcccaaatcccagcgtcagaacaggaaaccctcgatcttgacgccggagtctccgagcacagtggcgattggttggatcaggatagcgtgagtgaccaattttcagtggagtttgaggtggaatcactggattcagaggactattctctgtcagaggaggggcaagagctatcagatgaggacgacgaggtgtaccaagtgacggtgtaccaggcaggtgagtcggataccgacagttttgaggaggatccagagatctctctcgcagattattggaagtgtacaagctgtaacgaaatgaacccccctctcccaagtcactgtaacaggtgctgggccctgcgcgagaactggctgccagaggataaaggtaaagacaagggggaaatatctgaaaaagcaaagctcgaaaactccacccaagccgaagaagggttcgacgtcccagactgcaaaaagacaattgttaacgattcaagagaatcgtgcgtagaggagaatgatgacaagatcacgcaggcctcacaatcccaagagagcgaggactactctcagccatctacgtccagctctataatttactcaagccaggaggacgtcaaagaatttgagagagaggaaactcaggataaggaagaatcggtggaaagcagcctgccccttaacgcaatagagccttgcgtcatttgtcagggtaggcccaaaaacggatgtatcgtccacggcaagactggtcatcttatggcttgttttacttgtgctaaaaagctcaaaaagcggaataagccatgtcccgtctgccgccaaccaattcagatgatcgtcctgacctactttccatag

SEQ ID NO: 29349 - DNA, 732 bp, Artificial Sequence
  Description of Artificial Sequence: Synthetic coding sequence
atgtgcaacaccaacatgagcgttcccaccgacggagccgtgactacctcgcagattccagcaagtgagcaggagacgcttgtccgacctaaacctttattgctgaagctcctgaagtccgtgggtgcccagaaggatacgtacacaatgaaggaagactactggaagtgcacgtcctgcaatgaaatgaacccccctctgccaagtcactgtaaccgttgttgggcactcagggagaactggctgccagaagacaaggggaaggataaaggagagatttcagaaaaggcaaaattagagaattcgacgcaagcagaggaaggattcgacgtgcctgattgtaaaaagacaatcgtgaacgattcgagagagtcctgcgtggaagagaatgatgacaagatcacccaggcttcacagtcccaggagtccgaggactactcccaaccctctaccagttcgtcaattatatattcttcccaggaggacgtgaaagaattcgagcgtgaagagactcaggacaaagaggagagcgtcgaaagctctctgccactaaacgccatcgagccttgtgtgatttgtcagggcagacctaagaacgggtgcatcgttcacgggaaaacaggccaccttatggcctgctttacttgcgctaagaagctgaagaaacgaaacaagccgtgtcccgtctgcagacaaccgatccagatgatcgtgttaacctactttccttag

SEQ ID NO: 29350 - DNA, 657 bp, Artificial Sequence
  Description of Artificial Sequence: Synthetic coding sequence
atgtgtaatacaaatatgtctgtgcccaccgacggtgccgtgaccaccagtcagattcctgcttcagaacaggagacactggactattggaaatgtacctcatgcaacgaaatgaatccacccttgcctagccactgtaatcggtgctgggctctgagggaaaactggcttcccgaggacaaaggtaaggacaagggtgagatttctgagaaggctaaactggagaactccactcaggctgaggaaggcttcgacgttccagactgcaagaagaccatcgtgaacgacagtcgagagtcctgcgttgaggagaatgatgacaaaatcactcaggcttcccagagtcaggagtccgaggattactcacagcccagcacttccagctcaatcatatactcttctcaggaggatgtgaaagagtttgagcgtgaggagacccaggataaggaagagagcgtcgaatccagcctgcccctgaacgccattgaaccatgtgttatctgtcaggggaggccaaagaatggttgtatagtgcacgggaaaaccggtcacctgatggcttgtttcacttgtgccaaaaagctgaagaaaaggaacaaaccatgccctgtctgccggcagccgatacagatgatcgtgttgacttacttcccctag

SEQ ID NO: 29351 - DNA, 657 bp, Artificial Sequence
  Description of Artificial Sequence: Synthetic coding sequence
atgtgtaatactaacatgtcagtgcctaccgatggagccgtgacaacgtcccaaatccctgccagtgaacaggagacactcgactattggaagtgtaccagttgtaacgaaatgaatcccccactcccatctcattgtaacagatgctgggcattgcgcgaaaactggttgcctgaagacaagggaaaggataagggggagattagcgagaaggctaagcttgaaaacagcactcaggcagaggagggctttgatgtacccgactgcaaaaagaccatcgtcaacgacagtagagagtcctgcgtcgaggaaaacgatgataagataactcaggcatcccagtcccaggagtcggaggactattctcaaccaagtacttccagttctattatttacagctcacaggaggatgtcaaagaattcgaaagagaagagacccaggataaagaggagagtgttgaatcctcgctgcccctgaacgccatcgaaccctgcgtcatttgtcaaggtcgaccaaagaatggttgtattgtgcacggaaaaaccggacacttgatggcttgcttcacctgtgcaaagaaactaaagaagcggaacaagccttgccctgtgtgccgccagcctattcagatgatcgtgctgacatacttcccctag

SEQ ID NO: 29352 - DNA, 771 bp, Artificial Sequence
  Description of Artificial Sequence: Synthetic coding sequence
atgtgtaatacaaatatgagcgtgcctactgatggagctgtaacgacctctcaaatccccgcttcagagcaggagacactggtgcggccaaagcctctgctgctgaagctgctaaagagtgtgggcgctcaaaaggacacttacacaatgaaagaggttctgttctatctggggcagtatatcatgaccaagagactctacgatgaaaaacagcagcatattgtgtactgttccaacgatctgctgggcgacctttttggcgtgcctagctttagcgtgaaagagcacaggaaaatctacaccatgatctaccgtaacttggtggtcgttaatcaacaggagagctcagattctggaacaagcgtctctgagaatcggtgtcacctcgagggtgggtcggatcaaaaagacctagtccaagagctgcaggaagagaaaccctcatctagtcatctcgtttcgagaccctcaacaagctcaaggcgcagggcaattagcgaaactgaggagaacagtgatgagttgtccggagaaaggcagaggaagcggcataagtctgatagcatatcattgtctttcgatgagagtttggcgctttgtgttatccgggaaatctgttgtgagcggtcatccagttcagaatccacaggcaccccatcaaaccctgacctagacgctggagtttatcaagtgacagtgtaccaagctggcgagtcggatacagattccttcgaggaggaccctgaaatcagcctcgctgattactggtag

SEQ ID NO: 29353 - DNA, 813 bp, Artificial Sequence
  Description of Artificial Sequence: Synthetic coding sequence
atgtgcaacaccaacatgtcagtgccaacagatggtgccgtgactacctcccagatccctgcgagcgaacaggaaacactggatctggatgccggtgtctccgagcactcaggggattggctggatcaggactcggttagcgatcagttttccgtggagttcgaggtggagtcgttggatagcgaagattattctttaagcgaggagggacaggaactgtcggacgaggatgacgaggattattggaagtgtacatcctgtaacgagatgaatcctcctcttcctagtcactgtaaccggtgctgggcactcagggaaaactggctgccggaggataaggggaaggataagggcgagatttccgagaaggccaagttggaaaattcaacacaggcggaagagggattcgacgtgccagactgtaagaaaaccattgtcaacgatagccgggagtcttgcgttgaagagaacgatgataagattactcaggcctcccagtcacaggagtctgaagactattctcagcccagcactagcagcagcattatctatagtagtcaggaggacgtaaaagagttcgaacgtgaggagacccaggataaggaggagagcgtagaaagttctctccctttaaacgccattgagccctgtgtgatttgtcaaggtagaccgaagaatggctgtatagtgcatgggaaaactggccaccttatggcttgttttacctgcgcgaaaaagctgaagaagagaaacaagccctgccctgtgtgtagacagcccattcagatgattgtcctgacctactttccatag

SEQ ID NO: 29354 - DNA, 1494 bp, Artificial Sequence
  Description of Artificial Sequence: Synthetic coding sequence
atggttcgtagtcggcagatgtgtaacactaatatgtccgtccccactgacggtgcagtgacgacctcgcagattccggcaagtgagcaagagacattggtccggcctaagcctcttcttcttaaactcttgaagagcgttggggcacagaaagacacatacacaatgaaagaggtgctgttttacctagggcaatatatcatgaccaagcggctgtacgatgagaagcaacagcatattgtttattgctccaatgatctgctaggggacctctttggtgtgcctagtttctctgtgaaggagcacagaaaaatatacaccatgatctaccgcaatctggtagtggttaatcaacaggagtccagtgacagtggtacatccgttagcgagaatagatgtcacttggaagggggaagtgaccagaaggatctcgtccaggaactacaagaggagaagccgtcctcgagtcatcttgttagcagaccaagcaccagcagtcgcagacgtgccatcagcgagacagaagagaacagtgacgaattaagcggggagcggcaaaggaaacggcacaaaagcgactcaatcagtctgtcttttgatgaatctcttgccctgtgcgtaatcagagagatttgttgcgagcgctctagttcttcagaaagcacgggcaccccaagtaatcctgatctcgatgcaggcgttagtgagcactccggggattggctggaccaggattctgtatccgatcagttctcggtggagtttgaggtggagtccctagactccgaagattattcactatcagaggagggacaggaactcagtgatgaagacgacgaagtttaccaagtgactgtataccaagcgggtgagtccgacacagattctttcgaagaagatcccgaaatttcactggcagattattggaagtgtacttcatgtaacgaaatgaacccacccctcccctctcattgcaaccgttgttgggcactaagggagaactggttgccagaggacaagggcaaagataagggagagatctcagaaaaggctaagttagagaattccacacaggccgaggaagggttcgacgtacccgactgcaagaaaacaatcgtgaatgactctcgtgaaagctgcgttgaggagaatgacgacaagattacccaggcttcccaatcccaggagtcagaggactattctcagccctctacaagctcatccattatatatagttctcaggaagacgtgaaagaattcgagcgagaagagacacaggataaggaagagagcgtagagtcgtccctacctctgaacgccatagaaccgtgtgttatctgtcaaggacgccctaaaaatggatgtatcgtccacggaaaaacagggcacctgatggcctgtttcacctgcgcaaagaaattgaaaaagcgcaacaaaccatgccctgtgtgccggcagccaatccaaatgatcgtacttacctactttccatag

SEQ ID NO: 29355 - DNA, 393 bp, Artificial Sequence
  Description of Artificial Sequence: Synthetic coding sequence
atgtgcaacaccaatatgagcgtgcccactgatggcgcagtaaccacatcacagattcccgcaagcgagcaagagaccctggtgcgcccaaagcctttgcttcttaaattactgaagtcagtgggggctcagaaggacacatatactatgaaggagttcgagagggaggaaacccaggataaggaggaatcagtggagtcgagtctgccccttaacgctattgagccatgcgttatctgtcagggtcggcctaaaaacggctgcatagtacacggcaagacagggcatttgatggcttgcttcacatgtgcgaaaaagctgaaaaagcgcaataaaccttgccctgtgtgccgccaacccatccagatgatagtactcacatacttcccctag

SEQ ID NO: 29356 - DNA, 774 bp, Artificial Sequence
  Description of Artificial Sequence: Synthetic coding sequence
atgtgtaataccaatatgagcgtgccaacggacggtgcggtcaccacgagtcagatccccgcatccgaacaggagactctcgtacgtccaaaaccgctgcttttgaaattgcttaaatcggtgggggcacagaaggatacatacaccatgaaggaggtgcttttctatttgggtcagtatatcatgactaaacgtctttatgatgaaaagcaacagcacattgtttattgctcaaatgatttacttggggatctgttcggagtgccaagtttcagcgtaaaagagcatcgcaaaatctacacgatgatctaccgtaatctggtggttgtgaaccagcaggagtcatcagactctggcaccagcgttagcgagaacaggtgccacctggagggcggatcagaccagaaggacttggtgcaggaactccaggaggaaaagcccagctcctcgcacctggtttcacgcccatccacttcctcccgcagacgcgcaatcagtgagacggaggagaactctgatgagttatcaggtgaaaggcagcgaaagaggcataagagtgattctatttcactctcctttgacgaatccttagctttatgtgtgatccgggagatttgttgtgaacgctcctcatccagtgaatctaccggaaccccgagcaaccctgacctcgacgctggagtgagtgaacactctggagattggctggatcaggattctgttagcgatcagttctccgtggagttcgaggtggagtccctggatagtgagtag

SEQ ID NO: 29357 - DNA, 891 bp, Artificial Sequence
  Description of Artificial Sequence: Synthetic coding sequence
atgtgcaatacgaacatgagcgtccctacagatggcgcagtgacgacctctcaaatccctgccagcgaacaggaaacactggacctggacgccggagtgtccgagcactctggcgattggctggaccaggactccgtcagtgatcagttcagcgtcgagttcgaagtagaaagtcttgactctgaagattactctctgtctgaggagggacaggagctgtcagatgaagatgatgaggtgtatcaggtgactgtttaccaagcaggcgaatccgacaccgactccttcgaagaggatcccgaaatatctctcgccgactactggaaatgtacctcatgtaacgaaatgaaccccccactgccaagccactgtaacaggtgttgggctttgcgggaaaactggctgcctgaggacaagggtaaagataagggcgagatatcggagaaagctaagttggagaactctacacaggcggaggagggatttgatgtgcccgattgcaagaagactattgtaaatgattcacgcgaaagctgcgtggaagagaatgatgacaagatcacccaagcttcacaatcccaggaatctgaggattacagccaaccgtctactagtagctctatcatttattcaagtcaggaggacgtgaaagagttcgaacgggaagaaacccaagacaaggaggaatctgtggagagctctctcccccttaacgcaattgagccatgcgtcatttgtcagggacgacctaagaacggttgcattgtgcatggaaagaccggacatctcatggcatgcttcacctgcgcaaaaaagctcaaaaagcggaacaaaccctgtccagtctgcagacagccaatccagatgattgtgctcacctattttccttag

SEQ ID NO: 29358 - DNA, 1341 bp, Artificial Sequence
  Description of Artificial Sequence: Synthetic coding sequence
atgtgcaacacaaacatgagcgtgcccactgacggcgctgtcacaacttctcagatcccggcatccgagcaggaaacgctcgtgagacccaagcccttgttgctgaagttgttgaaaagcgtcggcgctcaaaaggacacgtataccatgaaagagaagatttacacaatgatttaccggaacctggtggtggttaaccagcaagaatcaagtgattcagggacatctgtatccgagaatagatgccatctggagggcggttctgatcagaaggatctggtgcaggaactgcaggaagaaaaaccatcttcctcacacctcgtgtcgcgaccctctacgtctagcaggcgtcgcgctatctccgaaacggaagagaacagtgacgagctcagcggagaaaggcagcgcaagcgccacaagagcgacagtatctccctgtctttcgacgagtccctggcgctctgtgttatccgcgagatttgttgtgagaggtcaagttctagcgaatcaaccgggactcctagtaatccggacctcgacgcgggagtgagcgaacactcaggtgactggctggaccaggactctgtgagcgaccaattttctgtggaattcgaggtggaaagcctagactcagaggactactcactgtccgaagagggacaggagctgagcgatgaggacgatgaagtttatcaggtgacggtgtatcaggccggagaaagcgatacggatagcttcgaggaggatcctgagataagcttagcagactattggaaatgtacgagctgtaatgagatgaatcccccacttcctagccattgcaatcggtgttgggccctgcgtgaaaactggctgcccgaggacaaaggcaaagacaagggcgagatcagtgagaaagctaagttggaaaattcaactcaggccgaagaagggttcgacgtaccagattgtaagaagaccatcgtaaacgattcccgagaaagctgtgtggaggaaaacgacgataaaatcacgcaggcgtcacagtctcaagaatcggaggactactcccaaccctccacgtcctccagcatcatctacagctcgcaggaggacgtcaaagagttcgaaagagaggagacacaagacaaagaagaatccgtggaatcatccctgccactgaacgccatagagccctgcgttatttgtcaagggagacccaagaacggctgcattgtccacggaaagacagggcacttaatggcttgtttcacatgtgctaaaaaattgaaaaagcggaacaagccctgtcctgtgtgccgccagccaattcagatgatcgtgttgacctatttcccgtag

SEQ ID NO: 29359 - DNA, 642 bp, Artificial Sequence
  Description of Artificial Sequence: Synthetic coding sequence
atgcctaattttgttgtggactggagggtgtatactgacagcttgttcttgaccgtcgattttggactgtgcgccgaagagtcctcaacctctaggaaaagaaccaccgaagatgatattcctacacttcctaccagtgaacataagtgtatccatagccgcgaggatgaagacctcatagaaaatctagcacaggacgagacctccagactagatctgggtttcgaagagtgggatgttgcgggactcccgtggtggttcctgggcaatctgcgctccaactatacacctcggagcaacggatccacagatctccagaccaatcaggacgttggcaccgccatcgtatctgacacaaccgatgatctctggttccttaacgagagtgtgtccgagcagttgggcgttgggatcaaagttgaagctgcagacaccgagcagaccagcgaggaggtggggaaggttagcgataagaaagttattgaggtgggtaagaatgacgacctcgaggactcgaagagcctatccgacgacacagatgtggaggtgactagcgaggatgagtggcaatgtacggagtgtaagaagtttaatagcccatcgaagaggtactgttttcgctgctgggcgctcaggaagtag

SEQ ID NO: 29360 - DNA, 396 bp, Artificial Sequence
  Description of Artificial Sequence: Synthetic coding sequence
atgacatctttctcgacatccgctcagtgttcaacctctgattcagcttgcaggattagccctgggcaaatcaaccaggtgaggcccaaacttccccttctcaagatcctgcacgcagcgggagctcagggggagatgtttacagtgaaggaggtaatgcactacctgggccagtacataatggttaagcagctgtacgaccagcaggagcaacatatggtgtactgcggtggagatcttttgggggagctacttgggcgtcaaagcttcagcgtcaaagacccttcaccactatacgatatgttaaggaaaaatttagtgaccctggctacggctaccacagagatgggacatcttttctgccgaatcagccacgccctggagctcgcagactag

SEQ ID NO: 29361 - DNA, 1473 bp, Artificial Sequence
  Description of Artificial Sequence: Synthetic coding sequence
atgaccagtttcagcacttctgcacagtgttctacctccgactcagcatgccggatttccccagggcagatcaatcaggtgaggcctaagctgccgctgctaaagatcttgcatgctgctggcgcacaaggcgagatgttcacggtcaaggaggtcatgcattacctcggccagtacataatggtcaagcagctctatgaccagcaggagcagcacatggtctattgtggaggagacttgctcggggaactgctgggacgacaatccttttctgttaaggatcctagtcctttatacgacatgctgcggaagaacttggtgaccctggccacggcgactaccgatgcggctcagaccctggccctcgcgcaagatcacagcatggacatacccagtcaagaccagttgaaacagtccgccgaggagtctagcacgagcagaaaacgtacaactgaagatgatattccaactctgccaacctccgaacacaagtgtattcactcccgggaagatgaggaccttatcgagaacttggcccaggatgagacctctcggttggatctgggcttcgaagaatgggacgttgccggactgccttggtggtttctgggcaacctgcgctctaattacactccccgttctaatggatcgactgacctgcagaccaatcaggacgtcggcacagccatcgtgagcgacaccacagatgatctgtggtttctaaatgagtccgtatctgagcagctcggcgtcggtatcaaggtcgaggctgccgataccgaacagacatccgaagaggttggcaaagtttccgataaaaaggtgattgaggtgggcaagaatgatgacctcgaggattctaagtcactgtctgatgacactgacgtggaagtgaccagtgaggacgagtggcaatgcacggaatgcaaaaaattcaattccccctccaagcggtattgtttccgatgctgggctctgcgaaaggattggtattccgattgttcgaaacttactcacagcctatcgacatcagatattacagctatccccgagaaagagaacgaagggaatgacgtccccgactgcaggcgaactatttccgccccagtggtccggccaaaagacgcttatattaaaaaagaaaatagcaagttgttcgatccatgcaattccgtggaatttctcgatctagcccacagctcagagagtcaagaaaccatctccagcatgggtgaacaactggacaacctgtcagagcaaagaacagatacggaaaatatggaagactgtcagaatcttctgaaaccctgcagcttatgcgaaaagaggcctagggatggcaatatcatccatggtagaacgggccacctcgttacctgctttcattgcgccagaaggcttaagaaagcgggagcctcctgtccaatatgtaaaaaagaaattcagcttgttataaaagtcttcatcgcctag

SEQ ID NO: 29362 - DNA, 495 bp, Artificial Sequence
  Description of Artificial Sequence: Synthetic coding sequence
atgaccagtttctccacgtcagcccagtgtagcacttcagactctgcctgtcgaataagcccgggtcagatcaatcaggaaaatgagggaaacgacgtccctgactgcaggcggaccatctccgctccagtggtccgaccaaaagatgcctacattaagaaggagaacagcaagctatttgacccctgcaatagtgtcgaattccttgatcttgcacactcgagcgagtcccaggaaacgatcagctccatgggagaacagctggacaatctgagcgagcagcgcaccgacaccgaaaacatggaggactgccaaaacttgcttaagccatgctctctatgtgagaagcggcctagagacgggaacataattcacgggcgtacgggccacctggttacctgctttcactgcgcacgccgactcaagaaagcaggcgcttcctgtcccatctgtaaaaaggagattcagctcgttatcaaagtgttcatagcatag

SEQ ID NO: 29363 - DNA, 423 bp, Artificial Sequence
  Description of Artificial Sequence: Synthetic coding sequence
atgacttccttcagcacttctgcgcagtgctccacaagcgatagtgcgtgccgaattagccctggacaaataaaccaggtgaggcctaaactcccccttctgaagattctgcacgcagctggcgctcaaggagaaatgttcactgtgaaggaggtgatgcattatctgggacagtacatcatggtcaaacaattgtacgaccagcaggagcaacatatggtgtactgcgggggagacctgttgggtgagcttttggggaggcagagcttctcagtgaaggacccatcccctctgtacgatatgctcaggaagaatctcgtgaccctggcaacagcaaccacagccaaatgtaggggaaagttccacttccaaaagaagaactaccggagacgatacccccacacagcgtacctgcgtgcttag

SEQ ID NO: 29364 - DNA, 516 bp, Artificial Sequence
  Description of Artificial Sequence: Synthetic coding sequence
gatctgatagagaaccttgcgcaggatgaaacgagcagactggaccttggcttcgaggagtgggatgttgcagggttaccatggtggtttctaggcaacttgaggtcgaactacactccccgaagtaacggaagcaccgatttacagaccaaccaggtgatcgaagtgggcaagaatgacgacctggaagatagtaaaagcctttccgacgatactgacgtagaggtgacttcagaagatgaatggcagtgtacagagtgtaagaaatttaattccccatccaaaaggtactgttttcgctgctgggcactgcgcaaggattggtacagcgactgtagcaagctcacccactctctgagcacatcagatattaccgccattcctgaaaaggagaacgagggtaacgatgtacccgactgtcgacgtaccatctcggctcctgttgttcggcctaaggacgcatacataaagaaagaaaacagtaagctgttcgacccgtgtaactccgttgaatag

SEQ ID NO: 29365 - DNA, 1323 bp, Artificial Sequence
  Description of Artificial Sequence: Synthetic coding sequence
atgacatcattctccactagcgcacagtgcagtacttctgatagcgcctgtaggatcagccctggacagataaaccaagtgaggccaaaactcccattgctcaagatcctgcatgcagcgggagcccagggcgagatgtttactgtgaaggaagtgatgcactacctaggacagtacataatggtgaagcagctgtatgaccagcaagagcaacacatggtgtattgcggtggcgatttgctgggtgagctcctcgggagacagagcttttccgttaaggatcctagcccgctatatgacatgcttagaaagaatctggtgaccctcgcaactgccaccactgacgcggcacagactctggcgctggctcaagaccattccatggatatacctagccaggatcagcttaagcagtctgcggaggagagcagtacaagtcggaaacggacaactgaagacgatatccctactctgcctacgtcagagcacaagtgcatacattcccgggaggatgaggatctcatcgaaaacctggcccaggacgaaactagtagacttgacctcgggttcgaagagtgggacgtggccggtctgccttggtggttcctcggcaacctccggtccaactacaccccaaggtcaaacggctccactgacctccaaaccaatcaggttattgaagtgggcaaaaatgatgatctggaagattcaaagagcctgagcgacgacacagacgtggaagtgacctctgaagacgagtggcagtgcaccgagtgcaaaaagtttaattcaccgagtaagagatactgctttaggtgctgggccctgaggaaagattggtactcagactgctctaagcttacacattctctgagcacatctgacatcacagccatccccgaaaaggaaaacgaagggaatgacgtacccgactgtaggcgcacgataagcgccccagttgtgaggccgaaggatgcatacattaagaaggaaaacagcaaactgtttgatccctgcaactcagtagagttcctggatcttgcacacagttccgagagccaggagactatctcctccatgggtgagcagctggacaacctcagtgaacagaggaccgacactgaaaatatggaagattgccagaatctgcttaagccatgttctttgtgcgagaaacggcctcgcgatggaaacatcatccatggaagaacagggcacttagtaacgtgtttccactgtgctcgaagactcaaaaaggcaggcgcatcatgccccatctgcaaaaaggagattcagctggtcattaaagtgtttatcgcttag

SEQ ID NO: 29366 - DNA, 384 bp, Artificial Sequence
  Description of Artificial Sequence: Synthetic coding sequence
atgacttccttctcaacttctgcccagtgctccacaagcgactctgcatgtagaatttcccctgggcagattaatcaggttagaccgaagctgccactgctaaaaatactgcacgcagcgggtgcccagggcgagatgtttactgttaaggaagtaatgcactatcttgggcagtacattatggtgaagcagctgtatgaccagcaggagcagcatatggtctattgtgggggagatttgctgggggagctactgggacggcagtctttctcggtgaaggacccgtctcccctttatgatatgttgaggaagaatttagtgactctggccaccgccacgacaggttgtcagcgcagggtgaacgggccacagagagcctggtag

SEQ ID NO: 29367 - DNA, 462 bp, Artificial Sequence
  Description of Artificial Sequence: Synthetic coding sequence
atgactagtttctcaacctccgctcagtgctccaccagcgattccgcctgcaggatatctccgggacagatcaatcaagtgcggccaaaactacctctgttaaaaatcttacacgccgctggcgcacagggggagatgtttaccgtgaaagaggtgatgcactacctggggcagtatatcatggttaagcagctgtatgatcagcaagagcagcatatggtgtactgcggtggagatcttcttggcgagctgttgggtcgacagagcttctcggtaaaggacccaagccctctttatgacatgctcaggaagaacctcgtgacactggctacggccaccacggggtctcagtacggttacagcaaaagtaggccaacagaagccaaatgtcggggaaagttccattttcagaaaaagaattatcgcagacgatacccgcatacagcatacctccgtgcatag

SEQ ID NO: 29368 - DNA, 7649 bp, Artificial Sequence
  Description of Artificial Sequence: Synthetic coding sequence
atgttaggcaccggacctgcagccgctaccacagccgctacgaccagcagtaatgtatctgtgctgcaacagttcgcgtccggactcaagtcacggaacgaggaaacaagggccaaggccgcaaaagaactccagcactatgttacgatggaattgcgtgagatgtcccaggaggagagcactcgtttctacgatcagttgaaccatcatatattcgaacttgtgagttctagtgacgccaacgagcgtaaaggaggaatcttggcaatcgcttctttgataggagtcgaaggtggtaacgcaaccagaattggacgctttgccaactatctcagaaatctgctgccgagcaatgatcccgtcgtcatggagatggcgagcaaagccataggccgactcgccatggcaggtgataccttcactgccgagtatgtggaatttgaagtcaaaagagccttggagtggctgggcgctgacagaaacgaaggaaggcgtcatgccgctgtcctggtgctgagagaactggcaatctctgtgcctacctttttcttccagcaagtgcagcctttcttcgataatattttcgttgccgtgtgggacccaaagcaagctatccgggaaggcgctgtggccgcactgcgggcatgtctgattctcactacacagagagaacctaaggagatgcagaaacctcaatggtatcggcatacatttgaagaagccgaaaaggggttcgatgagactctcgctaaggagaagggcatgaaccgagacgatcgaattcacggggctctgctgattcttaatgaactcgtgcggatttcctccatggaaggcgaacggctgcgcgaggaaatggaggagatcacacagcagcagctggttcatgacaagtattgtaaggatctgatgggattcgggactaagccgaggcatatcactcccttcacttcatttcaggccgtccagccgcagcagtcaaatgcactagtcgggttgctcggttactctagccaccaggggttgatgggcttcgggacttcaccctcccctgccaagagcacattggtggaatccagatgttgtcgtgacctgatggaagaaaagtttgatcaggtgtgtcagtgggtgctaaaatgtcgaaatagtaaaaattctctaattcagatgaccatcctaaacctgcttcccagattggctgcgttcaggccctccgcatttaccgacacacaatacttgcaagacacaatgaatcacgtgctaagctgcgttaaaaaagagaaggaacgcaccgcagcctttcaggcacttgggctgctgtccgtcgccgtccggagcgagttcaaagtgtacctgcccagggtgctggatattatccgggctgctctgccacctaaagattttgcccacaagcggcagaaagcaatgcaggtggacgccaccgtgtttacctgcataagtatgttggcaagagctatgggacctggaatacagcaagatataaaggagctgctcgaacccatgttagcggtgggcctaagccccgcactgaccgcagttctttatgatctgagccgccagatcccacaattgaagaaagatatccaggacggcctgctgaaaatgctgtctctggtcctcatgcacaagcctctgcggcaccctgggatgcctaagggactcgcccatcagcttgcctctccaggactgaccaccctcccagaagcctcggacgtgggaagcatcactcttgcactacgaactcttggctcgtttgaattcgaaggacacagcctcactcaatttgtaaggcattgcgccgatcacttccttaactcagaacacaaggagatccgtatggaagcagccagaacttgctctaggctactgaccccttctatccacctcataagtggtcacgcacatgttgtttctcaaacagctgtacaggtggtcgcagacgtcttgtccaagctgctggtggtagggatcacagaccccgatccggatatacgctactgcgttctggcaagtctggatgagcggtttgacgcacacctggcacaggctgagaacctgcaagccctcttcgtcgccctgaatgatcaggtgtttgagataagggaactggccatttgcacggttggcaggctgtctagtatgaaccccgcatttgtgatgccttttctacgaaagatgctaattcagatattgaccgaattggaacacagcggaattgggcgaattaaggaacagtctgctcggatgttgggacatttggtgtccaacgcccctcggctgatccggccttacatggaacccattttaaaagccctgatcctcaaactgaaggaccccgatcccgatcctaaccccggtgttattaataacgttctggccaccataggggagctggcgcaggtttcaggcctggagatgcgtaagtgggtcgacgagctattcattatcattatggacatgctccaagatagtagtctgctggctaagcgccaagtagctttgtggacacttgggcagttggtggcttccacaggttacgtcgttgagccatacaggaagtatcccactttgttggaagttctgctcaacttcctcaagactgagcagaaccagggaacccgcagagaagccataagggtcctcggcctgcttggagcgctcgatccatataagcacaaggtcaatatagggatgatcgaccaatcaagggatgccagcgcagtcagtctgtctgagtcaaagagtagccaggatagttccgactactctacctccgagatgctggttaacatgggaaatttgcctttagacgagttctatcccgcagtgagtatggtggcattaatgaggatattcagagaccagtctctctcacatcaccatacaatggtggtacaggctatcacttttattttcaagtctctgggcttaaaatgcgttcaattcttgccccaggtgatgccaacgtttttaaacgtgattagggtgtgtgatggagcaattcgagagtttctttttcagcaactaggcatgctggtttcattcgttaagagtcatatacggccatacatggatgaaatagttaccctgatgcgcgagttctgggtaatgaacacttctatacagtctaccatcatcctacttatagaacagatcgtcgtggccctgggtggcgagttcaagctttatctcccacagctaatccctcacatgctgcgcgttttcatgcatgacaactcccccggaagaatcgtgtcaatcaaattgcttgcagccattcagctcttcggagctaatcttgacgattatttacatctactgctgccaccaattgtgaaactcttcgacgcgccagaggctccgctgcccagccgaaaggccgcattagagaccgtagacagactcacagagtcactggactttaccgactacgcaagcagaatcatacatcccattgtgcggacactggaccaatccccagagctacgctctaccgccatggatacattatcctcactcgtttttcagcttgggaagaaataccagatcttcatccctatggttaataaagtgctggttagacaccggattaaccaccaaagatatgacgtattgatttgtaggatcgtgaagggctacaccctggccgacgaggaggaagacccactgatttaccagcaccggatgttgcggtctggacagggagacgcccttgcgtccgggccagtggagacggggcctatgaagaagctgcatgttagcacaataaacctgcagaaggcgtggggcgctgccaggagggttagcaaagacgactggctggagtggctccggaggctgagcctggaactccttaaggacagctcgtctccgagtctcagatcatgctgggcattagcccaggcctacaacccaatggctcgggacctgtttaacgccgcttttgtttcctgttggtctgaactgaatgaagaccaacaggacgagctgatccgcagcatcgagctagcactgaccagccaagatatcgccgaagtgacacagacactgcttaatctagccgaatttatggagcattctgacaagggtcccctacccttacgggacgataacgggatcgtcctgttgggagagagagctgccaagtgccgcgcatacgcgaaagctctgcactacaaagagctggaattccaaaagggtcccacgccagcaatccttgagtctttaatcagcattaacaacaagttgcagcagccggaggctgccgcaggagttttagagtatgctatgaagcacttcggagaactggagattcaagccacctggtacgagaaacttcacgagtgggaagacgctctggttgcctacgacaagaaaatggacaccaataaagacgacccggaactcatgctaggcagaatgaggtgcctggaagccctgggggagtggggccagttgcatcagcagtgttgtgaaaagtggaccttggttaacgatgagactcaggccaagatggcaaggatggccgctgccgctgcatggggactggggcaatgggattcaatggaggagtatacctgtatgatccccagagatactcacgacggggctttttaccgcgctgtcctcgccttacaccaggaccttttttcactggcacagcagtgcattgataaggcccgtgatctgctggatgccgaactgacagccatggccggtgagtcatactccagagcctatggcgcaatggtgtcatgccacatgctgagtgagctagaggaggtgatccagtacaagctggtgccagagagacgggaaatcattcgtcagatctggtgggagcggctccagggctgccagcggatcgtggaagactggcaaaaaattctgatggtgagatcgcttgtggtctcaccgcatgaagatatgcggacttggctgaagtatgcatccctgtgcgggaagagcggcaggctagccttagcccacaaaaccttggtcctgttgcttggtgtcgacccgtccaggcagttagatcacccattgccaaccgtgcaccctcaagtaacttacgcatatatgaagaatatgtggaagtccgccaggaagattgacgcattccagcatatgcagcatttcgtccaaacaatgcaacagcaggcccagcacgctatagctaccgaagatcaacagcataaacaagagctgcacaagctgatggcgcgatgcttcttaaagttgggggaatggcagttgaatttacagggcatcaacgaaagtacaatcccaaaggtgctccaatactacagcgcggctactgaacacgacagaagctggtataaagcgtggcacgcgtgggccgtcatgaactttgaggctgtattacattacaagcaccagaatcaagctagggacgagaaaaaaaaactgagacacgcctcgggggcaaatattactaacgccaccacagcagctactactgcagctacagccaccacaacagccagcaccgagggctctaattctgagtccgaagcagagtcgacagagaactcccccactccgtccccacttcagaaaaaggtcacggaagacctgagtaaaacactgctgatgtatacagtgcctgctgtccaaggcttcttccgttcaatctccttgagccgtgggaataaccttcaagatacccttcgagtgctgacactttggtttgactatggtcactggcctgatgtcaacgaagctctggtggaaggcgttaaagcgattcagatagacacttggttacaagtgattccgcagctgatcgcacggatagacactccgcgacccctggtaggaagattgatccaccagctgcttacagacatagggaggtatcatccccaagcccttatctatcctcttactgtggcttcaaagagcactacaacagctagacataatgctgccaacaagattctcaaaaacatgtgcgagcattcgaataccctggtccaacaagccatgatggttagtgaggagctgatccgggtagccatactctggcatgaaatgtggcatgaaggcctagaggaagcatcacggctatacttcggggaacggaatgtgaaaggaatgttcgaggtgcttgaacccctgcacgccatgatggagcggggtccccaaaccctcaaggagactagctttaaccaggcttacggaagagacttgatggaagctcaggagtggtgccgtaagtacatgaaatccggaaacgtgaaagacctgactcaggcctgggacctatattatcacgtgttccgaagaatcagcaagcagctccctcagttgacgtctctcgagttgcaatacgtgagccctaaactgctgatgtgccgagacctggaattagccgtgccaggaacttatgatccaaaccagccgataattaggatccaatccattgcaccctctttgcaggtgatcactagcaagcagcgaccacggaaacttactttgatgggctctaatggccatgagttcgtgttcctcctgaagggtcacgaggaccttcgtcaggatgagagggttatgcagctgttcggcctcgtaaacaccctactcgccaacgatcctacttccttgcgtaagaacctgagcatccagcgatacgcggtgatccccttgagtaccaactctggcctgatcgggtgggttcctcactgtgacacgctacacgctttgatcagagactatcgtgaaaaaaagaaaatactgctcaacattgagcacagaattatgctccggatggcccctgactatgatcatctcacgctgatgcagaaggtcgaagtgttcgagcacgcagtgaacaacacagccggtgatgacctggctaagctgttgtggctcaagagccccagctccgaggtgtggtttgatagaaggaccaattatacgagatctctggctgtgatgtccatggtagggtacattctcggcttgggagacagacacccttccaacttgatgctggatagactgtctgggaaaatcctgcacattgatttcggggattgtttcgaggtcgctatgacacgcgaaaaatttccagagaaaatcccgtttagattgactcggatgttgaccaacgccatggaggtgacaggactggatggcaattatcgaatcacttgtcacacggtgatggaggtattgcgggagcacaaagattcagtcatggctgtgctggaagcttttgtttacgaccctctgctgaattggagactcatggacaccaataccaagggtaataaacgcagccgtacccgcactgattcctattcggccggacagagtgtggagattttagacggggtggaactgggggaacctgctcacaagaaaactggcaccactgtcccagaaagtatccatagctttatcggcgacggcttagtgaaaccggaggccttaaataagaaagcgatccagattattaacagggtgcgcgataaactcacaggaagagatttctcccatgacgatactctggatgtcccaactcaagttgaattactcatcaagcaggccacgtcccacgagaatttgtgccagtgttatatcggctggtgtcctttttggta

SEQ ID NO: 29369 - DNA, 2265 bp, Artificial Sequence
  Description of Artificial Sequence: Synthetic coding sequence
atgaactttgaggccgtgcttcattacaaacaccaaaatcaggcaagggatgaaaagaaaaaactcagacacgcctctggtgccaatatcaccaacgccacaaccgctgctacaacagctgccacggcaactactacagcctcaaccgagggctctaattccgaatccgaagctgaaagtactgagaattcccccactcctagtccattgcagaaaaaggttactgaggatctatcaaagacactcctcatgtacactgtgcccgcagtgcagggcttctttaggagcatctcactgtcgcggggaaacaatttgcaggatacactgcgagttctaacactatggttcgattacgggcactggcccgatgttaatgaggcacttgttgagggcgtcaaggccatccagattgatacctggttgcaggtcattcctcagctcatcgccaggatcgacaccccgagacctctggtaggacgactcattcatcagctgctgacagacattgggcgttaccatccacaggctttgatttacccacttaccgtcgcttctaagtcgaccaccacagcacgtcataatgccgctaataaaatactcaagaacatgtgtgagcacagtaacactctggtgcagcaggcaatgatggtctcagaggagctgattcgggtggcaattctatggcatgagatgtggcatgaaggcttagaagaggcgtcccggttatatttcggggaaaggaacgtgaaagggatgttcgaagtgctggagcctttgcatgccatgatggagagggggccacaaacactgaaggagactagcttcaatcaggcttacggacgcgaccttatggaagcacaggagtggtgccgaaaatacatgaagagtggaaatgtcaaagatctgactcaagcctgggacttatactaccacgtgtttcgacgcatatccaaacaactcccgcaactgacttctctggagctacagtacgttagccctaagctactgatgtgtcgggacctcgaattggctgtacctggcacctacgaccccaatcagcctatcatcaggattcagagcatagccccttctctccaagtgatcacgtccaaacagcgtccgagaaaactgacactaatgggctcaaatggccacgaattcgtatttctgctgaaggggcacgaggatctgcgacaggatgaacgggtgatgcagctcttcgggcttgttaacacactcctggcaaatgatcccaccagcctgagaaaaaacctctctatccagagatacgcagttatcccactctctacgaatagtgggctgattggctgggtaccccactgtgatactcttcacgcactcatcagggactatagggagaagaagaagatccttcttaacatcgaacaccgtattatgctgcgaatggcaccagattatgaccacttgacccttatgcagaaagtggaggtgttcgaacacgccgtaaataataccgccggagatgacctcgctaaactgttgtggctgaagtctccctcttcagaagtttggtttgaccgaagaaccaactacactagaagcctcgccgtaatgtccatggtcggctatatcctcggcttaggtgacaggcatcctagcaatctgatgctcgaccggctaagtgggaaaattctccatattgacttcggggattgctttgaggtcgccatgacccgcgagaaattcccagaaaagatccccttcaggctgacccgcatgctcactaatgcgatggaagtgactggactcgatggaaactatcggatcacgtgtcacaccgtgatggaggtcctgcgcgaacataaggatagtgtaatggcggtgttggaggcctttgtctacgaccctctcctgaactggagattgatggacaccaacacaaaggggaacaaacggtccagaaccagaaccgacagctattcagcaggccagtctgtggagattcttgacggtgtggagctgggagaacccgcacataagaagacggggacaaccgttcctgaatccattcactcatttattggtgacggacttgtgaaacctgaggccctgaacaaaaaggctattcaaatcatcaaccgcgttcgagacaagttgacaggaagggatttttcacacgatgataccctcgatgttcccacccaggtggagctcctgatcaaacaggcgacctcccatgagaacctctgtcaatgttatatcggctggtgccctttctggtag

SEQ ID NO: 29370 - DNA, 486 bp, Artificial Sequence
  Description of Artificial Sequence: Synthetic coding sequence
atgctggacaggctcagcggcaagatactccatatagatttcggcgactgctttgaagtagcaatgactagggagaagtttccagagaagatcccctttagactgacccgtatgctgaccaatgcgatggaggtgacgggtttggatggcaattatcgtattacatgccacactgtaatggaggtcctgcgggaacataaggatagcgtaatggccgttctcgaagccttcgtgtatgatcctctcctcaactggaggctgatggatacaaataccaagggtaataagcgctctaggactcgcacagactcctactccgctggtcagtcagtggagatacttgacggggtcgagttgggtgagcccgcacataagaaaactggcaccactgtgcctgagtcgattcactcttttatcggcgatggcctggtcaaacccgaggccctaaataaaaaggccattcagatcattaacagggtccggtag

SEQ ID NO: 29371 - DNA, 5186 bp, Artificial Sequence
  Description of Artificial Sequence: Synthetic coding sequence
atgctcggtactggaccggcagctgccaccacagccgcaactacctcaagcaatgtctcggtacttcagcaatttgctagtggcttgaaaagtagaaatgaggagactagggcaaaggccgcaaaggagctccagcactatgtgactatggaactgcgcgaaatgagccaggaggaatccacccggttttatgatcagctcaatcaccatatcttcgaactggtatcatcctccgatgctaacgagcgtaagggtggaattctggcaattgcatcccttatcggggtggaggggggaaatgccacccgcattggcagattcgcaaactacctgaggaatcttctgccctccaatgaccccgtagtcatggagatggcttctaaagctatcgggcgtcttgccatggctggcgacacatttacagccgaatacgtagaatttgaagtgaagagggcactggaatggctgggtgcagataggaatgaaggacgcaggcacgccgcagtgctcgtgttaagagaactggctatatcagtccccacctttttcttccagcaagttcaacccttctttgataacatttttgtggccgtatgggaccctaaacaagcaatcagggaaggtgctgtggccgctttgcgggcttgcttgattttgacaactcagcgtgagcccaaggaaatgcaaaagccacagtggtaccgccatacattcgaggaggccgagaagggttttgatgaaactctggccaaagaaaaaggaatgaaccgcgacgataggatccacggagccctgctgatcttgaatgaactggttaggataagctcgatggagggggaaaggctccgagaagagatggaggagatcacccaacaacaactagtccatgacaagtactgcaaggacctcatggggttcgggacaaaaccccgtcacatcacgccatttacgagctttcaagcagtacagcctcagcagagtaacgcattggtcggtctgctgggatattcaagccaccagggcttgatgggattcggtacgtcgccatctcccgctaagtctacactggtggagagtcgctgctgcagagatctaatggaagaaaagtttgatcaggtgtgtcaatgggttctcaagtgccgcaactcaaaaaattctttgattcagatgacaatcttgaatctgctgccccgactagccgctttccggccttcggcttttaccgacacccagtatctgcaagacacaatgaatcacgtgttgtcatgtgtcaaaaaggaaaaagagagaactgcagcgttccaagcactcggcttgctgagcgtggcagtgagatccgaattcaaagtgtacctgccacgggtgctggacatcattcgtgctgcactcccaccaaaggactttgcccataaacgacagaaggctatgcaggtggacgccaccgtgttcacctgtattagcatgctcgcgagagccatgggacccggtattcaacaggacataaaagagttgctcgagcccatgctagccgttggactaagccctgctttaaccgcagtcctttacgacctcagtcgccaaattcctcagcttaagaaagatattcaggatggactattaaagatgttgtctcttgtgctgatgcataaacctttgcggcaccccggaatgccaaagggactagcccatcagctcgcatcacccggattaaccactctcccagaggcgagcgatgttggcagtatcacactggcactgcgaacactaggcagttttgagttcgaagggcacagcctcactcagtttgtcagacattgcgctgaccacttccttaactcggaacacaaagagataaggatggaggccgcaagaacctgtagtcggctgcttacacctagcatccacctgatttccggtcacgctcatgttgtcagccagacagctgtgcaagttgtggccgacgtgttgagtaagctgctggtggtcggaattacagaccctgatcccgatattcgatactgtgtgctagcgagcttagatgaaagattcgacgcgcacctggctcaagcagagaatctccaggctctttttgtggctcttaacgatcaggtgttcgaaattagagagctcgcaatctgcaccgtggggaggctcagttcaatgaaccccgcatttgtgatgcccttcctgaggaaaatgctcattcagattctgaccgagctcgaacatagtggtataggaaggattaaagagcaatccgcaaggatgttagggcatctcgtcagtaacgcccctcggctcattaggccatacatggaaccaatccttaaagcactcatccttaaactcaaagacccagatccggacccaaatcccggagtgattaacaatgtgctggccaccattggtgaactggctcaggtcagcggacttgagatgcggaaatgggtcgacgaattatttatcattatcatggatatgctccaggattcctctctgctcgcaaaaaggcaggttgcattgtggaccctgggccagctggttgccagcaccggctacgttgttgagccttaccggaaatatcctactttgctggaggtgctgttgaactttctgaagacagagcagaaccagggcactcggcgtgaagcgatcagggtgcttggcttacttggagccctggatccctataagcataaggtcaacattgggatgatcgatcagtcgcgagacgcgagcgctgtcagcctgtctgagtcaaagagctcacaggacagctctgattatagtacgtctgaaatgttagttaacatgggtaacttaccccttgacgagttttatccagccgtgagtatggtcgccctaatgcgcatctttcgtgaccagagcctgtcgcaccatcataccatggtggtgcaggcaatcacctttattttcaaaagcctcggattgaagtgtgtacaatttctccctcaggtgatgcccaccttcctaaacgttattagagtctgtgatggcgcaatccgagaattcctctttcagcaattggggatgctggttagctttgtcaaatcccacatacggccttacatggatgaaattgtgacactcatgcgtgagttttgggtcatgaacacttccatccaatctactattattctcttgattgaacagattgtggtggctctggggggagagtttaagctatacctgccccagctgattcctcacatgttaagagtattcatgcacgataacagccccggtcgcattgtgtcaattaagttactggccgcaatccagctcttcggagccaatctcgacgactatctgcacttgcttcttccacctattgtgaagctctttgacgcccctgaggcaccacttccaagccgtaaggccgctctggagacagtggatcggttgacagagtccctcgattttacagattacgcttcaagaatcatccatccaattgtgcggacgctggaccagagccccgagctgcgaagtactgcaatggacaccctgagcagcctcgtgttccagctgggtaaaaaatatcagattttcatccccatggtcaacaaggtcctggttaggcacagaatcaatcaccagcgttatgacgtgcttatctgcaggattgtgaaagggtacactctggccgacgaggaggaggatcccctgatttaccagcatcggatgctgcgcagtggccagggggatgcacttgcttccgggcctgtggagactggtccaatgaaaaagctacacgtatccacaattaacctgcagaaggcttggggagccgctagaagggtgagcaaggacgactggcttgaatggcttcggagactctccctggaactgctcaaggacagcagttctcccagtctgcgtagctgctgggcgctcgcccaggcttataatccaatggcacgcgacttgttcaacgctgccttcgttagttgctggtcagagctgaatgaagaccaacaggacgaactgatccgttccattgaattagcattgacttcccaggatatcgccgaagtgacccagaccttgctgaatctggctgagtttatggaacactcagacaaaggacctctgcctctacgagatgataacggcatcgtcttgcttggtgaacgggcagcaaaatgtcgtgcctacgcgaaagctttgcactacaaggagttggagttccaaaaaggccctacaccagctatcttggagtcattgatatcgatcaataacaagcttcagcagcccgaggcagctgccggagtcctggaatacgcaatgaagcattttggggaattagagatccaagcaacctggtatgaaaagctacatgagtgggaagacgcactcgtggcatatgataaaaagatggacaccaacaaggacgatccagaactgatgctgggacgcatgagatgcctcgaagccctgggagagtgggggcagttgcatcagcagtgctgtgagaagtggacattagtgaacgacgagacccaggcaaagatggccagaatggcggcagccgctgcttggggcctgggacagtgggatagtatggaggagtatacctgcatgattccgagagacacacacgacggagcgttctatcgtgccgtgcttgcattgcaccaagacctttttagtttagcacagcaatgcatcgacaaggctcgtgaccttctagacgctgaactgacagccatggccggtgagtcttactctagggcttatggcgctatggtgtcttgccacatgctcagcgaattagaagaggttattcagtataagctggtgcccgagcgtagggagattatacgacagatttggtgggaacgccttcagggctgccagagaattgtggaggattggcagaagatattgatggtacgctcgctagtggtgtcacctcacgaagacatgagaacctggctaaagtatgcatccctgtgtggaaaatcaggacgcttggctatcgcaccgctgaacatgggcacggcaaatagtgcccagccaagatcactccggtcttggcgcacctggatacggattctcgattgtaaagacactgaggatgctgatctcacacctgccacgtatccgaagacatctctcgtgtgcggccaacagcaaaaatgccttcaggacaggccaaagta

SEQ ID NO: 29372 - DNA, 6269 bp, Artificial Sequence
  Description of Artificial Sequence: Synthetic coding sequence
atggaggatactcaggcgattgattgggacgtggaggaggaagaggagacggagcagtcttccgagagcttacgctgcaacgtggagcccgttggaaggctacacatcttctccggtgcccacgggcctgagaaagactttccgctgcatctggggaagaatgtcgtaggcaggatgcccgactgttcagttgcactgccatttccttcaatctctaaacagcatgccgagatcgaaatcctggcttgggacaaggctcccatccttcgcgactgtggttctttaaacggtactcagattctgagaccaccaaaggtgctgagtccaggagtgtctcatcggctgcgtgatcaggagctgatactgttcgctgaccttctttgtcagtatcatcgattggacgtgtccctcccttttgtgtcaagaggtcctctgactgtagaagagactcccagggtccagggcgagacacagccccagcgtcttttgctggccgaggactcggaagaggaggtggacttcctctctgagaggaggatggtaaagaaatcccgcacaacttcttcttccgtcattgtgccagaaagtgacgaagaaggtcattctccagtcctggggggattagggcctcctttcgcgttcaatctcaatagcgatactgatgtcgaggaagggcagcaaccagccaccgaagaggcatctagtgccgctcggaggggtgcaacagtcgaggcaaaacagagcgaggccgaggtggtaaccgaaattcaactggagaaagatcaacctctcgtcaaagagaaagataacgataccaaggtgaagagaggagctggtaacggcgtcgtgccggctggagtcatcctggaacggtctcagccccctggtgaagactcggacacagatgtggatgatgacagccggcctccaggaagaccagccgaagtacacctcgaaagagcccagccgttcggatttattgacagcgacactgacgccgaggaggaacgcattcccgcaaccccggtggtgatcccaatgaaaaaacgcaagatatttcatggagtcggaacccgtggacctggagccccaggtctggctcacctgcaggaaagtcaggccggatctgatacagatgtcgaagaagggaaagccccacaggccgtgcctttagagaagagccaagctagcatggtgattaattccgacactgacgacgaagaagaagtgagcgccgctttgaccctcgcacatttaaaggagtcacagcccgcaatatggaatcgggatgctgaagaagatatgcctcagcgcgtagtcttgttacagaggtcccagacaacaaccgagcgagacagcgataccgacgtggaagaggaggagttacctgttgagaatcgcgaggcagtgttgaaagatcacaccaaaattcgtgcactcgtgagggcacacagcgaaaaagaccagccccctttcggagactctgatgacagcgtagaggctgataaaagcagccctggaatacacctagaacgctcccaggctagcaccactgtcgatatcaatacccaggtggaaaaggaagtaccaccagggtccgcaatcatccatatcaaaaagcatcaggtgagcgttgaaggtaccaaccagactgatgtgaaggccgtcgggggtcctgccaaactgttggttgtatcattggaggaggcctggccactgcacggagattgcgagactgacgccgaggaaggcacatcactcacagcgtctgtggtagcagacgtgaggaagtcccagttaccagccgagggtgatgctggcgctgaatgggcagcagcagtcctcaaacaggagcgagcacatgaggtgggggcacaggggggacccccagttgcacaagtggaacaggatctgcctatatcacgcgaaaaccttacagacctggtggttgataccgacaccctgggcgagagtacccagcctcagcgcgagggcgctcaggtgcccaccggacgtgagcgggaacagcacgtcgggggtaccaaagattccgaagataactatggtgattctgaagacctggatctgcaggcaacacagtgcttccttgaaaaccaagggctggaggctgtccagtcaatggaagacgagcctacccaggcctttatgctcacaccgcctcaggaattaggcccaagccactgttcattccagactacggggaccctcgacgagccctgggaggtgttggctacccagcccttctgcctgcgcgagagtgaagatagcgaaacgcagccctttgacacccatctggaggcctacggcccatgtttgagcccccctagagccattccgggagaccaacatcccgaatcacctgtgcacacagaacctatgggcatccagggtcggggacgtcaaaccgttgacaaagtgatggggatccccaaagagacggcggagcgggttggcccagagaggggacccctcgagcgtgagaccgagaagctgctgcctgagcggcagaccgatgttacgggggaagaagaactgacaaagggcaagcaggatagagaacagaaacaactgctcgctcgcgacacgcagcggcaggaatccgataagaacggcgagtcagcttcacccgaaagagatcgtgagagtttgaaagtggaaatcgagacgagtgaagagatccaagagaaacaagtacagaaacagaccctgccttccaaggcttttgagagagaggtggagcggccagtggccaaccgagaatgtgatcctgctgagcttgaggagaaggtgcctaaagtgattcttgagcgagacacacagagaggggagccagaagggggttctcaagatcagaagggccaggcctcctcaccaacacccgagccaggtgttggcgctggtgatctgcctggccctaccagtgcccctgttccaagtggatcccagtccgggggacgagggtcccccgtcagtcctcgccgacaccaaaagggcctacttaactgcaaaatgcctcctgcagagaaagcatcccggattcgcgcagccgagaaagtgtctcgaggagatcaagagagccccgacgcctgcctgcctcctaccgtgccagaggccccagcccctccacagaaacctctcaacagccagtcccagaagcacctggctccaccaccgctgctttcccccctgcttccgtctatcaaacccaccgtccgaaagacgagacaggatggatcacaggaagctcccgaggcacccctttctagcgaactagaaccctttcacccgaagcccaagatacgcactcgaaagtcctctcggatgacaccattccccgctacctcagcagctcctgagccacatccctccacttccacagcccaacctgttaccccaaagccaaccagccaggctactcggagccgtactaatcgatctagtgttaagaccccagagccagtcgtccctacggcacccgaactccaaccatcaacgtccacggatcagcccgttacttctgaaccaaccagtcaagtgactaggggccgaaaaagtcggtcgtctgtgaagactcctgagacagtcgttccgactgcgcttgagctccagccatcaactagcactgacaggcccgtgacttcagagcctacatctcaggccactagaggaagaaagaatcgctcatctgtgaagacccctgagcccgtcgtgcctacagccccagagctgcaaccttcgacgtcaacagaccagccagttactagcgagccgacctaccaggccacgcgtggcagaaagaaccgttcatctgtaaaaacccccgaacccgtggtgccaaccgcaccagaactgcggccttcaaccagcacagatcggcctgtaacgcccaagcctacgtccagaactacacgcagtcgcactaacatgtcttctgttaaaacgccagagacagtggtgcccactgcccctgagttacagatctcaaccagcacagaccagcctgttacacctaagccaacttctcgaactacaagatcaagaacaaacatgagttctgtgaagaaccccgaatccacggttcctatcgccccagagcttccgccatcaacctcaaccgagcaaccagtcacgccagaacctacgagtcgcgcaacgagaggacggaagaaccgcagtagcggtaaaactcccgagacgctcgtgcctaccgcacctaagctggagccgagcacttcaaccgaccagcccgttacccccgagccgacatcccaggccacccggggtagaactaacaggagctcagtgaagacccctgagaccgttgtacccactgcacccgaactccagccatctacatccaccgatcaacccgtgaccccggaacccaccagccaggcgacgagaggccgaacggatcgcagtagcgttaaaacgcccgaaaccgtcgtgcccacagcaccggagctccaggcctccgcctcaaccgaccaacctgtgaccagcgaacctacgtctaggaccacacgaggccgtaagaacagatccagcgtgaagacgccagaaactgtggtgcccgctgctccagaattacagcctagcacttccaccgatcaaccagttactcctgagcctacgtcccgtgcaacacgtggcagaacgaacaggtctagtgtcaagacgccagagtccatcgtgcccatcgcccctgagctacaaccctccacaagcaggaatcagctggtcactcctgagcctacatcccgagctactaggtgtagaactaatagatcttccgttaagaccccagaaccggtagtgcccacggcccctgagccacaccctaccactagcactgaccagcctgttacccccaagcttacctctagggcaacccgaaggaaaactaataggagcagcgttaagacccccaagcccgtggagcccgcagcttccgatcttgaaccatttactcccacagatcagagcgtgaccccagaggccattgctcaaggtggacaaagtaagaccctcagatcctccacggtgcgggctatgcccgtgcccacgactcccgagttccagagccctgtaaccactgaccaacccatcagtccagagccaattacacagccgagctgcataaaacggcagcgggcagccggaaatccaggaagtttggccgctcccattgatcacaaaccgtgctccgcaccactggaacccaagagccaggcctccagaaatcagcgctggggggcagtgcgcgctgccgagtcacttacggccattccggagccagccagtcctcagctgctggagacaccaatacatgcctctcagattcagaaggtggagccagctggcaggtcaaggttcacccctgagctccagccgaaagccagccagtctaggaaaaggagcctggcaaccatggattccccccctcaccagaagcagcctcagcggggagaggtatcacagaaaacagtgattattaaagaggaagaggaagacacagccgaaaagccgggaaaagaggaggatgtcgtgaccccaaagcccggtaagcggaagcgcgatcaggctgaggaagagcccaacagaataccgagtagaagcctcaggaggaccaaactgaatcaagagagtactgcccctaaggtcctgtttactggagtagtcgatgccagaggcgagagagccgtgctcgcacttggcggatctctggctggaagtgccgcagaggcctcccacctggtcactgaccgaattcggaggactgtgaagttcctttgcgccctgggacgcggaatacctatcctcagcctggattggcttcaccagtcgcgcaaagccggtttcttcctccctccggacgagtacgtggttaccgatccagagcaggagaaaaatttcggatttagcctgcaggacgccctctctcgggctcgagaaaggcgcctcctcgaaggctatgagatctatgtgactcccggtgtgcagccacctccaccccagatgggagaaatcatatcttgttgcggcggtacatacctgccatcgatgccaagaagttataaaccacagcgggtcgtaatcacatgtccccaagactttccgcactgtagtatccctctcagggtaggcctgccacttctgtcaccagagttccttctgactggcgtgttaaagcaggaagctaagccagaggcctttgtcctttcacctctggaaatgagctcgacgta

SEQ ID NO: 29373 - DNA, 489 bp, Artificial Sequence
  Description of Artificial Sequence: Synthetic coding sequence
atggaggacacccaagccatcgactgggacgtggaagaggaggaagagaccgagcagagttcagaatcactgcgctgcaatgtagaacccgtaggtaggctacatatcttctcgggagcccacgggcctgaaaaggactttcctttacatctgggaaaaaatgtagttgggagaatgcctgactgttccgtggccctccctttcccatctatctccaagcagcacgctgaaattgagatacttgcctgggacaaggctcctattctgcgggattgcggctctctcaacggtacccaaatcctgcgccctcccaaagttctctcccctggcgttagccatagattgcgtgatcaggaactgattcttttcgcagacttgctgtgccaatatcaccggctggatgtgtcactccctttcgtgtcacgcggacctcttaccgtggaggagaccccgcgtgtgcagggagagactcagccccaaaggctgtag

SEQ ID NO: 29374 - DNA, 384 bp, Artificial Sequence
  Description of Artificial Sequence: Synthetic coding sequence
atggaagacactcaggccatcgattgggatgttgaggaagaggaagaaacagaacagtcgtcggagagcttgcggtgtaacgtggaaccagtcggcaggcttcacatcttctctggcgcacatgggcctgagaaagatttcccactccatctcggcaaaaatgtcgtgggtcgaatgccggattgttcagtggcactgccattccctagcataagcaagcagcacgccgaaatagagattctggcctgggacaaggcgccaattctgagggactgtggctcacttaacgggactcaaattttgcgacccccaaaggttctctcacctggggtgtcccacaggctccgcgaccaggagctaattctctttgccgacctcctgtag

SEQ ID NO: 29375 - DNA, 921 bp, Artificial Sequence
  Description of Artificial Sequence: Synthetic coding sequence
tgacatgtcggagggacaaaggattcggaggataattacggggactccgaggatctggacttgcaggccacacagtgctttctggagaatcagggattagaggctgtacagtctatggaagacgagcctacccaggcttttatgttgacaccgcctcaggagctgggcccttcccactgcagtttccagacaacgggcttgctgaattgtaagatgcccccagcagaaaaagccagcagaatacgcgcagccgagaaggtgagtagaggagaccaggaaagccctgatgcgtgccttccaccaactgtaccagaagcccctgcccctcctcagaagccactgaatagccagtcccaaaagcacctcgcaccaccccctctgctttctccgctgcttccatctattaagccaacggttagaaaaacacgccaggacggatcgcaagaggcccctgaggcccctttaagctccgagctggaacccttccacccaaaacccaagatcagaacgcggaaatccagcagaatgacaccattcccggctacgagcgctgccccagaacctcaccctagtacctctaccgcccagcccgtaaccccaaaacccaccagccaggccacgcgaagtcgcacaaacaggtcatccgtcaagaccccggaacctgttgtgcccacagccccagagctgcaaccaagtacttccactgatcaacccgtgacatcagagcctacatcccaagtgaccagggggaggaagtcacggtcgagcgtaaaaaccccagagaccgtggtacctaccgccctggagttacaaccttctaccagcacagacaggcccgtgaccagcgagcccacgtctcaggcaacccgcggtcgcaaaaatcgaagctctgtgaaaacacccgagccggtggtaccctag

SEQ ID NO: 29376 - DNA, 342 bp, Artificial Sequence
  Description of Artificial Sequence: Synthetic coding sequence
atggaggatacccaggccatagattgggacgtcgaagaagaagaggaaacagagcaaagctcagaaagtctgcgctgcaacgtggagccagtcggtaggctgcacatctttagtggagcacatggacccgagaaggatttccctctgcatctcggcaaaaatgtggtggggcgaatgccagattgcagcgtagccttgccctttccaagcattagcaaacaacatgccgaaatagaaattctggcatgggataaagctccaatcctacgtgattgcggatcgttaaatggcacccagatcttaaggccaccaaaagtccttagcccgggagtaagccactag

SEQ ID NO: 29377 - DNA, 5408 bp, Artificial Sequence
  Description of Artificial Sequence: Synthetic coding sequence
atggaggacacgcaggcaatcgattgggacgtggaggaagaggaggaaactgaacagagtagcgaatctctccgctgcaatgtagagccggtcgggaggctgcacatctttagcggagcacatgggccagaaaaggatttcccactgcaccttggaaagaatgtggtggggcgtatgcctgactgttcagtcgctctgccgtttccaagcatctctaagcagcatgcagaaattgaaatcctggcctgggacaaggccccaattctgcgggactgtggctctttgaatggaacccagattttgcgccctcccaaggttcttagccctggagtaagccaccggctacgcgatcaggagctgatattatttgcagatctcctgtgccagtatcacaggctagacgtatctctgcccttcgtgtctagaggaccactgaccgtcgaagagacccccagggttcaaggcgaaacccagcctcaacgactgttgttagccgaggatagcgaagaggaggtggacttcttgtcagagaggagaatggtgaaaaagagtagaacaacctcctcgtctgtaatcgtccccgagtctgatgaagaaggacacagtcccgttcttggtggattgggtcccccattcgctttcaatctgaattctgacacggatgtggaggagggacagcagcccgcaactgaggaggcctctagcgccgctaggagaggcgcaaccgttgaagccaagcagtccgaggccgaggtggtcactgaaattcagctcgaaaaggatcagccactggttaaggagaaagataacgacaccaaagttaaacggggtgctggcaacggggtggtgcctgccggagtaatactcgaacgcagccagcccccaggagaggattcagataccgacgtggacgacgacagccgcccacccggaagacccgctgaagtgcatctggaaagggcccaaccttttggattcatagactcagatactgacgccgaggaggagcgcatacctgctacacccgtggttattcctatgaagaaaagaaagatttttcatggagtaggaacaagaggacccggtgcaccgggactggcacatctccaggagtcacaggcaggaagcgacactgacgtcgaagagggtaaggcccctcaggccgtccctcttgaaaagagccaggcttctatggtgataaattccgataccgatgacgaggaagaagtgtctgccgctctgacactggcgcacctgaaagagtctcagccggcaatctggaatcgagatgccgaagaagacatgccacaaagggttgtgcttcttcaacggtctcagactaccactgagcgtgacagcgatacagacgtggaggaagaggagctccctgtggaaaatcgcgaggccgtgctcaaggaccacaccaagattcgtgccttggtacgtgcccacagcgaaaaggatcaacctccttttggcgactcggatgatagcgtggaagccgataagtcctcccccggaattcacctcgaaagaagccaagccagtacaaccgtcgatattaatacccaggttgagaaagaggtccccccaggaagtgccatcattcacatcaaaaagcaccaggtgtctgtggagggcacaaatcagactgacgtgaaggccgtaggaggccctgccaaactcttggtagtgagtctggaggaggcctggcccctgcatggagattgtgagaccgatgctgaagagggcacaagcttgactgctagtgtcgtggccgacgtgcgcaagtctcagctgcctgctgagggagatgccggtgccgaatgggcggctgccgtgttgaagcaggaacgcgctcatgaggttggagcccaggggggtccgcctgtagcccaggtggagcaggacctccccatctctagggagaatctgaccgacctggttgtcgacacagacaccttgggcgagagcacacagccacagagagagggggctcaggtcccaaccggcagagaaagggaacaacatgttggtggcaccaaagactctgaggataactacggggatagcgaggatttggacttgcaggctactcagtgtttcttagaaaatcagggtttggaagcagtccagtcgatggaagatgagccgacccaggccttcatgctgacaccgccacaggagttggggcctagtcattgtagcttccaaaccacggggacattggacgaaccatgggaggtgctcgcaacgcagccattctgcctccgggaaagcgaggactccgagacacagccattcgatactcacctggaggcctacggaccctgcctgtctccaccccgagccatcccgggagatcaacaccccgagtctcccgtgcataccgagccaatgggtatccagggtcggggaaggcaaacagttgataaggttatggggattcccaaagagacagccgagagggtgggacccgagagaggtcctctggagcgcgagacggagaaattattgccagagagacaaactgatgtgaccggcgaggaggagctgaccaaggggaagcaggatagagaacagaagcaacttctcgcccgagatacccaaagacaggagagtgacaagaacggcgagagtgcgtctccggaacgcgacagggaatccttaaaagtggaaatcgagaccagcgaggagatccaggaaaagcaagttcaaaagcaaactcttccaagcaaagcattcgagcgggaagttgagagacctgtggctaatagagagtgtgaccctgccgagctcgaggagaaagtgcccaaagtgatcctggagagagatacacaaaggggcgagcccgaaggagggtctcaagaccaaaagggtcaagcatcttcacctacacccgagcctggagtgggagcaggggatcttccaggtccgaccagcgcccctgtcccctctggatcccagtctggtgggcgaggctcccccgtgtctcctcgacgacaccagaaaggtctgctgaattgcaaaatgccccctgctgaaaaggcctctagaattcgcgctgcagagaaggtctcgaggggcgatcaggagtctcctgacgcatgcctcccccctaccgtccccgaagctcctgcgcctccacaaaaaccactgaactcccaatcccaaaagcaccttgctcccccaccactgctgtcacccttactgccttcaattaaaccaactgttcgtaaaacacgtcaggatggcagccaagaggctcccgaagccccactgtcatccgagcttgaaccttttcaccccaaacctaagataagaacccggaaatctagcagaatgacacccttcccagccacaagtgcagctccaaagctagagccaagcacctccactgaccagcccgtgacacctgagccaactagccaggccacgcgcggacgaacaaacaggagttctgtgaagactcctgaaaccgttgtgcctactgctccagaactgcagcccagtacttccacagatcagccagtcacccctgaacccacctcgcaggcaacacgaggacggaccgacagatcctcagtcaaaaccccagagaccgtggtccccaccgctcctgagctacaagcctccgctagcaccgaccagccggtgacctctgagccgacgagtcgaactactcggggacgtaagaaccgaagctccgtgaagaccccggagaccgtggttcccgcagccccagagctgcagccaagcacaagcaccgaccagccagtgacacccgaaccgaccagtcgggctacaaggggtcggacaaaccgtagttccgtgaagacaccggaatccatcgtccctatagcaccagaattgcagccaagcacatctcggaaccagctcgtgacccccgagcctacctcacgcgcaacgcgatgccgcaccaatcggtcttccgttaagacccccgagcccgtggtgcctaccgcccctgaacctcaccccacaacctccacagatcaacctgtgacacctaagttaacatcccgggctactaggaggaaaaccaaccgctcatcagtgaagaccccgaagccggtggaaccagccgcatcagatttagaaccctttacacccactgatcagtctgtgacacctgaagccatcgcccaaggtggtcagagtaaaaccctacgcagctcgaccgttcgcgcaatgcccgttccaacaaccccagaattccaatccccagtgaccaccgaccagccaatctcacctgagcccatcacacaacccagctgtatcaaaaggcagcgagcagcgggaaaccccggatctcttgcagcacccattgaccacaaaccatgcagtgctcctttggaaccaaaaagtcaggcctccaggaaccagcggtggggggcagttagagccgcagagtcactcaccgctattcccgagcccgcatctccgcaattactggagaccccgattcacgcatctcagattcagaaagtagaacctgccggacggagcaggttcacaccagagctgcagccaaaagcgtcgcaatctaggaagagaagcctggctacaatggattctcccccacaccagaagcaaccccagagaggcgaggtgtcccagaagacggtgatcatcaaggaagaggaggaggacacagccgagaaacccggaaaggaggaagatgttgtgacacccaagccaggcaaaaggaaacgtgaccaggccgaggaagaacctaacagaatcccctccagaagcctccgacggaccaagttaaaccaggaatccaccgcaccaaaagtactgtttacaggcgtcgtggacgctcgcggtgagagggctgtattggcactgggaggaagcctggctgggtctgcagccgaggccagccacctagtcacggaccggatccggaggacagtaaagtttctgtgcgccctcggacgcggtattcctatcttaagcctggactggcttcaccagtctagaaaggccggtttctttctgccgcctgatgagtacgtagtgacagatcccgaacaagagaaaaacttcggcttctcactccaggatgccctttcgcgggcaagagaaagacggttgttggaaggctatgaaatctatgtaacaccaggtgtccaaccccctcccccacagatgggagagataatttcatgctgtggcggtacatatctgccctctatgccgaggtcgtataaaccccagcgagtcgtgataacatgtcctcaggacttcccgcattgctcaatacctctccgtgtgggtttgcctctgctcagtccagaatttctgctgactggtgttctgaagcaggaggctaagcccgaggccttcgtgctatctccgctggaaatgagtagcacata

SEQ ID NO: 29378 - DNA, 666 bp, Artificial Sequence
  Description of Artificial Sequence: Synthetic coding sequence
atggaagatacgcaggccatcgactgggacgtggaggaagaggaagagacggaacagagttcagaaagcttacgttgtaatgtagagcctgtgggaagactacatatctttagcggcgcacacggccctgagaaagattttccacttcatctgggtaagaatgtggtgggcagaatgccagactgctccgtggccctgccattcccctcaatcagtaaacaacatgccgaaatcgaaattttagcttgggacaaagcacccatactgcgtgactgtggctcgttgaatgggactcaaatcctatcaagtagcctgccgccaccccagacatctctgctgccactctctttgcgcttgcgccttctgggagaagaacagattgatccattgtcaagactactcaaacagctgagcccacagccgctctcttaccggttaccaccaccccaaacatctctctcacctctaagccctcacctgggtccgctgggggaggaaaaaataggaccgctgtccaggccattgaagcagttatgtccgcagcctctgagcagctctctgcccccaccacagacgaacctaagcccactctcccctcatcttggcccactgggagccggacagatcggcccactaagccggccattgaaccagctgagcctgtag

SEQ ID NO: 29379 - DNA, 738 bp, Artificial Sequence
  Description of Artificial Sequence: Synthetic coding sequence
atggaagacacacaagccattgattgggacgtggaggaagaggaagagacagagcaaagttccgagtctctgagatgtaatgtggaaccagtggggagacttcacatcttctctggagctcatggaccagaaaaggactttcccttgcacctggggaaaaacgtcgtcggacgtatgcctgactgcagtgtggccctcccatttccctccatatccaaacaacatgctgagattgagattctggcatgggacaaagctcccattctgagggactgtggttccttgaacggaactcaaatattacggccacccaaggtgctctcaccaggcgtgtcacaccgcttgcgcgaccaggagctcatacttttcgctgaccttctgtgtcagtatcatcggctggacgtgagcttacccttcgtgtcgcggggacccttgactgtggaagaaacgccacgcgtgcagggagaaacccaaccccagcgccttttgctggcagaagactcagaggaggaagttgactttttgagcgaaaggagaatggttaaaaagtcccgaaccaccagcagtagcgttatcgtccctgagagtgacgaagaagggcactcccccgtcctaggaggactgggtccaccttttgctttcaatctgaactcggacactgatgtagaagagggacagcagccagctactgaagaggcctcttccgcagcacgccgaggcgcaacggttgaggcttag

SEQ ID NO: 29380 - DNA, 735 bp, Artificial Sequence
  Description of Artificial Sequence: Synthetic coding sequence
atggaagacacacaggccattgactgggacgtggaggaagaagaggagacagagcagagcagcgagtcccttagatgcaacgttgagccggtcggacggctccacatcttctccggggctcacggccctgaaaaggatttcccactccacctcggcaagaatgtggtaggacgtatgcccgattgcagtgtggctctcccatttccatccatctcaaaacagcacgcagagatcgaaatcctggcttgggacaaggctcccattcttagagactgcgggtcactgaacggaacacagatcctgagaccacccaaagtgctgtctcccggagttagccatagactgcgagaccaggagctgatcttgttcgccgacctcctgtgtcagtatcacagattggatgtgagcctgcccttcgtgagccgaggacccctgactgtcgaggaaaccccaagagtgcaaggcgaaacccagccgcagaggctgttactggcagaagatagtgaagaagaagtggacttcctgagcgaacgaagaatggttaaaaaatccaggaccaccagcagcagtgtgatagttcccgaatccgacgaggaaggtcactcaccagtgctcggcggactcggaccaccgtttgctttcaacttaaatagtgataccgatgttgaagagggtcagcaaccccatcggggtgggctgctgtcttgccagaaaaggtgccattgccggggatag

SEQ ID NO: 29381 - DNA, 5477 bp, Artificial Sequence
  Description of Artificial Sequence: Synthetic coding sequence
atggaggatactcaagcgatcgactgggacgttgaagaggaagaggagactgaacaatcctcagaatccctgcgctgtaacgtagagcccgtcggtcgtttgcacattttttcaggggctcatggacccgaaaaggactttcctctgcatctggggaaaaatgtagtggggagaatgcccgattgctccgtcgctctgccttttccatctatttcaaaacagcacgctgagatcgaaatcttagcctgggacaaagctccaatcctgcgggattgcggatctctcaacgggactcagatcctccgaccccctaaagtgctcagtccgggagtgagtcaccgactgagagaccaggaactgatcctgtttgccgacttgttgtgtcaatatcaccgattggatgttagcctgcccttcgtaagtcggggtccacttacagtcgaggaaacccctagagtccagggcgagacccagcctcagaggctgctgctggcggaggactccgaggaggaggtggattttctgtccgaacgccgtatggtcaaaaaatcgcgcactaccagtagttctgtcattgtacccgaatcagatgaggagggccattcccccgtccttgggggattgggcccaccattcgcattcaatctgaactctgatactgatgttgaagaaggacagcaaccagccaccgaagaagcctcctccgccgcacggaggggggcaactgtggaggcaaaacagtcagaagcggaagtggtgaccgagatacagctggaaaaagaccagcccctggtcaaggagaaagacaacgacacgaaagtgaaacggggtgcaggaaatggagtggtcccagccggtgtgattctggagagatcacagcctcccggtgaggactccgataccgacgtagatgatgattccagaccgccagggcgacccgctgaagtccacctggagcgcgcacagcctttcggtttcatagacagtgacaccgatgccgaggaagagcggatcccggcaaccccggtggttatcccaatgaaaaaacgcaaaatcttccatggcgtaggcacgagaggcccaggcgctcctggattggcccatctgcaggaaagtcaggccggatccgacaccgacgttgaagaaggtaaggcccctcaggctgtgcctctggagaaatcccaggctagcatggtcattaattcagacaccgatgacgaggaagaggtttctgcagccctgactctcgctcacctcaaggagagccagcccgcaatctggaacagggacgccgaggaagatatgccacagagagtggtcctcctccagcgttctcaaacaaccactgagagagacagcgatacagacgtggaggaagaagaactgcccgtcgagaacagggaagccgtacttaaagaccataccaaaattcgcgcactcgtgcgggcacatagtgaaaaggatcagcctccattcggagacagtgacgactctgtggaggcagacaagtcgagcccaggaatacacctcgaacgaagccaggcatctactaccgtcgacatcaatacacaggtggaaaaggaagttcctcctggctcagccatcattcacatcaaaaagcaccaggtgagcgtggagggcactaatcagacagacgttaaggccgtggggggaccagccaaattgttggtggtctctctcgaggaagcatggccccttcatggtgattgcgagactgacgccgaggaaggtaccagcttaactgcatctgtggtggccgacgttagaaaaagccaactgcccgctgagggtgatgccggtgcagagtgggccgctgctgtgctgaaacaagaacgagcccatgaggtaggagcacagggtgggccacctgttgcccaggtggagcaggatctccctatcagccgcgagaacctcaccgatctggtggtggacacagacacgctgggcgaaagcactcagccccagcgtgagggagcccaggtgccaaccggtcgggagagagagcagcacgtcggagggaccaaggatagtgaagataactacggcgatagcgaggacctggatctgcaggccactcagtgcttcctcgagaaccaaggactggaggctgtgcagtccatggaggatgaacctacacaagcctttatgctgaccccccctcaggaactgggacctagtcattgttcctttcaaaccaccggtttactgaattgcaaaatgccccctgcggagaaagcttcaagaatccgggcagccgagaaagtctctaggggcgatcaggaaagtcccgatgcttgcttgcctcccactgtgccagaggcacctgcccctccacagaagcctctgaactcacagagccaaaagcacctggcaccgcctcccctcctttcccctctgctaccctcgatcaagcccacagttcgcaagacgcggcaagatggctcgcaagaggcgccagaggccccactctccagcgagctggagccattccacccaaagccaaagattcggacccgcaagtccagtcgtatgaccccttttcccgctacgtctgccgctccagagcctcacccgagtacatctaccgcccagccggtgacgccaaaacccacatcccaggcaacccggtctcgcacaaaccgatctagcgttaaaaccccggagcctgtggttcccaccgctcccgagcttcagccaagtacgtcgacagaccagccggttacaagtgaaccgacctcccaggtgactagagggaggaagtcgcggagctctgtcaagaccccggaaacagtggttcctactgccctggagttacaacccagcacctctactgatcggccagtcacatcagaacccaccagccaggctacaagaggacgaaaaaataggtcatcggttaagaccccagaacccgttgtacccacggctcccgagctacaaccaagcacaagtactgaccagcccgtcactagcgaacctacttatcaggccacaagggggaggaaaaacagaagtagcgtgaaaactccagagcctgtggttccgaccgcacctgaattaagaccctcaacaagcactgaccgtcccgtgactccgaagccaaccagtcgaacaacacgatcacgcacgaatatgtccagcgtgaagacccctgaaacggtggtgccaactgctcccgaactgcaaatttcaactagtaccgaccagccagtcacccccaagcccacttctaggaccactcgctcacggactaacatgagctcagtgaagaaccctgaatctacagttccgattgctccagagctgcccccttccacttccaccgaacagccggtaactccagaacccacatcacgggcaacaagagggagaaagaacagatctagcgggaagacaccggaaacgttagtcccaactgccccaaagcttgagccatcaacctctaccgaccagcccgttaccccagaacccacatcccaggccacacggggacggaccaatagatcttcagtgaaaactccagagacagtggtgccgacagccccagagctacagccttccacctctaccgatcagcctgttacacctgaacccacttcccaggctaccagaggccgaaccgaccgatcttctgttaaaaccccagaaactgttgtgccaactgcgccagagctgcaggccagcgcttccactgaccagcctgttacttctgagcctacatcgcgcacaactagaggaagaaagaaccgcagcagcgtgaaaacccctgaaacggttgtgcctgctgcacctgaactgcaacctagcacatctaccgaccagccggtcactcccgagcccacctctagggctactcgagggcgtaccaataggtcctctgtgaaaaccccagagagcatagtgccaatagcaccggaactgcagccaagcacaagcagaaatcaactggttacaccagagccaactagtcgcgctacacggtgtagaactaatcgcagcagtgtgaagacaccagaacctgttgtgccaacagcaccagaaccgcatcctacaacatcaactgatcaacctgtgaccccaaagctcacgagccgggcaactagaagaaagaccaacagaagttctgtgaaaacccccaaacccgtggaacccgctgcatctgacctggagccttttactcccaccgaccagtcagtcactccagaggctatcgctcagggtgggcagagcaaaacacttcgatcctctacagtgagagcgatgcccgtcccaactacacccgaattccagtcccctgtcactaccgatcagcctatatcgcccgagcctataacgcagccatcctgcatcaaaaggcagagggcagcagggaatcccggaagcctggcagcacccatcgaccacaagccatgcagtgctccacttgaaccaaaatctcaggcctccagaaaccagagatggggcgctgtccgggctgccgagtctctaactgcaatcccagagccagcatccccccagctgttagagacccctattcacgcctcccaaatacaaaaggtcgaacccgcaggtcgttccaggttcacaccagagctgcagcctaaagcctcacaatcaaggaaacgaagcctcgccactatggattcacctccacaccagaaacaaccacagagaggcgaggtgtcccagaaaactgtgatcatcaaggaagaagaagaggatactgctgagaagcctggcaaagaggaggatgtggtgacacctaaacctgggaaaagaaagcgggatcaggctgaagaagagccgaatcggatcccgtccagatcacttcggagaacgaaactaaaccaggaatccactgcccctaaggtgcttttcactggcgttgttgacgccagaggtgagagggcggtgttggccttaggtggctcattggctggctccgcggcagaagcttctcatcttgtaacagaccgaatacggagaacagtgaagtttctttgtgcactgggcagaggcatacccatcctctcactcgactggctgcaccaaagccggaaagccggtttctttctgcctccggatgagtatgtggttactgatccagaacaagaaaaaaacttcggcttcagcctgcaggacgccctgtctcgagcaagggaaaggaggctgctagaggggtacgaaatctacgtgacaccaggcgtacagcccccacccccacagatgggcgagatcattagctgctgtgggggtacgtacctaccaagtatgcctcgttcttataaaccccagagggtggttataacttgcccacaagacttccctcactgtagtataccgcttcgagtggggctgcccctgttgtccccagagtttcttttgactggtgtgctgaagcaggaagccaaacccgaagcattcgtgttgagccctctggaaatgagttcaacata

SEQ ID NO: 29382 - DNA, 4968 bp, Artificial Sequence
  Description of Artificial Sequence: Synthetic coding sequence
atgtatcatcgtttggacgtgtctctgccttttgtttcaaggggtcccttaaccgtagaggaaactcccagggtccagggcgagacgcaaccacaaaggctgctcctcgctgaagactctgaggaggaagtggacttcctctccgaaaggcgaatggttaaaaagagccgcacaactagttcaagcgtgatcgtccctgaatccgatgaggagggtcacagccctgtgctgggcggattaggccctcctttcgctttcaatcttaactccgacaccgacgtggaagaaggccagcagccagccaccgaagaggcgtccagtgctgccagaagaggtgccaccgttgaagccaagcagagcgaggccgaggtggttacagaaatacaactggaaaaagaccaacctcttgtcaaagaaaaagacaatgatacaaaggtgaagcggggtgctggcaatggcgtggtccccgcaggagtcattcttgaaagaagtcagccacctggcgaggattctgatacagatgtagacgatgactcacgccctcccggtcgaccagctgaagtccaccttgagcgcgctcagcccttcggattcattgatagcgacaccgacgcggaggaagagaggataccagcgacacccgtggtgattcccatgaagaagagaaagatctttcacggcgtgggcacccgaggacccggagctcccggtctggcacacctgcaagagtcgcaagctggatcagacacagacgttgaagagggcaaggcacctcaggcagtgccccttgagaaaagtcaagctagcatggtcattaattcggatactgacgacgaggaggaggtcagcgccgcactcaccctggcccatctgaaggagagccagccagctatctggaacagagatgctgaagaggacatgccacagcgggtggttttgctgcagcgcagccaaacaaccactgaacgggactctgatacagatgttgaggaggaggagctgccagtagagaacagggaagctgtgcttaaagaccacactaaaattcgcgctctggtgagagcccattctgaaaaagaccagcctccttttggggatagcgatgacagtgtcgaagcagacaaaagctcacccggtatacacctcgagagaagccaggcatcaacaacagtagatatcaacactcaggtggagaaggaggttccaccagggtcagccattattcacattaagaagcatcaggtcagcgttgaaggcaccaaccaaacagacgtgaaggccgtcgggggaccagcaaagctgctcgtggtttccctggaggaggcttggccgcttcatggcgactgtgagactgatgccgaggaggggacaagtctgaccgcgtccgttgttgcagatgttagaaaatcccaactgcctgccgagggggatgctggtgccgaatgggccgcagcggtgctcaagcaagagcgagcccatgaggtgggcgctcaggggggacccccagttgcccaagtggagcaggatctgcccatcagccgcgaaaacctgactgacctagtggttgacactgacactcttggggagagtacgcagccacagcgtgaaggcgcacaggtacccactggccgtgagcgcgaacaacatgtaggcggaaccaaggatagcgaagataactatggcgactcggaagacctggacttacaggccacacaatgctttcttgagaatcagggcctggaggttcaaagcatggaagacgaacctacgcaggctttcatgctcacacctcctcaggagctcggcccatcacactgcagcttccagaccaccgggttgctgaattgtaagatgcctcctgctgagaaggcctcacgaatcagggccgctgagaaagtctcccgaggagaccaggaatcccctgatgcctgtctgcctcccaccgttcccgaggcacctgccccacctcagaagcccctgaatagccagtcccagaaacaccttgcaccaccccctttattatctcccttgttgcccagcatcaagcctaccgtgagaaagacaagacaagatggctcacaggaagcccctgaggcacccctgtctagcgagctcgaaccttttcatcctaagcccaaaattcgtactcggaagtcctcgagaatgactcccttccctgcaacatccgcagcacctgagcctcacccatctacgtccacagcacagcccgtcacgcctaaacctaccagccaggctacacgcagccggaccaatcgttcatccgttaaaacccctgaacctgtggttccaactgcaccagagcttcaaccctctacctcaaccgaccagcccgtaacctcagagcctaccagtcaggtgacacgcggaagaaaaagcaggtcctcagttaaaacccccgagacggtcgtccccaccgccctagaactgcagcccagtaccagcaccgatcgccctgtaacctcggagccaacttcgcaggccacgaggggcagaaaaaacaggagctctgtaaagactccagaacccgtggtgccaaccgcacccgaacttcagcccagtacctccactgatcagccagtgacctccgagcctacatatcaggctacacggggaaggaagaacagatcctctgtaaaaacaccggaaccagtggtgccaaccgccccagagctccgtcccagcacatcaacagatcgccctgtgaccccgaagcccactagtcgaaccaccaggagtagaacgaacatgagctcagtcaagaatcctgaaagtacagtgcccatcgcaccagagttacccccttccactagtactgagcaacccgtcacaccagagcctacctcccgggctactagaggaaggaaaaaccgtagtagcggcaaaacccccgagactctcgttcccaccgcaccgaagcttgaacccagtacttccaccgaccagccggtgacccctgagccgacctcccaggctacacggggtcggactaaccggagtagcgtgaagacaccagagactgtagtgcccactgccccagaactgcagccttccacatctaccgatcaacccgtaactccagagccgacatctcaggccacacggggtcgcacagatagatcttctgttaagacccccgaaacagtggttccaacagccccagagctgcaggcttccgcctcaacagaccagcccgtcacgtccgaacctacgagcagaacaaccagaggacgtaagaaccgctcctctgtgaagacacctgagacagtggttcctgcagccccagagcttcagcccagcacctctactgaccagcccgtcacccccgaacccacgtcacgggcaacgcgtggcagaaccaatcggtctagcgtgaaaactcccgagagtatcgtacctatcgccccagagctccagcccagcacatcaaggaaccaattggtgacccctgaacccacatcccgggcaacaaggtgccgtactaaccgcagttccgtcaaaacgcccgaacctgttgtgccaacagctcctgaaccgcatccgacaacctctaccgatcaaccagttacacccaaattgacatccagagctactaggcgaaaaaccaatcgctcctcagtcaaaacgcctaagccggtggaacctgcagcatccgatttggagcctttcactcctaccgaccagtctgtcactccagaggcaatcgcacaggggggacaaagcaagacactcaggagtagtacggttcgcgcaatgcctgtgcccaccacacctgagttccaaagtcccgtgactaccgaccaaccaatatctccagagcccatcactcaacccagttgtattaaaaggcagagagcagcaggcaaccccggatcactcgctgcccctatcgatcataaaccatgcagtgctccactggaacccaaatcacaggcttctagaaaccaaaggtggggggcagtcagggccgcagagtcactgactgccattcccgaaccagctagtccccagctgctcgagacgccaattcacgccagccaaatacagaaggtagagcctgctggtcggtcccgatttacacctgaattgcagcccaaggcctcacagtccaggaaacgctcgctagctactatggatagccctccccatcagaagcagccccaacgcggtgaagtatctcagaagaccgttatcataaaagaggaggaggaggacactgccgagaagccgggaaaggaagaggatgtcgtgacccccaagcccggtaaaaggaaaagggatcaagccgaggaggagcccaaccgaattcctagccggagcctcagacggacaaagttgaatcaggaatctaccgcaccgaaggtcttattcacgggtgttgttgatgcccgaggggagcgcgcagtgctggcgctggggggttctttagccggatcagcagcagaagcgagtcacttagtgactgatcgcattaggaggaccgttaagttcctgtgcgcgctggggagggggatccccatcctcagcttggactggctgcaccagtcaagaaaggcaggttttttccttcctcctgatgaatacgttgtcaccgaccctgagcaggaaaagaatttcggcttctcactgcaggatgccctttctcgcgcaagggagaggaggctcctggaagggtacgagatttacgttacacccggagtgcagcctcccccacctcagatgggggagatcatcagttgttgcgggggtacgtaccttccttcaatgccccgttcctacaagccacaaagggtcgtgattacatgcccgcaggactttccccactgctccattccacttcgcgtcggtcttcctttactatcccccgagttcctcttgacaggcgttctgaaacaggaagcaaagcccgaggccttcgtgctctctccacttgaaatgtcatccacctag

SEQ ID NO: 29383 - DNA, 1941 bp, Artificial Sequence
  Description of Artificial Sequence: Synthetic coding sequence
atgggtctaccccgtctggtgtgtgctttccttctggcggcttgttgttgctgccctagggtggctggcgttccaggtgaggcagaacagccagcacccgagctggtggaggtggaagtgggtagcacagctctgctgaagtgtggcttaagccagtctcaggggaatctgagtcacgtggattggttcagtgtccacaaagagaagaggacactgatctttagagtgaggcagggccaggggcagtcagagcctggcgagtacgaacaacgtttgtccctccaggataggggagcaacattagctctgactcaagtgactccacaggatgaaagaatcttcctgtgtcaaggaaagcggcctaggagtcaggagtacagaattcagctccgggtatataaggcccctgaagagccaaacattcaagttaacccactcgggatccctgtgaatagcaaggagccggaagaagtggctacatgcgtaggccgaaatggataccctatccctcaggtgatttggtacaaaaacggacgtcctcttaaggaggaaaaaaaccgtgtgcatatccagtcctcgcagacagtcgagtcatccggcctatacaccctgcagtctatccttaaggcccagctggttaaggaggataaagatgcacagttttattgcgaacttaactaccgactcccatctggcaaccacatgaaagaatccagagaagtaacagtccctgtcttttacccaaccgaaaaagtctggctggaagtggaaccagtgggtatgctgaaagaaggtgacagagtggagattcgttgtctggctgatggtaaccctccacctcacttctccataagtaagcagaacccaagcacacgggaagcagaggaagagaccaccaatgacaatggggtgcttgtcctcgagcccgctaggaaagaacatagcgggagatacgagtgccagggcttagatctggacaccatgatctctttgttatcagaaccccaggagctgctggtgaattatgtctccgacgtgcgggtgagtcccgctgcgcctgagcggcaggagggatcttccctcacactcacctgcgaggcagagagctcccaggacttggagttccagtggcttcgagaagagacagggcaggtgttggagcgcggtcccgtcctgcaactgcatgaccttaagcgcgaagctgggggtggatacaggtgcgtggctagcgtaccatctatcccaggcctgaaccgtacccaattggtcaatgtggcaatctttgggcctccttggatggcctttaaagaaagaaaggtgtgggtcaaggagaacatggtgcttaatttgagttgcgaggcatctggccatccccgacctaccataagctggaacgtgaatggaactgcatcagagcaagatcaggacccccaaagagtgttaagcaccctgaacgtgctagtaacccctgaacttctcgagaccggagtcgagtgcactgcctcaaacgatttgggcaaaaacacttcaattctatttctagaactcgttaatctgaccacactcacccctgatagcaataccaccaccggactgtctacgtcaaccgcctcaccacacactcgagctaattccacctccacagaaaggaagctgccagaaccggagagccggggagtggttatagttgcagtcattgtctgcatactggttctggctgtcctcggcgcagttttgtactttctgtataagaaaggaaaacttccctgccgcaggtctggcaaacaggaaatcaccctgccgccttcccgcaagtctgagctcgtcgtcgaggttaaatccgacaagctcccagaggagatgggtctgctgcaagggagttctggagacaagcgcgcaccaggagaccagggtgagaagtacattgatctcaggcactag

SEQ ID NO: 29384 - DNA, 1584 bp, Artificial Sequence
  Description of Artificial Sequence: Synthetic coding sequence
atggtgtacattgtccggcagtttctcctctacaacgttagcggtagtgtttacctggatcaactcatcgtgttactgacagccaagttctcgattctccgcattgccggaagcagggtgcatcactccccatttagtggccatttggatggctgcagtttcctcagccttcagcacagcctgcacacgtctcttgatatgtcacggcacgaaaatgtgttcctgggactgacactctcctcaaagagcgcgggactgaagggtttccagttggcattcgtgccaggactactgcagggaaccggcggatatttagacggaccccttccaactccagttgacaaccctagggtgggcctggaggtgggcttgaggcttagcctcccaccactcccaccctgtcctggagtgcatatccagtctagtcagaccgtcgagtcttcggggctgtacacactgcagtcaatcctaaaagcacagctcgtgaaggaagacaaggacgcacaattctattgcgagctgaactatcgactgccctcgggaaaccacatgaaagagagtagggaggttacggttccagtcttctatcccaccgagaaggtgtggctggaagttgagcctgtcggcatgctcaaggaaggcgacagggttgagattaggtgtctagccgacggcaacccccctccccattttagcatatctaagcagaacccatcaacgcgggaggctgaggaggagacaacaaatgacaacggcgtactagttctcgaacccgctagaaaagagcacagtggcaggtacgagtgtcagggcttggatctagatactatgatctcacttctaagcgagccgcaagaactgctggtaaactacgtctcagacgtccgggtcagccctgctgctcccgagaggcaggagggtagctccttaacactgacctgtgaagccgagagttcccaggacttggagttccagtggctgcgcgaagagacaggccaggtgttagaaagggggccagtgttgcaactgcatgatctgaagcgggaagccggagggggttaccgctgcgtggctagcgtgcccagcatcccaggcctgaaccggacacaactcgtgaacgtcgccatcttcggccctccatggatggcattcaaggaaagaaaggtgtgggtgaaagaaaatatggtactgaatctcagctgcgaggctagtggccacccacggcctacgattagttggaacgttaatggaacggcctctgaacaagatcaggatccccaacgagtgctgtccaccctcaacgtgttggttacaccagagctcctcgagacgggtgtcgagtgtacggcatccaatgatctcgggaagaatacttccatactgttcttggagttagtgaacttgaccacactaacgccagactccaatacgaccaccggcttatctacctccacggcatcgccacacacaagagctaattcaaccagcactggaaaacccggacttgccagggagcaggggtgtgccagggccagctttctcccctgtccttccccagagtctcctgttcagaaaggtgagtag

SEQ ID NO: 29385 - DNA, 141 bp, Artificial Sequence
  Description of Artificial Sequence: Synthetic coding sequence
ggtgtggtgatcgtcgcagtcattgtttgcattctggttctcgccgttttaggggctgttctgtatttcctctacaaaaagggcaagttgccatgtaggcgttccgggaaacaagaaatggaacgcaacacctctatttag

SEQ ID NO: 29386 - DNA, 2253 bp, Artificial Sequence
  Description of Artificial Sequence: Synthetic coding sequence
atgggtaaaagtgagtctcagatggacataacggacattaatacccctaaacctaaaaagaagcagcgctggacaccactcgaaataagcctcagtgtgctggtgctgctgctgaccatcattgccgtcactatgattgcattatacgccacatacgatgatggaatctgcaaaagttccgactgcatcaaaagcgcagcacggctcattcagaatatggacgccacgaccgaaccctgtaccgatttttttaagtacgcatgtgggggttggctcaagagaaatgtgatccctgaaaccagctcaaggtatggcaattttgatattctccgtgatgaacttgaggttgtgctgaaggatgtcctgcaggaacctaaaaccgaagacattgtggctgtacagaaggctaaggcgttataccggagctgcatcaatgaaagcgccatagacagcagaggcggtgaaccactgctgaagctgctccctgatatctacggttggcccgtggctacagaaaattgggagcagaaatatggtgcatcatggaccgcggagaaagcgattgcccaactcaacagcaaatacgggaagaaagttctcattaaccttttcgttggaacggatgacaaaaactcggtgaatcacgtaattcacatcgatcagccgagactgggtttaccgagccgggattactacgagtgcacgggcatttataaagaagcttgcaccgcttatgtcgacttcatgattagtgtcgcaaggctgattagacaggaggagcgcctgccgatcgacgaaaaccagctggcactagagatgaacaaagtaatggaacttgaaaaggaaattgctaatgccaccgcaaagccagaagataggaacgatcctatgctgctgtataataaaatgacattggctcaaatccagaacaatttcagtttggagattaatggaaaacctttttcatggctcaatttcaccaatgagatcatgtcaaccgtaaatatttctattaccaacgaggaagacgtcgtggtgtatgctcctgaatatttaactaagctgaagccaattcttacaaaatatagcgcgcgtgatttacagaatctaatgtcttggcgcttcattatggatctcgtgtcctcgctgagtcgcacgtacaaggagtctaggaacgcgtttaggaaagccctctatggcaccacatccgagaccgcaacctggaggaggtgcgccaactacgtcaacggcaacatggagaatgcggtgggcagactgtatgtcgaagctgccttcgccggagagtcgaagcatgtcgtcgaagatctgattgcccagatccgggaggtcttcattcagaccctcgatgatctgacatggatggatgcagagactaagaaaagggccgaggagaaagccctggctatcaaagaaaggataggctacccagacgatatagtctctaacgataacaagcttaataatgagtatctggagctaaattataaggaagatgagtactttgaaaacattattcagaatctaaagttttcccagagcaagcaactaaaaaaactgagggagaaagtggataaagacgagtggatttcgggagcagcagttgtgaacgccttctattcctccgggcgaaaccagattgtgtttccagccggaatattgcaacctccatttttcagcgcacagcagtcaaattctttgaactatggaggcatcgggatggtcatcggacacgaaatcacccacggcttcgacgataatggacgcaatttcaataaagatggagacctggtggactggtggactcagcagtctgcgagcaattttaaggaacagtctcagtgtatggtctaccaatatggaaatttctcatgggatctggcgggtggtcagcacttgaatgggattaacacactgggagaaaatatagccgacaacgggggactaggacaggcttaccgcgcttatcagaattatatcaaaaagaacggggaggagaagctcctacccggattggacctcaaccataagcagttattcttcctgaacttcgcccaggtctggtgcgggacctatcgaccagagtatgccgtgaattctatcaagactgatgtccactctcccggaaatttcagaatcattggcaccctccaaaattctgccgagttcagcgaagcatttcactgtcggaagaacagttatatgaatcctgagaaaaaatgtcgcgtctggtag

SEQ ID NO: 29387 - DNA, 2253 bp, Artificial Sequence
  Description of Artificial Sequence: Synthetic coding sequence
atgggtaaaagtgaatcccagatggacatcacggacattaacactccgaaacccaagaaaaagcagcgctggacacccttggaaatttcccttagcgtgctggtcttactattaacaattattgcggtgaccatgattgcattgtatgccacctacgatgacgggatctgcaagagctccgactgtataaagagcgccgcacgactgattcaaaacatggatgcaactactgaaccctgcacagatttcttcaaatacgcctgcggagggtggctgaaaagaaatgtcatccccgagacctcaagccggtatgggaactttgacatcttgcgagatgaattggaagtagtccttaaggacgtgctgcaggaaccaaagaccgaggatatcgttgcagtgcagaaggcaaaagcactgtacagaagctgtattaacgaatctgcaattgactccagaggtggggagccgctgctcaaacttttgccagacatctacggttggcctgtggctactgaaaactgggaacagaagtatggagcatcctggactgcggaaaaagccatcgcgcagcttaatagcaaatacggaaaaaaggtcttaataaatctttttgtgggaaccgacgataagaacagcgtgaatcacgtgatccacatagatcagccaagattgggcctgccgtcacgagactattatgaatgtacgggaatctacaaagaggcgtgcacagcatatgttgactttatgatcagcgtggccagactgattaggcaggaagaacggcttcccattgatgagaaccagcttgccttggagatgaataaagtcatggagcttgaaaaggagattgcaaacgctaccgcgaaaccagaagaccgcaacgatcctatgctcctctataataaaatgacgctagctcaaattcagaacaatttctccttggagatcaacggcaagccattcagctggttgaactttactaacgagattatgtctacagtgaatatttccataacaaacgaggaggacgtggtggtttacgcccctgaatatctcaccaaactaaagcctattctaacaaagtactctgcccgagatttgcagaacctgatgtcctggcgatttattatggatttggtaagcagtctgtctcgcacctacaaagagagtaggaacgcgtttcgtaaggcgctgtacggcacaacatctgagactgcaacatggcggcgatgcgctaactatgttaatggcaacatggagaacgctgtcggtagactgtacgtggaggccgcatttgcaggcgagtctaagcacgtcgtggaagacctgattgctcagattcgggaggttttcatccagaccttagatgacctaacttggatggatgccgaaaccaagaagcgggcagaagaaaaagccctcgccattaaagaacgaatcggctacccggatgacatcgtgtccaatgataataagcttaacaatgaatacctggagctgaactacaaggaagacgagtattttgagaacatcattcagaacctcaagttcagtcagagcaagcagttgaaaaaacttcgggaaaaggttgataaagatgaatggattagcggcgctgcggtcgttaacgcattctatagctccggtcgaaatcaaattgtgtttcccgcaggtatcttacagcctccctttttcagcgctcagcagtccaattcactaaattatggcggaattggaatggtgatcggacacgagattactcatggatttgatgacaatggacggaacttcaacaaagatggtgacctggtagactggtggacccagcaaagtgcaagtaatttcaaggaacagtcccagtgcatggtgtatcagtacggtaacttttcatgggatctggcaggcggtcagcatttaaatggcatcaataccttaggggagaacattgcagacaatggcggtctcgggcaggcgtacagggcctatcagaactatatcaagaagaatggcgaagaaaagctgttgccgggactcgatcttaatcataagcagttgttcttcttaaattttgctcaggtttggtgcggaacatacaggccagaatatgcagtgaactccatcaagactgacgtccactccccaggcaattttagaataattggaacgctgcaaaactcagcagaattctctgaggcatttcactgtagaaaaaattcgtacatgaatccggaaaaaaaatgccgagtatggtag

SEQ ID NO: 29388 - DNA, 2253 bp, Artificial Sequence
  Description of Artificial Sequence: Synthetic coding sequence
atgggaaagagtgagtctcagatggatataacagatataaatactcctaagccaaaaaaaaaacagcgttggacgccacttgaaatttccctgtcagttctggtactcctgctgacgattattgctgtaacaatgatagccttgtacgccacctatgacgacgggatctgcaaatctagcgactgtatcaaatccgccgctagactgatccagaacatggatgccacgacagaaccctgtacagacttcttcaaatatgcctgtggtgggtggctcaaacgtaacgttattcccgagactagtagtagatacgggaatttcgatatcctcagagacgagctggaggtcgtcctcaaggatgtgttacaggagcccaaaactgaggatatagtcgccgtccagaaggccaaggccctgtaccgcagctgtatcaacgagtctgcgatagacagcagaggcggagaaccactgctcaagctgctccccgatatatatggatggcccgtggctaccgagaactgggaacaaaagtatggcgctagctggacagccgagaaggccatcgcgcagttaaattctaagtacgggaagaaggtgctgatcaatcttttcgtcggaacagatgacaagaatagcgtgaaccacgtcatccacatagatcagcccagactgggtctgccatcacgtgattactatgagtgcactggtatttacaaagaggcatgtacagcatatgtggatttcatgattagtgtggcacgactcatcaggcaggaggagagactgcccatagatgagaaccagctggcactggaaatgaataaggttatggagcttgagaaagagattgccaacgcgacggccaagccagaagataggaacgaccctatgttgctctacaacaagatgacactagcacaaatccagaacaactttagcctagaaattaatggaaagccttttagttggctcaactttacaaacgagatcatgtccaccgttaatatctctattacaaacgaggaggatgttgtggtgtatgctccagagtaccttacaaaactcaaacctatcctcaccaagtactccgcacgagatctgcagaatctgatgtcgtggaggttcatcatggacttagtgtctagtctgtccaggacatataaagagtcccgcaatgctttccgaaaagccctgtacggtaccacttcagagacagcgacttggaggagatgtgccaattacgtaaacggcaatatggagaatgccgttggacgactctatgtggaggctgcctttgccggagagagcaagcatgtggtggaagacctgatcgcccagattcgcgaagtgttcattcagacattggatgacctgacctggatggatgccgagacaaagaaacgagccgaggagaaggcactggctattaaggaaagaatcgggtatcccgatgacatcgttagtaacgataataaactgaacaatgaatacttggaactcaactataaggaggacgaatattttgagaatattatccagaatctgaagtttagtcagtctaaacagctgaagaaactacgagagaaggtggataaggacgaatggatctccggggctgccgtagtcaacgctttctactcttccggcagaaaccagattgtgtttcctgctggaattcttcagcccccattcttttctgcgcagcagagcaactccctgaattatggcggtattggaatggttatcggccatgaaattactcacggcttcgatgataacggccgaaactttaataaagatggtgacctggttgactggtggacccaacaaagtgcttcaaactttaaggaacaatcacagtgtatggtgtaccagtatgggaactttagctgggacctcgccggtgggcagcacttgaatggtatcaacactctgggggaaaacattgcggacaacgggggtctggggcaagcttatcgggcttatcagaattacataaaaaagaatggagaggagaaacttctgcccggtcttgatctcaaccacaaacaactcttcttcttgaactttgctcaggtgtggtgcgggacatacaggcctgaatatgcagtgaattccatcaaaacggacgtccatagccctggaaactttaggataataggcacactgcagaactcagcagagttcagtgaagcctttcattgccgaaaaaacagttatatgaacccggagaaaaaatgtagggtatggtag

SEQ ID NO: 29389 - DNA, 486 bp, Artificial Sequence
  Description of Artificial Sequence: Synthetic coding sequence
atgggcaagtctgaatcgcaaatggacattaccgatattaatactcccaaacctaagaaaaagcagcggtggacaccactcgaaatctctttaagcgttcttgtacttttgcttacaattattgccgtgactatgatcgctctgtatgcaacgtacgacgatgggatctgtaagtcctctgactgtatcaaatctgccgcacgcctaatccagaacatggacgcaaccacagagccctgtactgacttctttaaatatgcgtgtggaggctggctgaaaaggaatgtaatccctgaaacctcatcaaggtacggaaacttcgacattctcagggacgaacttgaggtggtactgaaggacgtgctgcaagaaccaaaaaccgaggatatcgtggcggtgcagaaagctaaagcgttatatcgctcatgtatcaacgaatctgctatagactccagaggaggagaaccactgctgaaactgctgtag

SEQ ID NO: 29390 - DNA, 282 bp, Artificial Sequence
  Description of Artificial Sequence: Synthetic coding sequence
atggggaagagcgagtcgcaaatggatattaccgatataaacacgcctaaaccaaaaaaaaaacagaggtggacccccctagaaatcagtctgtccgtgttggtcctgttgttaacaattatcgccgtgaccatgatcgcgctctatgccacctacgacgacggcatctgtaagtctagcgattgtatcaagagtgcagcacggttaattcagaacatggatgccacaacagagccttgtacggacttctttaaatatgcatgtgggggatggctaaagtag

SEQ ID NO: 29391 - DNA, 702 bp, Artificial Sequence
  Description of Artificial Sequence: Synthetic coding sequence
atgggcaagtctgagtctcaaatggatattacggacataaacacaccaaagcctaagaagaaacagcggtggacacccctagagatttctttgagtgtcttagtgctcctccttaccattatcgctgttaccatgattgctctttacgctacgtacgatgacggaatttgcaagagcagtgattgtataaagtccgccgctagattgatccaaaacatggacgctactacggagccatgcaccgactttttcaaatatgcctgtgggggttggctgaagcgtaacgtcattcctgaaactagctccagatacgggaacttcgacatccttcgggatgaactggaggtagtactcaaagacgtgctccaagagcctaagacagaggatatcgtggccgtccagaaggcaaaagctctgtaccggtcctgcattaatgaaagcgcgatcgactctaggggcggagagcctctgctgaagttactgccggacatctatgggtggccagtggctacagaaaattgggaacagaaatatggcgcatcttggaccgccgaaaaagctattgcccagctcaactcgaagtacggaaaaaaggttctgattaaccttttcgtaggtacggacgacaagaactcagtcaatcacgtcatacatatagatcagcccagactgggtctaccttcacgtgactactatgagtag

SEQ ID NO: 29392 - DNA, 360 bp, Artificial Sequence
  Description of Artificial Sequence: Synthetic coding sequence
atgggaaaaagtgagagtcagatggacatcaccgacataaacacacccaaacccaagaaaaaacagcggtggacaccgctcgaaatttccctgagcgtgctggttctccttcttacaatcatcgctgtgaccatgattgccctgtatgctacctatgacgatgggatctgcaagtcaagtgattgtatcaaatcagccgcacgcctgattcagaacatggatgccaccaccgagccctgtaccgatttctttaaatatgcatgtggcggttggttgaaacgtaacgtcataccagagacaagctcccgatacggaaactttgatattctccgcgacgagcttgaagttgtcctgaaatag

SEQ ID NO: 29393 - DNA, 2253 bp, Artificial Sequence
  Description of Artificial Sequence: Synthetic coding sequence
atgggaaaaagcgagagtcagatggacataacagatattaatacaccgaaacctaaaaagaagcaacgctggactcctctggagatctccctcagtgttctggtgctcctgctgaccattatcgctgtgaccatgattgctttgtacgccacttacgacgacggcatctgtaaaagctccgactgcataaagagcgcagcacggttgattcagaatatggacgctaccaccgagccttgtaccgacttctttaagtacgcgtgtgggggttggctgaaacggaacgttatccctgagaccagtagtcggtacggcaacttcgatattcttcgagacgagctggaggtggtcctcaaggacgtactgcaggagcctaaaaccgaggacatcgtcgccgtgcagaaagctaaggccctgtatcgatcatgcattaacgagtccgctatagatagccgtgggggtgagcctctgctgaaactgctgccagacatttatgggtggccggtcgccaccgagaactgggaacagaagtacggcgctagctggacggctgaaaaagccattgcgcaacttaacagtaaatacgggaaaaaggttctgatcaacctatttgtgggaacagatgacaagaatagtgtaaatcatgtgattcacatcgatcagcctcgattgggactgccgagtagggattattatgagtgtacaggcatctataaagaggcatgtactgcatacgtggattttatgattagcgtggcccgtctgatccgccaagaggagcggctgcccatcgacgaaaatcagctggctctcgaaatgaacaaggtgatggagctggagaaagagatcgcgaacgctactgctaagcccgaggatcgcaatgacccaatgctgctgtacaacaagatgaccctagcacaaatccagaataatttttctctggagattaatggcaagcccttctcctggctcaactttactaatgaaattatgtctactgttaatatctcgattacgaatgaagaggacgttgtggtatatgcgccagagtacctgaccaagctgaaaccgatcttgaccaaatactcagctcgtgaccttcagaacctcatgagctggagattcatcatggacctcgtaagcagtctgtcccgcacctacaaggagagtcggaacgctttcaggaaggccctgtacggcactacatccgaaaccgcaacatggcgcaggtgtgccaactatgttaacggcaacatggagaatgctgtcgggcgactgtatgtggaggcggctttcgccggtgaaagcaaacatgtggtggaagatctgattgcccaaatccgtgaagtattcattcagactctggatgacctgacatggatggacgctgagacaaagaagcgtgccgaagagaaagcattggcaattaaggaacgcatcggctaccccgatgatattgtgagcaatgataacaaactaaacaacgagtacctggaacttaattataaagaggatgaatactttgaaaatatcatccagaacctcaagttttcacagtccaaacagctcaagaagcttcgggaaaaagtcgacaaggatgaatggatttccggtgccgctgtggttaacgcgttctacagctcagggcgaaatcagattgtctttccagcaggtatactgcaacccccattcttttctgcacaacagtcaaactccctgaattacggtggaatcggtatggttattggacacgaaatcacccacggcttcgacgacaacgggaggaactttaataaagacggagacctggtcgactggtggacccagcagtctgcaagcaacttcaaagagcaatcccagtgcatggtttatcagtacgggaatttttcctgggatctcgccggagggcagcacttgaatggaattaatacgctcggcgagaatattgctgacaacggaggccttggacaggcctaccgcgcataccaaaattacatcaaaaagaatggcgaagagaaactgctgcctggattggaccttaaccacaaacagctgttcttcctaaattttgcacaggtctggtgcggtacataccggccagagtatgccgtgaactctatcaagacagacgtgcattctcctggtaacttcaggattataggtaccctgcagaacagtgcagaattctccgaggctttccattgcagaaaaaacagttacatgaaccccgagaaaaagtgcagggtttggtag

SEQ ID NO: 29394 - DNA, 2253 bp, Artificial Sequence
  Description of Artificial Sequence: Synthetic coding sequence
atgggaaaatccgaatcccagatggacatcacagatataaatacccccaagcctaaaaagaaacagcggtggactccactcgaaatcagtctgtccgtcctcgtcctgctcctgaccatcatagctgtcaccatgatcgccctctacgccacctatgatgatggcatatgtaagtcgagcgattgtattaagtcagccgctagactcattcagaatatggacgcgacaaccgaaccttgcacagacttctttaagtatgcttgtggcggatggctgaagcgcaatgtgatccctgagacaagctccagatatggaaactttgatattctgcgagatgagctggaggtggttctgaaagatgtcctgcaggagcctaaaactgaggacattgtagcggtgcaaaaggccaaggcattataccgcagttgcatcaacgagtctgccatcgactccaggggcggagaaccattgctgaaactactgcccgacatctacggctggcccgtcgcgaccgagaactgggagcagaaatatggcgcatcatggactgctgaaaaggctatagcacagctcaactcaaagtacgggaagaaggtactaatcaaccttttcgtggggactgacgacaaaaatagcgtgaaccacgtgattcacatcgaccagccccgacttggactcccatctcgggattactatgagtgtaccggcatctacaaggaggcttgcacagcgtatgttgattttatgatcagcgttgctaggctgataaggcaggaggagagattacctatcgatgaaaaccaacttgccctcgaaatgaataaagttatggaactggaaaaagaaatcgccaatgctacggcgaagcctgaagatcgcaacgatccaatgctgctctataacaagatgaccttagcccaaatacagaacaacttttcactggaaatcaacggtaagccgttctcatggcttaacttcacaaacgagattatgtctaccgttaacatctctatcacgaacgaagaagacgtggtggtatacgcaccagaatatctgaccaagctgaagcctatcctgacaaagtatagcgcgagggatttacagaacttgatgagctggcgttttattatggatctggtgagcagcctttccaggacttacaaggaatctcgaaacgcttttagaaaagctctctacggcacgacgagcgaaacagccacttggcggagatgtgccaactacgttaacgggaatatggaaaacgcggtgggtcgattgtatgtagaggcagcttttgccggtgagtccaagcacgtagttgaggatctgatcgcacagatacgggaggtatttattcagactctggatgacctgacctggatggatgctgagacgaaaaaaagggctgaagaaaaggctcttgccatcaaggaacgtattggatatccagacgatattgtctctaatgataataagctcaataacgaatacttggaactgaattacaaggaggacgagtacttcgagaacatcatacagaatctgaagttctcgcaatctaaacagctaaaaaaattgagagagaaagtcgataaggacgagtggatttctggcgcagccgtcgtgaatgccttctattcgagcggacggaaccagattgtgttcccagccggaatcctccagccgccattcttttctgctcagcagtccaactcactgaactacggaggaatcggcatggtaattggccacgagatcacccatggctttgatgacaatggacgtaactttaataaggacggcgacttagtcgactggtggactcaacagtcagcaagcaactttaaggagcagtcacagtgcatggtgtatcaatacggcaatttttcctgggatcttgctggcggacagcacctgaacggcatcaacacattaggcgaaaacatcgcagataacggtggtctcggacaggcatatcgcgcatatcaaaactacatcaaaaagaatggtgaggagaaattgctgccaggattggatttaaatcataaacagctgtttttcctgaattttgcccaagtatggtgtggcacataccgccctgagtatgctgtcaattctatcaagacggatgttcacagccctggaaacttcaggattatcggcactctgcagaattccgcagaattcagtgaagcatttcactgccggaagaattcctacatgaacccggaaaagaagtgcagagtttggtag

SEQ ID NO: 29395 - DNA, 48 bp, Artificial Sequence
  Description of Artificial Sequence: Synthetic coding sequence
atggggaagtcagagagccagatggatatcaccgatattaatacttag

SEQ ID NO: 29396 - DNA, 894 bp, Artificial Sequence
  Description of Artificial Sequence: Synthetic coding sequence
atgactacccctcgaaattccgtgaacggaactttcccagccgaacctatgaaaggcccaattgccatgcagtccggccctaaacctctcttccggcgtatgtcaagcctcgtcggacccacccagtctttcttcatgcgcgagagcaaaacgctgggagcagtgcaaatcatgaacggcttattccatattgccctagggggactcctcatgatcccagccggaatttatgctcctatctgcgtgacagtatggtaccccctgtggggcggaatcatgtatatcattagcggctcgcttcttgcagcaacagagaagaattctcgtaaatgtttagttaagggaaaaatgatcatgaatagcctgtctctttttgccgctattagcggtatgatcctgagcataatggacatattgaatatcaaaattagccactttctgaagatggaaagtttgaacttcattagggctcacacgccttatattaatatttataactgcgagcccgctaaccctagcgagaagaattcaccttcaactcagtattgctattcaattcagtcgctgtttctggggatcctatcagtgatgttgatttttgcctttttccaggaattagtgatagctggcatagttgagaatgagtggaagagaacctgtagtaggccaaaatcaaacattgtcctgctgtctgcagaggaaaaaaaggaacagaccattgagattaaagaagaagtcgtgggtctgaccgagacatcttcacagccgaagaacgaagaggacatagagatcattccaatccaggaagaggaggaagaggagacagagaccaactttcccgaaccacctcaggaccaggagtcaagccccatagaaaatgattcatctccttag

SEQ ID NO: 29397 - DNA, 894 bp, Artificial Sequence
  Description of Artificial Sequence: Synthetic coding sequence
atgacaaccccgcgtaacagcgtcaacggaacgttccctgctgagccgatgaagggcccaatcgcaatgcaatcgggcccaaaacctcttttccgtcggatgtccagtctggtggggccaacacagtctttcttcatgcgagaatccaagaccctgggtgcagtgcagattatgaacggactcttccatatcgcccttggtgggttactcatgataccagccggtatctatgcacccatctgcgtcaccgtttggtatcctctgtggggcggtataatgtacattatttctggctctctcctggctgcgacggagaagaattctcgcaaatgccttgtgaagggcaaaatgattatgaacagcttgtccctgttcgcagctataagcggcatgattctctccattatggacatcttgaacataaagataagtcacttccttaagatggaatccctaaactttattcgggcacatactccttatattaacatctacaactgcgaacccgcaaaccctagtgagaagaatagcccttccacgcagtattgctactctattcagagtctcttcctgggcattctcagcgtgatgcttatctttgcattcttccaagagctggtgatcgctggcatagtggagaatgaatggaagcggacctgctccaggcccaagtctaacatcgtactcctttctgcagaggaaaaaaaggagcagaccatcgagatcaaagaagaggtggtcggactgaccgagacgtcttcacagccgaagaacgaggaggacatagaaataatcccaatacaggaggaggaggaagaggagacagaaactaacttcccagaaccgccacaggaccaggagagctcacctatcgagaacgactccagtccatag

SEQ ID NO: 29398 - DNA, 24 bp, Artificial Sequence
  Description of Artificial Sequence: Synthetic coding sequence
atgacgacccctagaaatagctag

SEQ ID NO: 29399 - DNA, 855 bp, Artificial Sequence
  Description of Artificial Sequence: Synthetic coding sequence
atgactactccaagaaattcagtcaacggaacatttcctgccgagccaatgaaaggacccattgccatgcagagcggacccaaaccactctttaggcggatgtcgagcctcgtcggcccaacgcagagcttttttatgcgcgaatctaagacacttggggctgtgcagatcatgaacggcctgttccatattgccctggggggtctactcatgatccccgctgggatctatgccccaatctgcgtgaccgtgtggtaccctttatggggaggtatcatgtacatcatctctggctcgctcctggctgctactgaaaaaaacagccggaagtgcctggtcaaggggaagatgattatgaacagtttgtcattatttgctgcaatcagcggcatgattcttagcataatggacattctgaacattaagatcagccactttctcaaaatggaatccctgaacttcatcagagcacataccccctacatcaatatctacaactgtgagccagctaaccctagtgaaaaaaattctccctctacccaatactgttacagcatccaaagcctgttcttagaattggtcatcgctggcatcgttgaaaacgagtggaagagaacttgttcgaggcccaagagtaacatcgtactcttgtccgctgaggagaaaaaagaacagaccatagaaatcaaggaagaagttgtgggcctgaccgaaaccagctcccagcctaagaacgaggaggatatcgagatcatcccaatccaagaggaggaggaggaggaaactgaaacaaatttcccagagcccccacaagaccaagaaagtagcccaatcgaaaacgattccagtccgtag

SEQ ID NO: 29400 - DNA, 21 bp, Artificial Sequence
  Description of Artificial Sequence: Synthetic coding sequence
atgacaactcctcggaattag

SEQ ID NO: 29401 - DNA, 894 bp, Artificial Sequence
  Description of Artificial Sequence: Synthetic coding sequence
atgactacacctcgaaatagcgtgaatgggacctttcccgctgagcccatgaagggacctattgccatgcagagcgggcctaaaccattgttccggaggatgagcagtttggtaggccctactcagagcttcttcatgagagaatctaaaactctcggagccgtacagatcatgaacggcctcttccatatagccttgggcggtcttctaatgattcccgctggaatctacgcccctatctgcgtaacggtctggtatccgttgtggggcggaataatgtatatcatttctggatcattgctggctgccactgagaagaattcacgtaaatgcctagtgaaggggaaaatgattatgaattctctctccctgtttgctgcaatttccggcatgattctctccattatggatatcctcaatataaagatctctcacttcctcaaaatggaaagcctgaactttattagggcgcatacaccatatataaacatatacaactgcgaacctgcgaatccgagtgaaaagaacagccctagcactcagtactgctattctatccagtccttgttcctggggattcttagtgtgatgctgatctttgccttttttcaagagctcgtcatcgctgggatagtagagaacgaatggaagaggacttgttccaggccaaaatcaaatattgtgctcctgtctgccgaggagaaaaaggaacaaaccatcgaaatcaaggaagaggtggttgggttgaccgaaacctcatcccaaccgaagaatgaggaggacatcgagattattcctatccaggaagaagaagaggaagagacagaaaccaacttccccgagccccctcaagaccaggagagctccccgatcgaaaatgattcatctccttag

SEQ ID NO: 29402 - DNA, 930 bp, Artificial Sequence
  Description of Artificial Sequence: Synthetic coding sequence
atggatgaccaagggtgtccaagatgcaagaccactaaatatcgaaacccctccctcaagctgatggtcaatgtgtgtggacataccctatgtgagtcgtgtgtcgacctgttatttgttcgaggtgccggaaactgccctgagtgtggcaccccattgcgtaaaagcaactttcgggttcagctgttcgaggatcctaccgtggacaaagaggtggagattagaaagaaagtgttgaaaatctacaataaaagggaggaggatttcccaagccttagggaatacaatgattttctagaggaggtcgaggagatcgtgtttaacctgactaataacgtcgaccttgataatacaaaaaaaaaaatggaaatctatcagaaggagaacaaggacgtcattcagaaaaataaactgaaattgactagagagcaggaagagctggaagaggcgctggaggttgaaagacaggaaaacgaacaaaggagacttttcatccagaaagaggaacagttacagcaaatcttgaaaaggaagaacaagcaggccttccttgacgaactggagagctcagacctccctgtggctcttcttttggctcagcacaaagacaggtccacccaactggaaatgcagctcgagaagccaaagccggtgaagccagtgactttctccaccgggataaagatgggccagcacattagcttggcccctatacataagctcgaagaggctttatatgagtatcagcctctgcagattgaaacctacggaccgcatgtgccagagttggagatgctagggaggttaggctacttgaatcatgtcagggctgcgagtccccaggacctagcagggggatacacttcatcgctcgcgtgtcaccgagcccttcaggatgccttttcgggacttttttggcagcccagttag

SEQ ID NO: 29403 - DNA, 804 bp, Artificial Sequence
  Description of Artificial Sequence: Synthetic coding sequence
atggatgaccagggctgccctagatgtaagacaacaaaatacagaaaccctagtctcaaactcatggtgaacgtctgtggacataccctttgcgaatcttgcgtagacctcctgttcgtgaggggagcgggtaactgcccagagtgcggaacaccattgcgtaaatcgaattttcgtgtgcagctgttcgaggatcctactgtagacaaggaagtagaaattcggaaaaaagtcctgaagatatataataaaagggaggaggactttcccagccttagggaatataacgacttcctcgaggaggtcgaggagattgttttcaaccttaccaataatgtagatctcgataacaccaagaagaaaatggagatctaccaaaaagaaaataaagatgtgattcagaaaaacaaactgaagctcacaagagaacaggaagagttggaagaggctttggaagtggaacgccaggaaaacgaacaaaggagactgtttattcaaaaggaagagcagctgcaacagatacttaagcgtaagaacaaacaagccttcttggacgaacttggccagcatataagtcttgctccaatccacaaactggaggaggccctttacgagtatcagccgctgcaaatcgaaacgtatgggccacacgtgcctgaattggaaatgctcgggaggcttggctaccttaaccacgtccgggctgctagccctcaggacttggcaggcggatacacttcttctctggcttgccaccgggctctgcaagacgccttttcaggcctgttctggcaaccttcatag

SEQ ID NO: 29404 - DNA, 510 bp, Artificial Sequence
  Description of Artificial Sequence: Synthetic coding sequence
acaagagagcaggaggagctggaggaagcactggaggtcgagcgccaagagaatgagcagcggaggctcttcattcagaaagaagaacagctacaacaaatcctgaagaggaagaataagcaggcattcctcgatgagctcgaatcgtctgatttgcccgtggccctgttgcttgcgcagcacaaggatagatccactcagcttgagatgcagctggaaaaacccaagccagtgaaacctgtgactttcagtactggcattaagatgggccagcacatatccctggcccctatacacaaacttgaggaggccctgtatgagtatcagcccctgcagatcgagacatatggccctcatgtccccgagctggaaatgcttgggaggcttggctacctaaatcacgtgcgagcagcttctccccaggatcttgctgggggatatacctcatccctggcatgtcacagggccctccaggacgccttcagcggcctcttctggcaaccctcgtag

SEQ ID NO: 29405 - DNA, 3963 bp, Artificial Sequence
  Description of Artificial Sequence: Synthetic coding sequence
atgttcgggctggaccagttcgaacctcaagtgaactctagaaacgctggtcaaggtgagaggaacttcaacgagacaggcttgagtatgaatacccattttaaagcacccgctttccatacaggcggacccccaggccctgttgatccagccatgagcgccctcggggaaccccctattcttggtatgaacatggagccatacggctttcacgcaaggggccactctgagctgcatgcagggggtctccaggcgcagcccgtgcatggctttttcggagggcagcagccacatcacggacatccagggtcccaccaccctcatcagcaccacccacattttggcggaaacttcggaggacctgacccaggcgcttcatgcctccacggaggaaggcttctggggtacgggggagcggcaggcggtctgggctcgcagcctccctttgctgaaggctatgaacacatggcagaaagccagggacccgaatcatttgggcctcagaggccaggaaatctgcctgacttccattctagtggcgcttcatctcacgcagtgcccgcaccatgcctcccactcgaccagagtcctaaccgcgcagccagttttcatgggctgcccagctcttcagggagcgactcccactcgctggaacctcggcgagtgaccaaccagggtgcagtcgacagcttagagtacaactatcccggtgaagcgccatctggacactttgatatgttcagcccctccgactcggaaggtcagcttccgcattatgctgctggacggcaagtgccgggaggagcctttcccggagcaagcgccatgccacgagccgctggaatggttggcttgtctaaaatgcatgcacagccacctcagcagcagcctcaacaacagcagcaaccccagcagcagcagcaacagcatggggttttcttcgaaagattctctggagcgagaaaaatgcccgtggggttggagccatccgtagggtctcgacatcctctgatgcagcctccccagcaagcccctccccctccccagcaacagcctccgcagcaaccaccccaacaacagccacctccccctccaggtcttctcgtaaggcagaacagttgtccccctgccctgcccaggccccagcagggggaagctggcaccccctcgggtggtcttcaggatggcggaccaatgctgccttcacagcacgcacagtttgagtacccaatacacagactggagaacaggagtatgcatccctactctgaacctgttttttctatgcagcaccccccaccacagcaggccccaaaccagaggttgcagcactttgacgcccctccctatatgaacgtcgcgaaaaggccacggttcgactttcccggatcagccggagtagaccgttgtgcctcatggaatggcagcatgcacaacggggcactggacaatcacctttcaccctcagcgtatccaggactcccaggcgagttcaccccccctgttccagacagttttccttccggtcccccactgcagcaccctgccccagatcaccagagcctccaacagcagcagcagcaacaacagcagcagcaacagcagcagcagcagcaacagcaacagcaacagcagcagcagcagcagcagcgccagaatgcggcacttatgattaaacagatggcaagtcggaatcagcagcagcgtctacgccagccaaatctggcacagttgggccatccaggtgacgtcggacagggcggactggtgcacgggggacctgtgggtggtttggcccagccaaatttcgaacgggagggaggctccactggggctggcagattgggtaccttcgaacagcaggcaccacacctggcccaggagtctgcctggttctctggcccacacccaccccctggggatttactgcccagacgaatgggaggtagcggtctgcctgcggactgtgggcctcacgatcccagtttggcaccgcctccaccaccaggcggttccggcgtactcttccggggacctctgcaggaaccgatgcgaatgcctggggaaggccacgtccctgctcttcccagccccggtctgcagtttggagggagcttgggcggactggggcagctgcagtctcccggagccggagttggactaccttctgccgcatctgagagaaggccacctcccccagatttcgctacgtccgccctgggagggcagcccggattccctttcggagccgctggtaggcagagcaccccgcactctggtcccggagtgaactcccctccttcggcaggcggaggtgggggtagttcaggtgggggtggtggaggaggcgcttatccgcctcagccagacttccagccttcacagcgaacttccgcttccaagttgggggctttatccctgggcagcttcaataagccgtcttccaaggacaaccttttcggccagtcctgtctcgcagccctttctaccgcttgccaaaacatgattgcctctctgggagctccaaatctgaatgtcacattcaacaaaaagaatcctccagaggggaagagaaagctgagccaaaacgaaactgatggcgcagctgttgccggtaatccagggtcagactacttcccaggcggaacagctcctggggctccaggacctgggggaccgtccggtacctcgagcagtggctccaaggctagcggcccaccaaatccgccagctcaaggcgatggaacctctctgtcccctaattatacgctggagtcgacaagtggaaatgacgggaaacccgtcagtggaggtggagggagaggacgaggtagacggaaaagggacagtggtcacgtgtcgcctggtactttctttgataagtactcagccgctcccgattcagggggagcccctggcgtttcaccgggacagcagcaggccagcggtgctgccgtggggggatcgagtgccggtgagaccagaggcgcacctactccacacgaaaaggccctcacttccccgtcctggggaaaaggggctgagttactcttgggcgaccagcctgatttgataggctccctggatggaggtgctaaatcagatagttcaagcccaaatgtgggcgagttcgcctcagacgaagtgagtacctcatatgctaacgaggacgaggtgagcagttcttcagacaatccccaggcgctcgtaaaggccagcagatcgccccttgtgacaggatccccaaagctgcctcctagaggtgtaggggcaggagagcatggccctaaagccccacctcccgctctcggtttgggaatcatgagcaatagcacgagcacaccagattcctatggagggggtggcggacctggtcaccctgggactccaggtctggagcaagtcagaaccccgaccagttcctctggggcaccgccacccgacgaaatacacccactggaaattctccaggcacaaattcagcttcagcgacaacagttttccatttcggaagatcagcctctgggacttaaaggtggaaaaaagggcgaatgcgcagtcggcgcatcaggcgctcagaacggcgattccgagctgggttcgtgctgctctgaggcagtgaaaagcgcaatgtctacaatcgacttggatagcctaatggcagaacacagtgcagcctggtacatgccagccgataaggctcttgtggactccgctgacgatgacaaaaccctcgcgccatgggaaaaagctaaaccgcaaaaccctaattctaaagaggcccacgatttgcccgctaataaggctagcgctagccagccagggtcccacctgcagtgcctgagcgtgcactgtactgacgatgttggcgacgcaaaggctcgcgctagcgtgcccacatggcgctcgctgcattccgatataagtaatagatttgggacgtttgtagcagccctgacatag

SEQ ID NO: 29406 - DNA, 4227 bp, Artificial Sequence
  Description of Artificial Sequence: Synthetic coding sequence
atgaaggccccagccgttctggctcctggcatcctcgtactgcttttcaccctggttcagcgcagcaacggtgagtgtaaggaggccctggcaaagtcagagatgaacgtgaacatgaaatatcagctcccaaatttcaccgcggaaaccccaatccagaacgtgatcctccacgagcatcatatatttctcggcgcaactaattacatttacgtcctcaacgaggaagatctgcagaaggtcgccgagtacaagactggacccgtgctggaacatccagattgctttccgtgccaggattgtagctccaaggctaatttatcaggaggagtatggaaggataatatcaatatggccctcgtcgtcgacacctactacgatgaccagttaatttcttgcggctccgtcaaccggggaacatgtcagcgccatgtgtttcctcataatcacaccgctgatatccagagcgaggtccattgcattttcagcccgcagatcgaggaaccctcccagtgtcctgactgcgttgtttctgcgctgggagcaaaggtcttgagtagcgtgaaggataggttcatcaattttttcgttggtaacaccataaattccagttactttccagatcaccctttacacagcatctctgttcggaggcttaaggagaccaaggatggattcatgttcctgaccgaccagtcctatatcgacgttctccccgaattcagagacagttaccctatcaagtacgtgcacgccttcgagtcaaacaacttcatttatttcttaacagtgcagcgagaaaccttggatgcacagacctttcatactcgcattatacgtttttgctcaatcaatagcgggctccacagttacatggagatgcctttggaatgtattttaaccgagaaacgtaagaagcggtccacaaagaaggaggtcttcaatatcctacaggcagcgtacgttagtaaacctggagcccaactggcgagacagattggcgcatcgctcaacgatgatattctgtttggcgtatttgctcagtctaaacccgacagcgccgagcctatggacaggagtgcaatgtgcgccttccctattaaatacgtgaatgactttttcaacaaaatcgtgaacaagaacaacgtgaggtgtctgcagcatttctatggccctaaccacgagcactgtttcaaccgcactttactgagaaatagttccggctgtgaggcccgaagagacgaatacagaaccgaattcactactgccctgcagcgggtggacctattcatgggacaattcagcgaggtgctgctcacttccatcagtacctttattaagggagacctcaccattgctaacttgggcaccagcgagggacgattcatgcaagttgtcgtgtctcggtctggaccaagcacacctcacgtgaactttcttctggattcccatccggtcagtcctgaggtgattgtggagcataccctgaaccagaacggatatacattggttatcacaggaaagaagattaccaagatccccctcaacggcctgggctgccgccattttcaatcatgtagccagtgtcttagcgctcctcctttcgttcagtgtggctggtgccacgacaaatgcgtgaggagtgaagaatgtctcagcggcacctggactcaacagatttgtctccctgcaatctacaaagtgtttccaaattccgccccactggagggagggacaaggctaactatctgtggttgggacttcggctttaggcgaaataacaagtttgatctgaaaaaaaccagagtcctgctaggcaacgaatcatgtaccctcacacttagtgaaagcacaatgaataccctgaagtgcactgttggacctgccatgaataaacacttcaacatgtctattatcatttcaaatggccacggaacaacgcagtactcgacattcagttatgtggacccagtcataacctctatctcacccaagtacggacccatggctggcggtaccctgctgacattgactggcaactatctcaatagcggtaactctaggcacattagcataggtgggaaaacctgtacgctgaagtctgtctcaaatagcatactggagtgctacaccccagcacaaaccatttcgacggagtttgccgtgaaattaaagattgacctcgcaaatagagaaacatcaatcttctcttacagggaggacccgatcgtctacgaaattcaccctaccaaaagctttatctccacatggtggaaagagcctttaaatatcgtttcattcttgttttgtttcgcatcaggaggaagcacgattactggagtgggtaagaacctgaattccgtaagtgtgccccgaatggttataaacgtgcacgaggccggacgcaacttcactgtagcgtgtcagcacagaagtaacagtgaaattatttgctgtacaacaccctccttacagcagctgaatcttcagcttccccttaagaccaaagcattttttatgttggacggaatcctatcaaaatactttgatctcatttacgtgcacaatccggtcttcaagccttttgaaaagcctgtgatgatcagcatgggcaatgagaacgtcctcgagattaagggaaacgacatcgaccctgaggcagtgaagggagaagttcttaaggtcggcaacaaaagctgtgagaacatccacctccacagtgaggccgttctctgcactgtgccaaatgatctgctgaaacttaattcggaattaaacatcgaatggaaacaggctatctcttccaccgtcttggggaaagtcatagtgcagcctgaccagaacttcactggcctgatcgccggtgttgtatcaatctctaccgccctcttactgctgctgggtttcttcctgtggctgaagaagcggaaacagatcaaagatctggggtccgaattggttcgatacgacgctagggtgcacacccctcatcttgatcgactcgtaagcgctagaagcgtctctcccacgacagagatggtgtccaatgaaagcgtggattacagggccacctttccagaagatcagtttcctaactcatctcaaaacggcagctgtcgtcaagtgcagtacccattgaccgatatgagtcctatcctcacaagtggcgatagcgacatcagctcacccctgctccagaacactgtgcatattgacctgtcggcactcaatcccgagttggtccaggccgtgcagcacgtggtgataggcccaagtagcctcatcgtgcatttcaacgaggttatcggaaggggccactttggctgcgtataccacggcactttgctcgacaacgatggtaagaagatccactgtgctgtaaagagtctaaaccgaatcaccgacatcggcgaggtgtctcagtttttgactgagggaatcatcatgaaagacttttctcaccctaacgtgcttagcctgctgggaatttgtctccgtagtgaagggagtccactggtagtcctgccctacatgaagcacggagacctgagaaatttcatccgcaatgaaacacacaaccccacggtcaaggatcttattggttttggcttacaagtggcaaaaggcatgaagtacttagcctctaagaaattcgtgcatcgagacctggccgctagaaactgcatgcttgatgagaagtttacagtgaaggttgccgatttcggtttggcacgagacatgtacgacaaggagtactacagtgtgcacaacaaaacgggcgctaagctacctgtgaagtggatggcgcttgagagtctacagacacagaaattcactacaaagagtgacgtgtggtccttcggagtgctgctttgggagcttatgaccagaggtgcacctccttatccggatgtgaacacttttgatattacggtgtacttattgcagggcagaaggctgcttcagccagaatactgcccagacccactgtacgaagtcatgctgaagtgttggcaccctaaagctgaaatgagaccaagcttcagcgagttggtgagcaggatcagcgcaatcttcagtacattcatcggcgaacactacgttcatgtgaatgctacatacgtaaacgtcaagtgcgtggcgccttatccttcgctactatccagcgaagataatgctgatgatgaggtggatacccgaccagctagtttttgggagacgagttag

SEQ ID NO: 29407 - DNA, 4173 bp, Artificial Sequence
  Description of Artificial Sequence: Synthetic coding sequence
atgaaggcccctgctgtgcttgcacctggaatactcgtcttactgtttacactcgttcagcgcagcaatggtgaatgtaaggaggcactggctaagtcagagatgaacgtaaacatgaagtaccagttaccaaacttcacggctgaaacccctattcagaacgtgattctacatgaacaccatatctttctaggtgctacgaactacatttatgtcctgaatgaagaggacctacaaaaggttgctgagtacaagaccggcccagtgctggaacaccctgattgtttcccgtgtcaggattgctcaagtaaggccaacttatccggcggtgtttggaaagataacataaacatggcattagtggttgatacctactacgacgatcagctgatatcatgcgggagtgtgaatcgcggtacctgccaacggcatgtgttcccacacaatcatacagcggacatccaatcagaagttcactgcatcttcagcccacagattgaagagccctcccagtgtccagactgcgtggtgtcagcactgggcgcaaaggtgctttcgtccgtcaaggaccgattcatcaatttcttcgttggtaatacaatcaatagcagctactttcctgaccatccccttcactctataagcgttcgcaggttgaaggaaactaaagatgggttcatgttcctgaccgaccagtcatatatcgacgtactgcccgagttccgagacagttaccctataaagtacgtacacgccttcgagagtaacaactttatctactttctgactgtacagagggaaacccttgacgctcaaaccttccataccagaattattcgattttgttctatcaacagcggcttgcacagctatatggaaatgccactggaatgtatcctcacggagaaacgtaaaaagagatcaaccaagaaagaagtattcaatattcttcaagccgcatacgtttctaagccaggtgctcaattagcaagacagatcggggctagtctgaacgatgacatcctatttggggtgttcgcacagtcgaaacccgattccgctgaaccgatggatcggtccgctatgtgtgccttcccaatcaagtatgttaacgacttctttaataagatcgttaacaaaaacaatgtgaggtgtctccagcacttctacgggcctaaccacgagcattgtttcaacaggactctgcttcgcaattccagcggctgcgaggcgcgacgggatgagtacaggaccgaattcaccaccgctctacagagggtggacttgttcatgggacagttttctgaggttctccttacctctatctctacttttatcaaaggcgatctgacaattgcgaatctgggaaccagtgaaggtaggtttatgcaggtggtggttagtcgatcagggccatctaccccacacgttaattttctcttggattctcatcctgtctcacccgaggtgattgtggagcacaccttgaatcagaatgggtatacgcttgtgatcaccggcaagaaaattacaaaaatccctttaaacgggctgggatgtaggcatttccagtcttgttcccagtgtctgtccgctccgccattcgtgcagtgtgggtggtgtcacgacaagtgtgtgagatctgaggagtgtctgtcaggcacctggacacagcagatctgcctcccagcgatctataaggttttccccaattctgctccattggaaggaggcacccgactcactatttgcggatgggactttggcttccgcagaaataacaaatttgatttaaaaaagacccgggttctcctggggaatgagtcctgcactctgactctgtctgagagcacaatgaacactctgaaatgcactgttggcccagctatgaataagcactttaatatgagcatcatcattagcaacggacacggaactactcaatattctactttctcctatgtggatcctgtgatcacatccatctccccaaaatacggtcccatggccggtggtaccctactgacactgaccggaaactacttgaatagcggaaacagccgacatatctccattggtgggaagacatgcactctgaagtcggtgtcaaacagtattttggagtgctacactcctgcacagacgatcagtactgaattcgctgttaagctgaaaatagatctggccaatagagagacctctattttctcatacagagaagaccccattgtttatgagattcaccctactaaatcattcatctccgggggtagcactatcacgggagttggcaagaacctcaactctgtcagtgtgccacgtatggtgatcaatgtgcacgaggctggtagaaacttcaccgtggcgtgccagcatcgctccaattctgaaattatttgctgtacaacacctagtctccagcagctcaacctgcagctaccactaaaaaccaaggcatttttcatgttagacggaatcctcagcaaatattttgacctgatctacgtgcacaaccccgtgtttaagccgttcgagaagccagttatgatttccatgggaaacgagaacgtgctggagattaaaggcaacgacatcgacccggaggctgtgaaaggggaagtgctgaaagttggaaataaaagctgcgagaacattcatttacacagcgaagccgtgctttgcaccgtgcccaatgatctccttaagctgaacagtgagctgaacatcgagtggaagcaggcgattagtagcactgttttggggaaggtcatcgtgcaacccgaccagaacttcaccggcttgattgctggcgtcgtatcgatctctacagccctgctgctgctgctcggattctttctgtggctcaaaaagcggaaacagattaaggatttaggctcggagttggtacggtatgatgcacgggtgcataccccccatcttgaccgactggtcagcgcacgtagcgtgagccccaccactgagatggtgtctaatgaaagtgttgattatagagcaacctttcccgaagaccagtttcctaattcaagccagaatggctcctgtcggcaggttcagtaccccctcacggacatgtctcctatccttacttccggggatagcgacataagctccccgttgctgcagaacactgttcacattgatctgagtgcccttaacccagagctagtacaggcagttcagcacgtagttatcggcccaagctctctcattgtccattttaacgaggtaattgggagaggtcatttcggttgtgtctatcatggcaccttactggataatgacggaaagaagatacactgcgccgtaaaatcactgaacagaattaccgacatcggggaagtatctcagtttttgacggaggggattatcatgaaagactttagtcatccaaatgttttgagcttacttggaatatgcttgaggagtgaaggttcccctctggttgtcctcccatacatgaagcatggcgatctcaggaattttattcgaaatgaaacccataaccctacagtgaaggacttgataggcttcggtctgcaagttgccaagggaatgaaatatttagcaagcaaaaagttcgtgcacagggatcttgccgctcgtaactgtatgctggatgaaaagttcaccgtgaaagtggcggactttggcctggccagggacatgtatgacaaagagtactactccgttcacaacaaaacaggggctaaactgccagtcaagtggatggctctggaatcactccaaacccagaagtttacaactaaaagtgacgtttggtcttttggcgttctgctgtgggagttgatgacccgcggagccccaccatatccagatgtgaatactttcgacatcacagtctacctgctacaggggaggagactgctgcaacccgagtattgccccgatccactctacgaggtgatgcttaagtgttggcaccccaaggcagaaatgaggccatctttttctgaattagtctcccgcatatccgctattttctcaacattcattggggagcactatgtacacgtcaatgccacctatgtcaatgtgaaatgcgttgctccgtaccccagtttattgagctccgaggacaatgctgacgacgaggtggacacccggcctgccagcttctgggaaacaagctag

SEQ ID NO: 29408 - DNA, 2295 bp, Artificial Sequence
  Description of Artificial Sequence: Synthetic coding sequence
atgaaggccccagccgtcctggcccctggaatactggtcctgctctttacactcgttcagcggagcaacggagaatgtaaggaggcactcgccaaatctgagatgaacgtaaacatgaaataccaactacctaatttcactgcagagactccaattcaaaacgtgatactgcacgagcatcacattttcttgggcgctactaactacatttatgtgcttaatgaagaagacctgcagaaggtggccgagtacaagacgggccctgttctggagcacccagactgctttccctgccaggattgtagcagtaaggctaacctttcaggcggtgtgtggaaggacaacataaatatggctttggttgtggacacttattacgatgaccaactgataagttgcggtagtgtgaatcggggtacatgtcaaagacacgtcttccctcacaaccacaccgcggacatccagtccgaagtgcattgcattttctcccctcagattgaggaacccagccaatgcccagactgcgtggtctccgccttgggtgccaaagtgctctcgtctgtcaaggatcggtttataaatttcttcgtgggcaacacaatcaactctagctattttccagaccaccccctccactctatctccgtgcggcgactcaaggagactaaggacggattcatgttcctcactgatcagtcctatatcgatgtcctacctgaattccgagattcatatcctatcaaatatgtgcatgcatttgaaagtaataattttatctactttttgacagtccagcgcgagactttggacgcccagacgtttcatactagaattattagattctgctctattaactccggactgcatagctacatggagatgccattggagtgcatcctgacagagaagagaaaaaaacggtctaccaaaaaagaggtgttcaatatcctgcaagcggcatacgtatccaaaccgggtgcacagcttgcaagacagatcggagcatcccttaatgacgatatcctgttcggcgtctttgcccagtcaaaacccgacagtgccgaaccgatggatagaagtgccatgtgcgctttccccatcaagtacgtgaacgattttttcaacaaaatcgttaacaagaacaacgttcggtgtctgcaacatttctacggccctaaccacgaacattgtttcaataggacactcctgcggaattcaagcggctgtgaggcccgacgggacgagtacaggaccgagttcaccaccgcactgcagcgggtggacctgtttatggggcaattcagtgaagtgctcctcaccagcatttctacttttatcaagggagacctgaccattgctaatctcgggaccagtgagggccgattcatgcaggtcgttgtcagtcggagcggcccatccacgccccatgtgaactttctgttagactcgcaccctgtgagtccagaagtgatcgtggagcataccttgaatcagaatggttataccttagtgatcacagggaagaaaatcacgaaaataccgctgaatgggcttggctgccgacacttccagagctgtagccagtgtcttagcgcgccacccttcgtgcagtgtggatggtgtcatgacaagtgcgtgagatcagaggaatgtcttagtgggacatggacacagcaaatttgtttaccagccatctataaggtgtttcccaattctgcccctttggaagggggaacgcgcctgacaatctgcggctgggattttggttttagacggaacaacaaatttgatttaaagaagacaagggtactgctaggaaacgaatcctgcacgttaactttgtcggaatccaccatgaacacactgaagtgcacagtcggccctgctatgaataagcacttcaacatgtccataattatcagcaatggtcatggaacaacccagtactcgacattttcttacgtagacccggttatcaccagtatatctccaaaatacggcccaatggctggcggaacactcctgaccttgactggtaattatctaaactcaggaaatagtaggcacatctccatcggaggtaagacctgcaccctgaagtccgtgtcaaatagtatccttgaatgttacaccccagctcagaccatctccactgaatttgccgtgaagctaaagattgacctggccaaccgcgagacctcaatcttcagctacagggaagacccaattgtgtacgagattcaccctacaaagtccttcatccgccacgtgaatatcgcgctcattcagcggtag

SEQ ID NO: 29409 - DNA, 783 bp, Artificial Sequence
  Description of Artificial Sequence: Synthetic coding sequence
atgaaggacttctctcatcctaatgtgctctcccttctggggatctgcctccgttcagaggggagccccctggttgtgctgccgtacatgaaacacggcgacctgcgcaactttattcgcaatgagacccacaaccccactgtgaaggatttaattggattcggactccaggtggcaaaaggcatgaagtatctggcaagtaaaaaatttgtgcaccgcgacctagcagctagaaactgcatgctcgatgagaagtttactgtcaaagtcgcagactttggcttagcacgggatatgtacgacaaggagtattatagtgttcataacaaaaccggcgcaaaacttcccgttaaatggatggccctggaatctcttcagactcagaaattcactactaaaagtgacgtttggagctttggtgtgcttctgtgggagctgatgacacgcggtgcccctccctatccggatgtgaacacctttgacatcaccgtgtatctgctccagggcagaagactcctccagccagaatactgccccgacccactctacgaagtgatgctgaagtgctggcaccctaaagccgagatgcgccctagtttcagtgaattggtctcccgcatatcggccatcttctccactttcattggcgagcattacgttcacgtaaatgctacctacgtgaacgtcaagtgcgtagccccatatccttccctcctctcatctgaagacaacgctgacgacgaggtggataccaggccagctagcttctgggagacatcatag

SEQ ID NO: 29410 - DNA, 1749 bp, Artificial Sequence
  Description of Artificial Sequence: Synthetic coding sequence
atggccgctcgcagctggcaggacgaactcgcacagcaggccgaagagggctccgctcgcttgcgggaaatgctatcagtagggttggggttcttgagaactgaacttggactggatctggggctcgaacctaagcggtatcccggatgggttattctcgtgggtacaggcgctctcggcctcctgctgcttttcttgctcggctacggctgggcagcagcatgtgcaggcgcacgcaaaaagcggaggagcccacccagaaaaagagaggaggccgctgccgtgcctgccgctgcgcctgatgatctcgccctgcttaaaaaccttaggagcgaggaacagaaaaagaagaaccgtaaaaaactgtcagagaaacctaaacccaacggcagaactgttgaagttgctgaaggagaagccgtccgcactccacaaagcgtaactgccaaacaacctcctgagattgataaaaaaaatgaaaagtctaagaagaataagaagaaatcaaagagtgacgctaaagccgttcaaaactcatcaaggcacgacggaaaggaggtggatgagggagcctgggagacaaagattagccatcgggagaaacggcaacaacgtaagcgcgataaggtgttaactgattccgggtccctggactcaacaatccctggtatcgagaatactatcactgtcacaaccgagcagctaacaactgcctcattccctgtgggttctaagaaaaataaaggagatagccacttgaatgtgcaggtgtcaaacttcaagagcggcaagggagattctactcttcaggtctccagtggactcaatgaaaacctcactgtgaacggtggcggatggaacgagaaaagcgtcaagctgtcttcccaaatatcagccggagaggagaaatggaactccgtctctccagcaagtgccggaaagcgcaaaactgagcccagtgcttggagccaggatactggcgacgcaaataccaacggaaaagattggggccgaagctggtcagaccgatcaattttttccggcatcggtagtaccgcagagcccgtcagccagtcaactacttccgattaccaatgggatgtgtcacggaatcaaccttatatcgacgatgagtggtcggggctgaatggcctctccagcgccgatcctaattccgattggaatgctcctgcagaggaatggggtaattgggttgacgaggagagggcctctctcctgaagagccaggaaccaatcccagatgaccagaaggtctctgatgacgataaagaaaagggcgaaggtgccctgccaaccggcaagtcaaagaagaagaagaaaaaaaaaaagaaacagggggaagataacagcacagctcaggatactgaggaattagagaaggaaatccgggaagatctgcccgtaaacacctcaaagacaaggccaaaacaggaaaaagctttcagtctaaagaccatttccacctctgacccagccgaggtgctggttaagaactcacagccaataaagacactgccacccgctacctctactgagccatctgttattttgagcaaaagtgatagcgataagtcctcttctcaggttccccctatcctgcaagaaaccgacaagtccaagagtaacaccaagcagaactctgtgcccccatctcagactaagtccgaaaccagctgggagtctccgaagcagattaagaaaaagaaaaaagcgaggcgcgaaacatag

SEQ ID NO: 29411 - DNA, 2148 bp, Artificial Sequence
  Description of Artificial Sequence: Synthetic coding sequence
atggcggctaacatgtatagagtgggagattatgtctatttcgaaaactcttcatctaacccttatttgattcgacgcatagaagagttgaataaaaccgcgaacggcaatgtcgaagcaaaagttgtgtgtttctatcggagacgggacatctcatcgacattgattgccctggctgataagcatgcgactttgagcgtgtgctataaagcaggcccaggcgcagataatggcgaggagggagaaatcgaggaggagatggagaatcccgagatggttgacttgccggaaaagctgaagcatcagctgcggcatcgagaactgtttctgtcccgacagctcgagtcactcccggcaactcacattcggggaaagtgtagtgtgaccctactgaatgaaacggaaagtctcaaaagctatctggagagagaagatttcttcttctattctctcgtctacgatccccagcagaagaccttgctggccgacaaaggggaaattcgggtgggaaaccgctatcaagcagacattactgatctcctcaaagagggcgaagaggatggtcgagaccagtcacgcctggaaacgcaggtatgggaagcccataacccgctcaccgataagcaaatcgatcagtttcttgtggtggccagatctgtggggacgtttgccagggccctcgactgctccagcagcgtgaggcaacccagccttcacatgagtgctgctgctgctagtagagatataactttatttcatgcaatggatacgctgcataagaatatttacgatatttccaaggctatatcagctctggtgcctcagggagggccagttctttgcagagatgagatggaagagtggtccgcctccgaagctaacctctttgaggaggccctggaaaagtacggcaaggacttcaccgacatacagcaagattttctgccctggaaaagccttacatctataatcgaatattactatatgtggaagaccactgacaggtatgtgcagcagaagcgattgaaggccgctgaggctgagtctaaactgaaacaggtgtacatccctaattacaacaagcccaacccaaatcagatcagtgttaacaatgtgaaagccggtgtggtgaacggaacgggcgctcctggacaatcgcccggagcaggaagagcatgcgaatcatgttacaccacccagagctatcagtggtatagctggggacctccaaacatgcagtgcaggttgtgcgcatcctgctggacttactggaagaagtacggcggattgaaaatgcctacccgactggacggcgaacggcctggtcctaacagatccaacatgagcccccacggactccccgctcggagctcgggttctccgaaattcgccatgaagacaaggcaggccttctacctacacactacgaagctgacgaggatagctcggagactgtgtcgtgagattctgagaccctggcatgccgcacgtcacccgtatctcccaattaactccgctgcaattaaggctgagtgtaccgcacgcctgccagaagctagccagagtccactggtgctcaagcaggccgtgcggaaacccctggaggccgtgctccgctatctggaaacacacccacgccctcccaaacccgatccagtgaagagcgtttcatctgtgctgtcgtccctgacccccgctaaggtggccccagtcataaataatggatcacccactattctcggtaaacggagttatgaacagcataacggggtggatggcaacatgaagaagcgcctcctgatgccgagcagagggcttgccaaccatggccaagctcgccacatgggaccaagtcggaatcttctgctgaatggtaagagttacccaacaaaagtcagattaattcgtggcggatcccttcccccagtgaagcggaggagaatgaattggatagacgcaccagatgatgtcttttatatggccacagaggaaactagaaagatcagaaaactgctttcctcttcagagaccaaacgtgctgctcgcaggccctacaaacctatcgcgctgaggcaatcacaggctttaccccctagacccccaccccctgctcccgttaacgatgagccaatcgttatagaggattag

SEQ ID NO: 29412 - DNA, 1887 bp, Artificial Sequence
  Description of Artificial Sequence: Synthetic coding sequence
atggttgatctcccagagaaactaaaacatcagctgcgacaccgagagctatttctgtccagacagctggagagtctccccgctactcacatacgtggcaaatgctccgtcacactcctgaatgagaccgagtctctgaagagttacttggagcgagaggatttcttcttttattcactggtctacgatccacaacagaagaccttgctggccgataaaggcgagattcgcgtgggaaaccgctatcaggccgacattaccgacctgctcaaggagggggaggaggatggcagagaccagtcaagacttgagactcaggtgtgggaggcccacaaccctcttacagacaagcagattgatcagtttcttgttgtggccaggtccgtcggaaccttcgccagagcactcgactgtagtagctctgtgcgtcagcctagcctgcacatgagcgccgcagctgccagcagagacatcactttattccacgcgatggatacgctccataaaaatatttatgatatcagcaaggccatctcagccctcgttccacaggggggacccgtgttgtgccgtgacgaaatggaggagtggtccgcctcagaagccaatctgttcgaagaagctctggagaagtacggcaaagactttacggatattcaacaggatttcctgccatggaaaagcctgaccagtatcatagaatattattatatgtggaaaacaacggaccgatatgttcagcagaagcggctgaaagctgctgaggctgagtctaaactgaagcaggtgtacattccgaattataacaaaccaaatcctaaccaaatctcagtgaacaacgtgaaagctggggtggtcaacgggacgggggcacccggacaatcccctggcgctggcagggcctgcgagagctgttacaccacccagtcatatcagtggtattcatggggtccaccaaacatgcagtgtaggctatgtgccagttgctggacctactggaagaagtacggtgggctcaaaatgccgacgagattggacggcgaacgccctggtccaaaccggtccaacatgtcaccccacgggcttcccgctcgaagcagcggcagccctaagtttgctatgaagactagacaggcattctaccttcacactacgaagctcacccgcatcgctcgaaggctgtgccgggaaatattgcgaccttggcacgccgctagacacccgtatctgcccatcaatagcgctgcaataaaggccgagtgtaccgcacggctgcctgaagcatcccagagccctctggtcttgaaacaggcagtgcgcaaaccccttgaagctgttctacgctaccttgagacccacccacgtcccccaaagccagaccctgtgaagagtgtttcttctgttctatcctccctcacacctgccaaagtggcacctgttatcaataatggatcgccaacaattctaggcaaaagatcatatgaacagcataacggggtggatggcaatatgaagaaaagactgctgatgccctcccggggaacgagctccgggctcgccaaccacggtcaggccagacacatggggcctagcaggaatctcctgctgaatggcaagagctatcccacaaaggtgcgacttatccggggaggctcattaccccctgttaagcgaagacggatgaattggatagatgctcccgacgacgtcttttacatggccactgaggagactcgcaaaattaggaaattgcttagctccagtgaaaccaagcgcgctgccagaagaccgtataagcctatagctctgcgtcagtctcaagctctgccccctagacctccccctcccgctcctgtgaatgacgagcccattgtgatcgaagattag

SEQ ID NO: 29413 - DNA, 768 bp, Artificial Sequence
  Description of Artificial Sequence: Synthetic coding sequence
atgaaaactagacaagcattctaccttcacaccactaagctgacacggatcgccagacgattatgccgcgagatactgaggccctggcatgcagctcgccatccatacctgcctattaactccgccgctataaaggccgagtgcactgccaggcttccagaggcttctcagtcccctttggtattgaaacaggcagtgagaaagcccctcgaggcagtacttcgatatctggaaactcacccacgtccgcctaagccagatccggttaaatctgtgtcttcggtgctttcatcactaacaccggcaaaagtggcaccagtgattaacaatggatcacccactatattgggaaagcgatcttacgaacaacataatggggtggatggcaatatgaagaaacggctgctgatgccttcccgcggaacgtacctgggattggctaatcacggtcaggccagacacatggggccatcccggaacttgttactgaatggaaaatcctatcctacaaaggttcgcttaattcggggtgggagtttgccccctgtgaagcggcgaagaatgaactggatcgatgcccctgacgatgttttctatatggccacagaggagacaaggaagatccggaagctcttgagcagtagcgagacaaaacgcgcagccaggagaccttataaaccaatcgccttgaggcagagccaggcgctgcccccaagaccccctcctccggcacccgtgaacgatgagcctattgttattgaagactag

SEQ ID NO: 29414 - DNA, 1293 bp, Artificial Sequence
  Description of Artificial Sequence: Synthetic coding sequence
atggctgcaaatatgtatcgagttggcgactacgtctatttcgagaatagctcctctaacccatacctgattaggcggattgaggagctaaataagaccgctaatggcaatgttgaagcaaaggtggtctgcttctataggcgcagagatatctccagtacactgatcgctctggctgacaagcacgctacgctgtcagtctgctacaaagccggaccaggggcagacaatggggaggaaggagaaatagaagaagaaatggaaaatcccgagatggtcgatctgcccgagaaactcaagcaccagctgaggcaccgcgagctgtttcttagcaggcagcttgagtcacttcccgcaacccacattaggggcaaatgctccgtcacactgctgaacgagaccgaaagtcttaagtcctatctggaacgcgaggacttcttcttttactctttggtgtacgatcctcagcagaagaccctacttgcagacaaaggcgagatccgcgtgggaaataggtaccaggccgacattactgacttgttgaaggaaggcgaagaggatggcagagatcaatccaggctagaaacgcaggtgtgggaagcgcacaatcctctaactgataagcaaattgaccaattcttagtggtcgctcgaagcgtcggaacattcgccagagctttggattgcagctcctcagttagacagccgagcctgcacatgtcagcggctgccgcttctcgagatattaccctcttccacgccatggacactcttcacaagaacatctacgatatcagcaaggcgatatccgctctggttcctcagggtggacctgtgttatgtcgcgatgaaatggaggaatggtccgcttcagaagctaatttgtttgaggaagccctggagaagtatggcaaagactttacggatatccagcaggactttttgccatggaagtctctgaccagcatcattgaatattactacatgtggaaaaccactgacagatacgtgcagcagaaacgattaaaagctgccgaggctgaatccaaactgaagcaggtgtacattcccaactacaacaagcccaaccctaaccagatcagcgtgaataatgtgaaggccggagtggtgaacggcactggtgcccctggccagtcccccggagctggaagggcctgtgaaagttgttatatgtcttcccttagaatactcctggacatcctggaggaaatttggtggctggaaaacgcgaatccggtgagatggcgggaggctaggacaaagccacagtag

SEQ ID NO: 29415 - DNA, 1422 bp, Artificial Sequence
  Description of Artificial Sequence: Synthetic coding sequence
atgcttcggcctgtgatagaggaagaaatttcgatgctcggggagatcactcatcttcaaacaatctcggaggaccttaaatctttaacaatggacccacacaaacttccatccagctctgagcaggttattctggatttgaaagggtcggactatagctggagctatcagacacctccaagttcgcccagcacaacaatgtcccgaaagtccagtgtttgcagctccctgaattctgtcaatagcagcgactcaagatcttcaggatcccactctcattcacccagttcccattatagataccggagtagtaacttagcacagcaggcaccggtcagactctcaagcgtttcctcccatgactctggcttcattagccaggacgcatttcagtccaaatctccatcccctatgccacccgaggcccctaatcagaggcgaaaggagaagagggagccagatccaaacgggggtggcccaacaacggcctccggaccacctgccgcagctgaggaggcccaacgcccacgttctatgacagtgtccgccgcaacgcgtcctggcgaagagatggaggcatgcgaggaactggcgctggctctctcaagagggctgcagttggacactcagcggagttcacgggattccctccagtgtagctcgggatacagtacccagaccacaacaccttgttgtagcgaggacacaatccctagtcaggtgagcgattatgactacttctccgtatctggcgaccaagaagcggaccaacaagagttcgataaaagctctacaattccgcgtaattccgatatctcacagtcctaccggcgtatgttccaagctaaacgcccagcgtcaactgccggactgcccacaactctgggtccagccatggtgacaccgggagtcgcaaccatcaggcgtactccatcgacaaagccatctgtgagacgcggaacaataggggcaggcccaatcccaatcaagacgcccgtaattccggtgaagacaccgacggtgcctgatctgcccggagtcctgccagcacctccagacggcccagaggagcggggtgagcatagcccagaaagcccatccgtcggtgagggtccccagggagttacctctatgccttcttccatgtggagcgggcaggcatcagtgaacccaccacttcctggacctaagccatctatccctgaggaacacaggcaggccatccctgaatctgaggcagaggaccaggaacgtgaacccccaagcgccaccgttagtcctggccagatccccgagtccgatcctgctgatctttctccaagagacactccacaaggcgaagacatgctcaatgccattagacgaggggtcaaactcaagaaaaccacaactaacgatcgcagtgcacctcgattctcttag

SEQ ID NO: 29416 - DNA, 2193 bp, Artificial Sequence
  Description of Artificial Sequence: Synthetic coding sequence
atggaggcagttatcgagaaggagtgttccgctctcggcggtctgttccagacaatcattagcgatatgaagggttcttatccagtgtgggaggactttattaacaaggccggaaagctgcagtcccagcttcgcaccacagtggtcgccgcagcagcattcctggatgcttttcagaaagtcgctgacatggccactaatacacgaggaggaactcgcgagatcggaagtgcactgacacgcatgtgtatgcgccatcgctcgattgaagccaaattacgccagttcagtagcgccttgattgactgcctaattaacccattgcaagaacagatggaggagtggaagaaagtggctaaccagttagacaaggatcatgccaaggaatataagaaagccagacaggaaatcaaaaaaaagtcttccgacactctgaagctccagaagaaagctaagaagggtagaggcgatatacagcctcagctggatagcgctctccaagacgtgaatgacaagtatctcctgcttgaggaaactgagaaacaggcagttcgcaaggcactcatcgaggagcggggaagattctgtacattcatctctatgctgagacctgttatcgaggaagagatatctatgctgggtgagataacacacctccagaccatttccgaggatctgaagagtcttacaatggacccacataagctgccatcctcaagtgagcaggttattcttgatcttaaagggtccgattacagttggtcataccagactccaccatcttctccatctaccacaatgagcagaaaatccagtgtctgttctagcctcaatagtgtgaacagtagtgactctcgctcttctggcagtcattcacattcaccgagcagccactaccgataccgcagctccaacctagcacagcaggcacccgttagactatcctcggtttcttcacacgacagcggctttatctctcaggacgcatttcagagcaagagcccttccccgatgcctccggaggccccaaaccagaatagcagcagcagtgctagttctgaggcttctgaaacctgtcagtcagtgtccgaatgcagttctcccacatccgtcagttctgggtctactatgggggcttgggtgtctacagagaaagactgggcgaagccagggccatacgaccaaccgctcgtgaataccttacaaaggcgcaaagaaaaacgggagccggaccctaatggtggtggaccaaccactgccagtggcccaccggctgccgcagaagaagctcagcggcctaggagcatgaccgttagcgcggcaactcgacctggtgaggagatggaggcttgtgaagaattagccttagccctgtctagaggtttgcaactcgacacccagaggtcttcacgtgactccctccagtgttcgtcagggtactctacacagaccaccaccccttgctgttcggaagacaccattccatctcaggtatcggattatgattattttagtgtgagcggtgatcaggaggcagaccagcaggagttcgataagagttcaacaatcccaaggaacagcgatatttcccagtcttatagaaggatgtttcaggcgaaaagaccggcaagcacagctggcctgccgaccactttaggacccgctatggttaccccaggcgtggccactatcaggcgcacaccaagtacgaagccatccgtccggagggggaccatcggagccggaccgatccctattaaaacaccagttattcccgttaagacgcccacagtgcccgatctcccaggagtgctccccgcacccccagatgggccagaggaacggggtgaacatagtcctgagagccctagtgttggcgagggccctcagggtgtgaccagtatgccaagctcaatgtggtccgggcaggcaagtgtaaatccccctcttccgggtccaaagccaagcatcccagaggaacataggcaggcaattccagaaagcgaggccgaagaccaggaacgggagcctccaagcgctacagtaagccccggacaaatcccagagtctgatcccgcagacctgtccccccgagatactccacagggggaggacatgctaaacgccataaggaggggcgtcaagttgaagaaaactacaaccaatgaccgctcagctccacgattctcatag

SEQ ID NO: 29417 - DNA, 1590 bp, Artificial Sequence
  Description of Artificial Sequence: Synthetic coding sequence
atgtcaagaaaatctagcgtgtgctcatccctcaatagtgtgaatagcagtgacagccgatcaagtggcagccactcccactcgccctcgtcccattaccggtatcgcagcagtaacctcgcccagcaggctccggtacggctgtcttccgtgtcctcgcacgactccggctttatcagtcaggacgccttccagtctaagtcaccttctccaatgcctcctgaggccccaaaccaaaactcttcctcatctgcttcttctgaggcgtcagagacctgccaaagtgttagcgagtgttcaagccctaccagcgtctccagcggatctaccatgggagcttgggtgtccacagagaagttgtccaacggcttttcccattattcactgagcagcgagtctcatgtcggcccaactggggctggcctgtttccacactgtctgccagcatcgaggctgttgccacgggttacctcagtgcatcttccggactacgcacactattataccattggtcctggcatgttcccttcttctcagatcccaagctggaaagattgggcaaaacctggtccatacgaccagccgctagtgaataccctccagagaaggaaggaaaagagggaacctgacccaaatggcggaggaccaaccaccgccagcggtccccctgcagcagccgaggaggcccagcgacctagatcgatgacagtgagcgcagccacgagaccgggagaggaaatggaagcttgcgaggagctcgcactggccttgtcccgcggactgcagctggatacacagagaagctcccgcgactctctgcagtgctcctcaggctactctacacagaccaccactccttgttgttccgaggataccataccgtcccaggtttctgactacgactatttctcagtatcgggtgaccaggaggctgatcaacaggagtttgataaatcttctacaatcccacgcaattccgatatttctcagtcctaccggagaatgttccaagctaagaggccggcttctaccgctggactgcccacaaccctgggacctgcaatggtgacgcctggggtagccactatacgcagaacaccgagtacgaagcccagcgtgcggagaggaactattggagcaggaccaattccaatcaaaactcctgttattccagtcaaaacgccaacagtaccggacctccccggtgtgctcccagccccacccgacggccctgaagagagaggggagcacagcccagagagcccatcagtcggtgaggggcctcagggcgtgaccagcatgcctagcagcatgtggagcggacaggctagtgtcaatccacctctgcccggaccaaagccgtccattcccgaggagcatagacaggccattcccgagtctgaggccgaagaccaggagcgtgagcctccctccgcaaccgtcagcccaggtcagatccccgaaagcgaccccgcagacttaagccccagagatacaccccagggcgaagacatgttaaacgcgattcggcgaggagttaaactcaagaaaaccaccaccaacgaccgatcggcgcctcgttttagttag

SEQ ID NO: 29418 - DNA, 2268 bp, Artificial Sequence
  Description of Artificial Sequence: Synthetic coding sequence
atggaggcggtaatcgagaaggaatgtagtgcacttgggggtctgttccagaccatcatttccgacatgaagggtagttaccccgtctgggaagacttcatcaacaaggccggaaaattgcagtcgcagctccggacaaccgttgtcgctgccgcagcatttttggatgcctttcagaaagtggctgacatggcaaccaataccaggggcggtactcgcgagatcggaagtgctctgacgaggatgtgtatgcgacacaggagcattgaagcaaaactgaggcaattcagcagcgccctcatcgattgcctcatcaatccgcttcaggagcagatggaggagtggaagaaagtcgccaatcagctggacaaggatcatgctaaggagtacaaaaaagctcgacaggagatcaagaagaaaagtagcgatactctgaaattacagaaaaaagctaagaaggggcgaggcgatatccagccccagctcgacagtgctctgcaggatgtgaatgacaagtatctgctgctcgaggagacagaaaagcaagcggtgagaaaggctctgatcgaggaaagaggcagattctgcaccttcatctccatgctgcggcctgtcattgaggaagagatttccatgctgggggagatcacccatttacagaccatcagcgaggacctcaagtctcttactatggacccgcacaagctgccttcttcttccgaacaggtaattttagacctcaagggatcagactactcctggagttaccagacacctccctcttccccaagtacaacaatgtctaggaagtcctcggtttgttcttccctgaattccgttaattcttccgattcccggtcctcaggctcacattctcacagccctagcagccattatcgttacagatcatccaacttggcacagcaggccccagtccgcctcagttctgtctcttcccacgatagcggattcatttcccaagatgcgttccagtccaagtcccccagtcccatgcccccagaagcacccaatcagttatctaacgggtttagccattattccctttcttcagaatcgcatgttggccctactggcgctggcctgtttccccactgcctgccagcaagcaggttactgcctagagtgaccagcgtacatctgcctgattatgcccattactacaccatcggcccaggcatgttcccaagttcgcagattccctcttggaaggattgggcgaaacccggaccctatgatcagccactcgtgaataccctgcagcggcgtaaagaaaaaagggagcccgaccctaatggaggcggtcccactactgcctctggcccaccagccgcagccgaagaagctcagcgtccgcgtagcatgaccgtctctgccgcaaccagaccgggtgaggagatggaagcttgtgaggaattagccctagcgttgtcgcggggtctgcagttagatactcagagaagttcccgagactctctgcaatgcagctccggatattcgacccagacgacaactccctgctgctcagaggacacaatcccatctcaggtgtcagactacgattacttcagtgtgagcggcgaccaggaggccgatcagcaggagtttgataagagcagtactatcccgaggaattcggatatttcccagtcttacaggagaatgttccaagcaaagcgaccggcatctaccgccggacttccaaccactctggggcctgctatggtgaccccaggagtcgctacaatcaggcggactccatcgaccaaacccagtgtcaggagaggcacaatcggcgctggaccaattcccatcaagactcccgtcattcccgtgaaaacgcccacagtccctgacctccccggtgtgctgcctgctcctcctgatgggcctgaagaacgcggagagcacagtccggaatcaccatccgtgggcgagggacctcagggggtgacctccatgcccagcagcatgtggagcggacaagcctctgttaatcccccattaccaggacctaagccttccattcccgaggaacaccgccaggcaattcccgaatcagaagctgaggatcaggaacgcgagcctcccagtgctacagtgtcacccggtcagatcccagaatccgaccccgctgacctgagtcccagggatactcctcagggcgaggacatgctcaacgccattcgacggggtgtgaaactgaaaaagactaccacaaatgatcgatccgcgcctcgattctcctag

SEQ ID NO: 29419 - DNA, 1437 bp, Artificial Sequence
  Description of Artificial Sequence: Synthetic coding sequence
atggccggtgtggaggaagtggctgccagcggttcacacctaaatggggatcttgaccccgatgatagggaagagggagctgccagtacggctgaggaggccgcaaagaagaaacggagaaaaaagaagaagtctaagggcccaagtgccgctggcgagcaggaacctgacaaggaatccggcgctagtgtggatgaagtcgcccgtcagttggaaagatccgccctggaagataaggagcgggatgaagacgacgaggacggagatggagacggggacggggcaaccggaaagaaaaagaagaagaaaaagaaaaagcgcggtccaaaagtgcaaaccgacccaccctcggttcccatttgcgatttataccccaatggcgtgttccctaagggacaagaatgcgagtacccgccaacacaggatggacgaaccgccgcatggcgaactacctccgaggagaaaaaagccctggaccaggcttctgaagagatctggaacgatttccgggaggcggcagaagcgcatcggcaggtgcggaagtacgttatgtcctggatcaaaccaggaatgaccatgatagagatttgtgaaaaactggaagactgctcccgcaagttgatcaaagaaaatggattgaacgctgggctggcattccctaccggatgctcactgaacaactgtgcagcccattacactccaaatgccggagacactaccgttctccagtacgacgacatatgcaaaatcgacttcggcactcacatctccgggaggattatagactgcgccttcaccgtgacctttaatcctaagtatgatactttactgaaggcagtaaaggacgccaccaacaccgggataaaatgcgccggtatcgacgttagactctgcgatgtgggtgaggctattcaggaagttatggaatcctacgaggttgagattgacggcaaaacataccaagttaaaccgataaggaacctgaacggtcactccattggccagtatagaatccacgccggaaagaccgtgccaattgtaaaaggcggagaagcaacccgcatggaggaaggcgaagtgtacgcaatcgaaacattcgggtctactgggaaaggagtggtccacgacgatatggagtgcagccattacatgaaaaatttcgacgtcggccatgttcccatccgattgccgcgaactaaacacttgctgaatgtgatcaacgaaaattttggaactctggcattctgcagacgctggttggaccggctaggggaaagtaaatatctgatggcgctgaaaaacctgtgtgatttgggcattgtcgacccatatccccctctttgcgatataaaaggctcctatacggctcagttcgaacacaccatcctactgcggccaacatgtaaagaagtggtgtcccgaggtgacgattattag

SEQ ID NO: 29420 - DNA, 1743 bp, Artificial Sequence
  Description of Artificial Sequence: Synthetic coding sequence
atgggaaccacagggttagagagtctcagcttaggagacagaggcgcagcgcctacggttacgagcagtgagcgcctggttcccgacccacctaacgacctgcggaaagaggacgtggcaatggagctcgaaagagtgggcgaggatgaagagcagatgatgataaaaagatcaagcgagtgtaatccactgttgcaggagcccatcgcatctgcgcagtttggagccacagccggaactgagtgccgcaagtctgtgccctgtgggtgggagcgggtggttaagcagcggctgttcgggaagacagctggcagatttgatgtgtacttcatctcgcctcagggtttaaaattcaggtccaagagtagtctggctaactatctgcacaagaacggggagacaagtttgaaacctgaagatttcgatttcacagttttaagcaagagaggaataaagagtagatacaaggactgctccatggccgctctaacaagccatttgcaaaatcaaagtaataatagcaactggaatttgcgcactcgctcaaagtgcaaaaaggatgttttcatgcccccatctagttcgtccgagctgcaagagagccgcggtctctcaaacttcacctctacccacctacttctcaaggaagatgaaggagtagacgacgtgaactttagaaaagttaggaagcccaaaggtaaagtaaccatcctgaagggaattccgataaaaaaaacgaagaaagggtgccgaaaaagctgctcaggcttcgtgcaatcagactccaagcgggaatccgtgtgcaataaggcagatgccgagtctgaacctgtcgcacagaagagtcagctcgaccggaccgtttgtatctccgatgcaggcgcttgtggggaaaccctgagtgtgacctctgaggagaattccctggtgaagaagaaggagcggagcctgagcagtggatcaaatttttgctctgaacagaagaccagcgggattattaacaagttctgcagtgccaaggattccgaacataatgagaagtatgaagatacctttctggagtctgaagagatcggcacaaaggtcgaggtggtggagaggaaggaacatctgcatactgatatcttaaaacgcggatccgaaatggataataactgctccccgacccgtaaggactttacaggagaaaagatcttccaggaggataccattccacgaacccagattgaacgtcggaagacaagtctttacttctcaagcaaatataacaaggaagctctgtctccgcctaggaggaaagcgttcaagaagtggactcctcccagatctccttttaacctggtgcaggagacgttattccatgacccctggaagctgttgattgcgactatctttctgaaccgcaccagcggaaaaatggctataccagtcttgtggaagtttctggaaaagtacccaagtgcagaagtggctcgcaccgccgattggagggatgtttctgagttgctcaaacccttgggcctgtacgaccttcgggctaaaactattgtcaagttcagcgatgagtacctgactaaacaatggaagtatccaatcgagctgcacggcatcggcaagtatggcaacgactcttataggattttctgcgttaatgagtggaaacaggtccatcctgaggaccacaagcttaacaagtatcacgactggttgtgggagaatcatgagaaactgagcctcagctag

SEQ ID NO: 29421 - DNA, 789 bp, Artificial Sequence
  Description of Artificial Sequence: Synthetic coding sequence
atggggactactgggctagagagtctttcgctcggcgaccgcggtgcggcacctacagtgacaagtagcgaaagattggtgcccgaccctccaaacgacctccggaaggaggacgtcgctatggaactggaaagagtcggcgaggacgaggagcagatgatgatcaagagaagctccgaatgcaatccacttctgcaggaacctatcgcatccgcacagttcggggctaccgctggtacggagtgccaggacaccatcccaagaacccagatcgaacggaggaagaccagcctgtattttagctccaagtataacaaggaggctctctcacctccacgacgcaaagctttcaagaagtggaccccacctcgctctccattcaatctcgtgcaggagactctctttcacgacccatggaaacttctgattgcaacgatttttttgaacaggacaagcggcaaaatggccatcccggtcctatggaaattcctggagaaataccctagtgccgaagtcgccaggacagctgattggcgggatgtctctgagctgctgaagcccctggggctgtatgacctgcgtgccaagactatcgtgaaatttagcgacgagtatctcaccaagcagtggaagtacccgattgaactgcatggaattggtaagtatgggaacgattcatatcgaattttttgtgtcaatgaatggaaacaggtgcaccccgaggaccacaaactgaacaagtaccacgattggctgtgggaaaaccacgaaaagctatccctttcttag

SEQ ID NO: 29422 - DNA, 1725 bp, Artificial Sequence
  Description of Artificial Sequence: Synthetic coding sequence
atgggtaccaccggcctggaaagtctttccttgggcgatcgtggggctgcccctaccgtaactagtagcgaacggctcgttccagatcccccaaacgacttacgaaaggaggatgttgctatggagctggaaagggtcggcgaggacgaggagcaaatgatgattaaacggtctagcgaatgcaaccccctcctccaagagcccattgccagcgcccagtttggagctaccgcgggaactgagtgtagaaagtcagtgccatgcgggtgggaaagagtcgttaagcaaagactgtttggcaaaaccgccggaaggttcgatgtttatttcatctccccacagggtctcaagtttcgtagcaaatcttctctggccaattacctccacaaaaacggggaaacaagcctgaaacccgaggactttgatttcaccgttctgtcaaaaagaggcatcaagtctcgttacaaagattgcagtatggccgcactgacctcccatttgcaaaaccagtctaacaacagcaattggaacctcaggacccgaagtaaatgcaagaaagatgtgtttatgccaccgtctagctcttcagagctgcaggagagtcgcggactgtcaaatttcacttcaacacaccttttgctgaaagaggacgagggcgtggacgatgtcaacttccgcaaggtaagaaagcccaaggggaaagttacaattctgaagggtatccccattaaaaagactaagaaggggtgcagaaagtcctgcagtgggtttgtgcagtcagactctaagcgggaaagcgtctgtaataaagctgacgctgagtctgagccagtcgcccaaaaaagtcagcttgatcgcactgtgtgcatcagcgacgcaggcgcatgcggagaaacgctttcagtgacaagcgaagaaaactcgctagtcaaaaagaaggagagatctctgtcctccggatctaatttttgctccgagcagaagacttccggcattattaataaattctgtagtgcgaaagattctgagcataacgaaaaatacgaggataccttccttgagtccgaagagatcgggactaaagtggaggtggtggagaggaaggaacatttgcacaccgatatactgaaacgaggatcagaaatggataataactgtagccccaccagaaaggactttacagaagacacgatcccccgtacacagattgaacgcagaaagacatctctgtacttttcctctaaatataacaaggaggcactctcaccacctagacgcaaggcctttaagaaatggactccccctcgatctcccttcaatttggtccaagagaccttgtttcacgacccctggaaactgctgattgccacaatctttcttaatcgcacatcagggaagatggccatccctgtgctctggaagttcctggagaagtacccgagcgcggaggtggccagaactgctgattggagggacgtgagcgaactgctcaagcccctcggattgtacgacttgcgcgcaaagactattgtgaaattctccgacgaatacctaaccaagcagtggaagtacccaatcgaactccatggcattggaaagtatggcaatgatagctatcggatcttctgcgtgaatgagtggaagcaagtacatcccgaagatcataagctgaacaaatatcatgactggctatgggagaatcacgaaaaactgtctctgtcctag

SEQ ID NO: 29423 - DNA, 93 bp, Artificial Sequence
  Description of Artificial Sequence: Synthetic coding sequence
atggtgaatgaggctaggggcaatagtagcctgaacccttgccttgagggaagtgcttctagcgggagcgagtctagtaaggactctagctag

SEQ ID NO: 29424 - DNA, 2094 bp, Artificial Sequence
  Description of Artificial Sequence: Synthetic coding sequence
atggaccatcgcaaggcacgcgtgctacctgccggacactattgtccttcgctcggcatttgggcgagtcaagtgggatccgtccggagtagcgtgcctccttctatcagcagaaatcctgccatggtgaacgaggcccgtggaaattcgtctctgaacccatgtctggaaggtagcgcgtcatcaggtagcgaatcaagcaaggactcaagccgctgctctacccctgggttggaccccgagcgccacgaacggttgcgggagaagatgcgccgacgcttggagtcaggcgacaaatggttttctcttgagtttttcccaccccgaacggccgaaggtgccgttaacctcattagtcgctttgatcgtatggccgcaggcggacctctctatatcgatgtcacttggcatcctgccggagaccctggatcagacaaagaaacttcttcgatgatgatagcaagcaccgccgttaactattgcgggctggagactatattacacatgacgtgctgccgacagagacttgaggagataacaggccacctacacaaggccaaacaactgggcttaaagaatatcatggccttaagaggtgatcctatcggagatcaatgggaggaagaagaaggcggatttaattatgcagtcgacctggtgaagcatatccgttctgaattcggtgactattttgacatttgtgtggccggataccccaagggtcatcctgaggcgggatcttttgaggcagacctgaagcacctaaaggaaaaggtttctgctggcgcagactttatcatcactcagctgttctttgaagcagatacttttttcagattcgtcaaggcctgcactgatatgggcattacctgtcctattgttccaggtattttcccgattcagggttatcacagcctccgacagctggtaaagttgtctaagctggaggtcccacaggagattaaagacgtcatcgaaccaatcaaagacaatgatgcggctattagaaattacggaatcgagctcgcagtgtcactctgtcaggagctgctcgctagcggcctcgtgcccggattgcatttctacacacttaaccgcgaaatggccaccacggaggttctgaaaaggttggggatgtggaccgaagacccaaggcggcctctgccctgggcactgtcagcccaccccaagcgcagggaagaggacgtaaggcctattttttgggcttccaggccgaaaagttatatatatcggactcaggagtgggatgaatttccaaatggtcggtgggggaatagcagcagccccgcttttggcgaactgaaggattactatctcttctacttgaaaagtaaatcacctaaggaagaactgcttaagatgtggggagaggagcttactagcgaagagagcgtgtttgaagtgtttgtactgtacttgagcggggaacccaataggaacggtcacaaggtgacatgcctgccctggaacgacgagccgctggcagctgaaacgagccttctgaaggaagagctgctgcgggtgaacagacaggggatcctgactatcaacagccaacctaacatcaatggcaaacctagctctgaccccatagtcgggtggggccctagcggaggttatgtattccagaaggcgtacctggagttcttcacctcacgggagaccgccgaggctcttctgcaggtgctcaaaaaatatgaactgagagttaattaccatctcgtgaatgtgaagggcgagaatattacgaatgcgcctgaactgcagcctaatgcagtgacatgggggatatttccaggcagagaaatcatacaacccaccgtggtggaccctgtgagcttcatgttctggaaagacgaagcattcgccctctggattgagagatggggtaagctgtacgaagaggaatcaccctctagaactattatccagtacatccatgataactactttctggttaacctcgtcgacaatgatttcccactggacaattgtctgtggcaagtagtcgaggataccctagaacttctgaaccgccctactcagaacgctagagaaaccgaggctccttag

SEQ ID NO: 29425 - DNA, 2094 bp, Artificial Sequence
  Description of Artificial Sequence: Synthetic coding sequence
atggatcaccggaaagcaagagttcttcccgctgggcattattgtccgtccttgggtatctgggcatctcaggtcggctctgtgaggagctctgtgccgccttctatctcccgaaaccccgctatggtgaacgaagcacgaggcaattcatcgctaaacccctgtctggagggttccgcctcttccggctctgaaagctctaaagatagctctagatgtagtacaccgggtctggacccggagcgtcacgaacgtctgcgggagaagatgagaagaagactggagtcgggcgataagtggtttagcctagagtttttcccaccacgcaccgccgaaggcgctgttaacctgatctcccggtttgaccgaatggccgctggaggcccattgtacatcgatgttacctggcaccctgcgggtgacccagggtccgacaaggaaacctcaagcatgatgatcgcgtctaccgctgtaaactactgtggattggaaacaattctgcacatgacctgttgtcgccagcgactggaagaaatcacagggcatctgcacaaagcaaaacagctgggactgaaaaatataatggctctgagaggagaccctattggagaccaatgggaggaggaagagggaggttttaattacgctgtggacctggtgaaacacatcagatctgagtttggtgattacttcgacatctgtgtagcgggatacccaaagggtcaccccgaagccggatctttcgaagcagacctcaaacacctgaaagagaaggttagcgccggagccgatttcatcattacccagctgttctttgaagcggacactttttttcgctttgtcaaggcctgcaccgacatggggattacctgtcctattgtgcccggaatattccccatccagggataccattcactacggcagttggtgaagctgtccaagcttgaggtcccgcaggagataaaagatgtcattgagccaattaaggataacgatgcagccattaggaattacggcatcgagctagcggtatctctgtgtcaggagttactcgcaagtggactcgttccaggactgcatttctacaccctaaaccgcgagatggccaccactgaggtgctgaagcgcttgggaatgtggacagaagacccacggcgaccactgccttgggccctgtctgcgcatccaaaacgcagagaagaggacgtcagaccaatcttttgggcctccagacctaaatcctacatttaccggacccaggaatgggacgaatttcccaacgggcgatggggcaactccagctcaccagcctttggtgagctcaaggattattacctgttctaccttaaaagtaagagcccaaaggaggagttgctcaagatgtggggcgaggaactgacttccgaggagtcagtgtttgaggtgttcgttttgtatctctccggtgagcctaacagaaacggacataaagtcacttgtttaccttggaacgacgaacctctggctgcggaaacttctcttctcaaggaagagctgttacgagtcaatagacagggaattctgacaataaatagccagcctaacatcaatgggaaaccttcctccgatccgatagtcggttgggggccatctggcggttatgtgtttcaaaaggcttacctggaatttttcacttcacgtgagacggcagaggcgctgctgcaggtgctgaagaagtatgaactgcgcgtcaactaccacctcgtaaatgtaaagggggaaaacataacaaatgcaccagaattgcagcccaacgcagtgacctggggaattttcccgggtcgggagatcattcagcccacagtcgtagaccctgtttcattcatgttctggaaggatgaagcgtttgccctgtggatcgaacgatggggcaagctgtatgaggaggaatccccaagcaggacaatcattcagtatatccacgataattactttctggtcaacctggtcgacaacgactttcctttagataactgtctgtggcaagtggtcgaggacacattagaactgctgaatcggccaacacaaaatgctcgcgaaactgaggccccatag

SEQ ID NO: 29426 - DNA, 1971 bp, Artificial Sequence
  Description of Artificial Sequence: Synthetic coding sequence
atggtgaacgaggctaggggcaactcctcacttaacccttgcctcgaggggtcagcctcaagcgggtccgaaagcagcaaagatagttcacggtgtagcacaccaggcctagatcccgagcggcacgagcgactcagagaaaagatgcggagaagactggagagcggtgacaagtggttctctttggaattcttcccacccaggactgccgaaggagctgtgaacttaatttcgagattcgaccggatggcagcgggagggccactctacattgacgtgacctggcatcccgcaggtgacccgggatctgacaaggagacctcttcaatgatgatcgcctccacggctgtgaattattgtggccttgaaactattctccatatgacctgctgcagacagcgcctagaagagataacgggtcatcttcataaagccaaacagttgggactgaagaacattatggctcttaggggtgaccctatcggcgaccagtgggaagaagaggaggggggttttaactatgctgtggacctggtgaagcacatcaggtcagaattcggcgactactttgacatttgtgtggcaggctacccgaagggccaccctgaagccggaagcttcgaagccgaccttaaacatttgaaggaaaaggtctctgcaggggcagatttcataataacacaactgttttttgaagctgatacgttcttcaggttcgtaaaggcttgcaccgatatgggaattacgtgtcccattgtgccagggatctttccgattcaggggtatcactcattaaggcaactggtcaagctctccaagctggaagtgccacaagagataaaagacgtgattgagccgatcaaggacaatgacgctgctattaggaactacggcatcgagctggcagtgagtctgtgccaggaactcttggccagcggacttgttcccggactccacttttatacccttaacagagagatggccaccacagaggtcctcaagaggctgggtatgtggactgaagatccacgcaggcctttgccttgggcgctctcagctcatccgaaaagacgcgaggaagatgtgcgtccaatattttgggcgtcccgcccaaagagctatatttataggacacaagagtgggacgaatttcctaacgggaggtgggggaatagctcatcgccagcttttggagaactgaaagactattaccttttctatcttaagtccaaaagccccaaagaggaactgctgaagatgtggggtgaggagttaacatctgaagaatccgtctttgaggtctttgtgctgtacttatcgggcgagccaaatcgaaacggtcataaggtgacttgcctaccctggaatgatgaaccccttgctgccgaaacctccttgcttaaagaggaacttctcagagtcaaccggcagggtattctgacgattaattcccagcctaatatcaacggaaagccaagcagcgatcccatcgtgggctggggcccttcaggcggttatgtattccagaaagcatatcttgagttcttcacaagcagagagaccgcagaagctcttctgcaggtcctgaagaaatatgaattgcgcgtgaattaccatctcgtgaacgttaaaggagaaaatattaccaacgcgcctgaattgcagccaaacgcagtgacttggggcatctttcctggcagggagattatccagcccacggtggtggatccagtttcattcatgttttggaaggatgaggctttcgctttgtggattgagagatggggcaaactgtacgaggaagaatcccctagccgcacgataatccagtacattcacgataattacttcttagtgaacctggtggacaacgacttccccctggacaattgcctctggcaggttgtagaggataccctggaacttctcaaccgtcctactcagaacgctcgagaaaccgaggcaccctag

SEQ ID NO: 29427 - DNA, 1971 bp, Artificial Sequence
  Description of Artificial Sequence: Synthetic coding sequence
atggtaaacgaggctagaggcaatagttccctgaatccatgcctcgaaggttccgcctctagcggttctgagagctctaaggactcttcacggtgttctaccccagggctggatccggaacgccatgagcggcttcgggagaagatgagaaggcgcctcgagagtggagacaaatggttcagcttggaattcttcccaccaagaaccgccgagggggctgtgaatctcataagccgcttcgatcgaatggcagccggaggacccctgtacattgatgtgacatggcacccggcaggtgatcctggatccgataaagaaactagcagcatgatgatcgcttccaccgcggtcaattattgtggattagagaccattctgcacatgacttgttgccgacagagactggaggagatcacagggcacctccacaaggccaagcagctgggtctcaaaaatataatggctctccgtggtgatcccattggcgatcagtgggaggaggaggagggaggcttcaattacgccgtagacttggttaagcatattcgatctgagttcggggattactttgacatctgcgtggcaggttaccctaaaggccaccccgaggcgggatcttttgaagcagacctgaagcatttgaaagagaaggtctccgcaggggcagattttatcatcactcagctgttcttcgaggctgacaccttctttagattcgtgaaggcctgtactgacatgggcatcacttgcccgatagtgcccggaatctttcccattcaaggctaccatagtctgcggcagcttgtgaagctaagtaaactagaggtcccacaggagataaaggatgtcatcgagcctatcaaggataacgacgccgcaattagaaactacggcatcgagctcgccgtgtctctgtgtcaggaactgttggcaagtggactcgttcccggtctgcatttctacactctgaaccgggaaatggcaacgaccgaagttctcaagagactcggtatgtggactgaagatccccgtcgcccactgccctgggcactctccgcccatcccaagaggagagaggaagacgtccgaccaatcttctgggcaagtcgccctaaaagctacatttatagaacccaagagtgggatgagtttccgaatggacgctggggcaactcttcttcccccgcattcggagagttaaaggattattacctcttttatttgaagagcaagtcccccaaagaggagctgttaaaaatgtggggagaggaacttaccagtgaggagtctgtcttcgaggtgtttgtgctctacctgtctggtgagccaaaccgtaatggccacaaagtcacctgcctcccttggaatgacgaacctctcgccgcagaaacctcactactaaaggaggaactgctgcgcgtgaaccgacaagggattctgacaattaatagccagcccaacataaacggcaaaccatcctccgaccctatagttgggtggggcccaagtggaggttatgtgtttcagaaagcctatctcgagtttttcaccagccgggagaccgccgaagctctgttgcaggtccttaagaagtatgagctcagggtaaattatcacctggtaaacgtgaagggagagaatatcaccaacgccccagagttacagcctaacgctgttacttgggggattttccccggtcgcgagattattcagcccacagttgtcgatcctgtctcattcatgttctggaaggacgaagcattcgcgctctggattgagcgctggggcaagctgtacgaggaagaaagcccctccaggaccattatccagtatattcatgacaactatttccttgttaatctggtggacaacgacttcccgctcgataattgcctgtggcaggtggtggaagacacactggaactcctaaaccgcccaactcagaatgctagagagacagaggcaccctag

SEQ ID NO: 29428 - DNA, 93 bp, Artificial Sequence
  Description of Artificial Sequence: Synthetic coding sequence
atggttaacgaagccagagggaacagttccctgaatccgtgtcttgagggtagcgcttcctccggcagtgagtcttctaaagattcttcctag

SEQ ID NO: 29429 - DNA, 432 bp, Artificial Sequence
  Description of Artificial Sequence: Synthetic coding sequence
atggtcaacgaagcacgcggaaactcctctctgaacccctgcttggaaggctctgcctcatccgggtctgagtcgtctaaggactcaagcaggtgttccacccctggcctggaccctgaacgtcatgagagactgcgggagaagatgcggcgtcggctggaaagtggagataagtggttttctctagagttctttccgccaaggaccgcagagggtgctgtcaacctgatctccaggttcgaccgcatggccgcagggggacctctatacattgacgtaacgtggcatccggctggagatccaggcagcgacaaagagacctcctcaatgatgattgcatccactgccgtgaactactgtggcctggagaccattctccatatgacatgctgccggcaaaggctggaagagatcactggccacctccactag

SEQ ID NO: 29430 - DNA, 162 bp, Artificial Sequence
  Description of Artificial Sequence: Synthetic coding sequence
atgtgccggggatgtggctgtctgccacccgatgctccctgtcccactctgtgttcgcggaatccagctatggtgaacgaagcccgaggtaatagcagcctcaacccctgccttgagggtagcgcctcctccgggtcagagtcatccaaagacagctcctag

SEQ ID NO: 29431 - DNA, 93 bp, Artificial Sequence
  Description of Artificial Sequence: Synthetic coding sequence
atggtgaacgaagctcgaggcaacagttccctgaatccgtgcctcgagggatcagccagcagtgggagcgagtcaagcaaggatagcagttag

SEQ ID NO: 29432 - DNA, 2508 bp, Artificial Sequence
  Description of Artificial Sequence: Synthetic coding sequence
atggcagcacccatccttaaagatgttgtggcttacgtggaagtttggtcctccaacggtaccgagaactactccaaaaccttcacaacccagttagtggacatgggggcaaaggtgtcaaagacctttaacaaacaggtgacacacgttatctttaaagatgggtatcagagcacctgggataaagcccagaaacgcggagtcaagctggttagtgtgctctgggtggaaaaatgtcggaccgctggggctcacatcgacgaaagcctgtttcctgccgctaatatgaatgagcacctttcctcactgattaaaaagaagcggaagtgtatgcagcctaaggatttcaacttcaaaactcccgagaacgacaaacggtttcaaaagaagttcgaaaagatggcgaaagaactacagcgccagaagacaaatttagatgacgatgtgccaatcttgctgtttgaaagtaacggctccctgatatatacgccgactatagagattaattcccgacatcatagtgctatggaaaaacgactacaggagatgaaagagaagagagagaacttatctccgacatcctcccagatgattcagcagtcgcacgataacccttctaattcattgtgcgaggccccattgaacattagtagggacaccctgtgttcagacgaatatttcgccggagggctccactcttcctttgacgacctctgcggcaattccggctgcggtaatcaggagagaaaactggaggggagcatcaacgacatcaaatctgacgtgtgcatctccagtttggtgttgaaagccaataacatccatagcagccctagctttacccatcttgacaagtcctctccccagaagttcctcagtaacttatccaaggaggagatcaacctacagcggaatatcgcaggcaaagtggtgacgccggatcagaaacaagctgccggaatgagtcaagagaccttcgaggagaagtatcggctgagtcctacattatccagcactaagggccacctgctcatccactcaagacccaggtcaagctctgtcaaaagaaaacgggtatctcacggctcccattcaccaccgaaagaaaagtgtaaacgtaaaaggtcgacccgaaggtctattatgccaagactgcagctctgcaggagtgaggacaggttacaacacgtagctggaccagcactggaagcactgtcatgcggggaaagctcatatgacgattatttcagtcccgataacttaaaagaacgctattcggaaaatctgccccctgaaagccagcttccctcttcccctgctcagctgtcgtgtcgcagtcttagtaaaaaggaacgaacaagcatatttgaaatgtcggatttttcatgtgtgggcaagaagaccaggaccgtagacataaccaacttcaccgcaaaaactatatcatctcctagaaagactggcaatggcgagggtcgcgcaacgagctcttgcgttacatcagcaccagaggaagcacttcgctgctgtcgccaggcaggaaaggaggacgcctgccccgaaggcaatggctttagctacactatcgaggatccggctctccccaaaggccatgatgacgatcttactccactggagggcagcctcgaggagatgaaggaagctgtaggcttaaaaagtacccagaacaagggaaccacaagcaagatttcaaacagctccgagggggaagcacagagtgagcatgaaccttgttttatagtagactgcaacatggaaactagcactgaggagaaggagaacctaccaggtggttacagcggttcggtcaaaaaccgtcccacaagacacgacgtactcgatgactcctgtgatgggttcaaggatctcattaaacctcatgaggagctaaagaagtctggcagaggtaagaaacccacaagaacacttgtgatgacgtcaatgccctcggagaaacagaatgtggtgatccaggttgtggataagttaaaaggattctccatagccccagatgtttgtgaaaccactacgcacgtactttcaggaaagccattacggactctaaatgtgcttctcggaatagctagaggatgttgggtgcttagttacgactgggtcttatggagcctggaactggggcattggatttctgaagagcccttcgagctttctcaccatttcccagctgccccactctgccgaagtgaatgccatctgtccgctggaccttacagaggaactctgttcgctgatcagcctgcaatgtttgtctctccagcgtcaagtccacctgtcgccaagttgtgcgagctggtccacttatgcggcggtcgagtgtctcaggttccaagacaggcgtcaattgtcataggaccctattccggcaagaagaaagctactgttaagtacctctctgaaaaatgggtgttggattctattacccagcacaaagtatgcgctccagagaactatcttctgagccaatag

SEQ ID NO: 29433 - DNA, 1833 bp, Artificial Sequence
  Description of Artificial Sequence: Synthetic coding sequence
atggctgccccaattttgaaggatgtcgtggcctatgttgaggtttggagttcaaacggaactgagaactactctaaaaccttcactacacaactcgtcgatatgggcgctaaagtgtcgaaaacttttaataagcaggttacacacgttatctttaaagatggttatcaatcgacgtgggacaaggcacaaaagagaggcgtaaaactggtgtccgtgctgtgggtggagaaatgtcgaaccgccggagcgcacatcgatgaaagtctgttccctgccgcaaatatgaacgaacatctttcctcccttatcaaaaagaaaagaaaatgcatgcagcccaaagatttcaattttaaaacgcccgagaacgacaaaaggttccaaaaaaaatttgagaaaatggctaaagagctgcagaggcagaagaccaacctcgacgatgatgtgccaatcctcctttttgagtcaaatggctccctcatttacacgcccaccatcgagatcaactcaaggcaccattccgccatggagaagcggttgcaggagatgaaagaaaaaagggaaaatctgagcccaacgtcttcccaaatgatccagcaatcccacgataacccgtcaaattccctgtgtgaggctccactgaacatcagccgcgacacgctttgtagtgacgaatactttgcaggaggactgcactccagttttgatgatctatgcggaaactccggatgtggaaaccaggaaagaaaacttgaaggatccatcaacgatatcaagtctgacgtgtgtatttcatccctcgtattgaaggcaaacaacatccatagctccccttccttcacccacctggacaaaagctccccacaaaagttcctgtcaaacctcagtaaggaagaaataaacctgcagagaaatatcgcaggtaaagtcgtgacccccgaccagaagcaggccgctggaatgtcccaggagaccttcgaagaaaaatacagactctctccaacattgagttctaccaagggccacttgttgatccattcaagaccgagaagttcaagtgtgaagcggaaacgcgtctcgcacgggtctcatagtccaccgaaagaaaaatgcaaacgcaagagatctaccaggcgcagtatcatgccccgattacaactgtgtcgatctgaggaccgcctacagcatgttgccggacctgccctggaagcattgtcctgtggggaatcttcttatgatgattacttcagcccagacaatctaaaagagcggtatagcgaaaacctgcctcctgaatctcagcttccgagcagccctgcccagctgtcctgtcgttccttgagcaaaaaggaacggacgtctatctttgaaatgtccgatttttcctgcgtgggaaagaaaacgagaactgtggatattactaattttaccgctaagaccatttctagcccacggaaaactgggaacggggaggggcgagccacttcgagctgcgtgacttccgctccagaagaggcactccggtgctgcagacaggctggcaaggaagatgcttgccccgaaggcaatggcttctcatacaccattgaggaccctgctctgcccaaagggcacgacgacgatctcaccccacttgagggaagcttagaggagatgaaggaggctgtgggtctgaagagcacccagaataaggggaccacatcaaaaatctctaactctagcgagggcgaagcccagtctgaacatgagccttgctttatagtcgattgtaacatggagaccagtaccgaagaaaaagagaacctgcccggaggatactctggctcaatgtag

SEQ ID NO: 29434 - DNA, 1689 bp, Artificial Sequence
  Description of Artificial Sequence: Synthetic coding sequence
atggccgctccgatcctaaaggacgtggtcgcttatgtggaggtatggagctccaatggaaccgagaactatagcaagacctttactacgcagctcgtggacatgggagccaaagtaagcaagactttcaataaacaggtgacgcatgtcatcttcaaggatggctaccagagcacttgggacaaagcccaaaagagaggggtgaagctggtcagtgtgttatgggtggagaaatgcaggaccgccggtgctcacatcgatgaatccttgtttccggcagccaatatgaacgaacacctttcttcattaatcaagaaaaagcgcaagtgcatgcagcctaaggattttaatttcaagacccccgaaaacgataaacggtttcaaaaaaaattcgagaagatggccaaggagctccagcggcagaaaacaaatctagccagccagatgatccagcagtcacatgataaccccagtaatagcttgtgcgaggctccccttaacatttctcgcgacactctgtgtagcgatgaatacttcgccggtggtcttcacagtagctttgacgacttgtgtggaaactcaggttgcggcaatcaggagaggaaactggaggggtccatcaacgatatcaagtctgacgtttgtatttccagtctggtgctgaaagcaaataatatccatagcagcccaagtttcactcaccttgacaaatccagtccgcagaagttcttatccaacctgtcaaaagaagaaatcaacctccagaggaacatcgcagggaaggtggtcacacccgatcaaaagcaagccgctggcatgtcccaagaaactttcgaggagaaataccgactatccccaaccctatcatcaactaagggacacctgctgattcactccaggcctcgctcctcttccgttaagcgaaagcgggtgtcacacggatcccactcccccccaaaagaaaaatgtaagagaaaaagatccacccgtaggtcaatcatgccacgactgcagctgtgcaggtcggaagatcgactccagcatgtggccggaccagcgctcgaggccctgagctgtggggaaagcagctatgacgactatttctcccccgacaatttgaaggagcgatattccgaaaatctgcccccagaaagccaactcccatcctcccctgctcagctgtcttgtagatctcttagcaaaaaagaaaggacaagcatcttcgagatgtcagacttctcatgtgtgggcaaaaagacaaggacggtggacataaccaattttactgccaaaaccatctcttccccacgcaagactggcaacggggagggtcgtgctacatcttcgtgtgtaacatccgccccagaggaggctctacgctgttgccggcaagccggtaaggaggacgcctgccccgaggggaacggattttcgtacacaatagaggaccccgcactgccaaagggccacgacgatgatctgacaccactggagggatcgctggaagagatgaaggaggctgtgggtctgaagtccacacaaaacaaaggtactacttccaagatcagtaacagctcagaaggggaggcccagtctgaacatgagccttgctttattgttgactgcaacatggaaacctcaacagaagagaaagaaaatctgccgggtggctatagtggatctatgtag

SEQ ID NO: 29435 - DNA, 234 bp, Artificial Sequence
  Description of Artificial Sequence: Synthetic coding sequence
atgaacgtactgcttggtagtgtcgtgattttcgccactttcgtgacactgtgcaatgcctcatgttactttattcccaacgaaggggtccctggcgattccactagaatgtttttgcacctgtgggtcatgaccaagactaccgccaaggagtcctcccgcagacgcacggccagcatttcctggtggagaaggaggacacaaaagagacctgtgctgtccgtcaacggatag

SEQ ID NO: 29436 - DNA, 345 bp, Artificial Sequence
  Description of Artificial Sequence: Synthetic coding sequence
atgaatgtacttctgggttccgtggttattttcgccacgtttgtaaccctttgcaatgcaagctgctatttcatccctaacgagggagtcccgggagactcaacccgcaaatgtatggatctgaaaggaaacaaacaccctattaattccgaatggcagactgacaactgcgagacgtgtacatgttacgaaacagagatctcttgctgtacactggtgagtaccccagtggggtacgacaaagataattgtcagcgtatttttaagaaagaggattgtaagtacatcgtggtggaaaagaaggatcctaagaaaacctgctcagtgtcagaatggataatttag

SEQ ID NO: 29437 - DNA, 3813 bp, Artificial Sequence
  Description of Artificial Sequence: Synthetic coding sequence
atgaccgatgacaattcggatgacaagatcgaagacgagctccaaacattcttcacatccgacaaggacggtaacacacacgcttacaacccgaagagtccacctacgcagaactcctccgctagtagcgtaaactggaattcagccaatcccgacgacatggtggtcgattacgagacggatccagccgtagtcacaggcgagaatatctctctttcgctgcagggcgttgaggtgttcggccacgaaaaatcttccagcgattttatttctaaacaggtcctggatatgcataaagactctatatgccagtgccctgcactcgttggcacggagaagcccaaatatcttcaacactcctgtcattcccttgaagcagtagaggggcagtctgtcgagccctcactccccttcgtgtggaagcccaatgacaacctgaactgcgcaggatattgtgatgccctcgaactgaaccaaactttcgacatgacagtggacaaggtcaactgtaccttcataagtcaccatgctattggaaagagtcagagctttcacactgccggtagtttgcccccaacaggcagacgtagcggcagtactagctctctgtcctacagcacgtggacgagctcacacagcgacaagactcacgccagggagacaacttacgatagggaaagcttcgagaatcctcaggtcaccccaagcgaggcccaggacatgacatatacagcctttagtgatgtggtgatgcagagcgaggtgttcgtatctgacatcggcaatcagtgcgcatgctcaagcggtaaggtgacctccgaatatacagatggtagtcagcagaggttggtgggggaaaaggaaacccaggcactgacccctgtaagcgatggcatggaggtgccaaacgatagtgcgctccaagagtttttctgccttagtcatgacgagagcaactccgagcctcactcccagagttcgtatcggcacaaagagatgggccagaacctccgggagactgtgagctattgcctgatcgacgatgagtgccctcttatggttccagcattcgacaagtcggaagctcaggtattgaatccagagcacaaagtgaccgaaactgaggacacacagatggtatccaaaggcaaggatttggggactcagaaccataccagcgagctgatcctttcttcaccccctggacagaaagttggctcatcatttggcctgacttgggacgccaacgatatggtaatctccacagataagactatgtgcatgtccacccccgtgctagagcctactaaagtgacattcagtgtgagtcctatcgaggccacggaaaaatgtaagaaggtcgaaaagggtaacagagggcttaagaatattcctgatagcaaagaggctcctgtcaacttgtgtaagccctctctggggaaaagtacaatcaaaacaaatacgcctatcgggtgcaaagtccgaaagactgagatcatcagctatcctagacctaactttaagaatgtcaaagctaaggttatgtcacgggcagtgctacagcctaaagacgcggcattaagtaaggttactcctaggccacagcagacttcagcatcttctccatcctctgtgaacagtagacaacagaccgtattgtcccgcacccccaggagtgatctgaatgctgacaagaaggccgagatcctcatcaataagacgcacaaacagcagtttaataagttgatcacgagccaagctgtgcacgtgacgactcactccaaaaacgctagccatcgggtgccgcgaaccactagcgctgtgaaatctaaccaggaggatgtggacaaagcttcctcatcaaacagtgcctgcgagactgggtccgtgagcgccctgttccagaagatcaagggcattctgcccgtcaaaatggaaagtgccgagtgcctggagatgacttatgtccccaacattgacagaatcagtcctgaaaagaaaggcgagaaagagaatggcacctcaatggaaaaacaggaactgaaacaggagatcatgaacgaaacttttgagtacgggagtctcttccttggttccgcttctaagaccaccacaacgagtgggcgtaacattagtaagcccgattcgtgtggactcaggcagatcgcagcaccaaaagcgaaagtcggacccccagtctcatgtctgagaaggaattctgacaaccgcaatccttcagccgatcgggctgtgtctccccagcgcattagacgcgtttctagctccggcaaacctacttctctcaagacggcccagagttcatgggtgaatctgcccaggccgctcccaaagagcaaagcaagcctgaagtcccccgcacttcgcaggacaggttcaacaccaagcattgcttccacacactccgagctgtccacatactctaacaattctggcaatgctgcggtgattaagtacgaagaaaaaccgcctaagcccgcattccagaacggcagctcaggcagtttctatctaaaacctctagtcagcagagcgcatgtgcacctgatgaagactccacctaaggggccaagccgaaaaaatttattcaccgccctcaacgcagtggaaaagtctaggcaaaagaacccacggtcactgtgcatccagccacaaaccgctcccgacgcgctcccccctgaaaaaaccctggaactgacccagtataagaccaagtgcgagaaccagtcgggcttcatcctgcagcttaagcagctgctcgcatgcggaaacactaaattcgaggctctgactgtagtgattcagcaccttctgagtgagagggaagaggcactgaagcaacacaagacattgtcccaggaactggtgaatctgaggggggagctggtgactgcttccactacgtgcgagaaacttgagaaagcccgtaatgaactgcagactgtctacgaggcctttgttcagcaacatcaagccgagaaaactgaacgtgagaatcgcctgaaggagttctacacacgagaatatgagaagctcagggatacttacattgaggaggccgaaaaatacaaaatgcagcttcaggagcagtttgacaacctgaacgctgctcatgaaacctccaaactcgagattgaagctagtcacagcgagaaactggaacttctcaagaaggcgtacgaggcatctctctcagagatcaagaagggtcacgagatcgagaagaaaagtttggaagatctattatcagagaagcaggagtccctcgaaaaacaaattaacgatctgaaatcggaaaatgatgccttgaatgagaagctcaaaagtgaagaacagaagcggagggccagagagaaggctaacctgaagaacccgcagatcatgtatctggaacaggaactcgagagccttaaggcagttctggagataaagaacgagaaattgcatcagcaagatattaagctgatgaaaatggaaaaactagtcgataacaatactgccctcgtggataaactcaagcgattccaacaggagaacgaggagctcaaagccaggatggataagcatatggctatttctaggcagctctcaacagagcaggcggtccttcaggagtcattggaaaaggagagcaaggtcaacaagagactgtctatggagaacgaggaactcctttggaagctgcacaacggggatctctgcagccccaagaggtctcctaccagcagcgcgataccactgcaatctcctcggaattccggctcattccctagcccgtcgataagcccacgctag

SEQ ID NO: 29438 - DNA, 1311 bp, Artificial Sequence
  Description of Artificial Sequence: Synthetic coding sequence
atgctgctgagccccaaattttcgcttagcaccatccacattcgtctgacggctaaaggcctgctgaggaaccttagactaccatctgggtttagaagaagcacagtggtgttccacacggtagagaagagtaggcagaaaaacccgaggtcactctgcatccaacctcaaacggctccggacgcacttccccctgaaaagacactagagctcactcagtataagaccaaatgcgaaaatcagtctggtttcatcctccagttaaagcaattactcgcctgcggcaatactaagtttgaagccttgacggtcgtgatacaacatctgctgtccgaaagagaagaagcactgaagcagcacaaaactctgagtcaggaattagtgaacttgaggggggagcttgttacagcctccacaacgtgtgagaaattggaaaaggctcgtaacgagctgcagacagtgtacgaggcgttcgtgcaacaacaccaggccgagaagactgagagagagaatcgcttgaaggagttttatactcgagaatatgagaaacttcgtgatacctacatcgaggaggctgaaaaatataaaatgcagttacaggaacagtttgataacctgaacgccgctcatgaaacatcgaagctcgagatcgaagcatcacattcagaaaaactggagctgctcaaaaaagcctacgaagccagtctcagcgagattaaaaaaggccacgagatagagaagaagtcattagaggacctcctctcagaaaaacaagagagccttgaaaaacagatcaatgatctcaaatccgaaaacgacgctctgaacgaaaagcttaaaagcgaggagcagaagcggcgagcccgagagaaggccaacctgaaaaatccgcagataatgtatctggaacaggagctggagtcactgaaggccgttcttgaaatcaagaatgagaagctgcatcagcaagatattaagctaatgaagatggaaaagctggtggataacaatacggctctcgtggacaagctgaagcgctttcaacaagaaaatgaggaactgaaggccagaatggacaagcacatggctatttccaggcagttaagtaccgaacaggccgtgcttcaggagagcttggaaaaagagtcaaaggtgaataagcgcctctccatggaaaacgaggagcttctctggaagctgcacaacggggacctgtgctcccccaaaaggtcgcccacctcatccgcgattccccttcagtcccccaggaactccggctctttcccctccccttcaatttctccaagatag

SEQ ID NO: 29439 - DNA, 1554 bp, Artificial Sequence
  Description of Artificial Sequence: Synthetic coding sequence
atgacggttccgggtgggtttaggtcttgtaccgagaccgatattagttccaagatcttcattaattctactcttacaccacccgcagggtccgaaaggcactatgatgcaaccctgctgaccttgctggtggtcggatcctattctctctgcatcattccgctgctcgctacatttacaggaaagaagaccggcaacgccgctgtcattaaatatgaagaaaaaccgccaaaacctgcctttcaaaacggctcttcaggtagtttttatctaaaacccttagtgtcccgggctcacgtgcacttgatgaaaacgccacctaagggacccagccgaaagaatttgttcaccgccctgaacgccgttgaaaagagcagacaaaagaacccgagatctctgtgcatccagccacaaaccgcgccagacgccctgcctcccgagaagacactggagctcactcagtataaaactaagtgtgaaaaccaaagcggattcatactgcagctgaaacagcttctggcatgcggaaacaccaagttcgaggccctcaccgtggtaatacagcacctcctttcagaacgggaggaggcgctgaagcaacataaaactctgagtcaggagctggtgaatctgcgtggggagctggtgaccgccagcaccacttgcgaaaaactggaaaaggcgaggaatgaactccaaaccgtatatgaagctttcgtgcagcagcatcaggctgagaaaacagagagagaaaatcgactcaaagagttctacactcgggagtatgaaaaactccgagatacctatattgaagaggcagaaaagtacaagatgcaacttcaggagcagtttgataacctcaacgcagcacacgaaacatctaagcttgaaatcgaggcgagccattcggaaaaactcgagctgctaaagaaagcatatgaggccagtctctcagaaataaagaagggccacgagatcgagaagaagtctctcgaggaccttctaagcgaaaaacaggagtccctagagaagcaaatcaacgatctgaaaagcgaaaatgacgctctgaacgagaagctaaaatctgaagagcagaagcggagggccagggagaaggccaacctcaaaaaccctcagattatgtaccttgagcaggagctggaaagcctgaaagctgttctggagatcaagaatgagaaacttcatcagcaggacataaagcttatgaagatggagaaactcgtggacaacaatactgcgctggttgacaaacttaagcgctttcaacaagaaaatgaggagctaaaggcacgcatggataaacatatggctatctcccgccaactcagtaccgaacaggctgtactccaggagtctctggaaaaagagagtaaagtgaacaaacgcctgtccatggagaatgaggaactgctgtggaagctccacaatggcgacctctgctcccccaagcgcagcccaaccagctctgcaatcccactgcagtctcccagaaattcggggagcttccccagccccagcatctcccccagatag

SEQ ID NO: 29440 - DNA, 2313 bp, Artificial Sequence
  Description of Artificial Sequence: Synthetic coding sequence
atgaccgacgataattcggatgataaaattgaggatgaactgcagacattcttcaccagtgataaggacggcaacacacacgcttataatcccaagtccccccctacacaaaatagctccgccagtagcgtcaactggaacagtgccaatccagatgacatggttgtggattacgaaaccgacccagctgtggtcactggggagaacatcagtttgtccctccagggagtggaagtatttggccacgagaagtcaagtagcgattttatcagtaaacaggttctcgacatgcacaaagactcaatctgtcagtgcccagcgctcgtgggcacagagaaacctaagtacttacaacattcctgccacagcctagaggctgttgaggggcagtcagtcgaaccttctttacccttcgtgtggaaacctaacgacaatttgaattgcgctggatattgtgacgccctggagctcaatcagacatttgacatgacagtggataaagtgaactgcaccttcatctcacaccacgctatagggaagagccaaagctttcacacagcaggcagcctcccacctacaggtagacggtccggctccactagcagcctgtcatattcaacctggacctcctctcatagcgacaagactcacgcccgagagaccacttatgatagagaaagcttcgagaatccccaggtgacaccgtcagaagcacaagacatgacttacacagcctttagcgacgtggtcatgcaaagtgaggttttcgtgagtgacattggaaatcagtgtgcctgctcctcgggaaaagtgacttctgagtataccgacgggtctcaacagaggttggtaggagaaaaagaaactcaggctctgaccccagtgagtgatgggatggaggttccaaatgacagcgccctgcaagagtttttctgtctgtcccatgatgagtctaattcggagcctcatagccagagctcctacagacacaaggaaatgggtcagaatttgagggaaaccgtgagttactgtctaatcgatgatgaatgccccctgatggtgcctgctttcgataagtctgaggcacaggttcttaatccggagcataaggtcacagaaaccgaagacactcagatggtcagtaagggcaaggacttgggaactcagaatcacacaagtgaactaatcttgtcatccccgccagggcagaaggtgggctcctccttcggcctgacctgggacgcgaatgatatggtaattagtaccgataaaaccatgtgcatgtcgacacctgttctggagccgactaaggtgaccttctctgtcagccctatcgaagccacagagaagtgtaagaaggtcgagaaaggaaacagaggactcaaaaacattcccgactcgaaggaagctccagtgaacctgtgcaagccttcattgggcaagtctaccatcaaaacaaacaccccaatcggctgtaaagtgaggaaaaccgaaatcatttcttaccctcggcctaacttcaaaaatgtgaaggcaaaagtaatgagtcgcgctgtgctacagccaaaagacgcagcattaagcaaggtgacccccaggccgcaacagacaagcgcctcctccccatcctctgtgaattctcgccagcagaccgtgttgagtaggacaccaaggtccgatcttaacgcagataagaaagcagagatcctgattaacaaaacgcataaacagcaattcaacaaactaatcacctctcaggccgttcacgtgacaacccactctaagaatgcatcacaccgcgtgccccgtacaacttccgcagttaagtctaaccaggaggacgtggacaaggcttcgtcctctaacagtgcctgcgaaacaggaagtgtgtcggcgttgtttcagaaaataaaaggaattctgcctgtgaagatggagagcgccgagtgcctggagatgacgtatgtaccgaacattgatcggatttcgccggagaaaaagggggagaaagaaaacggcacttccatggaaaagcaagagctcaaacaggaaatcatgaatgaaacctttgagtatggtagcctgttcctagggagtgcttccaagactaccaccacttctgggaggaacatttccaagcctgacagctgtggactgaggcagatagcggcaccaaaagccaaggttggcccacccgtgtcctgcctccgcagaaactcagataaccggaatccctccgcggatcgggcagtcagtccacagcggattagacgcgtgtctagcagtgtcctccctaaggcagccttctcgtag

SEQ ID NO: 29441 - DNA, 3651 bp, Artificial Sequence
  Description of Artificial Sequence: Synthetic coding sequence
atgaccgatgataattcagacgacaagatagaggacgagctacagaccttctttacgtccgacaaggatggaaatactcatgcttataacccaaagagtcccccaacccaaaacagttccgcttcgtcagtgaactggaatagtgccaatcccgatgacatggtggtcgactacgaaactgaccccgcagttgtgacaggggagaatatttcactgtccctacagggggtcgaggtgtttggccacgaaaagtcgagttcagattttatctcaaagcaggtattggatatgcacaaagattctatttgtcagtgtcccgcactagtcggtactgaaaaacctaagtacctccagcactcatgccatagccttgaggcagtggaaggccagtccgtcgagccctcactgccattcgtgtggaagccaaacgataacctcaactgtgcgggttactgcgacgcactggagttgaatcagacttttgacatgactgtcgacaaagtgaactgcacatttatttcccatcatgccatcgggaagagccaatccttccacactgcaggatccctgcccccaaccggtaggaggagcggaagcacctcatcccttagctactctacctggacttcttctcactcggacaagacccacgcccgagaaacaacgtatgatcgagaatcctttgaaaacccacaggtcaccccttctgaggcccaggatatgacgtacaccgctttctccgatgtggtgatgcagtcggaggtgttcgtgtcagacatcggaaatcagtgtgcttgtagctccgggaaggtgacttcagagtatactgatgggagccagcagcgcttggtgggtgaaaaagaaacccaggctctgactcccgtttctgacggcatggaagtgcctaacgattcagccctgcaagagtttttttgtctcagccacgacgaatcaaactctgagccccactcgcagtcaagttacaggcacaaagaaatggggcagaatctgagagagactgtatcatattgtctcatcgatgatgagtgccccctgatggtccccgcattcgacaaaagtgaagcccaagtgctgaatccagaacacaaggtgacagaaacggaagatactcagatggtttctaagggtaaagatcttggtactcagaaccacacttcagagctgatcttgtcttctcctcccggtcagaaggtaggatcctcattcgggttgacatgggacgcaaatgacatggtcatatccacggacaaaacaatgtgtatgtccacacccgtattagaaccaacgaaagtgacatttagcgtgtctcctattgaagccaccgagaaatgcaagaaagtcgagaagggcaacagaggcttaaagaatatacccgattccaaagaggcgcctgttaacctctgcaaaccatcacttgggaaatccacaataaaaacaaacacaccgatcgggtgcaaggtgcgaaaaacagaaatcattagctatccaaggccaaattttaagaatgttaaagcgaaagtgatgtcacgggctgttctgcagccaaaagatgcggctctgagtaaggtgactccacgacctcaacagacaagcgcttcgagccccagcagcgtgaattccaggcagcagactgttctctcccgcacccctcggtccgacctgaacgcagataagaaggcagagatactaattaataagacacacaaacagcagtttaacaagctgatcacatcacaggcggtccacgtgacaacacatagtaaaaatgcatcacaccgggtgcctcggaccacctcagcagtcaagtctaatcaagaggacgtagataaagcatctagcagcaactctgcatgcgagaccgggagcgtatccgcactgtttcagaaaattaagggaattctgcctgtcaaaatggaatctgctgaatgcctggagatgacgtatgttccaaatatcgataggatttcacctgagaaaaaaggggagaaggagaacggcacatcaatggaaaagcaggagttaaaacaagagatcatgaacgagaccttcgagtatggcagcctgttcttgggatccgcctccaaaactactactacgtccgggagaaacatctctaaacccgactcatgcggcctgcgccagatcgctgccccaaaggctaaggttggccctcctgtgagctgcctcaggaggaacagcgataacaggaatccatctgccgacagggctgtgagccctcagcgcattcgtcgggtgagctcttcagccggaaacgcagccgtcataaagtacgaagagaagcccccaaagcctgcgtttcagaatggctcctcaggaagcttttatctgaaacccctcgtctcccgcgcacacgttcatttgatgaaaactcctcctaagggtcccagtcgaaagaacctcttcacagcgttaaatgcggtggagaagagccgccagaagaacccacgctcactctgcatccagccccagaccgcaccagatgctttgccccctgaaaaaacccttgaactcacacagtataaaacaaagtgcgaaaaccagtccggcttcatacttcagctcaaacagctcctcgcttgtggtaacactaaatttgaagctctaaccgtcgtcattcagcatcttctatccgagagagaggaagctctgaaacaacacaagaccctttctcaggagttggttaatctgaggggggaactagtgacagcaagcaccacttgcgaaaagctcgaaaaggccaggaatgagttgcaaaccgtgtatgaggcattcgtgcagcagcatcaagctgagaagaccgagcgcgagaaccggcttaaggaattctatactcgggaatatgagaaattaagagatacatacatagaggaggcagagaagtacaaaatgcagctccaggagcagtttgacaacctcaacgcagcccatgagacttccaaactggaaattgaagcatctcattctgaaaaactcgaactcctgaagaaagcctacgaggcatcgttgagcgaaattaaaaaaggacacgaaatcgagaaaaagtctcttgaggacctgctctcagaaaagcaggaatcgctagagaagcagattaatgatctgaaatctgagaatgacgcgctcaatgagaaactcaagtccgaagaacagaagaggcgggctagggagaaagccaacctgaagaacccgcagatcatgtatctcgagcaggagctggagtccctcaaggcagtcctggagataaaaaacgaaaaattacaccagcaagacatcaagttgatgaagatggaaaagcttgttgacaataatacagcgttggtcgataagctaaaacgttttcagcaggagaatgaagaacttaaagcccgaatggacaaacacatggcaatcagtaggcagctatctacagaacaggcagtgctgcaggaatctctggagaaagaaagtaaggttaataagagactgtctatggaaaacgaagaactgttgtggaaactgcacaacggggatttgtgttcgccaaagcgcagccccacctctagcgctatcccactgcagtcccccagaaactccggttcctttccttccccaagtatctctccgcgatag

SEQ ID NO: 29442 - DNA, 1029 bp, Artificial Sequence
  Description of Artificial Sequence: Synthetic coding sequence
atgggatgtcctagctctaagctctgcctctatagcccttgtgctgccacgcgccgagaggaggcgctgaagcaacacaagaccctgagccaggagctcgttaatctccggggtgaattagtgaccgcctctacgacatgtgagaaactcgagaaagccagaaatgaactgcagaccgtctacgaggcatttgtgcaacagcaccaggccgagaagaccgagcgcgagaacaggctgaaagagttttatacaagggagtatgagaaactccgagatacgtatatagaagaggctgagaaatacaaaatgcagctacaggagcagttcgacaatcttaacgccgcacacgaaacgagtaaattagagattgaagcttcacacagcgagaaactggagctgctgaaaaaagcttatgaggcatccctctccgagatcaaaaaaggacacgaaattgagaagaagagcttagaagaccttcttagtgagaaacaagagagcttggaaaagcagataaacgacctgaaaagcgaaaacgatgccctgaacgaaaagctgaagtcagaggagcagaaaagacgggcacgggagaaagcgaatctgaagaatccccagattatgtacctggaacaggagcttgagtccctaaaagcagtcctcgaaattaaaaacgaaaaactgcaccagcaggatataaaattgatgaaaatggagaagctcgtcgataataacacagcgttggtggacaaacttaaaagattccagcaggagaatgaggagttgaaggctcgaatggacaagcacatggctattagtcggcagctgtccaccgagcaagccgtcttgcaagagagtctggagaaggaatcaaaagtcaacaagcgtctctctatggaaaacgaggaattgttatggaagctgcataatggggacctgtgctctcccaaaaggtcccccaccagctccgcaattcctctccagagtcccagaaactcggggtctttcccatcaccaagcatctccccccgatag

SEQ ID NO: 29443 - DNA, 3651 bp, Artificial Sequence
  Description of Artificial Sequence: Synthetic coding sequence
atgaccgatgacaattccgatgacaagattgaagatgaactccagacgttcttcactagcgataaggacgggaatactcatgcctataatcctaaatcgccccctacccaaaactcaagtgcttcttctgttaattggaactccgctaacccagatgatatggtcgtggattatgagacagacccagcagtcgtcaccggagagaatatctccctttcactgcagggcgttgaagttttcggacatgaaaaatcaagttcagacttcattagtaaacaggtcctagacatgcacaaagactctatctgtcagtgcccagcattagtaggtactgaaaagcctaaatacctgcaacacagttgtcacagccttgaggccgtggaaggccagagcgttgaacctagcctgcctttcgtgtggaagccaaatgataatttgaattgtgctgggtactgcgacgctttggaacttaaccagaccttcgacatgacagtcgacaaagtcaattgcacttttattagccaccatgccataggcaaatcccagtcctttcacacagctggcagcctcccacccaccgggagaaggtcaggctcaacctccagtctaagctatagtacatggacctcaagtcacagcgataagactcacgcaagagagaccacttacgatagagagtcgtttgagaaccctcaggtgactcccagcgaagcccaagatatgacctatactgcattcagcgacgtcgttatgcagagtgaggtttttgttagtgacataggcaatcaatgcgcctgctcttccggaaaggtgacatccgagtataccgatggcagccagcaacggctagttggtgaaaaggagacacaagccctgacccctgtgtcagacggaatggaggtccctaacgattccgccctgcaagagttcttctgtctcagtcacgacgaatcaaatagcgaacctcacagccagagcagctaccggcataaggagatggggcagaaccttagagagactgtatcttactgtctgatcgacgacgagtgccctctgatggtgcccgcttttgacaaatctgaggctcaggtgcttaacccggagcataaggttaccgagacggaggacacccaaatggtttctaaaggcaaagatcttggaacccaaaaccatacctctgagctgattctgtctagtccgccaggccagaaggtcggatcatctttcggcctgacctgggatgcaaatgatatggtgatttccaccgacaagacgatgtgtatgtctacacctgttctggaacccaccaaagtgacattctcggtctcaccaattgaggctactgagaagtgtaagaaggtagaaaaaggtaatcggggactgaaaaacatccctgatagtaaggaagctcccgtcaacttgtgtaagccgagtttggggaaaagcaccatcaaaacaaatacaccaattgggtgcaaggtccggaagaccgagatcattagctatccacgtcctaatttcaagaacgtgaaagctaaggtcatgtcccgcgcagtgctgcagccaaaggacgcggcattgagtaaagtgactccccgtccacagcaaacttcagcatcttcacctagttctgtaaactccagacagcagaccgttttgtcccgtaccccacgaagtgacctgaacgcagacaagaaggctgagattctcatcaataagacccacaagcagcaattcaacaagctgatcacgtcacaggccgtgcatgtaaccacccactctaagaacgcatctcaccgggtgccccgaacaaccagcgctgtgaagtcaaatcaggaagacgtcgacaaggcatcgtcgtctaactcggcctgtgagaccggctccgtgtcggccctgttccagaaaatcaaaggtatactccccgtgaaaatggagtccgcggagtgtctggaaatgacatatgtgcctaatatcgatcgcatttccccggagaagaaaggggagaaagaaaatgggaccagcatggagaagcaggagttaaaacaggaaattatgaatgagaccttcgagtatggatcactctttctcggatctgccagcaagaccactacaacaagcgggaggaacatcagtaagcctgattcctgtgggttgcggcagatagcagcccctaaggcgaaggtcggaccgccagtgtcctgtttacgcaggaattcagacaaccggaacccttctgctgacagagctgtgagtcctcagcgtatccggagagtgtcctcatctgctggaaacgctgccgttataaaatatgaggagaagccgcctaaaccagcctttcagaatggaagcagtggaagtttctacctgaagcctctcgtgtcccgagctcacgtgcacttaatgaaaacaccgccaaaaggcccttctaggaagaacctgttcaccgcacttaacgctgtggagaagagcaggcagaagaacccccgatctctttgtatacaacctcagacagctcctgatgcactgcccccagagaagaccttggaactcacacagtataagacaaagtgcgagaaccagagtggcttcatcctgcaactgaaacagctgctggcatgcggtaacactaagttcgaagctttgaccgtcgtgatccagcacctgttgagcgaaagggaagaagcattgaaacagcacaagacactgtctcaggaactggtgaacctcaggggcgagctggttaccgcttccactacctgcgagaaactggaaaaggcacgcaatgagctccagactgtatatgaggcctttgttcaacagcaccaagcagagaaaacagagcgtgagaatcgcctgaaggaattttatacaagagagtatgaaaaactcagagatacgtatatcgaagaagcagagaagtacaaaatgcaacttcaggaacagtttgataatctcaacgctgcccatgagacatccaaactggagatcgaggccagccactccgagaagctggagcttttgaaaaaggcctacgaagcgtcactttctgagataaaaaagggccatgagatcgagaaaaagagtttggaagacctgctgagtgagaagcaggagtctttggagaagcagatcaatgacctcaagtccgaaaatgacgctctgaacgagaagcttaagagtgaggagcagaagcggcgagctcgcgagaaagctaacctgaagaacccccagatcatgtatctagagcaggagctggagagtctgaaagccgttttggagataaaaaacgagaagctgcaccagcaagatattaagctcatgaagatggagaagcttgtcgataataatactgcacttgttgacaaacttaagcggttccagcaggaaaacgaagagctcaaggccagaatggataagcacatggcaatcagccgccagctgtctaccgaacaagctgtactccaggaatcattagagaaggaatctaaggtcaacaaacgactctctatggaaaacgaggagttgttgtggaaactgcacaacggggatctgtgtagccctaaacgctcaccaacctcctccgcgatccctctgcagagtcctagaaactccgggagcttcccaagcccttccattagtccacgatag

SEQ ID NO: 29444 - DNA, 1248 bp, Artificial Sequence
  Description of Artificial Sequence: Synthetic coding sequence
atgaagacccccccaaaagggccttcccggaaaaatctgttcactgccttgaacgccgtggaaaaatccaggcaaaaaaaccctagatcactatgtatccagcctcaaactgctcccgatgcgcttcctcccgagaaaactctagagctcacccaatataaaaccaagtgcgagaatcagtctggctttatcctgcagctcaaacagctgctcgcatgtggtaacactaaattcgaagccctcaccgtagttatacagcatctgctgtcagagagggaggaggcactcaaacagcataagacgttaagccaagaactggtcaaccttcgcggagaactagtgactgcctcaactacctgcgagaaactagagaaggcccgaaatgaactgcagacagtgtatgaggcctttgttcagcaacaccaggctgagaaaaccgaacgcgagaaccgcctgaaagagttctacaccagggagtacgagaaactgcgcgacacgtacatagaggaagcagagaaatataagatgcagctgcaggaacaatttgacaatttgaacgccgctcatgagacctccaagttggagatcgaggcctcgcatagtgagaagctggagctcttgaaaaaagcctatgaagcgtccctcagcgaaatcaaaaagggccacgagatcgaaaagaaatccctggaagatctcctgagcgagaaacaggagagtctggagaaacagattaacgacttgaagagtgagaatgatgcactgaatgaaaagctcaagtccgaagagcagaaacgtagggctagagaaaaagcgaatctgaagaacccccagataatgtacctcgaacaagaactggagtctctgaaggcggtactggagataaagaacgagaagcttcaccagcaagacataaagctcatgaaaatggagaagctggtggataataatactgctctggtggataagctcaagcgcttccaacaagagaatgaggagctgaaagcacgtatggacaagcacatggcaatttcccggcagctaagcactgagcaagctgtgctgcaggaatccctggagaaggaaagtaaggtaaataagcgtctatcgatggaaaacgaagagctgctctggaaactgcataatggggatctgtgtagtcctaagcgctcgcccacttcctccgcaattcccttacagagccccaggaattcgggatcattcccgtcgccaagtatttccccccgatag

SEQ ID NO: 29445 - DNA, 7406 bp, Artificial Sequence
  Description of Artificial Sequence: Synthetic coding sequence
atggctacagtcgtcgttgaggccacggagcccgaaccttctgggtctatagccaatcctgccgcttcgacctctccttcactttcacaccgcttcctggattctaaattctacttgctcgtggtggttggcgaaatcgttactgaagagcatctcagacgagccattggtaatattgagctagggattcgatcctgggacaccaatctaatcgagtgtaacctggatcaagagctgaaactgttcgtttccaggcatagtgctcgtttcagccctgaggtgcccggacaaaagattctccaccataggagcgacgttttagagaccgtagtcctaataaatccgtctgatgaagctgtttccaccgaagtccgcctcatgattacagacgctgcccgtcataagctgttggtattgacaggccagtgttttgagaacaccggtgagctcattcttcagtctggatcttttagtttccaaaattttatcgaaatcttcactgatcaggagatcggagaattgctctctaccacacacccggcaaacaaggcatcactaacactgttttgccctgaagagggagattggaaaaattccaatctagacagacacaatttgcaggattttatcaatatcaagctcaactcggccagtattctccctgaaatggagggattgtcagagttcactgaatacctgagcgaatccgtagaagtgccatctccgtttgacatcctcgaacctccaacatccggcggtttcctcaaacttagcaagccttgttgttacattttccccggaggtcgtggagattctgctctgttcgctgtcaacgggttcaatatgctgattaacggcggttcagagaggaagagctgtttttggaaactaatccggcacctggatcgagtcgactccatcctgctcacacacatcggagacgacaatctgcccggaataaattccatgctgcagagaaaaattgctgagttggaagaggaacagtctcagggttctactacaaattcagactggatgaagaatctcatctcccctgaccttggcgtggtattcctgaatgttcccgagaaccttaagaaccccgaacctaatatcaaaatgaaacggagtatagaagaagcttgcttcactctgcaatatttgaataagttaagcatgaagccagagcctttatttcggagcgttggaaatacaattgatccagtgatcctgttccagaagatgggagttgggaagctggaaatgtacgttctgaatccagtgaaaagcagcaaagagatgcaatatttcatgcaacagtggactggaacgaataaagacaaggcagagtttatcctgccaaatggtcaggaggtagatttacccatatcatacctcacgagtgtgtccagcctaattgtgtggcaccccgctaaccccgctgagaaaattatccgcgtcctttttcccggtaactctacacagtacaacatcttggagggccttgaaaaactgaagcacctggacttcttgaaacagcccttagccacccagaaagacctgacaggccaggtcccaacccccgtggtgaagcaaactaagctgaagcagagggccgattctagggagtcactgaaaccagccgcaaaaccactgccctccaagtcagtccgaaaggaatccaaggaagaaactcccgaggtgacaaaggtcaaccatgtggagaagccgccaaaggttgaatctaaggaaaaagtgatggtaaaaaaagataagcctattaaaacagaaaccaaaccctccgttaccgaaaaagaagtgccatctaaggaagagccatctcccgtgaaggctgaagtggcagagaaacaggctaccgacgtgaaacccaaagccgctaaagagaagaccgttaagaaggaaacaaaggtaaaaccggaggacaagaaggaggagaaggagaagccaaagaaagaagtcgccaagaaggaggacaaaacaccgattaagaaagaggagaaacctaagaaggaggaagtgaaaaaggaagttaaaaaggaaattaagaaagaggagaagaaagagccaaagaaagaagtcaagaaagaaaccccaccgaaggaggtcaagaaggaagtgaagaaggaggagaaaaaggaagtgaaaaaagaggaaaaggagccaaaaaaagagatcaagaaacttcctaaagacgcaaagaaaagctccactcccctgagcgaggcaaagaagccggcagccttgaaacccaaggttccgaaaaaggaggaatctgtaaagaaggacagtgtggcagccggtaagccgaaagagaagggaaagatcaaggtgattaaaaaggaagggaaagccgcagaagctgtagccgctgcagtgggcaccggggcaacaaccgctgctgtcatggcggctgcaggtatcgccgcaatcgggcctgccaaagaactagaagctgaacgctcactgatgagctcgcccgaagatcttaccaaggactttgaggaattgaaagcagaggaggtcgacgtgaccaaagatataaaaccacagctagagctcatcgaggacgaggagaaactcaaagaaacagagccagtcgaggcttatgtgatacagaaggaacgcgaagtcactaagggaccggcagaaagcccagatgagggcattactacgactgaaggcgagggtgagtgcgagcagacaccagaagaattagagcccgtggagaaacaaggtgtcgatgacatcgagaaatttgaggatgagggggcaggcttcgaggagtcatccgaaacaggcgattatgaggaaaaagcagaaacagaagaggctgaggagccagaggaagatggagaagagcacgtctgcgtgtcagcttcgaagcatagtcctactgaggatgaggaatccgcaaaggccgaggccgatgcctacattcgcgagaagcgggagtccgttgccagtggagacgaccgggctgaggaggacatggatgaggccattgagaaaggcgaggcagagcaaagcgaggaggaggcagacgaagaggacaaggcggaggatgccagggaggaagaatacgagccagagaagatggaagccgaggattacgtgatggccgttgtagacaaagcggcagaagcgggtggagctgaagaacagtatggcttccttactacgcccaccaagcagctgggggctcagagtcccggacgcgagccggcaagctcgatccatgacgagaccctccctggaggaagtgaaagcgaggctaccgccagtgacgaagagaatagggaagaccagcctgaggaattcactgctacatccgggtacacgcagagcactatcgaaatttcctcagagcctacccctatggatgaaatgtccaccccaagagatgtgatgtcggacgaaactaacaatgaagaaacggagtccccctctcaggaattcgtgaatattacgaagtacgagtccagcctgtattctcaggaatacagcaaacctgctgatgtgactccgttgaacggcttcagcgaggggagtaaaaccgacgccacagatggtaaggactacaatgcttcagcctcaaccattagccccccttctagtatggaagaagacaagttctccagaagcgcgctgagagatgcatactgctcggaggtcaaggcctcaaccacactagatataaaagacagtattagcgctgtttcatctgagaaggtcagcccttcaaaatcgccatccctgagcccctccccaccttcccctttggagaaaacaccactcggtgagaggtccgttaacttctcactcacacccaatgagattaaagtgtctgccgaagccgaggtggcccctgtgtcacctgaggtgactcaggaggtggtcgaggagcactgcgcctcgcctgaggataagacactggaggttgtgtcacccagccagtctgtcaccgggagcgcaggtcatacaccatattatcagtctccgaccgacgagaagtctagccacctgcctaccgaagtcatcgagaagcctcccgctgtgccggtgagtttcgagttctctgacgcaaaggatgagaacgagcgggcttccgtcagtccaatggacgagcctgtccctgactccgaatcccccatcgaaaaagttctgtccccattgagatctccacctctcattggcagcgagtccgcctatgagtcttttctgagcgccgacgataaggcctctgggcgtggcgctgaatcaccttttgaagagaagagcggcaaacaaggatctcctgaccaggtaagtcccgttagcgagatgacctctacaagcttataccaagataagcaggaagggaagagtaccgacttcgccccaatcaaggaggacttcggacaggagaagaaaacggatgatgtggaagccatgtcttctcagcctgcactggccctcgacgagagaaagcttggggatgtctcccccacacagattgatgtgagtcagtttggctcattcaaggaagataccaagatgtccatcagcgaaggcaccgtgtcagataagtccgccaccccagtggacgagggtgtagctgaggacacctattcacatatggaaggagtcgcttctgtaagcacggcctccgttgcaacctcctccttccccgagcctaccacggatgatgtgtccccgtctttacatgccgaggtgggctctccccacagcacagaagtcgacgactcactctccgtcagtgtggtgcagactccaactacctttcaggagaccgagatgtcgccaagcaaagaggaatgtcccaggccgatgtcgatttcacctcctgacttctctccaaagaccgccaaaagccggacgccagtgcaggatcaccgtagcgaacaaagcagcatgtctatcgagttcggccaggagtctccggaacagtcgctcgcaatggatttcagtcggcaatcacccgatcaccctacagttggcgcaggagttctacatatcactgaaaacgggccaacagaggtggactactctccttccgacatgcaggattcctcactgagtcacaagattccaccaatggaggaaccttcatatacacaggataacgatctgtccgagctcatctccgtatcccaagttgaggcaagtcccagcacctcatcagctcacacgcctagtcagatagcaagtcctctgcaggaggacactctgagcgacgtcgcccctccgagagacatgagcctgtacgcctcacttacctcggaaaaagttcagtcattggagggagagaagctgagtcccaagagtgacatttcccccctcacacccagagaaagctctccactctactccccaacctttagtgactccaccagcgccgttaaggagaagaccgccacatgccatagctcttccagtcctcccatcgatgccgcttccgctgaaccttatggtttccgagcctccgtactgtttgacaccatgcaacaccacctggccctaaacagggatctgtcaactccgggtttggagaaggattctggagggaagactcctggagacttctcctatgcttatcaaaagcccgaggagactactaggagtcctgatgaggaggactacgactatgagtcgtatgagaaaaccacacggacaagcgatgtcgggggatactactatgagaagatcgagagaactactaaaagcccttcagatagtgggtattcgtacgaaacaattgggaaaacgactaagacacccgaggacggggactactcctatgaaataattgagaaaactactcggactcccgaagaagggggatattcctatgacatctctgagaagacaacaagccctccagaggtttctggctactcatacgagaagaccgagcgtagtagacggctcctcgacgatatctccaacggctacgatgattcagaggacggcggtcataccctgggggaccctagctacagctatgagaccactgaaaagatcacctctttcccagaaagcgaggggtactcatacgaaacctccacaaaaaccacccggactccagacaccagtacctactgctatgagactgccgagaagataactcgtacgccccaagcaagcacctactcgtatgaaactagcgatctgtgctacacagccgaaaagaagtcgccatcagaggcgagacaggacgtggatctgtgcctggtatctagctgcgaatacaaacacccaaaaaccgaactttctcccagttttatcaatcccaatccattagagtggtttgcctccgaggaacccaccgaagagtctgagaagcctttgactcagtctggaggagctcctcctcctccgggaggaaagcaacagggacggcagtgtgatgagacacccccaacgtctgtctcagagagcgctcctagccagacagatagcgatgtgcctcctgagaccgaggagtgcccctctattacagccgatgcgaatattgattcagaggatgaaagcgaaactataccaaccgacaagacagtcacttacaagcatatggacccccctccggcacccgttcaggatcgatcgccctctcctcggcatccggatgtttcaatggtggatccggaggccctggctatcgagcagaatctggggaaagcgctcaaaaaggatttgaaagagaagaccaaaacaaagaagccaggcaccaagacgaagtctagctccccagtgaaaaagtcagacgggaaatctaagccattggcggcttctccgaagcctgccggattgaaggagtctagcgataaggtctctcgcgtagccagcccaaagaagaaggaaagcgtggagaaggccgctaagcctacaaccactcctgaagttaaggccgctcgcggtgaggaaaaggataaagagaccaaaaatgcagcgaatgcatctgcatctaagagcgccaagactgcgacagcgggaccaggtactaccaagaccacaaagagctcagccgtccccccaggacttccagtgtaccttgatttgtgctacatccctaaccactcaaattccaagaacgtcgatgttgagttttttaagcgcgtgaggtcctcatactacgttgtctctggaaacgaccccgcagcggaggagcctagtcgggctgttctggacgccctgctggagggaaaggctcagtggggttccaacatgcaggtgacactgatacccacccatgatagtgaggttatgcgtgaatggtatcaggaaacccatgagaaacaacaggatcttaacatcatggtgttagcctcaagttccaccgtcgtcatgcaggatgagtctttccctgcgtgtaaaatagagctgta

SEQ ID NO: 29446 - DNA, 432 bp, Artificial Sequence
  Description of Artificial Sequence: Synthetic coding sequence
atgcaacacagagggttcttactgttgaccctgctggctctattggctcttacgagtgcagtcgcgaagaaaaaggataaagttaagaaggggggtccaggctccgaatgtgccgagtgggcctggggcccttgcacaccttcctcgaaagattgtggcgtgggttttcgagagggaacatgtggcgctcagacacagaggatccgctgtcgggtgccgtgcaactggaagaaggagttcggtgcagattgtaagtacaagtttgagaactggggcgcttgcgacggcggaacaggaaccaaggtgcgccagggaacgctgaaaaaggctagatataacgcccagtgtcaggaaacaatacgggtcacaaaaccctgtaccccgaagacaaaagccaaagctaaagccaagaaaggtaaggggaaggattag

SEQ ID NO: 29447 - DNA, 432 bp, Artificial Sequence
  Description of Artificial Sequence: Synthetic coding sequence
atgcaacaccggggatttctgctcctaaccctgctggctctgctggccctcacctcggccgtagccaagaaaaaggacaaggtgaaaaagggtggccctggctctgagtgcgcagaatgggcctgggggccttgcacgccctcgagcaaagattgcggggtcggatttcgagagggcacctgcggcgctcagacccagaggatccgatgccgcgtgccatgtaactggaaaaaagagttcggagccgattgcaaatacaaatttgagaactggggtgcgtgtgatgggggaaccggtactaaggttcgccagggcacactgaaaaaagctaggtacaacgcacagtgccaggaaacaatccgagttactaagccctgtactcccaaaacaaaggccaaggccaaggctaagaagggaaagggcaaagactag

SEQ ID NO: 29448 - DNA, 432 bp, Artificial Sequence
  Description of Artificial Sequence: Synthetic coding sequence
atgcagcatcggggttttcttctgctgaccttactggctctgctcgcactgacctctgccgttgcaaaaaagaaagataaggttaagaagggcggaccagggtctgagtgcgccgagtgggcttggggaccatgtacgcccagcagcaaagattgcggggtcggattccgtgagggaacctgcggagcccaaacgcagaggataaggtgtcgtgtcccttgcaactggaaaaaagaattcggagccgattgcaagtataaattcgagaactggggtgcctgcgacggagggaccggaacaaaagtccggcaaggcactttaaaaaaggcacgatataatgcccaatgccaagaaacaatccgcgttaccaagccgtgtaccccgaagaccaaagctaaggctaaggccaaaaaaggcaaaggaaaggattag

SEQ ID NO: 29449 - DNA, 459 bp, Artificial Sequence
  Description of Artificial Sequence: Synthetic coding sequence
atgcagcataggggattcctcctgctcacccttttagctctcctggcactcacttcagccgtggctaaaaagaaagaggagggagcactccagtgctcggttccaggtgatcatccccgacatcaggctttgcatccacaggaccagtctaagggacagagtcaagaacgggagggaaagggacttgatgcaaagccaggttgtcagggagcgcctggcgtaacttggggactggcacacgccctgccgctgccaggccctcgctgtgatccgccagtaccctcagtgtgttccctcgccttgatcaaccatgcactgccttgccccagccattctccagcacctccactctcagcacagtccggagaaggccagggcattctcggctccctcagtcttccccagagcaatgtcagcccccgagcgcgtttctgcagcagcccccaatttcactactag

SEQ ID NO: 29450 - DNA, 432 bp, Artificial Sequence
  Description of Artificial Sequence: Synthetic coding sequence
atgcagcatagaggcttcttgttgcttaccttattagccctgctcgcccttactagtgcggtggccaaaaaaaaggataaggtcaagaagggcggtccagggagcgagtgtgccgagtgggcctgggggccatgcacaccaagtagtaaggactgcggcgtgggattcagagaagggacctgcggcgctcagacgcagcgaatccggtgtcgggtgccgtgtaattggaagaaggagttcggggctgattgtaagtacaaattcgagaactggggagcctgtgatgggggtactggaactaaggtcaggcaggggaccctaaaaaaggcacggtacaatgcccagtgccaggagaccatcagggtgaccaagccatgcaccccaaaaaccaaggctaaggccaaggctaagaagggtaaagggaaagactag

SEQ ID NO: 29451 - DNA, 432 bp, Artificial Sequence
  Description of Artificial Sequence: Synthetic coding sequence
atgcagcacagggggtttcttctgctgacattgttggccctgctggccctaacctccgccgtggcaaagaaaaaggacaaggtcaaaaagggtggcccagggagtgagtgcgctgaatgggcatggggaccctgtacgcccagctcaaaggactgcggagtgggattccgggagggcacatgtggtgctcagactcagcgaatcaggtgtcgcgttccctgtaattggaagaaggagtttggcgctgattgtaagtataagtttgagaactggggcgcatgcgacggcggaaccgggaccaaggtgcggcaaggaacattgaagaaggcacgctataacgcccagtgccaggagaccattagggtgactaaaccctgcacccctaaaacgaaggctaaggcaaaagcaaagaagggtaagggaaaggattag

SEQ ID NO: 29452 - DNA, 432 bp, Artificial Sequence
  Description of Artificial Sequence: Synthetic coding sequence
atgcagcaccggggattcctgctgctaacactgctggctctcttggcgctgactagcgctgttgctaagaagaaggacaaggtgaagaaaggtggccctggaagtgagtgtgccgagtgggcatggggcccatgcacacctagctccaaggattgtggggtcgggttcagggagggcacatgtggtgctcaaacccagagaattcggtgccgcgttccatgcaactggaagaaagagttcggcgcagactgtaagtacaagtttgagaactggggagcctgtgatggtggcacaggcaccaaggttagacagggcacgctgaaaaaagctagatataatgcccagtgccaggagaccatccgggtcactaagccatgcaccccaaagactaaagctaaagccaaggcaaaaaaggggaaaggcaaggattag

SEQ ID NO: 29453 - DNA, 150 bp, Artificial Sequence
  Description of Artificial Sequence: Synthetic coding sequence
atgcagcatcgcggtttcctgctgctcacacttctggcgctattggccctgacttctgctgtagctaaaaagaaggataaggttaagaaggggggacctggtagtgaatgcgccgagtgggcatgggggccatgtaccccctcctcgtag

SEQ ID NO: 29454 - DNA, 396 bp, Artificial Sequence
  Description of Artificial Sequence: Synthetic coding sequence
atgcagcatcgcggtttcctgctgttgactctgttggccctgctcgccctgacatctgctgtcgctaaaaagaaagacaaagtgaaaaagggaggtcccggatcagagtgtgcagaatgggcttggggcccatgcactcctagctccaaggactgcggagtgggcttccgtgaggggacatgcggcgcacagacccagaggatccgctgtcgggtcccgtgtaattggaagaaggaattcggagctgactgtaaatacaagttcgaaaactggggagcatgcgatggcggaaccggaactaaggtgaggcaaggcacattgaagaaggcacgctataacgcacagtgccaggagacaatccgggtgacaaagccttgcacgcctaagaccaagtag

SEQ ID NO: 29455 - DNA, 264 bp, Artificial Sequence
  Description of Artificial Sequence: Synthetic coding sequence
atgcaacatcgcggattcctcttgctcactctgctcgctttacttgccctgacctcagccgtggctaaaaaaaaggccgactgtaaatacaagttcgaaaactggggtgcctgcgatggcggtacaggaacaaaagttcgtcagggcaccctgaagaaagctaggtataatgcgcagtgtcaagaaacgataagagttacgaaaccatgtacacccaaaacgaaagcaaaggccaaggcaaagaagggcaaaggaaaggactag

SEQ ID NO: 29456 - DNA, 2715 bp, Artificial Sequence
  Description of Artificial Sequence: Synthetic coding sequence
atggccgagtcatctgagtcctttaccatggcatcttcccccgctcagaggcgcagaggcaatgaccccctgaccagctctccagggagatctagcagacggaccgatgctctcacaagctcaccaggccgagacctgccacctttcgaagacgagagtgagggtttgctaggcacggagggacccctggaagaggaagaagacggggaggaacttattggagatggtatggagcgcgattaccgagctattccggagctggacgcatacgaggctgagggactggcactggacgacgaggacgtggaggagctgacagcctctcagcgggaggcagccgaaagagctatgagacagcgggatcgagaagccggaaggggcttgggacgtatgcggagaggtctgctttatgacagcgatgaagaggatgaggaacggccagctcgaaagcgcaggcaggtagaacgggcaacagaggatggcgaggaagacgaggaaatgattgaatctatagagaatctggaggatctgaaggggcattccgtgagggagtgggtgtcaatggctggccctcgcctagaaattcaccatcgtttcaagaactttctgcggacacacgtggactcacatggccataacgtgtttaaggagcgtatatccgatatgtgcaaagaaaacagggagagcctcgtggtcaattacgaggatttggcggcacgggaacatgtcctggcatactttctccctgaagcgcctgcagagttactccagattttcgatgaggctgccttggaagtggtccttgctatgtacccgaaatatgatagaatcacaaatcatatacatgtgagaatttctcacctgcctctcgtagaggagctgagatctctgcgccagcttcacctgaaccagctcatcaggacgtcaggagttgtaacatcctgcacaggagtgcttccccaactgtcaatggtcaaatacaactgcaataagtgcaacttcgttctaggtccattttgtcagagtcagaatcaggaggtcaaaccgggatcttgtccagagtgccagtccgcaggccctttcgaggtgaatatggaggaaaccatataccagaactaccagcgcatcaggatccaagagtcccctgggaaggtggctgccggaagacttccccgatccaaggacgccatcttactcgccgaccttgtggattcttgtaaaccaggcgacgagatcgaactgaccgggatctatcataacaattatgatggtagcctgaatacggcgaacggttttcccgtctttgcaaccgtcatactcgccaatcatgtcgcaaagaaggataataaggtcgcggtcggcgagttgaccgacgaggacgtcaaaatgataacgtctctgtctaaagatcaacagatcggcgagaaaattttcgcttcaatagcacccagcatctacgggcacgaagatattaaacgaggcctggcgctggccctgtttggtggagagccaaagaacccaggaggtaagcacaaggttaggggagacattaacgttctcctctgcggtgacccaggaacagctaagtcacagttcctaaagtatatcgaaaaagtgtcctcccgtgctatattcaccaccgggcaaggcgcttccgccgtgggcttaaccgcctatgtgcaaagacatcctgtgagccgcgaatggacattagaggcaggcgctctggtcctcgctgatcggggtgtgtgcctgatcgacgagtttgacaaaatgaatgaccaggaccgcacaagtatccacgaagcgatggagcagcaaagcatctcaatctcaaaggctggcatcgtcacaagcctgcaagccagatgcacagtcatcgcagccgctaaccccattgggggacgttatgatccgtccttgactttctcagaaaacgtggacttgacagaacctatcataagccggtttgacatactgtgtgtggtcagagacaccgtggacccagtacaggacgaaatgctggcaagattcgtggtgggatctcatgtgcgccatcatccctcaaataaagaggaagagggcctggcaaacggctccgccgctgaacccgcaatgccgaatacatacggcgtggaacctcttccccaggaggttctgaagaagtacattatatacgccaaagagagagtacatccgaagctcaaccaaatggaccaggacaaggtggccaagatgtacagcgatctccggaaagagtcaatggcaacaggctcaattccgatcactgtcaggcacattgaatcgatgatcagaatggctgaggcacacgccagaatacacttacgggactacgtaatagaagatgacgttaatatggcaatacgagtgatgctcgagtctttcatcgacacacagaagttttccgtcatgcgctccatgcgcaagacgtttgctcgatacctgagcttcagacgcgacaataacgaattacttctgtttatactgaagcagctggtagcagaacaggtgacgtaccagagaaatcgctttggcgctcaacaggacacgatcgaggtgcccgaaaaggatctggttgacaaggcacgacagatcaacatccataatctgtctgcattttacgattccgagctttttcggatgaacaaatttagtcatgacctgaagaggaagatgatcttgcagcagttttag

SEQ ID NO: 29457 - DNA, 2427 bp, Artificial Sequence
  Description of Artificial Sequence: Synthetic coding sequence
atggcagagagctctgagagcttcacaatggcttcatcccccgctcagcgcaggcgcggaaacgacccgctcactagttcacctgggtggggtttagggcgaatgaggagaggcttactctacgattccgatgaggaggatgaggaacggcctgcacgtaagaggcgtcaggtggagagagccactgaggatggagaagaggatgaggagatgatcgagtccatcgaaaacctggaggacttgaagggccactcggtccgcgagtgggtttccatggctggcccacgcctggaaatacatcaccgtttcaagaattttctccgaactcacgtcgacagccacggccacaatgtcttcaaagagcgaatcagcgacatgtgtaaagagaatcgtgaatcactcgtggtgaattatgaggacttggcagcacgggagcatgtgctcgcctactttctgccagaagcacctgcggaactgctccaaatctttgacgaggccgctcttgaggtcgtgttggccatgtaccccaaatacgatcgtatcaccaaccatatccatgtgcgcattagccatctgccccttgtcgaggagttgaggtccctgcgccagctgcatttgaaccagcttatcaggaccagtggcgtggtcacaagctgcactggagtattacctcagctgtctatggtgaaatataactgtaacaagtgcaactttgttctgggaccattttgccaaagtcaaaaccaagaagtgaagccgggttcttgcccagaatgccaatctgccggtccattcgaggtcaatatggaggagaccatctatcaaaattaccagcggattcgtatccaagagagtcccggtaaggtggccgctgggaggctcccgagatccaaggacgccatactgctcgcagaccttgttgactcgtgcaaaccaggggacgagattgagttaaccggaatttaccataacaactacgacgggtctctcaataccgccaatggcttccctgtattcgctacagttatccttgcgaaccatgtggccaagaaagacaataaagtggctgtcggggaattaaccgatgaggatgttaaaatgatcacctccttaagcaaggaccaacagatcggagagaagatatttgcatctattgcaccctcgatctacggccacgaggatattaaaaggggactggccttggcactgttcgggggagaacccaagaatccaggcggaaagcacaaggtgcgcggtgacatcaacgtgcttttgtgcggagaccccggtacggccaaatcacagtttttaaagtatattgagaaggttagcagtcgcgcaatcttcactacaggccagggcgcatctgctgtaggattgacggcctatgtccagcggcatccagtgtctagagaatggacattggaagccggagctctcgtcctggctgaccgaggcgtatgccttatcgacgagtttgataagatgaacgatcaggaccgaacttctatacacgaggccatggagcagcagtctattagcatttcaaaagcaggcattgttacctccctgcaagccagatgtactgtgattgcagccgctaatcccatcggaggcaggtacgatccctctctgactttcagcgaaaatgtggatttaacggaacctattatttcccggtttgacattttatgcgtcgtgagagataccgtcgatccagtgcaggatgaaatgctggctcggtttgtggtggggtctcatgtccgacaccatccctccaataaggaggaagaaggattggcgaatggatctgcagctgaacccgcaatgccaaatacctatggagtcgagccactgccacaagaagtcttaaaaaagtacataatctacgccaaggaaagggttcatcctaagctgaaccagatggaccaggataaggtcgccaagatgtactcggacctgcgcaaagagtccatggccactggtagcatcccaatcactgtccggcacatcgagagcatgattaggatggccgaagcacacgcacgaatccacctgcgggactatgtcatcgaggacgacgtcaatatggctatacgtgttatgctggaatcatttattgacacccagaagttcagtgtcatgcgctccatgcgaaagaccttcgccagatacctgtcctttcgcagagataacaacgagctgttgctgttcatcttaaaacaattggtggccgaacaggttacctaccagagaaaccgcttcggggctcagcaggacactatcgaggtcccagaaaaggatttggttgataaggcacgacaaatcaatattcataatctttctgcattttacgatagtgaattgttccgcatgaataagttcagtcacgacctgaaacgcaaaatgatccttcaacagttctag

SEQ ID NO: 29458 - DNA, 2865 bp, Artificial Sequence
  Description of Artificial Sequence: Synthetic coding sequence
atggccgagtcttccgagtcctttacaatggcctcaagcccagcgcaaagacggagggggaacgaccctctaaccagctcacccggaagatccagtagacggaccgatgcactaacttcctcccccggaagggacctgccaccatttgaagatgagagtgagggcctgctcggaactgaaggaccactggaagaggaggaggatggagaggaactgatcggggacgggatggaaagagactatcgcgcaatcccagagctcgatgcctacgaggcggagggcctggccctggatgatgaggacgttgaagaactgacagcaagtcagcgtgaagctgggaggggcctattatatgattctgacgaagaggacgaggagcgcccagccagaaaacggaggcaagtagagagagccaccgaggatggcgaagaggacgaggagatgattgagagcatagagaacctcgaagacctgaaggggcacagtgtgcgggagtgggtgtccatggcgggacctaggctggaaatccatcacaggtttaagaactttcttaggacccatgtggacagccacgggcataatgtgtttaaggaacggatatccgatatgtgtaaggaaaaccgggagagccttgtggtgaactatgaggacttggcagctcgcgaacacgtcttggcgtattttctgccagaggcacctgccgagctcctgcagatttttgacgaggccgcactcgaagtggtcctcgccatgtatccaaaatacgaccgcatcacgaaccacatccatgtacgaatctctcatctgcccttggtagaggagctgcggtccctgagacagctccacctgaatcagctgattcgcacaagtggagtggtgacttcttgcaccggggtcctccctcaattgtctatggtcaagtacaactgtaacaagtgtaactttgtgctaggcccattttgccagagtcagaatcaggaggtgaagccaggctcatgcccagaatgtcagtcagccggtccattcgaagtcaacatggaggagactatataccagaattatcagcggattcggatacaggagagcccgggaaaggtggcagcaggtcggttgccccgatcaaaggacgccattctgctggctgacctggtggatagttgcaagcctggggacgagattgaactcaccgggatataccataataattatgatggcagtctcaacaccgccaatggctttcccgtgttcgctactgttattttggccaatcacgtggcaaaaaaagacaataaagtggcggtaggagaactgaccgacgaagatgtcaaaatgattacctctcttagcaaagatcaacagataggggagaaggagtcatccagaaatgctagtttagccgaagccggtattggcgcaatcccaagccagctgcttgcgattgagccgagcctaaggaggtctggcgttcctattggtgaggtcggcgtgagtcagagacaggaagcacggtctttcagctccgctaatactcattggttccttgaggaccttctggggccaagctgccgcgatacaatgatctttgcctcaattgccccttcgatttacgggcacgaagatattaagagaggcctggcgcttgctctctttggaggcgagcctaaaaaccccggagggaaacacaaggttcggggtgacatcaacgtattattgtgtggtgaccccggaactgccaagtcccaatttctgaaatacatagaaaaggtgtcatcgcgggctatttttaccacgggacaaggcgcttctgcggtcgggttaacggcctacgtgcagagacaccccgtgagtcgggaatggacactggaagccggtgccctcgtacttgccgatagaggcgtatgcctcatcgacgagttcgataagatgaacgatcaggaccgcacttccattcacgaggctatggaacagcagtccatttctatctccaaggccggtatcgtcacatcattgcaggccagatgcacagtcatcgctgctgccaatcctataggtggtcggtacgatccctcactgaccttcagtgaaaacgtcgatctcaccgagccaattataagtagatttgatatcttatgtgtagtccgcgatacagtggaccctgtccaggatgaaatgctagccaggtttgtggtcggcagccatgtccggcaccacccttctaacaaagaagaagaagggctagctaatggctccgctgctgaaccggctatgccaaacacgtacggggtagagccgttaccacaggaagttcttaaaaaatatatcatttacgccaaggaaagggtgcacccaaaacttaatcaaatggaccaggacaaagtggccaagatgtactcggacctgaggaaagagtccatggccacaggctcaatccctattactgtacgccacatcgagagtatgatccgcatggccgaggcgcacgccaggatccatctgcgcgattacgtgatagaggatgacgtgaatatggcgattagggtcatgctggaatcgttcatcgacacccagaagttcagcgtgatgcggagcatgcgcaaaacgtttgctcgatatctgagcttccgaagagataataacgagctgctattgtttattctcaagcagctagttgcagagcaggtcacttaccagaggaacagattcggcgctcaacaggacacgatagaggtccctgagaaagacctggtggacaaggccagacagatcaatatccacaatctttctgccttttacgactcggaactctttagaatgaacaagtttagtcacgatctcaaacgaaagatgatcctgcagcagttctag

SEQ ID NO: 29459 - DNA, 753 bp, Artificial Sequence
  Description of Artificial Sequence: Synthetic coding sequence
atggcactgcgcgcaggcctggttctggggttccacacacttatgacactcctctcacctcaagaggccggtgctactaaggctgatcatatgggctcgtacggcccagctttctaccaaagttacggcgcatcagggcagttcactcacgaattcgatgaggagcagctcttcagcgtagatctgaaaaaaagcgaggccgtgtggcgtctgcctgagttcggggacttcgcacgttttgatccacagggcggtcttgcgggaattgcagcaataaaagcacacctcgacatactggtagaaaggtctaacaggagccgcgcaatcaatgttcccccaagagtgactgtgctcccaaaatcacgcgttgagctcggacagcccaacattttgatctgcattgtcgataacattttcccacctgtgattaacattacatggctgcgcaatgggcaaacagtcactgaaggcgtcgcacagacatccttctacagtcagccagatcacctcttccgcaagttccattatctgccattcgttccctctgcagaggatgtatacgactgccaggtggaacactgggggctggatgcacctctactgagacattgggaactgcaggtgcccataccacctccggacgctatggagaccctggtgtgcgccctgggactggctattggtctagtcggttttttggttggaacagtcctgatcataatgggaacttatgtgtcatctgtgcccaggtag

SEQ ID NO: 29460 - DNA, 993 bp, Artificial Sequence
  Description of Artificial Sequence: Synthetic coding sequence
atgcatcggtaccgagcacctggagagcaggacggagatgccatgcctctcgggagcgccgtcgacattctggccacagacgatccaaatttctcccaagaggatcagcaggatacgcaaatttacgaaaagcatgacaacctgctccacggcaccaagaagaaaaaagaaaagatggtcagtgccgcttttatgaagaagtacatacatgtcgccaagatcatcaagccggtattaacccaggagtcagcgacttatatagcagaagaatactcccgcttacggtcacaagatagcatgagctcagatactgctcgcacatccccagtgactgcgaggactctcgaaaccctcattagactggccacggctcacgccaaagcgaggatgtccaaaactgtggacttacaggatgctgaggaggctgtagagctggtgcagtatgcatatttcaaaaaagtcctggaaaaggaaaaaaaacgtaaaaaaagatcagaggacgagagcgaaacggaagacgaagaagaaaagtcccaggaagaccaggagcagaagcgcaagcggcgaaagacccgccagcctgacgcaaaggatggcgactcttacgatccgtacgatttttcagatactgaggaggaaatgccgcaggtgcacactccgaaaaccgccgactctcaggagacaaaagagagccaaaaggttgaattgtcagagtctagagacgggataagcccatgttgcccaggctggagctggacacccggtctgaaacagtctttttatctgtcactgccgaaggggtgggattatcgccataagcccctttgtttatttgatttgatcctgttcaacgactgcagggtctccatggttgaaggcattcagggcggacctctgggctgtgtccctggatcctcctgcgcggtaaatcgtcacgagagtccccatcggatccatcaaccaggccaaagaagagcattactgttttcatag

SEQ ID NO: 29461 - DNA, 2289 bp, Artificial Sequence
  Description of Artificial Sequence: Synthetic coding sequence
atgtggtcgtgcggacggctcagggagatcacttggacctcatggactacacgcttgctcaacaatgcgtttgaggaactcgtcgcttttcagcgggctttgaaggatttcgtagcctcaattgatgctacatatgctaagcagtatgaagaattctacgtcggcctcgaagggtccttcggctccaagcacgtgtcaccgcgaactctcacttcttgtttcctgtcatgcgttgtgtgcgttgagggtattgttacgaagtgctcattggtgcgcccaaaggtggtaagatcagtccactactgcccagctactaagaagaccattgagcgtaggtactcagacctgaccacgcttgtagccttcccatcctcatccgtgtatcctactaaggacgaagagaacaaccccttggaaacagagtacgggctcagcgtttacaaggatcaccagacaattacaatccaggaaatgcccgaaaaggctccagctggacaactgcccaggagcgtggatgtaatcctggacgatgaccttgtggacaaggctaaaccaggcgaccgtgttcaggttgtgggaacttataggtgtctgccagggaagaagggaggctacacaagtggaacgttccgcaccgtcctgatcgcctgtaacgttaaacaaatgagtaaggatgcacagcccagcttctcggcagaggacattgcaaaaataaaaaagtttagcaaaacaaggtcaaaggacatctttgaccagctggcaaaatcgctcgccccatcaatacatgggcacgattatgtgaaaaaagccatcttgtgtctgttgttgggaggagtagagcgggacctggagaatggaagccatattcgaggggacatcaatatcttgctgattggggatccttccgtggccaaatcacaactcctccgatatgtgctgtgtaccgcacctcgggctatacccaccacgggaagagggtccagtggcgtaggactgactgcagctgtgaccaccgatcaggagacgggcgagcgacgcctcgaagcaggtgcgatggtgctcgcggatagaggagtagtctgcattgatgaatttgacaaaatgagcgatatggaccgcacagcaatccatgaggtgatggagcaggggcgagtgaccatcgccaaggccggtatccacgcacgcctgaacgctcgctgctcagttctggccgcagccaatcccgtctatggacgatatgaccagtataagacccccatggaaaacatcggtctgcaggacagcttgctatcgcgatttgacctcctgtttattatgctcgatcagatggacccagagcaggaccgggaaatttctgatcacgtgctgcggatgcaccgctaccgggcacctggcgaacaggacggtgacgccatgcctcttgggagtgctgtggacatcctcgcaactgacgaccccaacttctctcaggaggatcaacaggatactcagatttacgagaagcacgacaaccttcttcacgggaccaagaagaaaaaggagaagatggtgtcagcagcttttatgaagaagtatatccacgtggctaaaattattaaacccgtgctgactcaggaaagcgccacgtatattgctgaagaatattcgagactacgttctcaggactctatgagctccgacacagctcgcactagtcccgtaaccgcacgaacactggagacactgattcgccttgctaccgcgcatgcaaaggccaggatgagcaaaactgtcgatctccaggatgcagaagaggcagtggaactcgtgcagtacgcttactttaagaaggtgctggagaaggagaagaagaggaagaagagaagcgaggatgaatcagagaccgaagatgaggaggagaagagtcaagaggatcaggaacagaagcgcaagaggaggaaaactcgacagcctgacgctaaggacggcgactcatacgatccgtacgatttcagcgataccgaggaggagatgccccaggtgcacacacccaaaaccgctgactcgcaggagaccaaagagagccagaaggtggaattgtcagaaagtaggctgaaggcgttcaaagtggccctactggatgtgtttcgcgaagcccatgcgcaatccattgggatgaacagactcacagaatctataaaccgcgacagcgaagagccattctccagtgtggagattcaggccgcactctctaaaatgcaagacgataaccaggtgatggtgtctgaaggcatcatcttcctgatttag

SEQ ID NO: 29462 - DNA, 987 bp, Artificial Sequence
  Description of Artificial Sequence: Synthetic coding sequence
agatatcgggctcctggggaacaggacggcgatgcaatgcctctgggttctgctgtggatatactggcaacagatgatccaaacttttctcaggaagaccagcaggatactcagatttacgaaaaacatgacaatttgctgcacgggacaaaaaagaaaaaggagaaaatggtttctgccgctttcatgaagaaatacattcacgtcgccaagattatcaagcccgtacttacccaggaaagcgctacatacatcgcagaggaatacagccgcctgcggtctcaagactccatgtcctccgacactgctagaacatctccagtgactgctcgcacgctggaaaccctgattcgactcgctacagcccatgccaaagccaggatgtccaagactgtcgacctgcaggatgccgaagaagccgtcgaactggtgcagtatgcgtattttaagaaagtgctggagaaggagaaaaaaaggaagaagagatcagaggacgaatcggagacagaagatgaagaggagaaatctcaagaagaccaagaacagaagcggaagcgacgcaagaccaggcagccagacgctaaagacggcgactcttatgacccctacgacttctccgacacggaagaagagatgcctcaggtgcacacacccaaaactgcagacagccaggagactaaagagtcgcaaaaggttgaactgtcggaatccagagatggaatctccccttgttgccccggttggagttggacacctgggttgaaacagtctttctatctgagcctgcctaaaggatgggattataggcacaaacccctgtgcctgttcgatctgattcttttcaacgattgtagggtgagcatggtggaaggtattcagggaggccctttaggttgcgtgcccggtagtagttgcgccgttaatcgacacgagagccctcaccgcatccatcagccagggcagcggagggctctattatttagttag

SEQ ID NO: 29463 - DNA, 2562 bp, Artificial Sequence
  Description of Artificial Sequence: Synthetic coding sequence
atgctgcccagatcacctcctttgcctcgcggaaatctctggtggcgcgaagaatttgggtcattcagagcaggcgttgagtcaagctgggagcctcctagagacttcggtgggggatcttcactcgcagctggcatggcagggacagtggtacttgatgacgttgagctccgggaagcccaaagagactacctggacttcctggatgacgaggaggaccaagggatttatcagtccaaagtgcgggagctaataagcgacaatcagtaccgcctcatcgtgaacgtcaatgacctgcgacgtaaaaacgagaagcgggctaaccggctgctgaacaacgccttcgaagagctagtcgcctttcagcgggcactgaaggacttcgtggcctccatcgacgccacatacgccaagcagtacgaagagttttatgtcggactggaaggttctttcggatccaaacacgttagtccgcgtactctcacgtcatgtttcttgagctgcgtagtgtgcgtcgaaggcattgtcaccaagtgctccctcgtgaggcccaaagtcgtgcgctccgtacattattgtcccgctaccaagaaaaccatcgaacgtcgctatagcgatttgacaacactggttgcattcccctcgagctccgtttatcccaccaaggacgaggagaataatcctctcgagacggaatacgggttgagcgtttacaaagaccatcagacaataactattcaggagatgcctgaaaaagccccagccggacagttgccacgatccgtcgacgtaatattggatgacgacctggtcgataaggccaaacccggtgatcgcgtgcaggtggtaggtacataccgatgcctccccggtaagaagggaggatacacatctggtacattccgcactgtccttatcgcctgtaacgtgaagcagatgtctaaagatgcccagcccagcttctcagccgaggatatcgccaagatcaaaaagttcagtaaaacgaggagcaaagacattttcgaccaacttgcaaaatcactggcccctagcatccacgggcatgactacgtcaaaaaagctatcttgtgtttactgctgggcggagtcgaaagagacctggaaaacgggtcccacattcgcggagatatcaacattctgttgatcggcgacccttctgtggccaagagccaattgctgaggtatgtgctttgtacagctcctcgggcaatacccaccacagggaggggaagctctggcgtgggtcttacggccgctgtaacaaccgaccaggagactggtgaaaggcgcttggaggccggtgcaatggtgcttgcagaccggggtgttgtgtgtattgatgaatttgacaaaatgagtgacatggacaggaccgcgatacatgaagtaatggaacaaggcagagtgaccattgccaaagctggtatccatgcaaggcttaatgcgcgatgttcagttctcgcggctgccaacccagtgtatggacggtacgatcagtataagaccccgatggaaaacattgggctccaagactccctcctgtcacgattcgatctgctttttattatgctcgaccagatggatcccgaacaggacagagaaatctctgatcacgtacttcgaatgcatcggtaccgcgcacccggtgagcaggatggtgatgctatgccgcttggatccgccgtggatattctcgccacagatgatccgaatttctctcaggaggatcagcaggatactcagatctatgagaagcacgacaatttactccatgggacaaagaagaaaaaggagaagatggtgtctgctgcatttatgaagaaatatattcatgttgcaaaaattatcaagcctgtacttacacaggagagtgccacctacattgctgaggagtatagtaggttgcggtctcaagactcgatgtcctcggataccgcgagaacttcgccagtcaccgccaggacattagagacgcttatacgactggctactgctcacgcgaaggctagaatgagcaaaaccgtggacctccaggatgcagaggaggcagtcgaactggtgcaatatgcctactttaaaaaggtgcttgagaaagaaaaaaaaagaaaaaagagatccgaggacgagtcggagaccgaagacgaggaagagaagagccaggaggatcaggagcagaagaggaagaggagaaagacccggcaaccagacgctaaagatggagactcctacgacccttacgacttttccgacactgaagaggagatgccacaagtgcacaccccgaaaacagccgacagccaggagacgaaagaaagccagaaagttgagctctctgaaagcagactgaaggccttcaaagtggctctgttggatgtcttcagagaggcgcatgcgcaaagtatcggcatgaatcggctcacagaaagcattaacagagatagcgaagaacccttcagttctgtggaaatccaggcagctctgtccaagatgcaagatgataaccaggtaatggtgtccgaaggaattatttttctgatctag

SEQ ID NO: 29464 - DNA, 2592 bp, Artificial Sequence
  Description of Artificial Sequence: Synthetic coding sequence
atgagtagccctgccagcacccccagcaggcgcggatcacgcagggggcgagccacacccgcacagaccccacgctccgaggacgcccgatcttccccatctcaacggagacggggagaggactctacttctaccggagagctgcagcctatgcccactagccctggcgtggatctgcagagccccgctgctcaagatgtcttgttctcttcccctccacagatgcattcctctgcaattcccttggattttgatgttagcagtccgctcacctacggcaccccctcctcaagggttgaaggtacccccaggagtggcgtcagagggacgccagtgcgccagaggccagacctaggtagtgcacagaagggcctgcaggtggatctccagagcgatggtgccgcagccgaagacatcgttgcaagcgagcagagcctggggcaaaaactcgtgatatggggaaccgatgtaaatgtggctgcgtgcaaggagaattttcagcgatttctgcaacgcttcattgatccactggccaaggaggaggagaacgttgggattgacattaccgagcctctgtatatgcagcggcttggggagataaacgtaatcggtgagcccttcttgaacgtcaattgcgaacacatcaagtcctttgacaagaacctctataggcagctaatatcatacccccaagaggtgataccaacctttgatatggctgtgaatgagatctttttcgacaggtatcccgacagcattctagaacaccagatacaggtgagaccatttaacgctttgaaaaccaagaacatgaggaaccttaacccagaagacatcgatcagctgatcactatttctggaatggtgatcagaaccagtcagctcatcccggagatgcaggaggccttttttcaatgtcaggtctgcgcacacaccaccagggtggaaatggatcggggtagaattgcagaacccagcgtgtgtggcagatgccacaccacacactccatggcactgatacataatcgatctctgttctccgacaagcagatgattaaactgcaagagtcccccgaagatatgcctgcaggtcagacccctcatactgtcatactttttgctcataatgatttggtagacaaggttcagccgggagatcgtgttaatgtgaccggtatttaccgggcagtgcccatccgcgtcaaccctagggtctccaacgtcaaatccgtttacaaaacccacattgacgtgatccattaccggaaaacggatgccaagcggcttcacggactggatgaggaggccgaacagaagttattctctgagaagagggtggagctgctcaaggaactctcccggaaaccggatatctatgagcggctagcatctgcgttggctccatccatctacgagcacgaagatattaagaaaggcattctgctccaattgttcggaggtactagaaaagacttcagtcacactgggcgagggaagtttcgggcagagatcaacatactcctttgcggcgatcccggtacgagcaaatcccaactgctgcagtacgtatacaatctggtgcccagaggtcaatacaccagcgggaaaggctcctccgctgtgggcctgaccgcctacgtcatgaaagaccctgagacgcgtcagcttgtgctccagacaggtgccctggtgttgtcagacaatggaatttgttgcatagatgagtttgacaaaatgaacgaatctacgcgctcagtattgcacgaagtgatggagcagcaaaccctcagcatcgccaaagctgggatcatttgccagctgaacgccagaactagcgtactcgccgcagccaatcccatcgaaagccagtggaatcctaaaaaaaccacaatagagaacatacagctgccacataccctcctgtcccgattcgacttaattttcctgctgctcgatcctcaagatgaagcttacgacagacggctggcccaccatttggttgccctgtactaccagtctgaagagcaagcagaggaagaacttctcgatatggccgtactaaaagactacatagcctacgctcatagtacaataatgcccaggctctcggaggaagcaagtcaggccctcatcgaggcctatgtcgatatgagaaaaatcggcagttccaggggaatggtcagtgcgtatccgagacagctggaaagccttatcaggctggccgaagcacacgctaaggttaggctctcaaacaaggtagaagcaatagatgtagaagaggcaaaacggctccaccgtgaagccctaaagcagagcgccacagaccctaggactgggatagtggatatctccattctgactaccggcatgagcgctacaagtagaaaacgcaaggaggaactcgctgaggcgctgaaaaagctcatcctgagtaagggcaaaaccccagcgttgaagtaccagcaactcttcgaggacatacgcggtcagtctgacatagcgataactaaggacatgtttgaggaagccttacgggctctcgcagacgatgacttcctgactgtcacgggcaaaacagtgagactcctgtag

SEQ ID NO: 29465 - DNA, 2472 bp, Artificial Sequence
  Description of Artificial Sequence: Synthetic coding sequence
atgccaggacacttgcctttacgtgatgttgaggctaggatacctccacctaggggctcttgttctcgctgtcagcccaggttggaatggacatgtagggccctgctgcgtaggacgtgctgcttcccagcgctgcccaagtgcatattacaacttagcctgctcacgttgatgctagagggcacccccaggtctggcgtcaggggcaccccagtgagacagcgacccgacctagggtccgctcagaaggggttgcaggtggatttgcagagtgatggggcagccgcagaagatattgtggcatcagagcagagcctgggtcagaaacttgtgatctggggtaccgacgtcaacgtggctgcgtgtaaggaaaacttccaaagattcctacaacgctttatcgatccacttgctaaagaagaagaaaacgttgggattgatattactgaacccctgtatatgcagcggctcggggaaatcaacgtgatcggagagccctttctcaacgtaaattgcgaacacattaagtctttcgacaaaaacctgtacagacagctcatctcttaccctcaggaagtcattcctacattcgatatggcagtgaatgagattttttttgacagataccccgactccatcctggaacaccaaatccaggtacggccttttaatgctctgaagacaaaaaacatgagaaacttgaatccagaggacatcgatcagctgattacgatttcagggatggtaatacgaaccagccagctcattccggaaatgcaggaggctttctttcagtgtcaagtgtgcgcgcacacaacacgcgttgaaatggacagaggacgtatcgccgagcctagcgtgtgcgggagatgtcataccacccattccatggccctaattcataatcggagcctgttttcagacaaacagatgattaagttgcaggagagccccgaggacatgcctgcaggccaaacaccgcatacagtaattctttttgcccacaatgatctcgtcgataaagttcagcccggagacagagttaatgtaacaggcatctaccgtgccgtcccaattagggttaacccacgcgtcagcaacgtgaagtcagtgtacaagacgcatatcgacgtgatccattacagaaagacagatgccaaaaggcttcatggcctcgatgaagaggccgaacagaaattattcagtgaaaaacgcgtggagctcctgaaagagttgtccagaaaacccgatatctacgagcgactggcatccgccctcgcaccatccatctatgagcatgaagatattaagaagggcatcctgttgcagcttttcgggggtacgcgaaaagacttttcccatacaggaaggggcaaatttcgtgctgagataaatattctgctctgcggggatccaggaacaagcaagtcacaacttctgcagtatgtctataaccttgtacccaggggccaatacacttctggcaaaggctcttcagccgtgggcctgactgcatatgtcatgaaggatccagaaacccggcagctggtgctgcagactggcgctctggtgttatccgacaacggcatttgctgcattgacgagtttgacaagatgaatgagagcacccgtagtgttttgcatgaagtgatggagcagcagactctcagtatcgccaaagccggtataatatgccagctgaatgcgcgaaccagcgtactcgccgcagctaacccaatcgagtcccaatggaaccctaagaagaccactattgagaatatccagctgccacacacccttctgtcccgtttcgatcttatcttcctcctcttggatccccaggatgaggcctacgatagacggctcgcccaccatctggtggccctctattaccaatcggaagaacaggccgaggaggagctgctcgacatggctgtcctcaaagattacatagcttatgcccactccacaatcatgcctaggctttctgaggaggcttcacaggccctgattgaagcatacgttgacatgaggaagatcggttctagcagaggcatggtgagcgcctatccgagacagctcgagagcctcatcaggctcgcggaagctcatgccaaagtcagactgtcgaataaggtcgaggcaatcgatgttgaggaagccaagaggctacaccgcgaagcgcttaagcaaagcgcaactgaccctaggactggcatcgtcgacatatcaatcctgaccactgggatgagcgcaacatctcgaaaaaggaaagaggaacttgccgaagcattgaaaaagctcatcctctcgaaaggaaagactcccgcactcaagtatcagcagttgttcgaggacattagagggcagtcagacatcgccataaccaaagatatgttcgaggaggccctgcgggctctcgcagatgacgattttcttaccgtgaccgggaagaccgtgcggctgctgtag

SEQ ID NO: 29466 - DNA, 2592 bp, Artificial Sequence
  Description of Artificial Sequence: Synthetic coding sequence
atgagttcaccagcttcaacgcctagtaggcgaggctcccgacggggaagagctacacctgctcaaacacctcggagtgaggacgccaggagctctccatcccagaggagaaggggagaagactccacttctaccggagaactgcagccaatgccaacaagtccgggagtggaccttcagagtccagccgctcaggacgtcttattttcttcaccgccacagatgcatagttctgcaattccattggactttgatgtgagttcacccctgacatatggcacgcccagttctcgcgtcgagggcacgccaagaagcggagttcgcggaacaccggtgaggcagagacccgatctcggttcagctcagaaaggactgcaggtcgacttgcagagcgatggcgcagctgctgaggatatcgtcgcgtctgaacaatcacttggtcagaaattagttatctggggcacagatgtgaacgtcgccgcttgtaaagaaaatttccaaaggttcctgcagaggttcatcgaccctctggctaaggaagaagagaacgtcggaattgacatcactgagcctttgtacatgcaacgccttggggagatcaacgttatcggggagccattcctgaatgttaattgtgagcacattaagtcttttgacaagaacctctatcgccagcttatatcttacccgcaggaggtcattcccaccttcgatatggccgtcaatgagattttcttcgacagatacccggattctattttggaacatcaaattcaggtgcggcctttcaatgcgctaaagacaaagaacatgcgcaatttgaatccggaagatatagaccagttaataacaattagcgggatggtgataagaaccagccagctgatacctgaaatgcaggaggccttctttcagtgccaagtgtgcgctcacaccacccgcgtggagatggacaggggcagaatcgccgaaccatctgtgtgcggcaggtgtcacaccacacacagtatggcccttatccacaacaggtcactcttctcagataagcaaatgataaaactccaggaatcacccgaggatatgccagcgggacagactccccatacggtaattctttttgcgcacaatgacctagtggacaaggtccaacctggcgatagagttaatgtgaccgggatatatcgagcagtcccgatccgggtaaatcctcgggtttctaacgtgaagagcgtgtataaaacacatatagacgtgatccattacaggaagacagatgcaaaaagactacatggactggatgaggaagcagaacaaaagttattcagtgaaaaaagagttgagctgctcaaggaactgtccaggaagcccgatatttacgagcgtctcgcgagtgccctggcccctagcatatacgaacatgaagatatcaagaagggcatcctacttcagttgttcggtggcacacgtaaggacttctcccacactggccgaggcaaatttagggcagagattaacatactgctctgcggggacccaggcacatccaagtctcagctgctgcaatacgtatataaccttgtaccccgaggccagtacactagtggcaaggggagcagcgcagttgggcttaccgcatatgtgatgaaggatcccgagacaaggcagctcgttcttcaaactggcgcactggtgttgtccgacaatggcatttgctgcattgatgaatttgacaagatgaatgagtcaactcgctcagtgcttcatgaggtcatggagcagcagaccctcagcatcgcaaaggcgggaatcatctgtcaacttaacgctcgtacatcagttctggcagcagcgaaccccattgagtcccagtggaatcctaaaaaaacaaccattgaaaatatccagctgccacacacactccttagtaggttcgacttaatcttcctactgctggatcctcaagacgaggcctatgaccgacgccttgcccaccatctcgtggccctgtattaccagtcggaggagcaagccgaagaggagctgctcgacatggccgtcttaaaagattacatagcatatgcccatagtactatcatgccacgcctctcggaagaggcgtcccaggcattgatcgaggcctatgtggatatgcggaagatcggctcttctcggggaatggtgagcgcttacccgaggcagctggagtctttgatccgcctggccgaagcacatgccaaggttcgtctgagtaataaggtagaagctatcgatgtcgaggaggccaaacgcctgcatagggaagccctgaaacagagtgcaaccgacccaagaacaggaatcgtggacatctcgattctcactaccggtatgtctgccacctcaagaaagaggaaagaggagttggctgaagcgttgaagaagctgatcttatctaagggcaagactccagctctgaagtaccagcagctgttcgaagacattcggggacagtccgacatcgccatcacaaaggatatgttcgaggaagctttgagggctctagcagacgacgactttctaacagtgacagggaagacggtgcgcttgttgtag

SEQ ID NO: 29467 - DNA, 855 bp, Artificial Sequence
  Description of Artificial Sequence: Synthetic coding sequence
atggctcccagactctgctctatttcagtcaccgcaaggcgacttttaggaggacctggcccaagggcgggagatgtggccagcgctgccgctgctaggttctacagcaaggacaacgagggatcctggtttcggtccctgttcgtgcacaaggtagatccgcgtaaggacgctcacagcaccttgttatcaaagaaagagacttcaaatctctataagattcagttccataacgtgaaacctgagtacctggatgcctacaatagcctgactgaggccgtgcttcccaaactacatttggacgaggattatccttgtagtctggtggggaactggaatacttggtatggcgagcaggatcaagcggttcacctttggaggttctcagggggatatcccgcattaatggactgcatgaacaagctcaaaaataataaggagtaccttgagttccggagggagcgctcacagatgctgctgtcaagacggaaccagttgctactggagttttcattctggaatgagcctcagcctcgcatgggcccaaatatatatgaactacggacatataaattaaagcccggtacaatgatcgagtggggtaacaattgggccagagctattaaataccgacaggagaaccaggaggcagtgggtggcttcttcagccagatcggggagttgtacgtggtccaccacctgtgggcttataaggatctccagtctcgggaggagactcgtaatgctgcatggagaaaaaggggatgggatgaaaatgtgtattacaccgtccccctggtcaggcacatggaaagtagaatcatgattcccttaaagattagcccccttcaatag

SEQ ID NO: 29468 - DNA, 2076 bp, Artificial Sequence
  Description of Artificial Sequence: Synthetic coding sequence
atgtccggctttgatgatcctggtatcttttattccgattcttttgggggagacgcacaagccgacgagggccaggcaagaaagtctcaactgcagcggcgatttaaagaatttttacgccagtatcgcgtgggaactgaccggacaggtttcacattcaaataccgggacgaactgaaaagacattacaatcttggcgaatattggatcgaagtcgagatggaagatcttgcttctttcgatgaggacctggcagactacctctataagcagccagccgaacatttacagcttagtgacatgatgtctcacctggtgaagattcctggcatcatcattgccgctagcgctgtgagggcgaaagcaacaaggatctccattcaatgccggtcttgtcgcaatacgctgaccaatatagctatgcgtcctggtcttgagggttatgcattgcccaggaaatgcaatactgatcaggccggtcgcccaaagtgccccctggacccctattttattatgccagacaagtgcaagtgcgtcgacttccagaccctgaaactacaggaacttcctgacgctgtgccacacggcgaaatgccgaggcatatgcagctttattgtgatcgttacttgtgcgataaagtggtgcccggaaacagagtcacgatcatgggaatctactctattaaaaagttcggcttgactacaagcaggggcagagatcgagtgggagttggcatccgaagcagctacatccgggtgttggggattcaggtggatacggatggctctggaagatcctttgcgggagcagtgtcgccgcaggaagaggaagagtttaggcggctggccgcactccctaacgtgtatgaggtgatttcaaaatcaatcgcacctagtattttcggcggtaccgacatgaaaaaggctattgcatgcttgctcttcggtgggagcagaaagcgactacccgacgggctgacacggagaggggacattaacctgctgatgcttggcgaccccggtactgctaaaagtcagctcctgaagtttgtagaaaagtgctcccccataggggtttatacaagcgggaagggcagttcggctgctgggctgactgcatccgttatgagagaccccagctccagaaacttcatcatggaaggaggtgctatggtcctcgctgatgggggagtggtctgcatcgatgagttcgataagatgcgtgaggacgatcgcgtagctattcacgaggcaatggaacagcagacgatctctattgccaaggctggaattacaacaactctgaattcaaggtgttcagttctcgcggctgccaactcagtgttcggacgatgggatgaaaccaaaggagaggataacatcgacttcatgcctaccatactgtctcgttttgacatgatctttatcgtgaaagatgaacacaatgaggaaagagatgtgatgttggctaagcatgtcatcacgctgcatgtgtccgccctgacacaaacccaggccgtcgagggcgaaattgatcttgcaaaattgaagaaattcatcgcgtactgtcgcgtgaaatgtggacccagactgtctgcagaagctgccgaaaagctcaagaaccggtatatcatcatgaggagcggtgctagacagcatgagagagattctgaccggaggtcttcaattcctatcaccgtgcgtcagctggaggctattgtgagaatcgccgaagcactatctaaaatgaaacttcagccctttgccaccgaagccgacgttgaggaagccttaagactcttccaagtcagtactctggatgccgctctttcagggaccctgtcgggagttgaaggctttacatcgcaagaagatcaggaaatgctatccagaattgaaaaacagttaaagcgacgttttgcaataggctctcaggtaagcgaacactcgatcatcaaggatttcactaagcagaagtaccccgaacatgctattcataaagtgttgcagctgatgctacggaggggcgaaatacagcatcgcatgcagaggaaagtgttatacagactgaaatag

SEQ ID NO: 29469 - DNA, 696 bp, Artificial Sequence
  Description of Artificial Sequence: Synthetic coding sequence
atgagcgggttcgacgatccaggtatattttacagcgacagcttcgggggtgacgctcaggctgacgaggggcaggccagaaaatcacaactgcagcggagattcaaggagttcctgcggcagtatcgtgtgggcactgataggacaggttttaccttcaagtacagtcttgcccctagcctgattgaacacctgttaccagcccgttattgtagcggatgctgggctgccgctctgaaactcgatctggctccggcaagcagagacgagctcaagagacactacaatctgggtgagtattggatcgaggtggagatggaggatctggcatctttcgacgaggatttggccgactacctgtataagcagccagctgagcacttgcagttgttggaggaggctgccaaagaggtcgccgacgaagtgactaggccaaggccctctggcgaggaggtgttgcaggatatccaggtgatgcttaagagtgacgcttctccttcgagcatacgctccctgaagtccgacatgatgagtcaccttgtgaagattccagggatcatcatcgctgcgtctgccgttagggcaaaggccacccgaatttcgatccaatgcaggtcatgcagaaatacactgaccaatattgctatgaggccgggtctggaaggctatgccctcccacggaaatgtaatacctag

SEQ ID NO: 29470 - DNA, 1125 bp, Artificial Sequence
  Description of Artificial Sequence: Synthetic coding sequence
atgaacagctctgggattactacatggggtagtaccggtttgcgttggaggtggaggactaggccccgtcctagcggagaagaggtgctccaagacatacaggtaatgctcaagagcgacgcctctccctcttcgatcaggtcccttaagagcgatatgatgagccacctggtgaagatcccgggtattattatcgcggctagcgctgtgcgggctaaagccaccagaatcagtattcagtgcaggtcatgtcggaatacactaaccaacattgcaatgcgccctggattggagggatacgctctacccaggaaatgcaacactgaccaggccggaagacccaagtgtcccctcgacccttatttcatcatgcccgataagtgtaagtgcgtggactttcagaccctgaagcttcaggagctgccagacgctgtcccccacggcgagatgccacgccacatgcagctatactgcgacaggtatctgtgcgacaaggttgtccctggtaatagagtgacgattatgggtatttactcgatcaaaaagtttggcctcactacaagccgaggaagggacagagttggagtgggaataagatcatcctatattcgcgtgctcggaattcaggtggatactgatggctccgggaggagctttgctggcgcagtgagccctcaagaagaagaagaattcaggaggttagcggctctgcccaatgtgtacgaagtcattagtaaatctatcgccccttccatctttggtggaacggacatgaaaaaggccatagcttgtctgctgttcggaggttcgagaaagaggctacccgatggtttaactcgtcggggtgatataaacttgctgatgttgggggatccaggcaccgctaagagccaactcctgaaatttgtggagaaatgttctcctattggcgtgtacacgtccgggaagggctcctcggccgctggcctcacagcctcagttatgagagacccatcaagtcgtaatttcataatggagggtggcgcaatggtcctggccgatggaggcgtggtttgtattgatgagtttgataagcacagagaggctgcccaggccccactctgccattggctgcctggggtctag

SEQ ID NO: 29471 - DNA, 1788 bp, Artificial Sequence
  Description of Artificial Sequence: Synthetic coding sequence
atgttctattttcgaggctgtggcaggtgggtggccgttagttttaccaagcaacagttcccattggcacgcttaagttcagatagcgctgctcctagaactccacactttgacgtaatcgtgattggcggtggccacgctgggactgaggcagcgactgctgctgctagatgtgggagccgcactctgctgctcacccaccgcgttgacaccattggccaaatgagttgtaaccctagctttgggggaatcgggaagggtcacctgatgcgcgaggtagatgcactggacggcttgtgcagccgcatttgtgaccagtctggggtccactataaggtcctgaacagacgaaaaggccctgctgtgtggggcttgcgtgcccagatagaccgcaaactgtataagcagaacatgcagaaggaaatacttaacactccgctccttacagtgcaggagggggcagtcgaggacttgatccttaccgaacccgaacctgagcataccggtaagtgcagagtcagtggcgtggtacttccagaagaccaattgccctgttaccttacgcatactaaccctcgcgtggacgagattgtcctgaagaacttgcacttaaactctcacgtgaaagagactaccagaggcccaaggtactgtccttctattgagtctaaggtactgcggttcccaaacaggcttcaccaggtctggttggagcccgaaggcatggatagcgacctgatatatccacagggtttaagcatgaccttgcctgctgagttgcaagagaaaatgatcacctgcatcaggggacttgagaaagccaaggtgatccagcccggatatggagttcagtatgattatctagacccgaggcagatcactccatccttggagactcatctggtacagcgcctcttttttgccggacagataaatggcacaaccggatatgaggaagccgcagctcagggcgtcatagccggaattaatgcttccctgagggtatcaaggaagcctcccttcgtcgtgtctcggacagagggctatatcggcgtcctgatcgacgacctgactaccctgggcacttctgaaccgtaccggatgtttacctctagagtcgaatttcggctgtctttgcgaccggacaatgcggactcgcgactgacactgaggggctataaggacgctggctgcgtctcccagcagcggtacgagagggcctgttggatgaagtcttcactggaggaaggcatctccgtgctaaagtccatcgagttcctgtcgagcaagtggaaaaagcttatccctgaggcatcaatatctacgtctcgaagcctccccgtgagagctcttgacgtgcttaagtacgaggaggtggacatggactctctcgccaaggcagttccagaaccgcttaagaagtacactaagtgccgtgaactcgccgaacgcctgaaaattgaagcgacttacgaaagtgtgttattccaccaactacaggaaatcaagggggttcagcaggacgaagctcttcagcttcctaaggacctggactatctgacaatcagagatgtgagcctctcacacgaggtcagggagaagctgcacttctcacgccctcagacaatcggggcagcctcgaggatccctggagtcactccggctgccatcattaatctgctccggtttgtgaaaaccacccagcggaggcaaagcgctatgaatgagtcttcaaagacggatcaatatctttgcgatgccgacagacttcaggagagggaattatag

SEQ ID NO: 29472 - DNA, 2154 bp, Artificial Sequence
  Description of Artificial Sequence: Synthetic coding sequence
atgttctatttccgaggttgtggtcggtgggtggctgtctcattcaccaagcaacaattccctctggcacgcctgagtagcgattcagccgctcccaggacgccacacttcgatgttattgtcattgggggaggccatgctgggaccgaggctgccaccgctgccgcacgatgtggatctcggacactgcttttaacacatcgagtggacaccattgggcagatgtcatgtaatccatcgttcggaggtattggcaaggggcatctaatgagagaagtcgatgccttggacggattgtgctctaggatctgtgaccaatctggggtgcattacaaagtgctcaaccgtcgcaaagggccagctgtctggggcttacgagcacagatagatcggaaactgtacaaacagaatatgcagaaagaaatacttaacacaccactgctcaccgtacaggaaggcgctgtcgaggacctgattttaacagaaccagaacccgagcataccggaaaatgtcgagtcagcggggtggttctggtggacggaagcactgtctatgctgaatccgtgatcctcacaacaggcacctttctgcgcggaatgattgtcatcgggctagaaacgcaccccgctgggaggctaggtgaccagccaagtatcggactggcccagacactggagaaattgggttttgtggtgggaaggctaaaaacggggacaccacctagaatcgcaaaggaatcaatcaatttcagcattctgaataagcacatccccgacaacccgtcgatcccattctctttcactaatgaaaccgtctggataaaacctgaagatcagctgccctgttacctgacgcataccaaccccagagtcgacgaaatcgtactcaagaatttgcacctcaattcccacgtgaaggagacaacccgaggacctcggtactgtccctccattgagtccaaagtcctgaggttcccaaacaggctgcaccaggtttggctggaaccagagggaatggacagcgatcttatctacccccagggcctgtctatgaccctaccggcagaactgcaggagaaaatgatcacgtgtattagagggctggagaaggccaaagtcattcagcccgatggtgtgctgttgctgctacccaggatggaatgtaacggcgctatcagtgctcatcacaatttgcccctgcccggatacggcgttcagtacgattacctggacccaagacaaatcaccccctcactagagacgcacctggtccaacgcttgttcttcgctggacaaataaatggtacaactgggtatgaagaggcagccgctcagggtgtgatagctggtatcaatgccagtctgagagttagcaggaagcccccttttgtagtaagcaggactgaggggtacatcggtgtgttgatcgatgacctaactactcttggaaccagcgagccatatcgaatgttcactagtagggtcgaattccggctgagcttgaggccggataatgcggattctagattgacgctgagaggatataaggacgccggttgcgtgagtcagcagcggtatgaacgggcttgttggatgaaaagtagtttagaggaaggcatctccgtgctaaagtctatcgagtttctgagttcgaaatggaagaaactgatcccagaggcttcaatttctacatctagatccctccccgtgagagcattggacgtcctgaagtacgaagaggtggatatggactccttggctaaggctgtacctgaaccgttgaagaaatacaccaagtgcagagagctggcagagcggctgaagattgaggctacctacgagagcgtcttgtttcaccagttacaagagattaagggagttcagcaggacgaagcacttcaactgcctaaagatctggactatctgactatccgggacgtgtcactgtctcacgaagtcagggaaaagcttcacttttcccgccctcagacaattggggcagcctctcgcatccctggggtgacacccgcagccataattaacctactgcgtttcgtgaaaactactcagcgtcgccagtcggccatgaatgaatcatcaaagacagaccagtatctgtgcgatgctgatcgactgcaggaacgcgagctgtag

SEQ ID NO: 29473 - DNA, 1932 bp, Artificial Sequence
  Description of Artificial Sequence: Synthetic coding sequence
atgtcttgcaaccccagtttcggaggaattggtaaaggccatctcatgcgagaggtggacgcgttggacggcctatgtagcaggatctgcgaccagagcggcgtgcattacaaggtgcttaaccgccgtaaaggacctgccgtttggggtttacgggctcaaattgatcgcaagctatataaacagaacatgcagaaagagattctgaatacgccccttctcacggtgcaagagggagctgtggaagatcttattctgaccgagcccgaacctgagcatactggtaaatgccgggtttctggggtcgtgttggtcgacggttcaactgtttacgccgagtccgtgattctgacgactggtacatttctgcggggaatgatcgtcattggactggagactcaccccgctgggaggttaggggatcaaccgagtatcggactggcccaaactctggagaagttagggtttgtggtggggcgactgaagacagggacacccccaaggatcgcgaaggaaagtatcaatttttctatacttaataagcacattcccgataaccccagtatccctttctcgtttaccaatgagacggtgtggataaagcctgaggatcagctcccctgctatttgactcacactaacccgagagtggacgaaatcgtgctgaagaaccttcacctgaatagccacgtcaaggaaaccacacggggacccagatattgcccttcgattgagtccaaggtcctgaggtttccgaatagattgcaccaggtctggctggaacctgaagggatggacagcgaccttatctacccccagggactcagtatgacactccctgccgaactccaagagaaaatgatcacctgcatcaggggcctcgagaaggccaaggtgatacagcctgatggtgtgctactgctgctgccacggatggagtgcaacggggcaatttccgcccaccacaacctcccattgccgggttatggcgtccaatatgattatctggacccacgacaaatcaccccctctctggagacgcatctggtccagcgcttgtttttcgctggacaaatcaatggaactactggctacgaagaagctgctgcgcagggcgtcatcgctggtattaatgccagtctgcgagtctctagaaagccccctttcgtagtctccaggacagagggatatatcggagtcctcattgatgacctgacaaccctgggcactagcgaaccttatcgcatgttcacaagccgcgtcgaatttcgcctgtccctcaggccagataacgcggatagtcggcttactctcagggggtataaggacgcgggatgcgtgagccagcagcgctatgagcgggcatgctggatgaagagctccctggaagagggaatctccgtactgaaaagcatcgagtttctcagtagcaaatggaaaaaactgattcccgaggcatcaattagcacttctcgttcactgcccgtacgcgcacttgacgtgctgaagtatgaagaagtggatatggatagccttgcaaaagctgtgccggaacccttaaagaagtacactaaatgtcgggaacttgcggagagactgaagattgaggcaacctatgaaagtgttctctttcaccaactacaagagattaagggagtgcagcaggacgaggctctccaactccctaaggacctggattatctgacgatacgagacgtgtcattgagtcatgaagtccgagagaaactccacttctcacgaccccagaccataggtgccgcttcgcgcatccccggtgtaacaccagcagccattattaacctgttgagattcgtgaagaccactcagaggcggcaatcagccatgaatgagagctcaaagacagaccagtacctctgtgacgctgatagactccaagaacgggaattgtag

SEQ ID NO: 29474 - DNA, 2199 bp, Artificial Sequence
  Description of Artificial Sequence: Synthetic coding sequence
atgttctatttccggggatgcgggcgatgggtcgccgtatccttcacaaaacagcagtttccccttgctcgactgtctagcgatagtgctgccccaagaactccccatttcgatgtaatagtgatcggaggaggacacgccggtacggaagcagccacggctgccgctaggtgcggctctaggactcttctactgactcaccgcgttgacacgatcggccaaatgagttgtaacccttctttcggaggaatcgggaaaggtcacttgatgagagaagtggatgctttagacggactctgcagcagaatctgcgaccagtccggcgtgcattataaggtgttgaataggaggaaaggtccagcggtctgggggctgagagcccagatcgaccgaaagctgtataagcagaacatgcagaaagagattttgaacacccctctgctgactgtacaggagggggcagttgaagacttgatcctaactgaacccgaacctgaacatactggcaagtgcagagttagcggagtcgtgctggtagacgggtcaacagtttacgcggagtccgttatccttaccaccggcacttttctgagagggatgatcgtaatcgggcttgaaacccatcctgcaggacggttgggagatcagccgagcattgggcttgcacagactttggaaaagcttggtttcgtggtcgggcgtctcaagacgggtacgccaccccgaattgccaaggagagtattaatttcagcatcctgaataaacatattcctgataatcctagtatccctttcagctttactaacgaaactgtgtggatcaagccagaggaccaactgccttgctatctgacccataccaatccaagggtggatgagatcgttctgaagaatcttcatctcaactctcacgttaaggaaacaacccgcggtcccaggtattgcccatcgatcgaaagtaaggtactaagatttccaaaccgcctccaccaggtgtggctagaaccagagggtatggactccgatctcatctaccctcaaggactgtcaatgactctgcctgccgaactacaagaaaaaatgatcacctgtattcggggtctggagaaggccaaggttatacaacccggatatggcgtgcagtacgactacctcgatcctcggcaaataacccctagtctcgaaacacaccttgtccagagactcttttttgctggccagataaacggcacgaccggttacgaagaggccgcagcgcagactgagtgttgctcagtggctcgccttgagtgttcagatatgatatcgcagttgcaggcgatactgcttcctcaaccaagtcttgtggcagggaccgccggaatgcaccataatactcagggtgtgattgcgggaatcaacgcctcgctcagagtgagccggaaacctcctttcgttgtgtctcgcacggaaggctacataggcgttttaatcgacgaccttaccacgctcggaacttctgaaccctatagaatgttcaccagtagggtggaattcagactgtcattgaggcctgataatgctgactcgcgtctgaccttacgaggatataaagatgctggatgtgtcagtcagcagcgatatgagcgggcatgttggatgaagtcatccctggaggagggcatctctgtcttgaaatcaatagagttcctatcttcaaagtggaaaaaactcattcccgaggcgtccatctccaccagccgctctctgccagtgagagccctcgacgttctgaagtacgaggaagtcgatatggacagcctagcaaaagcggtcccagaaccccttaaaaaatacacgaagtgtagagaattggccgaacgcctgaaaattgaagctacatatgaaagcgtgcttttccatcagctccaggagatcaagggtgtgcaacaggatgaggctctgcagctccctaaagatctagattatttgaccattcgagatgtatcactctcccacgaggtgcgggagaagttgcacttttccaggccccaaacaattggagcagcctcccggattcccggagtgaccccagccgctatcatcaacttgctccgcttcgtcaaaactacccagcgacggcagtcagccatgaacgaatcctcaaagactgaccagtatctttgcgacgcagatcgccttcaagagcgtgagctgtag

SEQ ID NO: 29475 - DNA, 2079 bp, Artificial Sequence
  Description of Artificial Sequence: Synthetic coding sequence
atgttttattttaggggatgtggtcggtgggtggcagtatcattcaccaagcagcaatttcctctggcgagactgtcctctgacagtgccgctcccaggacacctcactttgatgtgattgtgatcgggggtggtcacgcaggcaccgaggctgccactgcagccgcaaggtgcgggtctcgaacgctgcttctgacccacagagtcgacaccatagggcagatgagctgtaacccctcttttgggggaatcggcaagggccacctgatgagagaagttgacgctctggatgggctgtgctccaggatttgtgaccagagcggcgtccactacaaagtcctgaatcgcagaaagggcccagctgtatggggattgagggcccagattgaccggaagctgtacaagcagaacatgcagaaagaaattctgaacacacctctgctgacggtgcaggagggtgcagtcgaggacctcattttgacagaacccgagcccgaacacaccggtaaatgtcgagtctccggtgtggtgctcgtcgacgggtcaaccgtatacgccgagtctgtgatactgacaactggcacctttcttcggggaatgatcgttataggtctggaaacgcaccctgcgggacggttgggtgatcaaccatcaataggactagcccagacactggagaagttgggctttgtggtgggccgtctgaagactgggactcctccgaggatcgcaaaagagagcatcaacttttcgatactgaacaagcacatacctgacaacccttctatacccttcagcttcacaaacgagaccgtatggatcaaaccagaggatcagttaccctgttatctcacccatacaaacccccgagtggatgagatcgtactgaaaaacctgcatctcaacagtcacgtcaaggagactactaggggcccaagatattgtccctctatcgagagcaaggtgctgcgcttcccaaaccgtctgcatcaggtgtggctcgagccagagggtatggacagcgaccttatttatccacagggactttcaatgacgctgccggcagagctgcaggaaaagatgattacttgtattcggggtctggaaaaggcaaaggtcatccaacctggatacggcgtgcagtatgactacctggaccccagacaaataacaccgtcactggaaacccacctggttcagcgcttgttctttgccggacaaattaacggaaccactgggtacgaggaggcagccgcacagggggtaattgcgggaatcaacgcctctctgagggtctctcgcaaaccgccattcgtcgtgtcgcgcaccgagggatatatcggtgtccttattgatgatcttactaccctgggcaccagcgagccatacaggatgttcacctccagggtggaattccgtcttagcctgcgaccggataacgccgactcacgacttacactgcgtgggtacaaggatgctgggtgcgtcagccaacagcgttatgaacgtgcatgctggatgaaatcctcccttgaagagggcatcagcgtgctgaagagcattgagtttctcagctccaagtggaagaaactcattcccgaagcatctataagcacctcacgtagcctgcctgttcgcgcattagacgtattaaagtatgaagaagtggatatggattcattggcgaaggccgtacccgaacccctgaagaaatataccaagtgcagagagctcgctgagagactcaagattgaggcaacctacgagtctgtattgttccaccaacttcaggaaattaagggagtgcagcaagacgaggccctgcagctgcccaaggacctcgattacctgacaatccgcgacgtgagcctgtcccacgaggtccgcgaaaagctccatttttcccgaccccagaccattggcgctgcgtcgcggataccgggtgtcactcccgcagctataatcaacctcctccgtttcgtgaaaacgacacagaggcgacaatcagcgatgaatgaatcctcaaagacggaccaatacctgtgtgacgccgatcgcctacaagaaagagagctgtag

SEQ ID NO: 29476 - DNA, 381 bp, Artificial Sequence
  Description of Artificial Sequence: Synthetic coding sequence
atgtcaatcggcgtgcctataaaagtgctgcatgaagcagaggggcacatcgtgacttgtgaaaccaacacaggagaggtgtatagagggaaactgatcgaagcagaagataatatgaattgccagatgtcaaatatcactgttacctatcgcgacggtcgggtggctcagcttgaacaggtgtatatcaggggttccaagatcagattcctaatcctccccgatatgctcaaaaatgccccaatgctgaaaagtatgaagaacaaaaatcagggcagtggtgccggtcgcggaaaggctgctatcctgaaggcccaggtggccgctcggggacgcggtagaggcatgggacgtgggaacatcttccagaaacgtagatag

SEQ ID NO: 29477 - DNA, 1083 bp, Artificial Sequence
  Description of Artificial Sequence: Synthetic coding sequence
atggctgcggctgcagcagccggtgccggaccggaaatggtgcgtggtcaggtctttgatgttggtccgaggtacaccaatctctcctatattggcgagggagcttacggcatggtatgttcagcttatgataatgtgaataaggtcagggttgcaatcaaaaagatttctccattcgagcaccagacttattgtcaacgcacattgagggagatcaagatattactgcgtttccgacacgaaaatatcatcggcattaacgacattatcagggcacctacaatagaacaaatgaaagacgtgtatattgtgcaggatttgatggagaccgacctatacaaactcttgaagacacagcacctctctaatgatcacatatgctattttttgtatcaaatcctgcgcggtctgaaatacatacactctgcaaatgttctccaccgtgacctgaagccgtcaaatctgctgttgaacactacttgcgacctgaagatctgtgacttcggcttggcacgcgtggctgaccctgaccatgatcataccggttttctgaccgagtatgtcgccacaaggtggtatcgtgcacccgagatcatgcttaactctaagggctacacaaaaagcatagatatctggtcagtaggctgcatactcgctgagatgctttctaatcgccctatcttccctggcaagcattatctagaccagctgaaccacatcctagggatcctcggatccccaagtcaggaggacctcaattgcatcatcaacctgaaggctaggaattatctcctgagcctccctcacaaaaacaaggtgccctggaacagactgtttccaaacgctgactccaaagcattagatctcctggataaaatgctgacattcaatccacacaaaaggatcgaagtcgagcaggcccttgcacatccttatctcgaacagtattacgacccatcagatgaacccattgcggaagcaccatttaagtttgacatggagctcgacgatctacctaaagagaaactgaaggaactcatcttcgaagaaaccgccagattccagccgggttatcgtagctag

SEQ ID NO: 29478 - DNA, 1047 bp, Artificial Sequence
  Description of Artificial Sequence: Synthetic coding sequence
atggtaagagggcaagtgttcgacgtcgggcctagatacaccaacctgagttacataggcgagggagcttatgggatggtctgcagcgcttatgacaacgtcaacaaggtgagggtggcgataaagaagatttctcccttcgaacatcagacttactgtcagaggactctgcgcgaaattaaaatcctgctgaggttcaggcatgagaatatcatcggaattaatgatatcatcagggcaccaaccatcgaacaaatgaaggacgtctacatcgtgcaggacctgatggaaactgatctctataagctcttaaagacacagcatttgtcaaacgatcacatttgttattttttataccagattctgcgcggactgaaatatatccacagcgcaaacgtgctgcatcgtgatctgaaaccttctaatctgctcctgaacactacctgtgatctgaagatttgcgactttggattggcacgggtggccgaccctgaccacgaccacaccgggttccttacagaatatgtagccactcgttggtatcgcgcacctgagatcatgctcaattcaaaaggctatacaaaatctatcgacatctggtccgtcgggtgcatactggcggagatgctgtctaaccggcctatcttccccggaaaacactacctggatcagcttaaccatatcctgggaatccttggatccccttcccaggaggacctaaattgtattatcaatctgaaagccaggaattacctgctctctttaccacataaaaacaaggtaccatggaaccgcctcttccccaatgccgactctaaggctttagacctgctcgataaaatgctgaccttcaaccctcataaacgcattgaggtcgagcaggccttagctcacccctacctggagcagtactacgatccatcagacgaacctatagccgaagctccctttaagttcgacatggagctggacgacctcccgaaggagaagctgaaggagctgatatttgaagagaccgccagatttcagcccggataccgctcctag

SEQ ID NO: 29479 - DNA, 951 bp, Artificial Sequence
  Description of Artificial Sequence: Synthetic coding sequence
atggcggctgcggctgcagccggagccggtcctgaaatggtgaggggacaagtgtttgacgtcgggccacgctacaccaacctatcatacatcggggagggagcctacggcatggtgtgcagtgcatatgataatgtgaataaagttcgcgtggccatcaagaagatttcaccctttgagcaccagacgtactgccaacggacactaagggagattaagatactgttacgctttagacatgaaaacattattggaattaacgacattatcagggctccaactattgagcagatgaaagacgtgtatatcgtacaggacctgatggaaacagatctctataagctattaaagacccagcatctgagcaatgaccacatatgttatttcctctaccagatcctcaggggtctgaagtacattcatagcgcaaatgttctgcaccgggatctgaagccttccaacctgttgctgaacaccacgtgtgacctgaaaatctgcgacttcgggctagcaagagtagctgatccagaccatgaccacaccggcttcctcacagagtatgtcgcaacgcggtggtatcgagcccctgagatcatgcttaattcgaaaggctacacaaagtcgattgacatatggtcggttggctgcattttagcggagatgcttagtaaccgacccatattcccagggaagcactacctcgaccagctcaaccatattcttgccttagacctattggataagatgctgaccttcaacccccacaaacgaattgaagttgagcaggccttggcacacccatacctggaacaatactacgaccctagcgacgagcccattgcagaggccccattcaagttcgacatggagctggacgatctgcctaaagagaagctcaaagagcttatcttcgaagaaactgcacgcttccagcccggatacaggagctag

SEQ ID NO: 29480 - DNA, 1095 bp, Artificial Sequence
  Description of Artificial Sequence: Synthetic coding sequence
atgtccggccctagagctggattttatcggcaggaactcaacaagacagtgtgggaagtgccccagcggctgcagggactacggccagtaggatctggtgcatatggatcagtatgctctgcctacgatgccagacttaggcagaaggtggccgtgaaaaaattatcaagaccatttcagagcttgattcacgcaagaagaacttatcgcgagctgcggctcctgaaacatctgaaacacgagaatgtcatcggcttactcgatgtattcactcccgctacatccatcgaggacttcagcgaagtatacctggtgactacacttatgggagccgacctcaataacattgtgaagtgccaggcactgagtgatgaacacgttcaattcctggtttaccaactactgagagggctgaagtatatccacagcgctgggatcatccacagagaccttaaaccctccaacgtcgccgtaaatgaagattgtgaactacgcatcctggactttggcctggcgaggcaagccgacgaagaaatgactggctatgtggcaacccggtggtaccgggcacctgagattatgttgaattggatgcactataatcagaccgttgacatctggtcggttggttgtatcatggccgaattgttgcaggggaaggctctcttcccgggaagtgactacatcgaccagcttaaacgcatcatggaagtagtgggcaccccttccccggaagtgctggccaagatttccagtgaacatgcacgcacctacatacagtctctccctcccatgccccagaaagatttgagttcaattttccggggagcaaatccgctggccatcgacctgctgggcagaatgttagtccttgattctgatcagagggtgagcgccgcagaagccttagcacacgcatacttttcccagtatcacgatcccgaggatgaacctgaggctgagccctatgatgaatccgtagaggccaaagagcggactttagaagaatggaaggagctgacctaccaagaggtactgagcttcaaacctccagaaccgccaaagccccctgggtccctggaaatcgaacagtag

SEQ ID NO: 29481 - DNA, 1095 bp, Artificial Sequence
  Description of Artificial Sequence: Synthetic coding sequence
atgtccgggccaagagctggattctataggcaggaactgaacaagacagtgtgggaagtcccacagaggctacagggactcaggcccgttggtagcggagcttacggctctgtatgctctgcctatgatgcgaggctcaggcaaaaggttgccgtaaagaagctttcaagacccttccagagcctgattcacgcccgtcgaacctaccgagagctccgccttttgaaacaccttaagcacgaaaacgttatcggattgttagatgtgttcacaccagccacatcaatcgaggatttttcagaggtgtacctggtcactaccctaatgggagccgacctcaacaatatcgtaaaatgtcaggctctgtccgatgagcatgtccagtttctcgtgtaccagctcttgcgcggactcaagtatatacattcagcaggcatcatccacagagatctgaagcctagcaacgtggctgtcaacgaggactgtgagctcagaatactcgattttggcttagccaggcaggctgacgaggaaatgactggctacgtggccacacggtggtaccgtgccccagaaataatgctgaactggatgcactataaccagaccgtggacatttggagcgttggctgcataatggcagagcttctccagggcaaagcactcttcccaggcagcgattatatcgatcagttgaaacgcattatggaagtcgtgggaaccccaagtcccgaagtgttagcgaagatcagcagcgaacacgctcgcacttatatccagtccctgccccctatgcctcagaaggatttgagctctatctttcggggtgcaaatcctctggccattgatctgttggggcgtatgctggtgcttgatagtgaccagcgggtcagcgctgctgaggcactagcacacgcttacttcagccagtaccatgatcctgaggacgagcctgaggctgaaccctacgacgaatccgtcgaagccaaggaacgtaccctggaggaatggaaggagttgacttatcaggaggtgctgtcatttaagccaccagagccacccaaaccaccgggaagtctcgagatagagcagtag

SEQ ID NO: 29482 - DNA, 642 bp, Artificial Sequence
  Description of Artificial Sequence: Synthetic coding sequence
atgggcgcagatctcaacaacatagtcaagtgccaggcactatcagatgagcacgtgcagttcctggtgtatcagctcctgaggggactgaagtacattcactcagctggtattattcaccgcgacctcaaaccatccaatgtcgctgttaatgaagattgcgaacttcgcatccttgattttggtctggcacgccaggcggacgaagagatgaccggctacgttgctacaagatggtaccgcgctccggagattatgctcaattggatgcactataaccagacaggcgcagggggtagaccctggggggatgaaggacagggtccaagattggctctggattggctgtgcatgccgggactccgcggacaggccaggtcccccaggatgtgggatccgcacagtaaagtcgccctgcagaggcccctggaacacgacggatgctggcccccattagcggttcaactgtggactagtccttgtctagggggattaggtatggcagaagaaggagtgtgcccatcctggggcctggacgtaacagttggactgctggaggaggggaggggggtgggcaccctgatggaggtacctagcccctcgcattctggctacctggtgagagggctgcatcatggctag

SEQ ID NO: 29483 - DNA, 1149 bp, Artificial Sequence
  Description of Artificial Sequence: Synthetic coding sequence
atggactttggcctggcactgctgctggctggtcttttagggttgcttcttggtcagagcctgcaggtgaagcctttacaggtagagccaccagagccagtagtggcagtggccctgggggctagccgacagctgacttgtcggctggcctgtgcagaccgcggtgcctccgtccagtggaggggattggacacctctttgggcgctgtgcaatcggataccggacgctccgtgctgaccgttcgaaacgcatccctgtctgccgcaggaactagggtgtgtgtcgggtcgtgcgggggaaggacctttcaacacacagtgcagctactggtgtacgcattccccgatcagctgacggtgagccccgcagcgctagtgccaggagatcccgaggtggcctgcacagcacataaggtgactcccgttgatcccaacgccttatcattcagcctcctggttggcggacaggaacttgagggggctcaggctttaggccctgaagtgcaggaggaggaggaggaaccccagggcgacgaggacgtgctgtttcgcgtcacggagagatggcggctgcctccacttggtacacccgtaccgccagctttgtattgccaggcaaccatgcggctgcccggtctcgaactcagccaccgccaggcaattcccgtcctacattctcctaccagccccgagcctcccgataccacaagcccagaatccccagacaccaccagtccagagtccccagacactacctcacaggaaccccctgacaccactagtcccgaaccaccagataagacctcccccgaacctgccccacagcagggaagcactcacacaccacggtcccccggttctacccgcacacggagacctgagatttcgcaggctggaccaacacagggcgaggtcatacccacagggagctctaagccagctggagaccaactgcctgccgcactctggacgtcatctgccgttcttggcttgctgttacttgccctgccaacctatcatttgtggaagagatgtcgccatctcgcggaagacgatacgcatccgccagcttcgttgcggctgctgccgcaggttagcgcttgggcaggcttgaggggaactggacaggtgggaatttccccatcctag

SEQ ID NO: 29484 - DNA, 1074 bp, Artificial Sequence
  Description of Artificial Sequence: Synthetic coding sequence
atgtcatccccccctcctgctcggagcgggttctaccggcaggaagtgaccaagacggcatgggaagtccgagctgtctatcgggatctacagcctgtaggcagtggcgcttacggggctgtttgctctgccgtcgacggtcgaaccggggcaaaggtggctataaagaaactctatcggccattccagtcagaattatttgcaaagagggcctacagggagctccgtttgctgaaacacatgagacatgaaaatgttatcgggctgttagatgtatttacccctgacgaaacactagatgattttacggatttctatcttgtcatgcctttcatggggaccgacctcggaaagttgatgaaacatgagaagctgggcgaggatcgtattcagtttctcgtctatcaaatgctgaagggccttagagatctcaagcccggaaacctggcggttaatgaggactgtgagctgaagatactggatttcgggttagctcgtcaagctgactccgagatgaccgggtatgtcgtgacaaggtggtaccgggctcccgaggttattcttaattggatgcgatatacccaaactgtggatatttggtccgtgggatgtattatggccgagatgatcacaggcaaaactctttttaaggggagcgaccatttggatcagttgaaggagattatgaaagttaccgggacccctcctgcagagtttgttcagcggcttcagtcagacgaggccaagaactacatgaaaggtcttccagagttagaaaagaaagattttgcctccatcctcactaacgctagccccttggccgtgaaccttctggagaaaatgctggttttagacgctgaacagagagtaaccgcgggtgaagctttggcacatccctatttcgagagcctccacgacactgaggatgaacctcaggtgcagaaatatgatgacagtttcgatgatgttgaccgcacactcgatgagtggaaaagagttacctataaggaagtgttgtctttcaaacctccaagacagcttggagcacgggttagtaaagagactccgctgtag

SEQ ID NO: 29485 - DNA, 837 bp, Artificial Sequence
  Description of Artificial Sequence: Synthetic coding sequence
atggcacttctccccgtgctttttttggtcacggttctgctgccatccctcccagccgagggcaaggacccggctttcacggcccttctgactacccagctccaagtgcagagagaaattgtgaacaaacataacgagctcagaaaagcagtctcccctcccgctagcaacatgctgaagatggaatggtcaagggaggtcaccaccaacgcccagagatgggccaacaagtgtacactgcagcattctgatcctgaggatagaaaaacttctacccgttgtggtgagaatttgtatatgagctctgaccccaccagctggtctagtgctatacaatcttggtatgatgaaatcctcgattttgtctacggtgtgggacctaagtcaccgaacgcagtggttggccattacactcagctggtctggtactcaacttatcaggtgggttgcgggatcgcctactgtccaaaccaggactccttgaaatactactacgtctgccagtactgccccgcaatgaagacatatcttaacaagcgggaaggcattaacgtgtggaaatgtttccttagactcagacatttccagctgcttcgaggcgagcagcttctcactttctccggaaataatatgaatcgcaaaaataccccttatcagcaaggaacgccttgtgcgggatgccccgatgattgtgataagggtctgtgcacaaattcttgccagtatcaggatctcctgtcgaactgtgactcattgaagaacactgccggatgtgagcatgagctgttaaaggagaaatgtaaagccacatgtctctgtgagaacaagatctactag

SEQ ID NO: 29486 - DNA, 459 bp, Artificial Sequence
  Description of Artificial Sequence: Synthetic coding sequence
atgcagcacgagaatgtgattggtttgctggatgtgttcactccggcttcatcccttagaaatttctacgacttctatctggtgatgcctttcatgcaaacggacctacaaaaaatcatgggcatggaattcagcgaggaaaagattcagtaccttgtgtaccagatgctgaaaggccttaagtacatacatagcgcgggtgtggtccaccgagacctcaaacccggaaatctggcagtgaacgaagattgtgagctgaaaatcctcgatttcgggctggcgaggcacgccgacgctgaaatgactggttatgtggtcactagatggtatagagcccctgaggtgattttaagctggatgcactataaccaaactggacaaatcttacacccagtccccgcaaccgacccacaggaaggcttccattccgcggtccccacaggtcagccccctgggtag

SEQ ID NO: 29487 - DNA, 1068 bp, Artificial Sequence
  Description of Artificial Sequence: Synthetic coding sequence
atgagtctcatacgcaagaaagggttttataaacaggacgtaaataagaccgcttgggagcttccgaagacctacgtttccccaactcatgtcggatctggagcatacggatctgtgtgcagtgctatcgataagaggagcggtgagaaggtcgccatcaagaagctgtccaggccatttcagtcagagatatttgcaaagagagcgtatcgtgaattactcttactgaaacatatgcaacacgagaatgtgattggactgctggatgtattcaccccagctagcagcctgcggaacttctatgatttttatctggttatgccctttatgcagaccgacctccagaaaataatgggaatggagttctcagaagagaaaattcagtatcttgtctatcagatgcttaaggggctgaaagacctgaagcctggcaatctcgccgtgaacgaagattgcgagcttaagatcttagactttggactggcaaggcatgccgacgcagaaatgactggatacgtcgtgaccagatggtatagggcccctgaagtcatcctctcctggatgcattacaaccagaccgtggacatatggtccgttgggtgtatcatggccgaaatgctaaccggcaaaacgctcttcaaaggcaaagactacctggatcagctgacacagattctgaaagtcacgggcgttcccggtaccgagtttgtgcagaagctaaacgacaaggccgctaagtcttacattcagtctctccctcaaactccccgaaaagactttactcagttattcccacgggcatcgccacaggcggctgatctactggagaaaatgttagaacttgatgtcgataagaggctgactgccgctcaggccttgacccacccgtttttcgagccttttagggatcctgaagaagaaactgaggcccagcaaccatttgacgatagcctggagcacgagaagttgaccgtggacgagtggaaacagcacatctacaaggaaattgtcaacttcagccccattgccaggaaggatagtagaaggcggtccgggatgaagttgtag

SEQ ID NO: 29488 - DNA, 774 bp, Artificial Sequence
  Description of Artificial Sequence: Synthetic coding sequence
atgtcactgatccggaagaaagggttctataaacaggacgtgaataagaccgcctgggagctacctaagacatacgtgtcaccgacacacgttgggagtggagcctacggctcggtgtgttctgccatcgataaacggagcggcgaaaaggtggccatcaaaaagctgagccgccctttccagtcagagatctttgcgaaacgtgcctatcgggaattgcttctgctgaagcacatgcaacacgaaaatgtaatcggactcctggatgtgttcactcccgcttccagcctgagaaacttttacgacttttacttagtaatgccctttatgcagaccgaccttcagaagataatgggcatggagttttcagaagagaaaattcagtacctagtgtatcagatgctgaagggcttgaagtacatccattcagcgggagtggtgcacagggatctgaagccaggaaatctggcagttaatgaagactgcgagctgaagattctcgatttcggactggcaagacacgcagacgctgagatgactgggtacgtagtgacacgctggtaccgggctcccgaggtgatcctttcatggatgcactataaccagactgggcagatcttgcaccccgtcccagcaactgaccctcaagagggattccactctgcagtgcccacagggcagcccccaggatgtggtcctgcaggggaagacgctggggctcgtcggggtcaagcacctgacggtcgagctggccctcatccctctcttctgtag

SEQ ID NO: 29489 - DNA, 933 bp, Artificial Sequence
  Description of Artificial Sequence: Synthetic coding sequence
atgtccttgatccgcaagaaaggattctataagcaggacgtgaataaaactgcttgggagctccccaagacgtatgttagccctacgcatgtggggtctggtgcctatggctcagtgtgctcagccatcgacaagcggtcaggagagaaggtggccataaagaagctctcccggccattccagagcgagatcttcgctaaacgggcttaccgggagctgctcctcttgaaacacatgcagcatgagaacgtaatcggcttacttgatgtgtttacacctgccagttccctgagaaacttttacgatttttatctggtcatgccctttatgcaaacagatctccaaaagattatgggaatggaatttagcgaggagaagattcagtatctggtctaccagatgcttaagggactgaagtacatccattcagccggtgtagtgcacagggatctgaaacccggaaacctggccgttaacgaagactgtgagttaaagatcctcgacttcggactggccaggcatgccgacgctgagatgacaggttacgtcgttacgagatggtatcgcgcacccgaggtcattctgagttggatgcactataaccagacagttgatatttggagcgtgggttgtattatggctgaaatgttgactggtaagacactgttcaaggggaaagattacttgctcgagaagatgctcgaactcgacgtggacaaaaggctgacagccgctcaagccctaacgcacccattcttcgaacccttccgcgaccccgaagaagagactgaagcccagcaaccattcgatgactcacttgagcacgaaaagctgacagtggacgagtggaagcagcacatatataaggagatcgtcaacttctccccaatagccagaaaagacagccggagaagatccggcatgaaattgtag

SEQ ID NO: 29490 - DNA, 1629 bp, Artificial Sequence
  Description of Artificial Sequence: Synthetic coding sequence
atgcccctgagggatgagaccttacgagaggtgtgggcctcagactctgggcacgaggaggagagcctcagtccagaagccccaagacgccctaagcagaggccagctcccgctcagaggctacggaagaaacgtaccgaggccccagagagtccctgtcccactggatctaagcctcgcaagcctggcgcaggcaggacaggacgacctcgcgaggagccttcccccgacccggcacaggctagagcgccacagacagtttacgcacgctttctaagggacccagaagctaagaagagagatcccagggaaaccttcctggtggcccgagccccagatgctgaggacgaggaagaggaggaagaagaagacgaagaagacgaagaggaggaggccgaagaaaagaaggagaagatcctgctacccccaaagaagcctttacgcgagaagtcctccgctgatctgaaggagagaagagccaaagcccagggccctcgtggggatctgggaagcccagaccctcctcctaagccgctgcgtgtcaggaataaggaagcccctgcgggagaagggacaaagatgcggaagacaaagaaaaagggaagcggcgaggccgacaaggatccctccgggtcacctgcatcggcaagaaagtcacccgctgccatgttcctggtcggagaggggagtcccgacaagaaagcacttaagaaaaaaggtacccctaagggggctcgtaaagaagaagaagaggaagaggaggcagcaacggttattaagaagagcaaccagaaaggaaaggccaaggggaagggcaaaaagaaggcgaaggaagagcgggcacccagcccacctgtagaggtggatgagcccagagagtttgtactgaggcctgcccctcagggcagaacagtccgctgtagactgacccgcgacaaaaagggcatggacaggggcatgtatccatcgtattttctccatctagacacagaaaagaaagtgtttctgctggctggcaggaagagaaagagatcaaaaaccgccaattacctcatcagtattgatccgactaacctgtctagaggaggggaaaatttcatcggcaagcttaggtcaaacctgctgggaaatcggtttaccgtgtttgataacgggcaaaaccctcagcgcggatacagcactaatgtggcctctctccgccaggaactggcagcggttatatatgagacaaatgtcttaggattcaggggccctcggaggatgacggtgataattcccggaatgtctgcagagaacgagcgggtccccataagacccagaaacgcctctgacggacttctggtaaggtggcagaacaaaaccctggagagcctcattgagttacacaacaagcccccagtgtggaatgacgacagtgggtcttacacactcaactttcagggtagggttactcaggcatctgtcaagaatttccaaatcgtacacgccgacgacccagactatatcgtgctacagttcggacgcgtagctgaggatgctttcaccctcgactacaggtatccactttgtgcgttacaggcctttgccattgccctgagcagctttgatgggaaactcgcctgcgagtag

SEQ ID NO: 29491 - DNA, 1083 bp, Artificial Sequence
  Description of Artificial Sequence: Synthetic coding sequence
atgtctcaggagagaccaacattctacagacaggaactgaataagaccatctgggaagtccccgaacgttaccagaatttaagtcccgtgggctccggcgcatatgggagtgtgtgtgccgctttcgatactaagacaggccttcgcgttgccgtgaaaaagctttccagaccattccaatctatcatacacgctaaacgcacttacagggagctgcgcctcctgaaacatatgaaacacgagaacgttatcgggctgctggacgtcttcaccccggctagaagtctggaggagtttaacgacgtttatcttgttacccacttaatgggggctgatctgaataatattgttaagtgccaaaagcttactgacgaccacgtacaattccttatctatcagatcctgaggggtctgaaatatatacacagcgcagacatcattcaccgggacctgaagccctccaatctggctgtcaatgaagattgtgagctgaaaattcttgatttcggcctggctcggcataccgacgatgaaatgactggctacgtggccacacggtggtacagagctccggagattatgctgaactggatgcactacaaccagactgtcgacatctggtccgttgggtgcattatggctgaactgctgactggacgcactttatttcccggtaccgatcatattgatcagctgaaactgattctgaggctcgtgggtaccccgggtgccgaactgcttaaaaaaatcagttctgagtcagcacgaaactatatccagagcctcactcagatgccaaaaatgaattttgctaatgttttcattggagctaaccccctcgccgtggacttgttagaaaagatgctggttctcgatagtgacaagcgtattacagctgcccaggcattggctcacgcctatttcgcgcaatatcacgacccagacgatgagccagtggccgacccttatgaccaatcatttgaaagccgggaccttctgattgacgagtggaagtctttaacatatgatgaagtcatcagttttgtccctccacctctggatcaagaagagatggagtcgtag

SEQ ID NO: 29492 - DNA, 924 bp, Artificial Sequence
  Description of Artificial Sequence: Synthetic coding sequence
atgagtcaggagcggcctacgttttatcggcaggaactcaacaagactatctgggaggttcctgagcggtatcagaatctctcacccgtcgggagtggggcatacggcagtgtctgtgcagcctttgacacaaaaaccggcttgagagttgcagttaaaaaactcagccggccttttcagagtattatccacgctaaacgcacctacagagagttaaggttgctgaagcacatgaaacacgagaatgtgatcgggcttctcgatgtttttactcctgcaaggtctctggaggagttcaacgatgtgtacctggtgacccacctcatgggggcagacctcaacaacattgttaagtgccaaaagctcacggatgaccatgtgcagttcttgatttatcaaatcttaaggggactgaagtacattcattccgccgatattattcaccgcgacctgaagccaagcaacttggccgttaatgaggattgtgagctcaagatcctggactttggcctcgcaagacataccgacgacgagatgactggctacgtggctactcgttggtacagggctcccgagattatgctgaactggatgcactataaccaaacagtcgacatatggagtgttggctgtatcatggcggaactgctcactggcaggactctctttcctggaacggaccatatcgaccagctgaaactgatacttcggttagtgggcaccccaggtgcagaactcctgaaaaagataagtagtgaatccctgtctacctgttggcggagatgcctgtattggactcagataagggaattacagagaccaaagcctctccatatgcctacccttcttagcactaccatcctcatgatgaatcaatggcccatcttaatgatttcccccttaaaagcgggaacgtcgttgtag

SEQ ID NO: 29493 - DNA, 852 bp, Artificial Sequence
  Description of Artificial Sequence: Synthetic coding sequence
atgaagcacgagaatgtgattggcctcctggatgtgttcacgccagccaggtccttagaggagttcaatgatgtgtatttggttacccacctgatgggagccgacttgaataacattgtgaaatgccagaaactgaccgacgatcatgtgcagttcctgatatatcagatcctgagaggactaaagtacatccattcagccgacatcatccaccgggacctaaagccttcgaacctggcagtgaatgaggattgcgaattgaaaatcttggacttcggtctggcacgccacaccgacgatgagatgaccggatacgtggcgaccaggtggtaccgggcaccagagattatgctaaattggatgcactataaccaaacggtagatatatggagcgtcgggtgcatcatggcagaactcttgacagggaggacgttgttccccggtactgatcacattgatcagctgaagcttatcctccgcctggtaggaacaccaggggcagagctgcttaaaaagatctcatctgagtctgcacgcaattacattcagagtcttacacaaatgcccaagatgaacttcgccaacgttttcatcggggcaaatccactagcagtcgatttactggaaaagatgctcgtcctcgactccgacaagcgcataaccgccgctcaggccctggcacatgcttattttgcacagtaccacgacccggatgatgaaccagtggccgatccttacgaccagtcgttcgaatcaagagatttgttaattgacgagtggaagtcgcttacctacgatgaagtgataagctttgtgccacctcccctggatcaggaagaaatggagagttag

SEQ ID NO: 29494 - DNA, 1140 bp, Artificial Sequence
  Description of Artificial Sequence: Synthetic coding sequence
atggccgctgctgccgctcaaggcggaggaggaggcgagcctagacgcactgaaggggtgggacctggggtccctggcgaagtcgagatggtgaaggggcagccatttgacgtcggacccaggtacacacagctccagtacataggggagggggcttatgggatggtatcatcagcatatgaccacgtgcgcaagactcgcgtggctattaagaagattagcccttttgaacaccagacctattgccagaggaccttgcgagagatccagatccttttacgcttccgacatgaaaatgtgatcggcattagggacatcctgcgcgcttctacactggaggctatgagagacgtctatatcgtccaagacctgatggaaacggatttgtataagctgctcaagtcacagcaactcagtaacgatcacatttgctatttcctctatcagatcctgagaggtttaaagtacatccattccgcaaacgtgctgcaccgggatctgaaacccagcaacctccttatcaacacgacctgcgacctgaaaatatgtgatttcggattggccagaattgcggatcctgagcacgatcatacaggatttcttaccgagtacgttgcgaccaggtggtacagggcacctgaaatcatgctgaactccaaagggtacacgaagtccatagacatctggtccgttgggtgcatcctggcagagatgctcagcaatagaccaatttttcccggtaaacattacctagaccagttgaatcatattctgggaattctggggtcaccgtcgcaggaagatctcaactgtattattaacatgaaggctcgcaactacctgcagagtttgcctagcaagaccaaggttgcctgggctaagctttttccgaagtccgatagtaaggcactcgatttattggaccggatgctcacgttcaaccccaacaaaagaatcacagtggaagaggccctcgctcatccctaccttgagcagtactacgatccaactgatgaacctgttgcagaagagcccttcaccttcgccatggagttggatgatcttcccaaggagcgcctaaaggagctgatttttcaggaaactgccaggttccagccaggggttctggaggccccttag

SEQ ID NO: 29495 - DNA, 1008 bp, Artificial Sequence
  Description of Artificial Sequence: Synthetic coding sequence
atggccgctgcggctgcacaaggaggcggtggtggagagccacgcaggacagaaggagtcggccctggggttccaggagaagtcgaaatggtcaagggtcagccctttgacgtggggcctcgttacacgcagctccagtacataggtgagggcgcttacggtatggtctcaagtgcatacgatcatgttcggaagactcgcgtagctatcaagaagatatccccgttcgagcatcagacctactgtcagcgcactttgagggagattcagattttactgcggttccgccatgagaatgtcataggtatccgggatatactgcgggcaagcaccttggaagccatgcgcgatgtttatatagtacaggatctgatggagacagatctatacaagttattgaagtcgcaacaattatccaacgaccacatttgttactttttgtaccaaattttgagaggtctgaagtacattcattcagcgaatgtgctgcaccgcgaccttaagccttccaacctgctcatcaacaccacctgtgatttgaaaatctgtgactttggtttggcccgaatcgccgaccccgagcacgaccacacaggttttttgacagaatatgtcgcgacacgatggtatagagcccctgaaattatgctaaacagcaaaggctacaccaaatcaattgatatatggagcgtaggttgcatattggcggagatgctaagtaaccggccaatttttccgggaaagcattacctggatcagctgaatcatattctcgccctagacttactggataggatgctcacctttaatccaaacaagagaataaccgtggaggaggctcttgcccacccatacctggaacaatactacgacccgaccgatgagccagtggccgaggaacccttcacgttcgctatggagctggacgacctgcccaaagagcggttaaaggagctgatcttccaggagaccgccaggttccaacccggtgtgttggaagcaccctag

SEQ ID NO: 29496 - DNA, 936 bp, Artificial Sequence
  Description of Artificial Sequence: Synthetic coding sequence
atggtcaaagggcaaccatttgacgttggcccaagatacacacagttgcagtacattggggaaggcgcttacggcatggtgtcatcagcgtacgaccatgtccgaaaaacacgggttgccatcaaaaaaatctcccctttcgaacaccagacctattgccagcggactctccgtgagattcaaatcttgctgaggttccggcacgaaaatgtgattggcatccgagacattctgagagctagcacgctcgaagccatgagggatgtatacatagtccaggatctgatggagacggacctctacaaactgctgaagagccaacaattgtcaaacgaccatatctgctactttctgtatcagattttgagggggctgaagtatattcatagcgctaacgttctgcaccgtgacctgaagccttctaaccttcttattaatacgacctgcgacttgaaaggctatacgaagagcatcgacatttggtctgtgggctgtatattggcagaaatgctgagtaaccgccctatcttccctggcaaacattatctggatcagctgaatcatattctcggcatcctaggaagcccatcgcaggaagatctgaactgcataataaacatgaaggctcggaactacctgcagtcccttccatcgaaaactaaagtggcctgggccaaactgtttcctaagagtgattctaaagccctggaccttctggatcgcatgctgacgttcaacccgaacaagcgcattacggtggaagaggccttagcgcatccatatctggagcagtactatgacccgactgacgagcccgtggcggaagaacctttcaccttcgccatggagctagatgacctgcctaaggagaggctgaaagaactgatttttcaggagacagcacgctttcagcccggtgtccttgaagcaccgtag

SEQ ID NO: 29497 - DNA, 1008 bp, Artificial Sequence
  Description of Artificial Sequence: Synthetic coding sequence
atggccgctgccgcagctcagggtggaggtggcggagagcctcgtaggacagagggagttggacctggcgtcccaggggaggtggagatggtgaaggggcagccattcgatgtcgggccaaggtatacgcagctgcaatatatcggagagggcgcatacggcatggtcagtagcgcctatgatcatgtgagaaagaccagagtcgcaataaagaagataagtccatttgaacaccagacgtactgccagcggactctgagggagatccagatcttgctgcgctttcgccatgaaaatgttattggaatccgagacattcttagggcgtctaccctcgaggctatgagggatgtttacatcgtgcaggatctcatggaaacagacttatacaagttactgaagagtcagcaacttagtaatgatcacatctgttatttcctgtatcagattctacgaggtctcaagtacatccattcagctaacgtactccatagagatttgaagccctctaacctgttgattaatacaacgtgcgacctaaagatatgcgacttcggcctagcacggattgctgatcccgaacacgaccacactggattcttgaccgagtacgttgcaacgcggtggtatagggcccctgagatcatgctgaatagtaaaggatatactaagtcgatcgacatttggagtgttggatgcatcctggctgagatgcttagtaaccgcccaatattccccggaaagcactatctggaccagctcaatcacattctggctttagatctcttagatcggatgttaaccttcaaccccaataaacggatcactgtcgaggaggccctggcccatccatacctggagcagtattatgatccgaccgacgaacctgtggccgaggagccattcactttcgccatggaactagatgatctccctaaagagaggttgaaagaactgattttccaagaaaccgctagatttcagcccggagtgctggaggctccctag

SEQ ID NO: 29498 - DNA, 1074 bp, Artificial Sequence
  Description of Artificial Sequence: Synthetic coding sequence
atggctgccgctgctgcccagggcggtggagggggtgagcccagaaggactgagggggtgggacccggtgtaccaggtgaagttgagatggtgaaaggccagccgtttgacgtgggtcctcgctatacccaactacaatacatcggcgagggcgcatacggaatggtttcaagtgcttatgaccatgtgagaaaaactcgtgttgcgattaagaaaatctcccccttcgagcaccagacctactgtcagcggacccttagagaaatccagattctgcttagattccggcacgagaacgtgatcgggatccgagatatcctaagagcatccaccctggaggctatgagggacgtttacattgttcaagatctgatggaaacagacttgtataagctcttgaaaagtcagcagctgagcaatgatcacatttgctacttcttgtaccaaatcttgcgcggacttaagtatatccactccgcaaatgtccttcacagagatctcaagccttccaatctgctgatcaacaccacttgcgatctgaagatttgtgactttggcctagcacggatcgcagaccctgaacatgaccacaccgggtttctgactgaatacgttgccacacgttggtaccgagcccctgagatcatgttgaatagcaaggggtacacaaagagcatagatatttggagcgttggatgcatcctggcagaaatgttgtcaaacagacccatatttcctggtaagcactacttggatcagctgaatcacatcctcggcatattaggaagcccctcccaggaggatctgaactgtatcatcaatatgaaggcacgcaactaccttcagtccctaccctctaaaaccaaagtggcatgggcaaaactgtttcccaaatctgactctaaggcgttggatttgctggaccggatgctcacttttaaccctaacaaaaggattactgttgaggaggctcttgcccacccatatcttgagcagtactacgatcccacagacgaggtgggccagagtcccgcagccgtgggcctaggagccggagagcaggggggaacctag

SEQ ID NO: 29499 - DNA, 798 bp, Artificial Sequence
  Description of Artificial Sequence: Synthetic coding sequence
atgcgggacgtctacatagtgcaggacttgatggagacggacctgtataaactcctgaagagtcaacagctctcaaatgaccatatctgctattttctgtatcagattctgcggggtcttaagtatatacatagcgcaaatgtactccatcgggatctcaaaccatcaaatttgcttatcaataccacttgcgacctgaaaatctgcgatttcggactggcgagaatcgctgaccctgagcacgaccacactggtttcctcacagaatacgttgcaaccagatggtatagagcaccagaaatcatgctgaacagcaaaggttataccaagtctattgacatatggagcgtgggatgtattttagcggagatgctttccaaccgaccaatattccccggaaaacactacctagaccagctaaaccacattttgggcattctggggagcccaagccaggaggatctgaactgcatcattaatatgaaagccaggaattacctacagagtctgccatctaagaccaaggtggcttgggcgaagttgtttcccaaatctgactctaaggcattggatctgttggatagaatgcttactttcaatcctaacaagaggatcacagtcgaggaagcattggcccatccctacttggagcagtactacgaccccaccgatgagcctgtcgctgaagagcccttcacttttgccatggaactggacgacttaccaaaggaaagactgaaagagctgatctttcaggagacagccagatttcagcctggtgtgctggaggccccttag

SEQ ID NO: 29500 - DNA, 1284 bp, Artificial Sequence
  Description of Artificial Sequence: Synthetic coding sequence
atgagccggtcaaaacgtgacaataacttttactctgttgaaatcggcgattccacattcacagtactcaagcgataccaaaacttaaagcccattgggtctggtgcacagggcatcgtgtgcgccgcttacgacgcaatccttgagagaaatgtggccattaagaaactttctcgacccttccaaaaccagactcatgccaagagagcctacagggaactggttctgatgaaatgtgtcaatcataagaacatcatcggtctgttgaacgtgttcacaccccaaaagagccttgaagagttccaggatgtatatatcgtaatggagcttatggacgcgaatctgtgtcaggtgatacagatggaactcgatcacgagcgcatgagttatcttctgtatcagatgctgtgcggtatcaaacacctacactctgctggaatcattcatcgggacctgaaacccagtaatatcgttgtaaaatctgactgtacacttaaaatcctggactttggcctcgcacggacggcgggaacttccttcatgatgacgccttacgtggttacaaggtactaccgtgctcccgaggttatcctgggcatgggatacaaggaaaacgtagacctctggagcgtgggctgtataatgggagaaatggtatgtcataaaatcctgttcccaggaagggactacattgaccagtggaacaaggtgatagagcagctaggtacaccatgccctgaattcatgaaaaagctgcagccaacagtgcgcacttacgtggagaaccgcccaaagtacgctgggtactccttcgaaaagctgttcccagatgtgttatttccagctgatagcgaacataacaaactgaaggcgagccaggcgagggacctactctcaaagatgctggttatcgatgccagcaagcgaatttccgtggacgaagcattacagcacccatacatcaacgtatggtacgaccccagcgaggctgaagcgccaccgcctaaaatccccgacaagcagctggatgaaagagagcacacgatcgaggagtggaaggagctgatctacaaagaggtcatggacctcgaggaaaggacgaagaacggcgtcatccgtggccagccgtcacccctgggggctgccgtaatcaatggtagtcagcatccctcatcctccagcagcgtgaacgatgttagcagcatgtctacggatcctaccttagcatcagacactgatagcagtctggaggcagccgctggtcccctgggctgctgccgttag

SEQ ID NO: 29501 - DNA, 657 bp, Artificial Sequence
  Description of Artificial Sequence: Synthetic coding sequence
atgagtcgctccaaacgtgacaacaacttttattccgttgagatcggggactccacttttacggtgctgaaaaggtaccagaacctgaaaccaattggctcaggcgctcagggcatagtctgcgcagcatacgatgctattttagagcgaaatgtggccattaagaagctgtcaaggccctttcagaatcagacccatgcaaaacgtgcctaccgggaactcgtgcttatgaagtgtgtgaatcacaaaaatatcatcggcctgctgaatgtctttaccccacagaaatcactcgaggagtttcaggatgtgtatatcgtgatggagttaatggacgctaatctctgccaggttatccagatggagttagaccatgaaagaatgtcgtacctgttataccagatgttgtgcgggattaagcatctacattccgcgggtataattcatcgggacctcaaacccagtaatatagtggttaagtctgactgcacactgaagatattagattttggactcgcccgaacagccggaactagtttcatgatgacaccatacgtggttacacggtattatagagcgcctgaggtgatactgggcatgggatacaaagagaacgggggaaggatgggcaagggaatcttcactcgtctccaatag

SEQ ID NO: 29502 - DNA, 1284 bp, Artificial Sequence
  Description of Artificial Sequence: Synthetic coding sequence
atgtcccgaagcaagagggataacaatttttactccgtggagatcggtgattccacttttacagtgctaaaaagatatcagaatctcaaaccgatcgggagtggtgcccaggggattgtctgcgccgcatatgacgccatcctcgaaagaaatgtcgccattaaaaaactcagcagaccttttcagaaccagacacacgcaaagagggcttacagagagttggttttgatgaaatgcgtgaatcacaagaacatcatcgggctccttaatgtgtttactccccaaaagagccttgaagagtttcaggatgtgtatattgtgatggagctgatggatgctaacctttgtcaggtgattcagatggaactggaccacgagaggatgtcctatctattgtaccagatgctctgcggaattaaacatcttcatagcgccggaatcatacatagagatctgaaaccctcaaatatcgttgtcaaatccgactgcacactcaagatcctagatttcggtcttgccagaacagccggaacatcattcatgatgactccctatgttgtgacccgctactatcgggctcccgaagtgattctgggaatgggctataaggagaatgtggacatctggagcgtcgggtgtatcatgggagagatgatcaaagggggagtcctgttccctggcactgatcatatagatcaatggaataaggtcatcgagcaacttggtaccccatgtcctgagttcatgaaaaagctccagcccaccgtgcgaacctacgtggaaaaccggccaaagtacgccggttattcattcgaaaaactgtttcctgacgtgctgttccccgctgattccgaacacaacaagctgaaagctagtcaagcaagggacctcctgagcaagatgctagttattgacgcatcaaaaaggattagcgtggatgaggcgctacagcatccctacataaatgtttggtacgatccctcagaagccgaggcccctcctcctaaaattcccgataagcaactcgatgagagagagcatacaattgaggagtggaaagagcttatctacaaggaggtgatggatttggaggaaaggactaagaacggtgtgattagggggcagccctctcctctgggtgccgcagttattaacggcagccagcacccgtctagctcctcttcagtgaacgacgtgtcaagtatgtcaaccgatcccacactggcctcagacacagattccagtctcgaggccgcagctggccctctaggctgctgcaggtag

SEQ ID NO: 29503 - DNA, 1155 bp, Artificial Sequence
  Description of Artificial Sequence: Synthetic coding sequence
atgtcccggtctaagcgggacaacaacttctatagcgtggagatcggggactctacatttaccgtcctgaaaagataccagaatctaaagcccatcggctcaggcgctcagggcatcgtgtgcgccgcatacgatgctatcttggaaaggaatgtagccattaagaaactgagccgtccattccagaatcagactcacgctaaaagagcatatcgtgagctggtcctgatgaagtgtgttaatcacaaaaacattattgggttgcttaacgtattcacccctcagaaaagtctggaggagttccaggatgtgtatattgtcatggagctaatggacgctaacttgtgtcaggtgatccaaatggagctggaccacgagagaatgtcctacttattgtaccagatgctttgtggaataaagcatctccactctgccggaatcattcaccgcgatctgaaaccgtccaacatcgtagtcaaatccgactgcaccctaaaaatactggacttcggactcgccagaacagccggtacaagtttcatgatgacaccttacgttgtcacccgttattacagggctcctgaggtgattcttggaatggggtacaaagagaacgttgatatttggagcgtcggatgtatcatgggcgagatgatcaagggaggtgtgctgtttcctggaacagatcatattgaccaatggaataaagtgattgaacaactcgggaccccttgcccagagttcatgaaaaaactgcagcccacagtgcggacctacgtggaaaatagaccgaagtatgcaggatacagctttgagaagttattcccagacgttctgttcccagcagattctgagcacaacaagcttaaggcatcccaagcacgggacttgttgtccaaaatgttagtgattgatgccagcaagcgcatcagtgttgatgaggctcttcagcatccgtacatcaatgtttggtacgatccatctgaggcagaggccccacccccaaaaatccctgacaagcagttagatgagcgcgagcataccatcgaggagtggaaggagctcatctacaaggaggtgatggacctggaagagagaacaaagaacggagtcatccgtggccagccgagcccactcgcacaagtccagcagtag

SEQ ID NO: 29504 - DNA, 1155 bp, Artificial Sequence
  Description of Artificial Sequence: Synthetic coding sequence
atgagtcggtcgaagcgagacaacaatttctattcagtggaaatcggcgattccacctttacagtcctcaaacgataccagaacttgaagcccattggctcgggcgctcagggcatcgtgtgtgccgcttatgatgcaatcctggagcggaatgtcgcaatcaagaaactgtcgcggccatttcaaaatcagacccacgccaagcgcgcataccgtgagttggtgcttatgaagtgcgtaaaccataaaaatatcatcggcctgctgaatgtgtttacccctcaaaaaagcctagaggagttccaagatgtgtacatcgtcatggaactcatggatgcaaatctgtgccaggtcatccagatggagctcgatcacgaacggatgtcttatttgttgtaccaaatgttatgcggaattaagcacctgcacagcgccggaataatacacagggaccttaagcccagcaatattgtggtgaagagcgactgcacgttaaagatccttgacttcggactcgcgcgaacagcagggacttcttttatgatgactccctacgtggtgacgagatactatcgggctcctgaagtgatcctcggcatgggctataaggagaatgtggacctctggtctgtgggctgcattatgggagagatggtctgtcacaagatactgttcccgggacgggactatatagaccagtggaataaagttattgaacagttgggcacaccctgtcccgagttcatgaaaaaattgcaacccaccgtgcgcacgtacgtcgagaatcgtcccaagtatgcagggtattcctttgagaaattgtttccggatgtgttgttccccgcagacagcgagcacaacaaactgaaagcctcccaagccagggaccttcttagtaaaatgctggtcattgacgcttccaagcgcatttccgtcgacgaagctctgcagcacccctatatcaatgtttggtacgacccaagcgaggccgaggcccctccacccaaaattcctgacaagcaactagacgaacgagaacacacaatcgaagagtggaaggaactgatctacaaagaagtcatggacctagaggagcgcaccaagaacggggtgattcgcggacaaccctcccccctggctcaagtgcagcaatag

SEQ ID NO: 29505 - DNA, 1284 bp, Artificial Sequence
  Description of Artificial Sequence: Synthetic coding sequence
atgagtcggagcaaaagggacaacaacttctatagtgtggagatcggcgatagtacatttaccgtgctcaagcggtaccagaatttaaaaccaatagggagtggcgctcaggggatcgtgtgcgccgcttatgacgccatactggagcggaacgtcgcgatcaagaagttgtcccgcccattccaaaaccagacacatgcaaagcgcgcttaccgggagctcgtattaatgaagtgcgtgaatcataagaacattatcggcctactgaacgtcttcaccccccaaaagagcctggaagagttccaggatgtgtatatcgtgatggaacttatggacgctaacctgtgccaagtaatccaaatggagctggaccacgagaggatgagctatctgttgtatcagatgctctgtggcatcaagcaccttcactcagccggaatcatccatagagacctgaaaccctctaacatcgttgtgaaatctgattgcacactgaaaatcttagattttggcttggcacgcactgcagggacctccttcatgatgactccctatgtggttacaagatactaccgcgctccagaagtcatcctcgggatgggttataaggaaaacgtggatctttggtctgtggggtgtatcatgggagaaatggtctgtcataagatcctattccccggtcgggattatatagatcagtggaataaagtaatcgaacagctgggaaccccatgtcccgagtttatgaaaaagcttcaaccaaccgtgcggacatacgttgaaaaccgcccaaagtatgctggttactctttcgagaagctttttccggatgtcctgttccccgctgacagtgagcataacaagctcaaggccagccaggcacgggatctgctgtctaaaatgctggtgattgatgcatcaaaaaggatctcagtggacgaagctctgcagcatccttacattaacgtgtggtatgacccgtcagaggctgaagcgcctcctcctaagattcccgacaaacaacttgatgaacgagaacacacaattgaggaatggaaggaattaatctacaaagaagtgatggatcttgaggaaagaaccaaaaacggggtgatcagaggccagccgtcacctctgggcgcagccgtgatcaacgggtcccagcacccctctagctcaagttcggtcaacgatgtgtctagtatgtcgaccgatcctaccctggcttccgataccgattcatcactggaggccgcagcgggacccttgggatgctgccgatag

SEQ ID NO: 29506 - DNA, 927 bp, Artificial Sequence
  Description of Artificial Sequence: Synthetic coding sequence
atgtcacgtagcaaacgggataacaatttttacagtgttgagattggtgacagtacctttacagtcttaaagagatatcagaatctgaagcccattgggtcaggcgctcaggggattgtgtgcgctgcgtacgacgccatcctggagagaaatgttgcgattaagaagctgtcaaggcccttccagaatcagactcacgctaaacgggcataccgagaattggtgctgatgaagtgcgttaatcacaagaacatcatcgggctcctgaacgtgtttacgccacagaagagtttagaggaatttcaggacgtctacatcgtaatggagctcatggatgccaacctgtgccaggtcatacagatggagctagaccacgaacgaatgtcttacttactttatcaaatgctgtgtggaatcaaacacctgcacagtgccggaatcatacacagggacctgaaacccagcaatattgttgtcaaaagcgactgtaccttaaagatcctggattttgggctggctagaaccgctggcactagtttcatgatgactccctatgtggtcacacgttattatagggcccctgaagtgatcctgggcatgggctacaaagagaatgcagacagcgagcataataaactcaaggcctctcaagctcgagacctgctctccaagatgctggtaatagacgcctctaagcgcatctctgttgacgaggccctacagcatccttacatcaacgtttggtacgacccttctgaggcagaagctccccctcctaagatccccgacaagcaattagacgaaagagagcacaccatcgaggaatggaaggagctgatatacaaagaagtcatggatctggaggaacgcaccaaaaacggagtcatacggggacagcccagcccattggctcaggtccagcaatag

SEQ ID NO: 29507 - DNA, 429 bp, Artificial Sequence
  Description of Artificial Sequence: Synthetic coding sequence
atgagtcggagcaaacgagataataacttctactccgtggaaatcggcgactcaaccttcaccgtactaaaaagatatcaaaacctcaaaccaatcggatctggagcccagggcattgtgtgcgctgcctacgatgccatcctcgagcggaatgttgcaataaaaaaactgagtagaccttttcagaaccagacccacgccaaaagagcgtaccgggaactggttctcatgaagtgtgtcaaccataagaacatcatagggcttctgaatgtattcacaccgcaaaaaagcctcgaggagttccaagacgtgtacatcgtgatggaactgatggatgcgaatctctgtcaggttattcagatggaactagatcacgaaagaatgagctacctattataccagatgctctgtggtatcaaacatttatag

SEQ ID NO: 29508 - DNA, 294 bp, Artificial Sequence
  Description of Artificial Sequence: Synthetic coding sequence
atgattataggcctcctgaacgtatttactccacaaaaatccttagaagagttccaggatgtatacattgtgatggagctcatggacgcaaatctatgtcaggtgattcagatggagctggatcacgagcgaatgagctacctcctgtatcagatgctgtgtggcatcaagcatctgcactctgctggcattatacaccgggatctgaagcccagtaatattgtagttaaaagcgattgtactctgaaaattctcgacttcggtctcgctcgtacagctggcaccagcttttag

SEQ ID NO: 29509 - DNA, 429 bp, Artificial Sequence
  Description of Artificial Sequence: Synthetic coding sequence
atgtctaggagtaagagggacaacaacttttattccgtcgagattggagactcaactttcacggtgctgaagcggtatcagaacctgaaaccgataggcagcggggcacagggcatcgtgtgtgctgcctacgatgcaattctcgagcggaatgtggctataaagaagttaagcaggcctttccaaaaccaaacacacgcaaaaagggcctatcgggagcttgtgctcatgaagtgcgtgaatcacaagaatattatcggcctgctgaacgtctttactccccagaagtctctggaggaattccaggacgtgtatatcgtgatggagttaatggatgccaatctgtgccaggttatacagatggagctggatcatgaaaggatgtcttacctcctgtatcagatgctctgcggcatcaagcacttatag

SEQ ID NO: 29510 - DNA, 1182 bp, Artificial Sequence
  Description of Artificial Sequence: Synthetic coding sequence
atgccgaaaaagaagcccaccccaattcagcttaacccagcccctgatggctcagccgtgaatgggactagcagcgctgaaaccaacctggaagccctgcagaagaagctggaggaactggaattggatgaacagcagcgaaaacgtctggaggccttcctgacccagaaacaaaaggttggggaactcaaagacgacgacttcgagaagatttctgaactcggtgccggaaatggcggagtagttttcaaggtttcacacaagccttccggtctggtgatggccaggaagctgatccaccttgagatcaagccggctattaggaaccagatcataagagagctgcaagttctccatgaatgcaatagcccttacatcgtcggtttctacggagctttttactctgacggggagattagtatctgcatggagcacatggacggtggcagcttggaccaggtgctgaagaaggccggacgaataccagagcagatcctggggaaggtctccatagccgtcattaagggcctgacttacttgcgcgaaaagcacaaaatcatgcaccgggacgtcaaaccctcaaacatattggtcaattctagaggggagatcaagctctgtgactttggcgtgtcgggacagcttatagactccatggccaactcttttgtgggaacgaggtcgtacatgtctcctgaaaggcttcagggcacacactatagcgtccagagtgatatctggtcaatgggtctaagcctagtcgaaatggccgtgggccgatatccaattccaccaccagacgctaaggagttggagctgatgttcggttgccaggtggagggtgatgctgccgaaacacctcctcgccctcgcaccccaggcaggcctctttcctcctacggcatggactctcgaccacccatggctatcttcgagctcctggactacatcgtgaatgagcctcctcctaagctgccctctggagtattctccctcgagtttcaggacttcgttaacaaatgtctaatcaagaaccccgcagagcgcgcagatctgaagcagctgatggttcatgccttcattaaaaggagcgatgccgaagaagttgactttgcaggatggctgtgtagcaccattggcctcaatcaaccgtctacgcctacgcacgcggcaggagtctag

SEQ ID NO: 29511 - DNA, 1203 bp, Artificial Sequence
  Description of Artificial Sequence: Synthetic coding sequence
atgctggctagaaggaagcccgttctgccagccttaaccataaatcccactatcgccgagggtccttcccccacctcagagggggcttccgaggcgaacctcgtcgatctccagaagaaattagaggagttggaactcgatgaacagcaaaagaaaagactggaggccttccttactcagaaggctaaagtaggagaattgaaggacgacgacttcgaaaggatcagcgaactgggagctggcaacggtggagttgtgacaaaggtccagcataggccctccgggttgatcatggcgagaaagctcattcatctggagatcaagccggctattagaaaccagatcattagggagctgcaggtcctgcatgaatgcaattcaccctatatcgtagggttttatggagccttttattcagatggggagattagcatctgtatggagcacatggacgggggatctctggatcaggttctgaaggaggccaagcgtataccggaagaaatactgggaaaagtgtccattgcggtattgcggggtttagcctatttgcgggaaaagcatcagataatgcatcgggatgtgaagccatccaatatattggtgaattctcggggagaaatcaagttgtgcgacttcggcgtgtcggggcaactgatcgattcaatggccaactctttcgtggggactcggtcatatatggcgcctgaacggctgcagggaacccactattctgtccagtccgacatatggtctatgggattgtctttggttgagctcgctgtcggacggtaccctatacccccacctgatgcaaaagaactggaggccatctttggaagaccagtcgtggacggtgaagaaggcgagccccactctatttcaccacggcctcgtcccccaggcagacctgtaagtggacatggcatggactcacggccagccatggcgatcttcgagctactggattacatcgtgaacgagccaccccctaagctgcccaacggagtgtttacccctgatttccaggaattcgtcaataaatgcctaatcaaaaatccggctgaacgggctgatttaaagatgctcactaaccacacatttatcaagcggtctgaggtggaggaagtagattttgccggatggctctgcaagacactgagactcaatcaaccaggcacccccacccgtacagcagtgtag

SEQ ID NO: 29512 - DNA, 1056 bp, Artificial Sequence
  Description of Artificial Sequence: Synthetic coding sequence
atgggagtgcagggcacattgatgtcccgcgaccagaccccacacttactaagcattctggggaagtctaagaggaaaaaagaccttcgtatttcatgtatgagtaagcctcccgcaccaaaccccacaccccctaggaatcttgattcgaggaccttcatcaccatcggcgaccggaatttcgaggtagaagccgacgacctcgtcaccataagtgagcttgggagaggagcctacggagtcgttgaaaaagtgcgacacgcccagtccggtacaattatggcggtcaaaaggatccgcgcaaccgtgaattcacaagagcagaagagactcctgatggacctggatatcaatatgcgcacagtagattgcttctacacggtaaccttctatggggcattattcagggagggagacgtttggatctgtatggagctgatggatacctccttggacaagttttacaggaaggtgcttgataaaaacatgacaattccagaagatatcctgggagaaattgccgtcagcatcgttagggcgctggagcatctacactcaaaactctcagttattcatagagacgtaaaaccctcaaacgttctgattaacaaggaaggccacgtgaagatgtgcgactttggcattagcggctacctggttgactcagtggccaaaactatggatgcaggatgcaaaccctatatggctccagaacggattaaccccgagttgaaccagaagggatacaatgtgaagagcgacgtgtggagtttagggattactatgatagaaatggccattctaagatttccttatgagtcctggggcacgccattccagcaacttaagcaggttgtagaggagcccagcccacagcttccggcagatcggttttccccagagttcgtggacttcactgcacaatgcctccgtaaaaacccggcagaacgtatgtcgtatctggaactaatggagcatcctttctttactctccacaagactaagaaaacagacatcgccgctttcgtaaaagagatactgggcgaggattcatag

SEQ ID NO: 29513 - DNA, 1044 bp, Artificial Sequence
  Description of Artificial Sequence: Synthetic coding sequence
atggaaagccccgcttcatcacaaccggctagtatgccacagagcaagggtaagtcaaaaaggaagaaagaccttcgcatctcctgcatgtccaagcctccagctccaaatcccacaccaccccgaaacctggattctaggaccttcattaccatcggcgaccgcaatttcgaggtggaagctgatgatctggttacaatatcggagctgggtcgaggcgcatacggcgtcgttgaaaaggttcggcacgcacagagcggcactattatggccgtgaagaggatcagagctacagttaacagccaagagcaaaaacggctgttgatggacctcgacattaacatgagaaccgtcgattgcttctacaccgttacattttatggcgctctgtttcgcgagggtgacgtttggatatgtatggaacttatggacacctctctcgacaaattctacagaaaggtgctggataagaacatgactattcccgaagacattctgggcgaaatcgctgtgtccattgtacgggctctggagcacctccatagtaaacttagcgtcatccatagagacgtcaaaccatccaatgtgctcatcaacaaggagggccacgtgaaaatgtgtgattttggaatctcaggctacctcgtggactctgttgcaaaaacgatggacgcaggatgtaagccttatatggccccagagagaattaacccagagttgaaccagaagggctacaacgtgaagtcagacgtatggagccttggaattaccatgatcgagatggctattttacggttcccatacgagagctggggcaccccgtttcagcagctcaagcaggtcgtcgaagaaccatccccacagctgcctgccgatcggttcagcccagaattcgtggacttcactgcacagtgcctgcggaagaaccccgctgagcgcatgtcctacctggagctgatggaacacccattcttcacccttcacaagacgaaaaagaccgatattgcagcctttgtcaaagagatccttggcgaagattcttag

SEQ ID NO: 29514 - DNA, 957 bp, Artificial Sequence
  Description of Artificial Sequence: Synthetic coding sequence
atgagcaaacccccagcgcctaatcccacgccccctcgtaacctggactcccggacttttatcaccatcggggatcggaattttgaagtggaggctgatgatctggtcacaatctccgagctgggaagaggggcttacggagtggttgaaaaagtgaggcatgctcagtcaggaacaatcatggccgtcaagcggatacgggcaaccgtgaattcacaagaacagaagaggctcctgatggacttggacataaacatgagaactgtcgattgtttctataccgtgacattttacggggcactattccgggagggcgacgtctggatctgtatggagttgatggacactagcttggacaaattctaccgcaaagtgctggataagaacatgacaatccctgaggatatccttggggagattgcggtttctatcgtgcgggctctggagcatcttcactcgaagctgtccgtcatccacagggacgtgaagcctagtaatgtgcttatcaacaaagagggccacgtgaaaatgtgtgatttcggtatttctggttatctcgttgactccgtggcgaaaactatggacgctggttgcaaaccttacatggccccagagaggattaatcctgaactgaaccaaaaggggtataacgttaagagcgatgtctggagcctgggtattacaatgattgaaatggcgattctacgtttcccctacgagtcctggggcactccattccaacagctcaagcaggtagtcgaagagcctagtcctcagctacctgccgatcggttttcccctgaatttgtagacttcaccgctcagtgcctgagaaaaaacccagcggaacgaatgtcgtacctagaactgatggagcatccctttttcactctacacaaaacaaaaaaaaccgacattgccgcttttgtgaaagaaatcctgggggaagacagctag

SEQ ID NO: 29515 - DNA, 1113 bp, Artificial Sequence
  Description of Artificial Sequence: Synthetic coding sequence
atgctttcaaactcccaggggcaatcccctccagtgccttttccagcccctgctcccccaccccagccgccaactcccgctctccctcacccgccagcccaaccccctccccctcctccccagcagttcccccagttccacgtgaagagcgggctacaaatcaaaaaaaacgcgattattgatgattataaagttacctcccaggtactgggactcgggattaacggcaaagtgcttcagatctttaataaaagaactcaggaaaaattcgcattaaagatgctacaggactgcccaaaagctcggagagaggtcgagctgcattggcgtgccagccagtgtccgcacatagtccgaatcgttgacgtttatgagaatctgtatgctggcaggaagtgtctgcttatagtgatggaatgcctcgacggcggtgagctgttttcccgcattcaagacaggggtgatcaggcgtttacagagcgggaggcaagcgaaatcatgaaatctatcggggaagcaatccagtacctgcactcgattaacatagcccatagggatgtgaaacccgagaaccttctctatactagcaaacgcccaaatgctatcctcaagctgacggacttcggattcgccaaggaaactacatcccacaacagcctcactacaccttgctacactccttattatgtagcgcctgaggtgctgggacccgaaaagtacgacaagagctgcgacatgtggtctctgggtgtcatcatgtatattttgctgtgcggatatccccctttctatagcaatcatggcctcgctatatctccaggaatgaagaccagaataagaatgggtcaatacgagtttcctaatccagagtggtcagaggtcagcgaggaggtgaagatgctgattaggaacctcctgaagaccgagccaacccagaggatgaccataactgagttcatgaaccatccctggatcatgcagtctacgaaggtgccccagacacccctacatacaagcagggttctcaaagaggacaaggagaggtgggaggacgtgaagggatgtctgcacgacaaaaacagtgaccaggcaacctggctgactcgactttag

SEQ ID NO: 29516 - DNA, 1203 bp, Artificial Sequence
  Description of Artificial Sequence: Synthetic coding sequence
atgctctccaactctcagggacagagtcccccagtgccattccccgctccggcacccccaccccaaccacccactcccgctttgccacatcctcccgctcagccgcctcctccacctccacagcagtttccccagtttcacgtcaaaagcgggctgcagatcaaaaaaaacgctatcattgacgactacaaggtcacttcccaggttctgggcctcggtattaacggcaaagtgctgcagatttttaataagcgaacgcaggaaaaattcgccctcaaaatgcttcaggattgccccaaagccaggagagaggtggaacttcattggagagccagccagtgcccccacattgttcgcatcgtggacgtgtatgaaaacctgtacgctggtcgcaagtgccttctgattgtaatggagtgcctggatggcggagagcttttttcgaggatccaagaccggggagaccaagcatttaccgaacgagaagcatctgaaatcatgaaaagcattggcgaggccattcagtacctccactctatcaatatagcccaccgggatgtgaagccagaaaatctgctatacacctcaaaacgacctaatgccatccttaaactaactgattttggatttgctaaggaaacaacaagtcataactccttgactaccccatgttacaccccttattatgtcgcaccagaggtgctgggaccagaaaagtacgataagtcatgcgatatgtggtccctgggggttatcatgtacatccttctgtgtggctatcctcctttctattcaaatcatggccttgccattagtccgggaatgaagacccgcatccgcatggggcagtatgaattcccaaaccccgagtggtctgaggtgtctgaggaggtgaaaatgctaattagaaacttgcttaaaactgagcctactcagcggatgactatcaccgaatttatgaaccacccgtggatcatgcagagtaccaaagtgccacaaacaccgctgcatacttctagagtgcttaaagaggataaagagcgctgggaggacgttaaggaggagatgacatctgcacttgctacgatgcgtgtcgactatgagcagattaaaatcaagaagatagaagatgccagcaacccactcttgcttaaacgcagaaagaaggctcgcgcactcgaagcggcagccctggctcactag

SEQ ID NO: 29517 - DNA, 1149 bp, Artificial Sequence
  Description of Artificial Sequence: Synthetic coding sequence
atggacggtgaaactgcagaggagcaggggggacctgtcccgccacccgttgccccaggtggccctggacttggaggagctcctggcggaaggcgggaacccaagaagtacgctgttactgacgactaccagcttagtaaacaagtgctcggtctcggagttaatggaaaagtcctcgaatgcttccatcggaggactggccagaagtgcgctttaaaactactgtatgatagtcccaaagcacggcaggaggtcgatcaccactggcaggcttccggcggaccacacatcgtctgtatcctggacgtatacgaaaacatgcatcatggtaagcgctgcctattaatcataatggaatgcatggagggtggcgagctgttcagtcgaatccaagagcgaggcgaccaggctttcaccgaacgggaagctgccgaaatcatgcgggatatcggaaccgctatccaattcttacatagccataacatcgctcaccgggacgtgaagcctgagaacctgctgtacacttccaaagagaaggacgcggtgttgaagttgaccgatttcgggttcgcaaaggagaccacccagaacgcattgcaaacgccatgttatacgccctattacgtcgcgccagaagtgttaggtcccgagaaatatgataagtcttgtgacatgtggagtcttggagtgattatgtacattctcctgtgtggttttccaccattctatagtaataccggtcaggctatttctcccggtatgaaacggaggatccggctgggacagtacggctttcctaatcccgagtggtcagaagtgtccgaggacgccaagcagcttatacgcttgctcctgaagacagacccaaccgaaagactgaccatcacccaattcatgaaccacccatggatcaatcagagcatggtcgtcccacagactcccctgcatacagcccgtgtgcttcaagaagataaggatcactgggacgaggtgaaagaagaaatgactagtgccctggcaacgatgcgagtagactacgaccaagtgaagattaaagacctgaagacaagtaacaaccgtctgctgaataaacggcgtaagaagcaggcgggaagctcttctgcctcccagggatgcaataaccaatag

SEQ ID NO: 29518 - DNA, 999 bp, Artificial Sequence
  Description of Artificial Sequence: Synthetic coding sequence
atggacggggaaactgctgaggaacagggcggtccggtcccaccacccgtggcccctggcggtccagggttgggtggagctcctggcggtcggcgagaacccaagaaatatgccgttactgacgactatcaactttccaagcaggtgctggggcttggcgtgaacgggaaggtgcttgaatgttttcaccggaggaccgggcagaagtgtgctctgaagctgctttatgacagtcctaaagccaggcaggaagtggaccaccattggcaggcatcgggcggaccgcacatcgtgtgcattctggatgtgtacgaaaatatgcatcacggcaaacgatgcctcctgatcataatggaatgtatggagggcggtgaattgttcagtaggatccaggagagaggcgaccaggccttcacagaaagagaagcggctgaaattatgcgcgacattggaactgctatccagtttctgcatagtcacaatatcgcacaccgggacgtcaaaccagaaaatctgctctatacctccaaagagaaggacgcggtgctgaagcttactgattttgggtttgccaaggagaccacccagaacgccctgcagacgccatgctacacgccttattacgtcgcgccagaggttctcgggccagagaaatatgacaagagttgtgacatgtggtccctgggcgtcattatgtacattctgctgtgcggcttccctccgttttatagcaatactggacaggctatatcccccggaatgaaaagaaggatccggctgggtcagtatgggttccctaaccctgagtggagcgaggtttccgaggacgcaaaacaattgatccggttacttttgaaaacagaccccaccgagagactcacaatcactcagttcatgaatcatccttggattaatcaaagcatggtggttccgcagacaccacttcataccgcacgtgtgttgcaggaagacaaggatcactgggacgaagtgaagtag

SEQ ID NO: 29519 - DNA, 1149 bp, Artificial Sequence
  Description of Artificial Sequence: Synthetic coding sequence
atggacggcgagacggcggaggagcagggaggcccagtcccccctcccgtggctcctgggggaccagggctggggggtgcccctggtgggagacgggaacctaagaaatatgctgtcaccgacgactaccagctcagtaagcaagtcctgggcctgggcgttaacggcaaggtactagagtgttttcaccggagaacagggcagaagtgcgccctcaaacttctctacgattctccaaaggctcgacaggaagttgaccaccactggcaggcgagcggcggaccccatatcgtatgtatcctggatgtctacgaaaatatgcaccacggcaagcgctgtttgttgattataatggagtgcatggagggtggcgagctgttttccaggatccaggaaagaggggaccaagccttcactgagcgggaggccgcagagataatgagggacattgggaccgccattcagtttctgcactcccacaacattgcacatcgcgacgtgaagccggagaatctcctgtatacgtctaaagagaaggatgccgtgcttaaactgacagattttggatttgccaaagaaacaacacagaacgcattgcaaaccccttgctacaccccatattatgtagccccagaagtgttaggacctgagaagtatgacaagagttgtgacatgtggtcactcggtgtaataatgtatatcctcctgtgcggatttcccccattctactcgaatacagggcaggcgattagcccaggtatgaaacgccgaatacgcctgggccagtatgggttcccgaatcccgaatggtcagaagttagtgaggatgcaaagcagctgattaggctgctgctgaagacagatcctactgagcgtttgaccattacacagttcatgaatcacccttggattaaccaatccatggtggtgccacagacccctctgcatacagctcgcgtgctacaggaagacaaagaccattgggatgaagtgaaggaagaaatgacaagcgcgcttgccactatgcgggtggactatgaccaggtgaaaatcaaagatctcaagacctcaaacaacaggttgctaaataaacgacgaaagaagcaggctggatcttccagtgcatcccagggctgcaataaccagtag

SEQ ID NO: 29520 - DNA, 360 bp, Artificial Sequence
  Description of Artificial Sequence: Synthetic coding sequence
atggacggcgaaaccgcggaagagcaaggcggtcccgtgccccctcccgtggcccctgggggacccggtttaggaggagctcctggcggacgaagggaaccaaagaaatacgcagttacagacgactatcagttaagcaagcaggtactgggtctgggggtcaacggcaaggtcttagagtgctttcatagaagaaccggacagaagtgtgcactgaagctgctgtacgactcgccgaaggccagacaggaggtcgatcaccactggcaagcctccgggggtccccacatagtctgtatccttgacgtgtacgagaatatgcaccacggcaagcgttgtcttctcatcattatggagtag

SEQ ID NO: 29521 - DNA, 1422 bp, Artificial Sequence
  Description of Artificial Sequence: Synthetic coding sequence
atgagtgaggaaagcgacatggacaaggcaattaaggaaacctcaatccttgaggaatactcaattaattggacccagaaacttggtgccggtatttccggcccagtccgggtctgcgtgaagaagagcacccaggaacgctttgctttgaaaatcctgctcgataggccaaaagccagaaatgaagtccgtctgcacatgatgtgtgcaacccatcctaatatagttcagataattgaggtttttgccaattctgtacagtttccccatgagagttcgccccgagctcgccttttaatcgtcatggaaatgatggagggaggcgagctgttccacaggatcagccagcatcggcatttcacagagaagcaggcatctcaggtgactaagcagatagccctcgctctacgccactgtcaccttttgaatatagcacaccgcgacttgaagccagaaaatctcctcttcaaagacaattccctggacgctccggttaagctttgtgattttggctttgccaaaatcgatcaaggagatctcatgactcctcagtttaccccgtattacgtcgcaccacaggtgctcgaggcccagcgacggcaccagaaggagaagtccggtataatacccaccagtcctactccctatacgtataacaagagctgcgatctctggtcactcggcgtgattatctatgttatgctgtgtggctacccccctttctactcaaaacaccattcccgcacaatccctaaggacatgcggaggaaaattatgaccggctcatttgagtttcctgaggaggaatggtcccagattagcgaaatggcaaaggacgtggtgagaaagctactaaaggttaagcctgaggaaaggctcaccatagaaggggtgctagatcacccgtggctcaacagcacagaggcacttgacaatgtgttaccctcagcacagctcatgatggataaggcggtcgtggctgggattcagcaggctcatgccgaacagcttgcaaatatgagaatccaggacttgaaagtcagccttaaaccattgcactcggttaacaaccccatcctcaggaagcgaaagctcctcgggacgaagcctaaagactccgtgtatattcacgaccatgaaaatggagctgaagacagtaacgtggcactggagaagctacgggacgtcatagcacagtgtattctgccccaggccggaaaaggtgaaaatgaggacgagaaactgaatgaggtcatgcaggaagcttggaaatacaatcgggaatgcaagctgctgcgcgacactctgcaaagcttttcctggaacggacggggtttcacagacaaggtggatcgactgaaacttgcagagatcgttaaacaggtgatcgaggagcaaaccacctctcacgagtcccaatag

SEQ ID NO: 29522 - DNA, 1416 bp, Artificial Sequence
  Description of Artificial Sequence: Synthetic coding sequence
atgtctgaagaaagtgacatggacaaagccattaaggaaacttctattctcgaggagtattcaataaactggacacagaaacttggtgcaggaatttctggtcccgtgagggtgtgtgtcaagaaatcaacccaggagagatttgctctaaagatccttctggatagacctaaggcgagaaacgaggttaggttgcacatgatgtgtgctacgcaccctaatattgtacaaattattgaggttttcgccaattctgtgcaatttccacacgaatccagcccacgtgccaggttacttatagtgatggagatgatggaaggaggggaactgttccatcgcatatcccagcataggcacttcactgagaaacaagcttcacaggttaccaaacaaattgccttagccctgcgtcattgtcatctgctgaacatcgcccacagggatcttaaacctgagaatctcctgtttaaggacaacagtcttgatgctccggtaaagctatgcgactttggcttcgctaaaattgaccagggcgatttgatgaccccgcagtttactccctactacgtggcccctcaggtactagaggcccagagaagacatcagaaggaaaaaagcggtataatccccacttcccctactccatacacttataataaatcctgcgacctgtggtccctgggggtgatcatttacgttatgctgtgcggatatccgccattttactccaagcaccacagccgtacaattccaaaggacatgcgacgaaagatcatgaccggatcatttgaatttccagaggaagagtggtcccaaatttctgagatggcaaaggatgtggtgaggaaactcctgaaggtgaagccggaagagcgcctcaccatcgaaggagtcttagaccatccatggctgaactctaccgaggccttggataacgtgttgccttcagcacagttaatgatggataaggccgtggtagcaggtatccagcaggcgcacgctgagcagctagctaacatgcgcatacaggatcttaaggtaagcctgaaacccctccacagcgtaaataacccaattcttaggaaacggaaactcctgggaaccaagcccaaagactcagtgtatattcatgaccatgagaacggtgcagaggacagcaacgtggcgctggagaaactccgggacgtcattgcgcagtgcatcttgccacaggccggagagaatgaggatgagaaactgaacgaggtgatgcaggaggcatggaagtataatcgtgaatgtaaattactacgggacactctgcagagtttcagctggaacggtagaggcttcaccgataaggtagacagattaaaattggcagagatcgtaaagcaggttattgaagaacaaactacatcccacgagtctcagtag

SEQ ID NO: 29523 - DNA, 1416 bp, Artificial Sequence
  Description of Artificial Sequence: Synthetic coding sequence
atgtccgaggagtccgatatggataaggcgattaaggaaacctcaatcctggaggaatatagcatcaactggacacagaagctaggcgcagggatcagcggccctgtgcgggtatgtgtgaagaaatccacacaggaacgcttcgccctgaaaattttgctagataggccaaaggctaggaacgaggttagactccatatgatgtgcgccacacatcccaatatcgtacagatcatagaggtatttgccaacagtgttcaatttccccacgagtcaagtcccagggcaagactcctgattgtgatggagatgatggagggtggcgagctgtttcacagaatttctcagcatcgtcatttcactgaaaagcaggcctcccaggtcaccaagcaagccacccttgcacttcgccactgtcaccttctgaacatcgcacatcgggacctgaaaccagaaaaccttttgttcaaggacaacagccttgatgccccagtgaagctgtgtgacttcggctttgccaagatcgatcagggagacctgatgactcctcagttcactccatattacgtggcgcctcaagtgctggaagcccagcgtcggcaccaaaaggagaaaagcggcataatccccacctctccaaccccttatacttataacaagtcatgcgacctctggagtctcggcgtgatcatctatgtcatgctttgtgggtatccccctttctactcaaagcaccactcgaggacgatcccaaaggatatgagacggaagatcatgaccgggtcgttcgaattcccagaagaggagtggtcccagatctccgagatggcaaaggatgtcgtaaggaagcttcttaaagtgaagcctgaagagaggctgaccatcgagggggtactcgaccatccttggctcaatagcacagaggctctggacaacgtgctcccctcagcccagctgatgatggacaaggctgtggttgcgggtattcagcaagcgcatgccgaacagctggctaatatgcggatccaggatcttaaagtgtctctcaaaccattgcactccgtgaataaccctatcctgcgtaaaagaaaactcttaggaaccaagcctaaagacagcgtttacatccatgaccacgagaatggagccgaggacagcaacgtggccctggagaaactgcgcgacgtgatcgcacaatgcatcctgccacaagctggcgaaaacgaggatgaaaaattaaatgaagtgatgcaagaggcttggaagtacaaccgggagtgcaaactgctacgcgatactctgcagtcattctcatggaatgggagaggatttaccgataaggtggacaggctgaagttggcggaaatcgtgaaacaggtaatcgaagagcagaccacatcgcacgagtctcagtag

SEQ ID NO: 29524 - DNA, 1422 bp, Artificial Sequence
  Description of Artificial Sequence: Synthetic coding sequence
atgagtgaagagtccgacatggacaaggcaataaaggagacatcaatactggaggaatactccattaattggactcagaagttgggagcgggtattagcgggcctgttcgagtttgtgtgaagaagagcacccaagagcgctttgctctgaagatccttctcgatcggccaaaggccagaaacgaggtgcgactgcatatgatgtgcgcaacccacccaaatatcgtccagatcatcgaggtgttcgcgaattcagtacagttcccccatgagtcctcccctcgggctcggttactgattgtgatggagatgatggaagggggtgaactcttccacaggatatctcaacaccgccatttcactgaaaaacaggccagccaggtgactaagcaggccaccttggctctcaggcattgtcacctgctcaatatagctcatcgtgatctgaaacccgaaaacctgctcttcaaggataactcgttggacgcccctgtgaaactgtgtgattttggatttgccaaaattgaccaaggtgacttgatgactccgcagttcacaccatactacgtcgcaccccaagtcctcgaggcacagaggcgacaccagaaagagaaaagcggtatcatccctaccagccccactccatatacgtacaacaaatcctgcgacctatggtctctcggcgtcataatatatgtgatgctgtgtggataccccccattctactccaagcaccactcccgtaccatccctaaagacatgagaagaaaaatcatgacgggatctttcgagttccctgaggaggagtggtcgcaaatcagcgaaatggcaaaagatgtagtgcgaaaactgctcaaggtgaagccggaagagcggcttacaatcgaaggtgtgttggatcatccatggttaaatagcacggaagccctggataatgtcctgccaagcgcgcaacttatgatggataaagccgtggtagcagggatccagcaagcccatgcagaacagttggctaacatgcgcatccaagatctaaaagtgagcctcaagccactgcactctgtcaacaaccctatcctgcgaaagagaaaacttctgggcaccaaacccaaggattccgtgtacatacacgatcacgagaatggcgcagaggactcaaacgtggctcttgagaagctccgtgacgtgatagcacagtgcatactgccccaagctggaaaaggtgagaacgaggacgaaaaactaaacgaagtgatgcaggaggcatggaagtacaaccgtgagtgtaagctactgcgagacacactgcaaagctttagctggaacggtcggggatttactgataaagtcgatcgcctgaagctggcagagattgtgaagcaggtgattgaagagcaaaccacatcccacgaatcccagtag

SEQ ID NO: 29525 - DNA, 2799 bp, Artificial Sequence
  Description of Artificial Sequence: Synthetic coding sequence
atggcagccgcagctgcagtggaagccgcagctcctatgggcgctctttgggggctggtacatgatttcgtagtgggacagcaggaggggcctgccgatcaggtggcagccgacgttaaatctggaaactatacagtgctgcaagtggtggaagccctggggagctcattagagaacccagagccacggacgcgtgccagggccattcagctcctgagtcaggtgcttctgcattgccacacattacttctcgaaaaggaggtcgtgcacctcatcctattttatgagaacagactgaaggatcaccacctcgtgattccctccgtactgcaggggctgaaggccctctccttgtgtgttgctctgccgccaggcctggccgtgtcagttctaaaggccatctttcaggaggtgcacgtgcagtctctaccccaggttgacagacacacagtgtataatataatcacgaattttatgagaacgcgcgaagaggaacttaagtccctcggggcagacttcacctttggctttatccaggtgatggatggggagaaagatcctcgaaatctgctcgtagcgttccgaattgtgcacgacctgattagcagagactatagcctgggacccttcgtggaggagctgttcgaggtcacttcttgctatttcccaattgactttaccccacctcctaatgacccgcatggaatccaacgcgaggacctgattctgagtctcagggcagtgctcgctagcaccccaagattcgcagaattcctgctgccactgctgatagagaaagtcgacagcgaggtgctcagcgcaaagctggattcacttcagacccttaacgcctgctgcgctgtctacggtcagaaggagttgaaggattttctgccttccctttgggcttccatccggcgagagtcatcccagagacgcactatcctagagatgttgcttggcttcctcaagctgcaacaaaagtggagctatgaagataaggatcaacgacccctgaatgggtttaaggatcagctgtgtagtttagtgttcatggcgctcacagacccctccacccagttacaactggtcggtatcaggaccttgacggtgctgggcgctcagcctgacctgctgtcctatgaggacctggaacttgccgtgggacatctctatcggctctctttcctaaaagaagactcacagtcctgtcgcgtggccgcacttgaggctagcggcaccttagccgcactttatcccgtggccttctccagccatttggtccccaaactagcggaggaactcagggtgggggaaagtaacctcaccaacggggacgagcccactcagtgcagtcgccacctgtgctgcctgcaggccttgtccgccgtaagcacccacccttccatcgtgaaggagacccttcctctgctgttgcaacacctgtggcaagtgaatagaggtaacatggtggctcagtcctccgacgttattgctgtctgtcagtccttgagacagatggcagagaagtgccagcaggacccggagtcttgctggtactttcaccagacggccataccctgcttgctggccctggcagtacaggcttcaatgcccgaaaaggagccaagcgtgttgaggaaagttctcttggaggatgaggtgctcgcagccatggtgtccgtgatcgggactgcaaccacccacttgtcccctgagctggccgcacaatcagtgactcatattgtgcccctcttcctggacgggaacgtgagctttcttcccgaaaactccttcccatccagattccaacctttccaggacgggagcagtggacaacgaagactgatcgctctcctgatggctttcgtgtgctccttgccccgaaacgtggaaataccccagctaaaccagctgatgagagagctgctggagctcagctgttgccactcttgcccctttagcagcaccgccgcagcaaagtgcttcgcgggactgctgaataaacatccagccggacagcagttggacgaatttctgcagcttgcagtggacaaagtagaggccggactcggcagtgggccatgcaggagccaggccttcacccttctgttatgggtgaccaaggcactcgtcctgcgctaccatccactatcctcttgtctgaccgctcgtctcatgggtctcctgagtgatccagagctggggccagctgccgctgacggctttagcctcttaatgtcagactgtacagacgtactcacacgggctggccacgctgaagtacgaattatgttcaggcagcgtttttttaccgataatgttcccgcactggtccagggattccacgctgcgcctcaggacgtcaagcccaactatctgaagggcctcagtcacgttctcaatcgattacccaaacctgtactcctgccagaacttccgacgctcctgagtcttcttctggaggccctctcgtgtcccgactgtgtcgtgcagctgtctactctgagctgtcttcagcccctgctcctcgaagctccacaggtgatgagcttacatgttgatactttggtgacgaaatttctaaatctgagctccagccccagcatggctgtgcggatcgccgcacttcagtgtatgcacgcactcacccggctgccgacccccgtcttgctcccgtataaaccccaggtgatccgcgcattagctaagcctctcgatgacaagaaacgtttggtgcgcaaggaagccgtgtccgcccgaggggaatggttcctcctgggcagtcccggatcatag

SEQ ID NO: 29526 - DNA, 1092 bp, Artificial Sequence
  Description of Artificial Sequence: Synthetic coding sequence
atgctcctgggattcctcaagcttcagcaaaaatggtcatacgaggacaaagaccagagacctctcaatggattcaaggaccaattgtgtagcctcgtgtttatggcactcacagacccttccactcagctgcagttagtaggaatccgtacactcactgttttgggagcccagccagatctgctctcctacgaagacctggagctcgcagtggggcacttatatcgcttgagcttcctgaaggaagattcacagtcttgtcgggtcgccgctctcgaagcttccggcacactagctgccctctatccagtcgcatttagcagccatttagtccctaaactggctgaggaattgcgggtcggcgagagcaatctgaccaacggcgatgagccgacacagtgttctcgccacctgtgctgcttacaggcactgtcagccgtctccacccacccatcaatcgtcaaggagaccttacctctcctcctgcaacacctctggcaggtgaacagagggaacatggtggctcagagcagcgacgttattgctgtgtgccaatcgctaagacagatggcggaaaagtgtcagcaggaccccgagtcatgctggtatttccaccaaacagccattccctgtcttctggctctggctgtgcaggcaagcatgccagagaaggagccaagcgtgctccggaaggtcttgttggaggacgaagtgctggccgctatggtgtctgtgattgggactgcaacaacgcatctgtcccctgagttggctgcgcagtcagtgacccacatagtgcccctgtttctggacggaaacgtatccttcttgcctgaaaattccttcccgagccgatttcagcccttccaggatggatcctccgggcagcgccgactgatcgcattactgatggcctttgtatgtagcctgcctagaaatgtcgagatccctcagctaaatcagctgatgcgagaacttttggaacttagctgtaccgcagccccttttttgccaccactattgccatctgcactgcaagactccagtacttccacactgcagggatcttcatggatgaactcttatagttag

SEQ ID NO: 29527 - DNA, 1128 bp, Artificial Sequence
  Description of Artificial Sequence: Synthetic coding sequence
atgaagttggtatggcctagcgccaagcttcttcaagcagccgctggtgcctctgcgagggcctgtgatagcgtcacatccaacgtgctcccgctgctgctggagcaattccataagcatagccagtcctcacagcgtagaaccatcctggagatgttgttgggcttcctaaaattgcaacagaagtggagttacgaagataaggaccagaggcccctgaatggttttaaggaccagttatgctccttagtatttatggccttgacggatcccagcacacagcttcaactagtgggtatccggacactgaccgtactcggggcacaacccgacctgctctcctatgaggatttggagctggccgtgggccacttgtacagactttctttcctgaaggaagattcccagagttgtcgggtggccgctttggaggctagtggaacccttgccgcactatatccggtggcattcagcagccacctcgttccaaaactggctgaagaactcagggtgggcgaaagcaatctaaccaacggagacgagccaactcagtgctccaggcacctttgttgtcttcaggcattgagcgccgtgagcacccatcctagcattgtgaaggagacacttcctcttttgctccagcacctatggcaggtcaatcgaggcaatatggtggctcagtcttccgatgtgatcgctgtgtgtcaaagtctcaggcagatggccgaaaagtgccagcaggacccagaatcctgctggtactttcaccagacagctatcccgtgtttgcttgccctggccgttcaggcatcaatgccagaaaaggagcccagcgtcttacggaaagtgttgctcgaagatgaggtcctcgcagcaatggtttctgtgatcggtaccgccactacccatttatcaccagagttggcagctcagagcgtaacacatatcgtgccactgttcctcgacggcaatgtttcctttctgcccgagaactcatttccttcgcgctttcagccttttcaagtgactgatgggtcatcaggccagagacgtctgatcgcgctcctgatggcttttgtctgtagcctccctagaaatggatctagctggatgaattcctactcttag

SEQ ID NO: 29528 - DNA, 1128 bp, Artificial Sequence
  Description of Artificial Sequence: Synthetic coding sequence
atgaagctggtttggccaagcgctaaattgctgcaggcggcagctggcgcatctgctcgcgcatgcgactcagttaccagcaacgtgctaccactactcctggaacagttccacaagcacagccagagttcccagaggcgaacaattttggaaatgctgttggggttcctcaaactgcaacagaagtggtcttatgaagacaaggatcagagacctctcaacggctttaaggaccagctgtgttcgctcgtttttatggcccttactgacccctccacacagctccagctggtgggcataaggacactgaccgtcctgggcgctcagccagatctgcttagttatgaagatttggaactcgcagtgggacatttataccgcctgtcgttccttaaagaagatagtcagtcttgccgggtagccgctttggaagcatccggaactttggcagcactttacccagtagcctttagttcccacctggtacccaagttggctgaagaactgagggttggagaatcaaatctaactaatggtgacgagcctacccagtgtagccgtcacctctgctgtcttcaagccctttccgctgtgtctacacacccttcaatcgtgaaagagactttacccctgcttctccaacacctttggcaggttaataggggcaatatggtggcccaatcttccgacgtgattgccgtgtgccagagcttgaggcagatggctgaaaaatgtcaacaggatcccgaatcctgttggtacttccaccaaactgcaataccttgcctgctggctctggcggtgcaggcctcaatgcccgagaaagagcccagcgtgttgaggaaagtgttgctcgaagatgaagtgcttgcagctatggtgtcagtgataggcaccgctactacccatcttagccctgagttggcagctcaaagtgttacccatatagtccccttgtttctagatggcaacgtgtcttttctgccagagaattctttcccctccagatttcaaccattccaggtcactgacggttcaagtggccagcggaggctgatcgctttgttaatggctttcgtgtgtagcttaccaagaaatggttcctcgtggatgaacagctacagctag

SEQ ID NO: 29529 - DNA, 2964 bp, Artificial Sequence
  Description of Artificial Sequence: Synthetic coding sequence
atggccgctgcagccgcagtggaggctgccgcacctatgggggcactgtggggcctcgtgcatgactttgtggtgggccaacaggagggaccagctgatcaggttgccgcagacgtcaagagtgggaactataccgttctacaggtcgtcgaggcactgggatcaagccttgaaaatcccgagcctcggacgcgggctcgtgccattcagctgctttctcaggttttgctccactgtcatacattgcttctagaaaaggaggtggttcacttaatcctgttttacgagaaccgtttaaaggatcaccacctggtaatcccctccgtgcttcagggcctgaaggcattaagcctgtgtgtcgccctcccacccggtctggcagtgtctgtgctgaaggccatattccaggaagttcatgtgcagagcttgccacaggtagatcgccataccgtttacaatattatcacaaattttatgcgcacccgggaggaaggtcctttcgtggaggaactgttcgaggttacatcctgctacttccccatagactttacgccccctccaaatgacccacatggaattcaaagggaggatctcatactgtccctgagagcagtgttggccagtaccccacgattcgccgagtttcttctccctttgcttattgagaaagttgattctgaggtcctgagcgctaagttagactctctgcagacccttaacgcctgttgcgcagtgtacggtcagaaggaactcaaggatttccttccctcgctttgggcgtccataaggagggaagtgttccagaccgccagtgagagagtggaggctgagggcttggcagctctccactcactgaccgcctgtctcagccgttctgtgctgagagccgacgctgaagatcttctggactcctttctcagcaatatcctgcaggattgccggcaccacctttgcgagcccgacatgaagttggtatggccatcagccaagctcttgcaggctgcagccggagcatctgcacgggcttgcgatagtgtcacaagtaacgtgttaccgctactcctggaacagtttcataaacattctcagtcctctcagcgcagaaccatcctggagatgctgttgggtttcctgaagctccagcagaaatggagctatgaggacaaggaccagaggcctcttaatggctttaaagatcagctgtgcagcctggtatttatggcactgaccgaccccagcacacagctgcagctggtcggcatcaggacactgaccgtgctgggcgctcagcccgacctgttgtcgtatgaggatcttgaattggcagtcggccacctctatagattgtctttcttgaaggaagacagccagtcctgtagggtggctgccttagaagcaagtggtacgttggccgcactgtaccctgtggcattctcttctcatctcgttccgaaattggcagaggaactgagagtgggcgagtcgaacctcactaatggtgacgaacccacacaatgcagtcggcacttgtgttgtcttcaagcgctgtccgctgtatcgacgcaccctagtattgttaaggaaactctgcctctgctgctgcagcacttgtggcaagtcaacaggggcaacatggtggcccaaagctctgacgttatcgctgtttgccagtctctgcgccagatggcagagaaatgccagcaggatcccgagtcttgctggtactttcaccagacagctattccttgcctgctggccctggcagtacaagccagcatgcccgagaaggagccgtcggtcctgcgaaaggtgctgctcgaggatgaggtgctcgcagctatggtttcagtgatagggaccgccacaacccacctctcacctgaattagcggctcaatccgttacgcacatcgttcctctattcctcgatggtaacgtgtcattcctgccagagaattcatttcccagtcggtttcagccttttcaagacggcagcagcgggcagaggcgactcatcgctctgctgatggctttcgtatgttcgctgcccaggaacgtggagatccctcagctcaatcagctcatgcgagagctactcgaactgagctgctgccacagctgcccattctcaagtaccgcagccgctaagtgctttgccggattactcaataaacaccctgccggtcagcagcttgacgaattcctccaactcgccgtcgacaaggtggaggcgggtctcggcagcggcccttgtcgcagtcaagctttcacacttcttttgtgggtgacaaaagccctggtgctgcggtaccatcctctgtcctcatgcttaacggccagattgatgggcctgctctccgatcctgagttgggtccagcggcagctgatggtttctctctactgatgtccgattgtaccgacgtcctcacaagggccggtcatgccgaagttcgaattatgttccgacagagattcttcacagataatgtgccagcgcttgttcaggggttccatgctgcaccacaggatgttaagcccaactatctgaaggggctgtctcatgttttgaatcggttgccaaagcccgttctgctcccagaactccctacccttctgtcactgctgctcgaggctctgagctgtccagattgcgtcgtgcagctgtccacactttcctgtttacagcctctgctcctggaggctcctcaggtgatgtctctacatgtagataccttggtgacaaaatttctgaatctgtctagctctcccagcatggctgtacgaatagccgcacttcaatgtatgcacgcactgacacgattgcccacgcccgtgcttctgccttacaaaccgcaggttattagggccctcgcaaagccccttgacgataagaagagattagtgaggaaagaggccgtgtccgccagaggggagtggttcctgctcgggagccccggaagctag

SEQ ID NO: 29530 - DNA, 3093 bp, Artificial Sequence
  Description of Artificial Sequence: Synthetic coding sequence
atggccgcagctgccgctgtcgaagctgccgcacccatgggtgcactctggggattagtgcatgatttcgttgtgggccaacaggaaggcccagccgaccaggtggccgctgatgtgaaatccggcaattacacagtgctgcaggtagtagaggccctcggctcttccctggagaacccagagccaagaacacgcgcaagggctatccagcttttgtcccaggtgctcctgcattgccataccttgttgctcgaaaaggaggtcgtgcaccttattctgttctatgagaacagacttaaagatcatcacttggtaatcccaagcgtgttacagggactgaaggcactctccctctgcgtggctctgccaccgggactggcagtaagcgttctcaaggccatcttccaggaagtccacgtgcagtctcttccgcaagtagacagacacacagtctacaacattatcaccaactttatgagaacaagggaagaggagcttaagtcattgggagccgacttcacattcgggtttatacaggtgatggacggtgaaaaagatccacgcaatctgctagtcgccttccgcatagtacacgatttaatttctcgagattacagcctgggaccgttcgtggaagagctgttcgaggtcactagctgctatttccctattgacttcacaccacctcctaacgatccccatggcattcagagagaggacctaatactgtcactcagagccgtgctggcttctactccgagattcgccgagtttctcctgccgctgcttatcgaaaaagtggattctgaagtcctgagtgccaaacttgacagcctgcagaccctcaacgcatgttgcgccgtctatgggcagaaagaactgaaggattttctccccagcttatgggcctcaattcgcagggaggtttttcagactgcctccgagcgagttgaagccgaaggcttagccgcactacactccttgaccgcatgcctgagccgttccgtgctgagggccgacgcagaggacctgcttgattctttcctctccaatatcctccaggactgccggcaccatctatgcgaacccgacatgaaacttgtgtggccttccgcgaagctgctccaggccgcagcgggagctagtgctcgggcatgcgactccgtcactagcaatgtcttacctttgctccttgagcagttccacaaacacagtcagagttcacagaggcgcacgatcctggagatgttactggggtttttgaaactgcagcagaaatggtcctacgaagataaagaccagaggcctcttaacggattcaaggaccagttgtgtagtctcgtgtttatggctctcaccgatccaagcactcaattacagttggtaggaatccgaaccctcactgtgcttggcgctcagccagatctacttagctacgaggaccttgaacttgcagtcggacacttataccgtttgagtttcctgaaggaagactcgcagagttgccgcgtggctgctctagaggccagcgggactcttgccgctctttatccggtagctttttcttcccatctggtgccaaagctggctgaagagctccgagtgggtgaatccaacctgacgaacggcgacgaacccacccagtgctccaggcacctgtgttgcttgcaggccctcagcgcagtaagtactcatccttcaattgtaaaggagactcttccattgctccttcagcatctgtggcaggtgaaccggggtaacatggttgctcaatcttctgatgtgattgcagtgtgccagagcctcagacagatggccgaaaagtgtcagcaggaccccgaatcctgctggtacttccatcagacagctatcccttgtttactcgccctcgccgtgcaagcctccatgcctgagaaggaaccttctgttttgcggaaagttcttctagaggatgaggtattagccgcaatggtgtctgtgatcgggaccgctaccactcatctcagcccagagctcgccgctcaaagtgtgactcacatcgttccgctgttcttggatgggaacgtgtcctttttacccgagaattctttcccctcccgctttcagccttttcaagatgggtcatctggacaaagaaggctgattgctctgctgatggcatttgtgtgttcgctcccccgtaatgtggaaatcccacagttgaatcaactgatgagagaactgctagagctcagctgctgccacagctgccccttcagttcaactgccgctgccaagtgtttcgcaggcctgttgaacaaacatcctgccggacaacagttagacgaatttttacagttagccgtggataaggtggaggcaggcttgggctccgggccttgccgttctcaggcgtttacactactcttgtgggtgaccaaggccctggtgctgaggtatcatcctttgtccagttgcctcaccgcccgtttaatgggccttctctccgatccggaactggggccagccgcagctgacggcttctctctgctgatgtccgattgtaccgacgtgctcactcgtgcaggccatgctgaagttcgcataatgttcagacagcggttcttcacagataatgtcccggcactggtgcaagggtttcatgcggctccacaggatgtgaaaccaaactatctaaagggactttcacacgtgctaaaccgcctgcccaagcctgttcttctccctgagctcccaacccttctgagtctccttctggaggcactgagttgtcctgattgcgtggttcaactgtcaaccctgtcatgtttgcagccactcctgctggaggcccctcaggtgatgagcctccacgtggacactctggtcaccaagtttctgaacctctcctcttcgccgagcatggcagttcgaatcgcagcgctgcaatgtatgcacgcgctgacgaggctccccacgcccgtgcttctgccgtacaagccacaggtgatacgagcccttgcaaaaccactcgacgataagaaacggctggtacgtaaggaggctgtctccgcacgaggggagtggttccttctagggagcccgggttcttag

SEQ ID NO: 29531 - DNA, 3030 bp, Artificial Sequence
  Description of Artificial Sequence: Synthetic coding sequence
atggccgcagctgcagctgtggaggccgcagccccaatgggggcattgtgggggctggtgcacgacttcgtggtgggccagcaggaagggcctgccgatcaggtggctgcgtctagcctggaaaaccccgaaccccgaaccagagcacgggcaatacagctgctgtcacaggtgctactgcactgtcataccctcttgcttgagaaagaagtagtgcacctgattctgttctatgagaaccgacttaaggaccatcatctggtcattccaagtgtgttgcaggggctcaaagccctgtctctgtgtgtggctctccccccaggtctggccgttagcgttctgaaagctatcttccaggaggtccacgtgcaggtggaccggcacacagtgtacaacatcattacaaactttatgcgcactcgggaagaagaactcaaatctctgggagccgatttcacgtttggattcattcaggtaatggacggggagaaggacccaaggaaccttctggttgcctttagaattgtgcacgaccttatttccagggactactccctgggcccattcgtcgaagagctcttcgaagtgacctcctgttatttccccatagattttactcccccacccaacgacccacacggtatacagcgagaggaccttatactcagtttgcgggctgtgctggcatctaccccacgctttgccgaatttctactgccattgctgatcgaaaaagtggatagtgaggttctgagtgctaagctggactctctgcagacacttaacgcttgctgcgcggtctatggacagaaggagctgaaggattttttaccctccttgtgggctagtatcaggagggaagtgtttcaaaccgcctcagaaagggtggaagccgaagggttggcagcccttcactccctgaccgcctgcctttcaagatctgtgctcagagcagacgcagaggacctcctggatagcttcttaagtaatatattgcaggattgccgccaccacctttgcgagcccgacatgaagctagtgtggccctcggccaagttgcttcaggcagcagcaggcgcatccgcacgcgcatgcgatagcgtgacttccaatgtcctcccgcttttgctcgagcaattccacaagcacagccagagtagccagcggaggaccatcctggaaatgctacttggttttctcaaactccagcagaagtggtcatatgaagacaaggatcagcgacctctgaacggatttaaggaccaactgtgttccctcgtcttcatggcactaactgaccccagcacccagctgcagctagtaggaattcgaaccttgaccgttctgggggcacagccagatctgctgtcctacgaggaccttgaactggccgtaggccacctctatcgcctgtctttcctgaaagaagactcccaatcttgcagagttgcagccctcgaggcttccggaactctggccgctttgtaccccgttgccttttcttctcatctggtgcctaaactggccgaagagcttcgcgtgggcgagagtaatctgaccaacggcgatgaacccacccaatgttcccggcatctgtgctgtctgcaggctctttccgcggtctcaacacaccctagcattgttaaggaaacactacctctgctcctgcagcacctgtggcaagtgaatcgtggcaatatggtggctcaaagcagcgacgtgatcgccgtttgccagtccctgcgacaaatggccgaaaaatgtcagcaagacccagagtcttgctggtatttccaccagaccgctatcccctgtttgctagcacttgccgtgcaagcctccatgcccgagaaggaacctagcgtcttaaggaaagtgctgctggaggacgaggtcctcgctgctatggtgtctgtgattggtacagccaccacgcatctctcacctgaacttgctgctcaaagcgtgactcacattgtccccttgttcctggacggtaacgtgagttttttgcctgaaaatagcttccccagtcggtttcaaccatttcaagacgggagctccggacagcgacgacttattgctttgcttatggccttcgtgtgtagtttgccacggaatgttgagattccccagctgaatcagcttatgagagaacttctcgaactttcctgctgccactcatgccccttctcatctactgctgcagccaagtgttttgccggactcctcaacaagcacccagccggacagcagctggatgaatttctgcagttagccgttgataaggtggaagcaggtctcggctccggcccatgcagaagccaggcatttactttgttactctgggtcaccaaggccctggtcctgaggtatcaccccttgtctagctgtctgaccgcacggctgatggggctgctgtccgaccccgaacttggccctgccgcagcagatgggttttccctcttaatgtccgattgcaccgacgtcctgacgagggcaggacacgcagaggtgcggataatgttccgccagagattctttaccgataacgtgcctgctctggtgcagggctttcatgctgcccctcaggacgtcaagcctaattatcttaagggactatcccatgtgctgaatcgcctgccaaagcctgtgctgctgcccgaactgccaacactactgtctctgctcttagaggctctgtcctgccccgattgcgtggttcaattaagtactttaagttgccttcagccgcttttgctggaggctccacaagtgatgtctctccatgtggacacccttgtcacaaaatttctgaacctgagctcctccccctcaatggctgtgaggattgcagcccttcaatgcatgcatgctctcactaggctgcccaccccagtcctcctcccatacaagccgcaggttatccgcgcattggctaagcctctcgatgataaaaagagactggtacggaaagaagcggtgtccgcccgaggcgaatggttcttactcgggagccccggaagctag

SEQ ID NO: 29532 - DNA, 3093 bp, Artificial Sequence
  Description of Artificial Sequence: Synthetic coding sequence
atggctgctgcagcagctgtcgaagccgctgctcctatgggcgctctttggggactcgtccacgatttcgtagtgggacaacaagagggacctgcagatcaggtggccgctgacgtgaagagtgggaattacaccgtactgcaggtggtcgaggcactgggctcctcacttgaaaatcctgagccgagaactcgtgccagggccattcaattactcagccaagtgctcctgcattgccatactctgttattagagaaggaggtggtacatctgatcctgttctacgagaaccggctgaaagatcaccatttagtcatcccaagtgtgctgcagggtctgaaagcactgagcctgtgcgtagcccttcctccaggacttgcagtgtctgtgctcaaggctattttccaggaggtgcatgttcagagtcttccccaggtggatcgccacacagtgtataacattattactaacttcatgcggacaagagaagaggaacttaaaagtctgggggcagacttcacttttggtttcattcaggtcatggatggcgagaaagatcccaggaaccttctcgtggcttttcgcattgtgcatgacctgatctctagggactacagtctcggacccttcgtcgaggagctgtttgaagtgaccagctgctacttccctatagatttcacccctccccctaacgatccacacggaattcaacgtgaggatctaatacttagccttagggctgtattggccagcacaccacgcttcgccgaatttctgctaccccttctgatcgagaaggtggacagcgaagtgctttcagccaaactggacagtttgcagacattaaacgcctgctgcgcagtctacggccaaaaagaactgaaggatttcttgccatccttatgggcctccatacgtagagaggtgttccaaacagcaagtgagcgcgtcgaggccgaagggctggccgcattacatagtctgactgcatgtctcagtagatccgttcttagagccgatgctgaggatctgctcgattccttcctgtccaacattctgcaagattgcagacatcacctgtgcgaacctgacatgaagctggtgtggccctccgccaagttgttgcaggcagctgcaggagcttctgccagggcctgtgactccgtgacgtcaaatgtcttgccactcctccttgaacaatttcacaagcattcacagtcctcacagcgcaggacgatcttggagatgctactaggatttctgaagctgcaacaaaaatggtcctacgaggataaggaccagcgaccactgaatggtttcaaggaccagctttgttctctcgtctttatggccctgacagaccccagcacccagctccagctggttggcatccgtactcttaccgtgctgggcgcacaacccgacctgctctcatacgaagatctcgagctagcggttggccatctttaccggctgagcttcctcaaagaggatagtcagagttgccgcgtggctgcactggaagccagtggcacactggccgcactgtatcccgtggccttctcgtcccatctggtgccaaagctggccgaggaactcagggttggagaaagcaacttgaccaacggagacgagccgacccagtgttcacggcatctgtgttgccttcaggccctgagtgcggtttctacccacccctcgattgtcaaggaaactctcccgctgctgctgcagcatctgtggcaggtgaacagaggcaatatggtggcccagtcatctgatgtgatcgccgtgtgccagtcattgcgccagatggctgagaaatgccaacaagacccagagtcatgctggtacttccaccagactgcgattccctgcttgctggccctcgctgtccaggcttcaatgcccgagaaagagccatccgtccttcggaaagtactgttggaagacgaagtcctggcagcaatggtgtccgtaattggcaccgcaacaactcacctttccccagaactggcagcccagagtgttacgcacattgtgccgttgttcctcgatgggaatgtgagttttctaccagaaaacagcttcccgagcagatttcagccatttcaagatgggtcctccggccagcgcaggctgatcgcactgttgatggcttttgtgtgctcgctcccacgaaatgtggaaataccacagctcaaccagctgatgcgggaactcctggaattgtcttgctgtcactcgtgccctttcagttcaaccgctgctgctaagtgtttcgccggtcttctgaacaaacatcccgcaggccagcagctcgatgaatttctacagctcgctgtggacaaagtcgaggcagggctaggctccggtccgtgcaggtcacaagcctttactctcctgttgtgggtaactaaggccctggtcctcagataccaccccctgagttcctgcctcacagcaagacttatgggtctccttagcgatcccgaactgggccctgcagctgcggacggctttagtctcctcatgagcgactgcaccgatgtcctgactagggccggacacgcagaagtaaggattatgtttagacaaaggtttttcacagacaacgtgccggctttggtgcagggtttccacgcagctcctcaggatgttaaaccaaattacctgaagggtttatctcatgtactgaaccgactgccgaagcccgtgctgctacctgagttacctacactgctcagcctgcttctagaggctctgtcatgtccagattgcgtggtgcagctgagtactctcagctgcctgcagccattattgctcgaagctcctcaggtgatgtcccttcacgtcgacaccctggttacgaagttcctgaacttgtccagttcgccatctatggccgtgcgaattgctgctctgcaatgtatgcatgctctgacccggctgccaactccagtgcttttaccctacaagccgcaggtcataagggcgctggcaaaacctctggatgataagaaacgcctggtaaggaaagaggctgtgtccgccagaggggagtggttccttctgggtagtcccggaagttag

SEQ ID NO: 29533 - DNA, 1734 bp, Artificial Sequence
  Description of Artificial Sequence: Synthetic coding sequence
atgcccaaaacgatttccgtgagggtaactacgatggatgcggaactcgagttcgctatacagcctaatactaccggaaaacagctcttcgaccaagttgtcaagactattgggctccgggaagtctggttcttcggtctgcagtaccaagatacgaagggcttctcaacctggctcaagctgaataaaaaagtgacagcgcaggatgttagaaaagagtcacccctgctgtttaagttccgagcaaaattttaccctgaggacgtcagtgaagaattgattcaagatatcacacagagactcttttttttgcaggtgaaggagggcatcctgaatgatgacatctattgcccaccagagaccgcggtcctgctggcctcatacgcagtccagagcaaatatggggattttaacaaagaggtgcataagtcaggatatttagctggggacaaactgctaccccaacgtgtgctggagcagcataagctcaacaaagaccagtgggaggagcggatccaggtttggcatgaggagcaccgaggaatgttgagggaggatgcagtcctcgaatatctgaagattgcccaagatcttgaaatgtacggggtgaattacttttcaatcaaaaacaaaaaggggagtgaactttggcttggagtggacgctctgggactgaatatctacgagcagaacgatcgacttacccccaagatcggcttcccatggtcagagatccggaatatttcctttaacgataaaaagtttgttatcaagcctatcgataaaaaggcacctgatttcgtcttctatgccccacggctgagaattaacaaaaggatactggcactgtgtatgggcaaccatgagctgtacatgcgccgtagaaaacctgacaccatcgaagttcagcagatgaaggctcaggcacgcgaggaaaaacaccagaaacaaatggaaagggctatgctggagaacgagaaaaagaagagggagatggccgagaaagaaaaggagaagatagagcgggagaaggaagaactgatggagcgcttgaaacagatagaggagcaaaccaagaaagcccaacaggagttagaagaacaaacacggagagccctcgagctggaacaggagagaaaaagagcccagtctgaggccgagaaattggcaaaggaaagacaggaggctgaggaagccaaggaagcgctgctgcaggcgagcagggatcagaaaaagacccaagaacagctagcactggagatggccgagttgaccgctcgcatttcccagctggagatggcaaggcagaagaaagagagcgaggctgtggagtggcagcagaaagcccagatggttcaggaagacctcgagaaaaccagagccgaattgaagaccgcaatgtccactccccatgtagcagaacccgctgaaaacgaacaggacgaacaggacgagaacggggctgaggctagcgctgacctccgtgcagacgccatggcaaaggaccgctcagaagaagagaggaccacagaagccgaaaagaatgagcgggtgcaaaagcatctaaaagcactgacgtctgaactggccaacgcccgagacgagtcaaagaagacagcaaatgacatgattcacgccgaaaatatgcggctgggccgtgataaatacaaaactctccgccagatccggcaggggaacactaagcagcgtattgatgagttcgaatccatgtag

SEQ ID NO: 29534 - DNA, 717 bp, Artificial Sequence
  Description of Artificial Sequence: Synthetic coding sequence
atgcggtttaagaacaggtttcagagattcatgaatcatagagctccggctaacggtcgatataaacctacctgctacgaacatgcagcgaactgctacacccacgcctttcttatagtgcccgcaatcgttggatccgccctgctgcatagactcagtgatgactgctgggagaaaatcacagcctggatctacggtatgggtttgtgcgcactattcatagtgtctaccgtttttcatattgtgtcctggaaaaaatcccatctgaggacagtggaacattgctttcacatgtgcgatcggatggtaatttactttttcatagccgctagttatgccccatggcttaacctcagggaattaggcccattggcatctcatatgcggtggttcatctggctcatggctgccggtgggaccatttacgttttcctgtaccacgagaaatacaaggtggtcgagctgtttttctacctgacaatgggcttttccccggctctggtggttacatctatgaataacaccgatggacttcaggagcttgcctgcggaggcctgatttattgtctgggagtcgtgttctttaagagcgatggcattatccccttcgcacacgccatatggcacctattcgttgcaactgcggctgccgtccattactacgccatctggaagtatctgtatagatcgcccacagacttcatgcggcatttgtag

SEQ ID NO: 29535 - DNA, 2127 bp, Artificial Sequence
  Description of Artificial Sequence: Synthetic coding sequence
atgtctacagccgacgctctggacgacgagaatactttcaagatccttgtagccacagacatccatctgggtttcatggagaaagatgccgttcgagggaacgacactttcgtgaccctggacgaaattctccgactggctcaggagaatgaggtggatttcatcttactcggaggagatctattccatgaaaacaagccctcaagaaagactctacacacatgccttgaattgttaagaaaatactgcatgggagaccggcctgtgcagtttgagatcctgtctgatcagtctgtcaattttggattcagtaaatttccttgggttaactaccaggatgggaatctcaacatctctataccagtgttttcaatccatgggaaccacgacgaccccaccggagcggacgccctgtgtgcattggacattctctcatgcgcaggtttcgtcaatcattttggtcggtccatgtctgtcgagaaaatcgacattagccccgtgctgttgcagaaaggctctaccaagattgcgttgtacggtctgggctcaataccggatgaacggctgtaccggatgtttgtgaataagaaagtcacaatgctgaggccaaaagaagacgagaattcttggttcaacctgtttgtgatccaccagaatcgctctaaacacggatcgactaatttcattccagagcagttcttagatgactttatagaccttgtgatctgggggcacgaacacgaatgtaagatcgcacctaccaaaaatgagcagcagctgttctatataagccagcccggttcgtccgtcgtgacttctttatctcctggggaggcagttaaaaagcatgtgggactcctcagaattaaagggcgaaaaatgaatatgcataagattccactgcacacagtcaggcagttttttatggaggacattgtgctggctaatcaccctgatatattcaatccagacaatcccaaagtgacgcaagccatccagtccttttgtttagaaaaaatagaggaaatgcttgagaatgcagagagggagaggctgggcaacagccaccagcccgagaaacccctggtgcggttgagggttgactatagcggaggattcgaacccttctctgtgctccggttcagtcagaagttcgtggatagggtcgcaaatcctaaagacatcatccatttttttaggcaccgggagcaaaaggaaaaaacaggggaagaaatcaactttgggaaactcattacgaaacctagtgagggaacgaccctgagggtcgaggacctcgtcaaacagtatttccaaaccgcagagaaaaacgtgcagctttcgcttttaacggaacgaggcatgggagaagctgtacaggaattcgttgataaggaagagaaggacgcgattgaagaacttgtcaagtaccagctcgagaaaacccagagattcctgaaggagcgccacatagacgccctggaagataagatcgacgaggaggtgcgtagatttagggagacacggcagaagaacactaacgaggaggatgacgaggtccgggaagccatgactcgcgctcgagctctacgcagtcaatcagaggagagtgcgagcgccttttctgccgatgatctgatgtcaatcgatttagccgaacagatggccaacgatagcgacgactccatcagtgcagccaccaacaagggacgcggacgaggaaggggcagaaggggcggtcggggacaaaacagtgccagtagaggcggttcacagcggggacgagccgacactggtttggaaacaagcactcgaagtagaaacagcaagacggccgtgagcgcctctagaaacatgagtatcatcgatgcttttaaaagcacaagacagcagccctcacggaatgtaactacgaaaaactatagtgaggtgatcgaagttgatgagagcgacgtggaagaggatattttccctaccacctccaagacagatcagaggtggtccagtacttcaagttctaagattatgagtcaaagtcaggttagcaaaggcgttgacttcgaatctagtgaagatgacgatgacgatccttttatgaatacatcaagtttaagaagaaacagacgctag

SEQ ID NO: 29536 - DNA, 2043 bp, Artificial Sequence
  Description of Artificial Sequence: Synthetic coding sequence
atgtccaccgctgacgcactggatgacgagaacactttcaaaattctagtagccacagatattcatctcggattcatggagaaggacgcggtccggggaaatgacacgttcgttacacttgacgagatcctaaggcttgcccaggagaatgaggtcgattttatactccttggaggcgatttgttccatgagaacaaaccgagccgaaagactctgcacacttgcttggaattgttgagaaagtactgtatgggggacaggcccgtccaattcgaaattctgtcagaccaaagcgtcaacttcggcttctctaaatttccatgggtgaactatcaggacggtaaccttaatatcagcatccctgtcttttcaatacatggcaatcatgatgaccccaccggagcggacgccttatgcgccctggacatcctgagttgtgccggatttgtcaaccactttggtaggtctatgagcgttgaaaaaatagacatctctcccgtacttctgcagaagggtagtacgaagattgctctttacggattgggtagtatcccagacgaacggctctataggatgtttgtgaataaaaaggtaaccatgttgcggccaaaagaggatgaaaactcctggtttaacttattcgtcattcaccagaacaggtcgaagcatggcagcaccaactttattcctgaacaattcttggacgactttatagatctggtcatatggggtcatgaacacgagtgcaaaatagccccaaccaaaaatgagcagcaactgttctacatatcgcaacctggctcttccgtggtcacttctctctctcccggtgaggccgttaagaagcacgtgggactacttcgtatcaaaggcagaaagatgaacatgcataaaattccgctacatacagtccgacagttctttatggaggatatagtgctcgcaaaccaccccgacatctttaacccagataaccccaaggtgacccaagccatacaaagcttttgtctagagaagatcgaagaaatgttggagaacgccgaacgcgaacgcttggggaatagccaccagccagagaagccactcgtaaggttaagggtggactattccggaggatttgagcccttcagcgttctccgcttttcccaaaagttcgttgaccgcgtagcgaaccctaaagatatcatccactttttccgccaccgagagcagaaggagaaaactggtgaggagattaatttcgggaaactgattacgaagcctagtgaggggacaaccctgcgtgtcgaggatctggtaaaacagtacttccagactgcagaaaaaaatgttcagctgagcctgcttactgagaggggaatgggcgaggctgtgcaggagttcgtggataaagaggaaaaggatgccatcgaggaacttgtgaaataccagctggagaagacacaacgctttctcaaggagcggcacatcgacgctctggaagacaaaatcgatgaggaggtgaggaggttcagagaaaccagacagaaaaacacaaatgaggaagatgacgaagtgcgcgaagccatgactagagccagagctctgagatcccagtctgaagagtctgcatccgcatttagcgccgacgatctgatgagcatcgatctggcggagcagatggcaaacgactccgacgattctatttcagctgcaaccaacaaaggcaggggcaggggccgtggcaggaggggaggaagaggccagaatagcgcgtcacgcggtggctcgcaaagaggaagagcctttaaaagcacgaggcagcaaccttcacggaacgtgaccacaaagaactatagtgaagtaatcgaggtcgacgagagtgatgtcgaagaggatatcttccctaccacctccaaaaccgaccagcgttggagttcaacttctagctctaagattatgagtcagtctcaggtctctaaaggagtggacttcgagtcttccgaggacgacgacgacgatccattcatgaacacttcttctttgcggaggaacagaagatag

SEQ ID NO: 29537 - DNA, 2124 bp, Artificial Sequence
  Description of Artificial Sequence: Synthetic coding sequence
atgagcacagcagatgcgttggacgacgaaaacacctttaaaatattggtggcaacagatattcaccttgggttcatggaaaaggacgccgttaggggcaacgatacctttgttactctggacgaaattctgaggctggcccaggaaaatgaagtggactttattctgctgggaggcgacctttttcacgaaaataagccctcgcgtaagaccttgcatacatgtcttgagttgttgaggaaatactgcatgggagatcgcccagtgcaattcgaaattctgtcagaccagtcagtaaactttggattctccaaattcccatgggtaaattatcaggacggtaacctgaatatcagcatccctgtgttcagcattcatggcaatcacgatgacccaaccggggcagacgcactgtgtgccttagacatactttcttgcgcaggcttcgttaatcacttcggacgatcaatgagtgtcgagaagattgatatatccccagtcctgctgcaaaaaggctccactaagatcgccctgtatggcctagggtcgatccctgacgagcgactctatcgaatgtttgtgaacaaaaaagttacaatgcttcgtcctaaagaggacgaaaacagctggtttaatctgtttgtgatacaccagaataggtctaaacatggatccacgaatttcattcccgaacagttcctggatgattttattgatctggtgatttggggccatgagcatgaatgcaagatcgcacccaccaagaatgaacagcagctgttctacattagccagccgggttcatctgtggttacatctctgagtccaggagaagccgttaaaaaacacgttggccttcttcggatcaaaggccgtaaaatgaatatgcataagatccctttacatacagtaaggcagtttttcatggaggacatcgtgctcgcaaatcaccccgacatctttaacccagataatccaaaagttacccaggcaatccagagcttttgtcttgaaaagattgaagagatgctggaaaatgcagaaagagaacgcctcggcaactcgcaccagccggaaaaaccacttgtgaggctgagggtggattactctggaggctttgagcccttttccgtgctgcggttcagtcagaagttcgtggaccgggtggccaaccctaaagacattattcactttttcagacacagggaacagaaagaaaaaaccggggaagagatcaacttcggaaagttgataacaaagcccagcgaaggaacaacactgcgtgtcgaagatctggttaaacagtatttccagacagccgagaagaacgtgcaactgtcccttctcaccgaaagggggatgggggaagccgttcaggagtttgtggataaagaagaaaaggatgccattgaagaactggtcaaataccagctggagaagacccagaggtttctaaaggaacgtcatatagatgctctggaggataaaatagatgaggaagtgcgacgattccgcgaaactcggcagaaaaataccaacgaggaggatgacgaggttcgcgaggcaatgaccagagcaagggcactgagatcacaatctgaagagagtgccagtgctttctctgccgacgatctgatgtctatcgacttagccgagcaaatggcaaatgatagtgatgatagcatcagcgctgcaactaataaagggaggggcaggggacggggtcgcagaggcggtcgcggacagaactctgcgtcccggggtgggagtcagcgtggacgcgatacagggttggaaacctcgaccaggtcccggaactccaagacagctgtgtctgcctctaggaacatgtcgatcatcgatgcgttcaagtccactaggcagcaacctagtcgcaacgtcactacaaagaactatagtgaggtgatagaggtggatgagtccgacgtggaagaggacatttttcctacaacttctaaaaccgatcaaagatggtcatctacatcatcctccaagatcatgtctcagagccaagtttcaaagggcgtggacttcgagtcctcagaggacgatgatgacgaccccttcatgaacacatcatccctgcggagaaatcgacgctag

SEQ ID NO: 29538 - DNA, 2136 bp, Artificial Sequence
  Description of Artificial Sequence: Synthetic coding sequence
atgaaccgaaacatctcccaccagaagggggatgacgagaacacattcaagatactggtcgcaactgacatccaccttggatttatggagaaggatgccgtccggggaaacgatacattcgtcaccctggacgaaattctgcgcttggctcaagagaatgaagtagattttattttgctcgggggagatttgttccacgagaacaagccaagtaggaagaccctccacacctgcctcgaactcttgcgcaaatactgcatgggagaccgaccagtgcagtttgaaattctcagtgatcagtccgtcaacttcgggttttctaagtttccttgggtgaactaccaggacggaaatcttaatatcagcataccagtgtttagtattcacggtaatcatgatgaccccactggggctgatgctttatgcgccttggatatactgagctgcgctggcttcgtgaatcactttggcagatcaatgtcagtggaaaaaatagacatctcccccgtactcctccagaagggatcaaccaaaattgctctctatgggctgggatctattcccgacgaaaggctataccggatgttcgtcaataaaaaagtgactatgctgcggccaaaagaagatgagaatagctggttcaatctatttgtgattcatcagaatcggtctaagcacggctctacaaacttcatccccgagcagtttctggacgattttatagatctggtgatctggggacacgaacacgaatgcaaaatagcacccactaagaacgaacagcagctgttttacatctcccagcctggctcatctgttgtcaccagtctaagcccaggcgaagccgtcaagaagcacgttggcctcctgcggattaagggtagaaagatgaacatgcataagattcctctgcataccgtccggcaattcttcatggaggatatagtacttgccaatcaccctgatatttttaacccagataatcccaaagtcacccaagccatccagagcttttgtctggagaagatcgaggagatgctggagaacgcggagagagagcggctgggcaactctcatcagcccgaaaaacccctggtcagattacgagtcgattattccgggggatttgaacctttctcggtactgagattctcccagaaattcgtcgaccgagtggcgaatccaaaagacatcattcattttttccggcatagggaacaaaaggaaaagacaggcgaagagatcaatttcggcaagctcataactaagccttccgaaggaactaccctgagagtggaggatcttgtcaaacaatacttccaaactgcggagaaaaacgtccagcttagcctgcttaccgagcgcggtatgggggaagccgtgcaggagtttgtcgataaggaagagaaggatgccatcgaagagcttgtcaagtatcagctggaaaagacccaacggtttctcaaagagcggcacattgatgccctggaggataagattgatgaggaagtcagaaggttccgggaaactaggcagaaaaataccaacgaagaggacgacgaggtccgcgaagctatgacccgggctagagccctgcggtcccaatctgaggaaagcgctagcgctttctccgctgatgatctgatgtctattgacttggccgaacagatggctaatgattctgacgatagcatcagcgcagcaaccaataagggcagaggcaggggtagggggagacggggtggcagaggtcaaaattctgcctcaaggggcggttcacaaagaggcagggctgacaccggtttggagacatcgacgagatctcgtaactcgaaaaccgctgtcagtgcttcccggaatatgagcattatagatgcattcaagtccacaagacaacagccaagcagaaacgttacgaccaagaactacagcgaagtgattgaggtggacgaaagtgacgtggaagaggacatctttcccaccaccagcaagacggatcagagatggagctccacaagctcatctaaaataatgtcccagtcgcaggtgagtaaaggcgtcgatttcgagtcttctgaagatgatgatgatgaccccttcatgaacactagttccctgcgtcgtaacagaagatag

SEQ ID NO: 29539 - DNA, 384 bp, Artificial Sequence
  Description of Artificial Sequence: Synthetic coding sequence
atgtcaacagccgatgctctagatgacgagaatacattcaagattttggtagccacggacatccacctcggcttcatggagaaagacgccgtgagaggcaacgacactttcgtcactctggatgagattttgcggcttgcacaagagaacgaagttgacttcatcttgcttgggggagaccttttccatgaaaataagccatccagaaagaccctgcacacctgtctggaactcctgagaaagtactgtatgggggataggcccgtgcagttcgaaattttgagcgatcagtccgtcaatttcggattttcgaagttcccctgggtcaattatcaggatggaaatttgaacattagcatccctgtcttcagtatccatggttag

SEQ ID NO: 29540 - DNA, 336 bp, Artificial Sequence
  Description of Artificial Sequence: Synthetic coding sequence
atgtctacagccgacgcactggatgatgagaacaccttcaaaatcctggtggccaccgatattcacctggggtttatggaaaaagatgctgtgagagggaatgatactttcgtgaccttggacgagattcttcggctggcccaagagaacgaagtggactttatactgttagggggtgacttgttccatgaaaacaaaccttcacgcaaaaccttgcacacttgtctggaactgctgcggaagtactgtatgggtgacaggccagtccagttcgaaatcctctctgatcagagcgtgaacttcgggttctccaaattcccatgggtgaactattag

SEQ ID NO: 29541 - DNA, 666 bp, Artificial Sequence
  Description of Artificial Sequence: Synthetic coding sequence
atgagtactgccgatgctttggatgatgaaaacacatttaagattcttgtggcgaccgatattcacctcggttttatggagaaggatgcagtgagagggaacgacaccttcgtcactttggacgaaattttgcgcctagctcaggagaatgaggtggatttcatcttgttgggtggcgatctttttcatgagaataagccttcacgtaagactctgcatacttgccttgaactacttaggaaatactgtatgggcgacagacctgtgcagttcgagattctttccgaccagtcggttaacttcggcttttccaaattcccttgggttaactaccaggacggaaatctgaacattagtatccccgtatttagcattcatggaaatcatgatgaccccacaggtgctgatgcactctgcgcgctcgacatcctgtcctgcgccggatttgttaatcacttcggacggagtatgtccgtggagaagattgatatttcacccgttctactgcagaaaggcagcaccaagatagctttatacggtctcggcagcattcctgatgagcggctgtatcgtatgtttgtcaacaagaaagttactatgctcagacctaaggaagatgaaaactcatggtttaacttgtttgtgattcatcaaaacagggtgtag

SEQ ID NO: 29542 - DNA, 822 bp, Artificial Sequence
  Description of Artificial Sequence: Synthetic coding sequence
atgactcctggtactcagtctccctttttccttttgctcctcctcaccgttcttaccgtggtaaccggctctggccacgcatcctctactcccggaggggaaaaagagacctcagcaacccagaggagtagcgtgccttccagcaccgagaaaaatgccctgtctactggcgtgtcctttttttttctgtccttccacattagcaatctgcagtttaactccagcctggaggacccgtctaccgattactaccaggagctccaacgagatataagtgagatgtttctgcagatatacaaacagggcggtttcctgggcctgtccaacattaaattcaggcccggtagcgtggtggtgcagctcacactggccttccgtgagggtaccatcaacgtgcacgatgtggagacacaattcaaccagtataagacagaggctgcttctcgatacaacttaaccatttccgacgttagcgttagcgacgtcccattcccattctccgctcagagtggcgctggggtgccgggatggggcatcgcccttctggtgctggtgtgcgtcctcgtcgccttagccatagtctacttaatcgccctggcagtgtgccaatgcaggagaaagaattacggccagcttgatattttccccgcaagggatacataccaccccatgtctgagtacccaacttaccacactcatggtaggtacgttccgccaagctcaacagatcgctcaccttacgagaaggtgtctgctggtaacggcggatcctcattaagttacactaatccagcagtggctgccacttctgctaacctctag

SEQ ID NO: 29543 - DNA, 675 bp, Artificial Sequence
  Description of Artificial Sequence: Synthetic coding sequence
atgacccccggtacccagagccctttttttctccttttgctacttaccgttctgaccgccactacagcgcctaaaccagcaactgtggtcactggctctgggcacgctagttcaactcctggtggagaaaaggaaaccagcgcgacgcagaggtcaagcgtcccttcttctaccgagaagaacgcctttaggcccggttccgttgtggtgcagctaacactggctttcagagaggggacaataaacgtccatgacgtggaaactcaatttaatcagtacaagacggaggccgcttcccggtacaacttgactatttccgacgtgtctgttagcgacgtaccgtttcctttcagcgctcagtccggggctggggtccccggttggggaattgctttgctggtccttgtttgcgttctcgtagccctggctatcgtgtacttaatagccctggcggtctgtcagtgcaggaggaaaaattacggccaattagacatcttccctgctcgtgacacttatcaccccatgagtgaatatcctacctaccacactcacggcaggtatgtcccaccatccagcactgaccggtccccttacgaaaaagtcagcgccggtaacgggggatcctccctgtcctatacaaatcccgctgttgccgcaacatctgcgaatctgtag

SEQ ID NO: 29544 - DNA, 501 bp, Artificial Sequence
  Description of Artificial Sequence: Synthetic coding sequence
atgactcctggcactcagtcaccattttttctgctgctcctgttaacggttctcacagctactactgcaccaaaacctgcgactgtggtgaccggatcaggccatgcttccagtactccaggtggagagaaagagacgagcgccacacaacgcagctccgtgccaagcagtactgagaaaaatgcctctggagcaggagtccctggatggggtatagctctgttggtgctggtgtgtgtgttggtcgcgctagccatcgtctacctgattgccttagccgtctgtcagtgccggcgtaagaactatggccagctcgatatcttcccggctcgggacacctatcacccaatgtctgagtatcctacatatcatacccacggcaggtatgtgccacccagcagcactgacagaagcccttatgagaaagtgtccgccggaaacggcggatcctccctgtcctataccaaccccgctgttgccgctaccagcgcaaatctctag

SEQ ID NO: 29545 - DNA, 612 bp, Artificial Sequence
  Description of Artificial Sequence: Synthetic coding sequence
atgactcccggaacccagagcccattcttcctgctgcttttactcacagtgctgactgtggtgacaggatccggccacgccagcagcacgcccggaggagagaaagaaacgtctgcaacacagaggtccagtgtaccatccagtacagaaaagaatgccattcctgcccctactacaacaaagtcatgtcgggagactttcttaaagtgtttctgccgctttatcaacaaaggcgtgttctgggcatctcctatactctccagtgtgagtgatgtcccgtttccttttagcgcccagtctggcgctggcgtccccggatggggtattgctctgctggtgttggtctgcgttctcgttgctctggccatcgtttacctgatcgccctcgcagtttgtcagtgtagacgtaaaaactatggccaactggacatttttcccgcacgagacacttatcatccgatgagcgaatacccaacgtatcacacgcacggccgatatgttcccccttcctcaacggatcggtccccctatgagaaggtgtcagctggcaacggaggatcatccttatcttacacaaaccccgctgtggcggctacctcagccaacctctag

SEQ ID NO: 29546 - DNA, 507 bp, Artificial Sequence
  Description of Artificial Sequence: Synthetic coding sequence
atgacccctggaacacagagcccatttttccttctgctgcttctgaccgttctgacggtggttaccggcagtggacatgcctcctcaacaccaggcggagagaaggaaacgtccgctacacaaagatccagtgtcccctcctccacagaaaagaatgcactgtcaactggggtctctttcttttttctctctttccacatctccaacctgcaattcaactcctcactggaagatccaagcacagattactaccaggagttacagagggatatttcggagatggccgtctgccaatgtaggagaaagaattacggccagctcgatatctttccagccagggacacataccacccaatgagcgaataccccacctatcacacccacggacgatacgttcctcctagcagcactgatcggagcccctacgagaaggtcagtgccggaaacggaggaagcagcctttcgtacacgaatccagctgtcgctgctactagtgcaaatctttag

SEQ ID NO: 29547 - DNA, 768 bp, Artificial Sequence
  Description of Artificial Sequence: Synthetic coding sequence
atgaccccgggtactcagtcaccattctttctccttctcctgctgactgtgctgacagtggtgacgggatcggggcatgcctcttcaacaccgggaggagaaaaagaaacctccgcaacgcagcgtagctccgtcccatcctcaacagagaagaatgcttttaacagttctctggaagacccatctaccgattactaccaggagcttcaaagggatatttcggagatgttcctgcaaatttacaaacagggaggctttctgggtctgagtaatatcaaatttcgtcccggaagtgtagtcgtccagctcactctggcctttcgagagggcaccattaacgtccatgacgtggagacccagttcaaccaatacaaaactgaggccgcatcaaggtataatctcacaatcagtgacgtgtcagtgagcgacgtgccttttccttttagtgctcagagcggcgctggcgttcccggatggggaattgcgctcctagtgttggtgtgtgttctggtggcactggcgattgtgtacctaatcgccctggctgtctgtcagtgccgccgaaaaaactatgggcagctggatatttttccggctcgggatacatatcaccccatgtccgaataccccacctaccatacccatgggcgttacgtgccccctagttcaacagatcgcagtccctacgagaaagtgtctgcaggaaacggtgggagctcactctcttacactaatcctgccgtagccgctacaagcgccaacctatag

SEQ ID NO: 29548 - DNA, 795 bp, Artificial Sequence
  Description of Artificial Sequence: Synthetic coding sequence
atgacccctgggacacaatcccctttttttctgctgctgttgctaaccgtgctgacagccacgaccgcgccaaagccagctacagtggtaactggctcaggacatgcctcaagcactcccggaggagagaaggagacttccgccactcaaaggagcagcgtgccttccagcaccgagaagaacgcctttaactcatcacttgaggatccaagtacagactactatcaagaactgcagcgcgacatttccgagatgtttctgcagatctacaagcagggcggattcttggggctctccaatattaaatttaggccaggaagtgtggtagtgcagctgacactggcctttagggagggcacaatcaatgtgcacgatgttgagacccagtttaaccaatacaagaccgaggccgcatctagatataatctcaccattagtgacgtgtctgtgtccgacgtgccattcccttttagcgcgcagtccggtgccggtgttccgggttggggaatcgcattgctcgtgttagtatgtgtgctcgttgcattggcaatcgtgtatctgatcgcccttgccgtgtgccaatgtcgccgaaagaactatggtcagttggatatctttccagctcgagacacttatcatccaatgtccgagtaccctacctaccatacccacggccgttatgtccctccgtcttctactgacagatccccgtacgaaaaagtgtctgccggtaacggtgggtcttctctgagctacaccaatcccgcagttgccgctacctccgctaatctgtag

SEQ ID NO: 29549 - DNA, 597 bp, Artificial Sequence
  Description of Artificial Sequence: Synthetic coding sequence
atgacccccggaactcagtccccattctttttactcttgctgctcaccgtgctgaccgtggtaactgggagtggccatgcatctagtactcccggtggggaaaaggaaacatcagcaacccagagatcttccgtccctagcagcaccgagaagaacgctctcagtacgggcgtgagctttttctttctcagcttccatataagcaacctgcagttcaattccagcctggaagatccatctactgactattatcaggaactccaacgtgatatcagcgagatgttcttgcagatatacaaacagggcggttttctaggtctttccaatattaagtttaggccaggcagcgtcgtggtacaactgactctcgctttcagggaaggcaccataaacgtgcatgatgtggaaactcagtttaaccagtataagaccgaagccgcttcccgttacaacctcaccatttccgatgtgagtggctgcttgtccgttcccccaaaggaactgcgggctgcaggccatcttagctctccgggatatctcccatcgtacgaacgggtccctcatctgccacatccatgggccttgtgcgccccatag

SEQ ID NO: 29550 - DNA, 1428 bp, Artificial Sequence
  Description of Artificial Sequence: Synthetic coding sequence
atgacacccggaacacagtcaccatttttcctgttgcttctgttgacagtcctcaccgtggtgacagggagcggccacgcaagttctacccccggaggagaaaaggaaacctctgcaacacagcgatcatcggtgccgtcaagtaccgagaaaaacgccgtgtccatgacctcaagcgtattatctagccacagccccggaagtggctcgtcgaccacccaaggccaggatgtgaccctggcgcctgctaccgagcccgcatcagggtcagccgctacgtggggacaagacgtcaccagcgtgcccgtcacaaggccagcccttggctctacaacgccgcctgctcatgatgtgacttccgccccagacaataagcccgctcctggcagtactgcgccacctgctcacggcgtcacctccgcaccagacacccggcctgcacccggttctacagctcccccagcccatggagtgacgtcggctcccgacaaccgccctgcccttggctcaaccgccccaccggttcacaacgtcaccagcgccagcggtagcgccagtggtagtgcttccacccttgtccacaacggcacttccgctcgagctacgactacgccagcatctaagagcaccccattctccatcccctctcatcacagcgacaccccaactacactcgcaagccattccacaaagacggacgcctcaagcactcaccacagcacggtgccccctctaacctcctcaaaccattccaccagcccccaactctcaactggtgtgagctttttctttctgtctttccacattagcaacctgcaatttaatagcagcctcgaggatcccagtaccgactattaccaggaattacagcgagacatcagcgagatgtttctgcaaatctacaagcagggaggatttctcggattgagcaatatcaaatttagacctggttccgttgttgtgcaactcactctcgcttttcgggaagggacgattaatgtgcatgacgtggagactcagttcaatcagtacaaaaccgaggccgcatctagatacaacctcaccattagtgatgtcagtgtgtctgacgtaccatttccattttctgctcagagcggagctggggtccccggatggggcattgccttacttgtcctcgtgtgtgttctggtcgctctggccatcgtatatcttatcgccctggctgtctgccaatgcagacggaaaaactacggtcagctggatattttccccgcaagggacacatatcaccctatgtctgaatacccaacctatcacacgcacggacgatatgtgccccctagctcaacagacagatcaccgtacgagaaggtcagcgccggaaatgggggatcatctctgagttacacaaatcccgctgttgccgctacatctgcaaacctgtag

SEQ ID NO: 29551 - DNA, 480 bp, Artificial Sequence
  Description of Artificial Sequence: Synthetic coding sequence
atgacacccggaacacagagccctttttttttactgctgcttctgacagtgcttacagctacaactgctccaaagccagccaccgtcgtaacaggcagtggccacgccagtagcacacctggaggtgagaaagagacctcagctacccagaggtcgtcagttcctagctctacggaaaaaaatgcattcaatagctctttggaggacccttcaacagactactatcaggagctccagcgtgacattagtgagatggcagtgtgccagtgcaggcggaagaactacggtcagcttgacatattccctgcacgggacacttaccacccaatgtcggagtatcccacgtaccacactcacggcagatatgtaccaccctcatctaccgaccgcagtccctacgaaaaggttagcgccggaaatgggggttccagcctgtcatacaccaaccccgctgttgcagccacgtccgcgaatttatag

SEQ ID NO: 29552 - DNA, 693 bp, Artificial Sequence
  Description of Artificial Sequence: Synthetic coding sequence
atgacccctggtacgcaaagcccattttttttgcttctgctgctcacagtgctgactgtagtgacggggtctgggcacgcctcttctacgcccggaggggaaaaggaaacttctgcaactcagcgtagttccgttccatcctctacagagaaaaatgccattcccgctcccacaacgacaaagagttgcagagaaacgttcctaaagtggcccggaagcgtagttgtgcagctaactctcgcgtttcgagagggcaccataaacgtgcacgatgtcgaaacacagttcaatcagtacaaaacagaggcggcttcaagatataacctgaccatctccgacgtgtcagtaagtgacgtgcccttcccttttagcgctcagtccggagcaggggtgccagggtggggcatcgctctgcttgtgctcgtctgcgtgctggttgccttggccattgtttatcttattgcattagccgtttgccagtgtaggcgcaaaaactatgggcagctggacatattccccgctagggacacataccacccgatgtctgagtaccccacctaccatacccatggccgatatgtgcctcccagctccaccgatcgatccccttacgaaaaggtgagcgccggaaatggcggtagtagcctgtcttatacgaaccctgccgtcgctgccacctctgccaacctctag

SEQ ID NO: 29553 - DNA, 1686 bp, Artificial Sequence
  Description of Artificial Sequence: Synthetic coding sequence
atgacacctggcacccagagcccctttttcctccttctcctgctcacagtactcaccgtcgtgaccggctctggccacgctagctctactcctggtggtgaaaaagaaacaagcgcaacccaaagaagcagtgtgccatcatctaccgagaagaatgctgttagcatgactagcagtgtactgagtagccatagccccggatctgggagctcaaccacccaggggcaagatgttacgctcgccccagccacagaacccgcaagcggcagcgccgctacttgggggcaagacgtgaccagcgtcccagtgacaagaccagccttgggctctactacaccacctgcgcatgatgtaacgtcagcacccgacacaagacctgcccctggctcgactgcacctcccgctcacggggtaacaagcgccccagacacccgccctgcacctggttccaccgccccacctgcccatggggttacctcagcccctgatactaggcctgcgccaggatcgactgcgccacctgctcacggcgtgactagcgcgcctgatacgagaccagccccagggagcaccgcccctcccgctcatggagttacaagtgcccctgatactagaagagcaccagggtcaacccccgcaccaggatctacagctccaccggctcacggcgtcacgtccgcccctgatacccgaccagctccaggttctaccgctcccccagcccacggagtgacctcggctccagacaatagacccgcactcggctcaacagctccgccagtccacaatgtaacttccgcttcagggagcgccagtggaagtgcgtccacactggtccataacggaacatcagccagagccactacgacgcccgcaagcaaatcaaccccttttagcattccgagccaccactctgatacaccaactaccctggccagccatagcacaaaaaccgatgccagctcaactcatcatagcaccgttcctcccctaacgtcatccaatcattccacctccccccagctctcaactggagtgtcctttttttttctaagttttcacatatcaaatcttcaatttaattctagcctggaagacccctccacggattattaccaagagctccagcgcgatatatcagaaatgttcctccaaatctacaagcagggtggattcctgggcctcagtaacatcaagtttagacctggctctgtcgtcgttcagctaacactggctttccgagagggcacaataaacgtacacgacgtcgaaactcagttcaatcagtacaaaacggaggcggcatctcggtataatttgaccatctctgacgtctccgtatccgacgtcccattcccgtttagtgcccagagcggtgccggtgttcccggttgggggattgccctactcgtgctcgtttgcgtcctggtggcacttgctatagtttacctgatcgctttagccgtctgtcaatgcagaagaaagaattatggtcaattggatatatttcctgcccgagatacataccaccctatgagcgagtaccccacctaccatacacatggcaggtatgtgcctccttcctcaacggaccggagcccttacgaaaaggtgagcgctgggaatgggggatcatccctttcttatacaaatccagctgttgcagcaacttctgcaaacctgtag

SEQ ID NO: 29554 - DNA, 690 bp, Artificial Sequence
  Description of Artificial Sequence: Synthetic coding sequence
atgactcctggtacccagagtcccttctttctgctactgctcctgaccgtccttaccgtggttactggatccggacatgcctcatcaactccgggtggggagaaggaaacatcagccacacagcggtcctctgttcccagttctaccgaaaagaacgctatctataaacagggaggattcctcggattaagcaatatcaagttccgcccaggtagcgtcgtggtccagctgactctcgcttttagagaaggtaccatcaacgtacacgacgtcgaaactcaattcaatcagtacaaaaccgaggcggctagccggtacaatctgacaatctctgatgtgagtgtgagtgacgttccctttccttttagcgcccagtccggcgctggtgtgcccggatggggcattgcgcttctggttttggtgtgcgttttggtcgcactcgcgattgtttatttaattgctttggctgtatgccagtgtcggagaaaaaactatggccaactagatatctttccagctcgagatacctatcaccccatgtccgaatacccgacataccatacccatggacggtacgtcccaccatcctcgaccgataggtcaccttacgagaaagtgagcgccggaaacgggggaagttcattgtcctatacgaacccagccgttgccgctacgtccgctaacctgtag

SEQ ID NO: 29555 - DNA, 780 bp, Artificial Sequence
  Description of Artificial Sequence: Synthetic coding sequence
atgactcccggaacgcagagccccttcttcctgcttctgctgttgacggtcctgaccgcgaccactgcacccaaaccagccacagtggttactggatcaggacatgcttcctccaccccaggtggagaaaaggaaacatctgcaacacagaggagcagtgtcccatcctcgaccgaaaagaatgccttcaactcctcgcttgaggacccaagtaccgattactaccaggagctgcagcgagacatctccgagatgttcttacagatctacaaacagggcggtttcctgggattatcaaacattaaatttagaccaggctccgttgtggtgcaactgacacttgccttcagagaagggactatcaatgtgcatgatgtagagacacagtttaaccagtacaagaccgaggccgcttccagatacaatttgaccattagcgatgtgtctgtgagcgatgtaccgttcccctttagtgcccaatcgggggcaggagtccctggatggggaatcgccctactggttctggtatgtgtgctggtggcccttgctatcgtttatctgatagctctggccgtgtgtcagtgtcgacgcaagaactatggccagctggatatctttcccgcacgcgacacataccaccctatgtccgagtatcctacctaccacactcacgggaggtacgtgcctccaagtagtactgataggagtccttacgagaagcgccaaaacggctggagcacgatgccgagaggagcattaccggaggagagtcaggggtag

SEQ ID NO: 29556 - DNA, 1833 bp, Artificial Sequence
  Description of Artificial Sequence: Synthetic coding sequence
atgggtctgaaagctgcgcagaaaacgctcttccccctccggtccattgacgacgtagttaggttattcgccgctgaactggggcgagaggaaccggatctcgtgctgctgtccctcgttctggggttcgttgagcactttctagcagttaacagagtgattccgaccaatgtgcccgagctcacctttcagccatctcccgcaccggaccctccagggggtctgacctatttccctgttgctgatctgtcaataattgccgctctgtatgcccgatttactgcccagatccgcggagcggtcgatctctcgctgtacccaagggaagggggagtgtcttctcgcgagctggtcaaaaaggtgagtgatgtgatctggaattccctgtcaaggagctattttaaagaccgggcacacatacagtctcttttttctttcatcacaggaactaaactcgactcatcaggtgtagctttcgccgtggtcggtgcctgccaggccctgggcttaagagatgtccacctggccttgtccgaggatcacgcttgggtggtctttggtccaaacggggagcagaccgctgaagtaacttggcacggcaagggaaatgaagatcgtagggggcagacagttaatgctggggtagcggagcgatcgtggctgtatctgaagggttcgtatatgcggtgtgaccggaagatggaggtagcatttatggtgtgtgcgatcaacccttccatcgatctgcacacggatagcttggaattgctccaacttcagcagaagttactctggcttctgtacgatttgggccacctggaacggtatcccatggccttggggaacctggctgatctagaggagctcgagcccactccgggtaggcctgacccactcaccctctatcacaagggcattgcctcggcgaaaacatactatcgggacgagcacatttatccatatatgtatcttgctggataccactgtagaaacaggaacgtgcgagaggcactgcaggcctgggccgacactgcaacggtgatccaagactacaactactgtagagaagatgaagaaatatacaaagaattttttgaggtggctaacgacgttatcccaaacttgctaaaggaagcagcctcccttttggaggcaggggaagaacgacccggtgaacagtcacagggcacccaatcccaaggaagtgccctgcaggacccggaatgcttcgctcatcttcttcggttttatgatgggatctgtaagtgggaggaaggctcacccacgccagtcctacatgtcggatgggctacctttctagttcagagtttaggtagatttgagggccaggtgagacagaaggtgcgcatagtgagccgagaggcggaagctgctgaggcagaggagccttggggagaggaagcccgtgagggcagaagacggggacctagacgagagtcaaagcccgaggaacccccaccaccgaaaaaacctgctctcgacaagggacttggaacagggcagggagccgtttcaggccctccacggaagccccctggaaccgtggccggaactgctcgtgggccagagggcggatctacggctcaggtccctgcaccaacagcaagccccccacctgagggaccggtacttactttccagagtgaaaaaatgaagggcatgaaggagctcttagtggctacaaagatcaactcctctgccattaagctgcaactcacagcccagagccaggtccagatgaaaaagcaaaaggtaagcacacccagtgactataccctctcattccttaagcgccaacgcaagggcctatag

SEQ ID NO: 29557 - DNA, 1833 bp, Artificial Sequence
  Description of Artificial Sequence: Synthetic coding sequence
atgggtctgaaagcagcacagaaaaccctgttcccccttagatccatcgatgacgtggtgagattatttgccgcagagctgggccgtgaggagccggacttagtcctgctctcgttagtgctgggtttcgttgaacatttcttggcagtcaatcgggtgatacctaccaacgtgcctgagttaactttccagcccagtcccgcacccgacccccctggaggtctgacctactttcccgtggctgacctctccattattgcagccctctatgcacgctttactgcgcaaattagaggcgctgtggacttaagtctctaccccagagagggaggggtcagctccagggagcttgtgaagaaagtatccgatgtaatttggaattccctctctcgttcttacttcaaggatagagctcacatacagtctttattcagtttcattacagggactaagttagacagttctggggtggcctttgcagtggtcggtgcatgtcaggcgctgggcctgcgcgatgtgcacttggccctcagtgaggaccatgcctgggtcgtcttcgggccaaatggtgagcagactgcagaggtgacgtggcatggaaaaggcaacgaagataggcgtgggcaaacagtgaacgctggggtagctgaacggagttggctgtacctgaagggatcatatatgcgctgtgacaggaagatggaagttgctttcatggtatgtgcaataaatccatccatcgatttgcacacggattctctcgaattactgcagctccaacagaagttgctgtggctgctttatgatctgggacacttggaaaggtatcccatggcccttggcaatttggcagacctggaggagctggagcccaccccaggtcggcctgaccccttaactctttatcacaaagggatcgccagtgctaaaacttattatagagatgaacacatctatccatacatgtacttggccggttaccactgtaggaaccgaaatgtgcgcgaggctctgcaggcttgggccgatacggctactgtgatacaggattataattattgcagggaggacgaagaaatttacaaggagttctttgaggtggcaaatgacgtgatcccaaacctgcttaaggaggctgcctcactgcttgaagcgggtgaagaacgcccaggagaacaaagtcagggaacacagtcccaggggagtgcacttcaggaccctgaatgcttcgcacaccttctgagattctacgacggcatctgcaaatgggaggaaggcagtccaacaccagttttgcatgtcggttgggccactttcctcgtgcaatctttgggcaggtttgagggccaggttaggcagaaggttaggatagtctccagggaggcagaggcagcggaagctgaagagccctggggggaggaggcacgggaaggcagacgcaggggccctaggcgtgagtcgaagcctgaggaaccacctccaccgaagaaaccagccctagacaaaggactgggaactggccagggagccgtctccggaccccctcgtaagcctcccggtacagtggccggaacggccagaggcccagagggtggcagcacagcacaggttcctgcacctactgcctccccaccaccagaaggcccagtgttaacattccagtccgaaaagatgaaggggatgaaagaactgctggtagcaaccaagattaattcatccgcaatcaagctccagctgaccgcccagtcccaagtgcagatgaaaaaacaaaaagtatctacacctagtgattacacactgagttttttaaagcgccagcgcaagggtctctag

SEQ ID NO: 29558 - DNA, 1848 bp, Artificial Sequence
  Description of Artificial Sequence: Synthetic coding sequence
atgggattgaaggcagcacaaaaaacactgtttcccctgaggtcaatcgacgacgttgtaaggttattcgcggcagaattgggaagggaggaaccagacttagtccttctttctcttgttttgggttttgtagagcactttctggccgtcaaccgtgtgatccccacaaacgtgcctgagctcacctttcagcctagcccagctcctgaccctcctggtggactgacctatttcccagttgctgatctgagcatcattgcagcactctatgccaggttcaccgcgcagatccggggagccgtggatttgagcttataccctcgggaagggggagtatcatctcgggagctggttaaaaaggttagcgacgtcatttggaacagcctgtcgcggagctatttcaaggaccgagctcacattcagtccctgttttcctttatcacgggttggtcccctgtgggcaccaagctggactcatcgggggtggctttcgccgtggtgggcgcatgccaggcattaggcctccgagacgtgcacttggccctgtccgaagaccacgcatgggtggtgttcgggcctaacggagaacagacagccgaggtgacttggcatggcaaggggaatgaggatcgacgcggacagactgtcaacgccggagtggccgagcggtcatggctttatttgaagggttcatacatgcgctgcgataggaagatggaagtggcatttatggtgtgcgccatcaatccgagcatcgatctgcacacagacagtctggaactgctgcaattgcagcagaagctgctgtggctgctgtatgatctcggccacttggaacgctatccgatggctcttgggaatctcgccgatctggaggagctggaaccaacaccagggagacctgatcccctgaccctctatcataaggggattgcatccgcaaaaacttactacagagatgaacacatctacccttatatgtacttggctggctaccattgccgaaaccgcaacgttagggaggccctccaagcctgggccgataccgccacggttatccaggactacaattattgtcgggaagacgaagaaatatacaaggaattttttgaggtagctaatgacgtgattccaaacctcttgaaagaagccgcttccctattagaggcaggagaggaaagacctggagagcaatctcagggaacgcagagccagggaagtgccctccaagatcccgaatgttttgctcatttacttagattctacgacggcatctgtaagtgggaggagggttcacccacacccgtgctccacgtgggctgggccaccttcttggtacagtccctgggccgatttgagggccaggttcgtcagaaggtgcgcatcgtctccagggaggcggaggcggctgaggccgaggaaccatggggcgaggaagccagagaaggtcgacggagagggccaagaagggaaagtaagcccgaagaacctccccctcctaaaaaacccgcactggacaagggacttgggacaggccagggcgcagtatcggggcctcccaggaagcctcctggaactgtggcaggcaccgcaagagggccagaagggggatccaccgcccaggtacctgctcctactgcatcccccccacctgaagggccagtcctcacatttcaaagcgaaaaaatgaagggcatgaaggaacttttagtggcgacaaaaattaattcatcagccatcaagctgcagcttaccgcccagtcccaggtgcagatgaaaaaacagaaagtgagcacaccctctgattatacactgagcttcctaaaacgccaaaggaagggactttag

SEQ ID NO: 29559 - DNA, 1848 bp, Artificial Sequence
  Description of Artificial Sequence: Synthetic coding sequence
atggggctgaaagctgcccagaagaccttgttcccacttcgatcgattgacgacgtagtgcgtctgtttgccgctgaactggggagggaggaaccagacctggttcttctctccctggtgcttggtttcgtggaacatttcctcgccgttaatagagtgatacccaccaacgtgcctgagctgacctttcaaccctcaccagccccagatccaccgggaggcctgacctatttccctgtggccgatctgtctatcatagctgcactgtatgcaaggttcacagcccaaatccgaggtgcggtggatctgagtctctacccgagagaaggtggggtctctagtcgcgagctggttaagaaggtatcggacgttatctggaattcactctcgagaagctatttcaaagaccgtgcccacatccaaagcctgtttagcttcatcacaggatggtccccagtcgggacgaaattagactcctcgggggttgcattcgcggtcgtaggcgcatgtcaggccctgggtctgcgtgacgtgcatctagccctgagtgaggatcatgcttgggtggtattcggtccaaatggcgagcaaacagcagaagtgacgtggcatggaaagggtaacgaggacaggagagggcagaccgttaatgccggagtcgcggaacggagctggctctatttaaagggctcctatatgagatgcgatcggaagatggaggtggcctttatggtgtgcgctataaacccgagcattgacctgcatacagactccctcgagttactccagttgcagcaaaaactgctgtggctgctatacgacttaggacacctggaacgttaccccatggccttgggcaatctggcagacctagaggaattggaaccaacccccggtagaccagatccactcactttataccacaaggggattgcatcagcaaagacttattatcgcgatgaacacatctacccatacatgtatctcgccggatatcactgcaggaataggaacgttagagaggccctgcaggcttgggccgacaccgctactgtaatccaggattacaactattgcagggaagacgaagaaatctataaggaattctttgaggtggccaacgatgtaatccccaacttgctgaaggaagctgcttctctactcgaggccggtgaggaacggccaggagaacagtctcagggaacccaatcccagggctcagcactccaagatccggaatgtttcgcccatctcttacgtttttacgatgggatttgcaagtgggaggaggggtctccaacccctgtgctgcacgtcggatgggcaaccttcctggtacagtcactcggacgattcgaggggcaagtgcggcaaaaagtccgcatagtatctcgagaggcggaagcagctgaagccgaggagccgtggggagaggaagccagggaagggagacgaaggggacctcgcagagagtcaaagcccgaggaaccacctcccccaaaaaagccagcattggacaaaggactagggactggacagggcgctgtgtcaggtccaccacgaaaacccccaggcacggtggctggtaccgcgagggggccagagggcggttctacagctcaagtcccagctccaacggcctcccccccacctgagggacccgtgctaacctttcagtcagagaagatgaaaggcatgaaagagttacttgtggccactaagatcaacagctctgctattaagcttcagctgacagcccagtctcaggttcaaatgaagaaacaaaaagtgtcgacacccagcgactacaccctgagcttcctgaagcgacagcgcaaaggtctgtag

SEQ ID NO: 29560 - DNA, 1668 bp, Artificial Sequence
  Description of Artificial Sequence: Synthetic coding sequence
atgggcctaaaagccgctcagaaaacccttttccccctgcgtagtattgatgacgtggtgagactgttcgcggctgagctagggagagaagagcccgacctcgttctcctaagtctcgttctgggcttcgtggagcacttcttagctgttaacagagtaatccccaccaacgttcctgagctgacatttcagccaagcccagccccagatccacccggaggactcacctattttcctgtcgcagatctctctataatagccgctctgtatgctcgctttactgctcagatccgcggagccgtggacctgtccctctacccccgtgagggaggcgttagctcaagggagcttgttaagaaagtgagcgacgtgatttggaactccttgagtcgatcctatttcaaggaccgtgcccatattcaaagcctgttctcttttatcaccggcacgaagctcgactcttccggtgtggcctttgcagttgtgggtgcgtgtcaggcccttgggctgcgtgatgtacacctcgcactcagtgaggaccatgcctgggtcgtctttggacccaacggcgaacaaacagcagaggtaacctggcacggcaagggcaatgaggaccggaggggacagacagtgaacgcgggagtcgcagagagatcttggttatatctgaaggggtcatacatgcggtgtgacagaaagatggaagtggccttcatggtgtgcgccatcaacccctccatagacctgcacaccgactccctcgagctgctccagctgcagcagaaactactgtggctgttgtatgatctggggcatcttgaaaggtatcccatggctctgggaaatctggcagatctggaagagctagaacctacgccaggtcggcctgaccccctgacgctgtatcataaagggattgcatcagctaagacatactatcgtgatgaacacatctatccctatatgtacctggcagggtaccattgcagaaaccggaatgtgagggaggccctgcaagcctgggctgacaccgccaccgtgattcaagactacaattactgccgcgaggacgaagagatctacaaggaattctttgaggtggcaaacgacgtgattcctaaccttctcaaagaagcagcgagccttttggaggcaggggaggaacgacccggagaacagagccaggtccgtcaaaaagtccggatcgtatccagggaggcagaagctgccgaggcagaagagccatggggcgaagaagccagggagggccgacgccgtggtccaaggcgggagagcaagccggaggagccacctcctcctaagaagccagcactggacaaaggactcggcacaggacagggagcagtgtctggccctcctcggaagcctcctgggactgtggcaggcactgcaagaggccctgagggaggttcaactgctcaggtgcctgcccctacagcctcaccaccaccagagggaccagtcctgacgtttcaatcggagaaaatgaaaggaatgaaggagctccttgtcgcaactaagatcaatagcagcgctattaaactgcagttaactgcgcagtcacaggttcagatgaagaaacagaaggtttcaacaccgtccgactacacactcagcttcctaaaacggcaacgcaagggcctgtag

SEQ ID NO: 29561 - DNA, 1728 bp, Artificial Sequence
  Description of Artificial Sequence: Synthetic coding sequence
atgggactgaaagctgcgcagaagaccctcttccctctgcgctctatcgacgacgtggtgagactttttgccgctgaattaggacgggaagagccagatttggtgcttcttagccttgtcctgggcttcgtggaacacttcttggctgtgaaccgagtgataccaaccaatgtgccggaacttacgtttcagccctcaccagcacctgacccccctgggggactgacttactttccggtggccgacctgagcattatcgcagccttatacgctcgatttactgcccaaattcgtggagccgttgatttatccctctatcccagggagggaggcgtgtcatccagagagctcgttaaaaaggtgtccgatgtcatctggaacagtctgagcaggtcctatttcaaagaccgagcacacatccaaagcctgttctcctttatcacaggaacaaagctggatagttctggtgtcgccttcgccgtggtgggcgcatgtcaggcgctggggttacgggacgtacacctggctctgtccgaagaccacgcatggtcttggctttacctaaagggatcttacatgcggtgtgaccgcaaaatggaagtggcatttatggtgtgcgccataaacccctcgatagaccttcacacagattctctggaattgctacagcttcagcagaagctgctatggctactgtacgaccttggccacctcgaacggtaccccatggccctcggaaacctcgccgacttggaggaacttgagccgactcctggcagacccgaccccctcaccctttatcacaagggtatcgcctccgccaagacttactacagggatgaacacatctacccatacatgtacttagcaggataccattgtaggaaccgaaacgtaagggaggctctgcaggcctgggctgacacagccacagtgatccaagattataattactgccgggaagatgaggagatttataaagaattctttgaagtggccaatgatgtcatcccgaatctcttgaaagaggctgcttccttgctggaagccggagaggaacgccctggtgaacaaagccaggggacccagtcccaaggctcagcgcttcaggaccccgaatgtttcgctcacctgttaaggttctacgatgggatctgcaagtgggaagaagggtcccctacgccggttctacatgtgggttgggctaccttcctagtccagagcctgggtcgttttgagggtcaggtgcgacagaaagtgcgtatcgtttctagggaggcggaagctgctgaagccgaggaaccttggggggaagaggccagggaaggcagacggcgaggccctcgacgggagagtaagccagaggagccaccccctccaaagaagccagcattagacaaagggcttggaaccggacagggcgctgttagtggaccacccagaaagccccctgggaccgttgcagggactgcacggggaccggagggaggttccaccgctcaggttccggcacccacagcttccccccctcccgaggggcctgtcctgacgttccagagcgaaaagatgaaaggaatgaaagagctcctggtggcaacaaagatcaactcaagcgccattaagctgcagttgacagcccagagtcaagtgcagatgaaaaagcagaaggtgagcaccccgtctgattatacgttgagctttctgaaacgccagcgcaaaggtctatag

SEQ ID NO: 29562 - DNA, 1833 bp, Artificial Sequence
  Description of Artificial Sequence: Synthetic coding sequence
atgggcctgaaagcagcccaaaagaccctttttcccctccgctcgatagacgacgtggtgcgcctgtttgcagcggagctcggaagagaagaacctgatctggtgcttctttctcttgtcctcggctttgtcgaacattttctggctgttaatagagtcatcccaacgaacgtcccagaactgaccttccagcctagtcccgcaccggacccccctggtggcctgacctattttccagttgcggatctatccattatagctgctctgtatgctagatttactgcccagattagaggtgcagttgatctgagcctatatccgcgagaggggggtgtttccagccgcgaactggttaaaaaagtatcagacgtcatctggaactcactaagtcgaagctattttaaagaccgagcacatatccagtccttattctcatttattactggtacaaaactggactcctctggagtggcctttgcagtagtgggtgcgtgccaggcccttggcctacgcgacgtgcatctagccctttctgaggaccacgcctgggtagtctttggcccaaacggcgaacagaccgccgaagtgacttggcatgggaaggggaacgaagatcgacggggacaaacagtgaacgccggtgtggccgagagatcctggctctacctcaagggctcatacatgagatgtgatcgaaagatggaagtggcctttatggtttgtgcgatcaatccaagtattgatctgcatacagactctcttgagctgttacagcttcagcaaaaactgctgtggctcctgtacgacttgggccacctggagcgctatcctatggctcttgggaacttggcagaccttgaggaattagagccaacccccggtcggccagacccactgacactgtaccataaaggcatcgcctccgctaaaacgtactaccgagatgagcatatctatccttacatgtatcttgccggatatcactgtaggaacaggaatgttagggaagctctacaggcctgggcagacacagctactgtgatccaggactacaactactgcagagaagacgaggaaatctacaaagaattttttgaagttgccaatgacgttattccaaacttattgaaggaggcagcaagtctactcgaggcgggtgaagagcggcctggggagcagagccaaggaacccagtcacagggctctgcactgcaggatcctgaatgtttcgcgcatcttctgcggttttacgatggtatttgcaagtgggaggaggggagtccaactccggtgctacatgtgggatgggccaccttcctggtgcaatccttaggtaggttcgaagggcaggtgcggcagaaagtccggatcgtgagtagagaagcagaggcagccgaagctgaggagccatggggagaggaagcacgcgaaggacggaggcgcggaccacggagagagtcgaaacctgaggagccacctccacccaaaaaaccagcccttgacaaaggcctgggtaccggacaaggggctgtgagcggaccgcctcgcaaaccccctggaactgtggccggaaccgccaggggtcccgaagggggaagtaccgctcaggtacccgcacctaccgcttcgccccctcctgaagggccagtcttaacatttcagtccgaaaagatgaaaggaatgaaagaactgctcgtggccacaaaaattaatagctctgctattaaactgcagctcacagcccagtcacaggtacagatgaaaaaacagaaagtttcaacacccagtgactacactttatccttcctcaagagacagagaaagggattatag

SEQ ID NO: 29563 - DNA, 1848 bp, Artificial Sequence
  Description of Artificial Sequence: Synthetic coding sequence
atgggcctgaaagccgctcagaaaaccctgttccccctgagatccattgacgacgtggtacggctcttcgccgcagagctgggtagagaagagccagacctggtccttctgtcactagtcctcggcttcgtggagcatttcctcgctgtcaatcgcgtcattccaacgaacgtgcccgaacttaccttccaacccagccctgctcccgacccaccaggcggacttacctatttccccgtcgccgacctgagtattatcgccgcattatacgctaggtttactgcccagataagaggggcagtcgacctttcactttatcctagggaaggcggtgtatcctctagggagctggtgaagaaggtctccgacgtaatttggaattccttatcgaggtcttactttaaggatagggcacatatccagtccctgttctcgttcattaccggatggtcgcccgttgggaccaagctagactcctccggagtcgccttcgccgtggtgggagcatgtcaggcgctgggactgagagacgtgcacctcgctctgtccgaggaccatgcttgggtggtattcgggcctaatggagagcagactgccgaggttacttggcacggtaaggggaacgaggatagaagaggccaaacagtcaatgcaggtgtcgccgaacggtcgtggttgtatttgaagggctcttacatgcgctgtgacaggaaaatggaggttgcttttatggtgtgcgcaattaatccgagtattgacctacatacagactcactcgaactgctccagttacagcagaaattactgtggttgttatacgatctgggccacctggaacgctaccccatggcgctaggcaatctagcggatttggaggaactggagcccacacccggacgtcccgatcctctcacgctgtaccataaggggatagcgagcgctaagacctactatcgggatgagcacatctacccttacatgtatctggccggttaccattgccgaaaccggaacgtccgcgaggctctccaggcctgggccgacactgccactgtaatccaggattacaactattgcagagaggacgaggagatctacaaggaattcttcgaggtggcaaacgacgtcatccctaatctgcttaaagaagctgccagtctcttagaggctggcgaggagcggcctggtgagcagagtcagggaactcagtcccagggaagcgcccttcaggacccagaatgtttcgcccacttgctgagattttatgacggcatatgtaagtgggaggagggaagccccacccccgtgcttcatgtcggatgggcaaccttcttggttcaaagcctcggtagatttgaaggccaagtgaggcagaaggtacggatcgtctctagagaggcggaggctgccgaagctgaagagccatggggagaggaggccagggaaggcagaagaaggggaccacgcagggagtctaaaccggaggaaccacctccacccaagaagccagcactggataagggcctgggaactggccagggcgctgtatctggccctcccagaaagccaccaggaaccgtggccggtaccgccagaggaccagagggcggaagtacggcgcaggtgccagcaccaaccgcatccccccctccagaaggacctgtgctgacattccaatcagagaagatgaaggggatgaaggaactgctcgtggctacaaaaattaattccagcgcaatcaaactgcagcttaccgcacagagccaagtccagatgaagaaacagaaagtgagtactcctagcgactatacattaagttttctcaagcggcagcgcaaaggactttag

SEQ ID NO: 29564 - DNA, 1848 bp, Artificial Sequence
  Description of Artificial Sequence: Synthetic coding sequence
atgggacttaaggccgcacagaagacgctatttccactcagaagcatcgatgatgttgtgcgactattcgctgccgaattggggagagaagagccagatctggttcttttatccctcgtccttggctttgtggaacattttctcgccgtcaatcgcgtcatccccaccaacgtgcccgagctaacatttcagccatctcctgcacccgatccacctggtggattgacttactttccagtcgccgatctgagcatcatcgcggctttgtatgcccgtttcacagcccaaattcgcggagccgtagatctgtcgctgtatcccagggagggcggagtgagcagtcgggagcttgttaaaaaggtgtctgatgtgatctggaacagcctgagtcggtcgtacttcaaagatcgggctcacatccagtccctctttagcttcattaccggttggtctcccgttggtaccaagctcgattcctcgggagtcgcattcgccgtagtgggcgcttgccaggccctgggcttgagggatgtgcacctggccctgagtgaggaccacgcctgggtggtattcggtcctaacggggagcagacggctgaggtaacctggcacggaaagggcaacgaagaccgaagaggccagaccgtgaatgcgggagtagctgaacgctcatggctttatctaaaggggtcctacatgaggtgcgacagaaaaatggaagtcgcttttatggtatgcgctatcaatccaagtatcgacctacacacagacagcctggagctgctacagttgcagcagaagctgctttggctgctgtacgatctgggacatttagagcgttatcctatggccctgggtaatttggctgacttggaggaattagagcccaccccaggacgtcctgatcccctgaccctctaccataagggaatagctagcgcgaagacttattatagagatgaacacatttacccttatatgtatctcgccggttatcactgccgtaacagaaacgtgcgggaggcacttcaagcatgggccgacacagccacagtcattcaagactataactactgtcgcgaggacgaagagatctacaaagaatttttcgaagtagcaaatgatgttatccctaatctgctgaaagaggcagcctccttgctggaagcaggcgaagagaggcctggggagcagagccagggcactcagtctcagggatccgcccttcaagatccagagtgttttgctcatctgctgcgcttttacgacggtatttgtaagtgggaggagggttcacctaccccagtacttcacgtcggttgggccacattcctggtgcagagtctgggtcgcttcgaggggcaggtgcggcagaaagttcgcatagtttctcgcgaggctgaggccgctgaggccgaagagccttggggagaggaggccagggaggggagaagacggggtcctagaagggaatcaaagcctgaagagcccccacctccaaaaaaaccagcgctggataagggcctaggtacgggtcagggggctgtttcagggccaccacgtaaacctccaggaactgttgccggtacagccagaggcccagaaggaggcagtaccgcccaagtaccagccccaacggcaagtccccctcccgagggacctgtgctcacatttcagtctgagaagatgaagggcatgaaggagcttctagtcgcgacaaaaataaattcaagcgccattaaattgcagctcacagctcagagtcaggtgcaaatgaagaagcagaaagtctccacccctagcgactacaccctatccttcttgaaacgtcagagaaagggactttag

SEQ ID NO: 29565 - DNA, 786 bp, Artificial Sequence
  Description of Artificial Sequence: Synthetic coding sequence
atgggcctgaaggcagctcagaagactttatttccccttaggtctatcgacgatgtcgtccgactgtttgccgcagagttgggcagggaggaacctgacctcgtacttttgagtcttgtactggggttcgtcgagcattttttggccgttaaccgagtgatacccaccaacgtgccagagcttacgtttcagcccagccctgcgcctgatccgccaggcggtctgacctatttcccagtggccgatctctcgatcatcgcagcgttgtacgcgagatttactgcccagatacgaggagctgtcgatctgagtctgtatcctcgggaagggggagtgagttcgagggaactagtgaagaaggtgagcgacgtgatttggaatagcctgagtcggtcctatttcaaggatcgcgctcacattcagagtttattcagtttcataactggtaccaaactcgactcatctggcgtggcttttgccgtggttggcgcttgtcaggctctgggtctccgcgacgtacatctggcactcagcgaagatcacgcgtgggtagtgtttgggccaaacggtgagcaaactgcagaggtgacctggcatggtaaggggaacgaggatcggagggggcagactgtgaacgccggagtggccgagagatcttggctgtacttgaaggggtcctacatgcgctgtgacaggaagatggaagttgcatttatggtgtgcgccattaatccttcaatagatttacatactgacagcttggaacttctgcagctgcagcagtag

SEQ ID NO: 29566 - DNA, 441 bp, Artificial Sequence
  Description of Artificial Sequence: Synthetic coding sequence
atggggttgaaggcggcacaaaagaccctgttcccccttcgatcaatcgatgatgtcgtcaggctgttcgctgccgagctaggaagagaagaaccagacttggtcctcctgtctctagtgctaggattcgtggaacatttcttggccgtcaatcgagtaattccgaccaacgtcccagaactgaccttccagccaagtccagctccagaccccccaggcggtctcacctattttccggttgctgacttgtctatcatcgcggcattgtatgctagattcacagcccaaatcaggggtgcagtggacctcagcttgtaccccagggaaggcggtgtaagttcccgcgaattagtgaagaaggtctcggacgttatttggaactccctgagtcgttcatattttaaagaccgggcacatatacagtccctattctccttctag

SEQ ID NO: 29567 - DNA, 441 bp, Artificial Sequence
  Description of Artificial Sequence: Synthetic coding sequence
atggggctgaaagctgcccagaagacactttttcctctgcggtccatcgatgatgttgtcaggctgttcgcggctgagttgggtagagaggagcccgacctggttcttctgagcttagtgctaggtttcgtggaacattttctcgcagtcaatagggttatccctaccaatgtgcctgaactgacattccagcctagccccgcaccggatcccccagggggactgacatacttcccagtcgccgacctgtccataatcgccgcactatacgctcggtttactgcccagatacggggtgcagttgatctgagcctgtatccaagggagggtggcgtcagtagccgggagctggtcaagaaggtctctgacgtgatctggaactctttgagtcgttcatactttaaagatcgtgctcacattcaatcactcttctccttttag

SEQ ID NO: 29568 - DNA, 1041 bp, Artificial Sequence
  Description of Artificial Sequence: Synthetic coding sequence
atgggtctgaaggcggctcagaaaacactgttccccctccggtccattgatgacgtcgtgcgactgttcgccgcagaactgggtagagaggaacccgatttggtcttactgtccctggtgctcggtttcgttgagcatttcctcgccgtcaatagggtgatacccaccaacgtgcccgaactaactttccaaccaagccccgcacccgaccctccaggcggactcacttacttccctgttgccgacctttcaatcatcgccgctctgtacgccaggtttaccgcccaaatccggggagctgtggacctctcactctaccctcgagaagggggagtctcctcacgcgagcttgttaaaaaagtgtccgatgtgatatggaactcgctttcgaggtcatatttcaaggaccgcgcacacattcagtcactctttagtttcatcacgggcactaagctcgattcttccggagtcgcgttcgccgtcgtgggggcatgccaggcattggggctgagggatgtgcatcttgcactctccgaagaccacgcctgggtggtttttggcccaaatggggaacagactgccgaagtcacatggcatggcaagggcaacgaggatcgcagggggcagacagttaacgcaggagtggccgaacggtcatggctctatctcaagggatcttacatgaggtgtgaccggaagatggaggtggcctttatggtctgtgccatcaatcctagcatcgaccttcacacagacagtcttgaactgctccagctacagcagaagctcctctggctgctgtatgatctgggccacctggaaaggtaccccatggccctggggaatctggccgacctggaagaattggagccaaccccaggcaggccagatcccctaaccctgtatcacaagggcattgctagtgctaagacctactatagggacgagcatatctacccttacatgtaccttgctggctatcactgtcggaacaggaatgtacgagaagctctacaggcttgggctgacaccgcgacatag

SEQ ID NO: 29569 - DNA, 1848 bp, Artificial Sequence
  Description of Artificial Sequence: Synthetic coding sequence
atgggactgaaggccgcacagaagacgctttttcccctcaggagcattgacgacgtggtgcgcttgttcgccgctgaactgggacgtgaagaaccagaccttgtcctgctcagccttgtgttggggttcgtggagcacttcctcgcagtgaatcgagtgatccccaccaatgtgcccgaactcacttttcagccctccccagctccagacccccctggagggctaacttatttccctgtggccgacctctccattatcgccgcactgtacgcccgatttactgcacagattcgcggtgccgtggatttgagcctttatcctagggaagggggagtgagcagcagagagttagtgaagaaagtgagtgatgtgatatggaactctctctctagatcctacttcaaggatcgagcccacatccaaagccttttttctttcatcactggatggagtccagttgggacaaagctagacagctccggggtggcctttgcagtggtgggggcatgccaggccctgggcctacgcgacgtccacctggctctcagcgaggaccacgcctgggtagtgtttgggcctaacggcgaacagacagcggaggtgacctggcacggaaaggggaacgaagacagaaggggacagacggtcaacgccggagtggcagaacgatcatggctgtatttgaaaggctcctacatgcggtgtgacagaaagatggaggtcgcctttatggtgtgcgccattaacccatctatagacctccacactgacagcctcgagctcctgcagctgcagcagaagctgctttggctgctatatgacctgggacacctggagcgttatcccatggccctcgggaacctcgctgatttggaggaactggaaccaacaccaggccgtccagaccctctcacactgtatcacaagggcatagccagcgccaaaacttattaccgcgacgaacatatttatccttatatgtatctggccggatatcactgtcgcaaccgcaacgtgcgggaggctctccaagcatgggcggacacggccactgtgatacaggactacaactactgtagagaggacgaggaaatttataaggagttctttgaggtcgcaaacgatgtaatacctaatttactgaaagaagccgcttctctgttggaggccggagaggaaaggcctggagaacaatcccagggaacacagagccaaggcagcgcactacaggacccagagtgcttcgcccacttgcttagattttacgatgggatatgtaagtgggaggaaggttccccgacaccagttctccatgttgggtgggccacatttctggtgcaaagtctgggaagatttgaggggcaagtcaggcaaaaagtccgtatcgtttctcgcgaggctgaagcagccgaagcagaagaaccatggggggaggaggcacgggagggaaggagaagggggcctcggagggagtcaaagccagaagagcccccacctccaaagaagccagccctggacaaaggcctggggactggacagggagccgtatctggtccaccgagaaagccacccggaaccgtggctggcacggcaaggggccctgagggaggtagcaccgcacaggtcccagctccaaccgcatccccacctcccgagggacctgttctgacattccagtccgaaaaaatgaagggaatgaaagaactgctggtggcaactaaaatcaacagtagcgcaattaaacttcagctgaccgcccaatcccaggtccagatgaagaaacaaaaggtcagtactcccagcgattacaccctcagcttcctgaagcgtcagaggaaagggctgtag

SEQ ID NO: 29570 - DNA, 846 bp, Artificial Sequence
  Description of Artificial Sequence: Synthetic coding sequence
atgggccttaaggctgctcagaagacactgttccctctgagaagcatagacgacgtggtaaggctctttgccgcagaactgggacgggaggaacccgatctggtacttttatccctggtgctaggttttgtagagcactttctggctgtgaaccgagtgattcccactaacgtgccagagctgactttccagcccagcccggcacctgatccaccaggcggactcacttacttccctgtagctgatctcagcataatcgcagcactttatgctaggtttacggcgcagattagaggtgcagtggatttatccctgtatcccagggagggtggagtgagcagtagagaactagtcaaaaaggtgtcagacgtgatctggaactcactgagccgatcctattttaaggaccgtgcccatattcagtcactctttagttttataaccgggacaaaattggacagctcgggagtggctttcgctgtggtcggggcttgccaagccctggggctgagggacgtgcacctcgctctcagcgaagatcacgcgtgggtggtattcgggccaaatggagagcagacagccgaagtcacctggcatggcaagggcaacgaagaccggagaggacaaacagtgaatgccggtgttgccgaaaggagttggctttatcttaaaggcagctacatgagatgtgaccggaaaatggaggtcgcatttatggtgtgcgccatcaacccttctatcgacctccacacagatagtctcgagctacttcagctccaacagaaactcctgtggctactatatgacctgggtcacctcgagcggtacccgatggccttaggatag

SEQ ID NO: 29571 - DNA, 1656 bp, Artificial Sequence
  Description of Artificial Sequence: Synthetic coding sequence
atggccgctcccgtcagattaggtcggaagcgtcccctgcctgcctgcccgaatcctctgttcgtgcggtggcttacggagtggagagatgaagccactcggtctcgcaggcgcacccgcttcgtttttcagaaagccttgcgttctctgcgcaggtatccgctgcctctgaggtctggcaaagaagctaaaattctccagcacttcggagacggtctgtgccggatgctggacgaacgacttcagaggcatcgcacaagcggcggtgatcatgccccagattctccatcgggcgaaaacagccccgctccccaaggcaggttggcggaagtccaagattcctccatgccggtgccggctcagcctaaggctgggggaagcggcagttactggccagctaggcattcaggcgcaagagtaatcttgcttgttctgtatagagaacacctgaaccctaatggacaccatttcctgaccaaggaggaactactgcagcggtgcgcccaaaagtctcctcgggtggcaccgggatctgctcgcccttggccggctctgagaagcctgctccaccgcaacctagtgctgaggactcaccagcccgcacggtattcactgacacctgagggactcgagctggcacagaagctggcagaaagcgaaggcttgtctctgcttaatgtggggattggtcccaaggaaccaccgggtgaggagacagcggttcccggagccgcttcggccgagctggcttccgaggctggagtacagcagcaaccattggagctgaggccaggtgagtacagggtactgctttgcgtggacattggggagacgagagggggtggccaccggcctgaattgttgagggaacttcagcggctacacgtgacccatacggtaagaaaactgcatgtgggagattttgtctgggtggcgcaagagaccaatccccgtgatccagcaaacccaggagagctagtgttggaccatatcgtggaaaggaaacggctcgacgatttgtgctcctctattatcgacggcaggtttcgtgagcaaaaatttcggcttaagaggtgcggcctggaacgccgagtgtacctggtggaggagcacgggtccgtgcacaacctttccttgcctgagtctactctgctacaagctgtcactaacacacaggtcatcgacggttttttcgtgaaaaggaccgctgacattaaggagtcagcagcttatctggctctcctgacgaggggcttgcaaagactgtatcagggacacaccctgagatctcgaccatggggcactccagggaatccagagagcggggctatgacttctcccaatcctctgtgctctctgctgacattcagtgactttaacgcgggtgcaattaagaataaagcccaaagtgtacgcgaggtttttgccagacagttgatgcaagtgcggggtgtgagcggcgagaaagcagcggcactagtggatcggtatagcactcccgcttctttacttgcagcctatgacgcttgtgctactcctaaggagcaggaaacactgctcagcaccataaagtgcggtaggctgcagcgcaacttggggcctgccctgtctcgaactctgagtcagttatattgttcatacgggcctctgacgtag

SEQ ID NO: 29572 - DNA, 1656 bp, Artificial Sequence
  Description of Artificial Sequence: Synthetic coding sequence
atggcggctcctgtgaggttaggcagaaaaagacctcttccggcatgccctaatcctctttttgtcagatggttaaccgagtggcgtgatgaggcgacccgatcccgcaggcgaacgaggttcgtatttcaaaaagccctgcggtcgctgcgtagataccctctgcctttgcgaagcggcaaagaagccaagatcctacagcactttggggatgggctctgcagaatgctcgacgaacgcttacagaggcatcggacctccggaggggatcacgctccagattctcctagcggtgagaacagcccagctcctcagggacgcttagccgaagtgcaggatagtagtatgccggttccagcccaaccaaaagccggaggctccggaagctactggccggctcgccactctggagctagagtgatcctgctggttttgtatcgagaacacctcaatcctaacggccaccacttcctgaccaaagaggagcttttgcagcgatgcgcacaaaaaagcccgcgtgtagctccgggaagtgccaggccttggcctgccctacgatcactgttgcatcggaatctggtgcttcgcacgcaccagccagctcgttattctctcacgccagagggactggaattagcccagaaactggcagagtcagaggggctatccttgctgaatgtcggcatcgggccaaaggagccccctggagaggaaacagccgtgcccggagccgcatcagccgagctggcctctgaagccggagtgcagcagcaacccctggaattgagacctggtgagtatagggtgttactatgtgtggatatcggcgaaacccggggtggcggacaccgccctgagctgctccgggagctgcagagactgcacgtaacacataccgtgagaaagctgcacgtcggagacttcgtatgggtggcccaggagactaaccctagagaccctgctaaccccggagagctggtattggaccacatcgtggagagaaagcggctggatgatctgtgcagctccatcattgacgggcgattccgggagcagaagtttcgcctcaaacggtgcgggctcgaaagacgcgtgtatctcgtcgaggagcacggctctgttcacaatctatcattacctgagtctactctgctgcaggccgtgaccaatacccaagttatagatggttttttcgttaaacgcacagcagatataaaggagagtgcggcttacctggcgctgctaacacggggactgcagcgcctgtaccagggccataccttgagaagtagaccttgggggacccctggcaacccagagtccggcgctatgacatccccaaatcctctctgcagcctcctcaccttctctgacttcaacgccggagcgatcaagaacaaagctcagagcgtgcgcgaagtgttcgccaggcagctgatgcaggtccggggagtgtccggcgagaaggccgcagccctcgtggatcgttattccacccccgctagcttactagccgcttatgatgcttgtgccactcctaaagaacaggaaaccttgttgagcacaatcaagtgcggtcgcctgcagcggaatcttggccctgctctcagtcgcaccctatcacagctgtactgcagctacggacccctgacttag

SEQ ID NO: 29573 - DNA, 2490 bp, Artificial Sequence
  Description of Artificial Sequence: Synthetic coding sequence
atgaactcaggcgtggcgatgaaatatggcaacgactctagcgccgagctaagcgagttgcatagtgcagcactcgcatcacttaagggagacattgtggagttaaacaaaaggttacagcaaactgaaagggaacgagatctgctggagaaaaagctggcaaaggcccaatgcgaacaaagtcacctgatgagagaacacgaagatgtccaggagcggacaacactgagatatgaagaaagaatcactgaacttcactccgtcattgcagagctgaacaaaaagatagatcgactgcagggcactaccatccgtgaagaggacgaatattcagaactacgatctgagctgtcacagtcccagcatgaagtgaatgaagattccagaagcatggatcaagatcagactagcgtgtctattccggagaatcaatctaccatggtgactgcagatatggacaattgttctgatctgaacagtgaactgcagcgcgtactcaccggactagagaatgtggtgtgtgggaggaagaagtcctcttgttccttaagcgttgctgaggttgacaaacacatcgaacaattgactaccgccagcgagcactgcgatctcgctattaagaccgtagaggagattgaaggcgtattgggacgcgatttgtacccaaatctggcagaggagaggtcgaggtgggaaaaggagttggctgggttgagggaggagaacgaaagcctcaccgccatgctttgctcaaaggaggaggaactaaaccgtaccaaggccaccatgaatgctataagagaagagagagatcgtctccgacgacgcgtgcgagaactgcaaacccgtttacagagcgtacaggcgacaggaccctctagccctgggagacttacatccacaaaccgccctatcaacccgagtaccggggaattgtccactagttcaagctcaaacgacatccctatcgcgaaaatcgcggaacgcgtgaaactgtcgaagacccgctccgagtcttcctcctcagacaggcctgtgctgggcagcgaaatttcatccattggagtgtctagctcggtcgccgagcatcttgcacactccctgcaggactgttcgaacatccaggaaatctttcaaactctatatagccacggatctgctatatctgaatctaaaatacgagagtttgaagtggagactgaaaggctgaactcacgcatcgaacatttgaaatctcagaacgatctgctgaccattacactggaagaatgcaagtcaaacgctgaacgcatgagtatgttggtgggcaaatatgaatccaatgctacagctctgcggctggccttgcaatattcagaacagtgcattgaggcttatgagctcctgctagcactcgcagagtccgaacagtcccttatcctcgggcagtttcgtgccgctggggttggaagctcacctggtgaccaatcaggcgacgagaatatcacccaaatgctgaagagagcccacgactgccggaaaacagccgagaatgctgccaaagctcttctgatgaaactggacgggtcctgcggtggcgcatttgccgtggccggttgctccgtccagccttgggaaagtctgtccagcaactctcatacctcaacaacaagttccacagcctcgtcttgcgatactgaattcaccaaagaagacgagcagcgtcttaaagattatatccaacagctcaagaatgacagggccgctgtgaagctgacgatgctggagcttgaaagcattcacattgacccactatcctatgatgtgaaaccacgaggtgattctcagcgcttagaccttgaaaacgccgtgctgatgcaggagttaatggccatgaaagaagagatggctgaactaaaggctcagctgtacttgttggagaaggagaagaaggcactggaacttaaacttagtactcgcgaggcccaggagcaggcttacctcgtgcatattgaacacctgaagtctgaggtcgaggaacaaaaggaacagcggatgcgctcgctaagttcaacaagctccggaagtaaggacaagcccggtaaggaatgtgcagatgctgctagtcctgcactcagcttggccgagttacgcactacatgttccgagaatgagcttgcagctgagtttaccaatgcaatacgccgagagaagaaattgaaggcccgagtgcaagagctggtctccgccttagagcgattgactaaaagtagcgagatcagacaccagcagtccgccgaattcgtgaacgatcttaagcgcgcaaatagcaaccttgtggccgcttatgagaaagcaaaaaagaagcaccagaataagctcaagaagctggagagtcagatgatggcaatggttgagcgccacgagacccaggtgagaatgctgaagcaacgcatcgccctcctggaagaagagaattcaagaccccataccaatgagacatcactctag

SEQ ID NO: 29574 - DNA, 2133 bp, Artificial Sequence
  Description of Artificial Sequence: Synthetic coding sequence
atgaaactggttttcttagtgttgctgtttctgggagctctcggactgtgtctagccggaaggcggaggagcgttcagtggtgcgcagtcagccagcccgaggctacaaaatgttttcagtggcagcgtaatatgagaaaagtgcgtggcccaccagtttcatgtataaagagagacagccccatccagtgcattcaagccattgcagagaatcgcgcagacgcagttactcttgacgggggtttcatttacgaggccggactggccccttacaagctccgccctgtggccgctgaggtttatggaactgaacggcagcctcgtactcattattacgctgtcgctgtcgttaagaaaggtgggagcttccagctcaatgagctacagggccttaaatcgtgccatacaggactgcggcgtacggctgggtggaatgtgcccattggtacgcttcgcccattcctaaactggaccgggccaccagaaccgattgaggctgcggtggccaggttcttttcagctagttgtgtccccggagccgacaaggggcagtttccgaatctgtgccgattgtgcgcgggaacaggggagaataaatgcgccttctctagccaggaaccttacttttcttattccggggctttcaagtgcctgcgcgatggggcaggggatgtggcatttatccgcgagtctacagtcttcgaggatctgagcgatgaagcagagcgagacgagtacgagctgctctgtcccgataacactaggaagcccgtggacaagttcaaagactgccatcttgccagggtgccttctcacgcagttgttgctcgatccgtgaatgggaaggaggatgctatctggaatctgttacggcaagcacaggagaaatttggcaaggataagagtcctaagttccagctctttggctccccctccgggcagaaagacctgctctttaaagactcggcaataggcttttctcgcgtgccaccccgaatcgactctgggctataccttggttccggatacttcacggccattcagaacctccgaaagtcggaagaagaggtggcagctagaagagccagagtcgtgtggtgcgcagtcggcgaacaagagctcagaaaatgtaaccaatggtccggattatccgagggctcagtcacctgcagtagcgcatccacaacggaagactgtatcgcccttgtactaaagggggaggccgacgcaatgagcctggacgggggatatgtctataccgccggtaagtgcggcctggtgcctgtcctggcggaaaattacaaatctcagcaatcatccgacccggaccccaattgcgtggatcgccctgtagaagggtatctggccgtcgcagtggttcggcgaagcgatacttctttaacatggaacagcgttaagggcaagaaaagctgtcatacagcagtggacaggacggctggctggaatatcccaatgggactgttgttcaaccagacaggaagctgcaagttcgacgaatatttctcacagagctgcgccccaggctctgaccctcgcagcaatttgtgcgctctgtgtataggagatgagcagggcgagaacaagtgtgttccaaatagcaacgagaggtactacggatacactggagcatttagatgcttagcagagaacgccggagacgttgcattcgtgaaagatgttacagtgctccagaacactgatggcaacaacaacgaggcttgggctaaggacctgaagctggccgactttgccttgctttgtcttgatggcaagagaaagccagtgacagaggcgagaagctgtcacctggccatggcgcctaatcatgctgtcgtcagcagaatggataaggtggagcggctgaagcaggttctgttgcatcagcaagctaaatttggaagaaacggatccgattgtcctgacaagttctgcctgtttcagagcgagactaagaacttgctgttcaacgacaataccgaatgccttgccaggttacacggaaagactacatacgagaaatatctgggtccccagtacgtagctggcattaccaacctgaagaaatgctctacttcccctctcctggaagcatgtgagttcttacgtaaatag

SEQ ID NO: 29575 - DNA, 1656 bp, Artificial Sequence
  Description of Artificial Sequence: Synthetic coding sequence
aaacctctcctcaatcatgttctggccatcaagggacccaggagcagatggaggactttttacaatattgcgacacggagaaaggccctgaagaacccgagtgaggagtatggcaagatacttgaggttgtgggccgatacagtgtacacaacgccggaatcagcttctccgtcaagaagcagggcgagacagtggctgacgtgagaactttgcccaacgcctctaccgtcgataatattcgttctatatttgggaacgccgtctctagagagctgattgaaattggctgtgaagataagacactggcttttaagatgaacggatatatctctaacgccaattacagcgtgaagaagtgtatttttctgctgttcatcaaccatcggctggttgagtctacttccctgcgcaaagccatcgaaaccgtgtatgcagcttacctgcccaagaacacacacccctttttgtacctgtcccttgagatctctccccaaaatgtggatgttaacgtgcacccaacaaaacatgaagtgcacttcctgcatgaggaaagtatcctggagagggtgcagcagcatatagagtccaagctcctagggagcaacagtagccgaatgtactttactcaaaccctgttgccaggactggccggtccctctggcgaaatggtcaaatccactacctccctcactagttctagtacttctggctcaagtgataaagtgtacgcccaccagatggtgcgaactgatagtcgagaacaaaagctggatgcatttctgcagcctctgtccaagcctctgtcgagccagccacaagccattgttaccgaggataaaacggacatttcctctggacgggctagacaacaggatgaagaaatgctcgagctgccggcacccgctgaggtcgccgctaaaaaccaaagtctggagggcgatacaaccaaaggaacttcagagatgtccgaaaaacgtggaccaacttcatctaatcctcgcaaaaggcaccgcgaagactccgacgtggagatggtcgaagatgattccaggaaagaaatgacagccgcatgcacccctcgtaggaggattataaacctgaccagtgttctcagcctgcaggaagagataaatgagcaggggcacgaggtattacgggagatgcttcataaccactctttcgtaggctgtgtaaacccgcagtgggctctcgcccaacatcaaactaagctgtaccttctgaataccactaaactgtctgaggaattattttaccagattctgatttacgactttgccaacttcggggtgctgaggctatcagaacctgcacctctctttgacctggcgatgctggccctggatagcccggaaagcggttggacagaagaggatggtccaaaagagggattagcagagtacatcgtagagtttttaaagaaaaaggccgagatgctcgcggattatttttcattagaaattgacgaaagcgaggtcccaggtagcattccaaactcatggaaatggaccgtcgaacacatcgtttacaaagccttgcgttctcatatcctacccccaaagcacttcactgaggacggtaatatcctgcagctggctaatctgcctgacctatacaaggtttttgaacggtgttag

SEQ ID NO: 29576 - DNA, 351 bp, Artificial Sequence
  Description of Artificial Sequence: Synthetic coding sequence
atgagtgagaagagaggaccaaccagtagtaatcctagaaaacgccatagggaagatagtgatgtagagatggtggaggacgattctcgcaaagagatgactgccgcatgcacacctaggcgacgcataatcaacttgacatctgtgctttcactgcaagaggagattaatgagcagggtcatgaagtgctgagggaaatgctgcataatcattccttcgtcggctgcgtgaatccccagtgggccctggcccaacatcagaccaaactctatttgttgaatactacaaagctgcgtgttaagtgcttagcccctttccaaaccccagggagtggactgtggaacacgtag

SEQ ID NO: 29577 - DNA, 525 bp, Artificial Sequence
  Description of Artificial Sequence: Synthetic coding sequence
atgtcagaaaaacgtggcccaacatcaagcaatccacggaagaggcaccgcgaggattcagatgtggagatggtggaagacgactccagaaaggagatgacagctgcatgcacgcctagacgccgaatcatcaatttgacatcagtcctgagcctccaggaagagatcaacgagcaaggccacgaggttttacgagaaatgttgcacaatcacagctttgtggggtgcgtgaacccccaaccatggcattctatcaagcccagctacacattctctacacccccttcgttttcggaagagctgttttatcaaatcctgatctacgatttcgccaactttggagttctacgcctaagtagcgaggtgccgggatctatccccaactcatggaaatggactgtagaacacatcgtgtataaggccctgagaagtcacatactccccccaaagcacttcaccgaggatgggaacatcctccagctcgcaaatttgccagatctgtacaaagtcttcgagagatgctag

SEQ ID NO: 29578 - DNA, 1977 bp, Artificial Sequence
  Description of Artificial Sequence: Synthetic coding sequence
atggcctttgaagcgttagcatcaatcagtcacgttgcccacgtgacgatcacaacaaagacagctgacggtaaatgcgcctatcgggcaagctattctgatgggaagttgaaggcgcctcctaagccgtgtgccggaaaccagggcacccagattacagtcgaagatttgttctataatatagctaccagacggaaggcactgaagaacccatctgaggaatacggaaagatcctggaggtggtgggacgctacagtgtacataacgctgggatttccttcagcgttaaaaagcagggggagacggtcgcagacgtcaggactctgcccaatgcaagtacagtggataatataagaagcatcttcggcaacgcagtgagcagggagctgatcgaaattgggtgcgaagataaaactcttgcatttaagatgaatgggtacatcagcaatgctaactactcagtgaagaagtgcattttccttctcttcattaatcatcgcttggtagagtccacctctctgaggaaagctatcgaaacagtatacgcggcatacctgcccaaaaacacacacccgttcttgtatttaagtctggaaataagtcctcagaacgtggacgttaacgtccatcctacgaaacacgaagtgcatttcttacacgaggagtcaatcctggagcgcgtccagcagcacatcgaatccaaactgctgggatcgaatagcagcagaatgtactttacacaaacactgttacctggactagccggaccctcgggagagatggtcaagtctactacctcgctgacatctagctccacttctggaagtagcgacaaagtctacgcacatcaaatggtccgaacagattcccgcgaacagaaactggatgccttcctccagcccctgtccaaacccctttcctcacagccccaagctattgtcaccgaggacaagacagacatctcgtcaggccgagcacgccagcaggacgaggagatgttggagctgcccgcaccggctgaggttgcagctaagaaccagagcctcgagggtgatacgactaaggggacttctgagatgtctgagaaaagggggcctacctcaagcaacccgaggaaacgccacagggaagactccgacgtggaaatggtggaggacgatagcagaaaggagatgacagcagcctgtacccccaggcgtaggattataaacctcacatcagtgctgtccctacaggaagaaatcaatgagcagggccatgaggtcctgcgggagatgctccataatcatagcttcgtggggtgcgtgaatccccagtgggccttggcccagcaccagacaaagctgtacctgctgaacactacaaagctgtctgaggagttattctatcaaattcttatctatgacttcgctaactttggtgtgttacgacttagtgagccggctccactgtttgatttggctatgctggcgttggattcacccgaatccgggtggaccgaagaagatggaccaaaagaagggttagcggagtacatcgtcgagttccttaaaaaaaaggctgagatgctcgctgattatttttccctagaaatagatgaagaggggaatttgattgggctcccgctactgatagacaactacgtgcccccactggaggggctgcccatcttcatcctacggctagccacagaggtgaactgggatgaggaaaaggaatgttttgaatcactaagcaaggagtgtgcaatgttctatagtattcgcaaacaatacattagcgaggagagtaccctgtctggccagcagtctgaagttcccggatccatacctaactcctggaaatggacggtggaacatatagtttacaaggcactgcgctcccacatactgcccccaaagcacttcactgaggatgggaatatcctgcagctcgcaaacctacctgacctatacaaggtgttcgagagatgctag

SEQ ID NO: 29579 - DNA, 960 bp, Artificial Sequence
  Description of Artificial Sequence: Synthetic coding sequence
atgattgaaaattgcctggacgccaagtccaccagcatccaggtaattgtgaaggaaggcggtctgaaattgatccaaattcaggacaatggaacgggtatccggaaggaggacctagatatagtgtgcgaacgcttcactacatccaagctacaaagttttgaggacctagcttccatctccacatacggatttaggggtgaggcactcgcaagcatctcgcacgtagcccacgtcacaattacgaccaaaactgcagatggaaaatgtgcctatagagcctcctactcagacggcaagctgaaggccccaccaaagccatgcgctggaaaccagggtactcagatcactgtggaagatctgttctacaacatcgccacaagacggaaggctttgaagaacccaagtgaagagtacggtaagatcctagaagtagtcggaagatacagtgtccacaatgcaggcatctcatttagcgtgaagaaacagggggagactgtagctgacgttcgcacactccctaacgcctccacagttgacaatatcaggtcgattttcggtaatgccgtaagtagagagttaatcgagattggctgcgaagataaaacgttagctttcaaaatgaatggctacatcagtaacgctaattattccgtgaaaaagtgcatatttctgttgttcatcaatcataggctggtagaaagtacctccctgcgaaaggcaattgagaccgtgtatgccgcatatctgccaaaaaatactcaccccttcttatacctttcccttgagattagtccccagaatgtggacgtcaacgtccaccccacaaaacacgaggttcatttcctgcacgaagaaagcatcctcgagcgagttcagcagcacatcgaaagtaagctgctggggtccaactctagccgaatgtacttcacacaaaaagagacaagtggtaggttctag

SEQ ID NO: 29580 - DNA, 1548 bp, Artificial Sequence
  Description of Artificial Sequence: Synthetic coding sequence
atgaatggatacatctcaaatgctaactacagtgtcaagaaatgtatcttcttactattcatcaaccatcggctggtggagtccaccagcctacgtaaggccatagagactgtttacgctgcgtatttgcctaagaatactcacccttttttgtacctcagtcttgagatttcaccacagaacgttgatgtaaacgtgcatccaaccaagcatgaggtgcactttctgcacgaggaatcaatcttggagcgcgttcagcagcacatagaatccaagctgctgggtagcaactcatctagaatgtacttcacccaaacacttcttcccggtctggctggacctagtggagagatggtgaaaagcacaacctctctcactagtagctccactagcgggtcatcagacaaggtatatgctcaccaaatggttcgcaccgactcaagggagcagaagcttgacgctttcttgcaaccattgagcaagccactttcatcgcaaccccaggcgattgttacggaagataagacagatatctcatcaggcagagcacggcagcaggacgaggagatgctggagctcccggctcccgctgaagttgctgctaaaaatcagtccttggaaggggacacgactaaaggtacgtcagagatgtccgagaagcgcggtcccacttcctccaacccgcgtaaacgacatcgcgaagacagcgacgttgaaatggtggaggacgactcgcgaaaagagatgaccgcagcttgcacaccaagacgccgtatcatcaatttgacgagtgtattaagcctccaggaagaaatcaacgagcaaggtcacgaggtgctgagggaaatgctacataatcatagttttgtaggctgcgtgaacccccagtgggctctcgcacagcaccagacgaaactctacctgttgaataccaccaagttatccgaggagctgttctatcaaattctgatctacgattttgcaaactttggagtgttgcgcttgagcgaaccagctccactcttcgacttggcaatgctggcactggactcccctgagagtggatggacagaagaagacggccctaaagagggccttgcagaatacatcgtcgagttcttgaagaagaaggcggagatgctggccgattacttcagccttgagattgacgaggaaggaaatttaatcggcctgccgctcctcatcgataactacgtcccgccattagaggggctccccatcttcattctgcggttggccacggaggtgaactgggacgaggaaaaggagtgttttgagagcttatcaaaggaatgtgccatgttctattccatacgcaaacagtatataagtgaagaaagtacgctgagtgggcagcaatctgaagtccctgggagcatccccaattcatggaaatggacagtggagcacatcgtgtataaggccctgcggagccacatcctcccgccaaaacacttcactgaagacggcaacattctccagctcgcaaatctccctgacctgtataaggtgttcgaacgctgttag

SEQ ID NO: 29581 - DNA, 2040 bp, Artificial Sequence
  Description of Artificial Sequence: Synthetic coding sequence
taaaggctcgatgaaaccgtggttaacaggattgccgcaggcgaggtgatacagcgcccagctaacgccattaaggagatgattgagaactgtctggacgccaagtcaacctcaatccaagtcatagtgaaggaggggggattaaagttgatacagatccaggacaatggcacgggaattcggaaggaggatctcgacattgtatgtgaacgctttacaacttcaaaattacagagttttgaggatctggcaagcatcagcacttatggattcaggggcgaagccctggcgtccatttcgcacgtcgctcatgtcactataaccaccaagaccgcagacggcaaatgcgcctacagagcctcgtatagcgacggaaagctgaaggctccacccaagccttgtgcaggaaaccagggcacccaaataactgtagaggacctattttacaatattgctaccaggagaaaggccttaaagaacccctccgaagagtacgggaaaatactcgaggttgtcggcaggtacagtgtccataacgcgggaattagtttttctgtaaaaaaacagggagagactgtggccgatgtcaggacccttccaaacgcctctaccgtggacaatatacgttccatattcggaaacgctgtctccagagagttgatcgaaatcggttgtgaggataaaacgcttgctttcaagatgaacggatacatttctaacgcaaactactccgtgaagaaatgcatttttctgctgtttatcaaccatcgcctcgtggagagtacatctctcagaaaggccatcgagacagtgtatgccgcatacctgccgaaaaacacccacccttttctttacctgagtctcgagataagtccccagaatgtggatgtcaatgtgcacccaaccaaacacgaggtacactttctacatgaggaaagcattttggaaagagtgcagcagcatatcgagtccaaattgctgggatccaactcctcccgaatgtactttactcaaacactattgcctggtctggctggaccctcgggcgaaatggtgaagtccactacgtcgctcacgagtagtagcacatccggtagctcagacaaggtctacgctcaccagatggtcaggactgactcccgagaacaaaagttagacgccttccttcagcctctgtcaaagcccctcagtagtcagccacaggccatcgtaaccgaggacaagactgatatcagctctggtcgagctaggcaacaggatgaggagatgcttgaactgccggcacctgctgaggtggccgctaaaaaccaaagcctcgagggagatacgaccaaaggaaccagcgagatgtctgagaaacgaggacctacatcctctaatccaagaaagcggcaccgcgaggatagcgatgtagaaatggtagaagacgacagccgaaaagagatgactgctgcgtgcacacctcggagacgtatcatcaacttaacaagcgttttatccctgcaggaagaaatcaatgaacagggacacgaggtgttgcgcgaaatgcttcataaccatagttttgtgggctgtgtcaacccccaatgggcgttggctcagcatcagaccaagctgtacttactgaacaccacaaaacttagcgaggaactgttctatcagatactgatctacgactttgctaacttcggggtcctgcggttaagtgaacctgctccactgtttgatttggccatgttggccctcgatagcccagagagtggctggacggaggaagacgggccaaaagaagggctggctgaatatattgtggagttcctgaaaaaaaaggcagaaatgttggcagactatttttccctggagattgacgagagtgaggttccaggctcaatccctaattcatggaagtggactgtcgagcacatcgtgtataaggcactccggtcccacattttgcctccgaaacattttacagaggacggtaacatactccagctagccaacctcccggacctgtataaggtcttcgaacgctgctag

SEQ ID NO: 29582 - DNA, 1548 bp, Artificial Sequence
  Description of Artificial Sequence: Synthetic coding sequence
atgaacggatacatttccaatgccaattatagcgtgaaaaagtgtattttcctactgttcataaatcatagactggttgagagtactagcttgagaaaggcaattgaaacagtttacgccgcatacctgcccaaaaatacacacccctttctgtacttgtcactcgaaattagcccgcagaatgttgacgtgaacgtacatcccaccaagcatgaggttcactttcttcacgaagagtccatactggaacgagtccagcaacatatagaaagtaaactcctgggcagtaatagttctcgtatgtatttcacacagacgctcttgccaggcttagcaggtccaagcggggaaatggtcaagagtaccacctccctcacttcttcctccacgagtggcagtagcgataaggtgtacgcacaccagatggttagaaccgacagcagggagcaaaaactggatgccttcctgcagccccttagtaagcctctgagctctcagccccaggcaatagtgacagaggacaaaacagacatttcttccggccgtgccaggcaacaggacgaggaaatgctggagctgcctgctcccgcagaagtggcagcaaagaatcagtccctggaaggggacactaccaagggaacgtcagagatgtctgagaagcgcggacctacttcatccaatccacgcaaacgccaccgcgaggattccgatgtcgaaatggtcgaggatgacagcaggaaggaaatgacagctgcctgcactcctcgtcgtcggattatcaatctcacctctgttctgtctctgcaagaggagatcaatgagcaggggcacgaagtgctgagagaaatgcttcacaaccactccttcgttggttgtgtcaatcctcagtgggccctcgcacagcatcagaccaagctgtacctcctgaacactactaaactgtccgaggagctgttctaccagatcctgatttacgattttgctaactttggcgtgttgagactgtccgaacccgctccactgtttgacctcgccatgctggctctggactcgccagagtccggatggactgaagaagatggacctaaagaaggtctggctgagtatatcgtggagttcctgaaaaaaaaggccgaaatgctggccgattacttttccctggagattgacgaagagggaaatctgattgggttacctctcctcatcgataattacgtgcctcctcttgaggggcttccaattttcatactacgcctcgccaccgaggtcaattgggatgaggaaaaagaatgcttcgagtcattgtccaaggagtgcgcgatgttttacagcataagaaaacagtacatctcggaggagagtaccctttcagggcaacagtccgaggttccaggttcgatccctaactcttggaagtggactgttgagcatatcgtttacaaggcactgagaagccatatcctaccaccaaagcattttactgaagacggtaatattttgcagcttgcaaacctgccggatctgtacaaggtctttgagcgatgttag

SEQ ID NO: 29583 - DNA, 1383 bp, Artificial Sequence
  Description of Artificial Sequence: Synthetic coding sequence
atgaacggctacatctctaacgccaattactctgtgaagaaatgcatatttttattgtttatcaatcaccggcttgtagaatctacgtctcttcgcaaggcaatcgagacagtctatgcagcttatctccctaaaaatacgcaccctttcctgtatctctccttagagatctcccctcaaaatgttgacgtcaatgtgcatcctacaaaacatgaagttcactttcttcacgaggagagcatactggagcgagtgcagcagcatatcgagtcaaagctgctaggctctaattcctcaagaatgtacttcacacagaccctgctccccggactggctgggccatccggagagatggtgaagtcaactacttccctcaccagttcctccacctccggcagcagtgataaagtctacgctcatcagatggtgagaaccgatagtcgggagcaaaagctggatgctttcctgcagcctctgagtaagcccctatccagccagccccaggctatcgtaaccgaagataaaacagatatcagctcaggcagggccagacaacaagacgaggagatgctcgaactgcccgctcctgcagaggtggccgctaagaaccaatctttggagggtgacacgacgaaaggaacctccgagatgagcgagaaaagaggcccaacatcctccaaccccagaaagcggcacagagaggactccgacgtagaaatggtggaggacgactccagaaaggaaatgactgctgcatgcacgcccagacgcaggatcattaacctaaccagtgtgctcagtctacaggaagagatcaatgagcaggggcatgaagtcctacgagaaatgcttcataatcattccttcgtgggatgcgttaatcctcagtgggccttggcccaacaccagacaaaattatatcttctgaacaccactaaactctctgaagaactgttctaccaaatcctgatatatgactttgcaaacttcggagtactgagactttccgaacccgcaccgttatttgatctagcaatgctggccctcgattcccctgagagcggctggacggaagaggatggacccaaggaaggcttggctgaatacattgttgagtttctcaaaaagaaagcagagatgttggctgactactttagtctggagattgacgaggaaggcaacctgattggcctgccgctgctaatcgataactatgtgccgcctttggaggggctgcctatcttcatcttgcgcttagctacggaagtgaactgggacgaggagaaggaatgcttcgagagcctgtctaaggagtgtgccatgttctattctatccgaaagcagtacatctccgaggagagtaccttgagcgggcagcaatag

SEQ ID NO: 29584 - DNA, 843 bp, Artificial Sequence
  Description of Artificial Sequence: Synthetic coding sequence
atgatcgaaaactgcctagacgccaagtccacaagtatccaagtgattgtcaaagagggtggcttgaagttgattcaaattcaggataacggcaccggcattcggaaggaagatctcgacatcgtctgtgagagattcaccacctcaaaactccagagtttcgaggatctggcttctatctccacttatggcttccggggagaggccctggcctcaatttcccacgtcgcacacgtcaccattactacaaagacggccgatggaaaatgtgcttacagggctagctattcggacgggaagctgaaggcgcctcccaagccgtgtgctggaaaccagggcacgcaaatcacagtggaggatctattctacaatattgcaacccgcagaaaagcactgaagaatccttccgaagaatacggaaagatcctcgaagtggtgggtcgctacagtgttcataacgccggaattagtttttctgttaagaaacagggcgaaaccgtcgcagatgtccgtacgctgccgaatgcgtccaccgtggacaacattcgcagcatcttcggtaatgcagtgagtcgagagctgatcgaaatcgggtgtgaagacaagacactggcgtttaaaatgaatgggtatatctccaacgcgaactattccgttaaaaagtgtatcttcctcctgttcatcaatcaccgcctggtagagtccaccagtctccgtaaagcaattgagaccgtttacgcagcgtatctgcctaaaaatacccacccgtttctgtaccttcgcctgtgttaccaggacctactggctccgttaggacgatggcttaatccacagcaggtgtag

SEQ ID NO: 29585 - DNA, 1548 bp, Artificial Sequence
  Description of Artificial Sequence: Synthetic coding sequence
atgaatgggtacatctctaacgctaactattctgtaaaaaagtgcatttttcttctcttcattaatcacaggctcgtggagagcacctcattaagaaaagcaatagagactgtgtatgccgcttacctgcccaaaaatacccatccattcttgtatttgagcctggagatctcccctcagaatgttgatgtgaatgttcatccaacaaaacacgaggtccattttctccatgaggaatctatcctcgagcgggttcaacaacacattgaaagcaagctgctgggaagcaactcttcacgcatgtatttcacccagacactgctccccggtcttgctggtccaagcggtgagatggtgaagtcaactaccagcctcaccagtagcagcacgtcaggatctagcgataaggtctatgcccaccaaatggtccggacagactccagggaacagaagcttgacgctttcttacagcctctgtctaagcccctgagcagccagcctcaggccatcgtgaccgaagacaaaacggatattagctccggtagggcccgacagcaagatgaggagatgctggagctacccgctcctgctgaggtcgcagctaaaaaccagtctctggagggcgacacaacaaaaggaaccagtgagatgagcgagaaaaggggtcctacaagctctaaccctaggaaaaggcaccgagaggacagcgatgtcgaaatggtagaagacgattcccgcaaggagatgactgccgcttgcacacctcggaggaggatcatcaatttaacaagcgtgcttagcttacaggaggaaattaacgagcagggacatgaagtacttcgggagatgttacataatcatagcttcgtggggtgcgtgaacccccagtgggccctggcgcagcaccagacgaagctctatctcctaaacaccaccaagctgtccgaagagctgttctaccagatactgatatatgattttgctaacttcggggtcctccggctgagtgagccagccccacttttcgatctcgccatgctagcgctggactcaccagagtctggctggactgaggaagacggcccaaaggaaggcctggctgaatacatcgtcgagttcttaaaaaagaaggccgaaatgttggccgactacttttctttagaaatcgatgaggaaggtaacctgattggtctccctctgctgatcgacaactacgtacctccactggagggactccctatcttcatcctacgacttgccaccgaagtgaattgggatgaggaaaaagaatgtttcgagagtctgagcaaggaatgtgctatgttttactccatacgcaagcaatatataagcgaagagtccacactttctggtcaacagtctgaggtgcctgggtctatcccgaatagttggaaatggaccgttgagcacatagtctacaaggccctgaggtcccatatcctccctcccaagcatttcaccgaggacgggaacatccttcagctggctaatctgcccgatttgtataaggtgtttgaaaggtgttag

SEQ ID NO: 29586 - DNA, 4290 bp, Artificial Sequence
  Description of Artificial Sequence: Synthetic coding sequence
atgattaaatgcttatctgtggaagtgcaggctaagctccgttctggactggcaatcagctccctggggcagtgcgtagaggagctggccctgaattctatagacgcggaggccaagtgtgtcgccgtccgcgtcaacatggaaacctttcaagtccaggtgatcgataatggcttcggtatggggagtgatgatgtggaaaaagttggcaacaggtactttacgtctaagtgccattccgtgcaagacctggagaacccacgcttctacgggttccgaggggaggctctcgcaaatattgctgacatggcgtctgccgtggaaatctccagtaagaaaaatcgcacaatgaagacctttgtgaaactcttccagagcggtaaggcacttaaggcatgtgaggccgacgtaactcgcgcaagcgccggaaccacagtgacagtgtataatctgttttaccagttacctgtgcggaggaaatgcatggatcccaggttggagtttgaaaaggtgcgacagcggattgaggccctgagcttgatgcatcctagtatatcattctccttacggaacgacgtcagcgggagtatggtcctgcaacttccaaagactaaggatgtttgctcacggttttgccagatttatggcctcggaaagagtcagaagctcagggagatcagtttcaagtacaaggaattcgaactgagcggatacatttcatctgaagcccattataacaaaaacatgcagttcttgttcgtgaacaagcggctggtattgaggacgaagctccataaacttatcgactttttacttcgcaaagagagcattatttgcaaacccaaaaacggcccaacctcaagacagatgaatagcagccttcgtcaccggagcactccagaactttacggcatctatgtcatcaacgtgcaatgtcagttttgtgaatacgacgtatgtatggaacccgctaagaccctgattgagttccagaattgggacacccttctcttctgtatacaggaaggtgtaaagatgtttctgaagcaagaaaaattattcgtggaactgtccggcgaggacatcaaagagttcagtgaggataacggattttcactgtttgacgctacactgcagaaacgagtaacgagcgacgagcggagcaactttcaggaagcttgtaacaatatcttagattcatacgagatgttcaatctccaatctaaggctgtgaaacgaaaaaccaccgccgagaacgttaatactcaatcatctagggacagcgaggcaacccgaaaaaacactaacgatgcctttctgtatatatacgaatcagggggacctgggcactcgaagatgaccgagccctcactgcagaataaagattcctcatgctcagagagcaaaatgttggaacaggagactatagttgcaagcgaggccggtgaaaacgagaagcacaagaaatccttccttgaacacagtagtctagagaacccatgcggaacaagcctggagatgtttctgtctcccttccagaccccctgtcatttcgaggagtccggacaggatctggaaatctggaaggagtccaccaccgtgaatgggatggccgctaacatcctgaaaaataataggatccaaaaccagccaaagcggttcaaagatgccactgaagtggggtgtcagcctttgccttttgcgaccaccttgtggggcgttcactccgctcaaaccgagaaggagaagaaaaaggaatcctccaattgtggcagacgcaacgtgttcagctatgggagggttaagctgtgcagtacagggttcataacccacgtggtgcagaacgaaaagacaaaatccaccgaaaccgaacactcttttaaaaactacgtgcgcccaggcccaacgcgggctcaggaaaccttcgggaacagaactcggcattccgtggagactccggatataaaagacctcgcttcaacgctgagcaaagagagtggacagttgcccaataagaagaattgccgaacaaatatatcttacggacttgaaaatgaacctactgcgacatataccatgttcagcgccttccaggaggggtccaaaaaatcccagactgattgcatcttgtctgacacttctccatcgtttccttggtatcgacatgtgagtaacgatagtcggaagaccgacaagttgattggtttttccaagcctattgtgcgcaaaaagctgagcctgtcttctcaattgggttccctcgagaagttcaaacgccagtatggaaaagtggagaaccctttggatacagaggtagaggagtctaacggggtgacaacgaatctctcactacaagtggaacccgatatattactgaaagacaagaatcggctggagaactccgacgtgtgcaaaataaccaccatggaacactcagacagcgatagctcctgccagcctgcaagccacatattaaactctgagaaatttcctttctctaaagatgaagattgcctcgaacagcagatgccaagcttgcgagagagtcccatgacacttaaagagctttccttgttcaaccgaaagccattggacttagagaagtccagtgaatctctggcctccaagctcagtcgtttgaaaggctctgaacgggaaacacagacgatgggaatgatgagccgctttaacgagctgccgaactcagactctagccgtaaggactctaaactttgctctgtactgacacaggacttctgcatgttgttcaataataaacatgagaagacggaaaatggagtgattcccacaagtgatagcgcaacgcaggacaacagttttaacaaaaattctaaaacacattctaactcaaacactacggaaaactgcgtaatcagtgaaacgcctttagtattgccgtacaataacagtaaggtcaccggtaaagattcggacgtgctcattcgcgcatctgagcagcagatcggcagtttggactctccatccggaatgttgatgaaccctgtggaggatgccaccggagatcaaaatggcatctgtttccagtcggaagaatccaaggcccgagcctgtagtgaaaccgaagagagcaacacatgctgctcagattggcagcgacacttcgacgtcgctttgggccgtatggtgtatgtcaataaaatgaccggtttgtctacgtttatcgcccctacagaagacatccaggcagcctgtacaaaggaccttactacggtggccgtggatgttgtactggagaatggctcccaatatcgatgccagcctttccggtcggatcttgtacttccgttcctgcctcgggctcgggctgaaagaactgtcatgcgacaagacaatagagatacggtcgatgacacggtgtcctccgagtctctccagtccctgtttagcgaatgggacaacccagttttcgccaggtaccccgaggtcgctgtagacgtgagctcaggacaagcagagtccctggccgtcaaaattcacaatattctttatccataccggttcaccaaagggatgattcactctatgcaagttctgcagcaggtcgacaataagttcattgcctgcttgatgtcaacaaaaaccgaggagaacggcgaggccgactcctacgaaaagcagcaggctcaggggtccggtcgaaagaaactgctgtccagcacgctgattccccctctcgaaattaccgtgaccgaggagcaacggagattgttgtggtgctaccataaaaatctggaagatctgggactggaattcgtgtttccggacacatcagattctctggtgttggtcggcaaggtgcccctgtgttttgtggaacgcgaagccaacgagctgcgccgtgggagaagcaccgttacaaagagcatcgtggaggagtttattcgagagcagctcgaactgctgcagaccactggagggatacaaggcacgctccccctcaccgtgcagaaagtgttggcatcccaagcttgtcacggcgctatcaagtttaacgacggactctctctccaagagagttgccggctgatagaggctctgtcatcctgccagctccctttccagtgtgctcatggcagaccctccatgcttccgcttgcagacatcgatcacctggaacaggagaaacagatcaagccgaacctgactaaactgcgcaaaatggcgcaggcctggagactattcggcaaggcagagtgtgataccaggcaatctttacagcagtcgatgcctccctgtgaacctccctag

SEQ ID NO: 29587 - DNA, 4362 bp, Artificial Sequence
  Description of Artificial Sequence: Synthetic coding sequence
atgatcaagtgcttatccgtcgaggtccaggcgaaactgcgatccggactggccattagcagcttgggacagtgcgttgaagagctcgccttgaactctattgacgcagaagctaaatgcgtggccgtgcgagtgaatatggagacgtttcaagttcaggttattgataacgggttcggcatgggctcagacgacgtggaaaaagtgggaaacaggtattttaccagtaagtgccattcagtacaagatctcgagaacccacgcttttacggctttcgtggtgaagccctggccaacatcgctgacatggcttccgctgttgagatctcctcaaaaaagaatcgcactatgaagacgttcgtgaagctgttccaatctgggaaggctctaaaagcatgtgaagcagacgtgactcgcgcttcagcgggaacgaccgtcaccgtgtataatttgttttatcagctacccgttcggagaaagtgcatggatccaagactggaatttgagaaagtacgccaacggatagaagctctttccttgatgcatcctagtataagcttctcactgcggaacgacgtttcaggaagtatggtccttcagctccccaagacgaaagatgtatgttcccggttttgtcaaatctacggcctgggaaaatctcaaaagttacgcgaaatatcgttcaaatacaaggaatttgagctgagtggttacatcagtagcgaagctcactataacaagaacatgcagtttctatttgttaataagaggctagtccttaggaccaaacttcacaaacttatagatttcctgttgcggaaagagtcgattatttgcaaacccaagaacggacccacctctcggcaaatgaatagcagcctgcggcaccggtccacacccgagctgtacggcatctatgtcatcaacgttcaatgccagttttgcgaatacgatgtgtgcatggagcccgctaagacattaattgagtttcaaaactgggacacacttctgttttgtattcaagagggcgtgaagatgttcctgaagcaagaaaagctctttgtggaactgtccggggaagacatcaaggagttctctgaggacaacggctttagcctcttcgatgccactctccaaaagcgagtcacatccgatgaaagaagcaattttcaggaggcctgcaacaatatcttggattcttacgagatgttcaacctgcaaagcaaggccgtgaagagaaagacaaccgctgagaacgtgaacacgcaatctagccgcgacagcgaagccacccgtaaaaacaccaatgacgccttcctctacatttacgagtccggcggaccgggtcacagcaaaatgaccgaaccttcattacagaataaggattcgtcctgctccgaaagcaagatgctggaacaggagaccatcgtcgcatccgaagcgggtgagaacgaaaagcacaaaaagtctttcttggaacactcctcccttgaaaatccttgcgggacttccttggagatgtttctctctcctttccaaacaccttgtcatttcgaagaaagtggacaggatttagagatctggaaagagagtaccacagtcaacggaatggcagccaacattctgaaaaataacaggatacaaaaccagccaaagagattcaaagacgcgacagaggtggggtgtcagccattaccatttgcaaccaccctctggggagttcactcagcccaaaccgaaaaagaaaagaaaaaggaatcaagcaactgtgggaggcgcaatgttttctcctacggccgagtgaaactgtgttcaaccgggtttatcacacacgtggtgcagaatgagaagaccaaatccaccgaaacagagcatagttttaaaaattacgtacgaccagggccaacccgagcgcaagaaacctttggaaataggacgcgccacagcgtcgagactccggacattaaagatctagcatccaccctgtctaaagagtcaggccaactacctaataaaaaaaattgccggacaaatatctcatacgggctggaaaacgaacctacagctacctacactatgttttccgcctttcaggagggaagcaagaagtctcaaacagattgtatcctgtccgacacaagcccgtctttcccatggtatcggcatgtgagtaatgatagcaggaaaactgataagctgatcggtttcagcaaaccaattgttaggaagaagctgagcctcagcagtcagttagggagcttggaaaaattcaagagacagtacgggaaggtggagaatccactcgacacggaggtcgaagaatcaaatggcgttaccaccaacctaagcctccaggtggagcctgacatcctgttaaaagataagaatcgcttagagaactccgatgtctgtaagataactacaatggaacattccgactccgattccagttgtcaaccggcttctcacatccttaattcagaaaagttcccgtttagcaaggatgaagattgcctcgaacagcagatgccaagtctgcgcgagagccctatgacactcaaagaactgagcctttttaacaggaagccactcgatctggagaagagctctgagtcacttgcgtctaagcttagccgcctcaaggggtcagaaagagaaacacaaacgatggggatgatgtctagattcaatgagttaccaaattcagatagtagtcggaaggattctaaactgtgtagcgtgttaacacaagatttctgtatgctcttcaataataagcacgagaaaaccgagaacggcgtgatcccgacatctgatagcgccacacaggacaactctttcaataaaaatagtaaaacgcactccaactctaatactacggaaaattgcgtgatttcggagacgccactggtgctgccttacaacaatagcaaagtcacgggcaaggactccgacgttctgattagagctagtgaacagcaaattggtagcttggacagcccgtccggaatgttgatgaatcccgtggaggacgcaacaggcgaccagaatggaatatgcttccagtcagaagaatccaaggcgagagcatgcagcgaaactgaggagtccaatacctgttgcagcgattggcagcgccacttcgacgtggcattaggcagaatggtgtacgtaaacaagatgaccgggctgtccacattcatagctcctactgaagacatccaagccgcttgtacgaaggatctgactactgttgcagtggacgtagttctggagaacggctcccagtataggtgccagccctttaggtcagatcttgtcctgccttttttgccacgcgcacgagctgagcgtactgtgatgcggcaagacaacagggacacagtggacgacacggtcagcagcgaatcgctgcagagcctattcagcgagtgggacaacccagtgttcgcaaggtaccccgaggtggcagtggatgtctcgtcaggtcaagcagaaagcctggccgttaagatccataacattctttacccgtataggttcaccaaaggcatgattcacagcatgcaagttctccagcaggtggacaacaagttcatcgcctgtctcatgagcaccaaaaccgaagagaatggggaggccggaggtaatctgctggttctggtggatcagcacgcagcccatgagcgcatacggttggaacagttgatcattgattcctatgaaaagcagcaagcacaaggttccggaaggaagaagctgctcagctcaacactaatacccccactagaaattactgttaccgaggaacagaggagactgctctggtgttatcacaagaacctggaggatctcggcttggagtttgttttcccggacacatccgattctctggttttagtaggaaaagttccactctgcttcgtggagagggaagccaatgagcttagacgtggcaggtctactgtgactaagtctatcgtggaagagttcatccgtgaacagctggagctgttacaaactactgggggaatccagggaactctgccactcactgttcagaaggttctcgcgagtcaagcttgtcacggcgcaattaaatttaacgatggactctccttgcaggaatcatgccggcttatcgaggctctgtcgtcctgtcagctgccgtttcagtgcgcacacgggcgacccagcatgcttcctctggcagacattgatcacctcgagcaggagaaacagattaagcccaacctgaccaagctgaggaagatggcccaggcttggagactgttcggtaaggcagagtgcgatacccgccagagcctgcagcagagcatgccgccttgtgaaccgccttag

SEQ ID NO: 29588 - DNA, 1176 bp, Artificial Sequence
  Description of Artificial Sequence: Synthetic coding sequence
atggtgtacgttaacaaaatgaccgggctgagtacatttatcgcacctacagaggacatccaggccgcttgcaccaaagatttgacaactgtggccgtggatgtggtcctggagaatgggagtcagtatcggtgtcaaccttttcgtagcgacctcgtgctccctttcttgcctagggccagggctgaacgtactgtgatgcgccaggataaccgagatactgtagatgacaccgtgtcctcggagagccttcagagtctattctccgaatgggataatcctgtgttcgctaggtaccccgaggtcgcagtcgacgtgagctcaggccaggcagaaagcctagcggttaaaatacacaatattctatacccgtataggttcaccaagggcatgatacactccatgcaggtattgcagcaggtggacaataagtttattgcgtgtcttatgtcaacaaaaaccgaggaaaatggggaggcgggaggcaatctcctggtcctcgtcgatcagcacgcagcccatgagagaatacggctggagcagcttattatcgactcgtatgagaaacagcaggcacaaggaagcggaagaaagaagctgctgagctccacgttgatccctcctctcgagatcactgtaacagaagaacagcgcaggctgctctggtgctatcacaaaaacctggaggacctgggccttgagtttgtatttccggacacaagcgatagcctggtgctcgttggtaaagtccccttatgctttgttgaacgcgaggccaatgaactgcggaggggtagatcgaccgtcactaaaagcattgtcgagttgctacagactactggaggtatccaaggaaccttgcccctgacggtgcagaaagtgttggcttcccaggcttgtcacggcgctatcaaattcaatgatgggctgagcctgcaggagtcatgcaggctaatagaggccctttcctcttgccaattgcccttccaatgtgcccacggcagaccctctatgctcccactggcggacatagaccatctagagcaagagaagcagattaaacctaaccttaccaaattacgcaaaatggcccaggcttggagactattcggtaaagccgaatgcgatacaaggcagagtctgcaacaatccatgcctccctgcgagcctccttag

SEQ ID NO: 29589 - DNA, 597 bp, Artificial Sequence
  Description of Artificial Sequence: Synthetic coding sequence
atgaaccctgtggaggacgctaccggggatcagaacggaatttgttttcagtcagaggagtccaaggcgagagcttgcagtgagactgaggaaagcaacacgtgttgcagcgactggcaacgacattttgatgtggcgttagggaggatggtctacgtaaataaaatgactggactctccacctttattgcccctactgaggacatacaggcagcatgtaccaaggatctgaccacggtcgcagtggacgttgtcctggaaaacggatctcagtaccgatgtcagccattccggagtgatcttgttttaccctttctgcctagagccagggctgagaggaccgtgatgcggcaggataacagagatacggtggacgacaccgtatcctctgagtccctccagtcactcttttctgagtgggataacccagtgtttgcaaggtacccagaagtgcttcagcaggttgataacaaattcatcgcttgcctgatgtcaaccaaaactgaggagaatggggaagccgctgaattgatgatgctccaagatccgtgttgccgccagagtagggaggatgagaatcatgagttctccctgtag

SEQ ID NO: 29590 - DNA, 489 bp, Artificial Sequence
  Description of Artificial Sequence: Synthetic coding sequence
atgatcaaatgcctttccgtagaagtgcaggctaaactgcgttcgggactggctatctcaagccttgggcagtgtgtagaggagctcgcccttaattctatcgacgctgaagcaaagtgtgtcgcagtcagagtgaatatggagacctttcaggtgcaggtcattgacaatggatttggcatgggcagcgatgacgtcgaaaaggttggcaatcgatattttacaagtaagtgtcacagtgttcaggatctggagaaccctaggttttacggctttagaggggaggctctcgccaacattgcagatatggcatccgccgtggaaatttcatctaaaaagaatagaacgatgaaaacatttgttaaactgttccagagcgggaaagcattgaaggcatgtgaagcagatgttacaagagctagcgccggaactaccgtgactgtttataacctgttttaccaactcccagtgagacgcaagtgtatgtag

SEQ ID NO: 29591 - DNA, 4362 bp, Artificial Sequence
  Description of Artificial Sequence: Synthetic coding sequence
atgatcaaatgtctctcagtggaggtccaggccaagctgagatccggtttggccatttcttcccttgggcagtgcgtcgaggaactcgcattgaactcaatcgacgcagaggctaagtgtgtggccgtacgggtcaacatggagacatttcaggttcaggtcatcgataacggcttcgggatgggatccgacgacgtcgagaaggtaggcaaccggtattttacatcaaaatgtcattccgtccaggacctggagaatcccaggttttatggttttcgaggagaagcactggcaaatatcgccgatatggcatcagccgtcgagatatcttctaagaaaaaccgtacaatgaaaacgttcgtcaaattatttcagtcaggtaaggccttgaaggcctgcgaggccgatgtcacaagagcctcagccggtacaactgtgaccgtgtacaacctgttttaccaactgccagtgaggagaaaatgcatggatccaaggctggagttcgaaaaggtgcgacaacggatagaggccttatctctgatgcacccgtctatatctttttcgttaaggaatgatgtttctggctcgatggtgctccagctccccaagaccaaggatgtgtgctcccgtttctgtcaaatctacggtttgggtaaatcacagaagctgcgcgaaatcagcttcaagtataaggaattcgagttgtcagggtacatttcatccgaggctcattacaacaaaaatatgcagtttctatttgtgaacaaacgcctcgttttacgaaccaagcttcataagttaattgacttcctcctgagaaaggagtccataatctgtaagcccaagaacggtccaacttcaaggcagatgaacagttccctccgtcatcgcagtacccccgagctctatggaatatatgtaatcaacgtgcagtgccagttttgtgagtacgacgtgtgtatggaacccgcaaaaaccctcatcgagttccagaactgggacacactcctgttttgcattcaggaaggagtaaagatgttccttaaacaggaaaagctgtttgtggagctgtctggagaagacattaaagaattttcagaagacaatggttttagtctgtttgacgccacactccaaaagcgcgtgacaagtgatgaacgctctaatttccaggaagcctgcaataacattcttgactcttatgagatgttcaacctccagtccaaggctgttaagagaaagacgacagccgagaatgttaatacgcaatcgtcacgtgattccgaagctaccagaaagaacaccaacgacgcatttctctacatatatgaaagcggcggaccaggtcactccaaaatgactgagccaagtctgcagaataaagactctagctgttccgagagcaaaatgctggagcaagagactatcgtggcatctgaagctggggaaaacgagaaacacaagaaatcgtttcttgaacatagctcactcgagaacccttgcggcacaagtttagagatgtttctgtccccattccagaccccctgccacttcgaggaatcagggcaggatttggagatttggaaagagtcgacaactgtgaatggtatggccgctaatatcctgaaaaataaccgcatacagaaccagcccaagcgctttaaggacgccacagaagtgggctgccagccattaccatttgccacaacgctatggggggttcattctgcacagaccgagaaggaaaagaagaaggagagtagcaactgcgggagaaggaacgtttttagctacggcagggtaaagctgtgtagcactggtttcattacgcatgtggtgcagaatgaaaagacaaagtcaacagaaacagagcatagcttcaagaactatgttagaccaggacccacaagagcccaggaaacatttgggaatagaacacgtcactctgtcgagactcccgacataaaggatttggcctccaccctaagtaaagaaagtggccagctcccaaacaagaagaactgtcgcacgaatatctcctacggtctggagaacgagcccacagcgacatacaccatgttctcagctttccaagagggtagcaagaaatcgcagactgactgcattctgtccgatacaagtcctagttttccctggtaccgccacgtgagtaacgactctcgaaagaccgacaaattaattgggttcagtaagcccattgttaggaaaaagttgtcactgtcatcacaattaggaagtctggagaaatttaagaggcaatacggaaaggtggagaacccacttgacacggaggtggaggaatccaacggtgtcactacaaacctgagcctccaagtcgagcctgacatactgctcaaagacaaaaatcgcctggaaaactctgatgtatgtaaaataacaacaatggagcactcagactctgatagttcctgccagcctgcatcacacattctgaacagtgaaaagttcccattctcgaaggatgaggactgcctggaacagcagatgcctagcctgagagagagccccatgaccctgaaagaactgagcctgtttaacagaaagccactggatctggaaaaaagttccgagtcactggccagcaaattgtctaggcttaagggaagtgagcgcgagacacagacaatggggatgatgagcagatttaatgagttgcccaattccgactcctcacggaaggattcaaaattgtgctccgtcctgacccaggacttctgtatgctgttcaataataaacacgagaaaaccgagaatggggtgatcccaacttccgatagcgccactcaagacaattcctttaacaagaatagcaaaacccactccaactccaatacaaccgagaactgtgtaataagtgaaacacctctcgtcctgccctataacaacagtaaagtaacaggcaaggattctgacgttctgattagagcctccgagcagcagatcggatccttggattcgccaagtgggatgctcatgaaccctgtggaggacgccacgggagaccagaacgggatctgctttcaaagcgaggagagtaaggcgagagcttgcagcgagaccgaggaaagtaacacgtgttgctccgactggcagagacactttgatgtagccctgggcagaatggtctacgtaaacaaaatgaccgggctgtcaaccttcatcgccccaaccgaggatatccaagccgcatgcacgaaggacctgaccactgtggcggtcgatgtggtcctcgagaatggatcacagtatcgttgccagcctttccgtagtgatctcgtactgccattcctgcctcgtgctcgcgctgagcggacagttatgagacaggataatcgggacaccgtagacgacaccgtgtcctctgagtcattacagagcctgttttccgagtgggacaaccccgtctttgctaggtatcccgaggtggcggttgacgtttcttccggccaggcagaatcactggcggtcaaaatccacaacatcctttacccctaccgcttcaccaagggcatgatccattccatgcaggtcttacagcaggtggataataaattcattgcctgcctgatgtccactaagaccgaggagaatggagaggccggaggaaatcttctcgtattagtagaccagcacgctgcccacgaacgcattcgtctggagcagcttatcattgattcctatgagaaacagcaggcccagggttccggaaggaagaagttactttcttcgactcttatcccccctcttgagattactgtcacagaggaacagcgacggctgttgtggtgttatcataaaaaccttgaggacctgggcctcgaatttgtgttcccagacacatccgacagcctggtgctggtggggaaagtgccattatgcttcgttgaacgcgaggcgaacgagctgcgcagaggacgctcaacagtgacaaagtcaatcgtggaggagttcatacgcgagcagctggagctattgcagacaactggaggcattcaaggtacgttaccgctgaccgtccagaaagtcctggcttcgcaggcctgccatggcgcaatcaagtttaatgatggcctatccctgcaggagtcctgtcggctcattgaggctctgtccagctgtcagctgccattccagtgcgcacatggaagaccatccatgttgcctctggcagacatcgaccacctcgaacaggaaaaacagatcaaaccaaacttaactaagttgcgcaagatggcacaggcttggaggcttttcggcaaggcagagtgcgacaccaggcagtcccttcaacaatctatgcccccttgtgagcctccttag

SEQ ID NO: 29592 - DNA, 321 bp, Artificial Sequence
  Description of Artificial Sequence: Synthetic coding sequence
atgataaaatgtttatccgtggaggtccaggctaagctgcggtccggactggccatctcttctttaggacagtgtgtggaggagttagcacttaacagcatagatgccgaggccaagtgcgtggcagtacgcgtgaatatggagacttttcaggtacaagtgattgacaatggcttcggcatgggcagtgacgatgttgagaaggtcggcaataggtattttactagtaaatgccattccgttcaggacctggagaaccccaggttttatggtttcaggggcgaagcattggctaatatcgccgacatggccagcgcctag

SEQ ID NO: 29593 - DNA, 135 bp, Artificial Sequence
  Description of Artificial Sequence: Synthetic coding sequence
atggctgacaagcctgacatgggagagatcgcgagttttgacaaagctaagttgaagaaaaccgagactcaggaaaagaataccctacctactaaggagaccatcgagcaggaaaagcgctctgagatctcctag

SEQ ID NO: 29594 - DNA, 1026 bp, Artificial Sequence
  Description of Artificial Sequence: Synthetic coding sequence
atggccgtccaacctaaggagacactgcaacttgagtcagctgccgaggtcgggtttgtaaggttctttcaaggtatgccggaaaagcccacgaccaccgtcaggctattcgataggggagatttttacactgcgcacggcgaagacgctctgctagccgcaagagaggtgtttaagacacagggagtcataaaatacatgggcccagctggcgctaaaaatttgcaaagcgtggtgctgagcaaaatgaatttcgaaagcttcgtgaaagatcttttactggttcgccaatatcgggtcgaagtctacaagaacagggctggaaacaaggcctccaaggagaatgactggtaccttgcttacaaggcatctcctggcaacctgagccaattcgaggatatcctgtttggcaataacgacatgtcagcaagtattggggtggtgggcgtaaaaatgtctgccgtggacggccaacgccaggttggcgtaggttacgtcgactccatccagcgcaagcttgggttgtgtgagttccctgacaatgatcagttctccaatttagaggctctgttaatccagatcggcccaaaagagtgtgtactgccgggaggagagactgctggggacatgggaaagctgcgccagattatccagcgcggaggcattctcatcactgaacgaaaaaaagccgatttctcaacaaaggatatctaccaagatcttaatagactactgaaggggaagaaaggtgagcagatgaacagcgcagtcctgccagaaatggagaatcaggtggcagtgtcttcgttgtctgctgttatcaagttcctggagctcttaagcgacgacagcaattttggccagtttgagctgactaccttcgacttttcccagtacatgaaattggatattgctgccgtcagggctctgaacctgttccagggatcagtggaagatacgaccggctcacaatccctggccgcactgctgaacaaatgtaaaaccccccaggggcagacctgttag

SEQ ID NO: 29595 - DNA, 2766 bp, Artificial Sequence
  Description of Artificial Sequence: Synthetic coding sequence
atggctgttcaaccaaaggaaaccctgcagctagaaagtgcagcagaagtcgggttcgtaaggttctttcagggtatgccagaaaagcctactacaactgttagactcttcgaccgaggcgatttctacactgcacacggagaggacgcgcttctggcggcacgagaagtgtttaaaacccagggagtaattaagtacatgggccctgccggagccaagaatctgcagagcgttgtcttgagcaagatgaattttgaaagctttgtgaaggacctgctcctggtgcgccagtaccgggtggaggtgtataagaatcgcgcaggaaacaaagctagcaaagagaacgattggtacctcgcctacaaggcctccccaggcaatctgagtcagtttgaggacatcctgttcggtaataacgatatgtcagcttccatcggcgtggtaggggttaaaatgagtgcggtcgacggacagcgccaggtaggcgtagggtatgtcgacagtatccagcggaaactcggtctttgtgagtttcccgacaacgatcagtttagtaacctagaggccctcttgattcagataggccctaaagagtgcgtgctcccaggtggggaaactgcaggggacatgggaaaactgagacagatcattcaacgcggtggtatcctcatcacagaacgcaagaaggcagacttctccaccaaggatatctatcaggacttaaatcgcttgctgaaaggcaagaaaggtgagcagatgaactccgcggtgctacccgaaatggaaaatcaggtggctgtaagctccttgagcgccgtcatcaaattcctggaactgctgtctgacgattcaaactttggacaattcgagttgactaccttcgatttttcacaatacatgaagcttgatattgccgcagtgcgcgcactgaatctcttccagggctccgtagaagacactacaggctcccagtccctggctgcattgctgaataagtgcaaaactccccagggccagcgtttggtgaaccaatggataaagcagcctcttatggacaaaaaccgtatcgaagaacggctcaacctggtggaagccttcgtggaggatgctgagctaaggcagactctccaggaggacttgcttcgaaggttcccagaccttaaccggttagcaaagaagtttcagcgccaggccgcaaaccttcaggactgttatcggctgtaccaggggatcaaccagttgcctaatgttatccaggctttggagaagcacgagggcaaacatcagaagctgctgttagccgtctttgtgacaccccttacagacttaagatctgacttctccaaattccaggaaatgatcgagactactttggatatggaccaggttgagaaccatgagttcctcgtaaaaccttctttcgatcccaacttaagtgagttaagagagattatgaatgacctggagaaaaaaatgcagtcaacactgatatctgctgccagagatcttggattagacccaggaaagcagattaaactggacagctctgcacagttcggatactactttagggtgacttgtaaggaagagaaggttctccgcaacaacaagaatttcagtaccgttgatattcagaagaacggggtgaaatttacaaacagtaaactgacttccctgaatgaggagtacaccaagaataagaccgaatatgaagaggctcaggatgccatagtcaaggaaattgtaaatatttccagcgggtacgttgagcccatgcaaacactgaatgatgtgctggcccagctcgacgccgttgtcagtttcgctcacgtgtccaatggggcacctgtcccttacgtgcgcccagccatcctggagaaggggcaaggacgaattattcttaaagcttcccgtcatgcctgtgtggaggtgcaagatgagattgcatttatccccaacgacgtctacttcgagaaggataagcaaatgttccatattatcactggacccaacatgggtggcaagtctacctatatcagacagactggagtgattgtgcttatggcacagataggctgttttgtgccttgcgaaagcgctgaggtcagcattgtcgattgcatcctcgcccgtgtgggtgctggtgactcacagctgaagggtgtgagcacattcatggccgaaatgttagagaccgccagtatcctgcgatcggcaaccaaggatagcctgattatcatcgacgaattgggtcggggtacaagtacctacgatggctttgggctcgcctgggctatttctgagtacattgcaaccaaaatcggcgctttctgtatgttcgcaacacacttccacgagttaactgccctggccaatcaaatacccaccgtcaataacctccatgtgacagccctgaccacagaagagactcttaccatgctttaccaagtcaagaagggcgtgtgcgaccagagctttgggattcacgtcgcagaactggccaactttcctaaacatgttattgagtgcgcgaagcagaaggccctcgagctggaggaatttcagtatattggggagtcacaagggtatgacatcatggagccggcagcgaaaaaatgctatcttgagcgggagaatctgcgagtgacagagccaaaggaccagtgcctcatactgctcacatggaagagaaaactcagaggtggcaaacgcagcgcttgttctagacctgagaggcagaatcaaggtagtggagagctgagttag

SEQ ID NO: 29596 - DNA, 2163 bp, Artificial Sequence
  Description of Artificial Sequence: Synthetic coding sequence
atgattggaatttggcacatcagattgctcctggctatatctctgagcctcaagaccttcagtcttgtcaccatgatctgccagttaccgttggttctgtgggtgttgaagtgcccgcagttaatggcaagggatatgggcaagttaagacaaataatacaacggggaggtattctaataacagagcgtaaaaaagccgatttctctacaaaagacatctaccaggacctcaatcgattactgaagggcaagaaaggcgaacagatgaattccgccgtgctcccggagatggaaaaccagggcagtgtggaggacactaccggcagccagagtttggctgcccttttaaataagtgtaagacaccccaaggacagcgcctcgtcaaccagtggatcaaacagcctctgatggataaaaaccggatcgaggagagactgaacctcgtagaggcttttgtggaagatgccgagctcaggcagacactgcaagaagatctcctgcgcaggtttcctgatttgaaccggctcgccaagaaatttcagagacaagcagccaacctccaggactgttataggctatatcagggcattaatcagctgcctaatgtaatccaagctcttgaaaagcatgaggggaagcaccagaaactgctcctggccgtattcgttactccgctcactgatttacgaagcgatttttctaaatttcaggagatgattgagactactctggatatggaccaagttgaaaaccacgaattcctggttaaacccagcttcgaccctaacctgtcagagctccgggaaattatgaatgaccttgaaaagaaaatgcagtctaccttaatcagcgctgctagagatctcggcctggaccccggaaagcagataaagctggactcctccgctcagttcggatactactttagggtcacatgcaaagaggagaaagtgctgcggaacaataagaatttctcaaccgtggacatccagaagaatggagtcaagtttaccaatagtaaactcacaagcctgaacgaggaatacactaagaataagactgaatatgaagaggcccaggatgcaatcgtgaaggaaattgttaacattagctcaggatatgttgaaccaatgcagaccctgaatgacgtcctcgcgcaactagatgcggttgtctctttcgcacacgtgagcaatggggcacctgtgccatatgtccgtccagctattctggagaaggggcagggacgcataatcctgaaggcatcaagacacgcttgcgtggaggtgcaggacgagatcgctttcattccgaacgacgtctactttgagaaggacaagcagatgttccacataatcacaggccctaatatggggggaaaatccacatatatccgacaaacaggtgtgatcgttctcatggctcaaataggatgttttgttccatgcgaatccgcagaagtctccatcgtggattgcatacttgcacgagtgggagccggtgactctcagctgaaaggagtgtctacatttatggccgaaatgttggagaccgcatctatcctgcgttccgccacaaaagactccctaattattatcgacgagcttggaaggggtacctccacatacgacggcttcgggctggcttgggctatatcagagtatatcgccacaaaaatcggcgctttctgtatgttcgccacacactttcatgagctgactgctctcgctaatcagattcccacagtcaacaatttacacgtcaccgcactgaccacagaggaaaccctcacaatgctctatcaggttaagaaaggtgtctgcgaccaatcattcggaatccacgtggccgagctcgctaactttccaaaacacgtgatagaatgcgcaaaacagaaggcactggagctggaagaatttcagtacatcggagagtcacaaggttacgatattatggagcccgcagctaagaagtgttatcttgaacgcgaacagggggagaaaattattcaagaatttctttccaaggtgaaacagatgccatttaccgaaatgagtgaagagaacattactatcaagctgaagcagctgaaagcggaagtgattgcaaagaataattctttcgtcaatgagataatttctagaattaaagtgaccacctag

SEQ ID NO: 29597 - DNA, 2433 bp, Artificial Sequence
  Description of Artificial Sequence: Synthetic coding sequence
atggctgtccaaccgaaggagactctccagctcgaatcagctgcagaagttggctttgtgaggttctttcaagggatgcccgagaaaccaactaccacggtgcgcttgttcgatcgaggggacttctacactgcccacggtgaagacgcgctcctggcagctcgggaggtgttcaagacacagggagttataaagtatatgggaccagccggtgcgaaaaacttgcaatcagtggtgttgtcgaaaatgaactttgagagcttcgttaaggatctgctgttagtgcggcaataccgagtcgaggtctacaaaaacagagccggtaataaagcatccaaggaaaacgactggtatctggcgtacaaggccagtcccggtaacctctcacagttcgaggatattttgttcggaaacaatgatatgtcagcctctatcggggtggttggagtaaagatgagtgcagtagatggtcaaaggcaggtcggtgtgggatacgtggacagcatacagcgtaagctgggactgtgtgaattccctgataatgaccagtttagcaacctagaggccctcctgatccaaattggtccgaaggagtgcgtgttaccagggggtgaaactgctggcgacatgggaaagttacggcagattatacaaaggggtggcattctgattaccgaacgcaagaaagccgacttttccaccaaggatatttatcaggatcttaaccggttgttgaaagggaaaaaaggcgagcagatgaacagcgctgtgcttcctgagatggagaatcaagtggctgttagcagtttaagcgccgtgatcaagttcctggaattgctgagcgatgactccaatttcggacagtttgagctgaccactttcgacttttctcaatacatgaagctcgacattgccgcagtgagggctcttaacctcttccagggctcagtggaggacacaaccggaagccaatccctggccgcactgctgaacaagtgcaagacaccacagggccagcggttagtcaatcagtggattaagcagccacttatggataagaacaggatagaagaaaggctaaacctggtcgaagccttcgtggaggacgccgagcttagacagaccctccaggaggacttgcttaggagattcccagaccttaataggctggctaaaaaatttcagcggcaagctgcgaacctacaggattgctatagattatatcagggcataaaccagttgcctaatgtgattcaggcacttgagaagcatgagggtaagcatcagaagttgctcttggccgtctttgtcacacctctaacggatctgcggtctgactttagtaaattccaagagatgatagagaccaccctggacatggatcaagtggagaaccacgagttcttagtaaagccgtccttcgaccccaacctgtctgagcttagggagataatgaatgacctggaaaagaaaatgcagtctactttaatatccgcagccagagacctgggcttagaccccggaaaacaaataaaactagactcttcagcacagtttggctattacttccgtgtgacttgtaaggaggagaaggtgctcaggaataataagaacttttcgaccgtcgatatacagaagaacggagtcaagttcaccaacagtaagctaacatcccttaacgaggagtacacaaagaataagacagaatatgaggaggcgcaggatgccattgtgaaagaaattgttaatatctcctcaggctacgttgagcccatgcagacgctgaacgatgtcttggcgcagctggacgcagttgtatccttcgcacacgtctccaacggggcacccgtgccttacgtgagaccggctatcttggagaaaggacaaggcagaatcattttaaaggcctcccgtcacgcttgcgtagaagtccaggatgagattgcattcattcctaacgacgtctacttcgagaaggataaacagatgtttcacattatcaccgggcctaacatgggtgggaagagcacctacatccggcagacaggtgtgattgtgcttatggcccaaattggatgcttcgttccctgcgaatcggcggaggtttccatcgttgactgcatcctggctcgggtgggagcaggtgactctcagctgaaaggggtaagtacattcatggccgagatgctggagactgcaagtattttgcgtagtgctacaaaggatagtttaatcattattgacgagctcggcagggggactagtacttatgatggtttcgggttagcttgggccattagtgagtacatcgccaccaaaataggtgccttttgtatgttcgctaccatcttcatgaaccttctgccgtggcccatcaggtaccaactccttattatctatatgagccagcactctcccttgaagagaccgtag

SEQ ID NO: 29598 - DNA, 507 bp, Artificial Sequence
  Description of Artificial Sequence: Synthetic coding sequence
atggacaagaatcgtattgaagaacgcctgaacctcgttgaggctttcgttgaagacgctgagctgcgccagactctccaggaagacctgctgcgcagatttcccgacctaaatcgactcgctaaaaaattccaaaggcaagccgcaaacttacaggactgctacaggctttatcaggggatcaatcagctccctaatgtaatacaggccctggagaagcatgagggcaagcaccagaagctcctgctggccgtgttcgtgacccctctgacagaccttaggtccgactttagtaagtttcaggagatgatagagacaactctggatatggatcaagttgaaaaccacgagttcctggtcaaaccaagtttcgaccccaatctcagtgagcttagggagatcatgaatgatctagagaaaaagatgcagagtaccctgattagcgccgctcgagatttaggtggttctctccaacctcggtcctctcggcttgcctgcgccacctag

SEQ ID NO: 29599 - DNA, 1602 bp, Artificial Sequence
  Description of Artificial Sequence: Synthetic coding sequence
atggctgtccagcccaaggaaacgcttcagctggagtcagccgctgaagtgggcttcgtcaggttttttcagggaatgcctgaaaaacctacgactaccgtccgcctttttgaccgaggcgacttttacactgcccacggcgaggatgccctgctggctgccagagaagtcttcaagacccagggcgttataaagtacatggggccagcgggagccaaaaacctccagagcgttgtactgagtaagatgaactttgagagtttcgtgaaggatctgctgttggtgagacaatatagagtggaggtgtacaagaacagagctggcaacaaggcctccaaggagaacgattggtatctggcatataaagcatcccccggtaatctgagccagtttgaagatatactgttcggtaataacgacatgtccgcatcaatcggggtggtgggagtgaaaatgtcagctgtggacggccagcgccaggtcggagtgggatatgtggattctattcagcgcaaactggggctatgcgagtttcccgacaacgatcagtttagtaacctggaggccctcctgatacagattggtccaaaggaatgtgtgctcccagggggagagaccgcgggagacatggggaaactgagacagattatccagcggggtgggattctgattacagaaagaaaaaaagcagatttttccaccaaagacatttatcaggacctgaataggctgttgaaagggaagaagggcgagcagatgaatagcgccgtgctgcctgaaatggaaaatcaggtggctgtctctagcctatctgccgtgataaaatttctagagcttctttcagacgattctaactttgggcaattcgaactgaccacattcgattttagccagtatatgaagctggacattgcagctgtgcgggctttgaacctgttccagggctctgtcgaagacaccacaggatcccagtcgctggcagccctccttaataaatgcaagacccctcaggggcagaggttggttaatcaatggatcaagcagccgctgatggacaaaaacagaatcgaggaaaggctgaatctggtggaagcctttgtggaggacgccgagctgcggcagacccttcaagaggatctactcagacggtttccagacctcaaccgcctggcgaagaagttccagagacaggcagccaacttgcaggattgctatcgcctgtaccagggcatcaatcagcttcctaatgttatccaagccctggagaagcacgaaggcaaacatcagaagctgctcctggccgtgtttgtcactccattaaccgacctgaggagtgacttctcaaagttccaggaaatgattgaaaccacccttgacatggatcaggtggagaaccatgagtttctggtcaaaccaagcttcgacccgaatctctcagagctcagagaaattatgaatgatcttgaaaaaaaaatgcaatccaccctgatctcagccgctagagacctgggtttggacccaggcaagcagatcaagcttgattcatcggcgcagtttggctactacttcagggtcacttgcaaagagaagtccccatcttag

SEQ ID NO: 29600 - DNA, 1233 bp, Artificial Sequence
  Description of Artificial Sequence: Synthetic coding sequence
atggctgtccagccaaaggagacgctgcagctggagtctgccgcagaagtggggtttgtgaggtttttccagggaatgcccgagaagccaacaaccaccgtgagattgtttgacagaggcgacttctataccgcacacggcgaggacgctctgctcgcagccagggaagtgttcaagactcagggcgtgataaagtacatgggaccagccggagccaagaacctgcagagtgtcgtgttaagtaagatgaatttcgagtcttttgtcaaagacttgttgttagtgcgtcagtacagagttgaggtttataagaatagggcgggtaacaaagcctctaaggaaaacgattggtatttggcatacaaggcctcgcccggtaatctcagtcagtttgaggatattctgtttggaaacaatgatatgagtgcttctataggggtggtgggcgtgaaaatgtctgcggtggatggacagcggcaggttggtgtgggatacgtggatagcatccaaagaaagctgggtctgtgtgaattccctgacaacgaccagttcagtaacctagaggctctgcttatccagattggtcccaaggagtgtgtcctacccggaggcgagacagccggtgacatgggtaagctcagacaaatcatccagaggggcggtattttgattaccgagcgcaagaaggccgacttttctaccaaggatatttaccaagaccttaatcggttgctcaagggaaaaaaaggggaacagatgaacagtgccgtacttccggaaatggagaaccaggtggcggtttcgtccctgtcagctgtcattaaattcctcgaactgctgagtgacgatagcaacttcggtcagttcgagctgaccacatttgacttctcccagtacatgaagcttgacatagccgctgtccgcgctcttaatctgtttcaggggagtgtagaagatactaccggctctcagtccctggctgctttgttgaacaagtgcaagaccccccaaggccagagattagtgaaccagtggattaaacaaccgctgatggacaaaaataggatcgaggagcgtttgaacctcgtcgaagccttcgtagaggacgccgagctccgccagacccttcaggaagactacttcgtggatagccagattcttacagatctccccaggagcttcaaggataagcagcaaacctacaaaattgtcaccgactcaattagagtctag

SEQ ID NO: 29601 - DNA, 1458 bp, Artificial Sequence
  Description of Artificial Sequence: Synthetic coding sequence
atggccgtccaaccaaaggagacccttcaattagaatcggccgctgaggtaggctttgttaggttcttccagggcatgcctgaaaaacccacaactaccgtgcggttgtttgatcggggtgacttttacacggcccacggagaggatgccctgctcgccgcaagggaagtgttcaaaacccaaggagtaatcaaatatatgggcccagctggcgcaaaaaacctccagagcgtggtgctctccaaaatgaactttgagtcttttgtcaaggacttgctcctggtacggcagtatagagtggaggtttataagaaccgtgctgggaataaagcttctaaggagaatgactggtacctggcctacaaagcttccccgggaaatctaagtcagttcgaggatatcctatttggcaataatgatatgtcagctagtattggcgttgttggcgtgaagatgagcgctgtggacggtcagagacaggtaggcgttggctacgtcgattctatccaaagaaaactgggcctttgtgaatttccggataacgatcagttctcaaacttagaggccctgcttatccaaattgggccaaaagagtgtgtgttacccggaggggaaactgctggagatatgggaaaactgcgccaaatcatccagagaggaggcattctcattaccgagcgaaagaaggccgattttagcaccaaagatatttaccaggacttaaaccgccttctaaaaggcaagaagggggaacaaatgaattccgcagtcctgcctgagatggaaaatcaggtggctgtctcttcactcagtgcggtgatcaaattcctggagctgctgtccgatgactcaaattttggtcagtttgagctgacaacttttgatttctctcagtacatgaaattggatattgccgcagtgagagcattaaatctcttccaaggctccgtggaggacactacaggtagtcaatcgctggcagccctgttaaataagtgtaaaactccacagggccagaggctcgtgaaccagtggattaaacaacccctgatggataagaaccgcattgaggaaagattaaacctcgttgaggcttttgtagaagacgcggaactgcgccagaccttgcaggaagatttgctgcggcgattccccgatctgaataggcttgcaaagaagtttcagagacaggcagctaatctgcaggattgctatcgcctgtatcagggcattaatcagctgccaaacgtcatccaggcccttgagaagcacgagggcaaacaccagaaactgctgttagcggtgtttgtaactccactgacagaccttagaagcgattttagtaagttccaggagatgatcgaaaccacccttgacatggaccaggtggagaatcatgaatttttggtgaaaccgtctttcgatcccaatctgtctgagttgagaaataatgaatag

SEQ ID NO: 29602 - DNA, 2607 bp, Artificial Sequence
  Description of Artificial Sequence: Synthetic coding sequence
atgggaccggctggagctaagaatttacaaagtgtggtcctatccaagatgaatttcgagtccttcgtgaaagatctccttctggtgcgccagtatcgcgtggaggtgtacaagaaccgcgcaggcaacaaggcatctaaagagaacgactggtatttagcctataaggcaagccccggtaacctgagccaatttgaggatatcctgtttgggaacaatgatatgagcgccagtatcggagtggtgggtgtgaaaatgtcggcagtggacggacagagacaagtgggcgtgggctacgtcgactcaattcaacgaaagttaggcctctgcgagtttcccgataacgaccagttcagcaacctagaggcactcctgatccaaataggcccaaaggaatgtgtcctcccaggcggtgagactgcaggcgacatggggaagctgcggcagatcatccagcggggaggcatcttgatcaccgaacggaagaaggccgatttcagcaccaaagacatctatcaggaccttaatagactcctgaagggaaaaaagggagaacagatgaattctgcagtcttgccagaaatggagaaccaggtcgccgtgtcatccctgtctgctgtaatcaagttcttggaactattgtctgacgatagcaattttgggcagtttgagctcactacatttgatttctctcagtacatgaagctagacattgccgcagtgagggctttgaatttatttcagggctcagtcgaggacactactggaagccagagtctcgccgctttactgaacaaatgcaagacaccacaggggcagagacttgtcaaccaatggatcaaacagccgcttatggataaaaaccgaatagaggagcgcctgaaccttgtcgaagcttttgtggaagacgccgaattgcgccagacgctacaggaggatcttttacgccgttttccagacctgaatcgattggcaaaaaaatttcagcgccaagctgctaacctccaagactgctaccgtctctaccaggggatcaatcaactaccgaatgtcatccaagctctggagaagcacgagggcaaacatcagaaactgttgctagctgtgtttgttacccccctaacagacctacgctcagacttttcaaaattccaggaaatgatagagaccaccctggacatggatcaggtggagaatcatgagtttctggtgaagccttccttcgatcctaatttaagtgagctgcgggaaattatgaacgaccttgagaagaaaatgcagtccacccttatctcggcagctagagacttgggtctggacccagggaaacagattaagcttgactccagtgcacaattcggatactactttagagtgacatgtaaggaagagaaggttttgcggaacaataaaaacttctccaccgtagatattcagaagaacggggtcaaattcaccaattccaaattaacctctctgaacgaggagtacactaagaataaaacagaatacgaggaggcccaggatgcaattgtgaaggagattgtcaatatcagttccggttatgtggaacccatgcagaccttgaacgacgtcttagctcagttggacgccgttgtgtcctttgcccatgtgtcgaatggcgctccagtgccctatgttcgacccgctatattggaaaaagggcaaggcaggatcatcctcaaggcatctcgccatgcctgcgtggaggtgcaagatgaaatcgcgttcatcccaaacgacgtatatttcgagaaagataagcagatgttccacattataactggacccaatatggggggaaagagtacctatatccgtcagactggagtgatagtcttgatggcccagatcggatgttttgtgccatgtgagagtgcagaggtgtctattgtcgattgcatcttggccagggttggcgctggtgactcccagctgaaaggagttagtaccttcatggccgagatgctggaaaccgcttctatcctccggagcgccacaaaggattccctgattatcattgacgaactggggaggggtacctcaacatacgatggcttcggattggcttgggctattagtgagtatatcgcaaccaaaatcggggctttttgtatgttcgcgacccacttccacgagcttaccgctctggccaaccagattcccaccgtcaataatctccacgtgacggctctgacaaccgaagagaccctgaccatgctctaccaggtgaaaaaaggtgtgtgcgaccagagctttggaattcatgttgccgagctggccaattttccaaagcacgtaatcgaatgcgcgaaacagaaggcccttgagctagaagagtttcagtacataggagaaagccaggggtatgatataatggagccagcagccaagaagtgctacttggaacgcgaacagggggagaagatcatccaggaatttttaagtaaggtcaagcagatgccctttacagagatgtcggaggaaaacatcacaattaaactgaagcagctgaaagcagaagtcatcgcaaagaacaattcctttgtcaatgagattatttcccggattaaagtcaccacatag

SEQ ID NO: 29603 - DNA, 3414 bp, Artificial Sequence
  Description of Artificial Sequence: Synthetic coding sequence
atgtcaaggcgaaagcctgcatctggcggactggcagcttcttcttctgcacccgcacggcaagcagtactgtcacgattctttcaatccaccggttcacttaaatccaccagctcttccactggtgctgccgatcaggtggatcccggagcagctgccgctgctgccgctgctgctgccgctgcccctccagctccaccagctcctgcttttccccctcagctacctccgcacattgctaccgagatagaccgacggaaaaagcggcctttggaaaacgatggacctgtcaaaaagaaagtcaagaaggttcagcaaaaagaggggggttcagatctggggatgagtggaaacagcgagccaaagaagtgcctacgtacccggaacgtgagcaaatcgctggaaaagttgaaagaattttgttgcgatagtgccttacctcaaagccgagtgcagacggagtctctccaggaacgttttgcagtacttcccaaatgtactgatttcgacgatatctccctactccacgcaaagaacgccgtgtcctctgaggacagcaagaggcagattaaccaaaaagacacaaccctctttgatttatcccagtttggcagttctaatacttctcacgaaaacttgcaaaagaccgcgagcaagtcggccaacaagagaagtaaatccatatatactcccctagagctgcagtatatcgagatgaagcagcagcacaaggacgccgtgttgtgtgtagaatgtggttacaaatacagattcttcggagaggatgcggaaatcgcagccagggaactgaatatatactgtcatcttgaccataatttcatgaccgcaagtattcccacccacagactgtttgttcatgtgcgacgactcgtggccaaaggttataaagtgggcgttgttaagcagactgagactgcagcacttaaagctatcggagacaataggagcagcctcttttctagaaagttaacagctctgtacaccaagtcaacactgatcggggaggatgtaaaccccctgattaaattggatgacgccgtgaacgttgacgagatcatgaccgacacctcaaccagctatctactgtgtatcagcgagaacaaagagaatgtgcgggataagaaaaagggcaacatcttcatcggaatcgtgggcgtgcagccagcaaccggcgaggtggtctttgactccttccaagacagcgcttccagaagcgaactagaaacgcggatgtcatcgctacaaccggtggagcttcttctgccttctgctctgtccgagcagacagaagccctgatacatagagcgacctcagtgtctgtccaggacgatagaataagggtcgagcggatggacaacatatatttcgagtactcccatgccttccaggcagtaacggaattttacgctaaggatacagtcgacatcaagggcagtcagatcatctcggggatcgtgaatctggagaaaccagtgatatgctcactcgcggcaattatcaagtacctaaaagagtttaacttagaaaaaatgctgagcaaacctgagaatttcaaacaattgtctagcaaaatggagttcatgacaatcaacggcacaactctcaggaatttagagatcctgcagaatcagacagatatgaaaaccaagggcagcttgctttgggtcttggaccacactaaaacctctttcggacggcgaaaattgaagaaatgggtgacccaaccactgctcaaactccgcgagattaacgcgaggctggatgccgtgtctgaagtgctgcactctgagtccagtgttttcggacagatcgagaaccacctgagaaagttgccagacattgagaggggcctgtgttctatctaccataaaaagtgtagtactcaggaattcttcctgatcgtgaagaccctctaccacctcaagtctgagttccaggcaattatcccagctgtcaattcccatatccagtctgatctcctaagaactgttattctggagataccagagctgttgtctcctgtggaacactaccttaagattctgaacgagcaggccgctaaagtgggtgataaaaccgaactgttcaaagacttgtcagactttcccctgattaaaaagaggaaagatgagattcagggtgttatcgacgagatccgaatgcacctgcaagaaatcagaaagatcctaaaaaaccctagtgcccagtatgtaactgtgtcagggcaagagtttatgatcgaaattaagaactcagcagtgagttgcatcccaaccgactgggttaaagtcggaagcacaaaagccgtctcacggtttcattccccctttattgtggagaattacagacacttaaatcaattgcgcgaacagctggtattagattgtagcgcagagtggttagatttcttggaaaagtttagtgagcattatcacagcttgtgtaaggctgttcatcatctggccacagtggattgcatattctccctcgcgaaagttgccaagcaaggtgactactgccgaccaaccgtgcaggaggagaggaagattgtgattaaaaatggcagacatccagtgatcgatgtgctcctcggggagcaggatcagtatgtgcctaacaacaccgatcttagcgaagattcagagcgagtgatgatcatcaccggtcctaatatgggcggaaaatcttcctatatcaaacaggtggccctgataactatcatggcccaaattggcagctacgtcccagcagaagaggccaccattggcatcgtcgatggtatttttacaaggatgggcgcagctgacaatatctacaaaggccagtcgacctttatggaggagttgacagatacggctgagattatccgtaaggcaacttctcagtcgctggtcatacttgacgaactaggaaggggcactagcactcatgacggcattgcaatcgcatatgcgaccctcgagtacttcatccgggatgtgaagtccctgacattgtttgtaacacattatcccccagtatgtgaactggagaagaactattcccaccaagtgggcaactaccatatggggtttcttgttagcgaagacgaaagtaaactcgacccaggcgcagccgagcaggtgcctgacttcgtaacctttctgtatcagatcacccggggtattgctgccaggtcttacggcctgaatgtggcaaaattagcagatgtgcccggagaaattctgaaaaaagccgcacacaagtcaaaggagctcgaaggcctgataaacaccaaaaggaagcgacttaaatatttcgccaagctctggacaatgcataacgcacaggaccttcagaaatggactgaagaatttaacatggaagagacccagacatctctgcttcattag

SEQ ID NO: 29604 - DNA, 3387 bp, Artificial Sequence
  Description of Artificial Sequence: Synthetic coding sequence
atgtctcggaggaagcccgctagtgggggactggccgcatcctctagtgcccctgcccgacaggccgtcctatcgagatttttccagtccactgggagcctgaaaagcacgagttcatctacaggtgccgctgatcaagtagacccaggcgctgccgctgccgctgctccaccagcgccagcttttccaccacagctgcccccacacatcgctactgaaattgataggcgtaagaaacgtcctctggaaaacgatggcccagtcaagaaaaaggttaagaaagtgcagcaaaaggaaggcggatccgacttgggcatgtcaggcaatagcgagccaaagaaatgtttgagaactcgcaacgtgtccaagtcgttagaaaaactaaaagagttctgctgcgactccgctctcccccagtcaagggttcagacagaatccctgcaagaaagattcgctgtcctacctaagtgcacagactttgatgacatctccctgttgcatgcaaaaaatgcagtgagctctgaggattccaagcgacagattaaccagaaagatacaaccctctttgacctgtcccaattcggttcctcaaacacatctcacgagaatctccagaagaccgctagcaaatcagccaataagcggagcaaatccatatacaccccactggagctgcaatacatcgaaatgaaacagcagcataaagatgccgtgctgtgtgtggagtgtggttataagtacaggtttttcggcgaagacgctgagattgccgcacgggaacttaacatttactgccacctggatcacaatttcatgacggcatctatcccaactcaccgcctattcgtgcacgtgcggaggctggtggcaaaaggatataaagtgggcgtcgttaaacagaccgaaaccgccgcactgaaggccatcggcgacaaccgctcttcactctttagtagaaagctcaccgccctgtacaccaagtcaactctgattggagaggacgtgaaccctctcatcaagctggacgacgcagtaaatgtggacgagattatgaccgacactagcactagttatctgttatgcatctccgagaacaaagaaaatgtgcgcgacaagaagaaaggcaatatctttatcggtatcgtgggagttcagccggcaacaggcgaagtggtctttgacagtttccaggactcggccagtaggtcagagctggagacccgaatgtctagcctgcagccggttgaactcctgctcccaagtgcgttgagcgaacaaaccgaggccttaattcacagagcaacctctgtgagcgtgcaggacgatcgaattcgagtggagagaatggacaacatttacttcgaatacagccacgcgtttcaagccgtgaccgagttttatgccaaggatacagtggacattaagggctcacagattatctcaggcatagtgaacttggagaaacctgtgatctgtagcctagctgccatcattaaatacctcaaggagtttaatctggagaaaatgctgagtaagcctgaaaatttcaagcagttatcttctaagatggagtttatgaccattaatggaactactctcaggaatctggagatcttgcagaaccagacagatatgaagactaagggcagtcttctatgggtgctcgaccacaccaaaaccagtttcggcaggaggaaactgaaaaagtgggtcacacagccactgcttaagctgcgagagattaatgctaggctagacgccgtgagcgaagtgctgcacagtgaatcttcagttttcggacagatcgaaaaccacctcaggaagctcccggacattgaaaggggtctttgcagtatctaccacaagaaatgcagtacccaggaattttttctgattgtgaagactctgtatcatctcaagtccgagttccaggccattattcccgctgttaatagccatatacagagtgatcttctgagaaccgtcatcctggagatcccagaactcttgtcacccgtggaacactacttgaaaatactcaacgagcaagccgcaaaagttggcgacaaaaccgagttattcaaagacctgagtgacttccctctgattaagaagaggaaagatgagattcagggagtgatcgacgagatccggatgcatttgcaggagattcgcaaaatactgaagaatcctagcgcccagtacgtgaccgtgagcggacaggagttcatgattgagatcaaaaacagcgccgttagctgcatcccaactgactgggtcaaggtgggcagcaccaaggctgtctctcgatttcattctccgttcattgtggaaaactatagacatcttaaccagcttcgcgagcaactggtgttggactgcagcgccgaatggctcgattttctggagaaatttagcgaacattaccatagcctatgcaaagccgtgcatcaccttgcaactgtggactgtatctttagcttggccaaagtggccaagcagggagattactgtcggccaacggtccaagaggaacggaaaatcgtaatcaagaacggcaggcacccggtcatcgacgtgctgctgggcgaacaagaccaatatgtgcctaataacaccgacctttcggaagactctgaacgcgtgatgattattaccggtcctaacatggggggtaaaagctcttatatcaagcaagtggccctgatcacaatcatggctcaaatcggcagttatgtcccggcagaagaagccactatcggtattgtcgacgggatttttacccgaatgggcgctgccgacaatatttataagggccagtcaacctttatggaagagctgactgataccgccgaaatcatcagaaaggctacctctcaaagcctggtgattctggacgagcttggccgagggacctctactcacgatggaattgctattgcttatgcaacgcttgagtacttcattcgggatgtgaagagccttacattgttcgtaacacactatcccccagtatgcgagctggagaaaaattatagccatcaggtggggaattaccacatggggttccttgtgtccgaagacgagtccaagctcgacccaggagcagccgaacaagttcctgacttcgtcacctttctgtaccaaatcacccggggaatcgccgcacgaagttatggtcttaatgtggcaaagttagccgatgtccctggcgaaatcctgaaaaaggctgctcataaatctaaggagctggaggggctcattaacactaagaggaaacgactcaaatacttcgccaaactgtggaccatgcataacgcacaggatctgcagaaatggacagaggagtttaatatggaggaaacgcagacatccctgctgcattag

SEQ ID NO: 29605 - DNA, 2811 bp, Artificial Sequence
  Description of Artificial Sequence: Synthetic coding sequence
atgttgaggcctgagatctccagtacgtctccatccgccccagccgtgtccccgtcatcaggcgaaaccaggtcaccacagggacccagatacaacttcggtttgcaggaaactccccaaagtcggccttctgtccaagtggtatccgcttccacttgcccaggaacctctggtgccgcaggggaccggtcctcttcttccagctctttaccttgccccgcaccaaatagtcgtcccgctcagggtagttacttcggaaacaagcgcgcttacgccgagaataccgtcgcatccaactttacctttggtgccagctcttctagcgctcgcgatacgaattatcctcagacattaaaaactcctcttagcaccggaaatccccagcggagcggttacaagtcctggaccccgcaagtcgggtacagcgcctcatcttcctctgcgataagcgctcatagtccttctgtaatagtcgccgtcgtagagggacggggactggcgaggggcgaaatagggatggcgtcaattgatttgaaaaacccgcagatcattctttcacagtttgctgataatacaacctacgctaaggttattactaagctcaagattctgagcccactcgaaattatcatgagtaatacagcctgcgccgtcggcaatagcacaaagctcttcactctgatcaccgagaactttaagaacgtgaacttcacaaccattcagagaaagtatttcaacgagaccaagggactggagtatatcgagcagttatgcattgcagaatttagcacagtattgatggaagtgcagagcaaatactattgcctcgcagctgtcgccgctcttctaaaatatgttgagtttatccaaaactcagtatacgcaccaaaatctctgaagatctgtttccagggcagtgaacagacagcgatgatcgatagctcgagcgcccagaatctggaactgctgattaacaaccaagactacagaaacaatcacacccttttcggcgtgctgaattacactaaaacaccgggtggatctcgacgactgcgatcaaatattctggaacccctggtggatatcgagacgatcaatatgcgcttggattgcgtacaggaattactgcaggacgaggagctgttcttcgggttgcaaagcgtgatatcgcgatttctggatacagagcaattgctcagcgttctggtccaaataccaaaacaggacactgtgaacgctgctgagtcgaaaatcactaatttgatctacctgaaacacactctggaacttgtggaccccctgaagatcgccatgaagaattgtaacactccactgctgcgggcttactacggatcactggaggacaagaggtttggtattattcttgagaaaatcaaaaccgtgatcaatgatgacgccagatatatgaagggttgccttaatatgagaacacagaagtgctatgctgtgcgttcaaatatcaacgagtttctggatattgcccgacgcacttacacagaaatcgtggacgacatcgctggcatgataagtcagctgggagagaagtacagccttcctctgcggacttcgttttctagtgccagagggttcttcatccaaatgacaactgactgcattgcccttccgtctgatcagctcccgagcgagttcataaagatttccaaagtcaaaaatagttactcatttacctccgctgatctgatcaaaatgaacgagcggtgccaggagagcttgcgggaaatatatcacatgacgtatatgatcgtctgcaagcttcttagtgaaatctatgaacacatccactgcttgtataagctgagcgatacagtgtccatgctcgacatgctgttgagctttgcccacgcgtgcacactgagcgactatgttcgaccggagtttaccgatacactggctataaagcagggatggcatcccatcctcgagaaaatttctgctgaaaagccaatcgctaataatacttatgtcactgagggcagcaacttcctgataatcacagggcctaacatgtcaggcaagtctacttacctcaagcagattgccctgtgtcaaattatggcccagattgggagctatgtgcccgcagagtacagttccttcagaatcgctaaacagatattcacaaggatctcaaccgacgacgacattgaaacaaattcttcaacatttatgaaagaaatgaaggagatcgcttatatattgcataacgcaaatgacaagtcactcattctcatcgatgagctggggcgaggaacaaataccgaagaggggattggtatatgttatgctgtgtgtgagtacctgctttctcttaaggcatttactctattcgccacccacttcttagagctgtgtcacattgacgctctctaccctaacgtggagaacatgcatttcgaagtccagcatgtgaagaacacctcccgcaataaggaggctatcctctatacttataagctgtcaaaaggactgaccgaggagaaaaactatggcctcaaggcagctgaggtgtccagcctgcccccaagcatcgtactcgacgcaaaagagattacaacccagattaccagacaaattctccagaaccagcgatctacacccgagatggagcgccagagggcagtgtaccacctggcgaccaggttagtgcagaccgcaagaaactcccagctggacccagacagtctgaggatatacctctcaaacttgaaaaagaaatataaagaggatttcccacggactgaacaagtccccgagaagaccgaggagtag

SEQ ID NO: 29606 - DNA, 813 bp, Artificial Sequence
  Description of Artificial Sequence: Synthetic coding sequence
atggcatccttaggggctaatcccaggcggacaccccaggggccacggcctggcgcagcctcgtctggctttccttcaccagctcctgtgccaggacccagagaggccgaggaggaggaggtggaggaggaggaggagctggctgagatccatctctgcgtgctctggaactccgggtatctcggaatcgcatattatgacacaagcgattccacaatccactttatgcccgatgctcccgaccatgaaagtcttaagttactgcaacgcgttctggatgaaattaaccctcaaagcgtcgtcacaagcgcaaagcaggacgaaaatatgactcggttcctgggcaaattagcctcccaggaacacagagagcccaagcgccctgagattattttcctcccatcggtcgacttcggtcttgagatcagcaagcaaagactactttccggcaattattcatttatcccggacgctatgactgccacagagaaaatattgttcctgtcctctataattcctttcgactgtctgctgaccgtccgggcactgggaggtctcctaaaatttcttggcaggaggcgcatcggtgtggaactggaggactataacgtctctgtacccatattgggcttcaaaaaatttatgttgacccacctggttaatattgatcaggacacatattcagtattacagatcttcaaatccgagtcacaccctagcgtgtataaagttgcttcggggctaaaggaaggcttgagcctgttcggtatcctaaaccgatgtcactgcaaatggggcgagaaattgctgtag

SEQ ID NO: 29607 - DNA, 813 bp, Artificial Sequence
  Description of Artificial Sequence: Synthetic coding sequence
atggcgagtctaggagccaatcctagacggacaccccagggccctaggcctggtgcagcgtcctctggcttccctagcccagcgcctgttcctgggccacgtgaggctgaagaagaggaagttgaggaggaggaggagctggctgagattcacctgtgcgtactgtggaattccgggtacctagggatcgcttattacgacacatctgactccacaattcactttatgcctgacgcacctgatcacgaatctttaaagctcttacagcgggtgctggacgagattaatccacagtccgttgtcaccagtgcaaagcaggacgaaaatatgacaagatttctgggtaaactggccagccaggagcatagggagcccaaacggcctgagataatttttctgccatcagtggactttggtttggagatctctaaacagagacttttaagcggcaactattcatttattcccgatgctatgaccgccacagaaaaaatcctgtttctgtccagcatcatcccctttgattgtctgctgaccgtcagagctcttgggggactgctcaagtttctgggtaggcgacgcattggcgtcgaactggaagactacaatgtgtctgtgccaattttgggtttcaagaagttcatgctaactcatctggtgaatatcgaccaggatacgtacagcgttctgcagatcttcaaatctgaaagccacccatccgtatacaaggtggcgtctggtctgaaagaaggcctgagtctcttcgggatcttgaatcggtgtcattgcaaatggggggaaaagttgctctag

SEQ ID NO: 29608 - DNA, 585 bp, Artificial Sequence
  Description of Artificial Sequence: Synthetic coding sequence
atggcttccctgggtgccaaccctaggagaacaccccagggacccaggcccggagctgcgagctccggtttcccatctcccgcacctgtccctggaccacgggaagcagaggaggaagaggtagaggaagaggaggagctagctgagatacacttgtgcgttctgtggaacagtggatatttaggaatcgcctactatgatacctccgattcaacgatccattttatgcccgatgctccggaccacgagtctcttaaactcctccagagagtgctggatgaaatcaatcctcaatccgttgttacatctgctaagcaggatgaaaatatgacgcgcttccttgggaaactcgccagccaagagcatcgggagccaaagaggcccgagattatcttccttccttccgtcgatttcgggctagagatcagtaaacagcggctgctctcgggtaactattccttcatccccgatgccatgacagcgactgaaaagatcctttttctctcgtccataattccttttgactgcctcctcacagttcgtgctcttggcggactgcttaaattcctaggaagacgcagatag

SEQ ID NO: 29609 - DNA, 813 bp, Artificial Sequence
  Description of Artificial Sequence: Synthetic coding sequence
atggcctccctgggcgcaaaccctagaaggacacctcagggccctaggcctggcgctgcctccagtgggtttccatcacccgctccggttcctggcccaagggaggctgaagaggaggaagtggaggaggaggaggagcttgcagaaatccatctgtgtgttctgtggaactctggatacctcggtatagcctactacgatacatccgactccaccatccatttcatgccggatgctccagaccacgaaagcctgaagttactccaacgcgtgttggacgaaattaatccccagtccgtggtgacttccgcaaaacaagacgagaatatgacccgcttcctaggcaaactggcatcccaagagcacagagagcccaagcgaccggaaatcatttttctacccagtgttgattttggcttggagatctctaaacagcggctgctatctggaaattattctttcattcccgacgcaatgacagccaccgaaaagatactgtttctttctagtatcattcccttcgattgtctcctgacagtgagggctcttggtggattgctgaagtttctcggaagacgccgtattggggtagaactggaagactacaatgtgagtgtcccaatcttgggatttaagaagtttatgctcactcaccttgtgaacatcgaccaggacacttattctgtcctgcagatttttaaaagtgagagccaccccagcgtctacaaggtggcaagcgggctcaaggaggggttgagtctgttcggcatcctgaatcgctgccattgcaaatggggtgaaaagcttctgtag

SEQ ID NO: 29610 - DNA, 864 bp, Artificial Sequence
  Description of Artificial Sequence: Synthetic coding sequence
atggccagcctaggtgcaaaccccagacggaccccccagggacctaggcccggtgcagcatcttccgggttcccctcaccagcacctgtacccggaccaagggaggcagaagaagaagaggtggaggaagaggaagagctggctgagatccacctctgcgtactgtggaactcagggtatcttgggatcgcttattatgacacatcagacagcacaatacatttcatgccggatgccccagaccatgagtctctcaaactgttgcagagagtgctcgatgagattaacccacaaagcgtcgtaacgagtgccaagcaggatgagaatatgacgcgattcctgggaaaactggccagtcaggaacacagggagcctaagagaccagagattattttcctgccaagcgtggactttgggctggagatcagcaaacaaagattgctgagcggtaactacagtttcatccctgatgccatgacagcgacagaaaagattctgttcctcagtagtattatcccttttgattgtttgctcacccctccaggtgatctcagatttacacccattcctctcctaattccctcacaagtgcgcgcactcgggggtctgttgaaatttttagggagaagacgcataggtgtcgagttggaggactataatgtctcagtccccatcctcgggtttaaaaagttcatgctgactcacctggttaatattgaccaggatacatatagcgtgcttcagatttttaagtcagagagccatcccagtgtatacaaggtggcttccggcctgaaggagggattgagcctgttcggtatcctgaaccgctgccactgcaaatggggcgagaagcttctgtag

SEQ ID NO: 29611 - DNA, 324 bp, Artificial Sequence
  Description of Artificial Sequence: Synthetic coding sequence
aagatcctgtttctctcatccattatacccttcgattgcctgctgaccgtgcgagcgttgggagggctgctgaagtttcttgggaggagaaggatcggcgtggaactggaagattataacgttagcgtgcctattttaggttttaaaaagttcatgctcacccacttggttaatatagaccaggacacatactcggtcttgcagatctttaagagtgagtctcatcccagtgtctataaagttgctagtggtctcaaggagggactttccttattcggcattcttaacaggtgccattgcaagtggggggaaaagttgctgtag

SEQ ID NO: 29612 - DNA, 765 bp, Artificial Sequence
  Description of Artificial Sequence: Synthetic coding sequence
atggcctctcttggcgctaaccccaggagaacacctcagggacctcgaccgggtgcggcatcctcagggtttccaagcccagcccctgtgcccggacccagggaggctgaggaagaggaggtagaggaggaggaggaattggctgagatccatttatgtgtgctttggaattctggctatttggggattgcttactatgatacttcagacagtaccatacacttcatgcctgacgcacctgaccacgagtctcttaaacttcttcagcgggtccttgatgaaatcaatcctcaaagcgttgtgactagtgctaagcaggacgagaatatgacccgcttccttggcaaactcgcgtcccaggaacacagagagcccaagcgaccagaaatcatattcctgccgagcgtggatttcggactagaaatttccaaacagagactgctttccggcaactattcattcataccagatgcaatgaccgcgaccgaaaaaattctatttctcagtagtattattccctttgactgcctgctaacagttcgagcattggggggactgctcaaattcttgggacgcaggaggatcggggtagaactggaagactacaacgttagcgtgcctatactgggcttcaagaaatttatgctgactcacctagtcaatattgatcaggacacataccgactggagtgtaatggagccatatcagcacagtgcaacctttgcctcctgggctccagtgattcccctgcttctgccagctag

SEQ ID NO: 29613 - DNA, 1542 bp, Artificial Sequence
  Description of Artificial Sequence: Synthetic coding sequence
atggcgatggaaattgactccagacccggtggtttacctggtagttcatgcaacctcggcgctgctagagagcatatgcaggccgtcacgcgcaactatataactcatccgagagtcacctatcggaccgtttgttcagtcaacggcccactggtggtgctcgatcgggttaaattcgcccagtacgccgagatcgtccacttcacgctgcccgatggcactcagagatctggacaggtgctcgaggttgcgggaaccaaagccattgtccaagtcttcgagggcacatccggcatcgatgcccgtaagactacatgtgaattcaccggtgacattcttcgcacacccgtgagcgaggacatgctcgggagagttttcaatggcagtggaaaaccaattgacaaagggccagtggttatggctgaagactttctggatatcaacggacagcccatcaatccccatagcaggatctacccggaggaaatgatccagaccggaataagtccgattgatgtgatgaatagtatcgccaggggtcaaaagattccgatcttctcagccgctggcctgcctcataatgaaatcgcagcccagatatgcaggcaggcaggcttggtgaagaagtcaaaggcagtgctggattatcacgacgacaacttcgcaatcgtcttcgccgcaatgggggtgaacatggaaaccgcacgattttttaaatcagattttgaacagaatggaaccatgggaaatgtgtgtcttttcctcaacctggccaatgaccctaccattgagcgtatcattactccccgactggcattgaccactgctgaattcctggcataccagtgtgagaagcacgttttggtgattttgaccgacatgtcatcctatgccgaggctctgcgggaagtatcggcagccagagaagaggtgccgggacgcaggggctttccgggatacatgtatacagatttggccacgatatatgagcgcgctggccgagtagaaggtagaggcggatcgatcactcagatacccatcctgaccatgcctaatgacgatataacacaccctattcccgatctgacagggttcataacagagggtcaaatctacgtcgaccgacagttacataatcgccagatctacccaccaataaacgttcttccatccttatctcgactgatgaagtctgccatcggcgaagggatgacgagaaaagatcacggagacgtctcaaatcagttatacgcatgctacgccatcggaaaagatgtgcaggcgatgaaagccgtggtgggagaagaagcactcacaagtgaggacctgctgtatctggaatttttgcagaaattcgaaaaaaattttatcaaccaaggaccatatgaaaatagaagcgtgttcgaatcactggacctggggtggaagctcctccggattttcccgaaggagatgctgaaacgaatcccccaggccgttatcgacgagttttatagtcgggaaggagctcttcaggatctcgcccctgataccgccctttag

SEQ ID NO: 29614 - DNA, 759 bp, Artificial Sequence
  Description of Artificial Sequence: Synthetic coding sequence
atgtcccggcaaagcaccctgtatagcttcttcccaaaatctcccgcactctctgatgcaaacaaggcaagtgctcgggcaagccgcgaaggcggtcgtgcagcagccgcaccaggcgcatccccaagcccgggaggcgacgccgcttggtccgaagccggacctgggcctcggcctcttgcccgttctgcatccccacccaaggccaagaacctgaatggtgggctccgccgttccgttgcacccgcagcacctacgtcatgtgactttagtccgggagacttggtgtgggcgaagatggagggatatccatggtggccttgccttgtatataaccatccttttgatggcacatttatccgggaaaagggcaagtctgtcagagttcacgtgcaattctttgacgattctccgacccgagggtgggtatctaagcgcttgctcaagccatatacaggctctaagtctaaggaggctcagaaaggtggacatttttattcagccaagcccgagatcctgcgcgctatgcagagggccgatgaggcgttaaataaggacaaaatcaaaaggctcgagctggcagtttgtgacgaaccaagtgagcccgaggaagaagaagagatggaggtcgggacgacctacgtaacggacaagagcgaggaagacaacgagatcgagtcggaagaggaagtgcagccaaaaacccaagggtccaggagaagtagtcggcaaatcaagaaacgccgaaagaaaaggtag

SEQ ID NO: 29615 - DNA, 3177 bp, Artificial Sequence
  Description of Artificial Sequence: Synthetic coding sequence
atggtcacgggtaatggttccctgaaacggaagtccagccgaaaagaaacaccctctgctacgaagcaggctacaagcataagctctgaaaccaagaataccctgagagcgttctccgcccctcagaatagtgaaagccaggctcatgttagcggcggaggagacgacagctcgcgcccaacagtgtggtatcacgagacactggaatggttaaaagaggaaaagagacgagatgaacacaggaggcggcctgatcaccctgactttgatgccagcaccctttatgtgcctgaggattttctgaattcctgcaccccagggatgagaaaatggtggcaaattaaaagccagaattttgatcttgtgatatgctacaaagtggggaagttttatgaattgtaccatatggacgctctcataggagtctccgagcttggtctggtgtttatgaaaggaaattgggcccattcaggatttcccgagatcgcatttggaaggtactcagactccctcgtacagaaaggatacaaagtagccagggttgagcagactgagacgcctgaaatgatggaagcacgctgcaggaaaatggcccatattagcaagtacgaccgagtggtcagacgggagatttgccgaatcattacaaagggaactcagacctatagtgtactagaaggcgacccgtccgaaaattattctaagtacttgctaagcctaaaggagaaagaggaggatagctcgggtcacacccgggcatatggcgtctgcttcgtggacacatccctcggcaagttcttcataggacagttcagtgacgatcgccattgcagtcgtttccgtactctagttgcccattaccctcccgtgcaggttctgttcgaaaagggaaacctgtctaaagagaccaagacgatactgaagagctccttgtcctgctcccttcaagaaggtctgatcccaggttcacagttttgggacgcctccaaaacccttcggactctgttggaagaggaatacttcagggagaagttatcggatggtataggtgtgatgttgccacaagtgctgaaaggtatgacatcagagagtgacagtattggacttactcccggagaaaaaagcgagctggccctttcagccttaggaggctgcgtcttttacctcaaaaagtgtcttatagaccaggagctcctctccatggccaacttcgaggagtacatccctctcgacagcgacaccgtttcgaccacccggagcggagcaatcttcacaaaggcgtaccagcgcatggtcctcgatgccgtcactctcaacaacctggaaattttccttaatggcaccaacggtagcactgagggcaccctcttagaaagggtggatacttgtcacacccctttcggcaaaagactcctgaagcagtggctgtgtgccccactctgcaaccattatgctatcaatgaccgactggacgctattgaggacttgatggtcgtccccgataagatctccgaagtcgtggaactgttgaagaagcttcctgacctggagcgtctcctgtccaaaatccacaatgtcggatcacctctgaagtcgcagaaccatccagacagtcgtgcaatcatgtacgaggagaccacgtattctaagaagaaaattatcgatttcctttctgccctcgaaggattcaaagtcatgtgcaagatcatcggcatcatggaggaagttgctgacgggttcaagtctaaaattctgaaacaggttatcagcctacagacaaaaaatcccgagggcaggttcccagacttgaccgttgagttaaacaggtgggacaccgccttcgaccacgaaaaggccagaaagacaggactaatcactcccaaggccggattcgacagcgattacgaccaggcacttgcggacattagggaaaacgaacagagccttctagagtatctagagaagcagcggaaccggattggctgtcgcactatcgtctactgggggatcggccgaaaccgatatcagttggaaatccccgaaaacttcacgacacgcaaccttcccgaagagtatgaattaaagtcgactaaaaagggctgcaaaagatattggactaagaccatcgaaaagaaactcgccaacctaattaacgctgaagaacgcagggatgttagcctgaaggattgtatgagacgtctattctataacttcgacaagaattataaagattggcagtcagcagtggaatgcattgccgtgttggacgtcctgttatgcttggctaactactcgcggggtggagacggtccaatgtgtcgacccgtgatcctcctacccgaggatacccctccgtttctcgagttaaaggggtcccgtcacccttgcattaccaagacattcttcggagatgacttcatcccaaatgatattctgatcgggtgtgaggaagaagagcaggagaacggcaaagcctattgtgtactggtgaccggaccaaatatgggaggcaagtccaccttgatgagacaggccggtctgctagcggttatggcacagatgggatgctacgttcccgctgaggtgtgcagactgacaccaatcgaccgagtgttcacgcgcctgggggcatctgatcgaattatgagtggcgaaagcactttctttgtagaacttagtgagactgcaagcatccttatgcacgctactgctcatagcctggtcctcgttgatgagttagggagggggacggctacgttcgacggaacagccatcgcgaatgcagtcgttaaagagttggcggaaaccatcaaatgtcggacactattctccactcattatcacagcctcgtggaggactactctcagaacgtggcagtgaggttgggccatatggcctgcatggtggaaaacgagtgtgaggaccctagtcaggaaaccattacctttttgtacaagtttattaaaggggcatgcccaaagagctacgggtttaatgccgctaggcttgccaatctgcctgaggaggtgatacagaaaggccacaggaaagccagggagtttgaaaagatgaatcaatcgttgcggttgttcagagaagtgtgtctggcctccgaaagatccacagtggatgcagaagctgtgcacaagctcctcaccctcatcaaggagctatag

SEQ ID NO: 29616 - DNA, 3693 bp, Artificial Sequence
  Description of Artificial Sequence: Synthetic coding sequence
atgtcccggcaatccactttgtacagcttcttccctaagtccccggctctgtccgatgcaaataaggccagtgcgagagccagtcgcgaaggcggaagggccgctgccgctccaggtgcctcaccatctccaggtggcgatgcagcctggtctgaggccggaccaggccctaggcccttagctagatcagctagtcctccaaaagccaaaaatcttaacgggggtctgcggcgatcagtcggcacgacatacgtcaccgacaagtctgaggaggacaatgagatcgagtccgaggaggaagtgcaacctaaaactcaggggagccgaaggagcagccgccagattaaaaaaaggagggtcattagcgactctgaaagtgatattggcggtagcgacgtggaattcaagcctgacacgaaggaagagggctctagcgatgaaatctcctccggggtgggagattccgagtccgagggactaaattctccggttaaagtggctcggaagcgtaagaggatggtgaccggcaatgggagcctgaagaggaagagcagccggaaagagactcctagcgcaaccaagcaggctacaagtatctctagtgaaactaaaaacacactgcgagccttcagcgcaccccagaactctgagtctcaggcacacgtaagtggcggtggggatgattccagccgtcccactgtctggtatcacgagaccctggagtggctgaaagaagagaaacggagagatgaacacaggcgaaggccagaccacccggactttgacgcatcgactctgtatgtgccggaggattttttaaatagttgcacccccggaatgcggaagtggtggcagatcaagtcacaaaattttgacctcgtgatctgctataaggtcggaaaattttatgaactttatcatatggatgcgcttattggggtgtccgaattggggttagttttcatgaagggaaactgggctcacagcggtttccctgaaattgcattcggacgatacagcgattctttggttcagaagggctataaggtggccagagttgagcaaacagaaacccccgaaatgatggaggcgagatgccgtaagatggcacatatcagtaaatatgatcgtgtggtgaggagggaaatttgtagaattattaccaaaggcacccagacgtatagcgttttagaaggtgaccccagcgaaaactattccaaatacctgctgtctttgaaagaaaaagaggaggattccagcgggcatactagagcctacggagtgtgtttcgtggacaccagcttggggaagttcttcattggacagttctcagacgatcgacattgctctcgtttcaggacacttgtcgctcactaccccccagtacaggtcctcttcgaaaagggcaatttatctaaggagacaaaaacaatactgaagtcaagtctcagttgtagcttgcaggaaggattgattcctgggtcccaattctgggacgctagcaagactctgagaaccctgctcgaggaagagtattttagggaaaagctatctgacggcatcggggtgatgctcccccaggtactcaaaggtatgacatcagagagtgattccattggtcttacacctggtgagaagagcgaattagcgctttcggctctgggcggttgcgttttctacctcaaaaaatgcctcatagaccaggaactcttgtctatggctaactttgaagagtacatcccactggatagtgataccgtcagcaccactcgttctggagcaatatttaccaaggcctaccagcgaatggtgctcgatgcagtgactctgaataacctggaaatcttcctgaacggcaccaatggaagtactgaagggactctgctggagagggtggacacctgccacactccgttcggcaagcggctgctgaagcagtggctttgcgctccactttgtaatcactatgccattaacgacagacttgacgcaatcgaagacctgatggttgttcccgacaagatcagcgaggttgtagagcttcttaaaaaattacctgacttggagagactgctgagtaaaatacacaacgttggctcccctctgaagagccagaatcaccccgactcgagagctatcatgtacgaggagacgacgtattcaaagaaaaaaataatcgactttttaagcgccctggaagggtttaaggtcatgtgcaaaatcatcgggatcatggaagaagttgccgatggtttcaaatccaagatactcaagcaggtgatcagcctgcaaaccaagaaccccgaaggcagattcccggacctcaccgtggagttaaacaggtgggacacggcgtttgaccacgagaaagctcgaaaaactggtctgatcacacctaaggctggctttgattccgattacgatcaggcgctcgccgatattcgggagaatgagcaatccttgctcgagtacctggaaaagcagcgaaaccgtatcggatgccgcaccattgtatattggggcattggacgtaacaggtaccagcttgagattccggagaacttcacgacacgtaacttgccggaggagtatgagttgaagagtaccaagaaaggctgcaagcggtattggaccaagacgattgaaaagaaactggcgaatttgataaatgctgaagaacgacgcgatgtgagccttaaggattgtatgagaagactgttctacaactttgataagaactacaaggactggcagagtgctgttgaatgcattgcagtgctggatgttttgctctgcttagcgaattactctagaggtggagacgggcctatgtgccgccctgttatcctgttgcccgaggacacaccgccattcttagagctgaaggggagccgccatccatgtattacaaagacgtttttcggcgacgatttcatcccaaatgatattttgatcggatgtgaggaggaagagcaggaaaatggaaaagcatactgtgtcctggttacagggccaaacatgggaggcaaatctaccctaatgagacaagccggattgctggccgtgatggcccagatggggtgttatgtccccgctgaagtctgcagactcactcccatagaccgggtttttaccagacttggggcatcagacagaatcatgagtggcgagagcacctttttcgtggaactgtcagagacagccagcattttgatgcatgccaccgcccattccctggttcttgtggatgaactgggaagggggaccgcgaccttcgacggcaccgcaatagcaaacgcggtagttaaagaactggctgaaaccatcaagtgcagaaccttgttctctacacattatcacagcctcgtagaagattactctcaaaatgtggctgtgagattgggtcacatggcttgtatggtggagaacgagtgcgaggatccaagccaggaaaccataacgttcctgtacaaatttataaaaggcgcttgccccaagtcttatggcttcaacgccgctaggctggcaaatctgcctgaagaagtcatacagaaaggacaccggaaagcgcgagagttcgaaaaaatgaaccagtctcttcgcctgttccgtgaggtctgtctagcttccgagaggagcactgtcgatgctgaagctgttcataagttgctgacccttattaaagaattatag

SEQ ID NO: 29617 - DNA, 975 bp, Artificial Sequence
  Description of Artificial Sequence: Synthetic coding sequence
atgcgaagattgttctataacttcgacaagaattataaagattggcagtcagcggtcgagtgcatagccgtgttagatgtcctgctctgtctcgccaattattcaagagggggtgatggcccaatgtgtcgcccagtcattctgctgccagaagacacaccgcctttcctcgaactgaaaggatcccgccatccctgtatcactaaaaccttctttggcgatgacttcatcccaaacgatatcttgatcggctgcgaggaggaggaacaggaaaacggcaagattgtgtgcctcctgctggaccagatctggggcgcaagcctccggatgcggcaggcaggcctgctggccgtgatggcccagatgggctgttatgtcccagctgaggtatgtcggctgacacccatcgatcgggtgttcacacgtcttggagcatcagatcgtatcatgtccggagagtctacgttttttgtagagctgagtgaaacagcctcaatactgatgcacgctactgcacactctctggttctagtagacgagctgggacgagggaccgctacattcgacgggaccgctattgcgaatgccgtggtgaaggaacttgcagaaactattaagtgccgtactctgttttccactcattaccacattagtcggaggttgttttcaaaatgttgctgtttggggcatatggcctgtatggtcgagaacgaatgcgaagacccttctcaagagaccatcaccttcctctataaattcatcaagggggcttgccccaagtcttatgggtttaacgcagccagactggctaatctcccagaagaggtgatccagaaagggcaccgcaaagctagggaatttgagaaaatgaaccaatcgctgcgcctttttcgcgaggtgtgcctggccagcgagcggtctacagtggatgctgaggccgtccacaaactcctgactctgatcaaagaactctag

SEQ ID NO: 29618 - DNA, 3201 bp, Artificial Sequence
  Description of Artificial Sequence: Synthetic coding sequence
atgtctcggcagtccactctgtattctttcttcccgaagtcccccgctctttctgatgcaaataaagcctccgccagagcgtcacgggaaggaggccgtgccgcatgtccaaggggcctgagttttcctagaagaggctgtgggctggagcgcggttgggcctggcgacctctggctcgcagtgcgtcacctccaaaggccaaaaaccttaacgggggtcttagacggtcagtcgctccggctgcccctacctcatgtgatttctccccaggggatctggtctgggcaaaaatggaaggatacccttggtggccttgcctggtatacaaccaccccttcgacggtaccttcattcgcgagaagggcaagtccgtcagggtgcatgtgcaattctttgatgattctcctacgcgcggatgggtcagcaagagactcctgaagccatataccgggagtaaaagtaaagaagctcaaaagggtggtcatttttattcagccaagccagagatcttgcgtgccatgcagcgagccgacgaggcactcaacaaagataaaataaaaaggttggagctagctgtgtgcgatgaaccgagcgaacccgaagaggaggaggaaatggaggtggggactacatacgtgactgataagagcgaggaagacaacgagatagaatcagaggaggaagtgcagcccaaaactcagggctctcgaagatccagccgacagattaaaaagaggcgtgtgattagcgatagcgagtccgatatcgggggttccgatgttgagttcaagcctgacacaaaagaggaagggtctagtgatgagattagcagtggggtgggagatagcgaatctgaaggtctgaattcaccagtcaaggtggctcggaagagaaagcggatggtcacaggcaatggctcactaaagcggaaatcctcaaggaaagagaccccaagtgcgaccaagcaggcgacatccatttcctcagaaacaaaaaacactctacgcgcattcagcgccccacagaactcagaatctcaagctcacgtctctgggggaggtgacgattcctcccggcctactgtttggtatcacgagacactggagtggcttaaggaggaaaagcgccgtgacgagcaccgacggcgacctgaccaccctgactttgatgcatccactctgtatgtcccagaggattttctaaactcatgcacgcccggtatgcggaagtggtggcaaataaaaagtcagaattttgacctggtaatttgttacaaggtcggtaagttctatgaactctaccacatggacgcccttattggggtcagcgagctgggtctagtgtttatgaaagggaattgggcccactcagggtttccggaaatcgcatttggtcgctactccgatagtctggtgcagaaggggtacaaggttgcgagagtcgaacagacagagacaccggagatgatggaagcaaggtgccgtaaaatggctcacattagcaagtacgacagggtggtgcgtagggagatatgccggatcattaccaaaggtacgcagacctacagtgtcctggaaggggatccttctgagaattacagtaagtacttattgtctcttaaggagaaggaagaagactcttccggacatactagagcctatggagtgtgctttgtggacacttccctcggaaaattcttcatcggccagtttagcgacgacaggcactgtagccgctttaggaccctcgtagcgcattaccctccggtccaggtgctgttcgagaaagggaacttatcgaaggaaacgaaaaccatcctcaaatcttctttatcatgttctctccaggagggcctgatccctgggagtcaattttgggatgcttctaagacactgcggacattgcttgaagaagagtatttcagagagaaattatccgatggtattggagtgatgctcccccaggtcttgaaaggcatgacaagcgaatccgattcaatcgggctgactccaggcgagaaatcagagctcgctctatctgccctcggtggctgcgtgttctatttaaagaagtgcctgatcgatcaggaactgctcagcatggccaatttcgaggaatatataccacttgacagtgatacggtatcgacaacaagatcaggcgcaatctttactaaagcctatcagcggatggtactggatgccgttactttgaataacctagagatcttcctgaatggcacgaacggctctaccgaagggactttgttagagagggtggacacatgtcacacacctttcggaaagcgcctgctcaaacagtggttgtgcgctcccttgtgtaatcattatgctattaatgatcgacttgacgccatagaggatctcatggtggtgcctgataaaatcagtgaagtcgtagaactgttgaaaaaattgcccgacttggagagacttctcagtaaaatccataacgtcggtagtcctttgaaaagccagaatcacccggatagcagggccattatgtatgaagaaaccacttactcaaagaaaaaaatcattgacttcctaagcgccctcgagggttttaaagtcatgtgcaagatcatcggcatcatggaggaggttgcagacggcttcaaaagcaaaattctgaaacaagtgatatctctgcagaccaaaaatcccgagggacgcttcccagacctcacagtggaactgaataggtgggatacggcctttgatcatgaaaaagcccgaaaaaccggcctcattaccccaaaggctgggtttgatagcgattacgatcaggcgttggccgacatcagagagaatgagcaatctctcttagaataccttgaaaaacaacggaaccggataggttgtagaaccatagtctactggggcatcggccgtaacagataccagctggaaatcccagagaactttactacacggaatcttccggaagagtatgagttaaaatctacgaagaagggttgcaagcgatattggactaagactatagaaaagaagttagccaatcttatcaatgcggaggagcggagggatgtgagtttgaaggactgcatgcgcagactgttctacaactttgacaagaattacaaggattggcaatcagcagtggaatgtatcgctgtgctgggcaagaccttaaataaacttgtcttgagactgtag

SEQ ID NO: 29619 - DNA, 1569 bp, Artificial Sequence
  Description of Artificial Sequence: Synthetic coding sequence
atgaggaagcctagggctgctgtgggatctgggcatcgtaaacaggccgcttcccaggaaggtcggcagaaacatgccaagaataactcacaggccaagccctcagcctgcgacgccggactggcgagacagcccgaggaggtggtgcttcaggcttcagtgtcaagctatcatctcttcagggatgtagccgaggtgacagctttcagaggcagccttctgtcttggtatgaccaagaaaaacgagacctgccatggcgaaggagagctgaggatgaaatggacctggaccggagagcttacgctgtttgggtatccgaggtcatgttgcaacaaactcaggttgccacggtgatcaactactacactggctggatgcagaaatggcctactttgcaggaccttgcctccgcgtctctcgaagaagtaaaccagttgtgggccggtctgggttattactcaagaggcaggagactgcaagaaggggctcgcaaggtggtcgaggaactggggggtcatatgccacgcaccgccgaaacacttcaacagctcctgccaggagtcgggagatacaccgctggggcaattgcgtctatagccttcggtcaggccaccggagttgttgacggaaacgtagcacgtgtgttatgtagggtgagggcaataggagcggatccttcatccaccttagtgtctcagcagctgtggggcctggcccaacagctggtggaccccgcacgccctggagacttcaaccaggctgctatggagctgggagcgactgtttgtaccccgcaacgtcccctctgtagtcagtgtcccgttgagagtctctgtcgcgctaggcagagggtggaacaggagcagctgttagccagcggctctcttagtgggagccctgatgtcgaggagtgtgccccaaacactggccagtgtcacctgtgtctcccaccatccgaaccatgggatcaaaccctgggcgtagtgaacttcccaaggaaggcttctaggaaaccaccgcgagaggagtcatcagccacctgcgtgttagagcagccaggcgcactgggcgctcagatcctgctggttcagaggccgaactctgggctgctcgccggactttgggagtttcccagcgtgacatgggagccaagcgagcagttgcagcggaaagccctcctccaggaacttcaacggtgggcagggccactgcctgcgacacatctgcggcacctgggggaggttgtgcacaccttttcacatattaagctgacttatcaggtctatggactggcactcgaaggacagacccccgtgacaactgtgccccctggggctaggtggttgacccaggaggagttccacacagccgctgtcagcacagctatgaaaaaagttttccgagtctatcagggtcaacagcccggaacatgcatgggatctaagcgctcccaggtttccagcccttgctcccgtaagaagccccgaatgggtcaacaagtgctggataatttcttcagatcccacatatccactgacgcccacagtttgaattctgctgcccaatag

SEQ ID NO: 29620 - DNA, 1566 bp, Artificial Sequence
  Description of Artificial Sequence: Synthetic coding sequence
atgcgcaagcctcgggcagcggtgggatcaggccatcgcaaacaagctgcgtcccaagagggtaggcagaaacatgctaaaaataactcccaagcgaagccgagcgcttgtgacggcctggctcgccaaccggaagaggtcgtcctgcaggcatcggtgagcagttatcatctgtttcgcgatgtggcagaggttacagcctttcgagggtctctgttgtcatggtatgatcaagagaaaagagacttgccatggaggcggcgagctgaagatgagatggacctggacagacgagcctacgcagtgtgggtttcagaagttatgctgcagcagactcaggtggctacagtcattaattactacactggatggatgcagaagtggcctaccctccaagacctcgccagtgccagtctcgaagaagtgaatcagctttgggctgggctcggctattacagtcgcggaagacgactacaggagggagcacgaaaggtcgtggaggagctgggcggacatatgcccaggacggccgagaccctgcagcagttactcccaggagttggaaggtatacagctggggctatcgcttctatcgccttcggtcaagcaacaggtgttgtggatggcaatgtcgcgcgtgttctttgccgagtacgtgccatcggggcagacccctccagcactttggtgagccagcaactttggggccttgcccaacaactggttgatccagcacgtcctggcgactttaaccaggctgccatggagctcggggcaaccgtgtgtacaccacagagaccgctgtgcagccagtgtcccgtggagtcactctgtcgggctagacagcgcgtggaacaggagcagctcctggcctcaggttctctgtctgggtcccctgacgtggaggagtgcgccccaaacacaggtcaatgccatttatgtctaccccctagtgagccatgggatcaaaccctgggggtggttaatttccctcgaaaagcatcacgcaagcccccaagagaagaatcatccgcaacctgtgtgctggagcagcctggagcgctcggggctcaaatactgctggtgcagcgccctaacagcggcctgctagccggtctgtgggagttcccttccgtaacttgggagcctagtgaacaactccagaggaaggcccttctacaggaactgcagaggtgggccggaccgctgcccgctacacatctgcgtcatctcggtgaggtagtgcacactttttcacatatcaaactgacttatcaagtttatgggctggcactggaaggacagacccccgttactacggtgccccctggagcaaggtggctcacacaagaagaattccatactgccgcagtgtctacagctatgaagaaggtcttcagggtgtaccagggtcagcaacctggcacttgcatgggcagcaagcggagccaggtcagttccccttgttctcgaaagaaacccagaatgggccaacaagtacttgataacttctttcgatcccatatcagcacggatgcccattccctcaacagcgccgctcagtag

SEQ ID NO: 29621 - DNA, 1641 bp, Artificial Sequence
  Description of Artificial Sequence: Synthetic coding sequence
atgacaccactcgtgtcgcgactgtctaggctttgggcaattatgcgaaagcccagagcggcagttggatcgggccaccggaagcaggcggcatcccaagaggggaggcaaaaacacgctaaaaacaactctcaagccaagccgtcggcgtgcgacgggatgatcgccgagtgtcccggagcaccagcagggttggcacggcaacccgaagaagtggtgcttcaggcctcagtctcatcttatcacctgttcagagacgtggcagaagtgaccgccttccgcggatctcttctatcatggtacgatcaggaaaaaagagacctcccctggagaagaagagccgaagacgaaatggatctggatagaagagcctatgctgtgtgggtgagtgaagtgatgctgcaacagactcaggttgccacggtcatcaattattacaccggttggatgcagaagtggccgaccctacaggacttggccagtgcgtcgctggaagaagtgaatcagctgtgggctggcctcgggtattattcaaggggccgtcgcctgcaagagggagcccgaaaggtggttgaggagctgggcggacacatgccacgaacagccgagactttacagcagctgctgcccggagttggcagatacactgccggagctattgcctctattgctttcggccaggcgaccggcgtcgtggatggcaacgtggcacgggtcctatgtagagttagggccattggggcagatcccagtagtactctcgtgtcccagcagctatggggcttggcgcagcaattagttgatcctgcaaggcccggtgactttaatcaggctgccatggaactgggggctaccgtgtgcacgcctcagcgacccttgtgctctcagtgccctgtagaaagtctttgtcgtgccaggcagagggtggagcaggagcagctcctcgcgtcgggctccctatcaggcagccccgacgtagaagagtgtgccccaaacacagggcagtgtcatctgtgcctcccccctagcgaaccatgggatcaaacgctcggcgttgtcaacttcccgagaaaggctagccgtaagcctccccgagaggagtcctcagcaacatgcgtgctggagcaacccggagctctgggcgcacaaatcctgctggtccagaggcccaatagtggcctgctcgccggtctgtgggaatttccaagtgtcacctgggagcccagtgagcaactgcagcgtaaagccctgctgcaggagctgcagcgatgggctgggccactacccgctacccatctgagacacctgggggaggtcgtgcatacttttagtcacattaagttgacctatcaagtttatggcctggccctagaaggacagacacctgtcaccactgtgcccccaggcgctaggtggttgacacaggaagagttccataccgcagctgtttctacagccatgaagaaggtttttagggtttaccaggggcagcagccgggtacttgcatgggctctaaaaggtcacaggtgtctagcccctgctcccggaagaaaccaagaatggggcagcaggtcctggacaatttctttagatcacatatctcaacggacgcgcattcccttaactccgcagcccagtag

SEQ ID NO: 29622 - DNA, 1599 bp, Artificial Sequence
  Description of Artificial Sequence: Synthetic coding sequence
atgagaaagccaagggccgctgtgggcagtggccaccgcaagcaggccgcttcacaggagggccgtcaaaaacacgccaagaacaactcacaagcgaagccaagcgcatgtgatgggatgatcgcggaatgtcctggcgctccagcgggattggccaggcagccagaagaagtagtgcttcaggctagcgtgtcctcctatcatctgttcagggacgtggctgaagtgaccgccttccgcggtagcctcctgtcatggtatgatcaggagaaacgggacttgccgtggcgcaggcgggcagaagacgagatggatctggatcgcagggcctatgcagtgtgggtgagcgaagtgatgctgcagcaaacgcaggttgccaccgttatcaattactacacaggatggatgcagaaatggcctactctccaagacttagcctccgcatccctagaggaggtcaatcagctgtgggccggacttggctactatagtagggggcgacgactgcaggagggagcacgtaaagttgtggaagagctgggcggtcatatgcctaggaccgctgaaactctgcagcagttactccccggtgtgggtagatatacagcaggggctatcgcaagtatcgcttttggccaggccacaggagtggtagacggaaacgtggctagagtcctatgccgagtgcgcgctattggcgctgacccttcttcgaccttagtcagtcaacagctctggggcctggcccagcaacttgtcgaccccgctcgacctggggactttaatcaagcagccatggagctgggggcaaccgtatgtacaccacagcgacccttgtgcagtcagtgccccgttgagtctctctgtagagctaggcaacgcgtggagcaggagcagctccttgcctccggaagcctgtctgggtccccagatgtggaggaatgtgcgcctaacactggacagtgccatttatgtctgcccccaagcgagccttgggaccaaacactgggagtcgtgaactttccgaggaaagcaagcaggaaaccaccacgggaagagtcttctgctacatgcgttcttgagcaacccggagctcttggagctcaaattctgttggtgcagcggccaaattctgggttgctggccggtctttgggagtttccctctgtgacatgggagcctagcgagcagctccagaggaaagcccttctacaggagctgcagcgttgggccggaccactgcccgctacgcatctgcgccatttgggcgaggtagtgcacaccttcagccatatcaagcttacttatcaggtgtacggactcgcccttgagggacagacccctgtgaccacagtgcccccaggcgcacgctggcttacacaggaggaattccacacagcagctgtaagcaccgcgatgaaaaaggtatttagagtgtaccagggacagcagcctgggacctgtatgggctctaaaagatctcaagtaagtagcccgtgctcccggaagaagccaaggatgggtcaacaggtcctggacaatttttttagaagccacattagcaccgatgctcacagcctgaattctgccgcacagtag

SEQ ID NO: 29623 - DNA, 1566 bp, Artificial Sequence
  Description of Artificial Sequence: Synthetic coding sequence
atgagaaagccacgcgctgccgtcgggtcgggtcacagaaagcaggcagctagtcaagaagggaggcagaaacacgcaaagaataattctcaggccaagcccagcgcttgtgatggcctagctcggcagccagaagaggtggttctgcaggcttccgtttcttcctaccacctgttccgggatgtggccgaggttaccgcgtttagagggtccctactgtcatggtacgaccaggagaaacgggatctcccatggagaagacgggctgaggacgagatggacctggataggcgcgcttatgccgtctgggtcagcgaggtaatgcttcaacagacacaggtcgcaaccgtaattaactactataccgggtggatgcagaaatggcctacacttcaggacctggcctctgcctctctcgaggaagtaaaccagctctgggccggacttggctattactcccggggaagaaggcttcaggagggggctcgcaaggtggttgaagagctgggtggacacatgcccaggactgctgaaactcttcagcagctcctgcctggcgtggggaggtacaccgccggagctatcgctagtattgcattcggccaggccacaggcgttgtagacggtaacgtggctagagtcctctgccgggtgcgcgctattggcgcagacccatcatcaacactggtgtctcaacaactctggggcctggcacagcagttagtggatccagccaggcctggcgacttcaaccaggcggctatggaactgggtgcaactgtctgcacaccccagcggcctctttgctcacagtgtccagtggagagcttgtgccgggcacgacagcgggtggagcaggagcagctgttggcgagtggcagcttaagtggttccccagatgtggaggagtgtgctcctaacaccggacaatgtcatctgtgtctccccccatcagagccctgggaccagacgttgggtgtggtgaatttccccaggaaggcatccaggaaacccccaagggaagagtccagcgccacttgcgtgcttgaacagccaggggctctgggcgctcagatcctcctcgtgcagcggcctaattcggggctcctggcagggctttgggagttcccaagcgtgacatgggaacccagtgaacagttgcagcggaaagccttacttcaggagcttcagcgctgggccggtcccctcccagctacacatctaaggcacctcggcgaggtcgttcacacctttagtcacatcaagttaacatatcaggtctacggcctcgctttggaaggccaaacccccgtcactaccgtcccacccggtgcgcgttggctaactcaagaggagtttcatacagcggcagtgagcacggccatgaagaaggtgttcagggtatatcagggacagcagccaggcacatgcatgggctctaagcgcagccaagttagcagtccatgctcccgcaagaagcccaggatgggacaacaggtcctcgacaatttcttccgcagccacatctctacggacgcacactcgctgaatagcgctgctcagtag

SEQ ID NO: 29624 - DNA, 1611 bp, Artificial Sequence
  Description of Artificial Sequence: Synthetic coding sequence
atgacaccgttagtcagtaggttatctaggctatgggctatcatgcggaagcctagggcagccgtagggtcaggacacaggaaacaagcagcaagtcaagagggccgtcagaaacacgctaaaaacaattcgcaggcaaaacctagcgcctgcgacgccggactggctcggcagcctgaggaagtggtgctgcaggcttcagtctcatcataccacctctttagggacgtggcagaggtgactgccttcagggggagcttgctgagttggtatgatcaagaaaagcgcgaccttccttggagacgacgggctgaggacgagatggatcttgaccgcagggcatacgccgtatgggtgagcgaggtgatgctgcagcagactcaggtggctaccgtcattaactattacacggggtggatgcagaaatggcccactctgcaggacctggccagcgccagcttagaggaagttaatcagttgtgggccggtcttgggtactacagtcgaggaagaaggctgcaagagggggctcgtaaggttgtcgaggaactggggggtcacatgccgagaacagccgaaacgcttcagcagctgctcccaggcgtagggagatataccgccggagccatcgcctccatagcgttcggacaggcgacgggcgtagtagatgggaacgtcgctcgagtgctttgcagggtcagggcgatcggagctgacccgagctcgacgctggtgagtcagcagttatggggcctcgctcagcagctggtcgaccccgctcggccaggcgacttcaaccaagctgccatggaactaggggctacggtttgtacccctcagagaccactgtgtagtcaatgcccagtcgaaagtctctgtagggctaggcagcgcgtggaacaagagcagctactcgccagcgggtccctttccggctcccctgacgtcgaggaatgcgcacctaacaccggccagtgccacctgtgtctgccaccgtctgaaccgtgggaccagacacttggggtcgttaacttcccacgcaaagcctcccgtaaacctccacgtgaggagagctctgctacgtgcgttctggaacaaccaggggctcttggggcacagattttacttgtgcagagacctaacagcgggttgctggccggactgtgggagttccccagtgttacttgggaaccttcagagcagctgcagcgaaaagctctcctgcaggagctacaacggtgggctggcccactgcccgctactcacctgagacacctgggagaagtggttcacaccttctcccatatcaagctcacctatcaggtttacgggctcgccctggaaggccagactcctgttacaacagttcctcccggagctcgctggctgacacaagaagagttccacaccgcagccgtttcaaccgctatgaagaaggtgtttcgcgtttaccaaggccagcaaccaggcacatgcatggggtccaagcgttctcaggtgagcagcccttgctcccgcaaaaagccaagaatgggccagcaggtgctggataatttcttccgcagccatataagtacagacgcccattcactcaactcggcggcacaatag

SEQ ID NO: 29625 - DNA, 1608 bp, Artificial Sequence
  Description of Artificial Sequence: Synthetic coding sequence
atgacgcccctggtgagccggctttcccgcttatgggccatcatgagaaagcctagggcagccgtgggatcagggcatcgaaagcaggctgcatcacaagaaggaaggcagaagcacgccaagaacaactcacaggcaaagccctcggcatgtgatggcctggcccgtcagcctgaggaggtcgtgctgcaggctagcgtgtcatcttatcacctttttcgtgatgtggcagaggtgacggctttcagaggtagcctgctgagctggtatgaccaggagaaaagagatcttccttggcgcagacgggctgaagatgaaatggatttagatagaagagcgtacgcagtgtgggtttcagaagtcatgctgcagcagactcaggtagcaaccgtgattaactattatacaggatggatgcagaaatggcccacactgcaggacctcgctagtgcttcgctggaggaggtcaaccagctttgggccggattaggatactatagcagaggccgacgtcttcaagaaggagccagaaaggtggtcgaagagctgggtggacatatgcctcgtacagccgaaacactgcagcagctcctgccaggcgttggcagatataccgccggagccatcgcgtctatcgcctttgggcaggctaccggcgtcgtggacggtaatgtggccagagtcctgtgccgcgtgcgcgcaatcggagccgatcctagcagcacactggtctctcagcaactgtgggggctggcacaacagctggtcgaccccgctcgccctggggatttcaatcaggcagccatggaacttggtgcaaccgtctgcacacctcagaggccactgtgctcccagtgccctgtggagtccttgtgtcgggcacggcagagggtcgaacaggagcagcttctagcctcaggcagtcttagcggcagccctgacgttgaagagtgcgctccaaacaccggtcagtgccacttgtgcctgccaccaagcgagccatgggatcagaccttgggagttgtcaactttcccagaaaggctagccgaaagccgcctagagaggaaagtagcgcaacttgcgttttggaacagcctggcgctctaggtgctcagatactgttagtccaaagacctaactcaggactcctcgcgggactgtgggaattcccgagcgtcacgtgggagcccagtgaacaactacagcgcaaagcacttctgcaggagttacagcgctgggctggccctcttcccgctactcacctgcggcatttaggggaggtcgtgcataccttctcccacatcaaattgacctatcaagtgtacggtctcgccttggagggccaaacacccgttacgaccgtgccccctggtgccaggtggctgacccaggaagagttccatacagcagcagtttccacagcaatgaagaaggtgtttagagtgtaccagggccaacaaccgggaacatgcatgggatctaaaagatctcaggtgtctagtccatgctctaggaaaaaaccccgaatgggccagcaagtgttggacaacttttttcgcagtcatatcagtaccgacgcccattctctcaactcagccgcacagtag

SEQ ID NO: 29626 - DNA, 876 bp, Artificial Sequence
  Description of Artificial Sequence: Synthetic coding sequence
atgcgcaagcctagagccgcagtcgggtccgggcatcgcaaacaagcggcatcccaggaaggccgtcaaaaacatgctaagaacaattcccaggccaaaccgagcgcatgcgacggtatgatcgccgaatgccccggagccccagctggcctggcccgtcagcctgaggaggtggttttacaggcctccgtctcatcttatcacttatttcgcgacgtcgcagaggtgaccgctttccggggaagcttgctctcttggtacgaccaggaaaagcgcgatctgccatggcggagacgcgcagaggatgaaatggacctggatcgcagagcttatgcagtgtgggtgagcgaggtcatgctgcagcagacccaagtagctactgtgatcaactactacactgggtggatgcagaaatggcctaccctgcaagaccttgccagtgcttctctcgaggaggtgaatcaactgtgggccggtttaggttactattctagaggtcggaggttacaggagggcgctcgaaaggtggttgaggaactgggagggcacatgcctcgaactgccgaaactctgcagcagttattgccaggtgtcggacggtacacagccggagccattgcatctatagccttcggccaagctaccggcgtagtcgacggcaatgtggctcgcgtgctttgcagagtccgtgcgatcggtgccgacccctcctcgaccctggtgtcccagcagctgtgggggctggctcagcagcttgtcgatccagcccgacccggagactttaaccaggcagccatggagctgggcgctactgtctgtactccccagcgccctctgtgttcgcagtgcccagtcgaatcattgtgcagagcctag

SEQ ID NO: 29627 - DNA, 1599 bp, Artificial Sequence
  Description of Artificial Sequence: Synthetic coding sequence
atgaggaaacccagggctgcagtgggtagcggccaccggaagcaggcagcctcacaggaggggcgacaaaagcacgccaaaaataacagccaagccaagccatcggcatgcgacggtatgatcgcggaatgccctggggctcccgctggactcgccagacagcccgaagaagttgtgctccaagccagtgtgagcagttaccacctgttccgcgacgtggcagaggtcacagcctttagggggtctttgctgtcctggtatgatcaggagaagcgggatctgccatggaggaggagagcggaagacgagatggacctggatcggagggcttatgccgtatgggtttccgaggtcatgctccagcagacacaggtcgccacggttatcaactattatactggctggatgcagaagtggccaactcttcaggacctcgctagcgcttccctggaggaggtgaatcagctgtgggctggactgggctactactctcgaggtcggaggctgcaggagggagctagaaaggttgtagaggagttgggaggacatatgcccaggactgctgagaccctccagcagcttctgccaggggtcggcagatacaccgctggggcaatcgcatctattgcattcggacaggcgaccggagttgtggacgggaacgtggcacgcgtcctgtgcagggttcgggctatcggtgcagatccctcctccacactggtttctcagcagctatggggcctcgctcagcaactggtggatcccgctcggcctggagattttaatcaggccgctatggagttaggggcaaccgtttgtactccccagagaccactgtgttctcagtgcccagtcgagtccctatgcagagcccgtcaaagagtggagcaggagcagttactggctagtggatcactgtctggttctcccgacgtggaagagtgcgcccctaacactgggcagtgtcatttgtgtttacccccatcagagccctgggaccagacattgggcgtcgtgaacttccccaggaaagcgtcgaggaagcctcccagggaagaatcaagcgctacttgtgtattagagcaacctggggcactaggtgcccagatactcttggtacagcggcctaactccgggctcctggcgggactttgggagtttcccagcgttacctgggagccatctgagcagttgcaaaggaaagctctacttcaagagctacaacggtgggctggccctctgccagctacccacctgaggcatctgggcgaggtggtgcataccttcagtcacattaagctaacttaccaagtctacggcctcgccctggaaggccagactcctgtgaccaccgtgcctccaggtgctcgctggctcacccaggaggaattccatacagccgctgtgtctaccgccatgaaaaaggtgttccgcgtataccaggggcagcaacctggtacctgtatgggctcaaagaggagtcaagtctcctccccatgtagccgcaagaaacctcgcatgggccagcaggtcctggataactttttcaggtcccatatctcaacagacgctcacagtctcaactccgcagctcagtag

SEQ ID NO: 29628 - DNA, 1650 bp, Artificial Sequence
  Description of Artificial Sequence: Synthetic coding sequence
atgacaccacttgtaagtcggctgtcacgtctctgggctattatgagaaaaccacgggctgctgtcggatctggccataggaagcaggcggcaagtcaggaggggagacagaagcacgctaaaaacaatagccaggctaagccaagcgcgtgcgacgcctgcgccggaatgatcgccgagtgtccaggagcccctgctgggctggctagacaaccggaagaagtggttctccaggcttcggtttcgtcgtaccatttattccgagatgtggccgaggtgactgcatttagaggcagtctgctgtcctggtacgaccaggagaaaagggatctgccttggcggcgacgcgcagaagacgaaatggatctggatcgcagggcctatgctgtgtgggtcagtgaggttatgctgcagcagacacaggtggcgacagtcattaactattacaccggctggatgcagaagtggcctacgcttcaggatcttgccagcgcctcactggaagaggtaaatcaactctgggccggtctgggatactacagcagagggcgtcgactccaggagggggctcggaaggtagttgaggagctgggtgggcacatgccccgaactgctgaaacattgcaacaattgcttcccggagttggacggtacactgccggtgcaattgcttccatcgccttcggtcaggctaccggggtggtggatggtaacgttgcccgagtactttgtcgcgtgcgggctatcggggcagaccccagttctacactggtcagtcagcagttgtggggattagctcagcaactggtcgatccagctcggccaggggacttcaaccaagccgcaatggaactgggggctaccgtgtgcactccacagcgcccactgtgctcgcagtgtccagtggagagtctgtgtcgcgcacggcagcgagtggagcaggaacagctgctggcctcgggatccttatccgggtcgccagacgttgaagagtgtgccccaaataccgggcagtgccacctttgcctgcccccttccgaaccctgggatcagacactcggagtggtcaattttcctagaaaggcaagccgcaagccaccaagggaagagtcgagcgccacctgtgtgctcgagcagcccggagccttgggggctcagatcctgctggtccagagaccaaactctgggctgctggcaggcctttgggaattcccaagtgtgacctgggagccttccgaacagctgcagcgtaaggccctgctccaagagctgcagaggtgggctggacccttgcctgctacccatcttcgtcatctgggggaagtcgtgcatacgtttagccatatcaaactcacttaccaggtgtatggactggctctggaaggccagactcctgtaactaccgtaccaccaggcgcacgttggctgactcaagaagaatttcataccgctgccgtgagcaccgctatgaagaaggtgtttcgagtttatcaggggcagcagccagggacgtgcatgggtagtaaacgttctcaggtcagtagtccgtgtagtaggaaaaagcccaggatgggtcagcaggtgctagataacttctttagatctcacatctcaaccgatgcccactcactgaattcggccgctcaatag

SEQ ID NO: 29629 - DNA, 1566 bp, Artificial Sequence
  Description of Artificial Sequence: Synthetic coding sequence
atgcggaaacccagagcagctgtgggatccgggcaccggaagcaggccgctagtcaggagggacgccagaagcatgcaaaaaataattcacaggccaagccatcagcttgtgacggtctggctagacaaccagaggaggttgtgttacaagcctcggtgagctcctatcatctttttagagatgttgccgaggtgaccgcttttcgcggatccctcctctcttggtatgaccaggagaagagagatctgccgtggagaaggagggccgaggacgaaatggatctggataggcgcgcatatgccgtctgggtgtccgaagtcatgttacaacaaacacaggtggccaccgtgatcaactactacacgggttggatgcaaaagtggcccaccctgcaggatttggcaagcgcaagcctagaagaggttaatcagttatgggcaggtctcggctattacagccggggaagacggctccaggagggcgcacggaaggttgtggaggaactcggcggacacatgcctcgcaccgccgagaccctgcaacagttactccctggagtgggcaggtacacggcgggagctattgctagtatcgcctttggccaggccaccggagttgtggatgggaacgtggcaagagtcctttgccgggtgagagctattggtgccgatccatcctccacattggtgagtcagcagctatggggactcgcccagcagctggtggacccggctcggcctggggacttcaatcaagcagctatggagctcggagccaccgtctgcacaccccagcgccctctgtgctcccagtgccctgtcgagtctttgtgtcgagcgcgacaaagggtcgagcaggagcaacttttagccagcggcagcctgagcggctccccagatgtggaggagtgtgctcctaacacaggccagtgccatctgtgtctaccaccttcagagccatgggaccagaccttgggggtagtcaactttccaaggaaggcgtcacgcaaacctccaagggaagagagcagtgccacctgtgtactggagcaacctggggcactcggtgctcagatcctgctggtgcagcggcctaactccggtctgctggcaggcttgtgggaatttccctcagtcacctgggagcccagcgagcaactgcaaagaaaggccctgcttcaggagttgcagcggtgggcgggtccgctccccgcaacgcaccttcgtcacctgggtgaggttgtccacacgttcagtcacattaagctgacctaccaggtatatggccttgccctagagggacagactcctgtgactacagtcccacctggcgcaaggtggctgacgcaagaagagttccacaccgctgcggtgtccaccgcaatgaaaaaggtattcagagtataccaaggccagcaacccggaacctgtatgggaagtaagcggtcacaggtgtcgtccccatgttctcggaaaaagcccaggatgggacagcaagtactggacaattttttcaggtcacacatctcaacggacgcacactctctcaactcagctgcccaatag

SEQ ID NO: 29630 - DNA, 648 bp, Artificial Sequence
  Description of Artificial Sequence: Synthetic coding sequence
atgaccccactggtgagccggctgtctcggttatgggaagtaaatcagttgtgggcaggcctgggctactatagcaggggaagacggctgcaagagggcgctcgtaaggtggtggaggagttgggtgggcacatgcccaggaccgccgaaacactgcaacaactcctgcctggagttgggaggtatactgctggcgcaatagccagtattgcgtttggacaggccaccggggtggttgacggcaacgtggccagggtgttgtgtagggtccgggctattggcgcagacccttccagcactctggtctcccagcagctgtggggcctagcccaacaactagttgaccctgccaggcccggagacttcaaccaggccgctatggagctcggcgctaccgtgtgtactccacaaagaccactgtgtagccagtgccccgtggaatcactctgtcgagccagacagagagtcgagcaagaacagctgctcgcgtcaggctccctgtctggttcacccgatgtggaagagtgcgccccaaatacaggacagtgccacttatgtctaccaccaagtgagccttgggatcagactctgggcgtggtgaattttccacgtaaagcaagccggaagcctccaagagaagaatcatag

SEQ ID NO: 29631 - DNA, 693 bp, Artificial Sequence
  Description of Artificial Sequence: Synthetic coding sequence
atgaccccattggtgagccgcctgtctcgtctgtgggccataatgcggaagcccagagctgccgttggctcaggacaccggaaacaagcagccagtcaggagggacgacaaaagcacgcgaagaataatagtcaagccaaaccgtccgcctgcgatggcggtgaaagcactctggggtggccaggtcttctcttctcctggcctgcagccgcaggcggatcttcagagggtctgctcgcaggcctttgggagtttccctcagtcacatgggagccttctgagcagcttcagcgcaaagccctgcttcaggagttacaaagatgggccggaccactcccggctacccaccttagacatctgggggaggtggtgcacacgttctcccacataaagctgacgtatcaggtttacggcctggccctcgaggggcaaactcccgtaaccactgtccccccaggtgccagatggctgacgcaagaggagtttcatacagcggcagtgtctaccgccatgaagaaggtttttcgagtgtaccagggacagcagccaggtacctgtatgggaagcaagcgaagccaagtttcctcaccatgttcgaggaagaagcctcggatgggccaacaggtcttagataacttctttagatcgcatatcagcactgatgctcactcactgaattctgccgcacagtag

SEQ ID NO: 29632 - DNA, 291 bp, Artificial Sequence
  Description of Artificial Sequence: Synthetic coding sequence
atgtctgataatgatgacattgaagttgagagtgatgaagagcagccaaggtttcaaagtgccgctgataaacgagcacatcataatgccttggaacgcaagcgccgagatcatattaaggatagcttccattccctacgggactcggtgccctcgctccagggagagaaactatacttcttgttctggaaactgtgtacccccgtattgcacaggcagtccctgatgcagaagtgccacacatttattagctcctaccaggtgcacaaaaaaaaagagtgtaagatttag

SEQ ID NO: 29633 - DNA, 405 bp, Artificial Sequence
  Description of Artificial Sequence: Synthetic coding sequence
atgtcagacaatgatgacattgaggttgaaagcgatgaagaacagccaaggttccagtctgccgctgataagcgtgctcaccacaacgctctggaacgtaaaagacgagatcacataaaggactcttttcattctctgcgtgactccgtcccatctctgcagggggaaaaggcctctagggctcaaatcttagacaaagctactgagtatatccaatacatgagacggaaaaatcacacgcaccagcaagacatcgacgatctcaagcggcagaacgctctgctcgagcagcaaggggaacacccctcttcgtggggctcttggccatgttgtgctcctgctaggagcggcttcggaacttgggcctgccgcgtccgagcatctcacggggtgtgcgctcagtag

SEQ ID NO: 29634 - DNA, 252 bp, Artificial Sequence
  Description of Artificial Sequence: Synthetic coding sequence
atgtccgacaatgatgatatcgaggtggagtccgatgaggagcagccccgtttccagtccgccgctgacaagagagcacatcacaacgccctggagcgtaagcggagggaccatatcaaggacagctttcacagcctgcgagattcagtgccatctctgcaaggagaaaaaggaactaaaatgaaactcactcttcctcccgtgtttccttacgagcacttaccttttccaaccgtcttctgtcacggatag

SEQ ID NO: 29635 - DNA, 456 bp, Artificial Sequence
  Description of Artificial Sequence: Synthetic coding sequence
atgtctgacaacgatgacatcgaggtggaaagtgacgccgacaaaagagcccatcacaacgcactagaaaggaaaaggagagaccatattaaggatagcttccatagcctcagagactccgttccatctctccagggcgagaaagcctcgcgggctcagattcttgacaaggccaccgagtacatacagtatatgcggaggaagaatcacactcaccagcaagatattgacgatttaaagcgccagaacgccctgctagagcagcaagttagagcactggagaaggctcggtcttcagcccagctgcaaactaattaccctagctctgataatagcctgtacacgaatgcgaaaggttcaacaatttcagccttcgacgggggaagcgattcgtccagcgagagcgaacccgaggagccccagtcccgaaagaagctgcggatggaagcgagctag

SEQ ID NO: 29636 - DNA, 483 bp, Artificial Sequence
  Description of Artificial Sequence: Synthetic coding sequence
atgtctgataatgatgatattgaggtagagtccgacgaagaacagcccaggttccaatccgccgctgacaagcgggcacaccacaacgctttggagcgaaaacggagagaccacatcaaagactcatttcattccctgagggactccgtaccttcactccagggagaaaaggctagtagggcacagatcttggataaggccacagaatatatccaatatatgagaagaaagaatcacactcaccagcaggacatcgacgatctgaaaaggcagaatgccttactggaacagcaagtacgggctttggaaaaagcccgttcttctgcgcagctgcagacgaactacccttcgtctgacaatagcttatacactaacgccaaggggagcacgatctcagccttcgatgggggatccgacagctcaagtgaaagcgaacctgaagagccccaatctagaaaaaagctgcggatggaagcgtcatag

SEQ ID NO: 29637 - DNA, 426 bp, Artificial Sequence
  Description of Artificial Sequence: Synthetic coding sequence
atgctgtctgtcaaaattacctccattttctcaatcttcttcttcttgctcttccaagaggaacagcctcgctttcaaagcgccgcagacaagagagcccaccataacgctctggagcgcaaaaggcgagatcatattaaagacagcttccactccctgcgggactcggtgcctagcctacagggggagaaagcttccagagcacaaatcctcgacaaggcaaccgagtatatccagtacatgaggcgcaaaaaccacacgcatcagcaagacatcgatgacctgaagagacagaatgctctgcttgaacagcagggggagcacccctcctcatggggatcttggccttgctgcgcacctgcacgctccggttttggtacctgggcctgcagagttcgtgcttctcacggcgtctgcgcccagtag

SEQ ID NO: 29638 - DNA, 312 bp, Artificial Sequence
  Description of Artificial Sequence: Synthetic coding sequence
atgtctgacaatgacgacatcgaagtcgagagcgacgaagagcagccccgattccagagcgcagccgacaaacgtgcgcaccataacgcgctggagaggaagagaagagaccacattaaagactcctttcatagtctgcgagactccgtccctagtctgcaaggcgagaaggcgagccgcgcacagatcttggataaggcaacagaatacatccagtacatgcggagaaagaatcacacccaccaacaagacattgacgacctcaagcgacagaatgccctgctggaacaacagggagagtctgagagctag

SEQ ID NO: 29639 - DNA, 312 bp, Artificial Sequence
  Description of Artificial Sequence: Synthetic coding sequence
atgtcggataatgatgatatcgaagtcgaatctgacgaggagcaacctcgcttccagagcgccgctgacaagcgggctcaccataacgcactcgagcgaaagcggagagatcatatcaaggacagtttccattccctgcgtgacagcgtgccaagtctccagggcgagaaagcctctagagcacaaattttggacaaggcgaccgaatatatacaatatatgcgacgaaagaaccatactcaccagcaggatatagacgatctgaaaagacagaacgccctgctggagcaacagggagaaagtgagtcttag

SEQ ID NO: 29640 - DNA, 13923 bp, Artificial Sequence
  Description of Artificial Sequence: Synthetic coding sequence
atgcctgtacccgatggatctgtggccgctgccggtctgggactggggttacctgctgccgattctagaggacactaccagcttctgttgtcaggcagggccttggctgataggtatcggaggatttacactgctgccctaaatgacagggatcaggggggaggttccgctggacacccggcatcccgcaacaagaagatcctcaataaaaagaaacttaagaggaagcaaaaatcaaaaagcaaagtcaaaacccggtccaaaagtgaaaatctggagaataccgtgattattcccgacatcaaactccattccaacccaagtgcatttaatatctactgtaacgtgcggcactgtgttttagaatggcaaaagaaggagatcagcctggcagctgcttccaaaaatagcgttcagagcggagagagcgatagtgatgaagaggaagaaagtaaagaaccaccaataaagctgccaaaaatcattgaggtcggcctatgtgaggtgtttgaactcatcaaagaaactcggttctcacacccgagcttgtgcctccgaagtcttcaggccttgctgaacgttttgcaggggcaacagcctgaagggctgcagtctgagcctcctgaggtcctcgagagtcttttccaactgctgctcgagatcacggtcagatcaacaggtatgaatgattctactggtcagagtttaactgccttgtcttgcgcttgcttgttcagtcttgtggcttcttggggcgaaactggcaggacgcttcaagccatctccgccatcttaacaaacaatggctcacacgcatgtcaaacaatccaggtcccaaccatcctgaactctctgcaacggtcagtacaggctgtattggtgggcaagattcaaattcaggattggtttagcaatgggatcaagaaggctgcactcatgcataagtggcctcttaaagaaatctctgtggacgaggacgatcagtgtctcctgcagaatgacggatttttcctgtacctgctctgcaaggacggcttgtataagattgggtctggttacagcggtactgtcagaggccacatctacaattctacttcacgcatccggaacagaaaggagaagaagagctggctggggtacgcacagggctatttgctataccgggacgtgaacaaccacagtatgacagccatcaggataagtccagaaacattggagcaggacggcacggtcatgctgccggattgccatacggaagggcagaacatcctgtttaccgatggagagtacattaaccaaatcgcagcatctagggacgatgggtttgtagtgagaatcttcgccacgagcaccgaacctgtgctgcagcaagagctccagctgaagctcgcccgaaagtgtcttcacgcctgcgggatttcacttttcgaccttgagaaagacctccatatcatcagcacagggttcgacgaggaatctgcaattctgggggctgggagagagtttgcactcatgaagaccgccaacgggaagatctactataccggaaagtaccagtctttgggcatcaagcagggcggtcctagcgcgggtaaatgggtcgagctccccattacgaagagccctaaaatcgtgcactttagtgttggtcatgatgggtcacatgcactgctcgtggctgaagatggtagcatctttttcacagggtcagcctcaaaaggagaagacggtgagagcaccaagtccagacgacaaagtaagccctataaaccgaagaagattattaagatggagggaaagatagtcgtctatacggcctgtaacaacggtagttcttctgttatctccaaagatggcgagttgtatatgttcggcaaagacgcaatttattctgacagtagctccttggtcacagaccttaaagggcatttcgtcacacaagtcgctatggggaaggctcacacatgtgtgctgatgaagaatggggaggtttggactttcggcgtgaacaacaagggacagtgcggccgtgacacaggtgctatgaaccagggcggaaagggcttcggcgtcgagaacatggcaactgccatggatgaggacctcgaagaggagctcgacgagaaagatgaaaagtcaatgatgtgcccaccgggaatgcacaaatggaagctggaacagtgcatggtttgtactgtgtgtggcgactgcactggctacggagcgtcttgtgtgtcatcaggtagaccagatagagtcccgggtggtatctgcggatgcggcagcggtgagagtggctgtgcggtttgcgggtgctgtaaagcatgcgcacgggagctcgacggtcaagaggcaagacagaggggcatcctagacgctgtgaaagagatgatcccgcttgacctgttactcgccgttcctgtgcctggagttaacatcgaggagcacctgcaactccgccaggaagagaagagacagagggttatccgcaggcacagacttgaggagggcagaggtccgcttgtatttgcgggtccgattttcatgaatcatagggagcaggctttggcccgactcaggtcccacccggcacagctgaagcataagcgggataagcacaaagatggaagcggagagagaggggaaaaagatgcctcaaaaatcaccacttacccgccaggatccgtccgcttcgactgtgagcttcgggcagtgcaggtttcgtgtgggtttcaccacagcgtggttctgatggaaaatggcgacgtgtatacgttcggctatggacagcatgggcaacttgggcatggcgacgtgaattctagaggatgccccactctcgtgcaggcccttccaggcccttccacccaggtgactgccggaagcaatcatacggcggtgttgcttatggatggacaggtgtttacattcggttctttttctaagggccagctggggcgaccgattttagatgttccatactggaacgcaaaaccagcgcctatgcccaatattgggtccaagtacggacgcaaggccacttggatcggggcttccggtgatcagacatttcttcggatagatgaggctttgatcaattctcacgtgctggctacgtcggagattttcgcatctaaacacataatagggttagtgccagcttctatctctgaaccacctccatttaaatgcctgctgattaataaagtggacggaagctgcaagacattcaatgacagtgagcaggaggatctgcagggtttcggtgtatgcttggacccagtttatgatgtaatctggcggtttagacctaacacccgggaactctggtgctataatgctgtggtggctgatgctcgcctcccttcagcagcagacatgcagtcacgatgttctattctgtcaccagagctggcgctgcccactggctctcgagcactgacaacgcgtagccatgcagctcttcacattctgggatgtttggacaccctggcagcgatgcaggatctgaaaatgggggtagcttctacagaggaggaaactcaggcggtgatgaaggtgtacagtaaggaggactactcagtggtcaaccgtttcgaatcacatggaggaggctgggggtattctgcgcacagcgtggaggctatccgcttctctgctgatacggacatcttgctgggcggtttgggactgttcggagggagaggggagtataccgccaaaatcaagttgttcgagcttggtcccgatggcggagatcacgaaactgatggggatctcctggccgagaccgacgttctggcctatgactgtgccgcaagggaaaaatacgctatgatgtttgatgagccagttctgttgcaagctggatggtggtatgtagcttgggcaagggtgagtgggccaagctctgactgcggaagtcatgggcaggcctctatcaccacagacgacggagtggtttttcagtttaagagttcaaaaaaaagtaataatggtaccgacgttaacgcaggacagattcctcagctgttgtatcgcctccccacatccgatgggtcagccagcaaaggaaagcagcagacctcggagccagtccatattctgaagcgcagttttgcgagaaccgtgtctgtagagtgctttgaatctcttctgtctattcttcactggagctggactacactggttctaggtgttgaggaactgagaggcctgaagggcttccaatttaccgccactttactcgacctggagcggctgagatttgtgggaacatgctgcctcagactgcttagagtttatacctgtgaaatatacccagtctctgcaactggaaaggccgttgtggaagaaacctctaaacttgcggagtgcattggaaagaccaggaccctcctgcgcaaaattctgtcagagggcgtagatcattgtatggttaaacttgacaatgatcctcagggttatctgagtcagcccctctcactgctggaggccgtgttgcaggagtgccataacacctttacagcctgctttcactcattctatcccacccccgctcttcagtgggcctgcttgtgtgatctgctcaattgtctagatcaggatatccaggaggctaacttcaaaactagttcatctaggctcctggcagctgttatgagtgcgttgtgccatacaagcgttaaactaacatccatattcccaattgcttatgacggcgaggtgctgctccggtccattgtgaaacaggtgtcaacagagaacgattccacgttggtccaccggttccctctgcttgttgcccacatggaaaagctctctcagtcggaagagaacatctctggcatgaccagtttccgggaggtgcttgagaaaatgttagtcattgtggttttaccagtgcgaaactctcttcgcagggagaacgagttgttcagttcccatttggtgagcaacacgtgcggactgctcgcttctatcgtaagtgagctgactgcctctgcacttgggtccgaagtggacggactgaacagcctgcattctgtgaaagcgtccgcgaaccggttcaccaaaactagccaagggaggtcatggaacactggaaacgggtctccagacgcgatttgtttttctgttgataagcccggtattgtagtggtcgggttcagcgtgtacggagggggtggcatccacgagtacgagttagaagttctcgtggacgattctgaacacgctggggacagcacccacagtcacagatggacctccctggagttagttaagggcacctacaccacagacgactcccctagcgacatcgcagagatccgccttgacaaagtggttcccctcaaagaaaacgtaaagtacgctgtcaggctccggaactacggatctagaaccgccaacggggacggcggtatgaccaccgtgcaatgtcccgatggggtaacgtttactttcagtacgtgtagtttgagttcaaacgggacaaatcagacccgaggacagattcctcagatcctttactaccgctctgaatttgacggggacttacagtcacagctcctttcaaaggccaacgaggaggataaaaattgttcaagggcacttagtgtggtgagtacggttgtcagagcgagcaaagatttgcttcaccgcgcactcgctgttgacgcagatgatatccccgagctattgtcgtccagctctctgtttagcatgcttctgcctctgattattgcttatatcggaccagtcgccgcagcaatccccaaggtggcagtggaggtcttcgggctggtccagcagctcctaccctctgttgcgatactaaaccagaagtacgcccctcccgctttcaatcctaatcagtctacggactctaccacagggaatcagccagaacagggactgagtgcgtgcacgactagctcacactacgccgtaattgaaagcgagcacccctacaagccagcctgcgtgatgcattacaaagtgactttccccgaatgtgtacggtggatgacgattgagttcgacccccagtgcggcacagcccaaagcgaggatgtgctgcgtctgttgatcccggtcagaactgtccagaatagcggatacgggcctaagctgaccagcgtgcacgaaaatctcaactcttggatagagttgaaaaaattttccggctccagtggctggcccaccatggtgttggtcctacctggaaatgaggcattattttctttggaaaccgcatcagattacgttaaggacgacaaagccagtttctacggctttaagtgtttcgccatcggttatgagttctctccgggacccgacgaaggcgtcattcagctcgagaaagagttagctaatcttggcggtgtgtgcgcagctgctctcatgaagaaggatctggcgctgccaattggcaacgaactggaagaggacctggagatcctggaggaagcggctctacaagtgtgtaagacacactccgggatcctcggtaaaggattagccctgagccactctcctacaattctagaggcgttggagggaaacctccctctgcagatccagtcaaacgagcagtcattcctggatgactttatcgcttgcgttcccggaagctcaggcggaagactagctcgatggttgcagcccgacagttacgccgaccctcagaaaacgtccctgatcttgaacaaggatgatatacgctgtggttggcccaccaccatcacagttcagaccaaagaccagtatggcgatgttgtccacgtacctaatatgaaagttgaagtgaaagccgtgcccgtgtctcagaagaagatgagtctacaacaagaccaagcaaaaaagccacagcgcataccagggtctcctgccgtgaccgcagcttcttccaatacggacatgacatacgggggactggcatcacctaagctcgacgtgagttacgaaccgatgatagtgaaggaggcacggtacattgcgatcactatgatgaaggtgtatgagaattatagcttcgaggagcttagatttgcttcccctaccccaaaaaggccctcggagaatatgctcattcgcgtgaacaacgatgggacctactgcgccaattggacacctggcgctatcggtctgtacactctccatgttactattgacggtatagagatcgacgccggtctcgaggtgaaggttaaggatccaccaaagggtatgatcccacccggaactcagctcgtgaagccgaaatcagaaccacagcctaataaagtgcgcaagtttgtcgccaaggatagtgcagggctgcggatccgatctcatccgtccctccagtccgagcaaattgggattgttaaggttaacggcactatcacatttatagacgaaatccacaatgatgacggcgtatggctgagattgaacgacgaaactatcaagaaatatgttcctaatatgaatggctataccgaagcttggtgtctaagcttcaatcagcatctgggaaaaagtctcttggttcctgtggatgaaagtaagacgaatactgatgatttctttaaggatattaacagctgctgcccacaagaagcaactatgcaggagcaagacatgccttttcttaggggaggcccaggcatgtataaggtggtcaaaactggaccctctggtcacaatatacgttcatgccccaacttaaggggcatccccataggcatgttggtcctgggaaataaagtgaaggcagtaggggaggtgaccaacagcgagggaacatgggtgcaactggaccagaacagtatggtggagttctgcgaatccgacgaaggcgaggcttggtcactggcccgtgacagaggcggaaaccagtacttaagacatgaagacgaacaagcattactggaccaaaatagccagacaccgccaccaagccctttttctgtgcaggccttcaataagggcgcaagttgttctgcgcaaggctttgactacggccttggcaacagcaagggcgaccgcggaaacattagcacaagtagcaagccagcctcaacctccggaaagtccgagctttccagtaagcactcgcgctcccttaaacctgatggccgaatgtcccggaccactgccgaccagaaaaaacctcgcggtacagagagcctgagcgcaagcgagagcttaattcttaagagcgatgccgcaaagctgcgctctgattctcactcccgaagtctgtcacccaatcacaacacgctgcagacccttaagtctgacggtcggatgccatcaagcagtagagcggagagcccgggacccggatctcgtctgagcagcccgaagcccaaaactctgcccgcaaaccgtagctcccccagtggtgccagtagcccaaggtccagctctccccacgataaaaatttgcctcagaaaagtactgctccagtcaaaactaaacttgacccacccagagaaaggagcaagtccgatagctatacactggacccagatacactccgcaagaagaaaatgcctttaacggaacccctcagagggaggtccacctcccctaaacctaagagtgtgcccaaagattcaaccgattcccctggctccgagaatcgcgctccaagcccgcatgtggtgcaggaaaacctgcatagcgaagtggtggaggtttgcacctcttctaccctgaaaacaaactcattgactgacagcacatgcgacgactcatcagagttcaagtccgtggatgagggctcaaataaggtccacttcagcatcggtaaagctccgctgaaagacgaacaggagatgcgggcatctcccaagatcagcagaaaatgcgccaaccgccacactaggcctaagaaggagaagtcctcctttctgttcaaaggagatggtagtaagcccttggagcccgcaaaacaggctatgagccccagcgtggccgaatgcgctcgcgcagtcttcgcctccttcctttggcacgaaggaattgttcacgacgccatggcctgcagcagtttcctcaaatttcaccctgagctgtccaaagagcatgccccaattagatcctccctcaattcccaacaacctactgaagagaaagaaacgaaactgaagaacaggcattccctcgaaatctcctcagctttaaacatgttcaatatagcacctcacgggccagatatatcgaaaatgggctccattaacaagaacaaggtcctcagcatgctgaaggagcctcctttgcatgaaaagtgcgaggacggaaaaacagagaccactttcgaaatgtctatgcataataccatgaagagtaaatccccattgccccttactctccagcatctggtggccttttgggaagacatctccctagcgacaatcaaggctgctagtcagaacatgattttcccttctcccggatcctgcgccgtcctcaagaagaaagaatgcgagaaagagaacaagaagtcaaaaaaggagaaaaagaaaaaagagaaagccgaagtgaggcctaggggcaacctgtttggggaaatggcccaactggccgtggggggtcccgaaaaagacaccatctgcgagctctgtggtgagagccatccctatcccgttacttaccacatgcgccaggcacatcctggttgcggaaggtatgctggtggtcagggctacaacagtataggccacttttgtggcggatgggccggtaattgtggggacggagggatcgggggatcgacatggtatctggtatgtgataggtgcagggaaaaatacttgcgcgagaagcaggccgcagccagagaaaaagtgaagcagagcaggcggaaaccaatgcaggtaaagactcccagggccctgccgacaatggaagcgcaccaggtcataaaggcaaatgctctctttctcctgtcactgagcagcgccgctgagccgagtatcctgtgttaccacccagctaagcccttccagagccagctccctagcgttaaggagggcatatccgaggaccttcctgtgaaaatgccatgcctctatttgcaaaccctcgctcgacaccaccacgagaactttgttggctatcaggacgacaatctcttccaggatgaaatgcggtacctccgatccacttctgtgccagccccatacatctccgtgacacctgacgccagccccaatgtcttcgaggagccagagtctaacatgaaaagtatgccaccttccctggagaccagcccaatcactgatacagacctggctaagcgaactgtgtttcagcgatcttactctgtggtggcctcggaatacgacaagcagcactctatcctccccgcaagggtgaaggcaatccctcgacggcgagtaaacagtggcgatacagaagtgggctctagtctgttaagacacccgagcccggaactgagtcgcctcatttccgcacattcctcgctttcaaagggagagagaaacttccagtggcccgtgcttgcctttgtcattcagcaccatgacctggaaggactggagatcgccatgaaacaggcactacggaagagtgcctgtcgggtgttcgctatggaagctttcaactggctgctctgcaacgtgatccaaactacatccctccacgacatcttatggcatttcgtggccagcttaacccccgctccggtggaacccgaagaagaggaagacgaggagaacaagacatcgaaagaaaattccgagcaggagaaggacacgagggtctgcgaacaccccctgtccgatatagtgatcgccggtgaggctgcgcaccccctgccgcatacatttcacagactcctgcagaccataagcgatcttatgatgtcccttccttcaggaagcagtctccagcagatggcgctccgctgttggagtctgaaattcaagcagagtgatcaccagtttctgcatcagtctaatgtgttccaccatatcaacaatatcttgtcaaaatctgacgatggagactctgaagagtcattttccatttccattcagagcgggttcgaagccatgagccaagaactgtgcatagtgatgtgccttaaggacctgacctcaattgtggacatcaagacttcatctcgccctgctatgataggatctctcaccgacggcagcaccgaaacattttgggaaagtggcgacgaggacaaaaataagaccaagaatataactataaactgcgtcaagggtatcaacgcgcgttatgtttctgtccacgtagacaatagcagggacttgggtaataaagtaacctcgatgaccttccttactgggaaggcagtcgaagatctctgcagaatcaagcaagtggacctggactccaggcacatcggatgggttacttctgagcttccagggggagacaaccatattataaaaatcgagctgaagggtcctgaaaatactctgagagttaggcaggttaaggtgctcggctggaaagatggggagtccacaaaaatagccggacagatctccgcttcagttgcccagcagagaaactgtgaggctgaaacccttcgcgtcttcaggctaatcacatcacaagtgttcggcaaactcataagtggcgatgccgaacctacccctgaacaagaggagaaggctctgctgagttctcctgagggcgaggagaaggtctacaatgccaccagcgacgctgacttgaaggaacacatggtaggcatcatctttagccgttcaaaacttaccaatttacaaaagcaggtgtgtgcccacatagtccaggccatccggatggaagctacccgggttcgggaggagtgggaacacgccatctcatctaaagaaaatgccaactcccagcccaatgatgaggacgcgtcatcggacgcctactgttttgaactgctgtctatggtcctcgccctgagtggcagtaacgtaggacgccagtacttagcccaacagctgacactgttacaggatctgtttagcttgcttcataccgcgagccccagggtgcaacgtcaggtgacaagcctgctgagacgagtgctgcctgaggttactccgagtagactggcaagcattataggcgtgaaatccttaccaccagccgatatctccgacataattcatagtactgaaaagggagactggaataaactagggatactggatatgttcctcggttgcattgccaaggctttgacggttcagctgaaagctaaaggcaccactatcaccggtaccgctggaactacggtaggcaaaggagtgactacagtgacactgcctatgatcttcaattcctcatacctccgtcgcggagagtctcattggtggatgaaaggtagtactccaacgcaaatctcggagattatcataaagctgataaaggacatggccgcagggcacctgagcgaggcgtggagtcgcgtgaccaagaacgctatcgcagagacaataatcgctctgaccaaaatggaagaagagtttagatccccagtgagatgtatcgccacgacacgcctgtggctagccctggcatcattgtgtgtattagaccaggaccacgtggatagattaagcagcgggcgatggatgggaaaggacggacagcagaagcaaatgcccatgtgtgacaaccatgatgacggcgaaaccgccgctatcattctgtgtaacgtgtgcgggaatctgtgcaccgactgtgaccgatttctgcatctacaccggcgaactaaaacacaccagaggcaagtgtttaaggaagaggaagaggcaattaaggtcgacctgcacgaagggtgtggacgcaccaaactcttctggttaatggcactcgccgacagcaagaccatgaaagctatggtcgaattcagagagcatacaggtaagcccactacctccagctccgaggcctgtaggttttgcggcagtcggagtggaacggagctcagcgcggtgggaagcgtttgcagcgacgccgactgccaggaatacgcaaagatcgcctgcagcaagacacatccttgtgggcacccttgtggaggggtgaaaaacgaagagcattgtctgccctgtctgcatggctgtgacaaatctgccacttccctgaaacaagacgcagacgatatgtgcatgatctgcttcaccgaagccctttccgccgcacctgcaattcaactggactgctcccacatatttcatctgcagtgctgcaggcgggtccttgaaaatagatggctcgggccacgcatcacttttggttttatcagttgtcccatctgtaagaacaaaattaaccatatagttctgaaggacctgctggacccaataaaggagctgtacgaagacgtccgacgcaaagccctaatgcgtctggaatacgagggccttcacaaatccgaagctataaccacgccgggagtgcggttctataatgatcctgccggttatgctatgaaccgctatgcttattacgtttgctataagtgtaggaaggcttacttcggcggtgaggctcgatgtgacgcagaggctggcagaggggatgattatgaccccagggaactcatctgcggagcatgctcagacgtcagcagagctcagatgtgcccaaaacatggaacagacttcctggagtataagtgtcgatattgctgttccgtagccgtctttttctgcttcggcaccacacacttttgtaacgcctgccacgacgacttccagcgtatgacttctatcccaaaggaggagttgcctcactgccccgcaggtcccaagggaaaacagctcgaggggacggaatgccctctgcacgtggtgcaccccccaaccggcgaggagttcgcccttgggtgcggagtgtgccggaatgcccacacattctat

SEQ ID NO: 29641 - DNA, 1542 bp, Artificial Sequence
  Description of Artificial Sequence: Synthetic coding sequence
atgcaggagcaggatatgcccttcttgcggggagggccagggatgtacaaggtagtaaagaccggcccttccggccacaatatccgcagttgtcctaatctaagagggatcccaatagggatgctggttctaggtaacaaagtcaaagccgtcggagaggtgaccaactcggaaggcacctgggtccagctggaccagaattccatggtggaattttgcgagtctgacgagggagaggcctggagcctggctagagatagggggggtaaccagtacctgaggcacgaggacgaacaagctttacttgatcagaattcacaaaccccgcctccctctccattcagcgtccaggcatttaataaaggggcatcctgtagcgctcagggctttgattatggcttgggaaactccaaggtactcactgtgctgcctacagccggagaccaactaagcgcaatcctgaatagtattcagtcaaggcctaacctgccagctccctccatcttcgatcaggcagcaaaaccccctagctcgctagtccatagtccatttgtgttcgggcagccacttagcttccagcaacctcagctgcagtcggatcgtgggaacataagtacaagcagtaaacccgcaagtacttctggaaaaagtgagctaagcagtaaacatagtcggtctcttaaacctgacggcagaatgtcacgaacaaccgctgatcagaagaagcctagaggaacagagtccttgagtgcttcagaatccctgattctgaagtcagacgccgctaagttgagatccgacagccattctcgatctctgagcccaaatcacaatacgctgcagacactcaaatccgatggccgaatgccaagcagctctcgcgcagagtcccccggtccaggctctcggctttcgtctccgaagcctaaaactcttccagccaatcgctcttcccccagtggggcttcctctccacgcagtagctcaccccacgacaaaaatctcccgcagaaatcgacagcgccagtgaaaaccaaactcgaccctccgcgtgagaggtctaaatcagatagctacaccctggacccagacacccttagaaagaaaaaaatgccactgacagaaccactcaggggcagaagtaccagcccaaaacccaagtccgtacctaaggactccacggactcccctgggagtgaaaatcgagcccctagtccacatgtcgtgcaggaaaatctgcacagcgaggttgtagaagtgtgtacgtccagtacactcaagactaactcactcacggactccacatgtgatgactcaagcgaatttaagtcagtagatgagggatccaacaaagtccatttctctattggtaaggctccactgaaagacgagcaggaaatgcgcgcaagccccaagatttcacgaaagtgcgccaacagacacactagacccaagcggaagatcgagttttcgttccagcgcaggtggattcaggcattcagagcatcccaggcttctcatgtgagcttctgcggtagatag

SEQ ID NO: 29642 - DNA, 14037 bp, Artificial Sequence
  Description of Artificial Sequence: Synthetic coding sequence
atgatgatgtgtgcagcaactgcctctccggcagccgctagtagcgggttggggggagatggattttatcctgcagctacgttttccagctcaccggctcctggcgcactgtttatgccagtcccagacggaagcgtggccgcagccggactggggctaggtcttccggctgcagattctcgtggccattatcagctgctgctctcaggcagggctctggcagaccgataccgcaggatttacaccgcagcgctgaatgaccgcgaccagggaggtggtagcgcagggcaccccgcatcgaggaataaaaaaattctgaataaaaagaagctaaagagaaaacagaaatcaaaatcaaaagtcaaaacacgctcaaaaagcgagaaccttgagaatactgtgataatacctgatatcaagttgcactctaacccttctgcgtttaatatatattgcaacgtcagacactgcgttctagagtggcagaagaaagagatatctttggctgcagcctctaagaacagcgtccagagtggggagtctgacagcgacgaggaagaggagtccaaagagccccctattaaactccccaagatcattgaagtgggtctgtgcgaggtgttcgagctgataaaggagacacgcttcagccatccaagtttgtgccttaggagcttgcaggcgttgctgaatgtgttgcagggccagcagccggaggggttacagagtgagccccctgaggtgctggagtcattattccagctcctgttggagattacagtgaggtcgaccggtatgaatgatagcaccggccagagcttaacagcattgtcatgcgcatgtctgttctccttggtcgcctcttggggtgagaccgggaggactttacaggcaatatccgccatcctgaccaataatggctctcatgcgtgccaaacgatccaggtccctactatactcaattcacttcagcgctccgtgcaagcagtcttggtcggcaagattcagatccaggattggttctctaacgggataaaaaaagctgccctgatgcataagtggcctttgaaggaaatatccgtggacgaggatgatcagtgtctcctccagaacgatggtttcttcctctacttactctgtaaggacggtctgtacaagataggctccggatactctggcacagtgagaggtcatatatacaacagcacatcgcgcatccgcaaccggaaggagaagaagtcctggcttggctatgcgcaagggtacctcctttatagagatgtaaataaccactctatgacagccattaggatatctcctgagaccctcgaacaggacggtactgttatgcttccggactgccatacagaggggcaaaacattctctttactgacggggagtacatcaaccagattgctgcctctcgggacgatggtttcgtggtgaggatttttgctacttccactgaacctgttctgcaacaggaactgcaactcaaactggcaagaaaatgccttcacgcctgtggcatttccttgtttgatctagaaaaggacctacatatcatttccaccggcttcgacgaggaatctgccatacttggcgctgggagggagttcgctttgatgaaaacagctaacgggaagatttattatacaggtaaataccaaagcctgggtattaagcaaggaggtccttcagctggaaaatgggtcgagcttcccatcacaaagtctccaaaaattgtgcacttctccgtggggcatgatggaagtcatgctctactggttgctgaggatggatctatctttttcactgggtccgcctccaagggtgaagatggcgagagcactaaaagccgcaggcagagtaagccctacaaacccaagaagatcatcaaaatggaagggaaaattgtggtgtacacggcttgtaacaatgggtcatcttccgttatctcaaaagatggcgaactgtatatgtttggtaaagacgccatctactctgatagcagctcactggtgaccgacttgaaagggcacttcgtaacacaagtggcgatggggaaagctcacacatgtgtgcttatgaagaatggagaggtttggacctttggggtgaataataagggccagtgcggcagggataccggagctatgaatcaaggtggcaaaggcttcggggtggagaatatggcaaccgccatggacgaggatctcgaggaagagctggacgagaaagatgaaaaaagcatgatgtgccctcctggaatgcacaagtggaaactggaacagtgcatggtgtgtacagtatgcggcgattgtacaggatacggggcatcgtgcgtgtctagcggcaggcctgatagggttccgggaggcatctgcggatgcggatccggcgaaagtggatgtgccgtgtgcggttgttgtaaagcatgtgcaagagagctcgatggtcaagaagctagacaacggggtatactcgacgcagtcaaagagatgattccacttgatttgttactggcggtgccggtcccaggggtgaacattgaagagcacttgcagctccggcaagaagagaaaaggcaaagagtgatccggaggcatcggttggaggaggggagagggccattggtttttgccggtccaatctttatgaaccaccgagagcaggcattggcccgactgcgaagtcatcctgctcagctgaagcacaagagagacaaacataaagacggctcgggggagcgcggagagaaagacgcatcaaaaattacgacctacccgcctgggagtgtgcgcttcgactgtgagctaagggctgtgcaagtgagttgtggctttcatcactcagtggtgctgatggaaaatggcgatgtttacaccttcggatatggccagcacggtcagttgggccacggggacgtgaacagtaggggttgccctaccctcgtgcaggctctgccgggtccctccacccaggtaacagctggaagtaatcacaccgcagtgctgctgatggatggtcaggtatttactttcgggtcattttctaagggccaattgggtaggcctattctggacgtgccctactggaatgccaagcctgcgccaatgcccaacatcggatccaaatatggcaggaaggccacctggatcggtgcatctggagatcaaaccttcctccggatcgatgaagcactcatcaattcccacgtcctcgctacctccgagatcttcgcttccaagcacattattgggctggtcccagcctctatctccgagccccctccctttaagtgtctgctgatcaataaggtggacggctcctgcaagacattcaacgacagcgagcaggaggatttacaagggttcggcgtttgtctggatccagtgtatgatgttatttggaggttccgcccaaacaccagggaactctggtgttataatgcggttgtggccgacgctcgacttccatccgcagccgacatgcagtctcgctgctctatactgagtccagaactagcgctgccgaccggcagtcgagctcttacgacacggtctcatgcggcattgcacattctaggatgcctggatactttggccgcaatgcaggatctaaagatgggagtcgcttcaacagaggaggagacacaagccgtcatgaaggtgtactcaaaagaggattacagtgttgtcaaccgattcgagtctcacgggggaggctggggatactctgcacattccgtggaagccattaggtttagcgcagatacagatattctactgggaggccttggattgtttggcggaagaggcgagtatactgcaaaaattaaactttttgagcttggtcctgatggcggtgaccacgaaacggatggggaccttctggccgaaacagatgtgctcgcatatgattgcgcggcacgggagaaatacgctatgatgttcgacgagccggtgcttctgcaggcgggatggtggtatgtagcttgggctcgggtgtcagggccatcctccgattgtggcagtcacggccaagcttcaatcaccaccgacgatggagtcgtgttccagtttaaatcatctaagaagtccaataacggcactgacgtcaatgccggtcagatcccccagctcctgtacagattacctacttccgatgggtcggcaagcaagggcaagcagcagacgtctgagcctgtccatatcctgaaacgttccttcgctagaacagtgtccgttgagtgtttcgaatcactgttaagcattctgcactggtcgtggaccacactcgtgcttggggtcgaggagctacggggtctgaagggattccagtttacagctaccctacttgacctggagagattgcgattcgtcggcacatgctgtcttcgactcctgcgcgtgtacacctgcgagatatacccagtgtcagcgacaggaaaagccgtcgtggaggagacttccaaactggctgagtgcataggaaaaacaaggacgttgctgcggaagatcttatccgagggtgtggatcactgcatggtgaagttagataatgatccgcagggatacctgtctcagcccctgagtcttctggaggccgtactgcaggagtgtcataacacttttaccgcttgttttcatagcttctacccaacgccggctttgcagtgggcctgtctttgcgatctgctgaactgcttggatcaggacattcaggaagcaaatttcaaaactagctcaagccgtctgctggccgcagtgatgagcgccctgtgccacacatccgtgaagctgaccagcattttccctatcgcatatgatggcgaagtccttctgcgatctatagtgaagcaggtctcaacagaaaacgacagtaccctcgtgcatagatttccactgctggtcgcacacatggagaagctgtcacagtccgaagagaacatcagtggcatgacatctttcagagaagtgctggagaagatgcttgtgattgtcgtgctccctgtgcggaacagcttgcggagagaaaacgaactgttttccagccatctggtttcgaacacctgcggcctgctcgctagcatcgtatcagagttgacagcttccgctctaggctccgaggtggatggcctcaatagcctgcattccgtgaaagcctccgctaatcgcttcactaaaacttcccagggtaggagttggaacacaggaaatggatcccccgacgctatttgcttcagcgttgataagcccggtatcgtggtggttgggttctccgtgtacggcggaggcggaatccacgaatatgagcttgaggtgctggtagacgactcagagcacgccggagacagcacacatagtcatcgttggaccagtcttgagcttgtcaagggaacttacacgactgacgattctcccagcgatatcgcggagattcgactggataaagttgtccctttaaaggagaatgtgaagtatgccgtcagactgcgtaattatgggtctagaacagcaaatggcgatgggggaatgaccactgtccagtgccccgatggcgtgacatttacattctctacctgttccttgtcttccaatggaactaatcagactcgtgggcagatcccacagatcctttattaccgcagcgagttcgatggcgacctgcaatcacaactgcttagcaaagccaatgaggaagataagaattgtagcagagcgctttctgtggtgtctactgtggtccgggcttctaaggatctactgcatcgcgctctagctgtcgacgccgacgacatacctgagttgcttagcagttcgtccctgttttccatgctcctgcccctcatcatcgcgtacataggaccagttgcggctgccatccctaaggtggctgtggaagtctttggactggtgcaacagttactgccaagcgtggcaattctaaatcagaaatatgcgccacccgctttcaacccgaatcagtcaacggattctaccacgggaaaccaacccgagcagggtctgtccgcttgtactaccagttcccactatgcggtcatagagtcggaacacccatacaaacctgcctgcgtgatgcactacaaagtgacatttccagagtgtgtgaggtggatgactatcgagttcgacccccagtgtggcaccgcgcagtccgaggatgtccttcggttgctgattcccgtgaggacagtacaaaactcaggatacggaccgaaactgacctctgtccacgagaacctcaactcatggatcgaacttaaaaaattttcaggctcaagtggttggccaactatggtgcttgtgctccctggaaacgaggccttatttagcctcgagacggccagcgactatgtgaaagatgacaaggcatcattctacggcttcaagtgtttcgctatcggctacgaattctcccctgggccagatgagggcgttattcaactagagaaggagttggcgaacctaggtggtgtctgtgctgctgcccttatgaagaaggatctagccctgccaattggcaatgaattggaggaggatctggaaatcttggaagaagcagccctgcaggtgtgcaagacgcacagcgggattctgggcaaaggtctggccctgtctcacagtccaacaatactggaggctctggaggggaatctcccactgcagatacaatctaacgagcagtccttccttgatgattttatcgcctgcgtgcctggctcaagcggcggaagactggcccgatggttacagcccgacagctacgcggatcctcagaaaaccagcctgatcctcaataaagacgatatccgatgtgggtggccaaccaccatcactgtgcagaccaaagaccaatatggggatgtagtgcacgtccctaacatgaaggtggaggtcaaggcagtccctgtgtcacaaaagaagatgagcctccaacaggatcaggccaaaaagccgcaaagaatccccggatcaccggctgttacagccgcatcaagtaatactgatatgacatatggcggtctggctagccctaaactggacgtgtcctacgagcctatgattgtaaaagaggcgaggtatatcgccataaccatgatgaaggtgtatgaaaactacagctttgaggaacttcgatttgccagtcccacgccaaagcgccctagcgagaatatgctcatccgcgttaacaatgatggaacctactgcgctaactggaccccaggagccattggactatatacactgcacgtcacgatcgacggaatcgagatagacgccggtcttgaggtcaaggtgaaagacccccctaagggaatgattcctcctggaactcaattggtcaagcctaaaagcgaacctcagccaaataaggtgagaaagttcgtggccaaggactcagctggcctacggatccggagccacccttccctccagagcgaacagattggaattgtcaaagtaaacggcacaattacgtttattgatgaaatccataatgatgacggggtctggctccgcttgaatgacgagacaatcaagaagtacgtcccgaacatgaacggatacaccgaggcctggtgcctctcgtttaaccaacatctggggaaatcactgctcgtccctgtggacgagtcgaaaactaataccgatgatttcttcaaggacataaactcttgctgtcctcaggaggctacgatgcaggaacaagacatgccttttctgcgcggtgggcctgggatgtacaaagttgtgaaaacaggaccctcagggcacaacataagatcctgcccaaaccttcgaggtatacccatcggaatgctggtgttgggcaacaaggttaaagccgttggggaggtaaccaattccgagggaacctgggtgcagctggaccagaactccatggttgagttttgcgagagcgacgagggagaggcctggtcactggccagagaccgcggtggcaaccagtatctgcggcacgaagacgaacaggcgcttctggaccagaactcacagacccctccacctagccccttttcagtccaggccttcaacaaaggcgcttcatgcagcgcccaggggtttgattacggattgggaaactcaaagggcgaccggggaaatatctccaccagctcaaaacccgcaagcacaagcggtaagtcggagctgtcgtcaaaacacagtcgtagtctgaaaccagacggaagaatgagtagaaccaccgctgatcagaaaaagcctaggggcaccgaatcattgagcgcatctgagagcctgatcctaaagtcggacgccgctaagctgaggagtgacagccacagccgatccctgagccccaatcacaacacgctgcagaccttaaaaagcgacggcagaatgccttcttcttcgagggcggagtcccctggcccagggtctaggctttcttcgcctaaacctaagacactgcccgctaacagatcctcaccgagcggggcatcttctcccaggtcctcatctccacacgataaaaatctccctcaaaaaagcacagcaccagtaaagacaaaactggaccctcctcgcgagcgttcaaaaagtgattcttataccctggatcctgacactctgcgtaagaagaaaatgccccttactgaacctctcaggggaagatctacctcccctaagcccaagagtgtacccaaagattcaacagattcgcctggctcagagaatcgggcaccaagcccccatgtagtgcaagaaaatttgcacagtgaggttgtggaagtgtgtacctcaagcactctgaaaaccaacagtctcactgacagtacctgtgacgactcatcggaatttaaatcagtggatgaggggagtaacaaggtgcacttcagtatcggcaaagccccactgaaggacgaacaggagatgcgcgcttcacccaaaattagtaggaagtgtgctaacaggcatactaggccaaagaaggagaaatcttcctttctatttaagggcgacggttcaaaacccctggaacccgctaagcaggctatgagtccaagcgtagccgagtgtgccagggccgtgttcgcaagttttctgtggcacgagggaatcgtgcacgacgccatggcatgcagttcattcctcaagttccatccagagctttccaaggaacacgcacctatccgatcttccctgaactcccaacagcctacagaggaaaaagagaccaagctcaagaaccgccattcactagaaatatcctcagccctgaatatgttcaatatagccccacacggccctgacatcagtaagatggggtctataaacaagaacaaagtgctctcaatgctgaaggaaccccctctgcacgagaaatgtgaagacggaaagacagagactaccttcgaaatgtctatgcataacaccatgaaaagcaaaagtccgttgccactgacccttcagcacctggttgctttttgggaagacatatctttggcaactataaaggcagcctcgcagaatatgatcttccccagccccggtagttgtgcagtgctcaagaaaaaagagtgcgaaaaggaaaacaaaaaaagcaagaaggaaaagaaaaaaaaggaaaaagctgaagtgagacccaggggcaatctgttcggcgaaatggctcagttagccgtaggcggtcccgaaaaagacaccatatgtgaactttgcggagaaagtcacccttaccctgtgacatatcacatgcggcaagctcatcccggatgcggaagatacgccggtggtcagggatacaactcaattggccacttttgcggtggctgggccggtaactgtggggatggaggaatcgggggatcaacatggtacctggtttgcgaccggtgcagagagaagtacctcagggaaaagcaagcagcggcaagagagaaagtaaaacagagtcggaggaagccgatgcaggtcaagacacccagggcactccccactatggaagcccaccaggtcatcaaggccaatgccctgtttctgctctcactatcaagcgctgccgagccttccattttgtgttaccatcccgctaagcccttccagtctcagctcccaagtgtgaaagagggaatttcggaagatcttcctgtaaagatgccctgtctttacctccagaccctggccaggcaccaccatgaaaactttgtaggctaccaagatgacaacctttttcaggacgagatgagatacctgcggagtacctcagtccccgcaccttatatttcagtgacacccgacgccagcccaaacgtatttgaggaaccagagagcaacatgaagtctatgccaccctcactggaaacttcgccgattaccgatacagatctcgctaagcgaacagtctttcaacggtcctacagtgtcgtcgccagcgaatacgataagcagcatagcatactccccgctcgagttaaggccattcctaggcgccgtgtcaacagcggcgacaccgaagtaggctcttccctgctgcgacacccctcaccggaactgtcgcgcctgatctctgcccatagctctctgtccaaaggcgagaggaacttccagtggcccgtgctagcatttgttatccagcatcacgaccttgaggggctcgagatcgccatgaaacaggccttaagaaaatccgcctgccgggtgttcgccatggaagctttcaattggctgctgtgcaatgtgattcaaacgacgtctctgcacgatatcctgtggcatttcgtggcatccctcacaccagcacctgttgagccagaggaagaagaggatgaagagaataagacatctaaggagaacagcgaacaggagaaagacacgagagtttgtgaacaccccctgtctgacatagtgatagctggggaggccgcacaccctctgcctcacaccttccacagactattacaaacaatcagtgatctgatgatgagcctcccttcagggtcatcattgcagcagatggcactgcggtgctggtccttgaagttcaagcagtcagaccaccagttcctacaccagagtaacgtgtttcatcacatcaataacatccttagcaaatccgacgacggagattcagaggagtctttctccattagcatccagtccggattcgaggcaatgagccaggaactgtgcatcgtgatgtgtctgaaagatctcaccagcatcgttgatatcaagacgtcttctcgtccagccatgattgggagcctgacagatggctctacagaaaccttctgggaatctggcgatgaggataagaacaaaactaagaacatcacaatcaactgcgttaagggtattaatgctcgatacgtgtctgtacacgtggacaattctagagacctgggcaataaagttacctcaatgacgttccttaccggcaaggcagtggaagatctctgcagaattaagcaggtggacctggattcaagacatatcgggtgggttacatccgagctgcccggtggtgataaccatataattaaaattgaattgaagggaccagagaataccttacgggtacgccaggtgaaagttctcggatggaaggacggagagagcaccaaaatcgctggccaaatctcagcttcagtggctcaacagcggaactgcgaggccgagacactcagagtgtttcgcctgataacgtctcaggtgtttggcaagctgattagtggggatgcggaaccgacccctgaacaagaggaaaaggccctcctgtcttcacctgaaggagaggagaaggtgtacaatgcaacctccgatgcagacctcaaagagcatatggtgggtattatcttctctcgctcgaagctgactaacctccagaagcaggtctgcgctcatattgtgcaggcaatccggatggaagctacaagagtcagggaagagtgggaacatgcaatcagttccaaagagaatgctaactcacagccaaatgatgaagacgcgtctagcgacgcctattgttttgagctgctctctatggtgctggcactgtctggctctaatgttgggagacagtacttggctcagcagctgacgctgctgcaggacctgttctctcttctgcacactgcaagccctagagtccagagacaagtgacaagccttcttagacgggttcttcccgaagtcacaccatcaaggctggcatctattatcggtgtcaagtctttaccacctgctgacattagtgatatcatccactccaccgaaaagggcgattggaacaaactgggcattcttgacatgtttttgggctgcatcgccaaagcccttacggtgcaacttaaggcaaaggggactacgatcacaggtactgcaggaacgacagtcggtaagggcgtgacaaccgtgacgctgcccatgatcttcaattcctcttatctgagacgtggtgaaagccattggtggatgaagggttccacgccaacacaaattagcgagattataattaaactgatcaaggatatggccgctggccacttgtctgaagcctggagtcgggtcacaaagaatgccattgcggagaccatcatagcactgaccaagatggaagaggaatttagatcccctgtcaggtgcattgcgaccacacgcctctggcttgccctggcgagtctctgtgtcctcgatcaggatcatgtggatagattgtctagcgggcgatggatgggaaaagacggccagcagaaacagatgccaatgtgtgacaatcatgatgacggcgaaaccgctgccatcatcctttgcaatgtatgtgggaacctatgtacggactgtgatcggtttcttcaccttcatcggagaactaagactcaccagaggcaagtatttaaggaggaggaggaagcaattaaagtggacctgcatgagggttgtggtagaaccaaactgttctggctgatggctctagctgactcgaagaccatgaaggctatggtggaattccgagagcacacgggaaagcccaccacatcatctagcgaggcttgccgtttctgcgggtccagaagtgggactgagctctccgctgtgggcagcgtttgtagcgacgcggattgtcaagagtatgccaagatcgcatgttcaaagacccatccatgtggccatccttgcggaggtgtgaagaacgaagagcactgcctaccatgcttacacggatgcgataaatccgctacaagtctcaaacaagatgctgacgacatgtgcatgatttgctttaccgaggcactgagcgccgctcctgcgatccagctggattgcagtcatatcttccacttgcagtgctgtcgaagagttctggagaatcggtggcttgggccaaggatcaccttcggattcatctcctgcccaatttgtaaaaacaagattaatcatatcgttctcaaagatctgctggatcctatcaaggagctttacgaggacgtacggaggaaagccctgatgcgcctcgaatatgagggcctgcacaaatccgaagccatcacgaccccaggagtgagattctacaatgacccggcaggttacgctatgaaccggtatgcctattacgtttgttacaaatgtaggaaggcctattttggcggagaggctaggtgtgacgcggaagccggaagaggggacgattacgatcctagggagttgatctgcggggcttgctccgacgtgagcagagcccagatgtgccccaagcacggcacggatttcctcgaatataaatgcagatactgttgtagtgtggcagtgttcttttgcttcgggactacacatttctgcaatgcatgccacgatgacttccagcggatgacaagcatacccaaggaggagctgcctcattgtccagccggacctaaaggcaagcagcttgaggggacagagtgccctctccatgtcgtccatccacctacaggcgaggaattcgccctgggatgcggcgtctgtcgaaacgcacacacattctag

SEQ ID NO: 29643 - DNA, 13923 bp, Artificial Sequence
  Description of Artificial Sequence: Synthetic coding sequence
atgccggtccccgatggaagtgtcgccgctgctgggctgggactgggcctgcctgccgctgattcaaggggtcactatcagctgctcctgagtggcagagctcttgcggatcggtacagacgcatttacacagcggcactgaatgatcgagatcagggaggcggaagcgcaggtcaccccgcatcaaggaacaaaaaaatactaaataaaaaaaagcttaaaagaaaacaaaagagcaaatccaaggtgaagacccggtcgaagtcagagaacttagagaacactgttatcattcccgacatcaagctgcattccaatccttccgcgttcaacatctactgtaacgtccgccactgtgtgttggaatggcaaaaaaaagaaatctccctggctgccgcttcaaaaaactcagtgcaaagtggggaatccgactcagacgaagaagaggaaagcaaagagccccctatcaagctaccgaaaattattgaggtcggactctgcgaggtattcgaactcattaaagagactaggtttagccatcccagcctgtgcctgcgttctctgcaggcattgctgaacgttctccaggggcaacagccagaaggcctgcagtcagagccacctgaagtgctggaatctctttttcagctgttacttgagattacagtgagaagtacgggcatgaatgactcaacaggccagagcctgacagctctttcctgtgcctgtctgttttccctcgtagcaagttggggagaaacagggaggacactccaggccatcagcgctatcctaacaaacaacgggtcacacgcctgccagaccatccaggtgccaacgatcctgaattcacttcagcgctctgtccaagctgtcctggtgggtaaaatacagatccaggactggttcagcaatggaataaagaaagcggcactgatgcacaaatggccactgaaagaaatatccgtggacgaagatgatcagtgtctgctccaaaacgatggctttttcctttacctgttatgcaaggatgggctgtacaagatcggttccggttattcgggtacagtgaggggacacatttataattccacttcccggatccgcaataggaaggagaaaaaaagttggttaggatacgctcagggttaccttctgtaccgggacgtaaacaatcactccatgacagctatccgaatctcccctgaaacactggagcaggacggcactgttatgctacccgactgccatactgagggccagaacattttatttacggacggagaatatattaatcagatcgcggcatcacgcgacgacggattcgtggtgaggatctttgccacctctaccgagcccgttttgcaacaagagcttcagctcaagctcgctcggaagtgtttacatgcttgtggcataagcctttttgatctggaaaaagaccttcacattatctccacgggcttcgatgaagagtccgcgatcctcggagctgggagggagttcgctttgatgaaaactgccaatggaaagatatactacacgggaaagtaccaatcactcggcatcaaacagggtggtcccagcgcaggtaaatgggtagagctccccattaccaagtccccaaagatagtgcatttttccgtgggacacgacggaagccatgcgttgcttgtggcagaggatggcagcatcttctttaccggctccgccagcaagggtgaggatggcgagagtactaaaagtcggcgacagagtaagccctacaagcctaagaagataattaagatggagggaaagatagtagtgtataccgcatgcaataatgggtcatctagcgtcatttctaaagacggtgagctctacatgtttgggaaggacgcgatttacagcgactcttccagcttggttacggatcttaagggccactttgtcacccaggttgctatggggaaggcccatacctgcgtgctgatgaaaaacggagaggtctggacatttggggtgaacaataagggacagtgtggacgcgatacgggtgccatgaaccaggggggaaaaggctttggtgtggaaaacatggctacggcgatggatgaggacctggaagaagagcttgacgagaaggatgagaagtctatgatgtgtccacccggtatgcacaagtggaagctcgaacagtgcatggtatgtacagtgtgcggggattgcaccgggtacggagctagctgcgtttcttcaggccgtcctgacagagtgcccggtggcatttgcggatgtggcagtggcgagagcgggtgcgcagtgtgcggctgctgtaaggcctgcgctcgagaactagatggccaggaagcaagacagagagggatactcgacgcagtgaaggagatgatccctcttgacctgctgctggcagtgcccgtccctggagttaacattgaggaacacctccagctgcgtcaggaagagaagaggcagcgagtgattaggaggcaccggctcgaggagggtcgcggtcccctggtctttgccggtcctatcttcatgaatcatcgcgaacaggcgctagcacgcctgaggagccatccagcccagctgaagcataaacgcgacaagcacaaagacgggagcggagagagaggagaaaaagacgcctctaagataacaacctacccacctgggtccgtgagatttgattgtgaactgcgcgcagtgcaagtctcttgtggcttccaccacagcgtggttctgatggaaaacggggacgtttacactttcggatacggtcaacatggtcagttgggccacggagacgttaattccagaggctgtccaaccttggttcaggctctgcctggccctagtacgcaggtgacagctggctctaatcatactgccgtgctattaatggatggccaggtgttcacttttggctcttttagtaagggccagctgggcaggcctattctggacgtcccatactggaacgccaagcctgctccgatgcctaatattggtagcaagtatggacgaaaagccacctggataggtgcttctggtgatcagacatttctacgaatcgacgaggcattaattaacagccacgtgctggctacgtctgaaattttcgcgagcaagcatatcattggcctggtgccggctagtatctcagaacccccaccattcaaatgtttactcattaacaaggttgacggatcctgcaaaacgttcaacgacagcgaacaggaagacctccagggctttggcgtttgcctcgatccagtgtatgatgtgatctggcgatttagaccaaacacacgagagttgtggtgctacaatgctgtggtcgccgacgccagactacctagtgcagccgatatgcagtcacgatgttcaattctctcacctgaactcgccctgccgacgggcagtcgagcactcaccactaggtcacatgccgctctgcatatactcggatgcctggacaccctagctgccatgcaggatttgaagatgggcgtggccagcactgaggaagagacacaagccgttatgaaagtgtacagtaaggaggactactcagtggttaataggtttgaatctcatggtgggggttggggctactctgcccactcagtggaagctattcggttttccgccgacaccgatattcttctggggggtctgggactttttggaggtcggggtgaatacacagcaaagatcaaactctttgagctgggacctgatggcggtgaccatgaaacagatggcgatctattggccgagacagatgtattggcatatgactgtgccgctcgggagaaatacgccatgatgttcgatgaacccgtcctcctccaggccggttggtggtacgtggcatgggctcgcgtgtctggaccttcatcagactgcggatctcacggacaagccagtatcactacagacgatggggtcgtgtttcaattcaagtcatctaagaagagtaacaacggaacagatgtcaatgctgggcagatccctcaactactctaccgcttaccaacctcagatggcagtgccagcaagggtaagcagcagacttctgagcccgtgcacatcctaaaaaggtcattcgccagaacagttagtgtggaatgctttgaaagcctgctaagtatactccactggtcctggactactttggtgctgggtgtggaggaactgagagggctcaaggggtttcagtttactgcaacactgctggacctcgagagactacgctttgtgggtacgtgctgcttgaggctcctccgcgtgtacacatgtgaaatttaccctgttagcgccacaggtaaggccgttgtcgaggaaaccagcaagctcgcagagtgcattggaaaaacacgcaccctcctgaggaagatcctcagtgaaggagtggatcactgtatggtaaagctggataacgatccacaggggtacctctctcagcccctcagtctgttggaggccgtcctccaggagtgccacaacacttttacggcatgtttccattccttttaccctacccccgctctgcagtgggcatgtctctgtgatctactcaactgtctggatcaggacatccaggaagctaatttcaagacttcatcatcacgcctcctggcggctgtcatgtctgccctctgccacacatctgtgaagctcacgagtattttccccattgcatacgatggggaggtgctgctgcggtcgatcgtcaaacaagtatctaccgagaacgattccaccctcgtccataggttccccctgctggtcgcacatatggagaagctcagtcagagcgaagagaacatcagcggcatgaccagctttcgcgaagtactggaaaagatgctcgtgatcgtagtgctgcctgtgcggaacagcctgaggcgggaaaacgaacttttctcatctcatttggtgagtaatacatgtggacttctagcaagcatcgtgtctgagctcacagccagcgcactgggcagcgaggtcgatgggctgaactcgctgcactcagttaaagcgtccgcaaaccgcttcacaaaaactagccaaggaaggtcttggaatacaggcaatggatctccagatgccatctgtttctcagtggacaaacctgggatcgtggtcgtaggtttcagcgtttatggcggtgggggtatccatgagtacgagctggaggtgcttgtggatgacagcgagcacgctggagattcaacccattcccatcgctggacctccttggaacttgtgaagggcacatacacgaccgacgactcaccaagtgatattgccgaaatcaggctggataaggttgtccctctaaaagagaacgttaaatacgctgtccgcctgcgaaactacggcagtagaacagcgaacggagacgggggaatgaccaccgtgcagtgtcccgatggcgtcactttcacgttttccacctgcagcttatcctcaaatggaacaaatcagacaaggggccaaatacctcagatcctctactatcgcagtgagtttgacggtgaccttcagtcacagcttctgagcaaagccaatgaagaagacaagaactgctctcgcgctctgagcgtcgttagcaccgtggtgcgtgcgtctaaagaccttctgcatcgtgccctggccgtcgacgccgacgacatccctgaactgcttagtagctcttcattgttctcgatgctcctgccacttatcattgcttatatcggacctgtggccgctgcaatccctaaggtcgccgtggaagtcttcgggctggttcagcagctcctgccttcagtcgccattctgaaccagaagtacgctcccccagcattcaatcccaaccagtccaccgactctactactggaaaccaacccgagcaggggctgtccgcttgcaccaccagttcacattacgccgtgatagagtctgaacacccttataagccagcctgcgtcatgcactacaaggtgacattccctgagtgcgtaaggtggatgaccatcgagttcgaccctcaatgtggcaccgcccagtcagaggatgtcctccggctgctgatccccgtgagaactgtccagaatagtggttatggcccaaagctgacttccgtgcatgagaatctgaattcttggatcgagctgaagaaatttagcggatcaagcggatggcctacaatggtgctcgtcctgcctggcaacgaggcgttgttctccctggaaaccgcgtctgattatgtgaaagatgacaaagctagcttttatggtttcaagtgctttgcaattggctatgagtttagtccaggacccgacgaaggcgtgatccagctggagaaggagctggctaacctcggaggtgtctgtgcagccgcactgatgaagaaagatctggctctacctattgggaacgaattggaggaggatctagaaattctggaagaggccgcattacaggtatgcaagacgcattccgggattctcggcaaagggcttgcattgagccactctcccactattctcgaagctctagagggaaacctgccgctgcaaatacagagcaatgagcagtccttccttgacgatttcattgcctgcgtgcctggctccagcggtgggaggctcgcgagatggctccagccagactcctatgctgatcctcagaaaacttccctgatccttaacaaggatgacatccgctgtggttggccaaccaccatcaccgttcaaactaaggatcagtatggggacgtggtgcatgtgccaaacatgaaggtggaagtaaaggctgtgccagtctctcaaaagaagatgtccctgcaacaggaccaggccaagaagccgcaaaggatcccgggaagccccgctgtaaccgcagcctcatccaatactgacatgacgtacggcggattagctagccccaaactcgatgtgagctacgaacccatgatcgtgaaagaggctcggtacattgctattaccatgatgaaggtctatgaaaattattcatttgaagaacttaggtttgccagcccgacccccaaaagaccgtcagagaacatgctcatcagggtgaataatgacgggacctactgcgcaaactggacccccggtgctatagggttatataccctgcacgtgactatcgacggaattgaaattgacgcaggcctggaagtgaaggttaaggatcctcctaaaggaatgatcccgccaggcactcagcttgtgaagccaaaatcagagccacaacctaataaggtccgcaaatttgtggctaaagactctgcaggactgagaatcagatcccacccttcgcttcagagtgaacagatcgggatcgtcaaggtgaatggcacgatcacatttatcgacgagattcataacgacgatggcgtgtggttgagattgaatgatgagaccattaaaaaatacgttcccaatatgaatgggtacactgaggcgtggtgcctgagttttaaccaacatctggggaagagcctcctggtcccagtggatgagtcaaagacaaatacggacgactttttcaaggatattaactcctgctgcccacaggaggctacaatgcaagagcaggacatgcctttcctccgcggagggccagggatgtataaggttgtcaagactggtcccagcggccacaatattagatcgtgtccaaatctgcggggaattcccatcggcatgctcgtgctcggcaacaaagtgaaggccgtaggtgaggtgactaacagcgagggcacctgggtacagctggatcagaactccatggtggagttctgcgagtcagacgagggtgaggcttggagcctggccagggatagaggcggaaatcagtacctccgacacgaagacgaacaggcactgctcgaccagaattcccaaacccccccaccatcacccttctcagtgcaggcttttaacaagggagcttcctgcagcgcgcaagggttcgattacggactgggtaattcaaagggcgatcggggtaacatatctacttcctccaaacctgccagcacgtcagggaagagcgagctatcttcgaagcacagccgctcacttaaacccgatggcaggatgtcgcgtacgacagctgaccagaagaagccacgcggaactgagagtctgagtgcctctgagtcactcattctgaaatcagacgccgctaaactaaggtcggactcccattctcgcagtctgagccctaatcacaatacattacagactctgaaatcggacggcaggatgccatcttcaagccgcgctgagagccccggaccaggatcccgcctgtccagcccaaagccaaaaactctgccagcaaatcgtagcagcccaagcggcgcttcgagccctcgcagtagctccccacatgacaaaaacctcccccagaaatccacagcccctgtcaaaaccaagttggatccccctagggagagatccaaatccgattcatatacactcgaccccgacacacttcgaaaaaagaaaatgcccctaaccgaacctctcagaggcaggagcacatcccctaaacctaaaagtgtccctaaggatagcacagactcaccagggtctgagaacagagctccctctccccacgtcgtgcaagaaaacttacacagcgaggtcgtggaggtttgcacgagctctacccttaagacgaactccctcacagactcaacttgcgatgactcatccgaattcaagagtgtagacgaaggttccaacaaggtacacttcagcattggtaaggcgcctctgaaagacgaacaggaaatgcgggcttctcccaaaataagccgcaagtgtgccaatcgccataccaggcctaagaaagaaaagtctagtttccttttcaagggtgacggcagcaaaccattagaacctgccaagcaggcaatgagtccttctgtagccgagtgtgcccgagctgtctttgcttccttcctgtggcacgaggggatcgtgcatgatgccatggcctgttcaagcttcctgaagttccaccctgagttgtcaaaggaacacgccccaattaggtcttctctcaacagccagcagccaaccgaagaaaaagaaactaagttgaagaaccgacactccttggaaatctcatccgccttgaatatgttcaatattgccccacacgggcctgatatttccaagatgggctcaattaataagaataaggtgttgtccatgctaaaggagccacccctgcatgaaaaatgcgaagacggcaaaacagagaccaccttcgaaatgagcatgcacaacaccatgaaatccaagtcccccctgcccctgactctacagcacctcgtggctttctgggaagacataagcctcgccacaataaaggcagcgtcgcagaacatgatcttccccagccctggcagctgcgccgtcctgaagaagaaggagtgtgagaaagagaataaaaaaagcaagaaggaaaaaaagaaaaaagaaaaggccgaagtccggcctagaggcaatctgtttggcgagatggcacaactggccgtgggtggcccagaaaaggacaccatatgcgagctctgtggcgaatctcatccttatccagtgacttatcatatgcgccaggcccacccgggttgcggacggtacgcaggaggtcaggggtacaacagcatcggtcacttctgtgggggttgggcaggaaactgcggcgacgggggaatcggcggatcaacctggtacctggtatgcgatcgttgtcgcgagaaatacctcagagaaaagcaggcagccgctagagaaaaagtgaaacagtccagacggaaaccaatgcaggtaaagacaccacgcgctcttcccacaatggaggcccaccaggtgattaaagcaaacgctctctttctactttcccttagttctgccgcagagccatctatactatgttaccaccccgctaagccttttcagagtcagttgccatccgttaaggagggcattagtgaggacctgccggtaaagatgccatgtctttaccttcagactttggcacgtcaccaccacgaaaacttcgtgggctaccaggacgataacctctttcaggatgaaatgcgctatctccgcagcacctctgttcctgccccatacatcagtgttacccccgacgcttccccaaacgtcttcgaggagcctgaaagtaatatgaaaagcatgcccccttccctggaaacttcaccaatcaccgataccgatctagcaaagcgaacagttttccagcgctcttatagtgttgtggcaagcgagtatgataagcagcactccatacttccggcacgcgtaaaggccatcccccgtcgtcgtgtgaattccggcgacaccgaggtgggttcaagtcttctcagacatccttcccctgaactgtcacggctgatttctgcccactctagtctgagtaaaggggaacggaattttcagtggcccgttctggcttttgtaattcagcaccacgacctggaaggtttggaaatcgccatgaaacaggcactgaggaaaagtgcctgcagagtgtttgcaatggaggcgttcaattggttgctctgcaatgtaattcaaactacttcactccacgacattctatggcactttgttgccagcctcacacccgctcctgtcgaaccagaagaagaggaggatgaggaaaacaagacctcaaaggagaactccgagcaggagaaggatacccgagtgtgcgagcatcccctgtccgacatcgtgatcgccggagaagccgctcatcctttaccccacaccttccatcggcttttgcaaactatctcagaccttatgatgtccctgccttccgggtcttccttacagcagatggcactgcggtgctggagtttaaaatttaaacagagcgaccaccagttcctgcatcagagcaatgtctttcatcacattaacaacattctgagcaagagtgatgatggagactctgaagagtcatttagcattagcatccaaagcgggttcgaggctatgtcacaggagttgtgcatcgtgatgtgtcttaaggatctcacttctattgtggatattaaaacatccagcagacctgccatgatcggctccctgaccgacggcagtactgaaacattctgggaatctggagatgaagataagaacaagacaaaaaacatcaccatcaattgcgtaaaaggcatcaatgcccgttacgtatcagtgcatgtggataatagtcgggatttggggaataaggtgacttctatgacctttctgacaggcaaagcagttgaggatctatgccgcatcaagcaggtggacctggacagccgacatatcggttgggtgacttcagagcttcccggtggtgacaaccacattataaaaattgaacttaaggggcctgaaaacactctaagagtgcggcaggtcaaggtgctggggtggaaggatggcgaaagtacaaagattgccggtcagattagtgcatccgtggcccagcagcgcaattgcgaagccgagacattgcgtgtatttaggcttataaccagccaggtgttcgggaagctcatctctggagacgccgagcccacacctgagcaggaggagaaggctctgctgagctctcccgagggggaagaaaaagtctataacgcgaccagcgatgcagatctcaaagaacatatggtgggtattatcttttccagaagcaaattaaccaatcttcagaaacaagtttgtgcccacatcgtgcaggcgatccgaatggaggcaacgcgcgtgagagaggagtgggaacacgccattagttcgaaggaaaacgcaaattctcaacctaatgatgaagacgcttcctctgacgcgtattgttttgagctactatccatggtattggcgctctcagggagcaacgtcgggaggcagtacctggcacagcagctaacgctgctgcaagacctcttttctctgctgcatacggcgtcacccagagtgcaacggcaggttacgagtctcctccgcagggtgctcccagaggtgacacctagccgcctggcctctatcattggcgtaaaatccctaccaccggctgatatctcagacattattcattccacggaaaagggcgattggaataagctgggcatcctggacatgttcctgggttgtatcgcaaaggctcttactgtgcagctcaaggctaagggtactacaattacaggaaccgcaggaacaactgtgggaaaaggagtgaccaccgtgacccttccaatgatctttaatagctcatacttgaggcgcggagagtcacactggtggatgaaaggttccacccccactcagatctctgagattattattaagctcattaaagacatggctgctggacacctcagcgaggcttggtcgcgggtcacaaagaatgccattgccgagacaataatcgcccttactaaaatggaggaagagttccgcagtccggttagatgcattgctaccacccgactgtggttggcactggcttccctgtgcgtattagatcaagatcatgtggataggctgagctcaggcaggtggatgggaaaggacggacagcagaagcaaatgccgatgtgtgataatcacgatgacggagaaacggcggctatcattctttgcaatgtgtgcgggaacctatgtacagactgtgataggttccttcatttacataggagaaccaaaacccaccaaaggcaagtgttcaaggaggaggaggaggccattaaggtcgatttgcacgagggctgcggccgaactaaactcttttggcttatggctttggccgactcaaaaacgatgaaggcaatggtggagttcagggaacacaccggcaagcccaccactagtagttcagaggcgtgccgtttttgcggctcaaggagcggcacagagctgtcggctgtggggtcagtgtgctctgacgctgactgccaagaatacgccaagattgcgtgttctaaaactcacccatgcggacatccgtgcggaggcgtaaaaaatgaagaacattgcctgccctgcctgcatggatgcgataagtccgcaacaagcttaaagcaggatgccgacgatatgtgtatgatttgctttactgaggccttgagcgctgcacctgccatccagttggactgctcacatatttttcacttgcagtgctgtagacgagtactcgagaaccgctggttaggaccaaggataaccttcggatttatcagctgtcccatctgcaagaataaaattaaccatatagtactcaaagatctcctggacccaatcaaggaactctatgaagacgtgaggcgaaaggcccttatgagactggaatatgagggcctgcataagagcgaggcaatcaccactccaggggttcgattctacaacgaccccgcaggctatgccatgaatagatacgcctactacgtttgctacaaatgccggaaggcgtactttggcggagaagcccgttgcgacgcagaagctggacgtggggatgactacgatccccgtgagcttatatgtggcgcttgctcagatgtaagccgagcacagatgtgcccaaagcatggaactgacttcctcgagtacaagtgcaggtattgctgttcagtcgccgtgttcttctgctttggcacgacacacttttgcaacgcatgtcatgatgattttcagcgcatgacctcaattcccaaggaggaattgcctcactgtccggcaggtccaaaaggcaaacagctggagggcacggaatgtcccctgcacgtggtacacccgccaacaggggaagagttcgctttggggtgcggggtctgccgcaacgcgcacaccttctag

SEQ ID NO: 29644 - DNA, 930 bp, Artificial Sequence
  Description of Artificial Sequence: Synthetic coding sequence
atgagacccgaccgcgctgaagccccaggtcctccagcgatggcagccggtggtccaggcgcaggctctgcagccccagtctcaagtacttccagtctgcctcttgccgctctgaatatgcgggtgagaagacggttgagtctcttcctcaatgtcaggacccaggtcgccgctgattggaccgctttagcggaagagatggacttcgagtacttggagatcagacagctagagacccaggccgaccctactgggaggctgctggacgcttggcaggggagacctggagcctccgtggggaggcttctggagttactgaccaaactaggcagagatgatgtgctactggagctgggacctagcattgaggaagactgtcagaaatatattcttaagcaacagcaagaagaggctgagaagccactgcaagttgcagcggtcgacagtagcgtgcccagaacggccgagcttgctgggatcaccaccctggacgaccctctgggccatatgccggaacgtttcgacgccttcatttgctactgcccctccgatatccaattcgtccaggagatgatacggcagcttgagcagaccaactatcgtctgaagttgtgcgtttcggacagggatgttctgcctggaacgtgcgtctggagtatcgcctccgaacttattgaaaagagatgccggagaatggtcgttgtggtgagtgacgattatctgcagagtaaggaatgcgattttcaaacaaagttcgctctcagtctgagtccaggagcacaccagaagcgtctgattcccatcaagtataaggctatgaagaaggagtttccttctatcctgcgatttattactgtctgtgactacaccaacccttgcacaaaatcttggttctggactcgcctggccaaggctctatccctgccctag

SEQ ID NO: 29645 - DNA, 858 bp, Artificial Sequence
  Description of Artificial Sequence: Synthetic coding sequence
atggcagcaggtggccctggggctggctcagctgcccctgtgtcctccacctcctcattacctctcgccgctttaaatatgagggtccggagacgcctcagtctatttctgaatgtcagaacacaagttgcggcagattggacagccctcgccgaggaaatggatttcgagtaccttgaaatccggcaactggagactcaagccgatcctacaggtgcaagcgtgggccgtttgctcgagctgcttaccaagctcggacgcgatgacgttctgctcgagctcggccctagtatcgaagaggattgccaaaagtatatattaaagcaacagcaggaggaagcagaaaaacctctccaggtcgccgctgtggactcatccgttcctcggacagccgagctggccggaataactaccctggatgatccactcggccacatgccggaacgatttgacgcatttatttgttattgcccctccgatattcaatttgtgcaggagatgatcaggcagctggagcagactaactatcgactcaaactctgtgtttcagatcgggatgtgctgccagggacgtgtgtctggagtatcgcctcggagctgattgaaaaacgctgtcggagaatggtagtagtggtttcagacgactatcttcaatcaaaagagtgcgacttccaaacaaaattcgcgctcagcctgtcccctggagctcaccagaagcgtctgatccccatcaagtacaaggcaatgaagaaagagtttccgtccattctccgcttcattaccgtttgtgattacactaacccctgtacaaaatcatggttttggactcgcctggccaaggctctctctctgccatag

SEQ ID NO: 29646 - DNA, 954 bp, Artificial Sequence
  Description of Artificial Sequence: Synthetic coding sequence
atgcggcctgatcgcgcagaagctccagggccacctgcaatggccgctggaggacctggcgcaggatctgctgctcccgtctcctcgaccagcagtctgcctctggctgccttaaacatgagagtcagaagacggttatctcttttcctgaacgtaaggacccaagtggccgcagactggactgcacttgctgaggagatggatttcgaatacctagaaatacgccagctggaaactcaagccgatccaacaggacgattgctggacgcctggcagggaagacctggagcttctgtcggtcgactgctggaattgctgacaaagctgggacgcgacgatgtgctgctcgaattggggccttctattgaggaggactgccagaagtacattcttaagcagcaacaagaagaggctgagaaacctctgcaggtggcggcagtcgattcatctgtgcctcgtacggcagaattagccggtataaccacactcgatgacccccttgggcacatgccggagcgctttgatgcttttatttgttattgccctagcgacatccagttcgttcaggaaatgatcagacagctcgagcagactaactaccggttgaagctttgtgtctctgatcgtgatgtgcttccaggtacatgcgtgtggtctatagcaagcgagctgatagaaaagagactggcccgaagacctagagggggttgccggagaatggtggtggtggtatccgatgactacctccagtccaaggaatgtgatttccagacaaagtttgccctctcattgtcacctggtgcgcatcagaaacgcctgattcccatcaagtacaaggctatgaaaaaggaattcccaagtattctccgatttatcaccgtatgcgactacaccaacccgtgtaccaagtcttggttttggactcgacttgcaaaggctttgtctctgccttag

SEQ ID NO: 29647 - DNA, 510 bp, Artificial Sequence
  Description of Artificial Sequence: Synthetic coding sequence
atggctgccggaggcccaggcgctggcagcgctgcacccgtctcttccacaagttcactaccgctggccgcactaaacatgagggtcaggcggcgactgtcactgttcctcaacgtccggacccaagtcgcagctgactggacagctttggccgaggaaatggactttgaatatcttgagattagacagttggagacccaggccgatcccactggacggctcctcgatgcgtggcagggaagaccaggagcttctgtgggacgcctgctggagctactgactaagctaggccgagatgatgtgctcctggagctcggaccatccatcgaagaggattgccagaagtacattctgaaacagcagcaggaagaagccgaaaaaccactgcaggttgccgctgtcgacagctctgtcccccctcacctgatgaccccctggggaatttgcctctcagtgagtatgcctagctcagcaatagcgcctgctacctcaagcctctgccgcaggtag

SEQ ID NO: 29648 - DNA, 963 bp, Artificial Sequence
  Description of Artificial Sequence: Synthetic coding sequence
atggaactgctctctccgcctctgcgagacgtcgacctgactgcccctgatggttccctttgttcatttgctaccactgatgacttttatgacgatccctgtttcgacagcccggacctccgattctttgaagatttggatcccagactgatgcacgtgggcgcactcttaaaaccagaggaacacagccactttccggctgcagtgcatcccgctcccggagcacgggaagatgagcacgtgagagcaccctctggccaccaccaggcagggcgatgtctgttatgggcttgtaaagcttgtaagcggaagactactaacgctgataggcgcaaggccgctacaatgcgtgaacggcgtcgcctgagtaaggttaacgaggcctttgagaccttgaaacggtgcaccagctctaaccccaatcagaggctgcctaaagtcgagatcctgagaaatgcgatacggtatatcgagggactgcaggcactgctccgagatcaggacgcggctccgcctggcgctgccgcagccttctatgcacctgggccattacctcctggtcgagggggagagcactattcaggggactctgacgcctcttctccaaggagcaactgttcagatggcatgatggactactcagggccaccatctggtgctcgcaggcgtaactgttatgaaggtgcctattacaatgaagcaccatcagaacctcgacccggtaaatccgcggctgtgtcttctctggactgtctgtcctctatagtggaacgtattagtactgaatctccggcagctccagcgttactgctggccgatgtgccatcggagagccctccccgtaggcaggaagcagccgctccatcagagggggaatcatctggagaccctacacagtcacctgatgcagcccctcaatgccccgcaggggcaaatcctaatcctatctaccaggtgttgtag

SEQ ID NO: 29649 - DNA, 5537 bp, Artificial Sequence
  Description of Artificial Sequence: Synthetic coding sequence
atgggggacgtaaagcttgtggcatcttctcatatctcaaaaacttcattgtcagttgacccttccagggtcgactccatgcctctcaccgaagccccagcatttatcctgccacccagaaatctctgtatcaaagagggggcaacagccaagtttgaaggtcgtgttcggggataccccgaaccacaggtgacctggcacaggaacggacagcctatcacgtctggtggacgcttccttctcgattgtggaatcagaggcacattcagtctggtgatccatgcggtgcatgaagaggacaggggtaaatatacatgtgaggccacaaacggttcaggtgcaagacaagtgaccgtcgaattaactgtagagggatctttcgccaaacaactcggtcagcccgtagtgtctaaaacactaggggaccgctttagcgcccctgctgtcgagacccggccatctatctggggagagtgcccccctaagttcgccactaagctgggcagagtggtcgttaaagagggccagatgggccgattttcctgcaagattaccggcaggccacagccccaggttacatggcttaagggaaacgtgcctcttcagccgtccgcgcgagtcagcgtcagtgagaaaaacggtatgcaggtcttggagatccatggcgttaatcaggacgatgtgggagtctatacgtgcttagtggttaacggctccggcaaggcatccatgagtgcggaactcagtatacaggggttggacagtgctaaccggtctttcgtgagagaaactaaagctacaaattccgacgttagaaaggaggtgacgaacgtgatctcaaaggaatctaagctggattctctggaggctgccgcaaagtctaagaactgctcaagtccccagcgaggcggttcacctccctgggccgctaatagccagccccagcctcccagggaaagcaaacttgagtcttgtaaagacagtccgaggaccgcccctcagactcctgttctgcagaaaacttcttcctctatcacccttcaggcggctcgcgtccagcccgaacctcgggctcctggcctaggtgtgctgagtccctctggggaggagcgtaagcgacctgctccccctcgcccagcaacatttcctacaaggcagccaggactaggaagccaggacgtggtctccaaggctgctaataggaggattcccatggagggtcagagggattctgcctttcctaagtttgagtctaaaccccaaagccaggaagtcaaggaaaatcagaccgtgaagtttaggtgtgaaggtttggcagtgatggaagtcgccccttctttcagttccgtgctcaaagattgcgcggtcatcgaaggccaggattttgtgctgcagtgctcagtcagaggtacaccagtccccaggatcacctggttgttgaacggacagccaatccagtacgcccgttcgacatgcgaagccggtgtggctgaattgcatatccaagatgcccttcctgaagaccacggtacttatacatgcttagccgagaatgcactggggcaagttagctgttcagcctgggttactgtgcacgaaaagaagagtagccgtaaatccgagtacctcctaccagtggccccttcaaagccaaccgcacctatctttcttcagggcttgagtgacttaaaggttatggacgggagtcaggtaaccatgacagtgcaggtcagcggaaacccccctcccgaggtaatctggctccataatgggaacgagattcaagaatcagaggacttccacttcgagcagcgtggcacccagcactcgttatgtatccaggaggtgttcccggaggatacaggaacctacacgtgtgaagcctggaactctgcaggggaagtgagaacccaggctgttctgacagttcaggagccgcacgacggaacccagccgtggttcatttccaaacccagaagcgtgaccgcctcccttgggcagagcgttttgatcagctgcgcaatcgctggtgaccctttccccactgttcactggctgagagacggaaaggcgctttgtaaggacacagggcattttgaagtactgcaaaacgaagacgtattcaccctggtgctgaagaaagtacaaccctggcacgccggtcagtatgaaatcctcctgaagaacagagtgggcgaatgtagctgccaggtgagcctcatgctgcagaattcgtctgccagagcgctcccacgaggcagagagcccgctagctgcgaggacctctgtggtgggggtgtgggagcggacggaggcggatctgatagatatgggagcctgcggccaggctggcctgctaggggacagggctggctcgaggaagaggacggggaggatgtgagaggcgtgttgaagagacgcgtggagacacggcagcacacagaagaggccataagacagcaagaggtagagcagctggatttccgcgacctattaggaaaaaaagtaagtacgaaaactctttccgaagacgatttgaaggagatcccggctgaacagatggacttccgggcaaaccttcagcgtcaagtaaagcctaagacagtgtctgaagaagagcgcaaagtgcactccccacagcaggttgacttccggagcgtactagccaagaagggaaccagcaagacacccgtccccgaaaaggttccacccccaaagcccgcaacacctgattttcgctcggtgttgggaggaaaaaagaaactgcccgcagagaatggtagttcttcagctgagacattgaacgcaaaagctgtcgaaagctccaagcctctgagcaatgcccaaccgagcgggcctctcaagccagtgggaaacgccaagcctgcagagactctcaaacccatgggcaatgccaaacccgctgagaccttgaagcctatgggcaatgctaagccagatgaaaacttgaaaagtgcatcaaaggaagaacttaagaaagacgtgaaaaacgatgttaattgcaaaaggggccacgcaggaacaacagacaacgagaagagaagtgaaagccaggggaccgccccagctttcaagcaaaagttacaggatgtgcacgttgctgagggaaaaaaactgcttttgcagtgtcaagtctcaagcgatccccctgccaccatcatttggaccctgaacggcaaaaccctcaaaaccaccaagtttatcatcctgagtcaagaaggcagcctctgttccgtttcaatcgagaaggcgctccctgaagataggggcttgtacaaatgcgtcgcaaagaatgacgctggtcaagcagagtgttcttgccaagtgacagtggatgatgcccctgcaagcgaaaataccaaggcaccggagatgaagtcccgccgtcctaagtcctccttgccacctgtgttgggtactgagtccgatgcaaccgttaaaaaaaaacccgctccgaaaactcctccaaaggcagccatgccacctcaaatcattcaatttcctgaggaccagaaagtcagagccggtgagtccgtcgaactctttggaaaggtgactggcacgcaacccatcacttgcacttggatgaagttcagaaaacagatacaggagtcagagcatatgaaggtggaaaatagtgagaatgggtcgaaacttacaatcttagctgccaggcaggagcactgtggttgttatacactgttagtggagaataagctagggagccgacaggcccaagtgaacctaactgttgtggacaaaccagaccccccagccggtaccccatgtgcgtccgatatccgctcaagttctctgactttaagttggtacgggagttcctacgacggaggttctgccgttcagagctactctatcgagatctgggacagtgctaacaagacctggaaagagctggcaacctgcaggagcacctcttttaacgtgcaggacctgctgcctgatcatgagtataaatttcgggtccgagcaatcaatgtgtatggaacctccgagccatcccaagagagcgaacttactactgtcggagaaaaacctgaagagccaaaagatgaggttgaagtgtccgacgacgatgaaaaggagcccgaagtcgattatcgcacagtcaccatcaacactgagcagaaagtttcagatttttatgacatcgaggaacgcctcgggtctggcaagtttgggcaagttttccgactggtcgaaaaaaaaacccggaaggtgtgggccggtaagttctttaaggcatactctgccaaggaaaaagaaaatattcgccaggaaatcagcataatgaactgcctgcaccatccaaagttggttcaatgcgttgacgcttttgaagaaaaggccaacatcgtcatggtgctggagattgtgtccggaggcgagctcttcgagcgcatcatcgacgaagattttgagttaaccgagagagagtgcattaaatacatgagacagatctctgagggagtggaatacatccacaagcagggcatagtccaccttgacctaaaacctgaaaatattatgtgcgtcaacaagacagggacaagaattaagctgattgacttcggtttggctcgacgcctcgagaacgccggttccctaaaagtcctgttcggcactccagagtttgtggcgcctgaggtcatcaattatgaacccatcggatacgccacggatatgtggagtattggtgtgatctgctatatccttgtttcaggcctgagcccgtttatgggagacaacgataacgaaaccctcgcgaacgtgacatctgccacttgggacttcgatgacgaagccttcgacgagatatctgacgatgccaaggacttcatttccaatctcttaaagaaggatatgaaaaatcgactggattgcactcagtgtctgcagcacccatggctgatgaaagataccaaaaatatggaagctaaaaaactgtccaaggaccgaatgaagaagtatatggccaggcggaagtggcagaagaccggcaacgcagtgcgagcaattggcaggcttagcagtatggccatgatcagcggcttgtccggcaggaaatcgagcacaggttctcccacatcccctctgaatgcagagaagctcgagagcgaagaggacgtctcacaggcattcctggaggcagtcgcggaggagaaacctcacgtaaagccctatttttccaagacgatccgggacctcgaagtggttgaaggaagcgccgcacggtttgactgcaagatcgaaggttatccagacccggaagtcgtgtggtttaaggacgaccagtctatcagagagtcacggcattttcagatcgattatgacgaagacggaaactgctccctaattattagtgatgtgtgcggggatgacgatgcaaagtacacatgtaaggccgtgaacagtcttggggaagccacatgcaccgccgagttgatcgtggagactatggaagaaggtgagggggaaggcgaggaggaggaggagta

SEQ ID NO: 29650 - DNA, 2145 bp, Artificial Sequence
  Description of Artificial Sequence: Synthetic coding sequence
atgaagtctaggagacccaagtcaagcttaccgccagtcctgggtaccgagagtgacgcaaccgtgaagaagaagcccgcaccgaagaccccccctaaggcagcgatgcctcctcagataatccaatttccagaggatcagaaagtcagggccggagagtcagtggagctcttcggcaaagtcaccggaacacaacctattacttgcacctggatgaaatttaggaagcagattcaggagagtgaacacatgaaggttgagaacagcgagaacggctcgaaattgacaatcctggcagctagacaggagcactgcggatgttataccctcctggtggagaacaagctgggttctcgacaagcccaggtgaaccttactgtggtggataaacccgatccccctgccggaactccctgcgcaagcgacattaggtcatcaagcttgacactgtcctggtacggatcatcgtacgacggaggctctgccgtacagtcatatagcattgagatatgggattccgccaataaaacctggaaggaactggctacttgtagatcgaccagtttcaatgttcaggatcttttgccagaccacgaatacaagtttcgggtcagagccattaatgtttacggtacgagcgaaccttctcaggagagtgagctgacgaccgtcggggagaaacccgaggaacccaaagacgaggtcgaagtgagtgacgatgacgaaaaagagccggaggtggattatagaaccgtgactattaatactgaacaaaaagtgagcgacttttatgatattgaagaacgtctgggcagcggcaagtttgggcaggtgttcagacttgtcgaaaaaaagaccaggaaagtctgggcgggaaaattcttcaaggcctactcggctaaggagaaggagaatattagacaggaaattagtatcatgaattgcttacatcaccccaagctagtacagtgcgtcgatgctttcgaagagaaagctaatatcgttatggtactcgaaattgtgagcggtggagagctgttcgagagaatcatcgatgaagatttcgaacttactgagagggagtgcatcaagtacatgaggcagattagtgaaggtgtcgaatacatccacaagcaggggatcgtccacctggatctgaaacccgaaaacattatgtgtgtgaataagacggggacccgcatcaaactgattgatttcgggctggcgaggcggctagaaaacgctggatccctgaaggttttatttggcaccccagagttcgtggccccagaagtcatcaactacgagccaatcggatatgcaaccgacatgtggagtattggcgtcatatgctacatcttggtatctggattatctccttttatgggggacaatgacaatgagactcttgccaacgttacatctgctacttgggactttgatgatgaggcattcgatgaaatcagcgatgacgccaaagacttcattagtaacctgctgaagaaagatatgaagaatcggctggactgtacacagtgtctccaacatccatggctgatgaaagacacaaagaatatggaggccaagaaactgtctaaagaccgaatgaagaagtacatggccagacgcaaatggcaaaaaacagggaacgcggtgagagctatcggtcgactttcttccatggccatgataagcgggctgtcgggacgcaaaagcagcacaggatcccccacctccccactgaacgcagagaagctcgaaagcgaagaggatgtgagtcaggccttcctggaggccgttgctgaggaaaaaccccacgttaagccatactttagcaagactatcagggacctggaggtggtggagggctctgcggctaggttcgactgcaaaattgaagggtatccagatccggaagtcgtgtggttcaaggacgatcagagcatccgggagtcccgccattttcagatcgattatgatgaggacggcaactgctcactaatcatcagcgatgtgtgtggggatgacgatgccaagtatacgtgtaaagccgtgaacagccttggcgaggccacatgcacagccgaactgattgtcgagaccatggaggaaggtgagggcgagggcgaagaggaagaagagtag

SEQ ID NO: 29651 - DNA, 5591 bp, Artificial Sequence
  Description of Artificial Sequence: Synthetic coding sequence
atgggagacgtcaagctggttgcaagtagtcacatctcgaaaacaagtctgagcgtcgacccttcccgcgttgactctatgcccctcactgaagctccagccttcattcttccacccagaaatctgtgtataaaagagggcgcaaccgcgaagttcgagggccgagtgaggggatatccagaaccgcaagtgacctggcataggaacgggcagccgatcaccagcggcggacgctttctgttggattgtggtattagaggtacttttagccttgtgatccacgcggtacatgaggaggataggggcaaatacacctgcgaagctacaaatggctcaggagccagacaggtgacagttgagctcactgtcgaaggttctttcgctaagcaactgggccagcccgtcgtttcaaagactttaggtgacaggttctctgcccctgcagtcgaaacccgccctagtatctggggggagtgccctcccaaattcgcaacaaagctgggcagagtggttgtgaaggaggggcagatggggaggttctcgtgcaaaatcactggcagaccccagccacaagtaacttggcttaaagggaatgtgcctctccagccatccgcaagagtctccgtgtcagaaaagaacgggatgcaggtgttagaaattcacggcgttaatcaggacgacgtgggcgtctacacatgtctcgtggtgaatgggagcgggaaagcatctatgtccgctgagctgtcaatccaaggtttagatagcgcgaatcgctcattcgtgagggagaccaaagctaccaattcggacgtgcgcaaagaggtcactaatgttataagcaaggagtctaagctcgactccctggaagcggctgctaagagcaaaaactgttccagcccccagcggggtggctctccaccttgggcggctaactctcaaccacagccccctcgggagtccaaattggagagctgtaaagacagtccccgtaccgccccacagactccagtattacaaaaaacgtcctccagtatcactctgcaggccgctagggtgcaacccgagcccagggctccagggctcggcgtgcttagtccatccggagaggagcgaaagaggcctgcaccgcctcgccctgccacattccctacacggcagccgggactgggctcgcaggatgtggtgtccaaggccgctaaccgcagaatccctatggagggccaacgcgactccgccttccccaagttcgaatctaaaccccagtctcaggaagtcaaagagaatcaaacagtgaaattccgttgcgaagtttcaggtataccgaagcccgaagtagcttggttccttgagggcaccccagtccgcaggcaggaaggctctatcgaggtctatgaagacgcaggcagccactacctctgtttgttgaaagcgaggacgagggattcaggcacctatagctgtacagcaagcaatgcccaaggtcagctaagctgttcttggaccttacaggtcgaacgtctcgccgtgatggaagtagctccttccttcagtagtgtcctcaaggactgtgccgtaatcgagggccaggatttcgtgctgcagtgctctgtgagaggtactccagtccccagaataacctggctgctcaacggccagccaatccaatacgcaagaagcacctgcgaggccggagtggctgaactgcacattcaagacgcccttcctgaggaccacgggacatatacctgtctggccgagaacgccctcggccaggtgagttgttctgcatgggtaacggtgcacgagaaaaagagctccaggaaatctgagtacctgctgcccgttgcaccctcaaagcccacggccccaatttttcttcaagggctgtcggatctgaaggtgatggacggatctcaggtgactatgacagttcaagtgagtggcaaccctccaccagaggtcatatggttgcataacgggaacgagatccaagagagcgaggatttccacttcgaacaacgagggactcagcactccctgtgcatccaggaggtattccctgaggacactggtacttacacctgcgaggcatggaatagtgcaggcgaggtgaggactcaggcagtcctgacggtgcaggagccacatgacggcactcagccctggttcatttccaaaccgaggtctgtcactgcgtcactggggcaaagtgtgctaatttcatgtgcaattgcgggagacccgttccctaccgtccactggcttcgtgatggcaaggctctgtgtaaggacacaggccactttgaagtcttgcagaacgaggatgtattcaccctcgtgctcaagaaggttcagccttggcatgccggtcagtacgaaattctgttgaaaaatagggtgggcgaatgcagctgtcaagtctccttgatgctgcagaattcgagcgcgagagccctaccacggggacgggagcctgcgtcttgtgaagacctttgtgggggaggggtgggggctgacggaggaggcagcgacaggtatggttcgttgaggcccggatggccagctcggggtcagggctggctggaggaggaagacggagaagacgttagaggcgtgctcaaacggagagtcgagacacgccagcatactgaggaggcaattcgccaacaggaagtggaacagctggacttcagagatctgctgggtaagaaagtgtctacaaagacactctctgaggacgatctgaaagaaatcccagctgagcagatggactttagagccaatctccaaagacaggtcaagcctaagactgtatccgaggaggagcggaaggttcatagtccgcaacaggttgatttcagaagtgtgttagctaaaaaaggaacctccaagaccccagtacctgaaaaagttccccctcctaagcctgccacccccgacttccggtcagtgttgggcggaaagaagaagttaccagccgaaaatggatcgtcctcagcggagaccttgaacgccaaagcagtggagtcctcaaagcccctaagcaatgcacagcccagcggacccctgaagcccgtaggtaacgccaagcctgccgagactctgaaacccatgggcaatgctaaaccagctgaaacactgaaaccaatgggaaacgccaagcccgacgaaaacctcaaatccgcctccaaagaagaactgaaaaaagatgtgaagaacgatgtcaattgcaagcgcggtcacgccggaactactgataatgagaagaggagcgagtcccaggggactgccccagccttcaagcagaaactgcaggacgttcatgtggcagagggaaagaagctgctcctgcagtgtcaggttagctcagatcctcccgcaactatcatctggactctgaatgggaagacattgaaaaccactaagttcataatcctatctcaggagggctccctgtgttccgtctccatcgagaaagctctccccgaagatagggggctgtacaagtgtgtggcaaagaacgacgcaggacaggctgagtgctcttgccaggtgacggtagatgatgctcctgcttcggaaaacaccaaagccccagaaatgaagagccggagacctaagagcagcctccctcctgtgcttggtaccgaatccgacgcaacagtgaaaaagaagccagcaccaaaaactccccctaaggcagcgatgcctccacagatcatccagtttccagaagatcagaaagtacgggctggagagagcgtagagctgtttggaaaggtcacaggaacccagcctatcacgtgtacctggatgaagttcaggaagcagatacaggagagcgagcatatgaaggtggagaatagtgagaacgggagcaagcttactatcttagccgcaagacaggagcactgtggatgctatactctgctggtggagaacaagctggggtcacgtcaggcgcaagtcaatctgaccgtcgtggataagcccgatcctcccgcaggcacaccctgcgcatccgacatcaggagctctagcctgacactgagctggtatgggtcttcatacgacggcggaagcgctgtccagtcgtatagtatagaaatctgggatagtgcaaacaagacgtggaaggaactggcaacctgcagatccacctctttcaatgtgcaggacctgctacccgatcatgagtataaatttagggttagagctattaacgtttacggcacaagcgagccgagccaggaatctgagctaacaaccgtgggagagaaacccgaggagcctaaggacgaggtcgaagtctcagatgatgatgaaaaggaaccagaggtcgattaccgtactgtcacaattaacacagaacagaaggtctccgatttctatgacatagaggagcgcctggggtctggcaagtttggccaagtttttaggctggtcgaaaagaaaaccagaaaagtatgggccggaaaattctttaaggcctattctgccaaggagaaggagaacatacgtcaggagatatcgataatgaattgtctgcatcaccccaagctggtacaatgcgtggacgcttttgaggaaaaagccaatatcgttatggtgttagaaatcgtgtcagggggagagttgttcgagcgcatcatagacgaggatttcgagttaaccgagagggagtgcatcaaatatatgcgccagatttccgaaggggtggagtacattcataagcagggaatcgtgcacttagatctgaagcccgaaaacatcatgtgtgttaataagactggaaccaggatcaaacttattgacttcggcttggcgagaagattggaaaatgctggcagcctgaaggtactttttgggacccccgaatttgttgcccctgaggtgatcaattacgaaccaatcggctacgccacagacatgtggtcaataggggtgatatgttatattctgaatcggctagattgtacccagtgtctccagcacccttggctcatgaaggacacaaaaaatatggaggccaaaaaactgtcgaaagaccgaatgaagaagtacatggccaggagaaagtggcagaagaccggaaatgcagtccgagctatagggaggttatccagcatggcaatgataagtggactaagcggcagaaagtcaagcaccggaagccccacttcccctcttaatgccgagaagctggaatctgaagaggatgtttctcaggccttcctagaggctgtggctgaagagaaacctcacgttaaaccctacttttcaaagacaatcagagacctcgaagtggtcgaaggcagcgctgcgagatttgattgtaaaatcgaagggtacccggaccctgaggtggtctggtttaaggacgatcagtcaattcgagaatcccgccacttccagatcgactatgatgaagatggcaattgcagcctaatcatttctgacgtgtgtggcgatgacgacgccaagtacacatgcaaagccgtgaattctctgggcgaagctacctgcacggctgaattgatcgtggagacaatggaagagggcgaaggagaaggagaagaagaggaggaata

SEQ ID NO: 29652 - DNA, 5744 bp, Artificial Sequence
  Description of Artificial Sequence: Synthetic coding sequence
atgggggacgtcaagctggtggcaagctcccatatctccaaaacctcgttgagcgtggatcctagccgggtggactcaatgccccttaccgaggcgcctgcctttatactaccaccaaggaatctctgcatcaaggagggtgctacggctaaattcgaaggtcgggtcagaggttatccggagccgcaggtaacctggcaccgaaacggacaaccaataacaagtggaggtaggtttctcttggattgtggcatacggggaacattcagtctggtaattcacgctgtccacgaggaggaccgaggaaagtacacctgcgaggctacaaacggcagtggtgccaggcaggttaccgttgagctgactgtggaaggaagctttgctaagcagctgggccaacctgttgtgtccaagacactgggcgatcggttttctgcgcctgcggttgagacccggccttccatctggggcgagtgccctcctaaattcgcaaccaagcttggacgggtggtggtcaaagaagggcaaatggggagattttcatgtaagatcaccggcaggccacagcctcaggtgacatggttaaagggaaatgttcccctccagccgtccgccagagtgtcagtttcagaaaagaacggcatgcaggtactcgagattcacggggtaaatcaagacgacgtgggggtgtacacatgtctggtggtgaacggaagtggaaaggcctctatgagcgccgaactgtccatccagggactagactccgctaatcgatctttcgtaagggagaccaaagcaaccaatagcgacgttcgtaaggaggtaacaaacgtcattagcaaggagagcaaacttgacagcctcgaggctgccgctaaatctaaaaattgctcatcaccccagcgtgggggaagccccccttgggcggcaaactcgcagcctcagccccctcgcgagtccaaactagaatcctgtaaggacagtccacgcaccgctcctcagacaccagttctgcaaaagacttcatccagcatcacgctacaggccgctagggtgcaaccagagcccagagcgccaggattgggggttctatccccaagcggtgaggaacgtaaaaggcccgctcctcccagacccgcaacttttcccacgaggcagcccggtcttggaagccaagacgtagtctctaaggctgccaatcggagaatccccatggaggggcaacgagatagtgcattccctaagttcgagtcaaaaccccagtctcaggaggtcaaagaaaaccagactgttaagttccggtgcgaggtgtcaggtattcccaagcctgaagtggcttggttccttgaagggacccccgttcggaggcaggaaggatcaatcgaggtatatgaagacgctgggagtcactacttgtgtctcctgaaggcccgaacaagggattctgggacctatagctgtaccgctagtaacgcgcaaggccaactctcatgtagctggacattgcaggtagagcgtctggcagtcatggaggtggcgccaagtttttctagtgtcctcaaggattgcgcagtcatcgaagggcaggatttcgtcctccagtgtagtgtaaggggcacgccagtacctagaattacttggctgctcaatggacagccaatccagtacgcacggtctacttgtgaggctggggtggcggagcttcacattcaggatgctctgcccgaagatcacggcacctacacctgcttggccgagaacgccctgggtcaggtgtcttgctccgcctgggtgactgtccacgagaagaagtcaagtcgtaaatcagagtacttgttacccgtcgctcccagtaagcctacagcccctattttcttgcagggattgtctgatcttaaggtcatggacgggtcccaggtaaccatgactgtgcaggtctccggtaacccccctccagaggttatctggttgcataatgggaacgagattcaggagagcgaggatttccactttgagcagcgcggtacccagcattccctgtgtattcaggaggtgttccctgaagacaccggcacttatacgtgcgaagcatggaatagcgcgggtgaggtacggacccaggcagttctcacagtccaggagcctcacgacggcacccaaccctggtttatctccaagccacggagtgtgacagcctcgctgggacagagcgttctgattagctgcgcaatcgccggagaccccttcccaactgttcactggttgcgcgatggaaaagcactgtgcaaagatacgggtcatttcgaagtcctgcaaaacgaagacgtgttcacgctggtactcaaaaaagttcagccttggcacgctgggcagtacgagattctgctgaagaaccgagtcggcgaatgctcttgtcaggtgtctttgatgcttcaaaactcatccgcacgtgcactccctcgcggacgtgagcctgccagttgcgaggacttgtgtgggggtggtgtgggggcagatggcggtgggtccgataggtatggttcactcaggcccggttggcccgctcgaggacagggatggttggaagaggaggacggggaggacgtacgaggcgtgctgaagcggagggtagaaaccaggcagcacactgaggaagccatccggcaacaggaagtcgagcagcttgactttcgcgacctcttgggcaagaaggtgagcactaagacactttctgaggatgacctgaaggagataccggcagaacagatggatttcagggcgaatcttcaaaggcaagtcaagcctaaaacggtgtccgaggaagaacgcaaggtgcattcacctcagcaggtggattttcggagcgtcttggcaaagaaagggactagtaagacacctgtacccgaaaaagtgccacctcctaagcccgcaactccggatttccggagtgtcctcgggggtaaaaaaaagctgcctgcggagaacgggtcgagtagtgccgagaccttaaatgcaaaggccgtggaaagctctaaaccactcagcaatgcgcagcccagtgggccactgaagcctgttggaaatgcgaagccagctgaaaccctcaagccgatggggaatgccaagcccgctgaaactctaaagcctatggggaacgcgaagcctgacgaaaatctgaagagcgcctctaaggaagaattgaagaaggacgttaagaatgacgtgaattgtaagcggggacatgccggtacgacggacaatgaaaaacggagcgagtcccagggaactgccccagccttcaagcagaagctgcaggatgtccatgtagccgagggcaagaagctccttttgcagtgccaagtatcctccgacccgcctgccaccattatctggacgctcaatggaaaaactttgaaaacaaccaagtttatcatcttgagccaggagggctcgctgtgcagtgtgtccatcgaaaaggcccttccagaagaccggggtttatataaatgcgtggcaaaaaacgacgccggtcaggctgaatgttcgtgccaagtcacagtcgacgatgccccagcatccgagaacactaaggcccctgagatgaagagtaggcgccctaaaagcagcctgcccccagtgttagggactgagagtgacgccacagtgaagaagaagcctgcacccaagactcctcctaaggcagccatgcctcctcagatcatacagtttccggaggaccagaaagttcgcgctggggagtctgtcgagctgttcggtaaggtaaccggcacccagcctatcacttgcacctggatgaagtttaggaaacagatacaggaatcggagcatatgaaagttgagaattcagaaaacggctctaagctaaccatcctggcagccagacaagagcactgcggctgttacactctcctggtggaaaataaacttggctcgcgacaggcccaggtgaacctaacagttgtggataagcctgacccccctgcaggaactccatgcgcgagcgatatccgaagcagctccctcactctgagttggtacggttcttcctatgacgggggatcagctgtccagagttattccatcgagatctgggactcagcaaacaagacttggaaagagctcgccacttgccggagtacttcttttaatgtgcaggacctgcttccagaccacgagtacaagttcagagttagagccatcaacgtgtatggaacaagcgaaccctcacaagagagcgagctcacaaccgtgggcgaaaagcccgaggagccaaaagacgaagtcgaggtgtccgatgacgatgaaaaagagccggaggtagattatcggacggtcacgattaatacagaacagaaagtgtcagacttttatgacatagaagaacgattaggctcagggaagttcggccaggtctttaggctagttgaaaaaaagacccggaaggtctgggccggtaagtttttcaaggcgtatagcgcaaaggaaaaagagaacatcaggcaggagataagtattatgaattgcctccaccaccccaagctcgtgcagtgcgtggatgcattcgaggaaaaggctaacatcgtgatggtccttgagattgtatccggcggtgagctctttgagagaatcatagatgaagatttcgaactaacggaaagggagtgtatcaagtatatgagacagatcagcgaaggagtggaatacatccacaagcaggggatcgtgcatctggacctgaaaccggagaatataatgtgtgtgaacaagaccgggacaaggatcaaactgatcgacttcggcctggccaggcggctggaaaacgccggaagtctgaaggtgttattcggaactcccgaatttgttgcacctgaagtgattaattatgagcctatcgggtacgctacagacatgtggagcatcggtgttatctgctatatccttgtttcgggacttagtccattcatgggggataatgataatgagactctcgctaacgttacgtcagcgacctgggatttcgatgacgaagcgtttgacgaaatcagtgatgatgctaaagacttcataagtaatctgctgaagaaagatatgaagaatcgcctggattgcacgcagtgtttacaacacccgtggctcatgaaggatactaagaatatggaagcaaagaagctgtcgaaagatcgcatgaaaaaatatatggccaggagaaagtggcagaaaactggtaatgccgtgagagctatcggacggttgagtagcatggctatgattagtggactcagcggacgcaaaagctcgaccggaagtcccacttcacctttaaacgcggagaaactggagtcggaagaggacgtgtcccaagctttcctggaggcagttgctgaggaaaagccacatgttaagccctacttctcgaagactatccgagatctggaggtggttgagggctccgcggcaagatttgactgcaagatagagggataccccgacccggaggtggtttggttcaaggatgatcagtccattcgggagtctcgacactttcaaatcgattacgatgaggacggaaactgttccttgatcataagtgacgtgtgtggggacgacgacgcgaaatacacttgtaaggcggtgaattcgcttggtgaggccacctgtactgctgagctcattgtggaaacaatggaggagggcgagggagaaggtgaggaagaagaggagta

SEQ ID NO: 29653 - DNA, 231 bp, Artificial Sequence
  Description of Artificial Sequence: Synthetic coding sequence
atgggtgatgttaaactggtggcgtcttcccatatctccaaaacatcactgtcggttgacccatcacgggtggacagcatgcctctgactgaggccccagctttcatcctgccccctcggaatctgtgcatcaaagaaggtgcaaccgctaagttcgagggacgcgtgagggggtaccccgaaccccaggttacatggcaccgcaatggccagccaataacatcaggatag

SEQ ID NO: 29654 - DNA, 5591 bp, Artificial Sequence
  Description of Artificial Sequence: Synthetic coding sequence
atgggagacgtgaaattggttgcgtccagtcatatttcgaaaacgtcactgagcgtagacccatcccgcgtggactccatgcctctgactgaagcgccagccttcatactgccccctagaaacttgtgcattaaagaaggcgctaccgccaaatttgaaggcagagtaagaggttacccagagccgcaggttacatggcacaggaacggccaacctatcacaagtggcggacgatttttactggactgcggcattcgtggcacattctcattggtcattcacgctgtgcatgaagaggacagaggaaagtacacatgtgaggccaccaacggtagtggcgctaggcaggtgactgtcgagctgaccgtcgagggcagcttcgctaagcagttgggccagcccgtggtctctaaaacattgggcgatcgcttttcggcccctgctgtggagactcgccctagcatttggggcgagtgtcctccaaaattcgccacaaaactcggaagagtcgtggtcaaggagggccagatgggccgattttcctgtaagatcacagggcgtccccagccacaagtcacttggctgaagggcaacgtgccactccaaccctctgcccgagtgtctgtatctgaaaaaaatgggatgcaggtgctcgaaatccacggcgtgaaccaggacgacgtgggggtgtacacgtgtctcgtggtgaacggctctgggaaggccagtatgtcagcagagctatccatccagggtcttgattcagcaaaccgttcctttgtcagggaaacaaaggcaactaattccgacgtccggaaagaggtcacaaacgtgatcagtaaagagtccaaacttgacagcctggaagccgctgccaagtctaaaaactgttcttcaccacagagagggggttcacccccttgggctgcaaattctcagccccagccacctagagaatccaaattagaatcatgcaaggattccccgagaaccgcaccacagacgccagtgttgcaaaaaacctcttcttcaatcactctgcaggcagcaagagtccagccagaaccgagggctcccggactcggcgtcctgtccccctcaggagaggaacgcaaacggcctgcacccccacgccctgccacatttcctacaaggcagccgggactggggagccaagacgtcgtgtcgaaagctgccaaccggagaatccccatggagggccaaagggactctgcatttcccaagttcgagtcgaaacctcagagccaagaggtgaaggaaaaccagactgtcaaatttaggtgcgaggttagcggtattcccaagcctgaggttgcctggttcttagagggcacaccggtcaggcgacaggaaggctcgatcgaagtgtacgaggatgccggtagtcattacctttgcctcttaaaagcacgcacccgcgactccggcacatattcctgcacggcctcaaacgcccagggccagctctcatgttcttggactcttcaggtagagcgtttggcagtaatggaagtggctcctagcttttcctcagtcctcaaggattgcgccgtgatcgagggccaggatttcgtgttgcaatgttctgtgcgcggaacaccggtccctaggatcacctggcttttgaacggccaaccaatccagtacgcacgctccacctgcgaggccggagtggccgagctgcatatccaggacgctctgccagaagaccatgggacttatacatgtttagccgagaatgctcttggacaagttagctgtagcgcgtgggtgactgtacatgagaagaagagtagccggaagtccgagtacttgcttcccgttgccccatcaaaacctaccgcaccgattttcctgcaaggcttgagcgaccttaaggtaatggatggttcccaggttaccatgacggtacaggtatcaggcaacccccctcctgaagtcatctggctgcataacgggaacgagatacaggaatcagaggacttccactttgaacagcggggtacccaacactctctctgtatccaagaggtctttcccgaagataccggcacctacacctgtgaggcctggaattcggccggtgaggttcgcacgcaggccgtcctgactgtccaggaaccccacgatggaacccaaccctggttcatttccaaacctaggagcgtcacagccagccttggccagtctgtgctgatctcctgcgccattgctggtgatccatttccaaccgtgcactggctccgtgatggaaaagctctttgcaaagataccggccacttcgaggtgctgcagaacgaagatgtgttcaccctggtcctcaagaaggttcagccctggcatgccggtcagtatgaaatactccttaagaacagggtcggtgaatgcagttgccaggtctccttgatgctccagaattcatcagctcgggctctgccaagggggcgagagccagccagttgcgaagatttatgtgggggtggggtgggtgcagatgggggaggatccgataggtatggcagcctcaggcccggatggcccgctcgcggtcagggttggttagaagaggaggatggcgaggatgttcgcggtgtattaaagaggcgtgttgagacgcgccagcacacagaagaggctatccgtcagcaagaagtggaacagctggacttccgagacctcctgggaaagaaagtgtctacaaaaactttgtccgaagacgatttgaaagagatacccgcagagcagatggactttcgcgcaaatctccagcggcaggtcaagccaaaaaccgtctctgaagaagaacgtaaggtgcatagtcctcagcaggtcgacttccgctctgtactcgctaagaaaggaacatccaagacacctgtcccagaaaaggtgcctcctcccaagccggcaacccccgatttcagatctgtcctggggggaaaaaaaaagctgcccgctgagaatggttctagctccgcagagactttgaatgctaaagcagtcgagtcatccaagccgctgtcaaacgcacaaccaagcggcccacttaagcctgtggggaacgccaaacctgccgagacacttaagcccatgggcaacgcaaagcccgcagagaccctgaagcctatgggaaacgcaaagccagatgaaaacctgaagtctgcgtcaaaggaggagcttaagaaggatgtgaagaacgatgttaattgcaagagagggcatgccggtacaacggataacgaaaagaggagtgaaagtcagggtacggcgcctgcgtttaagcagaagctccaggacgtccatgtggctgaggggaaaaagcttctccttcagtgccaagtgtcatcagatcctccagccacaatcatatggactcttaacgggaagacactgaaaacaactaagttcatcatcctgtcccaagagggcagcctctgctcagtttccattgagaaggctctgcccgaagaccgcggattatacaaatgcgtcgctaaaaacgatgccggacaggctgaatgcagttgccaagttacagttgacgacgctccagccagtgaaaatactaaggcacccgagatgaaaagccgcaggcccaagtcctctctcccccctgttctgggtaccgagtcggatgctactgtgaagaagaagcctgctcccaaaacaccaccgaaggcagctatgcctcctcaaataattcagtttcccgaagaccagaaggttagggccggagagtccgtggagctattcggcaaggttacggggacgcaacccatcacatgcacctggatgaaatttcgcaagcagatccaggagtcagaacacatgaaggtggagaatagcgagaatgggtctaagttgacaatcctcgcagcaaggcaggaacactgtggttgttacactctgcttgttgaaaataagctgggctccaggcaagctcaggtcaatctaaccgtggttgataagcccgatcctccagctgggacaccgtgcgcctctgatatccggtcatcgagcctcaccctgtcatggtacggtagttcttacgatggcggatccgctgttcagtcatattcaatcgagatctgggattccgctaataaaacctggaaagagcttgccacatgcaggtcgacgagctttaacgttcaggacctgctgccagatcacgaatataagttcagggtccgggctatcaacgtctacggtacctcggaaccgtctcaggagagtgaactgacaacagtaggcgagaagcccgaagagccaaaggacgaagtcgaggtttctgacgatgacgagaaagagccggaggtggattaccgtaccgttacaataaacactgagcaaaaggtgagcgacttttatgacattgaagaaaggctcggctcaggaaaattcgggcaggtgttcaggctggtggaaaagaagactagaaaggtgtgggccggaaagttttttaaggcttacagcgcaaaagagaaagaaaatatccgacaggaaataagcatcatgaactgcctgcaccaccccaagcttgtccagtgcgtggacgccttcgaagaaaaagctaacattgttatggtacttgagatagtctccggaggagaactgtttgaaagaataatagatgaggactttgaactcacagagagagagtgcataaaatatatgcgccagatttccgagggggttgaatatatccacaaacagggaattgtacacctggatcttaaacctgagaatattatgtgtgtgaacaagaccggcactagaattaagctcatcgacttcggtctcgccagacgtctcgaaaatgcagggtctctcaaggtgttatttggcacgcccgaatttgtcgctccagaagtgataaactacgaaccaattggctacgcaaccgacatgtggagcataggagtgatttgttatatcctcaatcggctcgattgtacacagtgcctgcagcacccttggctgatgaaggacacaaaaaacatggaggcaaaaaagctcagcaaggaccgaatgaagaaatacatggccaggcggaagtggcagaagacaggcaacgcggttagagcaattggcagactctcttctatggccatgatctccggtctgagcggacgcaagtcttcaacaggctcgcccacctcaccacttaatgcggaaaagctcgagtcagaggaggacgtgagccaggcctttttggaggccgtggccgaggaaaagcctcacgtaaagccatacttctcaaagactatcagagacctagaggttgtggaagggtcagccgcacgctttgattgcaaaattgaaggttacccggatccggaggtggtgtggtttaaagatgatcaaagcatcagggaatctcggcacttccagatcgattacgacgaagacggtaactgtagtctgatcatcagcgacgtgtgcggagatgatgatgccaagtacacttgtaaagccgtgaactctctgggggaagcgacctgtacggccgaattgatcgtagagacaatggaagagggtgagggggagggagaagaagaggaggagta

SEQ ID NO: 29655 - DNA, 465 bp, Artificial Sequence
  Description of Artificial Sequence: Synthetic coding sequence
atggcaatgataagcgggctttcaggacggaagagcagcacaggctctccaacctcccccctgaacgccgaaaagttagagtcagaagaagatgtctcgcaggccttcttggaggcagtggccgaggagaaaccgcacgtgaagccatacttcagcaagactatcagggacctcgaggtggtggagggcagcgccgcacggtttgattgcaaaatcgaaggttacccagatcctgaggtcgtgtggttcaaggacgatcaatctattcgagagtcgcgtcacttccagattgactatgatgaggacggcaattgcagcctgatcatcagcgatgtctgtggggacgacgatgccaagtacacatgcaaggcagtgaactccttgggggaggccacctgtacggccgagcttattgttgagacaatggaagagggagagggagaaggggaagaggaagaagaatag

SEQ ID NO: 29656 - DNA, 5744 bp, Artificial Sequence
  Description of Artificial Sequence: Synthetic coding sequence
atgggcgacgttaaactcgtggcaagctcgcacatttcgaagacgtcattgtcagtagatcctagccgggtagacagtatgcctctcactgaagccccagcattcatactccccccacgcaacctctgcatcaaggagggcgctactgctaagttcgaaggtagggtgaggggataccctgaaccccaggtgacttggcatagaaatggacagcctattacttcgggtgggcgtttcttactggattgtggcatacggggaacctttagcttagtaattcacgccgtccatgaggaagacagaggcaagtatacttgcgaggccacaaacggaagtggggctcgccaggttaccgtggagcttacagtggagggctcatttgccaagcagctcgggcagccagtcgtgagcaaaacgcttggggataggttcagtgctccagcagtggaaacaagaccttcgatctggggtgagtgcccccctaagtttgctaccaaattgggtagggtggtcgtgaaggaaggtcaaatgggcagattttcctgcaaaataaccgggagacctcaacctcaggtcacatggcttaaggggaatgttcctctgcagcccagtgcacgcgtttccgtatctgagaagaatggcatgcaggtgctcgaaatacacggggttaaccaagacgacgtgggtgtctacacatgcctggtggtcaacggcagcggaaaggcctctatgtccgcagagctgagtattcagggactggactccgcgaaccgttcgtttgtgcgggaaacgaaggcgaccaatagcgatgtcagaaaagaagtaaccaacgtcatatccaaggagagcaagctggattcactggaggctgcagccaagagtaagaactgttcaagcccacagagaggcggttctccaccttgggccgcaaatagccaaccgcagccacccagagaaagtaagctggaatcttgcaaagattctcctaggaccgctccgcagacgccagtactccaaaaaacatcttcatccatcaccttgcaagccgctcgggtacagcctgaaccacgggcacccggactgggagttttatccccgagcggtgaggagcgtaagcgcccagccccacctcgccctgcaacgtttcccacacgacagccaggtctgggctcccaggacgtggtgagtaaggcagccaataggaggatcccaatggagggtcaacgtgacagtgccttccctaagttcgagagcaaaccccagagccaggaagtgaaagaaaatcagaccgtcaagttccgatgtgaagtctcagggattcctaagcccgaagtcgcttggttcttggagggtacccctgtgcggagacaggagggatctatagaagtttatgaagacgccggttcccactacctctgtctcctaaaggctagaacaagggactccggcacatacagttgtacagcgagtaatgctcagggccaactttcttgtagctggacgctgcaggtcgaaaggttggcggtaatggaagtcgccccttcattctcaagcgttttgaaggactgtgcagttatcgagggccaggattttgtcttacagtgctccgtgcgcggtacaccagtgcccagaattacatggttactgaatgggcagcctatccaatatgctcggagcacttgtgaggccggtgtggccgaactgcacatacaggatgcactgccagaagaccacggtacctacacttgtctggccgaaaacgcactggggcaagtgtcatgttcagcttgggtcaccgtgcacgaaaaaaaatcctctcgcaagagcgagtaccttctccccgtcgcaccctccaaacccaccgccccaatttttctgcagggcctgtcagatctaaaagttatggacggctcccaggttacaatgactgtgcaggtgtcaggcaacccacccccagaagtcatatggctccataatggcaatgaaattcaagagtctgaggatttccatttcgagcagcggggtactcagcacagcctatgcattcaggaagtgttcccggaggacaccggtacctatacttgcgaagcgtggaactcggcgggagaggtccggacgcaggcggtcctgacagtgcaggagcctcacgacggtactcagccttggttcatctctaaacctcgtagcgttaccgcatcacttgggcaaagtgttctcattagctgcgcaatcgctggcgaccccttccccaccgtgcactggctacgtgacgggaaggccctttgtaaggacacaggtcatttcgaagttcttcagaatgaagatgtgttcactctcgttctcaaaaaggtccagccctggcacgcaggacaatatgaaattctactgaagaatcgcgtgggagaatgcagctgccaagtctctctgatgctacagaactctagtgctagagcactgccgcgaggacgcgaacctgcctcctgtgaggacctctgcggagggggtgtaggggcagacggaggtggaagtgaccggtatggaagtctgagacccggatggcctgcccgagggcagggttggctagaggaggaagatggagaggacgtacggggtgtactaaaaagaagagtggagacaagacagcacaccgaagaagccattcgtcagcaagaggtcgagcagctcgactttagagatctgctgggtaagaaggtttccacgaaaacgctgagtgaagacgatctgaaggagatccccgctgagcagatggactttcgcgcaaatctccaacgacaagtgaaacctaaaacagtatctgaggaggagcgcaaggtgcacagccctcagcaggtggactttcggtccgtgctcgccaagaaagggaccagcaaaactcctgtgccggagaaagtgccacctccaaagcctgccacaccagatttcaggtccgtgttagggggaaagaaaaagttgcctgctgaaaatggaagttcaagcgctgagaccctaaatgcgaaggctgtggaaagctctaagccgttgtctaatgctcagcccagtggcccacttaagcccgttggaaacgcgaagcccgctgaaaccctgaagcctatgggaaatgctaaaccagctgagacccttaaacctatgggtaatgcaaaaccagatgaaaatctcaagtcagcttccaaagaagaactaaagaaggatgtaaagaatgacgtgaattgcaagagaggtcatgcagggacaacagataatgagaagagaagcgagtcccaagggacagccccagcctttaagcagaaactccaagatgtgcacgtggcggagggcaaaaaactcttgctgcaatgtcaggtgtcaagtgatccccctgcaaccatcatctggaccctgaacgggaagaccttgaagacaacgaaatttattattctgtctcaggaaggatccctgtgcagcgtatccattgagaaagcattgccagaagacaggggtttatataaatgcgtggccaagaatgatgcgggacaggcggaatgcagctgccaggtcactgtagacgatgcacccgcaagcgagaacacgaaagcgcctgagatgaagagcagaagacctaagtcctccttgccccctgtactgggcacagagagcgatgcgacggtgaagaagaagcctgccccaaaaactcctcctaaggctgctatgcctccacagattattcagttccccgaagaccagaaggttagagccggagaaagtgtggagttgttcggaaaagtcacaggcacccagcccatcacctgtacatggatgaagtttcgaaagcagatccaggagtccgaacacatgaaagtggagaattctgagaacgggtccaagctgactattctagccgctcgccaggaacattgtggctgctatacactcttggttgagaataagcttgggtcacgtcaagcccaggtcaacttgaccgttgtcgacaaaccggatccccctgcaggaactccgtgtgctagcgacattagatcgtcgtcattgacactgtcctggtacgggagctcctacgatgggggttcagcagtacagtcttatagcatcgaaatctgggactctgctaacaaaacttggaaggaactggccacctgccgcagtacatccttcaatgttcaagatctgcttcctgaccacgaatacaaattcagggtgcgagctatcaatgtgtatggcacaagcgagccttctcaagagagtgagctgaccactgtaggagaaaaaccagaggagccgaaagacgaggtagaggtgtccgatgatgacgagaaagaaccagaggtggattatcgcacagtgaccattaataccgagcagaaagtgtcagatttttatgacattgaagaaaggctaggatccgggaagttcggccaggtgttccgccttgtggaaaagaagactcggaaggtttgggcagggaagttcttcaaggcctattccgcgaaagagaaagaaaacatccgccaggagatcagcatcatgaactgcctccatcaccctaagctggtgcagtgtgtggacgcctttgaagagaaagccaacattgtgatggtgctcgaaattgtctccggcggagagctgtttgaacgcataatcgacgaagactttgaattgacagagcgcgaatgcatcaaatatatgagacagattagcgagggggtcgagtatatccataaacagggcatagtgcacttggacttgaaaccagagaatatcatgtgcgtgaataagacaggcacaagaattaagctgattgatttcggcctggccaggagactggagaatgccggatcgctaaaagtgctttttggcacacccgaatttgttgcacctgaggtaatcaactatgagccaatagggtatgctaccgatatgtggtccattggtgtcatttgttacattcttgtgtctggactttctccttttatgggagataatgataatgaaaccctcgcaaatgttacaagcgcaacctgggattttgacgacgaggcattcgacgaaatcagtgacgacgccaaagacttcatctctaacctactcaagaaagatatgaagaatcgcctcgactgtactcaatgcctgcagcatccctggctaatgaaagacaccaagaatatggaagccaagaaactctctaaggaccgaatgaagaagtatatggcaaggagaaagtggcagaagactggcaatgccgtgagagctataggacgcctgtcatccatggctatgattagtggcttgtcaggacgaaagtctagtacaggctcaccaacgagcccattgaacgccgaaaagctggagagcgaagaagatgtcagtcaggcctttctggaggccgttgcggaagagaagcctcacgttaaaccgtacttcagcaaaactatccgcgatctggaggtggtggagggaagtgcagcacgctttgactgtaaaattgaggggtatcccgaccccgaggtggtgtggttcaaagacgatcagtctatcagggaatcacgccacttccagatcgattatgatgaggatggtaattgttctctaattatctcagatgtgtgcggggatgatgatgcaaagtatacctgtaaggccgtgaactctctgggggaagcaacatgcactgcggaactgatcgttgaaaccatggaggaaggagaaggagaaggcgaagaggaggaggaata

SEQ ID NO: 29657 - DNA, 5930 bp, Artificial Sequence
  Description of Artificial Sequence: Synthetic coding sequence
atggcccagcgaacaggactggaggacccagaaagatatctcttcgtggatagggcagtgatttataatcccgcaacacaggccgactggaccgccaagaagctggtgtggatcccctctgagcgccatgggttcgaggccgcatcaattaaggaggagcgcggtgacgaggtgatggtggagctggcggagaatggaaagaaggctatggtcaataaggacgatatccagaaaatgaaccctccgaaattttccaaagtagaagacatggccgagctgacatgtctcaatgaggcatcggtgctccacaatctgaaagaccgatattatagcggattgatttacacttattcaggccttttctgcgtagtaatcaacccatacaaaaaccttcccatctattccgagaacatcattgaaatgtatcgcggtaagaaacgacatgaaatgccgccacacatatatgcaatatctgagtccgcttaccgttgtatgttgcaagatagggaagatcagtcaattctctgcactggcgagtctggagccggaaagacggagaacacgaagaaggtaatccaatatttggcacacgtggccagcagccacaaaggcagaaaagatcacaacatcccgggagagctggaaagacagctgctccaggctaaccccattctggagtcctttgggaacgctaaaaccgtgaagaacgataattcatcacggttcggcaagtttatccggatcaactttgacgtgaccggatatatcgttggcgctaatattgaaacctaccttctggaaaagtctagggccgttcgccaggctaaggacgaaaggacattccacatcttttaccaactgctcagtggggcaggtgaacacctgaagtccgacttgttgctagaggggtttaataactaccgatttctatccaatggctacattcccattcccggacagcaggataaggacaatttccaggagacaatggaagccatgcatatcatgggcttctctcacgaagaaattttgtcaatgcttaaggtggtttcatctgtcctccaattcggaaatatctcatttaaaaaagaacgcaatacagaccaggctagcatgccagagaatacagtagcacagaagctgtgtcatttgcttggcatgaacgttatggagttcactcgcgcaatacttaccccacgcattaaagttgggagagattacgtgcaaaaggcccagaccaaggagcaagcagatttcgccgtcgaggcactggcgaaagccacatacgaaaggttgtttcgatggctggtgcaccgaataaataaagccctggacaggaccaaacgccagggggcttcttttataggcattttggatatagctggttttgagattttcgaattgaatagtttcgagcagttgtgtataaactacacaaacgagaagttacagcagctctttaaccatacaatgtttatacttgagcaggaggagtatcaacgtgagggcattgagtggaactttatcgattttggcctggatctccagccctgtattgatctgattgagaggcccgctaatccccctggcgtcctcgccctgttggatgaagaatgttggttccctaaagcaaccgacaagacatttgtggaaaaactcgttcaggagcaaggatctcacagtaagtttcagaaacccaggcagctcaaggacaaggccgacttctgtatcattcactatgcaggtaaggtggactacaaggctgacgagtggctgatgaagaatatggacccgctgaacgacaacgtggccaccttgctacaccaatcctccgaccggttcgttgcagaactctggaaagacgttgaccgcattgtggggctcgatcaagtgactggtatgactgagaccgcattcgggtccgcttataaaacgaaaaaggggatgtttcggacggtgggccagctctacaaagagtcactgacgaagctgatggccacccttaggaacaccaaccctaactttgtgaggtgtatcattcccaatcacgaaaagagagccggaaagctggatccccacctggttctggatcagctccggtgtaatggcgttctggagggcattaggatatgtcgacaagggtttcctaaccgcattgttttccaggagtttaggcaaagatacgaaattctgactccgaatgctatacccaaaggattcatggatggcaaacaggcatgcgagcggatgattcgagccttggaacttgatccgaacctgtacaggattgggcagtcaaagatcttcttccgcgctggtgtgctcgcacatctggaggaggagcgcgacctgaaaatcacagacatcattatattcttccaggctgtgtgcagggggtatctggccaggaaagcatttgcaaagaagcaacagcagctgtctgccctgaaagtgctccagaggaactgcgcagcttatttgaaactaagacattggcagtggtggcgcgtgttcactaaggtgaaacccctcttacaagtcactagacaggaagaggagttgcaggccaaggatgaggaactcctcaaagtgaaagagaagcaaacaaaggtcgagggagagcttgaagagatggagaggaaacatcagcagctgcttgaagagaaaaacatactcgccgaacaacttcaggcggagacggagttgtttgccgaagccgaagagatgagagcccgtctggcagccaagaaacaggagctggaagaaattcttcatgacctcgagagcagagtggaggaggaagaggaacgaaatcagatcctccagaacgagaaaaaaaaaatgcaggcacacatacaagacctagaggagcagctggacgaagaagaaggagcacgccagaagctgcaattggagaaagtaacagcagaggccaaaatcaagaagatggaggaggagattctactgctggaagatcagaattctaagttcattaaggagaagaaactgatggaggatagaattgcagagtgcagtagccagctggctgaggaggaggagaaagctaagaacctggcaaaaattagaaacaaacaagaggtgatgatttccgatctggaagaaaggttaaaaaaagaagagaagaccaggcaagagttggaaaaagccaaaaggaaactcgacggagaaactaccgatttgcaggaccagatcgctgaactgcaggctcaaatcgacgaactgaagctccagctggctaaaaaagaggaagaactgcaaggagccctggcgaggggagacgacgagacgctacataaaaataacgccctgaaggtggtgcgggaattgcaggctcagattgcagagctgcaagaggatttcgagagcgagaaagccagcagaaataaggcagaaaagcagaagagggatctcagtgaagaactcgaggcgcttaagaccgagctggaggacacactggacacaaccgctgctcagcaggaactgcggaccaaacgcgagcaggaggtggctgagttaaagaaggccctagaggaagaaaccaagaaccacgaggcccaaattcaggacatgcggcaacgccacgcaaccgcactcgaggaactgagcgagcagttagaacaagccaaacgcttcaaggcaaatctagagaagaataaacaaggcctggaaactgacaataaggaactcgcatgcgaggtgaaggttctgcagcaggtgaaggctgagagtgaacacaagcgaaaaaagttggatgcccaggttcaggaattacatgctaaggtgtccgaaggagatagactcagggtggagctggctgagaaggcaagcaagttacagaatgaactggacaatgtgtctactcttttggaggaagccgagaagaagggcattaaatttgccaaggatgcggcatcattagagtcccagcttcaagatacccaggaattactgcaggaggaaactcgacaaaaactgaacctcagtagcagaatccgccaactcgaagaggaaaagaactcactgcaagaacagcaggaagaggaggaggaggcaagaaaaaatctcgagaaacaggtactggcactgcagtcccaattggccgataccaagaagaaagtggacgacgatctcgggacaatcgagagcctggaagaggctaagaagaagttactgaaggacgctgaggctctgagtcagcgcctggaggagaaagccctggcctacgataagctcgaaaagaccaaaaacaggttgcagcaagagctcgacgatctcacagtggatctcgaccaccagcggcaggtggctagtaaccttgaaaagaaacagaagaagtttgatcagctgttagccgaagaaaaatccatcagtgcccgatacgccgaagaaagggacagggctgaagccgaagccagagagaaagagacaaaggcactatctcttgctcgagccctagaagaggccctcgaagccaaagaggaattcgaacgccagaataagcagctgcgagccgacatggaagatctaatgtcttccaaagatgacgttggaaagaatgtgcacgaactggaaaaaagcaagcgggctctcgaacagcaggtggaagaaatgagaactcagttggaagagctggaggacgagctgcaggccaccgaagacgccaaactccgattggaagtgaacatgcaggccatgaaggctcaatttgagcgggatctgcaaacacgtgatgaacagaatgaggaaaaaaagagactgttgattaagcaggttagagagttggaagctgaactggaagatgagaggaagcagagggcactggccgtggcctcaaagaagaaaatggaaatcgacctgaaagacctggaggcacagatcgaggccgctaacaaagcgagagatgaggtgataaagcagttgcgcaagttgcaagctcagatgaaggactaccaacgcgagctcgaggaggccagggcaagtagggacgagattttcgcccaaagtaaagagagcgagaaaaagctcaaatccctggaggccgagattctgcagctacaagaagaactcgccagttcggaacgggcacgccgacacgctgagcaggaaagagacgagctagcggatgaaatcaccaactcagccagtggcaaatccgcgctgctggacgaaaagagacggctcgaagctcggatcgcacaactggaagaggagctggaggaagaacaatcgaatatggaactgctgaacgatcgcttccgtaagaccacacttcaagttgacacccttaatgctgaactggccgcagagagaagcgctgcccaaaagagtgataatgcaagacagcaacttgagcggcagaataaagagttgaaggctaagctgcaggagctggagggagccgtgaaatccaagttcaaggcaaccatcagcgccctggaggccaaaatcggccagctcgaagagcaattggaacaagaagctaaggagcgcgcagcagctaataagttggtgaggcgcacagagaagaaactgaaggaaatcttcatgcaggtggaggacgaaaggagacacgcagatcagtataaagaacagatggagaaagccaatgccagaatgaagcagctcaagcggcaactggaggaggccgaggaagaagcaacccgcgctaatgcctcccgacgtaagttgcagagagagcttgatgacgccacggaagctaacgagggcctgagtcgggaagtttctaccctgaagaaccggctgcgccgtggagggccaatcagtttctcgagttcaagaagcgggagacgtcagttacacctcgaaggcgcaagcttggagttgtctgatgacgatacagaatccaagaccagcgatgtgaacgagacgcagccacctcagagcgagta

SEQ ID NO: 29658 - DNA, 6023 bp, Artificial Sequence
  Description of Artificial Sequence: Synthetic coding sequence
atggctcagcggaccggactggaagatcccgagagatacctgttcgtggatcgggctgtgatctataatcctgccacacaggccgactggactgccaaaaagctggtgtggatcccctcagaaaggcatggctttgaagcagcctcaatcaaagaagagagaggcgatgaagttatggtagagcttgctgagaatggcaaaaaggccatggtgaacaaggatgatattcagaagatgaatccgccaaaatttagcaaagtcgaggatatggccgaattgacatgtctgaatgaggcaagcgtgttacataacctgaaggatcgttactactcaggcttaatctatacctattcaggactattctgcgtggtgataaacccctataaaaatctccccatatactctgagaacattatcgaaatgtaccgaggcaaaaaaaggcatgaaatgccgccacacatttatgcaatctccgagtccgcataccgctgtatgcttcaagaccgtgaggaccaatccatcttgtgcaccggcgagagcggtgctggaaagaccgagaatacaaaaaaagtgatacagtacttggcccacgtggctagctcccacaaagggaggaaagaccacaatattccccaggagtctcctaagccagtcaagcaccagggggagctcgaacggcaactcctgcaggcaaaccctattcttgagtcctttggtaatgcaaaaaccgtgaagaatgacaactcctcgcggtttggcaagttcattcggattaattttgatgtcaccggctacattgtgggagctaatatagagacttacctgcttgaaaaaagtagagccgtacgccaagctaaggacgagcggactttccatatcttctaccaattgctgtctggggctggggaacatctcaagagcgacctactgctggagggcttcaacaattatcgcttcctgtcaaacggctatattccgattcccggtcaacaggacaaggataacttccaagaaacgatggaggctatgcacatcatggggttctctcacgaagagatcctgagcatgttgaaagtggtctcctcagtgcttcagtttggcaatatttcctttaagaaggaaagaaatactgatcaggcatcaatgccagagaacactgtggcgcagaaattgtgtcatctccttggtatgaacgtgatggaatttactcgggctattcttacaccgaggatcaaggtaggcagagactacgtccagaaagctcaaaccaaagagcaggctgattttgcagttgaggccctagccaaggctacctatgaaaggcttttccgttggctggtccatagaattaacaaagctctcgaccgtacgaagagacagggggcatccttcatcggaattctggatatagcaggtttcgaaatctttgaacttaattcctttgagcagctgtgcataaattacaccaacgaaaaactgcagcagctgttcaaccacactatgtttatcctggaacaggaggagtaccagcgcgagggaatcgagtggaactttatagactttggtcttgacttgcaaccatgtatcgatctcatcgagcgccctgccaatccaccgggagtgctcgcactactggatgaagagtgttggtttcccaaagctaccgacaaaacttttgttgagaagctcgtgcaggaacagggaagtcactccaagttccaaaaaccaaggcagttaaaggacaaggccgatttttgcatcatacactatgcaggaaaggtggactacaaagcagacgaatggctgatgaagaacatggatcccctgaacgacaatgtggctactctcctgcaccaaagttcagatcggtttgtggcagagctctggaaggacgagatccagaatattcagagagcatccttttatgattcggtgtcaggactgcatgagccccctgtagatagaatcgtcggcttagatcaggtgaccggaatgaccgaaaccgccttcgggagtgcttacaagacaaagaaggggatgttcaggacagtgggccagctctacaaggaaagtcttaccaagttaatggccaccctccgaaacactaacccaaatttcgttcgctgtatcatccctaatcatgagaagcgggctggtaaactggacccacatctggtgttagatcagctccgatgcaatggcgttttagaaggtatccggatttgtcgacagggctttcctaatcgcattgtgttccaggaattccggcagcgttacgagattctgacgcccaacgctatcccgaaggggtttatggacggtaagcaagcttgtgagcgaatgatcagagctctagagctggatccaaatctgtacagaataggccagagtaagatctttttccgagccggtgtgttggcgcacctggaggaagaacgagacctgaaaatcactgacatcatcatcttcttccaggcagtgtgcagagggtacctagccagaaaagcttttgcgaagaaacagcagcagctgtccgcccttaaagttctgcagcgaaactgcgcagcatacttgaaactccgccactggcagtggtggagagtgttcacaaaagtgaagcccctcctgcaggtaacaagacaagaggaggagttgcaagctaaggacgaggagctgctcaaggtgaaggagaagcagacaaaggttgagggggagttagaagagatggagcgaaagcaccaacagctgttagaagagaagaacatcctagccgagcagctgcaggctgagacagaattgttcgccgaggctgaggaaatgcgagccaggcttgccgctaagaagcaggagctcgaagagatcctgcacgacctggaaagtcgtgtcgaagaagaagaagagcgtaatcaaattctccagaacgagaaaaaaaaaatgcaggcacacatccaagacctggaggagcagctcgatgaggaagagggtgccaggcagaagctgcagctggagaaggtgacagcagaagccaagatcaagaagatggaggaggagatcttgttactggaggaccagaacagtaagttcattaaggaaaaaaagctaatggaagaccgcattgctgaatgctccagtcaactagccgaggaagaagagaaagctaagaatctcgccaaaattagaaacaaacaggaggttatgatcagtgatcttgaagagcgcctgaaaaaggaggagaaaacacgacaggagctggagaaagctaaacgcaaattggatggagaaaccaccgacctgcaggaccaaattgcagagctgcaggcccagattgatgagctgaagctgcaattagccaaaaaagaagaagaactgcagggggcactggctcggggagacgacgagactctccacaagaataacgctcttaaagtcgttcgggagctacaggctcagattgccgagctccaggaggactttgagagcgagaaggcctcacgcaacaaggcagaaaagcagaaaagggatttgagtgaagagctggaagcgctgaagacggagctagaggacacactggatactaccgctgcccagcaagagcttcgcacaaagagggaacaggaggttgccgaactgaaaaaagctctagaggaggagactaaaaaccatgaagcccagattcaggacatgagacagcgtcatgccacggccctggaggagctctctgagcagcttgaacaggccaaacgctttaaggcaaacctggagaaaaacaaacaagggttggagacagacaacaaagaattggcgtgtgaggtgaaggtgctccagcaggttaaagcagagtcagaacacaagagaaaaaagttagacgcccaagtccaggagctacatgctaaggtatccgaaggggacaggctccgggtggagctcgctgaaaaggcgagcaagctgcagaacgagcttgacaatgtgagcacactcctggaggaggcagaaaagaagggtataaaatttgcaaaagacgccgcaagcttagaaagtcagctgcaagacactcaggaattgctccaggaagaaacgcgccagaaactgaacctgagctctcggattaggcagctggaagaggaaaaaaattccctgcaggaacagcaggaggaggaagaggaagcccgtaaaaatctagaaaagcaggtgctcgctctgcagtctcaactggccgacactaagaaaaaggtagacgatgacctgggcaccatcgaatccctggaagaggctaaaaagaaactactaaaggacgcagaggccctttcacagcgcctggaggagaaggccctggcttatgataagctcgagaaaactaaaaatcgactacagcaagagctcgatgacctgacagtggaccttgaccaccaaaggcaggtggcctccaatctggaaaagaagcagaaaaagtttgaccagctgctggctgaagaaaaaagcatctctgccagatacgccgaggaaagggacagggccgaggccgaggcgcgagaaaaggaaaccaaagctttaagcctcgccagggcgcttgaagaggccctcgaagccaaggaggagtttgagcgccagaacaagcagctgagagccgatatggaggatctgatgagctcaaaagatgatgtgggcaagaacgtgcacgagctggagaagtcaaagcgggctctcgagcaacaggtggaagagatgcgcacccagctggaagagctggaagacgagctgcaagctactgaggatgccaaactaaggttggaggtcaacatgcaggctatgaaggcccagttcgaacgagacttgcagacaagagatgaacagaacgaagagaaaaagcgcttgctcattaaacaggtgcgggagctggaggctgaactagaggacgaaagaaaacagagggctctggccgtggcttcgaaaaaaaagatggagatcgatttaaaagatctggaagcccagatcgaagcagccaacaaagcccgtgacgaggttattaagcaacttaggaaactgcaggcgcagatgaaagactaccagagggagctggaggaagctagggctagccgtgatgagatcttcgcacagagcaaggaaagcgaaaaaaagctcaagagcctggaggctgaaattctccaactacaggaggagttggcaagcagcgaacgcgctcgaagacatgccgagcaagagagggacgaattggccgacgagatcacaaactccgcctccggcaagtcagcactcctggacgagaagcgcagactggaggctaggatcgcacagttggaggaggaactggaagaagagcagagcaatatggagctgctgaatgacagatttcgcaaaacgactttgcaagtggacactctcaatgcggaactggcagccgagcgctccgccgcacagaagtcagacaatgctcgccagcagctcgagcgacagaataaggaactgaaggccaagcttcaggaacttgagggcgctgtgaagtccaagtttaaggccacgatcagcgccctggaagcgaaaattggacagctggaagagcagctggaacaggaagctaaggaacgggctgcggctaacaagcttgttcgcaggaccgaaaaaaagctcaaggagatctttatgcaggttgaagatgagaggcgccatgctgatcaatataaggaacagatggagaaagctaatgcaagaatgaaacaattgaaaagacagcttgaagaagcagaagaagaagccacaagagcaaacgcctctaggagaaagctccagcgggagctggacgacgccacagaggcgaacgagggcttatctagggaagtctctaccctcaagaaccgactgagaagaggcggaccgattagcttttccagcagtcgctctggacggaggcagctccatctggaaggcgctagtctcgaactgagcgacgatgacaccgagagtaagacctcagatgttaatgagacccagccccctcaaagtgagta

SEQ ID NO: 29659 - DNA, 5978 bp, Artificial Sequence
  Description of Artificial Sequence: Synthetic coding sequence
atggctcagcgcacaggcctggaggatccagaacgttatctgttcgtagaccgcgcagtgatctacaacccagctacacaggctgattggaccgccaaaaagcttgtgtggattcccagcgagcgtcatggcttcgaagctgcaagtataaaagaggagcggggagatgaggttatggtggagcttgcggagaacggcaaaaaggcaatggtcaataaagatgacatacaaaagatgaacccaccaaaattctctaaagtggaagatatggcggagttgacatgtctcaatgaagcgagtgtgttgcacaacttgaaggataggtattactccggcttaatttatacttactcagggttattttgcgtggtcattaacccttacaaaaatctcccaatctattctgaaaacatcattgaaatgtacagagggaagaaacggcacgaaatgcctccccacatttatgccatatccgaatccgcttacagatgtatgctgcaagatagggaggaccagagcatcttgtgcacaggcgagtctggggctggaaaaacggagaacacaaagaaagtgatacagtatctggcccacgtggcctcttcccacaaggggagaaaagatcataacattccacaggaatcaccgaagcctgtcaagcaccaggcatccgccctgttgtacggagaactagaacgccaactgctgcaggccaacccgatcctggaatcctttgggaatgctaaaaccgtgaagaatgataattcctccaggttcggtaagttcataagaataaacttcgacgtcacagggtatatcgtcggggctaatatcgaaacgtaccttctcgaaaaatctagagccgtcaggcaggccaaagacgaaagaaccttccacatattttatcagctgctgtctggagccggagagcacctgaaatcagatctgttactggaagggtttaataactatcggtttttgtccaacgggtacattcctatccctgggcagcaagataaggacaattttcaggaaaccatggaagcgatgcatatcatggggttcagccatgaggaaatactgagtatgctgaaggtggtctcttccgttttgcagtttggaaatatctccttcaaaaaggagagaaatacggatcaggcctctatgccagaaaacactgtggcacagaaactgtgtcatctactaggcatgaacgttatggagttcacacgcgcaatccttacaccgcgtatcaaggtcggcagggactatgtacagaaagcccagaccaaggaacaggcagattttgcagttgaagctctggccaaagctacctacgagaggttgtttcggtggctagtgcatcgcataaataaggcacttgacagaaccaagcggcagggggctagcttcattggaattctggacatagccggattcgaaatctttgaattgaactctttcgagcaattatgtataaactatactaacgagaagcttcaacagctgtttaatcatacgatgttcattctggagcaagaagagtaccagagggagggaatagagtggaacttcattgatttcggactcgacttacagccttgcatcgacctgattgagaggcctgcgaatccgcctggtgtccttgcccttttagacgaagaatgttggtttcctaaagccacagataagacttttgtggagaagctggtgcaagagcaaggaagtcactcaaagttccagaagccaagacagctgaaggataaagcagacttttgcatcatccactatgcgggaaaagtagattataaggccgacgagtggctgatgaaaaacatggatcctctgaacgacaacgtcgcaactcttctgcatcaatctagcgatcggtttgtcgccgagctgtggaaagatgtggaccgcatcgtcggcttggatcaggtgactggcatgaccgagacagcctttggatctgcctacaaaacgaagaaggggatgttccgcaccgtggggcaactgtacaaggagagcctaacgaaactcatggctaccctccggaacaccaacccgaatttcgtgagatgtatcatccctaaccacgagaagcgagcagggaagcttgacccccacctcgtccttgatcagctcagatgcaacggggttctcgaaggcatcagaatctgtaggcaggggttccctaatcgaattgtgtttcaagaatttaggcaacggtatgaaatactgacccccaatgctatacccaaaggatttatggacgggaagcaggcttgcgaaagaatgattcgcgctctggagcttgatcccaacctgtataggattgggcagagtaagatatttttccgggcaggggttctggctcatctcgaagaagaacgggatctgaaaataactgacatcataattttctttcaagccgtctgtcgagggtacctggcaaggaaagcttttgcaaaaaaacagcagcagctgagcgccctgaaagtgctgcaaaggaactgtgcagcttatttgaagctccgtcactggcaatggtggcgagtgttcaccaaggtgaaaccactcctgcaggtgactaggcaggaggaagaacttcaggcaaaagatgaagagctcttgaaagtcaaagagaagcagaccaaggtggaaggagaattagaggaaatggaaaggaagcatcaacagctgcttgaggaaaaaaacatccttgccgagcagctgcaggccgaaacagaactctttgccgaagcggaagaaatgcgcgctcgattggcagccaagaaacaggaactggaggagatcctccacgatctcgagtcccgggtcgaagaggaggaggaacggaaccagatcttgcagaatgagaaaaagaaaatgcaagctcatatccaggatttggaggaacagctggacgaggaggaaggggctagacaaaagctgcagcttgagaaggtgactgccgaagcaaagattaaaaagatggaagaagagatcttgttactggaggaccagaattcaaagttcattaaggaaaagaaattgatggaggatcggatcgctgagtgctcctctcaactggcggaagaagaagagaaggcgaagaatctggccaagattcggaataaacaggaggtgatgatttccgacctggaggagcgtctcaagaaggaagagaaaacacgccaagagctcgagaaagccaagcgcaaacttgatggggagactactgacctccaagatcagattgcggaactgcaggcccagatagacgagctcaagctgcaactcgccaagaaagaggaagagctgcagggggcactggctcgtggggatgatgagacgctgcataaaaacaatgccttaaaagtagttagagagttacaggcccaaatcgccgagctgcaggaagatttcgagtctgagaaggcctccaggaataaagccgagaaacaaaaacgcgatctaagcgaagagctggaggctctgaagacagagttggaagacacactggatacaacggcagcacaacaggaactgagaacaaaacgcgagcaggaagttgctgagcttaaaaaagctctggaagaggagaccaaaaatcacgaggctcagattcaggatatgcggcagcggcacgcgactgcactggaagaactcagcgaacagctcgagcaggccaagcgcttcaaggcaaacctggagaaaaacaagcaggggctcgagacagataacaaggaactggcatgtgaagtgaaggtgctacagcaggttaaagccgagtctgaacacaaaagaaaaaagctggatgctcaggttcaggagctccacgcaaaagttagcgaaggtgatcgtttgcgcgtcgaacttgccgagaaggcctcaaaattgcagaacgagttggacaatgtgagcacactcttggaggaagcagagaagaagggcattaaatttgcgaaagacgcagcgtctttggaaagtcagctgcaggacacgcaggagctccttcaggaagagacccggcagaagctgaacctgagcagtcgaatcagacagttagaggaggagaaaaactctctccaggaacagcaggaagaggaggaggaagccaggaaaaacctggagaagcaagttttggctctgcaatctcaattggcggacaccaagaagaaagtggacgatgacctcggcacaatagagtccttggaggaggctaaaaaaaagctcttgaaggacgctgaagccctaagtcagaggttggaagaaaaggccttggcctatgacaagctcgagaaaaccaaaaaccgactacagcaggaactggacgacctgaccgtggaccttgaccaccagaggcaggttgccagcaacttggaaaaaaagcagaagaagtttgatcaattgttggctgaggaaaagagcatttctgctcggtacgcggaggagcgggaccgcgctgaggccgaggcacgggaaaaggagactaaagccctctccttggccagggccctcgaggaagcactggaagccaaggaggagttcgagagacagaataaacagctgcgggcagacatggaagatctgatgtcctccaaggatgatgtcggaaaaaatgtacacgagctcgaaaagtccaagagggctttagaacaacaggtggaggagatgagaacccagctggaagaattggaagacgagctgcaggctactgaggacgcaaaattgaggcttgaagtcaacatgcaggccatgaaggcacaattcgagagggacctacagacccgagatgaacaaaacgaagaaaaaaagagattgctgataaagcaggttcgagagctggaggccgagctggaagatgagaggaagcaacgagctctggccgtggccagcaagaagaagatggagatcgatctcaaagacctggaggcccaaatagaggccgctaacaaggcacgggatgaggtgatcaagcagcttcgcaagctgcaagcccagatgaaggattaccaacgggagctggaggaagcgcgagcttctcgcgatgagatcttcgcccaatcgaaggagagcgagaaaaaactcaagtccctggaagcagagattcttcagctgcaggaagagttggcctcgtcagaacgagccagacgccacgcagagcaggaacgcgacgagctggccgacgagatcactaactcggcttccggcaaaagcgctctgttggacgaaaagaggcggctcgaggctaggatcgctcaactggaagaggagctcgaggaggagcagtctaatatggagctgctcaacgatcgctttcggaagaccacactgcaggtcgatacgttaaacgccgagttagccgctgagcggtccgctgcccagaagagcgataacgccaggcagcaattagaaaggcagaataaggagctgaaagccaagctccaagagctggagggggcagtgaaaagtaaattcaaggccactatctcagcattggaagccaagattgggcagctcgaggaacaactggagcaagaggctaaggaacgggcagcagctaacaaactggtgcgcagaaccgagaagaagctgaaagagatctttatgcaggttgaggacgaaaggcgccatgcagaccagtacaaggaacagatggaaaaagccaatgctagaatgaagcagcttaagcggcagcttgaggaagcagaggaggaggctacacgcgctaatgccagtcgacgcaagttgcaaagggagctggacgatgccaccgaggcaaacgaaggtttatcccgcgaagtaagcacactaaaaaatcgcctcagacgcggaggtcctatctcattttccagcagtagatcaggaaggcggcaattacatctggaaggcgctagcttagaactctccgatgatgacacagaatctaagacctctgatgtcaacgagacacaacctccccagtccgaata

SEQ ID NO: 29660 - DNA, 5993 bp, Artificial Sequence
  Description of Artificial Sequence: Synthetic coding sequence
atggcacagcgtaccggattagaagatcctgagcggtacttgttcgtggatagagccgttatttataacccagccacacaggccgactggaccgcgaagaagctggtttggatacctagcgaacgacacgggttcgaagccgcatctattaaggaggaacgcggagacgaggttatggtcgaactggcagaaaatggcaagaaggccatggtgaacaaagatgatattcaaaagatgaacccgcctaaattttccaaagtcgaagatatggctgagttgacatgccttaatgaagctagcgtcctccacaatctgaaggacaggtattatagtgggctcatctatacatattcaggcttattctgcgtcgttattaatccttacaaaaacctgccaatttatagtgaaaatataatcgagatgtaccggggaaaaaagagacacgagatgccgccacatatctatgccatttcggaatcagcgtacagatgcatgctccaggaccgggaagatcagtcgattttgtgtaccggcgaatccggggctggaaagaccgagaatactaaaaaagtcatccagtacctggctcacgtcgcttctagccataagggcagaaaggatcacaacattcctggagagctcgagcgacagctcctgcaggcaaatcccatccttgaatcctttgggaacgcgaaaaccgtaaaaaacgataatagttcacggtttggaaaattcatccgcatcaactttgatgtgaccggctatatagtcggtgcaaacattgaaacctatcttctggagaagtctcgagccgtcaggcaggcgaaggacgaaaggacattccacatattttaccagctcctgtctggtgccggtgagcaccttaagagtgatctgctactggagggcttcaataactaccgattcctctctaatggatacattcctatcccaggacaacaggataaagataacttccaggagaccatggaagccatgcacattatgggcttctcgcacgaggagatcctttcaatgctgaaagttgtgtcaagtgtgctccagtttggtaatatctccttcaagaaggaaagaaatactgaccaagcatcaatgccggagaacaccgttgctcagaagttatgccacctgctcgggatgaacgtgatggagtttaccagggccattttaacgccgcgtatcaaggtcgggcgagattatgtccaaaaggctcagaccaaagagcaggcagactttgccgtggaggcgttggccaaggcaacctacgagcggctgttcagatggctagtgcacaggattaataaagcattagatcgcaccaagcggcagggtgcctcgttcatcggaatacttgatatcgcagggttcgagatcttcgaattgaacagtttcgaacagctatgtataaactataccaacgagaagctccagcagttgttcaatcatactatgttcatcctcgaacaggaggagtaccagcgagaggggatcgagtggaatttcatcgactttggattggacttgcagccgtgtattgacctgatagagaggccagccaatcctcccggagtgttagccctactcgacgaggaatgctggttcccgaaggccacggacaaaactttcgttgaaaaacttgtgcaggaacaaggctctcactccaaattccagaagccacggcaattgaaagataaagccgacttctgcatcatccattatgccggaaaggtggattacaaagctgacgagtggttgatgaagaatatggatcccctcaatgacaatgtggccaccctcctgcatcagagctcggaccgcttcgtagctgagctctggaaagatgagattcaaaacatccaacgggctagcttctacgattcagtttcaggtctacacgagccaccagttgaccgtattgtcggccttgatcaggtgaccggaatgacagagactgctttcggaagtgcttataaaacgaaaaaggggatgttccggacagtaggacagctctacaaggagtctctgactaaattaatggccactcttagaaataccaatcccaactttgtgcggtgcattatcccaaaccacgagaaaagggcaggaaaactggacccccatctcgttctagatcagctgagatgtaacggagttctcgagggcattcgtatctgccgtcagggatttccaaataggatcgtctttcaggagttcaggcagaggtatgagattctgacgccaaacgctatcccaaaggggtttatggacggaaagcaggcctgcgagagaatgatccgtgccctggaactggatccaaatctctaccggataggccagtctaaaattttctttagagccggagttctcgcccacctagaagaggaaagggacctgaagatcactgatattattatcttcttccaggctgtatgtaggggttatttagcacgcaaagcatttgcaaaaaaacagcagcagttaagtgcgctgaaagtactgcagcggaattgtgccgcttatctgaaattgcgccactggcagtggtggcgagttttcactaaagttaagccattgctgcaggtaacaaggcaggaagaggagctccaagctaaggatgaagagctactgaaagtcaaggagaagcagaccaaagttgagggagaactcgaagaaatggagaggaaacatcaacagctattagaggaaaagaatattctcgctgagcaactgcaggccgaaaccgagttgtttgctgaggcggaggagatgcgtgccaggctcgccgctaaaaagcaggaactggaggaaattcttcatgacttggagagccgtgtcgaagaggaggaggagagaaaccagatcttgcaaaacgaaaaaaagaagatgcaggctcatattcaagatttggaggaacaacttgacgaggaggaaggagctcggcagaagctgcagcttgagaaggtgactgcagaagcaaaaattaagaagatggaggaagagatcctcctcttggaggatcaaaattcaaaattcatcaaagagaaaaaacttatggaggatcggatcgcggagtgttcttcccagctcgccgaagaggaggagaaggcaaagaacttggccaagatcaggaacaagcaggaggtaatgatttctgacctggaggagcggctgaagaaagaggagaaaaccaggcaagagttggaaaaagccaagcgcaagctggacggcgagacgaccgaccttcaggatcaaatagctgagctccaagcccagattgatgagttaaagctgcagctggccaaaaaagaggaggagctgcagggcgcactggccaggggggacgacgagaccctacacaaaaataacgctctgaaggtcgtgcgcgaactgcaggctcagatagctgagctacaggaagacttcgagagcgagaaggctagcaggaataaggccgaaaaacaaaagagggatctgagcgaagaactcgaggcattgaaaactgaactggaagacacactggataccaccgcggctcagcaggaattgaggactaagcgcgagcaggaggttgctgagctgaaaaaggctcttgaagaagaaaccaaaaatcacgaagcgcagatccaggacatgcgacagaggcacgcaacagcccttgaggaactgagcgaacaattggagcaagcaaagcggtttaaggcaaacttggagaagaataaacagggcctggagaccgataataaggagctggcctgcgaggtgaaggtgctgcaacaggtgaaggcagagagcgagcacaaaagaaagaagctggatgcccaggtgcaagaactccacgcaaaggtgtccgaaggtgatagactacgggtggagctggctgagaaggcaagcaagctgcagaacgaactggataatgtgtcaactctgctggaggaggctgagaaaaaaggaataaagttcgccaaggatgcggcttccctcgagtcccagctgcaggatactcaagagttactgcaggaagagacccggcagaaattgaatctttcttccagaatcagacagttggaagaggaaaagaatagcctgcaggagcagcaggaggaagaggaggaggcaagaaaaaatcttgagaagcaggtgctggctcttcaatcccagctggcagacaccaagaagaaagtggacgacgatctgggaacgatcgagtctctggaggaggccaaaaagaagctattaaaggatgccgaggccctcagtcagcgccttgaggagaaggcactcgcttatgacaagctcgagaaaactaaaaacaggttacagcaggagcttgatgatctcactgtggatctggaccaccagagacaggtggcttctaacttggaaaaaaagcaaaagaagtttgatcagctgctggcagaagagaaatccatttccgctaggtatgctgaagaacgggatagagctgaagctgaggcccgtgaaaaagagaccaaagcattatccctggcccgagctctcgaggaggcactggaggccaaggaagaattcgaaaggcagaacaaacaactgcgtgccgacatggaggacctaatgagctcgaaagatgatgtcgggaagaatgtgcacgagctggaaaagtcaaagcgggcattagagcagcaggttgaagagatgagaacccagctcgaggagctagaggacgagctgcaggctactgaagacgccaagttgcgtcttgaggtcaacatgcaggcaatgaaggcacagttcgagcgtgacctccagactagagacgagcagaacgaagaaaaaaagcgcctgctcatcaagcaagtgagggaacttgaagccgagctggaagacgaacgaaagcaacgagcattagcagttgcctccaagaagaaaatggagatcgatcttaaagatctggaggcccaaatcgaggcggctaacaaggccagagatgaggtgatcaaacagcttcgcaagctacaggcacagatgaaagactatcaaagagagctggaggaagcccgagcctctcgagacgaaatatttgcccaaagcaaagagagcgagaagaagttgaagagccttgaggccgaaattctgcagctacaggaggaactggcctcatctgagcgagcgagaagacacgccgaacaggaaagggatgagctggccgatgaaatcacgaacagcgcctcagggaagtccgctcttctggacgaaaagcgcagattagaggcgaggatagcgcagttagaggaggaattagaagaagagcagtcaaatatggaactgctaaacgaccggtttcggaagaccaccttgcaggtcgatacattaaacgcggaactggctgctgaacgttccgctgcgcaaaagagtgacaatgcgagacaacagctcgagaggcagaataaggaattgaaggcaaagctgcaggaactggaaggcgcagttaagagcaagttcaaagctactatcagtgctctggaagctaaaattggacagttggaagagcaattggagcaggaggccaaggaaagagctgccgcaaacaagttggtcagaaggaccgaaaagaaactcaaagagatatttatgcaagtcgaggatgaaaggcgccacgctgaccagtataaagagcagatggagaaagctaatgccaggatgaagcagctcaagcgacaactcgaagaagccgaagaggaagctacgcgagccaacgccagccgaaggaaactgcaaagggaattagatgatgcgaccgaagctaacgaaggtctgagtcgagaggtctcaactttgaaaaacagactgcgaagaggcggacccatttccttctcctcttctagatcggggaggaggcagctacacctcgaaggcgctagcctcgaactctccgatgatgatacggagagtaaaacctctgatgttaacgagacccagcctccgcaaagtgaata

SEQ ID NO: 29661 - DNA, 567 bp, Artificial Sequence
  Description of Artificial Sequence: Synthetic coding sequence
atggcgcaaaggactggcctagaggacccagagcgttacctctttgtggatagagcggtgatctacaaccccgcaacacaagcggactggacagcaaagaagctggtgtggatacctagtgagcgccacggattcgaggccgcatctatcaaagaggaacggggtgacgaggtgatggttgagttagcggagaatggcaaaaaagctatggtaaataaagacgacattcagaagatgaatcctccaaaattcagcaaggtggaggatatggcagagctgacctgccttaacgaggccagcgtcctccacaacctgaaggatcggtactattcggggctcatttacacgtattccgggctgttttgcgtggtgatcaacccatataagaacttaccaatctattccgagaacatcatcgaaatgtatcgtggtaaaaagcggcacgaaatgccacctcacatctacgccatttcagaatctgcctacagatgcatgctgcaggatcgtgaagaccagtctattctctgtacaggcgaaagtggagccggaaagacggaaaatacctag

SEQ ID NO: 29662 - DNA, 1446 bp, Artificial Sequence
  Description of Artificial Sequence: Synthetic coding sequence
atgtatgacgccgaacggggatggtcactctcatttgccggatgcggattcctgggtttttaccacgtgggggcaacgcggtgtctgagtgagcacgccccacacctgctgagagacgcacggatgctctttggggcttctgccggagcactgcattgtgttggtgtgttatcaggaatcccactggaacagactctgcaggttttgtctgacctggtacgcaaagcccgatcaagaaacatcggcatctttcacccaagctttaatctgtccaagttcctgcggcagggactttgtaagtgcctcccagctaacgtccatcagctgatctctggcaagataggaatctctctgacccgcgtgtctgacggtgagaacgtacttgttagcgattttcgctctaaagacgaggtggtagatgccttagtgtgctcctgcttcatccccttctattccggactgattcctccaagtttcagaggggtgcgctacgtggatggtggggtgagcgataatgtgccatttatcgacgcgaaaaccacgattaccgtgagcccattctacggcgagtacgacatctgccctaaggtgaaatctaccaatttccttcacgtcgatatcacaaagctttcactccggctgtgcaccgggaacctgtatcttttatccagggcgttcgttcctcccgacttaaaagtactgggagagatttgtctgcgcggttatttggacgcctttcgattcctagaagagaaaggtatctgtaatcgaccgcagcctggactcaagagcagctctgaagggatggatccggaggtggccatgccctcatgggcgaacatgtctctagactcatcacccgagagcgccgcacttgcggtccggcttgagggggacgagctgttggatcacctacgactgtctatccttccctgggacgagtccattctcgatacactgtcacctcggctggcaactgccctgagcgaggaaatgaaggataaagggggttacatgtcgaagatctgcaatctgcttccaataagaattatgtcgtacgtgatgctgccttgcactctgcctgtagagtcagccatcgccatagtccagaggctggtgacctggctgccagatatgcccgatgacgtactctggttgcaatgggtaacaagtcaggtttttacacgcgtgctgatgtgtctgctaccggcatctcgttcacagatgccagtgagctcacaacaggcctcaccttgcacacctgagcaggactggccctgctggactccatgtagccccaaaggctgccctgccgagaccaaagccgaggccacccctagaagcatcctgcggagttcactcaacttcttcttgggaaataaagtccccgcaggcgcagaaggactttctacattccccagctttagcttggagaagtccctgtag

SEQ ID NO: 29663 - DNA, 4149 bp, Artificial Sequence
  Description of Artificial Sequence: Synthetic coding sequence
atgtacaagggtaagaaacgacacgaaatgccaccccatatctatgccatcacagacaccgcttataggtcaatgatgcaggatcgggaggaccagagcattctgtgtaccggcgaatccggcgctggcaaaactgaaaacaccaaaaaggtgattcaatacttggcctatgtcgcatcaagccataaaagtaagaaggatcagggagaactcgagagacagctgttacaggctaaccccatcctggaggcgtttggcaacgcaaagaccgtgaagaatgacaatagtagtcgattcgggaagtttatcagaattaactttgacgttaatggctacattgtgggagcaaacatcgagacatacctgctggagaaatcacgtgcaattcggcaggcgaaagaggaaagaacctttcatatattctattacttactgtctggtgctggtgaacacttgaaaacggacctgcttctggagccgtacaataaatacaggttcctgagcaatggccatgttaccatacctggccagcaggacaaggacatgttccaagaaactatggaggccatgcgaataatgggaatccccgaggaagagcaaatgggcctactgcgagtgatatctggcgtcctgcagcttggcaacattgtgttcaaaaaagaaaggaataccgaccaggcttcaatgccggacaacacagccgcacaaaaggtgagccatctcctgggtataaacgtcaccgattttacccggggtattctgactccacggattaaagtgggcagggattacgtccagaaagcgcagacaaaagaacaagcagatttcgctatagaggccctggcgaaggctacctacgaaaggatgtttcggtggctcgtgctgagaatcaataaggcactggacaaaaccaagaggcaaggcgcttccttcatcggtattctcgacattgcagggtttgagatcttcgatctaaatagcttcgagcagctttgcattaactatactaatgagaaactgcagcaactgttcaaccataccatgttcatcctagaacaggaggagtaccagcgtgaagggattgagtggaactttattgactttggcttggatctccagccatgtattgatctgatcgagaagccagccggaccgcctggtattctggcactgttggatgaggagtgttggtttccaaaagccactgacaaatcatttgttgagaaagtgatgcaggagcagggcactcatccaaaattccaaaaaccaaagcaactgaaagataaggcggatttctgcattattcactatgctggcaaggtagactacaaggccgatgagtggctcatgaaaaatatggaccctcttaacgataatattgccacactactgcaccagagttctgacaagttcgtaagcgaactatggaaggacgtcgatcgcatcatagggctagaccaggtcgcgggtatgtctgaaacagccttgccgggagcgtttaaaacacgtaagggcatgttccgtactgttggacaattgtataaagaacaactggcaaagctgatggccaccttgcggaacaccaaccctaattttgtgcggtgtatcatccccaaccacgaaaagaaggctggcaagctggatccgcacttagttcttgatcagctccggtgtaacggcgtattagaaggtatccgcatttgcaggcaaggattccctaaccgggtggtatttcaggagtttcgtcagaggtacgagatcctgactccgaactccattcccaaaggcttcatggatggcaaacaggcatgcgttttgatgatcaaggcactggagctggattctaatctataccggatcggccagagtaaagtgttctttagagctggtgttctggcccatctggaggaagaacgggacctgaagatcactgacgtgatcattggatttcaggcttgctgtagggggtacctagcacgcaaggccttcgccaagaggcagcagcagctgaccgccatgaaagtactgcagcgaaattgcgccgcatacttgaagctaagaaattggcagtggtggaggctcttcaccaaagtgaagccgctgctccaggtatctcgccaggaggaggagatgatggctaaggaggaagagctcgtaaaagtgagggagaagcagttggccgctgaaaaccgactgaccgagatggagaccttgcagtcccagttaatggccgaaaagcttcaactgcaggaacaattgcaggcagagaccgaactgtgtgcggaggctgaagaattgcgagccaggttgactgcaaagaagcaggaactggaagagatttgtcacgatctggaagcgagagttgaagaagaagaggaaaggtgccagcacttacaagccgagaagaaaaaaatgcagcagaacatccaagaactcgaagaacagctagaggaagaggagtcagcacgtcagaagttacaattagagaaggtgactactgaagctaaattgaagaagctagaggaagagttagacgacctgctggttgacctggatcaccaaagacaatcggcatgtaacctggagaaaaagcagaaaaagttcgatcagttgttagctgaggagaagacaattagtgcgaaatatgccgaagagagggacagagccgaagcagaagcccgtgaaaaagagacaaaagctcttagcttagccagagcactcgaggaagctatggagcaaaaagctgagctcgagagactcaataagcagttccgaaccgagatggaggatctgatgagtagtaaggatgatgtcggcaagtctgtgcatgagctggagaagtccaagagggcccttgaacagcaggtcgaggagatgaagacacagctcgaggagcttgaggatgagcttcaggccaccgaggacgccaagcttcgcctcgaggtcaacttacaggccatgaaggctcagttcgaaagggatttacagggccgtgatgagcagtctgaggaaaaaaaaaagcagcttgtgaggcaggtgcgagaaatggaggccgaactcgaggacgagcgtaagcagagaagcatggcggtggccgctcggaagaaactagagatggacttgaaggatctggaagcacatatcgactccgctaacaaaaaccgagatgaagccatcaagcagctccgaaagttacaagctcagatgaaagactgcatgagggagttggacgatacacgagcctcgcgggaagagatcctggcacaggctaaagagaatgaaaaaaaactgaaatctatggaagccgaaatgattcagctgcaggaagaacttgccgctgccgagagagctaagagacaggcccagcaagagagagacgagctagcagatgagatcgcaaatagtagtgggaagggagcccttgcgctcgaggagaaacggcgtctggaggccagaatcgcacagcttgaagaagagttggaagaggagcaggggaacacagagcttattaatgatcggctcaaaaaagccaatctgcagattgatcaaattaacactgacttaaatctggagcggtcacacgcgcagaagaacgaaaatgccagacagcaactcgagcgccagaacaaagaattaaaggtgaagctgcaagagatggaggggacagtaaaaagtaagtacaaggccagcatcaccgcacttgaggctaaaattgctcagttggaagaacaactggacaacgagaccaaagagcgtcaggccgcatgcaaacaggtgcgcaggactgagaaaaagctgaaggatgtgctcctgcaggtggatgacgaacgccgaaatgctgagcagtacaaggatcaggcagacaaggcttctactaggctgaagcaacttaagcgccagttagaggaagccgaggaggaggctcaacgcgcaaatgcttctcgcagaaagctccagcgagagctcgaggatgcgaccgaaaccgccgacgccatgaacagagaagtctccagtctcaagaacaagctgcgtcgcggagacttgccattcgtggttcccagacgaatggcgcgaaagggggcaggcgatggatccgacgaggaggtggatggaaaggcggacggtgctgaagcaaaacccgcagagtag

SEQ ID NO: 29664 - DNA, 1689 bp, Artificial Sequence
  Description of Artificial Sequence: Synthetic coding sequence
gcctcgggaacgaggcggagatggcccccaacaacaagttggcggcgtcctcgtaggggctgctcccgcagttggaccacttgctggtggacgtggacgacctccgcacgggcaagagccacttggagaagaagccgacgatccttgactagctcctggcggagaagacggccttccctcccctccatgcagagatccgcgaccggccttcgtaggaggccagagcggagacggcctcggctgtgcaggtggccgggtcccgaagaagccatggagcagaaagctgagctggagcgcttgaataagcagtttcgcaccgagatggaggatcttatgagctctaaagatgatgtgggcaagagcgtgcacgagctcgaaaaaagtaagagagcccttgaacagcaggttgaggagatgaagacccaactggaggaactggaagacgagctccaggccacggaggacgccaagttaagacttgaggtcaacctccaggccatgaaggcccagttcgagcgcgacctgcagggcagagacgagcagagtgaagagaagaagaaacaattggtgcggcaagtgcgggaaatggaagccgagctcgaagatgaaagaaaacagcgcagtatggccgtcgccgcaaggaagaaactggagatggacctgaaagacctcgaggcccacatagattcagcaaataagaatagagacgaggctatcaagcagttgcggaagctgcaggcccagatgaaagactgcatgcgggagttagatgatacccgagcctcaagggaagaaattttagcacaggcaaaggaaaacgagaagaagttgaaaagtatggaggccgagatgatccaactgcaagaggagctggccgcagccgagcgtgccaaaagacaggcccagcaggaacgggacgagttggctgacgagatcgctaattcctcaggcaagggggcattggccctcgaggaaaagcggagattggaggccaggatcgcccagcttgaggaggagctcgaagaggaacaagggaacacagaattaatcaatgacagactcaaaaaggctaacctgcagatcgatcagattaacacagacttaaacctggagagatcacacgcccagaagaacgagaatgcacgccagcaactagagagacagaataaggaactgaaggtgaagttgcaggaaatggaaggtactgtgaagagcaagtacaaggcatctattacagcactcgaggcgaaaattgcccagttggaggagcagttggacaacgagacaaaggagcgccaagcagcatgcaaacaagtgagacgaactgaaaagaaactgaaggacgtgctcctgcaggtggacgatgagcgcagaaatgccgagcagtataaagatcaggcggacaaggcatccacacgcctgaaacagctgaaaaggcaactagaggaagccgaagaggaggcacagcgagcaaacgcctctcgacggaaactgcaacgcgaactggaggacgccacagaaaccgcagacgctatgaaccgcgaggtcagttcgcttaaaaacaaactgagaagaggggatcttccatttgtagtaccgcgaagaatggctaggaaaggcgctggtgacggctctgacgaggaggtggacgggaaggctgacggggctgaggctaagccggcagagtag

SEQ ID NO: 29665 - DNA, 657 bp, Artificial Sequence
  Description of Artificial Sequence: Synthetic coding sequence
atggcccagcaggcagcagataagtacctctatgtggacaaaaatttcattaacaatcccctcgcccaggctgattgggcagctaagaaattggtgtgggtcccatctgataaatcagggttcgaacctgcttctctgaaggaggaggtaggagaggaagcaatcgtggagctcgtcgagaatggaaagaaagtgaaagtgaataaggacgatatccagaagatgaatcctccaaagttttccaaagtcgaggacatggccgagctcacatgtttaaacgaggcatccgttttacataatctgaaagagcgctactactcagggctgatatacacctacagtggcttattctgcgtcgtgataaacccttataagaacctgcccatttacagcgaagagattgtggagatgtataaaggcaaaaaacgccacgagatgcctcctcacatttacgctatcacggataccgcatatcggtccatgatgcaagatcgggaggatcagtccatcctgtgcacaggcgaaagcggcgcaggcaagaccgagaacaccaagaaggtgatccagtatttagcgtacgttgcaagcagccacaagtccaagaaagatcaggaggcctactttaagaaccgggctgttaggctcggggttctatag

SEQ ID NO: 29666 - DNA, 312 bp, Artificial Sequence
  Description of Artificial Sequence: Synthetic coding sequence
atggctcagcaggcagccgataaatacctttacgtggacaagaacttcataaacaaccctctggcccaagccgactgggccgcaaagaaactggtttgggttccaagcgacaaatcaggcttcgagccagccagcttaaaagaggaggttggagaggaagcgatcgtggaattggtggagaatgggaagaaggtcaaagtgaataaagatgatattcagaagatgaatcccccaaagttctcaaaagtcgaggatatggccgagttgacttgcctcaatgaggcctccgtcctgcataatctgaaagagtag

SEQ ID NO: 29667 - DNA, 519 bp, Artificial Sequence
  Description of Artificial Sequence: Synthetic coding sequence
atgagctcgaagagagcgaaggctaagacaacaaaaaagcggccacagcgagctaccagtaacgtgttcgccatgtttgaccagtctcaaattcaggagttcaaggaagctttcaatatgatcgaccaaaatcgggatggcttcattgataaagaggacctgcacgacatgctggcaagtcttggaaagaacccgactgatgaatacctcgaaggcatgatgtctgaggcccctggccctatcaactttacaatgtttctcacgatgtttggggagaaactgaacggaactgatcccgaggacgtgatccggaatgctttcgcgtgtttcgacgaagaggcctcagggttcattcatgaagaccatttgagagagctgctgaccacaatgggcgaccgtttcacagatgaagaggtggatgaaatgtacagagaggccccaatcgacaagaagggtaatttcaactacgttgagtttacccgcattctgaaacatggagctaaagacaaggacgattag

SEQ ID NO: 29668 - DNA, 357 bp, Artificial Sequence
  Description of Artificial Sequence: Synthetic coding sequence
atgtccagtaagagagctaaggctaagaccaccaagaagaggccacagcgggcaacatccaacgtgttcgcaatgttcgatcagagccagatccaggaatttaaggaggccttcaacatgatcgaccagaatcgcgacggattcattgacaaggaggacttgcacgatatgcttgctagccttgggttcatccatgaagaccacctgcgggagttgctgacaactatgggggaccgattcacggacgaagaggtcgacgagatgtatagggaggcacctattgataagaagggtaattttaattatgtggagtttaccagaattcttaagcacggagcaaaggataaggacgactag

SEQ ID NO: 29669 - DNA, 927 bp, Artificial Sequence
  Description of Artificial Sequence: Synthetic coding sequence
atgcaggaactcacgctgtccccaggacctgctaaactgacccctaccttggacccaacccatagaatggaattaattctcagcaccagccccgctgagctgaccttagatcccgcttgtcagccaaaactccctctcgacagcacttgtcagccagagatgactttcaaccctggccctactgagcttaccctggatccagagcaccagcctgaggagacacccgctccttccctggcagaactcacactagaacccgtgcacaggcgccctgagctgctggatgcctgcgccgatctgatcaacgatcagtggccgcgttctaggacttcaaggctacattccctcggccagtcctctgacgcatttcctctgtgtctgatgctgctctctccacaccctactctggaggctgcacctgttgtggtaggacatgcgcgattatctagagtgctgaaccagccacagtccttgcttgtggagaccgtcgttgtagcacgggctttaagaggaaggggattcggcaggaggctcatggaggggctggaagtctttgccagggctaggggatttagaaaactccatttgactactcatgaccaggtacacttctacacacacctaggataccagttgggagaaccagtgcaagggctggtcttcacgagtaggcggctgcctgcgactctccttaacgccttccccacagccccatcccccaggcctcccagaaaagctccaaatctgactgcccaggctgcccctaggggtcctaagggtccacctcttcctccccctcctcctctaccagagtgcctaacaatttctcctccagtcccttccgggcctccatctaaatccctgctggaaacgcagtatcaaaacgtgcggggtagaccgattttctggatggagaaagatatttag

SEQ ID NO: 29670 - DNA, 861 bp, Artificial Sequence
  Description of Artificial Sequence: Synthetic coding sequence
atggaactgattctgtccacttcacctgctgaacttactctcgatcccgcttgtcagccaaaattgccccttgactctacctgtcaacccgaaatgacattcaaccccggacccaccgaattaacccttgatccagaacaccagccagaggaaacgcctgccccaagcttggccgagcttactctcgaacctgtccaccgcaggcccgagctcctcgacgcttgcgccgacttgattaatgaccaatggccacgctccagaacaagcagactgcatagccttggtcagagctccgacgccttccctctgtgccttatgctccttagccctcaccctactctggaggcagctccagtggtagtcgggcacgcccgtctgtccagggtacttaatcagccgcagagtctgctggtcgaaactgtcgtggtggctagagccttacgtggcagagggttcggtagaaggctcatggaaggtttggaggtctttgctcgcgctaggggcttcagaaaactgcacctgactacacatgatcaggtccacttttatacacacctgggctatcagctcggggagcccgtacaaggcctcgtgttcacctccagacgcctgccagctactctcctgaatgcattccccaccgctccctcccctcgtccgccacgtaaggcccctaatctgaccgcccaggctgcacctcgtggccctaaggggccaccactgcctcctccccctcctttgcctgaatgcttgaccatcagcccacccgtacccagtggccctccctccaaaagcctcttggaaacacagtaccaaaacgtgagaggtaggccaatattttggatggagaaagatatttag

SEQ ID NO: 29671 - DNA, 174 bp, Artificial Sequence
  Description of Artificial Sequence: Synthetic coding sequence
atggaactgatactgtccacgtcacccgctgaattaactctcgaccctgcttgtcaacctaagctgccccttgatagcacttgccagcccgagatgacatttaacccagggccaactgagctgactttggatcccgagcaccagcctgaggagacacctgccccaagtctatag

SEQ ID NO: 29672 - DNA, 861 bp, Artificial Sequence
  Description of Artificial Sequence: Synthetic coding sequence
atggaactcatcctgagtacctccccggctgaattgaccctggacccggcttgtcagcccaagctgccgctcgattccacctgccagccagaaatgacatttaatcccggacctaccgaactgacactggacccagagcatcagccagaggaaacgcctgctccatccctagcggagttgactctggagccggtgcatagaaggcctgagctgcttgacgcatgcgccgacctaattaatgaccagtggccccgaagcaggacatcgagactccattcgctgggacagtcttctgatgcgttccccctctgtctcatgctgctgagtccacatcccacattagaggctgcgccagtcgttgtcgggcatgctagactgagtagggtcctgaaccagccccagtcattactggtagagaccgtggtggtggcgcgtgcgttgagaggtcggggttttggcagaaggctaatggagggtctggaggtatttgcacgtgctcgcggattcagaaaactacacttgaccacccacgatcaggtccatttctatacacatctagggtaccaactgggagagcctgtgcaaggcctcgtcttcactagtaggcgtctgcccgctacactcctgaacgctttccccaccgctccgtccccacgcccacccaggaaggctcctaatctgactgcccaagcagccccacgagggcctaaaggtcctccgttaccacctccaccgccattgcccgaatgtttgacaattagtcctccagtgccatcaggcccaccaagcaagtctctcttggaaacccagtatcagaacgtgcgcggtcggcctattttctggatggaaaaagatatctag

SEQ ID NO: 29673 - DNA, 861 bp, Artificial Sequence
  Description of Artificial Sequence: Synthetic coding sequence
atggaactgattctaagcacatcccccgctgagttaaccctggatcctgcatgccaaccaaagctgccgctggattcgacatgtcagccagagatgaccttcaatcctggaccgaccgaattaacgctggaccctgagcatcaacccgaggagacccctgcgccatcgttggctgagctgacactggaacccgttcatcggagacccgaactgctggatgcctgtgctgatctgattaatgatcagtggcccagatcccggacttcaagattgcatagcctgggccaaagcagtgatgcgttccccctttgtctgatgctgcttagcccccaccctacgctcgaggcagccccagtggtggtgggccacgctaggttgtcccgggttctgaaccagccccagtcccttttggtggaaacagtggtggtcgccagagccctacgaggccgaggctttggtcgcagactgatggaggggctggaagtctttgcacgggcacggggtttccggaagttgcacctgacaacgcacgatcaagtgcacttctacacacatctgggttaccagctgggggagccagttcagggcctcgtcttcacctctcgccgactcccagctactttgcttaatgcattcccaactgccccttctcctcggcctccgaggaaggctcctaatcttacagctcaagccgctccacgcggacctaaagggccaccactccctccacctccgcctttaccagagtgccttacaattagcccccctgtgccctcaggccctccttccaaatcgctactggaaacgcagtaccaaaatgtgcggggacggccaattttctggatggaaaaagacatatag

SEQ ID NO: 29674 - DNA, 261 bp, Artificial Sequence
  Description of Artificial Sequence: Synthetic coding sequence
atggagctgattctgtcgaccagtcctgccgagctgacactggacccagcgtgtcagccaaagctgcctctcgatagtacgtgccagcctgaaatgacattcaatccaggacccactgaactgacgctcgaccctgagcaccagccggaggagacgcccgctccaagccttgccgaactgaccctggagcccgtgcatcggcgacccgaactgttggatgcttgcgcggacctaatcaatgatcagtggccacgctcctag

SEQ ID NO: 29675 - DNA, 30 bp, Artificial Sequence
  Description of Artificial Sequence: Synthetic coding sequence
atggagttaatactcagcacatccccctag

SEQ ID NO: 29676 - DNA, 987 bp, Artificial Sequence
  Description of Artificial Sequence: Synthetic coding sequence
atggcggagcttcaggaggtgcagattactgaggagaaaccgctcttgcccggtcagacgcctgaagccgctaagactcacagcgttgaaaccccttacggatcggttactttcacagtttacggaacgcctaagccaaaaagaccggctatcctgacataccacgacgtgggactcaactacaaaagctgttttcagcccctgttccagttcgaggatatgcaggaaatcattcagaactttgtgcgagtgcacgtggatgcacctggtatggaggaaggcgcaccagttttccctctaggctaccaatatcctagtctcgatcaattggctgacatgattccctgtgttttgcagtatctgaacttctcgacaattattggcgtgggggttggtgctggagcttacatcttagcacggtacgcgctcacagggctgactagctccataccagagatgatactgggacatctctttagccaggaagagctgtcagggaatagcgagctaattcagaagtaccgtaacatcataacgcatgccccaaaccttgataacatagagctttattggaacagttataacaacagacgtgaccttaattttgaaaggggaggcgacattaccttgcggtgcccagtaatgttggtggtgggggaccaggccccacatgaggatgcagtggtggaatgtaattccaagctggaccctactcagaccagtttcctcaaaatggccgacagcggtggtcagccgcagctgacacagcccggtaaactgacagaggcatttaagtattttttgcaagggatgggctacatggcctctagctgcatgacccgactgtctagatcgcgtacggcgagtctgacttccgctgcctcagtggatgggaatcggtctagaagcaggaccttatcccaatcgtccgagtctggcacgctgtcttcaggaccccctggtcacaccatggaggtcagctgttag

SEQ ID NO: 29677 - DNA, 1116 bp, Artificial Sequence
  Description of Artificial Sequence: Synthetic coding sequence
atggctgaactgcaggaagtgcagattacagaagagaaacctctgcttccagggcagacacctgaagccgctaaagaggcagaattagccgctaggattctgctggaccagggacagacacatagcgtagagactccttacggtagtgtcacattcaccgtgtacggaactccaaaacccaagagacctgcaattttaacctatcacgatgttggcctcaactacaagagttgctttcagccattatttcaattcgaggacatgcaggagatcatccaaaacttcgtccgggtgcacgttgacgcccctggaatggaggaaggcgctccggtcttccctctaggataccagtatccaagcctggatcagctggctgatatgataccctgtgttcttcaatacctgaacttttctacaattatcggcgtgggcgtcggagctggagcctatatactggccaggtatgccctgaatcaccctgacaccgtcgagggattggtcctgatcaacatcgacccgaacgctaaaggatggatggactgggcggcacacaaattgaccgggttgacttccagtataccggaaatgatcctgggccacctgttttctcaggaggaactcagcggcaacagcgaactgattcaaaagtacagaaatattatcacccatgctccaaatttagacaacatagagctgtattggaactcttacaacaatcgccgtgacctcaattttgaacgcggtggagacatcacattgcgatgccccgtgatgctggtcgtaggcgatcaggcccctcacgaagacgccgtcgtggagtgcaattccaagttggacccaacacagacctccttcctcaaaatggccgacagtgggggacagccacagctcacccaacccggtaagttgacagaagccttcaagtatttcctgcagggaatgggatacatggcctctagttgcatgacaaggctttctagatccagaaccgcttctctgacaagcgcagcaagtgtcgacgggaaccgttccaggtccaggaccctctcccaaagcagtgaatccgggaccctgtccagcggtcctccaggacacacaatggaagtgtcctgttag

SEQ ID NO: 29678 - DNA, 1074 bp, Artificial Sequence
  Description of Artificial Sequence: Synthetic coding sequence
atggccgaactgcaggaggtgcagatcaccgaggaaaagccactgctgccgggtcagacgcctgaggcagccaaaacacactctgtggagacaccgtatggatcggtcacatttactgtgtacggtactcctaagccaaagagacctgcgatcttaacatatcacgacgtagggctcaactataagtcttgctttcaacccttgttccaattcgaagatatgcaggaaattatccagaatttcgtgagagtccacgtggacgcaccaggtatggaagaaggtgcaccggtgttccctctcggctaccagtatcccagtttggatcagctcgcagatatgataccgtgtgttttgcagtatctcaatttctctacaatcatcggcgttggcgtcggtgcaggggcatatatcctcgcgagatacgccctaaatcaccccgacactgtggagggcctggttttaataaatatagatcccaatgcaaaagggtggatggactgggccgctcacaagctcactggactgacctcaagcatccctgagatgattctcggtcatttattttcccaagaggaactgagcggaaactcagagctgatccaaaaataccgcaacattattacacacgcccctaacctggataacatcgagctgtactggaactcttataataacaggagagatttgaactttgagagaggtggggatattacactccgatgtccagtgatgttggttgtgggagatcaggcccctcacgaggacgctgtcgtggaatgcaacagcaagctggatcccacacagacgagcttcctgaagatggccgacagcgggggacagccgcagcttacccagcctggcaaattgactgaagcattcaagtattttctgcagggaatgggatacatggcaagtagctgtatgaccaggctgagtcggtcccgtactgcgtcccttacctccgccgcttcagtagatggcaacaggtctaggtcacggaccctcagccagtcttcagagtccgggaccctgtctagtggccctcctggacacacgatggaggtgtcttgttag

SEQ ID NO: 29679 - DNA, 1074 bp, Artificial Sequence
  Description of Artificial Sequence: Synthetic coding sequence
atggccgagttacaggaggtgcagatcacagaggaaaagcccctcctccccggtcagacccccgaagctgccaaaacccactctgtggagacaccatacggaagcgtgacatttactgtgtacggcacccccaaacccaaaaggcccgctatcttaacctatcatgacgtaggcttgaactataaatcctgtttccagccgctgtttcaatttgaagatatgcaggagattatccagaactttgtgcgcgtccacgttgatgcaccgggaatggaggaaggagccccagttttccctttgggttatcagtaccctagtttagatcagctcgcggatatgatcccatgtgtgctccaatatctaaacttctccacaatcatcggcgtcggcgtgggcgctggcgcttacattctggccaggtacgcgctaaatcatcctgacaccgttgagggtttggtccttattaacatcgaccccaatgccaaaggatggatggattgggccgctcacaaattgacaggtctaacttcaagtatccctgaaatgattcttggacatctgttttcccaggaggaacttagcggaaattcggagctgatccagaaataccggaatatcatcacacacgcccctaacctcgacaatattgagttgtattggaattcttataacaaccgacgagacctgaatttcgagcgcggaggcgatattactctgcgctgccccgtgatgctggttgtcggagaccaggctccccatgaagacgcagtggtagaatgtaacagcaagttagatcctacacagacatctttcctaaagatggccgatagtggcggacagccgcagctgacacagcctggtaaactcaccgaggccttcaagtacttcctgcagggaatgggctacatggcgtcatcgtgtatgaccagactgagccgaagccgaactgcatctctgactagcgcagcaagcgtcgatggaaataggagtagatcaagaaccttatcacaaagcagcgagagcggtacactcagcagtggcccaccaggccacactatggaagtgtcttgctag

SEQ ID NO: 29680 - DNA, 1026 bp, Artificial Sequence
  Description of Artificial Sequence: Synthetic coding sequence
atggcggaactgcaggaggtccagatcacagaggagaagcccctgctgcccggacaaactccagaggcggctaagactcactcagtggaaactccttacgggtcagttacgttcacggtgtatggcacacctaagcccaagaggcccgcaattctgacatatcatgatgtgggacttaattacaaatcctgctttcagcccctcttccagtttgaggatatgcaagaaatcatacagaacttcgttcgcgtgcacgtagatgctccaggaatggaggagggtgcaccagtcttccctctgggataccagtatccgagtttggatcagctcgccgacatgattccctgcgttctccaatacctgaactttagcacaataataggggttggggtcggggctggcgcatacatactggctcgatacgctctgaatcaccccgatactgtggaggggctcgtgctgataaatattgaccctaatgccaagggatggatggattgggcagcccacaaactcaccgggctgacttcctcgatccccgaaatgatactgggacacctgttctcccaggaagaactcagcggtaattccgagctgatacagaaataccggaacatcataactcatgctcccaacctggacaacatcgagctttattggaacagttataacaaccgacgcgatttgaattttgagagaggcggagacataaccctgcgctgcccagtcatgctggtagtaggggaccaggccccacacgaggatgccgtcatggcagactctggcggacagccacagctcacgcaacccggaaaactcaccgaggcttttaagtactttctgcagggcatgggctatatggcaagctcctgcatgactagactgtcgcgaagccggacagcttctctgactagcgccgcatctgtggatgggaaccgttcaagatcacgcacgttaagtcaatcttctgagtccggaacactctctagtggccctcccggacacacaatggaagtgtcctgttag

SEQ ID NO: 29681 - DNA, 1083 bp, Artificial Sequence
  Description of Artificial Sequence: Synthetic coding sequence
atggcagaactgcaagaagtgcagataactgaagagaagcccttattaccaggacaaactcctgaggccgctaaagaggcggagctcgccgctcggatcttactcgatcaaggacaaacccacagcgtagaaactccttacggatcagtcacatttaccgtttatggaactcctaagcctaagagaccggcaattctgacgtatcacgatgtcggtctgaattataagtcttgttttcagccactgttccaatttgaggatatgcaggaaatcatccagaacttcgtgcgggtacacgtggatgcgccaggcatggaggaaggcgcacccgtgtttcctctgggataccagtaccccagcttagatcagttggccgacatgataccctgtgtgctacagtatctgaatttctccacaatcattggagttggtgtaggtgcaggggcatatattctggctaggtatgctctaaaccatcctgataccgtggagggcctggtgctgatcaacatcgatcctaatgccaaaggctggatggactgggcggctcacaaactcaccggactgacctccagcatccccgagatgatcctgggacacttgttctcccaggaagagctctcgggaaactccgagctgattcaaaaatatcgcaacattattacgcacgcacctaacctcgataacatcgaactctattggaactcatataataaccgcagagacctgaactttgagagagggggagacattactctgcggtgcccagttatgctggtggtggagtgtaattctaagttagatcccacacagacttcttttctgaagatggccgactctggtggtcagccccagctgacacagccaggcaaactaaccgaagcctttaagtatttcctacaaggaatgggctacatggcttcttcttgtatgacacggctcagtagatcccgcactgcgtccttgacatcagctgcatctgtcgacggcaatcgcagcaggtcccgcacgctttctcagagctccgaaagtggaaccctgagctctggccctcctggacatactatggaggtgagctgctag

SEQ ID NO: 29682 - DNA, 1116 bp, Artificial Sequence
  Description of Artificial Sequence: Synthetic coding sequence
atggctgagctgcaggaagtccagattactgaggagaaaccgcttctgcccggacaaacccctgaggcagctaaagaggcggagctcgccgctcgtatcttactggaccaaggccagacccattcagtggaaaccccgtacgggagcgttacatttaccgtgtacggcacgcccaagcccaaacgtccggctatcttaacttaccatgatgtagggcttaattacaaatcttgttttcaacctttgttccagtttgaggatatgcaggaaataattcagaattttgtgagagtgcatgtggacgccccaggcatggaggaaggagctcctgttttccctctgggataccaatacccttcacttgaccaactcgccgacatgatcccttgcgtgctccagtacctgaactttagcacaatcattggagtaggggtgggcgctggcgcttatattttggctaggtatgcactgaaccacccggataccgtggaggggctggttttaatcaatatcgatcccaatgcaaaaggctggatggactgggctgctcataagctcaccggtcttacatcctcgatccccgagatgatcttgggccatctgttctcacaggaagaattgagcggcaattccgaactgatccagaagtatcgcaacatcatcacccatgcacccaatctggataacatcgaactgtattggaacagttataacaacaggagagacctgaatttcgagagaggcggagatatcactctccggtgtcccgtgatgcttgtagtcggggaccaggccccacatgaggatgcagtggtcgaatgtaatagtaaactggatcctacccaaacctcgttcctgaaaatggcagatagcggtggccagccacagctgacccagcccggaaaactgactgaggcctttaaatatttccttcaaggtatggggtatatggccagcagctgtatgacacgcctgtccaggtccagaaccgcaagcctgacctcagccgcatccgtagacggcaatcgatccagatcaaggaccctttcccagtcatccgaatctggcaccctgtcttcaggtccccctggccatactatggaggtcagctgctag

SEQ ID NO: 29683 - DNA, 1116 bp, Artificial Sequence
  Description of Artificial Sequence: Synthetic coding sequence
atggctgaactccaggaagtccaaattacagaagaaaaaccacttctccctggccagacaccggaagcggctaaagaagcggagttggccgctcggatcctgctggatcaagggcagacacattcagtggagaccccttacggctccgttacttttacggtctacgggacaccgaagcctaagcgcccagccattctcacgtaccatgatgtggggttgaattataaatcttgttttcagcctctgttccagttcgaggacatgcaggagatcatccagaattttgtgcgggtgcacgttgacgcgccagggatggaagaaggcgctcctgtgttcccactagggtaccagtatccatcactggatcaacttgctgatatgattccctgcgtgctgcaatatctgaacttttccacaatcattggggtcggcgttggagcaggcgcatacattttagctagatatgcactcaaccaccccgatacagtcgaaggtctggttcttataaacattgaccctaatgctaaaggttggatggattgggctgcccacaagttgacagggctgacctccagcatcccagagatgattttgggtcacctgttctcgcaggaggagcttagcggcaattcggaactgatccagaagtatcgcaacatcatcactcatgcacccaatctggacaatatcgaactgtattggaacagctacaacaacagacgggacttgaatttcgaacggggaggggatatcactctcaggtgccccgtgatgttggtcgttggggatcaggcaccacacgaggacgccgttgtggagtgcaattccaaactagaccccacccagactagctttctaaagatggccgatagtggcggtcagcctcagctgacgcaaccaggcaaactgaccgaagcattcaagtacttcctgcagggaatgggatacatggcatccagttgtatgacacgcctatcgaggagcaggacagcaagcctgacgtcagccgcttcggtggacggcaatagatctcgcagtcggacactgagtcaatcatctgaaagtgggactctctccagcggtccaccagggcatactatggaagtctcatgttag

SEQ ID NO: 29684 - DNA, 987 bp, Artificial Sequence
  Description of Artificial Sequence: Synthetic coding sequence
atggctgaactacaggaggtccagatcacagaggagaagccactgctgcctgggcagacacccgaagccgcaaagactcactcagtcgaaactccttatgggtctgtaacatttacggtgtacgggacacccaagcctaaacggccagccattttaacgtatcacgacgtgggactgaactacaagtcgtgcttccaacctctcttccaatttgaggatatgcaggagataattcagaatttcgtccgtgtgcacgtggatgccccagggatggaagagggtgcacctgtgttccctctggggtatcaataccccagtctggatcaactggcagatatgataccttgtgttctccaatatctcaacttctcaacgatcatcggtgtgggtgtaggggctggagcttacattctggcccgatatgcgctgacgggcttgactagcagcatccctgaaatgatcctgggtcatctctttagccaggaggaactgagtggaaactcagagctcatccaaaagtaccgtaacattattacacacgccccaaacttggacaacattgaactgtactggaactcttataacaataggagggacctgaacttcgagcgaggaggcgacattaccctgcgctgccctgttatgcttgtcgtgggtgaccaagcaccccatgaggatgccgttgtggagtgcaacagcaagcttgaccctacccagacctcattcttgaaaatggctgatagcgggggacagccacagctcactcagccaggaaagctcacagaggcatttaaatacttcctccagggcatgggatacatggccagctcctgtatgaccagactcagcagatcccgaactgcatctctgactagtgccgcttccgtggacggaaaccgatctcgttcccgtacactctcgcagtcgagtgagtcaggtactctttcctccggacccccaggccacactatggaagtgtcgtgctag

SEQ ID NO: 29685 - DNA, 1026 bp, Artificial Sequence
  Description of Artificial Sequence: Synthetic coding sequence
atggctgagcttcaagaggttcagataactgaggaaaaacccctgcttcccggtcagacacctgaggctgcaaagactcactctgtggagacaccctacgggagcgtaacatttacagtgtacggtacgcccaagcccaagcgaccagcaatcttgacatatcacgatgtggggttgaattataagtcatgtttccagcctctgtttcagttcgaagatatgcaggagattatccagaatttcgtacgagtgcatgtggatgccccaggtatggaggaaggtgctccagtgttcccacttgggtaccaatatccttccctcgaccagcttgcagacatgatcccttgtgttctacagtatctgaatttctctacgatcatcggggtcggggtgggagcaggcgcttatatcctggcacggtacgcgctaaaccacccagacaccgtcgaggggttggtgctgataaacatagaccccaacgcaaaaggctggatggactgggccgcacataaattgacaggtctgacatcctcaattccagagatgatcttggggcacttgttttcacaagaggaactgtccggaaactccgaactcatccagaaatatcgtaacattataacccacgcccctaatcttgacaacatagagctatattggaatagttataataacaggcgcgatctgaattttgagcggggaggggacattacacttcgatgtcctgtaatgctggttgttggcgatcaggctccccacgaggacgctgtcatggccgattccggtggccaacctcagctgacgcaaccaggcaagctgaccgaggcctttaaatactttcttcaaggtatgggttacatggcctcttcttgtatgacgaggctgtcgaggtctcggacagcctcacttacgtccgccgcttccgttgacggcaacaggtcccggagtcgcacactgagccagtcctctgagtccggcaccctctcttccggcccaccaggtcacaccatggaggtgtcctgttag

SEQ ID NO: 29686 - DNA, 1116 bp, Artificial Sequence
  Description of Artificial Sequence: Synthetic coding sequence
atggcagagctacaggaggtgcaaatcacggaagaaaaaccactgttaccgggacaaacacccgaagcggctaaggaagcagaactggccgcacgaatcctgctggaccagggccagacccatagtgtggagacaccatatgggtcggtcacattcactgtttacgggactcccaaaccaaagagaccggctatcctaacctatcatgacgtgggcctcaattataaatcttgtttccagcccctatttcagttcgaggatatgcaggaaatcattcagaacttcgtgagggtgcatgtggacgcccctggtatggaagagggagctcccgtctttccgctaggttaccagtacccttcccttgatcagctggccgacatgatcccctgcgtcctccagtatctgaatttcagcactataatcggcgtgggagtaggcgctggcgcttatattctcgctagatacgcgctcaaccatccggacactgtcgagggactagtgttgatcaacattgacccaaatgccaagggatggatggattgggccgcacacaaactcactgggctgacatcgagcattcccgaaatgatccttggccacctgtttagtcaggaagaactgagtgggaactccgaactcatccagaaatatagaaacatcattacccatgctcctaacctggataacatcgagctgtattggaacagttataataaccgcagagatctcaacttcgagaggggcggtgatatcactctcaggtgccccgtcatgctggtcgtgggtgatcaagcacctcatgaagacgcagtcgtggagtgtaatagtaaactggatccaacccagacgagtttcctcaaaatggccgattctggaggtcaacctcagctcacccaaccaggaaagctgacagaagccttcaaatactttctgcagggaatgggctacatggctagcagctgtatgacccggctgtcccgcagcagaacagcttcgctgacctctgctgcttcggtggacggcaatagatcgagaagtcgaacgctctcacagagctcagaatcaggcaccctgtcttccggccctcccggacacaccatggaggtctcctgctag

SEQ ID NO: 29687 - DNA, 1104 bp, Artificial Sequence
  Description of Artificial Sequence: Synthetic coding sequence
atggagaacgggggaagtatgcaggctacaatggccgagctgcaggaggtgcaaatcacagaggagaagcccttgctcccaggtcagacaccagaagcggcaaagacccactcagtggagacaccgtatgggtcagtaacctttactgtctatggcactcctaagcctaagcggcctgccatactcacttaccatgacgtcggccttaattataagtcttgtttccagccactctttcagttcgaggacatgcaagaaataatccaaaattttgtgcgggtccatgtggacgcgcctggcatggaagagggtgctcccgttttccccttgggataccagtacccaagccttgaccagcttgcggacatgattccgtgcgttctacagtacctgaatttctctacaattatcggcgtgggtgtcggcgctggagcttacattttggcgaggtacgctcttaatcaccccgacactgttgaaggacttgtcctgatcaatatcgacccgaacgctaaaggatggatggactgggcggctcacaagctgacgggcctgacaagttccataccggagatgatacttggtcatctgtttagtcaggaggaactctccggaaatagtgagttaattcagaaataccgcaatataattacccacgccccaaatctggacaacatcgagctctactggaactcatataataacaggcgggaccttaactttgaaagggggggtgacatcacgcttcggtgccccgtcatgttggtggtaggtgatcaggctcctcatgaggatgccgtggtcgagtgtaatagtaaactcgatccaacccagacgagttttctcaaaatggcagattctgggggacagccacagctgacccaacctggcaaactgaccgaagcgtttaaatactttctccaggggatgggctatatggccagcagttgtatgacacggctgtctaggagtagaacagcgagcttaactagtgctgcctctgttgacggcaatcgatctagatcaagaaccctgtcccaatccagcgagtcgggaactctgtcatctggacctccaggccatactatggaagtgagctgttag

SEQ ID NO: 29688 - DNA, 504 bp, Artificial Sequence
  Description of Artificial Sequence: Synthetic coding sequence
atggctgagctccaagaagtccagattacagaagaaaagcctttactacccggacaaacacccgaggccgcaaagacccatagtgtggagacaccatatggctccgtgaccttcaccgtgtacggtacgcctaaaccaaaaaggcctgccatcttgacatatcatgatgttggcctgaactataagagttgtttccaaccactgtttcaattcgaagatatgcaagagattattcagaattttgtacgagttcacgtagatgctccagggatggaagagggcgcaccggtattccctctaggctaccagtacccttcacttgatcaattagctgacatgatcccctgcgttcttcagtaccttaatttctctacaataatcggagtgggagtgggcgctggtgcatatatcctggcaaggtatgctttgaatcacccggacactgtggagggcttggtgttgatcaatattgacccgaacgccaagggctggatggactggtag

SEQ ID NO: 29689 - DNA, 1074 bp, Artificial Sequence
  Description of Artificial Sequence: Synthetic coding sequence
atggcagagctgcaagaagtgcagatcaccgaggagaagccgctgctgccaggccaaacgccggaagcagcaaagactcatagcgtggaaaccccctatggaagcgtcactttcaccgtctacggcacccctaaaccgaaacggcctgctattcttacatatcatgacgtagggcttaattataaatcttgcttccagccattgttccagttcgaggacatgcaggagatcatccagaattttgttcgcgtgcatgtcgacgcccctggcatggaggaaggagccccagtgttcccgctcggatatcagtacccctcactggaccagttggccgacatgatcccttgtgtactgcagtacttgaatttctccacaatcatcggcgtgggagtaggagctggggcatacatcctggctaggtacgcccttaatcatcccgacaccgttgaggggctcgtgctcattaacatagatccgaacgccaagggatggatggactgggctgcccataaattgaccggcctcactagctcaatcccagagatgatcctgggacacttatttagtcaggaggagctgtccggaaatagcgagctgattcaaaaatatcggaatatcattacgcacgcaccgaacctcgacaacatagaactgtactggaattcctataacaatcggcgagaccttaattttgaacggggtggagatataacactaagatgtcctgtaatgctggtcgtgggagatcaggcacctcacgaggatgcagtggtggagtgtaatagtaagctggatccaactcagacttcattcttaaagatggcagattcgggtggacaaccccagctgacacagccaggcaaactcacggaggcattcaagtactttcttcagggcatgggttacatggcttcatcttgcatgacgagattatcgcgaagcagaaccgcctcactgacgagcgctgcctccgtggatgggaatcggagccgcagccgcaccttgagtcagtcttccgagagcggcacattatcttctggccctcctggacacaccatggaagtgagctgttag

SEQ ID NO: 29690 - DNA, 522 bp, Artificial Sequence
  Description of Artificial Sequence: Synthetic coding sequence
atggccgaactgcaggaagtgcaaatcacagaggaaaagcccctgttacccggtcagacgcctgaggctgctaaggaggcggagctcgcagccaggatcttactggatcagggccaaactcatagcgttgagacaccatacggatctgtgactttcacggtttatggcacgcccaagcccaaaagacctgccattctcacataccatgacgtggggctcaattacaagtcttgttttcagcccttatttcagtttgaagacatgcaggagattatccagaattttgtgcgcgtgcatgtggatgctccaggaatggaggaaggggctccagtgtttcctctgggataccagtatccgtccctggatcagcttgcagatatgattccatgcgtgctccagtacctcaatttcagtacgattattggggtaggcgttggggcaggcgcttacattctggctaggtacgcactcaatcatcccgacactgtagaaggccttgtgttgatcaatattgatccatag

SEQ ID NO: 29691 - DNA, 759 bp, Artificial Sequence
  Description of Artificial Sequence: Synthetic coding sequence
atggcagagctccaagaggtgcagattaccgaggagaaacccctgttgccaggccagactccagaagcagcgaaggaggcggagctggccgctaggatcctgctggatcagggccagacccatagcgtggagacaccttacggcagtgtgactttcacagtgtatgggacgcctaaaccgaagcgcccagcaatactcacttaccatgatgttgggctgaattataaaagctgtttccaacctcttttccagttcgaggatatgcaggaaatcatccagaacttcgtccgggtacatgtggatgcaccaggaatggaggagggggctcccgtgtttccgttaggataccagtatccttcactggatcagttggcagacatgattccttgcgtgctgcaatacctgaacttctcgacaataattggagtcggcgttggagccggagcttacattctagccaggtatgctctgaaccatcctgatactgtcgagggactggttctgattaacatcgaccccaacgcaaagggttggatggactgggcagctcacaagctcactggcctaactagttccatcccagagatgatcctcggacaccttttcagccaggaagagctctcagggaatagcgagctcattcagaagtaccgaaacattatcacacatgcccctaacctcgacaatatcgagctctactggaactcttacaacaaccggagggacttaaacttcgagcgcggaggtgacataacttag

SEQ ID NO: 29692 - DNA, 525 bp, Artificial Sequence
  Description of Artificial Sequence: Synthetic coding sequence
atggctgagctacaagaggtgcagataactgaagagaaacctctgcttcctggtcaaacaccagaggctgccaaaacccacagtgtcgagacgccttacggctctgttaccttcaccgtctacggcactcctaaacccaagaggccagcaattttgacttaccatgacgtggggctgaactacaagagctgttttcagcctctgttccagtttgaggacatgcaggagatcattcagaacttcgtacgagtgcacgtcgatgcacccggtatggaagagggtgctcctgttttccctcttggctatcaatatcccagcctagaccagctagctgatatgataccctgcgtgcttcaatatctgaactttagcactatcataggggtgggcgttggcgctggagcttatatccttgctcggtacgccctaaatcatcctgataccgtagagggtctggtccttattaacatcgaccctaacgccaagggttggatggattgggcagctcacaaactgactgggtag

SEQ ID NO: 29693 - DNA, 1074 bp, Artificial Sequence
  Description of Artificial Sequence: Synthetic coding sequence
atggcagagctgcaggaggtgcagatcaccgaagaaaaacctctgctcccagggcagactcccgaagccgctaagactcacagcgtggagacaccctatgggtctgtgactttcaccgtatacggaacaccgaagccgaaaaggcccgctattcttacttatcacgatgtcgggctgaattacaagtcctgcttccagcctctcttccagttcgaagatatgcaagagataattcagaatttcgttagggtccatgtagatgcccctggcatggaagaaggagcaccagtctttcccctaggttatcagtacccaagtttagaccaactcgccgacatgatcccctgtgtcctgcagtacttgaattttagtaccattatcggggtgggtgttggcgcaggggcatatattctggcccgatatgccctgaaccaccccgacacagttgaaggactggtacttataaacattgatccgaatgccaaaggttggatggattgggcggcacacaagctgaccggacttacctcatcgattccagaaatgattctgggccacttattttcacaagaagaactgagcggtaattccgaattgattcaaaaatacagaaacattataacacatgccccaaacctggataatattgaactgtattggaacagctacaacaaccgacgggacctgaacttcgagcgcggtggggatattactcttcgctgccccgtgatgttggtggtcggagaccaggcccctcacgaggatgccgttgtcgagtgtaactccaaacttgacccgacccaaacatctttcctcaagatggctgatagcggcggtcagcctcagctcacccaaccgggaaaactgactgaggcattcaaatactttcttcagggcatgggttacatggcctcaagctgcatgacccgcctcagtcgttcacgaactgcctcccttacatcagcagcttctgtggacggcaaccgctcgagatccaggacacttagccagtcatctgagtcagggactctgagctccgggcctcctggacataccatggaggtgagctgttag

SEQ ID NO: 29694 - DNA, 450 bp, Artificial Sequence
  Description of Artificial Sequence: Synthetic coding sequence
atggccgagctgcaggaagtacaaattactgaagagaagccactcctccccggacaaactcctgaagccgcaaaagaggctgagttggctgcccgaattcttctagatcagggccagacccacagcgtggaaaccccttacggttctgtgaccttcactgtgtacggcacacctaaaccgaagagacctgctatcttaacctaccacgatgtgggtctcaattacaaatcttgttttcaaccactgtttcagttcgaggacatgcaagagattatccagaatttcgtgcgcgtacatgtcgacgcacccggtatggaggaaggagcccctgtctttcctcttggatatcagtacccgagcctggaccagctagccgacatgattccatgcgtgcttcaatatttgaatttcagtacgattattggcgtgggtgtgggtgcaggagcctag

SEQ ID NO: 29695 - DNA, 261 bp, Artificial Sequence
  Description of Artificial Sequence: Synthetic coding sequence
atggccgagctgcaggaagtccagattaccgaggagaagcccttgctgcccggtcaaacacccgaagctgccaaagaggccgagctggccgctcggattctgctcgaccaggggcagactcacagtgtggagactccatatggttccgtgaccttcaccgtatatggcacacccaagcctaaaagacctgcaatcttgacctaccacgacgtgggactcaattacaagtcgtgctttcagccactcttccagttcgaatag

SEQ ID NO: 29696 - DNA, 390 bp, Artificial Sequence
  Description of Artificial Sequence: Synthetic coding sequence
atggctgagctgcaagaagtgcagatcactgaagagaagccattattacctgggcagactcctgaggcggctaaggaggctgagttggcggcacgcatactcctggatcagggccagacccacagcgtcgagaccccctatggttctgtaacgttcaccgtctatggcacaccaaagcccaaaaggcctgcaattttaacgtatcacgacgtgggtctgaattataagtcctgtttccagcctctcttccagtttgaggatatgcaagaaatcattcagaactttgttcgcgtgcacgtggacgcacctgggatggaagagggagcgccagtgtttccactgggctatcagtacccatccctggaccagctggctgacatgatcccttag

SEQ ID NO: 29697 - DNA, 447 bp, Artificial Sequence
  Description of Artificial Sequence: Synthetic coding sequence
atggctgaactgcaagaggttcagatcaccgaggaaaagcctctcctaccaggtcaaactccggaggctgccaaagaggctgaactggcggctcgaatcttactagaccagggccagacacactctgtcgagacaccctatggttccgtcactttcactgtgtacggcacccccaagcctaaacgccctgccattttaacctaccatgatgtgggcctgaactataagtcgtgtttccagccccttttccagtttgaggacatgcaggagattatccaaaactttgtgagggtccatgtggacgcccctgggatggaagaaggggctccagtgttcccactgggataccagtatcctagcttggaccagttggctgatatgattccatgcgtgcttcagtacctgaacttttcaaccattatcggtgtgggcgttggcgctggttag

SEQ ID NO: 29698 - DNA, 405 bp, Artificial Sequence
  Description of Artificial Sequence: Synthetic coding sequence
atggcagaattgcaagaggtccagatcacagaagagaaaccactcctgcccggtcagacacctgaagcggctaaaactcacagtgttgagacgccttacggaagtgtaacctttactgtgtacggcacacccaaacccaagaggcccgctatcctgacctatcacgacgttgggttgaactacaaaagttgttttcaaccactgttccagtttgaggacatgcaagagatcatacagaacttcgtgagggtgcatgtggatgctcccggtatggaagaaggcgcaccagtgttcccactcgggtaccagtatccatcacttgatcaactggcggatatgattccctgcgtactgcagtatctcaatttttccaccattattggggtcggagtgggtgcaggctag

SEQ ID NO: 29699 - DNA, 327 bp, Artificial Sequence
  Description of Artificial Sequence: Synthetic coding sequence
atggcagagctccaagaggtccagatcacagaggaaaaacctttgctccctggccagacccccgaagcagctaagacacattctgtggagaccccgtacggatcggtgaccttcaccgtttacgggacaccaaaaccaaaaagaccagccatactgacttatcacgatgttggcctcaattacaaatcttgcttccaaccactctttcagtttgaggatatgcaggagataatccagaattttgtccgggttcatgtggacgccccagggatggaggaaggagcccctgtgtttcccctgggctatcagtatccaagccttgattag

SEQ ID NO: 29700 - DNA, 363 bp, Artificial Sequence
  Description of Artificial Sequence: Synthetic coding sequence
atggcggagcttcaggaagtgcagattactgaagagaaacctctgttgccagggcagacccctgaagcggctaagactcacagcgtcgaaaccccctacggctcagtgacattcaccgtatatggaactcccaagcctaagagacctgccattctgacataccacgatgttggcctcaattataagagctgcttccaaccgttattccagttcgaggacatgcaagaaattattcagaatttcgttagggtgcacgtggacgcccctggaatggaggagggggcacccgtgtttcctcttggctatcaataccccagcttagaccagttggctgatatgatcccctgcgtgttgcagtactag

SEQ ID NO: 29701 - DNA, 300 bp, Artificial Sequence
  Description of Artificial Sequence: Synthetic coding sequence
atggcggaactgcaggaggtgcaaatcaccgaggagaagccgttgttgccaggccaaaccccggaagccgctaaggaagcagagctggccgctagaattctccttgatcaaggacagacacattcagtcgaaaccccctacggcagcgtgacttttacagtttatggcacaccgaagccaaagcgaccggcaattctgacataccatgacgttgggctcaactacaagtcatgcttccagcctctatttcaattcgaggacatgcaggaaattatacagaactttgtaagggttcactag

SEQ ID NO: 29702 - DNA, 279 bp, Artificial Sequence
  Description of Artificial Sequence: Synthetic coding sequence
atggcggagctgcaagaggtacagatcaccgaggaaaaaccactcttacccggacagacacccgaagccgcaaaaactcattccgtcgaaacaccttatggttccgtcaccttcaccgtgtacggtacccctaaacctaaaaggcctgcgatcttgacataccatgacgtcggtcttaactacaagagttgctttcaacccttatttcagtttgaagatatgcaagagattattcaaaactttgttagggtgcacgtagatgccccaggcatggaatag

SEQ ID NO: 29703 - DNA, 462 bp, Artificial Sequence
  Description of Artificial Sequence: Synthetic coding sequence
atggcggaactccaggaagtccagattactgaggagaagcccctgcttccaggtcagactcctgaggcggctaagactcactcagtggagacaccgtacgggagcgtcactttcacggtgtacggaacccctaaacctaagcggccagctattctgacatatcacgatgtgggactcaactataagagctgtttccaaccgctgttccaattcgaagatatgcaagagattatacagaatttcgtcagggtgcacgtggatgcgccaggcatggaagagggcgctcccgtgttccctctaggttatcagtaccccagcctcgatcagcttgccgatatgattccatgtgtgctgcagtatctcaacttcagtacaattatcggagtgggagtaggcgctggggcttacatcctggctaggtatgcgctaaaccatcccgatactgtggaaggcctggtgtag

SEQ ID NO: 29704 - DNA, 1074 bp, Artificial Sequence
  Description of Artificial Sequence: Synthetic coding sequence
atggccgagctccaggaagtgcagattacagaagagaagccgcttctgccaggacaaacccccgaggccgcaaaaacccatagcgtggagactccatatggctcggtcaccttcacggtgtacggcaccccaaagccaaagagacctgcgatcctcacgtaccacgatgttggattaaactacaagtcatgcttccagccactattccagttcgaggacatgcaggagattatacagaactttgtccgcgtccatgtcgacgccccaggaatggaggagggagctcctgtgttccctttgggatatcaatatcctagtcttgatcaactggcagatatgataccttgcgttctgcagtacctgaatttttccacgattatcggagtgggcgtcggcgcaggcgcatacatcttggctcgatacgccctcaaccatcccgacacagtggaggggctggtgctcatcaacatcgatcctaacgccaaaggctggatggattgggcagcccacaagctcacgggcctcacctcatcaattccggagatgatcctgggacatttgttctcccaagaggaattaagtggcaactctgagctgatccagaaatacaggaatatcatcacccacgcgcctaatctggacaatattgaactgtattggaatagctacaataatcggagggatcttaattttgagcgaggcggagatatcaccttgcgctgcccagtgatgctagtcgtgggagatcaggcccctcatgaagacgccgtagtcgagtgcaattcgaagcttgacccaacccaaacctcatttctgaagatggctgattccgggggacagccgcagctcactcagcctggaaagcttactgaagcatttaagtacttcctgcagggcatgggatatatggcaagctcatgtatgacccgtctttcacgaagtagaactgccagccttacctctgctgcgagcgtagatggaaatagatcccggtcgcgtacactgtcccagagcagcgaatcaggaaccctgagctcgggaccgcctggccacactatggaggtatcttgctag

SEQ ID NO: 29705 - DNA, 585 bp, Artificial Sequence
  Description of Artificial Sequence: Synthetic coding sequence
atggctgagttacaggaggtacagattacagaggagaaaccacttttgccagggcagactcctgaggccgcaaaggaagctgagctggccgcacggattctgctggaccagggccagactcacagtgtggaaactccttatgggtctgtgacgttcacagtgtacggaacgcccaagccaaagcggcctgctatactcacgtaccatgacgtgggccttaactataaaagttgttttcaaccgctgttccaatttgaagatatgcaagagattattcagaacttcgtaagggtccatgtggatgcacctggcatggaagaaggcgcacccgtatttccattgggataccagtacccctcactcgaccaactggctgacatgataccctgcgtgttgcagtaccttaacttcagtaccataattggtgttggcgtgggagcaggtgcatatatccttgcccgatacgccctgaatcacccagatacggtcgagggcctggttcttatcaatattgatccaaacgcgaaagggtggatggattgggccgcacataagctcaccggcctgactagctctatcccctag

SEQ ID NO: 29706 - DNA, 387 bp, Artificial Sequence
  Description of Artificial Sequence: Synthetic coding sequence
atggcagagctccaagaggttcagattactgaagagaaacctctgctgccaggccagacacctgaagctgccaaaacccactcggtggaaacaccttatggctccgtgactttcaccgtgtacggaactcctaaacctaagcgtccagctatattaacctaccatgatgtcgggctcaattataaaagctgttttcaaccactgtttcaattcgaggacatgcaggaaattattcagaactttgtgcgcgtccatgttgacgctcctgggatggaggaaggagcgcctgttttccccttgggttaccagtacccaagtcttgatcaactagccgatatgatcccatgtgttcttcagtacttgaatttctctaccatcatagggtag

SEQ ID NO: 29707 - DNA, 660 bp, Artificial Sequence
  Description of Artificial Sequence: Synthetic coding sequence
atggccgaactgcaagaagttcagatcaccgaggaaaagccattgttgcctggacagactccggaggctgccaaggaggccgagttggcagcccgaatcctgcttgaccaggggcagacgcattctgttgaaaccccatacggttccgtaacctttacagtgtatgggacaccaaaacccaaacgcccagcaatcctgacctatcatgatgtcggactcaattacaaaagctgtttccagccgctgtttcagttcgaggatatgcaggagataatccagaactttgtaagagtacacgtcgatgccccaggcatggaagagggggcaccggtgtttcccctgggctatcagtatcccagtttagatcagctggctgacatgatcccctgcgtgttacagtatctcaactttagtaccatcatcggcgtgggcgtgggggctggagcctacatcctcgccaggtatgccctgaatcaccctgacacggtagaggggcttgtgcttattaacattgaccctaacgcgaagggctggatggactgggctgcccataaactaacaggtctgacctcaagcataccggagatgatcttgggccacctgtttagtcaggaggaactatcgggaaatagtgaactgatccaaaagtacaggaattag

SEQ ID NO: 29708 - DNA, 666 bp, Artificial Sequence
  Description of Artificial Sequence: Synthetic coding sequence
atggctgaactgcaggaagttcagattactgaagaaaagccccttttaccgggacagacacccgaggctgctaagacccacagcgtcgagaccccttacgggtcagtgaccttcactgtgtacggaacaccaaaacctaaacgtccggctattctgacctaccatgacgttggcctaaattataaatcttgctttcaaccactctttcagttcgaggatatgcaggaaatcatacaaaacttcgtacgggtgcatgtggatgcacccggaatggaggaaggcgcacccgtctttccactgggctatcaatatccatcactggatcagctggctgacatgattccatgcgtgcttcagtatctgaacttcagcaccatcatcggagtaggggtcggtgccggtgcatatattctggctcgctacgccttgaatcatccagacactgttgaaggtctggtccttatcaatattgatccaaatgcgaagggttggatggactgggccgctcacaagttgaccggactgacgtcttctatccctgaaatgattctggggcacctctttagccaggaagagctgtcaggaaatagtgagcttattcagaagtatcgcaatatcatcactcatgccccaaacctcgataacatcgagctgtactggaattag

SEQ ID NO: 29709 - DNA, 1116 bp, Artificial Sequence
  Description of Artificial Sequence: Synthetic coding sequence
atggctgaactgcaggaagttcagattaccgaagagaaacctctgctgcctggacagacaccagaagctgccaaggaggctgaactggccgctagaattttgctggaccagggacaaacccacagtgtggagacaccctacggatccgttaccttcactgtgtatgggactccaaagccaaaaaggcccgctatcctcacatatcatgatgtcgggttaaattataagtcctgcttccagcccttattccagtttgaagatatgcaagaaattatacagaattttgtgagagttcatgttgatgctcctggtatggaggagggggcaccagtgttccccctaggataccagtatcctagccttgaccagctggccgacatgattccctgtgtcctacagtatttgaacttctcaaccattattggcgtcggggtgggcgctggcgcatatattcttgccagatacgcacttaatcatccagacactgtggagggacttgtcctgataaacatcgaccctaacgccaaaggatggatggactgggcagcacataagttaactggacttacctcctcaatcccggagatgatcctgggccatctttttagccaggaagaactgagcggtaacagtgagctaatacagaagtacaggaatattattacgcacgctccaaacctcgataatatagagctgtattggaacagctacaacaaccgcagagacctgaatttcgaaagaggtggagatatcaccctccggtgccccgtcatgctggtcgtaggagaccaggcccctcatgaggacgctgtcgtggagtgtaatagtaagcttgaccctacccaaacttcattcttgaagatggcagactccggtggacagccgcagttgacccaacccggaaaactaacggaagccttcaaatacttcctccagggtatgggttatatggcatctagctgcatgacccgcctaagcaggagccgcaccgcatctcttacgtcagccgcttccgttgatggcaatcgctcgcgctcaaggaccctgagtcagagcagtgagagcggtactctgtcttctggcccaccgggacatacaatggaagtatcctgttag

SEQ ID NO: 29710 - DNA, 432 bp, Artificial Sequence
  Description of Artificial Sequence: Synthetic coding sequence
atggcagaactgcaggaggtgcagataaccgaggagaagcccctgctacctggccagactccagaggctgccaagacccatagcgtggaaaccccttatggttccgtcacattcaccgtttacggcacaccaaagcccaaacggccagccatccttacttaccacgatgttggcctcaactacaagagctgctttcagccacttttccaattcgaagacatgcaggagattatacagaattttgtgcgagtccacgtggacgccccaggcatggaggaaggcgcaccggtgttcccactgggatatcaatacccttcactggatcaactggcagatatgatcccatgcgtcctacagtacctcaacttttccactattatcggggtaggcgttggggctggggcttatatcctggccaggtacgccctgtag

SEQ ID NO: 29711 - DNA, 483 bp, Artificial Sequence
  Description of Artificial Sequence: Synthetic coding sequence
atggcagagctgcaggaagtgcaaatcactgaagaaaagcccctgctgccaggccagactcctgaggccgctaaaacacactctgtggaaaccccttatggatccgttacattcactgtctatggcacacccaagcccaaaagacccgcaatcctcacctatcatgacgttggcctcaactataaaagttgtttccagcctctgtttcagttcgaagacatgcaagagattattcagaacttcgtcagggtacatgtcgacgccccaggaatggaggagggagcgcctgtttttccacttggctatcagtacccatccctggatcagttagcagacatgatcccctgcgtgctacagtacctgaatttctcaaccattattggcgttggggtgggggctggcgcttacatcctggcacgctatgctctcaaccacccggatactgtagaaggtctggtactaatcaatatagatcctaactag

SEQ ID NO: 29712 - DNA, 426 bp, Artificial Sequence
  Description of Artificial Sequence: Synthetic coding sequence
atggcagaactgcaggaggtacagatcacagaggagaagcctctgttgcctgggcagacgcctgaagccgcaaaggaggccgagctggccgcaagaatcctcctagaccaaggccaaacacactcagtagaaactccatacgggagcgttacctttacagtatacggaacccctaagccgaaacgaccagcaatcctgacttatcatgatgtgggactgaattacaaatcctgtttccagccattgttccagttcgaggatatgcaggagatcattcaaaacttcgtgcgtgtgcacgtcgacgctcccggaatggaggaaggggcacctgtttttcctctaggctaccagtacccctctttggatcaattagcagacatgattccctgtgtgcttcaatacttaaacttctccactatcatctag

SEQ ID NO: 29713 - DNA, 357 bp, Artificial Sequence
  Description of Artificial Sequence: Synthetic coding sequence
atggccgagctgcaggaagtgcaaatcaccgaagagaagccgctgcttcctgggcagacccctgaggcagccaaggaggctgaactggcagctcggattcttctggaccaagggcagacacactccgtggagactccctacggtagcgtgacgttcaccgtgtatggaacacccaagcctaaacggccagccatactcacttaccatgacgtgggactgaactataagtcttgctttcaacccctgttccagttcgaagacatgcaggaaatcatccagaactttgtgagagtgcatgtggatgcaccaggcatggaggagggcgcaccagtctttcccctggggtatcaatattag

SEQ ID NO: 29714 - DNA, 423 bp, Artificial Sequence
  Description of Artificial Sequence: Synthetic coding sequence
atggccgagctgcaagaggtgcagattaccgaggagaaacctctcctccctggacagaccccggaggccgcaaaagaggcagaattggccgcaagaatactcctcgaccagggccagacacattcagtggagaccccatatggatcggtgacattcactgtatacggcaccccgaaacctaagcggccagctatacttacttatcacgacgtgggactgaattataaaagctgcttccagccactttttcagtttgaagatatgcaagaaatcatacagaatttcgtccgcgtccatgtcgatgctccaggcatggaggagggtgcaccagtatttccactcgggtatcagtacccaagtctggatcagttggccgatatgataccttgtgtattacagtacctgaacttctcgacaatttag

SEQ ID NO: 29715 - DNA, 435 bp, Artificial Sequence
  Description of Artificial Sequence: Synthetic coding sequence
atggcagagctgcaggaggtgcagatcaccgaagaaaagcctctcctccccggacagacacctgaggctgccaagacacactctgttgaaactccttatggaagcgtcacttttactgtttacggtactccaaaacctaaacgcccagctattcttacataccatgacgttggcctgaactacaaaagctgtttccagcctctgtttcagtttgaagatatgcaggaaatcatacagaacttcgttcgagtacatgttgatgctccagggatggaagagggagccccagtgtttcccctcggttatcagtacccttccctggaccaactggcagatatgattccatgcgtgctccaatatctgaacttttcaaccattataggtgttggggttggcgctggtgcatatatcctggcccgttacgctttgaactag

SEQ ID NO: 29716 - DNA, 462 bp, Artificial Sequence
  Description of Artificial Sequence: Synthetic coding sequence
atggctgaactgcaggaggttcaaataaccgaagagaagcctctgctgccgggtcaaactccagaagctgccaagacacactctgtagagactccctacggttccgtcacattcacagtttatggaacgccaaagcccaagcgaccggctatcctcacctaccacgacgtgggcttgaattacaaatcatgtttccagcccctatttcaatttgaggatatgcaggaaatcatccagaactttgtgcgggtgcatgtagacgcccctggaatggaggaaggagccccagtcttcccccttggatatcagtacccttctctcgaccagttagccgatatgatcccttgtgtcctgcaatatttgaattttagtaccataatcggcgtgggtgtaggagccggtgcctatattctggcacggtatgccttaaaccatcccgacacagttgaggggctggtttag

SEQ ID NO: 29717 - DNA, 675 bp, Artificial Sequence
  Description of Artificial Sequence: Synthetic coding sequence
atggccgagttacaagaggtgcaaattacagaagaaaagccactgctacctgggcaaacccctgaagcggctaagactcactctgtagaaacaccatacggctctgtaacttttacagtgtacgggaccccaaagcccaaacgtcccgctatccttacataccacgacgtgggcctcaattacaaaagctgttttcagcccctgttccaattcgaggatatgcaggagataattcagaacttcgttagagtgcatgttgacgcccctgggatggaggaaggcgctcctgtgttccctctgggctatcagtacccatccctggatcagctggccgacatgattccttgtgtactccagtacctcaatttctccactattatcggcgttggggtgggcgctggtgcttatattctggcgagatatgcactcaaccacccggacactgttgaggggctggtgctcattaatatcgacccaaatgccaaaggctggatggattgggcggctcacaagttaactgggctgacaagttctatacctgagatgatcctcggacacctcttctcccaggaggagctgtcaggaaactctgaactgatccaaaaatacagaaacatcattactcatgccccaaatttagataacattgagttgtactggaactcatacaactag

SEQ ID NO: 29718 - DNA, 453 bp, Artificial Sequence
  Description of Artificial Sequence: Synthetic coding sequence
atggctgaactgcaggaggtccaaatcaccgaagagaagcccctcctgccagggcagaccccagaggcagccaagacacatagcgtggaaaccccatacgggtccgtgactttcacagtttatgggaccccaaagcctaagcgtcctgcaatcttgacttaccacgatgttggactgaattacaaaagctgctttcagcctctatttcagttcgaagatatgcaagagatcatccagaatttcgttcgcgtacacgtagacgcacccggtatggaagaaggggctcctgtcttccctctcggttatcagtatccatcgctggatcagctagccgatatgatcccatgtgtgctccagtacctaaattttagtacgatcatcggagtgggcgtcggcgcaggcgcttatatactggccagatacgcactcaatcatccggatacagtcgaatag

SEQ ID NO: 29719 - DNA, 384 bp, Artificial Sequence
  Description of Artificial Sequence: Synthetic coding sequence
atggccgagcttcaggaagtccaaattaccgaggaaaagcccctcctgccaggccagaccccggaggccgctaaaacccactccgtggagactccatatggaagcgtaaccttcaccgtgtatggtactcctaagccaaaacgtcctgcaatcctgacgtatcacgacgtggggttgaattacaagagctgcttccagcccctgtttcaattcgaggacatgcaagaaattattcagaatttcgtccgggtgcacgttgatgcacctgggatggaggaaggagcccctgtctttcccctagggtaccagtatcccagcctggatcagctggccgacatgatcccatgcgttttacaatatttgaacttttcaacaataatctag

SEQ ID NO: 29720 - DNA, 450 bp, Artificial Sequence
  Description of Artificial Sequence: Synthetic coding sequence
atggctgagttgcaagaggtgcagatcactgaggaaaagcccttgctccctgggcaaaccccggaagccgctaagacccacagtgtcgagacaccttacggtagtgtgacatttacggtttatggcaccccaaagcctaagcgaccagcgatcctgacctatcacgatgttggactgaattacaaatcatgcttccagcccctgtttcagtttgaggacatgcaagagataattcagaacttcgtgcgtgttcatgttgacgcccctggaatggaggagggggcaccggtatttccactaggataccaatacccttcactcgaccaattagcagatatgatcccatgcgtactgcagtatcttaacttttctaccattatcggagtaggtgtcggagccggagcatacattcttgcgaggtacgccctgaaccacccagacaccgtgtag

SEQ ID NO: 29721 - DNA, 1128 bp, Artificial Sequence
  Description of Artificial Sequence: Synthetic coding sequence
atggatgaattacaggatgttcagctcacagaaattaagccactgctaaatgacaagaacggcacccgcaattttcaggattttgactgccaggagcatgacatagaaaccacccatggcgtggtacatgttaccattagggggctccctaagggtaaccggcctgtaatcctcacgtatcacgatattggtcttaatcataagtcttgcttcaatgcgttttttaactttgaagatatgcaggagattacccagcactttgccgtttgtcacgtcgatgccccaggacaacaggagggcgctcctagctttcccaccgggtatcagtatccaacaatggacgagctggctgaaatgctcccgccagtactgacccacctgtcactcaaaagtatcatcggaattggggtgggcgcaggggcatatattctgagccggtttgctctgaaccacccagagctggtggaagggttggtgctgatcaacgtggacccatgtgcaaaaggctggatcgattgggccgcatccaaactctctggcctgaccaccaacgtcgtggacatcattctcgcacaccattttgggcaagaagagctacaagcaaatctggacttaatccagacctaccgtatgcacattgcccaggacattaaccaggacaacttacagctgttcctgaattcgtacaacggtcggcgtgatcttgagatcgaacgtcctatcctgggtcagaacgacaataagtctaagaccttaaaatgctccaccctgttagtagtgggcgataactcccctgcggtggaagcggtagttgagtgtaacagcagactcaaccccataaacacaaccttgctaaagatggccgactgtggcggtttgcctcaggtggtccagcccggaaagttgactgaagccttcaagtacttcttgcaagggatgggatatatcccaagcgcctcaatgacccggttagcgcgatcccggacacattcgacttcgtcgagtctcgggagcggggagtctccattcagccgaagcgtcacctccaaccagtccgatggaacacaagagtcctgtgagtcacctgatgtgctggaccgacaccagactatggaagtttcatgttag

SEQ ID NO: 29722 - DNA, 1092 bp, Artificial Sequence
  Description of Artificial Sequence: Synthetic coding sequence
atggacgaactacaagacgttcagctgactgagatcaagccgctgctgaacgataaagaacatgacatcgagaccactcatggagtagtgcatgtgactataagagggttgccgaaaggaaacaggccagttatattaacatatcatgacattggccttaatcataagtcttgctttaatgcctttttcaattttgaagatatgcaggaaatcactcaacatttcgctgtgtgtcatgttgacgcacctgggcagcaggaaggcgcaccctcgttccccacagggtaccagtacccgacgatggacgagctggccgaaatgttgccccctgtgctgacacacctgagcctgaaatccattatcggcattggggtcggggctggcgcttatatcctgtccaggttcgccctgaatcaccccgaactggtagaaggactggtgctcattaacgtggatccttgcgctaaaggttggattgactgggcggcatccaagctgagcgggctaactactaacgtagtggacatcattctcgcccatcactttggtcaggaggagctccaagctaacctggatctcatccagacttatagaatgcacatcgcgcaggacatcaatcaggacaacctgcagctcttcctgaacagttataacggcagacgagatctggagattgaacggccaattctgggacagaacgataacaaatccaagacccttaaatgttcaaccttactcgtcgttggtgacaactcccccgcagttgaggctgtcgtggagtgcaattctaggctcaatcctattaacacaaccctgctgaaaatggcagattgcggaggactcccccaggtcgtacaacctggaaaattaaccgaggctttcaagtacttccttcaaggcatgggatacattccctctgccagtatgacccggctcgcgaggagccgcacacattcgacctccagttccctgggttccggggagtctccattctcccggtctgttaccagcaatcaaagcgacgggacacaggaatcatgcgaatctcccgatgtgctcgacagacaccaaacaatggaggtgtcgtgttag

SEQ ID NO: 29723 - DNA, 843 bp, Artificial Sequence
  Description of Artificial Sequence: Synthetic coding sequence
atggtgcaggaaaccagcaggaccttaaccgtccgctaccaataccctactatggatgagttagccgagatgttaccgccagtcttaacccacctttccctgaagagcattattggcatcggggttggggctggagcatacattcttagcaggttcgcccttaaccatcccgaactggtcgagggcctggtgttgatcaacgtggacccttgcgctaagggatggattgactgggccgctagtaaactgtccggcctgaccacaaacgtggttgacatcatcctggcccaccacttcggacaggaggagttacaggcgaacctagatctcatccagacctatcgcatgcacatcgctcaggatattaatcaggacaacctgcagctctttctgaactcttataacggacgcagagacctggagatcgaacgcccaatcttaggccagaacgacaataagtctaagactcttaagtgctctacacttctggtggttggtgacaacagcccagcagttgaggctgttgttgaatgcaatagccgcttaaaccccatcaacacaactcttctgaagatggccgactgtggaggcttgccccaggtggtccagccaggcaaactaacggaggcttttaagtattttcttcagggcatggggtatatccctagcgcctccatgacacgcttggcacgcagtagaacacattccacttccagctcactgggctcaggcgaatcccccttcagtcgctccgtcacctctaaccagtctgacggtacgcaggagagctgcgagagtcctgacgtgctggaccggcaccagaccatggaggtcagttgctag

SEQ ID NO: 29724 - DNA, 816 bp, Artificial Sequence
  Description of Artificial Sequence: Synthetic coding sequence
atgattaggtaccaatatcctactatggatgaattagctgagatgttgccccctgtgctgacccacctgtcactcaaaagtatcattggcattggggtgggcgctggagcgtacatcctgtcccggtttgcgttaaatcacccagagctggtagaaggactcgtccttattaatgtcgatccatgtgcgaaggggtggatagattgggcagcctctaaactgtctggtctgacaacgaatgtcgtggatatcatcctagctcaccacttcggccaggaagagctgcaggcaaaccttgaccttattcagacttacaggatgcacattgcccaggatataaatcaggacaatctgcagctgtttttgaattcttacaacggtaggcgcgatctcgaaattgaacggccaatactagggcagaatgataataagagcaaaaccctaaagtgctctaccctcctggtagtgggggataactctcccgctgtggaggctgtggtggaatgcaacagtagattaaatccgattaacaccaccctcctgaaaatggcagattgcggagggctgcctcaggtggttcaaccaggcaaactgacagaggcctttaaatactttctgcagggcatgggctacattccttccgcctcgatgacccgcttggccagatctcgaacccactcgacatccagttcactgggtagtggggagtcaccgttctccagatctgtgaccagtaatcaatccgatgggacgcaggagtcgtgcgagagccccgacgtgctcgaccggcaccaaaccatggaggtttcatgttag

SEQ ID NO: 29725 - DNA, 420 bp, Artificial Sequence
  Description of Artificial Sequence: Synthetic coding sequence
atgccagagggtcccgaattacatctcgcaagtcagtttgtgaacgaagcttgccgcgctctggtgtttgggggatgtgtggagaagtcctcagtgtctcggaaccctgaggtgcccttcgaatcttctgcctatagaatctcggcctcggcacgaggaaaagaactgcgcctgatcctgtccccgctgcctggtgctcaaccccagcaggagccacgcgcacctcgcggagccgctactccatgccccccagcactgctgcacggacctgcttggcctccagccaggccaatgttccgaggccacccgccagttcggcctctcggcccatggggcaaggtcgccgctggacctagggcgctgtgcctcgccggagtaccagctgttcagggggagtgcgccactaagccatctggttag

SEQ ID NO: 29726 - DNA, 1173 bp, Artificial Sequence
  Description of Artificial Sequence: Synthetic coding sequence
atgccggaaggccctgaattgcaccttgcttctcagtttgttaacgaggcctgtagagctttagtgttcggcggatgtgttgaaaagtcaagcgtctccaggaaccctgaggtcccgttcgagagcagcgcttatagaatttccgcatctgccaggggtaaagagttgcgactaattctttcccctctgccaggcgcacagccccaacaggaaccgctggctctggtgttccggttcggcatgtcaggtagcttccagctcgttcctcgtgaagagcttccaagacacgcacatcttaggttttataccgctccccctggcccaagattggcgttatgctttgttgatatccggaggttcgggcgatgggacctggggggaaaatggcagcctggcagaggtccttgtgtactgcaggaataccaacagtttagggagaatgtgttaaggaatcttgccgataaggcttttgacaggcctatttgcgaagccctgttagaccagcgctttttcaacgggatcgggaactacctcagagccgaaatactgtacaggctcaagatcccaccatttgagaaggcccgatcagttctggaggcccttcagcagcatagaccttctcctgagttgaccctgtcccagaagatcagaactaagttacagaacccggatctgctggaactgtgtcactccgtgccaaaggaggtggtgcagttgggcggtaaaggttatggatccgaaagtggagaagaagactttgcagccttccgagcatggctgcgatgttacgggatgccaggcatgagctctctgcaagacagacacggcaggacgatatggttccaaggtgatcctggccctctggcaccaaaaggcagaaagtcccgtaaaaaaaagtccaaggctactcaactgtcacccgaagaccgcgtcgaggatgcccttcctcctagcaaagccccatcgcgaacaaggagggctaagagagatctccctaagagaacagccacccaacggcctgagggcacctctcttcagcaggatccagaggctcctactgtgcccaaaaaagggaggaggaaggggcgacaggctgcatccggccattgcagacccaggaaagtgaaggccgacattccttcgctcgagccagagggaacaagtgcatcctag

SEQ ID NO: 29727 - DNA, 1173 bp, Artificial Sequence
  Description of Artificial Sequence: Synthetic coding sequence
atgccagaaggcccagagctacacctggcaagccagttcgtcaatgaagcttgcagggcccttgtcttcggtggatgtgtagaaaaatcctctgtgtcccggaacccggaggtcccctttgagtcttctgcctaccggataagcgcctccgcaaggggcaaagaactgcgtttaattttatcccctctgccaggagcacaacctcagcaggagccccttgcactggtgtttaggtttggtatgagcggatcctttcaattggtgccccgagaagaacttccacgacatgcccacttacgattctacacagcgcctcccggtcccaggttggccttgtgcttcgtggacatccgacgatttggcaggtgggatctggggggtaaatggcagccaggaagagggccttgcgtgctacaagagtaccaacaattccgtgagaacgtgctgagaaacctggcagacaaggccttcgatagacccatttgtgaagccctcctggatcagcggttctttaacgggattggaaactacctgagggcagagatactgtatcgcctgaaaattcctcccttcgaaaaggctagatccgtgctcgaagcccttcaacagcaccggcctagcccagagctcactctctctcagaagatccgcaccaaattgcagaacccagacctgctcgaattatgccactccgtgccaaaggaggttgtccagctgggtgggaaaggatatggcagcgaatctggcgaagaggacttcgccgcatttagagcatggctgcgctgctacggaatgccgggtatgagttccctgcaggataggcatgggagaaccatatggttccagggcgatcccggtcccctggcgcctaaagggcgtaagtcacgcaaaaaaaaatctaaggcaacacaattaagccccgaagatcgagtggaggatgccctgcctccaagcaaggcaccatctagaacccgcagagcaaaaagagatctgcctaaaagaaccgccacacaacggccagaaggcacctcccttcaacaagatcccgaagcgccaacagtgcctaagaagggtcgcaggaaagggaggcaggccgcttccggacactgtcgtccaaggaaagtcaaagccgacattccctctctggagccggaggggacctctgcctcatag

SEQ ID NO: 29728 - DNA, 999 bp, Artificial Sequence
  Description of Artificial Sequence: Synthetic coding sequence
atgcctgaagggccattggtccgcaaatttcaccacctcgtgagtccgttcgtgggtcagcaggttgtcaaaacggggggttcatctaaaaaactgcagcctgcgagcctgcaatctctgtggctgcaggacacacaagtgcacggaaaaaagctcttcctgaggtttgaccttgatgaagagatgggaccgccaggcagttcacccacccccgaaccgcctcagaaggaagtgcagaaggaaggagccgcagacccaaagcaggtgggagaacctagcggccagaagaccctggatggttcaagccgctcagcagaactggtaccccagggcgaggacgactctgagtatctggaaagagatgccccagctggagacgctgggcgatggctgagagtcagttttgggctattcggttctgtgtgggttaatgacttttctcgcgctaaaaaggcaaacaagcgcggtgattggagagacccgtcacccagactagtgctacacttcggcggaggcggatttctggctttttacaactgccagctgagttggtcatcatctcccgtggtgacaccaacatgcgatatcctttcagaaaagttccatagaggccaggcccttgaagcacttgggcaggcccagcccgtgtgttataccctgttggaccaacggtatttttctgggctgggaaacataatcaagaatgaggccctgtaccgagccggaatccacccactgtctctaggctctgtgctatctgcatcacgcagggaggtgctcgtggatcatgtggttgagttctccactgcctggctgcagggtaagttccagggacgaccccagcatacgcaagtataccaaaaagaacaatgcccagccggacaccaggtcatgaaagaagcttttggcccagaagatggcttacagcgcctgacgtggtggtgtccccaatgtcagccgcagctcagcgaggaacctgagcagtgtcagttctcttag

SEQ ID NO: 29729 - DNA, 954 bp, Artificial Sequence
  Description of Artificial Sequence: Synthetic coding sequence
atgcctgaagggccactcgtacggaagttccaccatctagtttctccctttgttggacaacaggtcgtgaagaccggtggtagctcaaagaagttgcagcctgcctccctgcagagcctctggttgcaggacacgcaagtgcacggcaaaaaactgtttctgaggttcgatctggatgaagagatggggcctcctggcagcagccctaccccagaaccacctcagaaggaagtccagaaaaaaaccctcgatggctcctctagaagcgcagagctggtgccacaaggggaggacgatagtgagtatctggagcgcgacgcccctgcaggcgatgccggacgctggctgcgggtctcctttggtctttttggtagcgtctgggtcaacgatttctccagagcaaagaaggccaataaaaggggcgactggcgggaccctagccctagactggtgttgcattttgggggagggggattcctggccttttacaactgccaactttcctggagttcctcacccgtggtgacaccgacttgcgatatcctctccgaaaagtttcaccggggtcaagcactggaagccctcgggcaagcccagcccgtgtgttataccctgctggaccaaagatacttttcagggctcggtaatatcatcaaaaacgaagcactctatcgggcaggcatccatccactctccctgggttctgtcctgtcggcctcaagacgcgaggtgctagtcgatcatgtcgtagagttcagcaccgcctggctccaggggaaatttcagggcaggcctcagcacacacaggtctatcaaaaagagcagtgcccggctggccaccaggtcatgaaagaggcgtttggccctgaggacggtttgcagcgccttacatggtggtgtccccagtgtcagccacagctgtctgaggagcccgagcaatgtcagtttagctag

SEQ ID NO: 29730 - DNA, 816 bp, Artificial Sequence
  Description of Artificial Sequence: Synthetic coding sequence
atgggtcccccaggctcatcaccaaccccagagcctcctcagaaggaagtgcagaaggagggcgctgcagaccctaaacaggttggcgagccctctggacagaagaccctagatggtagttcacggagcgcagagctggttccccagggagaagacgattctgagtaccttgagcgggatgccccagcaggtgatgcagggagatggttgcgggtatcatttggcctgttcggatccgtctgggttaacgacttctcaagagccaagaaagcaaacaagagaggagattggcgcgaccctagtccaagactggtgctgcacttcggcggaggtggctttctggctttttacaattgccagctaagctggtcgagttccccagtggtaacccccacgtgtgatatattatccgaaaagttccaccgtgggcaggcattagaggccctgggccaggcacagcccgtgtgttacactctgctggatcagcggtacttttcaggcctaggtaacatcatcaagaacgaagccctgtacagagctgggattcatcctctaagtctcggctccgtacttagcgcgtcaaggcgagaggttcttgttgatcatgtcgttgagttcagtactgcctggctacagggcaagtttcaaggtcggcctcaacatacacaggtatatcaaaaagaacaatgcccagccggacatcaagtgatgaaggaggccttcggccctgaggatggcctgcagcggttaacatggtggtgcccccagtgtcaacctcagctcagcgaggaaccagagcaatgccagttttcctag

SEQ ID NO: 29731 - DNA, 999 bp, Artificial Sequence
  Description of Artificial Sequence: Synthetic coding sequence
atgccagaggggcctttagtccgcaaatttcatcacctagtgagccctttcgtgggccagcaggtggtgaaaacaggtggatccagcaagaagctccagccagccagcttgcagagcctctggttgcaggacactcaggtgcatggcaagaagttatttttacgtttcgacctggatgaggagatgggtccacccggtagcagccctactcccgagccgccacagaaggaggtgcagaaagaaggagctgcagacccgaagcaggtcggtgagccctctggtcagaagaccctggacggaagctcccgcagcgctgaattggtgcctcaaggggaagacgacagcgagtaccttgaaagggacgccccagccggtgacgctggcagatggctaagagtctcttttggattgttcgggtctgtgtgggtcaacgattttagtcgggctaagaaagcaaacaaaaggggggattggagggaccccagtcctcgcctggttctccattttggtggagggggattcttggccttttataattgccaactcagttggtctagctctcccgtggtcacgccaacatgcgacattttgagtgaaaagttccatagagggcaggcactggaagctctgggtcaggcccaacctgtttgttacacattgctagaccagcgctacttttcaggcttggggaacattatcaagaatgaggctttatatagagcagggatccaccctcttagcctggggtcagtactcagcgcttctcgaagggaggtcctcgttgatcatgtggtcgagttcagtaccgcctggctgcagggcaaatttcaggggagaccccagcatacacaggtgtaccagaaggagcagtgccccgctgggcaccaggtcatgaaggaagcttttggacctgaggacggcctgcagcgcctgacctggtggtgccctcagtgccagccccagctgtccgaggagcctgagcagtgccagttttcatag

SEQ ID NO: 29732 - DNA, 999 bp, Artificial Sequence
  Description of Artificial Sequence: Synthetic coding sequence
atgcccgagggtccgctggtccgcaagtttcatcacctggtgagcccatttgtcgggcaacaggttgtcaagaccggtgggtcgtccaaaaaactccaacctgcttcactacagtcactgtggttgcaggacactcaagtgcacgggaagaaattatttctgaggtttgacctggacgaggagatgggcccacctggctcttctccaactccggaaccaccacaaaaagaggtgcagaaggaaggagcggcagatcccaagcaggtcggagaaccttccggacagaagactttagacggatcctctagatccgccgagctggtcccacaaggagaggacgactctgaatacctggagagagacgctccagcaggcgacgcgggacgctggttgagggtttctttcggcctcttcggaagcgtgtgggtcaatgacttttctagagccaagaaagctaataagagaggcgactggcgggacccatctccacgcctcgtgctgcacttcggcggaggaggattccttgccttctacaattgccaattatcctggagttctagccccgttgtgacccccacctgtgatatactgtccgagaaattccacaggggtcaggcactagaagccctgggtcaggcacagcctgtgtgctacacactcctggatcagcggtacttctctgggctgggcaacattattaaaaacgaggccctctatagagccggaattcaccctctgagtctcggatccgtgctgtcggcgtcgaggcgagaggtcttggtggatcatgtcgtggagttttcaactgcctggctccaggggaaattccaagggaggccgcaacacacccaggtctaccagaaagagcagtgtccggcaggccatcaggtgatgaaagaggcgtttggccctgaggatggcctccagaggctgacttggtggtgtccacaatgccagccccagctgagtgaggagccagagcagtgccagtttagctag

SEQ ID NO: 29733 - DNA, 651 bp, Artificial Sequence
  Description of Artificial Sequence: Synthetic coding sequence
atgccagaaggccctctcgtccggaagttccaccacctggtgagcccatttgtcgggcagcaggtcgtcaagacaggaggcagctctaaaaaactgcagcccgcttccctccagtctctctggcttcaggatactcaggtgcgactggtgttgcacttcggtggcggaggatttcttgcgttctacaactgccagctgagttggagcagttctcccgttgtcacacctacttgtgacatcctctccgagaaatttcatagaggtcaagccctggaggcactggggcaagctcagcctgtctgctatacacttttggaccagagatatttctccggcctgggaaatatcatcaagaacgaggctttataccgcgcagggatccatcctctgtcactgggttcagtgctatccgcgtccaggcgtgaggttctcgtggatcacgtggtcgaattttccaccgcttggctccaaggcaaatttcagggccgaccgcagcatacccaagtatatcagaaagaacagtgccccgcagggcaccaagttatgaaggaggctttcggaccagaggatggactgcagagactaacctggtggtgccctcagtgtcagcctcagctcagtgaagaaccagagcagtgccagttcagctag

SEQ ID NO: 29734 - DNA, 1818 bp, Artificial Sequence
  Description of Artificial Sequence: Synthetic coding sequence
atggtggaaggccctggctgcactcttaacggcgagaagatccgtgcccgagtcctgccaggccaggctgttacaggagttcgcggaagcgctcttcggtcgctccagggtagagctctgcgactcgcggcatccaccgtggtggtgtctccacaggcggcagcgctgaataatgattctagtcagaatgtgctaagtctgttcaacggatatgtatatagcggcgttgaaaccttgggcaaggagctgttcatgtacttcgggccaaaggcgttgagaatccatttcggcatgaaaggtttcataatgatcaatcccctggaatacaagtataagaatggggcatctcctgtgctggaggtacagctcacaaaggaccttatctgttttttcgacagctctgtagagctgaggaatagcatggagagccaacaaagaattcggatgatgaaggaactcgacgtgtgttctcctgagttcagcttcttaagagccgaatcagaagtgaagaaacaaaaaggccgtatgctgggagacgtactcatggaccaaaatgtcctcccgggtgtcgggaacatcattaaaaacgaggctctgttcgattccggcctgcatcccgctgtgaaggtgtgtcagctgacggatgagcagatccaccacctgatgaagatgattagagactttagtatcctgttctaccgatgtagaaaagccggactggctctgagcaaacattacaaggtttataagaggcccaactgtggtcagtgtcattgcaggatcactgtctgtaggttcggagataataatagaatgacctacttctgtccgcactgccagaaggagaaccctcagcacgtcgacatatgtaagctgccaactaggaacaccattatctcctggactagtagcagggtggatcacgtaatggactccgtagccagaaaatctgaggaacattggacttgtgtggtgtgcactctcattaacaagccttctagtaaggcatgtgatgcctgtctcacatccagaccaatcgatagtgtcctcaagagtgaagaaaattccaccgtgtttagccatctgatgaagtatccctgtaacacctttggcaaaccccacactgaggtgaaaatcaacagaaaaacagccttcggcacaacgacactggtgctaaccgatttttcaaataaatcgagtactctggagcgaaagactaaacaaaaccagattctagatgaggagttccagaattcccccccagcaagcgtgtgtctgaacgacatccagcaccctagcaaaaagaccaccaacgacattactcaacccagctcgaaggtgaacatatcccccacaatcagctccgagtctaagctgtttagccccgcacataaaaagcctaagaccgctcagtactcatctcctgagctcaaaagttgcaatcctggctacagtaacagtgagctccaaattaacatgacagatggacctcgtaccttaaaccctgacagtccaagatgttccaagcacaacaggctgtgcattttaagggtggtcggcaaggatggagagaataaagggaggcagttttatgcatgtcctctccccagagaagcacagtgcggcttttttgagtgggccgatctgagtttccctttctgtaatcacggaaaacgcagtacaatgaagaccgtgttgaagatcggtcccaataacgggaaaaatttttttgtctgccctctcgggaaagaaaagcagtgtaatttctttcagtgggcggaaaacgggcctggtataaaaatcatcccaggttgctag

SEQ ID NO: 29735 - DNA, 1743 bp, Artificial Sequence
  Description of Artificial Sequence: Synthetic coding sequence
atgcctggatggccctggggactgttgctcactgccggtaccctgttcgcagctctgtctcctggacccccagccccagctgacccctgccatgatgaggggggagctcccagagggtgcgtccctggactggtgaatgctgccctcggacgggaagtcctggcctccagcacgtgcggcaggcctgcgactcgcgcatgcgacgcttccgaccctagaagagcccacagccctgcgctgcttacaagcccgggaggcacagcgagcccattgtgctggagatcagagtcgctacctcgcgctccactcaacgtcactcttacagtgccgctcggcaaggccttcgaattagtctttgtctctctccggttctgctccgctccccctgcttcagtggctctcctgaagtcccaggaccacggtcgcagctgggctccactggggttctttagttctcattgcgacctggactatggtcgtctgcctgctcctgctaacggacctgcgggtccaggtccagaggcactctgctttcctgctcctttggcccagcccgatggatcaggactcctcgccttctcaatgcaggactctagtccaccagggctggatctggactcttcgccagtcctacaagactgggtgacggcaactgacgtgcgcgtggtgctgacccgcccatctaccgcaggtgaccccagggacatggaggccgttgtgccctatagctacgcggctacagatctgcaggttggcggaagatgtaagtgcaatggtcacgcctccagatgcctgctggatacacagggccatctcatttgcgattgtcgccacggcactgagggtcccgactgcggtagatgcaaacccttttattgcgacagaccgtggcagcgggctaccgcccgtgaaagccacgcctgcctcgcttgtagctgcaacggccacgcgcgaaggtgtcgcttcaacatggaactgtatcgcttgtcgggccgtcgctctggaggcgtctgcctgaactgtagacataatactgccggaagacactgtcactattgcagggaggggttctaccgggaccctggtagggctctgtccgatcgacgagcatgccgggcttgcgactgtcacccagtgggtgccgctgggaagacctgcaatcagacgaccgggcagtgtccctgtaaggacggagttactgggctaacctgtaaccggtgtgccccagggtttcagcagtcgcgttcacccgtcgccccatgtgtgaaaacccctattcctgggcctaccgaagactccagccctgtgcagccacaagattgtgattcccactgcaaaccagcgagaggcagctacaggatttccttgaagaagttttgcaaaaaagattatgccgttcaggtagcagtgggggcacggggagaggcacggggagcctggactcgtttcccggtggccgtgctcgcagtgttcaggagcggagaggagcgggctcggcgaggaagcagcgctctatgggtgccggctggggacgccgcttgcgggtgccctaggctcctgcccggacgacgctatctgttgctaggcggaggcccaggcgctgccgctggaggggcaggaggcaggggtcctggcttgatcgctgcccgtggatcactggtgcttccctggcgggacgcctggacacggaggctccgcaggctccaaaggcgcgagcggcgaggacgttgtagtgccgcttag

SEQ ID NO: 29736 - DNA, 2547 bp, Artificial Sequence
  Description of Artificial Sequence: Synthetic coding sequence
ctcttttgcttcgtcttctcagtctctcttcaggtggatatagtgccgtcacagggagaaatctccgtgggagagtcgaaattctttctctgccaagtggccggagacgcaaaggataaagacatttcttggttctcacccaacggcgaaaagctgaccccgaaccaacagaggatctctgtggtctggaatgacgattccagtagtactctcaccatttataacgcaaatattgatgacgcaggcatttacaaatgcgtcgtcaccggggaggatggcagtgaatctgaggccactgttaacgtgaagatattccagaaattgatgttcaagaatgctccgaccccacaagagtttagagaaggcgaggatgccgttatcgtctgtgacgttgtctcatcattgccccctactattatttggaagcataagggcagggacgtgatcttgaagaaagatgtacgctttattgtgctgagcaataactatctgcaaattcgagggatcaagaaaacagacgagggaacataccgctgcgaggggcgtatcctggcaagaggggaaattaatttcaaagatattcaggtgatcgtcaatgtacctcccacaatacaagctagacaaaacattgttaatgccacagctaacctggggcagagcgttaccctcgtctgcgatgctgaaggctttcccgagccaactatgtcctggaccaaagatggagagcagatcgagcaggaagaagacgatgagaaatacattttcagcgatgattcctcccaactgacaataaagaaagttgacaagaatgatgaggctgaatacatctgtatcgcggagaataaagccggtgagcaagacgcaaccattcatttgaaagtctttgcgaaacccaaaatcacctacgtggagaaccagaccgctatggagctggaagaacaagtgaccttaacctgtgaggcgtcgggcgaccccatcccctctatcacctggcgaacctccacacgcaatatttctagcgaagaaaaggcatcttggaccagacccgagaagcaggagaccttagatgggcacatggtggtcagatctcatgccagagtgagttctctaacactgaaatcaatccaatatactgacgccggagaatatatttgcactgcaagcaataccataggtcaggacagccagtctatgtatctcgaggttcagtatgcgcctaagctgcagggccctgtcgctgtgtatacctgggaagggaatcaggtgaacatcacgtgtgaagtgtttgcttatccttctgcaaccatcagctggttccgtgacggccaactgctgccatcttccaactactctaacatcaaaatctacaataccccctctgcgagttatctggaggtgacccctgactcagagaatgatttcggaaactacaattgcaccgcggtgaatcgtatcggccaggaatctctggagttcattctggttcaggccgacacccccagctcaccttccattgaccaggtggagccatattcgtcaaccgcccaagtgcaatttgatgagccagaggcgacagggggagtgcccattctaaagtacaaggctgagtggagagccgtgggggaggaggtctggcacagcaagtggtacgatgccaaggaggcctccatggaagggatcgtgactattgtgggacttaagccagaaacaacctatgcggtgcgcctcgccgctcttaacggcaaagggcttggagagatttcagccgcttctgaatttaagactcagccagtccctggtgaacccagtgcgcctaagctggagggacagatgggcgaagatgggaatagcatcaaagtgaacctgatcaaacaggatgacggaggatctcctataagacactacctcgtgcggtatcgtgctctctcgagtgagtggaaaccggagataaggttaccttctggatccgatcacgttatgctgaaaagcttggactggaatgccgagtatgaggtgtacgtagtggccgaaaaccaacagggcaagtccaaggcagctcacttcgttttccggacttcagctcagccaactgcgatccccgcaaacgggtctccaacttctgggcttagtacgggtgccatcgtgggaatactcatcgtcatctttgtacttcttctggtcgtggtggacataacatgctatttcctgaacaaatgcggactctttatgtgcattgcagtgaacttatgtggtaaagcaggacctggagctaaaggaaaggacatggaagagggtaaggccgcattcagcaaggatgagagcaaagaacccatcgtagaagtgcggaccgaagaggagagaactcccaaccatgatggcggaaaacatacagagccaaacgagacgaccccgttgacagagcccgaaaagggtcctgtggaggctaaaccagagtgccaggagactgaaaccaagccggcaccggctgaggtgaaaaccgtccctaatgatgctactcaaaccaaggagaatgaatctaaggcatag

SEQ ID NO: 29737 - DNA, 1995 bp, Artificial Sequence
  Description of Artificial Sequence: Synthetic coding sequence
ataacaatccgagatgaaatctgggtgcttttctgtttcgtattcagcgtgtccttgcaagtggacatcgtgccatcccagggggagataagcgttggagaatctaagtttttcttgtgccaggtggcaggggatgccaaggacaaggacattagctggttttctccaaacggagagaagctgacgcctaaccagcagagaatctctgtggtttggaatgatgactcctcatccactctgacaatttataacgccaatatagatgacgcgggtatttacaagtgtgtagttaccggtgaggacggctccgagtccgaggcaactgtgaacgttaagatttttcagaagctgatgttcaagaatgcaccaactccccaagaattccgggaaggcgaggatgccgtgattgtttgcgacgtcgtttcttctcttccgcctacaattatctggaagcataaaggtagagatgttattcttaagaaggacgtccgattcatcgtgttgtctaataattacctacaaataaggggcatcaaaaaaactgatgaaggcacttacaggtgtgagggaaggattctggcccgaggagagattaatttcaaagatatacaggttatagtcaatgtcccacctacgatacaggctcggcagaacattgttaacgccacggctaacctgggacagtctgtgactcttgtgtgcgacgctgaaggtttccctgagccaaccatgagctggacaaaagatggagagcaaattgagcaggaggaggatgatgaaaagtacatcttctccgacgactcttcccagctgaccattaagaaagtcgacaagaatgacgaggccgaatacatttgtattgccgagaacaaggcaggcgagcaggatgcaaccatccacctaaaggttttcgccaaaccaaaaatcacatacgtggaaaaccaaacggctatggagctcgaggaacaggtcactctaacgtgtgaggcatctggcgatcccattcccagcataacttggagaacttccacacgcaatatttcatccgaagagaaggcctcctggacgagacctgagaaacaggaaacgctagacggccacatggtggtacggagccacgcccgagtatcttctttaacactcaaaagcattcagtatacggacgccggtgagtacatctgcaccgcatctaatacaataggccaagattcccaatccatgtatttggaagttcagtacgcccctaaactgcaaggcccagtcgccgtgtacacttgggagggcaatcaggttaatataacctgtgaggtcttcgcatacccatcagccactatttcttggttcagggatggtcagttgctgccctcatcgaattacagcaacattaaaatatacaacacccccagcgcctcgtatctggaagtaacgcccgacagcgagaacgactttggcaactacaactgcaccgccgtgaaccgcatagggcaagagagtctggagttcatactcgtgcaagctgatactccgagctcgcctagcattgatcaagtggagccttattcttccacagcccaggtccagtttgacgagccggaggccacgggtggagtccctatcctcaaatataaagcagagtggagagccgttggcgaggaggtttggcattccaaatggtacgacgctaaggaggcaagtatggaggggatcgtcactattgtgggccttaagccggaaaccacctatgccgtgagattggctgccctaaacggcaaggggttgggcgagatttccgcagctagcgagtttaaaacccagccagtccaggctccccctcctactgctagcgcctctagttccacccccgtgccacttagtcctccagatactacctggccattgccggcactcgcaactacagaacccgctaaaaatatcgcacagaatcactgctgtaacatgttccaggcaggccttcacaatgctctcatgaagtag

SEQ ID NO: 29738 - DNA, 942 bp, Artificial Sequence
  Description of Artificial Sequence: Synthetic coding sequence
atggagggtatcgtgaccatcgttggacttaagccagaaaccacctacgctgtccgtctggcagcactaaacggaaagggcctcggcgaaatcagcgccgcatcagagtttaaaacccaaccagtgcatagccctccacccccagcttctgcctcctcctcaaccccagtgccgctgtctcctccggacaccggggaaccaagcgctccaaaactggagggacagatgggtgaagacggcaactctattaaggtcaaccttattaaacaggatgacggaggttcccctatccgccattacctggtgcggtatcgtgcccttagtagcgaatggaagccagagattcggctgcctagtggctccgatcacgtgatgctgaaaagcctggactggaacgccgaatatgaagtatacgtggtggctgaaaaccagcaaggcaagtcgaaggcagctcattttgtcttccgcacatctgcccagcccaccgcaattcccgctaacggtagtccaacaagtgggctgtctaccggagccatcgtcggcattctgatcgtgatctttgtgctgctgctggtcgtcgtggatatcacatgttattttctcaacaaatgtggtctatttatgtgcatcgctgtcaatttatgtgggaaagctggccctggcgctaaaggcaaagacatggaggaaggtaaggcagcattctcaaaggacgagtcgaaagaacccatcgtcgaagtgcggacagaggaggagcgcaccccgaatcacgacggtggcaagcacacggagccaaacgagaccactccactgacagaaccggaaaaaggtcctgtcgaggccaagcccgaatgtcaagagaccgaaaccaagcccgctcctgccgaggtgaagaccgttccaaatgatgcaactcagaccaaggagaacgaatctaaagcgtag

SEQ ID NO: 29739 - DNA, 570 bp, Artificial Sequence
  Description of Artificial Sequence: Synthetic coding sequence
atgactgagtataagctggttgtggtgggggctggaggagttggcaagagtgcactcacaattcaactcattcagaaccactttgttgacgagtatgaccctaccattgaagatagttataggaaacaggtggtgatagacggagagacatgtctcctggacatactcgatactgctggccaggaggagtactccgctatgcgcgaccagtacatgaggacgggggaaggatttctttgtgtgtttgctataaacaactcaaagtctttcgccgatatcaatctgtaccgtgaacagatcaagcgggtgaaagattccgacgacgtcccaatggtgcttgtcggcaataagtgcgacctcccaacgcggacagttgacacgaaacaggcccacgagctggcaaagtcttatggcatcccttttatcgagacctctgccaagactaggcagggagtcgaggatgctttctacaccctcgtgagagagatacgacaataccgtatgaaaaagctcaacagttctgacgatgggacccagggatgcatggggctaccctgcgtcgttatgtag

SEQ ID NO: 29740 - DNA, 651 bp, Artificial Sequence
  Description of Artificial Sequence: Synthetic coding sequence
atgccgggaaatctgatgtcgcagacctcaagggctgtgtcaatatggaagttcccggctaaattgggcaaaacacacgggcacagggccttggaagccaccggaatgatgttgagggtcctggttggagccgtccttccagcaatgctcctggccgctccccctcctattaataaattggccctctttccagataagtctgcctggtgtgaagccaagaacatcacccagatcgtcggtcacagtggttgcgaggcgaaatccatccagaaccgggcatgtctaggtcaatgcttctcttactccgtgccaaataccttcccccagtctacggaatccctagtgcattgcgattcttgcatgccagcacagagcatgtgggagatcgttacccttgagtgccctgggcatgaggaggtacccagagtggataagctggtcgagaaaattctgcactgcagttgtcaagcatgcggcaaagagccttcgcacgagggattgagcgtctacgtccagggggaagacggtcctggatctcagcctggaacacatccacacccccatccacatcctcaccccggaggccaaacaccggagccagaggatccccctggcgctccgcatacagaggaggagggggcagaagactag

SEQ ID NO: 29741 - DNA, 546 bp, Artificial Sequence
  Description of Artificial Sequence: Synthetic coding sequence
atgatgctgcgtgtgttggtcggcgctgtgctgcctgcaatgttgttggcagcgccaccacccattaataagctggcccttttcccagataaatccgcctggtgtgaggcgaaaaacatcacccagatcgtgggacatagtggatgtgaagccaagagcatccagaaccgcgcttgtcttgggcagtgcttcagctactccgtaccaaacaccttcccccaatccacggaaagtctcgtccactgcgattcctgcatgccagctcagagcatgtgggaaatagtgacactcgagtgcccagggcacgaagaagtgcctagagtcgataagctggtggagaaaatcctccattgttcatgtcaggcctgtggaaaggagccttcccacgaaggtttgtcagtgtacgttcagggcgaagatggccctggctctcagcccggaacccacccgcacccacatcctcacccccacccagggggacagaccccggaaccagaggatcctcctggtgctccacacactgaagaggagggcgctgaggattag

SEQ ID NO: 29742 - DNA, 351 bp, Artificial Sequence
  Description of Artificial Sequence: Synthetic coding sequence
atgatgctaagagtgctagtaggggcagtgttgcccgcaatgctgcttgctgccccaccaccaatcaataaactggccctgtttccggacaaaagtgcttggtgcgaggcaaagaacataactcaaatcgtgggtcattctggatgtgaagctaaaagtatacaaaacagagcttgcttgggtcagtgctttagttactcagttcccaacactttccctcaaagtacggaatctctggtgcactgtgacagttgcatgcccgcacagagtatgtgggagatcgtgaccctcgagtgccctggacacgaggaggtgccaagggtcgacaaactggtggaaaagatactgtag

SEQ ID NO: 29743 - DNA, 492 bp, Artificial Sequence
  Description of Artificial Sequence: Synthetic coding sequence
atgctcagggtcctggtgggggctgtgctccccgctatgcttctggccgctcctccgccaatcaacaaattagccttgtttcctgataaatccgcctggtgtgaggcaaaaaacatcactcagatcgtgggacacagtggctgcgaggccaaatctatccagaaccgggcttgcctaggacagtgttttagctactcagtgcccaacacattccctcagtcaaccgagtcactggttcattgtgattcttgtatgccagcccagtctatgtgggagattgtcaccctggaatgtcccggtcacgaggaggtgcctcgagtggacaagctggttgagaaaatcttacactgctcatgtcaggcttgtgggaaagaaccatcccacgagggattatccgtatatgtacagggcgaggatggaccaggcagtcagccagggactcatccccacccccacccacacccccaccccggaggccagacgcccgaatag

SEQ ID NO: 29744 - DNA, 354 bp, Artificial Sequence
  Description of Artificial Sequence: Synthetic coding sequence
atgatgctccgagtcctcgtgggagccgtactcccggctatgctgttagccgctccaccacctattaacaagctggccttgtttccagataagtccgcctggtgtgaagcgaaaaacatcacacagatcgttggacacagcggatgcgaagccaagtcaatccagaatagagcttgtctcggacagtgtttcagttattctgtgccaaatacgttcccccagtctactgaatctcttgtccactgtgactcatgtatgcccgctcagtccatgtgggagattgtgacactagagtgccccggacacgaagaggttccaagggttgataagcttgtagaaaagattctgcattag

SEQ ID NO: 29745 - DNA, 330 bp, Artificial Sequence
  Description of Artificial Sequence: Synthetic coding sequence
atgatgctgcgggtgctggtcggggctgttctaccggctatgttgctcgccgctcctcccccaattaataaactggcgttgttcccggacaaatctgcgtggtgtgaagcaaagaatataacacagattgtgggacactctggctgtgaggccaagagcatccaaaaccgtgcttgcctaggtcagtgctttagttatagcgtgcctaacacttttcctcaaagcaccgagagcttggtccactgcgatagttgtatgcctgcccagtcaatgtgggagattgtgaccctggagtgtcctgggcacgaagaggtgcctcgcgtagattag

SEQ ID NO: 29746 - DNA, 387 bp, Artificial Sequence
  Description of Artificial Sequence: Synthetic coding sequence
atgatgctgcgggttctggtcggagctgttctcccagcaatgctactcgctgctccaccccctatcaacaagctagccctgttccccgacaagtctgcctggtgtgaagcaaagaacattacccagattgtcggtcatagcgggtgtgaggcgaagagtatccagaaccgcgcatgcctcggacagtgtttcagctattccgtgccaaacacatttccacagtccacggagagtctcgtgcactgcgattcttgtatgcccgctcaatcgatgtgggagatcgttactctagagtgtcccggacacgaggaggtgcctagagtagataagctcgtagaaaagatcttgcactgctcatgtcaggcctgtggtaaagaaccatcctag

SEQ ID NO: 29747 - DNA, 543 bp, Artificial Sequence
  Description of Artificial Sequence: Synthetic coding sequence
atgctgagggtcctggtgggggctgtgctccctgccatgctccttgccgcaccaccacccatcaataaattggccttgtttcctgacaaatctgcctggtgtgaggccaagaatatcacacagatcgtgggacactctggatgcgaggcaaaaagcatacagaatcgcgcatgcctggggcagtgctttagctatagcgttccgaacacatttccccagagcaccgagtcacttgtgcattgtgacagctgcatgccggctcaatccatgtgggaaatcgtcaccctcgagtgcccaggccatgaggaagtgccaagagtggataaactcgtcgagaagatactccactgtagctgccaggcgtgcggcaaggagcccagccacgaggggctgtctgtgtacgttcagggagaagacgggcctggatcccaacccggaactcaccctcacccccatccacacccacaccccggtggacaaactcccgagcccgaagacccccctggtgctcctcataccgaagaagagggtgcggaggactag

SEQ ID NO: 29748 - DNA, 8456 bp, Artificial Sequence
  Description of Artificial Sequence: Synthetic coding sequence
atggccgcacacagaccggtcgaatgggttcaagcagtggttagccggtttgacgagcagctgccaatcaagactgggcagcagaacactcacactaaggtatcaactgagcataacaaagaatgcctaatcaatatctctaagtacaaatttagtctggtgatctccgggctgacaactatccttaaaaacgtcaacaacatgcgtattttcggagaggccgcagagaaaaacctatacctgagccagctgatcatactggacacactagaaaaatgcttagccggacagccaaaggatacaatgcgattagacgaaaccatgctggtaaaacaactgctgcctgaaatatgtcatttcctccacacctgtcgggaaggcaatcagcatgctgccgaactcagaaatagtgctagcggagtactgttctcgctttcgtgtaataattttaacgcagtgttctccaggatttctaccagactgcaggaactgaccgtgtgctctgaggacaacgtggatgtgcacgatatcgagttgctccagtacatcaatgtagattgtgcaaagctgaagagattgttgaaggaaaccgcatttaaatttaaggccctgaagaaagtagctcagctggcagttattaactcactggaaaaagccttttggaactgggtggagaactacccagatgagttcaccaagttgtatcagatccctcagaccgacatggcggaatgcgctgagaagctttttgatttggtggacggctttgccgaaagcactaaacggaaagctgcagtttggcctcttcaaattatattactgatcctctgccctgagattattcaggatatcagtaaggacgtggtagacgagaacaatatgaacaagaagctgttcctcgacagcctccgaaaggccttagcgggacatggcggttctaggcaactgaccgagagtgccgcaatagcctgcgtcaagctgtgtaaagcgagtacctatattaattgggaagataattctgtcatattcctgttagtgcagagcatggtcgtggatctgaaaaacctgctgtttaacccaagtaaaccattctctcgcggaagtcaacctgctgatgtagatctcatgatagactgtctagtgagttgctttaggatcagtcctcacaacaatcaacactttaaaatctgcctggctcaaaattccccctcaacatttcattatgtgctcgttaacagtctgcataggataatcaccaatagtgcacttgactggtggcccaaaatcgacgctgtatactgtcactccgtggagttgaggaatatgttcggtgagacactgcacaaagcggtacagggctgcggcgcacaccccgcaattcggatggctccctcccttacattcaaggagaaggtgacatcactgaagtttaaagagaaacccaccgatctggagaccaggagctacaaatacctcctgctgtcgatggtcaagttgatccatgcggaccccaaactcctcctgtgcaaccctaggaagcaaggaccagaaacacagggaagcaccgccgaactgattacaggtctggtgcagctggtcccccagagtcatatgcccgaaatagctcaagaggctatggaggccctgttggtgctgcaccaactggatagcatcgacctctggaatcccgatgccccagtggaaacattttgggaaatctcatcgcagatgctgttctatatttgtaagaaactaacatcccaccaaatgctctcctcaaccgagattttgaagtggctacgggagattctgatatgtaggaataaattcttgctgaagaataagcaagccgaccggtcaagctgtcattttctcctgttttacggagttggttgcgatatccccagttcggggaatacctcccaaatgtcaatggatcacgaggagctgctgcgtacccccggagccagtctacgcaaagggaagggaaacagttcaatggattccgcagccggttgctccggtacacctcccatttgtcgccaggcccagaccaagttggaggttgccttatacatgtttctatggaaccccgatacggaggccgtcctggtggcaatgtcatgtttccggcacctttgcgaagaagcagatatcagatgcggtgtagacgaagtaagtgtgcataatctcttgcccaactataacactttcatggagtttgcctccgtcagcaatatgatgagcaccggccgtgccgctctccagaagcgggtgatggccctgctaaggcgcatagagcacccaactgccggaaataccgaagcttgggaagacacccatgccaagtgggaacaggcaacaaagctcattctgaattaccccaaagccaagatggaggatggccaggccgctgagtccctgcacaagaccattgtcaaacgacggatgagccatgtatctggaggaggctcaattgacctctcagacactgattctcttcaggagtggatcaacatgactgggttcctgtgcgcattagggggtgtgtgcctgcaacagaggagcaactctggtctggctacctatagtccccctatgggcccagtgagtgagcgcaaaggttcaatgatctcggttatgtcttccgagggcaacgccgatacccccgttagtaaattcatggataggctgctgtcgttgatggtgtgtaaccacgagaaggtaggcctgcagattaggactaatgtgaaggacctggtgggcctcgagcttagccctgctctctacccaatgctgtttaacaagctgaaaaacactatcagcaaatttttcgattcccaggggcaagtcctgctgactgacactaatacccagtttgtggagcagacaatcgccatcatgaaaaacctcctggacaaccacaccgaaggttcttctgaacatctcggccaggcaagtattgaaaccatgatgctcaatctggtgaggtacgtgcgtgtactgggcaacatggtgcatgctattcagatcaagactaaactctgtcagctggtggaggtcatgatggctcgacgggacgacctctctttctgtcaggaaatgaaattccgcaacaagatggttgagtatttgactgactgggtgatgggcacttctaatcaagccgctgatgacgacgtgaagtgtctcactcgcgacttggaccaggcatctatggaggccgtggtttccttgcttgcaggcctgcctcttcagccagaggaaggagacggcgtggagctgatggaggccaaatcccaactgtttctcaagtatttcacactgttcatgaacctgctgaacgactgtagtgaggtggaagacgagtccgcgcagacagggggtaggaaacggggtatgagtcgcaggcttgcctcactgaggcattgcactgtactagctatgtctaatttgctcaatgcaaatgtggacagtggcttgatgcactcaataggactcgggtatcacaaggacctgcagaccagggctactttcatggaagtcttgactaagatattgcagcagggaaccgaattcgatacactggcagaaaccgtgctggccgataggtttgagagattagtggaacttgtgacgatgatgggagatcagggggagctaccaatcgcaatggcgcttgctaacgtggtgccgtgttcacagtgggatgagctcgcgcgtgttttagttaccctgttcgattcacggcacctgctgtaccagcttctctggaatatgtttagtaaagaggtggaactagccgacagtatgcagactctttttcggggaaactccttggcgtcaaagattatgacgttctgtttcaaagtgtatggtgccacttacctgcagaagctgctggacccactgctccgtatcgtgatcacatcatctgattggcaacacgtgtcgtttgaagtggaccccactaggctcgagcctagcgagagtctggaggagaaccagcgaaaccttcttcagatgactgaaaagttctttcacgcaataataagtagtagctctgaatttccaccccagcttcggagcgtgtgccactgtctgtatcaagtcgtctcacagcgttttcctcagaactcgataggtgccgtgggatctgcaatgttcctgcggtttatcaatccagcaattgtgagtccatatgaggcgggaatcctggacaagaaaccgcctccccgaatcgaaagaggcctgaaactgatgagcaaaatactgcaatccatcgccaaccatgtgctctttacgaaagaggagcacatgcggccatttaatgacttcgttaaaagtaatttcgatgcagcccgaaggttctttctggacatcgcatccgactgccctactagcgatgcggttaaccattcgctgtcgttcatctcagacggaaatgtgcttgcattacatcgcttgctgtggaacaatcaggagaagatcggtcagtatttgtcatccaaccgcgatcacaaggcggtgggccgtaggccctttgacaaaatggccaccctcctcgcgtatctgggacccccagagcacaaacccgtggcagacacccattggtctagtctgaacctaacgtcttccaagttcgaagaattcatgaccaggcatcaggtccatgaaaaggaggagtttaaagctctaaagacattgtctatcttttatcaggccggaacttctaaggcgggaaatccaatcttttattacgtcgcgaggcggtttaaaacaggacagataaacggagatctcctgatttatcatgtccttctgaccctcaagccgtactacgccaagccttatgagattgtcgtggatcttacacacactggtcccagcaataggttcaaaaccgattttttgagcaagtggttcgtagtgttccctggtttcgcgtatgacaatgtctccgctgtgtatatctacaactgtaacagctgggtccgggagtatacgaagtaccatgaaagactgcttaccggactgaagggctcaaaacgcttggtgtttattgattgcccaggaaagcttgccgagcatatcgaacacgaacagcaaaagctgcccgctgcaaccctagccctggaagaggatcttaaggtgttccataatgctctcaaactggcacataaggatacaaaagtctcaattaaagtggggtcgaccgcagtccaggtgactagcgctgagaggactaaagttcttgggcaaagcgtgttcttaaatgacatctactacgccagtgagattgaggagatttgtttagtggatgagaaccagttcaccctaaccattgctaatcagggcacaccactgacattcatgcaccaggaatgcgaggcgatcgtccaatctatcattcacattagaacgcgatgggagttaagtcagccggactccatccctcaacacacaaagatcagaccaaaggacgtgcctgggaccctccttaatattgccctcctcaatctggggtctagtgacccatctttaaggtccgccgcttacaatctgttgtgcgctctgacgtgtacattcaatctgaagatcgaaggacagcttctcgaaactagcggactctgtatcccagccaataatacgttattcattgtgagcatttctaaaacattggccgcaaacgagcctcacttgaccctggagtttctcgaggagtgtatttctgggttctccaaaagttccatagaactgaaacacctctgcttggagtacatgactccctggctgtccaaccttgtgcggttttgcaaacataatgatgacgccaagcggcaacgcgtgacagctatccttgacaagcttatcacaatgactatcaacgaaaagcagatgtaccctagcatccaggccaaaatctggggtagcctggggcaaatcaccgacttacttgatgtagtccttgatagctttattaagacgtctgctacggggggattgggctccatcaaagctgaggtcatggcagatactgcagtagcactggctagtggcaacgtgaaattggtctcttcaaaggtgatcggcagaatgtgcaaaatcattgacaagacctgcctgtcgccgactccaacactggagcaacaccttatgtgggatgatattgctatcttggccagatatatgctgatgctctctttcaataatagtctcgacgttgcggctcatttgccatacctttttcacgtagttactttccttgttgctaccgggccattgtcattgagggctagcacacacggtctagtgattaacattatccatagcctttgcacctgctcacagcttcacttcagcgaggaaacgaaacaggttttacgacttagcttgactgagttttccctgcccaaattttatctgctcttcggcatcagtaaagtgaaatcagccgcagttatcgccttccggtccagttatcgggaccggtcgttctctcccggatcatacgagagagagacctttgctctgacgtcacttgagacggtcactgaggctctgctcgagatcatggaggcttgtatgcgggatatccctacttgcaaatggcttgaccagtggacagagctggcccagcgctttgcctttcagtacaatcctagcctgcagcccagagccctggtcgtgttcggctgcatctcgaaaagagtgagtcacggccagattaagcagatcatccgcatactgagtaaggcactggaatcgtgccttaaaggccctgatacttacaattcccaagttttaatcgaggccaccgtcatcgccctgacaaagttgcagcccctcctgaataaggattctccactccacaaggccctcttttgggtcgccgtggccgtcttgcaactcgatgaggtcaacctttattcggccggtaccgccttgctggagcagaacctccacactctggattcactcaggatttttaacgataaatcaccagaggaggtgttcatggccataaggaaccccctcgaatggcactgtaaacagatggatcatttcgttggcttaaacttcaattcaaattttaattttgctctggtggggcacctccttaaagggtacagacacccaagccccgcaattgtcgcaaggaccgtcaggatcttacataccttgctcaccctggttaacaagcaccgcaactgtgacaagtttgaagtgaatacacagtctgtggcctatttggccgcactcctgaccgtgagcgaggaggtgagaagtagatgctctctaaagcacaggaaaagcttgctgttaaccgatatcagcatggagaatgtgcccatggatacatatccaattcatcacggtgaccctagctatagaacccttaaggagactcaaccttggtccagtcctaaaggaagcgagggatacctggccgcaacttatcccaccgttggccagacctcaccgcgagctcggaaaagcatgagtctggacatggggcaacccagtcaggccaacacaaagaagctgctgggaaccagaaagtcctttgaccatttaatatctgatactaaggcacccaaaaggcaggagatggagagtgggataactacaccccctaagatgaggcgcgtcgcagaaactgattacgaaatggagactcagaggatttcctcaagccagcagcacccccatctgaggaaagtgagcgtgagcgaaagcaatgtcctgcttgacgaggaagtgttgaccgatccgaagatacaggcactcctgctcacagtactcgcaacactggttaagtatacaactgacgagttcgaccaacgcattttgtacgagtatctggcagaggcgagcgtcgtctttccaaaggtattcccagtggtgcacaatcttctggactccaaaatcaacacgttactgtctctctgtcaggatcctaacctcctgaatccgatccacggtatcgtgcagagcgttgtttaccacgaagaaagtccacctcagtaccagacatcctacctgcagagtttcggatttaacggtctgtggcgcttcgccggacctttcagcaagcaaacccagatacctgattatgcagaactaattgtcaaatttctcgacgccctgatcgatacctacctgcccggaatcgacgaagagaccagtgaggagtccttgctcaccccgacctctccctacccacccgctttgcagtcacagctgtccattactgcgaatttgaatttgtcaaacagcatgaccagcctcgcaactagccagcacagtccagggatagacaaagaaaatgttgagctcagccccacaacaggtcattgtaatagcggcaggaccagacacggatctgcttcacaggtccaaaagcagcgaagcgccggttcttttaaacggaatagtattaagaaaatcgtcta

SEQ ID NO: 29749 - DNA, 8519 bp, Artificial Sequence
  Description of Artificial Sequence: Synthetic coding sequence
atggctgcccatcgccctgttgagtgggtgcaggccgtggtgagccgatttgacgaacagctgccaatcaaaactgggcagcagaacacccacacaaaagtgtccacagaacacaataaagagtgtctcatcaacatctcaaagtacaaattcagtctggtgatttctggactgaccaccattctgaagaacgtgaataatatgcgtatcttcggagaggccgcagagaaaaacttgtatttatcccagctgattatcctcgatacccttgaaaagtgtttagcaggacagccgaaggacactatgcggctggatgagacaatgttggtgaaacagcttctcccagaaatctgtcacttcctgcatacctgtcgcgagggcaaccagcacgcagctgaactgcgcaattctgcaagcggtgtactgttcagtttgtcctgcaataattttaacgcggttttctctcggataagcacccgccttcaagaactcacagtatgttctgaagacaacgtggatgtgcacgacatcgaactgctgcaatacatcaacgtggattgtgccaaactgaagagactcctaaaggaaacagcattcaaattcaaggccctaaagaaggtggcacagctggccgtgattaattctctggaaaaggccttctggaactgggtggaaaattacccagatgagtttacaaaactgtatcagattccgcagacagacatggctgaatgcgctgagaagctcttcgacctggtggatggcttcgctgaaagcactaagcggaaagcagctgtatggccactgcaaattattctgcttattctctgtccagagatcatccaggacataagcaaggacgttgtggatgaaaacaacatgaacaagaaactgttcctggactccctacgcaaagcactggctggtcacggcggaagcagacagctcacagaaagcgctgcaatcgcatgtgtgaagctctgcaaagcgtctacatacatcaactgggaggacaactcggtgatttttttgctcgtccagtcaatggtggtggacctcaagaatctgttgttcaatccatcgaaacctttttctagggggtcgcaacctgcggatgtggatctgatgatcgattgtctcgtcagctgctttcggattagcccccataataatcagcactttaaaatctgtctggcccagaactccccctccacctttcattatgtgctagtgaattctctgcaccggattataacaaatagcgcactggattggtggccaaagatcgacgcagtctactgtcacagtgtggaattgcggaatatgtttggagaaactttgcataaggctgtgcagggttgtggagcacacccagcaatccgtatggccccatcactgaccttcaaagagaaggtgacctcactgaagtttaaggagaagcccacagatttggagactaggtcttacaagtacttgctgctgtcaatggtgaagctcattcatgctgatcctaaactgctgctgtgtaatccaagaaagcaagggccagaaacccaaggctcaaccgcagaactgatcacagggctcgtgcagctagttcctcaatctcatatgccggagatcgcccaggaggcaatggaagccctgcttgtgctgcaccagctggacagtattgacctgtggaaccccgacgcccctgtggaaaccttctgggagatcagctcacagatgttgttctatatctgcaagaagctgacctcccatcagatgttatcatccactgagattctgaaatggttgagagaaatattgatttgccgtaacaaattccttctgaaaaataagcaagctgatcgctctagctgccacttccttctgttttacggagtgggatgtgacatcccgtcttctggaaatacttctcagatgtccatggatcacgaggaactgctgcggactccaggcgcttcactgcggaaaggcaaaggtaactcgagcatggattccgcggctggatgctccggcactcctccaatttgccggcaggctcagacaaagttggaagtggcactgtatatgttcctttggaaccctgataccgaggctgtcttagttgcgatgtcttgctttcgccacctgtgtgaggaggccgatatcagatgcggagttgatgaggtttccgtgcataacctgctgcctaactacaatacctttatggagttcgcaagtgtgtctaacatgatgagcaccgggagggccgctctgcaaaaaagggtgatggcccttcttcggcgtattgagcatccaacagcgggtaatacggaggcttgggaagatactcatgccaaatgggaacaggcgacgaagcttatcctgaactatccaaaggccaaaatggaagacgggcaggccgcagagagcctccacaagacgatagttaaaaggcgcatgtcccacgtcagcggcggaggctcaattgacctgagtgacacggatagccttcaggaatggatcaacatgaccggcttcctatgtgctttgggcggagtctgtcttcagcaacgaagtaattctggcctggccacctattcgcctccaatgggtccagtttccgagcgaaagggtagcatgatctcagtgatgtcctcagaaggaaacgctgatacccccgtgagcaaattcatggaccgccttctctcactgatggtttgcaatcatgagaaagttggcttgcaaatcaggacaaatgtgaaggatctggtcggcctggagctgtcgcccgcactgtatcctatgctatttaacaaattaaaaaacacaatctcaaagttctttgactcccaggggcaggtgttgcttactgacactaatacacaattcgtcgagcagaccatcgcgattatgaaaaacctcctcgataatcacaccgagggttcctccgagcatctgggacaggcctctattgaaactatgatgctcaatctcgtgcgatacgtccgagtgctggggaacatggttcatgctatccaaataaagactaaactttgtcagctggtggaagtgatgatggctcgccgagacgacttgagcttctgtcaggagatgaaattccggaataagatggtggagtatctcacagactgggtgatgggaaccagcaatcaggcggcagacgatgacgtgaaatgtctaacaagagacctggaccaggcttccatggaggcagtggtgtcgctgctcgctgggttgccgctccagcccgaagagggtgatggagtggagttaatggaggctaaatcacaactgttcctcaaatatttcacgctctttatgaacctgctcaacgactgcagcgaggtggaggatgagtcagcacaaacagggggtaggaaacgcggtatgtcaagacgactggctagtctccgccattgtactgtgcttgccatgagcaacttactcaatgcaaacgtggactctgggctcatgcatagtatcgggctgggatatcataaagatctgcagactcgtgcaacgttcatggaagtactgaccaaaatcctccagcagggaactgaatttgatacacttgctgaaacggtgctcgcagatcgctttgagcgcctggtcgagttggtgactatgatgggggaccagggcgaactgcctatcgctatggcccttgccaacgtggtgccctgctctcagtgggacgagttagcccgagtgctggtgaccttatttgacagtcgtcacttgctgtaccagcttctgtggaacatgttctccaaagaggtggaactcgccgattcaatgcagacattgtttcgagggaattcactggctagcaaaatcatgacgttctgttttaaggtgtatggggctacctatttgcagaaactgttggatcctttactgcggattgtcattaccagctcggattggcagcacgtgtcatttgaagtcgatccaacaaggctggaaccatccgagtctctggaggagaaccaacgtaatctgttacagatgactgagaagtttttccacgctattatttcctcttcctcggaattccctccccagctgcgatcggtgtgccactgtctgtatcaggcaacctgccattcccttttaaacaaagcaacggtaaaggagaaaaaggagaataaaaagagcgtggtttcacagagatttccccagaatagcattggcgctgtcgggtctgcaatgtttctaagattcattaatcccgcaattgtgtcaccatatgaggctggtatactcgacaagaagccgccaccgaggatcgagagagggctgaagttaatgagtaaaattttgcagagtattgccaaccacgttctgttcaccaaagaggagcacatgcggccattcaacgactttgtgaagagtaatttcgacgccgcacgcagattttttctggacatcgctagcgactgccccacctctgacgcagtgaaccattctctgagtttcatttcagacggtaacgtgcttgcacttcataggctcctgtggaataatcaggagaagatagggcaatatcttagctcgaaccgcgatcataaggcagtgggtcggcgtccgtttgacaagatggcaacactgcttgcttacctcggtcctccagagcacaagcctgtggccgacacccattggtcttccctcaatctcacatcaagtaaatttgaagagttcatgacaagacatcaggtacacgagaaggaggagtttaaggcactcaagactctcagcatcttttaccaggcaggaacatcaaaggcaggaaatcccatcttttattacgtggcaagaaggttcaagactgggcagatcaatggggacctgcttatctatcatgtgctcctgaccctgaagccttattatgctaaaccgtacgagattgtcgtggacttgacccatacaggcccttccaaccgcttcaaaacagactttctgagtaagtggttcgtggtgtttcccggtttcgcttacgacaatgtttcagcggtgtacatctacaattgtaatagctgggtgcgcgagtataccaagtatcatgagagactgctaacaggcctgaaagggtcgaaacggcttgtctttattgattgccccggaaagttagctgaacatattgaacacgagcagcagaagcttcctgcagctacgctcgcactggaggaggacctaaaggtgtttcacaacgcacttaagcttgcccacaaggacacgaaagttagtatcaaagtcggatctaccgctgtgcaggtgactagcgctgagcggactaaggtgctgggacaatcagtgttcctgaatgatatttattatgcgtcagaaatcgaagaaatctgtctggtggatgagaaccaatttactctcacaattgccaaccaaggcacgcccctaacattcatgcaccaggaatgtgaagcaatcgtgcaaagtataatacacatcaggacccggtgggaattgagccagccagactccattccccaacataccaagattcggccaaaggatgtgccgggaacgctgttgaatatagccctattgaatctaggaagttcagatccttctttgaggagcgccgcttataacctgctgtgcgcacttacctgcacttttaatctgaaaatcgaaggccaattactcgagacctcggggctctgcattccagctaacaacaccctgtttattgtatcgatcagtaaaacactggctgccaatgaaccccatctgaccctggagtttctggaagaatgcatatccggtttctcaaaaagcagcatcgagctaaagcacctgtgtcttgagtacatgactccgtggctctcgaatctagtacgcttctgcaagcataacgacgacgctaaacgtcaacgggtgacggccatcctggataagctgatcactatgaccataaatgaaaagcaaatgtatccttccatccaggccaaaatctggggcagcctcgggcagataaccgatctgctcgacgtggttcttgattccttcattaaaacaagtgccaccggcggactgggttcaatcaaggccgaggtgatggccgacacagccgttgcgctggcaagcggaaatgtgaaactagtttcctccaaggtcattggaaggatgtgcaagatcattgacaaaacatgcttatcccctaccccaaccctggagcagcatctgatgtgggacgatattgccattttagccaggtacatgctcatgctcagcttcaataacagcttggatgttgctgcacatttgccctatctgttccatgtggttactttcctcgtagccacagggccactgagcctgagagcttcaactcatggccttgtgatcaacatcatacacagcctatgtacctgctcccagctgcatttttccgaggagactaagcaggtcttaaggttaagcctgactgagttctctctgccaaagttttacctattattcgggatctctaaggtcaagagtgcggctgtgatagcttttcgctccagctaccgggatcggtccttctctccgggatcttacgaacgggagacattcgccttaacttctctagagacagtcaccgaagcactgcttgaaatcatggaagcttgtatgcgggacatccctacgtgcaagtggctcgatcagtggacagaactcgctcagcggttcgcttttcagtacaacccctcattgcagcccagggcccttgtggttttcggctgcatcagcaagagagttagccacgggcagattaaacagattattcgcatcctgtccaaagcactcgaatcatgtctgaagggccctgatacctacaattcacaagtgctcatcgaagcaaccgtgatcgcacttactaaacttcagccgctgcttaacaaggattctccgctgcacaaagctttgttctgggtagctgtcgcagtcctgcaacttgatgaggtgaatctttattcagcaggaaccgccctgctggaacagaacctgcacaccctggattcactgagaatattcaatgacaaatctcccgaggaagtttttatggccattcggaacccactggaatggcattgcaagcagatggaccactttgtggggctcaactttaattccaactttaattttgctcttgtgggccatcttctaaaaggttacaggcatcccagccccgctattgttgcccgtacggtgagaatcctccacacccttctgactctcgtgaataaacacaggaactgcgacaaatttgaggttaatacccaaagcgtagcctatctggccgctcttctgactgttagtgaggaggtaaggagcagatgttcattaaaacaccgaaagtccctgctgctcaccgacatcagcatggaaaacgtgcctatggacacgtatcccatccaccacggcgacccatcgtatcgcacattaaaggagactcagccctggtcttctcccaagggctccgagggctacttagctgcaacctacccaaccgtgggtcagacttccccccgtgctaggaagtccatgtcgctagacatgggccaacccagtcaggctaataccaagaaactcctgggcactagaaagagctttgaccatctgatctctgacactaaagctccaaagaggcaagagatggagagcggcataacaaccccccctaaaatgagacgggtggccgagacagattatgagatggaaacccagaggatttccagctcacagcagcacccacacctacggaaggtgtccgtgtctgagtcaaacgtcctactcgatgaagaagttttgacagatcccaagattcaggctctcctcctgacagtactcgccaccctggtcaagtacaccacagacgagttcgatcagcgcatcctatacgagtaccttgcagaggcctctgttgtgtttcctaaggtgttccctgtggtccacaatctccttgattcgaaaattaacaccctgctgtccctgtgtcaagaccctaatctgctgaatccaatccacggaatcgtgcagtccgtggtctaccatgaagaaagcccaccccaatatcagacaagctatttgcagtcctttggattcaacggtctttggagatttgctggcccttttagtaagcagactcagattcccgactacgcagaactcatagtgaaatttctggacgcactgatcgatacgtaccttcccggaattgacgaagagacctctgaggagagcctgctgactcctacatctccttaccctcctgcgctgcagagtcaactgagcatcactgccaacctaaacctttctaatagcatgacaagcctggccacttcgcagcacagccctggcatcgacaaagaaaacgtggagctctcccccacaaccgggcattgcaatagcggacgcacacggcatggttcagcttcacaggtacagaagcagagatctgctggctcttttaagaggaacagcatcaaaaagatcgtgta

SEQ ID NO: 29750 - DNA, 615 bp, Artificial Sequence
  Description of Artificial Sequence: Synthetic coding sequence
atgcacgaacgatactcaaacgtccaggtagctggcccagtggatagaaccagctccaaggattctccactgcacaaggccctcttttgggtggccgtagccgtgctgcaactggacgaagtgaacctgtactccgccggaacagcactccttgagcagaatttgcatactctggacagtctcaggatttttaatgacaaatccccggaggaggtgtttatggctatacggaacccgctggagtggcactgtaagcaaatggaccatttcgtgggactcaatttcaattccaatttcaactttgctttagtcgggcatctccttaaaggataccgtcaccctagtccagcaattgtggccagaacggtgagaattcttcacaccctgctcactctcgttaacaaacacagaaattgtgataaattcgaggtgaacacgcagtctgtggcatatttagccgcactgctgacagtgagcgaggaggtgcgatcacggtgctccctgaagcatcgtaagtccctgctgctgacggacatcagcatggagaatgttccaatggacacataccctatccatcacggtgacccgtcttataggaataaagaaaaattttag

SEQ ID NO: 29751 - DNA, 1782 bp, Artificial Sequence
  Description of Artificial Sequence: Synthetic coding sequence
atggccgctcaccgacccgttgagtgggtacaggcagtcgtctccaggttcgacgaacaacttcctattaaaaccggccagcagaacacacatacaaaagtgtccaccgaacacaacaaagaatgcctaataaacattagtaagtacaaattctccttggtgatcagcgggctcaccaccatcctcaaaaacgtgaacaatatgagaattttcggggaggccgctgaaaaaaacttatacctcagccagttgattatattagatactctggagaagtgtctcgctggacagccaaaagacacaatgagactcgatgagaccatgttagtgaaacagcttcttccagagatttgtcacttcctgcatacctgccgggaagggaatcagcatgccgctgagttaaggaatagtgcaagcggggtgctctttagcctgtcttgcaataatttcaacgctgtgttttcaagaatctcgactcgactgcaggagttgacagtgtgctcggaggacaatgtggacgtacatgacatcgaactgctccaatatattaatgttgattgtgctaagctgaaaagactcctgaaggagactgctttcaagttcaaagctctaaagaaggtggcgcagcttgcagtaattaactccctcgaaaaggctttttggaattgggttgagaactatcctgatgagtttactaagctctaccaaattccccagactgacatggcagagtgtgcggagaagctgtttgacctcgtcgacgggttcgcagaatcaaccaaaaggaaagcggcagtgtggccgctgcagataatcctgcttatcttatgtccagaaattattcaggacataagtaaggacgttgtcgacgagaacaatatgaacaaaaagttgtttctggattcccttagaaaagcgctggctgggcacggaggctcacgccagctgacagagagcgccgcaattgcttgcgtaaaactgtgtaaagcctcgacatacatcaactgggaggacaacagcgtaatcttcctgctggttcagtccatggtcgtcgacctgaagaacctcctcttcaaccctagtaaacctttcagtcggggttcgcaacctgctgatgtggacctgatgatcgactgcctcgtatcctgtttccggatcagtccacataacaatcagcactttaagatctgcctcgcacagaatagtccttcaactttccattacgtactggtgaattcactgcatcgcattatcaccaattcagcgttagattggtggcctaaaattgatgccgtctactgccattccgtggagctgcggaacatgttcggcgaaaccttgcacaaggctgtgcagggatgtggggctcatcctgcgatccgtatggccccttccctaacttttaaagaaaaggtcaccagtctgaaatttaaagagaagcctaccgacctggaaacacgatcctacaaatatcttctactaagcatggtgaagctcatccatgcagaccctaaactcctgctgtgcaacccccgaaagcagggaccggaaacccaggggtccactgccgaactgatcacgggattggtgcagcttgtgccacagagccacatgccagagattgcccaggaggctatggaggctctgctggtactgcaccaactagacagcatcgatctttggaacccggatgctcctgttgaaacattttgggaaattagatacatgtacttctacttcctgaacagtacatttaagttctacttcgtctttttaagttag

SEQ ID NO: 29752 - DNA, 1917 bp, Artificial Sequence
  Description of Artificial Sequence: Synthetic coding sequence
atgcacgagcgatacagcaatgtgcaagtcgccggaccagtggaccgcacgtccagcaagttctgcgggtcattcaactgtcggtttgccttccagtataaccctagtctgcagccacgagctctggtggtcttcgggtgtatcagcaagcgggtctcccatggacaaatcaagcaaataatccgtatactcagcaaagccctcgaaagctgcctgaaagggcctgacacttataattcccaggtgctgatagaagcaacagtcatcgccctgacaaaactccaaccactcctgaacaaggacagtcctctccacaaagcattattttgggtggcagtcgccgtattgcagctggacgaagttaatttatactcggcgggtaccgccctgcttgaacagaacctacacaccctcgatagcctgcgtatttttaacgataagtcccctgaggaggtttttatggcaatccgcaatcctctggagtggcattgcaagcaaatggatcattttgtgggactgaattttaatagcaacttcaacttcgcactcgtaggacacctcctcaagggctatcgacatccttcccctgccattgttgcacgaacggtgcggattctccatactcttcttactctggtgaacaagcacagaaactgcgacaagttcgaggtgaacacgcagtctgtggcttatttagccgctcttttgacggtgagcgaggaggtccggagtaggtgcagcctgaaacataggaagtccctactgctgactgacataagcatggagaacgtgcccatggatacttaccccattcaccatggcgaccccagttatcgaaccctgaaagagactcagccttggtcatcccccaagggctccgagggctatctggcagccacataccctacagtcggccagactagtcctcgcgcacggaagagtatgtctctggacatgggccaaccttcacaggcgaatactaagaagcttctgggcactaggaagtctttcgaccacctgatatctgacaccaaggcaccaaagcgccaggagatggagtctgggattacgacacctccgaagatgagacgcgttgcagagaccgattacgagatggagacacaaaggatttcatccagccagcagcatccccacttgagaaaagtgagtgtttcggagtctaatgtgctgcttgatgaagaagtacttactgatccaaagattcaggccctgctgctgactgttcttgcgacactggtgaagtacaccacggatgagttcgaccagcgcatcctctacgagtatctagccgaagcttccgtcgtgtttccaaaagtgtttcctgtcgtacataaccttcttgatagtaagatcaacacactgctgtcactatgccaagatccgaatctgttaaacccaatccatgggattgtgcagtccgtggtgtaccatgaggaaagcccaccacaataccagacttcatacctgcaatcctttggtttcaacgggctttggcgatttgccggtccatttagcaaacagactcagattccagattatgccgagctgatcgtgaagttcttggatgctttaatcgacacatacctcccaggtatcgacgaagaaactagcgaagagtctctgctcactcctacaagcccataccctcctgccctccaaagtcagctctcaattaccgccaaccttaatcttagcaactcgatgacaagcctagctacctcacaacacagtcctgggattgataaggagaacgtggaattatcaccgacaaccggacattgtaatagcggcaggacccgccacggcagcgcttcacaggtgcaaaagcagcggagtgccggaagcttcaaactagcccttctgaatctgctgactgcgcatcagaactcattgtag

SEQ ID NO: 29753 - DNA, 7508 bp, Artificial Sequence
  Description of Artificial Sequence: Synthetic coding sequence
aactgggaggacaactccgtcattttcctcctcgtgcaatctatggttgtggatctgaagaaccttctgtttaatccgagtaaacctttctcacgtgggagccaacccgcagacgtggatttaatgatagattgcctggtttcgtgcttccgaatcagccctcataacaatcaacatttcaagatctgtttggcgcagaacagcccctccacctttcattatgttcttgtgaacagtctccacaggattatcactaacagtgccttggactggtggcccaagattgatgctgtgtattgtcacagcgtcgagctgcggaacatgtttggagaaacattacacaaagccgtacagggttgcggcgcacatcctgctattcgaatggccccatcacttacattcaaagaaaaggtcaccagtctgaaattcaaagaaaagccaaccgacttggagacccgttcatacaagtatcttttactctctatggtgaaactaatccatgccgaccctaagcttctcctctgcaaccctaggaagcagggtcccgaaacccagggaagcaccgccgagctgattacgggcctggtgcagctagtgccccaatcccatatgccagaaattgcccaggaagcaatggaggccctgctggtacttcaccaacttgatagtatcgatctgtggaatccagatgctcccgttgaaactttttgggaaattagctcacagatgctcttttacatatgcaaaaagttaacctctcaccagatgctgtcctccactgaaatcctgaagtggctgcgagagatcctcatttgcagaaacaagtttctgttgaagaataaacaggctgacaggtcctcttgtcactttctgctgttctatggagtggggtgcgatatcccctccagcggcaatacatcccagatgtccatggaccacgaagagcttctccggacacccggtgcgagtctgcggaaaggtaagggaaattctagcatggatagtgccgctggctgtagtggcactccgcctatttgtaggcaggcacagaccaaactggaagttgctctatatatgttcctttggaacccggacactgaggcagttcttgtggctatgagttgtttccgtcacctatgtgaggaggcggacattagatgcggggtggacgaagtttccgtccataatctcctgcccaattacaacactttcatggaatttgcatctgtgtccaacatgatgtccacgggccgtgccgcactccagaaaagggtgatggctctgttgaggcgcatcgaacatcccacagctgggaacacagaagcctgggaagatacacacgccaagtgggaacaggcaaccaagctgatcctaaattacccaaaggcgaagatggaggacggccaggccgcagagtccctgcacaagacaatcgtaaaaaggagaatgagtcacgtttcagggggaggttccatcgacttgtcagacacagacagcctgcaggaatggataaatatgacgggcttcctgtgcgcccttgggggagtgtgcctgcaacagaggagtaactcaggtttggccacctactcccccccaatgggccctgtgagtgaaagaaaagggtcgatgatttccgttatgtcctccgaaggaaatgcagatacacccgtatctaagttcatggatcggctcctgtcccttatggtgtgtaaccacgagaaagtaggactgcagatccgcacgaatgtaaaggatttggtaggcctcgaactgtccccagcactataccccatgttattcaataagctcaagaatactatttctaaattctttgactctcagggccaagtgctgctgactgacaccaacactcagttcgtggagcagacaattgcaatcatgaagaatctgctagacaaccacactgaaggatcaagcgagcaccttggccaagcaagcattgaaactatgatgctaaacctagtgcgctatgttcgggtcctaggaaatatggtgcatgctatccagataaagaccaaactgtgccagttggttgaggtgatgatggccagaagagacgacttgagtttctgccaagaaatgaaattcagaaacaagatggtggagtatctgacagattgggtgatgggaacttcaaatcaggccgctgatgatgatgtgaagtgcctcacacgggacttggatcaagctagcatggaggctgtggtcagcctcctcgctggtctgcccctgcagcccgaagagggggacggcgtagagttaatggaagctaagtcccaactgtttctgaaatatttcaccctttttatgaacctgctgaacgattgcagcgaggtcgaagatgagtctgctcagacaggaggaagaaaaagaggcatgtcccggaggctggcctcactgaggcactgtactgtgctggcaatgtccaacttgctcaacgccaacgttgactccggcctcatgcattccatcggccttggataccataaagacctgcagactcgggcaacctttatggaggtgttgactaagattctgcagcaaggcaccgaatttgacacccttgccgagaccgttttggccgatagattcgaacgcctggttgagttggtgacaatgatgggagatcaaggtgaactgcccatagccatggcactggctaacgtggtcccgtgcagccaatgggacgagcttgcgcgtgtgctggttaccctctttgattcgagacatctgctttatcaactactttggaatatgttctctaaagaggtggagctggcggattctatgcaaacgttattccgagggaactccctggcctccaagatcatgacgttctgttttaaagtgtatggggcaacctacctgcagaaacttcttgacccccttctcaggatcgtgattactagctccgactggcagcatgtgtctttcgaggtggatccgacccgccttgagccttccgaatccctggaggagaatcagcggaaccttcttcagatgacagaaaagttttttcacgctattatttcctcatcctcagaattcccgcctcaactccggtcagtctgccactgcctttatcaagttgtttcgcagaggtttccacagaactcaattggcgcagttgggagtgccatgtttcttagattcatcaatcccgcaatcgtgtctccatacgaagctggaattctggacaagaagcccccacctaggatagagaggggcctcaaactgatgtccaaaatcctgcaatcaatcgccaaccacgtcctctttaccaaagaagaacacatgcgcccttttaacgattttgtaaaaagtaattttgacgccgctcggaggtttttcctggatatcgcctccgactgccccacgtccgacgcagtgaatcattccctaagcttcattagtgacgggaatgtactggccctccaccgcctcttgtggaataaccaggagaaaatcgggcagtacctgagttcaaatcgcgatcacaaagccgtcggcagacggccttttgataaaatggccactcttctcgcgtatctggggcctccggagcacaagcctgtagccgacacgcattggtcgagcctgaaccttacatccagtaaatttgaagagttcatgacaagacaccaggtccatgaaaaggaagagtttaaagcactcaagaccctgtccatcttttaccaggctggaacctctaaggcaggtaaccccatcttctattatgtggcgcgacgctttaaaaccggccagatcaacggcgatctgctgatctaccatgtactcctgactctcaagccttattatgcaaaaccctatgaaatcgttgtggacctaacacacactggacccagcaatcgctttaagacggactttctgagtaagtggtttgtcgtgttcccaggctttgcatatgataatgtatcagctgtttatatctacaactgtaattcctgggtgcgcgagtataccaagtatcacgagcggctgctcacgggcctgaagggatccaaacggttagtgttcatcgactgtcccggtaaactcgccgagcatattgagcacgaacaacagaagctgcccgcagcgacccttgctctcgaggaggacctcaaagtgttccacaacgctcttaagctcgcccataaggatactaaggtcagcattaaagtcggttccaccgcggtccaagtaacgtctgcagagcgaactaaagtcctgggacagagcgtgttcctgaacgacatttactacgcaagtgagatcgaagaaatctgtttggtggatgagaaccagtttaccctcaccatcgcgaaccagggaacacctttaacctttatgcatcaagagtgcgaagcgatcgtgcaatccatcattcacatacggacccgctgggagttaagccagcccgattccattcctcaacacaccaagataaggcctaaggatgtgcccggaacactgcttaacatcgccttactgaatctggggtcctctgatccctcattacgtagcgctgcatacaatttgctgtgtgccctcacttgcacttttaatctgaagatcgagggacagctgctagaaacttcagggctctgtatcccggctaataatacgctgtttattgtctccatctccaaaacactagccgcaaacgaaccgcatctgaccctggaatttttggaggagtgtatcagtggcttcagcaagtcttctatagaacttaagcacctttgtctagagtacatgaccccatggctgtccaacctagtacgattctgcaagcataatgacgacgcaaaacgccaaagagttacggccattcttgacaagctgataacaatgaccatcaacgaaaaacaaatgtacccctctatccaggccaaaatttggggctctctgggacaaatcacggacctcctcgatgtggtgcttgactcattcatcaaaacaagtgcgacgggaggccttggaagcattaaagccgaagtaatggcagataccgccgtcgcattagcctcaggaaacgttaagctggtaagctccaaagtgatcggacgaatgtgcaaaattattgataagacttgtttgagcccaacaccgaccctcgagcaacacttaatgtgggacgacatcgccatactggccaggtatatgcttatgttgtcattcaacaatagtctggacgtggctgcgcatttgccttacctttttcatgtggttactttcttggtagctacagggccactttctctgagagccagcacccacggcctggtgatcaatataatccactcactctgtacatgctcccagttgcatttctctgaggaaaccaagcaggtactgcgcctttctctaaccgaattctcactgcctaagttttacctactcttcggcatatccaaggtgaaatccgcggcagtaatcgcctttcggtcttcgtatagagataggagtttttcaccaggcagctacgagagggaaaccttcgccctaacatcacttgaaacagtgactgaagctctgcttgagatcatggaagcttgtatgcgggatattcccacttgtaagtggctcgaccagtggacggagctggcccagcgcttcgcatttcagtacaatcccagtcttcagccgcgagcccttgtggtcttcggttgtatctccaagagggtgagccacggccaaatcaaacagattatccgaattctgtccaaggcgctggaatcctgtctgaagggacccgacacctataatagccaagtgctgatcgaggcaactgtaatcgctcttactaagctacagcctctgctcaataaagactcccccctgcacaaagcgctcttctgggtggccgtggctgttctgcaactagacgaggtcaatctgtacagcgcgggtacagccctgctagagcaaaaccttcatacattagactcactgagaattttcaatgataagagtcctgaggaggtatttatggctattcggaatccactggaatggcattgcaaacagatggaccattttgtaggccttaatttcaactccaattttaatttcgcactggtgggccatctattgaagggttatcgccacccgagtcccgctatcgtcgccaggaccgtacgcattctgcacacgctcctcacgctggtcaacaagcataggaactgtgacaagtttgaagtgaatacccagtcagtagcatacttggccgctctgcttaccgtcagtgaggaggtgcggtcccgatgctctctgaagcataggaagagtctcctcctcacagatatctcaatggaaaacgtaccaatggatacataccccatccaccacggagatcccagttacagaacgcttaaggagactcaaccatggtcaagccccaagggctctgaaggctacttagccgcaacctatcccacagtgggtcaaacatcccctagggcgcgtaagagcatgtcccttgatatggggcaacccagccaggcgaatactaaaaaactcttgggcacccgtaaatccttcgaccacctcatcagtgacaccaaggccccaaaaaggcaggagatggagtctggtattactacccccccaaaaatgcggagggttgccgagaccgactacgaaatggaaactcagagaatctccagtagtcagcagcatccacacttgaggaaagttagcgttagcgaatccaatgtcctgctggacgaagaagtgctaaccgacccaaagatccaagccctcctcctgacggtcctggctactctggtaaagtatacgaccgacgagtttgatcagcgcatcctctacgagtatctggctgaggcatccgttgttttccccaaggtatttccagtggtgcacaacttactggatagtaaaatcaatactctcctttccctttgtcaggatcccaacctgctgaaccctattcacgggatagtccagtccgtagtttatcatgaggaatctccgcctcagtatcagactagctatcttcagtcctttggttttaacggactgtggcgattcgctggacccttcagtaagcagacccagattccggattacgctgagctgatcgttaagtttctggatgcgttaatagacacttacctgcccggaatcgatgaggaaaccagcgaggaatcccttcttacacccacatcaccctaccctcccgcactgcagtcacagctgtctattaccgccaatctcaatttgagcaatagtatgacatcccttgctacctcccaacacagtcccgctagtctcccctgtagtaagtcggccgtcttcatgcagttgtttccacatcagggcatcgacaaagagaatgtagagctctccccgacaacaggccattgcaattccgggcgaacccgccatggtagcgcatcccaagttcagaagcagcgatcagctggaagctttaagcgcaactctatcaagaaaatcgtgta

SEQ ID NO: 29754 - DNA, 1524 bp, Artificial Sequence
  Description of Artificial Sequence: Synthetic coding sequence
atggcaggtgcaatcgcgagcagaatgtctttttccagcctgaaacgcaaacagcccaaaaccttcacagtgcggatagtgacgatggacgccgagatggagtttaattgcgaggtcaaaaaacagatcctcgatgaaaagatttattgcccccctgaggcaagcgtgttgctagcatcatacgcagtccaagcaaaatatggggattatgaccctagcgtgcacaagcgcggatttctggctcaggaagaacttctccctaagcgagtgatcaacctgtatcaaatgactcctgagatgtgggaagagagaatcacggcttggtacgctgaacaccgtgggagggcgagggacgaggcagaaatggagtacctgaagatcgcccaggacctagagatgtacggcgtcaactacttcgccattcgcaacaaaaagggcaccgaactgttacttggagtggatgccctggggttgcacatatatgaccctgagaatagactcacacctaagatttctttcccctggaacgaaatccgtaatattagctactctgacaaggaatttaccatcaagccgctggataaaaaaatcgacgtcttcaagtttaattcatccaagctacgcgtgaataaactcattctgcaactgtgtatagggaaccacgatctgtttatgcgccgacgcaaagccgactccttagaggtgcagcagatgaaggcccaggcaagggaggagaaggctcgcaaacagatggaaaggcagcggcttgcgagagaaaaacagatgcgcgaggaagcggagcggaccagagatgaactggaaagaagactcctacagatgaaagaggaggcgaccatggcgaatgaggccttaatgaggtcagaggaaacagctgacctgctggcagaaaaggctcagataaccgaagaggaagcaaagttactggcccagaaggctgccgaagccgagcaggaaatgcagaggattaaggcaactgcaatacggaccgaggaggagaagaggctgatggagcagaaggtgctagaggctgaggtgttggcccttaagatggcagaggagagtgaaaggcgggctaaagaggctgatcagcttaaacaggacttgcaggaggctcgcgaggctgaaaggcgcgctaagcagaagctcttggaaatcgccacaaaaccgacatacccaccgatgaacccaatccctgcaccgttacctccagacatcccctcatttaacctgatcggcgactcgttgtcatttgacttcaaagacaccgacatgaagagacttagcatggagatcgaaaaggaaaaggtggaatatatggagaagtctaagcacctccaggaacagttgaacgagctcaagacagagattgaagcgctgaaactcaaggagcgggaaaccgccctggacattctgcacaatgaaaatagtgaccgcggtggaagttccaagcacaatactattaagaaaccacaagcgcaagggcgtcggcctatctgtatttag

SEQ ID NO: 29755 - DNA, 1788 bp, Artificial Sequence
  Description of Artificial Sequence: Synthetic coding sequence
atggccggagccattgcttcacgaatgtctttctcatctctgaagagaaagcagccaaaaacattcactgtcaggatcgttacaatggacgccgagatggaatttaactgcgagatgaagtggaagggcaaggacctgtttgatctggtgtgtcgcactctaggcttgcgcgaaacctggttcttcggtctccaatacaccatcaaagacacagtggcttggttaaagatggacaagaaagtactggatcacgacgtttcaaaagaggaacctgttacatttcacttcctggcaaagttctacccagaaaacgcagaagaagagctcgtccaagaaataacacagcatttgttttttttgcaagtgaaaaagcaaatcctagatgaaaagatctactgccccccagaggcgtcggtactcctggcttcatacgctgtccaggctaaatacggagactatgacccatctgtccataagcgagggttcctcgctcaggaagaactgttacctaagcgggttatcaacctatatcagatgacacccgaaatgtgggaagaacgaatcaccgcttggtatgccgaacaccgtgggagagcaagagacgaagctgagatggagtatctgaagattgcccaagacctggaaatgtacggagtgaactattttgccattcgtaacaagaaggggaccgagctgctactgggagtagatgcactgggcctccacatctacgatcccgagaaccgccttacgcctaagattagttttccttggaatgagataaggaacatttcttactccgacaaggaattcaccattaagcctttggataagaaaatcgatgtgttcaaattcaatagctccaaacttcgcgtgaacaaactgatcctccagctgtgtatcggcaatcacgatctgtttatgcggcgaaggaaagctgattcactggaggtgcagcaaatgaaggctcaggctcgggaagaaaaggccaggaaacagatggagcgccagcggcttgcgagagagaaacagatgcgcgaagaggcggagagaacccgtgatgaattggaacgcagactgctccagatgaaggaagaggccaccatggccaacgaagctctcatgaggtctgaagaaacggcggatttactggctgagaaagctcagatcacagaggaggaagctaagctgctggcgcaaaaagccgcagaagccgaacaggagatgcagcggattaaagcaaccgccataagaacagaagaagagaagcgccttatggagcagaaggtgcttgaagccgaggtgttggcactgaagatggccgaggagtccgagcgtcgggcaaaagaagcagaccagctgaaacaggatttacaggaagcaagagaggcagaaagacgggcaaaacaaaagctgttagagatagcaactaagccgacttaccccccaatgaaccctatcccagcacccctgccacccgacattccttcattcaaccttattggcgattccctttccttcgacttcaaagatacagacatgaagcgcctgagcatggaaatcgaaaaggaaaaggtcgagtacatggaaaaatccaagcatcttcaggaacagcttaatgagctaaaaacagaaattgaagcccttaagttgaaggagcgcgagactgctttagatatcctgcacaacgagaatagtgaccggggagggtccagtaaacacaacactataaagaaactgaccctccaaagcgcaaaatccagagtggccttttttgaagagctgtag

SEQ ID NO: 29756 - DNA, 663 bp, Artificial Sequence
  Description of Artificial Sequence: Synthetic coding sequence
atggcgggagccatcgcttctcggatgagcttcagctcactgaaacggaagcaacccaagacattcacagtgagaatcgtgaccatggacgccgagatggagtttaactgcgaagtgaaaaaacagatcctagatgaaaagatctactgtccacccgaagccagtgtgctgctggcatcttatgctgtccaggctaaaaataagaaaggaaccgagcttctccttggggtggatgctctaggtctgcatatttacgaccctgagaacagactgacacccaaaatctcattcccatggaatgagatccggaacattagctattctgataaggagttcacaatcaagccactggataagaagatcgacgtcttcaaattcaattcgagcaaactcagagtcaataaattaatcctacagttgtgcatcggaaaccacgatctgtttatgcgacgcagaaaggcggattcactggaggtccaacagatgaaagctcaggcgcgagaagagaaggcgcgtaaacagggacagcggggacggtcggctgaggccggacctgccggttcaacccggggaggtgcgaagtcccaggctgaagcccctggcgattgccaccaggcccatgtgccggcacacgagcccaacagctcaacggtggcctcatag

SEQ ID NO: 29757 - DNA, 1524 bp, Artificial Sequence
  Description of Artificial Sequence: Synthetic coding sequence
atggctggagccatagccagccggatgagcttctctagcttaaaacgaaagcaacctaaaacattcactgtaaggatagttacaatggatgccgagatggaattcaattgcgaggtgaagaagcagattctcgatgaaaaaatatattgtccgccagaagcatccgtgctcctggcaagctacgccgtgcaggcaaagtacggggactatgatccaagtgttcacaaaaggggttttttggctcaggaagagttactcccgaagcgtgtgataaacttgtaccagatgacgcctgagatgtgggaggagagaattacggcctggtacgcagagcatagaggaagggcacgggatgaggccgaaatggagtatctcaagatagctcaagaccttgagatgtatggagtgaattacttcgccatcaggaacaaaaagggcacagagctcttgctgggcgtggacgcactaggattgcacatctacgatcctgagaaccgcctgacgcccaagatatctttcccatggaacgagattcggaatatctcatattcagataaggaattcactatcaaacccctggataaaaaaatcgacgtgtttaagtttaacagttccaaactccgtgtgaacaaactgattctgcagctgtgcattggcaatcacgatctcttcatgagaagacgcaaagccgactctctggaggtccaacagatgaaggcccaagctcgagaagagaaagcgcgtaagcaaatggaaagacagcggctggctcgggaaaagcaaatgagagaggaggccgagcgaacccgcgacgagctggagaggaggctgctgcagatgaaagaggaggctaccatggccaacgaggcactaatgcgctctgaggagactgccgatttgctggcagagaaagctcagattaccgaagaagaggctaaacttctggcccaaaaagctgccgaggcagagcaggagatgcagagaattaaagctacggcgatacggactgaagaagaaaagcgccttatggagcagaaggtgctcgaagctgaggtcctcgcgttaaagatggctgaggagagcgagcgcagagcaaaggaagccgatcagctcaaacaagacctgcaggaagcaagagaagcagaacggagagcgaaacaaaaattgctggagatcgcaaccaaaccaacgtatcctccgatgaacccaatacccgcaccactgccgccagacatcccatccttcaacctcatcggtgacagcctgtctttcgacttcaaagacacagacatgaaacgcctcagcatggagatcgagaaagaaaaggtggagtacatggagaagtccaaacacctacaggagcagctgaatgagttaaagactgagattgaagccctcaaactaaaagaacgagagactgcactggatatcttgcataacgagaattcagatagaggcggttcgtcaaaacacaatacgatcaagaaaccacaggcccaggggaggagacccatctgtatttag

SEQ ID NO: 29758 - DNA, 1773 bp, Artificial Sequence
  Description of Artificial Sequence: Synthetic coding sequence
atggccggagccatcgcctctaggatgtcctttagttccctaaaacgaaagcagcccaaaacattcaccgtgaggattgtgactatggatgcagagatggaattcaactgcgagatgaagtggaaaggcaaggatctcttcgacctggtgtgtcgaaccctgggcctgcgggagacatggttcttcgggttacaatacacgattaaagacaccgtcgcttggctgaagatggataagaaggttcttgatcatgatgtgtcaaaggaggaacccgtgacattccattttctggccaagttctacccggagaatgccgaggaggaactcgtgcaggaaatcacccagcacttgttctttttgcaggttaagaagcagattctggacgagaagatttattgccctcctgaagccagtgtcctgctggccagttacgccgtccaggccaaatatggcgattacgacccctccgtgcataagcggggttttctggcacaggaagaactgctcccgaaaagggtaatcaatctctaccagatgacacccgagatgtgggaagaacggatcactgcctggtacgccgaacaccgaggcagagcacgggatgaggccgagatggagtatctgaagatcgctcaggatttagaaatgtacggtgtgaactactttgctatcagaaataagaaaggcactgaactcctgctgggagtagacgctctgggcctgcatatttatgatccagagaatagactgactcctaagatctcatttccctggaacgagatccggaacatttcctattcagataaggaattcactattaaaccattggacaagaagatcgatgtgtttaaattcaattcctcaaagctgcgggtaaacaagcttattctccagctgtgtatcggtaatcatgacctcttcatgcggagacgcaaggcagattcccttgaggtgcaacagatgaaggcccaggccagagaagagaaagcacgcaaacagatggagcggcaaagattggcacgcgaaaagcaaatgagggaagaggctgagaggacgcgggatgagttggagcgtagattactgcagatgaaggaggaagccacgatggccaatgaggccctaatgagatcggaggagaccgctgatttgctagctgagaaagcccagataacagaagaggaagccaagctcctggcgcagaaggctgctgaagcagagcaagaaatgcaaagaatcaaggccaccgccatcaggacagaggaggagaaaagactgatggaacagaaagttcttgaggcggaagtgctggctctgaaaatggcagaggaatctgaaaggcgcgcaaaagaggcagaccagctgaaacaggatctccaggaggccagggaggccgagcgtagggcaaagcaaaagctactggagatagcgaccaagccaacctaccctccaatgaatccgattccagcccctcttccccctgacattccctcctttaatctcattggcgactctctgagcttcgattttaaggacaccgatatgaaacgtctcagcatggaaatcgaaaaagagaaggtggagtatatggagaaaagcaaacatttgcaagaacagctgaatgaacttaagaccgagattgaagccctgaaattaaaggaacgcgaaaccgccctggatatcctgcataatgagaactccgatagaggtggttcctccaagcataataccattaagaaaccccaggcccaggggagaagacctatctgcatctag

SEQ ID NO: 29759 - DNA, 1650 bp, Artificial Sequence
  Description of Artificial Sequence: Synthetic coding sequence
atggccggagcaattgcatcgcgcatgtcgttctctagcctgaaaaggaaacagccaaagacattcaccgtccgaatcgtcactatggatgccgagatggaatttaactgtgaaatgaaatggaaagggaaagacctgtttgatctagtgtgcaggactctcgggttgagagagacatggttctttggactccagtacactataaaggatacggtggcttggctgaaaatggacaaaaaggttaaaaagcagatcctggacgagaagatttattgccccccagaagccagcgtcttgctggctagttacgccgtgcaggctaagtatggtgactatgacccaagtgtgcacaagcggggtttcctcgctcaggaggaactactgcctaagcgagtcatcaacctttatcaaatgaccccagagatgtgggaagagcgcatcactgcctggtatgcagaacatcgaggaagggccagagacgaagccgaaatggagtatctcaaaattgcgcaagacctggagatgtacggggtcaactactttgccatcaggaataagaaagggaccgaactgctgctaggcgtggacgcacttggattgcacatctatgatccagagaacagactgacaccgaaaatatccttcccatggaatgagatacgtaacattagctatagcgacaaagaattcacgattaaacccctggataagaaaattgatgtgtttaaattcaacagttcaaagttacgcgttaataaactgattcttcaactgtgcatcgggaaccatgacctgttcatgagaaggcgtaaggctgattcactggaggtgcagcagatgaaggctcaggctcgagaggaaaaagcccgtaagcaaatggaacggcaaaggctcgctcgggaaaagcaaatgagagaggaagccgaacggacacgtgatgagcttgaaagacgcctactgcaaatgaaagaggaggcgactatggctaatgaggcccttatgcggagtgaggagaccgctgacctgctggctgagaaggcacagatcacagaggaggaagccaagctgctggcccagaaggctgctgaagcagagcaagagatgcagcgcatcaaggccacagccattaggaccgaggaggaaaagaggctcatggaacaaaaggttctcgaagctgaggtgctggcactgaagatggctgaggagtcagagagacgcgcaaaggaggccgatcagctgaaacaggacttgcaggaggcacgcgaggcggagcgacgggctaagcaaaaactcctggagattgcgacaaagccaacctatcctccgatgaatcctatccccgctccgttgccacctgatatcccaagcttcaacctgattggtgactcgctgtcattcgatttcaaggacacggacatgaagcgattgtcaatggaaatcgagaaggaaaaagtggagtatatggaaaaatctaaacacttgcaggaacagctcaatgaactgaagaccgaaattgaggcactgaagttgaaagagcgggagactgcacttgatatcctgcataatgagaactcggacagggggggatcatcgaaacacaataccataaagaagcctcaggcccagggccgacgcccaatctgcatttag

SEQ ID NO: 29760 - DNA, 1647 bp, Artificial Sequence
  Description of Artificial Sequence: Synthetic coding sequence
atggccggagcgatcgcttcccggatgtcattttcatcattaaagcgcaaacagcccaagaccttcacagtccgaatcgtcacgatggacgctgaaatggaattcaactgcgaggtgctggatcacgatgtcagtaaggaggagccagtgacctttcactttctggctaagttctatcctgagaacgcagaagaggaactcgtgcaggaaataacacaacaccttttctttctccaggtgaagaagcaaattctagatgagaaaatttattgtccaccggaggccagcgtgctactggccagctacgcagtacaagctaagtacggcgactacgatccatcagtccataaacgtgggttcctggcccaagaggaactgttacccaagcgggtcattaatttgtatcagatgacccctgaaatgtgggaggagaggataaccgcgtggtacgctgagcacagaggcagggccagggacgaagcagaaatggagtacctgaaaatcgcccaagacctggagatgtatggcgttaattatttcgccatcagaaataagaagggcacggagctgcttctgggtgtggatgccttgggactgcatatctacgaccccgagaaccgccttacacctaagatcagcttcccatggaatgagataaggaatattagctactcggacaaggaatttaccatcaaacccctcgataaaaagattgacgtgttcaaatttaactcaagcaaactgcgcgtgaataagctgatcctccagctctgcataggaaaccatgatctgtttatgagacggaggaaggccgactccctcgaagtgcagcagatgaaggcccaggctcgggaggaaaaggcccgaaaacagatggaacggcaaaggctggctcgagagaaacagatgagagaagaggccgagcgcacccgggatgagctggaaaggaggctgcttcagatgaaagaggaagcaacgatggccaacgaagctctcatgagatccgaggagaccgcggacctgctggccgagaaggcccagatcaccgaagaagaagccaaactcctcgcgcagaaagctgccgaagctgagcaagagatgcagcgaatcaaagctaccgccatccgcactgaggaagaaaaacgattgatggagcagaaggtgttggaagccgaagtccttgcactaaagatggcggaagaatccgagcggagagcaaaggaagctgaccaacttaagcaagatctgcaggaagcaagggaagccgagagacgggctaaacagaagcttctggagatagccaccaaaccgacttacccacctatgaaccccatccccgcaccccttcctccagacatccctagctttaatctgatcggggactctctctcttttgatttcaaggacactgacatgaaaagactgtcaatggagattgaaaaggaaaaggtggaatatatggagaaatcaaagcatttgcaagagcagcttaacgaactgaagaccgaaattgaggcgttgaaactgaaggagcgtgaaactgcactggacattctgcacaatgaaaatagcgatcggggaggctccagcaagcataataccatcaagaagcctcaggcgcaaggacgccgacccatttgtatttag

SEQ ID NO: 29761 - DNA, 1773 bp, Artificial Sequence
  Description of Artificial Sequence: Synthetic coding sequence
atggcaggggcaatcgccagtcggatgtctttcagcagcctgaagaggaagcagcctaagacgttcaccgtccgtatcgtgacaatggacgccgaaatggagttcaattgtgaaatgaagtggaaggggaaagacctgtttgatctcgtatgtaggactctcggattgcgcgaaacctggttctttggtttacagtatactatcaaggacaccgtcgcttggctcaaaatggataagaaggttttggatcacgacgtgagtaaagaggagccagttaccttccattttctggcaaagttttatcccgagaatgcagaagaagaattggttcaggagattacacagcacctcttcttccttcaggtgaagaaacagatcctggacgaaaaaatttactgccctccggaggcatcggtgctgcttgcttcatacgctgtacaagccaagtatggggactatgacccttctgttcataagcgtgggtttctggcacaggaagagctgctgcctaagagggtcatcaacctctatcaaatgactcccgaaatgtgggaggagcgcatcacggcttggtatgccgagcacagaggtagggccagggacgaggcggaaatggagtacctcaaaattgcccaggacctggagatgtatggcgttaattatttcgcaatccgaaataagaaaggtaccgaacttctcttaggagttgatgccctgggcttgcacatatatgacccagagaataggctcaccccaaagatcagctttccttggaatgaaattcgcaatatatcttactccgataaggagttcaccatcaagcccctggacaaaaagatagatgtatttaaatttaacagcagcaagttgagggtgaacaagctaatcctgcagctctgcatcgggaaccacgatttgttcatgcgtcgacggaaagccgattcattagaggtacagcagatgaaagcccaagccagggaggaaaaagcaagaaagcagatggagagacaacggctcgctagagagaaacagatgcgtgaggaggcagaacgaactcgagacgagctcgaacgcaggttgctccagatgaaagaagaggccactatggcaaatgaggcattgatgcgcagtgaagaaaccgcggacctcctggctgaaaaggcccagatcacagaagaggaggcaaagctgctggcccagaaggccgctgaggccgagcaggaaatgcagcgcatcaaagccacagcgattcgaacagaggaggagaaaaggttaatggagcaaaaagtcctggaggccgaggtgctggcacttaaaatggctgaggagagcgaaaggcgcgctaaagaagccgatcagctcaagcaggacctgcaggaagccagagaggcggagcgaagagccaagcagaagctcctagagatcgccacaaagccgacatatccccctatgaatcccatcccagcccctctgccaccggatatcccatcattcaatctgataggggattcattgtcgtttgacttcaaggatacagacatgaagcgcttgtcgatggagatcgaaaaggagaaggtggaatacatggaaaagtccaaacatctccaggaacaactgaacgaattgaagacggaaatagaggcactcaagctgaaggagcgggaaactgccttagacattctgcacaatgagaactcagaccgaggcggaagtagcaaacacaataccattaagaaaccccaagcccagggaaggcgccctatttgtatttag

SEQ ID NO: 29762 - DNA, 1806 bp, Artificial Sequence
  Description of Artificial Sequence: Synthetic coding sequence
atggccggagctatcgctagtagaatgtctttttcctcactgaaacgaaagcaaccgaaaactttcaccgtacgaatagttaccatggatgcagagatggagtttaactgtgaaatgaaatggaaggggaaggatctttttgaccttgtgtgtcgtactcttgggttacgtgaaacctggttttttggactacagtatacaatcaaggatactgtagcatggctgaaaatggacaagaaagtgctggaccacgacgtcagcaaggaggaaccagtcacgtttcattttctcgcgaaattttatcccgagaacgcagaggaagaattggtgcaggagatcacgcaacatctgttcttcctgcaggtgaagaagcagatcctcgatgaaaagatttattgccctcctgaggcttcggtgcttcttgcatcttacgccgtgcaagccaagtatggggactatgatcccagtgtgcacaagcgcggatttttggcccaggaagaactactgccaaagagggtcataaacctgtaccagatgacgcccgagatgtgggaagaacgtatcacggcatggtacgcagagcatagaggaagggcgcgagacgaggcggaaatggagtacctaaagatcgctcaggacctggagatgtatggcgtgaattattttgccatcagaaataagaaaggcacggaactgttactcggcgtagacgcattggggctacatatctacgaccctgaaaacaggctgacaccgaaaatctcttttccatggaatgagatccgaaacataagctatagtgataaagaatttaccatcaagccgctagataaaaaaattgatgttttcaagttcaatagcagcaaactcagggtgaataaactgatcctccagttatgcatcgggaatcatgacctcttcatgagacgaagaaaggcggactcattggaggtgcaacagatgaaggcccaggccagggaggagaaagcacggaagcagatggaacgccagcgtcttgctcgggagaagcagatgcgagaggaggcagaacgcacccgcgatgaacttgagcggaggctgctgcagatgaaggaggaagccacaatggccaatgaagccctgatgagaagcgaagaggccgaacaggaaatgcagcgtatcaaggcaactgccatcaggactgaagaagagaaaaggttgatggaacagaaggtacttgaggcagaggtccttgctctgaagatggccgaagagagtgaaaggagggccaaggaggccgaccaacttaagcaggatcttcaggaagccagggaagccgagagacgggcaaagcaaaagctccttgaaatcgctaccaagccgacatacccacccatgaatccaattccagcccctctgccccctgacatcccatcattcaacctgatcggggacagcttgtcattcgattttaaagacaccgatatgaagcgactctctatggagatcgagaaggagaaggtcgaatacatggagaaatcgaagcacttgcaagaacagctgaatgagttgaagaccgaaatcgaagcgctaaagctcaaagagagggagactgcccttgacattcttcataatgaaaatagtgaccgtggcggtagctcgaaacacaacactataaagaaaggtatgtttctcttcttcttcattctgttctgctggttttctctgaaaccaaaggcagaggacctgtcagcgtttgagcctagcaactctccatgtcgggctccgtcccctgagtggccgtccctcaagtccagctctaggtag

SEQ ID NO: 29763 - DNA, 1686 bp, Artificial Sequence
  Description of Artificial Sequence: Synthetic coding sequence
atggccggtgccatcgcctcccggatgagtttcagctcattgaagcggaagcagcccaaaaccttcactgtgagaattgttaccatggacgcagagatggagttcaattgcgaaatgaaatggaagggcaaagacctttttgatttggtctgcaggactctgggccttcgagagacctggtttttcggtctgcagtataccataaaggatacagtggcctggctgaagatggacaagaaggtgctagaccatgacgtgagcaaggaggaaccagtgacctttcattttctcgcgaaattttacccggagaacgcagaggaggaactggtccaggaaattacgcaacatctcttctttctccaagtgaagaagcagatcttggacgagaaaatttattgccccccagaggctagcgttttgcttgcgtcctacgcggtccaagccaagtacggagattatgacccgagtgtacacaagcggggatttttggcgcaagaagaattgttgcccaagagggtgattaacctgtaccagatgacgcccgaaatgtgggaagagaggatcactgcatggtacgctgagcaccgcggtagggctcgggacgaggcagaaatggagtatctcaagatagcccaggacctggaaatgtatggagtgaactattttgctatcaggaataaaaaaggtactgaactgctgcttggggtcgatgccctcgggctgcacatttatgatccagagaataggctcactccaaagatctcatttccctggaacgaaattcggaatataagctactcagataaggagttcacgatcaaacctttagacaagaaaatagatgtcttcaaatttaacagctctaagttgagagtgaacaagttaatcctgcagctgtgtataggaaaccatgatctgtttatgagaaggcggaaagctgattctctcgaagtgcagcagatgaaagcccaggcacgcgaggagaaagccagaaagcaaatgaaagaagaagcaaccatggccaatgaggctcttatgcgcagtgaagagacagccgacctgctggcggaaaaagctcagatcactgaggaggaggccaaattgcttgcccagaaagcagctgaggccgaacaggagatgcaacgaataaaagccaccgccattcggacggaggaagagaaacgcctcatggaacagaaggtactggaggccgaggttctcgcactgaagatggctgaggagtccgaacgcagggcaaaggaggccgatcagttgaaacaggatctgcaggaggcgagagaagcagagcgtcgcgctaaacaaaagcttctggagattgccaccaagccgacatatccccctatgaatccgatccccgctccactgcctcccgacatcccatccttcaacctcatcggtgacagccttagctttgattttaaggacactgacatgaaacggctatctatggagatcgaaaaggagaaagtggaatacatggaaaaaagcaaacaccttcaggaacagcttaacgaactgaaaactgaaattgaggccctcaagttaaaggaacgcgaaactgccctggatatcttacataatgagaattccgaccggggaggatccagtaaacacaacactatcaagaagccacaggcccagggtagaaggcccatctgcatctag

SEQ ID NO: 29764 - DNA, 1773 bp, Artificial Sequence
  Description of Artificial Sequence: Synthetic coding sequence
atggctggcgctattgcctcccggatgtccttctcatctctcaaacgtaagcaaccaaagacatttacagtgaggatcgtcacgatggacgcagaaatggagtttaactgcgaaatgaaatggaaggggaaggatctgttcgacttggtgtgtagaaccctaggactaagagagacttggttttttggccttcagtacacaataaaagatacggtggcctggctgaagatggacaagaaggtcctggaccatgatgtgagcaaagaagagccagtgacttttcattttctggctaaattctaccccgaaaacgcagaagaggagttggttcaggagatcacacaacacttgtttttcctccaggtgaagaagcagattctcgatgagaaaatttactgtccaccagaggccagtgtcttgctggccagctacgccgtccaggccaaatacggcgactacgacccaagcgtgcataagcgaggattcctagcccaggaagaactattaccaaagcgagttataaatctgtaccaaatgactccagaaatgtgggaagagcggattaccgcctggtacgccgagcatcgcggtcgcgcaagggacgaagcagagatggaatacttgaagatagcacaggatttggaaatgtatggcgtaaattacttcgcaatcaggaacaagaaaggcactgagctgctcctgggcgtggatgctctcgggttgcacatctacgaccctgagaatagactgacccccaaaatttcgtttccatggaacgaaatccgcaacattagctatagcgataaagagtttactatcaaacccctagacaaaaagatcgacgtcttcaagttcaattctagcaagctcagggtcaacaaactcatcttacagctatgcatcggaaatcacgatctgttcatgcggagaaggaaggctgactccttggaggtgcagcagatgaaggcccaggctcgcgaggaaaaagctcgtaaacagatggagcgtcagaggttggcaagagaaaaacagatgagggaggaggcggagcgtacaagggacgagttagagcggcgtctattgcagatgaaagaggaggcgaccatggcaaacgaggcactgatgcgatccgaggagaccgctgatctgctggccgaaaaagcacagattacagaggaggaggctaagttgttggcccagaaagcagccgaggcagagcaagagatgcagcgcattaaggccactgctataaggactgaagaggagaaaaggttgatggagcagaaagtacttgaagccgaggtgctggccctcaaaatggctgaggaatcagagcggagagccaaggaggccgaccaacttaagcaagatctgcaggaagcccgtgaggctgagcggcgtgccaaacagaagctattggagatcgctaccaagcccacttacccaccaatgaatcctattcctgccccacttccgcctgatataccatcatttaacctaatcggcgactctctgagctttgacttcaaggataccgacatgaagcgcctctccatggagattgagaaggagaaggtggaatatatggagaagtcaaagcatctgcaggagcagctcaatgagttgaagactgaaattgaggccctgaagctgaaggagcgggagaccgccctggacatcctccataacgaaaactctgatcgaggcggatcctctaaacataacaccatcaagaagccacaggcccagggccgaaggcccatttgcatttag

SEQ ID NO: 29765 - DNA, 498 bp, Artificial Sequence
  Description of Artificial Sequence: Synthetic coding sequence
atggcaggcgctatcgccagccgcatgtctttctcatctctgaagaggaagcagccaaaaacattcaccgtgaggatcgtcactatggatgcggagatggagttcaactgtgaaatgaaatggaaagggaaggacctgttcgacctggtgtgtcgcacccttggtcttcgggaaacctggttctttggcctccagtatactatcaaagacacagtcgcatggcttaaaatggataaaaaggtcttagaccacgacgtatccaaggaggaaccagtgacttttcacttcctggccaagttttaccctgagaacgcggaagaggagctggtccaggaaatcactcagcacctttttttcttacaggtcaagaaacagatattggatgagaaaatttactgcccccctgaggcctcagtcctgttagcatcatatgccgtgcaagctaagttaaccctgcagtctgccaagtccagggtggcattcttcgaggaattatag

SEQ ID NO: 29766 - DNA, 663 bp, Artificial Sequence
  Description of Artificial Sequence: Synthetic coding sequence
atggcaggggctatcgccagtcgaatgtccttctccagcttgaaacgaaagcagcccaagaccttcaccgtgcgaattgtgacaatggacgccgagatggaatttaactgcgaagtgaagaagcagattcttgacgaaaagatttactgtcccccagaggcttccgtgcttttggccagttatgctgttcaagccaagaataaaaaaggaacagaactgcttctcggtgtggatgccctcggactccatatttacgaccccgagaatagactcacacccaagatctcattcccctggaatgaaatccgaaatatatcatattctgataaagagttcaccatcaagcctcttgataagaagattgacgtgttcaagttcaactcgagcaagttgagggtcaataagctaatcttgcaattgtgcatcggcaatcacgatctcttcatgaggaggaggaaagcagactctctggaagtacagcaaatgaaggcccaggctagggaggagaaggcacgcaaacaggggcagcggggacgcagcgccgaggccggacccgcaggatccacgaggggcggagccaagtcacaagcagaggctccgggtgattgccaccaggcccacgtgcctgcgcacgagccgaatagcagcacggtagcatcctag

SEQ ID NO: 29767 - DNA, 2772 bp, Artificial Sequence
  Description of Artificial Sequence: Synthetic coding sequence
atggagcgaggactgcccctactctgcgccgtgctcgctcttgtcctagcccctgccggagcctttcgcaatgacaaatgcggggacaccataaagattgagtctcccggatatttaaccagccctgggtacccacattcttaccacccaagcgaaaaatgtgaatggcttatccaggccccagatccatatcaacgcatcatgattaactttaatccacactttgacctagaagaccgggattgtaagtatgattatgtggaagtgttcgacggtgagaacgagaacggccatttcagagggaagttctgcgggaagattgccccacctcccgttgtgtcgtcgggcccattcttatttatcaagtttgttagtgattacgaaactcacggcgctggtttctcaattcgctacgaaatcttcaaacgcggaccagagtgttctcaaaattatacaacacctagcggtgtaatcaagagtcctggcttcccagagaagtatccaaactctctcgaatgcacatatatcgtgttcgtgccaaaaatgtctgaaatcatcttggaatttgagtcattcgatctggagcccgacagtaatccgcctgggggtatgttttgtaggtacgataggctagagatatgggacgggtttccggacgtcgggccacatatcggacgctattgcggtcagaaaacgccaggaaggatcaggtcatctagcggtattctgtccatggtattttatacagatagtgcaattgcgaaagaggggttctccgccaactactcggtgttgcagtcgagcgtctccgaagactttaagtgcatggaggctttagggatggaatccggagaaatccactctgatcagatcacagcctcatctcagtattccaccaattggtcagcagagcgcagtaggctaaattatcccgagaatggttggacgcccggtgaagactcatatagggaatggatccaagtggatctgggcctgctgcgattcgtaacagcagtcggcacccagggagctatttctaaagaaactaaaaagaagtattacgtgaagacctataagatcgacgtaagttctaacggggaggactggataacgattaaagaggggaataaacctgttttgttccaagggaacaccaacccgactgatgtggtagtcgcagtttttcctaaacccctgatcactagatttgtgcggatcaagcccgctacatgggagaccgggatctcaatgaggtttgaggtctatggctgcaagatcaccgattacccatgtagcggaatgcttggcatggtttccgggcttatttcagactcgcaaataacaagcagtaaccagggagacaggaactggatgcccgaaaatatccggttggtaaccagccggagcggatgggcactgccccctgcaccccactcctacattaatgagtggctgcagatcgatcttggcgaggaaaagatcgtaagaggtattataattcagggaggcaagcatcgagaaaataaggtgtttatgagaaagtttaagattggctactccaacaacgggagcgattggaagatgattatggacgactcaaagaggaaggccaaatccttcgagggcaacaacaactatgacacaccagaactgcggacttttccagccctgtctactcgattcattagaatatatcccgagagggccacccacgggggtctcggcctgcggatggaattgctcggatgtgaagtcgaagcacctactgctggcccaacaactcctaatgggaatcttgttgatgaatgtgatgacgatcaggccaattgtcattcgggcaccggcgatgatttccagctgaccggaggaacaaccgtccttgcaactgagaagcccaccgtgatcgactccactattcagagcgagttccccacctatggatttaactgcgaattcggatggggtagtcacaaaacattctgccactgggagcatgataatcatgttcaattgaaatggagcgtgcttaccagcaagacgggtcctatccaggaccatactggcgacggcaatttcatttattcacaagctgatgagaaccaaaaaggcaaagtggctagactcgtgtccccggtggtgtactctcagaatagtgctcattgcatgacattttggtatcacatgtctggtagtcacgtggggactctgagggtcaagctgagatatcagaagccagaggagtacgatcaattagtatggatggccattggccaccaaggcgaccattggaaggaaggaagagtgcttttgcataagtcactcaaactctaccaggtgatttttgagggtgagatcggcaagggaaacctggggggtattgctgtggatgatattagcatcaataaccacatttcacaggaagattgcgcaaaacctgcagaccttgacaaaaagaatccagagatcaaaatcgacgagacgggcagtacgcccggatacgagggagagggagagggggataaaaatatcagtcgcaagccaggaaacgtcctaaagactctcgatccaattctgattacgatcattgcaatgtcggccttgggcgtactcctcggggctgtctgcggtgtagtgctgtattgcgcctgttggcataatgggatgagcgaacgcaaccttagtgctctcgaaaactataacttcgagcttgtggacggtgtgaagctgaagaaggacaaacttaacacccagtccacctacagcgaagcctag

SEQ ID NO: 29768 - DNA, 420 bp, Artificial Sequence
  Description of Artificial Sequence: Synthetic coding sequence
atggatgatagcaagcgtaaagctaaaagtttcgaggggaataataattatgatacaccagaacttcgtacctttcctgctctgtctactagattcattaggatctaccctgaacgcgcaacgcacggcggtctggggctgcggatggagctgcttgggtgtgaagtcgaagccccaactgccggtccaacgactcctaatgggaatctggtcgatgaatgtgacgacgaccaagccaactgtcattctggcaccggtgatgattttcaacttaccgggggaaccacagtattagcgactgagaagcccacagtgatcgacagtacaatccagagtggttccagattttttaagcaccatcacaaacagcagagcatgaggccgcagaatttgcaccacaattcaatactactgctctag

SEQ ID NO: 29769 - DNA, 1926 bp, Artificial Sequence
  Description of Artificial Sequence: Synthetic coding sequence
atggaaagaggtctgccacttctgtgtgcagttctggcactggttctggctccagctggcgctttccggaacgacaaatgcggggatactatcaagattgaaagccctggctacctgacctctccaggatacccacactcataccatccatctgaaaagtgcgagtggttgattcaagcgccagacccctatcagcggatcatgataaatttcaatccacattttgatctagaggatagggactgtaagtatgactacgtggaagtttttgacggcgagaacgaaaacggccacttcagggggaaattttgtgggaaaatcgcccctccacccgtcgtgtccagcggcccttttttattcatcaagttcgtctctgactatgagacgcacggggctgggttctccattcgatacgaaatttttaagcgcggtccagaatgctctcagaattacacaacaccttccggcgttatcaaaagccctggtttcccagagaagtatcctaatagccttgagtgtacttatatagtgttcgtacccaagatgtcagaaatcatactggagttcgaatcatttgacctagagccagactcaaatcccccaggcggtatgttctgtcggtatgataggctggaaatatgggacggattcccagacgtgggacctcacatcggccgatattgtggacagaaaacccccggacgcataaggagctccagcggtatcctgagcatggtcttctacactgatagcgcgatcgccaaagaaggcttctctgcaaactactctgtactccagagctccgtaagtgaagatttcaagtgtatggaagccttgggtatggaaagcggggaaatccatagcgatcaaattacagcctccagtcagtatagcactaattggagtgctgaacggagcaggctgaattatccagaaaatggctggactcccggagaagatagttaccgcgagtggattcaggttgacctgggcctgttgagatttgtcacggccgtgggaactcagggcgctatatcgaaagaaacaaagaaaaaatattatgtaaagacctataagattgacgtctcgtctaacggcgaggattggattacgatcaaagagggtaataaacctgttctgttccagggtaacaccaaccctactgatgtcgtggtggcagtgttcccgaaacccctgattacaaggtttgtgagaatcaaaccggcaacctgggaaaccggcatttccatgcggtttgaagtttacgggtgcaaaatcacagactacccatgtagtggtatgctgggtatggtgtcagggttgatttctgacagtcaaatcacaagctctaaccagggggaccgaaactggatgcccgagaacatacgcctggtgacgagcagatctgggtgggcactccccccagccccacatagctatattaacgaatggctacagatcgacttaggggaggagaagatagttcgcggaatcattattcagggtggcaagcacagagagaataaggtattcatgcgcaagtttaaaattggatactctaataatggtagcgactggaagatgatcatggacgacagcaagcggaaagccaaatcttttgagggaaacaacaattacgacacacctgagctgagaaccttccccgcattgtctactagatttatccgtatctatcccgagagggccacgcacggtggcctgggtttgcggatggaattgcttggatgcgaagtggaaggcactattaatactgaccaagagtgcccatgcgcccgagctttggcaaaagacgctaagaaaaaaaagcgttgggctgattcaactcactgccgctgcgtgaggtcgattcatggcgagatgtggagtagtgggaagggcgtttgtagtctagatgccaacctttag

SEQ ID NO: 29770 - DNA, 567 bp, Artificial Sequence
  Description of Artificial Sequence: Synthetic coding sequence
atgtctgagatcatactggaattcgaatcttttgatctcgagccagactctaacccacccggagggatgttctgtcgatatgaccggcttgagatctgggacggctttccagatgtcggaccacacatcggacgctattgtggccagaagactcctggtaggatcaggtcatcgagtgggatcctatccatggtgttttacaccgatagcgccatagccaaagagggctttagcgcaaattactcagttcttcagagtagtgtgagtgaagactttaaatgtatggaggcactcggcatggaatccggagagattcatagcgatcagatcaccgcctccagtcagtattccaccaactggagcgctgagcgctcacgactcaactaccccgaaaatggttggacccctggtgaggattcttaccgggagtggattcaggacgcaaagtatcggctaagagtgtcagtggttcggagcaagtcctctagttcaagtacatcactggaaccccgacctctgagctctttaaagctcagctttttttcatataaaatcaaaattacctag

SEQ ID NO: 29771 - DNA, 1830 bp, Artificial Sequence
  Description of Artificial Sequence: Synthetic coding sequence
atggaaagggggttgccacttctgtgcgctgtgctggccctggtgctggcccctgcaggggcattccgaaatgataagtgcggtgatactatcaagatcgaaagcccaggctacttgacgtcgcccggatatccacactcctaccatccttccgagaaatgtgagtggctcattcaggcccctgacccctatcagagaatcatgatcaatttcaacccccatttcgacttggaggatcgggattgtaaatatgattatgtagaagtctttgatggcgagaacgaaaacgggcacttccggggaaagttctgcggaaagattgcgcctcccccagtggtttcaagcggcccttttctgttcatcaaattcgtgtcagactacgaaacacacggtgcagggtttagtatcagatacgagatctttaagcgaggaccagaatgttctcagaattataccacgccttctggcgttatcaaaagtcctggctttcctgaaaagtatcctaattccctcgagtgtacatacatcgttttcgtgccaaagatgtccgaaatcatccttgagtttgagtcattcgaccttgagcctgatagtaaccccccagggggaatgttctgtagatatgatcggttagagatctgggatggctttcccgacgtggggccacacatcggcagatactgcggacagaagactccgggtcggatcagaagctcctctggaatcctcagcatggtgttctataccgacagtgcaattgctaaggaaggcttctctgcgaattatagtgtgctccaaagttctgtctctgaagactttaaatgtatggaagccctgggtatggagtcgggggaaatccacagtgaccaaattacagcttccagtcagtattccacaaactggtcagcagagaggtcaaggttaaactatcccgaaaacggttggaccccaggcgaagactcttaccgcgaatggattcaagtggaccttggcttactgaggttcgtgacggcggtggggacacagggcgcaattagcaaagaaaccaagaaaaaatattacgtgaagacatacaaaatcgacgtgagcagtaacggcgaagattggattacgattaaagaaggcaataaacccgtgttgtttcagggcaataccaaccctaccgacgtagtggtggccgtttttccaaagcccctgattacacgtttcgtcaggataaaacccgctacgtgggaaacgggaatttccatgaggtttgaagtgtatgggtgtaagattacagactatccttgtagtggtatgcttggcatggtatcagggctgattagtgattcacagattacctccagcaatcagggagataggaactggatgccggagaacatcaggcttgttacttcccgcagcggctgggccctcccgccagcccctcactcctacattaatgaatggcttcaaatcgacctgggcgaagagaaaattgtgcggggaatcatcatacagggcggaaagcatcgggagaataaggtgtttatgcgaaagttcaagatcggctacagcaataatggcagcgattggaagatgattatggatgattctaagcgaaaggccaaatccttcgaggggaataacaattatgatactcccgagcttagaactttccccgcattgagcacacgcttcattcgcatttatcctgaaagagctacccatggtggtcttggcttgcgtatggaactgctcggatgcgaagtagagggcggaaccaccgtattagcaaccgagaagccaactgtaatagacagcaccatccagagtggtatcaagtag

SEQ ID NO: 29772 - DNA, 1935 bp, Artificial Sequence
  Description of Artificial Sequence: Synthetic coding sequence
atggaaagagggctacctttactgtgcgctgtacttgctttagttctcgctccagccggtgcgtttcgaaatgacaaatgcggggacaccatcaagatcgaaagtccaggatacctgacgtctcccggatatccccactcttaccacccctctgagaaatgtgaatggttgattcaggccccagacccttatcagcggatcatgatcaacttcaacccccactttgatttggaggaccgcgattgcaagtatgactacgtcgaggtctttgacggtgaaaatgagaacggacactttaggggaaaattttgcggaaagatcgccccaccaccagtcgtgtctagtggcccatttctgttcatcaagtttgtctccgattacgagacgcatggtgctggcttcagcatcagatatgagatcttcaagcggggtcccgagtgcagtcaaaattacactacacccagcggggtcattaagagccctggctttccagagaagtaccctaacagcttggagtgcacctatatagtgtttgtccccaaaatgtcagaaataatcctagagttcgaaagttttgacttagaacccgactcgaatccgccaggtggaatgttctgtcgctacgaccggctggaaatctgggatggattccccgacgtgggccctcacatcgggcgttattgcgggcagaaaactccaggtcgcatccgctctagcagtggcatcctgagtatggtcttctataccgactccgctatcgctaaggagggcttcagcgccaactactcagtcttgcagagcagcgtgtccgaggacttcaaatgtatggaggcccttgggatggagtcaggcgaaattcactcggatcaaattaccgcatcaagccaatacagtacgaattggagcgctgagcgatctcggttaaattacccagagaacggctggaccccaggagaagacagctacagagagtggatacaggtcgatttaggcctgttgcgatttgttaccgctgtcgggactcaaggagctatctcgaaggaaacgaagaaaaagtattatgtgaaaacttacaagattgatgtctcttccaacggggaggactggatcaccattaaagagggcaataagccagtgttattccagggcaatactaatcccacggatgtcgtggtcgctgtcttccctaaaccacttataacccgatttgtacgaattaaacctgcaacgtgggagaccggcataagcatgcgcttcgaggtatacgggtgtaagatcaccgactacccatgctctggcatgcttggtatggtgtctggactaatcagtgattcccagatcacatcctccaaccagggggaccgtaactggatgcccgaaaatatcaggctggtgacttcaagatccggatgggcactccccccagctccgcattcttatataaacgagtggttacagatcgatcttggggaggaaaagattgtgcgcggaattattatacaggggggaaagcatagagagaataaagtgttcatgcgcaagtttaaaatagggtatagtaataacggtagtgattggaaaatgatcatggatgactctaagaggaaggccaagagttttgaagggaataataactacgatactcctgagctgaggactttccccgctctttcaacccggtttattcggatttacccagagagagccacccacggtggcctgggactcaggatggagttattgggttgtgaagtggaagctcctacagccggtcccacaacacctaacggaaatctcgtggacgagtgtgacgatgaccaggccaactgccattccggcactggcgacgattttcagctgacaggcggaacaacagtcctggccactgaaaaacccactgtgatcgatagcactatccagtcaggtatcaagtag

SEQ ID NO: 29773 - DNA, 2115 bp, Artificial Sequence
  Description of Artificial Sequence: Synthetic coding sequence
atggagagaggactccctcttctgtgtgcagtattggctcttgtgctggcgcctgcaggagcctttagaaacgataagtgcggagacactataaaaatcgagtccccaggatatctgactagccctgggtatccacactcgtatcacccctcagaaaaatgcgagtggttgattcaagcccctgacccatatcagagaatcatgatcaacttcaacccacacttcgacctcgaggatagggactgtaagtacgactacgtcgaggtatttgatggagagaatgagaatggacatttccgtggaaagttctgcggcaagattgccccaccgcctgtcgtctccagcggccctttcttgtttatcaagtttgtttccgattatgagacacatggtgcgggattttcgatcaggtatgaaatcttcaagcggggaccagagtgtagccaaaattacactacaccctctggcgtgattaagtcccccggttttcctgaaaagtatcctaactccctggagtgtacgtatatcgtgtttgtgccaaagatgagcgagatcatacttgagtttgaatcttttgatctcgagcccgatagtaatcctccgggaggtatgttctgcaggtatgataggttggagatttgggatggcttcccagacgtgggaccacatattggtcgctattgcggacaaaagacccctggaaggattcggtcctcaagcggaattttgagcatggtgttttatactgatagcgcaatagccaaggaaggcttcagcgctaattatagcgttctccagtcctccgtcagcgaagactttaagtgcatggaagcactcggcatggaatccggagaaatacattccgaccaaataaccgcatctagccagtattcaaccaactggtcagcagagaggtcccggttgaactatcccgagaatggctggactcccggtgaggattcatatcgcgaatggattcaggtcgatctgggactcttgcgcttcgttaccgctgtagggacccaaggtgcaataagcaaagagacaaagaaaaaatactatgtgaaaacctacaagattgacgtgtcaagtaacggggaggactggattaccatcaaagaaggtaacaaacctgtactcttccaaggcaatacgaaccctaccgacgttgtcgtggctgtgttccccaaacctctgatcacgcggttcgtgaggattaagcccgctacctgggaaaccggcatctccatgcggttcgaagtctacggatgtaagataaccgactacccttgcagtgggatgttagggatggtttcagggttaatttccgactctcaaatcacgagctcgaatcaaggagatcgaaactggatgccagagaatatacggctggtcaccagtagaagcggatgggccttgccacctgcacctcattcttacattaacgagtggcttcagatcgacttgggtgaagaaaaaatagttcggggaatcattattcagggcggtaagcaccgggagaataaagtcttcatgaggaagtttaagattggctattcaaacaacggcagcgactggaagatgattatggacgattcaaagcggaaagcaaagagtttcgaaggcaataacaactacgatacacctgaactgagaacttttcccgcactgtctacaagattcattcgaatctaccccgagcgagctactcatggagggctgggattgcgaatggaacttttgggatgcgaggttgaggccccaacagccggacccaccacacccaatggcaatctagtggatgagtgcgatgacgaccaggctaattgtcattcggggactggcgatgactttcagctgaccggagccgagacaatctttatccccctactgtaccactttagttcttgcttgagctgggaccagctcactcctgtatgcgtgttagttacccctcatggacgggaactgcctagaaatcggtcctgcctcgcccgtacacgggcatcctccttccctcacgttatatggattgacgagttatttctgatagctacgaccatctgtaacaataacctgagccacttcgaatcccagcgattgggtttgtcttag

SEQ ID NO: 29774 - DNA, 261 bp, Artificial Sequence
  Description of Artificial Sequence: Synthetic coding sequence
atggagctgctggggtgtgaggttgaagcacctactgctggccctaccactccaaatgggaacttggtagacgaatgtgacgatgatcaggcaaattgtcactctggaacaggcgatgatttccagttaactggtgggacgaccgttcttgctacggaaaaacctacggtaatcgatagcaccatacagtcagcgaggcttgaagtatctactctgaatctaagcctccacaaccctcctcagcagaaggccctaatttag

SEQ ID NO: 29775 - DNA, 2772 bp, Artificial Sequence
  Description of Artificial Sequence: Synthetic coding sequence
atggaacgcggattgccacttctctgcgcagtcctggctctggtgttggcccctgctggggctttcagaaacgacaaatgtggggacacaattaaaatcgaatcccctggctacctcaccagcccgggataccctcactcctaccaccccagcgagaaatgcgagtggctgattcaggccccagacccttaccagaggatcatgattaatttcaacccccactttgatctggaggatcgcgattgcaagtacgactacgttgaagtttttgatggcgaaaacgaaaacggccacttcaggggcaagttctgtggcaagattgcacctccccctgtcgttagctcaggcccttttttgtttattaagttcgtctcagactacgagactcatggggctggttttagcattaggtacgagatcttcaaaagggggcctgagtgctctcagaactacaccacaccctccggagtcatcaaatccccaggttttcctgaaaagtatcccaattcgttagagtgtacatatatcgtgtttgtgccgaagatgagtgaaatcatcctggaattcgagtccttcgacctggagccagacagcaatcccccaggtggaatgttctgtcggtatgacagactggagatatgggacggattccccgacgttggaccgcatataggccgatactgtggccagaaaacaccgggtcggatccgatcttccagcggcattcttagtatggtgttctacaccgacagtgcgattgctaaagaggggttctctgctaactactccgtgcttcagagttccgtcagtgaggactttaagtgcatggaggccttaggaatggagagcggagagattcacagtgatcagatcaccgcttcgtcccagtacagcacaaattggagtgcggaaaggtctaggttaaattatccagagaacggatggacccccggagaagatagttatagggaatggatccaggtcgacctggggctgttgaggttcgtcacggctgtgggtactcagggggctatctcaaaggagacgaagaagaagtactatgttaaaacttataagatcgatgtctcctcaaatggtgaggattggatcacgattaaagagggcaataaaccagtgctttttcagggcaacacaaatccaaccgatgtcgtggtagccgtgttccctaagcccttgatcaccaggttcgtgcgcatcaaaccagcgacctgggagacaggcataagcatgcgatttgaagtgtacgggtgcaaaattaccgactacccctgttccgggatgctagggatggtgagcgggttgattagcgactcccagatcaccagcagtaaccagggtgatcgtaattggatgcctgaaaatataagattggtgacctccaggagcgggtgggcactgccacccgctccccattcgtacatcaacgaatggctacagattgacctgggcgaagaaaaaatcgtgcgcggaatcatcatccaggggggtaagcaccgggaaaataaggtattcatgcgcaaattcaaaatcgggtacagcaacaacgggagcgactggaagatgataatggatgacagcaagagaaaggccaagtcctttgaaggcaacaacaactatgatacccctgaattacggacattccctgctctatccacccgcttcattcgcatatacccagaaagggcgacacacggcggacttgggttgcgcatggaactgctcggatgtgaggtggaagctcctaccgctggcccaaccacaccgaatgggaacctggtcgacgaatgcgatgacgaccaagccaactgtcactccggcaccggcgacgactttcagttgaccgggggaaccacagtgctggctactgagaagccgaccgtgattgactccacaatacagagcgaattccccacgtatggttttaactgcgaatttggctggggcagccacaagacgttttgtcattgggaacatgacaaccatgtgcaacttaagtggtctgtgctcaccagcaagaccggcccaatccaggatcacaccggcgatggcaactttatatactcacaggccgacgaaaaccagaagggcaaagtggctagactggtgagccctgttgtgtactcacaaaatagcgcccactgcatgacattttggtatcacatgtccggtagtcacgtagggacactgagagtgaaactacgataccagaagcctgaggaatacgatcagctagtgtggatggcgattgggcaccagggggaccactggaaggagggcagggtgctgctgcataagtctctgaagctgtaccaagtgattttcgaaggtgaaataggcaaggggaaccttgggggaattgccgtggatgacatatcaattaacaaccatatatctcaggaagattgcgcaaaacctgctgacctcgataagaagaatcccgaaattaagatcgatgaaacagggtcaacccccggatatgagggggagggcgagggagataagaatatctctaggaagcccggtaacgttttgaagaccctggatccaattctgattaccattatcgccatgtcggcattgggggttctgctgggagctgtgtgcggggtggttctgtattgcgcctgctggcacaatgggatgtccgaacgaaacctttctgctctggagaattacaattttgaacttgttgacggtgtgaagctgaagaaagataaactgaatacccagagcacctacagcgaggcttag

SEQ ID NO: 29776 - DNA, 2208 bp, Artificial Sequence
  Description of Artificial Sequence: Synthetic coding sequence
atgtccgaaatcattctggaattcgaatcatttgatctggagcctgactctaaccccccaggcggaatgttctgtcgatacgatagattagaaatctgggatggatttcccgacgtcgggcctcacattggcagatactgtggtcaaaagacccctgggagaataagatcaagtagtggcattctgagcatggttttctacactgattccgccatagctaaggagggcttctcagcgaactatagcgtgcttcagtcgagcgttagcgaagactttaagtgcatggaggccctcggcatggaatcgggcgagatccatagtgaccaaatcactgccagttctcagtacagcaccaactggtccgccgagcgttctaggctgaactacccggagaacggctggactccgggagaggactcttatagagagtggatacaagttgacttgggactcctgcgctttgttactgctgtgggaacacagggcgctataagcaaagaaactaagaaaaaatattatgtgaagacgtacaagatcgacgtatcatccaacggggaggactggatcacaatcaaggagggcaacaagcccgtcctctttcagggaaatacaaatcctaccgacgtagtggttgcagttttccccaagccgcttattaccagatttgtgagaattaaacctgcaacttgggagactggtatcagcatgcgctttgaagtttatggatgcaagatcacagactatccttgcagcggcatgcttggaatggtctccggactgatctccgatagccagatcacctcctcaaatcagggcgaccggaattggatgcccgaaaatatacggctggtgacaagcagatctggatgggcattgcccccagctcctcattcatatattaacgagtggctgcagatcgatctcggggaggaaaagatcgtgagagggattatcattcagggcggaaaacatagagagaacaaggtgtttatgaggaagttcaagattgggtacagtaacaatggtagtgactggaagatgataatggatgattccaagagaaaagccaagtcattcgagggcaacaataattatgatacacccgaactgcgaacttttcccgctttatcaacccgcttcatccggatctatccggagagggccacgcacggtggtttagggctccgcatggagctgctcggctgtgaagtcgaagcacctacagccggacccacaactccgaacggtaacctagtggacgaatgcgacgatgatcaagccaactgccacagcgggaccggcggtacaactgtgctcgcaactgagaagccaactgtaatcgacagcactattcaatccgagttcccaacctacggtttcaattgtgagttcggatggggcagccacaaaaccttctgtcattgggaacacgacaaccacgtacagctgaaatggagcgtgctcacttcaaaaacagggcctattcaggatcacacaggtgacggaaatttcatttacagtcaggccgacgagaaccagaaggggaaggttgctaggctggtgagtccagtggtctattctcagaattctgctcactgcatgacgttctggtatcacatgagcggcagccacgtcggtaccctgagagtgaaacttaggtaccagaagccagaggagtatgatcagttggtgtggatggctataggtcatcagggcgatcattggaaggaaggtcgagttttgcttcataaaagtttaaagctctaccaggtgatctttgagggagaaattgggaagggaaatctcgggggtatcgctgtggatgatatctccattaacaaccatatatcccaggaggactgcgccaaaccagcggatcttgacaagaaaaaccccgagatcaagattgacgaaactgggagtacaccgggatatgagggagaaggcgaaggagataaaaatattagccgcaaacccggaaatgtgttaaaaaccttagaccccatcttaatcaccattatcgccatgtccgcattaggcgtgcttctgggtgccgtttgcggagtagttctatattgcgcatgttggcataacggcatgtccgaacgtaatctgtctgccttagagaattataactttgagctggtggacggagtgaagctgaagaaagataagctcaatactcagagtacgtacagcgaggcctag

SEQ ID NO: 29777 - DNA, 2721 bp, Artificial Sequence
  Description of Artificial Sequence: Synthetic coding sequence
atggagagaggtttaccgctgctgtgtgcggtcctggctctcgtgctggccccagcaggggcattccggaacgacaagtgcggggatacaattaaaattgagtcccctggttatctgactagtccaggctacccccactcttaccacccttcagagaagtgcgaatggcttattcaagctcccgacccataccaaagaattatgataaatttcaatccacactttgacctggaagatagagattgcaagtatgactatgtggaggtcttcgacggcgagaacgagaatggacacttcagaggcaagttctgtggtaagatcgctccacctcctgttgtcagcagcggccctttcctctttatcaagttcgtatccgactatgaaacccacggtgcgggattcagcatccggtacgaaattttcaagaggggacccgagtgcagccagaattatacaacaccgagcggtgtgataaaaagtccagggttcccggaaaagtatccgaacagtctggagtgcacctatatcgtcttcgtccccaaaatgtccgagatcatactcgagttcgaatcttttgacctcgagcccgattcgaacccgcctggcggaatgttctgtcgatatgatagattagaaatttgggatggtttccctgacgtgggaccgcatatcggcagatattgcggtcagaagacccctggtagaatacgctcctcctcgggaatcctgtcaatggttttctacactgatagcgccatcgctaaggaggggttttccgctaactactctgtcctgcagtcttctgtgtctgaggacttcaaatgcatggaagcgctcggaatggaaagcggcgaaatccatagtgatcaaattactgccagctctcaatactcaactaactggagcgccgagagaagccgactgaattatcccgagaatggatggactcctggagaagacagctatcgggagtggatacaagtggacctgggcctgctgagatttgtaaccgctgtaggaactcagggggctataagcaaagaaacaaaaaagaagtactacgtcaagacctacaagattgatgtctcttccaacggcgaagattggatcacaattaaggaagggaataagcccgtgctctttcagggcaacactaaccccactgacgttgttgtcgcagttttccccaaacctctgatcacccggttcgtcagaattaagccagctacctgggagacaggcatctcaatgagattcgaagtgtacggatgcaagattacagattacccttgctccggaatgttggggatggtaagcggacttataagtgattctcaaataacctctagcaatcagggagaccggaactggatgcccgagaacatccgtctggtgacttctcgcagcggatgggccttgcccccagctccccactcgtacatcaatgagtggttgcagatcgaccttggggaggagaagatcgtgaggggaataatcatacagggaggaaaacacagagagaacaaggtcttcatgcggaagtttaagattggctacagcaataatggctcggactggaagatgatcatggacgactcaaagcgcaaagccaaatcatttgaggggaataataattacgatacaccggagctccgcacatttccagcactcagcactcggtttatcagaatttacccggaaagggctacccacggagggctgggcctccgaatggaacttctgggctgtgaggtagaggcccctactgcagggccaaccacgcccaatggaaacctggtggacgaatgcgatgacgatcaggccaactgccacagtgggacaggagacgattttcagttgaccgggggaaccacagtactggccaccgaaaaacccacagtgatcgacagtacaattcagtctgagttcccaacttacgggttcaactgtgagtttggttggggcagtcacaaaactttctgtcactgggagcatgacaaccatgtacaattgaagtggagcgtcctgacatctaagacaggaccaattcaggatcacactggagacggcaattttatctatagtcaggccgacgagaatcagaaaggcaaggtagcacgcctggtgagtccagtggtctatagccagaattcagcccactgtatgactttttggtaccacatgagcggttcacacgtcgggaccctgcgcgttaaactgcgatatcagaaacccgaggagtacgaccaactagtgtggatggctattggacaccagggagatcattggaaggaaggcagggttctcctccataagtccctgaaattgtaccaggttatcttcgagggagaaattgggaagggaaatctgggtggcatcgccgttgacgatatctccatcaacaatcacatatctcaggaggattgcgcaaggagcaccccgggttacgagggagagggtgaaggggataaaaatatatccaggaaacctgggaacgtcctgaaaacacttgaccctatcctcattacgatcatcgctatgtcagcactcggagtcctgttgggagccgtctgcggtgtagtgctctattgtgcctgttggcataacggcatgtcagagagaaacctcagcgcacttgagaactacaatttcgagctggtggacggtgtgaagttgaagaaagataaactgaatactcagagtacctactcagaagcctag

SEQ ID NO: 29778 - DNA, 318 bp, Artificial Sequence
  Description of Artificial Sequence: Synthetic coding sequence
aaccacatttcccaggaagattgcgcaaggtctacgccaggctacgaaggcgagggtgaaggggataaaaacatctctcggaagcccggaaatgtgctgaaaactctggacccaattttgattactattatcgctatgagcgccctcggcgtgctgctgggggcagtttgtggagtggtcctgtactgcgcctgctggcataatggcatgagtgaacgaaacctgagtgccctcgagaactacaatttcgaattggtggatggcgtgaaactcaaaaaagacaaactcaatacccagagtacgtactccgaggcctag

SEQ ID NO: 29779 - DNA, 234 bp, Artificial Sequence
  Description of Artificial Sequence: Synthetic coding sequence
tagccaaccgctggtcctacgaccccaaacggcaacttggtagacgaatgcgacgatgaccaggccaattgccactccgggaccggcgatgacttccaattgaccggtggaaccaccgtgctagccaccgagaaaccaacagtaatagatagcactattcaatccgccagacttgaggtttcgactctgaacctgagtctccataacccaccccagcagaaagcgctcatctag

SEQ ID NO: 29780 - DNA, 303 bp, Artificial Sequence
  Description of Artificial Sequence: Synthetic coding sequence
tgaacgcacgggggattgggccttcgcatggagttgctaggctgcgaggtggaggcccctactgctgggccaaccacgcctaacggtaacctagttgatgagtgcgatgatgatcaagccaactgtcattcgggcaccggggatgatttccaacttaccgggggtaccacagtcttggctaccgagaagccgactgtcatcgactccacaattcagtccgggtcaaggttctttaagcatcaccataaacagcaatccatgcgaccacagaaccttcaccacaatagcatacttttgctgtag

SEQ ID NO: 29781 - DNA, 711 bp, Artificial Sequence
  Description of Artificial Sequence: Synthetic coding sequence
gtggacctcggtctactcaggtttgtgacagcggtgggcactcagggcgcaatcagcaaagaaacgaagaagaagtattacgtcaaaacgtataagattgacgtgtcatccaacggggaggactggatcacaatcaaggaggggaacaaaccagtgctcttccaggggaacactaaccccaccgacgtcgtggtcgccgtctttcctaagccattaatcacccggttcgtgaggatcaaaccggctacgtgggagactgggatcagcatgagattcgaagtctatgggtgtaaaatcaccgattacccctgttctgggatgctgggtatggtttcagggctcatatctgacagccaaatcacgtccagcaatcagggtgacaggaactggatgcccgagaatattcggcttgttacaagtcgctcaggatgggccctgcccccagctcctcactcttacattaatgagtggctgcaaatagacctgggcgaagaaaaaatcgttagaggaatcattatccagggaggcaagcatcgggagaataaggtatttatgagaaaattcaaaattgggtattccaataatggcagcgactggaaaatgataatggacgatagtaaaaggaaggccaaggtccgagccggagactgggaagaggtcatcccctatgtccttgacttcaaccaggggccattggcatttagtcgttag

SEQ ID NO: 29782 - DNA, 513 bp, Artificial Sequence
  Description of Artificial Sequence: Synthetic coding sequence
tagcctggtggcatgttctgtcggtatgacagattggaaatctgggacggctttcccgatgtgggacctcatatcgggcgatattgtggacagaagactcccggtagaattagaagctcatcaggtatcctttcaatggtgttttacaccgactctgccattgccaaagagggtttctccgctaactattcggtgctgcagtcctcggtatccgaagattttaaatgcatggaagcattagggatggagtcaggtgagatccatagcgatcagatcactgcaagctcccagtacagcacaaattggagcgccgagaggagccgcctgaattatcctgagaacggctggactcccggtgaggattcttatcgtgaatggatccaggatgctaagtaccgtctgagagtgagcgtggtgcgcagcaaaagttcttcatcctcaacatccctggaaccgagacccctttcctccctcaagctctctttctttagttacaagattaaaatcacttag

SEQ ID NO: 29783 - DNA, 2721 bp, Artificial Sequence
  Description of Artificial Sequence: Synthetic coding sequence
atggatatgttccctctcacttgggtattcttggcgctatacttctcccggcaccaggttaggggacagcctgaccctccttgcgggggacgtctgaactccaaagacgcgggatatataacatcgccaggctatccccaagactatccatcgcaccagaattgtgaatggattgtatacgcacctgaaccaaatcaaaaaatcgtgttgaatttcaatccccattttgagatcgaaaagcatgactgcaagtacgattttatcgagatccgggacggtgattctgaaagcgctgatctgctgggcaagcactgtggaaatattgctcctcccaccatcatctcttccgggtctatgctgtacatacggtttacctctgactacgctagacagggcgctgggttctctctgcgctacgagatctttaagaccggctctgaggattgcagcaagaattttacctctcccaacggcacaattgagtcgccaggctttcctgaaaaatatcctcataatctcgattgtacatttacaattctcgctaagcccaaaatggaaattatcctacagtttctcatcttcgatctggagcatgatcctttgcaagtgggcgagggcgactgtaagtatgactggctcgacatctgggacggtattccccacgttggaccactcatcggcaagtactgcggcacgaagaccccatccgaactgaggagcagtacaggcatcctctcactgactttccatacggatatggctgtggctaaagacggtttcagcgcccgttactacttggtccaccaggagccccttgagaattttcagtgcaatgtgccccttgggatggaatctggacgcatcgccaatgagcaaatttccgcaagttctacatattccgacgggaggtggactccccagcagtcaaggttacacggagatgacaatggctggaccccgaatctggatagcaataaggagtacctgcaggtggatctgaggttcttgacaatgttgactgcaattgcaacccagggcgctatcagccgtgagacccagaatgggtattacgtgaagtcatacaagcttgaagtctccacaaacggtgaggactggatggtgtacagacatgggaaaaaccacaaggtcttccaggcaaacaacgacgctactgaagtcgtcttaaataagctgcacgcccctctacttacccgattcgtgaggattagacctcaaacgtggcacagcgggatagcgttgcggctggagcttttcggatgtcgcgtgaccgatgccccatgtagtaatatgcttggcatgctgtccggactcatagccgattcccagattagcgcgagctctactcaagagtatctgtggtcccctagtgctgcccgactggtgagctcccggtccggctggttcccccgaattccccaagcccagccaggtgaagagtggctccaggtcgacctcggaacacccaagacagtcaaaggcgtgattatccagggcgcacggggaggggatagcatcacagctgtggaggccagggcattcgtccggaaattcaaggtctcttatagcctgaacggcaaagactgggagtatattcaggaccctagaacgcagcagccgaagctgtttgaggggaatatgcattacgacacacccgacatcagacgatttgaccctatacctgcgcaatacgttcgagtgtaccccgagagatggagtccagctggcatagggatgcggctggaagtgctggggtgcgattggaccgactccaaacccacagtagagacacttggccctacagtaaagtcagaagaaacaacgacaccataccccaccgaggaggaagccactgagtgcggagaaaactgttcttttgaggacgacaaagacttgcagctgccatctggatttaactgcaacttcgactttttggaggaaccatgcggttggatgtacgaccatgccaaatggttgcggaccacatgggctagttcttcatcacctaatgaccggacatttccggatgatcgcaattttctccgccttcagagcgattcgcaaagggaaggccagtacgccagattgatttctcctccagtacatttgcccagatctcccgtatgcatggagttccagtaccaggctaccggaggtcgtggcgtcgcactgcaggtggtaagagaagccagccaagagtctaagctgctctgggttattagagaagaccagggtggcgaatggaagcacgggcgtattattttgccgagctatgacatggagtaccagatcgtgtttgagggcgtgatcggaaaggggcgttccggagaaattgctatagacgacatccggatttcaacagatgtgcctttggagaattgtatggagcccatctccgcattcgccggtgaaaactttaagggtggtacgctgctgccgggtactgagccgacagttgacactgtaccaatgcagcccatacctgcttactggtactatgtgatggctgctggaggtgctgtcctggtgttagtgagtgtggcactggctctcgtactgcactaccataggtttaggtatgccgcaaagaagactgatcattccataacttacaagaccagtcattacacaaacggcgctccactggctgtcgagcctacactcaccatcaagctcgaacaagatagaggctcacattgctag

SEQ ID NO: 29784 - DNA, 300 bp, Artificial Sequence
  Description of Artificial Sequence: Synthetic coding sequence
atggatatgttcccattgacgtgggtcttcctcgcgctgtacttctcaaggcatcaagtaagaggacagcctgatcctccctgcggagggaggctaaactcaaaagacgcaggctacatcacaagcccagggtacccccaggattatccatctcatcagaactgcgaatggatcgtgtatgcgcctgaacccaaccagaagattgtgcttaattttaacccacattttgagatcgagaaacacgactgcaacctgctgagcgcctggaagatcagcctcacttcacgctccttcgcctag

SEQ ID NO: 29785 - DNA, 1668 bp, Artificial Sequence
  Description of Artificial Sequence: Synthetic coding sequence
atggacatgtttccgttaacgtgggtttttctggctctctacttctcgcgtcaccaggtacgaggacaaccagatccaccttgtggcggtcggctgaactcaaaagacgctgggtatattacgtcacccggttatccccaggactatcccagtcatcaaaactgtgaatggatcgtgtacgcccctgaaccaaatcagaaaatcgtgctgaatttcaatcctcactttgaaattgaaaaacacgactgtaaatatgacttcatcgagattcgagacggcgattccgagtccgctgatctcctgggaaagcactgtggcaatatcgctcctcccaccatcatcagtagcggcagcatgttgtacatccgctttacctccgactacgcacgtcagggagccggattttctctaaggtacgaaatcttcaaaactggcagcgaagattgctcgaaaaactttaccagccctaacgggactattgagtcacccggatttccagaaaaatacccccacaatctggactgcactttcaccattttggctaagcccaagatggagataatccttcaattcctcatcttcgatctggaacacgatccattacaagtcggcgaaggcgattgcaagtacgattggctggacatctgggatgggatcccacacgtggggcctctgattggaaagtactgcggaacgaagaccccgtcagaactgcggagtagtacagggatcctgagtctcacttttcacacagatatggccgtggctaaagacgggttctccgccagatattatttggtccaccaagaacccctagaaaacttccagtgtaatgtgcctcttggtatggagtctgggagaattgccaacgagcagatatcggcctctagtacttacagtgacggcaggtggactcctcaacagtctcggctgcatggagatgataacggttggactccaaatctcgatagtaacaaggagtacttacaggtcgatctacgctttttgactatgctcaccgccatcgctacacagggagctatcagcagggagacacaaaatggatactatgtgaagtcgtacaaactggaggttagcacgaacggcgaggattggatggtttaccggcatggcaagaatcacaaagtgtttcaagcaaataacgatgcaactgaagtggtactgaacaaactgcatgctcccttgttgacaaggtttgttagaattaggccccagacgtggcactcgggcatagcgctccggctcgagctcttcggctgtcgcgtcacggacgccccttgcagcaacatgcttggtatgctgagcgggctcatagccgattcacagataagcgcctcctccacgcaggagtacctgtggtctccttccgctgcacgcctggtgagctcaagaagtggctggtttcctcgcatacctcaagctcagccaggtgaagaatggctgcaagtggacctaggcacccctaaaaccgttaagggggtcatcattcagggcgcacggggaggggacagcattaccgctgttgaagctagagcctttgtccggaagtttaaggtgagctatagtttgaacggcaaggattgggaatacatccaggacccccgaactcaacagccaaaggtggggtgtagctggagaccattgtag

SEQ ID NO: 29786 - DNA, 2706 bp, Artificial Sequence
  Description of Artificial Sequence: Synthetic coding sequence
atggacatgttccccctgacctgggtgttccttgccctgtacttcagtaggcatcaggtgcggggacagcctgaccctccctgcggcggtcggcttaactccaaggacgctggctacatcacctctcctgggtacccccaggattatccctcgcaccagaactgcgagtggatcgtctacgctccggagcctaaccagaaaatcgtactcaacttcaacccacacttcgagattgaaaaacacgattgcaaatatgatttcatagagatccgggacggggactctgagagtgctgaccttttagggaagcattgcggcaacatcgccccacccactattatatcgagcggtagcatgctgtacattaggttcactagtgattatgcaagacagggggcaggttttagcctgaggtacgagatttttaaaaccggttctgaagactgttctaagaatttcacgagccctaatgggaccatcgagagccccggttttccagaaaaatatccacataatttggactgcacctttactatcctggccaaaccgaagatggagatcatcttacagttcctgatcttcgatctggagcacgatcctcttcaggtgggagaaggggactgcaaatacgactggttggatatctgggacgggatccctcatgtaggtccattgattgggaagtattgtggcacgaaaacaccttcagaactccgctcctcaaccggcattctatctttaacttttcacacagatatggctgtcgccaaagatggtttctcagccagatactacctcgtgcaccaggaacctctcgaaaatttccagtgcaacgtgccgctgggtatggagtctggacgcattgcaaacgaacagatctctgcttcgtcgacctattcagacggtaggtggacaccccagcagagcagattgcatggcgacgacaatggctggacgcctaatctggattctaataaggagtatttacaggtggatctgcgctttctgacaatgctgactgccattgccacccagggagccattagcagggagacacaaaatggctactatgtgaagagctacaaattagaagttagtaccaacggtgaagactggatggtgtacagacatggcaaaaatcacaaggtcttccaggccaataatgacgccactgaagtggtgctgaacaagctgcacgctccgttgttgaccagatttgtccggattaggccccagacctggcactccggtatcgcactccgcctcgagctattcggatgcagggtgactgatgccccatgttctaatatgttgggcatgctctccggcttgatagccgattcccaaatcagtgcgtcttcaacccaggagtacttatggagcccgtctgcagctaggctcgtgagctccaggtcaggatggttcccacggatcccacaggcgcaaccaggagaagaatggctgcaggtcgatttaggcactcctaaaacggtaaagggagtgattatccagggcgctcgagggggagactcaattactgctgtagaagccagagctttcgttaggaagtttaaagtctcctacagtttgaatggcaaagattgggaatacatacaggatccgaggacacagcagccaaagctgttcgaaggaaacatgcactacgacaccccggatatacgtcgtttcgacccaatccctgctcagtatgtccgtgtatatcctgaaaggtggtcccccgctgggatcggaatgagactggaggtcctggggtgtgattggactgactcaaagcccaccgtggaaaccttagggccaacagtaaaaagcgaagagacgaccactccttatcctaccgaagaggaggcaaccgagtgcggtgaaaactgctctttcgaggacgacaaagacctccagctgcctagcggttttaactgcaactttgatttcctcgaagagccttgtggatggatgtacgaccacgctaaatggctgcggacaacttgggcaagctctagcagccctaacgaccggacgttcccggatgatcgcaacttcttgcgactgcaaagcgactctcagagggagggccagtatgctagactgattagccctcccgtgcacctgcccaggagccctgtctgtatggagttccagtatcaggccacaggcggtcgaggggtggccctccaggttgtgagggaagccagccaagaaagcaagttgctttgggtgattcgcgaggaccagggcggtgaatggaaacacgggagaattattctgccgagctacgacatggagtaccagattgtgttcgaaggcgtcatcggcaagggccgtagcggagaaattgccatcgacgatataagaatatccacagatgtgcccctggagaactgcatggagcctattagtgcctttgccggaggcactctgctgcctggcacagagcccaccgtggataccgtgccgatgcagccaattccagcctattggtattacgtgatggcagccggaggagccgtgctggtgttggtgagcgtggccctggccctcgtcctgcattatcaccgctttcggtacgctgcgaaaaagactgatcacagcatcacctacaaaacgagccactacacaaacggcgctcctctcgcggtagagcctaccctgactattaagctggagcaggatcgaggctcccattgctag

SEQ ID NO: 29787 - DNA, 2781 bp, Artificial Sequence
  Description of Artificial Sequence: Synthetic coding sequence
atggacatgttcccgctaacctgggtgtttctcgcgttgtatttctctcgccaccaggtcagaggacaacccgaccccccttgtggcggaaggctgaactcaaaggacgctggatacatcaccagcccaggctaccctcaggactacccatcgcaccaaaactgtgaatggatcgtctatgccccagaacccaaccagaagattgttcttaactttaatcctcactttgaaatcgagaaacacgactgtaagtatgacttcattgagatccgcgatggcgattcagaaagcgcggatctcttgggtaagcactgcggcaatattgcaccccctacaatcatctccagcggcagtatgctgtatatccgtttcacatctgactacgccaggcagggcgctgggttctccttgagatatgagatatttaaaacaggcagcgaggactgttctaaaaatttcacctcacccaacgggaccattgaaagtccgggttttcccgagaaatacccgcacaacctcgattgtaccttcaccattctagccaagcctaaaatggaaataattctccaattcttgatttttgacctggaacatgatcctctgcaggtgggcgagggcgactgtaagtatgattggctggacatatgggatgggatacctcatgtaggaccgctaattgggaagtattgtggcacgaaaacaccctctgagctacgaagttctaccggaattctgagcctgacttttcatactgacatggcggtggctaaagatggattcagtgctagatactatctcgtccatcaggagcctttggagaattttcagtgcaatgtcccgctcggtatggagtcaggaagaatagccaacgaacagatctccgcatcatctacctattcagatggcaggtggactccacaacagagccgtttacacggagatgataacgggtggactcccaatctcgattctaataaggagtatttacaggtggacctgagatttctgaccatgctcactgccatcgccacgcagggcgctatctctcgggagactcagaatgggtattacgtgaaatcttataagctggaggtttccacgaacggggaagactggatggtctatcgccatgggaagaatcataaagtatttcaagccaacaatgacgcaacggaagtggtactgaacaaactgcacgcccctctactgacacgattcgttcggattcgtcctcagacctggcattcaggtatcgctcttcgactggagctcttcggatgccgcgtaacagatgcgccttgctccaatatgctcggcatgctgagcggcctcatagcagacagtcagatctccgccagctctactcaggaatacttgtggagccccagcgctgctaggctcgtgtccagtagaagtggctggtttccaagaattccccaggctcagccaggggaagagtggctgcaagttgatctgggcacccccaaaacggtgaagggagtgattatccagggggctcgcggaggcgactccataactgccgtagaggctcgcgcatttgtgagaaagttcaaggtgtcatattcactcaacggaaaagactgggagtacattcaggatccacgtacccagcaacccaagctcttcgagggcaacatgcactacgatacacccgacatacggcgattcgatccgattcctgcgcaatatgttcgcgtttatcccgagagatggtcacctgccggtattggcatgcggctggaagtgcttggatgcgattggacggattcaaagcctactgtcgagactctcggccctaccgttaaatcggaggaaacgacaacaccatatcccaccgaagaagaagccactgagtgtggtgaaaactgttcattcgaggatgataaagatcttcaattgccgtcagggtttaactgtaatttcgattttctagaggaaccttgtgggtggatgtacgaccacgccaaatggctccggacaacatgggcttccagcagtagccctaatgacaggactttccccgatgacagaaatttcctgaggctgcagagtgattcccaacgcgaggggcagtacgctcgccttatctcccctccggtgcacctcccacgcagcccagtgtgtatggaattccaatatcaagcaacagggggtcgcggtgtagccctgcaggtggtgcgcgaggcgtcacaagagtccaagctgctgtgggttattcgcgaagatcagggcggagagtggaagcatgggaggattatactgccgagttatgatatggaataccagatcgtgttcgagggagtgatcgggaaaggccgatccggagaaattgccatcgatgacataaggataagcaccgatgtcccactggagaactgcatggagcctatatcggcgttcgccgtggatatccccgagatacacgagcgggaaggatatgaagatgaaatcgatgatgagtacgaagtggattggtctaactcgagtagtgctaccagtggcagcggagcccctagcaccgacaaggaaaaatcctggctgtacacactggacccaatcctgattacaataatcgccatgagcagcttgggagtcctgttgggagccacatgcgccggattgctgctgtattgcacctgttcatactcaggtctgagcagtcgttcttgcacaacactggaaaactacaatttcgaattgtatgatggactaaagcacaaagtgaaaatgaatcaccagaagtgctgttccgaagcctag

SEQ ID NO: 29788 - DNA, 2796 bp, Artificial Sequence
  Description of Artificial Sequence: Synthetic coding sequence
atggacatgttccctctgacatgggtctttctggctctgtacttctcccgacaccaggtccggggacagccagatcctccttgtggtgggagactgaactcgaaggacgccggatatatcacctccccaggatacccgcaggattaccccagtcaccaaaactgtgaatggattgtgtacgcgccagaacctaatcagaaaattgtccttaattttaatccgcattttgagatcgagaagcatgattgcaagtatgatttcatcgagattagagacggcgatagtgagtccgccgacctgctaggcaaacattgcggaaatatcgcacctccaactattatctctagcggctctatgctatacataaggttcacctcagactatgctaggcaaggagctggattcagcctacggtacgagatcttcaagacagggtccgaagattgttcgaagaattttacatctcctaacggcacaatcgaatcccctgggttcccagagaagtaccctcacaatctggattgtacgttcacaattctcgcgaagcccaaaatggagattatcctacagttcttgattttcgacctggaacacgatcccctgcaggtgggtgaaggcgactgcaaatacgattggttagacatctgggacggcattcctcacgtaggtcccctgatcggaaagtactgtggaacaaaaacgccctccgagttacgctcttctaccggcatcctatcactcacctttcacacggacatggctgtggctaaagatggcttctctgccaggtactatcttgtccatcaggagcctctcgaaaactttcagtgcaatgtaccgcttggcatggagtccggccgtattgctaacgagcagatatctgcctcttccacctacagcgacggcaggtggacaccacagcagtcccgcctgcacggtgatgacaatggctggacacctaacctggatagcaataaagagtaccttcaagtggatctcaggttcctcacaatgcttaccgcaatcgctactcagggtgctatctcacgtgaaacccagaatgggtattatgtcaaatcatacaaacttgaagtgtccaccaatggagaagactggatggtatacagacatgggaaaaaccacaaggtgtttcaggccaacaatgacgcaactgaagtggttctgaataaactgcacgcacccctactgacaaggttcgtccggattagaccccagacttggcacagtggtatagcacttcgcctcgaattgttcggttgcagggtcaccgatgcaccttgctcaaacatgttgggaatgttgtcaggacttattgccgatagtcagatatccgcttctagcacccaggaatatctgtggtccccttctgccgcaagattggtgtcttcaaggtcaggctggtttccgaggattcctcaggcccaacctggggaagagtggctgcaggtcgatctgggaacccccaagactgtaaagggggtgattattcagggagctcggggaggggacagtattactgctgtagaggcgagggcttttgtccggaagttcaaggtcagttactctctaaacgggaaagattgggaatacattcaggatccccgaactcagcagccgaagctgtttgaaggaaatatgcactatgacacgcccgatattcggcgtttcgaccccattccggcacagtacgtgcgcgtttaccccgaaaggtggagtcctgcagggataggcatgcgacttgaggtgctcgggtgtgactggacagactccaagccaactgtggagacactcggtcctaccgttaagtccgaggaaacaacaaccccataccctactgaggaagaagccacagagtgcggagaaaattgttctttcgaggacgacaaagacctccagctgccatctggctttaattgcaatttcgactttttggaggagccttgcggttggatgtatgaccatgccaagtggctgcggaccacatgggcaagcagtagctcccccaacgaccggacctttcccgatgacaggaatttcctgcggttgcaaagcgactctcagagagaagggcaatacgccaggcttatctcccccccagtgcacctgcccagatcgccagtgtgcatggagtttcagtatcaggccacagggggtcggggagtggccctgcaggttgtgagggaggcgtctcaggagtccaagctgctttgggtaatccgagaagatcagggtggcgagtggaaacatggaagaattatcctccctagttatgatatggagtaccaaatagtgtttgaaggcgtgattgggaagggcaggtccggcgaaattgcaattgacgacatccgtatatccactgacgtgccgctcgagaactgcatggaaccaataagcgcctttgccggagagaactttaaggtggacattccggagatacacgaaagggagggatacgaagacgaaattgacgacgagtacgaagtcgattggagcaattctagttccgcaacgagcgggtcgggtgccccatccactgacaaagagaaatcttggctctacacgctggaccctatactgattacaattattgccatgagtagcctgggggtcttactcggtgccacttgcgccggactgctcctgtattgcacgtgtagctacagcgggctgtcgtctcgatcgtgtacaaccctggagaactataatttcgaactctatgacggactgaaacataaggttaagatgaatcaccagaaatgctgttcagaggcgtag

SEQ ID NO: 29789 - DNA, 2730 bp, Artificial Sequence
  Description of Artificial Sequence: Synthetic coding sequence
atggacatgtttcccctgacttgggtgtttctggccctgtacttcagcaggcatcaggtccgcggacagcctgatcccccttgcgggggaagattgaattcgaaagatgctggatacattacctcacccggatacccccaggattacccctctcaccagaactgcgagtggatcgtgtacgctcctgaacccaaccagaaaatcgtcctgaattttaacccacacttcgagattgagaagcatgactgcaagtatgatttcatcgaaataagggacggagacagtgagagtgctgatttactgggtaagcactgcggaaatatcgctcctccaactatcatcagcagcggatccatgctgtacattcggtttaccagtgactatgctagacagggggcaggtttcagtctgagatatgagatttttaagacagggagcgaggattgttctaagaactttacgtcccccaatggtacgatcgagtccccgggatttcccgagaaataccctcataatctggattgcacctttacaattcttgcaaaacccaagatggagattattctccagttcctgatcttcgacctggagcatgaccccctacaggtgggggagggagactgcaaatatgattggctcgacatttgggacgggattccacacgtcgggcctctgatcgggaagtactgtggtaccaaaacaccatccgaactgaggtccagcaccggcatcctgtccctaactttccacaccgacatggcagtcgcaaaggacggtttctccgcacgatactatttggtccaccaggagccactcgagaacttccagtgcaatgtgcccctggggatggaatctggacggatagccaatgaacagattagtgcttcctccacctactccgacggcagatggaccccacagcagtccagactgcatggagacgataacggatggacgcccaatttggacagtaacaaagagtatttacaggtggacctccgattcttgacgatgctgacggctatagcaacccagggtgccatcagccgggagacccaaaatggttactacgttaaatcctataaactggaggtgagtacaaacggggaggactggatggtctacaggcacgggaagaaccacaaggtcttccaagcgaacaacgatgctaccgaggtggttctgaacaaactgcacgcgccattattaactcggtttgtgcggatcaggccccagacctggcattcagggatcgccctcaggttggaactgttcggctgtagggtgaccgatgctccctgctcaaacatgctggggatgttatctggcctgattgcggattcgcagatcagcgcctctagtacccaagagtatctttggtctccctccgccgctcggctggtctcgtccaggtctggttggttccctaggataccccaggctcagccaggggaggagtggttgcaggtcgatcttggcacacctaaaaccgttaaaggggttattatccagggcgcacgtggaggtgatagcatcacagctgtggaagcaagggccttcgtacgcaaattcaaagtgagctacagtctaaacggaaaggactgggagtatatccaagatccacgcacacaacagcctaagcttttcgagggcaacatgcactatgacacccctgatatccgaagattcgatcctatccctgcacagtacgtccgggtgtaccctgagcggtggagccctgcaggcattggaatgcgcctcgaggtgctaggttgcgactggaccgactctaaaccaactgtggaaaccctgggtcccaccgtcaagtcagaggagaccacaaccccatatcctaccgaggaagaggccacagagtgtggtgagaattgttcatttgaggatgataaggatctgcaactcccaagcgggtttaactgtaactttgattttctcgaggagccctgcggctggatgtatgaccatgctaaatggttacgcaccacctgggcttccagctcctccccaaatgatagaactttcccggacgaccgtaacttcctccggctgcagtccgacagtcagagggaaggtcagtatgctcgcttgatctcaccaccagtccacctccctcgatctcctgtgtgtatggagtttcagtatcaggccactggaggacgtggagtggcactacaggttgtcagggaagcgtcacaggagagtaaactcctctgggttattagagaagaccaaggtggcgagtggaagcacggtaggatcatcctgccatcgtatgacatggagtaccagatcgtcttcgagggggtcattggaaaaggacggtctggggaaatcgccatagacgacatcaggatatccactgacgtacccctggaaaactgcatggagccaatctcagcatttgccgatgagtacgaggtcgactggtcaaatagttcttcggcgacatccggttcaggcgctccgtcaacagacaaggaaaagtcctggttgtacacacttgatccaatcctgatcacaattatagcaatgtcttccctgggcgtgctgctgggagccacttgcgcgggtctgctgctatattgcacctgttcatactctggcttaagttccaggtcctgtactaccctggagaattataactttgagctctacgatggcctgaagcacaaggtgaaaatgaatcatcagaaatgctgttccgaggcttag

SEQ ID NO: 29790 - DNA, 1668 bp, Artificial Sequence
  Description of Artificial Sequence: Synthetic coding sequence
atggacatgttccccctcacatgggtgtttctcgccctatatttctcacgccaccaagtgcggggacaacccgacccaccttgtgggggaaggttgaactccaaagatgcgggttatattacttccccgggatatccgcaggattacccaagccatcagaactgtgaatggatcgtgtatgctccagaacccaatcagaagattgtgcttaatttcaacccccactttgaaatcgagaaacatgactgcaagtatgactttatcgaaattcgcgacggagattcagaaagtgcggatctgctcgggaaacactgtggtaacatcgccccacctacaattatcagcagcggatccatgctgtatattaggttcacctccgactatgctaggcagggtgccggattctctttgcggtacgagatcttcaagaccggcagcgaagattgctcaaagaacttcacaagccccaacggtacaattgaatcacctggattccccgagaagtacccacacaatctcgactgtactttcacgatactggcgaagcctaaaatggagatcattctgcagtttctgatatttgaccttgaacacgaccctctccaggtcggagagggggattgtaagtacgattggctggacatttgggacggtattccacacgtggggcctctgataggaaaatactgtggcacgaaaacaccttccgaactgcgatcaagcactggcattctttccctaacgttccacacggatatggccgtcgcaaaagatggattcagcgccaggtactacctagtacaccaagaaccactggagaactttcagtgcaacgtgcccctcggaatggaaagcgggaggatagccaatgagcagatcagcgcttcctccacatacagcgatgggaggtggacaccccaacagagcagactgcacggggatgataatgggtggacgccaaacctggacagtaacaaggaatatttgcaggtggatttgaggttcttgaccatgttgacagccattgctactcagggcgcaatttcaagggagacgcagaatggctactacgttaagtcctataaactagaggtgtccaccaatggagaggactggatggtataccggcacggtaaaaaccacaaagtgtttcaggcaaataatgacgctacggaggtggtgctcaacaaactacacgccccactgttgaccagatttgtccgtatccggcctcagacctggcactccgggattgcgctgaggttagagctgttcggatgcagggtgactgatgctccgtgctccaacatgttaggtatgctgagcggtcttatagccgacagccaaatatccgccagctctactcaggaatatctctggtccccatccgctgccaggctggtttcatctagatcgggttggtttccccgtatcccacaggcacagccaggcgaggaatggctgcaggtggatttgggaaccccaaagaccgtgaagggggtgatcattcagggcgctagagggggagacagtatcactgcagttgaggcacgggctttcgtgagaaaattcaaggtcagttattctttgaacggcaaggactgggagtacatccaggatcccaggacccagcaacctaaagtgggctgctcttggaggcctctgtag

SEQ ID NO: 29791 - DNA, 309 bp, Artificial Sequence
  Description of Artificial Sequence: Synthetic coding sequence
atggatatgtttcccctgacttgggtgttcctggccctgtatttctcgcggcaccaggtgcggggtcagccagacccaccttgcggagggcgtctgaactccaaagacgccggttatattacatctccgggttatccccaggattacccgagccaccagaactgtgaatggattgtctatgcccctgagcccaaccagaagatcgtgctgaacttcaacccacactttgagatagagaaacacgactgcaagtacgattttatagagatccgagacggcgattctgagtcagccgacctccttgggtag

SEQ ID NO: 29792 - DNA, 2781 bp, Artificial Sequence
  Description of Artificial Sequence: Synthetic coding sequence
atggatatgtttccactgacctgggtgtttctggcgctttacttttccagacatcaggttcgtgggcagcccgatcccccatgtgggggtaggctcaatagcaaagatgctggatacatcacatcccccggttacccacaggattatcccagccatcagaactgtgagtggattgtttatgccccagaaccaaaccagaagatcgtacttaatttcaatccccatttcgagattgagaagcatgactgtaagtacgactttattgagatccgggacggcgattcagagagcgctgatttactcgggaagcattgcgggaatatcgctcccccaacaatcattagttctggatcgatgctgtacataaggttcactagcgattacgctcgacaaggcgcaggattctctctgagatacgagattttcaaaacagggtctgaggactgtagtaaaaacttcacatcaccgaatggtacgattgaaagtcctgggtttccggaaaaatatccacataacctcgattgtaccttcaccatactggccaagccaaagatggagattatcctgcagttcttgatcttcgaccttgaacatgacccactccaggtgggagaaggcgactgcaagtacgattggttggatatctgggatggcatccctcacgtcgggccattgatcggtaaatactgcggaaccaagacaccaagcgaactgagatcctccacagggatattgtcactgaccttccacaccgacatggctgtggctaaggatggcttcagtgcgcgatactacctggtgcaccaggagcccttagagaacttccagtgcaatgtgcccctcgggatggagagcggtcgtatcgcgaacgagcagattagtgccagctcaacatattccgacgggaggtggacgccacagcaatcacgactccacggggacgacaacggctggactcccaatctggatagcaacaaggaatatttgcaggtcgacctccgatttcttacaatgctcaccgcgatcgcgacacagggcgctattagtcgggagactcagaacggctattatgtgaaaagctacaagctcgaagtctctactaatggggaggattggatggtttataggcacggtaaaaaccataaagtgttccaggccaacaatgacgccaccgaagttgtacttaacaaactgcatgcaccgttattgactaggtttgtgcgaatccgacctcagacttggcactccggcattgcactgagactggagctttttgggtgccgtgttacagatgctccatgttccaatatgctcggcatgctctcaggattaatagccgattcccaaatatccgcatcctcaacacaagaatacctgtggtccccaagcgcagcgaggctagttagcagccggtccggctggtttcccaggatacctcaggcccagcctggagaggagtggctccaggttgacttgggaactcctaaaaccgtgaagggtgtcatcatccagggggctcggggaggcgattcaataaccgcggttgaagccagagccttcgtgcgcaaatttaaggtctcatatagcctgaatggaaaggactgggaatacattcaagacccacgcacccagcagcccaaattgtttgaagggaatatgcattacgatacacctgatattagacggttcgatccaattccagcccagtacgttcgtgtgtaccctgagcgatggagtcctgctggaataggcatgagactggaagtgctgggctgtgactggacagatagtaagccaacggtggagactcttggtcccaccgtcaagtcggaggaaacaactacaccttatccgacagaagaggaggccaccgagtgtggggagaactgctcctttgaggacgataaggatctgcagctacctagcggatttaactgtaatttcgatttcttggaggagccatgtggctggatgtacgatcatgccaagtggctgagaaccacttgggctagctcctcatccccaaacgataggacgtttccagatgatcgaaatttcctgaggcttcagtctgattctcaaagggagggccagtacgccaggcttatttcccctcccgtgcatttgcccagatcccctgtatgtatggaattccaatatcaggcaaccggcggtcgaggggttgccctgcaggtggtgcgggaggccagccaggagagtaagctcctctgggtgatcagagaagatcagggcggagagtggaaacacggaaggataatcctgccttcctacgatatggagtaccagatagtgtttgaaggagtcatcggcaagggacgctccggagagatcgcaattgatgacattcgcatcagcacagatgtaccgttggaaaactgcatggctacagtttctgcaagtattgtggacatcccagaaatccacgagcgggagggatacgaagacgaaattgatgacgaatacgaggtggattggtcaaatagctcatccgccacatctggttctggagctcccagcaccgacaaagagaagagctggctgtatacattagaccccatcctcatcaccattatagccatgtcctccctaggggttcttcttggggcaacttgcgccggtctccttttgtactgtacttgcagctatagcggtctgagctcccgatcttgcactacactggagaattataactttgaattgtacgatggcctgaaacacaaagtcaaaatgaaccaccagaaatgttgcagcgaggcctag

SEQ ID NO: 29793 - DNA, 2730 bp, Artificial Sequence
  Description of Artificial Sequence: Synthetic coding sequence
atggatatgtttccactgacctgggtgtttctggccctgtacttttctagacaccaagttcgtgggcaacccgatcctccctgtggcggtagattaaacagcaaggacgcgggatacatcacaagcccagggtatcctcaggactaccccagtcaccagaactgtgaatggatagtatatgccccagaaccaaatcagaaaattgtgctgaatttcaacccccattttgagatcgagaaacacgactgcaaatacgacttcatcgaaattcgcgacggcgactctgagagtgccgatcttctggggaagcactgtggcaatatcgcccctccaaccataatctcatcggggagcatgctttatatccggtttacttccgactacgcacggcagggagcaggatttagccttcgatatgagatctttaaaactgggagtgaggactgctctaagaacttcacaagccccaacggcaccatcgaatcgcccggtttccccgagaaatacccccataatctggactgtacattcactattttggctaagcccaagatggaaatcattctgcagtttcttatattcgatctcgaacacgaccctctgcaggttggcgagggtgactgcaaatacgattggctagatatttgggacggtatcccacatgtgggcccactgattggcaagtattgcggcaccaagacacctagtgaactgagatcctccaccggaatcctgagcctcacatttcacacagatatggcggtggctaaggatggttttagcgcccgttattacctggtccatcaggagcctctggaaaactttcagtgcaacgtgcccctggggatggagtccgggagaatcgccaacgagcaaatatctgcatcaagcacgtattctgatggccgatggacaccgcaacagagcagactccacggggatgacaacggctggactccaaatctagacagtaacaaagagtacctgcaggtggacctgaggtttctgacaatgctaacagcaatagctacacagggtgcaatttcacgcgagacccagaatggctactacgtaaagtcgtacaagctcgaggtgtccacaaacggcgaggattggatggtttacaggcacggaaaaaaccataaggtttttcaagcaaacaatgatgcaacagaagttgtgctgaacaagctccatgccccactcctcaccagattcgtcaggatccggccacagacatggcattccggaattgcgctccgcctggagttgttcgggtgtcgcgtgaccgacgctccgtgttcaaatatgctgggcatgttgtccggcctgatcgccgactcacaaatttctgcgtcctcaactcaggaatacctatggtcgcccagtgctgcaaggctggttagttccagatccgggtggtttcccagaatacctcaggcacagccgggagaggaatggctccaagttgatctgggcacacctaagacagtcaaaggagtgatcatccagggtgctagaggcggagactccatcactgctgtggaagctcgcgcttttgtccgcaaattcaaagtttcctatagtctgaacgggaaggactgggaatacattcaggaccccagaactcagcagcctaaacttttcgaaggcaacatgcattacgacacgcctgacatccgcaggtttgatcctatcccagcccaatacgtacgcgtgtatccggagcgttggtcccccgctggtattggtatgaggctggaggtgctgggctgtgactggacagactccaaacccaccgtggaaaccttaggaccgaccgtcaagagtgaagagactactacgccttaccccactgaggaggaggctacagaatgcggggagaactgttcctttgaagacgacaaggatttacagctgccttccggttttaactgcaacttcgatttccttgaggagccttgtggttggatgtacgatcacgccaagtggctgagaaccacatgggccagcagcagttcccctaatgaccgcacctttcctgatgaccgtaattttctcagactccaatcagactctcagcgcgagggtcagtacgccaggctgatctccccgccagtccatttgccgagatcacctgtatgtatggagttccagtaccaagcaacgggcggacggggtgtcgccttacaggttgtacgggaagcctcgcaagaatcgaaacttctctgggtcattcgggaagaccaaggcggtgagtggaagcacgggaggattattcttcccagttatgatatggaataccagatagttttcgaaggcgtgatcggcaaggggagaagcggggagatcgcaattgacgatattcgaatcagcaccgacgtcccccttgagaattgtatggggccaaaggcttgtatcgcggatgagtacgaagttgattggagcaactcttccagcgccacaagcggctctggggctcccagcactgataaggaaaagtcctggctctacaccctagatcctatcctcatcactatcatcgccatgagtagtctgggcgtgctcctgggcgcaacttgtgccggtctgctgctctactgcacttgttcctactctgggttatcctccaggagttgcactaccctcgaaaactacaatttcgagctgtacgacggcctcaaacacaaggtaaaaatgaaccaccagaagtgctgcagtgaggcctag

SEQ ID NO: 29794 - DNA, 462 bp, Artificial Sequence
  Description of Artificial Sequence: Synthetic coding sequence
atgaccaaaatcaaggctgatcctgacggcccagaggcccaggctgaggcatgctccggcgaacggacataccaggagttgttggtcaatcagaatccaattgctcagcctttggcttcacggaggttgactagaaagctgtataagtgtatcaaaaaggccgtgaaacagaaacagatacgacgtggcgtgaaggaagtacagaaattcgtgaacaagggagagaaaggaatcatggtgttggcgggagataccttgccaattgaggtgtactgtcaccttccagtaatgtgcgaggaccggaacttaccctatgtatacataccttctaaaactgatctcggggcagccgcaggttctaagcggccaacttgcgtcatcatggtgaagccgcacgaagagtatcaagaagcctacgatgagtgtctggaggaggtccagtcgctgcctctgccgctctag

SEQ ID NO: 29795 - DNA, 273 bp, Artificial Sequence
  Description of Artificial Sequence: Synthetic coding sequence
atgacaaaaattaaggctgaccccgacggaccagaagcccaggccgaagcttgttcaggagaacgcacataccaagagcttctcgtgaaccagaaccctatagcccaacctcttgcatcccgacgtttaacccggaagctatacaagtgtattaaaaaagcggtgaagcagaaacagatccgcagaggagtcaaggaagtccagaaattcgtgaataagggcgagaagggaacctgggtgcagccccaggctccttcagcgcctcccgtgtag

SEQ ID NO: 29796 - DNA, 2265 bp, Artificial Sequence
  Description of Artificial Sequence: Synthetic coding sequence
atgtggaaattgttaccggcagccggaccagccggaggggagccctaccgcctgcttaccggtgttgaatacgtggtgggtcggaaaaactgcgcaatcctaattgagaatgatcagtctatctcccgaaaccatgcagtacttaccgcgaatttttccgtgacgaatctgtcacagaccgatgagatccccgttttgactttgaaggataactcgaaatacggcacttttgtcaacgaggagaaaatgcaaaatggcttcagtcgcaccttgaagtctggcgacggaatcacttttggcgttttcggctccaaattccgaatcgagtacgaaccactggtcgcttgctctagctgtcttgacgtgtcaggaaaaacagcactcaatcaggccattctacagctagggggatttacagtgaataactggactgaggagtgcactcatttagtgatggtgtctgtgaaagttacaatcaaaactatctgcgccctaatctgtggcaggcctattgtgaaaccagagtacttcacagagttcctgaaggccgtggagtcaaagaagcaaccccctcagatcgaaagcttctatccaccacttgatgagccttcgatcgggtccaagaacgtagacttgtcgggtcgacaggagcgaaagcagatttttaagggaaagaccttcatatttttgaatgcgaagcagcataagaaactgtcatctgccgtggtgtttggtggaggtgaagcaagacttataactgaggagaacgaagaggaacacaattttttccttgcacccggtacatgtgtcgttgataccgggattacaaatagccaaacactcattcccgattgtcagaaaaagtggatccagagcattatggacatgcttcagaggcagggtctgagacctatacctgaggctgagatcggacttgccgtcatctttatgaccaccaaaaactactgtgaccctcaagggcacccatcaacagggctcaagacgacaactccaggtccaagcctgagccagggagtgtctgtggacgagaaacttatgccaagtgctccagtgaatacgacgacttacgtagccgacactgaaagcgaacaggccgacacctgggacctgagcgaacggcctaaggagattaaggttagtaaaatggaacagaaattccgcatgcttagtcaggacgccccaaccgtgaaagagagttgtaagacctcgtccaacaataatagtatggtttctaacacccttgccaaaatgcgtattcctaactatcagttgtcccctactaagttgcccagtataaataagagcaaagatcgagcttctcaacagcagcagaccaattctataaggaattactttcagcctagcacaaagaagcgggagcgggacgaagagaaccaggaaatgtcaagctgcaaatccgctagaattgaaacttcatgttctctcctcgagcagacccagccagcgacgccgtctctgtggaagaataaagaacagcatttgtcagagaatgaacctgttgacaccaacagtgacaataatctcttcactgatacggatctcaaatccatcgttaagaactcggcaagcaagtcccatgcagctgagaagctgaggtctaataagaagagagaaatggacgatgtggctatcgaggacgaggtgctcgagcagcttttcaaagatacaaaacctgaacttgagattgatgtgaaggtgcaaaagcaggaggaggacgtgaacgtgcgcaagcgccctaggatggatatcgagaccaacgacacattctcggacgaggctgtacccgagtcatctaagatctcccaagagaacgagatcggcaagaaaagagaactcaaagaagactccctgtggagcgccaaggaaatctcaaataacgacaaattgcaagatgattccgaaatgctgcccaagaaattacttctgaccgagtttcgatcactggtgataaaaaatagcacatctaggaatccttcaggcattaatgatgattacggtcagttaaaaaattttaagaagttcaaaaaggtcacttacccaggcgcagggaagctgcctcacatcatcggcggttccgacctgatcgcccaccatgccagaaaaaacactgagctagaggagtggttaagacaggaaatggaggttcaaaaccaacatgccaaagaggaaagcttagctgatgatctttttaggtataacccttacctcaaaagaaggcgatag

SEQ ID NO: 29797 - DNA, 1437 bp, Artificial Sequence
  Description of Artificial Sequence: Synthetic coding sequence
atgtggaaactcctcccagcagctggtcccgcaggaggcgaaccttaccggcttttgactggcgtggaatatgtcgtgggcaggaagaactgtgctatcctaattgagaacgatcagagcatttcaagaaaccacgccgtgctgaccgcgaacttctccgtgacaaacctctctcagacggacgagatcccagtgctgaccttaaaggataattctaagtatggcacatttgtgaatgaagagaagatgcagaatggcttttctcgcacactgaagtctggcgacgggattacatttggcgtgtttgggagcaagttcaggatcgaatatgagcccctggttgcttgctcctcgtgcctcgatgtatccggtaagacagctctgaatcaagcaatcctgcagctcgggggtttcactgttaataattggaccgaagagtgtacgcacctcgttatggtgtctgtaaaggtcaccattaagactatatgcgcgctgatttgtgggagacccatcgtgaaacctgagtattttacagagttccttaaagccgtggagagtaaaaaacagccccctcagatcgagtccttctacccgcctcttgatgagcctagcattgggtcaaaaaatgtggacctgagcgggagacaggaacggaagcagatttttaagggaaagacattcattttcctcaacgctaagcagcataagaagttgagctctgctgttgttttcgggggtggcgaggctagactgattaccgaagagaatgaagaagagcacaattttttcctggctccgggaacgtgcgtggtagataccggaataactaactcgcagaccctcattcccgattgtcagaagaaatggattcagagcatcatggatatgctgcaacggcaaggtttgcggccaatcccggaagcagagatagggttggcggtcatcttcatgaccaccaagaactactgtgacccacaggggcatcccagcaccggcttaaagacaacaacacccggacccagtctgtcccagggagtttccgtcgacgagaagctgatgccatctgctcccgtgaacaccacaacatatgtggccgacactgagagcgagcaggctgacacctgggatctgagcgaaaggccaaaggaaatcaaggtgtccaagatggagcagaaattcagaatgttgtcacaggatgccccaaccgtgaaggagtcgtgcaagaccagctcaaataacaacagtatggttagcaacaccctcgcgaaaatgaggattccaaactaccagctgagcccgaccaagctcccctctatcaacaagtccaaagatagggcctcccagcaacagcagactaacagtattaggaattattttcagccaagtacaaagaaaagggagcggctgcacctcaagaagaaaaaaaagaaaaagtag

SEQ ID NO: 29798 - DNA, 333 bp, Artificial Sequence
  Description of Artificial Sequence: Synthetic coding sequence
atgggcgcatctggctcaaaggcccgaggcctgtggcctttcgcctccgccgcagggggaggcggatccgaggccgctggcgctgaacaggccctcgttaggcctcggggaagggcagtgcccccattcgtgtttacgcgacgcggatccatgttctacgacgaagacggcgaccttgctcacgaattctacgaggagactatcgtcactaaaaatggtcagaaacgagccaaactgagaagggtacacaagaaccttatcccacaagggatagtgaagttggaccatccccgtattcacgtggacttccccgtgattctttacgaggtgtag

SEQ ID NO: 29799 - DNA, 1206 bp, Artificial Sequence
  Description of Artificial Sequence: Synthetic coding sequence
atgtggtcggggggttcgggtaaggcacggggttgggaggcagctgcgggagggcgatcttccccgggtcgccttagcagacggcgtatcatgtcaatgtccccaaagcatactacacctttctcagtgagcgacatcttgtctccactggaggaatcttataaaaaagtggggatggaagggggagggctgggcgctccgttagctgcgtacaggcaaggccaggctgctcctccgactgctgcaatgcaacagcacgctgttggacaccacggagctgttactgcagcttaccatatgacagctgctggcgtcccgcagctgtcacactctgccgtggggggttactgcaatggcaaccttggcaatatgtccgaactccctccatatcaggacactatgcgcaattctgcttctggccctggatggtatggcgctaacccagaccccaggttccctgcaatcagccggtttatgggcccagcctcggggatgaatatgtccggcatgggagggctgggttctttgggcgatgtttcaaagaacatggcccctttgccttccgcacccagacggaaacggagagtcctcttcagccaggcccaagtgtatgagctggaacggaggttcaagcaacaaaaatacctcagcgccccagagcgcgaacatctggcatctatgatccatctgacgcccacccaggtaaagatctggttccagaaccaccggtataagatgaagcgccaggccaaggacaaggccgcacagcagcaactccaacaggatagcggtggcggagggggaggcggtggcactgggtgtccccagcagcagcaggctcaacagcagtccccccgaagagtcgctgtccccgtgctggtgaaagatggtaagccttgccaagccggagcaccagccccaggagcagccagcctgcaggggcatgcacagcagcaggcccaacaccaggcacaggccgcacaagctgccgcagcagcgatcagcgtgggctctgggggagccggacttggtgctcatcccggacaccagccgggatcggcgggacaatcgcccgatctggcgcaccacgccgcaagcccggcagctctgcagggacaggtgtcatcgctttcacatttgaacagctcagggagtgattacggtaccatgtcatgcagcacgcttttgtatgggcgtacatggtag

SEQ ID NO: 29800 - DNA, 1116 bp, Artificial Sequence
  Description of Artificial Sequence: Synthetic coding sequence
atgtccatgagcccaaaacatactacccctttttccgtgtcagacatactctcccccctagaagaatcctataagaaagtcggaatggagggaggtggtctgggggcaccgctggctgcctatcggcagggccaggcggctcctcccacagcggctatgcaacagcacgccgttggccaccatggggctgtgaccgcagcatatcatatgaccgctgccggagtcccacagctgtcccactccgccgtggggggttattgtaacggtaacctgggaaacatgagcgagcttccaccttaccaggacacgatgagaaactctgcttcgggtcccggatggtacggggctaacccggaccccagattccccgctatctcacggttcatgggtcccgcatccggaatgaacatgtctggcatggggggtttggggagcctgggggatgtttccaagaacatggcacctctgccctccgcaccccgaaggaaacggcgtgtgctcttttcacaggcccaggtttacgagctggaacgccgttttaaacagcagaaatatcttagtgcaccagagagagagcatctggcctcaatgatccatttgacacctacccaagttaaaatatggttccagaaccatcggtacaaaatgaaacggcaggctaaggataaagcggctcagcagcagttacagcaggactccgggggagggggaggagggggagggactgggtgtccacaacagcagcaggcgcagcagcaaagcccccgtagagtcgccgtgcctgtgctcgtgaaggacgggaagccctgccaggccggagcacctgcgcctggagcagcttcactgcaggggcatgcacaacaacaggcccagcaccaggctcaggcagctcaggcagctgcagctgcaatcagcgttggaagcgggggtgccggacttggggctcatcccggacatcaacctggttctgccggacagtcccctgatttggctcaccatgctgcatctcctgccgcactgcaagggcaggtaagcagtttaagccaccttaactcatccggttccgactacgggaccatgagttgtagtactctgctgtacggacgaacctggtag

SEQ ID NO: 29801 - DNA, 1116 bp, Artificial Sequence
  Description of Artificial Sequence: Synthetic coding sequence
atgagtatgtcaccaaagcatactacccccttcagtgtgtccgatattctgtctccacttgaagagagttataaaaaggtgggaatggaaggaggcggactgggagcacctctggccgcttaccggcagggtcaggccgctcccccaactgcagccatgcagcagcatgcagttggccaccacggcgcagttactgccgcataccacatgactgccgctggggtcccccagctctcgcactccgcagtgggagggtattgtaacggcaaccttggcaacatgtccgaactgcctccctaccaggataccatgaggaattccgcatccggacccggttggtatggggctaaccctgatccaaggttccccgcaatttccagattcatggggccagctagcggcatgaatatgagcgggatggggggtcttggatcgctgggggacgtgtctaagaacatggcgcctctgccatcagccccacgacgtaagcgcagggtgctcttttctcaggcccaggtatacgagcttgagcgccgtttcaagcagcagaagtacctttcagcccctgaacgagagcacctggctagtatgatccacttgacaccaacccaagtgaagatttggttccagaaccaccgctacaaaatgaaacgccaggcaaaggataaggctgcgcaacagcaactgcagcaggactccggcggagggggtggagggggaggcaccggatgcccacaacaacagcaagcccagcaacagtccccaagaagggtggccgtgccagttctggtgaaggacgggaagccctgccaggcaggcgctccagcgccaggggctgccagtttacaggggcacgctcagcagcaggcccagcatcaggcccaggcggctcaggctgccgctgcggctatttccgtgggaagcgggggtgcagggctgggggcacatcctgggcatcagcctggcagcgctggccagtctcccgaccttgcccaccatgcagccagtccggcagccctgcaggggcaggtgagttcattgtcacacttgaactcctctgggtctgattatggcaccatgtcttgctcaaccctcctgtacggcagaacatggtag

SEQ ID NO: 29802 - DNA, 1116 bp, Artificial Sequence
  Description of Artificial Sequence: Synthetic coding sequence
atgtctatgtccccaaagcatacaactccattctcagtcagcgacatcctttcgccactggaggaatcctacaaaaaagtcgggatggaggggggaggccttggtgcccctctagcagcctacagacagggccaggctgccccacctactgccgctatgcagcagcatgcagtcggccaccacggcgctgttaccgcggcataccacatgaccgccgcaggagtacctcagctctcccacagcgctgtgggcggatattgcaatggaaatctgggcaatatgtcagagctgcccccataccaggatactatgagaaatagcgctagcgggcctgggtggtacggtgctaatcccgaccctcgcttccctgcaatctcccggtttatggggccagcttccgggatgaatatgtccggaatgggaggcttgggatccctgggggacgtcagtaagaacatggcacccctccctagcgcaccaagaaggaaaaggcgggtgctgttttcccaggcacaggtgtatgagcttgaaaggcggttcaaacaacagaaatatctcagcgcccctgagagagagcacctggcttctatgattcatctgacccctacccaggttaaaatctggttccagaaccatagatacaaaatgaagaggcaggccaaagataaggcagcccagcaacagttgcagcaggactctgggggtggcggaggaggtggagggacgggttgccctcagcagcaacaagcacaacagcaatcaccccgaagagtagccgtacccgtcctcgtgaaagacggtaagccatgtcaggcaggtgccccagcaccgggtgctgccagtcttcagggccatgcccagcagcaagcccagcaccaggctcaggccgcacaagccgcagcagcggctatcagcgtcgggagcggaggagcgggacttggcgctcaccctggtcatcagcccggtagcgctggccagtcacccgatctggcccatcatgccgcttcccctgccgcactgcagggccaggtttcttctctcagccacttgaactcgagcggaagcgattatggcaccatgtcatgctccacactcctttacggcaggacatggtag

SEQ ID NO: 29803 - DNA, 105 bp, Artificial Sequence
  Description of Artificial Sequence: Synthetic coding sequence
atgtggagcggagggtctggcaaggcacgaggctgggaggctgccgcaggaggacggagtagtccaggcagactgtctgcttatgctcccccactcgtggcgtag

SEQ ID NO: 29804 - DNA, 573 bp, Artificial Sequence
  Description of Artificial Sequence: Synthetic coding sequence
atgttgagagtccctgagcctagaccgggtgaagcaaaagccgagggcgcagcgcctcctaccccatctaaacctctgacgagctttctaatacaggatattctgagagatggagctcccgaggaggctgagacgctcgcggagacagagccggagagacacctgggctcatatttactagattcagaaaatacttctggagctctgcctagactccctcaaacacccaagcaaccccagaagcgcagcagagccgctttctctcacacccaggtgattgagctggagaggaaattctcccaccaaaagtatctttctgcgcctgaaagggctcacctggcaaagaacctgaagttgaccgaaactcaggtaaaaatttggttccaaaaccggaggtacaaaactaagcgcaagcagctgagcagcgagctcggagacctcgaaaagcactccagcctccccgcacttaaagaggaggcttttagtagggcctccttagtgtctgtgtataacagttacccctattacccctatctgtattgcgtggggtcatggtcccctgctttctggtag

SEQ ID NO: 29805 - DNA, 705 bp, Artificial Sequence
  Description of Artificial Sequence: Synthetic coding sequence
atgttgagagtacctgaacccaggcctggggaagccaaagctgagggtgcagctccacctacgcccagcaagccattaaccagcttcctgatccaggacatcctgagagacggcgctcagagacagggaggtcggacctcgtcacagcgccagcgcgatcctgaacctgaacctgaaccggagcccgagggcggtagatccagagcaggagcccagaatgaccagctttccacaggtccccgtgctgcccctgaggaggccgagactctggcagagacggaacccgaacgccatcttggctcttacctgcttgactccgagaacactagcggggcattgcctaggcttcctcagactccaaagcagcctcagaagcgctcacgggctgcttttagtcatacacaggtgattgagctggaaaggaaatttagccatcagaaatatctgtccgccccagagagagcccacctagcaaagaacctcaagctgacagaaacccaggtcaaaatatggtttcagaaccgtaggtacaagacaaaacggaagcaactaagctctgaactcggggacttggaaaagcactcatcactgcctgcgcttaaagaggaggcgttctcacgcgcatcactggtgtcagtgtacaacagttacccctattacccatatttatattgtgttggctcctggagccctgctttctggtag

SEQ ID NO: 29806 - DNA, 480 bp, Artificial Sequence
  Description of Artificial Sequence: Synthetic coding sequence
atgctcagagtgccagaacccaggcccggagaagccgagacccttgctgagactgaacctgaacgccacctcggctcatacctgctcgattctgagaatacaagcggtgccctgcccaggctgcctcagacacccaaacagccccaaaagcggtccagggccgctttctcccatactcaggttatagagttggaacgcaagtttagccatcaaaagtacctgtccgctcccgaacgcgctcatctcgctaagaatctcaagctcacagaaacccaggtcaagatctggtttcaaaacaggcggtataaaactaaacgcaagcaactctcctcggaactgggcgacttggagaaacactcgtcccttcctgcgctcaaggaggaggctttctctcgtgccagcctcgtatctgtgtacaactcttatccatactatccttacttatactgcgttgggagctggtcccccgctttctggtag

SEQ ID NO: 29807 - DNA, 4212 bp, Artificial Sequence
  Description of Artificial Sequence: Synthetic coding sequence
atggcaacccagcagaaagccagtgatgagagaatctcccagtttgatcataatttactacctgagctgtctgcactgttgggactggatgccgtgcagctggccaaggaattggaagaggaggagcagaaggaaagggcaaaaatgcaaaaaggatacaacagccaaatgcgttccgaagcaaagaggttgaagacttttgtgacctacgaaccttactcgagctggattcctcaggagatggctgctgcaggattttattttaccggtgtcaaatctggaattcagtgcttctgctgctctttaattctcttcggggcaggactgactcgcttgccaattgaggatcacaaaaggttccaccccgactgcggatttctcttgaacaaggacgttggtaatattgctaaatatgatatccgcgtgaaaaatctgaagtccaggctgagagggggtaagatgagataccaggaagaagaggctcgtctggccagctttcgcaattggcccttctacgtgcagggaatctccccctgtgtgctgtctgaggccggtttcgtgttcacaggcaagcaggacactgtgcagtgctttagctgcggaggctgccttgggaactgggaggagggtgacgacccctggaaggaacacgcgaaatggttcccaaaatgcgagttcctacgtagtaagaaatcgagtgaggaaataacccagtacatccagtcctataaggggtttgttgacattaccggagaacattttgttaatagctgggtccaaagggagctgcccatggcttctgcttactgcaacgatagtatcttcgcatatgaggagttacggctcgactcttttaaagattggcctcgcgagtctgcagtgggtgtggccgctctggctaaggcaggtctgttttacactggaatcaaagacatcgttcagtgttttagctgtgggggttgccttgaaaagtggcaagagggggatgaccctctggacgaccacacacggtgctttcctaactgcccatttctacagaacatgaaaagctctgctgaggtcacgcccgaccttcagtcacggggagaactgtgtgagcttttagagactacaagtgagagtaatctggaagactcaatcgccgtgggcccaatcgttcctgagatggctcagggagaggcacagtggtttcaggaagcaaagaacctgaatgagcagcttcgggctgcttacacgtccgcttctttccgacacatgagtctcttggacatatcttcagacctagcaactgaccacttgcttgggtgtgacctgagcatcgcgtctaaacacatctctaagccggttcaagaacccctcgttctgcccgaagtgtttggaaatctgaactcggtaatgtgcgtggaaggcgaagcagggtcagggaagacagttctgttgaaaaaaatcgcgttcctgtgggcctccggatgttgccctctgctgaaccgattccagctggttttctacctcagtctaagttcaaccagacccgacgagggcctagcctccatcatctgcgatcagctcctggaaaaggaggggagtgtgacagagatgtgtgttcggaatatcatacagcaactgaagaatcaggtgctgtttcttctagacgactataaagagatttgctccattcctcaagtcataggcaagttgattcagaagaaccacctctcacgaacatgtctccttatcgccgtgagaactaaccgcgcaagagacattagaagatatctggaaacgattttagagatcaaggctttcccgttctacaacacagtgtgcattttgcgcaagctgttctcccacaacatgacgcgactgcggaagtttatggtttattttggtaaaaaccaaagtttgcagaaaatacagaagactccgctgtttgtagccgcaatatgtgcacactggttccagtatcccttcgatccatcattcgacgatgtcgccgtgttcaagtcttatatggaacgtctctcactcaggaacaaagcaacagccgaaatcctaaaagccaccgtttcctcttgcggtgagttggcccttaaagggtttttttcctgttgctttgagtttaatgacgacgatttagcagaggcaggagtggatgaggatgaagaccttacgatgtgtctgatgagcaagtttacagctcagaggctgagacccttttaccgttttctgtccccggcatttcaggagttcctcgccggaatgaggctcattgagctgttagacagtgatcgtcaggagcaccaggaccttggcctctaccatctgaaacaaatcaattctccgatgatgacggtgagcgcgtataacaattttctgaactacgtgtccagcttgccttccacaaaggcgggtcctaaaattgtctcccacttgttgcatttagtcgataacaaagagtcacttgagaacatcagcgagaatgatgattacctgaaacaccagccagagatctcactgcagatgcagctactaagaggcctgtggcagatatgcccccaggcctatttctccatggtcagcgaacacctgctcgtactggccttgaagactgcctaccagtctaataccgtggccgcttgttcaccgttcgtgttgcaattcctccaggggaggacacttaccctgggcgctctgaatttacagtatttcttcgaccatccagaaagcctgtctctcctcaggagcattcattttccgatcagggggaacaaaactagtcctcgagcccacttttcggttctcgaaacgtgctttgacaagagccaggtgccaaccatcgaccaggactatgcatctgctttcgagcccatgaacgagtgggagagaaatttagctgagaaggaggataatgtcaaatcatacatggatatgcaaagaagggcctcgcccgatctgtcaacaggttactggaagctctctccaaagcaatacaaaattccctgtctggaagttgacgtaaatgacatcgacgtggtgggccaggacatgctggagattctaatgaccgtgttctccgcttctcagagaatagaactacacctgaaccactcacggggattcatagaatctattcggcctgccttggagctcagcaaagcctctgtgacaaagtgttcaatctccaaactcgagctgtcagccgcagagcaggaacttctgctaaccctgccatctttggagagtcttgaagtgagcggcacgattcaatcccaggatcagatatttcccaacctggacaagttcctgtgtctaaaggaattgagcgtcgacctggagggaaacattaacgtcttctccgtcattccggaggagtttcccaactttcatcacatggaaaagctcctcatccagattagcgcagaatacgatccctcaaaattggttaagttgatccaaaactcccctaacctgcacgtctttcacttgaaatgcaatttcttctccgatttcggatctttgatgaccatgttggtgtcttgtaagaagctaactgaaataaagttttccgacagttttttccaggcagtccccttcgtggccagccttcctaacttcatcagcttaaaaatcctgaatctggaaggtcagcaattccccgacgaagagacaagcgaaaagtttgcatatatacttggaagcttaagcaatttggaagaactgattctgcctaccggcgatggaatatatcgtgtggccaaactgatcatacagcagtgccaacagcttcactgcctgcgcgtgctgtcattttttaagacgctgaacgatgactcagttgtggagatcgcaaaggtagccatctcaggaggttttcagaagctcgaaaatctgaaactatcaataaaccataaaatcaccgaagaaggttatcggaactttttccaagctctagacaacatgcccaatctgcaggagctcgatattagccgacattttacagaatgtattaaagcccaggctacaaccgttaaatcactttctcagtgcgtgttaagactgccccgtctcatcaggctcaatatgttgagctggctgttagacgcagacgatatcgccctattgaatgtgatgaaggagaggcacccccagtcgaaatatctgacgattctgcagaagtggatcctgcctttctctccaatcatccagaagtag

SEQ ID NO: 29808 - DNA, 3726 bp, Artificial Sequence
  Description of Artificial Sequence: Synthetic coding sequence
atgccgttacatataggcgacttcgtgtgggattccaaggtccactctttacagtcgagtctaaatatcttctctttactccctacaaaaggacgtactgaacacctattcttttcgcacatcctttcttttcattggcctgccttctcaagtattagactcgagctgtggattaacctccgttgcgagttcttgagatctaagaagagcagcgaagagataacacaatatatccagtcttacaagggttttgttgatattacaggcgaacatttcgttaactcatgggtacagcgcgaattgcctatggcctccgcctactgcaatgatagcatcttcgcttatgaagagctgcggcttgattcttttaaagattggcctagggagagtgcggtgggcgtggctgctctcgccaaggctgggttattctatacaggtatcaaggacattgtccagtgcttttcgtgtggcggatgtttagagaaatggcaggagggagacgatcccctggacgaccacacaagatgctttcccaactgccccttcctgcaaaatatgaaatcaagcgcagaagtgacccctgatctccagagtcggggagaattatgcgagctgctagagaccacctccgaatccaatctagaagattctattgcagtgggcccaattgtgcccgagatggctcaaggagaagcccagtggtttcaagaggctaaaaaccttaacgagcaactgcgcgctgcatacaccagcgcctcctttcggcacatgtcactcctggatatcagcagcgatctggccactgatcacttgttaggctgtgatctcagtattgcttctaagcatatttctaagccagtgcaggagcctctagtacttcccgaggtcttcgggaacttgaactccgttatgtgcgttgagggcgaggccggaagcggcaaaactgttctcctgaaaaagatagccttcctgtgggcaagcggctgctgccccttgctcaaccggtttcaactggttttttacctgtccctttcttcaacacggcctgacgaaggcctggccagtatcatatgtgatcagctgttggagaaggaaggatccgtgacagagatgtgtgttcggaacatcatccagcagcttaaaaatcaggtattatttctgctcgatgattacaaggaaatttgttccatcccgcaggtcatcggaaagctcatccagaagaaccacctgtcacggacttgcctgcttatagccgtgagaaccaatagggcacgtgacatcagacggtatctggaaaccattcttgagatcaaggcattccccttttataacactgtttgcattctgcggaagctctttagtcataatatgacacggctgagaaaatttatggtttacttcggcaaaaatcagtcactgcaaaaaatccaaaaaacccctctgtttgttgccgcaatatgcgcgcactggttccaatacccttttgatccgtcttttgacgacgttgccgtgtttaaaagttatatggaaaggctgagcttacgcaacaaggcaacagcggaaattcttaaggccaccgtgtcatcatgcggtgagttggccctgaaggggttcttttcttgttgctttgagtttaacgacgacgaccttgccgaggcaggcgtggatgaggatgaggatctgaccatgtgcctgatgagcaaatttacagcccagcgactgcggcctttctacaggtttctaagtcccgcttttcaagagttcctcgctggcatgcgcctcatagaattgctagactctgatagacaggaacaccaggacctggggctgtaccaccttaaacaaataaacagccccatgatgacagtgagcgcctataacaattttctaaattatgtttccagtctgccaagcacaaaggccggtccaaagattgtgtcccacctactgcacttagtcgacaacaaggagtccttggaaaatatcagcgagaacgatgattacctgaagcaccagccggaaatttcgcttcaaatgcagctccttaggggcctgtggcagatatgcccccaggcgtatttctcgatggttagcgagcacctgctcgtgctggcgcttaaaacggcttatcaatccaacacagtggccgcatgtagcccttttgtgctgcaattcctgcagggacgaactctcaccctcggagctctgaatcttcagtatttcttcgatcaccccgagtctctttcacttctgaggagcatccacttccccattcggggtaacaagaccagtccgagagcccactttagtgtgcttgagacatgcttcgacaagagtcaagtgccaaccatcgatcaagactatgcctccgcctttgaacctatgaacgagtgggagaggaacctggccgaaaaggaggacaatgtcaagtcttacatggacatgcagcgccgagcgtcccccgacctcagcacgggctactggaaattgagtcctaaacagtacaaaattccttgccttgaagtagatgtaaacgacatcgacgtagtcgggcaggatatgctggagatcctgatgacagtgttcagtgcctcgcagcgtattgaactgcacttgaatcatagcaggggctttatagagtccattaggcctgccctagagctttccaaggccagcgtcaccaaatgtagcatcagcaagctggagctgtcagccgcagaacaagagttactgttaactctgcccagcctggaatccctggaagtcagcgggactattcaatcacaggaccagatttttcccaacctagataaattcctgtgtttgaaggaactgagcgtagatttggagggaaatattaacgtattcagcgttatcccagaggagttccctaatttccatcatatggagaaattacttattcaaatctcagccgaatatgacccctccaaactggtgaagctgatccagaacagtcccaatcttcacgtgtttcacctaaagtgtaacttttttagcgactttggaagcctgatgaccatgttagtaagttgtaagaaactgaccgagattaaattttctgattcattcttccaggctgttcctttcgtggcttcgctgcccaactttatttccctgaagattttgaacctggagggtcagcagttccccgatgaggaaacctctgaaaaatttgcttacatcctcggttctctctccaaccttgaagaattaatactccctactggagacggaatttatagagtagctaaactcattatccagcagtgccagcaactccattgtctgcgggtgctatctttctttaagaccctcaacgatgattcagttgtcgagatcgccaaagtcgcgatcagcggcggattccagaaattggaaaaccttaagctgtccataaatcataagatcacggaggagggttaccgcaacttcttccaggccctcgacaatatgccaaatctccaagagctcgacataagcaggcacttcacggaatgcatcaaagcacaggctaccaccgtgaagtcactatcgcagtgtgtgctgcgcttgcctcgtctcattagactgaacatgttatcctggctgcttgatgctgatgatatcgccttgctgaacgtcatgaaggaacggcatccacagtccaagtatctcaccattctgcagaaatggatcctcccattcagccccattatccagaagtag

SEQ ID NO: 29809 - DNA, 4212 bp, Artificial Sequence
  Description of Artificial Sequence: Synthetic coding sequence
atggctacgcaacagaaagcaagcgatgagagaatatcacagtttgaccataatctgctgcccgaactgtcggctctgctgggcctcgacgctgtgcaactagccaaagagctggaggaagaggagcagaaagagcgtgctaagatgcagaaaggctataatagtcagatgcgatcagaggccaagcggcttaagacctttgtgacttatgaaccctatagttcctggatcccccaggagatggcagccgcaggcttctattttacaggcgtgaaaagtggcatccagtgtttctgctgcagtctcattctgtttggcgcaggattaacgcgactgcccattgaagatcacaagcggttccaccctgactgcggcttcctgctcaacaaggatgtgggaaatatcgcaaagtacgacattagagttaaaaatctgaagagtcgcctgagaggcggaaagatgaggtatcaggaagaagaagcacgcctggcaagcttccgcaactggcctttttacgttcagggcatctctccatgcgtgttgagtgaagccggtttcgtgttcaccggaaagcaggacactgtccagtgtttttcatgtggtggctgtttaggcaattgggaggagggagacgatccgtggaaagaacacgcaaaatggttccccaaatgtgagttcctgagatccaagaagtcctccgaggagattactcaatacatccaatcatacaaaggtttcgtagatatcactggcgagcactttgtgaattcctgggtgcagagagagctgcctatggcgtctgcgtactgcaacgactctattttcgcctatgaggagctcaggctcgacagtttcaaagattggccccgagaatccgctgtgggcgtggcagcactagccaaagccggactgttctatacggggatcaaagacattgtgcaatgtttctcttgcggtggttgtctggagaaatggcaagaaggcgacgaccccctggacgatcacacacgctgctttcctaattgtccgtttcttcaaaacatgaaaagctctgccgaagtgacccctgatctgcagagcagaggggaactttgcgaattgttggaaacaacgagcgagtctaacctcgaggactccatagccgtgggccctatcgtgccagagatggctcagggggaagctcagtggtttcaggaggcgaagaatttgaacgagcagctgagagccgcttataccagcgcctctttccgccacatgtcactgttggacatttcatccgatctggccacagaccacctgttgggatgcgacctgtctatcgccagtaaacacatctctaaacctgtgcaggaacctctcgtgctgccagaggtgtttggaaatctgaattcagtgatgtgtgtcgaaggggaggcaggaagcgggaaaactgtgctgctgaagaaaattgccttcctttgggcctctggatgctgcccactgctcaacaggttccagctggtcttctacctatccctatctagcacacggccagacgaagggctggcatcaatcatttgcgaccagctgctcgagaaggaagggtcggtgaccgagatgtgtgttcgaaacattattcagcagctcaaaaatcaagtgttattccttttagatgactataaagagatctgcagcattccccaagtcattggaaaactcatccagaaaaaccacctgtctcgcacgtgtctgctgatcgctgtgagaaccaacagagcaagagacataaggcgctacttggaaaccatcctggagatcaaagcttttccgttttacaacaccgtttgcatccttcgaaagcttttttcacacaatatgaccaggctccggaaatttatggtctacttcggaaaaaatcagagcctgcagaaaatccagaagactcctctctttgtagctgcaatctgcgctcactggtttcagtatccctttgatccctcattcgatgatgtggccgtcttcaagtcctatatggagcggttatcactccgcaataaagccactgccgagattctgaaggccactgtatcctcatgtggggagctcgccctcaaggggtttttcagctgttgtttcgaatttaacgatgacgacttggccgaggcaggggtggatgaagacgaggatcttaccatgtgcctcatgtccaaattcaccgcacagcgactgcgccctttctaccggttcctgtcccctgcatttcaagaattcttagccggaatgcggctgatcgagttgctggacagtgatagacaagagcaccaggatctcggactgtatcacctgaagcagattaattcacctatgatgactgtctccgcctacaacaattttctcaactatgtgagttcacttccatcgaccaaggccggacccaaaatcgtaagtcatctgcttcatctggtcgataacaaggaaagcctggaaaatatttcagagaacgacgattacctgaaacaccagcctgagatttctctgcagatgcagttgctgcggggattgtggcaaatctgtcctcaggcttactttagtatggtgtccgagcacctgcttgtcctcgccctgaaaacagcttaccaaagcaatacagtggcggcatgttcacccttcgtgctgcaattcctgcagggacggactttgacactgggcgctctcaatctgcagtacttcttcgaccaccccgaaagcctgagccttctgcgctcaattcatttccccatccggggtaacaaaacatcaccgagggcacatttttcggtgttggagacgtgttttgataaatcgcaggtgcctaccatcgaccaggattacgcatccgcgttcgaacccatgaatgaatgggagaggaatctcgcagaaaaagaagacaacgtgaaatcttacatggacatgcagagaagagcgagcccagacttatctaccgggtactggaagttatctcccaaacaatacaaaataccttgcctggaggttgacgtcaacgacattgacgttgtcggccaggacatgctcgaaatactgatgaccgtgtttagtgcatcacagcggatagagctccatctgaaccattcacggggatttattgagtcaataaggccggcactcgagttatctaaggcttccgttaccaaatgtagcatatcaaagctagagctcagcgctgctgagcaggaacttctcctgacacttccttccttggagagcttggaggtgtccggcaccatacagagtcaggaccagatttttcccaaccttgataagttcctttgcttgaaggagttgagtgtggatctggaaggcaacattaatgtcttctccgtgattcctgaggagtttccaaatttccaccacatggaaaaactgctgattcagatctctgccgaatacgatccttctaaactcgtgaagttgatccagaatagcccaaacctgcacgtgtttcacctgaagtgtaactttttctctgattttggttcactgatgaccatgctggtgtcttgtaagaagctgaccgagatcaaattctcagattctttcttccaagctgtcccttttgtcgccagcctacccaacttcattagcctgaagatcctcaatctcgaagggcaacagtttccggacgaggagactagcgaaaaatttgcatacatcctggggagcctatctaatctagaggagctgattctgccaacaggcgatggaatatatagagtggccaaactgataatacagcaatgccagcagctccattgcctaagagtgttatcattcttcaaaactctgaatgatgattctgttgtggagatagcaaaagtggcaatcagtggcggattccagaaacttgagaatctcaaattatctatcaaccataagatcaccgaagaaggctataggaacttttttcaggcactggataacatgcctaatctccaggagctcgacatcagcaggcactttaccgaatgtatcaaggcacaggccacaactgttaaatccttgagccaatgcgtgctgcggctacctcggctgattcggctgaatatgctatcctggctgttggacgctgacgacatagccctgctgaatgtgatgaaagaacgacatccacagtctaaatacctgactattctccaaaaatggattttgccattttctcctattatccaaaagtag

SEQ ID NO: 29810 - DNA, 3726 bp, Artificial Sequence
  Description of Artificial Sequence: Synthetic coding sequence
atgcctctgcatatcggtgatttcgtctgggactcaaaagttcactctctccagtcctctctcaatattttttcgctcctgcccaccaagggcaggacagaacacctttttttctcacacatcttatcgtttcactggcccgcatttagctccattagactcgagctgtggattaatcttaggtgcgaattcttgcgttcaaaaaagtcctccgaagagatcacacagtacatacagtcctacaagggattcgtcgacataaccggtgaacactttgtgaattcgtgggtacaacgcgagctgcccatggctagcgcttactgcaacgacagtattttcgcctatgaggagcttagattagactcttttaaagattggccacgggagtccgctgtgggagtcgccgcattagctaaagcaggcctcttctacactggaatcaaagatatcgtgcagtgctttagctgtgggggttgtctggagaagtggcaggaaggtgatgacccacttgacgaccacacaagatgcttcccaaattgcccgtttttacagaacatgaaatcttccgctgaagttacaccggatctacagagccgcggagagctgtgtgaattactggaaaccacaagcgaatccaacttggaagattccatcgccgtggggcctattgttccggagatggctcagggcgaggcacagtggttccaggaagccaagaatctgaatgaacagctgcgcgctgcttataccagtgcatccttcaggcatatgagcctcttggacatatcttctgatttggccaccgatcacctgcttggctgtgatttgtccattgcttcaaagcacatcagcaaaccagtgcaggaaccgctggttctgcctgaggtgtttggaaatctgaactcagtaatgtgtgttgaaggcgaggcgggttccggcaagactgtgttgttgaagaagatcgcctttctgtgggcttccggctgttgtcccctcctcaaccgcttccagctggtgttttacctctctctcagttcaacaagacccgatgagggtctggcatccataatatgcgaccagctacttgagaaagagggatcagtgactgagatgtgcgtccgtaacatcattcagcagctgaaaaaccaggtcctcttccttctggacgattacaaagagatatgcagcatacctcaggtaattggcaagctgatccagaagaaccacctgagccgtacatgcctgctcattgctgtgcggactaatagggccagggatatcagacgatacctagagacaatcctcgagataaaggccttcccgttctacaatacagtttgtatcctcaggaagcttttcagtcacaatatgacaaggctcaggaagtttatggtgtacttcggcaaaaaccaatcgctgcagaaaattcagaaaacccctctgtttgttgccgcaatttgtgctcactggttccagtacccattcgacccatcctttgatgacgttgcagtttttaagtcctacatggagagactgtctctacgaaacaaagcaaccgcagagatcctgaaggccaccgtctcaagttgtggcgaattggccctaaaggggtttttctcctgttgtttcgaattcaatgatgatgacttagcggaggccggtgtggatgaggacgaggatttgacaatgtgtctcatgtcaaagtttacagctcaacgcctgagacctttctataggtttctttcacccgcatttcaggaattcctggctggcatgaggctgatagaattgctcgatagcgaccgccaggaacatcaagacctcggcttgtaccacctcaagcagatcaatagtccaatgatgactgtcagtgcctacaataattttctcaactatgtttcctctttgcccagcactaaggccggacctaagatcgtctctcacttgctgcacctcgtagataacaaagaatcgctggaaaacatttctgaaaacgacgactatctgaagcatcagcctgagatatccttacagatgcaactgctcagagggctgtggcaaatttgcccacaggcttactttagcatggtgagtgagcatctgctggttctcgccttgaagaccgcctatcaatcaaatacggtcgcggcatgctcacccttcgtccttcaatttctgcagggcagaaccctgacacttggggctctcaatctgcaatatttcttcgatcaccccgagagcctcagcctgctgagatccatccatttcccaatcagggggaataagacctcccccagagctcacttttccgtcttggagacatgtttcgataagtcacaggtgccaacaatagatcaggactacgcgtccgcattcgaaccaatgaacgagtgggaacgcaatctggctgagaaggaggataacgtgaagtcctatatggacatgcagcggagggcctcccccgatctgtccactggttactggaagttatcccccaagcaatacaagattccctgcctggaagtagatgtaaatgacatcgatgtcgtcggacaggacatgctcgaaatcctaatgaccgtttttagcgcctcacaaaggattgagctgcaccttaatcattccagaggatttattgagtccatcagacccgcactcgagctcagcaaagcaagcgttacaaagtgtagcatatctaaattggagctttcagcagcggagcaggaactcctcctcacattgccaagcctggagtctttggaagtgagtggtactatccaaagtcaggaccaaatttttcccaatctggataagtttttgtgtcttaaggagctgagcgtggacttggagggtaatatcaatgtgttctctgtcatccccgaagaatttcccaactttcaccatatggagaagttgctgatccagatcagcgccgagtatgacccatcaaaactggtaaaacttatccaaaactcgccgaatttgcatgtgtttcacctgaaatgcaattttttctccgacttcggaagtctgatgacaatgctcgtgagctgcaagaaactgacagagattaaattctcagactcatttttccaggcagtcccttttgtagcttcactacccaattttatttctcttaaaatcctcaaccttgagggccaacagttcccagacgaggaaacgtcagagaaattcgcatacatcctgggcagtctgtcaaacctcgaagaacttattctacccaccggggatggcatatatcgagtggctaagctgattatccaacaatgccaacagctccattgtcttcgcgtgctgtcattttttaagacactgaacgatgattctgttgtggaaatcgccaaagtggccattagcggtggcttccaaaaacttgaaaacctgaaattatccatcaatcacaagataactgaagaaggttaccgcaactttttccaggcgctcgacaacatgcccaatttgcaggagctcgacattagcaggcacttcacggaatgcatcaaagcacaggccactactgtcaagtctctctctcagtgcgtcttgaggctgccacgccttatcagactgaatatgcttagctggctcttggacgcggatgatattgcgctattgaatgtgatgaaggagcgacacccccagtcaaagtacctgaccattctgcagaaatggatcctgcctttttcaccaatcattcagaagtag

SEQ ID NO: 29811 - DNA, 678 bp, Artificial Sequence
  Description of Artificial Sequence: Synthetic coding sequence
atgctcgggctcgacgcttgtgaattgggggctcagctgctggaactgctgagactggcgttatgtgcccgagtgctgctggcagataaggaaggcggtcccccagccgtcgacgaggtgctggatgaggccgttccggagtaccgcgcaccgggtaggaaaagtctgctggagatcagacaacttgatcctgacgaccgcagcctggctaagtacaagagagttctgctgggcccattgccccctgctgtggacccttctctccccaacgttcaggtgactagactgactctgctgtctgaacaggctcccggtccagtggtgatggatctgactggtgacctcgcagtcctgaaggatcaggtctttgtcctcaaggaaggtgtagattatagggtgaagatcagtttcaaggttcacagggagatcgtctctggtctcaaatgcctgcaccacacatacaggcggggtctgagggtcgataagaccgtgtatatggttggctcttacggcccatccgcccaagagtacgaatttgtgactcctgtggaggaagctcccaggggagcattggtccggggtccctatctagtcgtctccctctttacagacgacgaccgcacacatcacctgtcatgggagtgggggttgtgtatatgtcaagactggaaagattag

SEQ ID NO: 29812 - DNA, 882 bp, Artificial Sequence
  Description of Artificial Sequence: Synthetic coding sequence
atgcctgctagatctggcgcacagttctgccggaggatgggccagaagaagcagcgccctgccagggcagggcaaccgcattcatcaagcgacgccgctcaagcgcctgctgaacagcctcatagctcttccgatgccgcacaggctccttgccccagagaaagatgtttgggtccccctaccacccctggcccataccgctccatctactttagctctccaaaggggcatcttacacggctggggctggaatttttcgaccagcctgctgtgccgctggccagagcattcctgggtcaggtgctggtccgcagactgcctaatgggaccgagcttcggggacggatagtcgagacggaggcgtaccttggacctgaagacgaggccgcacactcacgtggaggtagacagacgccaaggaaccggggtatgtttatgaaacccggaaccctgtacgtttatatcatatacggcatgtatttctgtatgaatatttcaagccagggcgatggggcttgtgtgctgttacgcgcactcgaaccgctcgagggattagagactatgagacagctgcgctctactctgcgaaagggaacagcttccagggttctgaaggatcgtgagctgtgtagtggacccagcaagttgtgtcaggcgctcgccatcaacaagtcgttcgatcaacgtgatctcgcacaggatgaggccgtttggcttgaacgcggtccactcgaaccgagtgagccggctgtcgtggccgctgccagagtgggcgtcgggcacgcaggagagtgggcaagaaagccccttcgcttttacgtgcggggaagcccatgggtatccgtcgtagatagggtggccgaacaggacacgcaggcctag

SEQ ID NO: 29813 - DNA, 846 bp, Artificial Sequence
  Description of Artificial Sequence: Synthetic coding sequence
atgggacagaaaaaacagcgacctgccagagcaggacagccccacagctcctccgatgcagcgcaggccccagctgagcagccacattcaagctctgacgcagctcaagcgccttgcccgagggagaggtgtctggggccaccaactaccccgggtccttataggagcatctacttttctagcccgaagggtcatctcacccggttaggcctggagtttttcgaccaaccagctgtgccactagcacgggctttccttggccaggtccttgtgcggaggctgcctaatggcactgagcttagagggcgaatcgtcgagacagaagcatatctggggcctgaggacgaggctgctcattcacggggaggcaggcaaacacctcggaatagaggcatgtttatgaagcctgggacattatacgtgtatataatctatggaatgtatttttgtatgaacattagctcacagggggacggtgcttgtgtcctcctccgtgccctcgaaccacttgaaggcctggagactatgcgccagctgagaagtaccctaaggaagggaacagcgtctcgtgtactaaaggatagggaactctgtagtggaccttccaaattgtgccaagcgctggccataaacaaaagttttgatcagagagacttggcgcaggacgaagccgtctggcttgagagaggacctttggagcccagcgagccagctgtggtagcggcagctagagtgggtgttggacacgccggagagtgggccagaaagcctctgaggttctacgttagaggatcaccctgggtctccgtcgtagacagagtggccgaacaggatacgcaggcatag

SEQ ID NO: 29814 - DNA, 756 bp, Artificial Sequence
  Description of Artificial Sequence: Synthetic coding sequence
atgggccaaaagaaacagaggcccgcaagagctgggcagccccactcgagcagcgacgcagctcaggctcccgctgagcagccgcactcttccagcgacgcggctcaggcaccgtgcccccgtgagcggtgtctcggccctccaaccacccctggaccgtataggtccatctacttctccagcccaaagggccaccttactcgcttgggtctggagtttttcgatcaaccagctgtacctttagcacgcgcttttctgggccaagttctcgttagacgtctgcccaacggtaccgagctccgtggcagaatagttgaaacagaagcttacctcggtcccgaggatgaagcagcccacagccgtggcggacggcagactccaaggaaccgagggatgttcatgaagcctgggaccttgtatgtttatataatctacggaatgtatttttgcatgaacatttccagccagggcgatggggcatgtgtgcttttgcgtgctctcgaaccactagaagggctggagacaatgcgacagttgcgaagcaccttgcgtaagggtaccgccagcagagtccttaaggatagagaactgtgtagcggtccatcaaagctgtgccaggctcttgcgattaacaagtcatttgaccagagggatttggctcaggacgaggccgtctggttggaacgaggaccactcgaacccagcgaaccggcagttgtggccgcagcgagggtgggtgttggacatgccggatag

SEQ ID NO: 29815 - DNA, 1044 bp, Artificial Sequence
  Description of Artificial Sequence: Synthetic coding sequence
atgcacgcccactgcctgcccttcctcctgcacgcttggtgggctttgctgcaagctggagctgccactgtggcaaccgccttactccggaccagagggcaaccgtcttcacccagtccactcgcctatatgctgagcctttatcgtgatccactgccccgtgccgatatcatacggagcctgcaggccgaagatgtagctgtggatgggcagaattggacgttcgccttcgatttctccttcctaagccagcaggaggaccttgcgtgggcggagctgaggctacagctgtcctctccagttgatttgcccaccgaaggctcactggccattgagattttccatcagccaaagccagacactgagcaggcaagtgattcttgcctggagaggtttcaaatggatctgtttaccgttactctgagtcaggtgacgttcagtctaggtagcatggttctagaggtcacgaggcccttgtctaaatggttgaaacaccctggcgcactggagaaacagatgtctcgcgtcgccggagagtgttggcctagaccccctacccctcccgcaaccaatgtcctgttgatgttatacagtaacctgagtcaagagcagagacagctgggcggaagtactctcttgtgggaggcggagtcttcctggcgtgctcaggaaggacagctttcctgggagtggggaaaaagacacagacgccaccatctccccgaccgaagtcagttgtgtaggaaagtgaaattccaggtggacttcaacttaattggatgggggagctggataatctaccctaagcagtacaatgcctacaggtgtgagggtgaatgccctaaccccgtcggtgaggagtttcaccctacaaaccatgcctacatccaaagccttctcaagcgttaccagccccatcgggtgccttccacctgttgtgccccagtaaaaactaaaccattgtccatgctttatgtggacaacggaagggtactgctggatcaccacaaagacatgatcgtggaagaatgtggctgcttgtag

SEQ ID NO: 29816 - DNA, 879 bp, Artificial Sequence
  Description of Artificial Sequence: Synthetic coding sequence
gaccagcagctggggatccagacaaaggacgtcgccgtggacggccagaattggactttcgccttcgacttcagcttcctgtctcagcaggaagacctggcatgggcagaattgagactgcagctctcaagcccagtagacttgccgaccgagggttccctggctattgagatcttccaccagcccaagccagataccgagcaggcttcagattcctgtctggaacgattccagatggatttgtttacagtcacactcagtcaggtgaccttctccctggggagcatggtgttggaagtcactagacccctatccaaatggctcaaacatcctggcgctctcgagaagcagatgtcgagggtggcgggagagtgttggcctagacctccaaccccgccagcaaccaacgttctcctcatgctgtactctaatctcagccaggagcagaggcagcttggtgggagcaccctgctctgggaggctgagagcagctggcgcgcacaagagggacagctctcgtgggaatggggcaagaggcatcggagacatcatctgcctgaccggagccagctttgccgcaaagtcaaattccaggtggactttaatctgatcgggtggggctcttggattatctaccccaaacaatataacgcctatcgatgtgagggggaatgcccaaatccggtgggggaggaattccaccctaccaaccatgcctatattcagagcctgctgaagcgttaccaaccgcaccgggtgccaagcacctgttgtgccccagtgaagaccaagccactttccatgttatacgtggacaacggcagagttctcctcgatcaccacaaagacatgatcgtcgaggagtgcggctgtctgtag

SEQ ID NO: 29817 - DNA, 534 bp, Artificial Sequence
  Description of Artificial Sequence: Synthetic coding sequence
atggtgctgctgtctaccctgggaattgtgtttcaaggcgaaggacctcctatctcatcctgtgacacaggcacgatggccaactgtgagcgcacttttatcgcaattaagccagacggggtacagcgcggactagtgggggagattattaaacgctttgagcaaaaagggttcagacttgtcggcctgaaatttatgcaggcttcggaggacctacttaaggagcactacgtcgacttgaaagatcggccttttttcgcaggactggttaagtacatgcactctggccctgtcgtcgcgatggtatgggaaggccttaacgtggtcaagacagggagggtgatgctgggagaaacaaacccagctgactccaaaccaggaactatcaggggcgatttctgtatccaggtgggcaggaacattattcatggatcggattccgttgaatccgctgaaaaagagatcggcctatggttccaccctgaagagttggtagactataccagttgcgcccagaactggatctacgagtag

SEQ ID NO: 29818 - DNA, 534 bp, Artificial Sequence
  Description of Artificial Sequence: Synthetic coding sequence
atggtgctactttctactctcggcatagtcttccagggagaaggacctccgatttccagctgcgatactgggacaatggccaattgcgaaagaacgtttatcgccataaaacccgatggcgtgcagaggggcttggttggcgagatcattaagcgcttcgaacagaagggcttcaggcttgttggcctcaagtttatgcaggcaagtgaggatctgctgaaggagcactacgtcgaccttaaagatagacccttctttgctggcctggtaaaatatatgcactccggccctgtggtagctatggtgtgggagggtctaaacgtcgtaaagaccgggcgtgttatgctgggcgaaacaaatccagctgattcaaagcctggaacaatacgaggcgatttttgtattcaggtaggccgtaatatcatccatgggagcgactccgtggagtcggcggaaaaagagataggactgtggtttcatccagaggagctggtcgactacacttcgtgcgcccaaaactggatttatgaatag

SEQ ID NO: 29819 - DNA, 459 bp, Artificial Sequence
  Description of Artificial Sequence: Synthetic coding sequence
atggcaaactgtgaaaggacttttatagcgatcaagccagatggagtgcagcggggactggtaggagagattattaaaagatttgaacagaaaggttttcgactggttgggctgaagttcatgcaggcctctgaagatctgctgaaggagcattatgttgacctgaaagatcgtccgtttttcgccggtttggtgaaatacatgcacagtggccctgtcgtggctatggtctgggagggtctcaacgtggttaagacggggagagtgatgctgggagagactaatccggctgattccaagcccggaacgatcagaggagacttctgtattcaggttgggagaaacatcatccatggttctgacagtgtagagagtgcggaaaaagaaattggtctctggtttcaccctgaagagctggttgactacacgtcgtgcgctcagaactggatctatgaatag

SEQ ID NO: 29820 - DNA, 183 bp, Artificial Sequence
  Description of Artificial Sequence: Synthetic coding sequence
atggtcttgctcagcaccctcggaatcgtgttccagggcgagggcccacctatctcttcctgcgacacagggaccatggcgaactgtgaaaggacattcatcgctatcaaacccgacggagtccagagagggctggttggcgagatcattaagcggttcgaacagaaaggatttaggctgtag

SEQ ID NO: 29821 - DNA, 1443 bp, Artificial Sequence
  Description of Artificial Sequence: Synthetic coding sequence
atggctacagtccccggtctccagccgctgcccaccctggaacaagatctcgaacaggaagagatccttatagtgaaagtcgaggaggatttctgtctggaagaggaaccaagcgtcgaaacagaggacccctctcccgagactttccgccagttgttccgcctcttctgttaccaggaggtggcaggccctcgcgaagccctgtcaagactgtgggagctgtgttgccgctggctcagacccgagctgagaacgaaagagcagatcttagagctgctggtgctggagcagttcctaacagttctccccggtgagatccaggcaagagtgcgggagcagcagcctgaatctggagaggaagccgttgtgctggtcgaaggactgcagcgcaaaccacggaaacatcggcagcggggaagcgagctgctgtcagacgacgaggtgcccttggggatcggtggccagttcctgaaacaccaggccgaagctcagccagaggacctgtctctggaagaggaggccaggttctctagccagcagcctccagcccagctgagtcatcgccctcagaggggcccactcctgtggccagaacggggtccacctgcacctcgccaccaggagatggcctccgccagccccttcctgtccgcatggtcccaggtccctgtcaacctggaagacgtcgccgtgtatttgagtggagaagaacccagatgcatggatcctgcccaaagggacgccccactcgaaaacgaaggccctggtatccagctggaggacggcggagatggccgagaggacgcgccactgagaatggagtggtatcgcgtcctcagtgctcgatgtcagggacccggacaccctttaccaggccagagacctgctcctgtgcggggactggtccgccctgaccaacccaggggtgggccaccccctggaaggagggccagtcatggggcagacaaaccctatacttgtcccgagtgtgggaagggtttttcaaagacttctcatctgaccaaacaccagcggactcatactggggagcggccttacaaatgtctcgtctgcggcaaagggttcagtgataggtccaacttttctacccaccagcgagtgcacacgggagagaagccgtatccatgcccggagtgtggaaagaggttctctcagtcctcttccctggtgatccaccgtaggactcactcaggtgagcgcccatacgcctgtacccaatgcggcaaaagattcaacaattccagccacttctccgcccacagacgaacacacaccggcgagaaaccctacacttgtcccgcatgtgggagagggttccggagaggcactgatctacacaagcaccagcgcacacatatgggcgctggctcactgcctactttgcaaccagtggctccgggaggcccaggcgcaaaggcctag

SEQ ID NO: 29822 - DNA, 588 bp, Artificial Sequence
  Description of Artificial Sequence: Synthetic coding sequence
atgggaggcttgttctggcgtagtgcactacggggactgcgctgcggccctcgcgctcctggcccatctctcctggttaggcatggctccgggcttcccccatctgccttaaaacgagggccaagctggacaagagaaaggacccttgtggccgttaaaccggatggcgtgcaaaggcggctcgttggggatgtgatacaacggttcgagcgcagaggatttactcttgtgggaatgaaaatgttgcaagcgcctgagagcgttttagccgaacactatcaggatttacgcagaaagcctttttacccagcgctgattaggtacatgagttcaggtcccgtggtagccatggtctgggagggctataatgtcgtgcgggcatctagagccatgatcggccacaccgacagcgcagaggccgctccaggcaccattcggggagacttcagcgtccacattagcagaaacgtgattcatgcgagtgacagtgtggaaggcgcacaaagagagatacagctctggttccagtcttccgaacttgtgtcatgggcagacggtgggcagcacagctcaatccatcctgcttag

SEQ ID NO: 29823 - DNA, 354 bp, Artificial Sequence
  Description of Artificial Sequence: Synthetic coding sequence
atgaaaatgctccaggccccagaatccgtgctggccgaacattaccaggacctgagacggaaacctttttacccagcactgatccggtatatgtctagtgggccagtggttgccatggtctgggaggggtataacgtggtgagagctagccgtgctatgatcggccatactgacagcgccgaggcagccccaggcacgatcagaggtgatttttccgtgcacatcagccgcaacgtgatccatgccagcgatagtgtggagggcgcacagagggaaattcaactctggtttcagtcaagtgagctcgtatcctgggcggatgggggacagcactcatcgatccatccagcctag

SEQ ID NO: 29824 - DNA, 510 bp, Artificial Sequence
  Description of Artificial Sequence: Synthetic coding sequence
tagtggcgcagtgctctgcgcggactcaggtgtggcccacgagccccagggccaagtctattggtaagacatggctctggcggaccttcctggacacgcgagaggactctggtggctgtaaagcctgacggtgttcaaagacgactggtgggagatgtcatccaacgttttgagagacgcggatttactctcgtgggtatgaagatgctccaggcaccagagtctgtcctggctgagcattaccaggatttgcggaggaaacccttctatcctgcccttattcggtacatgtcatctgggcctgtggtagcaatggtgtgggagggctataatgtggtccgcgcatccagggccatgatcggccacaccgactcagctgaggcggcaccgggaaccatcaggggagacttttcagtgcacatatcctcgcaccgcttggctcccctcgaccggggtcagagggagcagcaaatggtccccggtataccacagggggcacacgaagcctag

SEQ ID NO: 29825 - DNA, 702 bp, Artificial Sequence
  Description of Artificial Sequence: Synthetic coding sequence
atgggagggcttttctggcgctccgccctgcgcggtctccgatgtggaccaagagcaccgggtccctccctcctggtgcgccacggctccggcggaccttcctggacacgagagcgcaccttagtggccgtcaagcccgacggagtgcagaggcggctggtaggtgacgtgatccagaggttcgaacgcaggggattcacactggtcggcatgaaaatgctccaagcaccggagagcgtcctggcagagcattatcaggacctgagacggaaaccgttttatccagccctcatccgatatatgagctccggtcctgttgtggccatggtatgggaaggatacaacgtggttcgcgcatctagagctatgatcgggcataccgactccgctgaggctgcacccggaacaatcagaggtgactttagtgtccacatctcacgcaacgtcattcacgcatcggacagcgtggagggggctcagcgagagatccagctctggtttcagtcttcggagctaagccccactggcgctccctggccatctcggaggccaacgtggcgtggtaccaccgtatcaccacgcaccgccacttccagtgcccgtacatgctgtggtacaaaatggcccagttctcaagaggcagcactgggcctcggatccggacttctcagattctcttgcgggaccgcagcaatcagatag

SEQ ID NO: 29826 - DNA, 354 bp, Artificial Sequence
  Description of Artificial Sequence: Synthetic coding sequence
atgaaaatgctgcaggctccggaaagtgtgttggccgaacactatcaggatcttagaaggaagccattttaccctgctctaattagatatatgtccagcggcccagtggtggcaatggtatgggagggttataacgtggttcgggctagccgagcaatgatcggccacaccgatagcgccgaggcagcacctggcactatacgcggtgacttttctgtgcacattagtcgcaacgtcatccacgcctctgacagcgtggagggagcccagcgcgaaatccagttatggttccagagctccgagctagtgtcctgggctgatggcggacagcatagttccattcaccccgcatag

SEQ ID NO: 29827 - DNA, 114 bp, Artificial Sequence
  Description of Artificial Sequence: Synthetic coding sequence
atgaagatgctgcaggcccctgagtctgtgctggctgaacactaccaagatctgagaagaaaacctttttacccagccctgatccgctatatgtcctctggtcccgttgtgtag

SEQ ID NO: 29828 - DNA, 195 bp, Artificial Sequence
  Description of Artificial Sequence: Synthetic coding sequence
atgttccttcagtattacctgaacgagcagggagaccgcgtgtacacccttaagaaatttgaccccatgggacagcaaacatgttccgcgcatcccgctcgtttttctcctgatgacaaatattcccgccaccggataacgataaagaagagatttaaggtgctgatgactcagcagccaaggcccgtactgtag

SEQ ID NO: 29829 - DNA, 7668 bp, Artificial Sequence
  Description of Artificial Sequence: Synthetic coding sequence
atgccccctctgctggctcccctactgtgcctggctctcctccctgccctggccgctagaggccctcgctgttcacagcccggagagacctgcctgaacggcggtaagtgtgaggctgcaaatgggaccgaggcttgcgtgtgcggtggggcattcgtcggccctcgctgtcaagaccctaatccctgcctctcgacaccatgcaagaacgccggtacgtgtcacgtggtagatcgccgaggagtggccgattacgcctgcagctgtgcactaggcttctccggccctctctgccttacacctctagacaacgcctgcctgaccaacccctgtcggaacgggggaacttgtgaccttctgacattgactgaatacaagtgtagatgtcccccaggatggtctggcaaatcatgtcagcaggccgatccatgcgcctcgaacccctgcgccaacggaggtcagtgcttaccatttgaggcttcatacatatgccactgccccccaagcttccacggtcccacatgtagacaagacgtgaatgaatgcggacagaaaccagggctgtgtagacatggtgggacatgtcacaacgaggtaggcagctacaggtgcgtgtgtcgcgctacccacacaggcccaaactgcgagcggccttatgttccctgttctccttctccatgccagaacggaggtacctgccggccaacaggcgatgttacacacgagtgcgcctgtctccctgggttcaccgggcagaattgcgaagaaaatatcgatgattgtccgggaaataactgtaagaatggtggagcatgtgttgacggcgttaacacctataactgcaggtgtcccccagagtggaccgggcagtactgcactgaagacgtggatgaatgtcagttgatgcctaatgcatgccagaatggcggtacgtgtcacaatacacatggaggctataattgcgtatgcgtaaatggctggactggagaggactgcagcgagaacatcgatgattgcgcctctgctgcatgcttccacggcgctacgtgtcacgaccgcgttgcttctttctattgtgagtgccctcacggcaggaccgggttgctgtgtcatctgaacgatgcatgtatttctaacccgtgtaatgagggctccaactgtgacaccaatcctgtgaatggaaaggctatttgcacctgcccatcaggatatactggccctgcctgttcacaggacgtggacgagtgctcattgggagccaacccatgtgaacacgccggaaagtgcatcaataccttagggtcttttgagtgtcagtgcctgcaaggatatacaggcccacggtgtgaaatcgatgttaacgaatgcgtgagcaacccatgccaaaacgatgcgacttgcctggatcagattggagaattccagtgcatttgcatgcccggatacgagggagtgcattgtgaagtcaatacagacgagtgcgcatccagcccgtgcctgcataatggcagatgtctggataagataaacgagtttcagtgtgaatgccctactggcttcacaggacacctctgtcaatatgacgttgacgagtgtgcaagtaccccttgcaagaacggcgcaaaatgtttagatggaccaaatacctatacctgtgtttgtactgagggatatacaggcactcactgcgaagtggacatcgatgagtgcgatccagacccttgccactacggatcttgtaaggatggagtagctacttttacttgcctttgccggccaggctatacaggacatcattgcgagacaaatatcaacgaatgcagctcgcaaccctgccgccatggcggtacatgccaggaccgggataacgcctacctgtgcttctgtctgaaagggacgactggacccaattgcgaaattaacctagacgactgtgctagttcaccctgtgactctgggacctgcctcgataaaattgacgggtacgagtgtgcatgcgaacctggctatactggctccatgtgtaacataaatattgatgaatgtgcaggaaatccatgtcacaacggaggaacgtgcgaggacgggatcaacggcttcacatgcaggtgtcctgagggctatcatgatccgacttgcctgtccgaggttaacgagtgtaacagcaatccttgtgtgcacggggcttgtagagactcactgaacgggtacaaatgtgactgcgacccaggatggtccgggacaaattgtgacatcaacaataatgagtgcgaaagcaacccctgtgtcaacggcggaacctgcaaggatatgacctctggctacgtatgcacctgcagagagggattttcaggacccaactgtcagaccaacatcaacgagtgtgcctccaatccttgtctcaaccagggtacgtgtattgatgatgtggctgggtacaagtgcaactgccttctgccatatacgggggcaacctgtgaggtcgtgctggccccttgtgccccaagcccctgcaggaatggaggggagtgcagacagagtgaagattacgagagcttcagctgcgtctgtccaactggttggcagggccagacctgtgaagtcgacattaacgagtgcgtgctctctccgtgtaggcacggcgcatcttgtcaaaacacacatggcggatatcgttgccattgccaggccggatattctggtcgcaactgtgaaactgatatcgacgattgccggccaaatccctgccacaacggcggatcttgtacagatgggatcaacaccgcattctgcgactgcctgcccggattccgaggcacattctgtgaggaagacatcaatgaatgtgcctctgacccctgccgtaatggtgctaactgcacagactgcgtggattcctatacgtgcacatgtcccgcaggctttagcggtatacactgtgagaataatacaccagactgtaccgagagcagttgcttcaatggtggtacctgtgtcgatgggatcaattcattcacctgcctgtgcccgcctggattcacaggatcgtactgtcaacacgatgtgaacgagtgcgatagtcagccctgtctacatggcggtacttgccaggacggttgcgggagttaccggtgtacgtgtcctcagggttacaccggccctaactgtcagaatctggtgcattggtgcgattccagcccatgtaagaacggagggaagtgttggcaaacacacacccagtaccgctgtgagtgcccttcgggatggactggactttattgcgacgtcccatcggtcagttgcgaggttgctgcccagcggcagggagtcgatgtggctaggctttgtcagcacgggggactgtgtgtcgacgctgggaacactcaccactgcagatgtcaagcaggttacacagggtcttactgcgaagacttagtcgacgaatgctccccctcaccatgccagaatggggctacatgcactgactaccttgggggttactcttgtaaatgcgtggccggataccacggggttaactgctctgaagaaatagacgagtgtctgtcgcacccctgtcagaacggcggaacctgcttggacttgcctaatacatataaatgttcctgcccgcgagggacccaaggagtgcactgcgagatcaacgttgacgactgtaatcctccagtggatcccgtctcccgatctcctaagtgctttaacaacggtacttgcgttgaccaggttggagggtatagttgcacatgtcccccaggattcgttggtgagagatgcgagggcgatgtgaatgagtgtctgagcaacccatgcgatgcaagaggtacccagaattgtgtccagagagtgaacgacttccattgtgagtgccgagccggtcataccggtcgcaggtgcgaatctgtgatcaacggctgtaagggaaaaccatgtaaaaacggcggaacgtgtgctgtagcttccaacactgctcggggattcatctgtaagtgtccagcaggcttcgaaggagccacatgcgagaacgatgccagaacttgtggatcgttgagatgtttaaatggagggacatgtatatctggaccgagatctccgacctgtctatgcctagggccatttaccggccctgagtgtcaatttcccgcttcctcaccctgccttgggggaaatccctgttacaaccagggtacgtgtgagcctacctccgagtcaccattctaccgctgcttatgccctgcaaagtttaacggcctgttgtgtcacatcttggattactcttttggaggaggcgcaggacgggacatacctcccccactgatcgaagaggcctgtgagttacccgaatgtcaggaggacgctggtaacaaagtctgttcactgcagtgcaacaatcacgcctgcggctgggacggaggagattgctccctcaactttaacgacccatggaaaaattgcacccagtccctgcagtgttggaagtatttcagcgacggacactgcgattcgcagtgtaattcagcagggtgtctgttcgacggcttcgattgtcagagagctgagggtcagtgcaacccattatatgatcaatattgcaaggaccatttttctgacggtcattgcgaccaaggatgtaatagcgccgaatgcgagtgggatggattggattgcgcggaacatgtccctgaacgactggccgctggtactcttgtggttgtggtgctaatgccacctgagcagctgcgtaactcctcatttcattttctgcgagagcttagtagggttctacacacaaatgtcgtctttaagagggatgcccacggccagcagatgatattcccatattatggtcgagaagaagaactgaggaagcatcctatcaagcgggctgcggaggggtgggccgctcccgatgcccttttgggacaggttaaggccagcctgctgcctggcggatctgagggcggacgaagacggagggaactcgatcccatggacgtgagaggcagcatagtttatctggaaatcgacaataggcagtgtgtacaggcttcttctcagtgtttccagtccgcgactgacgttgccgcttttttaggcgctctagcaagtttgggctcattaaatattccctacaagatagaggccgttcagtcggagacagtggagccccctcctcctgctcaattacattttatgtacgtcgcagcagctgcttttgttctcctgttcttcgttggttgtggggttctgctgtcccgcaaaaggagacgacagcacggtcaactctggttcccagagggctttaaagtgtccgaggcctctaaaaaaaaacgtcgcgaaccgttgggagaggacagcgttggcctgaagcccctcaagaacgcctctgatggagccctgatggacgacaatcaaaatgagtggggggatgaagacctggagaccaagaaattcaggttcgaggaaccggtggtcctgcctgatctggatgaccagacagaccatcggcagtggacccagcagcacttggacgcagcggaccttaggatgagcgccatggcccctactccccctcagggtgaggtggacgcagactgcatggacgtaaacgtgaggggccctgacggcttcaccccactcatgatagcgagttgtagcggaggcggactggagaccgggaatagtgaagaggaggaagacgcacccgctgttattagcgatttcatatatcaaggcgcatctctgcacaatcaaacagatagaacaggagagaccgccctgcacctggccgcaagatactctcgctccgacgcggctaaacgcttgcttgaggccagtgccgatgcaaacattcaggataatatgggacgaacacctctgcacgcagctgttagtgccgatgcccagggcgtcttccagattttaattcgcaaccgagccactgatctggacgctcgcatgcacgatgggaccacccctctgattctggccgctcgtctcgcagtcgaaggtatgctagaggacctcattaactcccacgctgacgtaaacgcggtggatgatttgggcaagtctgccctgcactgggctgccgcagtcaataatgttgatgctgcggtagtgctgctcaaaaacggcgctaacaaggatatgcaaaacaaccgggaagaaactccattgtttttagcagcaagggagggctcctatgaaactgcaaaagtcctattagatcactttgcaaatagggatatcaccgatcacatggataggcttccgagggatatcgcccaggagaggatgcaccacgacatcgtgcgcctgttagacgagtacaacttggtgcgcagccctcagttgcacggcgctccactgggcggaactcctaccctctcgccacctctgtgcagccctaatggctatctggggtctctcaagccaggcgtgcagggcaagaaggtgcgaaagccttcttccaagggactggcttgcggaagtaaggaagctaaggacctaaaggcccgacgcaagaagagccaggatggcaaaggatgtttgctggattcctcgggaatgctgagtcctgtggactcacttgagtctccacatggatacctgtcggatgtggcaagccccccactgctcccttcaccatttcagcagtctccaagtgttcctctgaatcatttgcccggtatgcccgacacacatttgggcatcggacatctgaatgtggcagccaaacccgaaatggccgcactcggcggtggaggacggctcgcgttcgaaaccgggcctcctaggctctcacatctgccagtggcaagtggaaccagcacagtactgggatcaagtagcggcggagccttgaattttacagtgggaggtagtaccagccttaacgggcagtgcgaatggctgtctcggttgcagtcaggtatggtccctaaccagtacaaccctctgcgaggttctgtggcaccaggacctctgagtacccaggcgccatccttgcagcatggcatggttggtcctctccattcttccctggcggcatctgccctgagccaaatgatgtcttatcaggggctgccaagcacaaggctagcaacacagccacacctagtgcaaacacaacaggtgcagcctcagaacttgcagatgcagcaacaaaatctgcagccagccaacatacagcaacagcaatctctgcagcctcccccacccccaccacagccccacctgggtgtctcctcagccgcatccggacacctgggacggtcatttctttccggtgaaccatcccaggcggatgtccagccgctcggaccctcctcactggctgtccacactatcttaccacaggagtcccccgcactcccgacttcattgccgtctagcttggtgccgcctgtaactgccgctcagttcctcactccccctagccagcattcctattcctcccctgtggacaacacacccagtcaccagctgcaggtccctgagcacccgttcctgacaccatcccccgaaagccccgaccagtggagctcttcgtcaccgcacagtaatgttagcgactggagcgagggagtcagtagtccgcctacgtctatgcaatcacagattgccagaatccccgaagcttttaagtac

SEQ ID NO: 29830 - DNA, 6011 bp, Artificial Sequence
  Description of Artificial Sequence: Synthetic coding sequence
atgcagccaccctctctgctgcttttgctcctgctgctacttctactttgcgtcagcgtcgtgaggcctagaggactcctttgtgggtctttccctgaaccttgtgccaacgggggtacctgcctgagcttatccctgggccagggcacttgccagtgcgcacccggattcctaggggaaacctgccagtttccggacccatgtcagaacgctcagctatgccagaatgggggaagctgtcaggccctcctgccagccccactaggccttccctcttctccctccccactgactccttccttcctgtgcacctgcctacccggttttacaggagagcgctgccaggcgaagttagaggacccgtgccccccttctttctgtagcaagagaggcaggtgtcacatccaggcatctggccgacctcagtgctcatgcatgccaggatggaccggagagcagtgccaacttcgcgatttctgcagcgcaaacccctgtgtgaacgggggagtgtgcttagcaacttaccctcagattcagtgtcattgcccccctggtttcgagggtcacgcatgtgagcgtgatgtaaatgagtgtttccaggatccaggcccttgcccgaagggtacaagctgccacaacacacttggcagctttcaatgtttgtgtcccgtggggcaggaaggccctcgctgcgaattgcgagctggaccatgcccaccaaggggctgctccaacggtgggacatgccagctgatgcctgaaaaagactccacctttcatctctgcctgtgtccccctggattcatagggcctgattgtgaagtaaatccagataactgcgtcagtcatcagtgtcagaacggaggcacatgccaggatggcctggacacttacacctgcctgtgccctgagacctggactggatgggattgcagtgaagatgtcgacgagtgtgaaacacaaggccctcctcactgtcgaaatggcggtacttgccagaactctgccggatctttccactgtgtctgcgtgtctggctggggcggtacatcctgcgaggagaatctcgatgactgtattgctgcaacatgcgccccaggtagtacgtgcatcgatcgagtgggctcctttagttgtctttgccctccgggaaggacaggcctgttgtgtcatctggaggacatgtgtcttagccagccatgccatggcgatgctcagtgctcgaccaacccactgacaggcagcacgctgtgcttgtgtcaacctggatacagcggcccaacatgccatcaggatctggatgagtgcctgatggcgcagcagggaccatctccttgtgaacacggcggatcctgcttaaacacgccaggatcctttaactgcctttgccctcctgggtacactggaagtcgatgcgaggctgatcacaatgagtgtctgtcacagccatgccatcctggctcgacatgcctcgacctactggccacgtttcactgcctatgccctcctgggcttgagggtcagctgtgtgaggtggagacaaatgaatgcgcaagcgccccttgtttgaatcacgctgattgccacgatctgttgaatggctttcaatgcatttgcctgcccggattttccggtacccggtgcgaggaagatatcgatgaatgccggtcaagcccctgcgcaaacggtggccagtgccaagatcagccgggagcctttcactgcaagtgcctgccgggatttgaaggccctcggtgtcagaccgaagtggatgagtgcctgtcagacccctgtcccgtcggcgcatcatgcttagatctgcccggtgcctttttttgcctgtgtcccagtgggttcactggacagctttgtgaagtccctctatgtgcccctaacttgtgtcagccgaaacagatttgtaaggaccagaaggacaaggccaattgcttatgtccggacggctcaccgggttgcgccccacctgaggacaactgcacatgtcaccacggccattgccagcgtagctcttgcgtctgtgatgttgggtggacagggccagagtgcgaagcggagctgggaggctgtatctccgccccatgtgcacacggcggtacctgctatcctcaaccttccggctacaattgcacttgccctactggctatacaggccctacatgctctgaggagatgaccgcctgccacagcggcccttgccttaacggcggttcgtgtaatccgagccctggagggtactattgcacatgcccaccctcgcacaccggaccgcagtgccaaacaagcactgactactgtgtgtcagcaccatgcttcaatggcggtacttgtgtgaaccgcccaggcacattctcatgcctgtgcgcaatgggcttccaggggcctcggtgcgaaggcaagctgcggccaagctgcgctgactcaccatgtaggaaccgggctacctgccaggattcaccacagggtccacggtgcttgtgccctacagtgtacaccgggggaagttgccaaactctgatggacctctgcgctcagaagccgtgcccacgaaatagtcactgcctgcaaacaggacctagtttccattgcttgtgcctgcaaggttggactggaccactgtgcaatcttccactgagttcctgccagaaggctgctctatcacagggcatagacgtgagcagtctgtgccataatggcggtttgtgcgtggacagtgggccttcatatttttgccattgccccccaggttttcagggatccctgtgtcaggaccatgtgaatccttgtgagagcaggccttgccagaacggtgcaacctgcatggctcagccttccggatacctatgccaatgtgcaccgggttatgacggccagaattgttcaaaggagttggatgcttgtcagtcccagccatgtcataatcacggcacctgcacacctaaacccggagggtttcactgcgcctgcccccctgggttcgtgggcctgcggtgtgagggagatgtggacgaatgccttgatcagccttgccatcccaccggaacggcagcatgccactccttagccaacgccttctattgccagtgcctgccaggtcacacgggccagtggtgcgaggtggagatcgatccgtgtcattctcagccttgctttcatggcggtacttgcgaggcaactgccggttccccactaggattcatctgtcactgccccaaaggcttcgagggcccaacgtgctctcacagagcaccaagctgcggcttccaccactgtcatcatggaggtctgtgcctgccctctcccaagcctggatttccaccacggtgcgcatgcttatcgggctacgggggaccggactgcctgacacctccagcgccaaaaggatgcggccctccttctccttgcttgtataatggctcttgctctgagaccactgggttgggcggtcctgggttcaggtgtagctgtcctcacagttcacctgggcctaggtgtcaaaagccaggcgcaaagggctgcgaaggacggtcaggtgacggtgcctgtgatgccggatgttcaggacctggcggaaattgggacggcggagattgcagtcttggggtcccagatccttggaagggctgcccatcccactctcggtgttggctactgtttcgggatggccagtgccacccacagtgcgattcagaggaatgtctgttcgacggatatgattgtgagacccctccagcctgcaccccagcttacgatcaatattgccatgaccattttcataacggacattgtgagaaaggatgcaacacagccgaatgcggctgggatggcggagattgccgcccagaggacggggaccctgagtgggggccttcgctggctctcctggtcgtcctttcaccccctgccctcgatcagcagctgtttgccctcgctagggtcttatcgctaactctcagagttgggctatgggtgcgcaaggatagggatggacgtgatatggtgtacccatatcccggagccagagccgaagagaaactggggggaacacgcgaccccacataccaggaacgcgcagctcctcagacacaaccattggggaaggaaacagatagcctatctgcagggtttgtggtcgtgatgggcgtcgatcttagcaggtgcgggcctgaccaccccgcaagcaggtgcccctgggaccccggactcctgctccggttcctcgcagctatggccgcagtgggtgctcttgaacctctgctcccgggtccattgctcgctgttcaccctcacgccggaactgctcccccagccaaccagctgccctggcccgtgctttgctctcctgtggccggagttattctgctggctctgggcgcactgcttgtcctacagctgatcaggcggcgtagacgcgagcacggggcactgtggctgcctccaggcttcacccggaggcccagaactcaatcagcccctcataggcgacgcccacctcttggggaggattcaatcggactaaaagccttgaaacccaaagcagaagtggacgaggacggtgttgttatgtgtagtggcccagaagagggcgaggaagtgggccaggccgaagagacaggcccaccatccacctgccagctatggagcctgagtggcggatgtggtgccctcccccaagcagctatgcttaccccccctcaagagtcagagatggaagcacctgatctggatacgagaggccctgatggtgttactcccctgatgtccgcggtctgttgcggtgaagtgcagtccggaacattccagggggcatggctgggctgccctgaaccatgggaacctctacttgatgggggagcctgccctcaggcccataccgtgggaaccggagagacccctctgcacctggcagcgagattttctcgacctaccgccgcaagaagactgctggaagcgggagccaaccctaatcagcctgaccgggctggtcgcacccctctgcacgcagcagtagccgctgatgcccgtgaggtgtgccagttattattaaggtcacggcagaccgccgtggacgccagaactgaagatggcaccactcccctaatgctggccgctcgactcgctgttgaagacctagtcgaggagctgattgctgcccaagccgatgtgggcgctagagataagtggggaaagaccgccctgcattgggctgccgctgtgaataacgcaagagcggcacgctccctactgcaggcgggtgcagacaaggacgctcaggacaaccgcgagcagacacctctgtttctagccgctcgggaaggcgctgtagaagtggcgcaattgctcttgggcctgggtgctgcccgtgaattgcgggaccaggcgggtcttgcccctgccgacgtggcccatcagaggaatcattgggatcttctaactcttctggagggcgcaggacctcccgaagcacggcataaagccactcctggcagggaggccggacctttccccagggctagaaccgtgtcggtctccgtcccacctcatggcggaggcgctctgcctcgctgtagaaccctgtccgcaggagccggaccccgaggaggtggtgcctgtctgcaggccaggacatggtcagtagatttagctgctcgagggggaggagcgtactctcattgtcggtctctgagcggtgtaggcgcaggaggcggacccactcctcgcggtaggagattttcagccggtatgagggggcctaggccaaatccagccattatgagaggccgatacggcgtcgctgcaggtcgtgggggtagagtgtcgaccgacgattggccctgcgactgggtcgccctgggagcgtgtggatcagcgtctaacatccccatccctcctccatgcctgactccatcccccgaaaggggatcccctcagcttgactgcgggcctcctgcactgcaggaaatgccaatcaatcaaggaggcgaaggcaagaaata

SEQ ID NO: 29831 - DNA, 561 bp, Artificial Sequence
  Description of Artificial Sequence: Synthetic coding sequence
atgagcgccgtatgctgtggggaagtgcaatccggaacctttcagggggcatggctgggatgccctgaaccctgggagccattgctggacggcggagcctgtccacaagcccatacagtaggtacaggggaaacaccattgcacttagccgcacggttctctcggccaactgcggcacggcgtctgctggaggccggagccaaccccaaccagccagatagagctgggagaacgcctctgcacgcagctgtggccgcagacgctcgggaggtctgccagttgctactaaggagcaggcagactgctgtagatgcgagaaccgaagatggtacaacgcccttgatgttggctgccagactcgccgtagaagacctggtggaggagcttatagccgctcaggcagatgtgggcgcacgcgacaaatggggagccgatgcggctatcccaggaggcgcaggccgaagtggaggatctagtccggcaaccgccggagccggtggcagcccccgtgctgctggacccggatgggcaagcgctggagggagaaggagtccaacatag

SEQ ID NO: 29832 - DNA, 1734 bp, Artificial Sequence
  Description of Artificial Sequence: Synthetic coding sequence
atgcactggctgagaaaggtccaagggctctgcactctgtggggtactcaaatgtcctcgagaactctgtatatcaattctagacaattggtatcgctccagtggggacaccaggaggtccccgcaaaattcaattttgcctcagatgtgcttgatcactgggccgacatggagaaggcgggaaaacgactgcccagtcctgccctctggtgggtaaatggcaagggtaaggaactgatgtggaatttcagggagttaagcgaaaacagccagcaggccgcaaacgttctgtcaggggcttgtggactccagcgcggtgacagagtggcagtggtcttgcctcgcgtaccagagtggtggcttgttatcttgggctgcattagggccggactaattttcatgccgggaacaattcagatgaaatctactgacattctttacagattgcagatgtccaaagcaaaggcgattgtggcaggggatgaagtaatacaagaggtagatacagtcgcctcagagtgcccgagtctcaggataaagcttctagtttctgagaagtcatgtgacgggtggcttaatttcaaaaagctgctcaatgaagctagtaccactcatcactgtgtggagaccggaagccaggaggcctctgcgatatacttcacctctgggacttcagggctcccgaaaatggcagagcatagttactctagcctcgggcttaaggcgaagatggacgccggttggacgggtttgcaggccagcgatattatgtggaccattagcgacacgggatggatcctaaatatcctctgcagtctgatggagccatgggctctcggggcttgcaccttcgtccacctgctcccaaaatttgacccattggttattctaaagactctcagcagctacccaataaaatcaatgatgggcgcaccaattgtttatcgaatgctccttcagcaggatctgtcctcatacaagttccctcatcttcagaactgcgtaactgtcggggagagtctgctgcctgagacccttgaaaattggcgagctcagactggcctcgacatccgggagtcctacggccagacggaaaccggacttacatgtatggtgtctaagacgatgaagattaagcctggttacatgggaacagccgctagctgctatgatgtgcagatcatcgacgataaagggaacgtcctgccgcctggcacagaaggcgacataggtatcagggtgaagcccattcggccaataggtatcttctctggatacgtggataatcctgataaaaccgcggcaaatatacgaggtgatttttggctcctgggtgacaggggaataaaggatgaagatggatattttcaattcatgggtcgcgcaaacgacatcattaactcgtcaggataccgcattggaccttcagaggtcgaaaacgccctgatggagcatcctgcagtcgtcgagaccgccgtgatcagcagtccagatcccgtacgcggagaagtcgtgaaagccttcgttgtactcgcatcacagtttttgtcccacgatcccgaacaattgactaaagaactgcaacagcatgtcaaatccgtgactgccccatacaagtatcccaggaagattgagttcgttttgaaccttccaaaaacagtgaccggaaaaatccagagagctaaactgcgggataaggaatggaaaatgagtggcaaggccagggcccagtag

SEQ ID NO: 29833 - DNA, 4368 bp, Artificial Sequence
  Description of Artificial Sequence: Synthetic coding sequence
atgggcggtgcctgtagcagctttacaacatcttcttcccccacaatttatagtacttcggtcacggatagtaaggcaatgcaggtcgaatcctgcagctcggccgttggagtgtccaaccggggagtgagtgaaaaacagttgacatctaacacagttcagcaacacccgagcaccccaaagcggcatacggtgctctatatctccccccctccagaggatcttctcgacaactctcgaatgtcttgccaggatgagggctgcggcctagaatcggagcagtcatgtagcatgtggatggaagactcaccatctaacttctcaaacatgtcaacatcgagctataatgataacaccgaagttcctagaaagagccgcaaacggaacccaaaacagagacccggtgtaaagcgaagggattgcgaggaatctaatatggatatctttgatgcagatagcgccaaagcgccacactacgtgctgtctcagctgactaccgataacaaaggcaacagcaaggcagggaatggcactctcgagaaccaaaagggcaccggagtgaagaaatcgcctatgctgtgtggacagtaccctgtgaaatccgaaggcaaggagctgaaaatcgttgtccagcccgagacacagcatagggcaagatatctcacagagggatctcgtggttccgttaaagaccgtacccaacagggctttcccacagtcaaactcgagggacacaatgaacccgtggtcctgcaggtgttcgtagggaatgattccggccgtgtaaaacctcacggtttctaccaagcttgcagagtgacgggcaggaacaccactccctgcaaggaagtcgatatcgagggcactacagtgatcgaggtggggctggacccatcaaataatatgacgttggcagtagattgcgttggcatcctcaagctgcgcaatgccgacgtggaggccagaatcggcatagccggtagcaaaaagaaaagtaccagagcacgcctggtcttccgagtgaatataatgcgtaaagatgggagtactttaacccttcagaccccaagcagtcccattttatgtacacagcccgctggcgtgcccgagattttaaaaaaatcccttcattcatgctcggtcaaaggtgaggaagaagtctttctgatcggtaagaattttctaaagggaactaaggtgatttttcaagaaaatgttagcgatgaaaactcctggaaatccgaggctgagatcgatatggaactgttccaccagaatcatctgattgttaaagtgcccccataccacgatcagcacataacccttccagtgagtgttggcatatacgttgtgacgaacgctggcaggagccacgatgtccagccctttacctatactcccgaccccgcagctgccggtgctcttaacgtcaatgtcaagaaagagatcagctcgccagctcgtccttgtagctttgaggaagcaatgaaagcaatgaaaacgaccggttgtaacctagacaaggtcaacattattcctaatgccttaatgacacccctgatcccctctagcatgatcaagagtgaggacgtaacgccaatggaggtgacagccgaaaaaaggtcaagcactattttcaagactacaaaaagtgtcggaagtactcaacagacacttgaaaatatttcaaatatcgcaggcaacggcagctttagctcccccagtagtagtcatctgcccagtgagaatgagaagcaacagcagattcaacccaaagcttataaccccgaaaccctgaccacgattcagactcaagatatcagtcagcccggaaccttcccagctgtttccgccagcagccagttgcctaactcggacgctttacttcagcaagctactcagtttcaaactcgcgaaacccagtctagggaaatcttgcagtcggatgggactgtggtaaatctgagccagcttacagaggcttctcagcagcagcaacaatctcctcttcaggaacaggcccagactttacagcagcaaataagtagcaacatctttcctagtcccaactctgtgtcacagctgcagaacacgattcagcagctgcaagcaggatctttcaccggaagcactgctagcggcagctccggtagcgtggacctggtgcagcaggttttagaggcccagcagcaactgagctccgtgctgtttagcgcacctgatggaaatgagaatgtacaagaacagctttcggccgacatcttccagcaggtctcgcagattcaaagcggggtctcacctggaatgttcagctcaacggagcctactgtgcacacccggccagacaacttactgcctgggagggcagagtcagtccatccccagtccgaaaataccctttccaaccagcagcagcagcagcaacagcagcaacaggttatggagagctcagccgcaatggtgatggagatgcaacaatctatatgtcaggcagcagcccagattcagagcgaactatttccctccacggccagcgctaatgggaacctgcagcagagtccggtgtatcagcagacaagccatatgatgtcggccctttccaccaatgaagacatgcagatgcagtgcgagctgttctcaagtccacccgctgtaagcggaaacgagacatccactactactacccagcaggtcgccactcccggaacaaccatgttccagacctcctcttctggtgatggagaggaaactggaacccaggccaaacagattcagaacagcgtcttccagactatggtgcagatgcagcactccggcgacaaccagccccaggtcaacttgttctctagcactaagagtatgatgtcggtgcagaattcagggacgcagcagcagggtaacggcctgttccagcagggaaatgagatgatgtccctgcagtccggcaattttcttcagcaatctagtcatagccaggcacagctgtttcatccacagaatcctattgctgacgcacagaatctttcacaagagactcaaggtagtctgttccactcacctaatccaatcgtacactcccagacctctactaccagttccgagcagatgcagcctcccatgttccattcccagagcacgatcgccgttctccaggggagctcagttcctcaggatcagcagtctacaaatatatttctttcccaaagtcctatgaataacctgcagacaaacacagtcgcacaggaagcattcttcgcggcacccaactccatttcccccctacagagtacatcaaatagtgagcagcaagcagctttccagcagcaggcccctatttctcatatccagacacctatgctgtcacaagagcaggctcagccccctcagcaagggctgtttcagccacaggtggcattggggtctctcccaccgaaccctatgccccaatctcagcagggaacaatgttccaatctcagcactctatagtggctatgcagagcaattctccctcacaggagcagcagcagcagcagcagcagcaacagcaacagcagcaacagcaacagcaatccatactgttcagcaaccagaacacgatggccaccatggccagtccgaagcagccacctcctaatatgatttttaaccccaatcagaatcctatggcgaaccaggagcagcagaaccagagtatatttcaccagcaatcaaacatggcacccatgaatcaggagcagcaaccgatgcagtttcagtctcagagcaccgtttcatccctccaaaaccccggacctacccagagtgagagctctcagacccctctcttccactcctcacctcaaatccagttggttcagggtagcccgagcagtcaggagcagcaagtgaccctgttcctgagtccagcatccatgtctgctctgcagacgtctatcaatcagcaggacatgcagcagagtcctttgtatagcccgcagaataatatgccaggtatccagggagctacgtcctccccacagccccaagccactctctttcacaacactgccggtgggaccatgaatcagctgcagaatagccctggttcatcacagcagaccagcggaatgttcctgtttgggatccagaataattgcagccagctactaacaagcgggccagctacgctgccagaccaactcatggctatctcacagccaggacagccacagaacgagggacagccgcctgtgactactctcctcagccagcagatgcctgagaattcacccctcgcaagcagcattaatacaaatcagaacatcgaaaaaatcgatctgctggtgtcactgcagaatcagggaaacaatctcacaggctctttctag

SEQ ID NO: 29834 - DNA, 4647 bp, Artificial Sequence
  Description of Artificial Sequence: Synthetic coding sequence
atgccgtccgattttatctcattactatccgccgatctggacctggagagtccgaagagcctgtacagccgggactccctcaagctgcatccttcccagaactttcatcgcgctggcctgctggaggaaagtgtgtacgacctgctccccaaagagctacagttgcccccatccagggagacatcagttgccagtatgtctcaaacttccggaggcgaggctgggtcacctcctcctgccgttgtggcagcggatgcgtctagtgctccgtcaagctccagcatgggtggagcctgttctagctttaccacaagtagttcacctacgatttattctacaagtgtgaccgattccaaggcaatgcaagtggagagctgtagcagcgccgttggtgtctcgaacaggggggtctccgagaagcagctgacaagcaatactgtccaacaacatcccagcactcctaagaggcatacagtcctatatatttctccgccaccagaggacctgctcgacaattcccggatgtcgtgccaagacgagggatgcggccttgagagtgagcagtcttgcagtatgtggatggaagattctcctagtaatttttcaaacatgtcaacatccagctataatgataacactgaagtccctagaaagtctagaaagcggaaccccaagcagagacccggagtgaagcgccgagattgtgaagaatctaatatggacatctttgacgccgactcagctaaggcacctcactacgtgctgtctcagctgacaactgacaacaaaggcaacagcaaggcaggtaatggaactctggagaatcaaaagggcacaggggtgaaaaaatcgccgatgctgtgtgggcagtaccccgtcaagtctgagggcaaggaactgaaaatcgtggtgcagccggagacccagcaccgggctcggtacttaactgaggggtctcgtggatcagtcaaagaccggacgcagcaaggctttcccacagtgaaactggagggccacaatgaaccagttgtgttgcaggtatttgtaggtaatgattctggcagagtgaaacctcacggattttatcaggcgtgccgggtgacggggaggaacactacgccatgtaaagaggtcgacattgaggggaccacagtaattgaggttgggttagatccctcaaataatatgaccctggctgttgattgcgtgggcatccttaaactccggaacgcggacgtcgaagcaaggattggtatcgctggatctaaaaagaaatctacccgggcacgcttggtatttagggtgaacataatgaggaaggacggatcaactttaaccctgcagacacccagctctcccattctgtgtacacaaccagcaggtgtcccagagatactgaagaagagcttgcattcctgctcggtgaagggtgaagaagaggtgttcctgatcggaaagaacttcctcaaggggaccaaagtaatcttccaggagaacgtgtccgatgaaaattcctggaagagcgaggcagagatcgacatggagctctttcaccaaaatcaccttatcgttaaggtgccaccctatcatgatcagcatattaccctacccgtgtcggtgggcatctatgtggtcacgaacgcagggagaagccatgacgtacagcctttcacatataccccagacccagccgcaggcgctcttaacgtgaacgttaaaaaagaaattagcagtcctgccaggccttgttcctttgaggaggcgatgaaggcaatgaaaacgactggatgcaatcttgacaaggtgaacattatccctaacgcattgatgacacccttgatccctagtagcatgatcaagagtgaagatgtgacaccgatggaggtgacagcagagaagagaagttctaccatcttcaagacgactaaatctgttggcagcacccagcagactctggagaatattagtaacattgccggtaacggttctttctctagtccctcgtcaagccatctcccttctgagaacgaaaagcagcagcagatccagcccaaggcctacaaccctgagacactgaccacgatccagactcaggatatctcgcaacccggaaccttccccgctgtcagtgcctcctcgcagctgccgaactcggacgccttgttgcaacaggctacacagtttcagacccgagagacccagtctcgcgagatcttacagtctgacggtactgtggtgaatctgtcccagctcacggaggcctcccagcagcagcagcagtccccactacaggagcaggcacagaccctgcagcagcagattagctccaatatctttccaagtcccaacagcgtttctcaactgcagaatacaatccagcagctccaggcgggatctttcaccggatccacggcaagcgggagttccgggagtgtggaccttgtgcaacaggtcctcgaggcacagcagcagctctcatcggttctcttcagtgcccctgacggtaatgagaacgtgcaggaacagctgagtgccgacatcttccagcaagtgtctcagatccaatccggggtcagtccagggatgtttagctcaacagaacccactgtgcacacccggcctgacaacctgctgcctggtcgtgctgagagcgtccaccctcagtccgagaacactctatccaatcagcagcagcagcagcaacaacagcagcaggtgatggagtccagtgctgccatggtgatggagatgcaacagagtatctgtcaggctgcagcccagattcaaagtgagctgttcccttccaccgcgtctgccaacgggaacttacagcagtccccagtgtatcagcagaccagccatatgatgagtgctttaagtaccaacgaggatatgcagatgcagtgcgaactgttctccagccctcctgctgtttctggaaacgagacttcaacaaccacaactcaacaggtcgcaactcccggaactactatgtttcaaacaagctcaagcggggacggcgaggaaactggcacccaggcgaaacagatccagaattcagtgttccagacgatggtgcagatgcagcactccggcgacaatcagccacaggtgaatctgttctcttctactaaatccatgatgagtgtgcaaaattctggaactcaacagcagggcaatgggttattccagcagggcaacgaaatgatgagtctgcagtccgggaattttctgcaacaatccagccattctcaagcccagttgtttcaccctcaaaacccgatcgccgatgctcaaaacctcagccaggaaacacagggttcgctctttcacagcccgaaccccatcgtccacagccagacttcaaccacaagctccgaacagatgcaacctccaatgttccatagtcagtcaacgatcgccgtgctgcaggggagcagcgttccgcaggaccagcaatccactaacatcttcctctcgcagtcaccgatgaacaatctgcagacaaatactgtcgcacaggaagcgtttttcgccgcacccaactccatatcacctcttcagtcaactagtaattctgagcagcaggcagcatttcaacagcaagccccaatatcgcatattcagacacctatgcttagccaggagcaggcacagccgcctcagcaagggttattccagcctcaggtcgccctgggctccctgccacccaatcccatgccccagtcccaacagggaaccatgtttcaatcacaacacagcattgtagccatgcagtcaaatagcccgagccaagagcagcagcagcagcagcagcagcaacaacaacagcagcagcaacagcagcagagcatcctcttttcgaaccagaataccatggccaccatggcaagcccaaaacagcctccgcctaacatgatcttcaacccaaatcagaaccctatggcaaaccaggagcagcagaaccaaagtatctttcaccagcagtccaatatggctcctatgaatcaggagcaacagccaatgcagttccagtcccaaagcactgtgtcgtctctgcagaatcccggtccaacacagtccgagagttcacagacacccttgtttcactcgtctccccagattcaactagtgcagggctccccttcatcccaggaacaacaggttaccctgtttttgtccccagcctcgatgagcgctctgcagacatcaattaaccagcaggatatgcagcagtcacccctgtattctccccagaacaacatgccgggaatccagggtgcaacaagcagcccacagccgcaggccactctctttcataacaccgccggagggactatgaatcagctgcagaatagtcccggttcatctcagcaaacttccggaatgtttctctttggcatacagaacaattgtagccagctgctgacatccggaccagctacactccctgaccagcttatggctatttcccagcccggacagccacagaacgagggccagccgcctgtgaccacgcttttatcccagcagatgcccgagaatagccctcttgcatctagcatcaatactaaccagaacatagaaaagatcgatttgctggtgagcctgcagaatcaggggaataacttgaccggatctttttag

SEQ ID NO: 29835 - DNA, 4367 bp, Artificial Sequence
  Description of Artificial Sequence: Synthetic coding sequence
atggggggagcctgcagcagctttactacatctagtagtcctaccatatactctactagcgttacggatagtaaggcaatgcaagtcgaatcttgtagtagcgctgtgggcgtcagtaacagaggcgtcagcgagaaacagctgacaagtaataccgtgcagcagcacccttcaacccctaagaggcacactgtcctttacattagcccacccccagaagacctgctagacaacagtaggatgagttgccaggacgaagggtgcggcctggaaagcgagcaatcatgctctatgtggatggaagactccccaagcaactttagcaatatgtccacttcatcgtataatgacaatactgaggtccccaggaagtcacgtaagcggaaccccaaacagcggccaggagttaaacgcagggactgcgaagaatctaacatggacatatttgatgcagacagcgcaaaagccccacactacgtgctgtcacaactgacaactgacaataaaggaaatagtaaggccggtaatggtacactggaaaatcagaagggtaccggagtcaagaagagtcctatgctctgcggacagtaccctgtcaagtcagaaggaaaggagttaaaaattgtggtccagccagaaacacagcacagagcccgatatttgactgaaggcagcagaggcagtgtgaaagacaggacacagcagggctttccaaccgtgaagctggaagggcataacgagccagtagtgttacaggtatttgtcgggaatgattctggtcgtgtgaaacctcacggcttttaccaggcttgccgtgtcaccggcagaaacacaacaccttgcaaagaagttgatatcgaaggaaccactgttattgaggtcggactagacccttccaacaacatgaccctcgctgtagattgcgtcggcatcttgaagttgaggaacgcggatgtcgaagcgcgaatcggcatcgccggtagcaaaaagaagtctacccgtgctagactggtatttcgagtgaacattatgcgcaaggacggatcaacactgaccctgcagactcctagctcaccgatcctctgcacccaacccgctggggtgcctgagatcctgaagaaatctctgcacagctgcagcgtgaaaggtgaggaggaagtatttcttattgggaagaactttctgaagggcactaaagtgattttccaggagaacgtttctgatgaaaattcttggaaaagcgaagccgagatagatatggaactgttccatcagaatcacctcatcgtgaaagtacccccttatcatgaccagcatattaccttaccggtttccgtggggatttatgttgtgaccaacgctggccgttcgcacgatgtacagcccttcacgtatacacctgaccctgctgccgctggggctctgaacgtgaacgtgaaaaaagagatatcaagccccgctaggccctgctcgttcgaggaagcaatgaaagcaatgaagaccaccggttgtaacttggataaggtgaacattattcctaatgcactcatgactcctctgatacccagctctatgatcaagtcagaggacgtcacacctatggaggtaaccgcagagaaaagatcttccacgatttttaagaccaccaagtctgtcggatcaacacaacagactttagagaacatcagcaatattgccggaaacggtagcttttcctctccctcgagtagccatctaccaagcgaaaacgagaagcagcaacagattcagccaaaagcctacaatccagagacactcacaactatccagacccaggacatcagtcagcccggtacctttcctgcagttagtgctagcagccaactacctaactcagatgcccttctccagcaggcaacccaatttcagacaagagagacacagtcccgcgagattctgcaatctgatggaacagtggtcaacctgtcccagctgacagaggcgagtcagcagcaacagcagagccctctgcaagagcaggctcaaactctgcagcagcaaatttcttctaatatctttccttcgccaaactctgtgagtcaactacaaaacaccatccagcagctccaggcaggctccttcacgggttccacagcatcaggaagctctggctccgtggatctggttcaacaggttctggaggcccagcagcagctgtcctccgtcctgttctcggcacctgacgggaacgaaaacgtacaggagcaactgagcgctgacatctttcagcaggtatcacagattcagtctggtgtgagtcccggaatgttctcttctacagaacccaccgtgcatactcgcccagacaatctgcttcccggtagggcagagtctgtacacccccagtctgaaaacactcttagcaaccagcagcagcagcaacagcaacagcaacaggtgatggaaagcagcgccgctatggttatggaaatgcagcagtcaatctgtcaggctgccgctcagatccagtccgaactcttcccatccactgctagcgctaacggaaacctacagcagtctccagtgtaccagcagacctcgcacatgatgagcgctctttcaacaaacgaagacatgcagatgcaatgtgaactcttctccagcccccctgcagtcagcggaaatgaaacaagcacgaccactacccagcaggtagccacacctggcaccacaatgtttcagacatcttcaagcggggatggggaggagaccggcactcaggccaaacagatacaaaattccgtgttccagacgatggtccaaatgcaacactcgggcgacaatcagccccaggtgaatctctttagctccacaaaatccatgatgagcgtacaaaacagtggtacacagcagcagggcaacggcctgtttcagcaaggtaacgaaatgatgagcctgcagtcaggtaatttcctgcaacagtcttctcattcacaggctcaacttttccatccccagaatcctatagccgatgctcagaacctgtcgcaagaaacacagggcagtctgtttcacagccccaacccgattgttcactcacagacctctaccacaagtagcgagcagatgcagccaccgatgttccattcccaaagcactatcgctgtcttgcagggaagcagcgtcccgcaggaccaacagtcaacaaatatcttcttgagccaatcgcccatgaacaaccttcagaccaacactgtggctcaggaggcattctttgcggctccaaactccatttcccctctgcaatctaccagcaacagcgaacagcaggctgcgtttcagcagcaggcccctatcagccacattcaaacacctatgctgtctcaagagcaggcacagcctccacaacagggcctcttccagccccaggtagccctcgggtccttgcctcccaaccctatgccacagtcccagcagggaaccatgtttcagagccagcattccatcgtagccatgcagagcaacagtccttcccaagagcaacaacagcaacagcaacaacagcaacaacagcagcaacaacaacagcagtcgatcttattctctaaccagaacaccatggcaacaatggcttctcccaaacaaccccctcctaatatgatctttaatccaaatcagaaccctatggcaaatcaggagcagcagaatcagtctattttccatcagcaaagtaacatggcacctatgaatcaggaacagcagcctatgcagttccagtctcaaagcaccgtgtctagcttacagaaccctggacccacgcaaagtgaatcctcccaaacgccgctctttcacagcagcccgcagattcagttagtccaaggcagtcctagcagccaagaacagcaagtgacattgttcctctcgccagcttccatgtctgcgctgcaaacatccatcaatcagcaagacatgcagcagtcgccattatacagtcctcagaataacatgccagggatccaaggcgcaacttctagcccacaaccgcaggccactctgtttcataatacagcaggtggcactatgaatcagcttcaaaactcccctggcagttctcagcagaccagcgggatgtttctgttcgggatccagaacaactgcagtcaactgttgacctccgggccagccactctgcccgatcagctcatggctatttcacagcccggacagcctcaaaatgagggtcaacccccagtgacaactttgttaagccagcagatgcccgaaaatagcccattagcaagctcaattaacactaaccagaatattgagaagatcgacctgttagtgtccctgcaaaaccaagggaataaccttaccggcagcttcta

SEQ ID NO: 29836 - DNA, 4595 bp, Artificial Sequence
  Description of Artificial Sequence: Synthetic coding sequence
atgccatctgactttatctctctgctctccgccgacttggatctcgagagcccgaagtcgttatattccagggagtctgtgtatgacctcctaccaaaggagcttcagcttcctccttcacgcgagacgagcgttgcttcaatgtcacagacttccgggggagaagcgggaagcccacccccagctgtggtggctgctgatgcttcatccgccccaagctcttcctctatgggaggcgcttgctcgagtttcacaacttccagttcccctaccatatacagcaccagcgtcactgatagtaaggctatgcaggtggagagctgcagcagtgctgtcggtgtcagtaataggggggtgtcagaaaaacagcttacctctaataccgtgcaacagcaccctagcacacccaaacggcacaccgtcttgtacatcagcccaccccctgaggatctgctggacaatagcagaatgtcctgccaagatgaggggtgtggcctcgaaagcgagcagtcatgcagcatgtggatggaagacagcccgtctaactttagcaatatgtccacttcatcatacaacgataacactgaagtgcccagaaagtcgcgcaagagaaaccctaaacagagacccggagtgaaacgcagagattgcgaagagtcaaatatggacatcttcgacgccgattccgcgaaggctccacactacgtcttgtctcagcttacgactgataataagggcaacagcaaagcaggtaatgggacacttgagaaccagaagggtacaggcgtgaagaaaagccccatgctctgcggacagtatccagtcaagagtgagggcaaggaactcaagattgttgtgcagccagagacccagcacagggcgcgatacctgacagaaggcagtaggggcagcgtgaaagaccgaacacagcaggggttcccgaccgtcaagctggaagggcataatgaacccgtagtcttgcaggtgttcgtgggaaatgactcgggcagagtgaagccccacggattctatcaagcatgcagggtgaccgggaggaacacaaccccctgtaaagaggtggacatagagggcacaacagtgatcgaagtgggactcgacccaagtaacaacatgacactggcggttgactgcgtgggaatactcaaactgcggaacgctgacgtcgaagcacgaatcggaatagctggcagtaagaaaaaaagcaccagagccaggctggtctttcgggtcaacatcatgaggaaggatgggtccacccttacgcttcagacccctagctcccctatcctgtgcacgcagccggcaggagtgcctgaaattctaaagaaaagcctccatagctgcagcgtgaagggcgaggaagaggtcttcttaataggcaagaacttcttgaagggcaccaaggtcattttccaggaaaacgtatctgacgagaactcctggaaaagtgaagctgaaattgacatggaattgttccatcagaaccacctgatcgtgaaggttcctccttatcatgatcagcatatcacactgcccgtgagcgttggcatttatgtcgtcactaatgccggacgctctcacgatgtgcagccctttacctacacaccagatcctgccgctgctggtgcgttgaacgttaacgtgaaaaaggagattagctcccctgccaggccatgcagtttcgaggaggcaatgaaagccatgaaaactactggatgtaatttggacaaggttaatataatccccaatgccctgatgacaccccttatcccctcctcaatgataaaaagtgaggatgttactccaatggaggtcaccgcagaaaaacgaagttcaaccatttttaaaactaccaaatccgttggttctacccagcagactctggagaatatcagcaatatcgcaggaaacggctcattctcgtctccatcttcttctcatctgccatcagaaaatgagaagcagcagcagattcagcccaaagcatataaccctgaaaccctgaccacgattcagacccaggacatctcacagccaggaacatttcccgctgtgagtgccagctcgcagctccctaacagtgatgctcttttacaacaggccacacaattccagactagagagacccagagtcgcgagatactccaatccgatggcacggtggtgaacttgagtcagctcacagaagcgtcacaacaacagcagcagagtcccctccaggagcaagcccagaccctgcagcagcagatttcctcaaatatctttccatcccccaacagtgtcagtcagttacagaatactatccagcaattacaggctggttctttcaccgggtcaactgctagcggtagtagcggaagcgtcgatctcgtgcagcaagttttagaagcccagcagcagttgtcatcagtcctgttctccgcacccgatggaaacgagaacgtccaagaacagctgtctgccgacatatttcaacaggtgtcacagatccagtccggcgtttcccccggtatgtttagtagcactgagcctacggtccacaccaggccggataatctgttaccgggtagagccgagtcggtccaccctcaaagtgaaaacactcttagtaaccaacagcaacagcagcaacaacagcagcaggttatggagtcaagcgccgctatggtaatggaaatgcagcagagtatttgccaggccgctgcccagattcagtcagaactctttcctagcactgctagtgccaatggcaacttgcaacagagtccagtgtaccaacagacctctcacatgatgtccgcactctcgactaacgaggatatgcagatgcagtgtgagctgttctccagtccaccggcagtgtctggcaatgaaacctccactactaccacccaacaggtggccacccccggaacaacgatgttccaaacaagctcttctggggacggtgaagagacggggactcaagctaaacagattcagaatagcgtttttcagaccatggttcagatgcaacattcaggagacaatcagcctcaagtgaacctcttttctagcacgaagtcaatgatgtcggtgcagaatagtgggacccagcaacagggcaacggactgtttcagcaggggaacgagatgatgtcactgcagagtgggaacttcctccagcaatctagccactctcaggcacagctctttcaccctcaaaatcccatagccgacgcacagaatctttcacaggagactcagggctcattattccactcccccaaccctattgtgcactcgcagacgagcaccaccagtagtgagcaaatgcagcctcctatgtttcacagccagtccactatcgcggttctacaagggagctctgttcctcaggatcaacagtccacaaatatctttttgtcccagagtcctatgaacaatttacagacaaatactgtcgcacaggaggctttctttgcagcccctaatagcattagtcctctgcagtctacttcaaattctgagcaacaggctgcatttcagcagcaggctcccatctctcacattcagacaccgatgctctcacaagagcaggcccagccccctcaacagggcctcttccaaccacaggtcgcgctcggatctctcccccctaaccccatgccacagtcacagcaggggaccatgttccaaagccaacatagtatcgtggcgatgcagagcaacagcccttctcaggagcagcaacagcagcagcagcagcagcaacagcagcagcagcagcagcagcagtcaatcttattttcaaaccagaacaccatggccacaatggcttcccctaagcagccacctccaaatatgatctttaatccaaatcaaaacccaatggcgaatcaggaacagcaaaatcagtcaatttttcatcagcagagcaacatggccccaatgaaccaggagcaacagcctatgcagttccagtcccagtcaacggtgagtagtctccagaatcctgggccaactcagtctgagtcttctcagacacccctatttcactcatccccgcagatccagttagtacagggctcccctagttcccaagaacagcaagtgaccttattcctgtcccccgcttccatgtcagccctgcagacctcaatcaatcaacaggacatgcagcagtctcctttgtattcccctcagaacaacatgcctgggatccagggcgctacttcctcccctcagcctcaggccacactgtttcataacaccgccggtggaaccatgaaccaactgcagaactcgcccggtagctcacagcagacttcagggatgttcctatttgggattcaaaacaactgtagccaacttttgacttctggaccagccacactaccggaccagctgatggccataagccaacccggacagccccagaacgaggggcaaccccctgtgaccacgttgctgtcccagcagatgccagaaaactcccctctggcatcatctatcaacactaatcagaacattgagaagatcgatctgctggtgtctctacaaaaccagggcaacaacctaaccggcagttttta

SEQ ID NO: 29837 - DNA, 4367 bp, Artificial Sequence
  Description of Artificial Sequence: Synthetic coding sequence
atgggtggtgcctgtagctcgttcactaccagtagctctccgaccatttacagcacctccgtgaccgactccaaagccatgcaagtggagtcgtgctctagtgcagtgggagtatcaaacagaggggtctccgagaagcagctgacgtcaaatacagtacagcaacatccttcaacacctaagcggcacaccgtactttacatctcaccaccccctgaggacctccttgacaacagtcgcatgagttgccaggatgaaggttgcgggctcgaaagtgaacaaagctgctctatgtggatggaggattccccttcaaacttctccaatatgtctaccagctcctacaatgataacacagaggtcccgagaaagtctcgtaagaggaacccaaagcagcgccctggagtgaaaagaagagattgcgaagagagcaacatggacattttcgacgccgatagcgctaaagctccccactacgtgctgtctcagttgaccaccgataacaaaggcaactctaaagcaggaaatgggaccctggagaatcaaaagggcactggggttaaaaaaagccccatgctctgtgggcagtacccagttaaatctgaggggaaagagctaaaaattgtggtgcagcccgagacacagcatcgtgccagatacctgactgagggttcccggggttcagtgaaggatagaacccagcagggattccccacagtgaaactggaaggacataacgaacccgtcgtgctccaggtgtttgtgggcaatgacagcggacgcgtcaagccacatggtttctaccaggcatgtcgagtaactggtcgaaataccacgccttgcaaggaggtggatatagaggggacaaccgtgattgaggtgggtttagacccttcaaataacatgacactcgccgtggattgcgtcggcatattgaagctgcggaacgccgacgttgaggcccgaatcggcatcgcaggaagtaagaaaaaatctactcgtgcccgtctggtgttcagggtgaacatcatgcgaaaagatggaagtaccttgacactgcaaacaccatcgtctcccattctgtgtactcagcccgctggtgtcccggaaattctgaaaaagtcactgcattcctgttcagtaaaaggagaagaggaggtcttcttaattggcaagaactttctgaaaggtaccaaagtcatctttcaggaaaatgtgtccgatgagaactcctggaagagtgaagccgagatcgacatggaattgttccaccagaaccaccttatcgtgaaagtccccccttaccacgaccagcatattaccctccccgtttccgtgggtatttatgttgttaccaacgccggtcgtagtcacgacgtccagccatttacatataccccggatccagctgccgcaggggcacttaacgttaatgtaaagaaggaaatctcgtcccccgcacggccttgcagcttcgaagaggctatgaaggcaatgaagacgacagggtgcaacctcgacaaggtgaacatcatccccaatgctttaatgactcctctgataccaagtagcatgatcaaatctgaagatgtcactccaatggaagtaactgcagagaaacggtctagcaccatttttaaaacaactaaatcagtaggatccacgcagcagactttagagaatatttcgaacatagcgggaaacgggtctttcagctctccatcaagtagccatctgccttcggaaaacgagaaacagcaacagattcagccaaaggcgtacaatccagagactctgactaccattcagacccaggacatctcccaacccggaactttcccggctgttagcgcatccagccagctcccaaacagcgatgccctgctccagcaggctacacaatttcagacccgcgagacccagagccgggagatcctccaatccgacggaaccgtcgtcaacctgtcacagcttacggaagccagccagcagcagcagcagtcgcccctgcaggaacaggcgcagacgctgcaacagcagattagctcaaatattttccctagtcctaatagcgtgtctcagttacagaatactatccagcagctgcaggccggaagctttacagggtcaactgcaagcgggtcctcgggatccgtagacctggtccagcaagtcctcgaggcccagcagcagctctcctctgttcttttttcagctcctgatggcaacgagaacgtgcaggaacaactaagcgctgatatcttccaacaagtttcgcagattcagtctggcgtgtcaccagggatgttctctagcaccgagccaaccgttcataccagacccgacaacctcctgccaggacgggctgagtctgtacacccccagtctgagaatactctgtcaaatcaacagcagcagcagcagcagcagcagcaggtgatggaatcttctgccgcaatggttatggagatgcaacaatctatctgtcaagccgcagcccagattcagtccgagctattcccatcgactgcttccgccaatggcaacctgcagcagtctccagtctaccagcaaacctctcacatgatgtccgcgctgagcaccaacgaggatatgcagatgcagtgtgaattgttctctagccctcccgcagtgagtggaaatgagacaagtacaacaacaacacagcaagtagcaacacccggtaccaccatgttccaaacttcctccagcggcgatggggaagagactggaacccaagctaaacagatccagaactccgtctttcaaaccatggtacagatgcaacatagcggcgacaaccagccgcaggtgaatctcttctcctcaaccaaaagcatgatgtctgtgcaaaactctggcacccagcagcaagggaatggactgttccaacaaggtaacgagatgatgtctttgcaatcagggaattttctccagcaatcatcacactctcaggctcaactcttccacccacagaaccccatagcagacgcccagaatctgtctcaagagacacagggcagcctgttccacagcccaaatcctattgtacattcccagacaagcacaacttcttctgaacagatgcaaccacctatgtttcactcccagtccacgatcgctgtgctccaggggtccagcgttccccaggatcagcagtctacaaatatcttcctgtcccagtcgccgatgaacaacctgcagactaatacggtggcccaagaggctttctttgccgctccgaattccattagcccactccagtccacatccaacagtgaacaacaggcagcgtttcaacaacaggcccctataagccatatccagacgccgatgctgagccaagagcaagcacagcccccacagcagggcctgttccagcctcaggtcgccttaggcagtttgccacctaacccaatgccacagtcccagcagggcacaatgtttcagtcccaacactccattgttgcgatgcagagcaactcacccagtcaggaacagcaacagcagcagcagcagcaacagcagcagcagcaacagcagcagcagtcaatactgttttctaaccaaaataccatggccacaatggcgtctcccaagcaaccaccccctaacatgatcttcaatccaaatcagaatcctatggcaaaccaagaacaacagaaccagagcattttccatcagcagtccaatatggctccaatgaatcaggagcagcagccaatgcagttccagtctcagtcaacggtgtctagcctccagaaccccggacccacccaaagtgagagcagccagacgcccttgttccactcttcacctcaaattcaactcgttcagggatccccgagctctcaagagcagcaagtcactctatttctttctcccgcatccatgtccgcccttcaaacgtctatcaatcagcaagacatgcaacaatcgcccttatactccccacagaacaacatgcccggtatacagggagcgacttctagtccccaacctcaagcaacgcttttccataataccgccggaggtaccatgaatcagctccagaactcaccagggagcagtcaacagacctcaggtatgttcctttttgggatacagaataattgttcacagttactcacatcgggcccagccactctacctgatcagctgatggccatttctcaacctgggcagcctcagaacgaaggacagccgcctgtgacaacacttctcagccagcagatgccagaaaactcacctctggcctcttcgataaacacgaaccagaacatagaaaagattgatcttctggtatccctgcagaaccaggggaacaacctcacaggttcttttta

SEQ ID NO: 29838 - DNA, 4646 bp, Artificial Sequence
  Description of Artificial Sequence: Synthetic coding sequence
atgcccagcgatttcatctctctcttatctgcggatctggacctagagagcccgaaaagcctgtactccagggacagcctgaagctacacccaagtcagaactttcaccgggcagggctgctcgaagaatccgtgtatgatctgcttcccaaggagctgcagttacctccaagccgggagacatctgtggccagcatgtcccaaacctccgggggtgaagccggttccccaccccctgcagtcgtagcagcggatgcctccagtgccccaagcagctctagcatggggggtgcatgctcgtcatttacaaccagtagcagccccaccatatacagcacaagtgtgaccgactccaaagccatgcaggtggagtcctgttcttcagccgtgggcgtatccaatcgtggggttagcgagaagcagctgacgtctaacacagtccagcagcatcccagcacacctaaaaggcacactgtgctctacatttcccctcccccagaggacttgctcgacaattcaagaatgtcctgtcaggacgagggctgcggactggaaagcgaacagtcatgctccatgtggatggaggatagtccgtcgaatttctcgaacatgagcactagtagctataatgataatactgaagtcccacgtaaatccaggaagagaaacccaaaacaacgcccaggagtgaaacgtcgcgactgcgaggagagcaacatggacatcttcgatgcagacagtgcaaaggctcctcattatgtgctcagccagctgacaacagacaataaagggaacagcaaggccggtaacggaaccttggaaaaccagaaggggacgggcgtaaaaaagtctcctatgttgtgcggccagtacccagtgaagtccgaaggcaaagaattaaagatcgtcgtacaacccgagacccagcacagggcacgttatctgactgaggggtccagagggtctgtgaaagaccggacgcagcagggctttccgaccgtgaaactcgagggacacaacgagccagtggtcctccaggtcttcgttggtaacgattctggcagagtgaaaccacacggcttctatcaggcttgcagagtcacaggcaggaacaccactccctgcaaagaagttgacattgaggggactacagttatcgaggtgggcttggacccttctaacaacatgactctcgccgtcgattgtgtcggtatcctaaagttgcggaacgcagatgttgaagctcgaatcggaattgcaggctctaagaagaaatcaacacgcgcacgcctcgtcttccgcgtgaatataatgcgcaaggatggaagtactctcacattgcagaccccttcatcccccatattgtgcacgcagcccgcaggcgttccggagatcctcaagaagtcattacattcttgttcagtgaagggagaagaggaggtgttcctgattggaaaaaacttccttaagggcaccaaagtcatttttcaagagaacgtgagtgatgaaaattcgtggaagagcgaggccgaaatcgatatggaattattccaccagaaccatctgattgtgaaagtccctccctaccacgaccagcacatcactctgccagtttctgtaggcatctacgtcgtcaccaacgccggtcgctcccacgacgtgcagccctttacctacacccccgatccagccgctggcgctctgaacgtaaatgttaagaaggagatctcctctccggctcggccatgtagcttcgaagaggcgatgaaggctatgaaaactaccggctgtaatctcgacaaagttaacatcatcccgaatgctttaatgactcctctgatcccctcttctatgattaagtctgaggacgttactcctatggaggtgacagccgaaaagagatctagcactattttcaaaacgacaaagagcgtggggtccacgcagcagacactcgagaatatttctaacatagccggaaatgggtcctttagcagtccctcatcttctcatctacctagcgagaacgaaaaacagcaacagatccagccgaaagcatacaacccagaaacactgacaactattcagacacaagatatcagccagccaggaactttcccagccgtcagcgcctctagccaactgcccaattcagatgccctcctgcaacaggccactcagttccagacacgcgagacccagagccgggagatactccagtcagatggaacagtggtcaacttgtctcagctgactgaagccagccagcagcagcaacagtctcccctgcaagaacaggcgcaaacgctgcagcaacagatttcaagtaatatcttcccaagccctaactctgtgagtcagctgcagaacacaattcagcagttgcaggcaggttcatttactggcagcaccgcgagcggctcctccggcagcgtggatctcgtgcagcaggtgttggaggcccagcaacagctgtcatcagtgttattttccgccccagacggaaacgagaacgtacaagaacagcttagcgccgacattttccagcaagttagtcagattcagagtggtgtatccccgggaatgttcagctctaccgagcccacagttcatacccggccagacaacctgctgccaggtcgtgccgaatcagtgcacccccagtctgaaaacactcttagtaaccaacaacagcagcagcaacagcagcagcaggttatggagtcctctgctgccatggtgatggagatgcagcagagtatttgccaggccgctgctcagatccagagtgagctttttcccagcacagcaagcgctaacgggaatctgcaacaatcaccagtgtatcagcaaaccagccacatgatgagcgcgctgtctacaaatgaagatatgcagatgcaatgcgagctattctcatctcctcctgccgtgagcgggaatgagacctccaccacaaccacccagcaggtcgcgacccctggtactactatgtttcagacatcttccagcggtgacggcgaagaaaccggcacacaggctaagcagatccagaattctgtgtttcaaactatggtccaaatgcaacactctggcgacaaccagccccaggtgaaccttttctcaagtacgaaaagcatgatgtctgtgcaaaacagtggcactcaacagcaagggaatggcctgtttcagcagggcaacgaaatgatgagtctacagagcggcaatttcctgcagcagagctctcattcccaggcccagttattccatcctcaaaatcctatagccgacgcccaaaacctgtcccaggagacgcaaggaagtctttttcatagccctaatcccattgtacactctcagacctccaccacttcatctgagcagatgcaaccgcctatgttccatagccagtccactattgcggtgctccagggtagctctgtgccccaggaccagcaatccaccaatatcttcctcagtcagagtcccatgaacaacctacagaccaatacagtggcacaggaagccttctttgccgcacccaattcaatctcccccctgcaaagtacaagcaacagcgagcagcaggctgcctttcagcagcaggctccaatcagccacatccagacaccgatgctgtctcaagaacaagcccagccaccccagcaaggcctgtttcagccccaggtggcactggggtctttgccacctaatccaatgcctcaatcacagcagggcacaatgtttcagagccagcatagtatagtcgcaatgcagagcaattcacctagccaggagcagcagcagcagcaacagcagcagcagcagcaacaacagcaacagcagcagtcaattctcttttctaatcagaacacaatggctactatggcctccccgaaacagccacccccaaatatgatttttaatcctaaccagaatcctatggccaaccaggagcagcagaaccagtcaatctttcatcagcagagcaacatggcccctatgaatcaggaacagcagcccatgcagttccaatcgcagtcaacagtgagctctctgcaaaaccctgggcctacccagtcagagtcaagccagacacctctgtttcatagttctccccagatccagctggttcaaggatctccatcatcccaggagcaacaggttaccttgttcttgagccctgcctcaatgagcgcgctccagaccagtattaatcaacaagacatgcagcaatcccctctatactccccccagaacaatatgccgggaatccagggtgcaacttccagtccccaaccccaggccactttattccataacacggcgggtggtactatgaaccagttacaaaacagtcccggaagtagccagcaaacctctgggatgttcttgtttggcatccaaaacaactgctcacagctgctgacgtcgggccctgccactctgccagatcaattgatggctattagtcagccgggacagcctcaaaatgagggccagccgccagtgactacgctgctttcacagcagatgcccgaaaattcccctttagcaagctctatcaatactaaccaaaacattgagaagatcgatcttttagtgtcattgcagaaccaggggaataaccttaccggctccttcta

SEQ ID NO: 29839 - DNA, 4649 bp, Artificial Sequence
  Description of Artificial Sequence: Synthetic coding sequence
atgccaagtgatttcatctctctgttatctgccgacctggacctggagagccccaagtcgttgtactccagagattctcttaagctgcatccttcgcaaaacttccacagggccggactattggaggagagtgtgtacgacttacttccaaaagagcttcaactgcccccatcacgggagacatctgtggcaagtatgagccagacctcgggcggagaggcaggaagcccccctcccgctgttgtagcagccgacgcctcttccgcaccttcctcctcgtccatggggggtgcgtgctcatccttcaccacctctagctcgccgacaatctactcaacgtccgtcacagactcaaaggcaatgcaggttgaatcctgtagtagtgcagtaggggttagcaatagaggtgtctctgaaaagcagttaaccagtaacacagtacagcagcatcctagcactcccaagaggcacacggtactgtacatctccccaccgcctgaggacttgctcgataattcgcggatgtcctgccaagatgagggctgtggactggagtcggagcaaagctgttcaatgtggatggaggattccccctcgaattttagtaacatgtcgactagttcatacaacgacaataccgaggtgccacggaagagtagaaagagaaatcccaaacagcgaccaggtgtgaagagacgagactgtgaggaatcaaacatggacatctttgacgccgattctgctaaagcgcctcattatgtcctttcacaactgactacggataataaaggaaattcaaaggccggaaatgggaccctcgaaaaccaaaaaggcacgggcgtcaaaaaatcacccatgttatgtggccaatacccggtgaagagcgaaggcaaagagctcaagatagttgtgcagcccgagacacagcatagggcacggtatctgaccgaaggcagccggggatctgttaaagatagaactcagcaaggctttcccactgtcaagcttgaggggcacaacgagcccgttgtgttacaggtattcgtcggcaacgactctggaagagttaaaccccatgggttttaccaggcttgccgtgtgaccggccgtaataccactccttgcaaagaagtggacatagagggaactacggtgattgaggtggggctggacccttctaataacatgacactcgcagtggattgcgtcgggattctgaaactgcgcaacgctgatgtggaggctcgcataggcattgctggttcaaaaaagaagtctacccgagcgcgactggttttccgtgttaacattatgagaaaagatggttccaccctaaccctccaaacaccatcatcccctatattatgtacccagcctgctggtgtgccagaaattctgaagaaatccttgcactcctgctccgtgaaaggagaggaggaagtcttcctgattggtaaaaatttcctgaagggaaccaaggtgatatttcaggagaatgtaagcgacgagaattcgtggaagagtgaggcagaaatcgacatggagttattccaccagaatcatttaattgtgaaagtgccgccttatcacgatcagcatataactctgccggtaagcgtgggaatctacgtcgtaacgaacgccggacgctcgcatgatgtccaaccatttacatacacacccgatccggctgcggcaggagccctcaacgtgaacgtgaagaaagagatctcatcccccgcaaggccgtgttcattcgaagaggccatgaaggccatgaaaacaactgggtgcaacttagacaaggtgaacatcatcccgaacgcactgatgacaccactgattccttccagcatgattaaatctgaggatgtcacgccaatggaagtgactgctgagaagcgttcctccacaatctttaaaaccacgaaatctgtgggcagtacgcaacagactctagagaacatttccaatatcgcagggaatggatctttttcctcgccttcatcgagccatctgccttccgaaaacgaaaaacagcagcagatccaacctaaagcttataatccagaaacgcttactacaattcagacccaggacatttcgcagcccggaaccttccccgctgtgagtgcctcaagccagcttcccaatagcgatgcgttacttcagcaggctactcagttccagactagagaaacacagagtagggaaattctccagtcagatggaacggtcgtcaacctcagccagttgacagaggcatcgcagcaacagcagcagtctcccctccaagagcaggcgcagaccctgcaacagcagataagctccaatatatttccctctcctaactctgtttcgcagctccaaaatactatccagcagttgcaagccggaagcttcacagggagcaccgcctctggctcaagtggcagtgtggacctagttcagcaggttcttgaggcccagcagcagctcagcagtgtgctgttctcagccccagatgggaacgagaacgtgcaggagcagctctctgccgatatcttccaacaagtctctcagatacagagcggtgtgtcgccaggcatgttctcttccaccgaacccacggtgcatacccggcctgataatcttctgcctgggcgagccgaatcagtgcaccctcaatcagagaataccctgtccaatcagcagcagcagcagcagcagcaacaacaggtcatggagagttccgctgccatggtgatggagatgcagcagtcaatttgtcaggctgctgcccagatccagtcggaactgttcccctcaacagccagtgcaaatggtaatctgcagcagtctcctgtgtatcaacagactagccatatgatgtctgcactctctacaaacgaggacatgcagatgcagtgcgaactattctctagcccaccagccgtttcgggaaatgaaacatcaacaaccaccacacagcaagtggcaacgcctggcaccacaatgttccagacaagctcatccggggacggcgaagagacaggcacgcaggcaaaacagatccagaatagtgttttccagactatggtgcagatgcagcattcaggagataatcaaccgcaggtgaatctcttttcgagcaccaaatccatgatgtcagttcagaatagcggcacgcaacagcaaggaaacggccttttccagcagggcaacgaaatgatgtctctccagtccggaaacttcctgcagcagtcgtcacatagccaggcacagcttttccacccccagaaccctatcgccgacgcccagaacttgtcccaggagactcaaggatctctgttccacagccccaacccaatagtacatagtcagactagcaccacctctagtgaacagatgcagccacctatgttccattcacaaagtactattgcagtcttgcagggatccagcgtcccacaagaccaacaatcaaccaacatcttcctctctcagtcccccatgaacaacctgcagacaaataccgtggcgcaggaggcatttttcgctgctccaaattccatttcaccactacagtctaccagcaactcagagcagcaggcagccttccagcagcaagccccaatcagccacatccagacgccgatgctgtcacaggagcaggcgcagcctccacagcaaggattattccagccccaggtcgcactggggagcctgccacctaacccgatgccgcagagccagcaggggactatgtttcaaagccagcatagcatcgttgctatgcagtccaattcacccagtcaagagcagcagcagcagcaacagcaacaacagcagcagcagcagcagcagcagcagagcatcctcttctctaaccagaacacgatggctacaatggcctctcccaagcaacctccccctaacatgatctttaaccccaaccagaatccaatggccaaccaggagcagcagaaccagagcatttttcatcagcaaagcaatatggcgcctatgaatcaggagcagcaaccaatgcagtttcagtcgcagtcaacggtgtcctctctgcaaaacccgggacccactcaatcagagtcctcccagaccccactgttccatagctctccacagatacaacttgtccaggggagtccgtccagccaagagcaacaggttaccctcttcctgagccccgcaagtatgagtgcccttcagactagtattaatcagcaggatatgcagcagtcacctctatattccccccagaacaatatgcctgggatccagggagcaacaagctccccccagccacaggctactttgtttcataacacagcgggaggcactatgaatcagctccagaacagccccggttcatcccaacagacaagcggcatgttcctcttcggcattcagaacaactgtagccagctgctcacgtccggtccggcaacattgccagaccagctgatggcgatctctcagcccggacagccccaaaatgaagggcaacctccagttacgacactgctgagtcagcagatgcctgagaattccccactggcgagttcaatcaacaccaaccaaaacatcgagaaaatcgacttgctggtgtcgcttcagaaccagggcaataatcttaccggaagttttta

SEQ ID NO: 29840 - DNA, 2151 bp, Artificial Sequence
  Description of Artificial Sequence: Synthetic coding sequence
atgccttctacatcctttccggtgccatctaagttcccccttgggcctgctgcagccgtcttcggccgaggcgaaactctgggccctgcgcctagagctgggggaaccatgaagtcagccgaggaggaacactatggttatgcctcgtcaaacgtcagcccagccctgcctttaccaacagctcactcaacgttgccagccccttgccataatctccagacttctacacctggtataatccctcccgcagaccacccatcaggttacggagccgctctcgacggcggaccagcagggtactttctgtcctctggccatacccgacctgacggcgctcctgctcttgaatctccgagaattgagattacatcatgtctgggactctaccacaacaacaaccaattcttccatgacgtggaggttgaagacgtgcttccctctagcaaacgtagtccctccacagccacacttagcctaccatccctcgaggcctaccgcgacccgtcctgtctgtcccccgcaagctcactctccagccgaagctgcaactcagaggcctctagctacgagtctaattattcttacccctacgcgtcccctcagactagcccctggcaatctccttgcgtatctccaaaaaccaccgatcctgaggagggtttcccaagaggactgggtgcttgtacactcctgggttccccccgtcatagcccctctaccagccctcgcgcttcagtgacggaagagtcctggctcggggcacggtccagcagacctgccagcccctgtaacaagcggaaatacagcctcaacgggagacaacctccatactcgccacaccactcaccaactccttctccacatggcagcccccgtgtgtcagtgactgacgatagttggttaggcaatacaactcagtatacgagctccgctattgtcgccgcaatcaacgcattaactaccgattccagcctcgaccttggagacggtgtgcccgtgaaatctaggaaaaccacactggaacagccccctagcgtagctttgaaggttgaaccagtgggtgaagacctaggttcgcccccaccacctgccgactttgctcctgaggactactctagtttccaacacatccggaaggggggattctgtgatcaatacctagctgtgcctcaacatccctaccaatgggccaagcccaaaccactcagcccaacaagttacatgagccccactcttcctgcactggactggcagctgccctcgcactccggcccatacgagctccgcatcgaagtccagcccaaaagtcaccatcgagctcactatgagacagagggttctagaggcgctgtgaaggcaagtgcaggtggtcatccgattgtacagttgcacggttatctcgagaacgaaccgcttatgctgcagctgttcatcggcactgcagatgacagactgctaagaccacacgcattttaccaggtgcatcggataacggggaagaccgtctccactacatcccatgaagcgatcctgtctaacaccaaggtgctcgagatccctttactccccgaaaatagtatgcgggctgtaatcgattgcgctggaatactgaagctccgcaatagtgatattgaactacgtaaaggggagaccgacatcgggagaaagaacacccgtgtgcgcctggtgttccgggtgcatgtgcctcagcccagtggccgtacattatctctccaggttgcttccaaccctattgaatgctctcagagaagtgcccaggagctccctctcgttgagaagcagtcaaccgactcttaccctgttgtgggaggcaaaaagatggtgctttccgggcataacttcctacaggactccaaagtgattttcgtggaaaaagctcctgacgggcaccacgtgtgggaaatggaagccaaaaccgatcgagacctgtgcaaaccaaacagtttggtcgttgagatcccccctttccgcaaccagcgcattacatctcccgtccacgtgagcttttatgtgtgtaatggcaaaagaaaaagatcccagtatcagcggtttacttacctcccagccaatggtaacgccatttttctcaccgtgtcgagggagcacgaacgtgtcggatgctttttctag

SEQ ID NO: 29841 - DNA, 2478 bp, Artificial Sequence
  Description of Artificial Sequence: Synthetic coding sequence
atgccttccaccagctttccagttccctctaagttccctcttggacctgccgctgctgtcttcgggcgtggcgaaacgctggggcctgccccacgggcaggcggtactatgaagtcggccgaagaggaacactacggctatgcttcttccaatgtctcacctgctctgccattgcccaccgcccattccactcttcccgctccttgccacaacctgcagacatccacaccaggcatcattcctcccgctgaccacccttcggggtacggcgctgccttagacggagggcctgcgggttacttcctctccagcgggcatacccggccagacggtgcaccagccctggaaagtcctaggatcgaaattactagctgcctgggtctttaccacaataacaaccagttctttcatgatgttgaagtggaagacgtgctaccatcatccaaaaggtctccctccacggccaccctaagccttccatccctagaggcttatcgggacccttcttgtctcagccccgcaagcagtcttagctctaggagttgtaatagcgaagcgtcttcttacgaaagcaattattcgtacccttacgcctcaccccagacttctccctggcagagcccttgcgtgagtcccaagacaaccgaccctgaagagggcttccctagaggtttaggtgcatgcactctcctgggatctccccgacactctccctctacatcacctcgggcttcagtaacggaggaaagctggctgggcgctagatctagcagacccgcaagcccctgtaacaaacgtaagtattcgctcaatggccgtcagcctccgtactccccgcaccatagtccgacaccttcaccgcacgggagccccagggtgtcggtcacagatgactcctggctgggaaacactacacaatatacttcctctgccatcgtagctgctattaacgccctgacgacagatagctcgttggatctcggagatggagtcccagtcaaatcccgcaagacgaccctggaacagccaccctctgtcgccctgaaggtggaacctgtaggcgaggatttgggaagcccccctccacccgcagattttgcaccagaagactattcctcatttcagcacattaggaaagggggtttttgtgaccaatatctggcagtgcctcaacacccctaccagtgggcaaagcccaagcctctgtctccaacctcatatatgtctccgactctccccgctctggactggcagttgcccagccattctggcccatatgagctcagaatcgaagtccagcccaagtcgcaccatagggcccactacgaaaccgagggttcgcggggagccgtgaaagcaagcgccggtggccaccctatcgtgcagctgcatggttacctcgagaatgaacccctgatgctccagcttttcatcggaactgcagatgacaggcttctgagacctcacgcattctatcaggtccatcgaatcactggaaaaactgtcagcacaacctcccacgaagcgatcctatctaacaccaaagtcctggaaatccccctgcttccggagaatagtatgagggctgtgatagattgtgctgggattctaaagctgaggaacagcgacattgagcttcgaaagggagagacagatatcgggaggaagaacacacgtgtgagactggtgttccgcgttcatgtaccccaaccaagcggccgaacgctaagcttgcaggtggcatcaaatcctatcgagtgcagtcaaagatctgcacaggaactcccactcgtcgaaaaacagtctactgactcataccctgttgtggggggtaagaagatggttctgagtggacacaactttctccaggatagtaaggtgattttcgtggagaaggctcctgatgggcatcacgtttgggaaatggaggccaaaacggaccgggacttgtgcaaacccaattctctggtggtggagatccccccatttaggaaccagcgaattacatcaccagtccatgtctcattctatgtttgcaacggaaagagaaagcgctctcagtaccagcggttcacatatctgccagctaatgtaccaataatcaagactgagccaaccgatgattatgaaccggcaccgacatgcggaccagtcagtcagggactgtcccctctgcccagaccgtactattcgcagcagctggccatgccgcctgatccaagttcctgcctggtcgcagggttccccccttgtccccagcgatcaacgctgatgccggctgcccctggagttagtcctaagctccatgacctgagccctgccgcttatactaagggtgttgcctcacctggccattgccacctgggcctgccacaaccagcaggcgaggcaccggctgtgcaggatgttcccaggcctgtcgccacgcacccaggctccccgggacagccacctcccgctctgctgccccagcagtag

SEQ ID NO: 29842 - DNA, 2832 bp, Artificial Sequence
  Description of Artificial Sequence: Synthetic coding sequence
atgcctagcacttctttccctgtgccttccaaattccccctcggccctgctgctgccgtgttcgggagaggggaaaccctgggacccgcacccagagctgggggtactatgaagagcgcagaagaggaacactacggttatgcaagcagtaatgtaagcccagctttgcccctgcctactgcccactccacgctccccgcaccttgtcacaaccttcaaacttccacccccggtatcattccgcctgccgatcatccctccggctatggcgctgcactggatgggggacccgcaggatatttcttgtcaagtggacacaccaggcctgacggagcccctgcattggaaagcccaagaattgagatcacgtcttgcctcgggctctaccacaacaacaatcaattcttccatgacgtggaggttgaggatgtccttccgtcctccaagcggtctcctagtacggccaccctcagcctgccatccctcgaggcatatcgagatccgagctgcctatcacctgcgtcctccctttcaagcaggagttgcaatagcgaggcctcttcttatgaatctaattatagttatccctatgcctctccgcagaccagcccctggcaatctccctgtgtgagtcccaaaaccaccgatccagaagagggtttccctagagggttaggggcttgtaccctcttagggagccctcgacactctccatccacctctcctcgtgcctccgtgaccgaggagtcctggctgggtgccagatccagcaggcccgcaagcccttgcaacaagcgtaagtacagcctgaatgggaggcagcccccttacagcccgcatcatagtcctactccctcaccccacggaagtcctcgagtctcagttactgacgacagctggctgggcaacacaacccagtacacaagctcagcaatcgttgccgcaattaacgccctgacaactgactcaagcctggatctgggcgacggcgtccctgtcaagagcagaaagaccactctcgagcaaccgccatcggtcgctcttaaagtagagccagtgggcgaggatttgggctcaccccctccaccagcggactttgcccctgaagactatagcagcttccagcacatccgcaaaggaggtttctgtgaccagtatctggccgtgccccagcacccttatcagtgggcaaagccgaagccactcagtccaacctcttacatgtctcctactctgccagctctggattggcagctgccctcgcactccggtccttatgagcttcgcatcgaagtccaaccgaagtctcatcatcgtgctcattacgagacagaggggtcgcgaggggctgtcaaagccagtgctggtggccatccaatagtgcagctgcatggctaccttgagaacgaacctttgatgctccagctgtttattggcacagcagatgataggctgctgcgtccccatgccttttaccaggtccataggattactggcaaaactgtgagtactacctctcatgaggccattttgagtaacacaaaggtgctggagattcctctgcttcccgaaaactcaatgcgtgctgtcattgattgcgccggaattctaaaactgagaaattctgatattgaattgaggaagggtgagaccgatatcgggagaaagaacacacgggttaggcttgtgtttcgggtgcatgtgcctcagccctcaggacgcactctctcattacaggtggcttctaaccccatcgagtgttctcaaagatctgctcaggaattgcccctagtcgagaagcagtccaccgactcctatcctgtggtgggtggtaagaagatggtattgtcaggacataacttcctccaagattccaaggtgatcttcgtggaaaaggctcccgatgggcatcacgtctgggaaatggaagctaaaacagatagagacctctgtaagccaaactcactggttgtagagatccctcctttcagaaatcagcgcataacaagccccgtgcacgtctccttctacgtgtgcaatggcaagcgtaagcgcagccagtaccagcggtttacttacctcccagcaaatgttccaataatcaagaccgaaccaacagacgactacgagcccgctcctacttgcggacctgtgtcccaagggctaagccccctgcccaggccctactactctcagcagctggctatgcctcctgatccttcttcttgcctggtggctggcttccccccatgtcctcagagaagtaccttgatgccagcagcccctggggtttcccccaagctacacgacctttctcccgcagcctacacgaagggcgtggcctccccaggacactgtcacctagggttgcctcaacctgctggggaagctcccgctgtgcaggacgttcccaggcccgtcgcaacgcaccctgggagtcccggtcagcccccacccgcacttctgccccagcaggtgtccgctcccccatccagcagctgtccgccaggactcgaacactctctgtgcccgtccagcccatcccctccactgccccctgccacacaggagcctacctgcctgcagccttgttcacctgcatgccctcctgctaccgggaggcctcagcatctccctagcacggttcgcagagacgagtcacccacggcaggccctagactgttgcccgaggttcacgaagacggcagcccaaatcttgcccctatccctgtaacagtgaaaagagaaccagaagagctcgaccagctctatctggatgatgtcaatgagatcatcaggaacgatctttcctcgacctctacccatagctag

SEQ ID NO: 29843 - DNA, 2793 bp, Artificial Sequence
  Description of Artificial Sequence: Synthetic coding sequence
atgaccgggctggaggatcaggaatttgatttcgagtttctgttcgaattcaaccagcgcgacgaaggcgctgcagcagcagcccctgagcactacggttacgccagctccaacgtgtcccccgctctgccactgccaacagcccatagcacattgcctgctccatgtcacaacctacaaacatcaacgcctggtatcatccccccagctgatcatcctagtggctatggggctgcactggatggcggtcctgcgggttatttcctcagctctgggcacacgcggcctgacggagccccagccctcgaaagcccgcgtattgagattacaagttgcctgggactttaccataataacaaccagttttttcacgatgtggaagtcgaggacgtgctgccgtcatccaagaggagcccatccaccgctacgttatcccttccctccctggaggcctatagggacccctcatgtctgtcgcccgctagtagcctgagcagtagatcatgcaattctgaggcctcatcctatgagagcaactacagttacccctacgcgtcaccgcagacatcgccctggcagtcaccatgtgtctcccctaagactactgaccccgaggaaggcttcccgcgaggccttggtgcgtgcacattgctgggaagtcccagacactccccatcgacctctcctagagccagcgttactgaggagtcttggctcggcgcacgctcctcccggcctgcctccccgtgtaataagcgaaaatattccctgaatggtcggcagcccccttacagccctcatcacagccctactcctagccctcatggcagccctagagtctccgtcactgacgatagctggctcggtaacaccactcagtacacctctagcgctattgtggcggctatcaacgctttaaccactgattcttctctggacctcggcgatggagtgcccgtgaagagccgcaagacgaccctggagcagcctccttcggttgctctgaaagtggagccagtgggagaggatcttgggtcgccaccacctcctgcggatttcgcgccagaagactactcctcattccaacacatacgaaagggtggtttctgcgaccaatacctcgcggtaccacagcatccctaccagtgggcaaaaccaaagcccttgtctccaaccagctatatgtctcccaccttacccgcactggactggcagcttccctcacactcgggcccatacgagctccgcatcgaagtgcagcctaaaagtcaccacagagctcattacgagactgagggatcacgcggagcagtgaaggcctccgcagggggacaccctattgtgcagttgcacggatatctcgagaacgaacccttaatgctccagctttttatcggcaccgccgacgataggcttctgcgacctcacgccttttaccaagtgcatagaatcactggcaagaccgtcagcactacttcccacgaggctatactcagcaatacgaaggttctcgaaattcctctgcttcctgagaattcaatgagagccgttattgactgtgcagggattcttaaactgagaaattctgatattgagctcaggaagggcgagacggatatcggcaggaagaacaccagggtccgtctagttttcagggttcatgtcccccaaccatctggacggactctctcactgcaggtcgcctccaaccctatagagtgtagtcaacggagcgctcaggagctgcctctggtggagaagcaatctacggattcttaccctgtcgtgggaggcaagaaaatggtgttgtctggccacaactttctgcaggacagcaaggtgatcttcgtcgagaaggccccagacggccaccacgtttgggagatggaagctaaaaccgatagggacctctgcaaaccaaactccctggtcgtcgaaatccctccttttagaaaccagcggatcactagccccgttcacgtgtcattctacgtctgcaacggaaaaagaaagcgatcccagtaccaaagatttacctatctccctgccaacgtgcctatcatcaaaaccgagcctactgacgattatgagcctgccccaacctgcggaccggtgtcacaggggctctcaccattacctcggccttattattcccaacaattggctatgcctccagacccgtcaagctgcctggtggccggttttcccccttgtccacagagaagtacgcttatgccagctgcgcctggggtgtcccctaaactgcacgatctgtctcctgcagcctataccaagggcgtggcctctccgggacactgccacctgggtctccctcagcccgcaggcgaggcgccagccgtacaggacgtgccccgaccagtggctacccaccctggctcaccagggcaaccccctcctgctttgctgccccagcaagtctctgccccacccagcagcagctgtcctccagggctcgaacatagtctgtgcccctcatcaccgagtcccccattgccacctgccacgcaggagcccacctgtttgcagccttgttccccagcctgtcccccagcgaccggcaggcctcaacatttaccttcaacagtgaggcgcgacgagtctcctactgctggccctcgcctgctccccgaagttcatgaggatggctctccgaatctggcccctatccctgttaccgtgaagcgggaacctgaggagctagatcagctttacctggacgacgtgaacgaaatcataagaaatgacctgtcgtcgaccagcacccatagctag

SEQ ID NO: 29844 - DNA, 1062 bp, Artificial Sequence
  Description of Artificial Sequence: Synthetic coding sequence
atgctgcagctgttcattggtaccgccgacgaccggctccttaggcctcatgccttctaccaggttcatcggattaccgggaaaactgtcagtaccacatcccatgaggcaatcttgtctaacacgaaggtacttgaaatcccactgctgccagaaaacagcatgagagctgtgatcgattgcgccggaatcctgaagctgcgaaactcagacatagagctgcggaaaggcgagacggacatagggagaaagaatactagagtgcggcttgtgttccgcgtccacgttccccagcccagtggcagaaccttgagtctccaagtcgccagtaatcccatcgagtgctctcaacgaagcgcccaggagttgccccttgtggaaaagcagtcaacagacagctaccctgtggtcggcggtaaaaaaatggtcctgagtgggcacaattttctccaggacagcaaggtgatatttgtggagaaagcccctgacgggcaccatgtgtgggagatggaagctaaaactgatcgcgacctatgtaagcccaacagcctggttgtggaaattcctccattccgcaaccagagaattacgtcacccgtgcacgtctccttttacgtttgtaatggcaagcgaaagcggtctcaataccaacgattcacatatcttcctgccaatgtgccaattattaaaaccgagcccacagatgattatgaacccgctcccacatgcggccctgtgagtcagggcctctcaccgctgccaaggccctattacagccaacaacttgccatgcctccagatccaagctcctgtctggttgcgggatttcccccatgccctcagcgaagcacacttatgcccgcagcacccggtgtgagccccaaattgcatgacctgagtcccgctgcctacaccaagggtgtggcctcccctggacactgccacctgggactgccacagccagccggagaagcacctgcagtgcaggacgtgcccaggcctgtcgctacccacccgggtagcccaggacagcctcccccagccttgctgccgcagcagtag

SEQ ID NO: 29845 - DNA, 2724 bp, Artificial Sequence
  Description of Artificial Sequence: Synthetic coding sequence
atgaagagcgggactctggagcactacggatatgcatcaagcaacgtgagccctgcactccccctccccaccgcacacagcactctccccgcaccttgccacaatcttcagacaagtacacccggaataatcccccctgccgaccacccatctggttatggcgctgccctggacggcggtcctgccggatactttttaagctctggccataccagaccagatggggctcccgcattggagtctccacgcatcgaaatcacaagctgcctggggctttatcataacaataatcagttctttcatgacgttgaggttgaagacgtgcttccctccagtaagcgatcaccatcaacagcaacacttagcctaccctccctggaggcctatcgcgatccctcctgtctgtcccctgccagctcactatcttctcggtcatgtaactctgaagctagcagttacgagtccaactatagctacccctacgccagccctcagacaagtccctggcagtcaccctgtgtatctcctaaaaccactgacccagaggaggggttccctagagggctaggggcttgcactcttctgggcagccccagacattccccgtcaacatcccccagagccagtgtgactgaggaatcttggcttggtgcacggtccagcagaccagcttccccctgcaataaaaggaagtatagtctcaacggcaggcagcctccttactcccctcaccacagtcctaccccaagcccccatggatcccctcgcgtgtcagtgacagacgatagttggctcggtaacaccacacagtatacatctagtgccatcgtcgcagcaatcaacgctttgactaccgacagtagtctggatctcggggacggtgtgcccgtgaaatctcgcaagacgactctggagcagcctccctccgtggcccttaaagtcgagcctgtaggtgaggacctcggaagccccccacctcctgccgactttgcgcctgaggattattccagtttccagcacatacgcaagggtggcttctgtgaccagtaccttgcggttcctcagcacccctaccagtgggcaaagccaaaacccttgagccccactagctacatgagccccactttaccagctcttgattggcagctgccctcccacagcggaccctacgagctccgcattgaggttcagccaaagagccaccacagggcccattacgaaacagaaggcagtcgaggcgctgtcaaagcgtctgctggcggtcatcccattgtgcagctgcacgggtacctggagaacgagcccttgatgctgcagctctttattggcacggccgatgataggctcctccgccctcacgcgttttatcaggtgcaccggatcaccggcaagaccgtaagtaccacttcacatgaagccattctcagcaacacaaaagtattggagatccccctgctgcctgagaatagcatgcgggcagtgattgattgcgcgggaatactcaaactgaggaattccgacatcgaactgcggaagggcgagactgatattggaaggaagaatacaagagtgaggcttgtgttccgagtccatgtaccccagccgagcggaaggaccctcagcctacaagtagcatccaaccccatcgagtgctcgcaacggtctgctcaggaactcccgctagtagaaaaacagagcactgactcatatcctgtggtgggcggaaagaaaatggtgctgtccggccacaacttcctgcaagactccaaggtgatcttcgtggaaaaggcaccagacggccatcacgtctgggagatggaggcaaagactgatagagacctgtgcaaaccaaatagtcttgtagttgagattccacccttccgcaaccagaggataacatctccagtgcatgtatcgttttatgtctgcaatgggaaacgtaagagaagccaatatcagcgattcacctacttgcctgcgaacgtgcctattattaaaaccgagcccaccgacgattacgaacctgcccctacatgcggccctgtctctcagggcctgagtcccttgccccgaccatactacagtcaacagctggctatgcctcccgaccccagctcttgtctggtagctggcttcccaccgtgtccccagaggtccactctcatgccagccgctcctggagtttctccaaaattacatgatctgtcacctgccgcatacactaagggagttgcctcccctggtcactgccacttgggactgccgcagccggcaggggaggctcctgccgtgcaggatgtgcctcgcccagtagcaacgcacccgggttctccaggacagcctccaccagcactgcttcctcagcaggtctcagcacccccttcttccagctgtcctccgggacttgagcacagcctatgtccaagcagcccatcacctccactgcccccagcaacccaagaacccacttgcctccagccatgtagtcctgcctgtcccccagctacaggcagacctcagcatctcccctctaccgtcaggagggatgagtctcccacagccggtccgaggctgctgccagaagtgcatgaagacggctcaccaaacttggcacccattcctgtgactgtgaaaagagagccggaggaactcgatcagctgtatctcgatgacgtgaatgagataatacgtaatgatctgagcagtaccagtacacattcatag

SEQ ID NO: 29846 - DNA, 2745 bp, Artificial Sequence
  Description of Artificial Sequence: Synthetic coding sequence
atgaccgggctggaggaccaggagttcgattttgagtttctgtttgagtttaaccagagagacgaaggtgctgccgctgctgcgccagagcactatgggtacgcctctagcaacgtgagccccgctctgcccttgccaactgcccattctacactgcctgcgccatgccacaacctgcaaacatccacgcctggcatcattcctcctgccgatcatccatcaggatatggagctgctctggacgggggacctgctggttactttctgtccagtgggcacactcggccagatggggctcccgctctggagagtcctcgaatcgaaatcacttcatgtctgggcctgtaccataataataaccaattcttccacgatgtcgaggtggaagacgtgcttcctagtagcaagaggtcccccagtacagctacactgtccctgcctagcctcgaggcctacagggacccctcatgtttatccccagcttctagtctgagctcacgctcttgcaacagtgaagcaagctcctacgagagcaattatagctacccctacgcatctccccagacatccccatggcaatctccatgcgtgtccccaaagacaaccgatcccgaagaggggtttccaagggggctgggagcctgcaccttgctggggagtcccaggcatagccctagcacatcccctagggccagtgttacagaggaatcttggctgggcgctagaagcagccggccagcttctccgtgcaataaacgtaaatactcgctgaacggcagacaaccgccatattccccccatcattctcccacaccctctccccacgggagtccacgggtgagtgtgactgatgacagttggttgggcaatacaacccagtatacaagttcggcaattgtggcagctattaacgccctgacaacagattcgtctttggatctcggagacggggtacccgtgaaatctagaaaaacgactcttgagcaaccgccatccgtagctctcaaggtggaaccagttggcgaggaccttgggtccccccctcctccagccgattttgctccagaagactatagcagttttcagcatatccgtaaaggcggattctgtgaccagtacctggccgtgccacagcatccttatcaatgggctaagccaaagcctcttagccctacctcttacatgagccccacactgccagcgctggactggcagttgccatcgcactccggtccatacgaactgcggattgaggtgcagccgaagagccaccacagagctcactatgaaaccgagggtagtaggggtgccgtcaaggcttctgcaggcggtcacccaatcgtgcaacttcacggctacctggaaaacgagccccttatgctacagctcttcattggaaccgctgatgaccgccttctccgcccacacgctttctatcaggtccatagaattacagggaaaacagtgagtactaccagccatgaagctatcctatccaatactaaggtactggaaattccccttctgcccgagaatagcatgcgtgcagtcattgattgcgcaggcattctgaagctcaggaatagcgatatcgagctgcgcaaaggcgagactgatatcggtagaaagaatacccgggtcagattagtcttccgagtacacgtgcctcagccaagcggcagaacgctgtcacttcaggtcgctagtaatcctattgagtgctcccagagatctgcacaggagttgcctcttgtggagaagcagtccaccgattcatacccagtagtgggtggcaagaaaatggtcctctctggccacaactttttgcaggacagtaaagtgattttcgtcgagaaagccccagacgggcatcacgtctgggagatggaagccaaaactgatcgggacctgtgcaaacccaattcgctggtggtggagattcctcccttcagaaatcagcggatcacttcaccggtgcacgtgagtttttacgtctgcaatggtaaacgcaaacgttcacagtatcagcgttttacctacctgccagctaatgtccctattataaaaactgagcccaccgatgattatgagcccgctcccacatgcggcccagtctcacagggattgtcacctttaccccgaccctactacagtcagcaacttgcgatgccccctgacccgtcaagctgtcttgtcgccggtttccctccctgccctcagcggtctactctgatgcctgcagcgccaggagtgagtccaaagctgcatgatctcagccctgccgcatacacgaaaggagtggcatctcctgggcactgccacctcggattgccacaaccagcaggcgaagccccagccgtgcaggatgtgcctcgcccagtggctacacatcccggatcgcctggtcagccgccaccagccctgctgccacagcaggtctccgcgcctccaagtagcagttgcccacctggcctggaacactcattgtgtcccagttctccatcaccacccctgcctcctgcaacccaggagcccacatgcctgcagccgtgctcccccgcatgccctcccgctacggggaggccccagcatctgccgtcaactgttcggagagatgaaagcccgaccgccggacctcgcctgctccccgaggtgcatgaggatgggtctcctaacctggcaccaatacccgtaaccgttaaaagagagcctgaggagctcgaccaactgtatttggacgactag

SEQ ID NO: 29847 - DNA, 2142 bp, Artificial Sequence
  Description of Artificial Sequence: Synthetic coding sequence
atgccgtctacatccttccctgtgccaagtaaatttcctctgggcccagccgctgctgtgtttgggagaggtgagacgttgggacccgcacctagggccggaggcactatgaagtcagctgaggaagaacactatggctacgcttcctctaacgtgtctcccgctctccctctgccaaccgctcattctactctgccagccccatgccacaacctgcaaacttccacgccaggaatcattcctcctgctgaccatccatcaggatacggagcagcccttgacggaggcccagccggatacttcctgagctccggtcatacccgacctgacggtgcacctgcgctcgaaagtcctcgaattgagattacctcatgtctgggcttgtaccataacaataaccagttctttcacgatgtagaagtggaagatgtgctgcccagctctaagcggagtccctcaacggctaccttgtcactgccatccctagaggcctaccgagatcccagctgtctgtctccagcttcatcgctgtccagccgctcatgtaattcagaggcaagttcctacgagtcaaattactcttatccgtacgcaagtcctcagacatccccctggcagtcaccatgtgtgtctccaaagacaactgatcctgaggagggttttccacggggactgggggcttgcaccctgcttgggtcccccagacatagcccatcgaccagcccccgagcttcagttacggaagaatcttggctcggagcgcgaagttcccggcctgcctccccctgtaacaagagaaaatacagcctgaatggaaggcagcctccgtactcaccgcaccacagccctaccccgtccccgcatggctctccccgtgtgtcagtgacagatgattcctggttaggaaacaccacccaatatacaagtagcgccatcgtggcggcaataaatgccttgacgaccgactcttcattggacctgggcgacggagtgcccgtcaaatcaaggaagacgaccctggagcagccaccttctgttgcactgaaagttgaaccagtaggcgaagatctggggtccccgccaccacctgccgacttcgctcctgaagattattccagtttccagcatataaggaaaggcggattttgcgaccagtaccttgctgtcccacagcatccatatcagtgggcgaagccaaagccattgtcccccacttcgtacatgtctcctaccctacccgcactggactggcaactgcccagccattcaggtccatatgagctgcgtatcgaggtccagcctaaatctcaccacagagcccactatgagactgaaggttccaggggcgcagttaaggcctcggccggtggacaccccattgtgcagcttcatgggtacttagaaaatgagcccctgatgctgcagttgtttatcggaaccgccgacgatcgtttactgcggccacatgctttttatcaggtccacagaattactggtaaaactgtgtccacgacctcccacgaggccatactttccaacaccaaggttcttgaaatcccactgctgccagagaactctatgcgcgctgtaatcgactgtgccggtattctaaagctgcgaaactccgacattgagctcagaaagggggagactgacatcgggaggaaaaacacaagggtgcgcctggtgtttcgagtacatgttccacagccctccgggagaacgttgagcttacaggtggcctcaaacccaatcgagtgctcacagaggtcggcccaagaacttcctttggtggaaaagcagtcaaccgactcatatcccgtggtcggcggtaagaagatggtgctgtcagggcacaactttttgcaggacagcaaagtgatttttgtggagaaggctcctgacggccaccacgtatgggagatggaagcaaagactgaccgggacctatgtaagcccaactccttggtcgtggagatccctccgttccgaaaccaacgcatcactagtcctgtgcacgtgtccttctatgtctgcaacggcaagcgcaagcgtagccaataccagcggttcacttacctccccgcaaacgtaaacgagataatccgcaacgatctttcctccacgagtacacatagctag

SEQ ID NO: 29848 - DNA, 1416 bp, Artificial Sequence
  Description of Artificial Sequence: Synthetic coding sequence
atgctgcagttgttcatcggaactgctgatgacagacttcttaggccacacgcattctaccaggtacacagaattaccggtaaaacagtgtccactacatcacacgaagcgattttgtccaatacgaaagtattagagattccactcttacccgagaattccatgcgggctgtgatcgattgcgctgggatcttaaagctgcgaaattctgacatcgagctccgtaaaggcgagacagacatcgggaggaagaatactagagtgagacttgtgtttcgggtgcatgtcccccagcctagcggcagaacactgtccctgcaagtcgcttcaaaccccatcgagtgctctcaacggtcggcccaggaactgcccctggtcgagaagcaatccactgattcttatcctgtagtgggtggcaaaaaaatggtccttagcggccacaactttcttcaagatagtaaagtcatatttgtagagaaagctccagacgggcatcatgtgtgggagatggaagcgaagactgatagggacctgtgcaagcccaactcgttggtcgtagaaattcccccttttcggaatcagagaatcaccagtccagtgcatgtttccttctacgtctgtaacgggaagcgcaagaggtctcagtatcagcgattcacttacctgccagccaatgtccccattatcaagacagaacccaccgatgactatgagccagccccaacgtgcgggccagtctcacagggactgtcccctttaccgcgtccgtattactctcagcaattggcaatgcccccagatccgagttcttgcttggtcgcaggctttccgccttgtccacagcgctcgaccctgatgcccgctgccccaggcgttagcccaaagttgcatgacctttcgccggcagcctacaccaagggcgtagcgtccccaggccattgtcacctgggactaccccaacccgctggggaagcccctgccgttcaggacgtgcccaggcccgttgctacccatcctggaagtcccggtcagccacctccagctttgctgccccagcaagtcagtgcccctccctcaagcagctgtcctcctgggttggagcacagcttgtgtccaagcagcccttcgccacctctgcctccagcaacccaggagccgacctgtttgcagccttgcagcccagcatgccctccggcaacagggcgtccgcagcacctgccaagtactgtacgcagagacgagagcccaacggccggtcccagactgctcccagaggtacatgaagacggctcccccaatctggctcccataccagtgacagtgaagcgggagccggaggagctggatcagttatacctggacgacgtgaacgaaatcatcagaaatgacctgtctagcaccagtacccattcatag

SEQ ID NO: 29849 - DNA, 2766 bp, Artificial Sequence
  Description of Artificial Sequence: Synthetic coding sequence
atgaacgccccagaacgtcagccgcagccagatgggggtgacgctccagggcatgaaccaggaggcagtcctcaggatgagctggacttttcaattctgttcgactatgaatatcttaaccccaatgaagaagaaccgaatgctcacaaagtggctagcccgccaagcggtcccgcttatcccgacgacgtgctcgactatggacttaaaccctactctcccctggcttccctttcaggcgaacccccaggccgattcggggagccagaccgtgtgggcccacagaaatttctgtcggccgctaagcctgccggagcctctggtctgtccccacgtatcgagatcaccccatctcatgagttaattcaggccgttggcccactgaggatgcgggacgctggacttctagtggagcagccccctttagcaggcgtagcagcatctccaaggttcactctccccgtccctggatttgaggggtaccgtgagcccctctgtcttagtcctgccagctcgggatcctctgcatcttttatttctgatacattttccccgtacactagcccgtgcgtgtcccctaacaacgggggtccagacgacctgtgtccgcagttccaaaatatccctgcccattactctccaaggacctcccccattatgtcaccacgtacaagcctagctgaagactcttgcctgggcaggcactccccggtcccacgccctgcatcccggagctcaagtcctggtgctaaaagaagacatagctgtgctgaggctcttgtcgctctcccacccggagcatcaccacagaggtccagatcaccaagtcctcagccctcttcccatgtggcacctcaggaccatggaagtcccgctggataccctcctgtcgccggttctgcggttattatggatgctctaaatagtctagctaccgattccccatgcggcattccacctaagatgtggaagacctcccccgacccgtcacctgtctccgccgcaccatcaaaagccggactgccaagacatatctaccctgcagtcgaatttttgggcccatgcgaacagggagaaaggcgtaacagcgcgccagagtcgatcctgctcgttccccctacctggcccaaaccattggtgcccgctataccgatctgtagcattccggtgaccgcttcactccccccactggaatggccattgtctagccagagcggaagttacgagcttaggatcgaagtgcagcctaaacctcaccatcgtgcacactacgagacggaaggatcacgaggagctgtgaaggccccaaccggagggcatccagtagtgcaactgcacggatatatggaaaataaacccctgggattgcagatcttcatcggcaccgccgacgagaggatcttaaagccacatgctttttaccaggtacaccgcatcaccggtaaaactgtcaccactacaagctatgaaaagatcgtgggtaatactaaagtcctggagataccgctcgaacccaagaacaatatgcgggcaaccatcgactgcgccggaatcctgaagttgcgcaatgcagatatagagttgaggaagggagagactgatatcggcagaaagaatacacgggtcagacttgttttccgagtgcacatccccgagtcatcaggccgaatagtaagccttcaaactgcatccaaccccatcgagtgctcccaacggtcggcccacgagctgcctatggtggagaggcaagacactgactcgtgtctcgtgtacgggggtcagcagatgatacttaccggccagaattttacgagtgagtctaaagtcgtgttcacagaaaagactacggatggacaacagatctgggagatggaggcaactgtcgataaggacaaatcccaacccaatatgctgttcgttgaaatcccagagtatcgcaataagcatattcggacaccagtcaaggtcaatttctatgtgatcaatgggaaaagaaagcgcagccaacctcagcacttcacctatcaccctgtccccgctattaaaacagagcctacagatgaatacgaccccacacttatttgcagtcctacgcatggaggcctcggatcacagccctattacccacagcacccaatggtcgcggagtctccttcctgcctggttgcaaccatggcaccctgccagcagtttagaaccggcctctccagccccgacgccagataccagcagcagaaccccgctgccgtcctgtaccagcgcagcaagagtctgtctccatccctgttggggtatcagcagcctgccctcatggccgcacccctttccttggcagatgctcaccggagcgttcttgttcatgctggatcccagggccagagcagcgctttactgcaccctagtcctactaatcagcaggcctcacctgtcatacactactcaccaaccaaccagcagctaagatgtgggagtcaccaggagtttcagcacatcatgtactgcgagaacttcgctccaggaacaactcgccctgggccaccacccgtgtcacagggtcagcgactgtctccgggatcgtaccccacagtgatccaacagcaaaatgccaccagtcagcgcgctgcaaaaaatgggccaccagttagcgatcaaaaagaagtcttgcccgctggcgtcaccattaagcaagaacagaacctggaccagacctacctcgatgatgaactgatcgatacccacctctcatggattcaaaacatcctatag

SEQ ID NO: 29850 - DNA, 978 bp, Artificial Sequence
  Description of Artificial Sequence: Synthetic coding sequence
atgagtccgagaacgagcctggccgaggattcttgccttggccgacattcccctgtccctagacccgcaagccggagcagcagcccaggagctaagcgtaggcacagctgtgcagaggccctcgtcgctttgccacctggcgcatccccccagcgctccagatctccctcaccccagcctagtagccacgtggccccacaggaccacggatcaccagccggatatcctcccgtggcagggagcgccgtgataatggacgctcttaatagcctcgctaccgacagcccatgcggcatccctcccaaaatgtggaagacctcaccagacccatctcccgtgtccgcagcaccctcaaaagcgggactgccacggcacatttacccggcagtggaatttctcgggccatgtgagcagggagaaagacgtaactcggctcccgaaagcattctgttagttccacctacgtggccaaagccactcgttccagcgatcccgatctgttccatccccgtcacagcatccctgccccctttagagtggcccctgagcagccagtcaggcagctacgagctgcggatagaagtacagcctaagccccaccatagagcccactatgaaacggaaggctctcgtggggctgtcaaggctccaaccggaggtcatcctgtcgtgcagctgcatggatatatggaaaataaacccttgggcctgcaaatctttatcggaacggccgacgaacggatattgaagccacatgccttttatcaggtccatcgcatcacgggcaaaacagttacaaccacttcttatgagaagattgtggggaataccaaagttcttgaaattcctctggaaccctcgacggcaccacacctgctcagcccttttatgtttattagtcagcctggggtgcatactaggatcaacgtgtgggcactgtctggcctgagtctgaaggaactggctaccagtctctag

SEQ ID NO: 29851 - DNA, 2778 bp, Artificial Sequence
  Description of Artificial Sequence: Synthetic coding sequence
atgaacgcccctgaaaggcagccccagccagacggtggtgatgcccctgggcacgagcctggaggatccccccaagatgagctggacttttctatcctctttgattatgagtatctgaaccccaatgaggaagagcccaacgctcacaaggtggcgagcccaccaagcgggcctgcttacccggatgatgtgcttgactacggtctgaaaccttactcacccctcgctagcctgtctggtgaaccacccggtaggttcggtgagcctgatagagtgggaccccagaagttcctctcagcagccaagcccgcaggcgcttcggggctgtcccctcggattgagattaccccatctcatgaactgatccaggcagttgggcctctgaggatgcgagacgccggacttttggtcgagcagccgccattagccggtgtggccgcaagtccaagatttacgttgcccgtgccgggatttgagggttatcgggaacccctgtgtctctctccggcatctagcggatccagcgcatccttcatttccgacaccttctctccatacacatcaccctgcgtgagcccaaataatggcggacctgatgacctgtgtccacaattccagaatatccctgcccactacagccccagaacatcccctataatgagcccacggacctcattagccgaggatagttgtctggggaggcatagtcctgtcccacggcctgcatcccgatcctcctcccctggggcaaagaggcgccattcatgtgccgaagcattagtagccttacccccaggagcctctccccaaaggtcacggagcccgtctccccagccatcaagtcacgtggctccccaggatcacggaagtccagcgggatacccacctgtcgctgggtccgcagtcatcatggacgccctgaatagcctggctacagattcgccctgtgggatcccccctaaaatgtggaaaacgagcccagaccctagcccggtgtctgccgcacccagcaaagcaggtctccccagacacatataccccgcagtcgagttcttgggtccctgcgagcagggtgaaagacgaaatagtgcgccagaatccattttgctggttcctcctacgtggccaaagcctttggtacctgcaatcccgatatgctctatccccgtgactgcctccctcccccctctggagtggcctctaagttcccaatccggcagttacgaattgaggatcgaagtccagccaaagccgcaccatagggcccactatgaaaccgagggctcaaggggagcagtaaaggcccctaccgggggacaccccgtggtgcagctacacggctacatggaaaataagccactggggcttcaaatatttattggaaccgccgacgagagaattctgaagccccatgccttttaccaggttcatcgcatcactggcaagacagtgacaacaacgtcctatgaaaagatcgtcggcaacacgaaagttctggagatcccgttagagccaaaaaacaacatgcgagcaaccattgattgtgctggaatcctgaagcttcgcaacgctgacattgagctgcgcaagggcgagactgatatcggccgaaagaacacccgggttcgcctggtgttcagagtgcatatccccgagtcttctggcagaatcgtgagcctacagactgcttccaaccctatcgagtgtagccagcgctctgcgcacgaactgcccatggtagaaagacaggacaccgactcttgcctggtttacggaggccagcaaatgatcctaacgggtcaaaacttcacaagcgagagtaaggtcgtgttcacagagaaaacaacagacggccagcagatctgggagatggaggcaacagtcgacaaggacaaatcccaaccaaacatgctgttcgtggaaattcccgagtatagaaacaagcacattaggactcccgtcaaggtgaacttctacgtcatcaatggcaagagaaagcgttcgcaaccccagcacttcacataccatccagtgcccgctattaagactgagcccacggatgaatacgatcctacccttatttgcagtccaactcacggcggtcttggcagccagccttattatccacaacatcctatggtggctgagtccccaagctgcctggtagcaaccatggccccatgtcagcaatttcggacgggcctctcatcacctgatgccaggtatcaacaacaaaatcccgcagctgtcctgtaccagaggtctaagtcgctcagtccgtctctcttaggctaccagcaaccagctcttatggcagcgcctctcagtctggccgacgcgcacagatccgtacttgtccatgctggatcccaaggccagagcagcgccctgctgcacccaagcccaaccaatcagcaggcatctccagttatccattattcacctaccaaccagcagttgcgctgtggatcgcaccaagaattccaacacatcatgtattgcgagaacttcgcccctggtactacaagaccgggaccgccacctgtctctcaagggcagcgattgtcaccgggatcctacccaaccgtgattcagcagcaaaacgcaacttctcagcgggctgccaagaacggaccacctgtaagtgatcagaaggaggtgctcccagctggggtgaccattaagcaggagcagaatctagatcagacgtatcttgacgatgtaaacgaaataataaggaaggagttttccgggcctccggcaaggaaccagacatag

SEQ ID NO: 29852 - DNA, 2706 bp, Artificial Sequence
  Description of Artificial Sequence: Synthetic coding sequence
atgcaaagagaggctgcatttcgcctcgggcattgccacccactccgcattatgggatctgtggaccaagaagagcctaatgcacataaggtggctagccctccctccggccctgcatatcctgatgatgtactagactacggtctgaagccttattccccactagcgagtcttagcggagagccgccaggcagatttggagagcctgatcgggtggggccacagaaattcctcagcgccgcaaaacctgccggagctagcggattgtcacccagaatagagattacccctagccacgaactgattcaagccgttggccctcttaggatgagggatgccggactgcttgtggagcagccccctttagctggagtggctgcctccccgaggtttaccttgcctgtgcccggattcgaaggctatcgtgaacctctctgcctgtctccagccagctccggctcttccgcctccttcatttccgatacttttagcccctataccagtccctgtgtcagccccaataatgggggacccgatgatctgtgtcctcaattccaaaacatccctgctcactattctccaaggacgagccctattatgtccccaaggacctccttggcagaggactcatgtctggggaggcacagtccagtgcccaggccggcaagccgctctagcagccctggggctaagagaaggcatagctgcgccgaggctctcgtggcgctacccccaggagcttcacctcagagaagtagatcccctagcccgcagccttccagccacgtcgcccctcaagatcacggatcccccgcaggttaccccccagtggcaggttccgcagtgatcatggatgcactgaatagcctggcaacagactccccatgcggaattcccccaaaaatgtggaagacctcccctgacccgagccccgtgtcagctgcaccctccaaagccggattgcccagacacatttaccctgcagttgagttcttggggccttgtgagcagggagaacggaggaactcggcacctgaatcaattctgttggtgccaccaacatggcctaaacctctggttccagccattcccatctgtagcattcctgtgacagccagcctacctcccttggaatggccccttagcagccagtcgggatcctatgaactacggattgaggtgcagccgaaaccgcatcaccgggcacattacgaaactgagggatccagaggcgcagtcaaggcaccaactggtggccaccctgtggttcaattgcatggctacatggagaataaacctttaggcttgcaaattttcatcggaacagccgatgagagaatactcaagcctcacgcattttatcaggtccacagaattactgggaaaaccgtcactaccaccagctacgaaaagatcgtgggcaacactaaggtgctggaaattccactggagcccaaaaacaatatgcgagctactattgactgtgccggaatacttaaactgcgtaatgctgacatcgagctgaggaaaggagagacagacatcggaagaaaaaacacccgcgtgcggctcgtcttcagggtgcacattccagagtcctcgggacgaattgtatccctccaaaccgcctccaatcctatagaatgttcccagaggtcagcccatgagctccccatggtggagcggcaggatacggattcctgcctggtttatggaggacagcagatgattcttacagggcaaaactttacgtctgaatccaaggttgtgtttactgaaaagactaccgatggtcaacagatctgggagatggaagctactgttgacaaggataagtcccagcctaatatgttgttcgtggagattcctgagtacaggaacaaacacattcggacacccgtgaaggttaatttctatgtgattaatggaaagcggaagcgctctcagccccaacatttcacttaccatcctgttcctgccattaaaactgaacccacagacgaatacgatcccaccctgatctgcagccccactcacggcggtctcgggtcccagccgtattatcctcagcatccaatggtggcagaatccccaagctgtctggtcgctacgatggccccatgccaacagtttaggacgggcctgtcctcaccggacgcgagataccagcagcaaaatcccgcagccgtgctatatcaacgctctaaaagtctgagccccagcttactggggtatcaacagccagcgcttatggctgccccactctctctcgccgatgctcatcggtccgtactggtgcacgccggaagccaaggacagtcatctgcactactccatcccagtcctacgaatcaacaggcatcaccagtgatacactattctccaaccaaccaacagcttcgatgcggatcgcaccaggagtttcagcatattatgtattgtgagaactttgcacctggaactacccgtcctggacccccacccgtgtcccagggccagaggttgtccccagggagctacccgacggtgatacagcagcagaacgctacatcacagagagctgccaagaatggtccaccagtgagcgatcagaaggaggttttgcctgctggcgtgaccattaagcaggaacagaatctggaccagacctacctcgatgatgaactgattgatacacacctcagttggatccaaaatattctctag

SEQ ID NO: 29853 - DNA, 3207 bp, Artificial Sequence
  Description of Artificial Sequence: Synthetic coding sequence
atgacgaccgctaactgtggtgcccacgatgaattagattttaagctggttttcggcgaagatggcgcacccgcaccccctcctccaggtagccgccctgcagatctggagcccgacgattgtgcaagcatatacattttcaacgtggacccccctccatctactttgacaactcccctgtgtctgccccaccacggactcccgtcccattcctccgtcttatcgccaagtttccagctccaatcacacaagaattatgagggcacatgcgagataccagagagcaaatactccccacttggagggccaaagccattcgagtgcccgagcattcagatcacgagcatcagtcccaattgtcaccaggagttggacgcgcatgaagacgacctgcaaatcaatgaccctgagagagaatttctggagagacccagccgcgatcacctctatttaccactagagccttcctacagagagtctagcctctctccctcacctgcatcatctatatcttcgcgtagctggttttccgacgcatcttcatgcgagtctttgtctcacatctacgatgacgtcgactccgagctgaacgaggctgcagcaaggtttacactgggatcaccactcacctctccaggcggttcccctggcggttgccctggagaagagacctggcaccagcagtacggactcggccactccttatcccctaggcaatccccctgccacagtcctcgcagtagtgttacagacgaaaactggctctcccccaggcccgcatcaggtccttcttcccgtccaactagcccgtgtggcaaaaggcgccatagtagcgccgaggtgtgctacgccggttctctcagtccccaccactcccccgtgcccagccccggtcacagtcccagggggtctgtgaccgaagatacttggttgaacgcaagcgttcatgggggatcagggttaggcccagcagtgtttccttttcagtattgtgtggaaactgatatccccttgaagacacgtaaaacctccgaagatcaagccgctattctccccggaaagctagaactgtgctcagacgaccagggcagtttatcccctgcccgagaaacttctatcgacgacggcttgggatctcaatatccgctgaagaaggattcgtgcggggatcagttcctatctgtgccaagtcctttcacctggagcaaacctaagccgggtcacacgcctattttccgtaccagctccctacctccccttgattggccccttccagctcactttgggcagtgtgagctgaagatcgaggtgcagcccaaaacccaccacagagcccactatgagaccgaggggtcccggggtgctgtgaaggcatcaaccgggggtcatcccgtagtgaagctgctgggctacaacgagaagcccatcaacctgcagatgtttattggaacggcggacgatcgctatttgagacctcatgctttctatcaggtgcaccgcattacgggcaaaacagtcgctacagcaagccaggagattataattgcttctaccaaggtgctggagatccccttgctgccggagaataatatgtcagccagcatcgattgcgccggaattctcaaactgcgaaatagtgatatagaactgcgcaagggggagacagatattggaaggaagaatactcgtgttcgcttggtgtttcgggtccatataccgcaaccctcaggcaaagtgttgagtctccagatcgctagcatccctgttgaatgtagccaaagatctgcacaggagctgccccacatcgaaaagtactccattaactcttgctccgtgaacgggggtcacgagatggtggtcacaggctcaaacttcctgcccgagtcgaagataatattcctcgagaagggccaggacggacgaccgcaatgggaggtggagggcaaaatcatcagggagaagtgtcagggtgcacacatcgtgctggaagtgcccccatatcacaaccccgctgttaccgccgctgtccaggtacatttttacctgtgtaatggcaaaaggaagaagagtcagtcacaaagatttacatacaccccagtgttaatgaagcaagagcaccgtgaggagatagatctctcctctgtccccagcctgcctgttccccatcctgctcaaacacagcggccatcaagcgacagtggttgctctcacgactcagtcttatcaggccagaggtcgttaatatgtagtattccacagacctatgccagcatggtgacctcatcccacctaccccagctgcaatgcagagacgagagcgtaagcaaggagcaacacatgatcccaagcccaatcgtccatcagccattccaggtcacacccacaccccctgtaggatccagctaccaacctatgcagacgaacgtggtgtacaacggtccgacatgcctgccaataaacgctgcctcctcacaggagtttgactcggtacttttccagcaagacgcgactcttagtggcctggtcaatctgggctgccagcccttatctagcatcccctttcattcctccaattccggcagcactggacacctgctcgctcatacaccacattctgttcacaccctcccgcatttgcagagcatgggatatcactgttccaatacgggtcagcggagtctttcttcaccagttgccgaccagattacagggcaaccctcttcccaactgcaaccaattacctacgggccatcccacagcggcagtgctaccacagcgagtcccgcagcttctcacccacttgcttcatctccactgtctggccctcccagcccacagctacagcccatgccgtaccagtcaccgtcctccgggactgcctctagcccgtctccagccacacgtatgcatagcgggcagcacagcacccaggcacagagtacaggacaagggggactctccgctcctagctcactgatctgtcacagtttgtgcgacccagccagtttcccacccgatggcgctacagtgagcattaaaccagagccagaggaccgagagccaaattttgcaactataggattgcaggatatcacactggatgatgatcaatttataagtgaccttgagcatcaacccagcggtagcgctgagaagtggcccaatcacagcgttctttcctgtcccgctcctttttggaggatatag

SEQ ID NO: 29854 - DNA, 3228 bp, Artificial Sequence
  Description of Artificial Sequence: Synthetic coding sequence
atgacgaccgccaactgcggcgctcacgacgagctcgacttcaaactggtttttggtgaggacggcgctcccgcacctccacctcctggcagtcggcctgcggacctagaaccagacgactgtgccagtatatacattttcaacgtggatccacctccctccaccctcacaacacccctttgtctgcctcaccatggactgccatctcatagtagtgtccttagcccctcctttcaactgcagtcgcacaagaactacgagggtacctgcgagatcccagaaagtaagtatagcccactcggaggtccgaaacccttcgagtgtccgagtattcagataacatcaataagccctaactgtcaccaggaactagacgcacacgaagacgacctgcagattaatgacccagagcgcgaatttctcgagcgaccttcccgagaccacctgtaccttccactggaacccagttatcgggagtcttcactgagccctagccctgccagtagcatatccagccggagctggttttccgacgccagctcctgtgaatcactgtctcatatttatgacgacgtcgattcagaactaaacgaagccgctgcacggtttacccttgggtcccccttgacctcccccggaggatctccaggcggatgccccggtgaggagacctggcaccagcagtatggccttgggcacagccttagtcccaggcagagcccatgccatagtccaaggtccagcgtcactgatgaaaactggctgtctccgagacctgcatccggcccatcctctaggccaaccagcccttgcggcaaaaggagacattcctcagcagaggtgtgctatgccggaagcctgtcaccacatcactcacccgtcccgtcccccggacacagccccagaggaagtgtgaccgaggacacctggttaaacgcttctgtccacggcggtagtggcttaggtcccgcagtctttccattccagtattgtgttgagacggacatcccccttaagacaagaaaaacaagcgaggaccaggccgcaatcctaccaggtaagctagagctatgttctgatgatcaaggaagtttgagtcccgctagagagaccagcatagacgatggactgggctcccagtatcccctaaagaaagatagttgcggcgatcagtttttgtctgttccaagcccgttcacctggtcaaagcccaagccaggacacaccccaatcttcagaacaagctcgttaccccctctggattggccacttccagctcactttgggcagtgcgagctcaagattgaggtccagcctaagactcaccatcgcgctcactacgagactgaagggtcccgcggtgctgttaaggccagtactgggggacacccagtggtaaagttgctgggctataatgaaaagccaataaatttacagatgtttatcgggacagcagatgaccggtacctgaggccccatgccttttaccaggtgcaccggattacgggaaagaccgtcgccacagcctcacaggaaattataatagcatccacaaaggttctggaaattcctctgctgccagagaacaatatgtccgcttccatcgattgcgctggaatcctcaagctgcgcaactccgatattgaactgcggaaaggtgaaacagacatcgggaggaagaacacaagggtgcgactagtgttccgggtccacatacctcaacctagcggtaaagttttgagtctgcaaattgcctccattcccgttgaatgtagccagagatccgcccaagaactgcctcatatcgaaaagtacagcatcaattcctgctctgtaaacggtggccatgagatggtggtcacaggcagcaactttctgcctgaatccaagataatcttcctagagaaggggcaggacggaaggccccagtgggaggtcgaggggaaaattattcgggaaaagtgtcagggcgctcacatagtcctggaggtgccgccttatcacaatcccgctgttacagccgcagtccaggtacacttctacctttgcaacggcaaacggaagaagagccagtcacagcggttcacatacacccccgtgctcatgaaacaggaacaccgagaagagatcgacctcagcagtgtgccatcattgcccgtgcctcatcctgcccagacacagagacccagctctgactccgggtgttcccatgactcagtcctgagtggacaacgcagtctcatttgctccataccccaaacatatgcgtcaatggtaacctcatcgcatctaccccaattgcagtgtagagacgagtccgtgtccaaagaacagcacatgataccctctcccatcgttcatcaacccttccaggtgacaccgaccccacccgtcgggtctagttatcagcccatgcagacgaatgtggtctataacgggccaacctgccttcccattaatgccgcatcctcacaggagttcgacagtgtgctcttccagcaggatgctaccttgtcaggccttgttaacctcggttgccagcctctgtccagcatcccatttcacagttccaattctggcagtaccggacatctgctcgcccatactccccattcagttcataccttaccccacctacagagtatgggttatcattgcagcaataccggacagcggtctctgtcttcgccagtagcggatcagattaccggccagcccagctcacaactgcaacctattacttatggtccctctcattctggatccgcaaccaccgcgtcgcctgcggcttctcaccccctggcttctagtcctctgtctggtccgccttccccacagctgcagccaatgccctatcaatccccaagctctggaacggcatcttctccgtcacccgcaacgcggatgcattcaggtcaacactcaacacaggcccagtctaccggacaaggagggcttagtgccccaagctcactgatctgccactccctctgtgatccagccagttttcctcctgacggggctactgtgagcatcaaacccgagcctgaggatcgcgagccaaacttcgcaactatcggactgcaagacattaccctcgacgacgttaatgagattatcggtcgtgatatgtcccagatttctgtgagtcaaggcgcaggagtaagcaggcaggctccattgccatccccagagtcactggacctcgggcgatcggacggcctgtag

SEQ ID NO: 29855 - DNA, 3198 bp, Artificial Sequence
  Description of Artificial Sequence: Synthetic coding sequence
atgaccactgcaaactgcggagctcatgacgaactggactttaaactggtgttcggagaagacggagcacccgcaccccctcccccaggcagcaggcctgcggatttggaacccgatgactgcgctagcatctacatcttcaacgtggacccccctccttccacattgactactcccttatgtctgccccaccatgggctcccaagtcacagctccgttctttcaccgtcattccagttgcaaagccacaagaactatgaagggacctgcgagattccagagtccaagtactcccctctgggcggtcctaagccatttgaatgtccatctattcagattacctccattagtcccaattgccatcaggagttagacgctcacgaagatgacctgcagatcaacgaccccgaacgagaattccttgaacggcctagccgcgaccacctctatctgcccttagaaccaagctatagggaatcttcgctgtccccttcaccagcatccagtatcagtagcagatcttggtttagcgacgcctcctcatgtgagtccctgtcacacatttatgacgatgtggactcagagctgaacgaggccgcagccaggtttaccctgggaagccctctgacgtccccaggcggaagccctggaggatgtccaggggaagagacatggcaccaacagtatggcttgggccattctctgtctccgaggcagtccccatgccattccccacgcagttcagttaccgacgagaactggcttagccctaggcccgcatccggaccatcaagtcggcctacgagtccatgcgggaagagacgccattcgtctgctgaggtgtgttatgcaggctccctctctcctcaccactctcctgtgccaagccccggacactcacccagaggcagtgtgacagaagatacatggctcaacgcaagcgtgcatgggggtagtggcttgggaccagctgtgtttccatttcaatactgcgtagagaccgatataccactgaagaccagaaaaaccagcgaagaccaggccgctatcctgcccggaaagctagagctgtgttccgacgaccaaggttctctgtcacccgctagagaaactagcattgacgacgggttgggcagccagtacccactaaagaaggacagttgcggtgatcagttcctctccgtcccctctccttttacctggtctaaacccaagcccggacacacccctatctttcgaacttcgtccctgccaccactggactggccactgcctgcccacttcggccagtgcgaattaaaaatagaagtgcagcctaaaacccaccatcgggctcactatgagactgagggatctcggggtgccgtgaaggccagcactgggggacaccccgtcgtgaagctgctcggttataatgagaagcccattaacctacagatgttcatcggcacagccgacgatagatatctgcgccctcatgcgttctaccaggttcatcgtattaccggcaagacagtcgccaccgcctcacaggaaataattattgcctcaacgaaggttcttgagatcccattgctgcccgaaaataacatgagtgcgtccattgactgcgctggaattctgaagctccgaaatagcgatattgaactgcgaaaaggggagaccgatatcggccgtaaaaacactcgagtgagactcgtctttcgcgtacacataccacagccgtccggcaaagttctgtctcttcagatcgcctctattcccgtcgagtgtagtcagaggagcgcccaggagctcccacatatcgagaagtacagcattaattcatgttcagtgaatgggggtcacgaaatggtggtaaccggctccaactttcttcctgagtccaaaatcatatttctggaaaaaggtcaggacgggagacctcagtgggaagtggagggtaagataatccgggaaaaatgccagggcgctcacatagtgctggaggtcccaccttatcataaccctgccgtgactgccgctgtccaggtacacttctacctctgcaatggtaagcgcaaaaagtctcagagccagcgcttcacctacactcccgtgctgatgaagcaggagcacagagaggagattgatctgtcttccgtcccgtcccttccagtccctcacccagcgcagacacaacgcccttctagtgactctggctgctctcatgactcggtcctctcaggtcagcggagtcttatctgttcaataccacaaacttacgcctcaatggtgacatcttcccatcttcctcaactgcagtgtagggatgaatcagtttcaaaggaacagcacatgattccgtccccgatcgtgcaccaacctttccaggttactcccaccccaccagtgggatcctcttaccagccaatgcaaactaacgtggtttataatgggccaacctgcctgccaattaacgcggctagttcacaagagttcgactcagtgctgttccaacaagacgcgacgttgagtggacttgtaaatttgggctgtcagccactatcttctattcctttccatagctccaactctggtagcaccgggcacctactcgcccataccccccactcagttcacactttgccacatctacagtccatgggctaccattgcagcaacaccgggcagcgcagcctgagtagtcctgtggccgatcagataacaggacagccttctagccagctgcaaccaataacatatggtccatcccactctggcagcgctactaccgcttccccagccgcaagtcatcccctcgcaagtagcccactgagtggcccaccaagtccgcagcttcagccaatgccttaccagtcccccagttctggaactgcatcctcccctagtcccgcaacccggatgcatagtgggcaacatagcacgcaggcccagtctaccggccagggcggtctgtctgcccctagctccctgatctgtcattccctttgcgaccccgcttcttttccgccagacggtgctacagtctctatcaagccagaacccgaagatagggaacccaattttgctacaattgggctgcaagacatcaccctggatgatgacctattcacctcaaataacttcgatctccttcagttgcgacccaccttctggcctgtgcccgctggtagatatctgaggaacctggagtag

SEQ ID NO: 29856 - DNA, 1770 bp, Artificial Sequence
  Description of Artificial Sequence: Synthetic coding sequence
atgtttattggcaccgctgacgatagatatctgcgcccacacgccttttaccaagtacacaggatcaccggcaagactgtggcaaccgccagtcaggagattatcatagcgtctaccaaagtgttggagattcctctccttccagaaaacaatatgagtgcgagcattgactgtgctgggatactgaagctgaggaacagcgacattgagctgcgcaagggggaaactgatatcggcaggaagaacacaagggtacggctggtgtttcgggtgcacatcccccaaccttcaggaaaggtgttgtcactgcaaatcgcatctattcctgtggaatgctctcagaggtcggcccaggaactgcctcacatagaaaagtacagcataaacagttgcagcgtcaatgggggtcatgaaatggtggtaactggatccaatttcttgccagagtccaaaataatcttcctggagaagggacaggatgggcgtccccagtgggaagtggagggaaagattatccgcgagaagtgtcaaggagctcacattgtgctggaggtgcctccatatcataaccctgcagtgacagctgctgtgcaggtgcatttctatttatgcaacggcaagagaaagaaatcacagagccagcggttcacttacaccccagtactgatgaagcaagagcacagggaggagattgatctttcatcagttccctcgctgcccgtgccccaccccgctcagacgcaacggccatcttctgactccggctgctcacacgacagtgtcttgagtggccagcgctcactgatctgcagcatccctcaaacctacgcatcaatggtgacatctagtcatttaccacaactgcagtgtcgggacgagtccgttagtaaagaacaacacatgatcccatcaccaatagtgcatcagccctttcaagtaacaccaacgccacccgtggggtctagttaccagcccatgcagactaatgttgtatataacggtcctacctgtttaccgatcaacgcagccagcagccaagaattcgactcagtactgttccagcaagacgctacactcagtggcctggtgaatcttggatgccagcctctgagcagtataccattccattcttcaaatagcggatcaaccggtcacttactggcacacactccgcactccgttcacacccttccccacctccaatccatggggtatcactgcagcaataccggccagcggagtctcagctctccagtggccgatcaaatcactggccagccttcctcccagctgcagcctattacatacggtcccagccatagcggctccgctactacggcaagccccgctgcttctcatcccctagcgagctcgccactgagcggccctccatcaccccagcttcagccaatgccttaccagtccccgtccagcgggacggccagctcccccagtcccgcaacgcgtatgcacagtgggcaacattctacccaagcccaatccacaggccaggggggactgagcgccccatcctcgttaatttgtcatagcttgtgtgatccagcaagttttccccctgatggagccactgtgagcatcaaaccagaacccgaagaccgcgagcccaactttgccacaatcggcttacaggatattactctggacgacgatcagttcatttctgatctggaacatcagccgtccggctcggctgagaagtggcccaaccatagcgtactttcctgccctgccccattctggcgaatttag

SEQ ID NO: 29857 - DNA, 2709 bp, Artificial Sequence
  Description of Artificial Sequence: Synthetic coding sequence
atgggcgcagcctcctgcgaagatgaggaactggagttcaagctcgttttcggagaagagaaggaagccccaccactcggcgcaggcggactgggagaagagctggatagcgaagacgctccgccttgttgccgcctcgccctgggggaacctccaccttacggtgccgcaccgataggaatcccaaggccacctccaccaagaccagggatgcattctcctccgccaagaccagctcccagcccaggcacatgggagtctcagccagccaggtctgtgaggcttggtggccctggcggaggggctggcggtgctggaggagggagggtcctcgagtgcccttcgattcggataacaagcatatctcctacccctgagccacctgctgcactggaagataatcctgacgcctggggtgatggctcccccagggattaccctccacctgaaggcttcggcggttaccgggaagccggtggccagggcggaggcgcatttttctctcccagtcccggtagctcttccctgtcttcttggtcttttttttcagacgccagcgatgaggccgctttgtatgcagcatgtgacgaggttgaaagcgagctcaacgaagcggcatctcgcttcgggctcggctcgcccctaccctccccaagggcatccccacggccttggacccccgaggacccatggtcattatacggtccctccccgggtggcagggggccagaagactcatggttgttactgtccgcacctggcccaacaccggcaagccctagaccagcctctccttgcgggaagaggaggtatagcagctctgggaccccgtcttccgccagcccggctttgagccggagaggctccctgggcgaggagggaagtgaacctcctcccccacccccattacctttggctcgggatccaggcagtcccggaccctttgattacgtaggtgctccccctgcggaaagtatcccacagaaaacccgacggaccagcagtgagcaagcagtggcactgccaagaagtgaagaacccgcaagttgcaacggaaagttacccttgggcgctgaagaaagtgtcgcaccacctggtggcagccggaaagaggtggcaggcatggattatctggcggtgccgtctcctttggcatggtcgaaagccagaattggaggccactcacccatcttcaggacttcagccttgccccctctggactggcccctgccctctcagtatgagcagctggagctgcggattgaagttcagcctagggcgcaccatcgagcccattacgaaacggagggctcacgaggagctgtcaaagccgcacccggaggccacccagtggtgaaactgctgggatatagtgagaagccactcactctgcaaatgtttattggtactgctgacgagcgtaatttaaggcctcacgccttctatcaggtacatagaattacaggaaagatggtggctacggcctcgtacgaggccgtagtgtccggaactaaagtcctggagatgaccctgctgcccgaaaacaacatggcagccaacatagactgcgcgggtattttgaaacttaggaattctgatatcgagttaagaaaaggcgagacagacattggcaggaaaaacacccgtgtccggctggtctttagagtgcacgttcctcagggaggaggcaaggttgttagtgttcaagccgcaagtgtgccaatcgaatgtagccagcgctccgctcaggaactgccccaggtggaggcctactccccgtcagcttgctcagtgcggggaggcgaggaactggtgcttactgggtccaacttcctcccggactcaaaggtggtttttatcgagcgcggaccagacggcaaattgcagtgggaagaggaagcgacagttaacagactccaatctaatgaagttacactgacccttacagtccctgagtactcaaacaagagggtctcacgcccagtgcaggtgtatttttatgtgtccaatggacgacgcaagcggagcccaactcagtctttcaggtttctgcctgtcatctgcaaagaagaacccttgcccgattcttccctcagaggctttcctagtgcctctgctacccctttcggtaccgatatggacttttcgcccccacggccaccttatccttcttatccccacgaggatcctgcctgcgagaccccatacctctcagaggggttcgggtacgggatgccgcctctgtacccgcagacagggccaccaccgtcttaccgccctggattgcgaatgtttccagagactcgcggaacaaccggctgtgcccaacctcccgcagtgtcctttctcccaagaccattcccctccgacccttatggcggtcggggaagctccttctctttgggccttccctttagcccacctgcgccttttcgcccaccccctctacctgcaagcccccctctggaagggccttttcccagccagtctgatgtgcatcccctgcccgcagaaggctataataaggtcggccctggctatggtcctggcgagggcgcaccggagcaagagaaatctaggggtggatattccagcggctttcgggatagtgtccctattcagggtatcacattagaggaggtatccgagataatcggcagagatctttctggtttccccgctcctccgggtgaggaacctccagcctag

SEQ ID NO: 29858 - DNA, 2895 bp, Artificial Sequence
  Description of Artificial Sequence: Synthetic coding sequence
atgattactaccctccccagcctcttacccgcatccttggcttcaatcagccatagagtgactaacctgccatcaaacagcttgtcccataacccaggacttagtaagcctgattttcccggaaactctagccctgggcttccctccagtagctcacccggaagggacttaggagcacctgctggcagcatgggggcagcatcgtgcgaggatgaggagcttgaattcaaactggtcttcggagaagagaaagaagcccctccgctgggtgcaggaggtctaggagaagagctggacagtgaggacgccccaccatgctgtcgtctggctctaggcgaaccgccaccatacggagcggcacccatcgggatacccaggccgcctcccccaaggcctggcatgcactctccacccccaaggcctgctccaagtcctgggacctgggagagtcagcccgctcgctcagtacgcttaggcggacccggaggcggtgccggtggcgcaggtgggggacgggtgctggaatgcccctccatccggattacaagtatttcaccaactcctgagccccctgcagctctggaggataacccggatgcttggggggacgggtctccaagagattacccccctcccgaggggttcggaggttatcgggaggccggtggtcaaggtggaggcgcttttttcagtccaagcccgggaagctcatctctgtcctcttggtctttcttcagcgacgcttcagatgaagccgctttgtacgccgcatgcgatgaagtcgaatccgagttgaacgaggctgccagccggttcggcctcggttcgcccttgcccagcccgcgagccagccccaggccatggacacccgaggatccgtggtcactgtatggacccagccctgggggtcgagggcctgaagacagctggctgctgctgagtgcacccggaccaactcccgcatcgccaagacccgcttccccatgcggcaagagacggtacagtagctccgggaccccttctagcgctagcccagcgctgagtcgcagggggagtttaggcgaggaaggttctgagccacctccccctccgcctctcccgctcgctagggaccctggatcaccaggacccttcgactacgtgggcgctcccccagctgagtccattccacagaagactaggagaacatctagtgagcaagcggtggcactcccgaggtccgaggagccagctagttgcaacggcaagctgccactgggtgccgaggagtcggtcgcccctcctggtggctcaaggaaagaagttgccggaatggattacttggcggtccccagtcctctcgcttggagtaaggccaggattggtggacatagcccaatatttagaacttcagcccttcctcctcttgattggccgctgccaagccagtatgagcagctagaattaagaatcgaggtgcaaccaagggcacatcacagggctcactacgaaactgaagggagcaggggggctgtgaaagcagcacccggtggacatccagtggtgaaactgctcggctattccgagaaacccctcaccctgcaaatgttcatcgggacagccgacgagcggaatttgcgcccacacgctttttaccaggttcataggatcaccggcaaaatggtagccacagcctcctatgaagcagtggtgtccggcacgaaagtgttggagatgactctccttccggagaacaacatggccgctaacatcgactgcgccggaattcttaagcttcgaaacagcgacattgagctgagaaagggtgaaaccgatatcggacgcaagaataccagagtgagacttgtattccgcgtccatgttcctcagggcggaggcaaggtggtaagtgttcaggccgcatccgtgcccatcgagtgtagtcagcggagcgcacaggaattgccccaggtggaagcctattccccatctgcatgcagcgtaagagggggagaagaattagtactcaccggcagcaacttcctgccagattcgaaggtcgtgtttatcgagcgcggtcccgacggaaaattgcagtgggaggaggaggctacggtgaaccggctgcagtctaacgaagtgacgctcaccctgacagtgcccgaatattccaacaagcgtgtgtctcggccagtgcaagtgtacttctacgtctccaatggtcggagaaaaagatcaccgacacagtctttcaggttcctcccggtgatttgcaaggaagagccattgccagactcatctctgagaggcttcccctcagcttcagccacgccctttggtaccgatatggatttctccccacctaggccaccctacccttcctatccacacgaggaccccgcttgcgagacaccctatcttagcgagggattcggctacggaatgcctccgttataccctcaaaccggcccacctccttcctacagacccggactgagaatgttccccgagactaggggtacgaccggctgcgcccagcctccagccgtgtccttcctccctcggcctttcccctctgacccgtacggagggaggggatcctcattttcccttggcctacccttctcccctcctgccccattccgccctccgccacttccagcctccccacctcttgagggaccctttccttcccagagtgatgtgcatcccctcccagctgaaggctataataaggtaggcccaggatacggtccgggagaaggcgctccagagcaagagaaatctcggggagggtatagtagcggctttagagatagtgtgcccatccaagggatcacgctggaggagggcggttgcggtacgggaggctgcgagtgtgagtgcgtgcaggagattgcgctccacgtctgctag

SEQ ID NO: 29859 - DNA, 2670 bp, Artificial Sequence
  Description of Artificial Sequence: Synthetic coding sequence
atgccagcctcaatctccagtatctttcctggccctactctgctcctgagttgcgggtccgaggagctggacagcgaagatgcccctccatgctgcagattggccctgggcgagcctcctccatatggcgctgcccctattggtattccaaggcctccaccacctaggcctggaatgcattcccccccaccgagacccgctcctagccctggaacttgggagtcccaacctgctaggagcgtgagattggggggaccgggtggcggagccggtggagccggtggtgggcgagtgctggaatgtcctagcatacgcatcacctcaatctcccccacgccagagccgcctgccgctttggaggacaaccccgatgcctggggcgatggttcgccaagagactacccacccccagaaggcttcggtggctatagagaggccggtggacaggggggtggggctttcttttctccatcacctggcagcagcagtctaagcagttggagctttttcagtgacgcctctgacgaggcagcactgtacgccgcttgcgacgaagttgaatcagagctgaacgaggccgcttcaaggtttgggctgggtagccctctcccatctcccagggcttccccaagaccgtggactcccgaagacccttggagcctgtatgggccttctcctggaggcagggggcctgaagatagctggctgctgctcagtgctcctggaccgactcccgctagccccaggcccgcatccccctgtgggaagcggaggtacagtagctctggaacacccagttcagcatccccagccctgtcccgcagagggtctttgggagaagagggatctgagccgcctccaccccctcctctgccccttgcacgcgatcccggatcacccggacccttcgattatgtgggagcccctcctgccgagagcatccctcagaaaacacgccgtacatctagcgagcaggcagtcgccttacctcgctccgaagagcccgctagctgtaacgggaaactacctcttggggctgaagaaagcgtggcccctcccggaggttctcggaaggaggtggccggaatggactacctagcagtgccttcaccactggcttggtctaaggccagaattgggggtcattcgcccatcttcaggacatccgctctgccaccgctggactggccgctgccatcacagtatgagcagctggaactacgaatcgaggttcagccacgagcccatcacagggctcattacgaaacggaaggctcgcgcggtgccgtcaaagcagcgcctggcggtcaccccgtggttaagcttcttggttactccgagaagcccttaaccctccaaatgtttattgggacagctgacgaacgcaatctcagaccccatgcattctatcaggttcaccgtatcacaggcaagatggtcgctaccgctagctatgaggccgtggtctcaggaactaaagtactggaaatgacccttctgccggagaataacatggccgcaaatattgactgtgccggaattctgaagcttcggaatagcgatattgagttgaggaagggtgagacagacataggacgtaagaacactagggtgcgtctggtgtttcgggtgcatgtgcctcaggggggaggcaaagtcgttagcgtgcaggctgcctctgtgccaattgagtgctcgcaaagaagtgcccaggagctgcctcaagtggaagcttatagccccagtgcctgctcagtgagggggggagaagagctggtcctgaccggttccaatttcctgcctgattccaaggtcgtcttcatcgaacgcggtcccgatggtaagcttcaatgggaagaagaggcaaccgtgaaccgtcttcaaagtaatgaggtgacactcaccttgacagttcctgagtacagcaataagcgcgtctctcgtcctgtgcaggtctacttctacgtgtctaatggccgtcggaagaggtcccctacacagagttttcgatttttgccagtgatttgcaaggaagagcccttaccagacagcagtctgcgcggattcccttccgctagcgctacgccgttcgggactgacatggatttctcgccacccagacccccttatccaagttaccctcacgaggatccagcgtgtgagacgccgtacttgtccgagggcttcggttacggtatgccacccttgtatccacagaccgggccacccccatcctaccgccctggtcttcggatgtttcctgagactcgcggaactacaggttgcgctcaaccacccgctgtgagcttcttgcctcggccatttccaagtgacccatacggaggtcgcggatcctccttctctctcggactacctttcagtcccccagcccctttcagaccacctccgctccccgcatctcctcccttagagggaccctttcctagtcagagcgacgtgcaccccctcccagccgagggctataacaaagtgggtccagggtacgggcctggcgagggcgcaccagagcaggagaagtctcggggagggtattctagcggctttcgtgacagtgtcccaatacaaggaattacccttgaggagggcggttgtggaacaggcggttgtgagtgcgaatgcgttcaggagatcgccctgcatgtgtgttag

SEQ ID NO: 29860 - DNA, 2745 bp, Artificial Sequence
  Description of Artificial Sequence: Synthetic coding sequence
atgcttagcggacgagaccttggcgctccggctggaagcatgggagccgctagttgtgaggacgaagagttggagttcaaactggtgtttggagaggagaaagaagcaccgcctctgggagccggaggcctcggtgaggagctcgactcggaagacgctccgccttgctgtcgcctcgctctgggagaaccacctccttacggcgctgctccaatcgggatccccaggccaccccctcccaggcctggtatgcactcccctcctcccagaccggctccaagtcctgggacatgggagagccagcccgctcggagcgtccggctgggaggacccggagggggtgccggaggtgctgggggagggcgagtgctggaatgtccctcaattcggatcacttcaatcagtccaaccccagagccacccgctgctttagaagacaatcctgatgcatggggagatggttcaccacgcgactacccccctcctgaaggcttcggcggataccgggaagcagggggtcaaggcggaggagccttcttcagcccatctccaggatcttcaagtctatcgagctggtcatttttttcagatgccagcgatgaggccgctctctacgcggcttgtgatgaggtagagagcgaactgaatgaagccgctagtagatttggactgggcagccctctgcccagccctcgggcttctcctcggccatggacccccgaggatccctggtcactgtacggtccatctccgggtggaagaggcccagaggacagctggctacttctatctgctcccggaccgactcctgcaagtcctagaccagcttcaccatgtgggaaaagacggtattcctcctcaggcactccatcttctgccagccctgctctatcccgcaggggcagcctgggcgaggagggctctgaaccccctcccccacctccacttcccttagcgcgtgacccaggtagcccaggtccctttgactacgtgggagcaccccctgccgagagtatcccacagaagaccaggcggacgagcagtgagcaagctgtggccttgcctaggtccgaagagccagcttcgtgcaacggaaagcttccactcggagccgaggaatccgtggccccacccggtgggagcagaaaggaggtagctggcatggactacctcgcagttccctccccgctggcatggtctaaggcaaggatcggcggtcattcaccgatttttcgcaccagtgccctgccaccactggactggcctctgccttcacaatatgaacaattagagctgcgaatcgaagttcagcctcgggctcatcaccgtgcccactatgagacagagggctcccgaggggctgtgaaggccgctcccggtggccatcccgtggtcaaactcttgggctactccgagaagcctctcactctacagatgttcataggcaccgctgacgaaaggaacctgcggccacatgcattttaccaagttcataggatcaccgggaaaatggtggccactgcctcctacgaggcagtggtgtccggcacgaaggtattggaaatgacactattaccagagaacaatatggcagccaacattgactgtgcaggcatcttgaagctccgtaattccgacatagagctaagaaagggtgaaactgatatagggagaaaaaacacaagggtgagattagtatttcgggtgcatgttccccagggaggcggtaaggtggtgagtgtgcaagcagccagcgtcccaattgaatgttcccagagaagtgcgcaagagctcccacaggtggaagcttatagtccctcagcgtgcagcgtccggggtggtgaggagctggtgctgaccgggtccaacttcctacccgattcaaaagtcgtgttcattgagcggggacctgatggcaaattgcaatgggaagaagaagccactgtaaacagactacaatccaacgaagtcacacttactttaaccgtgcccgagtactccaataaacgggtgtcgcgcccagtccaggtgtacttctatgtgtctaatggcagacgtaaacggagccccacccagagcttcagatttctcccagttatttgcaaagaagagccactgccggactcctccttgcggggattccccagtgcctcagctacaccatttggtacggatatggacttttctcctcccaggcctccgtatccatcttatcctcacgaggacccagcctgcgagacgccttacctgagtgaaggcttcggttatgggatgcccccactgtatccgcagacagggccaccaccgtcctatcgccctgggcttcgaatgttccccgagacgcggggtaccactggatgcgcccagcctccagccgtatcgttcctaccacgtccattccctagcgacccttacggaggccgtggcagctcttttagtctgggccttccattttcacctcctgcaccattccgccctccccctctgcctgcctccccaccactggagggaccctttcctagccagagtgacgtgcatcccctcccagccgaggggtataataaggtgggcccaggatacggacccggagagggcgctccagagcaagagaagtcacgtggcggatactcctccggttttcgagacagtgtgcctattcaaggtattactctggaggagggtgggtgcgggacaggcggttgtgagtgtgagtgtgtgcaggaaattgccctgcatgtctgctag

SEQ ID NO: 29861 - DNA, 2802 bp, Artificial Sequence
  Description of Artificial Sequence: Synthetic coding sequence
atggccgatggcggtgcagatagtgccgctcagaggctccctgaaggtccaggacgcgttgctcctgggagggatttgggcgctcccgcaggcagtatgggggcagcctcttgcgaagacgaagagctagagtttaagctagtgttcggcgaagaaaaggaggctcctccgcttggagccggaggcctgggcgaagagctcgatagcgaagatgcccctccgtgctgtcgactggctttgggcgagccacccccttacggcgctgccccaatagggataccccgaccgccaccccctcgacctggtatgcactccccacctcctcggccagctcccagtcccggaacctgggagtcccagcccgctcgctctgtaagacttgggggacccggtggtggcgcaggcggagccggaggaggccgagtgctagaatgcccgtctattagaataactagcatttctcccacaccggagccgccagccgctctggaagataatccggacgcctggggagatggaagccctagagattaccctccacctgagggattcggaggttatcgagaagccggagggcagggtggcggtgcctttttttccccttccccaggtagtagttcgttgagcagctggtcttttttttctgacgcctctgacgaggcagccctgtatgccgcttgcgacgaggtcgaatccgaactgaatgaagcggcatcgaggtttgggctggggagcccactcccatcaccccgagcgtcaccccgaccatggacacccgaagacccatggagcctgtacggacctagccccggaggaagggggccagaggacagttggctactgttatccgcccctggcccaacacctgcctcccccagaccggcttcaccttgcgggaagagacgctattccagcagcggcacaccctcttccgccagtcccgctctctccagaaggggtagcctcggagaggaaggctctgaacctccccctcctccacccttaccactcgccagagaccctggatctcccggaccctttgactatgtgggggctccgccagcagaatcaattccgcagaaaacaaggcgcaccagtagcgagcaggcagttgccctccctagatctgaggagcccgcaagttgtaatggcaagctaccgctaggggctgaggagtcagtggcgccacccggaggttcccgcaaagaagtggcaggtatggattacctcgccgtgccatctccgctcgcttggtctaaagccagaatcggaggacactctcctattttccgaacttctgctcttccgccattggactggcctctgcccagccaatatgagcaactcgagctgagaatagaagttcagcctagggctcaccatagggcccactatgaaactgaagggtctagaggcgctgttaaagccgcacccggagggcacccagtcgttaagctgcttgggtactcagaaaagcccctaacgttgcaaatgttcatcggcacggcagatgaaaggaacctgaggccccacgctttttatcaggtgcatcgcatcactgggaagatggtcgccaccgcatcatatgaagccgtcgtcagtggaaccaaagttttagagatgaccctgttgccagagaacaatatggcggcaaacattgattgcgcaggcatacttaagctccgcaacagtgacattgagctgaggaagggggagactgacatcggccgaaagaacaccagagtgagattggtttttcgcgtgcacgttccacaggggggaggaaaagtggtcagcgtgcaggcggcttctgtgccaatcgaatgcagccagagatccgcacaggagcttccacaggtagaggcatattcaccatccgcatgtagtgtgaggggaggagaggaactagttctgacaggtagtaacttcttgcctgactcaaaggtcgtgtttattgagcggggacccgatgggaaactgcagtgggaagaggaagccacggtgaaccgcctgcaatccaatgaagtgaccctaactttgacagttccagagtattccaacaaacgcgtgagcaggcccgttcaagtgtatttttacgtgtccaacggcagaaggaaacgtagccctacacagtccttcaggtttcttcccgtgatatgcaaagaggagccactcccagatagctccctccggggtttccccagcgctagcgcaacccccttcggtactgacatggatttctctccaccacgccctccctatcccagctatccccatgaggatcctgcttgtgagacaccttacctgtcagagggattcggatatgggatgcctcctttataccctcagacaggacctccaccatcatacaggccgggtctgagaatgtttccagagactcggggtacaaccgggtgtgctcaaccacccgctgtttcgttcctgccacgaccttttcccagcgacccgtatggcggaagaggatcaagcttctccctgggcttaccattctcacctcccgcaccttttagaccccctcccctgccagcatcccctccgctcgagggtccctttcctagtcagagtgatgttcacccacttcctgctgaggggtataacaaggttggcccaggatatggtcctggagaaggagcccctgagcaggaaaaatcccggggagggtactccagtggcttcagagattctgtgccaattcaaggaataactttggaggagggcggatgtggtactggaggctgcgaatgcgaatgcgtgcaggaaatagctctgcacgtatgctag

SEQ ID NO: 29862 - DNA, 2481 bp, Artificial Sequence
  Description of Artificial Sequence: Synthetic coding sequence
atggcagacggcggtgccgacagcgcggctcaacgcctgcccgaaggtccaggccgagtcgcaccagggcgtgatcttggcgctcccgcaggcagcatgggagccgcatcctgtgaagacgaagaacttgagttcaaactggtgtttggagaggaaaaagaagcccctccattaggagcgggaggccttggtgaggagttggattcggaggacgctccaccatgctgtagactcgccttgggggagcccccaccctacggggcagccccaattggaattcctcgtcctcctccccctagacctggaatgcattctccccctcctcgtcccgctcccagcccagggacttgggagagccagccagctcggtcagttcgcctcggaggccctggcggtggggcaggtggtgccggtggcggtagagtgcttgagtgtcccagtataagaatcacaagtatcagtcccactccagaaccacctgcagcactcgaagataatcccgatgcatggggagacggcagcccaagggattaccccccacccgagggttttggcggttacagagaagcgggagggcaaggcggaggagccttcttttcaccaagccccggtagctcttctttgagcagctggagctttttctcggatgcatccgacgaggcagcactttacgcagcctgcgacgaagtagagagtgaactcaatgaggctgcttcacgctttggcttgggtagtcctctcccctccccccgagcttcccccaggccatggactcccgaggacccctggtctctgtatgggccaagtccgggtggacgaggtcctgaggatagctggctgctgctctctgcgcctggtcctacacccgcaagcccccgtccagcttccccctgtgggaaaagaaggtactccagctctggcaccccttcctcagctagccccgctctttctcggaggggctctttaggcgaagagggatctgagcccccaccacctcccccattgccactggcgcgtgacccagggtcccccggtcccttcgattacgtcggtgccccacctgccgagagcatccctcagaagacaaggaggacctcaagcgagcaggccgtagcacttcctcggtccgaggaacctgcttcctgcaacggaaagttaccccttggagcagaggaaagtgttgccccaccaggcggatccagaaaggaggtggcaggcatggattatctggcagtccctagtccactggcatggagcaaagcgagaatcggagggcactctcccatcttccggacgtctgctctgcctcctctagattggcctctcccttctcagtatgaacagcttgaactgcggatcgaggtccagcccagagcacaccacagggcccattacgaaaccgaaggttcaagaggggctgttaaagctgccccagggggtcatcccgtggttaaactcctcggttactcagagaagcctctcacccttcagatgtttattgggacagcagacgaaaggaacctgagaccacacgccttctatcaggttcacaggatcacaggcaagatggtggctactgcctcatacgaggcggtggtgtcaggaactaaagtgttggaaatgaccctgttgcctgaaaacaatatggctgccaatattgactgtgctggcatactcaaattgcgaaatagcgacattgagctgcgcaaaggggaaaccgacatcggacgtaaaaatacccgcgtgcgcttagtattcagggtgcatgtgccgcagggagggggtaaggtggtatcagtccaggctgctagcgtgcctatagagtgtagccagaggtctgcgcaggagctgccgcaagtggaggcatactccccctcagcctgctccgtcagaggtggggaggagctggtgctgactggatcaaatttccttcccgacagcaaggttgtgttcatcgagcgtgggcctgatggtaaactgcagtgggaggaggaagctacagtcaatagactgcaaagcaatgaagtaacactaaccctgacggtgcccgagtatagcaacaaacgtgtttctcgtccggtgcaagtttacttctatgtcagtaacggcaggaggaagaggtcacctacgcagtcatttcggttcctgccagtgatctgtaaagaggagccactgccagatagttctctcagggggtttcccagtgcttcagccacaccctttgggacagacatggacttttcaccacctcgcccaccttatccatcctacccccatgaggatcccgcttgcgagacaccttaccttagcgagggttttggatatggaatgcctccgctttatcctcaaaccgggccacctccgtcatatcgccctggattgagaatgttccctgagacacggggaaccacagtgagcgaaatcattggccgagatctgtcgggctttccagcccctcccggagaagagccgcctgcctag

SEQ ID NO: 29863 - DNA, 2706 bp, Artificial Sequence
  Description of Artificial Sequence: Synthetic coding sequence
atgggtgctgcttcctgcgaagatgaggagctggaattcaagctcgtgtttggcgaggagaaagaggcaccccctctgggagctggcggattaggtgaggagttggacagtgaggacgctccaccttgttgtaggctggccctgggggaacctcccccatatggggcagctcccattggaatccctagaccacctccccctcgtcccggaatgcactctcctccccctcgccctgccccttctccagggacttgggagagtcagcctgccaggagcgtgcggctcggcggacctggcggtggagccggtggggctgggggaggcagggtactggaatgtccttccattcgaataacttcgatctctcccaccccagaaccccctgcagcattggaggacaacccagacgcgtggggtgacggcagcccccgtgattaccctcctcccgaagggtttgggggatatcgggaggccggagggcaagggggaggggcattcttttccccgtccccaggctcttcttcactgtcgtcttggagcttcttttccgatgcaagcgacgaggcagccttatatgccgcttgcgacgaggttgaatctgaacttaatgaggccgcatcgagattcggactggggtccccattgccatctccacgggctagcccacgtccttggaccccggaggacccttggtccttgtacggacctagcccagggggtcggggaccagaggactcctggctccttctgagtgctcccggacctacccctgcttcacctcgaccagcaagtccctgcgggaaaaggaggtacagtagttctggcaccccatccagcgcttctccagcccttagccgccgaggctccctcggggaggagggatcagaaccaccccctcctccgccactgccactagccagggaccctggaagccccggtccattcgattacgtgggtgctcctccagcagagtctattcctcagaagacacgcaggactagctctgagcaggctgtcgcattacccaggtctgaggaacctgcctcctgcaacggtaagctgccattaggtgctgaagagtctgttgctcccccagggggaagccgaaaggaagttgccggaatggactatctcgctgtccccagcccgctggcctggtccaaggccaggattggagggcactctcccattttccggacctccgcactccctcccctggattggcctttgccatctcagtatgaacagctggaactgcgtatcgaggtacagcccagagcccatcacagggcccattacgaaacagaggggtcccgcggagctgtgaaggcagctcctggagggcatcccgtggtgaaactgcttggatatagtgaaaagccgctgactctacagatgttcataggaactgccgatgaaagaaatctccgacctcatgcgttttatcaggtccatagaatcaccggaaagatggttgcaacggctagctacgaagctgtggtctccggtacaaaagtgttggaaatgaccttactccctgagaacaacatggcggctaacattgactgtgccggaattctgaagctcagaaacagcgacatagagttaagaaagggtgagaccgatataggccgtaagaacaccagagtgcgactggtgttccgtgttcacgtgccacagggtggcggaaaggtggtgagcgtgcaggccgcttccgtgccaatagaatgcagccagcggtccgcacaagaactccctcaggttgaggcctattccccctctgcctgcagtgtccggggtggagaagagttggtattaacaggttcaaatttcctgccggactctaaggtcgtatttatcgaaaggggaccagacgggaaactccagtgggaggaggaggccacagtcaacagactgcagtccaatgaggtgaccctgacgctcaccgtgcccgagtattcgaacaaaagagtctcccgtccggtgcaagtatatttttatgtttcgaacgggaggagaaagaggtcacctacacagtcgtttagattcctccctgttatttgtaaagaggaaccactgcctgacagtagcttgcgaggctttcccagcgcatctgctaccccatttgggactgatatggacttttcccctccacgcccaccgtacccatcctaccctcacgaggatcctgcatgcgaaaccccttatttatctgaaggcttcgggtacgggatgccgccattatacccccaaaccgggcctcccccaagttacagaccaggcctcaggatgtttcctgaaacaagaggaactacaggatgcgcacagccacctgctgttagcttcttgcctaggccattcccttctgatccctatggcggacgtggatcgtcttttagcctcggcctcccattttcaccaccagcaccttttaggccccctccgctacccgcttccccgcctctggaaggaccttttccatcacagtcagacgttcatcccctaccagccgaggggtacaataaggtgggccctggttacggccctggagagggggcacccgagcaggagaagagccgcggaggttatagctcgggattccgggactctgttcccatccaggggattacccttgaggagggtggctgcggcactggtggctgcgaatgcgagtgtgtccaagagatcgctctacatgtgtgctag

SEQ ID NO: 29864 - DNA, 2499 bp, Artificial Sequence
  Description of Artificial Sequence: Synthetic coding sequence
atgcattctccgcctcctcgccctgctccctccccaggtacgtgggaatctcagccagctagatcagtaaggctaggaggcccaggtgggggagctggaggcgctggaggcggaagagtccttgagtgccctagcatccgaattacaagcatctctccaacacctgaaccccctgccgctttagaagacaaccccgacgcctggggtgacgggtcacctcgtgattaccccccacctgaaggctttggcggatatagggaagcgggagggcagggcggaggcgctttcttctctccctcaccaggctcttccagtctgtctagctggtctttctttagtgatgcctcagacgaggccgctctctacgccgcatgcgacgaggtggagagcgagctgaacgaagcagcgtcccgattcggccttggttctcctcttccatctcctcgcgctagcccgcgtccttggacaccagaggatccctggagtctgtatggaccatcccccggaggccgaggtccagaggatagttggctgctcctgtcagctcccggtccaactcccgcatccccacggccagctagcccttgcggcaaaaggagatacagtagttctggaaccccatcgagcgcttcccccgcattgtctaggcgtggatccttgggcgaagaaggctctgagccaccacctccgccacctcttcccctcgccagagaccctggaagtcccggtcccttcgactatgtcggggctcctcccgctgagtctattccccagaaaactcgcagaacctcctctgagcaggcagtcgctctcccccgatccgaagaacccgcaagctgcaatgggaagttacctttgggagcagaggagtcggtcgcgccacctggtggctcccggaaggaggttgcaggcatggactaccttgccgtgccatcgccccttgcgtggtcgaaagctaggatcggtgggcactccccaatttttcggacatccgcattgccgccattggattggcccctgccatcacaatacgaacagcttgagctgagaatagaagtccagccgagggcacaccaccgcgcacactatgagaccgaaggaagcaggggggctgtgaaagcagccccaggtggccacccggttgtgaaactgctggggtactctgagaagcccctcaccctgcagatgttcattggcaccgctgacgagcgcaacctgcgtccgcatgccttttaccaggttcatagaatcacaggcaagatggtcgctacggcctcttacgaggcagtagtgtccgggacaaaggtactcgaaatgacgctgttgcctgaaaacaatatggcggctaatatagactgcgccggaatcctgaaactccgcaactccgacattgaactccgcaagggtgaaacggatatcggaaggaagaacacacgcgttcggctcgtgttccgtgtccacgttcctcagggtggcggtaaggtagttagtgtacaggccgctagcgtccctatcgaatgttcacagcgttctgcgcaggagctcccacaagtcgaagcctactcaccgagtgcctgtagcgtcaggggcggtgaggaactggtgttaaccggctccaactttctgcccgactccaaggttgtctttatagagcgcggacccgatggaaagctgcaatgggaggaggaagcaacagttaaccggttgcagtcaaatgaggtgactctgaccctgacagtccccgaatactccaataaaagagtgtctaggcctgtgcaagtctatttctatgtgtctaatggcaggcggaagaggagtccaacccagtccttccgcttcttacctgttatctgcaaggaagagccgctcccagattctagcctcagaggattccctagcgctagcgcaacaccttttggcactgacatggatttttctccaccgagacctccttatcctagttatcctcatgaggacccagcttgtgaaacaccctaccttagcgaaggattcggttatggcatgcctcccctgtacccacagactggcccacctcccagctaccgcccaggactgagaatgtttcctgaaacaagaggtacaaccggatgtgctcagccaccagccgtcagcttcctgcctcgcccattcccgagtgatccctatggaggacgaggttcttctttctctctcggactgccattctcccctcctgcaccttttaggccgcctcctctgccagcatccccgccattagagggcccatttccctcccagtctgatgtgcacccgctacctgccgagggatacaacaaggtggggccagggtacgggcctggcgaaggggcacctgaacaagagaagagccgtgggggatactccagtgggttcagagacagtgtaccgatccagggcatcaccttggaagaagtcagcgaaattatcgggagggacttgtccggattccctgctccaccaggcgaggagccccctgcgtag

SEQ ID NO: 29865 - DNA, 2385 bp, Artificial Sequence
  Description of Artificial Sequence: Synthetic coding sequence
atgggagcggcatcatgtgaggacgaggaattggagtttaagctggtttttggcgaggagaaggaagccccacctctgggtgcaggtggcctgggcgaggagctcgactcggaagatgctccgccatgctgtcggctggctctgggcgagcctcccccttacggtgcggcacctattggtatacctagacccccaccaccaaggcccggtatgcattcaccccctccgagacctgctccatcacccggtacttgggagtctcagccggctcggagcgttcgcctgggtggcccaggaggcggagccggaggggctggtggtggcagggtcctcgagtgtccttccatccggatcacctctatttcccctacccctgagccaccagccgcattagaagacaatcctgacgcttggggagatggctcccccagagattacccccctccggagggattcggtggctatagggaggcgggtggacaggggggaggtgccttcttctccccgagccccggatcatcttctctcagtagctggagttttttttcagacgcatctgacgaagccgctttgtacgccgcatgtgatgaggttgaaagcgaacttaatgaggccgctagtcgcttcggattaggctccccgctgccatcgcccagggcaagcccaaggccctggacccctgaggacccatggtccctttacggcccatcacctggtggcagggggccagaggattcctggcttctactgagtgctcctggtcccactcctgcaagccccagacccgctagcccctgcggtaaacggaggtatagctcatcaggaacgccctcatctgcatcaccagccctgtccaggagggggtctctcggcgaggagggctccgaacccccaccgccaccaccactccccctggcaagagatccgggtagcccgggtcccttcgactatgttggggcaccacccgctgaatccattccccagaagacccggagaacctcgagtgagcaggctgtggcattaccccgttcagaggaacctgcgtcatgtaacggaaagctgccactgggagcggaggagagcgtggcccctcccggagggtcaaggaaggaggttgctgggatggattatctggccgtcccctccccgctggcctggtctaaggccaggatcggtgggcattcacccatcttccgaacaagcgcattgcctcctctggactggccacttccaagtcagtacgaacagctggagctgaggatcgaagtgcaaccgcgtgctcaccaccgagcacattacgagacagagggatctcgcggagccgttaaagctgctccaggcggacaccccgtggtcaaactgttgggttacagtgagaaacccctgaccctgcagatgtttatcggcactgcagacgagagaaacctgcgcccacatgctttctaccaggtacataggatcactgggaagatggtggccacagcgtcttatgaggccgtcgtgagcgggaccaaagtgttggaaatgacccttcttcctgagaacaatatggctgccaatatagactgtgccggtatcttgaagctgagaaattcagatatcgaactacggaaaggagaaacagacatcgggaggaaaaacacgagagtgaggctggtttttcgagtacacgtgccccaaggtggcggaaaggtggtgagtgtccaggccgcttcggtgcctatagaatgtagccagcgcagtgcccaagaacttccccaggtggaggcatattctcccagtgcatgctcagtacgcggaggcgaggagctggtgttgaccgggagcaattttctccccgactcaaaggttgtatttattgagcgtggtcccgatggcaagctgcagtgggaggaggaggcgacagttaataggctgcagtctaacgaagtcacactgacccttactgtgccagaatattctaataaaagggtgtctaggcccgttcaggtttacttctatgtgagtaacggtcggagaaaaaggagccccacgcagtcttttcgctttcttccagtaatttgcaaagaagagccattaccggacagctctctgcgcggttttccctcagcatccgccacaccctttggaacagacatggattttagtccacctcggccaccgtacccttcctaccctcacgaggacccggcatgcgagacaccatatctgtctgagggatttggctacggcatgccccctctgtacccccagactggccctcccccttcctatcgccctggcctcaggatgtttcctgaaaccaggggaactacagtgtctgaaataattggacgcgacctgagcgggttcccagccccacccggtgaggaacctcctgcatag

SEQ ID NO: 29866 - DNA, 2499 bp, Artificial Sequence
  Description of Artificial Sequence: Synthetic coding sequence
atgcattcaccgcctccaaggcctgctccgtccccaggcacttgggagagtcagcccgcacggtctgtgcgcctgggcggacccggtgggggagccggaggcgctggtggcggaagggtactggagtgcccttcaattcgtattacatccatcagtcccacacccgagcctcctgctgcactggaggacaatcccgatgcctggggggacggaagcccccgagactaccctcctccagagggcttcgggggttaccgcgaggcaggtggccaggggggaggcgcattcttttccccatcccccggatcctcaagcttaagcagctggagtttcttcagcgacgccagcgacgaagccgcactctacgcagcctgtgatgaagtggaatcagagctcaatgaggctgcttccaggttcgggttagggagtccccttccttcgcccagagccagtccccgtccttggaccccggaggacccctggtcactctatggcccaagcccgggtggacgtggcccagaagatagttggctgctgctgtccgccccaggcccaaccccggcatctcctaggcctgcatccccgtgcggaaagagacggtactctagctccggcactccctcttctgcgagccccgctctgtcgcggagagggagcttaggggaagaggggtctgaacctccccctccacccccacttcctctggctagggacccaggctccccgggacctttcgactacgtgggtgcacccccagctgagagtattccacagaaaacacgtcggacaagctccgagcaagcggtggccctacccagatcggaggaacccgcttcttgcaacggaaaattgcctctcggagctgaagaatctgtggcccctcccggaggttcgcgcaaggaagtggcaggcatggattacctcgccgtgccgagtcctctcgcctggtccaaggctcgcatcggaggccactcccctatcttcagaacaagtgcactgccacccctcgattggccactgccatcgcagtatgaacagcttgaactgaggattgaggtgcagccccgagcacaccatcgcgcacactatgaaaccgaagggtcaaggggcgcagtgaaggctgcacccggtggacatcctgtggtgaaactacttggctacagtgaaaagcctctgaccctccagatgtttataggaacagcagacgagagaaacttgagacctcatgctttctaccaggtgcaccgaattactggaaaaatggtcgccacagccagctacgaggccgttgtgtctggcacgaaggtgctcgagatgaccctgttgccggaaaacaatatggccgctaatattgattgcgcaggaatactgaaacttcgcaactccgacatagagctgaggaagggggaaactgacatcgggcgtaaaaatactcgtgtgcgactggtcttcagggtacacgtcccgcagggagggggtaaggttgtctccgtgcaggccgcttctgtaccaatcgagtgctcacagcgcagcgcccaagaacttcctcaggttgaggcttactctccaagtgcatgttccgttcgcggaggcgaagaacttgtcctgacaggtagcaatttcctgccagactctaaagttgttttcattgagagggggcctgacgggaaacttcagtgggaggaagaggccacagtgaaccgcttacagtcaaatgaggttacactaactttaacagtgccagagtactcaaataagagagtgagcagacccgtgcaggtctatttttatgttagcaacgggcgacgtaaacgaagccccacccagagcttccgatttctgccagtcatttgcaaagaagagccgttacctgatagctccctgcgcggattcccttcggcatccgccacgcccttcggcactgatatggatttttccccccctagaccaccgtatccgtcatacccccacgaagatccagcatgtgagacaccgtatctttccgagggttttggctatggaatgccaccattgtacccgcagaccggcccacctccatcctaccgaccagggctgaggatgttccccgagaccagaggtactactggatgcgctcagcctccagcggtgtcattcctgccaagaccattccccagcgatccttacggcggaagaggcagctcgttttcgctgggtctgccattctcccctccagccccatttcggccacctcctctccccgcatccccaccgcttgaagggccatttccctcgcagtctgatgttcaccccctacccgctgagggctacaacaaagtgggtccaggatatgggccaggcgagggggcaccagaacaggaaaaatcgcggggaggttattcatcaggtttccgggacagcgtccctattcaggggattactctcgaagaggtcagtgaaattattggacgggatttgtctggtttccccgctcctccgggtgaagagccgcctgcatag

SEQ ID NO: 29867 - DNA, 990 bp, Artificial Sequence
  Description of Artificial Sequence: Synthetic coding sequence
atgtttatcgggactgctgacgaacggaatctcaggccccacgccttctatcaggtgcatcgcatcaccgggaagatggtggcaacagcaagctatgaggcggtggtgtcggggaccaaggtgctcgagatgaccctattgccagagaataatatggcagctaatatcgattgcgcaggaattctcaagctccgcaactccgatattgagctccgcaaaggggagactgatataggaagaaaaaacacacgcgtgcgcctggtcttcagggtccatgttccacagggcggaggcaaggtggtgtcagttcaagctgcatctgtacctatcgaatgctcacagagatcagcccaagaactgcctcaggttgaagcttactctccttcggcgtgctccgtcagaggaggggaggaactcgtgctcaccggatctaactttctgccggactccaaggtggtgttcatcgagcgcggtccggacggcaaattgcaatgggaggaggaagccacagttaaccgtctccagtcaaatgaggtgactctgacactgacggtgccagaatactctaacaaaagggtgagcaggcctgtccaagtatatttttatgtcagcaatggcagaagaaaaagatcccccacacaatccttcagatttttgcctgtgatctgtaaggaagaaccgctccccgatagctcactcagaggctttccgtccgctagcgctactccattcgggaccgacatggacttcagcccgcctcgtccaccatacccaagctatccccacgaggaccctgcatgcgaaaccccatatttgagcgagggcttcggatacggaatgccacctctctatccccaaaccggtccccctccttcatatcgtcctgggttgcgcatgtttcccgagactcgtggcaccacagtgagtgaaattatcgggagagacctctcgggttttccagccccaccaggcgaggagccgcctgcctag

SEQ ID NO: 29868 - DNA, 2574 bp, Artificial Sequence
  Description of Artificial Sequence: Synthetic coding sequence
atgatcacaactttgccctccttattaccagccagcctggctagtatttcacaccgcgtgactaacctccctagcaactccttgtctcacaatccaggactaagcaaaccagatttccctgggaattcctctcctggactgccctcaagctccagtcccggacgggaccttggcgcacctgccggttccatgggagccgcttcatgcgaagacgaagaactcgagttcaagttagtgtttggagaggagaaagaggctcccccactgggtgcgggaggcctcggggaggagctggactccgaagatgctcctccttgctgccgtctagcactgggcgaacctcccccttatggagcagccccaatcgggatccccagacctccgccacccaggcctgggatgcatagtccccctcccagaccggcacctagtcccggaacgtgggaaagtcagcctgccaggagtgtgcgcctgggcggaccgggtggaggggctggtggcgctggcggaggcagggtactggaatgcccatccattaggatcaccagcatttcaccgacacctgaaccccctgccgcactcgaggataatccagacgcctggggggacgggtccccacgggactacccccctccagagggcttcggtggctaccgggaggccggaggacaggggggtggagcttttttcagcccctcacctgggagttcttcattgagctcgtggtcttttttttctgatgcaagtgatgaagcggcactgtatgccgcttgcgatgaggtcgaatccgagctcaacgaggccgcatctagatttggcctcgggtccccattacctagtcctagagctagcccaaggccatggactccagaagatccatggagtctgtacggaccctctcccggtggtcgtgggccagaggactcctggctcctactgtccgcaccaggacctactcccgctagcccaaggcctgcttctccctgtggaaagcgccgttatagtagttctggaacaccatcctcagcctcacccgctctttctcgcaggggtagcctgggtgaggagggtagcgagcccccaccccctccccctttaccactagcaagagatcctggatccccagggccttttgattacgtgggcgcaccgcctgcagagagtatccctcagaagacccgccgaacctcttcagaacaggctgtggcactccccaggtctgaagaacctgcttcctgcaacggaaagctcccgctcggcgcagaggagagtgtggctcctccgggaggcagtagaaaagaagtggcaggcatggactatctggcagtcccttcaccactggcttggagcaaggccagaatcggcggtcattcccctatttttcgcacctctgctttgccaccattagactggccgctgccttcgcagtacgagcagctcgaactgcgtatagaggtccagccccgtgctcaccatcgcgcacattacgagactgagggctcacgcggagccgtcaaggctgctcccggtggtcatcctgttgtaaagctcctcgggtactctgaaaaacccctaacactgcaaatgtttattgggacggcagacgaaaggaacctcaggccgcatgccttctatcaggtgcaccggatcaccggcaagatggtggctactgcatcctatgaggccgttgtgagcggaaccaaagtccttgagatgaccctgcttcccgagaacaacatggccgcaaatatcgactgtgccggtattctgaagctcaggaacagtgacattgagctgagaaagggagaaactgacattggcaggaaaaatactcgggtgcgactagtatttcgtgtacacgtgccacaaggaggaggcaaagtggtgtctgtgcaggccgcaagtgtgccaatcgaatgttctcagagatccgcacaagaactcccccaagtggaggcctattccccctccgcttgctcagttagggggggtgaagagctggtactgacaggttcaaatttcctgcccgattccaaagttgtgtttatcgagcggggacccgatggtaagctgcagtgggaagaagaagcaactgtgaacaggctacaaagcaatgaagtgacccttacactcactgtgccggagtacagcaataaacgggtgagtaggcccgtacaggtgtatttttacgtcagtaatgggagacgtaaaaggagtcccacccaatcattccgctttctgcccgtgatatgcaaggaggaaccccttcctgattcttctttaagaggatttccatccgctagcgctacaccgttcggcactgacatggacttctcaccccctcggccaccctatccatcttaccctcacgaggaccctgcttgtgaaaccccctacttgagtgaggggttcgggtacggtatgccccctctgtatcctcaaaccggtcctcctccgtcctatcggcctggactacggatgttccctgaaactagaggcacgaccgtgagcgagatcatcgggagagatctttcaggctttcctgcgcctccaggagaagaaccacctgcctag

SEQ ID NO: 29869 - DNA, 2175 bp, Artificial Sequence
  Description of Artificial Sequence: Synthetic coding sequence
atgcactcaccacccccacggcctgcacccagcccgggaacttgggaatctcagccagctcgtagcgtgcgcctcggtggcccagggggtggcgctgggggagccggagggggacgggtgcttgagtgtccgtccatccggattacgtccatctcacctactcctgagccccctgcagccttagaagataatcctgacgcatggggtgacggaagccctcgcgattatcccccacctgaagggttcgggggataccgggaggccggagggcagggcggtggagcattcttctctccttctccaggctcctcatccctgagtagctggtctttttttagcgacgcctccgatgaggcagcactttatgccgcttgtgacgaggtggagagtgagctgaatgaggctgcgtctcgattcggattaggcagcccgctacccagtccccgtgcctcaccacgtccctggacgcccgaggatccctggtcactgtacgggccatctccagggggacgcggacccgaagacagttggctcctgctttccgcaccaggccctactccggcttcacccagacctgctagcccctgcggcaagcggaggtattcttcttccggcaccccttctagcgctagccctgcgctgagccggaggggctccctcggagaagagggaagtgagccacccccacccccacctctacctctggcaagagacccgggaagtcctggcccatttgattatgtgggggctcctccagccgaatccatcccccagaagactagaaggacctcgagcgaacaggccgtcgccctgcctcgatcagaagaaccagcgtcctgtaatggtaagctacctctgggggctgaagaatcggtggcccctccaggcggaagcagaaaggaagtcgctggtatggactacctggccgtcccgtctccgctcgcttggtctaaggcgagaattgggggtcattccccaatttttcgcacatctgcgctgcctcctctggattggcctttgcctagccagtacgaacaactggaactgagaattgaggtacaaccccgagcacaccatagagcacactacgagacggaggggtcacgcggtgccgttaaagccgctccaggtggccaccctgtggtcaagttactgggctactcggagaagccattaactttgcagatgtttatcgggacagctgacgaacggaatttgcgcccacacgctttttatcaggtccaccgcatcaccggcaaaatggtcgcgactgccagttatgaggcggttgtgtcaggcactaaggtcctggagatgaccctcctcccggagaataatatggccgcaaacattgactgtgcagggattttaaaactgcgcaactccgacatcgagctgcgcaaaggagagacggatattggacgtaaaaacacaagggtacgactagtgttccgtgtgcatgtgccccaaggcggagggaaggtggtgtccgttcaggcagcttctgttcccatagagtgtagccagcggtcagctcaagaactcccccaggtagaggcatacagcccgagcgcatgctccgtgcgcggtggtgaggaattagttctcaccgggagcaatttcttgccagattccaaggtcgtgtttatcgaaaggggaccagacgggaagctccagtgggaggaagaagccaccgttaatcgcctgcaaagtaatgaagtgacgcttacactgactgttcccgagtactctaacaaacgcgtgtccagacccgtgcaggtgtatttctatgtgagcaacggcaggaggaagcgaagccccactcagtctttccgctttctccccgttatctgcaaagaggagcctctgcctgattcctcccttcgagggttcccatccgcttccgccacgccgtttggaactgacatggatttcagccctcccagacccccatatcccagctatccccacgaggacccagcctgtgagacaccgtatctgtccgaggggtttggttatggtatgccacccctttatccacagacggggccacctccgtcttaccggccaggattaaggatgttccccgagactcgtggcacaacggtatcagagatcataggaagagacttatccggatttccagcacccccaggcgaggagccacctgcttag

SEQ ID NO: 29870 - DNA, 432 bp, Artificial Sequence
  Description of Artificial Sequence: Synthetic coding sequence
atgggagccgcttcctgtgaggacgaggagctggagttcaagttggtctttggggaagaaaaagaggctccacctctgggcgctggaggcttgggtgaagagctggacagtgaggatgctcccccatgttgtaggctagccctgggagaaccacctccatacggggcagcccctattgggattccaaggcctccaccccctcgtcccggaatgcactctcctcctccaaggcccgctcctagccctggtacctgggagagtcagccagcgaggtccgtgagacttgggggtcccggtggcggtgccggtggtgcgggaggcggtcgggttctcgagtgcccctccattaggattactagtattagccctactccagagccaccagctgccttggaggataaccctgatgcctggggcgatggttctccctag

SEQ ID NO: 29871 - DNA, 2424 bp, Artificial Sequence
  Description of Artificial Sequence: Synthetic coding sequence
atgttgtctgggagggacctgggggctccagcaggatcaatgggggctgccagttgcgaagatgaagaactggagttcaaactcgtattcggagaagaaaaagaggctccacccctcggagcgggtggcctaggggaagaattggactccgaagatgcacctccctgttgcagactggccctgggggaacctcccccttacggggctgcgccaattgggatcccccgacccccaccccctcgcccaggtatgcattcgccacctcctagaccagcccctagtccgggaacttgggagagccaacctgcacgtagcgtcaggctcggcggacccggaggcggagctggaggagctgggggaggccgagtgctcgagtgccccagtatccggataacttccatctcacctacgcccgaacccccagccgcactcgaggacaatcctgacgcctggggtgacgggtccccacgggactacccgccacccgagggctttggcggttacagggaggccggaggacaaggcggaggcgctttcttctccccatcaccgggttcttcttccttgtcatcttggtcattctttagtgacgcttcagatgaggcagccctttacgcggcatgcgatgaagtagaaagtgagctgaatgaggccgctagccggttcgggcttggtagcccattaccatcgcctcgggcaagcccacgtccctggactcccgaggacccctggtctttgtacggcccaagtccaggcggaagaggaccagaggactcctggctactcctgagcgcacccggacctacacccgcaagccctcgacccgcatcaccctgcggtaaaagacggtacagtagctcaggcaccccctcaagcgcctctcccgcactttctcggaggggttcactgggcgaagagggaagcgagccaccaccgcctccgcctctccctctggcccgagatcctgggagcccaggcccatttgactatgtcggcgctcctcccgctgagtcgatcccccagaaaactaggaggacaagcagcgaacaagcagtagcccttcctcgcagcgaggaacccgcatcctgtaatggcaagttacccctgggcgctgaggaaagtgttgctccccctgggggaagccgcaaggaagtcgcgggaatggactatctggccgtccccagccccctggcttggtcaaaagctcggattggcggacattctcccattttcaggaccagcgctctgccacctctcgattggcccctccctagtcaatacgagcagctggagctcaggatcgaggtgcagccacgggcacatcacagagctcattacgagactgaaggttccagaggggctgtcaaggccgctcccggtggacacccggtcgttaagttgttgggctattcggagaagcctctcacgcttcagatgtttatcggcaccgccgacgagaggaacctgcggcctcatgcattttaccaggtgcaccgcatcacgggaaaaatggtcgctacagcgagttacgaggccgtcgtttccggcaccaaggtgttggaaatgactctgctccccgagaataacatggctgctaatatcgattgcgccggtatcctcaagctgagaaacagtgacattgagcttcgaaagggtgaaacagacatcggaagaaagaatacgcgggtgagactcgtctttcgtgttcacgtgccacaagggggagggaaagtggttagtgtccaggccgcaagcgttccaatcgagtgttcgcagagatcagcgcaagagctgccacaagtcgaagcctatagcccctctgcttgttcagtccgcggtggagaggagctggtgctcacaggctccaatttcctacctgattctaaggttgtattcatcgagaggggccctgacggcaagttacaatgggaggaggaggccacggtaaatcggctgcagtccaatgaggtgacattaaccctgaccgtgcccgagtatagcaataagcgggtttctcggccagttcaagtttacttttacgtgtctaatggcagaaggaagagatcccctacgcagtcttttcgttttcttcctgtgatttgtaaagaagagccactgccggattcatctctccgaggatttcccagcgcaagcgcaacgccctttgggacggacatggacttttctcccccacgcccaccctaccccagttatcctcacgaagatcctgcgtgcgaaacaccatatctgtctgaaggattcggctacggaatgcctccgctgtaccctcagaccggaccaccaccaagttaccgtcccggactgagaatgtttcccgaaacaagagggacaactgtgagcgaaattatcggcagggatctgtccggctttcccgctcccccaggtgaagaacccccagcctag

SEQ ID NO: 29872 - DNA, 1311 bp, Artificial Sequence
  Description of Artificial Sequence: Synthetic coding sequence
atgttcattgggacagctgacgagaggaatctccgaccacatgcattctaccaagttcataggatcacgggaaagatggtggcaactgctagctacgaagctgtggtgagtggtacgaaggttctagaaatgactttgctccccgaaaacaacatggcagccaatatagactgtgcaggcatccttaagttacgcaactcagacattgaactcaggaagggcgagactgatatcggcaggaaaaatactcgcgtgaggttagtgtttcgcgtccatgtgcctcagggcggtggcaaagtggtctctgtgcaggctgcatccgtgcccattgagtgctctcagcggtcagcacaggagctgccgcaggtcgaagcatactcgccttcggcctgctcagtccgcggtggcgaagaactggtgctgacgggaagcaattttctccctgacagcaaggttgtctttattgaaaggggccctgacggaaaactgcagtgggaagaggaagccacagtcaaccgtctgcaatctaatgaagtgactctgacactgaccgtgccggaatactctaataaacgggtttcaagacccgtccaggtgtacttctatgtgtctaatggaaggaggaagagatcaccaacccagagcttccgattcctccccgtgatctgcaaggaagaaccccttcccgactcctcattgagggggtttccaagtgcaagtgcaacaccattcggaaccgacatggacttctcacctccacgaccaccttacccttcttacccccatgaggaccccgcatgcgaaaccccatacctgagcgaaggctttggatacgggatgccaccgctgtacccacagaccggccctccaccgagttatcggcctggcctgaggatgtttcctgaaactagagggacaacaggctgtgctcaacccccagcagttagctttctgccgaggccctttccatccgatccctatggcggtagggggagtagcttctccctagggctgcccttcagcccgcctgcgcctttccggcctccaccacttccagcctcacccccattggagggacccttcccttcccagagcgacgtgcacccactgccggcagaaggctacaacaaggtgggaccaggatatggccctggcgaaggcgctccagaacaggagaagtccaggggcggttactcatcaggcttccgggattcggtgccaatccaggggatcacactggaagaaggagggtgcgggactggagggtgcgaatgcgagtgtgtccaggaaatcgcgctgcacgtgtgttag

SEQ ID NO: 29873 - DNA, 570 bp, Artificial Sequence
  Description of Artificial Sequence: Synthetic coding sequence
atggatttttctcccccaaggccgccatatccctcatatccccatgaggatcccgcttgcgaaaccccctatctgtccgaaggtttcggatatggtatgccacctctctaccctcagacaggtccaccgccaagctataggcccggtctgcgcatgtttcccgagactaggggtacaaccgggtgcgcacagccacctgcagttagcttcctgcccagaccatttccgtctgatccctatgggggtcggggtagctctttcagcctcggtctcccattctcccctcccgcacccttcaggcctcctcccctgcctgccagtcctcctctagagggacccttcccaagccagtccgacgttcacccactcccagccgagggatataacaaggtgggccctggttacggaccaggcgagggtgccccagagcaggaaaaatcaagaggcggatattcttcaggcttccgggatagtgtccccatccaggggatcacactggaggagggtggatgtggaactgggggatgcgaatgtgagtgcgtacaagaaattgccttgcatgtctgctag

SEQ ID NO: 29874 - DNA, 2673 bp, Artificial Sequence
  Description of Artificial Sequence: Synthetic coding sequence
atgcctgcatctatcagtagtatatttccaggcccaactctgctgttatcttgcggctcagaggaattggattccgaggatgctccaccatgctgtcgcctggcgcttggtgaacctccaccctatggcgctgcaccgattggcatacctagaccccctccccctagacccggaatgcattcccccccaccaagacctgccccaagtccaggcacatgggaatctcagcccgcacgcagcgtccggctggggggtccaggcggaggtgccggtggcgcagggggaggcagagtgttagagtgtccctccattcgcataacatctatctcccccacaccagagccacctgcagcactggaggataatcccgacgcgtggggagacgggagcccccgagactaccccccaccagagggtttcgggggataccgggaggccggaggccagggcggaggcgcattcttttccccttctcccggatccagttccctgtcgagctggtcatttttttcggacgcatccgacgaggctgccctttacgccgcttgtgacgaggtggaatcggagctgaacgaagctgcttcccggtttggacttggttcccctcttccatcgccaagagcttctccaagaccctggacgcccgaagatccatggtccctttacggcccatcccccggtggccgtgggcctgaagattcttggctcctgctgtccgcaccaggaccgacacccgcatctccgagaccagcatccccatgtggaaaacgaagatactcaagtagtgggaccccttcttctgcgtcacccgcacttagtaggcgcggaagcctgggagaagaaggctccgaacctcctcccccacctcccctgcctctggcacgggacccaggcagtcctggtccttttgactatgtcggtgcaccccctgccgagtccatccctcagaagacaaggagaacaagctctgagcaagccgttgcactgccaagatccgaggagcccgcatcctgcaatggcaaattaccacttggagccgaggaatctgtcgctccacctggcggttctcgcaaggaagtcgctggcatggactatctcgccgtgccctcccccctcgcatggtccaaggccagaataggaggacattctccaatcttccgaaccagcgccctcccacccctggactggcctctcccttcgcagtatgaacaacttgaacttagaattgaagttcagccaagggcccatcaccgtgcccattatgagacagagggcagtcgcggagccgtgaaagcagctcccggtggccacccagtcgtcaagcttctggggtattccgaaaaacctttgactctccagatgttcattgggactgcagatgaaaggaacctgcggccacatgctttttatcaggtgcatcgtatcactggcaagatggttgctaccgcttcttatgaggccgtggtgtcaggtacaaaggtgttagagatgaccctgcttccagaaaataacatggccgcaaatatagattgtgctggtatccttaaactgcgcaactccgacatcgagcttaggaagggcgagacagacattggaaggaagaatacgcgggtcagactggtgtttcgagttcacgtaccgcaggggggtggcaaggtcgtgagcgtacaggctgcgtctgttcctatagaatgcagtcaacggagcgcacaggagctgcctcaagtggaagcatactcccccagcgcctgtagtgtgcgcggtggagaggagctcgtcctgactggatctaattttctgcctgactctaaagtagtctttatagagagagggcctgatgggaagctgcaatgggaggaagaagcgaccgtcaatcgtctccagtcaaacgaggttacactgaccctcactgtcccagaatactctaacaaaagagtgagtcggccagtgcaggtctatttctacgtttctaacggtaggcgcaagaggtctcctacacagtctttccggtttttacccgttatctgtaaggaggaacctttaccagacagcagtttacgaggatttccgtctgcgagcgcaactccctttggaacggacatggatttcagtcctcctagacccccttatccatcctacccacatgaagatccagcgtgtgagacgccttatctctcggaagggttcggctacggaatgccgcctctgtatccccaaacgggaccgcctccgagttaccgaccgggactgaggatgtttcccgaaactcgagggactaccggatgcgcacaacccccagctgtgtccttccttccgaggccgtttcccagcgatccatatggtggtcgagggtctagcttcagcttaggcctccctttcagtcccccagctccctttcgcccaccaccactccccgcatcgcctccattggaaggcccttttccaagtcagagtgacgttcatcctctgcctgcagaagggtacaacaaagtggggccaggatatggccctggcgagggcgctccagagcaggagaaatcaagaggcggttactcctccggctttcgtgatagcgtccccattcaggggatcactctggaagaggtgtctgaaatcattggacgggacctgtcaggcttccccgctccccctggcgaagagcccccagcgtag

SEQ ID NO: 29875 - DNA, 2748 bp, Artificial Sequence
  Description of Artificial Sequence: Synthetic coding sequence
atgctgtctggcagggacttaggcgcaccagctgggagcatgggcgcagcatcttgtgaggacgaagagctggaatttaagttggtctttggcgaagagaaggaagcgcctcccctaggggcaggcggactcggggaggaactggacagcgaggacgcacccccatgctgcagactggctctgggtgaaccaccaccatacggggctgcaccgatcggcatccctaggccccctcccccacgcccaggcatgcacagtcccccaccacgcccagccccttctcccggaacatgggagagtcaacccgcaagatcggtgaggctgggcggaccagggggaggggctgggggagcagggggagggcgtgtgttagagtgcccttccatccgcataaccagtatctctccgacccctgagccaccagcagcgttggaagataacccagatgcatggggagacggaagcccgagggattacccccctcccgagggatttggtggctatcgtgaggccggtggtcaaggcggaggggcatttttcagtccctcccctggttcttcttcactgtcatcatggtcattcttctctgacgcttccgacgaggccgctctttacgccgcatgtgacgaagtggaatctgagctcaatgaagctgcgagtcggttcggtctgggttctcctctgccatctccaagagcttctccgagaccttggacccccgaagatccttggtctctgtatggcccttcacctggcggacgaggcccagaggatagctggttgctattgtcagctcccggtcctacacccgctagcccacgccctgcctcgccctgtggcaaaaggaggtactcatcatctggcacaccgtccagcgcatcacccgcattgtctaggagagggtccctgggcgaggaagggagcgagccgcctccgccacctcctctgccactggcccgagatccgggatctcccggaccttttgattatgtgggagctcctccggctgaatcaattcctcagaaaaccagacgcactagctctgaacaagccgtggccctccctagatctgaggagccagcatcctgtaacggtaagttacctctgggcgcagaggagtcggtagccccacctggcggatcccgcaaagaggtggcaggcatggactacctggccgtcccttcgccactggcctggtctaaggccaggatcgggggacactctcctatattccgaacctccgctttacctcccctagactggcccttgccttcccagtacgaacagcttgagctccgcattgaagtgcaacctcgcgctcaccaccgcgcacattacgagactgaggggtcacgcggtgcggttaaagccgctcccggagggcatccagtcgtgaaactgctcgggtattcagagaagccactgaccctgcagatgttcatcggtaccgccgacgagcgaaatctccgcccacatgctttttaccaggtgcaccgcatcaccggcaaaatggtggctactgcctcctacgaggcagtggtatctgggaccaaggtattggaaatgactttactccctgaaaataacatggccgctaatatcgactgtgccggtattctgaagttgagaaacagcgacatcgaactgcgtaagggcgagactgacattgggagaaagaatacacgtgtgcgactggttttccgcgtgcatgtcccccagggtggtggcaaagtggtcagtgtgcaggccgcaagcgtaccaatcgaatgcagccagcgaagtgcccaggagctgcctcaggtcgaggcctactccccctccgcttgcagtgtgcgaggcggagaggaactggttctgactgggtccaactttttacctgactctaaagtcgtgtttattgagcgcggacctgatgggaagctacagtgggaagaagaagccactgttaatcggcttcagtctaacgaggtgacactcacactgaccgtgccagaatacagcaacaagagagtctctagacctgtgcaggtgtacttctatgtaagcaatggacgtcggaagaggtctcctacccagagctttcggtttctcccagtgatatgtaaagaggagcccttaccagactcatccctgcggggatttccctcagctagcgccacaccatttgggactgatatggacttcagcccgcctcgccctccttatcccagttaccctcatgaggatcctgcctgtgagaccccgtacctttcggagggcttcggatatggcatgcctcccctgtatccccagactggcccaccgccatcataccgcccaggccttagaatgttccccgaaacccggggaaccacaggatgcgcacagcccccagccgtctcctttctaccacggcctttcccatccgacccgtacggcggacggggatccagcttctcgctggggttacccttctcacctcccgctccgttcaggcctcctcccctacctgcaagcccacccctcgagggaccgttcccttcacaatccgatgttcaccctctgcccgcagaggggtacaataaggtaggacctggttatgggccaggggagggagcccctgagcaggaaaaaagtcgagggggatacagtagtggatttagagactccgttccaattcagggcatcaccctggaggaagtctccgagatcatagggcgtgatttatccggattccccgcacccccaggcgaggagccccctgcttag

SEQ ID NO: 29876 - DNA, 573 bp, Artificial Sequence
  Description of Artificial Sequence: Synthetic coding sequence
atggatttcagtccgcctcgccctccataccctagttacccccacgaagaccccgcttgtgagaccccctacctgtcagaaggttttggatacggtatgcccccattatatccccagacgggcccacctccttcctaccggccagggctgaggatgtttcccgaaacccggggtacaacaggctgtgcgcagccccctgccgtgtcattcctccctaggcctttcccgagcgatccatatggaggcagggggagctccttcagcctggggctgccattttccccaccagccccttttcgaccccctccgctgcccgcatccccacccctggagggcccttttccctcacaatctgatgtgcatccattgccagctgagggatacaataaggttggacctggctatgggcctggcgagggcgctccagaacaggagaaatcccgcggaggttattcctctggattccgcgactcggtacctattcaggggattactcttgaggaggtgtccgagatcatcgggcgagatctctctggttttccggctcctcccggagaggaacccccagcttag

SEQ ID NO: 29877 - DNA, 2349 bp, Artificial Sequence
  Description of Artificial Sequence: Synthetic coding sequence
atgcctgctagtattagctcaatctttcctggaccaacgctacttctgagctgcggatcagaagagctggattctgaagatgcccctccctgttgccgtctggctcttggagaacctccaccttacggcgcagctccaatcggcatccccaggccacctcccccaaggcctggcatgcactcgccaccgccacgacctgctccgtctccaggaacctgggaatcccagccagcacggtcggtgagactgggagggccaggcggtggcgcaggaggagctggagggggaagagtgcttgaatgccccagcatacgcatcacctcgatcagtccaacgcctgaaccacccgcagccctggaagacaaccccgatgcatggggggatggaagtccgagagattacccgccacctgagggtttcggtggctacagagaagctgggggacagggaggaggagcctttttctccccaagtcccggatcttcttctctttcgtcatggagcttcttcagtgacgctagcgacgaggccgcactctatgccgcatgcgacgaggttgagagcgagctcaacgaagcggctagtcgctttgggctcggttctcccctgccttctccacgcgcatcgccgaggccttggacccccgaggatccttggagtctctatggtccgagccctggcggacggggaccggaggacagctggctgcttctgagcgcgcctgggccaacacctgcttctcccaggcctgcaagcccatgtggaaagcgtaggtacagttcctctgggaccccatcatctgcatcacctgcactgtctcggcgtggctcactcggcgaagagggatcagagccccctccaccgccaccgttacccctggcgcgtgacccaggaagtcctggcccatttgactacgtgggggctcctcctgctgaaagtataccacaaaagaccaggcgtacatcaagtgaacaggccgtggctctaccacgttctgaggaacccgcaagttgcaatgggaagcttccactaggcgcagaagaatcggtggccccaccaggcggttctcgcaaggaagtggccggaatggattacctggccgttccctctccgctagcctggagtaaggccagaataggcggtcactcccctatcttccgcacatcagccttgccgccactggattggccactgccttcccagtatgagcagttggagcttcgcatcgaggtgcaaccacgggcacaccatagggctcactacgagaccgagggatcaagaggggctgttaaggcagctccaggcggacacccggtggtaaaactgctgggatattccgagaaacctctgacattacaaatgttcataggaaccgccgatgagcgcaacctgaggcctcatgctttctaccaagttcaccgcatcacagggaagatggtggcaacggcttcctacgaggctgttgtgagcggtactaaagttctggagatgacactgctgcctgagaataatatggccgcaaacatcgactgtgcaggcatcctcaaacttcggaattcagacatcgagctgagaaagggggaaactgacataggaaggaaaaatacacgcgtgcgacttgtcttccgcgtgcacgtgccacaggggggaggaaaggtggtatcagtgcaggcagcgtccgtccctattgaatgtagccagagatccgcccaagagctgccacaggtggaggcttactctcctagtgcctgtagcgtcaggggtggggaagagttggtgctcactggcagtaactttctacccgactccaaggtggtgttcatcgaaagaggtccagacggtaagttgcagtgggaggaggaggccactgtgaacagactgcaatccaacgaagtaactctgacgcttaccgtgcctgagtacagcaacaagcgcgtaagtcgtcctgtccaggtatacttctacgttagtaacgggcgtaggaaacgctcccctacacagtcgttccgcttcctgcccgtaatttgtaaagaggaaccccttcccgattcctcgcttagaggttttccatccgcaagcgccacaccttttgggacagatatggacttttccccaccgagaccaccatatccgagttacccgcacgaggacccggcttgcgaaactccttacctgtcagaggggtttggatatggcatgcctcctttgtacccccagaccggtcccccaccaagctacaggcccggactccgcatgtttccagaaacaagaggaaccactgtgagtgaaattattggcagggacctgagtggcttccccgctccccctggcgaggagcccccagcttag

SEQ ID NO: 29878 - DNA, 2805 bp, Artificial Sequence
  Description of Artificial Sequence: Synthetic coding sequence
atggctgatggaggcgcagacagtgcggcacagaggctgcctgagggtcccggaagagtggctcccggacgggacctgggtgcacccgctggatccatgggtgctgcttcatgtgaggatgaagaacttgagttcaagttggtctttggcgaggaaaaggaagctcctccgcttggggcaggagggctgggggaggaactggacagcgaggacgcacctccatgctgccgcctggccctgggcgagccccctccctatggagctgcccctattggaattcccaggccaccccctcccagaccaggtatgcactcccctcccccaaggcccgcaccatctccaggcacatgggagagccagccggcaaggtctgtgcgactgggagggccaggtggcggagccggtggggcaggagggggaagggtgctggagtgcccttctatccggataacctccatttcacccaccccagagcccccagctgctctcgaagataaccccgacgcatggggcgacggatcccccagagactacccaccgccagaaggattcggcggttatcgcgaagccggtggacagggcggtggcgcttttttctcaccctccccgggatcttcatcactgtcctcttggagcttttttagtgatgcatccgacgaagctgctttatacgcggcatgcgacgaggtggaaagtgaattgaatgaagccgcaagcaggtttggcctgggctctcctctcccctctccccgtgcttcccctagaccatggaccccagaagatccctggtcactgtacggaccctcccctggtggaaggggccctgaggattcctggctcctgctgtccgctcccggacctactcctgctagccccaggccagccagcccatgcggtaaacggaggtattcgtcttccggtaccccaagctctgctagccctgcattgtcacgcagaggaagccttggtgaagaaggttccgagccacccccaccgccaccactgccactcgctcgggatcctggcagtcccggtccctttgactatgttggagcacccccagcagagagtataccacagaaaacaagaagaacgtcttctgagcaggccgtcgcactgcctcgcagcgaggagcccgcaagctgcaatggaaaattgcctctcggcgctgaggagagtgtcgctcctccaggaggttcaagaaaagaagtggcaggaatggactatctcgcagtaccatccccacttgcatggagcaaggctaggattgggggacacagtcctatcttccgaacttcagcactccccccactggattggccactcccctctcaatacgagcagttggagctccgcatagaagttcagcctagagcacatcatcgcgctcattatgaaacagagggctccagaggtgccgtgaaagcagccccaggcggacaccctgtcgtgaaactcttaggatatagtgaaaaacccctgaccctccagatgttcattggtacagcagacgagaggaacctgcgccctcatgccttctaccaggtgcaccggataactggaaagatggttgccaccgccagctacgaagccgttgtgagcggcactaaagtgctggaaatgaccctgctcccagagaataatatggcggctaacatcgactgcgccggtatcctcaagctgagaaatagcgacatcgagctccgaaagggggagaccgacattggcagaaagaatacacgtgtccggctcgtctttcgcgtgcatgtgccccagggcggaggtaaggtggtctctgtgcaggccgcatcagtgccaatagagtgttctcagcgaagcgctcaggaactgccacaggtagaagcctacagccctagcgcctgcagcgtcagaggcggagaggagctcgtgctgacgggctccaactttttacctgactcaaaagttgtttttatagaacgaggacccgacgggaagctgcagtgggaggaggaagcaactgtcaacagactccaatctaacgaagtaaccctcaccttgactgtccccgagtacagcaacaaacgtgtcagtcgcccagtccaggtgtacttctatgtcagcaatgggaggcgtaagcgtagtccaacccaatcattcaggttcctcccggttatttgcaaagaggagccattgcctgattcctctctgcgaggcttcccttcagccagtgccactcctttcggtacagatatggactttagtccccctcggcctccgtatccgagctacccccacgaggaccccgcatgcgagacgccttacctgagtgaaggcttcggctacggcatgccaccgttatatcctcagacaggaccacccccatcgtataggcctgggttgcgaatgttccctgagacccgaggaaccacagggtgtgcccagcccccagctgtctcttttcttccacgccctttcccctccgatccttacgggggaaggggcagcagtttcagtctgggccttccattctctccccctgcgccatttcgtccacccccactacccgcttcacctccgctagaaggtccgttcccttcgcagtccgatgtgcacccactccccgctgagggctacaacaaagtgggacccggatatggaccaggcgaaggggctcctgaacaggaaaagtccaggggcggttacagttccgggttccgggattccgtgccgatccaaggcatcactttggaagaggtcagtgaaataatcggtcgagatctctctgggttccccgctcccccaggcgaagagccacccgcttag

SEQ ID NO: 29879 - DNA, 1314 bp, Artificial Sequence
  Description of Artificial Sequence: Synthetic coding sequence
atgttcataggcactgcggatgaacggaacttgcgccctcatgcgttttatcaggtacaccgaattacaggcaagatggtcgccacagcgtcatatgaggcagtagtgtccggaacaaaggtgttggagatgactttattacccgagaataatatggcagccaatatagactgcgccggaatcttgaaattgcgcaatagtgacattgagctacgtaaaggagagactgatatcggtcggaaaaatacacgcgttcggctggtgtttcgagtccacgtgcctcagggtggcggaaaagtggtgtcagtacaggctgcgagtgtgcccatagaatgtagtcagcgcagcgcacaagagttaccacaggtcgaagcttactccccttccgcctgttccgtccgcggaggcgaagagctggtgctgacaggcagtaactttctccctgacagtaaggtggtgtttatagaaagagggccagacggcaaattgcagtgggaagaggaagccacagttaaccgtcttcagagcaatgaagtcactctcacactgaccgtgccagagtactccaacaagcgtgtgagcagaccggtccaggtttacttttacgtgagtaacggtcgtcgcaagcggagtccaacgcaaagttttaggttcttgccagtgatttgcaaggaggaacctttgccagattcaagcttgagaggatttccaagcgccagtgcaactccttttggtaccgacatggacttctcaccgcctcggcctccttacccaagctatccacacgaggatccggcttgcgaaacaccttacctctcagaagggtttggatatggtatgccacctctgtatccccaaactggacctccgccaagttacagaccgggacttcggatgttcccagagaccaggggaactacagggtgcgcacaaccaccagcagttagcttcttgcccagaccttttcccagcgacccttatgggggtcgagggagctccttttctctgggcctgcctttctcccccccagctccgttccggccacctcccctccctgcttcaccccctctggagggccctttcccatcacaatccgatgtgcatccccttcccgctgagggttataacaaggtcgggccaggttacgggcctggggagggggcaccggaacaggaaaagagcagaggcggttactcgtcaggcttcagagattctgttccaatccaaggaatcaccctcgaagaagtctccgaaataatcgggagggacttgtctggcttccctgctccacctggtgaagagcctccggcttag

SEQ ID NO: 29880 - DNA, 2496 bp, Artificial Sequence
  Description of Artificial Sequence: Synthetic coding sequence
atgcattctcctccaccccgtcccgcaccgtccccagggacatgggagtcccagccagctcggtcagtccgacttgggggacccggaggcggagcgggtggtgccggtggtggcagggttttagaatgtccgtccatcagaataacatctatatccccaacacctgaacctcctgcggctctggaggacaatcccgacgcctggggcgatggcagtccccgtgattatcccccacccgagggttttggtgggtacagagaagccggtgggcaggggggaggggcatttttttccccttcccccggatcatcctctctgagctcctggtccttcttcagcgacgcttccgacgaagcagccctctatgcagcttgcgacgaagtggaatcggagcttaacgaagcagcgtccaggtttgggcttgggagcccactgcctagcccacgggcaagtccacgcccttggactcctgaggatccgtggtcactgtacggcccttcaccaggtggaagaggccctgaggacagttggctattgctgagtgctccgggacccactcccgcatcccccagacctgcctccccctgtggaaaacgtcgctattctagttcaggtacccctagcagcgccagcccggcactgtctcgccgtgggtccctcggcgaagaaggcagcgagccccctccgccaccacctctgccactcgctcgcgatccgggttcacccggtcctttcgactacgttggtgcaccacctgccgagagcatccctcaaaagacgcggagaacaagctccgagcaggccgtggccctgcccaggtcagaggagccagcctcctgcaatggcaaacttccactgggggctgaggagagtgtggcgccacctgggggatcacggaaggaggttgccggtatggactacttggcagtgccatctcctctcgcttggtccaaggctaggattggaggccattcacctatatttcgcacgtccgccctccccccactggattggcctctgcccagtcagtacgaacaacttgagttacgaattgaggtgcagcctcgagcacatcatcgggcacactatgaaacagaaggtagtcgcggtgctgtcaaagccgcacctgggggtcatccagtggttaaattactcggttattcggagaagcccttgactctgcagatgttcataggtaccgctgatgagcgtaacctccgccctcacgcattctaccaggtgcatagaatcactggtaagatggtcgccactgcaagttatgaagccgtggttagcggcaccaaggtcctagagatgacactgttgcctgagaacaacatggcagccaacatcgattgcgctggtatcttaaagcttcgcaactctgacatcgaacttcgaaaaggcgagactgacattgggcgaaaaaacactcgcgtaagactggtgttcagagtgcacgtgcctcaaggtggcggtaaagtcgttagtgtgcaagcagccagcgtcccaatcgaatgttcccaaagatccgctcaggagctgccccaggtcgaggcctattccccatccgcgtgtagcgtacgcggtggcgaggaacttgtactgactggaagtaatttcctgcccgacagtaaggtcgtgtttatcgaaagaggccctgatggaaagctacagtgggaggaggaggcaactgtaaatcgacttcagagtaatgaggtcactctgaccctcactgttcctgaatatagcaataaaagagtttcacgtcctgttcaggtatacttctatgtctctaacggtcgtagaaaaaggtctccaacccagagcttcaggtttctgcctgtcatctgtaaggaggaaccgctgccagactcttccctgcggggattcccttctgcaagcgccaccccgttcggcacggatatggacttctcaccaccgaggcccccttatccatcttatccccacgaggatcctgcctgtgagacgccttacctgagcgaagggttcggctacggcatgccgcctctgtacccacaaacagggcctccaccttcctacaggccagggttacggatgtttccggagaccagaggcaccacaggctgtgctcaaccaccagcggtctcttttctgccccgaccattcccttctgatccctacggcggacggggatcttcgtttagtttggggctgccatttagcccacctgcccctttcagacccccacctctgcctgctagtcccccattagagggacctttcccttcccagtcagatgtgcatccattgccagctgagggctataacaaggtgggtcccggatatggccctggagagggagcgcctgagcaggaaaaatccaggggtgggtacagctccgggtttcgcgatagcgtgccaattcagggaatcactttggaggagggaggatgtgggaccggcggatgtgagtgcgaatgcgttcaagagatcgccttgcatgtgtgctag

SEQ ID NO: 29881 - DNA, 249 bp, Artificial Sequence
  Description of Artificial Sequence: Synthetic coding sequence
atggacttctctccccctagacctccctacccctcctatccccacgaagaccccgcttgtgaaactccatatctctccgaggggtttggatatggaatgccccctctgtatccgcagacaggacctcccccatcatataggcccggactcagaatgttcccggaaacacgcggaactacagtcagcgaaatcatcggaagggacttatcagggtttccagctccccctggagaagaaccaccggcatag

SEQ ID NO: 29882 - DNA, 315 bp, Artificial Sequence
  Description of Artificial Sequence: Synthetic coding sequence
atgtcctcagctgccaggtcacgtttgactagggcaacccgccaagaaatgctgttcttagcactcctactcttgcctgtcgtagtcgcttttgccagagccgaagctgaagaagatggtgatctgcaatgcctgtgcgtgaagacaacatctcaggtgagaccacggcatatcactagcctggaagtgatcaaggccggaccccactgccctactgcccagctcattgcaacactcaaaaacggtcggaagatctgcttggatctccaggcactgctgtacaagaagattatcaaggaacacctggaaagttag

SEQ ID NO: 29883 - DNA, 2907 bp, Artificial Sequence
  Description of Artificial Sequence: Synthetic coding sequence
atggcagaggatgacccttacctgggtaggcccgagcagatgttccatctcgatccttccctgacgcatacaatcttcaacccagaggtgttccagccgcagatggcgctgcccacggacggcccatatctgcagatcctcgaacagcctaaacagagaggctttagatttcggtacgtgtgtgaagggccatcccatgggggacttcccggtgcctcatccgaaaagaacaagaaaagctaccctcaagtcaagatctgcaactatgtcggtccagccaaagtgattgtgcagctggttaccaacggaaagaatatccaccttcacgcccattcgttagttggcaagcactgtgaggacgggatatgcacggttaccgcgggtcctaaggacatggttgttggatttgcaaatttgggcattcttcacgttaccaaaaaaaaggtgtttgaaactctggaggctcgtatgaccgaggcctgtattcgtggttacaatcctggactgctcgttcaccctgatctcgcctacttacaggccgaaggaggaggagatagacagctgggagaccgggagaaagaactgatcagacaggctgccctgcagcagactaaagagatggacttgagcgttgtacgcctgatgtttactgccttcctgcctgattccacggggagtttcactagaaggcttgagccagtggtctccgacgcgatctatgacagcaaagcacccaacgcatcaaatcttaagatcgtgcgcatggacagaaccgccggttgcgtaaccgggggagaagagatatatcttctctgtgacaaagtgcaaaaagacgacatccaaattaggttctatgaggaagaagagaatggtggagtgtgggaaggctttggtgatttctctcccacagatgtacacaggcaatttgccatagtgttcaagactccgaagtacaaggacattaatatcactaagcctgcctctgtttttgtgcagctgcgcagaaagtctgacttagagacttctgaacccaaaccctttctttactacccagagattaaggataaggaggaagtgcagaggaagcgacagaaactcatgccaaatttttcggactccttcggaggtgggagcggcgctggcgctggagggggagggatgtttggaagcgggggaggaggcggaggcactgggagcaccggcccaggttattctttcccccattatggctttcccacttacggaggcatcacatttcatccaggtacgacaaagtctaacgcgggaatgaagcacggcactatggacacagaatccaagaaagaccctgaaggctgcgataagagcgacgacaaaaacaccgtgaatctgtttgggaaggtcatcgaaactaccgaacaggatcaggaaccctctgaggcgacggtgggaaatggcgaggttacgttgacctatgccactgggaccaaagaagagtcggcaggagtacaggacaacttgttcctcgagaaagctatgcagctcgctaagaggcatgctaacgccctgttcgattatgccgtgaccggtgacgttaagatgctgctggcggtgcaacgacacttgaccgcagttcaggacgagaacggagattccgtgctgcaccttgctatcatacatctgcacagccagctcgtccgcgacctccttgaggtaacttcgggcctaatttctgacgacattatcaatatgcgcaatgacttgtaccaaaccccactgcatctggcagtgatcaccaaacaggaagacgtggtcgaggaccttctgcgtgccggtgcagacctgagtctgctcgatcgtctggggaatagcgtgctgcaccttgcggcaaaggagggccacgataaggtgctctcaatcctgctgaaacataaaaaggccgcacttctgctcgatcatcctaatggagatgggctcaacgctattcatctggccatgatgagcaactccctcccttgcctgttgctactggtggcggcaggggcagatgtaaatgcacaggaacaaaagtcagggaggacagccctgcacctggctgtcgaacatgacaacatttcactggcaggatgtctgctgcttgaaggagatgcccacgttgattccacgacatacgacgggacaactcccctgcacattgccgctggtagaggctccacccggctggctgcactcctgaaagccgctggtgccgaccccctggtggaaaattttgagcccttgtacgatttagatgattcttgggaaaacgcaggcgaggatgagggggtagtgccaggtactacccccctggacatggctacatcttggcaggttttcgatatcctcaatggaaaaccatatgagcctgagtttacctcggacgaccttctcgcgcaaggagatatgaagcagctggccgaagatgtaaagcttcagctctacaagctgcttgaaatccctgatcccgacaaaaactgggctactctggcccagaagcttggactgggcatattgaacaacgctttcaggctttcaccagctccttcaaagacgcttatggataactacgaagtgtcgggaggtacggtacgggaactagttgaagctctgaggcagatgggatacactgaagcaattgaagtgatacaggccgcttctagccctgtcaaaaccaccagccaggcccactcccttcccctctcacccgcttcgacacgtcaacagatcgatgagctgagagattcagactctgtgtgtgattctggcgttgaaacttcatttcggaaactcagtttcactgaatctctcaccagcggcgcaagcctgctgaccctgaacaaaatgcctcatgattatgggcaggagggcccactcgaagggaagatttag

SEQ ID NO: 29884 - DNA, 2907 bp, Artificial Sequence
  Description of Artificial Sequence: Synthetic coding sequence
atggccgaagacgatccgtacctaggtaggcccgaacaaatgttccatctggatccgtccctgacacacactatttttaatcctgaggtgttccagccgcagatggccttgcctactgacggcccttacctgcagatactggaacagccaaagcagcggggttttagatttagatatgtgtgcgaaggtccctctcacggcggactgccaggtgcctctagcgagaaaaataagaaatcctacccacaagtaaagatttgtaattacgtgggcccagccaaggtgatcgttcagcttgtcacgaatggaaaaaacatccacctgcacgcccactctctggtggggaagcattgtgaagatggcatctgcaccgtgactgccggaccaaaagacatggtggtcggttttgccaacctggggatactgcacgtgacaaaaaagaaagtgttcgaaactcttgaagccaggatgacggaggcgtgcatccgaggttataaccccggacttctcgtgcatcccgacctcgcttacctccaggcagaagggggaggcgaccggcagctcggcgaccgggagaaagagcttatcaggcaggctgctctgcagcaaacaaaggaaatggacctttcagtcgttcgactgatgttcaccgctttccttcccgattcaacagggagtttcacaaggagattggaacctgtggtgagcgacgctatctatgattccaaggccccaaacgcgagcaatctcaaaatcgttcgaatggaccgcactgccggatgcgtcaccggaggtgaggaaatctacctgctctgtgacaaggtgcagaaagatgacatacagatccggttctatgaggaagaggaaaacggaggcgtgtgggagggctttggggacttttcacccacagacgtccacaggcaatttgccatcgtctttaaaactccaaagtacaaggatatcaacattacgaaacctgcctccgtctttgtgcagctccgcagaaaatccgacttggaaacttctgaaccaaagccgtttctgtactatcctgagatcaaagacaaggaggaagtgcaaagaaagcgccagaagctcatgcccaattttagcgattcttttggcggagggtctggggctggtgctggcggaggcggaatgttcggctccgggggagggggtggcggaacgggcagcaccggccctggctacagcttcccacactacggcttccccacttacgggggtatcacatttcacccaggaaccacaaagtccaatgccggtatgaagcacggtaccatggacacggagagcaagaaagacccagaggggtgtgacaaatccgatgataaaaatacagtcaaccttttcggcaaagtcattgagactaccgaacaggaccaggaaccatctgaagctaccgtgggcaacggagaggtcaccttaacctacgctactggcaccaaggaggaatcggccggagttcaggacaatttgtttctggaaaaagccatgcaacttgccaagagacatgccaatgctttgtttgactacgcagtgaccggcgatgtgaagatgctgctggctgtacagaggcatttaactgccgttcaggacgaaaatggcgactcagtcctccacctcgcaatcattcacctacattctcaactggtgagggacctgttggaggtgacctcaggcttaattagtgacgatatcattaacatgcgcaatgacctgtatcagacacccttacatttagcagtaatcacaaagcaggaggacgtggtcgaggatctcctgcgcgctggggctgacctgtcccttctcgaccgtctcggaaacagtgtgttacaccttgcagctaaggagggtcacgacaaggtcctctctattctgcttaagcacaaaaaagccgcattactcctcgaccatcccaacggagacggcctcaacgccatccacctagctatgatgtccaattcactcccctgtctgctgcttctggtcgccgctggcgctgatgtaaacgcccaggagcaaaaaagcggacggaccgctcttcatctcgcagtagaacacgataacatttccctggctggctgcctgctgttagaaggagacgcccacgtggacagtacgacctacgatggaactacgcccctccatattgctgctggtagagggtccacacggctggccgctctgctcaaggccgcaggcgctgatcccctggtcgaaaacttcgaacccctatacgaccttgacgattcttgggaaaatgcgggtgaggatgagggagtcgttccgggaacaacaccactcgatatggccacctcatggcaggtctttgatatattgaatggaaaaccttacgagcctgagtttacttccgatgacttgttggctcagggggacatgaagcagctcgctgaggacgtcaagctgcagctgtataaattgttggagattccggatccagacaagaattgggccacgcttgcacagaaactgggtctcggaatcctgaataatgccttcaggctctctcctgccccttcaaaaaccctcatggacaactatgaggtgagcggaggcaccgtccgcgaattagtagaggccctgcgccaaatggggtatacagaggccatcgaagtgatccaggcagcatccagtccagtgaaaaccactagtcaggcccatagcctgcctttgtcacccgctagtacccgacaacagatcgacgaactgcgggattctgacagtgtgtgcgattctggagtggagacatccttcagaaaactttcattcaccgaatccttgactagcggcgcaagtctgcttacactcaacaaaatgccacacgattatgggcaggaaggcccactggagggcaaaatatag

SEQ ID NO: 29885 - DNA, 438 bp, Artificial Sequence
  Description of Artificial Sequence: Synthetic coding sequence
atggccgaggatgacccctacctggggaggcctgaacagatgttccatcttgacccctcactcacccatactatctttaaccccgaggtcttccagcctcagatggcactgcccacagctgacgggccatacctacagatcctggaacagcccaagcagagaggctttcggttccgttacgtctgtgaaggtccaagccacggaggactgcctggcgctagcagcgaaaagaacaagaagagctacccacaggttaaaatctgcaactacgttgggcctgccaaggtcatcgttcagttggttaccaatggaaaaaatatccatctccatgctcactcactggtgggtaaacattgtgaggacggcatttgtaccgtgacggccggacccaaggacatggtagtgggtttcgcaaatctgggaattcttcatgtgtag

SEQ ID NO: 29886 - DNA, 225 bp, Artificial Sequence
  Description of Artificial Sequence: Synthetic coding sequence
atgaagaggacgaccagctttcgaatggcagaggatgatccatacctgggcaggcctgagcagatgttccaccttgaccctagcctgacacatacgatatttaatccggaggtgtttcagccccagatggcactgcctaccgacggcccatatctccagattttagaacagcctaagcagaggggttttcgatttcgctatgtctgcgaggggccttctcactag

SEQ ID NO: 29887 - DNA, 1923 bp, Artificial Sequence
  Description of Artificial Sequence: Synthetic coding sequence
atggccgctctgtacagaccaggcctgcggctaaattggcacgggctgtctccattggggtggcccagctgcaggtcaatccagactctacgcgttttgagcggggatctcggtcagctgccaacaggaatccgcgactttgtagaacactctgccagactgtgccagcccgagggaattcacatctgcgatggaactgaagccgagaatacagccacactgacgctgctggagcagcagggattgatcagaaagttgccaaagtacaacaactgttggctagccagaacagaccccaaggacgtggccagagttgagtccaaaacggtaattgtaacccccagccagcgcgatactgtgcagctgccccctggaggtgctcggggtcagctgggcaattggatgagcccagcggacttccagcgcgcagttgacgaacggttccccggttgcatgcagggacggaccatgtatgttctgcctttttctatgggtccagttggttcaccactgagtcggatcggagttcagcttacagattctgcctacgtggttgcgtcaatgagaatcatgacccgcttggggacgcccgtgctgcaggccctgggtgatggtgatttcgtcaaatgtctgcatagcgtgggacagcctcttaccggccagggagagcccgtttcccagtggccatgtaacccagaaaagacacttatcggacatgtacctgatcagcgcgaaataattagtttcggcagcgggtacggcggaaactcactgctggggaaaaaatgtttcgccctgaggattgcctcccggttagccagggatgaggggtggctcgccgaacacatgctgatcttggggattacatctcctgctggcaagaagaggtatgtggctgccgctttccctagtgcttgtggtaaaacgaacctcgctatgatgcgccctgcccttccaggatggaaggtggagtgcgtgggggacgacatcgcttggatgcgcttcgactctgagggcaggctccgcgcaataaatccagaaaatggtttttttggagttgctcctggtactagcgccactacaaaccccaacgccatggcaactatccagtccaatacaatcttcaccaacgtagccgaaaccagcgacggaggagtctactgggaaggaatcgaccaacccttgcctccaggcgttaccgtcacctcgtggctcgggaaaccttggaaaccgggagacaaagaaccctgcgcccacccaaactctagattttgcgccccagcacgacagtgtccgatcatggacccagcttgggaggctcccgaaggggtgcctatagacgcaattatatttggaggcagaagaccgaaaggagtgcccttggtgtacgaggccttcaactggaggcatggcgttttcgtcggcagtgccatgcgtagcgaaagcactgctgctgccgaacacaagggaaaaattattatgcacgatccctttgccatgcgtccctttttcggttataactttggtcattatttggagcactggctttctatggaaggcaggaagggcgcacagttaccccgaatctttcacgtcaactggtttcgtcgtgacgaagctggacactttctgtggcccggattcggggagaatgccagagtgctagattggatctgccgcagacttgagggcgaagacagtgcaagagaaactcctatcggtcttgttcccaaagagggcgctttggacctcagtggcctgcgcgcaatagacacaactcagcttttctctctcccaaaagacttctgggaacaggaagtaagagacattcggagctatctgacagagcaagtcaaccaagacctgccaaaagaggtgctggctgaactggaggcactggagcggagggttcataagatgtag

SEQ ID NO: 29888 - DNA, 3477 bp, Artificial Sequence
  Description of Artificial Sequence: Synthetic coding sequence
atgacgcacggtgaagaactgggctccgatgttcatcaggactctattgtgttaacataccttgaagggctcctaatgcaccaggcagccggaggatctggaacagccgtggataagaagtcagctgggcacaacgaggaggaccagaatttcaatattagcgggtcagcctttcctacttgtcagtccaatggcccagttctgaatacccatacctaccagggcagcggaatgcttcatctcaagaaagcgcgactgctacagtctagcgaggactggaacgcggcaaagagaaaacgcctgtcagactcaatcatgaatctcaatgtgaagaaggaggcattgctggcaggcatggtcgactccgtccctaagggaaaacaggactcaacgcttctcgcaagtttgttacagtcgttctcctcacgtctccagaccgttgctttatcccaacagataagacagagcttaaaggaacagggatacgcgctcagccatgattccctaaaggtggagaaggacttgcgttgttacggtgttgctagctcacatttgaagaccctgctgaagaagtctaaggtcaaggaccaaaagcccgatactaatctgccagacgtcacgaagaatctaattcgcgaccggtttgccgaatctccacaccacgtgggacagtccggaaccaaggttatgtccgagcctctttcatgtgctgcgcgattgcaggcggtggcttccatggtggaaaagagagcttcacctgctacaagccccaagcccagcgttgcctgcagccagctggccctcctcctctccagcgaggcccatctccagcagtacagtagggaacacgccctgaagactcagaatgccaatcaggctgcctctgaaaggctggctgccatggccagattgcaggaaaatggccagaaggacgtcggctcttatcagctgcccaaagggatgtccagtcatctgaatggacaagctagaacaagcagctccaaactgatggcgagcaaaagcagcgccacagtgttccagaatcccatggggatcatcccctcatccccaaaaaacgcaggctacaagaattcactcgagcgcaacaacatcaagcaggcagcaaacaatagccttctgctgcatctgttgaaatcccaaactattcccaaaccaatgaacgggcactcgcactcagaacggggaagtattttcgaggagtcgtcgacacctacaactattgatgagtattctgacaacaatccctccttcacggatgattctagtggagacgagtcgtcctatagcaactgcgttcccatcgacctatcctgtaaacaccgaactgagaagtcagagagcgaccagccggtgtccctggacaactttacacaatccctcctgaacacttgggaccccaaggtgcccgatgtggatatcaaagaagatcaggatacgagcaaaaactcaaaactgaatagtcaccaaaaggtgacactgttgcagctgctcttaggccacaaaaatgaggagaacgtggagaagaatacatctccccagggagtgcataatgatgtctcgaagtttaatacccagaattacgccaggacgagcgtcattgagtcgccatccaccaataggacaacgcctgtttctacgccaccgttacttacatcatccaaagccggatctcccatcaatctcagccagcactctttggtgattaagtggaatagtcccccatacgtgtgtagcactcagtcagagaagctgacaaatacagccagtaatcactcaatggatctgaccaagagcaaggacccgccaggcgagaagcctgcacagaacgaaggggctcagaattctgctacgttctccgccagtaaactcctgcaaaacttggcccaatgcggaatgcaaagttctatgtccgtggaggaacaacgccctagtaagcagctactgaccggcaacaccgataaaccaatcggcatgatagacaggctgaactctcccctgctgtctaacaagactaatgccgtcgaggagaataaagcattcagttcacagccaactggacctgaaccaggcctttcagggagcgagattgagaatcttctggagagacggacagtcctgcagctgcttttaggtaaccccaacaaagggaagagcgaaaagaaagaaaaaacaccactcagagacgagagcactcaagagcatagcgaacgcgctctgagcgagcagattctgatggttaagataaaaagcgaaccctgtgacgacctgcaaattcctaacactaacgtgcacttgagtcacgatgccaaatccgcaccctttttaggcatggctccagctgtacagaggtcagctccggctctcccagtctcagaggacttcaagtcagagccagttagtccacaggacttcagctttagtaagaatgggctgcttagcaggttactgcgacagaatcaagacagttatctcgctgatgacagtgatcgatctcaccggaacaatgagatggccctgttagagtctaaaaatctttgcatggttccaaaaaagaggaagctttataccgagccactggagaaccctttcaaaaagatgaaaaacaatattgtcgatgcagcgaacaaccacagcgctcctgaggtcttgtacggtagccttctgaatcaagaggagttgaaatttagccgcaacgatttggaattcaagtaccccgcaggacacggttctgctagcgagagcgaacatcgctcctgggccagggagagtaagtcattcaatgtcctcaagcaactgctgctctcagaaaattgtgtgcgcgatctgagtccgcatagatctaactcagtcgcggatagcaaaaaaaagggacacaagaataatgtgactaattctaagccagagttttccatctcgagtctcaatgggcttatgtactctagtacacaaccatcttcctgcatggataaccgtactttcagttacccgggtgtcgtcaagacaccggtgtcacccaccttccctgaacatctgggatgtgcgggatctaggcctgaaagtggcctcctcaatggctgcagtatgccttccgaaaaaggacctatcaagtgggtaataaccgatgctgaaaaaaatgagtacgagaaggatagccccagactaacgaagaccaaccctattttgtactatatgctccagaagggaggtaactcagtgacctccagggagacgcaggataaggatatttggcgagaagcttccagcgcagaatccgtatctcaggttaccgccaaagaagagttactgcctactgccgaaaccaaggcaagttttttcaacctgcgtagcccctacaactctcacatgggaaataatgcctcacgccctcacagcgctaacggtgaagtatacggtttgctcgggagcgtcctcacaatcaagaaggaatctgagtag

SEQ ID NO: 29889 - DNA, 3477 bp, Artificial Sequence
  Description of Artificial Sequence: Synthetic coding sequence
atgacacatggggaagagctgggctctgacgtccaccaggactccattgtcctcacatacttggaggggctcctgatgcatcaggcagcaggaggatcgggaaccgccgttgacaagaagagcgcaggtcataacgaggaggaccagaatttcaatattagtggaagtgccttccccacttgtcaaagtaacggcccagttctcaacacacatacgtaccaggggagcggtatgctgcacttgaaaaaagctagacttcttcagtcttcggaggattggaatgctgcaaagcggaagaggttgtcagattccatcatgaacctgaatgtcaaaaaggaggccctcctcgctggcatggtcgactctgtacccaaaggcaagcaagactctaccctgcttgcttccctccttcagtcattttcctcccgacttcaaaccgtcgctctgagtcagcaaatcagacagagcctgaaggaacagggatacgctttatcccacgacagcctgaaggtggagaaggatctccgctgctatggtgtggcctctagccaccttaagactctcctcaagaaaagtaaagttaaagatcagaaacccgacactaacctgcctgatgtgactaagaacctgatccgcgaccgattcgccgagtcaccgcaccacgtgggccagagcggcacaaaggtcatgtctgagcccttgtcttgcgccgctcgcttgcaggcagttgcttccatggtggaaaagcgtgcctcgccagcgacatcccctaaacctagtgtagcctgctcgcagctggctctcctgctttctagcgaagctcatttgcagcagtactcaagggaacacgcactcaagacacaaaacgccaatcaagcggcaagcgagcggctcgcggctatggccaggcttcaggagaatggacagaaagatgtggggagctatcagctgcctaagggcatgagtagccacctgaacggacaagccaggacatcctcctcgaagctgatggctagtaaaagttccgctacagtgtttcagaaccccatgggcatcattccctcctcccccaaaaacgccggatacaaaaacagtctcgaacggaataacataaagcaggccgctaataattccctgttacttcacttgctcaagtcccagacaatcccaaagcctatgaatggccacagtcactctgagcgagggagcatttttgaagagtctagtaccccgacgaccatcgacgagtatagtgacaataatccaagctttaccgatgactcttcaggagacgaatcttcctactcaaattgcgtacccattgacctttcttgtaaacaccgaaccgaaaaaagcgaatctgatcagcccgtctcactagataacttcactcaatccctccttaacacgtgggatccgaaggtcccagacgttgacatcaaagaagaccaggacactagcaaaaatagtaaactgaactctcatcagaaggtaacattactacagctcctgctgggccataaaaatgaagaaaatgttgagaagaataccagcccccaaggggtgcataatgacgtcagtaagtttaatacccagaattacgccagaaccagtgtcatcgagtcaccctctacaaacagaacaacccccgtctctactcctcccctgctgaccagcagtaaggccggaagtcccattaatctgagccagcactcactggtgataaagtggaattcccctccctatgtgtgtagcacccaatcggaaaagttgacaaacacggcaagcaatcactcaatggacctgaccaaaagcaaagatcctcccggtgagaaaccagctcagaatgagggagcccagaactcagctacattttccgcgtcgaaactgctgcagaacctcgctcaatgcggaatgcagtccagtatgagtgtagaagagcaacgtccatccaagcagttgttaaccggtaatacagacaagcccatcggtatgatcgacagacttaactcaccacttctgtcaaataaaactaatgccgtggaagagaacaaggcattcagttctcagccgacgggtcccgaaccaggcctgtcagggagtgaaatcgagaatctgctggagcggcgaaccgtgttgcagcttctgctcggcaatcccaataagggcaaatcagaaaagaaagagaagacacctctgagagacgagtccacgcaggagcacagtgaaagggctctgtccgagcaaattctcatggtcaagataaaatcagagccttgtgatgacctgcaaattccaaataccaatgtgcatctgagccacgacgcaaaatcagctccattcctcggcatggcccctgccgtccagcggagcgccccagccctgccagtgtccgaagactttaaaagcgaacctgttagtccccaggactttagctttagcaaaaatgggctgctttccagattgctgagacagaaccaagatagctatctggccgacgacagcgatagatcccaccgaaacaacgagatggcgctgctggaatcgaagaacctgtgtatggtccctaaaaaacgtaagttatacactgagccgctggaaaaccccttcaagaagatgaagaacaacatagtggatgcggctaataaccactccgcccctgaggttctgtacgggtcactgttaaatcaggaggagctgaaattctccagaaacgacctagaattcaaatatccagcaggccacgggtcagcctcagaaagtgagcaccgctcatgggcccgtgagtctaaatctttcaatgtgctgaagcagctgctgctctctgaaaattgtgtccgggatctgtcgcctcaccggtctaactccgtagccgattccaaaaaaaagggccataaaaataacgtgactaactctaagcctgagttctctatcagtagcctgaatggcttaatgtatagctccacccagccaagcagctgtatggataaccgtacattctcttatccgggtgtggttaaaaccccagtgtcaccgactttcccagaacacctgggttgcgctgggtcccgtccggaaagtggactgctcaacggatgttccatgcctagcgaaaaggggcctattaagtgggtgataacagacgctgaaaagaacgaatacgaaaaagactctccacggttgacaaaaacaaatcccatcctctattatatgctgcaaaaaggtgggaatagcgtcaccagtcgcgaaacccaggataaggatatttggagagaagctagcagcgccgagagtgtcagccaagtcaccgccaaggaggaacttctacccaccgccgaaactaaagccagtttcttcaatctacggtctccctacaattcccatatgggcaacaatgcctctaggcctcactccgcgaatggcgaggtgtacggcctgcttgggtccgttctgaccataaagaaggagtctgagtag

SEQ ID NO: 29890 - DNA, 3477 bp, Artificial Sequence
  Description of Artificial Sequence: Synthetic coding sequence
atgactcacggcgaagagctcggcagcgatgtgcatcaagactccatcgtgctcacatatctggaaggtctgcttatgcatcaagctgccggaggctctggcaccgctgtagataagaagtccgccggacataatgaagaagaccagaattttaacatcagtggatctgcctttcctacttgccaatctaacggaccagtcctgaacactcacacatatcagggcagtggcatgcttcacctgaaaaaagctagattgctccaaagtagcgaggactggaatgcagccaagaggaagaggctgagtgactctataatgaaccttaacgtgaaaaaggaagccttactggcaggcatggtggattctgtgcccaagggaaagcaggacagtaccctattggccagcctgctgcagtctttcagtagtagacttcaaaccgtggccctctcccagcagattcggcaatctctgaaggaacaggggtacgcgctttcacatgattctctgaaggtggagaaggacctcagatgctatggcgtggcctcttcccatcttaaaactctgctaaaaaaatctaaggtcaaggaccagaagcccgatactaatctcccagacgtcaccaaaaacttaattcgggacaggttcgccgagtccccgcatcacgtcggtcagtctggcacaaaagtgatgtccgagcccttatcttgcgcagcaaggctccaggctgttgccagcatggtggaaaaacgtgcatcgcctgctaccagtcccaagccttcagtggcatgttcacagctcgccctcctgttgagctctgaggcgcacctgcagcaatacagccgtgagcatgcgctgaaaacccagaatgccaaccaggcagcctcagaacggctagcggctatggctaggttgcaagagaacgggcagaaagatgttggcagttatcagctacccaaggggatgagctctcatctgaatggacaggcgagaacctcatcttcgaagctaatggcaagcaagtccagtgctactgtgtttcagaatcctatggggataattccatcatccccgaaaaatgctggttataagaattccctggagcgcaataatatcaaacaggcagctaacaatagcctgctgttacacctactaaagtctcagactattccgaagcccatgaacggacactctcactctgaaagagggtcaatcttcgaagagtcttcaacacccacaaccattgatgagtacagtgacaataacccctctttcaccgatgatagctccggggatgaaagttcctactctaattgtgtaccgattgatctctcttgcaagcaccgcacggaaaaaagtgaatccgaccaacctgtctcgctcgataacttcacacagtctctgctgaacacctgggaccctaaagtgccagatgtcgacatcaaagaggatcaagacacctccaagaactcgaagctgaattcccaccagaaggtcaccctgctccagttattgctcggacataaaaacgaagaaaatgtggagaaaaacacgagtccgcaaggagttcacaatgacgtaagcaagttcaacacccagaattatgcccgaaccagtgttattgaatctcctagtactaatcggactacaccggtgtccacacccccactgctgactagctccaaggctggtagtcccatcaatctgagccagcattctcttgtcattaaatggaactcccccccttacgtttgctcaacacagagtgaaaagctcactaatacagcgtccaatcactccatggatctcaccaagtcaaaagaccctccgggtgaaaagccagcccagaatgagggagcccagaattctgccacattctcagcgagcaagcttctgcagaatcttgcccagtgcggcatgcagtctagcatgtctgtcgaagagcagcgaccatcgaagcagctattaactggcaataccgacaaacctatagggatgatcgatcgtcttaacagtccactgctgtcgaataaaacgaacgctgtggaggaaaataaagccttctccagccagcccactggtccagaaccaggacttagcggttccgagattgaaaatctgctcgaaagaaggaccgtgctgcagctcctgctgggcaaccctaacaaggggaaaagtgaaaagaaagagaagacccccttacgcgatgagtcaactcaggagcattcagagagagcactgtcagagcagattctgatggtaaagataaagagtgagccatgcgatgacttacagatccccaatacgaatgtgcacctttcacacgatgctaaatctgcgccttttttaggcatggcaccagctgtgcagcggagcgcccctgcccttccagtgtccgaggacttcaagtccgagcctgtatcaccccaagacttcagcttttcaaaaaacggactcttaagtagactcctgcgacagaaccaggacagttaccttgccgacgattccgacagaagtcacagaaataacgagatggccctgctggagtctaaaaatctttgtatggtccccaaaaaacggaagttgtacactgagccccttgagaatccatttaagaagatgaagaacaatatcgtggacgcggctaacaatcactccgctccagaggtgctgtatggtagtttactaaatcaggaggagcttaagttttctcgtaatgatcttgaattcaaataccctgcaggacacggatctgcctcagagagcgaacatcggtcgtgggctcgggaatctaagtcttttaatgtgctgaaacagctgctcttatccgaaaattgtgttcgagatttgtcgccacacaggtctaattcagtggccgacagcaagaagaaaggacataaaaataacgtgaccaattcaaaacccgaattttccatctcctctctcaatgggctgatgtactcatctacgcagccttcctcttgtatggacaatcgtacgtttagctaccctggggtcgtaaagaccccggtttcccccaccttccccgaacacttagggtgcgccggaagtagaccggagagcggcctattgaacggttgttccatgccaagcgaaaagggacccatcaagtgggtaattacagacgctgagaagaatgaatacgaaaaggatagcccaagactgacaaagaccaatcccatactatactacatgctgcagaaggggggaaattctgtgaccagccgcgagacacaagacaaagacatctggcgcgaagctagttccgccgagtccgtgtcacaggtgacagctaaagaagagcttttgccaactgctgagacaaaggcctccttttttaatttaaggtcaccctataactctcatatgggaaataacgcttcacgcccacactccgcgaatggggaggtgtacggactcctgggaagcgtgctgacaattaagaaagaatccgaatag

SEQ ID NO: 29891 - DNA, 201 bp, Artificial Sequence
  Description of Artificial Sequence: Synthetic coding sequence
atgacgcacggagaagaactcggttccgacgtgcatcaggactccattgtgctgacctatctagaaggccttctgatgcatcaggctgctggcggtagcggaactgctgttgacaagaaatcagcaggacataatgaggaggatcagaatttcaacatttctggctcagccttccccacatgccaatctaacggcccttag

SEQ ID NO: 29892 - DNA, 4176 bp, Artificial Sequence
  Description of Artificial Sequence: Synthetic coding sequence
atgcccagtagcctccttggcgctgcaatgcccgcttcaacatcagctgccgctttacaggaggcactggagaatgcgggacgactaatagaccgacaactgcaggaagaccgcatgtatcctgatctctccgagctgctaatggtgtccgccccaaacaaccccacagtctcaggtatgtcggatatggactacccacttcaaggccctggcctgctttctgtgcctaaccttcctgaaatttccagtataaggcgggtccccctgcctccagaactagtcgagcagtttggccatatgcagtgtaattgcatgatgggggtatttcctcccatttccagggcatggctgacgatcgactccgacatttttatgtggaattacgaagacgggggtgatctggcgtactttgacggcttgtcagaaacaatcttggcggtagggctggtgaaacccaaagccggaatctttcaacctcatgttagacatttgctagtgctcgctactcccgtggacattgtcattctgggactctcgtatgcgaacctgcagacaggcagcggtgttctcaacgattcgctgtctggcggaatgcagctgctgccggacccactctacagtcttcctacagataacacttatctgctgacaatcacctctaccgataatggtcgcatcttccttgctggtaaggatggatgtttgtatgaggtggcttaccaagccgaagctggctggttctcccagcggtgtaggaagatcaatcatagtaaatccagtctgtccttcctcgtgccgtccctgctacagtttactttttctgaggacgatccaattctgcaaattgcgatcgacaattccaggaatattctctacaccagatctgagaaaggagtgatacaggtgtatgacctcgggcaggacggccagggaatgtctagagtggcctccgtttcccagaacgccattgtttcagctgctggaaatattgcacgcaccattgacagatccgtcttcaaacctattgtccagatcgctgtgatcgagaacagcgagtcacttgactgccagctccttgccgtgacacatgctggcgttaggctgtacttcagtacttgtcctttcaggcagccccttgcaaggcctaacacactgaccttggtgcatgtacgacttccaccaggatttagcgcgtcctctactgtcgagaagccctcaaaggtgcaccgggctctttatagtaaggggattcttctcatggcagcgtctgagaacgaagacaacgatatcctctggtgtgtgaatcacgacacttttccttttcagaagccaatgatggagacacagatgactgccggagtcgatgggcattcttgggccctgtccgctatcgacgaactcaaggttgataagataatcactccacttaataaagatcacataccaattactgattcccctgtggttgtccagcaacatatgctgcctcctaaaaagttcgtcctgctctcagctcaaggcagcctcatgtttcacaagctgaggcccgtggaccaactgcggcatctgctcgtgagcaacgtcggtggagacggagaagaaatcgagagattcttcaagttacaccaagaggaccaggcctgcgccacctgtctcatccttgcttgtagtacggctgcatgcgaccgagaagtgtcagcctgggccaccagggccttcttccgttacggaggtgaggcgcagatgaggttcccaactacactgccccctcccagcaacgtgggccctatcctaggcagtcctgtatacagctcctctccagtgccttctggcagtccataccccaatccaagtttcttaggtactccttcgcatggcatccagcctcccgctatgtctactcccgtatgcgcattggggaatcctgcaacccaggctaccaatatgtcttgcgtcaccggacccgaaattgtgtacagtgggaagcataatggaatctgcatttacttctcgcgcatcatggggaacatctgggatgcatcactggttgtcgagcgcatcttcaaatcggggaacagggagatcactgcgattgagagttccgttccgtgtcagttactggaatccgttctgcaggagcttaagggtctgcaagagtttctggaccggaactctcaattcgccggtggaccactcggtaaccccaatactacagctaaggtgcaacagcggctcattggctttatgcgccctgagaacggtaatcctcagcagatgcagcaagagcttcagcggaagtttcatgaagcccagttaagcgagaaaatctccttacaggctatccagcagcttgtccgaaaatcataccaagcattggcactttggaaactattgtgcgaacaccagttcactattattgtggccgaactgcagaaggaactccaggaacagttaaagatcacaacattcaaggaccttgtgattagggataaagagctgacaggcgctcttatagcctccctgataaactgctatatacgggacaatgcagccgtcgacgggatcagtctccacctgcaggatatttgccctctcttgtattcaacggatgatgccatctgcagcaaagcaaacgaactactacagcgatcgcgacaagtccagaataaaaccgagaaggagaggatgttacgagagtctctgaaggaataccaaaagatatccaaccaagtcgacctgtctaacgtgtgcgcacagtacagacaggtgagattttatgaaggggtggttgagctgtctctgactgccgcagagaaaaaagatccccaggggctcggcctgcacttttacaaacacggcgaaccagaggaggatatagtgggactgcaggctttccaggagagacttaattcgtataaatgtataactgatacgttgcaggagctggtgaatcagtccaaagctgcaccgcaatcaccctccgtgccaaaaaaaccagggccacccgtgctcagtagtgaccctaacatgctctctaacgaggaggccggtcaccacttcgagcagatgctaaaattgagccaacgttccaaggacgaacttttttctatcgcgctgtacaattggttgatccaggtcgatcttgccgacaagctgctccaagttgcctcacccttcctggaaccccacctcgtccgcatggctaaggtggaccagaatagggtccgatacatggacctgctctggcggtattacgaaaaaaatcgaagcttcagcaatgcagcccgtgttctctcccgacttgctgatatgcactctacagagatcagtctacaacagcgcctagagtatatcgcaagggccatcctgtccgccaaaagttcgacagctatctcgagtatagctgccgacggcgagtttctacacgaactggaggagaagatggaagttgcgcgaatacaacttcagattcaggaaactctgcagcgccaatactcacaccactccagcgtacaggacgctgtatctcagcttgattccgaactcatggatatcactaagctgtacggcgaattcgccgatccatttaaactcgcagagtgcaagttggcaatcatccattgcgccggatactctgatccaatcctagttcaaaccttgtggcaggatattatagaaaaagagctgtcagacagcgtgacgttatcctcttcagatcgaatgcatgcgctgtctctgaaaatcgtgttactcgggaagatatacgcaggtacaccaagattctttcctctggacttcatagtgcagttcctcgagcaacaggtgtgtactctcaactgggacgtcggattcgttatccagaccatgaacgaaataggtgtccccctccccaggctgctggaggtttatgatcagcttttcaagagtcgggatcccttctggaatcgcatgaaaaaacctcttcacctgctggactgcattcatgttctgctcattaggtacgtggaaaacccttctcaagtacttaactgcgaacgcaggcgcttcactaatttgtgcttggacgcggtctgtggttacctagtggagctgcagtctatgagttcctccgttgctgtgcaagcaattactggcaattttaagagtttacaggctaagttggaaaggctgcactag

SEQ ID NO: 29893 - DNA, 2334 bp, Artificial Sequence
  Description of Artificial Sequence: Synthetic coding sequence
atggattccaaggagtcactgacccctggccgagaggagaacccttcctcagtcctcgctcaggagcggggagacgtaatggatttctataaaaccctccggggtggtgccactgtaaaagtctctgcatcgtcgccctccctggcagttgcgtcccagtccgactccaaacagcggaggctattagtggacttcccaaaaggatccgtttccaatgcccagcagcctgatctgtccaaggccgtgtcattatctatgggactttatatgggagagaccgagactaaagtcatgggcaacgacctggggttccctcagcagggtcaaatctcactttccagcggtgagacagatctgaagttgttggaagaatcaattgccaacctcaacaggtcgacaagcgtccccgagaatccaaagtcttcagcgtccacagccgtgagtgccgctccgaccgaaaaggagttcccaaagacccacagtgatgtgagttccgaacagcagcacctgaaaggtcagaccggcaccaatggtggaaacgtgaagctgtacaccaccgaccagtccacctttgatatcttgcaagacttagagttttcgtcagggtcgccaggcaaggagacaaacgaatccccctggcggagtgatctactgatcgacgagaattgcctgttgagtccgttggctggggaagatgactccttcttattggagggcaattccaatgaagattgcaaacctcttattctgcctgataccaagcccaaaataaaggacaacggggacttagttttgagctccccaagcaatgttacccttcctcaggtcaaaacggaaaaggaggattttatcgagctttgcactcccggtgttatcaagcaggaaaaattgggcacagtgtattgtcaggccagctttcccggagcaaatataattggtaataagatgagcgccatttctgtccacggggtgagcaccagcggaggacagatgtatcactacgatatgaatacggcctcgctgtcacagcagcaggaccagaagcctatttttaatgtgatccctccaatccctgttggctccgagaattggaatcggtgtcagggttctggggacgacaatctgaccagcctgggcacactgaactttccaggccgaactgtgttctcaaatgggtatagttcaccttccatgcgccctgatgtaagtagtcctccgtccagttcttctaccgctactaccggacctcctcctaagctgtgtctggtatgctccgatgaggcctctggatgccactacggagtgctcacctgtgggagctgtaaggtgttctttaaacgggcagtggaaggccagcacaattatttgtgcgcgggtcgaaacgactgtattatagacaaaattcggagaaagaactgtccggcatgtagataccgcaagtgcttacaggctggaatgaatctggaggcccgtaagacaaaaaaaaagattaaaggcatccagcaggctactaccggagtttctcaggaaacttctgaaaaccccggaaataagacgattgtccccgcaacactcccccagttgacgccaactctcgtcagccttctcgaggtcatcgaacctgaggtgctgtacgccggttatgacagtagcgtgcccgactcaacttggaggattatgactactctcaatatgctcggtggcaggcaggtcattgcagccgtcaagtgggccaaggccatcccgggatttcgcaacttgcatctggatgatcaaatgacactgctccaatacagctggatgtttcttatggctttcgcactcggctggaggagctaccgtcaatctagcgccaatctgctgtgcttcgcgcctgacctgatcattaacgagcagcgaatgacccttccttgtatgtatgaccaatgtaaacacatgttatatgtcagctctgagttgcatcggctgcaggtatcctatgaagagtacttatgtatgaaaactctactcttgctgagctccgtaccaaaagacggactgaaaagtcaagagctgtttgacgagattcgaatgacctatattaaggagcttggcaaggcgattgttaagcgggagggcaatagctcgcagaactggcaacgtttctaccaactgacaaagttactggacagcatgcatgaagttgtggaaaaccttttaaattactgcttccagacgtttctggataagaccatgtctatagagttcccagaaatgctggcagagattatcacaaatcagatccccaaatactctaacggcaacattaaaaagttattattccatcaaaaatag

SEQ ID NO: 29894 - DNA, 1782 bp, Artificial Sequence
  Description of Artificial Sequence: Synthetic coding sequence
atggatagcaaagagtccctgacacccggacgggaagagaatcccagcagcgtgctcgctcaggaacgtggcgacgttatggacttctacaaaaccctcagagggggtgcaacagtgaaggtgtcagccagcagcccgtcactcgcagtggcctcccagagcgacagtaagcagagaaggttgctcgtcgacttccccaaggggagtgtcagtaatgcacagcaaccagacctgtcgaaggcagtgagcctgtccatgggtttgtatatgggagagactgaaacaaaggttatgggcaacgatctgggatttccacagcaagggcagatctcactatcatctggagagaccgaccttaagctcctcgaagagtcgattgctaaccttaatcgttccaccagtgtgcccgagaacccaaagtcgagcgcctcgacagctgtgtccgcggctccaacagagaaggagtttcccaaaacgcattctgatgtcagcagtgaacagcaacacttgaaaggccagacaggaaccaatggcggaaacgtcaaactgtacactacggatcagtcaacatttgacatcctgcaggacttggagttcagcagtgggtcccccggtaaagagacgaatgagtccccttggcggagcgacctgttgatcgacgaaaactgcctcttgagcccactggcaggagaagacgattccttcctgttggagggtaacagcaatgaggactgcaaaccacttatccttccagatacaaagccaaagatcaaagataacggagaccttgtcctctcctcaccttccaatgttacactgccacaggtgaagacagaaaaggaggacttcatagaactgtgtacaccgggagtcattaagcaggaaaagttagggactgtttattgccaggcatcgtttcccggtgcaaatatcatcggcaacaaaatgtccgcgatcagtgtccacggagttagtaccagtggtggtcagatgtatcattatgacatgaatacagcttcactgagccagcaacaggatcagaagccaatattcaacgtgatcccaccgatacctgtgggcagtgagaattggaatcggtgtcaggggtccggggatgacaatcttacttccttagggacattgaatttccccggtcgcaccgtttttagtaatggttactcttccccctctatgagaccagatgtttcctcaccacccagctcctcatccactgcaaccaccgggcctcctccgaaactctgtctggtctgttctgacgaggcgtccggctgccactacggggttctgacctgtgggagctgcaaggtcttctttaagcgcgcagtggagggccagcacaactatctgtgtgctggcagaaatgactgcataattgataaaatccggagaaaaaattgccccgcatgccgctacaggaaatgtctgcaggctggaatgaacctggaagtcgtgcctaaggatggcctgaagtcccaggagcttttcgatgaaatcaggatgacctatatcaaagaactgggcaaagctattgtgaaaagggaaggtaattcgagtcagaactggcagcggttttaccagctgactaaactcttggactctatgcacgaggttgtagagaatctgctgaactattgttttcaaacatttctggacaaaacaatgtccatcgagttccctgagatgctcgccgagattattacaaatcagatacccaaatactctaacgggaacatcaagaagttgttattccaccagaaatag

SEQ ID NO: 29895 - DNA, 2334 bp, Artificial Sequence
  Description of Artificial Sequence: Synthetic coding sequence
atggactccaaagaatcattgaccccaggacgcgaggaaaatccaagctccgtgctcgcccaagaaaggggagatgtcatggacttctacaagacccttcgtggcggtgcaaccgtgaaggtttccgctagcagtccctctctggcagtagccagtcagagcgattcaaaacaacgcagactgcttgtagatttccccaaaggaagtgttagcaatgcgcagcagcccgatctgagtaaggcagtgtctctgagcatgggactctacatgggtgaaaccgagaccaaggtgatgggcaacgacctcggttttccccaacagggtcagatctccctgtccagcggagagacggatttaaaattgttggaggagtctatcgcaaacctgaataggtctacctcggtcccggagaacccgaagtcatccgcttcgaccgccgtcagcgccgcacctactgaaaaggaatttcccaagacacattccgacgtgagcagtgagcagcaacacctcaaagggcagaccggcactaatggagggaatgtgaaactgtacaccactgatcagtccacctttgacattcttcaggatctcgagtttagcagcgggtctcccggtaaagagactaacgaatccccatggcgatccgacctactgattgacgagaattgtctcttgtcaccactggcgggtgaagatgactcattcctgttagaagggaacagtaatgaagactgtaaacctcttatcctgcctgacaccaaacctaagatcaaggacaacggtgatctcgtactgagctcacccagtaacgtcactctcccccaagtcaaaacagaaaaagaggactttattgaactgtgcaccccgggtgtgataaagcaggaaaaactgggaactgtgtattgccaggcatcattcccgggagctaacatcatcggcaataagatgagtgccatttccgtacatggggtgagcacatcaggcggtcagatgtatcattatgacatgaataccgcctcactctctcagcagcaagaccagaaaccaattttcaatgtgatcccacctattcctgtgggttctgaaaactggaaccgctgccagggcagtggcgatgataatctcacctccctgggcacgctgaactttccgggtcgcactgtgttctccaatggttattcttcaccaagcatgaggccagacgttagtagtcccccatcctcatcgagcacagccacaacagggccacctcccaaactgtgtttggtgtgctcagacgaggcctccgggtgtcattatggagtgctgacatgtggcagctgtaaggtatttttcaagcgggctgtcgaaggacagcataattacctgtgcgcgggacgtaatgactgcatcattgataagatcaggcgcaaaaactgccccgcttgccgctaccgtaaatgcttgcaggccggaatgaatctggaagccagaaagacgaagaagaagatcaagggtatccagcaagctactactggcgtgtctcaggaaacaagcgaaaacccagggaataaaactattgtacctgctaccctccctcagttgacccctaccctggtaagcctcttagaagtgatcgaacccgaagtgctgtacgcagggtatgatagctccgttcctgattccacatggcggattatgacgacattgaacatgctgggcggacgccaggtgatcgcggcagtgaagtgggccaaagcaatccccggatttcgtaacctgcacctcgatgaccagatgaccctcttacaatacagttggatgtttctcatggcatttgctttagggtggcggtcttaccgtcaaagttcggccaacctgctctgtttcgctcctgatctgattattaatgaacagcggatgactctgccgtgtatgtatgatcagtgcaaacacatgctgtacgtaagtagcgagctccacaggcttcaggttagttacgaggagtatctatgcatgaagacgttactactactctcttcagtgcccaaggacgggctgaagagccaggagctgttcgacgaaatcaggatgacttacattaaggagcttggaaaagctattgtaaaacgtgaaggaaattccagccagaattggcaacgattctaccagctcaccaaactgctcgattcaatgcacgaggttgtcgagaatttgctgaactattgttttcaaacgtttctcgataaaacgatgtccatagagttcccagagatgttagcggagatcattacaaaccagatacccaaatattcaaatgggaacattaagaaattactttttcaccagaaatag

SEQ ID NO: 29896 - DNA, 2337 bp, Artificial Sequence
  Description of Artificial Sequence: Synthetic coding sequence
atggactcgaaagaaagcctgactcctgggagagaggagaacccaagctccgtgctcgcccaagaaagaggtgacgtgatggatttttataagacgctgagaggaggcgctacagtgaaggtgtctgcctcgtccccatcattagccgttgcatctcagagcgactcgaagcagcggagactgctggtggactttcctaaaggaagtgtatccaacgcccagcagcccgacctctcaaaagccgtgtctctcagcatggggctgtacatgggggaaacagagactaaagtgatgggtaatgaccttgggttcccacagcaggggcagatttccttgtcctcgggggagaccgatcttaagctgctggaagagtccattgctaatttgaatagatctacttccgtacccgagaatccgaaatcctcagcttcaaccgctgtgtccgcagcgcctacagagaaggagtttcctaagacccacagcgatgtttcctcagagcagcagcaccttaaggggcaaactggaaccaacggaggaaatgtcaaactgtataccacagatcagagtaccttcgacattctacaagacctcgagttttcctctggtagcccgggaaaagagacgaacgaaagcccttggcgctcagaccttctaattgatgagaattgcctactgagtcccctcgctggcgaggacgattcattcctgctggagggaaacagcaacgaagactgcaagccactgatcttgcctgacactaagcctaagatcaaagataacggcgaccttgttctctcgtcacctagcaatgtgacgttgccgcaggtgaagacagagaaagaagacttcattgagctctgtactccaggagttatcaaacaggaaaagctagggacagtttattgccaggcttcttttccaggggctaacataattgggaacaaaatgagcgctatctctgtacacggcgtgtcaaccagcggtggacagatgtaccattacgatatgaacactgcaagtttatcccagcaacaagaccaaaaaccaatatttaacgtgatcccacccatcccagtaggaagcgagaattggaatcgttgccaaggctccggagacgacaacctcacctcgctgggcaccctgaatttccccggacgcacggtcttcagtaacggctattcctccccatccatgcgaccggatgtctctagcccgccaagctccagttcaactgctacgaccggccctccgcctaaactttgtttggtgtgctctgatgaggcatcaggatgtcactacggagttcttacatgtggcagttgtaaggtcttctttaagagagcagttgaaggcaggcagcacaactatctgtgtgccggtcggaatgattgcattattgataagatcagacggaagaattgtcctgcatgtcgataccggaaatgtttgcaggccggtatgaatctggaagccaggaaaacgaaaaaaaagattaaaggcattcagcaggccaccactggggtaagtcaggaaacttccgagaatccgggaaataagactatagtgccagctaccctccctcagctcacccctacgctggttagcttactagaagttatcgagccagaagtgctttatgctggttacgacagcagcgtgccagattcgacatggcggattatgacgactttaaacatgctggggggtaggcaggtgattgctgcagtcaagtgggccaaggccattccgggattccgtaatttgcacctcgatgaccagatgacactcttgcagtactcttggatgtttctgatggcattcgcccttggctggcgctcctatcgccaatcctctgccaatctcctttgcttcgccccagacctcattataaatgagcagcgaatgacccttccatgtatgtacgatcagtgcaaacacatgttgtatgtaagtagcgagctacaccgccttcaggtgtcttatgaggagtatctgtgtatgaagactttgcttctccttagctccgttcctaaggacggactaaaaagccaggaactcttcgacgaaattagaatgacctacattaaggagctgggcaaagccattgtgaagagggagggaaactctagtcagaattggcagaggttttaccagcttacgaaattattggactcaatgcatgaggtagtggaaaacctgcttaattactgtttccagactttcttggacaagaccatgagcatcgaattccccgagatgcttgctgaaattataaccaaccagataccaaagtactctaacggaaacattaaaaagttactgtttcaccagaagtag

SEQ ID NO: 29897 - DNA, 2229 bp, Artificial Sequence
  Description of Artificial Sequence: Synthetic coding sequence
atggatagcaaagagtctcttacacccggtcgcgaggagaatccctcttcagttttagcgcaagagagaggagacgtgatggacttctataagactctaaggggtggcgctactgtcaaggtgtcggcctcaagccctagtctcgccgtagcctctcagagtgattcaaagcagcgacgtctgctcgtcgacttcccaaaggggagcgtgtctaacgcccagcaacctgacctgagtaaagctgttagcctctctatggggctgtacatgggagagactgagaccaaagtgatgggtaacgatctggggtttccccagcaggggcaaattagcctgagcagcggagaaactgacctgaaactcctggaagagtccattgccaatctcaacagatctactagcgtccccgagaaccctaaatcaagcgctagcacggctgtctcagccgctcctacagagaaagaatttcctaagacccacagtgacgtaagctctgagcagcagcatctgaaaggccaaactggcacaaacggtgggaatgtgaaactctatacaactgaccagagcactttcgatatcctgcaggacctagagtttagcagcgggtctccgggtaaagagacaaacgagtctccctggcggagcgacttgctgattgacgagaactgcttactgtcccccctcgctggtgaggacgactctttcctcctggaggggaactccaatgaagactgtaaaccattgatcttgcctgacaccaaacccaaaattaaggataatggagatctcgtcttgtcatctcccagcaatgtgaccctacctcaggtaaagacggagaaggaagacttcattgaactctgtactcccggtgttatcaagcaggaaaagctgggtacggtttactgccaggcctcattccccggtgccaacataattggtaacaagatgtccgcaatcagcgtccacggcgtgtcgacctcaggaggccagatgtatcactacgacatgaataccgcatctctctcacagcaacaagaccagaaacccattttcaatgttatacctccaatccccgttgggtcggagaattggaaccgatgccaaggaagcggagatgacaacttgacaagcctgggaacccttaacttccccggaagaactgtgtttagcaacggttattcttcgccatcaatgagacccgatgtatccagcccgcctagctcctcatcaaccgccacaacagggccacccccaaagttgtgtctggtatgcagtgacgaagcgtccggctgccattacggcgtattaacatgcgggagctgcaaagtcttttttaaacgggctgtggaaggtcaacacaattacctgtgtgcaggcagaaatgattgcatcattgacaagattcgtcgtaagaactgcccagcttgccggtatagaaagtgtctgcaggctgggatgaatctggaggccaggaagactaaaaaaaaaataaagggaattcaacaggcaaccactggggtgtcacaagaaacatcagagaaccctggaaataaaactattgtgccagccaccttgcctcagctgacccctaccctggtgagtctgctggaggtgatcgagcccgaagtgctttacgccggatacgactctagcgttcctgacagcacgtggaggataatgacaaccttgaatatgctcggcggacggcaggtgattgccgcagtcaagtgggccaaggctatccctggtttcagaaacctccacctggatgaccaaatgacacttttgcagtattcctggatgttccttatggcatttgccctgggctggcggagttatagacagagctctgcgaacctgctgtgcttcgccccagatcttattatcaacgaacagaggatgaccctcccatgtatgtatgaccagtgcaagcatatgctgtatgtgagctcggaactccaccggttacaggtgagttatgaggagtatctgtgtatgaagaccctcctgctcctgagctcagtgccgaaagacggtcttaagtcgcaggagctgtttgacgagattcgcatgacctacatcaaagagctgggtaaagcaattgtcaagagggaggggaactcaagccagaactggcagcgcttctaccagttgactaaactccttgactccatgcacgaaaatgtgatgtggttaaagcctgaatccacatctcacacactgatatag

SEQ ID NO: 29898 - DNA, 1143 bp, Artificial Sequence
  Description of Artificial Sequence: Synthetic coding sequence
atgcgcccagacgttagttctcccccatccagctcttccacagcaactaccggaccacctccgaaattatgtctggtttgcagcgatgaggcctctggctgccattacggcgtcctcacatgcggatcttgcaaggtgttttttaaacgggctgtggagggacagcacaactacctatgtgccggacggaatgattgtatcattgacaagatacgccgaaaaaactgccctgcgtgcaggtataggaagtgtctgcaggcgggaatgaatctggaggccaggaagaccaagaaaaagattaagggtatccagcaggccacaacgggggtgagtcaagaaacatctgagaacccgggtaataagaccatcgtgccggcaactcttcctcagctcacccccaccctcgtcagcctactggaagtgattgaaccagaggttctttatgccggatatgatagttcagttcccgacagtacatggaggattatgactaccctgaacatgctcggcggtcgccaggtaatagccgcagttaaatgggccaaggccatcccgggattccgcaatctgcatctagacgaccagatgacactcctgcagtatagctggatgttcttgatggcatttgccctcggatggcgctcctatcgacagagcagcgccaacttactttgctttgctccagacctcatcattaatgagcagagaatgacactcccatgcatgtatgaccagtgtaaacacatgttgtatgtgtctagcgagctgcaccggctgcaggtgagctacgaggagtatctttgcatgaagactttgctcttgctgagttcagtacccaaggatggtttaaaatctcaggaactcttcgacgaaattagaatgacttacataaaagaactcggaaaagctatagtgaaacgggaggggaactcgtcccaaaattggcaacggttttatcagttgacaaaactgctcgattccatgcatgaagtcgtcgagaatctactcaattattgttttcaaacgttcctggataagacgatgagtatcgaattcccagaaatgctagctgagatcatcacgaaccagatccccaaatacagcaatggcaatatcaagaagctactgtttcaccagaaatag

SEQ ID NO: 29899 - DNA, 2256 bp, Artificial Sequence
  Description of Artificial Sequence: Synthetic coding sequence
atggacagcaaggaatcgctcacgcccggtcgagaagagaatccgagtagcgttctcgcacaggaaaggggagacgtcatggacttttacaagactctccggggaggcgcaactgtgaaagtatcggcatcttccccgtccctagcagtggcatcacaaagcgatagcaaacagcggcgtctcctggttgactttcccaaggggtctgtgtccaatgcccagcaaccagacctatccaaggcagtcagtctgagcatggggctgtacatgggcgagacagagactaaagttatgggcaatgaccttggattcccgcagcagggccagatctccctatctagtggagagacggaccttaaactgctagaggagtctatagccaacctgaaccgatctactagcgttcccgaaaatccaaagtcttctgcatccaccgcggttagcgctgctcccactgagaaggagttccccaaaacacactctgacgtgtcgagtgaacaacaacatcttaagggccagaccggcacaaacgggggaaatgtaaaactgtacacgaccgatcagtcaacatttgatattctccaggacttggaattttctagcggcagccctgggaaggaaactaatgagagcccttggcgcagcgacctgctgatcgacgagaactgcctgctgtcacccctggccggtgaagatgactcttttctccttgaaggcaacagcaatgaggactgtaagcccctgatcctcccagacacaaagccgaagatcaaagataatggggatctggtcctttcatcgccgagcaatgttaccctcccacaggtgaagaccgagaaagaggacttcatagaactgtgcacacctggcgttatcaagcaagaaaaactcggcactgtgtactgccaagcatcgttccccggagccaacattatcgcaagcctctcacaacagcaggaccagaagccaatttttaacgtcatacctccaattcctgtagggagcgaaaattggaatcgctgccaggggtcaggcgatgataacctgacttccctgggcacactcaatttccctggcagaaccgtgttctccaacggatactcaagtcctagtatgagaccagacgtgagtagtccaccctcctcctctagcaccgcaactactgggcctccgcctaaactttgcctagtgtgttcggacgaggctagcggctgtcactacggggtcctgacttgcggttcttgtaaagtcttttttaagcgggctgtggagggccagcacaattacctctgcgctggcagaaacgattgcataattgacaagattcgaagaaagaattgtccggcttgtcgttacaggaagtgtctgcaggccggtatgaaccttgaggctcgtaagacaaagaaaaagataaagggcatccagcaagccacgactggcgtctctcaagaaacttccgagaatcctggcaacaagaccattgtgcccgctacattgccgcagctgactcccaccctggtgagcctgttggaggtgatagaaccagaagtactgtatgctgggtatgatagtagcgtgcccgactcaacctggcgaattatgacaaccctcaacatgctaggtggtcgtcaagtgatagcggctgttaagtgggcaaaggccatccctggcttccggaacttgcacctggacgatcaaatgaccctgctccaatactcctggatgtttctgatggcatttgctctgggttggaggagttaccgccagtctagcgccaacctcttatgcttcgcaccagacctcatcataaatgaacagcggatgacactgccctgtatgtacgaccaatgtaaacacatgctgtatgtgtctagtgagttgcaccggttgcaggtgagctatgaggagtacctctgcatgaaaacactgctgcttctctcttccgttcctaaggatggacttaaatctcaggagctcttcgatgagattcgcatgacttatatcaaggagctaggaaaggcgattgtgaagcgtgaaggcaactccagtcagaattggcagcggttttaccaactgacaaagctcctcgactcaatgcacgaagtcgtggaaaatctactgaactattgttttcaaacgtttttggacaagactatgtcgattgaatttcccgagatgctggccgaaattatcaccaatcaaatcccgaaatatagtaacgggaatattaagaaactgctttttcaccagaagtag

SEQ ID NO: 29900 - DNA, 435 bp, Artificial Sequence
  Description of Artificial Sequence: Synthetic coding sequence
atggattctaaggagtctctcactcccggacgggaggagaatccttcgagcgtgctggctcaggagcgaggtgatgtaatggacttttacaaaactcttagaggcggtgctaccgtcaaggtatccgcaagcagcccgagtttagccgtcgcatcacagtctgacagcaagcagaggcgattactcgtggatttccctaagggctcagtatctaacgcccagcagcccgacctcagcaaggccgtgagtttatccatggggctatatatgggagaaactgaaactaaggtgatggggaacgaccttgggttcccacaacaggggcagatatccctcagctcaggagagaccgatctcaagctgttggaggaatctattgctaatttgaaccgttcaactagcgtaccagaaaatcctaagagttcagcctcctag

SEQ ID NO: 29901 - DNA, 438 bp, Artificial Sequence
  Description of Artificial Sequence: Synthetic coding sequence
atggatagcaaggaatccctcaccccgggtagggaggaaaacccgagcagcgttttggctcaagaacggggagatgtcatggatttttacaaaaccttaaggggtggcgcaacagtgaaagtttcagccagctcaccgtcactggccgtggcatctcagtccgactccaaacagcgcaggctgttggttgattttccaaaaggctccgtttcaaacgcccagcaaccagatctgtctaaggcagtgagtctctctatgggcctttacatgggggaaaccgagactaaagtcatgggcaatgacctcgggttcccccagcaagggcaaatatcactcagtagcggggagacggatctgaagctgttggaggagtctatcgcgaatctgaacagaagcacctccgttcctgagaaccccaaaagttccgcctccacatag

SEQ ID NO: 29902 - DNA, 2334 bp, Artificial Sequence
  Description of Artificial Sequence: Synthetic coding sequence
atggacagtaaggagagcctgactcccggtagggaagaaaacccctcctctgtactagcacaagagcggggagacgtaatggatttctataagaccctacgcggaggcgctacagtcaaggtctccgcctctagtccaagcctggcagtagcgtctcaatcagacagtaagcagagacgtctacttgtggatttccccaaggggagtgtgtcaaatgctcagcaacccgacctgagtaaagcagtgagcctctctatgggactgtacatgggagaaaccgagactaaggtgatgggaaatgaccttgggtttcctcagcagggtcaaatctccttaagttcaggagaaacagatctgaagttattggaggagtccattgccaatctgaaccgcagcacaagcgtacctgaaaatcccaagagttctgccagtactgcagtgtccgccgctccaaccgaaaaggagttcccgaaaactcatagcgatgtctcaagtgagcagcaacacctaaaggggcagacaggaactaatgggggtaatgtgaagctgtatactacagatcagtctaccttcgatatcctccaagatcttgagttctcatccgggtccccgggtaaagaaactaacgagagcccttggcggagtgatcttttgatcgatgagaactgtctgctgtcgccgttggccggtgaggacgacagctttttattggaagggaatagcaacgaggactgtaaaccactaattctgcctgacactaaacccaagattaaggataatggggacttggtgctgagcagccctagcaatgtgaccctgccccaggttaagaccgaaaaggaggattttattgagctgtgcactcctggagtgatcaagcaggaaaagctcggcaccgtttattgtcaggcctcttttcctggcgctaacatcatcggtaataaaatgagcgcaatctctgtgcatggggtatcaacaagcgggggtcagatgtatcattatgacatgaacactgcctccctttcgcaacaacaggaccagaagccaatctttaacgttatccctcccattcccgtggggtctgagaattggaatcgctgtcaaggctctggagacgacaacctgacttcactgggcactctgaatttccccggacggaccgtcttttctaacggctacagtagtcccagtatgaggcctgacgtctccagtcccccaagctcttcatcaaccgcaaccacaggacctcctccgaagctttgcttagtctgtagtgatgaggcttcaggctgccactatggggtgttgacctgcgggagctgcaaagtgttttttaagcgcgcagtcgaaggccagcacaactatctctgcgctggccgtaacgattgtattattgataagatacggagaaaaaactgcccagcctgccggtaccgcaaatgtctgcaagccggaatgaaccttgaggccagaaagacaaaaaagaaaattaaagggattcaacaggctaccaccggggtatcccaggagaccagcgagaatccgggaaataagacaatagtgccggctactttgccacagcttacacctaccctcgttagcctcttagaggtcattgagcctgaggttctttacgccggttatgatagctcggtgcctgattccacctggaggattatgactacattaaatatgttgggtgggaggcaggttattgcagctgttaagtgggccaaggcaatccccggatttcgaaatctgcacctggatgaccagatgactctcctacagtactcatggatgttccttatggccttcgcactgggctggagatcctataggcaatcgtctgccaatctactgtgttttgctccagacctgatcattaacgagcagcggatgaccttaccttgtatgtatgatcagtgcaagcacatgctctatgttagcagtgaactgcacaggcttcaggtgtcttatgaggagtacctatgcatgaaaactcttctcctgctgtcctcggtccctaaggacgggctaaagtcacaggagctgtttgacgaaatcaggatgacctacataaaggaactgggcaaagccatcgtgaagagagaaggaaatagctcccagaactggcaaagattctatcagttgacaaagctcctggactccatgcatgaagtcgtagagaacctgttgaattactgtttccaaacatttctggacaagaccatgtctatcgaatttcctgaaatgctcgccgaaattattaccaaccagatccctaaatattctaacgggaacatcaaaaagctgctgtttcaccaaaagtag

SEQ ID NO: 29903 - DNA, 2337 bp, Artificial Sequence
  Description of Artificial Sequence: Synthetic coding sequence
atggattctaaggagagcctcactccaggtagggaagagaatccctctagcgtgctcgcacaggaaagaggggatgtgatggatttctacaagacgcttcgaggaggagccacggtcaaggtttccgcgagctctccatcactggcagttgccagccagtccgacagcaagcagcgacgcctgctagttgatttccccaagggtagtgtcagcaacgcacagcaacccgatttgtcgaaagctgtcagtctgagcatgggattgtatatgggcgagacagagactaaggttatgggaaatgatttgggtttccctcagcaagggcagatcagtctcagttcgggtgaaaccgatctgaagctgctcgaggagtcaatcgctaatctgaaccggtccacgtccgtgccagaaaaccccaaaagttccgcctcaacagctgtctccgctgcaccaacagagaaggagttccccaagacccactccgatgtctcgtccgagcagcagcacctgaagggacagaccgggacaaatggtgggaacgtcaagctttacaccacggaccagtccacgttcgatatactgcaggatctggagttcagctcgggcagcccaggtaaagaaaccaacgaaagcccttggcgaagtgacctcctgatcgatgagaattgcttgctgtctccactggccggagaggacgattcctttcttctggagggcaactctaacgaggactgcaaacccctgattttaccagacaccaaacctaagatcaaagacaacggcgacctggtcctgtcatcgccgtccaatgtcaccctaccccaggtgaagacagagaaggaggattttattgaactctgcacccccggagtcatcaaacaggaaaagctggggacggtgtactgtcaggcatcttttcccggtgccaacataataggtaacaaaatgtctgcgatttccgtgcacggcgtgtctacgtccggaggccagatgtaccactatgatatgaataccgcttccctgagccagcagcaggaccagaagcccattttcaacgtaatcccccctatccctgtggggtctgaaaattggaaccgatgtcagggaagtggcgatgataacttgactagtctcggcacactcaacttccccggacggaccgtgttctcgaacggctatagctcaccttcaatgcgccctgatgttagcagcccgcctagctcatcttctaccgccacaacgggcccacctcccaagttatgcttagtatgtagcgacgaggctagtggctgccactacggcgtgctaacatgcggaagctgtaaagtgtttttcaagcgggcagtggaaggccgtcagcacaattatctgtgtgctgggcgaaatgattgcataatcgataagatccggcgaaagaactgcccagcctgcaggtacagaaagtgtctccaggcaggaatgaacctagaggctcgcaagacaaagaagaaaatcaagggcatccaacaggcaacaaccggagtgtcccaggagacctccgagaatccaggaaacaagacaattgtccctgcaaccctgcctcagctaacccctacactggtgagcttgttagaagtcatcgagcccgaggtgctgtatgccggttatgactcttcagtacctgacagcacatggagaatcatgaccacactcaatatgctgggtggcaggcaggttattgcggctgttaaatgggctaaggcgatcccaggttttcgcaacctgcacttggacgaccagatgactttgctgcaatattcctggatgttcttgatggctttcgccctgggatggagatcataccgtcagtctagcgccaatttgttatgctttgctcctgacctcatcatcaacgaacaacgcatgaccctgccatgcatgtacgatcagtgtaaacatatgctctatgtttcatccgaactgcatcgtttgcaggtttcatatgaagagtacctgtgtatgaagacgctgctactgctgtccagcgtgcctaaggacggcctgaaatctcaggaactattcgatgaaatccggatgacttacataaaggagcttggcaaggcaatcgtgaaacgggagggtaatagttcccaaaactggcaaagattctaccagctgacgaaacttcttgattctatgcatgaggttgtggagaaccttctgaattactgcttccagacctttcttgacaagacaatgagcatagagtttcccgagatgctggcagagataattactaaccagatacctaagtacagtaatggcaatatcaagaagctgctgttccatcagaaatag

SEQ ID NO: 29904 - DNA, 438 bp, Artificial Sequence
  Description of Artificial Sequence: Synthetic coding sequence
atggacagcaaagagagtctgacccctgggcgtgaggagaatccctcctccgtgctggctcaggaaaggggagacgtcatggatttttacaaaacactgcgaggtggcgctaccgtcaaggtttctgcctcatctccgagcctggcagtcgctagccagagtgacagcaagcagcggcgtctactggttgatttccccaaagggtcagtaagcaatgcccaacagccagatttatcaaaagccgtatccctgagtatgggattatatatgggtgagactgagaccaaggtgatgggaaatgacctgggatttccgcaacaggggcagatttctttatcctcaggcgaaacagaccttaaactcttagaagaatccattgccaatctgaacagatccacctctgttcctgagaaccccaaatcaagcgccagcacctag

SEQ ID NO: 29905 - DNA, 438 bp, Artificial Sequence
  Description of Artificial Sequence: Synthetic coding sequence
atggatagtaaggaaagcctgacccctgggcgtgaagaaaatccctcctcggtgctggcacaggaacgtggtgatgtgatggacttctacaaaacactgaggggaggggctacggttaaggtgtctgcttccagcccaagcctcgcggtagcctctcagtccgatagcaagcaacggcgtctcctagtagacttcccaaagggctccgtgtccaacgcacagcagccagacctgtctaaagcagtttctctcagtatgggtctctacatgggggagactgaaactaaagtgatggggaatgacctcgggtttccgcagcaggggcagatatcgctgtcgtcaggagaaaccgatttaaaactccttgaagaaagtatcgcgaaccttaacaggtcaacctcagtgcctgaaaaccccaagtcgagtgcctccacatag

SEQ ID NO: 29906 - DNA, 438 bp, Artificial Sequence
  Description of Artificial Sequence: Synthetic coding sequence
atggacagcaaggaatccctgaccccaggaagggaggagaatccctccagtgttctggcccaggaaaggggggacgtgatggacttttacaagactctgagaggaggggcaactgtgaaggtgagcgcgtcttctccctcgttggctgtcgcgagtcagagcgactcaaaacagcggaggctcttggtggacttccccaaaggctcagtttccaatgcccagcagcccgatctgagtaaggccgtgagcctgagtatgggcttgtatatgggggagacagagacaaaggtgatggggaacgacctcggttttccacaacaggggcagataagtctgtctagcggagaaaccgacctgaagttacttgaagaaagtatagctaatttgaaccggtctacctccgttcctgagaatccgaaaagctccgcgtctacctag

SEQ ID NO: 29907 - DNA, 1914 bp, Artificial Sequence
  Description of Artificial Sequence: Synthetic coding sequence
atgcatgactctattaggttcggcaatgtcgacatgccatgcgtccaagcccagtacagcccttcacccccagggagcagctacgcggctcaaacctatagtagtgaatatactactgaaatcatgaatcctgactacactaaactgactatggatctcggttccaccgagattactgcaactgcgacaactagcctcccaagcatttcaaccttcgtggaaggctactcttccaattatgaactgaaaccttcttgcgtgtaccaaatgcagagaccactaataaaggtggaggaaggcagggctcctagttaccaccaccatcatcatcaccaccatcaccatcatcatcaccaccagcagcagcaccagcagccatctattccccctgccagttctcctgaggacgaggtattaccctctacttctatgtactttaagcagagcccaccttcaaccccgactactcccgcattccctccacaagccggtgcactctgggatgaagcgctaccctccgctcccggatgtatcgctccaggccctctgctcgaccctccaatgaaggccgttcccacggtcgccggagcacgctttcccctgttccattttaaaccatctcctcctcatcctcccgcaccgtcgcccgctggaggccaccacctgggatacgaccccactgccgcagcagccctttccctgcccctcggtgctgccgctgccgctggatctcaggccgcagcgctcgaaagtcacccttacgggctcccacttgcaaagcgggctgctccgctggcgtttcctcccctgggtttgaccccttccccaacagcgagttctttactgggtgaatctcctagtctgccatcccccccatcacggtctagctcatccggtgaggggacctgtgctgtctgtggagacaacgccgcatgccagcattatggcgtgcgcacctgcgaggggtgtaagggcttcttcaaaaggaccgtacaaaagaacgcaaagtacgtctgcctcgcaaataaaaactgtccagtagacaagaggcgaaggaataggtgtcaatattgccggttccagaagtgcctatctgttggcatggtaaaggaagtagttcggactgatagtctgaaaggacggagaggtagactccctagcaagcctaagtcccccctgcagcaggagccaagtcagccatcccctccatcacctccaatatgcatgatgaacgctctggtgcgcgctctgacggactccacccccagagacctggactactctagatactgccccaccgatcaagcggctgctgggacggacgcagaacacgtacaacaattctataatcttctgacggcaagcattgacgtctctcgcagctgggctgaaaagattcccggttttacagatttgcctaaggaggatcagacgttgttgatcgaaagcgccttcttggaactgttcgtcctgcggctctctatccgatccaacacagctgaagacaaatttgtgttctgtaatggacttgtattacaccgcctccagtgcctgagaggattcggggagtggctggacagcatcaaggatttctcactaaatctgcagtcactcaaccttgacatccaggctctggcctgccttagcgcattgagcatgatcactgaacgacacggcctgaaggagccaaaacgggtagaggagctgtgcaataagattacttcttcactaaaagaccaccaaagtaaaggccaggccctggagcccacggagtctaaggtgctcggcgctctggtagagcttagaaaaatttgcaccttgggactgcaaagaatattctacctcaagttagaggacctggttagccccccttccattatagacaagctattcctggacactctccccttttag

SEQ ID NO: 29908 - DNA, 1332 bp, Artificial Sequence
  Description of Artificial Sequence: Synthetic coding sequence
atgccttgcgtgcaggcgcagtacagcccatctccgccagggagtagttacgctgctcagacctactcaagtgagtatacaacggaaattatgaatcccgactatactaagctgacgatggatctcggttcaaccgagattactgcaaccgcaacaactagtctgccgtctatcagcacttttgttgagggatacagttctaattatgagctaaaaccgtcgtgtgtctaccaaatgcaacggcctctgattaaagtggaagaaggacgcgctccaagctaccatcatcatcatcaccaccaccatcaccaccatcaccatcaccagcaacagcatcagcagccctctattccacctgcctccagtcccgaggatgaggttctccctagcaccagtatgtacttcaaacagagtccacccagtaccccaacaacgcctgcctttccacctcaggccggagcactgtgggacgaagcgctgccttctgcaccaggctgtatcgccccaggacctcttttagacccccctatgaaggcagtgcctacggtggccggtgcacggtttccgctgtttcatttcaagccttctcctccacaccctccagccccatccccagctggtggacaccacctggggtatgacccaactgccgcagccgctctgtcacttcccctgggggctgcagcggcagcgggaagccaggctgccgcactggaaagtcacccctatgggctgcccctcgcaaaacgagctgcgccactggcctttcctccactcgggctgacacctagcccgacagcatcctcattgctcggcgagagcccaagcctgcccagccctccctcccgtagtagctcaagcggagaggggacttgtgccgtctgtggggataacgcggcatgtcagcactatggtgtgcgaacctgcgaggggtgcaaaggctttttcaaaaggacagtacagaagaacgctaagtacgtctgtctggccaacaagaattgccctgtggataagcggaggaggaaccggtgtcaatactgccgctttcagaagtgcctgtctgtgggtatggtgaaagaagtggtaagaactgacagtctgaagggcaggaggggacgcctgccatcaaagccaaaaagtccgctgcaacaggagccctcccagccttctcccccatcaccccctatctgcatgatgaacgcactcgtaagggcacttacagattccacaccgcgagacctcgactactcacgagtctcctttatgatctcttgcttccagatgaacgaccaaggcctttacttatggctgttggtgatacgggttgattag

SEQ ID NO: 29909 - DNA, 894 bp, Artificial Sequence
  Description of Artificial Sequence: Synthetic coding sequence
atgaaagcggtaccaaccgtagccggagcacggtttcctctgtttcacttcaagccatccccacctcatcccccagcccctagtccggcaggcggtcaccacctcgggtacgaccctacagccgcagccgcattatcgctccccctgggagcagctgcagctgccggttcacaggccgctgctcttgaaagtcacccatatgggttgccgctggcaaagcgagctgcgcctctggcatttccacctcttggcctgacaccttcccccaccgcctcttcactgctaggcgagagcccaagccttccctcccccccttcccgatcctcgtcctccggggagggtacctgcgctgtctgtggcgataacgccgcttgtcagcactatggagtgagaacttgcgaaggttgtaaaggtttttttaaacggacagttcagaagaacgctaagtacgtctgtcttgccaacaaaaactgtcctgtggataagcggagacggaacaggtgtcagtattgccgattccaaaagtgcctctctgtcggaatggtgaaagaagtggtgaggactgactcgctgaaaggcagacggggaaggctgcccagtaagcccaagagcccgctgcagcaggagccttcccagccgagcccaccaagccccccaatttgtatgatgaacgcgcttgtgagagccctgacggacagcactcccagagacctcgactactctagggtctcattcatgatctcctgcttccagatgaatgaccaggggttgtacctgtggctcctagtgatccgcgtactcgacagctttcacacgtttagcatctttctcgctagcttcagcaactccgtgcatccactacagcaaatcatttttgcccttctgaacctgtag

SEQ ID NO: 29910 - DNA, 1881 bp, Artificial Sequence
  Description of Artificial Sequence: Synthetic coding sequence
atgccttgtgttcaggcccagtatagtccctctccacccggttcttcctatgccgcacagacctacagctccgaatacactaccgaaattatgaacccggactacacaaagcttacgatggatcttggaagcacagagattactgcaacagctacaacttctctcccatcaatctcgacatttgtcgagggctacagttcgaattatgagctgaagccatcatgtgtttaccagatgcaaagaccgctgataaaggttgaggagggacgagccccttcctatcatcaccaccatcatcatcaccaccatcaccaccatcaccaccagcaacagcatcagcagccttcgattccgcctgcatccagccctgaggacgaggtactcccttccacttcaatgtattttaagcagtcccctccaagtacccccacaactccagctttcccaccacaggctggtgcactatgggatgaggccctgccaagcgccccagggtgtattgccccagggcctctgctggatcctcccatgaaggctgttcctactgtggccggtgcccgatttcccctgttccacttcaagccatccccaccccatccccctgctccaagtcctgccggtggccatcacctcggctacgacccaaccgctgcagcggcactcagtctcccccttggcgcagctgctgcggctggttcccaggcagctgccctggagtctcatccctacggactgcctctggccaagagagccgctcctctcgcatttcctccccttggtttaacccccagtcccactgccagttcattactcggtgagtcaccaagcctgccatcccctccttcaaggagcagctcttctggtgagggcacttgcgctgtttgtggcgataatgccgcatgtcagcactatggcgtgaggacatgcgaggggtgtaaaggattcttcaaaaggacagtacaaaagaatgccaaatacgtgtgccttgcaaacaagaactgcccagtcgacaagcgacggagaaaccggtgccagtactgtcgctttcagaaatgtttgtcggtgggaatggttaaggaagtagtcaggacagacagcctgaagggtcgaagaggtcgcttgccatccaaaccaaagagccccttgcagcaggaacccagccaacccagccctccctcgcctcccatttgtatgatgaatgcactggtacgcgctctcactgacagtaccccacgagacttagattacagccgctactgccctactgaccaggcagccgcaggtacggacgcagagcacgtacagcagttttataacctgctcaccgcttccatagatgtctcgcgcagctgggctgaaaaaatccctggcttcaccgatcttccaaaagaagaccagactctgctgatagaatctgcatttcttgagctgttcgtactgcggttgtcaatccgtagcaatacagctgaagacaagtttgtgttctgtaacggcctagtgctgcataggctccagtgtttgcgcggtttcggggagtggctagattctataaaggacttctccctgaatctgcagagcctgaacctggacatccaggctttagcttgtttaagcgcactaagtatgattactgaaagacacgggctgaaggagcccaaacgggtggaggagctttgcaataagatcacaagcagtctgaaagatcaccagtccaaagggcaggccctggaaccgaccgaatctaaggtgctaggggcactggtcgagttgaggaaaatctgtaccttagggctccagcgcattttctacttaaaacttgaggacctggtatcccctccttcaataattgataaactctttctcgacacactccctttttag

SEQ ID NO: 29911 - DNA, 627 bp, Artificial Sequence
  Description of Artificial Sequence: Synthetic coding sequence
atgggtaacgcccaagagcggccttctgaaacaattgaccgtgaacgcaaaagactcgtagagacactccaggcagattccggcctactgctcgatgcactattggccagaggtgttttaacaggccctgagtatgaggcacttgatgctctgccagatgccgaaaggagggtccggcgtctgctgctgttggtgcagggaaagggtgaggcagcgtgccaggagttactgaggtgtgcccagaggaccgcaggggcacctgaccctgcctgggactggcagcacgtgggacccggttaccgggacaggagctatgatcccccatgccccggtcactggacgccagaggccccaggcagcgggacaacttgccctggcctccccagggctagcgatccagacgaggcagggggtccggaaggatctgaggccgttcagtctggaacacccgaggaacctgaacccgaacttgaggctgaggcctcgaaagaggccgagcctgaaccagagcccgagcccgagctggaacccgaagccgaggcagagcccgagcccgaattggagccagagccagaccctgaacccgaacccgactttgaggagcgcgatgagtcagaggacagctag

SEQ ID NO: 29912 - DNA, 627 bp, Artificial Sequence
  Description of Artificial Sequence: Synthetic coding sequence
atgggcaatgcccaggagcgcccttccgagacaatcgatcgcgagagaaagagactggtggagaccctgcaggccgacagtggccttctcctggatgctctcctagctcggggagttctaactggccctgagtacgaagccctggacgccttgcctgacgctgaaagacgggtgagacggctgctgttgttggtgcagggaaaaggggaggcagcctgtcaagaacttcttagatgtgcacagaggactgccggagcccctgatcctgcatgggattggcagcacgtcggccctggttaccgggatcgaagctatgaccctccatgtcccggacattggacacctgaggcccctggaagtggcaccacctgccctgggcttccaagggcctccgatccggatgaggctggcggtccagagggatctgaggctgtccagagtggcaccccagaggaaccagagcccgagttggaagcagaggcctcaaaagaagccgaaccagagcctgaacccgagcccgagttggagcctgaggcagaagcagagccagagccagagcttgagccagagcccgacccagagcctgagccggactttgaagagagggacgaatcagaggattcttag

SEQ ID NO: 29913 - DNA, 2133 bp, Artificial Sequence
  Description of Artificial Sequence: Synthetic coding sequence
atggtcaagctagccaaagctggcaaaaaccaaggagaccccaaaaagatggcaccccctcctaaagaggtggaggaggatagcgaggatgaggagatgtctgaggatgaggaggacgatagttctggagaagaggtagtgatccctcaaaagaaaggaaaaaaagctgctgcaacatctgccaagaaggtggtagtgagtccgaccaagaaggtcgctgtggctacacctgcaaagaaggccgcagttacaccaggaaaaaaagcggcagctacaccagccaaaaagacggttacgccggctaaggctgtcaccacccccggtaaaaaaggcgcaacccctggcaaggccctggttgctacaccgggaaaaaagggggctgcaatcccggctaaaggagctaagaacggtaagaacgctaaaaaggaggattctgatgaggaagaggacgatgattctgaggaagacgaagaggatgacgaagatgaggacgaggatgaggacgagatcgaacccgcagctatgaaagccgcagccgctgcccctgcctctgaggatgaggacgatgaggatgacgaggatgatgaggacgacgatgatgatgaggaggacgattcagaggaagaagccatggagactacacctgccaaaggaaagaaggcggcaaaagtcgtgcccgtgaaggcaaaaaacgtggccgaggatgaggacgaggaagaagatgacgaagatgaggatgacgacgacgacgaggatgacgaggatgatgatgacgaagacgatgaagaggaagaagaagaggaagaagaagagcctgtgaaggaggccccaggaaaacgaaaaaaggaaatggcaaaacaaaaagccgcacctgaggccaaaaaacaaaaagtagaagggacagagccgacaacagccttcaatctcttcgttggaaacctaaactttaacaagtccgccccagaactgaagaccggaatcagcgacgtattcgccaagaacgacctcgccgttgtggatgtcaggattggaatgacacggaaattcggttacgtcgatttcgaatcggccgaagatctggagaaggctttagagctgacagggctgaaggttttcggcaacgagattaaactcgagaagcctaaggggaaggactccaaaaaggaaagagacgctcggacactgctagcaaagaatcttccttataaggtgacccaggatgaacttaaggaggtgtttgaagatgccgcagagattcgcttagtatcaaaagacgggaagtccaagggaattgcctacatagaatttaagactgaagcagacgctgaaaaaaccttcgaggagaaacaagggacagaaatagacgggaggagcatctcactttattataccggcgaaaagggccagaatcaggattatcgagggggtaaaaattcaacgtggtccggagaaagtaaaaccttggtgctgtcaaatctcagttattcagcaaccgaggaaacgctgcaggaggtattcgaaaaagccacattcatcaaagtcccacagaaccagaacgggaaatcaaagggctacgcttttatagaattcgctagtttcgaagatgccaaagaagccttgaatagctgcaataagcgagaaatcgagggcagagcaattaggctcgagctgcagggcccacgaggaagcccaaatgccaggtcacaaccgagcaagaccttattcgtgaaggggctatccgaagatactactgaagagacactcaaagaaagcttcgacggatctgtccgtgctcgcattgtgaccgaccgggagaccggctcctccaaaggattcggattcgtggacttcaactctgaagaagacgccaaagctgctaaggaagcaatggaagacggagagatagatggcaacaaggtgaccttggattgggctaagcctaaaggagagggaggattcggcggtcggggaggtggaaggggaggttttggcggtcgaggaggcggacgtggaggaaggggcggatttggaggacgcggaagaggaggattcgggggtagaggtggcttcaggggaggtcggggaggaggtggcgatcataagccccagggaaaaaaaaccaagttcgagtag

SEQ ID NO: 29914 - DNA, 1449 bp, Artificial Sequence
  Description of Artificial Sequence: Synthetic coding sequence
atggtgaaactggctaaagccggaaagaatcagggggatcccaaaaagatggcgcctccgccaaaggaggtggaggaggacagcgaagatgaggaaatgtccgaggacgaggaagacgactctagcggcgaggaggtggtaatcccgcaaaaaaagggtaagaaggccgctgcaaccagtgcaaaaaaggtggtcgtctcacccacaaagaaagtggccgttgcaacacccgcaaagaaagccgctgttactccagggaaaaaagcagccgctaccccagctaagaaaacagtcaccccagcaaaagctgtcacaacaccgggtaaaaaaggggcaaccccaggcaaggctttggtcgccacccccggaaagaaaggcgcagcgatcccagccaaaggggcaaagaatggaaagaatgccaaaaaagaggactcagatgaagaagaggatgacgattctgaggaggatgaagaggacgatgaagacgaagatgaggatgaggacgagatcgagcccgctgccatgaaagccgcagccgctgcccctgcatccgaggatgaagacgatgaggatgatgaggatgatgaggacggtaaaagcaagggaatcgcatatatcgaattcaagactgaagcagatgcagagaagacatttgaagagaagcagggcacagagattgacggccgaagcatcagtctgtactacactggcgagaaggggcagaaccaggattaccgaggcggaaagaattctacctggtcaggggagtctaagactctagtattgagtaatttgagctactcagctacagaggaaaccctgcaggaggtgttcgaaaaagctacctttataaaggtaccccaaaatcagaacgggaagtctaaaggatatgcatttatcgaatttgccagctttgaggacgcaaaagaagcgctgaattcctgcaacaagagagagatcgaaggcagagctatccgactagaactccaggggccacgaggcagtcctaacgccaggagccaacctagcaagacgctattcgtgaagggactttctgaggacacaaccgaagagactctcaaagagtcatttgacgggtctgtgcgggctcggatcgtcaccgatcgagagaccggctcatcgaagggctttggtttcgtggatttcaattctgaggaggatgctaaggccgctaaggaggcaatggaggacggggagattgacgggaataaagtgaccttagattgggcaaagccaaagggtgaaggcggatttgggggtaggggaggtggcagagggggtttcggcggacggggtggtggtcgcggagggaggggaggctttgggggacgcggtcgaggcggttttggaggtcggggaggctttcgcggagggcgaggaggaggaggcgatcataagccacagggaaagaagactaagtttgagtag

SEQ ID NO: 29915 - DNA, 1809 bp, Artificial Sequence
  Description of Artificial Sequence: Synthetic coding sequence
atggtgaaattggcaaaagccggaaaaaaccagggagatccaaagaagatggctcctcccccaaaggaggtcgaagaagacagcgaagatgaggaaatgagcgaagatgaagaagatgacagcagtggcgaggaattaaatgacgatttctatcagacaaccatgcacaccttatggaagaagggaaagaaggcagctgcaactagtgcaatcccggctaagggcgcaaagaatgggaagaacgccaagaaggaggactcagacgaggaggaggatgacgactccgaagaggacgaggaggacgatgaagacgaagatgaagacgaagatgagatcgagccggctgccatgaaggccgcagctgctgctccagccagcgaggacgaggacgacgaggacgatgaagacgatgaggacgatgatgacgatgaagaggatgacgatgatgatgaggatgacgaggaggaggaggaggaggaggaggaggaacccgtgaaggaagctccaggcaagcggaagaaggagatggctaaacaaaaagccgcaccagaagccaaaaagcagaaagtggaggggaccgaacccactacagcttttaacctattcgtcggaaacctgaactttaataaaagtgctcctgagttaaaaactggcatcagtgacgtgttcgcgaagaacgacctggccgtggtggacgtgcggatcgggatgaccagaaagttcgggtatgttgacttcgaaagcgctgaagacctggagaaagcgctggaactgaccggcttaaaggtttttggtaatgaaatcaagttggagaaacccaaagggaaagattctaagaaagaaagggatgccagaactttgcttgcaaagaatctgccatataaggtgacccaggacgagctaaaggaagtattcgaagacgcggctgaaatccgactggtgtctaaggatggaaagagcaagggtattgcatacattgagtttaagaccgaagcggacgcagaaaagacattcgaagagaaacaagggactgaaatcgacggtagatctatctctctatactatactggtgaaaagggccagaaccaagactatcggggaggtaaaaacagcacctggtctggtgagtccaaaaccttggtgctgagcaatctttcttattccgccaccgaggagacactacaggaggtatttgaaaaagcaacatttatcaaggtcccgcagaaccaaaacgggaagtccaaaggttatgcgttcatcgagtttgcatccttcgaagatgccaaagaggcgcttaactcctgcaacaagagggaaattgaagggagggccataaggctggagctgcagggtccccgtggaagcccaaacgccagatcacagcccagtaaaaccctctttgtgaaagggctttctgaggatactaccgaggagactctgaaggagagctttgatggttccgtcagagcgagaatcgtcaccgatagagaaaccggttcctccaaagggttcggcttcgtcgactttaactcagaggaagacgcaaaggccgctaaagaggccatggaggatggagagattgacggcaacaaagtcacactggattgggccaaacccaagggggaaggcggatttggagggagaggcggtggacgcggtggattcggagggaggggaggaggcagagggggaaggggtgggtttggcggaaggggcagggggggttttgggggaaggggaggtttcagagggggaaggggcggaggaggggatcataagccacaaggaaagaagaccaaatttgagtag

SEQ ID NO: 29916 - DNA, 885 bp, Artificial Sequence
  Description of Artificial Sequence: Synthetic coding sequence
atggaagactctatggacatggatatgagccccctgaggccacagaactaccttttcggttgcgaactgaaagcagacaaggactaccattttaaggtcgacaatgatgaaaatgagcatcagctttccctaagaacagtctctctaggagccggtgccaaagacgagctgcatatcgtcgaagcagaagctatgaattatgagggaagtcccattaaggtaactttggcgacactgaaaatgtcagtgcaaccaaccgtatccctgggaggctttgaaatcactccacccgtcgtcttgcgcctgaaatgcggctcagggcctgtccatatttctggacagcacttggtcgccgttgaggaagatgctgaatctgaggacgaagaagaagaggacgtcaaactcctttcaatatctggcaagcggagcgctcctgggggtggctctaaggtaccccaaaagaaagtaaagctagccgctgacgaggacgacgatgacgatgatgaagaggatgacgacgaggacgatgacgatgatgatttcgatgatgaggaggcagaagaaaaggcacctgttaagaagtcaattagagatacaccggctaaaaatgcacagaagtcgaatcagaacggcaaggactctaagccctcttcgacacctcgcagcaaaggtcaggaatcatttaagaaacaggagaagacacccaaaaccccaaaagggccatcctcggtagaggacattaaggccaagatgcaggccagcatagagaagggcggtagtctgcccaaggttgaggccaaattcattaactatgtgaagaactgttttcgaatgacagatcaggaagctatccaagatctgtggcagtggcggaagtccctttag

SEQ ID NO: 29917 - DNA, 798 bp, Artificial Sequence
  Description of Artificial Sequence: Synthetic coding sequence
atggaggacagcatggacatggacatgtcaccgcttcggccacaaaattacctgtttggttgcgagttgaaggcagacaaggattaccacttcaaggttgataacgacgagaatgagcatcagctgtctctgaggaccgtgtctcttggcgctggcgcaaaagacgaacttcacattgtggaagcagaagctatgaattacgagggctcacccatcaaagtgaccctagcaacactcaaaatgtctgtccagccaacagtgtcccttggtggattcgaaattacgccacccgtggtgctacgcctgaagtgcggcagtggccctgttcatatcagcggccagcacctggtcgctgtggaggaggacgctgagtctgaggacgaggaggaagaagatgtgaagctgctttcaatttccggcaagagatcggcccctggcggagggagcaaggtgcctcagaagaaagtgaaactggcagccgatgaagacgacgacgacgacgacgaggaagacgacgatgaagatgatgacgacgatgatttcgatgatgaggaggctgaggagaaggccccagtgaagaagggacaggaatccttcaagaagcaggagaaaacccccaagacgcctaagggaccttccagcgtagaggacatcaaagccaagatgcaagctagcatcgagaagggaggcagcctaccgaaggtggaagccaaattcatcaattacgtaaagaattgcttccgaatgaccgaccaggaagctatacaggacctgtggcagtggaggaagtccttgtag

SEQ ID NO: 29918 - DNA, 780 bp, Artificial Sequence
  Description of Artificial Sequence: Synthetic coding sequence
atggaagattctatggatatggacatgtccccactgcggcctcaaaattacctctttggatgcgagctgaaggccgataaagattaccattttaaagtggacaacgacgagaacgaacatcagctgtcccttcggactgttagccttggagcaggcgctaaggatgagctacacatagtagaagccgaggccatgaattacgaaggttcaccgattaaagtgacccttgctacgctgaagatgtcggtccagccgaccgtttccttgggtggatttgagattacgcctcccgtagttctgcgactcaagtgtggttccggccctgtgcacatttcaggccagcatctggttgctgttgaggaggatgccgagagcgaggacgaagaagaggaggatgtcaaactgctgtctatttcaggtaaaaggtctgccccaggaggtggttctaaagtgcctcagaagaaggttaagctggcagcagacgaggatgatgatgacgatgatgaagaggacgacgatgaggatgatgatgacgatgactttgacgacgaagaagccgaggagaaagcccctgtaaagaaaagcatacgcgacactcctgcaaaaaacgcacagaaatccaatcagaatggcaaagactctaaaccatcatctaccccccgatctaaggggcaggaaagcttcaaaaagcaggagaagaccccaaagacccctaaaggaccctcatctgttgaagacatcaaggcaaagatgcaggcctctattgaaaaggcccattag

SEQ ID NO: 29919 - DNA, 885 bp, Artificial Sequence
  Description of Artificial Sequence: Synthetic coding sequence
atggaggatagcatggacatggatatgtccccgctgcgccctcagaactatttattcgggtgcgagctgaaggctgacaaagactatcactttaaggtcgataatgacgagaacgagcatcagctgtctctccgtacagtgtcactgggcgcaggcgcaaaggacgagctgcacattgtggaggccgaggctatgaactatgaaggttcaccgattaaggtcacattagctaccctgaaaatgtctgttcaacccacagtgtcacttggtgggtttgaaatcacacctcctgtcgtcctgcgattgaagtgtggctctggccctgtgcacataagcggccagcacttggttgccgtggaagaggatgcagaatccgaggacgaggaagaggaggacgtaaagttgttgagcattagtgggaagcggtccgctcccggaggtgggagtaaggtacctcaaaaaaaggtgaagcttgccgctgacgaagatgacgatgacgacgatgaagaggatgacgatgaggatgatgacgatgacgattttgatgacgaggaggctgaggagaaggcccctgtaaagaagtctattcgtgacacccctgctaaaaacgcccagaagtcaaatcagaatggtaaagatagcaagccatcgagtactccacgttccaagggacaggagagcttcaagaagcaggagaaaacacccaaaacaccaaaggggccatcaagtgtcgaggacataaaagccaagatgcaggcgagcatagaaaaaggtggttcgctgccaaaggtcgaagccaaatttattaattatgttaagaattgttttagaatgactgaccaagaagcaatccaggacctttggcagtggagaaaaagtctttag

SEQ ID NO: 29920 - DNA, 867 bp, Artificial Sequence
  Description of Artificial Sequence: Synthetic coding sequence
atgaaggacaggacacaggagttgagaaccgctaaagactcagatgatgacgatgatgtagctgtaaccgtagatcgcgatcgattcatggatgagttcttcgaacaggtggaggaaattaggggcttcattgataagattgccgagaatgtggaagaggtaaagagaaaacatagcgcaatcctcgcatccccaaaccccgatgaaaagaccaaggaagagcttgaagaacttatgtcagatataaagaaaacagcgaacaaagtgcgaagcaagctgaagagtatcgagcaatctatcgagcaggaggaaggcctaaatcgcagctctgccgacctacggattcgaaagacccagcactctactctctctcgaaaatttgtggaagtgatgtcagagtataacgcaacacagtcagattatcgcgaaaggtgcaaaggtaggattcagcggcagctcgagatcacagggagaactacgacctccgaggaactcgaagatatgctcgagtcagggaatcccgcaatatttgcaagcggcatcataatggatagctctatcagcaaacaggccctctcagagatagaaaccagacacagcgagatcatcaagctagagaactccatccgcgagctgcacgatatgttcatggatatggctatgctggtagagagccagggagagatgatcgatcgaatcgagtataatgtcgagcacgccgtagactacgtggaaagagccgtttcggacacgaagaaggcggtcaagtaccagtcgaaggcgcgtagaaagaagatcatgattatcatttgctgcgtgatccttggcatcgtgatcgcgtccacggtcggcggaatctttgcctag

SEQ ID NO: 29921 - DNA, 183 bp, Artificial Sequence
  Description of Artificial Sequence: Synthetic coding sequence
atggaagaacagggtcattctgaaatggaaataattcctagcgaaagccacccacacatccaactcctcaagagcaaccgcgagcttctggtaacccacatacgaaatacgcagtgcctggtggataacttgctgaagaatgactatttttccgccgaggacgccgaaatcgtttgcgcatag

SEQ ID NO: 29922 - DNA, 183 bp, Artificial Sequence
  Description of Artificial Sequence: Synthetic coding sequence
atggaagaacaaggccactcggagatggagattattccatccgaatcccatccacacattcagttgctgaaatcaaatcgagagctgctggtgacccacatcagaaacacacagtgcctggtggataatctgctaaagaacgactatttcagcgcagaagatgccgaaatagtatgtgcatag

SEQ ID NO: 29923 - DNA, 138 bp, Artificial Sequence
  Description of Artificial Sequence: Synthetic coding sequence
atggaggagcaaggacactccgagatggagatcataccctctgagtctcacccacacatccaactgctgaaatccaaccgtgagcttctagtgacccacatccgaaacacacaatgtctggtggacaatttattgtag

SEQ ID NO: 29924 - DNA, 183 bp, Artificial Sequence
  Description of Artificial Sequence: Synthetic coding sequence
atggaggaacaaggacactccgagatggagattatccctagtgagagccacccacatatccagctgcttaagagtaaccgagagctgctggttactcatattcggaatacccaatgccttgtcgacaacctgctgaagaatgattatttctccgctgaagacgctgaaattgtgtgtgcatag

SEQ ID NO: 29925 - DNA, 750 bp, Artificial Sequence
  Description of Artificial Sequence: Synthetic coding sequence
atggaagagcaaggccacagcgaaatggagattatcccaagcgagtctcatccacatatccagctcctgaaatcaaatcgtgagctcctggtaactcacattcgaaacacacaatgcctggtggataatctgttaaaaaatgattatttttccgcagaggacgctgaaatcgtgtgcgcttgccctacccagcctgataaggtcaggaagattctggatttggtgcagtctaaaggagaggaagttagtgagttcttcctttacctcctgcaacagcttgcagacgcttacgtggatcttaggccctggctgctggagattgggttcagtccctctctgctgacccagagcaaagtcgttgttaacaccgatcctgttagccggtacactcagcagttacggcaccatctcggtagagacagtaagttcgtgctctgttacgcgcagaaggaagagttgctcctggaggaaatctatatggacacaatcatggagctggtcggattctcaaacgaatctctaggttcactaaattccctcgcctgcctattggaccacaccacaggcatcctgaacgagcaggctgcaagccggaaagttacaggatgtgtgtgcaggacatgttcctcctccaccacggccacccagagcggaaccccccgtcgctgtctgccatcctgctgtgcttcaccaacctggccgagctccccctctatggcttggacatcttgtactaggacatggacttag

SEQ ID NO: 29926 - DNA, 2340 bp, Artificial Sequence
  Description of Artificial Sequence: Synthetic coding sequence
atggaggaacaagggcacagtgaaatggagattattcccagcgaaagtcaccctcacattcagttgttgaagtctaacagagagctgctggtgacccacattcggaacacccagtgtcttgttgataatctgctgaagaacgattacttctcggcggaggacgccgaaattgtgtgtgcatgccccacccagcccgataaggtgagaaagattttagacctggtgcaaagcaaaggggaggaggtgtctgagttcttcctgtacctgctccagcagttagccgacgcctatgttgacctgcggccatggttactggaaatcgggttctcgccttcgttgctcacccaaagtaaagtggttgtgaacaccgaccccgtcagcagatatactcagcaattgagacaccatctgggcagagattcaaagttcgtactatgttatgctcaaaaggaggagctacttctcgaggaaatttacatggatactatcatggagctggtaggatttagcaacgagagcttggggtctctgaatagcctggcatgcttgctggaccatactacaggcatcctgaacgagcagggcgagacgattttcatcctgggcgatgccggagtcggtaagtctatgcttttgcagagactgcagtccctgtgggccaccggccgactcgacgccggtgttaaattcttcttccacttccggtgtcgaatgttctcttgctttaaagaatcagatcggctgtgtctgcaggacctcctgttcaagcattactgctacccggagagagaccccgaggaggtcttcgcctttctcctgcgctttccacacgtggcacttttcacgttcgacggcttggacgagctccacagcgacctagatctgagcagggtgccggacagtagctgcccctgggagcccgcacacccactggtactgctggctaatctgctatccggtaaattattgaaaggagcgtctaagctgctcactgcccgaaccggtattgaagtgcccagacagttcttgaggaagaaagtactcctaagaggcttttcgccatcccacttgagggcctatgcacgcaggatgtttccagaaagagcgctgcaggatcggctgctcagccagctggaggccaatccaaacctttgttccctttgctcagttccgttgttttgctggatcatcttccgctgcttccagcactttagagccgcttttgagggctcaccgcagcttcccgactgcaccatgactctcaccgatgttttcctccttgtcactgaagtccacctgaatcgcatgcagccgagtagtttagtgcagcgaaatactcggagtcctgtagaaaccctgcacgccggtcgggacaccctttgcagcctgggtcaggttgcccaccggggtatggagaagagcttgttcgtctttacacaagaggaagtccaggccagcggcttacaggagagggatatgcaactgggctttctcagggctcttcccgaattaggtcccggtggtgaccaacaaagttacgagttctttcacctgaccctgcaggccttttttaccgcattcttcctagtgctcgacgatagagttggcactcaggaattactgcgatttttccaagaatggatgccccctgccggagccgctactacgtcgtgttatcctcccttccttccttttcagtgtctgcaaggttccggccctgcacgggaagatctgttcaaaaacaaggaccatttccagttcacaaatttatttttgtgcgggctgctgtccaaggcaaaacagaaactgctaagacacttagtccccgcagccgctcttaggcggaagagaaaagccctgtgggcccatctgttcagctccttgcgcggatatttaaaaagcctacctcgcgttcaagttgaaagtttcaaccaggttcaggcgatgcctacttttatttggatgttacggtgtatctacgagacccagtcccagaaagtggggcagctcgctgcgcgaggtatttgcgcgaattacctgaaattaacatattgtaatgcgtgtagcgccgattgtagtgcactgagtttcgtgctccaccacttcccaaaacggttggcattggatcttgataataataatcttaacgactatggtgtccgggaacttcagccatgttttagtcgccttacggttctccgcctcagtgttaaccaaatcacggatggaggggtgaaggttctgtcggaggagctcacaaaatacaaaattgtcacttacctcggcctctggaagtccgtggatactatttgcttcaaaaagcagggacttctcaaatag

SEQ ID NO: 29927 - DNA, 495 bp, Artificial Sequence
  Description of Artificial Sequence: Synthetic coding sequence
atgaagtgcaaacccaatcaaacgcgcacgtacgaccccgaaggatttaaaaaaagagccgcatgcctgtgtttcagatccgagcgcgaggatgaggttctgctcgtatcttcaagcaggtaccctgatcgctggatagtgcctggaggaggaatggagcctgaggaagagccagggggtgctgcagtacgcgaagtatatgaggaggcaggcgtgaaggggaagttagggagacttctgggcgtcttcgagcagaatcaagaccgcaaacaccgcacatatgtgtacgtcttaacggtgacagaacttttggaggactgggaagactctgtgtccattggacgcaagcgggagtggttcaaggtggaggacgccataaaggtgctccagtgtcacaagccagtccacgccgaatatttagagaagttaaaattgggcggaagtccaaccaacggaaacagcatggctccctcatcccccgactcagatccatag

SEQ ID NO: 29928 - DNA, 792 bp, Artificial Sequence
  Description of Artificial Sequence: Synthetic coding sequence
atgagcctgtactgcggaatcgcatgccggaggaaattcttctggtgctataggcttctgtctacttacgttaccaagacgcgatatctcttcgagcttaaggaagacgacgacgcttgcaagaaagcccaacaaaccggagccttctacttatttcactctctcgccccactcctgcagacatcagcacatcaatatctcgcccctcgacactccctccttgaactggaacgcctccttggaaagttcgggcaggacgcccagaggatcgaggatagcgtactgattggatgcagcgagcagcaggaggcttggttcgcactggaccttggattagactcgtctttttccatatctgcctccctgcacaagccagagatggaaaccgagctgaagggatctttcatcgagctgcggaaggccctctttcagctgaatgcccgagatgcatccctgctgagtacggcgcaggctctgttgcggtggcacgacgcgcatcaattctgtagtcgcagcggtcaacccaccaaaaagaacgtggcaggaagtaaacgggtgtgtcccagtaataacatcatatactacccacaaatccaggttaatctgcgggagctggagacagccgcttggttttctcacgatgaagtggctaccgcactgaagcgaaaaggaccatacactcaacagcaaaacggaactttcccattttggctgcctccgaagctagccatttctcaccagctgattaaggagtgggtggagaagcaaacttgcagtagtctccctgcatag

SEQ ID NO: 29929 - DNA, 1059 bp, Artificial Sequence
  Description of Artificial Sequence: Synthetic coding sequence
atgtccttatactgcgggatagcttgcagaaggaagttcttctggtgctacagactgctgtccacttatgtgaccaagactagatatctgtttgaattaaaagaggatgacgacgcttgcaagaaggcacagcaaacgggcgcattctaccttttccattccctcgctccactcctccaaacttctgcacaccaatatctggccccacgccactctttacttgagctggaacgattgctcggcaagttcgggcaggatgcccaacgcatcgaagactccgtgctgatcggttgtagcgagcagcaggaggcatggtttgcccttgacctgggactggatagttccttttctattagcgcctctttgcataaacctgagatggagactgagttaaagggcagcttcattgagttacgaaaagctttgtttcagctgaacgcccgagatgccagcctcttgtcgaccgcacaggcacttctccgttggcatgacgcccatcagttctgcagcagatccggacagccaacaaaaaaaaatgttgccggaagtaagcgagtgtgtccatccaacaacatcatctattacccccagatggctcccgtggccatcaccctggtctctgatggcacgaggtgcctcctggctcgacagtcttcattccctaaaggaatgtactccgcactcgctggattttgtgacatcggggaaagcgtggaagagacgataagacgagaggtagctgaggaggtgggtcttgaagtagagagtctgcaatattacgctagccagcattggccattcccgtctggctcccttatgattgcgtgccacgctacggtgaaaccgggacaaaccgagatccaggttaatttgagggagctggagactgctgcttggttctcccatgacgaagttgctactgcgttgaagagaaaaggaccttacacacagcaacaaaacgggaccttcccattctggttacctcccaagttggctattagtcaccagctgattaaagaatgggttgaaaagcagacatgttcatctttaccggcatag

SEQ ID NO: 29930 - DNA, 708 bp, Artificial Sequence
  Description of Artificial Sequence: Synthetic coding sequence
atgtcactgtactgtgggatagcttgccgtcgaaagtttttctggtgctacagactcctgtccacgtatgtcactaagactcgttatctattcgaactcaaagaagacgacgacgcgtgcaagaaggctcagcagaccggcgctttctacctgttccactctctggcacctctgcttcagactagtgcacaccagtacctcgcccctcgacattctctgcttgagttggagagattgctcgggaagttcggccaggatgctcagagaattgaagacagtgtgctgatcggatgttctgaacagcaagaggcttggtttgccctcgatctcgggcttgattcttccttttctatctcagcctccctgcataagcccgagatggaaacagagttaaagggctccttcatcgaacttagaaaggccctttttcaattgaacgccagggatgcctccctcctgtctactgcgcaggccttgctccgctggcacgatgctcatcaattttgctcacggtccggtcagcctacgaagaaaaatgtagctggcagcaagcgcgtatgtccgtcaaacaacataatctactaccctcaagttaaagtgtggaaacgaccttctgcagagaagctgcaaaaaagatgggactggcggtggaaagcctgtagtacaatgcacccctccatcggaccatctctggtcgctcacagctag

SEQ ID NO: 29931 - DNA, 468 bp, Artificial Sequence
  Description of Artificial Sequence: Synthetic coding sequence
atggccccagtcgcaatcacattagtgagcgatggcactagatgtctgctggccaggcagtcatcatttcccaaaggaatgtacagcgctctcgcgggattctgtgatattggcgagtcagtggaggaaacgatacgtagggaagtggctgaggaggtgggccttgaggtggaatctttgcagtactatgcctcacagcactggccatttccttccgggtccctgatgattgcctgccacgctacggtgaaacccggtcaaacggaaatccaggtaaacctgcgggagctcgagactgccgcttggttcagtcacgacgaggtggcaaccgcactaaaacgtaaaggcccttatacacaacagcagaatggcacctttcccttctggcttcccccaaaacttgctatctcacaccagctgattaaggagtgggtcgagaagcagacatgtagcagcctgccggcttag

SEQ ID NO: 29932 - DNA, 681 bp, Artificial Sequence
  Description of Artificial Sequence: Synthetic coding sequence
atggagacagagttgaaaggttcgttcattgagctgcgcaaagcactgttccagctgaatgcaagagacgcatccctgttaagcacagcccaggcattgctgaggtggcacgacgctcaccagttctgtagccgcagcgggcaacccaccaagaagaacgttgcgggaagtaagcgcgtctgcccgtccaataacatcatttactaccctcaaatggcccctgtggccatcaccttagtttccgatgggacacgttgcctgctggcgaggcagagttctttcccaaaaggaatgtactcggcactggccggtttttgcgacatcggcgagtcagtggaagaaacaataagacgcgaggtggcagaagaggtcggccttgaggtcgaatctctgcaatactacgcctctcagcactggcccttcccttctggctcactcatgatagcttgccatgccactgtgaaaccaggccagaccgaaatccaggttaatctccgagaactggaaaccgcggcatggttctcacacgacgaggtggccactgctctcaagcggaagggcccatacacacagcaacagaatgggaccttccctttttggctgccccctaaactcgccataagccaccaactcattaaggaatgggtcgagaaacagacttgttcctcattgcccgcttag

SEQ ID NO: 29933 - DNA, 717 bp, Artificial Sequence
  Description of Artificial Sequence: Synthetic coding sequence
atgctgggtcagccagcaccactcgaacgcttcgcgtctcggcgaccgcaggtcctagctgtacgaaccgtatgtgacctggtgctaggaaagatggacaaggactgcgagatgaagcgcaccaccctcgatagccctctcggcaagctggaactctctggatgcgaacaaggcctccacgaaataaagctgttgggaaagggaaccagcgctgcagacgccgtggaagtaccagcacccgcagctgtgttgggaggacctgagccccttatgcagtgcactgcctggctcaatgcatactttcaccagcctgaagcaattgaggagttccccgttccggctctccaccacccagtctttcagcaggagagtttcactagacaggtgctttggaagttgctgaaggtagtaaagtttggtgaagttatttcgtaccagcagttggccgctctcgcgggtaatccaaaggcagccagagcagtgggcggtgccatgcgtgggaaccctgttcccatcctgatcccctgccaccgcgtggtttgcagttctggcgcagtgggtaattacagcgggggactggctgtcaaggaatggctgcttgcccatgagggacaccggctaggaaaacctggcctgggcggtagctctgggctcgccggtgcttggctgaaaggtgccggtgccacaagcggaagcccccctgcaggacggaattag

SEQ ID NO: 29934 - DNA, 1569 bp, Artificial Sequence
  Description of Artificial Sequence: Synthetic coding sequence
atgtctagcagaccattggaaagtccacccccatataggccggacgaatttaagccaaaccactacgcaccgtccaacgatatttatggcggagagatgcacgttcgccctatgctgagtcaacccgcttattcattttatcctgaggatgagattctgcacttttacaagtggaccagtccacccggtgtcatccgcattctatctatgctgataattgttatgtgcatagcaatattcgcgtgtgtcgcaagcaccttggcttgggatcgaggctatggcacctccctcttggggggaagtgtagggtatccttatggaggcagcggattcggctcttatggcagcggttacgggtacgggtatgggtatggatacgggtacggaggatacaccgatccccgagcagccaaggggtttatgctcgcgatggccgcattttgttttatcgctgcactcgtgatcttcgtgacgagcgtcatccggagcgagatgtccaggacaagaaggtattacctgtccgtgatcatcgtgagcgcaattctgggaataatggtatttatcgctactattgtatacatcatgggagtgaaccccaccgcccagagtagtggaagcctgtatggatctcaaatttacgccctctgtaatcagttttatacgccagcagctactgggctatacgtagaccagtatttatatcattactgcgtggtggacccacaggaggccatcgccattgtccttggctttatgattatcgtcgcatttgctttgatcatcttcttcgcagtgaagacccgaagaaagatggaccggtacgacaagagcaacattctgtgggacaaagaacatatatatgacgaacaaccacccaacgtggaagaatgggttaaaaatgtgtctgctggcacacaagacgtgccatccccaccctctgactatgtcgagagagtagacagccctatggcctattcctccaacggaaaggtcaatgataaacggttctatcctgagtcctcttacaagagcacaccggtcccagaagtcgttcaggaattacctctgacaagtcctgtggacgactttcggcaacccaggtactcttctggtgggaatttcgaaacaccttctaagagagcaccagcgaaaggcagggccggtaggtcaaagcggacggagcaggaccactacgaaacagactatactaccggaggtgagagttgcgacgagctggaagaggattggattcgcgagtaccccccaataacctccgatcaacaacgacaactgtataaacgcaactttgataccggtctgcaggagtataaaagtttacagtctgagcttgacgaaatcaacaaagagctttccaggcttgataaagagctggacgattaccgtgaagaatcagaagaatatatggccgcagccgacgagtataatcggctcaaacaggtgaagggaagtgctgactacaagtcaaagaagaaccactgcaaacagcttaagtcgaaactgtcccatatcaagaaaatggtcggtgactatgatcgacagaaaacatag

SEQ ID NO: 29935 - DNA, 1407 bp, Artificial Sequence
  Description of Artificial Sequence: Synthetic coding sequence
atgagctcccgaccgctggaaagtcccccaccctacaggcccgacgagttcaagcccaatcattacgcccctagcaacgatatttacggaggtgagatgcatgttagaccaatgctatcccagccagcctattcattttatcccgaggacgaaatcctgcatttctataaatggactagcccccctggtgtaatccgtattttgagtatgctgattattgtgatgtgtatcgcgatcttcgcgtgtgtggcaagtacacttgcctgggaccgcggatacggaacaagcctcctaggcggttctgtaggttacccatacggcggttctggctttggctcatacggctcaggctatggctatggatatggttatgggtatggctatgggggatacacagatccacgcgcagcaaaaggatttatgctggctatggccgcattctgttttattgctgcactggtcatatttgtaaccagtgttattcggtccgagatgtctcggaccaggcgttactatctgtccgtgatcatcgtctccgccattctgggaataatggtgttcattgccaccatcgtttatatcatgggcgtgaaccctaccgcacagtcctctggcagcctgtatgggagtcagatatacgcgttgtgtaaccagttttacacccccgctgctacagggctctacgtggaccaatatctgtatcactactgcgtcgttgacccacaggaggtgaagaatgttagtgccggaactcaggacgtgccaagccctcctagcgattacgtagagcgggtggactccccaatggcctactcaagcaacggaaaggtaaacgataaaagattttacccggagagcagctacaaaagtacccccgtcccggaggtcgtgcaggagctgcccctgactagccccgtcgatgacttcagacaaccacggtacagcagtggcggaaattttgaaacacccagtaagcgcgctcctgctaaaggcagagctggccgtagcaagagaaccgagcaggaccattatgagaccgactatacgaccggtggagagagttgtgacgaattggaggaagattggatcagggagtatcctccaataacttctgaccagcagcgccagctctacaagcgcaatttcgatacaggcctccaagaatataagagtctgcaatccgaactggatgaaatcaataaggagctgagccggctcgataaagagctggacgactacagggaagaatccgaggaatatatggcggctgccgatgaatataatcggctgaaacaagttaaaggcagtgctgattacaagtccaagaaaaaccactgcaagcagctgaagagtaagctcagccatatcaaaaagatggtgggtgattatgaccgtcaaaagacctag

SEQ ID NO: 29936 - DNA, 1569 bp, Artificial Sequence
  Description of Artificial Sequence: Synthetic coding sequence
atgagttcccgaccactggaatccccaccgccatacagaccggacgaattcaaaccaaaccactacgcccctagcaacgacatatacggcggagagatgcatgttcgacccatgctttctcagccagcatatagtttctatcccgaggacgagatattacacttttataaatggacgtccccacccggagttataagaattttgtctatgctcattatagtcatgtgcatcgcgatttttgcgtgcgttgcgtcaactctcgcttgggatcgcggatacggcacaagtctgctgggcggaagtgtgggatacccctacgggggaagcgggtttggaagttacgggtctggctacggctacggttacggctacggatacggctatggcggatataccgacccacgtgctgcaaaaggcttcatgcttgccatggccgctttttgtttcattgccgctctcgtcatttttgtgacctctgtgattcgatctgagatgagcaggacccgacgttattatctgagcgtcattattgtatctgcaatcttagggataatggtgttcattgctacgattgtttatattatgggggtaaacccaacagctcagtctagtggatccctctatgggagtcagatttatgccctgtgtaaccaattttataccccggcagccacaggactttacgtggaccagtatctctaccactactgtgttgttgatccccaggaggctattgccatcgttctcggctttatgattatcgtggcctttgccctgatcatatttttcgccgtgaagacccggagaaaaatggaccgatacgataaatccaacatcctgtgggataaggagcacatatacgacgaacaacccccaaatgtcgaggaatgggtgaaaaatgtatctgccggaacccaggacgtacctagccctccttccgactacgtagagagagtcgactctcccatggcctacagcagtaacggaaaagtgaacgacaaaagattttatcccgagtcctcctacaaaagcacccccgtgccagaagtagtgcaggaactcccactgacatcgcccgtcgatgattttcggcagccaaggtattcatctggagggaactttgaaactccttccaagagggcccctgccaaagggcgtgccggacggtccaagcgcaccgagcaggatcactacgaaaccgattatacaactggtggcgagagttgtgacgaactcgaagaagactggatccgggagtacccacctatcacctccgatcaacaacgccaattgtataaaaggaacttcgacacaggccttcaagagtataagtcattacagtctgagctggatgagattaacaaagagctttcccggctggacaaggagcttgacgactatagggaggaatccgaagagtacatggccgcagccgacgagtacaatcgtctgaaacaggtgaaagggtccgccgactataagagtaagaagaatcactgcaagcagctgaagtcgaagttgagtcatataaaaaagatggtgggcgactatgatcggcagaagacctag

SEQ ID NO: 29937 - DNA, 816 bp, Artificial Sequence
  Description of Artificial Sequence: Synthetic coding sequence
atgattatagtggccttcgctctaatcattttctttgctgtcaagacacggcgaaagatggaccgttacgataagtccaatatcctatgggacaaggaacacatatatgacgaacagcccccaaacgtggaggagtgggtgaagaacgtgtcagccggaactcaagatgtgccttcaccgccatctgattacgtggagcgtgtggactcaccaatggcctacagcagcaacggaaaggtgaacgataagcggttttaccccgagtcgtcctacaagagcacacctgtgccagaagtggtgcaggaactgcctctgacatctcctgtcgatgactttcgccagcctaggtatagttcaggcggaaattttgagactccaagtaagcgtgctcccgctaaaggcagggccggtcgaagtaaacggacagagcaggatcattacgagaccgactacacaactggcggagaatcttgcgatgagttggaggaagactggattcgcgagtatccaccaataacgtctgatcagcaaagacagttgtataagaggaattttgataccggattgcaagaatacaagtcactacaaagtgaactggacgagattaacaaggaactaagcaggctggataaggagttggacgactaccgggaggaatccgaggaatacatggccgctgctgacgagtacaaccggcttaagcaggttaaggggtccgccgactacaagtcaaagaagaaccattgtaaacagttaaagtcgaaactctcacacatcaagaaaatggtgggggattacgaccggcagaagacttag

SEQ ID NO: 29938 - DNA, 603 bp, Artificial Sequence
  Description of Artificial Sequence: Synthetic coding sequence
atggcatatagtagtaatggaaaagttaacgataaaaggttttaccccgaatcctcctataagtcgacccccgtacccgaagtggtgcaagaactgcctctgacgtcccccgtggacgattttaggcaaccacggtacagttcaggtggcaactttgaaactcccagtaagagagcaccggctaagggccgtgctggcaggtccaaaaggacagagcaagaccattacgaaactgattacacaaccggaggtgagagttgcgatgaactcgaagaagactggattagggagtatccccctatcacctcagaccaacagcgccagctatacaaacggaacttcgacacagggctccaggagtataagtcactccagtcagaactggacgaaataaacaaagaactgtcccgcctggacaaggaactggatgactatcgagaagagtcagaagagtacatggcggcagcagatgaatacaaccgccttaaacaggtgaaaggctccgccgattacaaaagtaagaaaaatcactgtaagcagctgaagagtaaactgtcccacatcaagaaaatggtaggagactacgaccggcagaagacatag

SEQ ID NO: 29939 - DNA, 3114 bp, Artificial Sequence
  Description of Artificial Sequence: Synthetic coding sequence
atgtggcgttgcggaggcaggcagggcctgtgcgtgctaaggcggctgtcgggcggacatgcccatcacagagcttggcgatggaactctaatcgggcttgcgagcgggctctgcaatataagctaggggacaaaatccatggattcaccgtgaaccaggtgacttctgttccagagctgttcctgacagccgtgaaactcacccacgatgacaccggggctaggtaccttcacctggcacgcgaagacacaaacaacctgttctcagtgcaattcaggacgacacccatggacagtacaggggttccgcacattctggagcataccgtgctctgtgggagccaaaaatatccttgtcgggatcccttctttaagatgctgaataggagcctgagtacttttatgaacgccttcactgctagcgattacaccctttaccccttttcgacccagaatccaaaggactttcagaatctcttgtcggtttacttggatgctacattctttccctgcctgagagagttagacttttggcaagaaggctggcgcctggagcacgagaatcccagtgatccccagaccccactggtgtttaagggtgtcgtatttaacgaaatgaagggcgctttcgtcaataatgaacgaattttctctcagcatcttcaaaaccggctcttaccggaccatacctactcagttgtaagcgggggagatcccttatgtatccccgaactgacatgggagcagctgaaacaatttcatgccacgcattaccatccatcaaatgctagattctttacttacgggaactttccactagagcagcacctcaagcagatccacgaagaagccctatccaagttccagaagatcgagcccagtaccgtcgtgcctgcgcagactccgtgggataaaccgcgagagttccagatcacatgcggtcctgactcctttgcgaccgatccttccaagcaaacaaccatctccgtgtcgttcttactgcctgacataacggacacctttgaggcatttactctgagcctcctttcttctctactgacctctggccctaactccccattctacaaagccctgattgagagcggactcggtactgatttttcccccgacgtcggatataacgggtacacacgcgaggcgtatttttccgtggggctgcaaggcatagctgaaaaagacatcgagaccgtgcgaagcctgatcgaccgaacaatagatgaagtggtcgaaaaaggattcgaagacgatcggatcgaggccctacttcacaaaatcgagatccagatgaagcatcagtcaaccagtttcggcttaatgctgacaagctacattgcaagttgttggaatcacgacggcgacccagtagaactgttaaaattaggaaatcagctggctaagttcaggcaatgcctgcaggaaaatcctaaatttctccaggagaaggtcaaacaatattttaagaataatcagcataagctcactttgtccatgcgcccagatgacaaataccacgaaaagcaggctcaggtggaggcgacaaaattgaagcagaaggtggaggccctgagtcccggagacagacagcagatctatgaaaaggggctagagctgaggagccagcagtctaagccacaggacgcgtcatgtcttccagctctaaaggtgtccgatattgaaccaacaatccctgtgactgaattggatgtcgtccttaccgccggagacattcctgttcagtattgcgcccagcccacgaacggtatggtgtattttcgtgccttctcatctctaaatacattgccagaggagctgagaccttacgtccctctcttctgtagtgtgctgactaaactgggttgtggccttctagattaccgcgagcaggcccaacaaattgaacttaagactggcggaatgtctgctagcccccacgtgttgcccgacgactctcatatggatacctacgagcaaggggtgctgttctcttctttgtgcctcgaccgtaatctcccagatatgatgcaattgtggagcgaaatattcaataatccctgctttgaggaggaggaacacttcaaggtgctggtgaaaatgaccgctcaggagttggccaacggcatccccgactctggacacctgtacgctagtatcagggctgggaggacacttactcccgcaggagacctacaagagacattctcaggaatggatcaggtgaggctgatgaagaggatcgcggagatgacagatatcaaacccattttaaggaaattgccacgcataaagaaacatctgctgaatggtgataatatgcggtgtagtgttaatgcaaccccccagcagatgcctcaaacggagaaggctgtggaggacttcctcagatccataggcaggagtaagaaggagaggagaccagttcgaccccacacagtggagaagcccgtgccgtcttcatctgggggagacgcccatgtccctcatggaagtcaggtcatccgaaagcttgtgatggagcccacattcaagccttggcagatgaaaacccacttccttatgccattccctgtcaattacgtcggcgagtgtatccgaacggtcccgtacaccgatcctgatcatgcctctctgaaaattctggctaggctcatgacagctaaattccttcataccgaaatcagagagaagggcggtgcgtacggcggaggcgctaagctgtcacacaacggcatatttacgctctatagttaccgggatcccaatacaattgaaacactgcagagcttcgggaaggccgtggattgggcaaaaagcggcaagttcacccaacaggatatcgacgaagccaaacttagcgtctttagcacggtcgatgcgccagtggccccatccgacaaagggatggatcacttcctgtacggcctaagcgacgagatgaagcaggcacaccgagaacagctgtttgccgtgagccacgacaagcttcttgctgtcagcgatcgctatctgggtaccggaaagagcacccacgggctggccattcttggacctgagaacccaaagatcgcaaaggacccatcttggattattcagtag

SEQ ID NO: 29940 - DNA, 1107 bp, Artificial Sequence
  Description of Artificial Sequence: Synthetic coding sequence
atgcaacctggctcctcacggtgcgaggaagagactccctctttgctttggggactggacccggtctttctggcatttgccaagctgtatatcagggatatcctggatatgaaggagtctagacaggtgcccggagtgttcctgtacaatggacaccctattaagcaggtggacgttctgggcaccgtaatcggtgtgcgtgagcgggacgctttttactcatatggtgtagacgactcaaccggtgtgatcaactgcatttgctggaaaaaactgaacaccgagagtgtgagcgcagcgcctagtgctgctcgtgagttatcactgacctcccagttaaagaagttacaggagaccatagaacagaaaaccaagatcgagatcggagacacgattagagttcggggaagcattcggacttatcgagaggagcgcgagattcatgcaacaacctactacaaagttgatgaccctgtctggaacattcagattgccaggatgctcgagctgcctacaatctacaggaaagtttatgatcaacctttccactcctccgcccttgagaaagaagaggctttgtcgaaccccggagcactggatctgccgagcctcacatcacttctctctgaaaaggcgaaagagttcctgatggaaaatcgggtgcagtcgttctaccagcaggagcttgaaatggtggaaagcctcctatcccttgcaaatcagccagttatacattctgccagctcagatcaagtgaactttaagaaagatacaacaagcaaagctatccattccattttcaaaaacgcgatccagctgctccaagaaaaagggcttgtttttcagaaggatgacggtttcgacaatctatactacgtgacaagggaagataaagacctccaccgaaaaattcaccggatcatacaacaggattgtcagaagcccaaccacatggaaaaagggtgccattttctgcatatcctcgcctgcgcccgtctctcaattcgtcccggactgagcgaagctgtgcttcagcaagttttggagctgctggaggaccagtccgacatcgtatctacaatggagcactactacactgccttttag

SEQ ID NO: 29941 - DNA, 1038 bp, Artificial Sequence
  Description of Artificial Sequence: Synthetic coding sequence
atgggcgtgtgtggctatctcttcctgccttggaagtgtcttgtggtggtaagccttcgtctgctgttcctggtgccaacgggagtgcctgtgcggtctggagacgcaacgtttccaaaagctatggacaacgtcactgtgcgccaaggggaatccgctacactcaggtgcacaatcgatgacagggttacccgggtagcatggctgaatagatcaactattctgtatgcgggaaatgacaagtggtccatcgacccgagagtgatcatcctggtcaatacaccaacacagtactcgatcatgatccaaaacgtggatgtgtacgacgagggaccgtatacctgttcagttcaaaccgataatcaccctaagacatcccgcgtgcatttgatagtccaagtgcctccacaaatcatgaatatttctagtgatattacagtgaacgaaggtagttccgttacgctgctttgtctcgccatcggacgacccgaaccaactgttacttggcgacacctcagcgtgaaggagggccaggggtttgtgtcagaagatgagtacctggagatcagcgacattaaacgcgaccagagcggggaatacgaatgcagcgcgctgaacgacgtggctgcccctgacgtccgaaaagtaaaaataacagtcaactaccccccatatatctcgaaagcaaagaataccggtgtgtccgtggggcagaagggcatcctgagctgtgaagccagtgccgtgcccatggcagagttccaatggtttaaagaggagactaggttggctacagggctagatggaatgcgcatcgaaaacaaggggaggatgtcaacgttgacattcttcaacgtgtccgaaaaagattacggtaattacacctgtgttgcaaccaataaactgggcaataccaatgcttcaatcacattgtacggtcctggcgcagttatcgatggcgtaaacagtgcctcgcgcgcactagcatgtctgtggctatctggcacactgttggcacatttttttatcaaattttag

SEQ ID NO: 29942 - DNA, 939 bp, Artificial Sequence
  Description of Artificial Sequence: Synthetic coding sequence
atgtatcaccccgcatactgggtggtcttctctgcaactacagcactgctgtttatcccaggtgttcccgtgagaagtggcgatgcgactttcccgaaagccatggataatgtgaccgtccggcagggcgaaagtgcaacattgcgctgtaccatcgacgatagagttactagggtagcctggctgaacaggtccactatcatgatacagaacgtggatgtgtacgacgaaggcccttacacatgttctgtccagacagataaccatcccaagacatctagagtccatctgatcgtgcaggtgcctccccaaattatgaatatctcttctgatattaccgtcaatgaagggtcttcagtgactcttttgtgcctggctatcggacgacccgagcctactgtgacatggcggcatttgtccgtaaaggaagggcagggattcgtttctgaagatgagtatctggagatctctgacattaagagagaccagagcggcgagtacgaatgttctgcccttaatgatgtggctgcccctgatgtgaggaaggttaagatcacagtgaattaccccccatatattagcaaggccaagaacaccggcgtttctgtaggacagaagggcattctgtcatgtgaagcgtctgctgtgccaatggctgaatttcagtggtttaaggaggaaacccgactggccacaggcctggacgggatgcgaattgagaacaaaggtcgcatgagtacactaacctttttcaacgtcagtgagaaagactacggcaactacacatgcgtagcaaccaataaactgggaaacacaaacgcctccatcaccttgtatgggccaggcgcagtcatcgatggcgttaattccgcctctcgggctctggcttgtctctggctcagcgggacactgcttgcccacttctttataaagttctag

SEQ ID NO: 29943 - DNA, 1017 bp, Artificial Sequence
  Description of Artificial Sequence: Synthetic coding sequence
atgtatcacccggcttattgggtggtgttcagtgctacaacggcccttctgttcatccccggagtgccggtgcgatcgggcgacgcaacatttcctaaggcgatggacaatgtgactgtgaggcagggcgaatctgctactcttcggtgcaccattgacgaccgggtgacccgggtcgcctggttgaatcgatccaccatcctctacgcaggcaatgataaatggtcgattgatccgcgagtaataattctggttaatactcctacccagtattccattatgatccagaatgtggacgtttacgacgaaggaccctacacttgctcagtccagaccgacaaccaccccaaaacatctagggtccacctcattgtgcaggtccctccgcaaattatgaatatcagctccgacatcacggtcaacgagggaagctcagtgactctcctgtgcttggcaattgggaggcccgagccgaccgtaacttggcgccacctgtccgtgaaggagggtcagggcttcgtcagcgaagatgagtacctcgagatcagtgacattaagagagaccagagcggagaatatgaatgctcagccttgaatgacgtagcggctcccgacgtgcgcaaagtgaagatcactgtgaactacccgccttatatcagcaaagctaagaataccggagtatcagtgggacagaagggtatcctctcttgcgaagctagcgcagtacctatggctgagttccaatggttcaaggaagaaactcgccttgcaactggcctggatggcatgcgcatcgaaaacaaaggaagaatgtctaccctcacattctttaacgttagcgaaaaggattacggaaattatacctgcgtggctacaaataaactgggtaataccaatgcttcaattaccttgtatggtccaggtgccgtgattgatggcgtgaacagtgcttccagagcactggcttgcctgtggttatctggaactctgctggcacatttctttatcaaattctag

SEQ ID NO: 29944 - DNA, 1065 bp, Artificial Sequence
  Description of Artificial Sequence: Synthetic coding sequence
atgggcgtctgtggatatctgtttctgccatggaaatgccttgttgtagtctcattacgcctgttattcctagtgcccaccggagtacccgtgcgttcaggtgacgcaaccttccccaaagctatggacaatgttactgttagacagggagagagcgccacactgcggtgcactattgacgaccgagtgactcgcgttgcctggttaaatcgaagtaccattttatatgccggtaatgacaaatggtccatcgaccccagggttatcatactggtcaatacccccacccagtactcgatcatgatccagaacgtcgacgtgtatgacgaagggccttacacctgcagtgtgcagactgataatcaccccaagactagcagggtgcacctcatcgtgcaggtaccaccccagatcatgaatatctcttccgacattacagttaacgagggaagcagtgtgactctcctatgtcttgccatcggaaggcctgaaccaaccgtcacttggcggcacctttccgtgaaggagggccaaggtttcgtgtcagaggatgaatatctcgagatatccgatattaaaagggaccaatcgggggagtatgagtgttccgccttaaacgacgtggcagctcccgacgtccgcaaagtgaagatcactgttaattacccgccatacatttcaaaggcaaaaaatactggcgtcagcgtcgggcagaagggcattcttagttgcgaagcttcagctgtacctatggcggagtttcagtggtttaaggaagagacaagactagcgacaggattggacgggatgaggatcgaaaataaaggaagaatgtctactttgacgtttttcaatgtgtcagaaaaagactatgggaattacacgtgcgtggccactaataaactgggtaatacaaacgcatccatcaccttgtacgagatatcaccctcatcagccgtcgccggtccgggtgcggtgatcgacggggtgaattctgcgtctagggccctggcctgtctgtggttgtccggaacactgcttgcccactttttcataaagttctag

SEQ ID NO: 29945 - DNA, 1662 bp, Artificial Sequence
  Description of Artificial Sequence: Synthetic coding sequence
atgtctaataatggactggacattcaagacaagccaccagcgcctcctatgagaaatacttcaacaatgatcggcgctggctccaaggacgcgggaaccctgaatcatggctctaaacctctgcctcccaaccctgaggagaaaaagaagaaagataggttttacagatcgattctgcctggcgataagacaaacaagaagaaggagaaggagcggccagagatctcactgccatcagatttcgagcacacgattcacgtggggttcgacgctgtgacaggcgagtttactggtatgccagaacagtgggcacggctgttacagacatcgaatataactaagtcagagcaaaagaaaaacccacaggcagtgttagacgtccttgaattctacaatagtaaaaagactagtaattctcagaaatatatgtcttttactgacaaatcagccgaggactataatagcagcaacgcactaaacgtcaaggccgtgtctgaaactcccgctgtgccccctgtgtctgaggacgaggacgatgacgacgacgatgctacgccccctcccgtcatcgcccctcgacctgagcacaccaagtcggtgtatactagatctgttatagagcctctacccgtgactccgactcgggatgtggctacttctcccatttctcctaccgagaataacactacaccacccgacgctttaacaagaaacaccgagaaacagaagaaaaagcctaagatgtccgacgaagagattcttgagaagctgcgctccatcgtgtccgtaggcgacccaaaaaaaaaatatacccgctttgagaagattggacagggggctagcgggacggtgtataccgccatggatgtcgcgacagggcaggaagtggcaataaaacagatgaacctacagcagcagcccaagaaggaactgatcattaacgagattctagtgatgcgagaaaacaaaaaccctaatattgttaactatctcgactcctacctggtgggtgatgagttatgggtggttatggagtatctggcgggtgggagcctcacagacgtagtgaccgaaacctgtatggatgagggccagatcgccgctgtctgtagggagtgcctacaggccctggagtttctgcattctaatcaggtgatccacagagacatcaagtccgacaacatcctattaggtatggatggctcggttaagctgacagactttggattttgcgcccagatcacaccagagcagagtaaacggtcaacaatggttggcactccttactggatggctcccgaggtagtgacccgtaaagcctatggcccaaaagtggatatctggtctctgggtattatggcgatagagatgattgagggggaacctccatatctaaatgagaaccccctccgggcactctatctgatcgcgaccaacggaacgccagagttacaaaacccagagaagctgagcgccatctttcgtgacttcctgaacaggtgtttggaaatggatgttgagaaaaggggatcagcgaaagagctactccaggtgagaaagctgcggttccaagtgtttagcaattttagtatgatcgcagcatctattcccgaagattgtcaggctcctctccagcctcattccacagactgctgttcatag

SEQ ID NO: 29946 - DNA, 1638 bp, Artificial Sequence
  Description of Artificial Sequence: Synthetic coding sequence
atgtccaataatgggcttgatattcaggacaagccacccgctccccctatgcggaacacaagtaccatgataggtgcgggttcaaaggatgctggcaccctgaaccacggatccaaacctctgccaccaaatccagaggagaaaaaaaagaaggaccggttttacagatctatcctgccgggagacaaaaccaataaaaaaaaggaaaaggagagaccagaaatctctctccccagcgattttgagcataccatccatgtggggttcgatgccgttacaggcgagtttacagggatgccagagcagtgggctcgactattacagacaagtaatatcaccaaaagcgaacagaagaagaaccctcaggccgttctcgacgttctcgagttctacaattccaagaaaacctctaatagtcagaagtacatgagcttcacggacaaatcagcagaggactataacagcagcaatgcactcaatgtgaaggctgtgtcagagactccagccgtgcccccagtgtcggaagatgaagacgatgacgacgacgacgccaccccccctcctgttatcgctccccgtcctgaacacaccaagagcgtctacactcgatctgtcattgagcctctcccagttacacccacacgcgatgtggcaacttcacccatctctcccacggaaaataataccacgccacctgatgccctgaccagaaacactgaaaaacagaaaaagaaaccaaagatgagcgatgaagagatcctcgagaaactcagaagcatcgtgagcgttggcgatcctaagaaaaagtatactcgcttcgaaaagatcggccagggagccagcggcacagtgtatactgcgatggacgttgctacgggccaggaagtggcgatcaagcagatgaatttacagcagcaaccgaaaaaagaactgataataaacgaaattcttgtgatgcgtgaaaataaaaaccccaacattgtgaactatctcgactcatacctggtgggggatgagttgtgggtggtgatggagtatctggcaggcggaagcctcacagacgtagtgactgaaacctgcatggatgaaggtcaaattgccgcagtctgtcgcgaatgtcttcaggcccttgagtttcttcactccaatcaggttatccatcgcgatatcaagtcagataatatcctcctcggaatggacgggagcgtgaagctgacagactttggattttgtgcgcaaatcacacctgagcagtctaagcgttccactatggtagggactccctactggatggcccctgaagtggtcactaggaaagcttacggtccgaaggtggacatctggagcctgggaatcatggctattgaaatgattgagggcgagcccccttacctaaatgaaaatcctcttagggctctatatctgatcgctacgaatggaaccccagaactgcagaatccagaaaaactatccgctatcttcagggacttcttgaaccgctgcctggagatggacgttgaaaaacgtggcagtgcaaaggagttgttgcagcatcagtttctgaaaatcgctaagcctctctcctctctgactccgctgatcgccgcagctaaggaagccactaagaacaatcattag

SEQ ID NO: 29947 - DNA, 300 bp, Artificial Sequence
  Description of Artificial Sequence: Synthetic coding sequence
atgtcaaacaatgggctcgatattcaggacaagccaccggcaccccctatgaggaacacatcaacgatgatcggcgctggctctaaggacgcgggtactttaaaccacgggtctaagcccctgccaccaaacccagaagaaaaaaaaaaaaaggatcgattttatcgcagtattctgccaggagacaaaacaaacaagaagaaggagaaggagcgcccagagattagcctgccctccgactttgagcacacaatacacgtgggtttcgatgccgtgactggtgaattcaccggtatgtag

SEQ ID NO: 29948 - DNA, 81 bp, Artificial Sequence
  Description of Artificial Sequence: Synthetic coding sequence
atgtcgaacaacggcctcgacattcaggacaagcctcctgccccaccaatgaggaataccagcaccatgataggtgcttag

SEQ ID NO: 29949 - DNA, 270 bp, Artificial Sequence
  Description of Artificial Sequence: Synthetic coding sequence
atgtctaacaacgggttggacatccaggacaagcctccagccccaccgatgaggaatacatcaacaatgattggcgcaggctccaaagatgctggtacacttaatcacggttcaaagcctctccccccaaacccagaggagaaaaagaagaaagaccgtttctataggtctatcttacctggggacaagaccaacaagaagaaagagaaagaacggccagaaatttcactcccatctgactttgaacacaccattcatgtgggtttctag

SEQ ID NO: 29950 - DNA, 192 bp, Artificial Sequence
  Description of Artificial Sequence: Synthetic coding sequence
atgtctaataatggactggatatccaggacaaacccccagctcctccaatgcgtaacacgtcaaccatgataggggcaggttctaaggatgccggaaccctaaatcacggttccaagccactccctcccaatcccgaagagaagaaaaagaaggaccggttctatcgctcaatcttacctggagacaaatag

SEQ ID NO: 29951 - DNA, 321 bp, Artificial Sequence
  Description of Artificial Sequence: Synthetic coding sequence
atgagcaataacgggctggatattcaagataaaccgcctgctccaccaatgcggaacacatcaactatgataggcgcaggttctaaagacgctggaacgctgaatcatggatctaagccacttcctcccaaccctgaagagaagaagaagaaggaccgattctataggtcaatccttccaggagacaaaactaacaaaaagaaggaaaaagaacgccctgagatcagcttgcccagcgatttcgagcacaccattcacgttgggtttgacgccgtcaccggagaatttactgggatgccagagcagtgggccaggctgtag

SEQ ID NO: 29952 - DNA, 1569 bp, Artificial Sequence
  Description of Artificial Sequence: Synthetic coding sequence
atgtcaaacaacggcctggatattcaggataagcccccagcaccccctatgcggaacacatcaacaatgatcggtgccggttccaaggacgcgggtacactgaaccacggcagcaaaccactcccccctaatcctgaagaaaaaaagaagaaagaccggttctaccgcagtatcctccctggggataagaccaataaaaagaaagagaaggagaggcctgagatcagtctgccaagcgactttgagcatacaatccacgttggttttgacgctgtcactggagaatttacggggatgcctgaacaatgggctcgcctgctccagaccagcaacatcaccaagagtgagcagaagaaaaacccccaggctgtgcttgacgtcctggaattttataactcaaagaagacaagcaacagtcagaaatatatgtcatttaccgataagtccgcagaggactataattcctctaacgccctgaatgtcaaagccgtaagcgagacccccgctgtccctcccgtgagcgaagacgaagacgatgatgatgacgatgcgacgccccctcctgtcatcgcacccaggccggagcatacaaagagtgtatatacccggtctgtgatcgagcctcttccggtgacacctacacgagatgtggcaacgagccctatctctcccacagaaaataataccactccacctgacgccttgacaagaaacactgaaaagcagaagaaaaagccaaaaatgtctgacgaggagattctagaaaagttgagatccatcgtttccgtgggggatccaaaaaagaagtacacaaggttcgagaaaatcggccagggcgctagcgggactgtgtacaccgcaatggacgtcgccacggggcaagaggtggccattaaacagatgaatctgcagcaacaacccaagaaagagctgattattaacgagattctggtgatgcgagaaaacaagaacccaaatatagtaaattatctggacagttatttggtcggtgacgagctgtgggtcgtgatggaatacctggcaggcggatctttgacagacgtagtgacagagacatgcatggacgaggggcagatcgccgctgtgtgtcgggagtgtctgcaggcactggagtttttacacagcaatcaggtcatccacagagatatcaaatccgataatatactcctcggaatggatggtagtgtaaagctgacagactttggattttgcgctcaaatcacaccggaacagtctaaacgttccaccatggtgggtacaccatactggatggcccctgaggtcgtcacccgtaaagcctacggaccaaaggttgatatctggtccctcggtattatggccattgaaatgattgagggcgaaccaccctaccttaatgaaaaccctctgagagccctctaccttattgccacaaatggcacacccgaactgcaaaaccccgagaagctgagtgccattttccgggacttcctcaaccgatgtcttgagatggacgtagagaagagaggctctgccaaggaactcctgcagcactcgtccaggctgtag

SEQ ID NO: 29953 - DNA, 1317 bp, Artificial Sequence
  Description of Artificial Sequence: Synthetic coding sequence
atgtttggaaagagaaaaaaaagagttgagatatcagctccatccaatttcgagcatagggtgcacaccggcttcgaccaacacgagcagaaattcacggggctgccccgtcagtggcagtcacttattgaggagtctgctaggcgtccaaaacctctggtcgacccagcctgcattacgagtatccagcccggtgctcctaaaggcgagccccatgatgtggctccaaatggacctagtgctgggggtctggccattccacagagctcaagttcctcttcccggccacccacgcgagcgagaggcgctccctcccctggggtgctgggcccacacgccagtgagccacaactcgccccacccgcttgtactcccgcagcacccgctgtgccaggaccaccagggcctagaagcccccagcgtgagccacagcgcgtgtctcatgagcagtttagggctgcactccagcttgtggtggatccaggggaccctcgctcctacctggacaactttatcaaaatcggcgaggggtctacggggatagtgtgcatcgcaaccgtgaggtcatctggcaagttggttgctgtgaagaagatggaccttcggaaacagcagcgaagggagctactgtttaacgaagttgttatcatgcgagactaccagcatgaaaatgtagtagagatgtataatagctatttggtgggagatgaattatgggttgtgatggagttcttagagggtggcgctctgacagacattgttacacatacacggatgaacgaggaacagatagctgccgtgtgcctagctgttctccaggcgctgtcagtactccatgcccaaggcgtaatccatcgagacatcaagtccgattccatcctgcttacacatgacggaagagtcaagctgtccgacttcggattttgtgctcaggtgagcaaagaagtgcccagacggaaaagcctggtaggtacaccttattggatggctcctgagctgatatctcggttgccatatgggccagaagtggacatctggagcctgggcataatggtcattgagatggtagacggagagccaccttactttaatgagcctcctctaaaagctatgaaaatgatccgtgacaatcttcccccacgcctgaaaaatctgcacaaagtgagtccaagccttaaaggtttccttgacaggctgctcgtgcgcgacccagcgcaacgcgctacagctgccgagctgctgaagcatcctttcctggctaaggcagggccacctgccagcattgttccccttatgcgtcaaaaccgcaccagatag

SEQ ID NO: 29954 - DNA, 1776 bp, Artificial Sequence
  Description of Artificial Sequence: Synthetic coding sequence
atgttcggcaagcgtaagaagagggttgaaatttcggccccatccaactttgagcaccgggtgcatacggggttcgatcagcatgagcaaaagttcacgggcttgccgaggcagtggcagtcattgatcgaggagtccgcccgtcggccaaagccactcgtagatcccgcttgcatcacatctattcagcccggtgcacccaagaccattgtccgaggatcgaaaggggcaaaagacggggcacttacactcctgctggatgagttcgagaacatgtcagtgactaggtccaacagtctgaggagagactccccaccacccccagccagggctagacaggaaaatggaatgcccgaggagcctgctacgaccgctcggggtggacctggcaaagccggtagtagggggaggtttgccggacactccgaggccggagggggatctggggatcgtcgtagggccggacctgagaagagaccaaaatcgagtcgggaaggaagcggcggtccacaggaatcaagtcgtgataagcggcctctctccggcccagatgtgggcaccccacaacctgctggactcgcctccggcgctaaacttgctgccggtcgtcccttcaatacataccctcgtgccgacacagatcatcctagtagaggggctcagggagaaccccatgatgtagcgcctaatggtccttctgcgggagggctcgcgatcccacagtcttcaagctcatcgagcaggccacccaccagagccagaggcgcaccgtctcccggtgtcctcggaccccacgcaagcgagccacagctggcccctccggcttgcaccccagcagccccagccgtaccaggcccacccggaccacgctctccgcaaagagagccccaacgagtgtctcacgagcaatttagggccgctttgcagctggttgtggaccctggggatccacggtcttatctggacaactttataaagatcggagaggggtccacagggatcgtctgcattgcgacagtgagaagctctggcaagctggtggctgttaagaagatggacctgaggaagcagcaacggagagagttactctttaatgaggttgtcatcatgcgggattatcaacatgagaacgttgtggagatgtataactcttacctcgtgggcgacgaactatgggtggtaatggaattccttgaaggcggagccctcactgatatcgtcacacatactcgaatgaatgaggagcagatcgccgctgtctgcttggcagtgctgcaggctctatccgtgctgcacgcgcagggagtgattcatagggatattaagtcagattccattctcctgactcacgacgggagagtgaagttaagcgactttggattctgcgcgcaggtcagcaaagaagtgccacgtcgaaagagcctggttggaactccatactggatggctccggaactgattagcaggctcccgtacggacccgaggtcgatatctggagcttgggcatcatggttattgaaatggtggatggggaaccaccctattttaatgaacccccactgaaggctatgaagatgatcagagataatcttccccctcggctgaagaacttacacaaagtatcaccatccctcaagggtttcctggatcggttactggttcgggatcctgcccagcgcgcaactgcagccgagctgttaaaacacccttttctcgccaaggcaggcccacccgcatctattgtgccccttatgcgtcaaaaccgtaccaggtag

SEQ ID NO: 29955 - DNA, 1188 bp, Artificial Sequence
  Description of Artificial Sequence: Synthetic coding sequence
atgggctgtcaacgttctcgcccttttaatacatatcccagagccgacaccgaccatccatccaggggggcacagggggagccccacgatgtggcccctaatggcccaagcgcgggaggcctggctatccctcagagctcttctagcagcagccggcctcctaccagggccagaggcgcacccagtcctggcgtgctgggccctcacgcctctgaaccccagctagctccccctgcgtgtactccggctgctcccgctgtgcctgggccacctgggcctcggtccccccagagagaaccgcagagggtgtcacatgaacaatttcgcgctgcattgcagcttgtcgtggatcctggagatcccagaagctacttggacaactttatcaaaattggggaaggctcaacaggcatcgtgtgcatcgcaaccgtgagatcctccggtaaactcgtagcggtgaaaaaaatggacttgaggaagcaacagcgacgggaactgctctttaatgaagtggtgataatgcgagattaccagcatgagaacgtcgtcgagatgtacaactcataccttgtgggggatgagctgtgggtggttatggagtttctcgaaggtggcgcattaaccgacatagtaacccacacccgcatgaacgaagaacagatcgcggctgtctgcttggcagtcctgcaggcattgtccgtcctgcatgcccagggcgtaattcatcgcgacattaaaagcgacagcatactgcttacccatgatggtcgcgttaaactcagcgattttggcttttgtgcgcaggtctctaaggaggtgcccagacggaagtcactggttggaacgccttactggatggcacctgaactgatctcccgcctgccttacgggccagaggtagacatttggagtctgggaataatggtgatcgagatggttgatggcgagcctccttatttcaatgagcctcccctcaaggctatgaaaatgattcgggataacctccccccaagactgaagaacttgcacaaggtgtcgccaagtcttaagggctttttggatcggctcttagtgcgggatcctgcccaacgagctacagccgctgagctgctcaagcacccatttttggcaaaggctggcccacctgcgtcaatcgtgccactgatgagacagaataggacacgctag

SEQ ID NO: 29956 - DNA, 1776 bp, Artificial Sequence
  Description of Artificial Sequence: Synthetic coding sequence
atgttcgggaaacggaagaagcgagtcgagatatctgccccaagcaatttcgagcacagggtgcacactggatttgatcagcatgagcaaaaatttactggcctccctaggcagtggcagagcctaatcgaggaatccgcaaggcggccaaaacctttagtcgatcccgcttgcataacctctatacagccaggggctcccaagacaatcgtacggggatctaaaggagcaaaggacggcgctctgacccttctcttagatgagttcgagaatatgagtgttacccgatccaacagcttacgtcgcgatagtccgcctccccctgcccgagccagacaggaaaacggaatgccggaagagcctgcaaccaccgctcgcggaggaccaggtaaagcagggtctcgcggtagatttgccggacactctgaggccggaggaggctccggtgatcgccgacgtgctggcccagagaagcgtcccaagagctcccgagaaggcagtggtggtccacaggagagtagtcgcgacaaaagacctctatccggacccgatgtgggaacaccccagcccgcaggacttgcctccggagctaaattagctgctggcaggccttttaacacttacccgagggccgataccgaccatcctagccggggagcgcagggcgagccacacgacgtcgctcccaacggccctagtgcagggggtttagccatccctcagagcagtagtagctcttctcggccacctacaagagctcggggagccccatcaccaggcgtgcttgggcctcatgcctcggagccacagctggcaccgcctgcatgcacgccggcagcacccgcagtacccggaccccctggacctcggagtcctcagagggaaccacagcgggtgagtcacgagcaatttagggcagctcttcagcttgttgtggaccctggggacccgaggagctacctcgacaacttcatcaagatcggcgaaggaagtacaggcatagtgtgcattgctactgtgagaagttcagggaagttagtggccgtcaagaaaatggatttgcgaaagcagcaaaggagggaactgctctttaacgaggtggtgattatgcgtgactatcagcacgaaaatgtcgtcgagatgtataatagctacctcgtcggcgatgaattgtgggtggtgatggagtttttggaggggggagccctgaccgatatagtcactcacaccagaatgaatgaggaacagatcgcagccgtctgcctagccgtgctccaggcgctcagcgtgcttcatgcacagggagtgattcatcgcgatattaagagcgacagcatactgttaacacacgacggtagagtgaaactgagcgattttgggttctgcgctcaggtgtctaaagaagtgcctaggaggaaatctctggtaggcaccccatactggatggcgccagaattgatcagccggcttccatacggccctgaagtggacatttggagcctcggcatcatggtcattgaaatggttgatggcgagcctccatactttaatgagccacccttaaaggcaatgaagatgatacgggacaacctcccacccaggctcaaaaacctgcacaaggtgtctccaagtctgaaagggttcctggatcgcctgttagttcgggaccccgctcagcgcgcaacggcggcagagcttcttaagcaccccttcctggcgaaggccggtcccccagcttctattgtgccactcatgcgccagaatcgaacgaggtag

SEQ ID NO: 29957 - DNA, 1776 bp, Artificial Sequence
  Description of Artificial Sequence: Synthetic coding sequence
atgtttggcaaaaggaaaaagagagtcgagattagtgcaccgagcaacttcgaacaccgggttcataccggtttcgatcagcacgagcagaaatttactgggcttcccagacagtggcaatctttaattgaagagtccgcaagacgtcccaaacctttggtcgaccccgcttgcatcaccagcatacagcccggtgctccgaaaaccatcgttaggggaagcaagggagccaaagacggagcgctcacactgctcttggacgagttcgaaaatatgagcgtgacccgatcgaacagtctcaggagagatagccccccaccgccagcccgagctaggcaggaaaatggcatgcctgaagagccagcgaccactgccagggggggacccggtaaagccggttctcgaggcagatttgccggtcattccgaggctgggggtggaagcggtgatcgccgtcgagcagggccagaaaagcggcctaagagtagccgtgaagggtcaggcggtccacaagagagttcgcgggacaagcgaccgctcagtggacctgatgtaggcacacctcagcctgctggtctggcttcgggagctaagctagccgctggccgtccttttaatacctaccccagagccgatactgaccatccgtcaaggggggcacagggtgagccccatgatgtcgcacctaacggcccaagtgcaggcggactggccattccgcagagctcatccagctcctcccggccaccaacgcgagctagaggcgcaccttcgccaggtgtgctcggcccacacgcatcagagccgcagcttgcaccgcctgcatgcactccagccgcacccgcagtacctggacctcccggacccaggagtccccagagggaaccacagcgggtgtcccacgaacagttccgcgcagctcttcagctcgtggtcgaccctggggaccccagaagctatctggataatttcatcaagatcggggaaggatccacaggaatcgtgtgtatcgcaacggtcaggagctcaggcaagctcgtggccgttaaaaaaatggatctacggaagcagcagcggagagagcttctcttcaatgaggtcgtgataatgcgcgattatcagcacgaaaatgtcgtggagatgtacaattcatatctagtgggtgacgaactatgggttgtgatggaattcctcgagggcggagccctgaccgacatcgttacacatacccggatgaatgaggaacagattgcggctgtgtgtttggccgtgctccaggcgctttctgtgctgcatgcccagggagtcatacatagagacatcaaatcagacagcattctccttacacacgatggaagagtgaaattgagcgatttcggcttttgtgctcaagttagtaaggaggtgcctagacgtaagtcgctggtcggaaccccttactggatggcccctgagctaatttcacggttaccttatgggcctgaggttgatatttggtccctaggaatcatggtcattgagatggtggacggtgagcctccttactttaacgaaccccctctgaaggccatgaagatgattcgggacaacctgcctcctaggctgaagaatctgcataaagtctccccttccctgaaggggtttctggacaggctgcttgtgagagaccctgcccagagggctactgctgccgagctccttaaacacccgttcttagctaaggccggaccacctgcctccatcgtccctctgatgcgacagaacagaacccgttag

SEQ ID NO: 29958 - DNA, 1044 bp, Artificial Sequence
  Description of Artificial Sequence: Synthetic coding sequence
atgacctggccacttaccgggcatcagcgtggagcttggcctagccccagccccccaccacctcctcccggactaccacccgagcctgaggtccctcccgcacttgaatgctgggaccctactccgcagagtccacggagtccacagcgcgaaccccagagggtgtcacatgagcagttccgcgctgcattgcagctggttgttgaccctggagacccacggagttatctggacaattttattaagattggtgaagggtccacagggattgtttgtatcgcaacagtacgctctagtggaaagctcgtcgcagtaaaaaagatggatctgaggaagcagcaaagaagggagttactgttcaatgaggtggttattatgagagattaccagcacgaaaatgttgtggaaatgtataattcatacctggtaggcgatgagctctgggtggtgatggagtttctcgaaggaggagccctgacggatatagtcacccatacaaggatgaacgaagagcagatcgcagccgtgtgtttggctgtgctgcaggctctgtctgttctgcacgcacagggggtcatccatagggatattaaatctgattctatcctcctgacccacgacggacgagttaagttgtcagactttggcttttgcgcgcaggtgtccaaggaagtcccgcgaagaaagtctttagttggcacaccgtattggatggccccagaacttatctcaagactgccatatggccctgaggtcgacatttggagcctggggatcatggttattgaaatggtggacggcgagcctccttactttaatgaacctccacttaaggccatgaagatgatcagggataatttaccccctaggttaaaaaatcttcacaaagtaagtccaagtctgaaaggctttctggatcgcttgctggtgcgcgatcccgctcagagggcaacagctgctgaactgctcaagcacccatttctcgctaaggccggtccaccagcctccattgtgccacttatgagacagaataggacgagatag

SEQ ID NO: 29959 - DNA, 1776 bp, Artificial Sequence
  Description of Artificial Sequence: Synthetic coding sequence
atgtttggcaagcggaaaaagagagtcgagatcagcgctccttccaacttcgaacatagagtgcatacaggctttgaccagcatgagcagaaatttacagggctcccacggcagtggcagtcactcattgaggagtctgctagacgtccaaagcccctggtggatccagcctgcataacctccatccagcccggtgcccctaagactattgtgcgcggatccaagggggctaaagacggagccttgaccttgctgcttgatgagttcgagaacatgagcgtgacccgatcgaatagcttgagaagagattcaccccctccgcctgcgagggcacggcaggaaaacggaatgcctgaggagccagctaccaccgctagagggggaccaggcaaggcaggatcccgtggaagattcgccggacactccgaggctggaggagggagcggcgatagacggagggcagggccagagaaaagacccaagtcttctcgcgaaggatccgggggacctcaggagagctcccgtgataagcggccattgtcaggccctgatgtaggcaccccacagccggctggcctggcaagcggcgctaagctagctgccggaaggccattcaacacctacccaagagctgacacagaccatccctcaagaggagcacagggagagccgcatgacgtagcaccgaacggaccgagcgctgggggtttggccatacctcaatcatcctcttcatctagtcgcccacctaccagagctaggggggcaccctcccccggtgttctcgggccacatgcttcagaaccgcagctcgctcccccagcctgtacccccgctgcgcctgccgtccccggaccacccggacctcgcagccctcaacgagaaccacagcgcgtgtcgcacgagcaatttcgcgctgcactacagctggtggtggatcctggggacccacggtcctacctggacaacttcatcaagataggtgagggcagcacggggatcgtgtgtattgccacggttagaagcagtgggaagctggtggctgtaaagaagatggatttgaggaagcagcagcgacgggaactcttgttcaacgaagtagtgatcatgcgcgattaccaacatgagaatgttgtggaaatgtacaactcgtacctggtaggcgacgagctctgggtggtgatggagttcctggaaggcggagctcttaccgacatcgtgactcacacccgcatgaacgaagaacagatcgcagctgtgtgcctagccgtgctgcaggcactgtccgtcttgcatgcccagggagtgatccacagagacatcaagagtgacagtattcttctcactcacgatggcagagtgaaacttagcgatttcggattctgcgcacaggtgagcaaggaagtgccaagaaggaagtcactggttggaactccatactggatggctcccgagctcatcagtcgattgccctacgggcctgaagtcgatatttggtccctggggattatggtcatagagatggtggacggtgagccaccatacttcaacgagccgcctctgaaggctatgaagatgattagagataatctgcccccacgcctgaagaacttgcataaggtgtctcctagcctgaagggttttctggaccgcctgttggtacgcgatcccgcacagcgcgcaacggctgccgaactgctgaaacatcctttccttgccaaggccggacccccagctagtattgtacccctgatgcgccaaaaccgaacccggtag

SEQ ID NO: 29960 - DNA, 1317 bp, Artificial Sequence
  Description of Artificial Sequence: Synthetic coding sequence
atgtttggtaaacgtaaaaaacgggtggagattagcgcgccttctaactttgagcatcgagtgcacactgggttcgatcaacacgagcaaaaattcactggcctgcctcgacagtggcagtctctgatcgaggaatctgcacggagacctaagcccctcgttgaccccgcatgcatcacgagtatccagcccggtgcacctaagggcgaaccacatgatgtggccccaaacggaccttccgcagggggtttagccataccccagtcgagctcttcttcatcaagacccccaactcgcgcacgaggggctccctcacccggagtgctaggccctcacgccagcgagccgcagttggcacctccagcttgtacccccgcagcacccgctgttcctgggcctcccggtcccaggtccccccaaagggagccccaacgtgtgtctcacgagcaatttagagcggctctgcagctggtggtcgaccccggagatccgaggtcatacttggacaattttataaagatcggcgagggtagcaccggaatcgtctgtatagcaacagtccgctcgtcggggaaattagttgccgtgaagaaaatggaccttagaaagcaacaaaggagagagttactgttcaatgaagtcgtgataatgcgggactatcagcatgagaatgtggtcgagatgtataattcttacctggtgggtgatgaattgtgggtggtgatggagttcttagagggcggtgcactcacagatattgtcacccatacccggatgaacgaggagcagattgcagctgtgtgtctggccgtgctgcaggccttgagtgttctgcatgctcaaggagtcatccaccgggacatcaagagtgactcaattttgctgacgcacgatggcagagttaaactaagtgacttcggattttgcgcccaagtgtcaaaagaagtgccgagaagaaagagtcttgtgggcaccccgtattggatggcccctgaacttatcagccgccttccatatggccctgaggtcgacatttggagcttaggaatcatggtcattgagatggtggatggcgaacctccatatttcaacgaaccacctctcaaagctatgaagatgatccgggacaacctgcctccccgactgaagaacttgcacaaggtgtcgccaagcctgaagggctttctggaccgcctgttggtcagagaccccgctcaacgcgctactgccgcagagctcctgaagcaccccttccttgccaaagctgggccacccgctagtattgtgcccctcatgaggcagaaccgcacccgctag

SEQ ID NO: 29961 - DNA, 1458 bp, Artificial Sequence
  Description of Artificial Sequence: Synthetic coding sequence
atggcccctaccatccagacacaggctcaacgggaggacggccaccgatctggagtggtgtgcagggtgaagtattgtaactcgcttccagacattccattcgatccaaaatttatcacctacccatttgaccaaaacaggtttgtccagtacaaagcgacttcgctggaaaagcagcacaagcacgacctgctcaccgaacctgatcttggcgtcaccatcgacctcattaatcccgatacgtaccgaattgatcctaacgtgttgctggatcctgctgatgagaagctgttggaggaagaaattcaggcccctacctccagcaaaagaagccagcagcacgctaaggtggtgccatggatgagaaaaactgaatatatatcaacagaattcaatagatacggcataagtaatgagaagccagaggtcaagatcggggtgagcgtgaagcagcaatttactgaagaagagatctataaggatcgcgactcccaaattaccgccatcgaaaagacctttgaggatgcacagaaatcgatctctcagcactactccaaacctagggtcactcccgtcgaagtgatgccagtctttccggactttaaaatgtggataaacccttgcgcacaggtgatttttgatagtgatcctgcaccaaaagatacatctggggctgcagcactcgagatgatgtcacaggctatgatcagaggcatgatggacgaggagggaaaccaatttgtagcctactttttacccgtggaagagacactcaaaaagagaaagcgggatcaggaggaggagatggattatgctcctgacgatgtgtacgattacaagattgccagggagtataactggaacgtgaaaaacaaagccagcaagggctacgaagaaaactatttcttcatctttcgcgaaggcgacggcgtttactacaacgaactggaaacacgggtgcgcctcagcaaaagaagagccaaggccggtgtgcagtccgggaccaatgcgctgctggtggtaaagcaccgtgacatgaacgagaaggagctcgaagctcaggaggccaggaaggcccaattagaaaaccacgaaccagaggaagaggaggaggaggagatggagaccgaagagaaggaagcaggcggttccgtgatgctgattctgcggacaatgccaaccttaatgatgaggaccgaggatcggcctaaagtggcagtaactatgatacagacggctgccgctatgggggtggccagtggtgctggggcaaccgcggcagccccagtcccctctccagtggccgcaagtacccgtcctcggaggatggcagtcaagctccagttactcatccctgttaagctgatagtgacagttacggagtcacagggtattcagggctggtttagacaccactattgcgagcagcaatcaacttttctcgtggtgtgcctctag

SEQ ID NO: 29962 - DNA, 873 bp, Artificial Sequence
  Description of Artificial Sequence: Synthetic coding sequence
atgggccaccctcctcttctgccactgctgttactcctgcacacgtgtgttcccgctagctgggggctgagatgcatgcagtgcaagacgaatggcgactgtagagtagaggaatgcgcactggggcaggacctttgccggactacaatcgtgcgactgtgggaggaaggagaagagctggaactggtcgagaagagctgcactcactcagagaagaccaacaggacattgagttatcggactgggctgaagataacgagcctcaccgaggtagtatgtggcttagacctctgcaatcagggaaattcaggtcgtgcggttacgtatagtcgctcccggtatctggaatgtataagctgtggcagctcagacatgtcgtgtgaacgtggaaggcaccagtctttgcaatgtcggtctcctgaggagcagtgtctggacgtcgtcacccattggatccaggagggcgaggaggtgctagagcttgagaaccttccccagaatggtcgacagtgttattcgtgcaagggcaacagcactcacggatgtagttccgaggagacattcctgatagactgccggggaccaatgaaccagtgtcttgttgctacaggaacacacgagcccaagaatcaatcctacatggtgaggggctgtgctaccgcctcaatgtgccagcacgcccacttgggcgacgctttttccatgaaccacatcgacgttagctgctgcacgaaaagtgggtgtaaccatcctgacttagacgtacagtatcgcagtggagctgctccccagccgggaccggcacatctgagcttgaccattacattactgatgacagcgaggctgtgggggggtactctcttgtggacctag

SEQ ID NO: 29963 - DNA, 1596 bp, Artificial Sequence
  Description of Artificial Sequence: Synthetic coding sequence
atggccccaaccatacagacccaggcccagagggaggacggacaccgtccaaactcccaccgaacactacctgagagaagcggtgtggtgtgtagggttaaatattgtaattcacttcctgacattccatttgatcccaagtttattacttaccctttcgaccagaatcgatttgtccagtacaaggcaacctcgcttgaaaaacagcacaaacacgatctgttgactgagcccgatctcggcgtgaccattgatcttataaatcctgacacctaccggattgatcccaatgtgctgctcgatccagcggatgaaaagctcctggaggaggaaatacaggctccaacctccagcaaaaggagtcagcagcacgccaaagttgtgccttggatgcgcaagacagagtacatctctaccgaattcaatagatatggaatcagtaacgagaaacctgaggtgaagataggggtgtctgtcaaacaacagtttactgaggaggagatctataaagatcgcgacagccagatcactgctatcgaaaagaccttcgaagacgcccaaaaatctatatcccaacactacagcaaacctagagtgaccccggtggaagtcatgccggtgtttcctgacttcaaaatgtggatcaacccatgcgctcaggtaattttcgactccgaccctgctcccaaggataccagtggtgccgcagcattagaaatgatgtcacaggccatgattagaggaatgatggacgaggaaggcaatcaattcgtggcctattttctccctgtggaggagacgctgaaaaagcgcaagcgtgaccaggaggaggagatggattacgctccagatgacgtatacgattacaaaatcgcacgtgaatacaactggaacgtcaaaaacaaggcttccaaagggtatgaggaaaattacttttttatatttcgagagggagatggggtgtattacaacgaactggaaacccgggtgcggctctcaaaaaggcgggcaaaagccggagtccagagtggtacaaacgcacttcttgtggttaagcaccgagacatgaacgaaaaagaactggaggcccaggaagcacgtaaggcacagcttgaaaaccacgagcctgaggaagaggaggaggaagaaatggagaccgaagaaaaggaggctggtggatccgatgaggagcaggagaagggcagctctagcgaaaaagagggttcagaggatgaacatagtggctctgaatctgagagggaagagggggaccgcgacgaggcttcggataagagcggttctggcgaggacgaatccagtgaggacgaagctcgtgccgcacgggataaagaggagatattcggaagcgatgctgactccgaggatgacgccgattctgatgacgaagatcggggtcaagcccaggggggttcagataacgattctgacagcggttcgaatgggggaggtcagaggtctaggtcacacagccggtctgcttcacctttcccgagcggatcagagcactccgcacaggaggatggcagcgaggctgccgcatccgattctagcgaagcagactccgacagcgactag

SEQ ID NO: 29964 - DNA, 867 bp, Artificial Sequence
  Description of Artificial Sequence: Synthetic coding sequence
atggccacaggaccaatacctacaggtttatgtctgcgcggtctagaatggtcagccgagtcctccacagccatagccagcctgatttctccatctaccccaagctcatcccccacgccttccaccagaactgtgctcttggatcccgcagatgagaagctgctggaagaagaaatccaagctcccaccagtagtaagcgatcgcagcagcatgccaaggtagtgccatggatgagaaaaacggaatacatctcaacagaattcaataggtatggcatttccaatgagaagccggaggtgaaaataggggtctctgttaaacagcagtttaccgaggaggaaatctacaaagatcgcgatagccagataacagcaatcgagaaaacattcgaagacgcccagaagtctataagtcagcactattcaaagccaagagtcacccccgtggaggtgatgcctgtatttcctgactttaaaatgtggatcaacccctgtgctcaagtgattttcgactcagatcccgcacccaaggatacaagcggagctgcagctcttgaaatgatgagccaggcaatgattagggggatgatggacgaggagggcaatcagtttgttgcctatttcctgcccgtagaagaaaccctgaagaaacgcaaaagggaccaagaagaagagatggactacgcccctgatgacgtctacgactacaaaatcgctcgggagtataattggaacgtcaaaaacaaggcatcgaaaggctacgaagagaactatttcttcattttccgggagggggacggcgtatattataacgagctcgagacatcaatccaatactcccatatgctgtataatctggtggcttag

SEQ ID NO: 29965 - DNA, 1176 bp, Artificial Sequence
  Description of Artificial Sequence: Synthetic coding sequence
atggacctggaaaaaaattacccgactccccgaacttcacggacgggccacggaggggttaatcagcttggtggggtgttcgttaatggacgccctttaccagacgtggtcagacagaggattgtagagctcgctcaccagggagtgcgaccttgtgacatctctcgccagctgcgagtgtcccatggttgtgtttccaaaatcctcggacgctactatgaaaccgggagtattaagcccggagtcatcggcggtagcaaacccaaggtagccaccccaaaagtggtcgagaaaatcgcagaatataagaggcagaaccctaccatgtttgcctgggagatcagagatcgcctactcgcagaaagagtgtgtgataatgacaccgtaccatctgtcagctccatcaaccggattattcggactaaagtgcagcagcctccaaaccaacctgttccagcctcctcccatagcattgtgagtacagggagtgtaacgcaagtatccagcgtgagcactgactcagcagggagttcatattctatcagcgggatactgggtattacaagtcctagtgctgacaccaataagagaaagcgcgacgaggggatccaggagtcaccagtgccgaacggtcactcattacctggcagagactttctcaggaagcagatgaggggtgacctgttcacccagcagcaattggaggtactcgaccgggtgtttgagaggcaacattactcagatatttttacgacgactgagcctatcaagcctgaacaaaccacagagtatagcgctatggcgagcctggctgggggattggacgatatgaaagcaaatcttgcctcacccacacccgcagacatcggttcgagcgtcccaggaccccagtcctacccaattgtgacagggagggatttagcctccacgactctgcccggttacccgcctcacgtacccccagcaggacaaggctcctatagcgcgcctaccctcaccgggatggtgcctggctcagagtttagcgggtccccatattcccaccctcaatactcgagttataacgattcatggaggtttcccaatccaggcctgttaggtagcccttattattattccgcagcagcacgaggtgcggctccccctgcggctgccacagcctacgataggcactag

SEQ ID NO: 29966 - DNA, 867 bp, Artificial Sequence
  Description of Artificial Sequence: Synthetic coding sequence
atggacctcgagaagaactatccaacacccagaacatcaaggaccggccatggaggagtgaaccaacttggcggagtttttgtaaacgggagaccgctcccagatgtggtgcgacagaggatagtcgagttagcccaccaaggtgtgcgaccttgcgacatctcccgacaacttcgtgtcagccacggttgcgtgagcaagattctggggagatattatgagactggatcaatcaagcctggagtcatcggaggctctaagcccaaggtcgcaactccaaaagtagtggaaaagatagccgagtataagcggcagaaccctacaatgttcgcttgggaaattcgcgatcggctgctcgccgagagggtttgtgataatgacactgtgcctagtgtgagcagcattaatcgcattatcagaacaaaggtgcagcagccccctaaccagcctgttcccgcttcctctcactccatcgtctcaactgggagtgtgacccaagttagttccgtgagcaccgactctgcgggaagctcctattcaatttccggtatccttgggattacttccccctccgcagacacaaataaacgcaagagggatgaaggcatccaagagagccccgtgccaaacgggcacagccttccagggcgtgattttttacgcaagcagatgagaggggatctatttacccagcagcagcttgaagtcctggatcgtgtttttgaaagacagcattattccgatattttcacgaccacagaaccaattaaacccgagcaagctgtaacttggcgcgctagaccttctccaggaacattacatactagcccaccgcttgacagagccgcaacacagcatagaaggtag

SEQ ID NO: 29967 - DNA, 987 bp, Artificial Sequence
  Description of Artificial Sequence: Synthetic coding sequence
atggatctggaaaaaaactatcctacccctagaacctcgcgaacagggcacggtggcgtcaatcagctgggaggtgttttcgtcaacggaaggccactcccagatgtggtgcgtcagcggatcgtggagcttgcgcaccagggggttaggccttgcgacatatcgagacagttgcgagtcagccacggttgtgtgagcaagatccttgggaggtattacgagactgggtcaataaagcccggagtgatcggcggtagcaagcctaaggtggccacgcccaaggtggtcgagaagatcgctgagtataaacgccagaatcctacgatgttcgcctgggagataagagacaggctactcgccgagcgcgtttgcgacaatgatacagttccatcggtgtccagcatcaatcgaatcatacggactaaggtgcagcagccaccgaaccagccagtccctgcctcttcccactctatcgtgtccacgggttccgtgacccaggtaagttctgtatcaaccgactcggctggatccagctatagcattagcggcattctgggaatcacgtcaccaagcgccgataccaataaaagaaagcgtgacgagggaatccaagaatcccccgttccgaacggccactcactgcctggcagagactttttgagaaagcagatgagaggagacttgtttacacagcagcagctcgaggtattagatcgcgtctttgagcgacaacactacagtgatattttcacaaccactgagccaatcaagccagagcagaccacagaatacagtgccatggccagtcttgccggagggctggatgatatgaaagccaacctggcatcaccaactcccgcagacattggttcgagtgttcccggaccacagagctatcctatcgtcacggggagcccctactactatagtgccgctgcccgaggcgctgcccctccagctgccgcaaccgcatatgaccgtcattag

SEQ ID NO: 29968 - DNA, 909 bp, Artificial Sequence
  Description of Artificial Sequence: Synthetic coding sequence
atgttcgcttgggagatacgcgaccggcttctggcggagcgagtctgcgataacgacaccgtcccatcggtgagtagcattaaccggattatccgtaccaaggtgcaacaaccacctaatcagcctgtgcccgcatcaagccacagtattgtctccaccggcagcgtcacacaggtgtccagtgtttccacagactctgccggaagttcctatagcattagcggaatcctcgggatcacgtccccaagtgctgacacgaacaagcgcaagcgcgatgaaggcatccaggaatcaccggtgccaaatggacactcgctccccggacgagatttcttgaggaaacaaatgagaggcgacttgtttacccagcagcaactggaagtgttggacagagtttttgaaaggcagcactactcagacatcttcaccacgaccgaaccaatcaaaccagaacagtggtgtcctgttcttatgcgccagtatttagtgcagccacaagctgttctgtttcagaccaccgaatactctgcgatggcatcactggctggtggactagatgatatgaaggcaaatctcgcgagtccgacccctgccgacattggctcttctgtacctggaccccagagttaccctattgtgactgggagggatttagcttccaccaccttacccggataccctcctcacgtgccgccagctgggcagggcagttattccgcccctacactgaccggtatggttcccggatctgagttcagtggttctccttacagccacccacaatactcgtcttacaatgactcctggagattccccaatcctggcctcctcggcagcccttactactacagtgctgctgctcgaggggctgccccaccagctgccgctaccgcctatgatcgtcactag

SEQ ID NO: 29969 - DNA, 1074 bp, Artificial Sequence
  Description of Artificial Sequence: Synthetic coding sequence
atggatttggagaagaactaccccacaccgcgaacgtctagaactggacacggcggtgtcaaccaactcggcggagtgtttgtaaatgggagacccttacccgatgtggtgaggcagcgaatcgtcgagctggctcaccaaggggtgcgcccatgcgacattagccgacagctgagagtctcacatgggtgcgtgtcaaagattcttggacggtattacgagacgggatccatcaagccaggggtaattgggggttccaagccaaaagtggccaccccaaaggttgttgagaagatcgctgaatacaaaaggcaaaaccctaccatgtttgcttgggagatccgggacagattactggctgagcgggtctgcgataatgataccgtgccgagcgtgagttccataaacaggatcatacgtacaaaggtgcagcagcctccgaaccagcccgtgccagccagcagccatagcatcgtgagtactggaagtgtgactcaggtgtcgagcgtgtctacggactctgccggaagctcttattctatcagcgggatactgggtatcacctcaccctctgcggacactaataaaaggaagagagacgagggaatccaggagtcacctgtaccaaacggtcatagcctacctggcagggattttctaagaaaacaaatgcgcggtgatctgttcacccagcagcagctcgaagttctggatcgcgtttttgagcgtcaacactattccgatatcttcacaacgacagaacccatcaaacctgaacagacgacagaatattctgcaatggcctcccttgccggaggcttagacgacatgaaagccaatctggctagcccaacaccagcggacattgggtcaagtgttcctggccctcagtcgtaccctattgtcacgggcagtgagttctcaggctccccctactctcatcctcagtattcgtcatacaacgactcgtggaggttccctaaccccggattgttaggaagtccttactattactcagccgctgccagaggcgcagctccaccggcagcagcgaccgcatatgataggcactag

SEQ ID NO: 29970 - DNA, 1089 bp, Artificial Sequence
  Description of Artificial Sequence: Synthetic coding sequence
atggatctcgagaagaattatcctaccccacgaacctcacgaactggccatggcggagtgaaccagcttgggggtgtttttgtaaatgggagacccctgcccgatgtggtgcggcagagaattgtggaactggctcaccagggagttcgcccatgtgacattagtagacagctacgagtgtcacacggatgcgtgtccaaaattctgggcaggtattatgagactggctctataaaacccggtgtaatcgggggaagcaagcccaaggttgcgactcctaaggtcgtggaaaagatagccgagtacaaacggcaaaacccaaccatgttcgcttgggaaatcagagaccgccttctggcagagcgagtgtgtgataacgacaccgtcccttccgtgtcttccataaacaggataatcaggactaaagtccaacagcctcccaaccagccagttcccgcttctagtcactctattgtgagtactggatcagttactcaagtcagctctgtctccacagatagcgccggatcttcatactctatctcaggtatacttggtataacaagtccctcagccgacacaaacaagaggaagcgcgacgaagggatccaagagagcccggtgcccaacgggcactccctgccgggaagagacttcctccgcaaacagatgaggggcgatctcttcacgcagcagcaactggaggtgttggaccgggtctttgaaagacagcattatagcgacatctttacaactaccgagcctatcaagccggagcagaccacagagtacagcgctatggcctctctagcagggggactggacgatatgaaggccaacctggcttcgcctacaccggcagacatcgggagcagcgtgcctgggccacagtcatacccaattgtgacggggagagatctggcttctactacactgcctggttatcctccgcacgtacccccagcaggtcagggcagctattcagcgccaactttaacggggatggtgcccggaagtccttactattacagtgcggctgctaggggggctgcaccacccgctgccgcaacagcatatgatagacactag

SEQ ID NO: 29971 - DNA, 1047 bp, Artificial Sequence
  Description of Artificial Sequence: Synthetic coding sequence
atggatctggaaaagaactaccccacaccacggacaagccggactgggcacgggggtgttaaccagctgggaggtgtgtttgtaaacggacggcctctacctgatgtggtgaggcaaaggattgtagagcttgcacaccaaggggtgcgcccttgtgacatcagccggcaactgcgcgtgtcccacgggtgcgttagtaagatcctgggcaggtactacgagactggtagtatcaagcccggagtgattggcggatctaagcctaaagtagccacaccaaaggtggtggaaaagatcgcggagtacaagcgccagaatccgaccatgtttgcgtgggaaatcagagaccggttactggctgagcgagtttgcgacaatgatacagtcccctctgtgtccagcattaataggattattcgtacgaaagtgcaacaacctcctaatcagccagtcccagccagctctcattccatcggcatccaggaaagccccgtccctaatggccacagtttacccggacgggatttcttgcggaaacaaatgagaggcgacctgttcacacaacagcaactggaagtgctagatagggtattcgaacggcagcactatagtgacatcttcacgactacagagcctattaagccggagcagaccacagagtactcagcaatggccagcctggcaggcggtctggacgacatgaaagcaaatcttgcctccccaacacctgcagatatcggctcctcggttccaggtccacaatcatatcccattgtgacagggcgagacctcgcttccaccactctgcccggttaccccccacacgtgccgccagctggccagggttcatatagcgcacccacactaacagggatggttcccggatcagagttctctggctccccatatagtcacccgcagtacagctcctataatgactcgtggcggtttcccaatcctggattactggggtctccctattattactctgccgctgccaggggtgcagcacctcctgctgcggcaaccgcatatgaccgacattag

SEQ ID NO: 29972 - DNA, 876 bp, Artificial Sequence
  Description of Artificial Sequence: Synthetic coding sequence
atggatcttgagaagaactaccctacaccgcgaactagccgcactggccacggcggtgtgaaccaactagggggagttttcgtcaatgggaggccgcttccagatgtggtacgccagagaatcgtcgaactagcccatcagggggtccgaccctgcgacatatccagacagctcagagtgtctcacggctgcgttagcaagatcttggggaggattattcgaaccaaagtacagcagccccctaaccagccagtgccagcctcatctcattcaattgtgtctaccggtagtgtcactcaagtgagcagcgtttctacggacagtgcaggaagttcatactcaatcagcggaattctgggcatcacatccccgtcggccgatactaacaagcgtaagcgcgatgagggaatccaggagagtcccgtaccaaatggtcacagtctgcctgggagggacttcctgcgtaagcagatgcgtggcgacctgttcacacaacagcaactggaagtgctagaccgtgttttcgagaggcagcactactccgatatatttactacaaccgaaccaatcaagccagagcagacaaccgaatactctgcaatggccagcctggccggtggtctcgatgatatgaaagctaatctggcctctccaacccccgcagacataggatcatccgtgcctgggcctcagtcctaccccatcgtcacaggctcggagttttccgggtccccttactcccatcctcagtattcaagttacaatgatagttggaggttccccaaccctggcctcctggggtctccctattactactcagccgcagcgcgaggagccgcacccccagcagctgcgacagcttatgatcgccactag

SEQ ID NO: 29973 - DNA, 960 bp, Artificial Sequence
  Description of Artificial Sequence: Synthetic coding sequence
atggacctggagaagaattatcccacccctaggacatcccgcacgggacacggcggagtgaatcagcttggaggtgtttttgtgaatggcaggccacttcccgatgtagtgcggcagaggatcgtggaactcgcccatcaaggagtacggccatgcgacataagtcgccaactccgcgtgtcccacgggtgtgtgagcaagattctcggaaggtactacgagaccggctccatcaaaccaggcgttatcggtgggagcaaacctaaggtggcaactccgaaagtcgtcgaaaaaatagccgaatataaacgtcagaaccccacaatgtttgcctgggagatcagagaccgtctcctggctgaacgggtttgcgacaacgatacggtgccctctgtgtcctcaataaatcgaatcatccgaacgaaggttcaacagcccccaaatcagcctgtgcctgcaagctcccattctattggcatccaggagtcccccgtaccaaatggacattcattgccagggagggactttttgaggaaacaaatgaggggcgacctctttacccaacagcagctggaggtgctcgacagagtgtttgaacgacaacattactccgacatctttacaactacagagccaattaagccggaacagacaaccgaatactcagccatggctagtctcgccggaggattggacgatatgaaggccaatctggcatctcctacacctgccgacataggctcctccgtgcctgggccacaatcctacccaatcgtcactggtcgtgaccttgcttccactaccctcccaggataccctccccatgtgccacctgccggacaaggctcatactctgcacctactctcacaggaatggtgccgggaagcccatattattattccgcagcagcgaggggagccgctccaccagcagccgcaacagcctatgatcggcattag

SEQ ID NO: 29974 - DNA, 852 bp, Artificial Sequence
  Description of Artificial Sequence: Synthetic coding sequence
atgtttgcttgggagatcagagatagactacttgcggaacgcgtctgcgataatgatactgtgccatccgtgagcagtatcaaccggataatccgaactaaggtgcagcagccacccaaccagccagtgcccgcatcctcgcactctatcgtgtccaccggcagtgttacccaggtcagcagtgtgtcaactgacagcgcgggatcaagttattccatcagcggcatcctcggcatcacctcacctagtgcggatactaataagcgcaaacgggacgagggaattcaagaatcccccgtaccaaacggccactcgctccccggtagggactttctccgaaagcagatgcgcggagacctctttactcagcagcaactggaggtgctcgacagagtgtttgaacgtcagcactactctgacatttttaccacaactgagccaataaaaccggaacaaacgacagaatattcagccatggccagcttggcaggcggacttgatgatatgaaagcgaacctcgcctcgcccacaccggctgatatcggttcctcagttccgggaccccagtcataccccattgttacaggccgagatcttgcatctaccacccttcccggatatccgccacatgtccccccagccggacagggtagctacagtgcccctaccctgaccggtatggtacctgggtctgagttttccggatccccctactcccatccgcagtattctagttataacgacagctggagattcccaaacccaggtcttctggggtctccttattactacagtgctgccgctaggggcgcagctccacctgctgctgccaccgcgtatgatagacactag

SEQ ID NO: 29975 - DNA, 924 bp, Artificial Sequence
  Description of Artificial Sequence: Synthetic coding sequence
atggacctagaaaagaattaccctacacccagaaccagtcggaccgggcatggcggtgtaaatcagctggggggtgtgtttgtcaacgggcgacccctgcctgacgtggtgaggcagcgtattgtggaacttgcccaccagggagtgcgtccatgcgacatttctcgccaactgagagttagccacggctgcgtctctaagatcctggggcgatactatgagactggaagcatcaagcccggtgtgattgggggatctaagccaaaggtggctaccccaaaagtagtggagaaaatcgcggagtacaagcggcagaacccgaccatgttcgcttgggaaatacgcgatcgattactggcagaaagagtgtgtgacaacgatacggtgccctccgtgtcatctatcaaccgaatcattagaaccaaggtccagcaacctcccaatcagccagtacctgcttcatcccattcaatagtaagcaccggttcagtcacgcaggtctccagtgtgagcacagacagcgccggtagcagctactccatcagtggtatcttgggtatcacttccccttctgctgacacaaataagaggaagcgggacgagggaatccaagagagccccgttcccaacggccactccctgcctggacgagattttctgcggaaacaaatgaggggggatctgtttacccagcagcagctggaggttctggacagggtgttcgagcgacagcactactcagacatttttaccacaactgaacctataaaacccgaacagtggtgcccagttctcatgcgacagtatctggtgcagccacaggctgtgttattccaggccgtcacatggcgagcacgccctagtcccggaactcttcatacaagccccccactcgatcgtgctgcaactcagcacagacggtag

SEQ ID NO: 29976 - DNA, 1197 bp, Artificial Sequence
  Description of Artificial Sequence: Synthetic coding sequence
atgccacataactccattagatccggccacggcggactgaatcaactcgggggagctttcgtgaacggacgcccacttccagaggttgtcagacagcgcattgttgatttggcacaccagggtgtacgcccttgcgatatatcccggcagctgcgcgtgagtcatggttgcgttagcaagattctgggacggtattatgaaacaggctccatcaggccaggcgttattggcggtagcaagcctaaggtggccactcctaaagtggtagagaagattggagactacaaacgacagaaccccacgatgttcgcatgggaaatccgcgatcggcttctggctgaaggagtctgtgacaacgacactgttccctccgtctccagcattaatcgaatcatacgtacaaaagtgcagcagcctttcaacctccctatggacagttgtgtagcaactaaaagtctctcccccggtcacactctgattccttcaagcgccgtgactccacctgaatctccccagtctgatagcctgggaagtacctactccatcaatggccttctcggcattgcacagcctggatccgacaaaaggaaaatggatgattcagatcaggactcttgccggcttagtattgattcacagagcagttcctccggtcccagaaaacatctgaggacggatgccttctcccagcatcatctcgaacccttggaatgcccctttgaaagacagcactatcccgaagcgtacgcctccccgtcccataccaaaggcgaacagggcctgtacccgctccccctgttgaactccacacttgatgatggtaaagccacgctaacaccaagtaacacacctttgggtaggaacctatctacacatcagacgtacccagtggtggccgctccacctttctggatatgttctaagagcgcaccaggttctcgtcctagtatgccattccctatgctcccaccatgtactggcagttcacgcgcacgtccttcatctcagggagagcggtggtgggggccacgatgcccagatacccacccaacctctccaccagctgaccgggctgccatgcccccacttccctcacaggcttggtggcaggaggtgaacactctcgcaatgccgatggccacacctcctaccccaccaacggcaagacccggagcttctccaacaccagcatgctag

SEQ ID NO: 29977 - DNA, 966 bp, Artificial Sequence
  Description of Artificial Sequence: Synthetic coding sequence
atgccccataatagtatccgcagcgggcacggcggattgaaccaactgggtggtgctttcgtgaatgggaggccactcccagaagtggtgcgacagcgaatagtcgatctcgcacatcagggagtgaggccgtgtgacatcagccgacaactgagagttagccacggctgtgttagcaagatattggggagatattatgagactgggagcattaggccgggtgttatagggggtagcaaaccgaaagtggccaccccaaaggtcgtagagaaaattggagactataaaagacagaacccaacaatgttcgcctgggaaattcgcgaccggctgctcgcggaaggtgtgtgtgacaatgatacagtccctagcgtgagttccatcaataggattattaggacaaaggttcagcagcccttcaacctgcccatggattcttgtgtggctactaagagtctcagtcctggccacactctgatcccctctagcgctgtcacacctccagaatctccacagagtgattctctgggaagtacatactctatcaacggtcttctgggaatagcccagccgggttccgataagaggaagatggatgacagcgatcaggactcttgtaggctaagcatcgacagtcaaagctcctcctcagggccacgcaaacacctgagaacagacgcctttagccagcaccaccttgaaccgctcgagtgtcccttcgaacggcagcactacccagaagcatacgctagcccatcccatacaaagggcgaacagggagagcgatggtgggggccacgttgcccagatacgcatcctacctcaccaccagctgatagggctgccatgcctcctctgcctagtcaggcttggtggcaagaagtgaatacactcgcgatgccgatggccacacctcccacacccccaaccgcgagacccggtgccagccccacccctgcgtgctag

SEQ ID NO: 29978 - DNA, 1197 bp, Artificial Sequence
  Description of Artificial Sequence: Synthetic coding sequence
atgccccataatagtattagatctggacacggcggacttaatcagttgggtggagcatttgtcaacggacgccctcttccagaggtcgttcgtcagaggatcgtggacctggcccatcaaggagtacggccttgtgatatttccaggcagctcagggtgagtcacgggtgtgtgagcaagatattggggagatactatgagaccggaagcattcgccctggggtcattgggggtagcaagcccaaagtcgcgacacccaaagttgtggaaaagattggcgactacaagcgccaaaacccaaccatgttcgcttgggagatacgtgataggctcctcgcagaaggtgtgtgtgataacgacacagtcccctcagtctcctcaattaaccgaatcatccgcaccaaagtacagcagccgtttaatctgccgatggactcttgcgtcgctactaagtccttgagccccggacacactctgattccttcgagtgccgtgacacccccagagtcaccccagtccgactctctcggatctacatactcgataaacggtctgctgggcattgcccagcccggatccgacaagcggaagatggacgacagcgatcaggacagctgcagactatcaattgattcacaaagttcctcatcagggccaagaaagcacctgcggacagatgctttttcacagcatcatttagagccattagagtgcccgtttgaaaggcaacactatcccgaggcctacgcatccccctcccatacaaagggggagcaggggctgtaccccctaccactgctgaactcaactttggatgacggcaaggcaactctaacaccgtctaataccccactgggccgaaatctgagtacccaccaaacctacccagtggtagccgcaccacccttctggatttgcagtaagtctgctcccggttctaggccctcaatgcccttccctatgttgccgccttgtaccggaagctcacgcgcacgccctagctcacaaggtgaacgctggtggggccctcgctgtcccgacacccatcccacatctcccccagccgacagggccgctatgcccccactgccctcccaggcctggtggcaggaagttaacacactcgccatgccaatggcaactccgcctacacctcccacggcacgacctggtgcttccccgacaccagcatgctag

SEQ ID NO: 29979 - DNA, 864 bp, Artificial Sequence
  Description of Artificial Sequence: Synthetic coding sequence
atgccacataacagcatccggtctggacacggaggattgaatcagctcggaggagcctttgtcaatggaagaccactccctgaggttgtcagacagaggatcgttgacttagcacatcaaggggtgcgaccttgcgatatctcccggcagctgagagtatcccacggatgtgtatccaagatcttggggagatactacgaaacagggtcaatcaggcctggagtcattgggggatccaagcctaaagtcgccacacccaaggtggtggagaaaattggagactacaaaagacagaaccccaccatgttcgcctgggagatacgcgaccgtcttttggccgagggcgtatgcgacaatgataccgtccctagcgtatccagcatcaacagaataattcgaactaaagtgcagcagccttttaatttgcctatggattcctgcgtagccaccaagtccttgtcccctggtcacactctgatcccatcctctgccgtcacgccaccagagtcaccccagagcgacagcctcggtagcacctactcaatcaatggcctgttgggcatcgcccaaccaggcagcgacaaacggaagatggacgacagtgatcaagacagttgccgcttatccatcgactctcagagctcctcctcaggtcctagaaagcatttgagaaccgacgccttttcccagcatcatttggagcccttggagtgccccttcgagcgccagcactatccggaagcctacgcctctcccagtcacaccaaaggagaacaggaggtcaacaccctagccatgcctatggccacgcctcctacaccccctacggccaggccaggcgcaagcccaactcccgcttgctag

SEQ ID NO: 29980 - DNA, 1353 bp, Artificial Sequence
  Description of Artificial Sequence: Synthetic coding sequence
atgccccataatagcattagatctggtcacggcggtctcaaccagttaggaggggctttcgtcaacgggagaccattaccagaggttgtacggcaacgcattgtggatctggcgcaccagggcgtgcgaccttgcgacatatcacgtcagttgcgcgtctcgcacggttgtgtctctaagatcctggggaggtactacgagaccggtagcatcaggcccggtgtgattggcggttcgaaacctaaagttgccaccccgaaggtggtcgagaagataggggactataaacgtcagaatccgactatgttcgcctgggagatccgtgataggcttctggctgagggtgtgtgtgataacgacactgttcccagtgtcagtagtatcaaccggattatccgaacgaaggtgcagcagccttttaacctgcctatggacagttgtgtggcgaccaaaagcctgtctccgggacacacattaatcccaagttccgccgttacaccgcctgagtctccccaaagtgactccctgggtagtacatacagtatcaacgggctgctgggcattgcacaacccggtagtgacaagcggaaaatggacgatagtgatcaagactcttgccgcctttcgatcgactctcaaagttcaagcagcggcccacgcaagcatctgcgaaccgatgcattcagccagcatcacctcgagccacttgaatgtcccttcgaacggcaacattatcctgaggcctacgcatcacccagccatactaagggagagcagggtctgtatcccttgcctctgctgaacagcacactggacgatgggaaggccacattgactccctcaaacacaccactgggaagaaaccttagcacacatcagacctaccctgtcgtggcagaccctcactctcctttcgccattaaacaagagacacccgaagtgagctccagttctagcacgccttcttccctatctagctcagccttcttggatttgcagcaggtcggatccggggttcccccttttaacgcgtttcctcacgccgcttccgtgtatggccagttcaccggtcaggccttactgtcaggaagagagatggttggtcctactctgcctggttaccctccccatattccgacctccggtcagggctcatatgcctcatctgctattgccggtatggtggccggttctgagtactcaggcaacgcatatggtcacactccctacagctcttattccgaagcctggagattcccaaatagttccctcctgtccagcccatactattactcaagtacaagccgcccatccgctcctcccacgactgcaaccgcgttcgaccacctatag

SEQ ID NO: 29981 - DNA, 570 bp, Artificial Sequence
  Description of Artificial Sequence: Synthetic coding sequence
atggctagcaaaagagctctggtgattctggctaaaggggctgaggaaatggagactgtcattccagttgacgtgatgcggcgagccggtatcaaggtcactgtggccggactagccggaaaagatcccgtacagtgctcccgcgatgtggtgatttgcccagacgccagcctggaggatgctaaaaaggagggaccgtatgatgtcgttgtgttgcccggtggtaacctcggtgctcagaacctaagcgaatccgcagcagtgaaagagatactcaaggaacaggagaaccgaaagggactaatcgctgccatatgtgcaggccctactgctttgttagctcatgaaataggattcggctctaaagtcacaacgcatcctcttgctaaggataaaatgatgaatggaggacactatacctattcagagaacagagtagagaaagatggcctgattctgaccagtcgcggtcccggaaccagcttcgaattcgctctggctatcgttgaggcattgaatggaaaagaggtggcagcccaggtgaaggccccactggttctgaaagattag

SEQ ID NO: 29982 - DNA, 570 bp, Artificial Sequence
  Description of Artificial Sequence: Synthetic coding sequence
atggcgagtaagcgggctttggtgatcctcgcaaagggggcagaagaaatggaaaccgtgattcccgtggacgtcatgcgtcgggcaggcattaaggtgacagtagcgggtctagcaggcaaagaccccgtgcaatgcagcagggacgtcgtgatctgtcccgatgcctcccttgaggacgccaaaaaagagggaccatatgacgttgtcgttctgccaggtggtaatttgggagcccaaaacctttccgagagcgcggctgtgaaggagatcctaaaagagcaggagaaccgcaagggactgattgcagccatttgtgccggacccacagctctgctggcgcatgagattggcttcggatcaaaagtcactacccaccctttagctaaagacaagatgatgaatggcggacattatacttacagcgagaatcgtgtggaaaaagacggcctaatcctcacttcccgaggacccggaacctccttcgaattcgccctcgctatagtagaagcactgaacgggaaggaagttgcagcccaggtcaaagctcctctagttctgaaagactag

SEQ ID NO: 29983 - DNA, 570 bp, Artificial Sequence
  Description of Artificial Sequence: Synthetic coding sequence
atggcatccaagagagccttagtgattctggctaaaggcgctgaggagatggagaccgtgatccctgtcgatgtgatgaggcgggcaggaatcaaggtgacagttgccggactggccggtaaagatcctgtccagtgtagccgagacgttgttatctgcccagatgcctccctggaagacgcaaaaaaagagggcccatacgatgttgtggtgctgcctggtggcaacttaggggctcagaacttgagcgaatcagccgctgtgaaagaaatacttaaagaacaggaaaatcggaagggactgattgctgctatttgcgcaggcccaacagcgctgctagcccacgagatagggtttggcagcaaagtcacaacccaccccctggccaaggataaaatgatgaacggtgggcactacacgtattctgagaatcgcgtcgagaaagatgggctaatcctgacatctcgaggacctggcactagcttcgaatttgctctagcaatagtcgaagccctgaacggtaaagaagtggccgcacaggtcaaagcacccctggtcttgaaggactag

SEQ ID NO: 29984 - DNA, 570 bp, Artificial Sequence
  Description of Artificial Sequence: Synthetic coding sequence
atggctagcaaacgagctttagtgattctggctaagggggcagaagaaatggagacagtgatccccgtggacgttatgcgccgtgcgggaatcaaggtaaccgtggctggcctggcgggaaaggatcccgtacagtgcagtcgagacgtggtgatctgtcctgatgcgtctcttgaggacgccaagaaagagggaccgtatgacgtggtggtgctgcccggtgggaacttaggagcgcagaatctctccgaaagcgcagcagtcaaggagattctaaaggaacaagagaaccggaaggggctgattgccgcaatttgcgcaggtccgactgcccttttagcccatgaaataggatttgggtccaaagtcacaacccacccgcttgccaaggacaagatgatgaacggcggtcattatacatacagcgaaaaccgggtcgaaaaggacggcttaattctgacctcgcgcggaccgggaacttcttttgaattcgctctggccatcgtcgaagcactgaacggaaaggaggttgccgctcaggtgaaggccccactggttctaaaagactag

SEQ ID NO: 29985 - DNA, 3561 bp, Artificial Sequence
  Description of Artificial Sequence: Synthetic coding sequence
atggacgagcctcctgggaagccactgagctgcgaggaaaaggagaaactgaaagaaaaacttgccttcctcaaacgtgaatactctaaaacactggccaggctgcagcgagcccagcgcgctgaaaaaatcaaacatagcatcaagaagacagtggaggaacaggactgtctaagccaacaagacctcagccctcagttgaagcattccgagccaaagaacaaaatatgcgtatatgataaactccatatcaagacccacttagacgaggaaaccggcgaaaagacgtccattaccctcgatgtgggcccagaaagcttcaatccgggtgacggccctgggggtctgcccatccagaggaccgatgatacccaggagcacttcccccacagagtgagcgacccatctggtgagcagaagcaaaagctcccctcccgcaggaagaagcaacaaaagagaacctttatatctcaggagagagactgcgttttcggaactgatagtttgcggctctctggcaaacgtctgaaggaacaagaagagatcagcagcaaaaaccccgcacggagcccagttacagaaataagaacccatctattgagcctcaagtccgagcttcctgatagcccggaaccggtgactgagatcaatgaagactccgtgctcattcctcctacggcacagcctgaaaagggagtggacaccttcttgcggaggcctaacttcaccagagcaacgaccgtgcctctacagacgctgagcgacagtgggagcagtcaacatttggaacatataccccctaagggctcatcagagttaacaacgcacgacctgaaaaatatccgatttactagccctgtaagcctggaagcccagggcaaaaaaatgaccgtcagcacggacaacttactggtgaacaaggccatatcaaagagcggacagctgcccacaagctcaaatctggaagcaaatatttcatgttccctgaatgaactgacatacaataacctccccgctaacgagaaccagaacctgaaagagcagaatcagacagaaaagtcgctcaagagcccttcagatacacttgacggtcgcaacgagaacctacaagagagcgagattctttcccagccaaagtctctgagtctagaggctaccagtcccttgagtgcagaaaagcactcttgcacagtgcccgagggattactgttcccagctgagtattacgtccgaaccaccaggagtatgtccaattgtcagagaaaagtggccgtcgaggcagtgatacagagccatctggatgtgaagaaaaaaggttttaagaacaaaaataaagatgcttcaaagaacctcaacctctcaaacgaagaaacagatcaatcagagattcggatgtctggcacctgcacaggacagccgtccagcaggacgagccaaaaacttttatctttgacgaaggttagctcaccagctggacccacagaagataacgatctcagcagaaaggctgtggcacaggccccagggaggcggtataccggaaagaggaaatctgcatgtacacctgcaagcgaccattgtgagcccctgctgccgaccagttcgctgagtatagtgaatagatctaaggaggaggttacatcccacaaataccagcacgaaaagctgtttattcaagtgaaaggtaagaaaagcagacaccagaaggaggacagcctctcatggagtaacagcgcatatctgtccttggatgacgacgcgtttactgccccattccatcgcgatggtatgttgtctcttaaacagctgttgtcctttttgagcattactgatttccaactgcctgacgaggatttcggtcctcttaagcttgaaaaggtgaagtcctgctcagagaagcccgtggagccattcgagtctaagatgtttggtgaacgccatttgaaggaggggagttgtattttcccggaagaactaagtcccaaacgaatggacaccgaaatggaagatctggaggaagatttgatagtccttccagggaaaagccacccaaagcgacccaactcacagagccagcacactaagaccggcctgagttcgtccatattgctgtatacccccctgaatactgtggctcccgatgacaatgatcgcccaaccactgatatgtgctcacccgctttcccaattctgggcaccactcctgcgtttggcccacagggcagctatgaaaaagccagtaccgaggtggcaggtaggacatgctgtacgccccagctcgcccacctcaaggatagtgtctgtctggctagcgacactaagcaattcgacagcagcggcagtcccgcaaaaccacataccaccttgcaggtctccgggaggcaggggcaacctacatgtgactgcgattctgtacctcctggcactcctccccctatcgagtctttcacatttaaggagaatcaactgtgccggaatacctgtcaggagcttcacaaacattccgtggagcaaacagagacggcagagctccccgcttctgattccataaaccccggaaatcttcagctggtgagtgaattaaagaatccatcaggcagctgcagcgtggacgtatctgcaatgttctgggaacgggctgggtgtaaggaaccttgcatcattacagcctgcgaggatgtggtctcactgtggaaggctcttgatgcctggcagtgggaaaaactgtacacctggcattttgccgaggtgccggtgttgcagatagttccagtacctgatgtctataatctcgtctgcgtagctctgggcaatctggagattagggaaattcgcgcactgttctgttcctcggatgacgaaagtgaaaagcaagtgctgctgaaaagcggtaacatcaaagccgtgcttgggctaaccaaaagaaggctggtgagctcgagcgggacactgtccgaccagcaagtggaggtaatgaccttcgctgaagacggagggggtaaagagaaccaattcctgatgcctccagaagaaactattctcacttttgccgaagtgcaggggatgcaggaagctctgctcggtactaccattatgaataatatcgttatttggaacctcaaaactggtcagctgctgaagaaaatgcatattgacgactcgtatcaagcctctgtctgtcataaagcctattctgagatggggctgctgttcatagtcctctctcatccatgcgctaaggaatctgaaagtcttcgatctcccgtgtttcagctaatcgtgatcaaccctaaaacgaccttgtctgtgggcgtaatgctgtactgccttccaccgggacaggcaggcagatttctagaaggggatgtcaaagaccactgcgctgctgctattcttacctccggaacaatagcaatctgggacctcctgttaggccagtgtaccgccttgctacctcccgtctccgaccaacactggtcctttgtgaaatggtccggcacagactctcaccttttagccggacagaaggacgggaatatttttgtgtatcactatagttag

SEQ ID NO: 29986 - DNA, 4344 bp, Artificial Sequence
  Description of Artificial Sequence: Synthetic coding sequence
atggcttccgccggaaatgccgctgaacctcaggatagggggggaggcggaagcggatgcattggagcacccggacgccctgcgggaggcggaaggaggcgccgaactggcggactacgaagagccgctgcaccagatcgggattacctccaccggccatcatattgtgacgccgcatttgctctcgagcaaatctctaagggaaaggccactggccgaaaggctcctttgtggctgagggccaaattccagaggttactgtttaagttagggtgctatattcaaaagaattgtggcaaatttctcgtggtgggactgctgatttttggggctttcgccgtcggtctgaaggcggctaacctggaaaccaacgtagaggaactctgggtagaagtaggagggagggtcagtcgggagctgaattatactcggcagaagattggggaggaggcgatgtttaatccccaattgatgatacagacccccaaagaagagggagccaacgtgctgacaacggaagcacttctgcaacacctggacagtgctcttcaggcctctagagtccacgtctatatgtacaatcggcaatggaagctggagcacctttgctacaaatccggcgagctgatcaccgagactggctatatggatcagatcatcgaatatctgtacccatgtctgataatcacacctttggattgcttttgggagggagcaaagctgcagagcggtaccgcctacttgctgggtaaaccccctttgaggtggacaaacttcgacccactcgagttcctggaggaattgaaaaaaatcaactaccaggtcgattcgtgggaagaaatgcttaataaagcggaagtggggcacggctacatggaccgcccttgcctgaaccctgccgatccagattgtcccgcaaccgctccgaataagaattctacaaagccccttgacatggccttagtactcaacggagggtgtcacggtttatcacggaaatacatgcattggcaagaagagctaattgtgggtggaaccgtgaagaacagcactggcaaactggtctcagcccatgctctgcagacaatgttccagctcatgacccccaagcaaatgtatgaacatttcaagggctatgagtatgtctcacacattaactggaatgaggacaaagctgcggcaatactcgaggcctggcagcggacctatgtggaggtggttcaccaaagcgtggcacagaattccacccagaaagtgctgtcttttaccactacgactctcgacgatatccttaagagtttctccgatgtgtcggtcattcgggtggcaagtggttatctgctaatgcttgcctacgcatgcctgactatgttacgttgggactgctccaaaagtcagggggctgtggggctagccggagtgctgctcgtggccctgtctgtggccgcagggctcggcctctgctcactgatcgggatatccttcaacgccgctacaacccaagtactgccattcctggcactgggagtcggtgtagacgatgtgtttctgttagcccacgcattttccgaaactggacagaataagcgcatcccctttgaggacagaaccggtgagtgtctgaaaaggaccggcgctagcgttgctctgacctcaatttccaacgtgaccgcgtttttcatggctgctctgattcctatccccgctctccgcgctttcagtcttcaagcagctgtggtggtggttttcaattttgcaatggtactgctgatcttcccagctattctctcaatggatctctacagaagggaggatcgtcgcctcgacattttctgttgcttcactagcccttgcgtgtcgcgcgttatacaagtcgagcctcaggcatataccgatacccacgataacacaagatactcgccccctcctccctactcttcccatagcttcgctcatgaaactcagatcaccatgcagagcacagtgcagctgcgaacagagtacgatccccacacccatgtatactacaccaccgccgagccacgttctgaaatctcggtgcagccagtcaccgtgacacaggacacactgtcttgccaatcgcctgaaagcaccagttccacccgcgacctgctttcacaattcagcgatagcagtcttcactgtcttgaacctccttgtaccaagtggactctttctagcttcgcagaaaagcactacgctccattcctgctgaagcctaaagccaaagttgtggtaatctttctgttcctgggactgctcggggtcagcctctacggcacgaccagagtgagagacggcttagacctgacagatatcgtccctcgcgagacaagagagtacgactttatcgccgctcaatttaagtatttctccttttacaacatgtatatagtgactcaaaaagctgattatccaaacattcagcacctgctgtacgatctccacaggtctttttccaacgttaaatacgtgatgctggaggagaacaagcagctccccaaaatgtggttgcactatttccgagactggctccaggggctgcaagatgctttcgacagtgactgggaaacggggaaaatcatgccaaacaactataaaaatgggtccgacgacggcgttcttgcatacaagctccttgtgcaaaccggatcccgagacaagcccattgacatctcacagcttacgaagcaaaggctcgtcgatgcagatggaattattaacccttctgcattctacatatacctcacagcatgggtgagcaatgaccccgtcgcctatgcggctagccaagcaaacatccgtccacaccggcctgaatgggttcacgataaagctgattacatgcctgagactcgtctgcgaatccctgctgctgagcccattgaatatgcacagtttcccttctatctgaacgggctccgagacactagtgattttgtcgaagcaatcgaaaaagtgaggaccatctgttcaaactatacctctctgggactcagcagctacccgaacggatacccgtttctgttttgggagcagtacatcgggctgaggcattggcttctgttatttatttccgttgttctggcctgcacctttctcgtgtgcgccgtctttttgctcaacccatggacagccggaatcatcgtcatggttctggcactgatgaccgtagagctgttcggaatgatgggactgattggcataaaactttctgctgtgcctgtggtgatcctgatcgccagcgtgggaatcggtgttgagttcacagtgcacgtcgccttagcttttttaactgctattggtgacaaaaatcgccgtgccgtgctggcgctggagcatatgtttgcgcctgtcctggacggcgctgtaagcacactcctgggcgtgcttatgttagccggaagcgaattcgacttcatcgtgagatactttttcgcggtgcttgccatcttgaccatcctgggagtgctgaacggcctcgtgcttttacccgtgctgctctctttcttcggaccgtaccctgaggtttccccagccaacggactgaatcggttgccaaccccttccccagaacctcctccaagcgtggtcaggttcgccatgccccctgggcatacacattctggtagtgattccagcgattctgagtatagctctcagacaaccgtgtcgggcctttcagaagagctgagacattatgaagctcagcagggagcgggaggccctgcccatcaggtgatcgtagaagccactgaaaatcctgtgttcgcccactctaccgtagtccatccagagtcacggcaccaccctccaagcaaccctcggcagcagcctcacctggacagcggttctctccctcctggcaggcaaggccagcaaccacgcagagaccccccacgggagggcctctggccaccgccataccgccctcgacgggacgctttcgagattagtactgaaggacattccggcccatccaaccgggcacggtggggcccaaggggagcccgttcacataaccctaggaatcctgcgtctaccgcgatgggaagttccgtgcccggttactgccagccaataactactgtgaccgccagtgcctccgtgaccgtcgctgttcaccctcctccggtacccggtccaggacgaaatccaaggggtggactgtgccctggctaccctgaaacggaccatggtttgttcgaagatcctcatgtacccttccacgttaggtgcgagagaagagattcgaaagtggaagtgattgagctccaggacgtggagtgcgaggaaaggcctagagggtcatcttctaattag

SEQ ID NO: 29987 - DNA, 1059 bp, Artificial Sequence
  Description of Artificial Sequence: Synthetic coding sequence
aaagccgaagtggggcacgggtatatggatcggccttgtctgaatccagccgatcctgactgccccgcaacagccccaaataaaaacagcactaagcccctggatatggccctggtgctgaacggcggttgtcatggtttatcacggaagtacatgcattggcaagaagagttgattgtcgggggtactgtcaagaactcaactggtaagcttgtgtctgctcacgccctccaaacaatgtttcaattgatgacacccaagcagatgtacgaacacttcaaaggctacgagtacgtaagccatattaattggaacgaggataaggctgcagctatccttgaagcatggcagcgcacttacgtcgaggtggtccatcagagtgttgcgcagaactcgacgcagaaagtgttgtcattcaccacaaccacgctggacgacatcctcaagtccttctccgatgtgtcagtgatccgcgtggcaagtggctatcttctgatggtgcttcctttcctggctttgggtgttggggtagatgacgtgttcctgcttgcccacgcattttctgagacgggccaaaacaagaggataccattcgaagatcgtacaggcgaatgcctgaagcgcacaggggcatccgtagcccttaccagcatctccaacgtgactgcattcttcatggcggctctgatccccattcctgctctgcgcgctttcagtctccaggcagcggtggtagtggtatttaacttcgcaatggttctgctaatcttccccgcaatcctgtccatggacttatatagacgcgaggaccggagactggacattttctgctgttttacatctccttgcgtgtctagagtaatacaggtcgaacctcaggcctacaccgacacccatgacaacactcgctattcacccccacccccttactcctcacattctttcgcacacgaaactcagattaccatgcagtctactgtccagcttcggaccgaatatgaccctcacactcatgtatactatactaccgccgaaccgagatcggaaatatcagtatag

SEQ ID NO: 29988 - DNA, 4341 bp, Artificial Sequence
  Description of Artificial Sequence: Synthetic coding sequence
atggaactcctgaaccggaatcgcctggtgattgtgagccccagatgtacacctcccaaagcatccggcggacccgcacgcagaggcttctacacattccggtctttttgcaaagatgggggtgggggagaggaggaagaggagaacggaggcgaggagaaagacgatcgcggagataaagaaacacgttctgataagggaaaggccaccggtagaaaagcgccactatggttgcgggcaaaattccaacgactgttgttcaaactgggatgctacatccagaaaaactgtggaaaattcctcgtggtgggattgttgatttttggggcattcgccgtgggtctaaaggcggctaaccttgaaactaatgtagaagaactctgggtggaagtggggggtcgcgtcagtagagagctcaactacactaggcagaaaattggggaagaagcaatgttcaatccccagttgatgattcagacaccgaaagaggagggcgcaaacgtgttaactaccgaggctctgctacaacacctggattcggctcttcaagccagtagggtccatgtgtacatgtacaaccggcagtggaagctagaacacctctgctataagagcggtgaactgatcacagagacgggctacatggaccagattatcgagtatctgtatccttgtctgatcattaccccactcgattgcttttgggagggcgctaagttacaatcgggcacggcctaccttctaggtaagcctcccctgcgttggacaaatttcgaccccctcgaatttttggaggagcttaaaaaaatcaactatcaagtggatagttgggaagaaatgttaaacaaggctgaagtgggacatggctacatggatagaccctgcctgaatccagccgatccggattgccccgcaactgccccaaacaaaaactccactaagccattggatatggcactcgtgctgaacgggggatgccacgggctatcgaggaagtacatgcattggcaggaagaattaattgtcggcggaaccgtgaagaactctacgggaaagttggtgtcggcacatgccttgcaaaccatgtttcagctgatgacgcctaagcagatgtacgagcattttaaaggctatgaatatgtaagtcatattaactggaacgaagataaggccgctgcgatattagaggcctggcaacgcacctacgtggaggtcgtacatcagtcggtggcgcagaattctacccagaaggtgctctcctttacgactactactcttgacgacatcctcaaaagtttcagtgacgtgtctgtgatcagagtcgccagtgggtatctcttgatgctagcctatgcctgtctaacgatgttacgctgggattgctcgaagagccagggagcagtgggactggcgggtgtgttacttgttgcactgtctgtggccgctggactaggtctatgcagtctcatcggaatttcattcaacgcagctaccacccaggtactgccttttctggctcttggagtcggcgtagatgatgtatttctgcttgcccacgccttctccgagaccggccaaaataagcgtatcccctttgaggatcggaccggggagtgtctaaaacggacaggagcaagcgtggccctgacatcaatcagtaatgttacggcattttttatggccgcactgattcccatcccagccctgcgcgcattctccttgcaggccgctgttgtggtcgtgtttaactttgccatggtgttgctgatcttccccgcaattctctcgatggatttgtacagaagagaggaccgtcgcctggacatattttgctgctttacaagtccctgtgttagtagggtgattcaggtcgagccccaggcttataccgacacacatgacaacacccgatattccccccctccaccctattcttctcactcattcgcacacgaaacccagatcacaatgcaaagcacggtccagcttcgaaccgagtacgatcctcacacacacgtctactacaccacagcagaacctaggtccgagatcagcgtacagccggtgaccgttacacaggataccttatcttgccagagcccggagagcacctctagcaccagggacttactgtcccaattcagtgatagtagtttgcattgcctggagcctccgtgcaccaaatggaccctgtccagcttcgcggagaagcattatgcaccctttttgctgaaacccaaggctaaggttgtcgtgatttttcttttcctcggtctgcttggagtgagcttatatggaaccacaagggtcagagacggactggatctgaccgatattgtgcctagggagacacgggagtacgatttcattgcagcacagttcaagtacttttctttttacaacatgtatatcgtgacgcagaaggccgattaccccaacatacagcacctgttatacgacctgcaccgctcttttagcaacgtgaagtatgttatgctggaagagaacaagcagttacccaagatgtggttgcattatttcagggactggctgcaaggtctccaagatgcttttgacagcgattgggagaccgggaagatcatgcctaacaattataagaacggatccgatgatggcgttctggcatataagctgcttgtccaaaccggcagcagggataagccaatagacatttcacagttgaccaaacagcgcctagttgacgcagatggtatcattaacccctctgctttttacatttacttaaccgcttgggtcagcaatgacccggtggcttacgccgcttcacaggcaaatataagacctcaccggccagagtgggtgcacgataaagctgattatatgcctgagacccgtctccgaatcccggcagctgagcctatcgagtacgctcagttcccattttacctcaacggactccgagataccagtgacttcgttgaggccatcgaaaaagtacggaccatctgcagcaattacaccagtctcgggctatcttcctaccccaatggatacccattcctgttctgggagcagtatatcggcctgaggcattggctcctgttgttcattagcgtcgtgctcgcctgcaccttcctggtctgtgctgtgttcctattaaacccgtggaccgctggcatcatcgttatggtgctggctctgatgacggtggaactatttggcatgatgggattgattggcattaaactgtccgctgttcccgtcgtgatcctgatcgcaagcgtggggattggagtcgagttcactgtgcacgttgccctagccttcctcactgccattggagacaagaacagacgcgcagttctagcgctggaacacatgttcgcgcctgtgctggacggggctgtgtctactctcctgggagttctaatgcttgctggatccgagttcgactttatcgtgaggtattttttcgcagtccttgcaattctcacgatccttggagtcctcaacgggttggtgctccttccggtgctactgagcttctttggaccatatcctgaggtgagccccgctaacggcctgaacagactgcccacaccatcccccgagccaccaccatcagtggtccgattcgctatgcctccaggccatactcactctggcagtgattcctccgactctgaatacagcagccaaacaacagtctccggattgtccgaggaattgagacactatgaagcccagcagggagctggaggccctgctcaccaggtaatagtggaagccacagaaaatccagtgttcgctcattctactgtggtgcatcccgaatcccgccaccatccgccatccaacccacgccagcagccccacctggattctggcagcttgccccctggccgtcagggacaacagcccaggagggacccaccacgggagggtctgtggccaccaccttacagacccagacgagatgccttcgagatttcaactgagggccactctggaccgtccaacagagcgagatgggggccacggggagcccgaagtcacaacccgagaaacccggcatcaacagcaatgggttctagcgtgccagggtactgccagcccatcactaccgtaacagcaagcgcctcagtcactgtggctgtgcatcctcctcctgttcccggacccggtcggaaccctagaggcggtctatgtcccggatatcccgaaacagatcatgggcttttcgaggacccgcacgtgcctttccatgtgaggtgtgaacggcgagacagcaaagtggaggtgattgaactgcaggacgtggagtgcgaagagaggcctcgtggctcttcttccaattag

SEQ ID NO: 29989 - DNA, 1758 bp, Artificial Sequence
  Description of Artificial Sequence: Synthetic coding sequence
ccctgtcgaaaatcctccgccttgaatagtcctaaggccgctgtggtggtggtgtttaactttgcaatggttctgctgatcttcccggctatactctctatggatttgtatcggagagaggatcgcagacttgacatattctgctgtttcacctctccgtgtgtgtctcgcgtaattcaggtcgaaccccaggcctataccgacacacacgataacacaagatatagtccaccccctccttatagctcccactcttttgcacatgaaacacagataaccatgcagtccactgtacagctgcgcacagagtatgatccccacacccacgtgtattatactacagccgagccaagaagtgagatctcggttcagcccgtgacggtgactcaggataccctgtcctgtcagagcccggagagtacctcatctacccgagacctcctgagtcagttttctgacagctctttgcattgtcttgaaccaccgtgcaccaagtggaccctgagctctttcgccgaaaagcactacgccccttttctcctgaagccaaaagctaaggtggtggtcatcttcttgtttctcggcctgttaggtgtgagtctctatggaacaacacgtgtgcgcgacgggttggacttaaccgacatcgtcccaagggaaaccagggaatatgatttcattgctgcccagttcaaatatttctctttttacaacatgtacatcgtgacacagaaggccgactatcctaacattcaacacctgctctacgaccttcacaggtcattctccaatgtgaaatatgtcatgcttgaggaaaataagcaactgcctaagatgtggctccactactttcgcgactggttacagggacttcaagacgccttcgatagtgactgggaaaccggtaaaattatgccgaataactacaagaatggttctgacgacggtgtgctggcgtacaaactgctggttcaaacaggttctcgagataagcccattgacatcagccagctcacaaagcagagactcgtggacgcagacggaattatcaacccctcagcgttctacatttacttaaccgcttgggtttcaaacgatccggtcgcttacgccgcatcccaggctaacatcaggcctcatcgccctgagtgggtccatgataaagctgattatatgccagagacccgcctgcgcataccggcagccgagcctatagagtatgctcagtttccattttatcttaacggcctccgagacaccagtgactttgtggaagctatagagaaggtgagaacaatttgctccaactatacaagcctaggattgtcttcgtatcccaatgggtatcccttcttgttctgggaacagtatatagggctgcgacactggctactactttttataagcgtggtgttggcctgcacctttttggtttgtgccgtattcttactgaatccatggaccgctggaatcatcgtcatggtcttggccctgatgacagtcgaactctttggcatgatgggcttgatcggcattaagttgtcagcagtaccggtggtgattctcattgcttccgtagggattggtgtggagtttacagtgcatgttgctcttgcattccttacagccattggcgacaagaatcgtagagccgtgctagctctcgaacatatgtttgcacccgtgctcgatggcgctgtcagcacactgcttggggttctcatgctggcaggcagtgagtttgactttatcgtgtag

SEQ ID NO: 29990 - DNA, 729 bp, Artificial Sequence
  Description of Artificial Sequence: Synthetic coding sequence
atgcctccaggccacacccattcgggcagcgattccagcgatagcgagtacagtagccagacaacggtcagcggcctgagtgaggaacttagacactatgaggcacagcagggggctggcggtccagcacaccaggtgattgtcgaagccaccgaaaatccagtcttcgctcattcaactgtagtccacccagagagtaggcatcacccaccctccaatcccagacagcagccacatctcgattctggaagcctaccccctggacggcagggtcagcagccaagaagggaccccccaagagaagggttatggcctccaccctaccgacctcggagggatgcatttgaaatttccaccgaagggcatagcggcccatctaatcgggcaagatgggggcctcgcggagcaaggtctcacaacccaagaaaccctgctagtacggccatggggtccagtgtgccgggatactgccagccaataacaaccgtgaccgcctcggctagcgtgaccgtggccgttcacccccctcccgtacctggccctggcaggaacccacggggaggcctgtgtcctggttacccagagacagaccacgggctgttcgaggatcccacatgcctgtctaccagtggcgttcggggaggcatacgaagatggaagtctttaagctgccgaacctggaatgcccgtagaggtccaggcgaagcggcaccaaccgaaggagattag

SEQ ID NO: 29991 - DNA, 1461 bp, Artificial Sequence
  Description of Artificial Sequence: Synthetic coding sequence
ggaaaagccactggcaggaaggctcctctctggctgcgggcaaaatttcagagactgctgtttaagcttggctgctatatccagaaaaattgtgggaaatttctggttgtgggactattgattttcggagccttcgccgtaggtcttaaggccgcaaacctcgaaaccaatgtagaagagctgtgggtcgaagtcggcggacgagtttcaagagagctgaattacacaaggcagaaaattggagaagaagccatgtttaatccacagttgatgattcagactcctaaagaggagggcgctaatgtgctgactaccgaggctctgctccagcatttggactccgccctccaagcttccagggtccacgtgtatatgtataatcggggtaaaccccctctgagatggacaaacttcgatccgctggaattcctcgaggagctcaaaaagattaactatcaagtggatagctgggaagaaatgctgaacaaggccgaggtgggccatggctatatggataggccatgtctcaatcccgctgaccccgattgtccagcgaccgctccaaataagaacagtacgaagccactagacatggccctcgttctgaatggtggctgccacggtctaagcaggaagtacatgcactggcaagaggagctcatcgtaggcggtacagtcaagaactctaccggcaagttggtgagcgctcacgctctgcaaactatgttccagttgatgacgccgaaacaaatgtatgaacacttcaaagggtatgaatatgtttcccacataaactggaatgaagacaaggctgctgccattctggaggcttggcagcggacttatgtggaagtcgtccaccagagtgttgctcaaaattctacgcagaaggtattgagctttacaactacaactctggacgacattttgaagagtttcagcgacgtgtccgtgattcgcgtggccagcggatacttgctgatgctcgcctacgcatgcctgaccatgttgaggtgggactgcagcaagtcccagggcgcagtagggctggctggtgtgctactagttgccctgagcgtggccgctggattggggctctgctctttgattggtatcagcttcaacgccgcaacaactcaggttctcccattcctggcactcggagtgggggtggatgacgtgttcttgctggcgcacgcattttcagaaacaggtcaaaacaagcgaatcccattcgaggataggacgggggaatgtctgaagcgaacgggggcatcggtggcactcacatcgatctccaacgtcaccgctttcttcatggctgccctgatccccatccccgctctgagggcttttagcttacaatacatcttgatggcccataggggaaggctttcattcaacgacactttatggtgcggaggccttaaaagctacatgcgctttccctacgaagaatag

SEQ ID NO: 29992 - DNA, 3891 bp, Artificial Sequence
  Description of Artificial Sequence: Synthetic coding sequence
atgtttaatcctcaactcatgatccagactccaaaggaggagggggcaaacgttcttacaactgaagcactcttacagcaccttgactcagcgctccaggcctcccgggttcatgtgtatatgtacaacagacagtggaagctcgagcatctgtgctacaagagcggagaattgatcaccgagactggttacatggaccagatcatagagtatctctatccttgtctcattattacaccccttgactgcttctgggagggtgccaagctccagagcggcacagcttatctgctgggaaagccccctttgcgctggacaaatttcgaccccctcgagtttttggaagaactcaaaaaaataaactaccaggttgacagctgggaggagatgctcaacaaagcagaggtagggcatggttacatggataggccctgcctgaatcctgccgatccagactgtcctgccacagcgcctaacaaaaattctaccaagcccctggacatggctttagtgctaaacggaggatgtcatggtctctctcgcaaatatatgcactggcaggaggaactgatcgtggggggtacggttaagaattcaacaggcaagctagtctcagctcacgctcttcagactatgttccaactgatgacgcccaaacaaatgtacgagcactttaagggctatgaatacgtgagtcatattaattggaatgaggataaggccgcagctattctggaggcatggcagcgtacatacgtcgaagtggtccaccaaagcgtggcgcaaaatagcacccagaaagttctgtcctttactactaccacgttagatgacattctgaaatcattttcagatgtgtctgttatccgcgtcgctagtggatatctcctcatgttggcctatgcttgtctgaccatgctgagatgggattgcagcaaatctcaaggcgcagtggggcttgccggagtgctgttggtcgctttatctgtggctgcgggactgggactatgtagccttataggaatcagcttcaacgccgcaaccacacaggtgctaccttttttggccctgggtgttggcgtggacgatgtatttctgttagcccacgcttttagtgagaccggccagaacaaaagaattcctttcgaagaccgcacaggagagtgtctgaagcgcacgggtgcttcggtagcactgacttccatctccaacgtgactgccttctttatggcagcccttatcccgattcccgcattgcgagcatttagcctgcaggccgctgtagtggtggtcttcaatttcgcaatggtgcttttgatctttcctgccattctttccatggacctttacaggagagaggatcggagactagatatcttctgttgctttacgagtccctgcgtttcaagggtcattcaggtggagcctcaggcctacaccgacacgcacgataacacccgctattccccaccacctccatatagctcgcactcttttgcccacgaaacacaaatcactatgcagagcacggtccagctgcgcactgaatatgaccctcacacacacgtctactatacaaccgctgagccaagatcagagataagcgtgcaacctgtgacagtaacccaggatacactgtcttgccagtcccccgagtctacatcttcaacacgcgacctgctgtcccagtttagtgacagttcattgcactgcctggagcctccttgcacgaaatggacactgtcttcttttgcagagaaacattacgctcccttcctgctaaaaccgaaagcgaaagtagtagtcatctttttgtttttgggccttcttggcgtgagtctttacggtacgactcgcgtgcgtgacggtctcgacctaaccgacatagtgcccagagagactcgcgagtatgatttcattgccgcacagtttaaatatttttccttctataatatgtacatcgtgacccagaaagctgattatccaaacatacagcatctgctctacgacctgcatcggagcttcagcaacgtcaagtatgtaatgctggaggagaacaagcagctgccgaagatgtggctgcattacttccgcgattggctgcaaggcctgcaagatgccttcgacagcgactgggaaaccgggaagattatgcccaataattataagaacggaagcgacgatggtgtccttgcctacaagcttctcgtgcagacaggtagcagggataaacccatcgatatttcccagttgactaaacaaaggctagttgacgcagatgggatcatcaacccctctgcgttctatatatacttgaccgcttgggtcagtaatgatcctgttgcctacgcggctagccaggccaacatcaggcctcatcgaccagagtgggttcacgacaaggctgattacatgcctgaaactagattaaggattccagctgcggagcctatagagtacgcccagtttcctttctatctcaatgggctgcgtgatacatccgattttgtcgaagctattgagaaagtccgtacaatctgcagcaattacactagcctgggactcagcagctatcccaatggctaccccttcttattttgggaacagtatataggcctgcggcactggttgttactgttcatttcggtggtcttagcctgtaccttcctggtgtgcgccgtctttctgttgaatccgtggacagcgggtatcatcgtgatggtgttagctctgatgaccgtggaattatttgggatgatgggactcatcggcataaagctcagtgctgtgcctgtggtgattttgattgcttctgttgggatcggggtggagttcacagtccatgtggcactggccttcctgaccgccattggagataaaaatcggagggccgtgctcgcgcttgagcacatgttcgcaccagtactggacggagctgtgagtactctccttggagtactgatgctggctggaagcgaatttgactttatagtcagatatttttttgctgttcttgctatccttacaattctgggggtcctcaatggcctcgtactcctgccagtccttctcagcttcttcggaccctacccagaggttagtccggcaaatggactcaatcggctcccgaccccatcgcccgaacccccaccgtccgtggtgcggtttgcgatgccgcctgggcatactcacagcggctcggattcgagtgattccgaatactctagtcagaccaccgtgagtggactgtcggaagagctgcgccattacgaagcacagcaaggggcagggggtccagcgcaccaggtgattgttgaagctaccgagaacccggtgttcgctcactcgaccgtggtgcatcccgaaagccgccaccaccctccctccaatcctcggcagcagcctcatctcgactctgggtctctacctccaggaaggcaaggtcagcagccgcgtagagatcccccaagggaaggactgtggccgcctccataccgtcctaggagggatgctttcgaaatttctacagagggccacagtggcccatctaacagggcgaggtgggggccacgcggagctcggtcccacaatccgcgaaatcctgcctcaactgccatgggaagcagtgtccccggatattgccagccaattacaaccgtgaccgccagtgcctctgtcacggtggccgtccatcctccccctgtgccaggccctgggagaaacccacgcggaggactttgtcctggataccccgaaaccgaccatggcctctttgaagatcctcatgtaccatttcatgtccggtgcgaaagaagggattccaaggttgaggtcattgagctgcaggatgttgagtgcgaagagcgacctcgcggttctagctctaattag

SEQ ID NO: 29993 - DNA, 3891 bp, Artificial Sequence
  Description of Artificial Sequence: Synthetic coding sequence
atgtttaaccctcagttgatgatacaaactccaaaggaggagggagccaatgtgttgacaacagaagcactgttacagcatctagacagtgccctccaagcaagcagagtgcacgtttacatgtataatcgccagtggaagctggagcatctttgctataaatcaggtgagctcataacagaaacagggtacatggatcaaatcattgaatatctctatccgtgtttgataatcacacctctcgattgcttctgggagggggctaagttgcagtcgggaactgcatacctcctgggcaagcctcccctccgctggaccaattttgacccgctcgaatttctcgaagagctaaaaaagattaactaccaggtggatagctgggaagagatgctcaataaggcagaagtgggtcacggatacatggaccgcccttgcctgaaccccgcagatccagactgccctgccacagctcccaataaaaattcaaccaaacctctggacatggctcttgtactcaacggcggatgtcatggactcagccgaaaatacatgcattggcaagaggaattgatcgtagggggaaccgtgaaaaatagcactggaaaactcgtgtctgctcatgcccttcaaaccatgttccagttgatgacacctaaacaaatgtatgaacactttaaaggctacgaatacgtttcacacatcaattggaacgaggacaaagcggctgccatccttgaagcctggcaacggacctacgtcgaagtggttcatcagagtgtggcccagaatagtacccagaaagtgctgtcgttcaccaccacaacactcgatgacattttaaagagcttcagcgacgtctcagtgatcagagtcgctagcggatacttgcttatgctagcctatgcatgcctcacaatgttgcgctgggattgcagcaagtctcagggcgcagtgggactagccggagtgctgcttgtggcactcagcgtggctgcaggactggggttatgcagcctgatcgggatatcattcaatgcagctactacacaggtgctcccatttctagccttaggagtgggggtggacgacgtcttcctgttagcccacgccttttctgagaccggccagaacaagcgtatacctttcgaagataggaccggggagtgtcttaagcgaactggggcatccgtggctctgacgtccatctctaacgttaccgccttttttatggcagccctcattccaatccctgccctcagggccttttccctgcaggccgctgtagttgtcgtcttcaactttgcaatggtgctcctaatttttcccgcaatcctaagcatggatctgtaccgaagggaagatcgcagactggatatcttttgttgtttcactagcccctgtgtgtctagggtcattcaggtggaaccacaggcatacaccgatacacacgacaatacccgttactcaccaccccctccgtattcctctcactcgtttgcccacgagactcagattacaatgcaatccactgtgcaactgcgcacagaatacgatccccacacccacgtttactacaccacggccgagcctcgatctgagatttccgtccagccggtgactgttacccaagatactttaagttgccagtcacccgagtccaccagcagtacaagggacctgctgtcccagttcagtgacagttctctccactgtctagagccaccgtgtacaaagtggaccttatctagcttcgccgagaagcactatgctccgtttctgcttaaaccgaaggccaaagttgtcgttattttcctcttccttgggctgctgggggtgagcctgtacggtaccacccgggtgcgcgacggactagacctgaccgacatagtgcctcgcgagactcgcgaatacgatttcatcgcagctcagttcaagtacttctctttctataacatgtatatcgtgacccagaaggccgattatccaaacatccaacatctgttgtacgatctgcacaggagcttttccaatgtgaaatatgtgatgcttgaagagaataaacagttgccgaagatgtggttgcactatttcagggactggctgcagggactgcaggacgcatttgattcggattgggagactggtaaaatcatgcccaacaactataaaaacggaagcgacgacggagtgctggcctataaactcttagtacagactggctcacgggacaagccgatcgacattagtcagctcacaaagcagcggctggtggacgctgatgggatcatcaacccaagtgccttctatatttacctgactgcctgggtgagtaatgatccagttgcctatgcggcatcacaggccaatattaggcctcataggcctgaatgggttcatgataaggcagactacatgcccgagaccaggttaagaattcctgccgcagaaccgattgaatacgcccaattcccattttaccttaatggcttgcgagatacaagcgacttcgtcgaggccatagagaaagtgcggaccatttgcagcaactatacctcactgggactgagctcatatcccaatggttaccccttcttattttgggaacaatacattgggttgagacactggctcctgttattcatttcggtcgtcctggcttgtacgttcctggtgtgcgcagtctttttgctaaatccatggacagctggtattatcgtgatggtcttggccctcatgactgtcgagctttttggaatgatgggcttgataggaattaaattgagcgcagtgccagttgtgatcctgatcgcatccgttggcattggggtggaattcacggtgcacgtagccctcgcattccttacagccatcggggacaaaaaccggagagctgtgcttgcactggagcacatgttcgcaccagtgctcgatggtgctgtgtccacactgctgggtgttttaatgcttgccggttcagaatttgactttatcgtcaggtatttctttgctgtgttggcgattctgactatcctgggagtgctgaatggccttgtgctactaccggtgttgttatcattctttgggccataccccgaggtgtcccccgctaacggccttaatcgattgcccactccaagccctgaacccccaccatcagtcgtgaggttcgcaatgccacctggacacacccactcaggatcagacagctctgactccgagtattctagtcagactaccgtgtccggactgtcggaggaactgcggcattacgaagcccaacaaggagcaggcggacctgctcatcaggttatagtcgaagccacggagaaccccgttttcgcccattccacagtagtgcatccggaatcgaggcaccaccctccttccaaccccaggcagcagcctcatctcgacagtgggtctctacccccaggccgacagggccaacaacccagacgtgatcctcctcgcgagggactatggcctcccccataccggccacgtcgggacgctttcgagataagcacagaaggacacagcgggccatccaaccgagctcgctggggccctaggggcgcaaggagtcacaaccccaggaaccccgcatcaaccgccatgggctctagcgtaccaggttattgccagccaattaccaccgtcaccgccagcgcgagtgtaacggtcgctgtgcatcctcctccagtgcctggcccagggcgaaacccccgaggcggtctgtgcccaggctaccctgagacagaccacggactttttgaagatccacatgtaccttttcacgttagatgcgagaggcgggatagcaaggtcgaggtaatagaactgcaggatgttgagtgcgaggagaggcccagaggcagcagctccaactag

SEQ ID NO: 29994 - DNA, 3891 bp, Artificial Sequence
  Description of Artificial Sequence: Synthetic coding sequence
atgttcaatccacaactgatgattcaaacacccaaggaggagggggctaatgtattgactactgaagccctcctgcaacacctcgactccgctttgcaggcttctcgcgttcacgtctatatgtacaaccggcagtggaaactggagcacctgtgctataagagcggtgagttaatcactgaaacagggtacatggaccagattattgaatacctttatccatgtctcattataacgcctctcgactgcttctgggagggtgccaagctgcaatcaggcaccgcatatcttctgggcaaaccccctcttcggtggacaaactttgaccccctggagttccttgaggaactgaagaaaataaattaccaagtcgatagctgggaagagatgttgaataaggcagaggtcggacatggctatatggataggccctgcctgaatcccgcagaccccgactgtcctgccacagctcccaacaagaattcgacgaagccgctggacatggcccttgtcctcaacgggggatgtcacgggctcagccgcaaatacatgcattggcaggaagagctcatcgtcgggggaactgtgaaaaactctactgggaaattagtctctgcccacgccctacagactatgttccagctgatgacccccaaacaaatgtacgaacattttaaaggttacgagtatgtctcccatatcaattggaatgaggataaagctgcagctatcttagaggcttggcagcgcacgtacgtggaggtggtccatcaatcagtcgctcaaaactccacccagaaagttctgtctttcactactacaacactcgacgatatcttaaaaagcttctccgacgtatccgttatcagggttgcttcagggtacctgctcatgttagcttacgcatgtcttacaatgctgcgatgggattgtagcaagtcccagggagcagtcggactggccggagttctgcttgttgcattatccgtggctgctggcctcggattgtgctctcttatcggcatctccttcaacgccgctaccacccaggtgctgccattcctggctttgggcgtgggggttgacgacgtgttcctattggcccatgcattctctgagacaggtcagaacaaaagaatcccatttgaagacagaaccggcgagtgcctcaaacgaactggggcatcagtagccctgacaagtatctctaatgtcaccgcattctttatggccgcactgatccccatacctgctctgcgcgcatttagtctgcaggcagcagtggttgtggtatttaacttcgcaatggtgctgcttattttcccagccatcctgtctatggatctgtacagacgggaagaccggcgactggatattttttgctgtttcactagtccatgcgtgtcacgtgtgattcaagttgaaccccaggcttacacagatactcatgataacacccgttatagcccccctccaccatacagctcacattccttcgcacatgagacccaaatcactatgcagagcaccgttcaactcagaaccgagtacgacccgcatacgcatgtctattacacaaccgccgagccacggagcgaaatttcagtccagccggtcactgtgacgcaagataccctgtcgtgtcagtccccagagtccacctcttccacccgagacttattgtctcagttcagcgatagctcgctacattgtcttgaaccgccttgcaccaaatggacactgtcctcatttgctgaaaagcactacgcgcctttcctcctgaaaccaaaagccaaggtggtcgtgatctttctatttctgggtctcctgggagttagcctttacggcaccaccagggtgagagatggactcgatctcaccgacatcgtgcctcgagaaacgcgggagtacgacttcatcgctgctcagttcaagtatttttccttctataatatgtacatcgttacccagaaagccgactatcccaacatccagcacttgttatatgatctgcatcggtcgtttagcaacgtgaagtacgtgatgcttgaggagaataagcagctcccaaagatgtggttacattatttccgggattggttacaggggttacaggacgcctttgatagtgattgggaaaccggaaaaattatgcccaacaattacaagaacggttcagatgacggggtgctggcttataagcttctggtccagacgggcagtcgagataagccgatcgacatctcacagttaaccaagcagcggctggttgatgcagatgggataattaacccatccgctttttacatttatctgacagcctgggtctcaaacgacccagtggcgtacgccgctagccaagccaacatcagaccgcaccggcctgagtgggtgcacgacaaagccgattatatgcctgaaacccgactgcggatccctgctgctgaacctattgaatacgcacagtttcccttttatctgaatggtctgcgggatacttcggactttgtggaggcaattgaaaaagtgcgaacaatctgttcaaactatactagtctgggcctcagcagttatcccaacggatacccctttcttttctgggagcagtatataggcctgagacactggctcctgttatttatttccgtggtccttgcctgcacctttctggtgtgtgccgtgtttctgctaaatccatggaccgcgggtattatcgttatggtcttggccctcatgactgtggaactgtttgggatgatgggcctgattgggattaaactgagtgctgtgcctgtggtgattctaatagccagtgtgggcatcggggttgaattcacggtgcatgttgccctggcattcttgacggcaattggcgacaagaaccggagggctgtgctggcactcgagcatatgtttgcacctgtgctggacggagccgtgtctactttattgggtgtcctcatgttggctggcagcgaattcgattttattgtacgttatttctttgccgtgctggctatcctgaccatattgggggtattgaacggccttgtccttttacccgtgctcctgtcattctttgggccataccccgaagtgagccccgctaacggactgaaccggcttccaacgccctcccctgagcctcctccaagcgtcgtgcggtttgctatgcctcccggtcacacccatagcggtagcgacagctctgacagcgagtatagctctcagaccaccgtctctgggctcagcgaggagctgcggcactacgaggcacagcaaggtgcgggtggccctgcacatcaagtcatagtagaggcaaccgaaaatcccgtttttgcacattccacagtggtgcatcctgaatctcggcatcatcccccatcgaacccaaggcaacaaccgcatctcgactctggctctctgcctcctggacgccaggggcagcagccgaggcgcgatccccctagagagggcctatggcctcctccttacaggcccaggcgcgatgccttcgaaatctcaactgagggtcactccggaccgagcaatcgggcacgctggggtcctcggggagcaagatctcataatcccagaaatccagcatccacagctatgggcagttcggttcccggttactgccagcctatcacaactgtgactgcttctgcgtctgttacagtggccgtgcaccctcctcccgtgccgggtccaggtagaaaccctcggggagggctgtgcccaggttatccagagactgaccatggtctatttgaagatccccatgtcccatttcatgtacggtgtgagcggcgagactccaaggtggaagtgatcgagctccaggatgtcgaatgtgaggaaagaccgcgtggatcttctagtaattag

SEQ ID NO: 29995 - DNA, 4146 bp, Artificial Sequence
  Description of Artificial Sequence: Synthetic coding sequence
atgggtaaggccacaggccgtaaggctcctctttggttgcgagctaagttccagcgtctgctatttaaactgggctgctacatccagaagaattgtggtaagtttctggtggtgggcttgctaatctttggcgcatttgctgtgggcctaaaggctgccaatcttgaaacaaatgtggaggagctttgggtggaagtggggggtcgcgttagtcgggaactgaactatactaggcagaaaattggcgaagaggccatgttcaaccctcaactcatgatccagacacccaaagaggagggcgctaatgtcctgactacagaggccctgctccaacacctggacagcgcactgcaagcctcaagagtccacgtttacatgtacaaccgccagtggaaacttgaacatttgtgttacaagagcggcgagctgatcacagaaaccggttacatggatcaaatcattgaatacctctacccatgcctgataattactcccctggactgtttctgggagggcgctaaattacagtctgggacagcctacttgctggggaagcccccactaagatggactaactttgaccctctggagttcctggaggaattgaaaaaaatcaattaccaggtcgattcctgggaagagatgttgaataaagccgaggtcggccacggatatatggatcgcccttgcctgaatcccgcagacccagattgccctgctactgcaccaaataaaaattcaactaagccactggacatggcgctggttttgaacggaggctgccacggtctatcaaggaagtacatgcactggcaggaggaactgatagtcggcggtactgtgaagaactctacgggtaagctggtctccgctcacgcgctgcagactatgttccagctgatgactccgaaacaaatgtatgaacactttaagggttatgaatacgtatcccacattaattggaatgaggataaggcggctgcaatcctcgaggcatggcagcggacctacgttgaagtggtgcatcagtccgtggcgcagaactctactcagaaagtgctcagcttcactacgactaccctcgatgatattctgaaatctttcagtgatgtgtctgtgattagggtggcctcaggctacctcttgatgcttgcttacgcatgcctgactatgttgcggtgggactgctcgaagtcccaaggtgcagtcggcttggctggggtgcttcttgtcgccctgtctgttgccgctggtctagggctatgttcactcattggtatttctttcaatgccgcaacgacacaggtgttaccttttttagccctaggggtgggtgtggatgacgtttttctactcgcccatgcattcagcgagactggacagaacaagcgcattcccttcgaggatagaaccggcgagtgcctgaaacgcaccggagctagcgttgccctcacgtccatctctaatgtgacagcttttttcatggctgctcttataccaatacccgctctgagggccttcagtctgcaagcagctgtcgtagttgtgtttaattttgctatggtgctgctcatctttcctgcaatcctgtctatggatttataccggcgagaggaccgtcggctcgatatcttttgttgctttacttcgccatgtgtgagccgcgtcatacaggtggagccccaggcttatacagatacccatgataatactaggtacagccctccccctccatatagtagtcacagcttcgcacatgagactcagatcaccatgcagtccaccgtacagttacggaccgagtacgatccgcatacccatgtgtactacaccacggccgaacccagaagtgagatctctgtgcagccagtgaccgtgactcaggacacgctttcatgccaaagcccagagtctaccagttcaacgagggacctcctgagccagtttagcgatagttcacttcactgtctggagcctccctgcactaagtggacattgagctcttttgctgagaaacactatgcgccatttcttctgaaacccaaggcaaaggtggtagtgatttttctgttccttgggctgcttggagttagtctctatggaaccacacgtgttcgcgatgggctcgacctcacagatatcgtgccacgcgagacccgggagtacgattttattgccgcacagtttaaatatttctcattttacaatatgtatattgtcacgcagaaagcagattatcccaacattcaacatctactgtacgacctgcataggagcttctccaatgtgaaatacgtgatgctagaagagaacaaacagctaccaaaaatgtggcttcactatttccgggactggctacagggccttcaggatgccttcgactcagactgggaaactgggaaaatcatgccaaataactataaaaatggttcagatgatggagtgctggcttacaaactgctcgtccaaacaggcagcagagacaagcctatagatatcagccagctcacaaagcagagattggtggacgccgacggaattatcaacccctccgctttctatatctatttgactgcttgggttagtaacgatcctgtggcgtatgcagctagccaagccaatattagaccccatagaccagagtgggtgcacgacaaggccgactatatgcctgaaacccgtctcaggataccggctgcagagcctatcgagtatgcccaatttccattctatttgaatggacttcgtgacaccagcgatttcgtggaagcgattgagaaggtccggacgatctgctccaactacacttcattaggtctctcaagctaccctaacggttatccatttctcttctgggagcaatacattggccttcgccactggcttctgctcttcatttcagtggtgctggcttgcaccttcctggtgtgcgccgtgtttcttttgaatccctggaccgctgggatcatcgtgatggtgctcgcactcatgacagtcgagttgtttggaatgatggggctcatcggcattaaactcagcgccgtcccagtggttatcttgatcgctagcgtcggcatcggggttgagtttacagtgcacgtagccctcgcttttttaacggcaatcggggacaagaaccgtagagcagtcctggccctcgaacatatgtttgctcctgtgctggacggtgccgtcagtactttgctcggcgttctgatgctggcgggttctgagtttgattttattgttagatacttcttcgccgttctggccatcctgaccatcctgggggtgttaaatggcctcgtactgctacccgtgcttctgagcttcttcggcccttaccccgaggtttctcctgccaatggtctgaatcggctgcccaccccttcccccgagcccccaccaagtgtagttcgcttcgcaatgcctcccggacacacccactccggtagcgattctagtgactccgaatacagctcccagacgacagtcagcggactgtcggaggagctcaggcactacgaggcccagcagggggctgggggtccagcccatcaagtcatcgttgaagcgacagagaatccggttttcgcgcactccacagttgtacatcccgagtcaagacaccacccgcctagcaacccgagacaacagcctcatttagacagcggctcgctaccccctggaaggcaggggcagcagcctcgaagggatcctccacgcgaggggctgtggccgccaccttaccgccctcgcagagacgcattcgaaatctctaccgaaggtcacagtgggccatctaatcgggcaagatggggcccacgcggagcacggtctcacaacccccgtaatcctgcctcaaccgcaatgggaagctctgtgcccggttattgccagcctattactactgttaccgcgtctgcctcggtcaccgtcgctgtgcatcctccccctgtgcctggacccggtaggaacccccgaggaggcctgtgcccagggtaccctgagacagatcacggactcttcgaagaccctcacgtgccttttcatgtacggtgcgagaggcgcgacagcaaagtagaggttattgagttgcaggacgtggagtgtgaggaaagaccacggggaagctcttcaaattag

SEQ ID NO: 29996 - DNA, 4146 bp, Artificial Sequence
  Description of Artificial Sequence: Synthetic coding sequence
atgggcaaggccacaggacggaaggcccctttgtggctgcgggctaagtttcaaaggctgctgttcaagctggggtgttacatccagaaaaattgcggaaagttcttggtggttggactcctcattttcggggcatttgcggtgggcctgaaagcggcaaatctggagacaaacgtggaggaactctgggtagaagtgggcggaagggtaagcagggagctgaattacacacggcaaaagatcggtgaagaggcaatgttcaatccacagctgatgattcaaacaccgaaggaggagggagctaatgtcctgactaccgaagctttgcttcagcacttggactctgcacttcaggcttctcgcgtccacgtgtacatgtacaaccggcagtggaaactggagcacctctgctacaagagcggagagctgattaccgaaacggggtatatggaccaaattatcgagtacctgtacccatgtctgattataacgccgctggattgcttctgggaaggtgccaaactgcagtccggcacagcatacctcctaggcaagccccctctgaggtggaccaacttcgatcccctggaatttttggaggaactgaagaagattaactatcaggttgattcatgggaggagatgctcaataaggccgaggtcggacacgggtatatggatcgtccatgcctgaatcccgcagatcccgattgcccggctacagccccaaacaaaaattccaccaagccccttgacatggctctggtcctaaacggaggctgccacggcctgagccgcaagtatatgcattggcaggaggagctgattgtggggggtacagtgaaaaattccaccggcaaactggttagcgctcatgcgctccagaccatgttccagctcatgacaccaaagcaaatgtatgaacattttaagggctatgagtacgtcagccatatcaattggaatgaagacaaggccgcagctattcttgaggcttggcagagaacctacgtggaggttgtgcatcagagtgttgcccagaattcgacccagaaggtgctcagtttcactactacaacactggacgatattctcaagtcattttctgatgtgtctgttattagggtggcaagcggttatttgctgatgctggcttatgcctgtcttactatgctgaggtgggattgctcaaagtcacaaggtgccgtcggcctggccggagtgcttcttgtcgccctgagcgtggccgcaggcttgggactgtgctcgttgatcggcattagctttaacgctgctacaacacaggtccttcctttcctagcactcggagttggagtggatgacgttttccttcttgcacacgccttttctgagacaggacaaaacaaacgtatcccgtttgaagacagaactggggaatgcctgaaacgcaccggtgcatctgtcgctctcaccagcattagtaacgtgaccgcatttttcatggctgccctgattcccattcctgcacttcgggcttttagcctgcaggcagctgtggtggtcgtgtttaacttcgctatggtactgctgatattccctgccatcctgagcatggacctgtataggcgagaggatcgacggcttgatattttctgttgtttcacaagcccatgcgtgagccgggtcattcaggtagagccgcaggcttacaccgatacccacgataatacaaggtattcacccccacccccttattctagtcactcatttgcccacgagacacagattactatgcaatccacggtccagctccggaccgaatacgacccacacacccacgtttattacacaactgcagaaccgagaagtgaaattagcgtgcagcccgtgacggtgacacaggacaccctgtcctgccagtcccccgaaagtacctcctccacacgggatctgttgtcccagttttcagattcatccctccactgcttggaacccccttgcacgaaatggacattgtctagctttgctgaaaaacactatgctcccttcctgctgaagcctaaagccaaggtcgtagtgatatttcttttccttggccttcttggcgtgtcactgtatggtactacgcgggtgagggacggtcttgatctcacggacatcgtcccacgcgagacccgagagtatgatttcatagccgctcagttcaaatacttttccttttacaacatgtacattgtgacacaaaaagccgattacccaaacatacagcacctgctttacgacttgcataggtccttctcgaatgttaagtatgtgatgcttgaggagaataaacagctgcctaagatgtggctgcactatttccgcgactggttgcagggactgcaggacgctttcgattcagattgggagaccggcaaaattatgcccaataactacaagaatggatcagatgatggcgtgctagcatacaaactcctggtgcagacgggctcccgcgataagcccatcgatattagtcagctgaccaaacaacggcttgttgacgctgacggaatcatcaatccttctgccttttatatctatcttaccgcctgggtaagcaatgaccctgtcgcctatgctgccagccaggccaacatacggccacacaggcccgagtgggtacacgacaaggccgactatatgccggaaaccaggcttaggattccagccgctgagccaatagaatacgcgcagtttcccttctaccttaatggtttgagagatacttcagactttgtagaggctatagagaaggtgcggaccatttgttctaactatacatccctcggcctgtccagctaccctaacggttatcccttcttgttctgggaacagtacatcggtctgaggcactggctgctgctgttcattagcgtcgtcctcgcttgcactttcctagtgtgcgcagtgttcctccttaacccctggaccgctggcattatcgtgatggtgcttgccctgatgaccgttgaacttttcggcatgatgggcctcatcgggattaaactgagtgccgtccctgtggtaatccttattgcctcagtaggtatcggagtggagttcacagtgcatgtggctctggcctttctgaccgccattggagacaaaaaccgtagagccgttctcgcacttgaacatatgtttgcgccagttctggatggcgctgttagtacattgctgggggtgcttatgctggcaggcagcgagttcgattttatagtacgctatttctttgccgtgctcgctatactcaccattctgggcgtgttgaacggtctggtgctactccctgttttgttgtcattttttggcccttacccggaagtgtctcctgcaaatggactgaacagactgcccactcctagccccgagccccctccttccgtggtccggtttgcaatgccacctggccatacgcatagcggctccgattcatctgactctgagtatagtagccagactaccgtttctggcttaagtgaggaattgcgacactacgaggcacaacagggggcaggcggtccagctcaccaggtgatcgttgaagccaccgagaatcctgttttcgcccatagtacagtcgtccatcccgagagtcggcaccatccaccaagcaatcctaggcagcagcctcatctggattccggatcgctaccacccggtagacagggccaacagccgcgtcgtgaccctcccagagaaggactgtggccacccccttatagaccaaggcgggatgcttttgagatttctactgagggacattcggggccatctaatcgagcacggtggggcccacggggtgcccgtagccacaatccacggaatcctgcatcaactgctatgggatccagtgtgcccggttattgccagccaattacaactgtcacggcatctgcatccgtgacagtggcggtacacccccctcctgtgcccggaccaggcagaaacccacgcggtgggctgtgtcccggataccctgaaaccgaccatggtttgtttgaagacccccacgtgccgtttcatgttaggtgtgaaagacgcgatagcaaggttgaagtgatcgagctgcaggatgttgaatgtgaggaacgaccacgcggtagctcgagtaattag

SEQ ID NO: 29997 - DNA, 255 bp, Artificial Sequence
  Description of Artificial Sequence: Synthetic coding sequence
atgggcaaagcaaccggcaggaaggcccctctgtggctgcgggctaagtttcaaaggctcctatttaagttgggatgctatatacaaaaaaactgcggaaaattccttgtggtcggactcctcatatttggggcattcgctgttggattgaaggccgctaacctcgaaaccaatgtggaggagttgtgggtggaggaggtcaatctgttatgcgggggtcagacctcgactttatggaatagttggaaaagctag

SEQ ID NO: 29998 - DNA, 525 bp, Artificial Sequence
  Description of Artificial Sequence: Synthetic coding sequence
atgtttaatccacaacttatgattcaaacacctaaagaggagggggctaacgtcctgacaacagaggcacttctccagcatttggatagcgcccttcaggctagtagagtccacgtgtatatgtataaccgccaatggaagctggagcatctctgttataagtctggcgaactgatcactgagacgggatatatggaccaaattattgaatacctgtacccatgcctcattatcactcccttggattgcttctgggagggggctaagctccagagcggcacggcgtacctgctcggaaaacccccactgagatggacaaacttcgatcctcttgagtttctggaggagctaaagaagatcaactatcaggtcgactcttgggaggagatgctgaataaggcagaggttgggcacggctacatggacagaccctgtctgaatccggcagatcctgactgtccagccacagcacctaacaagaatagtaccaaaccacttgacatggcattggtgctgaatgggtag

SEQ ID NO: 29999 - DNA, 525 bp, Artificial Sequence
  Description of Artificial Sequence: Synthetic coding sequence
atgtttaatccacagctgatgatacagactcccaaagaagagggggctaacgtgctaaccaccgaagctctgctgcaacaccttgacagcgctctgcaggctagtcgggtccacgtatatatgtacaaccgacagtggaagttggaacatctgtgttacaagtccggggagttgataacagagacagggtacatggaccagataatcgagtacttgtacccatgcctaatcataacccccctcgattgcttctgggagggggcaaaactgcagagcggcacagcctacttacttggtaaaccccctctgcggtggaccaacttcgatcccttggaattcctcgaggagcttaagaaaataaactaccaggttgactcctgggaagagatgctgaacaaggccgaagtgggccacggctacatggacaggccgtgcttgaatcccgcagaccctgactgccctgcgaccgcgcctaacaagaacagcactaagcctcttgacatggcgctagtgctgaatggatag

SEQ ID NO: 30000 - DNA, 279 bp, Artificial Sequence
  Description of Artificial Sequence: Synthetic coding sequence
atgttcaacccccagctgatgatccaaactccaaaagaagaaggcgctaatgtgctaactacagaagctttactccaacacctggactctgctctgcaggcatcaagagtccatgtctatatgtataatcgccagtggaaactcgagcacttgtgctataagtccggcgaacttataacagagaccggttatatggatcagattatcgagtatctgtacccttgtttaatcatcaccccattggattgcttctgggagggagctaagttgcagtcctag

SEQ ID NO: 30001 - DNA, 525 bp, Artificial Sequence
  Description of Artificial Sequence: Synthetic coding sequence
atgttcaatccacagttgatgatacagaccccgaaagaagagggtgctaatgtgctgactaccgaagctcttttgcaacacctggattctgccctgcaagccagcagggtgcacgtgtacatgtacaacaggcaatggaaacttgagcacctgtgctataagagcggggagctgatcactgaaacagggtacatggaccagatcatcgaatacctgtacccatgcttgattatcacccctcttgattgcttttgggagggcgcaaagctgcagagcggcaccgcatacttgctcggaaagcccccattaaggtggacaaatttcgaccctttggaattcctcgaggaactcaagaagatcaactatcaggtcgactcctgggaggaaatgctcaacaaagccgaggtcggacacgggtacatggacagaccttgcttgaatcccgctgatcccgattgccctgcaaccgctccgaataagaactccaccaaaccgctggacatggcactcgtgctgaatgggtag

SEQ ID NO: 30002 - DNA, 525 bp, Artificial Sequence
  Description of Artificial Sequence: Synthetic coding sequence
atgttcaatccccagctcatgattcaaacccccaaggaagagggtgccaacgttctgactactgaggccctgctgcagcatctggattccgctctgcaagcaagtagggtgcacgtttatatgtacaataggcaatggaagcttgaacacctctgctacaaatctggggaactgatcactgaaacaggttatatggaccaaatcatcgaatacctgtatccctgcctcattataacgccgctcgactgcttttgggaaggcgctaaactgcagagcggcaccgcgtatttgctgggcaagcccccacttcgttggacgaattttgatccgttggaatttcttgaagagctgaagaagatcaattaccaggtagattcctgggaggagatgttgaataaggccgaagtgggccacggatacatggatcgcccttgtctcaacccggctgaccccgactgccccgcaacagcacctaacaagaattcaactaaacccctagacatggccctcgttctgaatggatag

SEQ ID NO: 30003 - DNA, 954 bp, Artificial Sequence
  Description of Artificial Sequence: Synthetic coding sequence
atgccacgggaggacagagccacatggaagtcaaactacttcctgaagatcatacagctactggacgactacccaaagtgctttatcgttggagctgataatgttggcagcaaacagatgcagcaaattaggatgagcctccggggtaaagccgtggttctaatgggcaagaatactatgatgagaaaggctatacgtggccacctcgaaaataaccctgcactagagaagcttttaccgcacattaggggcaatgtgggcttcgtgtttaccaaagaggaccttacggagatcagagacatgttactggccaataaggtgcctgcagcagctagagctggcgcaatagctccgtgtgaagtcactgtccctgcccagaacactggccttggtcccgagaagacttctttcttccaggctcttggtatcacaactaaaatctcccggggaactatcgagatcctttctgatgtgcagctgattaaaacgggtgacaaagtgggcgcaagcgaagccaccttgctgaacatgctaaacatcagtccattttcctttggcctggtgattcagcaggtatttgataatggaagcatctataacccagaagttctggatatcaccgaggaaaccctgcattctcggttcttggaaggtgtccgcaacgtggcgagcgtgtgcctgcagatcggttatccaaccgtggccagcgtccctcactcgattattaatggctataaacgcgtcctggccctgtctgttgagaccgattatacatttccgctagcagagaaggtaaaagcatttttggccgacccaagtgcgtttgtggcagcagccccagtcgccgcagccaccaccgctgcccctgccgcagcggctgccccagccaaggtggaagccaaggaggaaagcgaggaatctgatgaggacatggggttcggccttttcgactag

SEQ ID NO: 30004 - DNA, 1818 bp, Artificial Sequence
  Description of Artificial Sequence: Synthetic coding sequence
atggacgatctggacgccctgttagcggatctagagagcacaacaagccatatctcaaagcgaccagtcttcctgagcgaggagacaccctattcgtatcctacgggaaaccatacctatcaagagatagccgtaccccctcctgtgcctccgccacctagcagcgaggctctgaacgggaccattctcgatccgctagatcagtggcagcccagttctagtcgatttatccatcagcaaccacagagcagcagccctgtgtacggctcctcagccaagacttcttccgtctcaaacccccaagattctgtgggctccccctgttcaagagtgggtgaagaggaacatgtctacagctttcccaacaagcaaaagtccgctgagccgagcccgaccgtgatgtcaaccagcctgggctcaaacctttcagaactggatagattgctgttagaactcaatgccgttcagcataacccccctgggtttcccgctgacgaagcaaattctagcccccctctgcctggagcactttccccattgtatggtgtccctgagaccaacagccccttaggcggaaaggcgggaccgctgaccaaagaaaaacctaaacggaacggtggcagggggcttgaggatgtgaggccatctgtagaatcccttctcgacgaactcgagtcttctgtgccgtcaccagtgccggctattactgtgaaccagggagagatgagctcacctcaacgcgtgacgtctacccagcagcagacccgcatttccgcctcttccgctaccagggaattagacgagctgatggcgtccctgtctgatttcaaaggtagctggcccctcgaggaggtggtgctgctagtcagcattagctcctccgttcaagagggggagaagtatcctcatccttgcgcagcgcgacacaggacaccaagcctgaggagccccgaccagccgccaccatgtcctcagttcatggctcaggggaagacgggttccagctcccctcccggagggccacctaaaccgggttcacagttagattctatgctgggcagtctgcagtcggaccttaataaattgggagtggccacagtcgctaaaggggtgtgcggcgcttgcaaaaagcccatcgccggacaggtcgtgactgctatgggcaagacgtggcacccagagcattttgtgtgcacacactgccaagaagagataggaagtaggaactttttcgagagagatggacagccatactgtgaaaaggactaccataatctgttctcacctagatgctactattgcaatgggcctatcttggataaggtcgtgaccgccctggataggacctggcaccctgagcattttttctgcgcccaatgtggggctttctttggtcctgagggatttcacgaaaaagacggaaaagcatactgcaggaaggactattttgacatgtttgcacccaaatgcggaggctgcgctcgagccatcctggagaattatatctcagccctgaacacgctgtggcatcccgaatgcttcgtctgccgagaatgttttacgcctttcgtcaacgggagcttcttcgagcacgacggccagccctattgtgaagtgcattaccatgaacgacggggaagcctgtgtagcgggtgccaaaagcctatcactggaaggtgcattactgccatggccaaaaagtttcaccccgaacatttcgtttgcgccttctgcctcaagcagctaaacaaaggaacatttaaggaacagaatgataaaccttattgtcaaaattgtttccttaagttgttttgttag

SEQ ID NO: 30005 - DNA, 702 bp, Artificial Sequence
  Description of Artificial Sequence: Synthetic coding sequence
atgggcaaaacgtggcacccagaacactttgtgtgcactcattgtcaggaggagattggatcccgtaactttttcgaaagggatggacaaccgtattgtgagaaagactaccataatctatttagccccaggtgctactattgcaatgggcctatcctggataaggtggtgacagccttagataggacatggcaccctgagcattttttctgtgctcagtgtggggcattttttgggccagaagggttccacgaaaaggacggtaaagcatattgtcggaaggattactttgatatgtttgcacctaaatgcggcggatgcgctcgtgccatcctggagaactatatcagcgcactcaatacactgtggcacccagagtgcttcgtgtgtcgtgaatgttttactccatttgtgaatggtagcttcttcgagcacgatggacagccctactgtgaggtgcattatcacgagcgtaggggctccctctgctccgggtgtcaaaaaccgataaccgggaggtgtatcaccgcaatggccaagaagttccaccccgatccatgtaccagcccaagaaccggccttgcatctacaccacactggtcccacctttttctgatttttcagcagtgttcgcgcggtgcgggaaagggaagacaaggactgttgggatctctttttattttaattccaccacccacctag

SEQ ID NO: 30006 - DNA, 1212 bp, Artificial Sequence
  Description of Artificial Sequence: Synthetic coding sequence
atgtccgccccttcatctaccggccctcagtactgccctggccttcccagtcgaaaggaggcgacaccagaaggcaggccagagacatgccttctgcctagttccccccaggcacaacgccctattcagggattggaacagcgggcagacggagagcgatgctgggcagcgggttggccacgagatggcggtcgctcctctcctggcggtcaggacgagggcggaggctcatggcctctggaagaggtggtactcctggtgtctatatcaagctcagtccaggaaggcgagaagtaccctcatccttgtgccgcacgtcacaggaccccgtcactaaggtcgccagaccagccccctccgtgtccgcaatttatggcacaaggtaagaccggcagcagctcaccgcctgggggaccgcctaaacctggctcccagttggatagcatgctcggatcactgcaatccgacttgaataagctgggagttgctacagtggctaaaggagtgtgcggagcttgcaaaaaacctatcgccggtcaagtcgtgaccgcaatgggcaaaacctggcaccccgaacacttcgtctgcactcactgccaagaggaaattggcagcaggaacttcttcgaacgggatgggcagccttactgtgagaaggactaccacaacttgttcagtcccaggtgttattactgtaacgggcctattctcgataaggtcgttacagctctcgataggacctggcacccagagcactttttttgtgcacaatgcggcgcatttttcgggccagagggtttccacgagaaggatggtaaagcgtactgtagaaaggactactttgatatgttcgcccctaaatgtgggggttgtgctagagccatcctcgagaactatattagcgcattgaacactctgtggcatccagaatgcttcgtgtgccgcgaatgctttacaccatttgtgaacggatcttttttcgaacatgatggacagccatattgcgaagtgcattaccatgagcgaagaggttctttgtgtagcggctgccagaagccaatcactggacgatgcatcaccgccatggctaagaagttccaccctgagcacttcgtctgtgcgttctgtcttaaacaactcaacaagggcaccttcaaagaacagaacgacaaaccctattgccaaaactgcttcctgaaattgttctgttag

SEQ ID NO: 30007 - DNA, 1674 bp, Artificial Sequence
  Description of Artificial Sequence: Synthetic coding sequence
atggacgatttagatgctctgctcgccgatctggaatccaccacaagtcatatttcaaagaggcccgtattcctcagcgaagagacgccctattcatacccgaccgggaaccacacctaccaggaaatcgcggtcccacctccagtcccaccacccccttctagtgaggctctgaacggcaccatactggaccccctggaccagtggcagcccagctctagtcgcttcatccaccagcagccccagagcagttccccagtgtacgggtccagcgctaaaaccagttcagtgtccaaccctcaagattctgtaggttcgccctgcagccgcgtgggggaggaggagcacgtgtatagttttccaaataagcaaaaaagcgccgagccgtcacctactgtcatgagcacaagcttgggcagtaacttgtcagaactggacaggctgttactagagttaaatgcagtacagcacaatcccccaggatttcccgcagacgaggccaactccagtccacctctgccaggcgctctgagtccgttatacggcgtgcctgaaactaattctccactgggtgggaaggccggacccctgactaaggagaagcccaagcgcaacgggggtagggggctggaggatgtgcgaccatccgtcgagtcgttgctggatgagctggaaagcagtgtgccaagtcctgtccctgcaattaccgttaaccagggcgaaatgtcttcccctcagcgtgtaacgtcaacgcagcagcaaacaagaatctctgcctcttctgccacacgcgagctggacgaactcatggcttccttatcggacttcaaatttatggctcagggcaagaccggcagcagctctccaccaggcggaccccctaagcccggaagccagctggattctatgctgggctcactgcagagtgatctgaataagcttggcgttgcaactgtggccaaaggcgtctgcggcgcatgtaagaaaccaattgcagggcaggtcgtgaccgctatgggaaagacttggcatcccgagcacttcgtgtgtactcactgccaggaagagataggttcccgcaacttcttcgaacgggatgggcaaccatattgtgaaaaggattatcacaacctgttttccccaagatgttattattgcaacggaccaattttggataaagtagtcaccgcacttgaccgcacttggcaccccgagcattttttttgtgctcagtgcggcgctttcttcgggccagaaggcttccatgaaaaggacggtaaggcctactgtcggaaggattacttcgatatgttcgctccaaaatgcggtggctgcgccagagctatcctggagaattatatttccgcgctgaacacactgtggcaccccgagtgtttcgtgtgtagggaatgttttaccccctttgtgaatggatccttttttgaacatgacggccagccgtactgcgaagtccactatcacgaaagacgaggcagcctgtgtagcggctgtcagaaaccaattactgggaggtgcataacagcgatggcaaaaaaatttcaccccgaacatttcgtttgcgcgttttgtctgaagcagctcaataagggaacctttaaagaacagaatgacaaaccatattgtcagaactgcttcttaaagcttttctgctag

SEQ ID NO: 30008 - DNA, 1275 bp, Artificial Sequence
  Description of Artificial Sequence: Synthetic coding sequence
atgtctacaagcctcgggagcaatctatctgaacttgacagattactccttgaactgaatgcggtccaacataatccaccgggtttccccgctgatgaagctaacagttccccccctctgcctggtgccctgagtccgttgtacggtgtccctgaaactaattcacctctgggcggtaaagccggaccgctgactaaagagaagccgaagagaaacgggggacgcggattagaggacgtgcgtccgtccgtcgaatctctgctggacgaactcgagagctcagttccttcccccgtgccagccatcacagtgaaccagggagagatgtccagcccccagcgcgtgacttcgactcagcagcagacccgaattagtgcttcttccgccacaagggaactggacgaactaatggcatctctgtccgattttaagttcatggcgcagggcaaaactggaagctcgagccctcccggagggcctcccaagcccggaagccagctcgacagcatgctaggttcactgcaatccgacctgaacaagctcggggtggcgaccgtcgctaagggggtgtgcggagcttgtaagaaacccatagccggacaggtggttaccgcaatggggaaaacctggcaccccgagcactttgtttgcactcactgccaagaggaaatcggatcgcgcaatttcttcgaacgcgacggtcagccatactgcgagaaagattaccataacctgttctccccccgatgctactactgcaatggacctatcttagacaaagttgtgactgcactggatcgtacatggcaccccgaacacttcttctgcgcccagtgcggtgcattttttgggcctgagggattccacgagaaggacggcaaagcgtactgccggaaggactactttgacatgtttgcgcctaagtgcggcggttgcgccagagccattctggagaattatatatccgcccttaatactctgtggcatcccgaatgctttgtctgtagagaatgctttacaccttttgtcaacggctctttttttgagcatgatggccagccttactgcgaagtgcactatcacgaaagaaggggatccctttgctcaggctgtcagaagcccatcaccggccgttgtattacagccatggccaagaagtttcaccccgagcattttgtgtgtgccttttgcctgaagcagctaaataaaggtactttcaaagagcaaaacgataaaccctactgtcagaattgtttcctcaagctgttttgctag

SEQ ID NO: 30009 - DNA, 951 bp, Artificial Sequence
  Description of Artificial Sequence: Synthetic coding sequence
atgagctcaccacagagagtcacttcaactcagcaacagactagaatatcagcgagcagtgccacccgcgagctggacgagctgatggcctctttatctgattttaaattcatggctcagggcaagaccggctcaagcagcccccctggcggaccgccaaagcctggtagtcagctcgacagcatgctgggatccctgcagtccgacctgaataaactgggcgtagctaccgtagccaagggcgtgtgtggagcctgcaaaaagcctattgcaggtcaggttgtgaccgcgatgggcaaaacttggcatccagaacacttcgtatgcacgcattgtcaggaggagataggaagcagaaactttttcgagcgggatggtcaaccctattgcgagaaagattatcacaacctgttcagccccagatgctattattgtaacggacctatattagataaggtggtgaccgcgctggatcgtacgtggcacccagaacactttttttgtgcacagtgtggggcttttttcggacccgagggctttcacgagaaggatgggaaggcatattgtaggaaggactacttcgacatgtttgcacctaagtgcggcggatgcgcgcgagccattctggaaaactacatcagcgcgttgaatacgttatggcatccagagtgtttcgtttgtcgcgagtgtttcaccccgttcgtaaatggctccttcttcgagcacgacggccagccttattgtgaggtgcactatcatgagagacgtggttcactctgctcaggctgccagaaacccatcacaggtcgctgcataaccgccatggccaagaagtttcaccctgaacattttgtctgtgccttttgcctcaagcaattgaacaagggtacttttaaagagcagaacgataaaccgtactgtcagaactgcttcctcaagctcttttgctag

SEQ ID NO: 30010 - DNA, 993 bp, Artificial Sequence
  Description of Artificial Sequence: Synthetic coding sequence
atgcctcatagcgtgactctgcgaggtccatcaccttgggggtttcgactagtgggcggaagggacttttcggctcctttgaccatttctcgcgttcatgccggatcaaaagccgctttggccgctctctgtcccggagatctgatccaggcaattaacggagaaagtaccgagttaatgacccacctggaagcccaaaatcgaatcaaaggctgccatgaccacctgaccctctcagtgtctagacctgagggcagaagctggccgtccgcacctgacgatagcaaggctcaggcacatcgcatccacatcgaccctgaaattcaggacgggagccccactacatctcgcaggccaagcggtaccggcaccggcccagaggacggccgtccttcacttggctcaccatatgggcagcccccacgcttccccgtgcctcataatgggtcctcagaagccacgctccctgcccaaatgtccaccctgcatgtgtcccctcctccatctgctgatcctgcacgcggtctgcccaggtcaagagactgtcgtgtggacctcgggtctgaggtctatcgtatgctcagggagccggctgagcccgtggcggcagaacctaagcaatccgggagctttcgttatctgcagggcatgcttgaggctggggaaggcggtgattggccgggtcctggaggacctcgtaatctgaaaccaaccgctagtaagttgggcgctcctctgtccgggctccaggggctccccgaatgtactcgatgtggtcacggtattgtggggaccatcgtgaaagctagggataaattgtaccacccagagtgttttatgtgttcagactgcggattaaatctcaagcaaaggggttacttttttcttgacgagagactttattgcgaatcccacgctaaggccagagtgaaaccccctgaaggctacgatgttgtcgcggtgtaccccaatgctaaggtcgaattggtctag

SEQ ID NO: 30011 - DNA, 741 bp, Artificial Sequence
  Description of Artificial Sequence: Synthetic coding sequence
atgccccactctgtgacccttcggggacccagcccctggggattccggctggttggaggacgcgacttctctgccccattaaccattagcagagtccatgctggatccaaggccgctctggctgccctgtgtcctggcgatctcattcaggccatcaatggcgagagtacagaactgatgacacacctcgaggcacagaatagaatcaagggctgccatgaccatctaaccctgtccgtcagtcgaccagaaggcaggagctggccgagtgcacccgacgactcgaaagctcaggctcaccgtattcacatcgaccccgagattcaggatgggagtccaacaacaagccggaggccctctggaaccggaaccggccctgaggacggcaggccaagcctcggatctccatacgggcaaccacccagatttccggtaccacataatggatccagcgaggctaccctgcctgcccagatgtctacactgcacgtgtcaccccctccgagtgcagacccggctcgcggattgcctagatcgcgcgactgccgagtggatttgggatctgaagtgtataggatgttaagggaaccagcagagcctgttgcggctgagccaaagcagtccgggtctttcaggtacctacaagggatgttggaggcgggagaaggcggagccccatcttctaggcatgggacaagtagtacgatcccttctgcaagttgcgctgtaacagccgcatag

SEQ ID NO: 30012 - DNA, 1791 bp, Artificial Sequence
  Description of Artificial Sequence: Synthetic coding sequence
atgtctaattacagcgtaagcctggtcggaccagctccttggggatttcgccttcagggaggtaaggatttcaacatgcccctgacaatttctagtctgaaggatggcggaaaggcagcccaagccaatgtgcgaatcggagacgtcgtcctgtccatcgatggcatcaacgctcagggtatgacacacctggaagcgcaaaataagatcaaagggtgcactggaagcctaaacatgacgctacaacgtgcctccgccgcacctaagcctgaaccggtcccagtgcagaaaggcgagcccaaggaagttgttaaacccgtaccgattacatcacctgcggtaagcaaggtcacctccaccaacaacatggcatataacaaagcacctaggccatttggcagcgtgagcagcccaaaagtgaccagcatcccttccccctccagcgcctttactccagcgcacgctacaacctcttcacacgcttccccctcccctgtagcagcagtcacacccccactttttgcggctagcgggctccacgccaatgccaaccttagtgcagaccagagtccttccgccctctcagctggaaagacagctgtgaacgtcccccgacaaccgacagtgactagcgtttgtagcgaaacatctcaggagctagctgagggccaaagacgaggatcacagggcgattcaaagcagcagaacggtccacctagaaagcacattgtcgagagatatactgagttctatcacgtccccactcatagtgatgcttcaaaaaagcgcctgattgaggatactgaagactggaggccacgcacaggtactactcaatcacgtagcttccgaatactggctcaaatcacagggaccgaacacctgaaggagtcggaagcggataacacaaaaaaagccaataacagccaggagccatccccacagctcgcttcaagtgtggcatctacgcggagtatgccagaatctctggacagtcctacatctgggagacccggtgtcacaagcctgacagcggcagccgcattcaaacctgtgggcagcaccggcgttatcaaatccccatcgtggcagcgccctaatcagggggtgccatcaaccgggaggatatctaattcagccacttactcggggtccgtggctcctgctaactcggcgctgggacagacccagccttcagatcaggatacactcgtgcagcgagccgagcatatccctgccggtaagcggaccccaatgtgtgcccattgtaaccaggtaataaggggtcccttccttgtggccctgggcaagtcttggcaccctgaggaattcaactgtgcgcattgcaagaacaccatggcctatatagggttcgtagaggagaagggtgccctgtactgtgagctctgttacgagaagtttttcgctcctgaatgtgggcgttgtcagaggaagattcttggggaggtcatctcagctttgaagcagacttggcacgtgtcctgcttcgtctgtgtggcctgcgggaaacccataaggaataacgtgttccacctcgaagacggcgagccctactgtgagaccgactattatgccctgttcgggacaatttgtcacggatgcgagtttcccattgaggccggtgacatgttcctggaagcgttgggctacacttggcacgacacctgcttcgtgtgttctgtgtgttgtgaatctctggaggggcagactttcttttcaaaaaaggataagccactgtgtaaaaagcacgctcactccgtgaatttttag

SEQ ID NO: 30013 - DNA, 645 bp, Artificial Sequence
  Description of Artificial Sequence: Synthetic coding sequence
atgagtaattactcagtatccctggttgggcctgccccatggggatttcgactgcagggagggaaggactttaatatgccactcactatctcctcccttaaggacgggggaaaggccgctcaggctaacgtgagaatcggggacgttgtcctgtcgattgatgggatcaacgcccagggaatgacgcatctggaggctcagaacaagatcaaaggatgcacaggctcactcaatatgacactccagcgggcttcagcagcccctaagcccgaaccagtccccgtgcagaaaaaaacccaggtaacaaacaatccaggaacagtgaagattccacctaagcgacccccacgcaagcacatagttgagagatataccgagttttaccacgtgccaacacactccgatgcaagcaaaaaacgacttatagaagacaccgaagactggcggccaagaacgggcacaacccagtcaaggagtttcaggatcctcgcgcagattaccgggactgagcatctcaaagaatccgaagccgataacaccaagaaagcgaaagagaaaatccccctccacgttttctccccgaagtacactaaattgcgcgactggcaccatgaggttagcgctcgagcactcaacgtgcagtag

SEQ ID NO: 30014 - DNA, 705 bp, Artificial Sequence
  Description of Artificial Sequence: Synthetic coding sequence
atgagcaactacagcgtttctttagtggggccagccccatggggctttaggctgcagggaggcaaggactttaatatgccactcactatcagttcactcaaagacggcggaaaagcagctcaggctaatgtgcgtatcggcgacgtagtgttgtctatcgatggcataaacgcccagggaatgacccacctagaagcgcaaaataagatcaaagggtgtactggtagcctcaatatgacgttacagagggctagcgcagcacccaagccagagccagttcccgttcaaaagccgactgttacgtcggtgtgctccgagacttcacaagagttagcagaaggacagcgcaggggctcccagggcgactcgaaacagcagaacggcaaaatcccacccaagagacctccgaggaaacatatcgtcgaaaggtataccgagttctaccatgtcccaacacactccgacgcatctaagaagaggctaatagaggatacagaggactggcgacccaggaccggtacaactcagtcccgttctttcagaatcctggctcagataactggaaccgagcacctgaaggagtctgaggccgataatacaaaaaaggccaaggagaaaatccctctgcatgtgttttcaccaaagtatacaaaactccgcgattggcaccatgaagtgtcagctcgggctttgaacgtacagtag

SEQ ID NO: 30015 - DNA, 1464 bp, Artificial Sequence
  Description of Artificial Sequence: Synthetic coding sequence
atgagcaattactccgtttcactggttggtcccgctccatgggggttcagattacagggtggaaaggacttcaacatgcccctgacaatctcgagcctgaaggacgggggaaaagctgcgcaggctaatgtcaggatcggtgatgtcgtgctgtccatagatggaattaacgctcaagggatgactcatctcgaggctcaaaacaagattaaaggttgcaccggtagtctcaatatgacgttgcagcgggcttcagccgcaccaaagccagagcctgtgccagtacagaagcctaccgtcacttcagtttgctcagaaacctcacaggagctggccgaggggcagagaagaggcagccaaggtgattctaaacagcagaatggaccacctagaaagcacattgttgagaggtacaccgagttttaccacgtgccgacccactctgatgcctcgaagaagagactcatcgaagacaccgaggattggcggcctagaacaggaaccacgcagagtcggagttttcggatcttggcacagataactggtacagagcatctcaaggaatccgaagctgacaatactaaaaaagctaataattctcaggagccctccccccagctggctagcagtgtagcctccacacggtctatgccggagtctctcgactcaccgacatccggcaggcccggagttacatcgctgacggctgcagccgctttcaagcctgttggtagtaccggagttatcaaatcaccttcttggcagcgaccaaaccaaggtgtgccttcaacagggagaattagcaactcagctacgtactccggcagcgttgctcccgcaaatagcgccctgggccagacccaaccatctgaccaggacacattggtgcagcgcgctgaacacataccggcaggtaagagaacgcccatgtgtgcacactgtaatcaggtgatacgtggcccttttttggtcgccctgggtaaatcttggcatccagaagagtttaattgcgcacattgcaagaataccatggcttatatagggtttgtggaggagaagggagcactgtactgcgagctctgctatgagaagttctttgccccagagtgtggcaggtgccagagaaaaatccttggcgaggtgattagcgccttaaaacagacctggcatgtgtcttgctttgtgtgcgtggcctgcggaaagcctattagaaacaacgtttttcatcttgaggacggcgagccctattgtgaaacggattattatgccctgtttggaactatctgccacggctgcgagtttcctatcgaagccggtgacatgtttctggaggctctcggttatacatggcatgatacgtgtttcgtgtgctccgtctgttgcgagtccttagaaggacagactttcttctccaagaaggataagcctctgtgtaaaaagcacgctcacagcgtgaatttctag

SEQ ID NO: 30016 - DNA, 705 bp, Artificial Sequence
  Description of Artificial Sequence: Synthetic coding sequence
atgagcaattatagcgtttccttggtagggcctgcaccttggggcttccgcctccaggggggtaaagacttcaatatgcctctcactattagtagcctgaaagacggtgggaaggcagcccaggccaatgtcagaatcggagacgtagtcttatcgatcgatggaatcaacgcccagggtatgacccatttagaggcccagaacaagatcaagggctgcactggtagcctcaacatgactttacagagggcctctgctgccccaaagccggagcccgttcctgtgcagaagcccaccgtgacttctgtttgctcagagacctcacaggaactggccgagggtcagcgcagggggtcccagggagacagtaagcagcagaacggccctgtgcccagaaaaatccccccacggaaacatatcgtggagaggtacacagagttttatcacgtgccaactcatagcgacgcgtctaaaaagaggctcattgaggacaccgaggattggcggccaagaacaggtactacacaaagcaggagcttcagaatcctcgctcagattacaggcactgagcacctgaaggaatctgaagccgacaacaccaaaaaggccaaggagaagattcccctgcatgtgttcagtcctaagtatacgaaactgcgtgattggcatcacgaggtcagcgccagggcactgaatgttcaatag

SEQ ID NO: 30017 - DNA, 645 bp, Artificial Sequence
  Description of Artificial Sequence: Synthetic coding sequence
atgtcgaattacagcgtgtcgcttgtgggcccagcaccctggggctttagattacagggcggaaaagacttcaatatgcccctaactatctccagccttaaagacggtggtaaagccgctcaggcaaacgtccggattggtgatgtggtcctgtccatcgatggaatcaacgctcagggcatgacgcacttggaagctcaaaacaaaattaagggctgtacaggatctctgaatatgactctacagcgtgcctccgcggcacccaagccggagcctgtgcccgtgcagaaggtgacccagaaacgcgaatcccggagctctcgtcgcactgcccctggcctacctcctagaaaacacattgtagagagatacactgagttctaccacgtgcccactcatagcgacgcctcgaaaaaaagactcatcgaggataccgaagattggcgcccacgcacaggcacaactcagtcccgttctttccggatcttggcacagatcactggaacagagcatctcaaggaatccgaggcagataataccaagaaggccaaggagaaaatccctctccacgtgttcagtccaaagtatacaaaactccgtgattggcatcacgaggtcagcgcaagagccctgaatgttcagtag

SEQ ID NO: 30018 - DNA, 1425 bp, Artificial Sequence
  Description of Artificial Sequence: Synthetic coding sequence
atggcttataacaaagcccctagacctttcggtagtgtgtcttcccctaaagttaccagcatcccatccccaagctcagcatttacgcctgctcacgctacaacgtcctctcacgcaagcccgtcacctgttgctgctgttacccctcccctgtttgctgcttctgggctgcacgctaatgcaaacctctccgcggaccaatcgccaagtgccctcagcgctggcaaaactgctgtaaacgtccccagacaacctacagtaacatctgtttgttcagaaactagccaggagttggctgaaggccaaagaagagggtcgcagggggatagtaaacagcaaaacggccctccccgtaagcacatagtggaacggtatactgagttctaccacgtacccacccatagcgacgcaagtaagaagcgattaatagaagataccgaggattggagacctcgcaccggaaccacccaaagccgctctttccgaattctagcgcagatcacagggacggaacatctgaaggagtcagaggccgacaacacaaagaaggctaataactcacaggaacctagcccacaactagcctcctcagttgctagcacaagatctatgcctgagtctctggactcaccaaccagcggaagaccaggggtaaccagcttaaccgctgccgctgccttcaagcccgtcggcagcacaggcgtgattaaatcaccatcatggcagcggcctaatcagggtgttccttctacaggcagaattagcaacagtgcgacctacagtgggtctgtggcaccagccaatagcgctctgggccagacgcagccaagtgaccaggacactttagtgcagagagccgagcacatacctgccggaaagaggactcctatgtgcgcacactgcaatcaggtgattagagggccatttctcgttgccctggggaaaagttggcaccctgaagagtttaattgcgctcactgtaaaaacacaatggcttacataggcttcgtggaggaaaaaggggcactatactgcgagctatgctatgagaagttcttcgccccagaatgcggacgctgccagcgcaaaatactcggagaggtcatttccgcgctgaaacagacatggcatgtgtcatgtttcgtctgtgtagcttgcgggaagcccatacgtaataatgtgttccacttggaggatggagaaccatactgtgagaccgactactatgcgcttttcgggaccatatgtcacggttgtgaattccctattgaagctggagacatgttcctcgaggccttggggtatacatggcatgacacctgctttgtgtgcagcgtgtgctgtgagagcttggaaggacagacctttttctccaagaaggataaacctctttgtaaaaaacacgctcactctgtgaatttttag

SEQ ID NO: 30019 - DNA, 411 bp, Artificial Sequence
  Description of Artificial Sequence: Synthetic coding sequence
atgagcaattactcagtaagcctcgtagggccagccccttggggtttccggctgcagggcggaaaggattttaatatgccattgacgatcagctccgctggggttcagtggcggaacttgggatctccccagcccccaagcccggagtttaaacggtttagctgtttaagcttgcctagttcttgggattaccgtcacgtgcctcccaggctcgctaactttgtgttcttggtcgagacaaaattcccgtatgtgggtcaggccggtctcgagctgcccactagcggcgatctccctactagtgcatcacagtccgctaaaataacaggcgtgagtcacagggcatggcctaccttgttttacactttgctgttcttcgccacaatctacccagaaattatactgtactag

SEQ ID NO: 30020 - DNA, 669 bp, Artificial Sequence
  Description of Artificial Sequence: Synthetic coding sequence
atggactcatttaaagtggtcctggaaggcccagccccatggggtttccggctgcagggaggcaaagacttcaacgtccctctctcgatctctcgcctgacacccggaggcaaagcggcacaggccggtgtggcagtgggggactgggtcttgtcaatcgatggggagaatgcgggttccctgacccacattgaggcccagaataagattagagcatgcggcgaaaggttatccctgggcctgagtagggcacaaccagtccaaagcaagcctcagaaggcctcagcccctgccgctgatcctccaagatacaccttcgcgccatcagtgtctctgaacaagaccgctcgaccattcggagccccaccgccagccgactctgcaccccagcagaatggtcaacccttaagacctttggtgccggacgcttccaagcagaggttgatggagaataccgaggactggagaccaaggccaggcaccgggcagtctcgctctttcaggatcctggctcacctaacaggcaccgaattcatgcaagacccggatgaagaacatctcaagaagagcagagaaaagtacgttttagaactccagtccccacgttacacgaggctgagagattggcaccaccagcggtctgctcacgtactgaatgtccaatcatag

SEQ ID NO: 30021 - DNA, 1374 bp, Artificial Sequence
  Description of Artificial Sequence: Synthetic coding sequence
atggattcgttcaaggtcgtgttagaagggcctgcaccttggggtttccgcctccagggaggcaaggattttaacgtcccactgagcatctcaagactcacaccgggagggaaagcggctcaggccggagtagcagtgggcgactgggtgctctctattgacggagagaacgctggatccctgacccacatcgaagcccaaaacaagattagggcctgcggcgagaggctgtcattaggcctgagtagggcacagccggtgcagagcaaaccacaaaaagcaagtgcgcctgctgcggaccctcccagatacacttttgccccttccgtaagcctcaataaaacagctcggcctttcggggctcccccacctgccgatagcgcccctcagcagaacggccagccactccgacccctggtgcctgatgccagtaagcagcgcttgatggaaaatactgaggattggaggccaagacccggtactggtcagtcacggtcttttagaatcctcgcccatcttaccggtaccgagtttatgcaagaccccgacgaagagcacttgaagaaaagttcacaagttcctcgaacagaagcccctgcacctgcctcctccacccctcaggaaccttggcctggtcccactgccccttcccctacatcacgccctccttgggctgtagaccccgcttttgccgaacgctatgcccctgacaagacgagtacggtcctgacccgccactcgcagcccgcaaccccgacccctttacagtcaaggacatctatcgtgcaggctgccgctggcggagtaccgggaggagggtctaataacggtaagactcccgtttgtcatcagtgccacaaggtgatcaggggcaggtaccttgtggctctcggtcacgcctatcatcctgaggagttcgtctgctcccaatgcggaaaagtgctagaggagggtggtttcttcgaagaaaagggggctatcttctgccccccatgctacgacgtgaggtatgctcctagctgcgccaagtgtaagaaaaagataaccggtgaaataatgcatgcactgaaaatgacatggcatgtgcactgctttacctgcgcagcttgcaaaacaccaatacgcaatcgggctttctacatggaagaaggcgtcccgtactgtgaacgggactatgagaaaatgttcgggaccaaatgtcatgggtgtgattttaaaatagatgctggtgatcgcttcttggaggccctgggcttttcttggcatgacacttgtttcgtgtgtgctatctgccaaattaatctcgaggggaaaacgttttactctaagaaggacagacctttgtgtaagtcccacgctttctcccacgtctag

SEQ ID NO: 30022 - DNA, 864 bp, Artificial Sequence
  Description of Artificial Sequence: Synthetic coding sequence
atggactcattcaaagtggtgctggaaggacctgccccttggggtttcagactgcagggaggtaaggacttcaatgtgcccctatccatcagtcgactcacacctggaggcaaggcagcgcaagcaggcgtggctgtgggcgattgggtactgtccatcgacggggaaaatgccggaagtttgacccacattgaagcccagaataaaattcgggcttgtggagagcgactaagcctcggtctttctagagcacagccagtgcagagtaaaccccagaaggcctctgccccagctgctgatccacctcgctatactttcgcaccgagtgtatctttgaacaaaaccgctcgcccattcggcgctcctcctcccgctgactcagcgcctcagcagaatggccagcccttgaggccacttgtgccagacgccagtaaacaaaggctcatggagaacaccgaagactggcgcccaagacccggaacagggcagtcccgttccttcaggattctagctcacttaacgggtaccgagtttatgcaggatcctgacgaggaacatctcaagaagagccggccataccgccctcagccataccaaccgccagctttgggatgcgggccttgtgtgtgcagagccctatgtcccggacagaacgagcacagcgccgatcccgcacagcctgcgggacacgctcacgcagcagcggagccccatttgcactgtgctggatcatgcaggcggggagctcgaagaggacagcagcagagacaggattctagagtttctccggttccccagggtcatccaggaccattgccgggaggagcgggtcctagggtgccgccaggtggtgtgtgcgtatag

SEQ ID NO: 30023 - DNA, 1272 bp, Artificial Sequence
  Description of Artificial Sequence: Synthetic coding sequence
atggattcttttaaagtcgtgctcgaagggcctgccccttgggggtttcgactccagggcggaaaggatttcaacgtgccattgtcgatatccagactcacccctggcggtaaagccgcacaggccggagtggccgtaggagactgggttctgtcgatcgacggggagaatgctggtagtctgactcacatagaggcacagaacaaaatccgggcatgtggagaacggttaagtctcgggctgtcacgcgctcagcctgtccaatctaaaccacagaaggtgcaaacccccgacaagcagcccctgaggcccctggtcccagacgcctccaagcagcgcctgatggaaaatacagaagattggagaccccgtcccggaactggtcagagtcggtccttccgcattttggcacacctgacgggtacggagtttatgcaggacccagacgaagaacatctgaaaaagagcagccaagtgccacgtacagaagctccagcaccagcctctagcaccccccaagagccctggccgggtcctactgctcctagccctacatccaggccaccatgggccgttgatccggcttttgcggaacggtatgctcctgataaaacgtccacagtgcttacgcggcattcccagcccgcaacccccacacctcttcagtccaggacgtcgatcgttcaagccgcagctgggggagtgcccggtggcggtagtaataacggaaaaactccagtgtgtcaccaatgtcacaaggtgattcggggacgatatctggtcgcccttggtcacgcctatcatcccgaagagttcgtgtgctcacagtgcgggaaagtgctcgaagaaggtggtttttttgaagaaaaaggcgcaattttctgtcccccatgctacgacgtgaggtatgccccatcttgtgctaagtgcaagaagaagatcacgggcgaaatcatgcacgcgttaaaaatgacgtggcatgtgcactgtttcacctgcgccgcatgcaaaacccccatacgaaatcgtgctttttatatggaggagggtgtaccctactgtgagcgggactacgagaagatgttcgggacaaagtgccatggatgtgacttcaagatcgacgctggagaccgctttcttgaggctctcggatttagctggcacgatacttgtttcgtctgcgctatctgtcaaatcaatcttgaaggcaagaccttctacagtaagaaggaccggcctctgtgtaagagtcacgcctttagtcacgtgtag

SEQ ID NO: 30024 - DNA, 522 bp, Artificial Sequence
  Description of Artificial Sequence: Synthetic coding sequence
atggactcatttaaggtagtcctggaggggcctgcaccttgggggtttaggctgcagggcggaaaggatttcaacgttcctttgtcaataagccgccttacaccaggcggaaaggccgcacaggctggtgtagctgtgggggattgggttttatccattgacggggagaacgccggatcccttacccatattgaagcccagaataaaattcgcgcatgtggggaacggctcagcctgggactttctcgggctcaacccgtgcaaagcaagccacagaaggcttccgcgccagcagcagatcctcccagatacacatttgccccatccgtaagcctgaataaaacggccaggccttttggcgcaccgcctcctgccgactccgcaccacagcagaatggccagcctttgaggcctttggtgcccgatgcttcgaaacagcgattaatggagaataccgaggattggaggccacgccctggcactggccaaagccgctccttcaggatcctggctcacctgtag

SEQ ID NO: 30025 - DNA, 273 bp, Artificial Sequence
  Description of Artificial Sequence: Synthetic coding sequence
atggattcttttaaggtcgtgctcgaaggacctgcgccttggggcttcaggctgcaaggcggtaaggactttaatgtccctctgtcgatttctcgcctgacccctggcggtaaggcagcccaggccggtgtcgctgtaggagattgggtgctgagcattgacggcgagaatgccggttccctgacccacattgaagctcagaacaaaatacgagcctgcggagagaggctatcacttggcctatccagggcgcagcccgtccagtctaagtag

SEQ ID NO: 30026 - DNA, 492 bp, Artificial Sequence
  Description of Artificial Sequence: Synthetic coding sequence
atggccgacgaggaaaaactgccgcctggctgggagaagcggatgtctagaagttctgggagagtgtattatttcaaccatataactaacgcaagccagtgggaacgacccagcgggaactcctcttctggaggcaaaaatgggcaaggggagcctgctcgggtgcggtgtagtcatctgctcgtcaagcattcccaatcccgacgaccttcctcatggcgccaggaaaagattacccggactaaagaggaggcgttagaactgattaatggttacattcagaaaataaaaagcggagaagaagacttcgaatctctagcgtcccagttcagtgactgctcttccgctaaggccagaggtgacctgggggcatttagcagggggcaaatgcagaagccattcgaagacgccagtttcgccctcagaactggggagatgtctggacctgtgttcacggactccggcattcacataatcctgcgaacagagtag

SEQ ID NO: 30027 - DNA, 138 bp, Artificial Sequence
  Description of Artificial Sequence: Synthetic coding sequence
atgcaaaagcccttcgaagacgcttccttcgctttgagaacaggtgagatgtctggcccagtgtttactgacagtggcatccacattatcctcagaaccgagtgttggcgacagacaagaggtcccaactgtttttag

SEQ ID NO: 30028 - DNA, 438 bp, Artificial Sequence
  Description of Artificial Sequence: Synthetic coding sequence
atggcagacgaagagaagctcccaccagggtgggaaaagcgaatgagtcgatcctccggcagagtttattactttaatcacattaccaatgcgagccagtgggagcgaccatctggaaattcgtcttccggcggtaagaacggtcagggagaaccagccagggtacgttgtagccacctgcttgtgaagcactcccagtcccgcagaccaagcagctggagacaagagaaaatcacccgcactaaagaagaggccctcgaactgattaatggatacattcagaaaattaaatccggcgaggaggatttcgaaagtttggcatcacagtttagtgattgctccagtgccaaggcacgcggagaccttggcgcattcagtagaggagcccaggggatggggctgacaagactgggggacccataccaccccgagggctag

SEQ ID NO: 30029 - DNA, 561 bp, Artificial Sequence
  Description of Artificial Sequence: Synthetic coding sequence
atgaccatggttgacactgagatgcccttttggcctacaaacttcggcatttcgtccgtcgacctcagcgtcatggaggaccacagtcattcgttcgatattaagcccttcacgactgtagatttcagttcaatctccaccccccattatgaggacatccccttcaccaggaccgaccctgtggtggccgactacaagtatgatcttaaattacaggagtaccaatccgctataaaagtggagcccgctagtcctccgtactacagtgaaaaaacacaactgtacaataaaccacatgaggagccgagcaactccctgatggccatcgagtgtcgtgtgtgcggggacaaagcctccggcttccactatggcgtgcacgcctgcgagggatgcaaagggtttttcagacgcacaatccgactgaagctgatctacgatcgttgcgatctaaattgcagaatccacaagaagtcacgcaacaaatgtcagtactgtcgctttcagaaatgcctggcagttggaatgagtcacaacgaggagctgcaaaaggatagttattag

SEQ ID NO: 30030 - DNA, 1752 bp, Artificial Sequence
  Description of Artificial Sequence: Synthetic coding sequence
atggggggactcgaaaaaaagaagtacgagaggggctccgccacaaattacatcaccagaaacaaggccaggaagaagcttcagctcagcttggccgattttaggcggctgtgtattttaaaggggatctatccgcatgaaccaaaacataaaaaaaaagtgaacaaaggttccaccgctgctaggactttttacctcattaaagatatcagattcctgctgcacgaaccgattgtcaacaagtttcgtgaatacaaagtctttgtgagaaagttaagaaaggcgtacggtaagtctgaatggaataccgtcgaaagactcaaggacaataagcctaattacaaattggaccacattatcaaggagcggtacccaacattcattgatgccttacgagacctcgatgacgcgctcagcatgtgcttcctttttagcacttttcctcggaccgggaagtgccatgttcagaccatccaattgtgtcgccgtctgaccgtcgaatttatgcattatattatcgccgcaagggccctgcggaaggtctttctctctataaagggaatttactaccaggctgaagttctcgggcagccgattgtctggattacaccttatgctttttcccacgaccacccgaccgacgtcgactatcgtgtgatggcgacctttaccgaattttacaccacattactgggcttcgtcaacttccggctgtaccaactgctgaacctgcactatccaccaaagctcgaagggcaggcccaagcggaggctaaggctggggaagggacctacgctttagactccgagtcttgcatggaaaaacttgctgccctctccgcaagcttggctcgagtggtggttcccgctaccgaggaggaagctgaagtcgacgagtttcctacagatggggaagaggaccgcagaaaagagctggaggctcaggagaaacataaaaaacttttcgaagggctgaaattctttctgaatcgcgaagtgccaagggaggcactggccttcatcattaggtcattcggaggcgaggtgtcttgggacaaatccctatgtattggagcgacctatgacgtgacagacagccggataacgcaccaaatcgtcgatagaccaggccaacagacctcggtgattggcagatgttacgttcagccgcagtgggtctttgattctgtgaacgccaggttgctgctccccgtggccgaatacttcagcggcgtacagctgccaccccacttgagtccctttgttaccgagaaagaaggagattacgttcccccagagaaactcaagctgcttgccttacagcgcggagaagaccccggaaatttgaacgagagcgaggaggaggaggaagaagatgataacaacgaaggggacggcgatgaagaaggtgaaaacgaagaggaggaggaggatgcggaagcaggttccgagaaagaagaagaggcgagactcgccgctctagaagaacaacgaatggagggtaagaagccaagagtgatggccggtacccttaagctcgaggacaaacagcggctggcgcaggaggaagaatccgaggctaagaggctggccatcatgatgatgaaaaagcgcgaaaagtatctgtatcagaagatcatgttcgggaagcgaagaaaaatcagagaagcaaacaaacttgccgaaaagagaaaagcccatgacgaggccgtgagatccgaaaaaaaagcgaaaaaggcacggccagagtag

SEQ ID NO: 30031 - DNA, 1767 bp, Artificial Sequence
  Description of Artificial Sequence: Synthetic coding sequence
atgggaggactcgagaagaaaaagtacgagcgaggcagtgccaccaattacatcactaggaacaaagccagaaagaagttgcaactgtctctcgcagatttccggagactgtgtatcctaaagggaatctacccacacgagccaaagcacaaaaaaaaagtaaataagggctccacggcggctagaacgttctatctgattaaagacatcagatttctgctgcacgagcctattgtgaacaagttcagggaatataaggtatttgtgaggaagctgcgcaaggcttatggcaagtccgagtggaacactgtggaacggctgaaggacaacaaacccaactacaagctagaccacattatcaaggaacgctaccctactttcattgacgcattacgtgacctcgacgatgcgctctcaatgtgcttcctcttttccacttttcctcgaactgggaagtgtcacgtgcagaccatccagctctgtaggaggcttacagtggaatttatgcattacatcatagccgcacgagccttacgtaaagtgttcctatcaatcaagggcatatattatcaggcggaggtgctggggcagcccatagtgtggatcacaccttacgccttctctcacgaccatccaaccgacgttgactatcgggtcatggcgacctttactgagttttacactaccctgttggggttcgtgaatttccggctgtaccagttgcttaacctgcactatcctcccaagttggaagggcaggcacaagccgaagccaaggccggagagggaacctacgccctagattccgagagctgcatggagaagctggctgcactgagcgcgtctctggcaagagtcgtcgtacctgctactgaggaggaagccgaagttgacgaattccctaccgacggcgagatgtcagcccaggaagaggatcgaaggaaggagctggaggctcaagaaaagcataaaaaactctttgagggcctaaagttctttctcaatcgcgaagtccctagagaagcattggcgtttattattcggtccttcggcggagaagtgagctgggataaaagcctgtgtatcggggctacttatgacgtgacggattcccgcattacccaccagatcgtggaccgccctggccagcaaacaagcgtgatcggcaggtgttacgttcagccccaatgggtctttgactcagtgaatgcaagacttctcctgcctgtcgccgagtacttttccggcgtgcagcttccccctcacctcagccctttcgttactgaaaaagagggagattacgtgcctcctgagaagctgaagctcctggccctgcagcggggagaagatccaggaaatctcaatgaatccgaagaagaagaggaagaagatgataataatgagggagatggcgacgaagaaggagagaatgaagaggaagaagaggatgcggaagcagggagcgaaaaagaagaagaagccagactagcggcactcgaggagcagcgcatggagggcaaaaagcccagggtcatggcgggaactctgaagctcgaagacaaacagcggttggcgcaggaggaggagtcagaggcaaaacgattggccattatgatgatgaaaaagcgggagaagtacctttaccagaaaatcatgtttggtaaacgaaggaagatccgagaggccaataaattagcagagaaacggaaggctcacgacgaggcggtgaggtccgagaaaaaagccaaaaaggcacggccagaatag

SEQ ID NO: 30032 - DNA, 1350 bp, Artificial Sequence
  Description of Artificial Sequence: Synthetic coding sequence
atgtgctttcttttcagcacgttcccccgtacaggcaaatgccacgtgcagacaattcaactctgccgacggctgacagtagaatttatgcattacatcattgctgctagggcactgaggaaagtttttctgtcaattaaagggatctattatcaggcagaggtgctagggcagccaatagtgtggattaccccttatgcatttagccacgatcaccccactgacgtagactaccgggtgatggccacgttcacagaattttataccacactgctcggcttcgtcaatttccggctgtatcagctgctcaacctgcactacccacctaagcttgagggacaggcgcaggccgaggcaaaagcgggagaaggaacgtatgccctggactctgaatcctgcatggagaaattggcggctctgtccgctagcctggcaagagtcgtagtgcccgcaacggaagaagaggccgaggttgacgagttccctaccgacggagagatgtccgcccaggaagaggatagacgtaaagagctcgaggcccaggagaagcacaagaaactgttcgaaggcctcaagttcttcctgaacagagaggtgcccagggaggccttagccttcattatacggagttttgggggtgaagtctcttgggacaaaagtctatgcatcggcgcaacatacgatgtcactgactcccggatcactcaccaaatagtggaccgcccagggcagcagacaagcgtcatcggaaggtgctatgtgcaaccccagtgggtgttcgacagcgtgaacgccaggctgctgctgccagtggctgagtacttttccggcgttcaactgccaccgcacctttcgcccttcgtgacggagaaggagggggactacgtcccaccagaaaagctgaagctacttgctctccagagaggagaagacccaggaaaccttaacgagtctgaggaagaagaggaagaagacgataacaatgagggtgatggtgatgaggagggtgagaatgaagaagaagaggaggatgcagaggccggaagtgagaaggaggaggaggccaggctggccgcactcgaggagcagcgcatggagggtaaaaagccacgcgttatggccggtaccttaaagctggaagacaaacagcgccttgcgcaagaggaggaatctgaagccaagcggttggccattatgatgatgaaaaagcgggagaagtacctatatcagaaaattatgttcggaaagcggcgaaagatcagggaagccaacaagttggccgagaagagaaaagcgcacgatgaggctgtgcggagcgaaaaaaaagcaaagaaggcacggccagaatag

SEQ ID NO: 30033 - DNA, 1350 bp, Artificial Sequence
  Description of Artificial Sequence: Synthetic coding sequence
atgtgttttttgttcagcacctttcctaggaccggcaagtgtcacgtccagaccatccagttgtgccgaagactcactgtcgagttcatgcattacattattgcggctagagcactacgtaaagtctttttaagcataaagggaatttattatcaggcggaggtcctcggtcaaccaattgtttggatcactccttacgccttcagtcacgaccaccccacggatgtggattatagggtcatggccacgtttaccgaattttatacaacactactgggctttgttaacttccgattgtaccaactgttgaatctacactaccccccaaagttggaagggcaggcacaagccgaggccaaagctggcgaaggtacttacgcactggacagcgaatcatgcatggaaaagttggccgctctctcagccagcttggcccgtgtggtcgtgcccgcaactgaggaagaggccgaagtggatgagtttccgactgacggggagatgtcagcacaagaagaggacagacggaaggagttagaagctcaagaaaagcataaaaagctattcgagggattaaagtttttcctaaaccgggaagtccctagggaggctctcgctttcatcattagaagtttcggtggagaggtgagctgggataaaagcctgtgtataggagcaacttatgacgtcactgacagtcgtattacacatcaaatcgtggatcggcctggccaacagacgtccgtgatcggacgatgttacgtgcaaccacagtgggtctttgacagtgtgaatgctcgactgttgttgcccgtcgccgaatacttcagcggagtgcagttgcctccccacctgagcccctttgtcaccgagaaggaaggcgactacgttccacccgaaaagttgaagcttctggcgctgcagcgcggagaggatcccggtaacctgaatgaatctgaggaagaggaagaggaggacgataataatgagggggatggggacgaggagggtgaaaacgaagaagaagaagaggacgccgaggcaggatcagaaaaagaggaggaagccaggctggccgctctggaggaacagaggatggagggaaagaaaccaagagtgatggctggcactttgaagctggaggacaagcagcgcctggcccaagaggaggaatctgaggcgaaaaggctagctatcatgatgatgaagaaacgagaaaaatacctgtaccagaagatcatgtttggtaagaggcgtaaaatcagagaggctaataaattagcagaaaaacgtaaagcacatgatgaggctgtgaggtcagagaagaaggctaagaaggctcgtcctgagtag

SEQ ID NO: 30034 - DNA, 5154 bp, Artificial Sequence
  Description of Artificial Sequence: Synthetic coding sequence
atggagccagccgctgcagccactgtccagcgtttacccgaactgggaagagaggatcgtgcatccgcccctgcagcagccgctgctgctgcggcagctgctgctgctgcggctgcagcacttgcggctgccgctgggggtggcaggagtccggagcccgcactgactcctgctgcgcctagtggcggaaacggttccggctctggcgcaagggaagaagcccctggcgaagcacccccaggaccactccctggcagagccggtggagccggacgtagaagaagacggggagcccctcagccaatcgcgggtggagcagcccctgtgcccggagcagggggaggcgctaattctctgttgcttcgtagggggcgacttaagagaaatttgtctgcagctgccgctgccgcatcctcttccagcagctcatccgcagctgcggcttctcactctcctggggctgcagggctcccagcatcctgctcagccagcgcgtcactgtgtacgagatctctggacaggaagacccttttactcaaacacagacagacactgcagttgcagccttctgaccgggactgggtgcggcaccaactgcaacgtggatgtgttcacgtcttcgataggcacatggcaagcacatacctgcgccctgtcctctgtaccctcgatactactgccggtgaagttgcagcccgactgcttcagctgggacacaagggaggaggcgtggttaaagttctcggacagggaccaggcgctgccgctgcccgagagcccgctgagcctccccctgaagccggtcccagactcgccccacctgagcctcgagacagcgaggtgcctccagctcgcagtgcgcctggggcattcggcggtccccctcgagcccctcccgctgaccttcccctccccgtggggggaccaggtggatggagccgacgggcttctccagctccatcggactcttcccccggtgaaccgttcgtggggggacccgtttcctccccaagagcaccgagaccagttgtttctgacacagaatcttttagtctgagcccctcggctgaaagcgtgtctgatcgccttgatccttattcttcagggggaggatcctcgtctagctcggaagagcttgaagctgatgctgcaagtgcacccacaggcgtgcctggccagcctcggaggcctggccatccagcacagccactgccactaccacagacagcctccagcccacagccacagcagaaggcaccaagagcgatcgacagcccaggaggagcagtccgggagggctcatgtgaggaaaaagccgcagccgctgttgcaccaggcggtctccaaagcactcccggtcgctctggggttactgctgagaaggccccacctcccccacctccacccactctctacgtgcagctgcacggtgagacaactaggcggctggaggccgaggagaaaccactacagattcagaatgactacctgtttcagctgggttttggcgagctgtggagagttcaggaggagggcatggactcggagattggatgcctaatccggttttacgcgggaaagccacatagtacaggatctagcgaaaggatacaactgagtgggatgtataacgtgcgtaaggggaagatgcagttgcctgtcaacaggtggactagacgtcaagtgattctctgtggcacatgtcttatcgtttccagcgtgaaggacagtctgacgggcaaaatgcatgtcctgccacttataggcggaaaagtagaagaggttaagaaacaccagcactgtctggcgttctcttccagcggcccacaaagtcaaacttattacatctgcttcgacacatttactgaatatttaaggtggctaagacaggttagtaaagttgcctctcagcggataagtagtgttgacctcagctgttgtagccttgagcacctgccggctaatctcttctattctcaggatctgactcatttgaatttaaagcagaatttcctgagacagaatccaagtcttccagccgcacgaggtttgaacgagctacagcgatttacgaagttgaagagccttaatctgtccaacaaccatctcggtgatttccccctggctgtatgctccatcccaacattggccgagctgaatgtatcgtgtaacgcgcttaggagtgtcccggcagctgttggtgtgatgcacaacttgcaaacatttttgctggacgggaactttctccagagcttgcctgcagaactggaaaacatgaagcaactaagctacctgggtttaagcttcaacgagtttacagatattcctgaagtgcttgagaagctcacagccgtggacaaactgtgcatgagtgggaactgtgttgagactctgcgacttcaggctctacggaagatgcctcacattaagcacgtcgaccttcgcctgaacgtgattcgaaagctaattgctgacgaagttgactttttgcagcatgttacacagctagatctgcgcgacaataagcttggggacctcgacgccatgatttttaacaatatcgaagtgctccactgcgagcggaaccagctcgtcaccctagatatttgtgggtactttctgaaagcactgtacgccagtagtaatgagcttgtgcagctggatgtctaccctgtcccaaattacttatcttatatggacgtaagcagaaaccgactggagaacgtaccagaatgggtgtgcgagtctaggaagttggaagttctcgacattggtcataatcagatatgcgagctgccggctagactgttttgtaatagcagcttgcgtaaactgttagctggccataatcagttggccaggctgcctgagcgcctcgaaagaaccagcgtagaggtcctcgatgtgcaacataaccagctgctggagcttcctccgaacctactgatgaaagctgatagtttaagattcctcaacgcgagcgccaataagctggagtcgctccccccagctacactgagtgaggagaccaattctatcctgcaggagctatacttgactaataatagcctgaccgacaagtgcgtgcctcttctcacaggccaccctcacctgaaaatcttgcacatggcctataatagactgcaaagtttcccagcatcaaaaatggccaagctcgaggaactggaggagatcgatctgtctggaaataaactgaaagctattccgaccaccattatgaactgtcgcaggatgcatacagtgattgctcactctaactgtatcgaagtgttccctgaggttatgcaactgcctgagatcaagtgcgtggatctgtcatgtaatgaactatccgaagtgacccttcccgagaatctcccacctaagctccaagagttggacctcaccggtaacccacgcttagtcctggatcacaagactctcgaactgttgaacaacatccgatgctttaaaattgatcaaccctctacaggcgatgcctccggtgcccctgctgtttggtcgcacgggtacactgaggcttcgggagtgaaaaataagttatgtgtcgccgcactgagcgttaacaacttctgcgataatagggaggccttatatggagtgtttgacggagaccggaacgtggaggtgccgtacctgctgcaatgtaccatgtccgacatcctcgccgaggaactgcagaaaactaaaaacgaggaggaatacatggtgaacacttttatcgtcatgcaaaggaaactcggcactgccggacaaaagctgggaggggcagccgttctctgtcatatcaagcatgatcccgtggatcccggaggatcattcacgctcacttccgccaacgtgggcaagtgtcaaacagtgctctgcaggaacgggaaacccctgcccctcagtcggtcctatatcatgagctgtgaggaggagttaaaaagaattaaacaacacaaggctatcattactgaagacggcaaagttaatggcgtgactgagtctacaaggattctgggctatacgttcctgcacccaagcgtggtcccacgtcctcatgtgcagtctgtgctcctgaccccgcaggacgagttctttatccttgggtcaaaagggctctgggattcactatccgtcgaggaggcagtggaagctgtcaggaacgtccccgatgctctagccgcagctaagaagctttgtaccctggcccagtcctatggctgtcatgacagcatttctgccgtggtggtgcagctgtccgtcacagaggattcattctgctgctgcgagttgagcgccggtggcgctgtgccccctccttctcccggaatctttcccccttcagtcaacatggtgatcaaggatcgccctagcgacggactgggggtgccatcctcatcatcaggcatggccagcgaaatcagctcggagctctcaaccagcgaaatgagctcggaagttggttccactgcaagcgacgagcctccccctggggctctgtctgagaactctcccgcatatccctccgagcagagatgtatgctgcaccctatctgtcttagtaattcctttcagcggcaactgagttcagccaccttctcctctgccttcagcgataacggacttgactcggatgatgaagagcccatagaaggcgtgtttactaacggctccagagtggaggtagaagtggatatacattgtagccgagctaaggagaaagagaagcagcagcaccttctccaagtacctgccgaagcttctgacgaaggcattgtgatctccgcgaacgaggatgagcctggtctgccacggaaagccgatttttccgcggtggggaccataggacgcagacgagcgaatgggtcagtcgcacctcaggaaagatcacataatgtgatcgaggtggcgacagacgctccgctgagaaaacccggaggatactttgccgcacctgcccaaccagacccagatgaccaatttatcatcccgccagaactggaagaggaggtgaaagaaatcatgaagcaccatcaggagcaacaacaacagcagcagccgccaccaccccctcagctgcagccacagttgccacgccattatcagttagaccagctgcctgactattatgataccccgttatat

SEQ ID NO: 30035 - DNA, 3618 bp, Artificial Sequence
  Description of Artificial Sequence: Synthetic coding sequence
atggatagcgaaatcggctgtctcatccgcttttacgccggaaagcctcactctaccggaagcagcgaaagaatccagctgtcggggatgtataacgtgagaaagggaaaaatgcagttgccagttaatcggtggactagacgccaagtgatcctgtgtgggacttgcctgatcgtttcatccgtgaaggactctctgacaggcaagatgcacgtcttgccactgataggtggaaaagtcgaggaggtaaagaagcatcagcactgcctggccttctcttccagcgggccacagtcccagacttattacatctgttttgatacgtttaccgagtatcttagatggttgcggcaggtgtccaaagtagccagccagcggatctcatccgtggatctgagctgctgctcgctcgagcacctgcccgcaaatctgttttactcacaggatttaacccatctaaacctcaagcagaactttctaagacagaacccttctctccccgcagccagggggcttaacgagctgcagcgtttcactaagctcaaatccctcaacctcagcaataatcatctgggggacttcccactggctgtctgctccatcccaaccttggcggagctcaacgtcagttgtaatgctctgagaagcgtgccggctgctgtcggggtgatgcataacttacagacatttcttcttgatggtaacttcttacagtctttacctgcggagctagagaatatgaagcaattatcctatctgggcctgagctttaacgagtttactgacattccagaggtcctcgaaaagctgacagccgtcgataaattatgcatgagcggcaattgtgtcgagaccttgaggctgcaggccctgcggaagatgcctcacatcaagcatgtggatctacggctgaacgtgatcagaaagcttattgccgatgaggttgacttcctccagcacgtcacacaactcgacttacgggataacaagctaggtgacctggatgccatgatcttcaacaatattgaggtgctccattgtgaaaggaatcaactcgtgacgttagatatctgtgggtacttcctcaaggccctgtatgcgtcatccaatgagctggtgcagctggacgtctatccagttccaaactatctgtcatacatggatgtgagccgaaacaggctcgaaaatgtccctgagtgggtgtgcgaaagcaggaagctggaggttctcgatattggtcataaccagatctgcgagctgccagcaagactgttctgcaactctagcctgagaaaactgctggctgggcacaaccagctggcaaggctgcccgaacgacttgagcgcacgtcggttgaggtcctggatgtgcaacacaatcagcttctggagctgccgccaaatttgctgatgaaggcagacagtttgagatttctcaacgccagcgctaacaaacttgagtcccttccaccagctacgttgagcgaggagactaactccatcctgcaggagctgtatctgactaataactctttgaccgacaagtgtgtcccactgctgaccggccacccccatctgaagatcttacacatggcgtacaaccgcttacaaagttttccagcttcaaagatggccaagcttgaggagttggaggaaatcgaccttagtggcaacaagcttaaggcgatccccacaaccataatgaattgtcgtaggatgcatacggtgatagctcacagcaattgtatcgaagtttttccggaggtcatgcagttaccagagattaagtgtgtcgacctgagctgtaacgagctttccgaggtgaccctgccggaaaatctcccccctaagctgcaggagcttgacctcacagggaatccccgactggtccttgatcacaagacactcgagctccttaataacattcgatgctttaaaattgatcagccatctacaggcgacgccagtggagcacccgctgtgtggtcccatgggtataccgaagccagcggggtgaagaacaaactgtgcgttgcggcactgtctgtgaacaacttctgcgataatagggaagccctctatggagttttcgatggggatcgaaacgtagaagttccttatttgctgcagtgcaccatgagtgacatactcgcagaagaactgcaaaaaacaaaaaatgaagaagagtacatggtgaacacatttattgtcatgcagcggaaactggggactgccggacaaaaacttggaggagctgcggtgctgtgtcacattaaacacgatcctgtggatccgggaggcagttttacccttacttcagccaacgtcggaaagtgccagaccgttctctgtaggaacggaaagcctcttccactttccagatcctacatcatgtcttgtgaagaggagcttaaacgcattaagcagcacaaggcgatcatcacagaagacggaaaagtaaatggagtcactgagtccactaggatcctcggttatactttcctccatccttctgtagtgccaagaccgcacgttcagagtgtgctcctgacaccgcaggacgagtttttcatccttgggtccaaaggcctgtgggactccttgagcgtggaggaagcagtggaggctgtgaggaatgtccccgatgcacttgcggctgccaaaaaattatgtacattggcccagagttatgggtgtcacgactcgattagcgctgtggtcgtccaactgagcgttactgaagatagtttttgttgctgtgaactgtcagctggtggtgccgtgccgccaccttctcctgggatatttcctccgtccgtgaacatggttatcaaagataggccctccgatgggctcggggtgcctagcagctcatctggaatggcttccgagataagttccgagctctctaccagtgagatgtctagcgaggttggatccactgctagtgatgaaccaccccctggcgcattgtctgagaactcgccagcctatccctccgaacagaggtgtatgctccaccctatttgcctgtccaactcttttcaacggcaactgagctcagccacgttttcctcagcttttagtgataatggcctcgatagcgatgacgaagagccaatagagggggtgtttaccaacggcagcagggttgaagtagaagtggacatccattgtagcagggctaaggagaaggaaaagcaacaacaccttttacaggttcctgccgaggcttcggatgagggcattgtgatctccgccaatgaagacgagcctggccttccgaggaaagcggacttttctgccgtgggcactattggtcggcgtcgggcaaacgggagcgtggcaccgcaagagcgcagccacaacgtcattgaggttgcaaccgacgcgcctctgagaaagcctgggggatacttcgccgcacccgcacagcctgaccccgatgatcagttcattatccctcctgagcttgaggaagaagtcaaggaaattatgaagcatcatcaggagcagcagcagcaacaacagcccccaccgccaccccagctgcaaccgcagctgccgagacattaccagttggatcagcttcctgactattacgacaccccactctag

SEQ ID NO: 30036 - DNA, 2379 bp, Artificial Sequence
  Description of Artificial Sequence: Synthetic coding sequence
atgcacatcctgcccctggtcggcggaaaaattgaagaggtcaagagaagacagtacagcctagctttcagctcagctggagcacaggctcaaacataccatgtgtccttcgagaccctggctgagtaccagaggtggcagcgtcaagcaagcaaagtggtgtcccagcggattagtaccgtggacctgtcctgttattctcttgaggaagtgcctgaacacctcttttacagtcaagatatcacatacctcaacctgcgtcacaattttatgcaattggagaggccgggaggattggatactctgtataagttctcacagctgaagggcctcaacttgagccacaataagctcggtctcttcccaatactgttgtgcgagattagtacactaaccgagctgaacctgtcctgtaacggcttccacgacttacccagccaaattggtaacctgcttaatctgcagaccctgtgcctggacggcaatttcttaactacacttccagaggaactggggaatctgcaacagctgtcttccctcgggatctcctttaataacttcagtcagatccctgaggtttatgagaaactaacgatgctggaccgggtggtgatggcaggtaattgcctcgaagtgcttaacctgggtgtcctgaacaggatgaatcacattaaacacgtagacctgagaatgaaccacttgaaaactatggttatcgaaaacttagaggggaataagcacattacacatgtggatctgcgagacaaccgcttgaccgatctcgatctgtcctccctctgctccctcgagcaactgcactgcggacgaaaccagcttagagaactgaccctgagcggcttctccctgcggaccctctacgcctctagtaatcgacttactgccgtcaacgtctatccggtgccatccctgctcaccttcctggatctttcacgcaacctgctggagtgcgtgcccgattgggcttgtgaagctaagaaaatcgaggttctagatgtttcctataacctcctaactgaagtccccgtgcgcatactcagcagtttgagcttgcgaaagctgatgttggggcacaatcacgtgcagaacctgccaaccctcgtcgaacatattcccctggaggtcctcgatctgcagcacaatgcactgacccggcttcctgatactttgttctccaaagccctcaacctgagatacctgaatgccagcgcaaactcattggagtcactcccatctgcttgtacaggagaggaatcacttagcatgctacagctactgtacctcactaacaacctactgactgaccaatgcataccggtcctggtgggacacctccacctgcgaatcctgcacctggccaacaaccagctccagacgttcccagcgtccaagctgaacaaactggaacagctggaggaattaaatctttcggggaacaagctcaagacgatccctacaacaattgcgaattgtaagcgtttacacaccttagtggcacacagcaataacatcagcattttcccagaaattcttcagctaccacagattcagttcgtcgatctgtcctgcaatgacctcactgaaattctgattcccgaggctctgcctgcaaccttacaggatctggaccttaccggtaacaccaatctcgttctagagcacaagaccttagacatatttagtcacattactaccctgaaaatcgaccaaaagcccctccccacaactgacagcactgtcacctctaccttctggagccacggactggctgaaatggcgggacagagaaacaaattgtgcgtttctgcattggccatggatagctttgccgaaggggttggggctgtttatggcatgttcgatggagaccggaatgaagaactgcctaggctgctccaatgtaccatggccgacgtgctcctggaggaggtacaacagagcaccaacgacactgtgtttatggctaacaccttcctggtttctcatcgcaagctgggcatggcgggtcagaagctgggctcgtctgcactcctgtgctatattcgccctgacactgctgacccggcatcaagctttagcctgactgtggctaacgttggaacttgtcaggcagtactgtgcaggggaggcaagcccgtgccgctgtccaaagtgttcagtcttgagcaagatccggaggaagcccagcgagttaaggaccaaaaggcaatcatcaccgaggtacccgaggatctcaaagagttccaaactactgatatccccgtgcatcactgtaattttagggccgtgcttggttgcttgtgtagcgcatccgtgcttggctcctacgcaggaccagccccaaggtggagaagaacgtag

SEQ ID NO: 30037 - DNA, 3972 bp, Artificial Sequence
  Description of Artificial Sequence: Synthetic coding sequence
atgaagcggaatggttcacggaattgtctgaaccgacggtcacgcttcggcagtagggaaagagactggctcagggaagacgtaaagcggggatgtgtctacttgtacggcgctgacacaacaacggccaccactacaacaactacaagctcatcaagcagctcctcttccagttccagcgacctgcacttagtcttatgcaccgtcgagacccccgcatcagagatttgtgccggtgaaggaagggagtcactgtatctacagctgcacggagacctggtgaggagactggagccaaccgagagacccctgcagatcgtttacgactacctgtccagactgggctttgacgaccctgtcaggattcaggaagaggcaacaaatccagacctggggtgcatgatccgcttctatggtgagaagccttgtcacatggatcgactggatcggattttgctctcagggatttataacgtcaggaaaggcaaaacacagctacacaagtgggcagagcggctagtggtgttatgtgggacatgcctcatagtgtcttccgtcaaggactgtcagacaggaaaaatgcacattctgcccctggtcgggggaaaaatagaggaggtgaagcgtcgccagtactctttagccttttcatccgctggggctcaggctcagacgtatcacgtatccttcgaaacactggccgagtatcagcgctggcagcgtcaagctagcaaggtggttagccagagaatctccaccgtggacctctcatgttacagcctggaagaggtgcccgagcacttgttctatagccaggacatcacttacctgaatttgcgccataattttatgcagttagaaagacctggaggtctagacactctttacaagttctctcagctgaaaggcctcaatctctctcataataaacttgggttgtttccgatcctgttatgcgaaattagcactttgacagaactgaatttgtcttgcaacgggtttcatgacctgccttcccaaattggtaacttgctcaatctgcagacactttgtttggacggcaacttcttgaccaccctcccagaggaactggggaatctccagcagctgtcttccttgggcatttcattcaacaatttctcccagattccggaggtgtacgagaaactcaccatgttggatcgggtagtcatggcgggaaactgtttggaagttcttaatctgggcgtgttgaacaggatgaaccacatcaagcacgtagatctgcgaatgaaccatcttaagaccatggtgatcgaaaacctggaagggaacaagcatattacccatgtcgaccttagggacaacagactgacagatcttgatctgagctccctgtgcagtttggaacagttgcattgcgggagaaaccaactcagagagttaaccttatctggcttctccctgcggaccttgtacgctagtagcaacagattaaccgccgtgaacgtataccctgttccatccctgctgactttcctcgatctgtccagaaaccttctcgagtgcgtcccagattgggcatgcgaggctaaaaagatagaggtgctggatgtctcttacaacctcctgaccgaagtgcccgtgaggatcttgtcaagtctgtctcttcgcaaactcatgttagggcacaatcacgtgcagaacctgcccaccctagtggagcacatccctctggaggtcctcgatctacaacacaacgcgctgacgcgccttcccgacacactgttttcgaaagccctcaacctgcgatatctcaatgctagtgcgaactcattagagtctctgccttcagcctgtactggggaagaatcgctgtcgatgcttcagctcttgtatttgacaaataacctgcttaccgaccagtgtattcctgttctggtgggccatcttcatctcagaattttgcatctagcgaacaaccagctgcagacgtttccagcaagtaaactcaataagctggagcaattggaagagctcaacctatccggaaacaagcttaaaaccatcccaacgaccatcgctaactgcaaacggttgcacaccctggtcgcccacagcaacaatatcagtatctttccagagatcctgcagctgccacaaatacagttcgtggacctgagctgtaatgacctgacagaaattctgatcccagaggctctgccggctaccctgcaggacctcgacttaactggcaacactaacctggtgttagaacataaaacacttgacatcttctcccacatcaccaccttaaagattgatcagaagccattaccaaccactgacagtacagtgacttctacattctggtcccacgggttggccgagatggcgggtcagcggaacaagctatgcgtgagtgccctcgctatggattcattcgccgaaggcgttggggcagtgtacggcatgttcgatggagatagaaatgaagaactacccagactgcttcagtgcacgatggcagacgtgctgctcgaagaggtgcaacagagtacgaacgataccgtcttcatggctaacactttcctggtctcacatagaaagttgggtatggcagggcaaaagctcgggagtagcgccctcctctgctacatccggcctgataccgccgatcccgcttcttcattcagcctgaccgtggctaatgtcggtacttgtcaagctgtcctgtgcagaggaggcaaaccagtacccctgtcaaaggtcttctctctggaacaggacccggaggaagcacagcgggtgaaagatcaaaaagcgatcatcaccgaagataacaaagtcaacggggtgacctgctgtacacggatgctggggtgcacttacttgtacccttggattttgcctaaaccacacatctcatctacaccgctgaccatccaggacgagctcctgatactgggcaataaggctttgtgggagcatttgtcctacacagaggccgtgaatgcagttcgacacgtgcaggaccctctggcggctgctaagaaactatgtactcttgcgcagagttatggatgtcaggacaatgtcggcgcaatggttgtgtatctgaacattggcgaagagggatgcacatgcgaaatgaacgggttaactttgccgggaccagtgggctttgcttccacaactaccatcaaagacgctcctaagcccgcaaccccttcatcctcaagcggcatcgcgagtgagttctcttcggagatgtcaactagcgaggtgtcatccgaggttggctctacagcaagcgacgagcataatgcaggaggcctcgacaccgctttgttaccccgtcctgaaagaaggtgtagcctccaccccacgcctacctccggtttattccagcggcaaccctcttcagccaccttttcttctaatcagtccgacaacggactcgattctgacgacgaccaacccgtggagggtgtgatcacgaatggcagcaaggtggaggtggaggttgatatacactgttgtcgtgggcgagacctggaaaacagtcctcctctgatcgagagcagtccgacgctgtgttctgaggagcatgccagaggcagctgttttggaatccgaagacagaacagtgtgaacagcggcatgctgttgccaatgagcaaagaccggatggagctgcagaaatccccctccacaagctgcctttatgggaaaaagctgtccaacggttctatcgtccccctggaggacagtctcaatctgattgaagttgccaccgaagtgcccaagcggaagacgggttatttcgctgcccctactcagatggagccagaagaccagtttgtggtcccgcacgatttggaggaggaagtaaaagaacagatgaaacagcaccaagatagtcggttggagcctgagcctcatgaagaagatagaactgagcctccggaagaatttgacacagcgctctag

SEQ ID NO: 30038 - DNA, 2871 bp, Artificial Sequence
  Description of Artificial Sequence: Synthetic coding sequence
atgaaacgcaatggtagccgaaattgtctcaatcggagatccaggttcggcagccgcgagcgggactggctgcgtgaggatgtcaaaagaggatgtgtctacttgtatggggcagacactacgacggctactaccactactacgacgagtagcagttcctcatcctcgagctcgtccagtgatttgcacttagtactgtgcacagtcgagacacccgcttcggaaatctgcgctggggaaggacgagaatctctttatcttcaactccatggcgacctagtgcggcgactggagcccacagagcgaccgttgcagatagtttacgactatttaagtaggctgggcttcgatgaccctgttcggattcaagaggaagctacaaaccccgacctgggatgcatgatccgcttctacggcgagaagccatgccacatggatcggcttgatcggatactgctttccggcatatacaatgtccgtaaagggaaaacacagctgcataaatgggcggagcggctggtggttctctgcggcacatgcttaattgtctcttcagtcaaggactgccagacaggtaagatgcatatcctgcccctggtcggcggaaagattgaggaggtcaagcgacgccagtatagcctcgcgtttagttccgcaggcgctcaggctcagacatatcacgtgtctttcgaaactctcgcagagtatcagcgctggcagcggcaggccagcaaggtcgtgtctcagaggattagcacagtggacttaagttgctactccctggaggaggtgccggaacatctgttctactcacaagatattacatatctgaatctgcgccacaacttcatgcagctcgaacgccctgggggtcttgacaccttgtataagttttcgcagttgaagggactgaatctgagccacaacaaacttggcctgtttcctattctgctgtgcgaaatctcgactctgaccgaactaaatctgtcttgcaacggtttccacgatttaccatctcaaatcggtaacctgctgaacttgcaaacgctgtgtctggatgggaatttcctgaccactctaccagaggagctaggcaacctgcagcagctctcttcactcggcatcagcttcaacaatttcagtcagattccggaagtatacgaaaagctgaccatgcttgaccgcgttgtgatggcaggaaactgcctggaggtacttaacctgggagtactgaatcggatgaaccatatcaaacacgtagacctgcgcatgaatcatctcaagactatggttattgaaaacctcgagggaaacaaacacataacgcacgtggatcttcgcgataaccgcctcactgacctggatctctcatccttgtgtagtttggaacagctccattgcggccgaaatcagttgcgtgagttgaccctgtcgggcttttctctgagaacactctatgcatcttccaatcggctgaccgctgtcaacgtttatccggtcccttctctcttgaccttccttgatttaagtcggaacctgctggagtgtgtgccagactgggcgtgtgaggccaaaaagatagaggttttggatgtgagttataacttgctgaccgaagtacctgtacgcatcctaagcagtctgtcccttcggaagttaatgctgggacacaaccatgtgcagaacttacccacgctggtggagcatatacctctggaggtcctcgacctgcagcataatgcactaacccgacttccagatactctattcagtaaagctctgaacctgagatacctgaatgcttcagccaactcattggaatctctgcctagtgcctgcacaggggaggagtccctgtccatgctgcagctcttgtatttgacaaacaacctcttaaccgatcagtgtatccccgtactggttgggcatctgcacctccgcatcctgcacctcgctaacaaccagctacaaacctttcccgctagcaaactcaacaaactcgagcagctcgaagagctgaacctcagtggcaacaagctcaaaacaatcccgactacaattgcaaactgcaagagacttcataccctcgtagctcactcaaataatatcagtattttccccgagatcctgcaactcccccagatacaatttgttgacctgagctgcaatgatttgaccgagatcctcatccccgaggccttaccagccaccctccaggatctggacctcacgggtaacactaacttagtgctggagcacaagactctggacattttttcccatatcaccactctcaagattgaccaaaagcccttaccaacaacggattcgacagtgacctccaccttttggtcccacgggctagccgaaatggctggacaaaggaataagctctgtgtaagcgcattggcgatggactcttttgcagagggcgtgggcgcagtgtatgggatgttcgatggtgacaggaacgaggagcttccacgactcctgcagtgtactatggcagacgtcctgctcgaagaagtccaacagagcactaatgacactgtgtttatggcaaacacttttttggtgtctcacaggaagctaggcatggctgggcagaagctgggatctagcgcgctcctgtgctatattcggcctgataccgctgaccccgcaagttcattcagtctcaccgtcgccaatgtggggacatgtcaggcagtactatgcaggggtggcaagccggttcctttgagcaaagtgttcagcctggaacaagatcccgaggaggcccagagagtaaaggaccagaaggcgatcatcacggaaaattgggtcttgaatcagaaacacctccaggattttcccggagaggataaatag

SEQ ID NO: 30039 - DNA, 3771 bp, Artificial Sequence
  Description of Artificial Sequence: Synthetic coding sequence
atgaagagaaacggaagtcgaaactgcttgaaccgcagatcacgctttggctcccgagagcgcgactggcttcgcgaagacgtcaagcgaggatgtgtctacctttatggcgctgacaccactactgcaaccactacgaccaccacgtcatctagttcttcaagctcttcaagctcttctgacctgcacctggtgctatgtacagtggagacccctgccagcgagatctgtgctggagagggcagagagtctttatacttacaattgcatggagatcttgtacgccgtctggagccaacagagaggcccttacaaatagtctacgactacctgagtcggttgggtttcgacgatcctgtgaggatacaggaggaggctaccaatccagaccttggctgtatgattcggttctacggggaaaagccgtgccatatggacagactagaccgaatccttctgtctggcatctacaacgtgaggaagggaaagacacaacttcataagtgggcggagaggctggtcgtgctgtgtggaacctgcctgatagtcagctccgtcaaggactgccaaaccggcaagatgcatattctccccctggtgggtggaaaaatcgaagaagttaagagacgtcagtactccttagcgttctcgtcagctggggcacaggctcagacctaccacgtgtcttttgaaaccttagcagaatatcaaagatggcagagacaggcaagtaaggtggtgtctcagaggatttcaacagtggatctgtcctgctatagcctggaggaggtcccagagcatctcttctactctcaggacattacctacctgaacctgcgccataatttcatgcagctggagcgtccaggaggcctggacacattgtataagttcagccagcttaaaggactgaatctctctcacaataagctgggcctcttcccgatcctgctatgcgaaattagcaccctgactgaactaaatctgtcttgcaatggatttcacgatcttccgagtcagattgggaacttgctgaacctccagactctgtgcctggacgggaatttcctaacgaccctgcctgaagagctgggcaatctgcagcaactgtcaagcctcgggatttcatttaacaacttttcgcaaattcctgaagtatacgaaaaacttacaatgctggaccgagtcgtcatggccggaaattgtttggaagtgctcaatctgggtgtgctgaaccgcatgaatcacattaaacatgtggatctacgaatgaaccacctcaagactatggtgattgaaaacctggaaggaaataagcatataacccacgtggatctcagggataaccgactgaccgacctggatctcagttctctgtgctctctggaacagcttcattgcgggagaaatcaactgcgtgagctgactctctccggatttagcctgcggaccctgtacgctagctccaataggcttacggccgtaaacgtgtaccccgtgccatcgctgctgacctttttggatctgagtcggaatctactggaatgtgtcccagattgggcctgcgaagctaaaaagatcgaggtgttagacgtgtcctataatttactgactgaggtcccagtaagaatcctgagctccctgtcactgaggaagttgatgttaggccacaaccacgtccaaaatctgcccaccctggttgagcacatcccattagaggtgctggacttgcagcataacgccctcacccggttgcccgatactctgtttagcaaggccttaaataagctgaacaagctggaacagttagaggagctcaatctatcaggaaacaaactgaaaactatccctacgaccatcgctaattgtaaaagactgcatacactggtagcacatagtaataacatttctatctttccagagattctgcagcttccacagatccaattcgtggacctgtcgtgcaacgatctgaccgaaattttgatcccagaggcccttcctgcaactctgcaggacctggacctgacagggaatactaacttagtgctcgagcacaaaacccttgatatctttagtcacattaccacactgaagatcgatcaaaagcctcttcctacaacggattccaccgtaacaagcaccttctggtcccatggcctcgccgagatggccggacagcgcaataagctttgcgtgagtgcactggccatggatagtttcgcagagggggtgggagccgtgtatggcatgttcgacggtgataggaatgaagaattgcctcgcctgctacagtgcacaatggccgacgtcttactcgaggaggttcaacagtctactaatgacactgtctttatggcaaacacattcttggtttcacaccgcaagttaggcatggcaggccagaagctgggttcgtctgccctgctctgctatatcagaccagacacagctgaccctgcctcttccttctcactgaccgtggctaacgtgggcacttgtcaggccgtattgtgccgcggtggtaaacccgtccccctgtcgaaagtcttttccctcgagcaggaccctgaagaggcccagcgcgtcaaggatcagaaggccattataaccgaagataataaggtgaacggtgtaacttgctgtactcggatgctaggctgtacatacctttacccctggattctccccaagccccatatctcttcaactccactgacaatccaggacgagctcctgattctaggcaacaaggccctttgggagcatctgtcctacacagaggctgtgaacgcagttcgacacgtccaagacccattagccgcagcaaagaagctgtgtactcttgctcaatcttacggctgtcaagacaacgtgggcgctatggtcgtttacctcaacatcggcgaggagggatgcacttgcgaaatgaacgggctgacactccctggccctgtgggatttgcctccaccaccaccatcaaagacgccccaaaacccgcaacgccttcctcttcttccggtattgctagcgaattctcctctgagatgagcactagcgaggtgagtagtgaagttggttctaccgctagcgatgaacacaacgcaggcggactcgacaccgctttgctgcctaggcctgaacgaaggtgttcgctgcaccccacaccaacgtccgggctcttccaaaggcagccctcatcagctacatttagctctaaccaaagcgacaatggcctagatagtgatgatgatcagcccgtggagggggttataactaacgggtcaaaggtggaagtggaggtggatattcattgttgtaggggcagggatcttgagaacagcccgccactgattgaatctagccccaccctgtgcagcgaagaacatgccaggggtagctgtttcgggattagaaggcagaattccgtaaattctggcatgctgctacctatgtccaaagatcgaatggaacttcagaagtcaccaagtacttcatgtctgtatgggaaaaaactctccaacggctctattgtccccctcgaggatagccttaacctgatagaggttgctaccgaagttcctaagcgcaagactggatatttcgcagctccaacacagatggagcctgaggatcagttcgtagtgcctcacgatctggaggaagaggttaaagagcaaatgaagcagcaccaagattctcggcttgagcccgagccacatgaggaagaccggacagagcccccagaagaattcgataccgctctgtag

SEQ ID NO: 30040 - DNA, 1272 bp, Artificial Sequence
  Description of Artificial Sequence: Synthetic coding sequence
atgaagaggaatgggagccggaactgcctcaaccgtcgatctcggtttggttcccgtgaacgagactggctaagagaagacgtcaagagaggatgcgtatatctttatggggcagatactactaccgccaccaccacaacaaccacaagttcctctagctcaagcagttcctcatcatctgacctgcaccttgtattgtgtacagttgaaacgccagcttccgagatctgtgctggagaaggacgagagagcctctacctgcagctccatggagatttggttcgtcgcttggagcccacagagaggccattacagatcgtttatgactacctgtcgagactcggcttcgacgacccagttcgcattcaggaagaagccactaaccctgacctcgggtgtatgatccgtttctatggcgaaaagccatgccacatggataggctggatcgcattcttctcagcggaatctataacgtgaggaagggtaagacacagctgcacaaatgggctgagcggctagtggtgctctgtggcacatgcctgatcgtctctagcgtcaaagactgccagacaggcaagatgcacattctgcctctcgtcgggggaaaaatagaggaagtaaaaaggcgccagtacagcctagctttctcttccgcaggagcccaagcacaaacataccacgttagctttgaaactttggctgaataccagagatggcagcgacaggcaagcaaagtggtgtcccaacggatttccaccgtcgacctgtcatgctactccctcgaagaggtgccagagcaccttttttactcccaagatataacttatctcaatctgcgacacaatttcatgcagctcgaaaggcccggtgggctggacactctgtacaaattctcccagctgaagggccttaacttgtcacacaacaaattgggcctgttcccgatccttctgtgtgaaatctccacgctgacggagctgaacctgagttgtaacggattccatgaccttcccagccagatcggtaatctacttaatttgcagaccctgtgtcttgacggaaattttctaaccacgctaccggaggaactcggcaatctacaacagctaagcagtctggggattagcttcaacaacttctcacaaattccagaggtgtatgagaaacttactatgctggaccgagtggttatggcgggaaattgcctcgaggtgctcaatctgggcgtgcttaataggatgaatcacattaaacatgtggaccttaggtag

SEQ ID NO: 30041 - DNA, 501 bp, Artificial Sequence
  Description of Artificial Sequence: Synthetic coding sequence
atggcaggtcagaggaataagctttgtgtgagcgctctggcaatggacagttttgccgagggagttggcgcagtttacgggatgtttgatggcgatcgcaatgaggagttgccaaggctcctgcagtgcactatggctgacgtgctgctcgaagaagtccagcagagcactaatgacacggttttcatggcaaatacctttctggtgtcacaccgaaagctgggaatggcgggtcagaaactgggctcaagcgctttactttgttacattcggccagacacggcagaccccgctagtagcttctcactgactgtggcaaacgtcgggacttgccaggctgttctgtgtcggggaggcaagccagtacccctcagtaaggtctttagcctggagcaggaccctgaggaggcacagagagtgaaagatcagaaagccatcatcacggaaaattgggtgctcaatcagaagcacctccaggattttcctggggaagacaagtag

SEQ ID NO: 30042 - DNA, 3972 bp, Artificial Sequence
  Description of Artificial Sequence: Synthetic coding sequence
atgaagagaaacggatcaagaaattgcttgaatagacggtctagatttggcagcagggaaagggactggctcagagaggatgttaagcgtggctgcgtctatttgtacggcgcagacacgactaccgccacaaccacaaccacaacgagtagtagctcttctagctccagctcttcgtcagacttgcatcttgtgctctgcacggtcgaaactcccgctagtgaaatctgcgctggagaaggacgtgagtcactgtatcttcagctgcacggagatctcgtacgccgattggagccaaccgaacggcctttacagattgtgtacgattatctctcccggttaggcttcgacgaccctgtgcgcatacaggaggaagccacgaatcctgatttggggtgtatgataaggttctacggcgagaaaccatgtcacatggatcgtctagataggatcttactcagcgggatctacaacgttcggaaaggcaagacacagctgcacaagtgggcagagcggttggtggtgctttgtggaacatgcctgattgtctcttcggttaaggattgccaaacaggcaagatgcacattctgccactggtgggagggaaaatcgaagaggtcaagcgcaggcagtatagcctcgccttcagcagcgcgggagctcaggctcagacataccatgtgagtttcgagaccctggcggagtatcagcgatggcagcggcaggcaagtaaagtggtgtctcagaggatctccacagtggacctgtcatgctatagtctcgaggaagttcccgagcacttgttctatagccaggatataacatacctgaacctgagacacaactttatgcagttggaacgcccaggcggactggataccctgtacaaattctctcagctgaagggcctcaatctaagccataataagcttggcctctttccgatattactttgtgagatttcgactctgacagaacttaatctgagctgtaatggcttccacgatttacccagccaaatcggcaacctcctcaacctgcaaactttatgcctggacggcaattttctgaccactctcccggaggagctcggcaatctccagcagctctccagcctggggatttctttcaataatttttcccagattccagaagtgtacgaaaaactaacgatgctggatcgagtggtgatggctggaaactgtctggaagtactgaatcttggagttctgaaccgaatgaaccatattaaacacgtggatctgagaatgaaccacctcaagacgatggtcattgaaaacctagaaggtaacaagcatataacccatgtggacctgcgcgacaatcgacttacagacttggacctgtcctctctgtgctccctagaacaactccactgcggacgcaaccagcttcgggagctgaccctctccgggttttcactccggacattgtacgcctcatcaaaccggctgacagcggtgaacgtgtacccagttccgtcgctgcttacctttttggacctgtcacgtaatctgctggagtgcgtgcccgactgggcatgtgaggccaaaaaaatcgaagttctagacgttagctataatctactcaccgaagtccctgttcggatcctgtccagtctcagtctcagaaaactcatgttgggccataatcacgttcagaacctgcccactctcgttgagcatattcctctggaagtgcttgatctgcagcataatgccttaacccgcctgcctgacactctgttctccaaagcactcaatctaagatacctcaatgcctctgctaatagtctcgaatctctcccatccgcctgtactggagaagagtcacttagcatgctgcagttactatacttgactaacaacctgttgactgaccagtgtatccccgtgctggtggggcacttgcaccttcgaattctgcatctcgccaataaccaattgcagaccttccctgcgagcaaactgaacaagctcgagcagctcgaggagctgaacctatcaggaaataagttgaagactatccccacgacaattgcaaactgcaagcgccttcacacactggtggcccactcaaataacatttcaattttccctgagattctgcagttaccccagattcagttcgtggacctcagttgtaatgaccttaccgaaattctgattcccgaagcattgcccgctaccctccaggacctggacctgacgggcaatactaatttagtgctggaacacaagacactggatattttttcccacattactaccctcaagatcgaccaaaagccactcccaacaacggattccacggtcaccagcaccttttggtctcatggacttgcagagatggctggccagagaaataagctttgtgtatctgccctggcaatggacagctttgctgagggcgtgggcgcagtgtatggaatgttcgatggggataggaacgaggagcttcccagattgctgcaatgcaccatggccgatgtgttactcgaagaggttcaacagtccaccaacgacactgtcttcatggctaacacatttctcgtatcccatcgtaaactgggcatggccggacagaaactgggtagctccgcactgctgtgttacattcgccctgacaccgccgatcccgctagttccttctctctcacagtagccaatgtaggaacctgccaggctgtgctgtgtagaggcggtaagcctgttccgctgagcaaggtgttctctctggagcaggacccagaagaagctcagcgagttaaagatcaaaaggccattatcactgaagacaacaaggtgaatggggtgacctgttgtacgcgcatgcttggatgcacatacctgtacccatggattctgcctaagccccacattagctccactcccctaactatccaagatgagctccttatcctgggtaacaaggccctgtgggagcatctcagctataccgaggccgtgaacgctgtgaggcatgtccaggaccccctggccgcagctaaaaagctttgcacccttgcccagtcatatgggtgccaggacaacgtcggcgcaatggttgtgtacttaaacatcggagaggaggggtgtacctgtgaaatgaatggtctgaccctccccggtcccgtgggatttgcgagcaccactaccatcaaagatgcaccaaaaccagccacaccctcttcatcttccggtattgcgtcagaatttagtagtgaaatgagcacttctgaagtttctagtgaagtgggttcaactgctagcgatgagcataatgccggaggtttagacaccgctctccttccaaggccggaaaggagatgctcacttcacccaacaccaacctccgggctgttccagcggcaacccagcagcgctaccttctccagtaaccaaagtgataatggcctcgactctgatgatgaccagcccgtggaaggcgtgattaccaatggatcaaaggttgaagtggaggtggatatacactgttgtagggggagagacttagagaattctcctccattgattgaatcctcgccaaccttgtgtagtgaagagcatgcacggggtagctgcttcggtatccgcaggcagaactcagttaattccggcatgctgctacccatgtctaaggatcgtatggaactgcagaagtccccgtctacctcctgcctttacgggaaaaagctgtctaatggcagtattgttcccctggaggattcgctgaatttaatagaggtggccaccgaggtacccaagcggaaaacgggctatttcgcagcacctacacaaatggagcccgaagaccagttcgtggtaccacacgatttagaagaagaagtcaaggagcagatgaagcagcatcaggattctcgcctcgagcctgagcctcacgaggaagaccgcacggaacctccagaggagtttgacacagccctctag

SEQ ID NO: 30043 - DNA, 1212 bp, Artificial Sequence
  Description of Artificial Sequence: Synthetic coding sequence
atgaccgccatcatcaaggagatcgtgagtaggaataagagacggtatcaggaagatggcttcgacctcgacctgacatatatatatcccaatataatcgccatgggtttccctgccgaacgcctggagggtgtgtaccgcaataacatagacgatgtcgttagattcctagactctaagcataaaaaccactacaaaatctacaatctgtgcgcagagcggcactacgacacagcgaaattcaactgccgcgttgcgcagtatccatttgaagaccacaaccccccacagctggaactgatcaagccattttgtgaagacctggaccagtggttgtcagaggacgataatcacgttgccgcaattcactgcaaagcaggcaaaggtcgcactggcgtcatgatttgtgcttacctgctgcacagaggcaagttcctgaaggcacaggaggcactggacttttacggcgaagtgcgcacacgcgacaaaaagggagttaccatcccaagccagaggcgatatgtgtattactactcatatctgcttaaaaatcaccttgactatcggcctgtcgcacttctgtttcataagatgatgtttgaaactatacccatgttctcagggggaacctgtaacccgcagttcgtcgtgtgccagctgaaagtgaagatttattcttcaaactcgggtccaacgagacgcgaagataagtttatgtatttcgagtttccacagccgttacctgtgtgcggggacatcaaagtcgaattctttcataaacagaacaaaatgctgaagaaggataagatgtttcatttttgggttaacacattctttattccgggaccggaggaaacatccgaaaaagtcgaaaatggaagcctctgcgatcaggagatagattctatttgttccatcgagagagcagataacgacaaagaatacctcgtactgacactgaccaaaaatgatctggataaggctaacaaggacaaagccaaccgttacttctctccgaattttaaagtgaaactctatttcacgaagaccgttgaggagccatccaaccctgaggcaagcagcagcacgagcgtcacccctgacgtctctgataatgaacccgaccattaccgctatagtgacactacggacagcgatcccgaaaatgaaccttttgacgaggaccaacacacccagattacaaaggtgtag

SEQ ID NO: 30044 - DNA, 531 bp, Artificial Sequence
  Description of Artificial Sequence: Synthetic coding sequence
atggggaaagccgctgcagctgtggcctttggcgcagaagtcggtgtgcgcctggcactgttcgcagcatttctggtaaccgagttattgcccccatttcagaggttgatacaaccggaagaaatgtggctatacagaaatccttacgtggaggcagagtactttccaacgaagcccatgttcgttatcgcctttctctcacccctgtcactgatctttctggcaaagttcctcaagaaagcagatacacgggattctcggcaggcatgcctggctgcctccttggctctggcgctcaacggcgtgttcactaatacgatcaagctcattgtcggcagaccgagacctgacttcttttacaggtgttttcctgacgggttggctcactcagatctcatgtgcaccggagataaggacgttgttaatgagggtaggaaatcctttccgagcggacactctagctgtatgaacatcatctggacattaccatatgcctgctttcatattattgaatttaacttagaaagttag

SEQ ID NO: 30045 - DNA, 651 bp, Artificial Sequence
  Description of Artificial Sequence: Synthetic coding sequence
atggggaaggctgccgctgcggtcgcctttggcgctgaagtgggggttagattagccctcttcgcagcatttctagtgacagaactgctgcctcccttccagcggctcatccagccggaagaaatgtggctgtatcgcaatccatatgtagaggctgaatactttcccaccaagcctatgttcgtgattgccttcctgtcccctctgtccctgatattcctggctaagttcctgaaaaaggcagatacccgggacagccggcaggcatgtttagcggcatctctggccctggcactgaacggcgtgttcaccaacacgattaagctcatagtgggcaggccacgaccggattttttctatcgatgcttccccgatggccttgcacactctgatctgatgtgtacgggggacaaggacgtcgtcaacgaaggacggaaatcattcccttccggccattccagcttcgccttcgcaggcctggcatttgcaagcttttatctagctggtaaactgcattgcttcaccccccagggtcgagggaaaagctggcggttctgcgcattcctgtctcccctgctgttcgcagccgtaatcgctctgtcaaggacatgcgactacaaacatcactggcagggtcccttcaagtggtag

SEQ ID NO: 30046 - DNA, 795 bp, Artificial Sequence
  Description of Artificial Sequence: Synthetic coding sequence
atgggaaaggcagctgccgcagtggccttcggagctgaggtgggcgttagactcgccctttttgccgcttttctagtcaccgaactgctccctcctttccagcgcctgatccaacccgaagaaatgtggctgtacagaaatccctacgtcgaagcagagtacttcccgactaagccaatgttcgtgatcgcgtttttgagccctttgtctctgatcttcctggcgaagtttctgaaaaaggcggacacaagagattctcgccaagcctgtttggccgcatcactagcgctggcgctgaatggggtgtttactaacaccatcaagttgatcgtggggagaccaagacctgactttttctaccggtgtttccctgatggacttgcacattctgatctgatgtgcaccggagataaggatgtcgtaaatgaggggagaaagtctttcccatcgggccatagttccttcgcctttgccggactggcttttgcaagtttctacttggctgggaaattgcattgttttactcctcagggtagaggtaagtcatggagattctgcgctttcctctcaccccttcttttcgccgcagtcatcgcgctgagcagaacatgcgattataaacaccactggcaggacgtgttggttggaagcatgattggaatgacgtttgcatatgtatgctatcggcaatactaccctcctctgaccgatgctgaatgccacaagccatttcaggataagctagtcctttctacagcccagaagccaggtgattcctactgtttcgacatttag

SEQ ID NO: 30047 - DNA, 1086 bp, Artificial Sequence
  Description of Artificial Sequence: Synthetic coding sequence
atgcacggcgattatacactgacactccggaaaggaggcaacaacaaactgataaagatctttcaccgcgatggtaagtatggattctccgacccgctgacattctcttccgtggtggaacttattaaccactaccgaaacgaaagtctggctcagtataatcccaaattggacgtgaagttgctgtaccctgtctctaagtaccagcaggaccaagtcgtgaaagaagacaacattgaagcagttgggaagaagcttcacgaatataatactcaatttcaggaaaagtcccgggagtatgacaggctatacgaggaatacacccggacgtcacaggagattcagatgaaacgcacggccatagaggcatttaacgaaactataaaaatcttcgaagaacagtgccagacgcaggagcgctactcaaaagagtatattgagaaattcaagcgtgagggcaatgaaaaggagatccagcgtattatgcataactacgacaagctaaagagccgaatctctgagattattgattcccggaggcgactggaagaggacttgaagaagcaggccgcagaatacagggagattgataagagaatgaactcaatcaaaccggacctgattcagttgcggaaaacccgtgaccagtatcttatgtggcttactcagaagggagtgagacaaaaaaaactgaacgaatggttgggtaacgagaacaccgaggaccaatacagcttagtggaagatgacgaggacctcccgcaccatgatgaaaaaacgtggaatgtggggagcagtaacagaaacaaggctgaaaaccttttgagaggtaaaagggatggtacgtttctggtacgggaatctagcaagcaaggttgctatgcatgcagcgttgtcgtggatggcgaagtcaaacattgcgtaatcaataaaactgctaccggatatggattcgctgaaccctataacttgtatagctccttaaaggagctcgtgctacactatcaacatacatccctagtccagcataatgattctttgaacgtcacacttgcttatcccgtttacgctcagcagagacgctag

SEQ ID NO: 30048 - DNA, 3207 bp, Artificial Sequence
  Description of Artificial Sequence: Synthetic coding sequence
atgcctcctcgcccatctagcggagaactctggggcattcatctgatgcccccacgcattcttgtggaatgtctgttgcccaacgggatgatcgttacgttagagtgtctgcgagaggctaccttgattactattaaacatgagcttttcaaagaggccaggaagtacccgcttcaccagctgttgcaagatgagtcttcttacatcttcgttagcgtcactcaggaagccgagagggaggaatttttcgacgagacccgtcgcctgtgtgacttgcggctgtttcagccattccttaaggtgattgaacccgtgggaaatcgtgaagagaaaattctgaatcgtgagatcggtttcgccattggtatgcccgtgtgtgagttcgacatggtgaaggacccagaagtgcaggacttcaggcggaatatcctgaatgtatgtaaggaggccgttgatctgcgcgatctgaattcgccacacagtcgtgccatgtacgtgtatccacccaacgtggagtccagcccagagctcccaaaacatatttacaacaaattagataaaggacagatcatcgttgtgatttgggttatcgtgagtccaaacaatgataaacagaagtataccctcaagattaatcacgattgtgtgcctgagcaagtgatcgctgaggctatacgaaaaaagacacgcagcatgctgctcagttccgagcagctgaaactgtgtgtgctggaatatcagggaaagtatatactgaaagtgtgtggatgcgacgagtactttctggaaaagtatccacttagtcaatacaaatacatccggtcttgcattatgctgggacgaatgccaaatctgatgctaatggcaaaagagtccctgtactcccaactgccaatggactgctttaccatgccttcgtatagcagacgcatcagcacagcgaccccatacatgaacggagagacctccaccaagagtttgtgggtgataaatagcgcactcaggatcaagattttgtgtgcaacctacgtgaatgttaatatccgggacatcgataaaatctatgtacgtacgggaatctaccatggcggtgagcccctgtgcgataatgtcaatacccagagagtgccttgtagcaacccgaggtggaatgagtggctaaattacgatatatatatccccgatctccctagggcagcccgactttgtctttctatttgtagtgtaaaggggaggaagggggctaaggaggagcattgtccgctggcctggggaaatattaatttgttcgactatacagataccttagtcagtggcaaaatggccctgaatctttggcccgtgccccatggtctagaggatttgttgaacccaattggtgttaccgggtcaaatccgaacaaggaaactccatgcctggaactggaatttgactggtttagtagcgtcgtcaaattccctgacatgagtgtgatcgaggagcacgccaattggagcgtgtcacgagaggcaggcttcagctatagccatgcaggcctgtccaatagactcgcacgcgataacgaattacgtgagaatgacaaggaacagttgaaggctattagcactcgggatccattgtccgagatcactgagcaagagaaagacttcctgtggagccaccgtcattactgcgtcaccatccctgagatcttacctaagctgctcctatcggtgaagtggaactctcgggatgaggttgcacagatgtactgtctcgtcaaagattggccacccattaagcctgaacaagccatggagctgctggattgtaattatcccgacccgatggttcgcggattcgccgtgagatgcttggagaagtatttgacggatgacaagctctcccagtatctgatccaactagtgcaggtcctgaagtatgaacagtatctggataacctgcttgtgaggttcctactgaagaaggcccttaccaatcagagaattggacatttctttttctggcacttaaagtcggaaatgcataacaagacagtttcgcagcgtttcggactcctgcttgaaagctattgtcgcgcatgcggaatgtacctcaagcacttgaatcgacaggtagaagcaatggagaaacttatcaatttaaccgacatcttgaagcaagaaaaaaaagatgaaactcagaaggttcagatgaaattcctggttgagcagatgagacggccagacttcatggacgcccttcagggattcctatccccacttaacccggcacatcagcttggaaacctccggctggaggaatgccgcataatgagctcggctaagaggccgctgtggttaaattgggaaaacccggatatcatgagtgagctactgtttcagaacaacgaaatcattttcaaaaacggagacgatctgcggcaggacatgctcactctgcagattatccgcattatggagaatatctggcagaatcaaggattagatttgagaatgctgccctacggctgcctgagcattggcgattgcgttggtcttattgaagtggtcagaaactcccatacgattatgcagatccagtgcaagggcggactcaagggggcactgcagttcaattctcacaccctacaccagtggcttaaggacaagaacaagggcgaaatatatgacgctgcaatcgatctcttcacaaggtcttgcgctgggtattgtgtggcaaccttcattctcggaattggagatcgtcacaacagcaatatcatggtaaaagatgacgggcagctttttcacattgacttcgggcattttctggatcataagaagaagaaattcggctacaaacgcgagcgcgtccctttcgtgcttacgcaggatttcctgattgtcatctcaaaaggcgcacaagagtgtaccaaaacccgggaattcgagaggtttcaagaaatgtgctacaaggcctatctggctatccggcagcatgccaacctgttcataaacctgttcagtatgatgcttggtagcggtatgcccgaactacagagctttgacgacattgcgtatatccgcaaaactcttgccctcgataagacagaacaggaggctctggaatacttcatgaagcagatgaacgacgcacaccatggcggatggaccaccaagatggattggatcttccacactattaagcagcatgctctcaattag

SEQ ID NO: 30049 - DNA, 357 bp, Artificial Sequence
  Description of Artificial Sequence: Synthetic coding sequence
atgccacctaggccctcctccggggaattatggggtattcatctaatgccacctaggattcttgtggaatgtctgctcccaaatgggatgatcgtgactctcgagtgcctgagggaagcaacccttatcacaataaagcatgagctcttcaaggaggccagaaagtacccattgcatcagcttctgcaggatgagtcctcctatattttcgtgtccgtcacccaggaggccgaacgagaggagtttttcgacgaaactaggcgtctctgcgaccttcgtctgtttcagccctttctcaaggttatcgaacccgtgggtaatagagaggagaagatcctaaatcgggagatcgggtag

SEQ ID NO: 30050 - DNA, 66 bp, Artificial Sequence
  Description of Artificial Sequence: Synthetic coding sequence
atgcctccaagaccttcttccggagaactgtgggggattcatcttatgcctcccaggatcctgtag

SEQ ID NO: 30051 - DNA, 3213 bp, Artificial Sequence
  Description of Artificial Sequence: Synthetic coding sequence
atgtgtttttcctttataatgcctcccgctatggcagatatcctggatatttgggccgtcgattcgcagatcgcgagcgatggctctattcccgttgatttcttgctgcccactggaatctatatacagctggaagtgccaagggaagctactattagctatatcaagcagatgctgtggaaacaggtgcacaactacccaatgtttaatctgctgatggacatcgattcatacatgttcgcctgcgtcaaccagactgccgtgtacgaagagctggaggacgagacacggcgactctgcgacgttcgacctttcctacccgtgctgaagctcgtgacaaggtcatgtgatccaggtgagaagctggatagcaagatcggagttctcataggaaagggactccatgaatttgacagcctgaaagatccggaagttaacgaattccggcgaaaaatgcgcaaattctcggaagagaaaatactgtcactcgttggcttgtcttggatggactggttaaaacagacctatccgccagaacatgagccgtccatccctgaaaacctggaagataaactgtatgggggtaaattgattgtggcagttcattttgagaactgccaagacgtgttttctttccaggtgtctccaaacatgaaccctatcaaggtgaacgagctggccatccagaaacggctgacaatccacgggaaagaggatgaagtttccccatatgactacgtcctgcaggttagcggaagagtggaatatgtctttggcgaccaccccctgatccagtttcagtatatcagaaactgtgtgatgaaccgcgcactgccgcattttattttagtggaatgttgtaaaatcaagaagatgtatgagcaggagatgatcgcaatcgaggccgctattaacagaaatagctccaatcttcctctgccgctgcctcctaagaaaacaagaattattagtcacgtatgggaaaacaacaatccatttcagatcgtgttagtgaagggcaataaactgaatacagaagaaactgtcaaggttcacgtgagggcagggttgttccacggcaccgagcttctctgtaagacaatagtgtcgtccgaagtctcaggaaagaatgatcacatctggaatgagcccctggaatttgacattaacatctgtgacttgccgaggatggctcggctgtgcttcgccgtgtacgctgtgctagacaaggtgaaaaccaaaaaaagcacaaagacaataaatccatcaaaatatcagactataagaaaggccggtaaagtccactatccagtggcctgggtgaacacgatggtattcgattttaagggacagctgcgcaccggagatatcattctacattcttggtcatcctttccagacgagctcgaggagatgcttaacccgatggggactgtgcagacaaatccttatactgaaaatgccactgctctgcatgtcaagttccctgaaaacaaaaaacagccgtactactatccgccttttgataaaataatcgagaaagcagctgaaatagccagctctgactccgccaacgtgagcagcaggggcggtaagaagtttctccctgtgttaaaggagatcctcgaccgcgatcccctaagtcagctctgcgaaaacgaaatggatctgatatggactcttcgccaggattgtagggagatctttccacagagtctccccaagttgctgctcagcatcaagtggaacaaattggaagacgtggcacaattacaggctctcctccaaatctggccaaaactccctccgagagaagccttggagctcctcgacttcaattaccccgatcagtacgtgagagaatacgcagtgggatgtctcaggcagatgtctgacgaggagttatcccagtaccttctgcaattggtacaggtactgaagtatgaaccatttctcgactgcgccctctctcggttccttctagaacgggctctgggcaatcgccgaatcggccaattccttttctggcacctgcggagtgaggtgcatattccggctgtttcagtccagtttggcgtgatcttagaagcctattgccgaggcagtgtgggacatatgaaagttctgtctaagcaagtggaggcgctgaacaagcttaaaaccctgaattcgctcataaagcttaacgccgtaaagctgaatcgagcaaaggggaaagaggcaatgcatacctgtttgaagcagagcgcttatcgggaggccctaagtgacctgcagagtcctctaaacccctgtgtgattctgtcagagttatatgttgaaaaatgtaagtatatggattctaagatgaaaccactgtggcttgtttataacaataaggtgtttggcgaagactcggtaggggtgatcttcaagaacggagacgatcttcggcaggacatgctgacgcttcagatgctgagactaatggatctgttgtggaaggaggctggactcgatctcagaatgctcccctatggttgtcttgctaccggagatcgatccggcctaatcgaagtcgtgtctacttctgaaaccattgccgatattcagttgaacagctctaacgtggctgcagccgcagcttttaacaaagacgctctcctaaactggctgaaggaatacaattcaggcgacgacctggatcgcgcaatcgaggaatttacactgtcctgcgccggatattgcgtggccagctacgtgctggggatcggcgaccggcactcagataacatcatggtcaaaaaaaccgggcagttatttcatatcgattttggccacatcttgggcaattttaaatctaaatttggaattaagcgggagcgcgtgcccttcattttgacttatgactttatccacgtgatccaacaaggaaagacaggcaacacagagaaattcggtcggttcaggcagtgttgcgaagatgcctacctcatactgcgaagacatggcaacctgttcattaccttgttcgccctcatgcttaccgctggcctgcctgaattaaccagcgtgaaggatatccaatacctcaaggattcgttagccctggggaaatccgaagaagaggcactgaagcagtttaaacagaagttcgacgaagcgctgcgtgagtcctggacaacaaaagtgaattggatggcccatacggtgcgaaaagattatcgatcctag

SEQ ID NO: 30052 - DNA, 303 bp, Artificial Sequence
  Description of Artificial Sequence: Synthetic coding sequence
atgtgcttctctttcattatgcccccagcgatggccgacattctcgatatttgggcagttgacagtcagattgcctcagacggtagcatccccgtcgatttcctgctcccgacaggtatctacatccagctggaagtaccgagggaggcaacaatctcttacattaaacagatgctgtggaaacaggtccataattaccccatgtttaatttattaatggatattgacagctacatgttcgcctgcgtaaatcaaaccgccgtttacgaagaactggaggatgaaacaaggaggttatgctag

SEQ ID NO: 30053 - DNA, 171 bp, Artificial Sequence
  Description of Artificial Sequence: Synthetic coding sequence
atgtgtttcagttttatcatgcccccagccatggctgatattctcgatatttgggcagttgattcacaaatcgcgtccgatggaagcattccggtcgattttctgctaccaaccggcatctatatacagctagaggtgccgagagaagccaccatatcatacattaagtag

SEQ ID NO: 30054 - DNA, 3213 bp, Artificial Sequence
  Description of Artificial Sequence: Synthetic coding sequence
atgtgcttctcatttattatgccccctgccatggctgatattcttgatatctgggccgtggattcacaaatcgccagtgacggcagtatacccgtggattttctgctacctaccggaatctatatccaacttgaggtgccacgagaggcaacaatttcatacatcaaacagatgttgtggaaacaggtgcacaactacccaatgttcaacttgcttatggacatcgacagttatatgtttgcatgtgttaatcagacagccgtctacgaggagttagaagacgagacccggagactgtgcgacgtacggcctttcctaccagtgctgaaactagtgacaagatcttgtgatcccggtgagaagctcgattctaaaattggggtgctgattggaaagggcctgcatgaatttgacagtcttaaagaccccgaggtcaatgagtttcggagaaaaatgagaaagttctccgaagaaaaaatcctaagcctcgtgggcttgtcatggatggactggctcaagcaaacttacccgcctgagcacgagccaagcattcccgagaacctggaggacaagctttacggcggtaaactgatagttgccgtacattttgagaactgtcaggacgttttcagctttcaggtgtcccccaatatgaatcctatcaaggtgaacgaactggccatccaaaaaaggcttacaatccacggtaaagaagatgaagtcagcccctatgactacgtactgcaagtgtcagggagggtggaatatgtgtttggggaccaccccctgatacagttccagtacattagaaactgcgtcatgaacagggctttaccacatttcattctcgtggaatgttgcaaaatcaagaagatgtatgaacaggagatgatcgccattgaggcagccatcaacaggaattccagcaacctgcctctcccactcccacctaagaagactagaatcatatctcatgtgtgggagaataacaatcccttccagatcgtccttgtcaagggaaataagttgaatactgaggagaccgtgaaagtgcacgtgcgagcaggactctttcacggcactgaattattgtgtaagacaattgtttccagtgaggtgtctggaaagaatgatcacatctggaacgagccccttgagttcgacatcaacatctgcgacctgccaagaatggccaggctgtgtttcgcggtgtacgcagtacttgacaaggtgaaaactaaaaaaagcacaaagacgattaatccttccaaatatcagaccattcgtaaagctggaaaggttcattatcccgtggcgtgggttaataccatggtcttcgacttcaaggggcagctgagaacgggggacattatactgcacagctggtcatcttttcccgatgaactcgaagagatgctgaacccaatgggcacagtccagacgaacccttataccgaaaatgctacagcgctacacgtgaaatttccagagaacaagaaacagccgtactattacccaccctttgacaaaattatcgaaaaggccgctgagattgcgagcagcgactcagccaatgttagcagtagaggtggcaagaaatttctgcctgtcttaaaggagatcttagaccgggatcctcttagtcagctgtgcgaaaacgagatggaccttatttggacactgcgccaagattgtcgggagatcttcccgcaaagtttacctaaactgttactgtcaattaagtggaacaagctcgaggatgtggcacagcttcaggctctcctccagatttggcctaagttgcccccacgcgaggccctggagttactggattttaattaccccgatcagtacgtccgcgagtatgctgtggggtgtcttagacagatgagcgatgaggagctatcccagtacctcctgcaactagttcaggttttaaagtacgagccgtttctggactgcgccttaagccgatttcttctggagagagctctgggcaatagacgcatcggacagttcctgttttggcatctacgcagcgaggtccacatcccagctgtgtcagtgcagttcggtgtaatcctggaagcctattgtagaggctcagtgggacacatgaaggtactcagtaagcaggtggaggcccttaacaaactcaagactctgaactccctgattaagttaaacgctgtgaagttgaatagagccaaaggcaaagaggccatgcacacctgcctcaagcagtctgcatatcgcgaagctctcagcgacctgcagtcgccactgaacccctgtgtgattttgagcgaactttatgtcgagaaatgcaagtacatggattccaaaatgaagccgctctggttggtctacaataacaaggtgttcggggaggattctgtgggagtgattttcaagaacggagatgatctccgccaagatatgctcaccctgcagatgttgcggttgatggaccttctttggaaggaggccggtctcgatttgaggatgctaccttacgggtgtctggccaccggtgaccgcagtggcttgatcgaagtcgtgtccacaagcgagaccattgcggacattcaacttaactcttctaatgttgctgccgctgcagctttcaataaagatgcactcttgaactggctgaaggagtacaattcaggagacgatcttgatagagcgatcgaagaatttactctctcttgtgccggatactgcgtagccagctacgtgctcggaataggtgatcgccactcagataacattatggttaaaaaaactggtcagctgttccacattgatttcggccatatcttagggaacttcaaatctaaattcggcatcaaaagagagagagttcccttcattctcacatacgatttcatccatgtcattcagcagggtaaaacggggaatacagagaaattcggcagattccgacagtgctgcgaagacgcatatttaattcttcgaagacacggcaacctatttatcacactgtttgcacttatgttgaccgcaggactgcctgagttgacatccgtgaaggacatacagtaccttaaagatagcttggccttgggcaagagtgaggaggaggcactcaagcagtttaaacagaaattcgatgaggcgctcagggaaagttggactaccaaggtgaattggatggcccatactgtccgtaaggactataggtcttag

SEQ ID NO: 30055 - DNA, 396 bp, Artificial Sequence
  Description of Artificial Sequence: Synthetic coding sequence
atgtgcttttcctttattatgcctcctgctatggccgacattcttgatatatgggcggtagattctcagattgcgtcagatggctctattccagttgatttccttctgccgacaggtatatacatccagcttgaggtacctagggaggccacaatatcgtacattaaacagatgctgtggaagcaagtgcacaattatccaatgtttaacctgctgatggacatcgacagttatatgtttgcatgcgtaaaccagaccgcagtctacgaggaactggaagacgagaccagacggctgtgcgatgtccggccattcctgcccgtgctgaaattagtcacacgatcctgtgatcctggggagaagcttgactccaagattggggtgctcataggctag

SEQ ID NO: 30056 - DNA, 2109 bp, Artificial Sequence
  Description of Artificial Sequence: Synthetic coding sequence
taggtgagggccggactcttccatggcactgaactcttatgcaagaccatcgtatcttctgaagtgtcaggaaaaaatgaccatatctggaatgagccccttgaatttgacattaatatctgcgatctgccaaggatggcaaggctgtgcttcgctgtctatgctgtgctcgataaggtgaagacaaaaaaaagtactaagacgataaacccgtctaagtaccaaaccatcagaaaagccggaaaggtgcactacccagttgcgtgggtcaatacaatggtgttcgactttaaggggcagctgcgcactggggacattatcctgcacagctggtctagctttcccgacgaacttgaggagatgttgaacccaatggggaccgtccaaacaaatccctacacagaaaatgccaccgctctccacgtgaaattccccgagaacaaaaagcagccctattactatccccctttcgacaagtctcgcggtggcaaaaagtttctgcccgttttgaaggagatccttgacagagatcctcttagccaactgtgcgagaacgaaatggacttaatatggacacttagacaagattgtcgcgagatcttcccgcaatcgctgccaaaactactgctgagcatcaagtggaacaagttagaggatgtggcgcagctccaggccttgctccagatctggccaaagctccccccaagggaggccctggagcttctggatttcaattaccccgaccaatacgtcagggagtacgccgtagggtgcctgaggcagatgagtgatgaagagctgtcccagtacctgctccaactcgtgcaggttctgaagtatgagccctttttggactgtgccctgtccagattccttctggaacgcgcactcgggaacagacggatcggtcaatttctgttttggcacctgagatctgaagtgcatattccagctgtaagcgtgcagtttggggtcattctggaggcatattgtcgaggctctgttggccacatgaaagtcttgtccaagcaggtggaggcgctgaacaagttaaaaactctgaacagcctgatcaagctgaacgctgtcaagctcaaccgtgccaaaggaaaagaggcaatgcacacatgtctgaaacagagtgcctaccgcgaggcattgagcgacctccagtcccctctgaacccctgcgttattctctctgagctgtatgtggaaaagtgcaaatacatggacagcaaaatgaaacctctgtggttggtgtataataataaggtgttcggagaggattctgtgggggtgatctttaaaaatggcgacgacctgagacaggatatgctcacattacagatgctccgactgatggacctgctttggaaggaggccggactggatctaaggatgctaccttatggttgtctcgccacaggggaccgcagtgggttgatcgaagtggtctccaccagtgaaacaattgcagacattcagctgaatagttcgaacgttgcagctgccgcagcgtttaataaggacgccctgctgaactggctgaaagaatacaatagtggcgacgatctcgaccgagcgattgaggagttcaccctgagctgcgcagggtattgtgtcgcctcttacgttttggggatcggggacagacatagtgacaacataatggtgaaaaaaaccggacagctttttcatattgactttggacacatactcggaaacttcaagagtaaatttggcattaagagggagcgagtgccctttatcctgacttacgattttattcacgtgattcagcagggtaagacgggaaacaccgaaaagtttgggaggtttcgacagtgctgtgaagatgcgtatctgatcctgcgtcggcacggtaatctgtttattaccctctttgccctgatgctcaccgccggactgcccgagttgacatcagtgaaagacatccagtatctgaaagactcactggctctcggtaagtctgaagaagaagctttgaaacaattcaagcagaaatttgacgaggcactgagggagtcatggacgaccaaggtgaattggatggcacataccgtccgaaaggattacaggtcctag

SEQ ID NO: 30057 - DNA, 1566 bp, Artificial Sequence
  Description of Artificial Sequence: Synthetic coding sequence
atggatctcatctggacattaagacaagactgtagagaaatctttcctcagtctctgcctaagctcctgttgtctataaagtggaacaagcttgaggatgtggcacagctgcaagctttactgcagatatggcccaaattgccacctcgggaggccctcgaactgttagacttcaactacccagaccaatatgtacgcgagtacgcagtggggtgtcttcgacagatgtctgacgaagagctatctcagtacctactgcaactcgtccaggtcctgaaatatgaacctttcctggattgcgccctctcccgattcctgcttgagagagcgctgggaaacaggaggattggacaatttctgttttggcatctgagatctgaagtgcatatcccggcagtgtctgtccagttcggggttattctcgaggcatactgccgcggttccgtgggacacatgaaggtcttgagcaaacaggttgaagccctgaataaactgaaaaccctgaactccctgattaagctgaatgctgtgaagctgaaccgggcaaagggtaaggaggctatgcatacatgtctgaaacagtccgcctaccgcgaagccttgtccgatctgcagagtccccttaacccatgtgtaattttgtccgaactgtacgtggaaaagtgtaagtacatggatagtaaaatgaagcccctgtggttggtgtataacaacaaagtgttcggtgaggactccgtaggcgtcatatttaagaatggtgatgtttgcttcccgttagacttgaggcaggacatgttgaccttgcagatgctgcggctcatggatctgttgtggaaagaagctggcttggatctgcgcatgcttccatatggttgtctggccacaggggaccgaagtggcctaatagaagttgtatcaactagcgaaacaatagctgacattcaactgaacagtagtaatgtggcagctgcagcagcatttaacaaggacgcccttttaaactggctcaaggaatacaactcgggagacgacctggatagagccatcgaagaattcaccctttcctgcgcaggctactgtgtggcgagttatgtgcttgggattggggatagacattccgacaatataatggtgaagaaaacgggccaactgttccacattgacttcgggcatatcctgggtaatttcaagagcaaattcggcatcaagagggaaagggtgccctttattctgacatatgattttattcacgtcatacaacaaggcaaaacgggcaacacagagaagtttggtagattcaggcaatgctgcgaggatgcctacctcatcttgagaaggcacggcaatctgtttataaccctgttcgcgctcatgctgaccgccggtctgccagaactgacctcagttaaggacatccagtacttgaaggacagcctcgcactcggcaaaagcgaggaagaagcccttaagcaatttaaacagaagtttgacgaggccttgagggaaagctggactactaaagtgaactggatggcccatacagttagaaaggattaccgcagctag

SEQ ID NO: 30058 - DNA, 3207 bp, Artificial Sequence
  Description of Artificial Sequence: Synthetic coding sequence
atgccgccaggggttgactgtccaatggaattctggaccaaagaggaaaaccagtctgttgtggtggacttcttgcttcccaccggggtctacctgaactttccagtgagccgtaatgccaatctgtcgacaattaaacagttgctgtggcatcgcgctcagtacgagcctttatttcatatgctttcagggcctgaagcctatgtctttacatgtatcaatcagacggccgagcaacaggaactggaagatgaacaacgaaggctttgtgacgtgcagccctttctcccggttctgcgtctggtcgctagggagggcgacagagtaaagaagctcatcaacagccagatttccctgctgataggtaagggtttgcacgaattcgattctctttgtgatccggaggtgaatgactttagagccaagatgtgccagttctgcgaagaagcagccgctcggaggcagcagctgggctgggaagcctggctacagtacagtttcccactccaattagagccatctgctcagacctggggcccaggcactctccggctgccaaatagagcgctcctcgtgaacgtcaaatttgaaggatctgaggaatcgtttacttttcaggtgtcaaccaaagacgttcccttagctctgatggcttgtgcactgcggaaaaaggctaccgttttccgtcagcccctcgtcgaacagcccgaagattacaccttgcaggtcaacggcagacacgagtatctgtacggatcctaccccttatgccagtttcaggtgcagaaacctcgggcaaaacctccaccaatacccgctaaaaaaccaagtagcgttagcctctggtcccttgagcaaccatttcgcatcgagctcatccagggcagtaaggttaacgccgacgaaagaatgaagttggtggtccaggctgggctgttccatggcaatgagatgctgtgtaaaacagttagctcgtctgaagtgtctgtttgctcagaacccgtctggaaacaacggctggagttcgacattaacatctgtgatctgcctcgtatggccagactttgcttcgccctgtatgcggttatcgagaaagctaaaaaggcacgttcaacaaagaaaaaaagcaaaaaagccgactgtccaatcgcatgggcaaacctgatgctttttgactataaggatcagctcaaaaccggggaacgttgcctgtacatgtggccctccgtccccgacgagaagggcgaactcctcaacccgaccgggacggtgcgatccaaccctaatacagatagtgccgctgctcttttgatatgtttaccggaagtcgcaccacatcccgtttattaccctgccttggaaaagctgcccggagggatgcttctcgcatctagggagtggcgccctgagctgctttggatgaggcttcacgcagaggactcagcccctagccggatgattggggtagcgatgcctggtcttggcgtcctgcccggactggttcaggccccaggagatgcagagtgcagcagactcttacagattctggaactggggcgtcactccgagtgtgtgcacgtaaccgaggaggaacaactccagctccgggagattcttgagcgcaggggctccggggagctctatgagcacgaaaaggacttggtgtggaaactgaggcacgaagtgcaggaacactttcccgaggctcttgccaggctgctcttggtgaccaagtggaacaagcacgaagatgttgcacaagatgccctgcctgccgtgtcatggcccgaattacccgtcctgagtgctttagaactactggatttttcatttcccgattgtcatgtggggtcttttgctataaagtccttacgcaaactgacggatgacgaactgttccagtacctgctgcaacttgttcaagtccttaagtatgagagctatctcgattgtgaactcaccaagtttcttctggatcgcgcacttgctaaccggaaaatcggacattttctcttctggcacctgcgatccgaaatgcacgtcccctctgtagcacttaggttcgggttgattctggaagcctattgtagggggagcactcaccatatgaaagtgctcatgaagcagggcgaagcactgagcaagttaaaagccctgaatgatttcgtgaaactgtcatcccagaagacacccaagcctcaaactaaagagctaatgcacttgtgtatgaggcaggaggcgtacttggaagcccttagccacttacagagccccctggatccatcaaccctgctggctgaggtgtgcgtggagcagtgcacatttatggatagcaagatgaagcccttatggattatgtactccaatgaagaagccggttctggcggatcagtggggatcattttcaagaacggcgatgacttacgccaggacatgcttactctacagatgatccagctgatggatgtactgtggaaacaggaaggactggatctacgaatgaccccctatggctgtttgcccacaggagataggaccggactgattgaagttgttctgcgttcagacacaattgccaacattcaattaaacaaatctaatatggcagccactgcagccttcaacaaggacgcccttctaaattggctgaaatcgaagaatcctggggaagccttggacagagccattgaagagttcactctctcatgcgccggatactgcgttgcgacttacgtccttggtatcggtgacagacattccgataatattatgattcgggaaagtggacagcttttccacatagattttggacacttcctggggaatttcaaaaccaagttcggcatcaaccgagaaagggtgccatttatcctgacctacgattttgtgcacgtcatccagcagggcaaaacaaataacagcgagaaatttgagagattcagaggatattgcgagcgagcatacaccatattgaggcggcacgggctgctttttctgcatcttttcgctctaatgcgcgctgccggattgccggagctttcctgtagcaaagacatccagtatctgaaagactctttagccctcggcaagacagaagaagaggctctcaagcatttcagagtgaagtttaacgaagccctgcgcgaaagctggaaaactaaagtcaactggctggctcataatgtgtccaaagataacagacagtag

SEQ ID NO: 30059 - DNA, 3207 bp, Artificial Sequence
  Description of Artificial Sequence: Synthetic coding sequence
atgccccctggcgtggactgtcctatggagttctggaccaaagaagaaaatcaatcagtagtcgttgactttctactgccaacaggagtgtacttaaattttcccgtgtcccgtaatgctaatctgagtactataaaacagctactgtggcatcgcgctcagtacgaacccctgtttcatatgttatctgggcctgaagcgtatgtgttcacctgtataaaccaaaccgctgagcagcaagagttggaagacgaacagcgtcgcctatgtgatgtgcaacccttccttccggtgctgcggttagtggccagggaaggtgaccgagtgaagaagttgatcaactctcagattagcctgctcattggcaagggccttcatgagtttgattccctgtgtgaccccgaggtgaacgatttccgggctaagatgtgtcagttttgcgaggaagccgctgccagaagacaacagctaggttgggaggcttggttacagtatagctttcccctgcagctggagccatctgcgcagacatggggaccaggcaccttgagactaccaaacagggcgctgctcgttaatgtgaagtttgaaggctccgaggagagctttaccttccaggtatcaactaaagatgtgcccttagctctaatggcatgtgctttaagaaaaaaagccaccgtctttcgccaaccactggtggaacagccagaagattacacccttcaagtcaacggacggcacgagtatctgtacgggagctacccgctttgtcagtttcaggtccagaaaccccgtgccaagccccctcccatacctgcgaagaagccctcttccgtttcattatggagtttagaacagccttttcgtattgaattgatccagggatccaaagtgaatgccgacgagcggatgaagctcgtggttcaagccggtctgtttcacgggaacgagatgctatgcaaaactgtttctagttccgaggtgagcgtgtgctccgagccggtttggaagcaacgactggagtttgacattaacatctgtgacctccctcgaatggcacggctgtgctttgcattgtatgccgtgatcgagaaggcaaaaaaagccaggtcaactaagaagaagagtaagaaagccgattgtcccattgcatgggcgaatctcatgctgtttgattataaagaccagttgaagacaggtgaaagatgtctatatatgtggccatccgtcccggacgagaagggggaactgctcaatcctacggggacagtaagaagcaacccaaatactgattctgccgctgcactcttaatatgtctgccagaggtagcccctcaccccgtctactaccctgcgttagagaaactaccagggggaatgctcctagcatctcgggagtggcgccctgaactcctgtggatgcgcctgcacgccgaagattccgcgccttcgagaatgataggagtggccatgccaggactgggcgtgcttcctggcttagtgcaagcccctggcgatgctgagtgtagtcgactcctccagatcctcgaactgggaagacactctgagtgtgttcacgtgacagaggaggagcagctacaactccgcgagatcctggagcggcgaggctccggtgaactatacgaacacgaaaaagacctggtgtggaaattgaggcacgaagtccaggaacacttccccgaggccctagccaggttgcttctggtgacaaaatggaataagcacgaggacgtcgcccagatgctctacctgctgtgtagctggcctgagttacccgtgctgtctgcgcttgagcttctggatttttccttccctgattgccatgtcgggtcttttgctattaaatcactgaggaaattgacagatgacgagctgtttcagtatttgctgcagttggtacaggtcctcaagtacgagtcctacctggattgtgagctgactaaatttctgttagacagagcactcgctaatcgcaagattggccattttttgttctggcacctccgtagcgaaatgcacgtgccatccgtggctttgagattcggtttgatcttagaggcctattgccggggatcaactcatcacatgaaagttctaatgaaacagggggaagcattgtccaagctgaaggctctaaatgatttcgttaaactttcttcccagaaaacacctaagcctcaaaccaaggagctgatgcatctatgtatgagacaagaagcttacctagaagcactgtcacacctgcaaagcccactcgaccctagtacgctgcttgccgaggtgtgtgtggaacagtgcacttttatggacagcaagatgaagcctctatggattatgtactcaaacgaggaggctggcagtgggggatcagtcggcatcatctttaaaaacggtgatgacctgagacaagatatgttgacactgcaaatgatacaactgatggacgtgctgtggaaacaggagggcctcgacctcagaatgaccccttatggatgtcttcctacgggcgatcgcacaggtctaatcgaggtggtactgcggagtgacactatagcgaacatccaactgaataaatccaacatggctgctactgcagcgttcaacaaagacgccctgttgaactggctgaaaagcaagaatcctggggaagccctagaccgcgctatcgaggaattcaccctgtcttgtgccggatactgtgtcgccacctacgtcctgggcatcggagacagacacagtgacaatattatgatacgggagagcggacagttgttccatattgacttcgggcacttcttagggaacttcaaaaccaaattcgggattaaccgggagcgcgtgccttttattctcacatatgatttcgtccacgtgattcaacagggaaagactaacaattcagagaagttcgagagatttcggggttactgcgagcgcgcttacacgattctgagaaggcatggtctgctgtttctccacctgttcgcgctgatgcgcgcagccggactgcctgagctgtcatgctcaaaagacatacaatatctaaaagactcccttgcactaggtaagacggaggaggaggctctgaagcattttcgggtgaagttcaatgaggctctgagagaatcttggaagactaaggttaattggttagcccacaatgtgtccaaagacaatcgccaatag

SEQ ID NO: 30060 - DNA, 3135 bp, Artificial Sequence
  Description of Artificial Sequence: Synthetic coding sequence
atgccgcctggagtcgattgtcccatggagttttggactaaagaggagaaccagtccgtggttgtcgactttctcctgccaacaggggtgtacctgaactttcctgtttcaagaaatgccaacttgtctaccatcaagcagctcctgtggcatagagcacagtatgaaccactctttcatatgctgtcgggccctgaagcctacgtcttcacctgcatcaatcaaacggcggagcagcaggaactggaggacgagcagaggaggctctgcgacgtacagccttttcttcctgtactgagattggtcgctagagagggcgatagagttaagaagcttatcaatagccagataagtctgctgatcggcaaagggctgcatgagttcgatagcctctgtgatcccgaagtgaacgactttagggctaagatgtgccagttttgtgaggaggctgccgctagacgccagcagctagggtgggaggcttggctacaatattcattccctctacagctggaaccaagcgcgcaaacatggggcccaggcacactgagactgcctaaccgagccctgctggtgaacgtcaagttcgaggggagtgaggagagttttacctttcaagtttcaaccaaggacgtgccactcgcgctgatggcctgtgcactcagaaaaaaagccaccgtgttcagacagcccttagtcgaacaaccggaagattacacattgcaagtgaatgggagacatgaatatttatacggaagctatcctctttgtcaattccaatacatctgttcgtgcctccattctggcctaacgccgcacctgactatggtccattcctcatccatcctggccatgagagacgagcagagtaaccctgcgcctcaggtccaaaaacccagagccaagccacctccgatccccgctaaaaagcccagctctgtctctctgtggtcgctcgaacagccgtttagaatcgaattaattcagggtagcaaggtgaacgcagatgaacggatgaaattggtggtgcaagcgggattgttccacgggaacgaaatgctttgcaagaccgtaagctcttctgaggtctcagtttgcagtgagccagtctggaagcagcggctggaattcgacatcaacatttgcgacctgcctcggatggcaaggctttgctttgccctgtatgccgtcatcgagaaagctaagaaggctaggtctaccaagaagaaatcaaaaaaggccgattgtcccattgcatgggctaatttgatgctcttcgattacaaagaccagctgaagaccggagagaggtgcctctacatgtggcctagtgtgcccgacgagaagggggaactcttgaatccaactgggacagtacgctcgaacccgaatacagattccgcagccgcattgttaatatgcttgcccgaagtagccccacaccctgtctattaccctgccctcgaaaaaatcctcgagttaggcagacatagcgaatgcgttcacgttactgaggaggaacagctacagctgagagagatactggaacggcgtgggtcaggagagctttatgaacacgagaaggacctggtgtggaaactgcggcacgaagttcaagagcatttccccgaggctttggctagacttctcctggtcacgaagtggaacaagcacgaggatgtagctcagatgctgtatctcctgtgcagctggccagaattgccggtcttgtcagctctcgaactgctcgatttttccttccccgactgtcacgtaggttccttcgccataaagtccctgagaaagctcacagatgacgaactgttccagtacctgcttcaactagtgcaggtccttaagtacgagtcctacctggactgtgaactcaccaagttccttctggatcgggctctggctaatcgaaaaataggccacttccttttctggcacttgaggtccgagatgcatgtgccctccgtcgcattgcggttcggactcatcctcgaagcttactgtcgcggaagcactcaccacatgaaagtgctcatgaaacagggtgaagcactctcaaagctcaaagccctgaacgacttcgttaaactttctagccagaaaacccccaagcctcaaacaaaagaactgatgcacttatgtatgaggcaagaggcgtatcttgaagcactttctcacctgcagtccccgcttgatccttctactctgctggccgaggtgtgtgtagaacagtgtacgtttatggattctaaaatgaagccgctgtggatcatgtatagcaacgaggaagcagggtctggtgggtccgtgggtatcattttcaagaacggggacgatctgagacaggacatgctgacattgcagatgatccagctgatggatgttctgtggaaacaagaaggactggatttaagaatgactccatatggctgccttccaacaggggaccggacaggcctaatagaggtggtcctcaggtccgataccatcgccaacatccagctaaacaagtccaacatggccgcaactgctgccttcaacaaggatgccctcctgaactggctcaaatctaagaatccgggtgaagccctagatcgtgctatcgaggaatttacgctgtcctgcgcaggttattgcgtggccacctacgtgctcggcatcggggatagacactcagataatatcatgattcgtgaatccggacagctttttcacattgattttggccatttcctgggcaacttcaaaacaaagtttggcattaaccgcgaaagggtgccattcatcctcacctatgacttcgtgcacgtcattcagcagggcaagacaaacaactccgaaaagtttgaaaggttcagaggttactgtgaacgggcatataccattctgcgccgacatggtttactgttcctgcacctgtttgctttgatgcgcgctgccggactgccggagttgagctgctccaaggatatccagtacctcaaggactccctcgccctaggtaaaacggaggaggaagccctcaaacacttcagagtgaaatttaacgaagcactgagagaatcatggaagacgaaagtcaattggctagcacacaatgtgagtaaagacaaccgtcagtag

SEQ ID NO: 30061 - DNA, 3207 bp, Artificial Sequence
  Description of Artificial Sequence: Synthetic coding sequence
atgcctccaggcgttgactgccctatggagttttggaccaaagaggaaaatcagtcggttgtcgttgattttcttttgcccacaggggtatacctgaattttccagtgagtagaaatgctaacctgtctaccatcaagcagttgctgtggcatagggcccagtatgagcccctgtttcacatgctgtccgggccagaagcctacgtgttcacatgcataaatcagactgctgaacaacaagaactggaagacgagcagcgtaggctgtgtgatgtgcaaccctttctgcccgtcttgagactagtcgcccgagaaggggatagagttaagaagctgattaattcgcaaatctccttactaatcggcaagggattgcacgaatttgatagcctctgcgacccggaagtgaacgactttcgggctaaaatgtgtcaattttgcgaggaggccgcagcgaggcgtcaacagctgggctgggaggcttggctacaatacagcttccctttgcagctggagccctccgctcaaacctggggtccagggaccttaaggctgccaaacagagctctgctcgtgaatgtcaaattcgaagggagcgaagagtcattcacgttccaggtgtccaccaaagatgttcccctggctctgatggcgtgcgctttgcgcaaaaaagccaccgtgtttcggcaacccttggtggaacagccagaggactacaccctccaagtgaatggacgacacgagtacctgtacgggagctaccctctgtgccaattccaagtgcagaagccacgcgcaaaaccaccacctattccagctaaaaaaccctccagcgttagtctatggagtctggagcagcccttccgaatagaactgatccagggttccaaggtgaacgccgatgagaggatgaagctcgtagttcaggccggactgtttcatggaaacgaaatgctatgcaaaacagtaagctcttctgaggtttctgtttgttccgaaccggtatggaaacaaagactggagttcgacatcaacatttgtgacctccccagaatggcccgactgtgctttgccctgtatgccgttattgagaaagccaagaaagcccgaagtactaaaaagaagtctaaaaaggcggactgcccaattgcctgggccaacctgatgctcttcgactacaaagaccaactgaagaccggagagagatgcctctatatgtggcccagcgtccctgatgaaaaaggagagctactgaatccaaccgggaccgttcgcagcaaccctaatacagactcggccgctgccctccttatttgcctacccgaagtcgcccctcaccctgtttactacccagctctggagaagctacccggaggtatgctgctggcttccagagaatggcgaccagaactcttgtggatgcgtctgcatgccgaagactcggccccaagcagaatgatcggggtcgcaatgcctggcctgggagtactccctggtctggtgcaggccccaggggatgccgagtgttcacgcctgttgcagatcctcgagcttggcagacatagcgaatgcgtgcatgtcactgaagaggaacagctccagctgcgggaaattctcgagcggaggggttccggggaactctacgaacacgagaaagaccttgtgtggaagcttcggcacgaagttcaagaacattttccggaagccttggctaggctgttattagtcaccaaatggaataaacacgaggatgtggcgcagatgctttatctactctgtagctggccggagcttcccgtgttgagcgctctcgagctcctggacttctccttccccgattgtcatgttgggtctttcgctattaagagtctgcggaaactgacggacgatgagttatttcagtacctgttgcaattggtgcaagtgctcaagtacgagagctacctcgactgcgagctaacaaaattccttcttgacagagccctggctaaccgaaagattggccacttcctgttttggcacctgagatctgaaatgcacgtaccctcagttgcgcttaggttcggcttgatccttgaagcatattgcagaggttccactcatcatatgaaggtgctgatgaagcagggggaggcgctgagcaagcttaaggcactgaatgattttgttaaactcagttcgcagaagacgccgaagccccagacaaaagagctgatgcacctatgcatgcgccaggaagcctatctggaggccctcagccacctgcagtcaccattagacccatccacgttacttgccgaagtgtgtgtggaacagtgtaccttcatggattctaagatgaaacctctttggataatgtatagcaatgaggaagccggttcaggtggcagcgttggcattatcttcaagaatggagatgacttaaggcaggacatgctcacgctgcaaatgattcaactaatggatgtgttgtggaagcaggaaggcttggatctccgcatgacaccttatgggtgcctccccacaggggatcggactggactgatcgaagttgtcttacgctcagatacgattgcgaacattcaattgaacaaatccaatatggcagccaccgctgctttcaacaaggacgcattgttaaattggttgaagtccaagaaccccggagaggctctggaccgcgctattgaggagttcactctgagttgcgccggttactgcgtggcaacctacgttctcggcattggcgaccggcattcagataacattatgatccgtgagtctggtcagttattccacattgactttgggcattttctggggaattttaagaccaaattcgggatcaatcgggagcgggtcccatttatcctaacatacgatttcgtgcatgtaatccaacaaggcaaaactaataacagcgagaaattcgagagattcagaggctattgtgagagagcttacacgatccttagacggcatggactgctctttctgcaccttttcgcccttatgcgcgctgctggcctgcctgagttgtcatgtagtaaagacattcagtatttaaaggatagcctggcgttgggaaaaactgaggaggaagcattgaagcatttccgggttaaattcaacgaagctttaagggaatcttggaagacaaaagtgaattggctcgctcataacgtaagcaaggacaacagacagtag

SEQ ID NO: 30062 - DNA, 960 bp, Artificial Sequence
  Description of Artificial Sequence: Synthetic coding sequence
atgatccccgagtccagtgaactggttgtccaggctgggctgttccatgggaatgaaatgctctgcaagactgtaagttcatcagaggtgtcggtctgctcggagcccgtgtggaaacagcggctggagttcgacattaatatctgtgaccttccaaggatggcccgactatgctttgccctctacgccgtgattgaaaaggccaagaaagccaggtccactaagaagaaatctaagaaagctgactgtcctattgcctgggctaatctcatgctcttcgactacaaggaccaactgaaaaccggcgagcgctgcctctacatgtggccatctgtacctgacgaaaagggtgaactcctgaaccctacagggacagtcaggtcgaaccccaatactgattcagcggctgctctattgatttgcttacccgaggtggccccacatccagtatactaccccgctcttgaaaagattctggagctaggtcgccatagcgaatgcgtacacgtaacagaagaggaacaactgcagttgcgggagatcctggaacggagagggagtggagagctctatgagcacgagaaggacctggtgtggaagttgagacacgaggtccaagaacactttcccgaggccctggctaggctgctgttagtcactaagtggaataagcatgaggacgtagcccaaatgctctacctgctctgtagttggccggaactgcccgtcctcagcgccctggaacttttggacttctccttcccagattgccacgtaggttcttttgccataaagtctcttaggaagctaaccgatgatgagctcttccagtatctactccagctggttcaggttctaaagtacgaatcttacctcgactgtgaactgacaaagtttctcttagatcgagcgcttgccaacaggaagatcgggcattttttgttctggcatctccgctag

SEQ ID NO: 30063 - DNA, 3309 bp, Artificial Sequence
  Description of Artificial Sequence: Synthetic coding sequence
atggaactggagaactataagcagcctgtggtccttcgcgaagacaactgccgtcgtcgtcggaggatgaaaccccgatctgccgcagcttccctctcatcaatggagcttattcccatcgaatttgtcctccctacctcccaaaggaaatgcaagtcacccgaaacagccctactgcacgttgcaggacacggaaacgtggagcagatgaaggcccaagtgtggcttagagccttagaaacttctgtcgcagcggatttttaccatagattggggccacaccatttcctgctgctatatcagaaaaaaggccaatggtatgaaatctacgataaataccaggtcgtgcaaactctggactgcttacgttattggaaggctacgcacaggtcccccggacaaattcatttagtccagcgccatcccccatccgaagaaagccaggcctttcaacgtcagttaacagctctgatcggttacgatgtgactgacgtgtcaaacgtgcacgatgacgagctggagttcacacgacgcggactggtgaccccaaggatggctgaggtggcttccagagaccccaagttatacgctatgcatccatgggttaccagtaagccgcttcccgagtatctgtggaagaagatcgccaataattgcatttttatcgtcattcatcgctcaacgacatctcaaacgatcaaggtgagtccggatgacactccaggcgctatcctgcagtctttctttactaagatggccaagaaaaagagtcttatggacataccagagagccagtcagagcaggactttgttctgagggtatgcgggcgagatgagtaccttgtgggggagactcccataaagaatttccagtgggtgagacactgtcttaaaaatggcgaggaaattcatgtggtgttagacaccccccctgaccctgctctggacgaagtgaggaaggaggagtggccccttgttgacgattgcaccggcgtgactggataccacgagcagttaacgatccacggaaaagatcatgagtctgtgttcactgtatccctctgggactgtgatcgaaagtttagagtgaagatcagaggtatagatatccccgtcctgccgcgaaatacagacctgactgtcttcgtcgaagccaatattcaacatgggcagcaagttctgtgccagcgacgaacgtcaccaaagcctttcacagaggaagttttatggaatgtgtggctcgaatttagcattaaaatcaaagatcttccaaagggcgctttgctgaatctccaaatttactgcggtaaggcacctgcactctcgagtaaggcttccgccgagtcaccctcatccgagagtaagggcaaggtgcagctgctttattatgtgaatttgcttctcatcgatcacagattcctgctgcggaggggcgagtatgttctgcacatgtggcagatttccggcaaaggcgaagatcagggatcctttaatgccgataaacttactagcgccaccaacccagacaaggagaactcaatgtctatctctatattactggataactactgccacccaattgctcttcctaaacaccaacctaccccagatccggagggcgacagggtcagagcagagatgcctaatcaactgaggaaacagctggaggctatcattgctactgacccgctcaaccctctcacagcagaggacaaggaacttctttggcattttcgctatgagtcgctgaagcatcccaaagcatatcccaagctgttctcttctgtcaaatgggggcaacaggagatcgttgctaaaacgtaccagctgctcgcacggagagaggtctgggatcagagtgcactggacgtgggacttaccatgcaattgctcgactgcaatttttcagatgaaaacgtccgggctattgccgtacagaagctggaatccctggaggacgacgacgtcctacattatctgctccaacttgttcaggccgtgaaatttgaaccataccacgactcagcgctggccagatttctcctgaagcgtggcctgagaaacaaacggattgggcacttcctcttctggttcctaaggagcgaaattgcccagtcacggcactatcagcagcgttttgccgtgattttggaagcttatctgagagggtgtggaaccgctatgctgcatgactttacgcagcaggtgcaagtgatcgaaatgctacagaaggtcaccttggatattaagtccctttccgcggaaaagtacgatgtgtccagccaggtaataagtcagctcaagcagaagctcgagaacctgcagaattcacagctccctgagagctttcgagttccttatgaccccggactcaaggccggtgccctggccatcgaaaagtgcaaggttatggcttctaagaagaagccgttatggctggagtttaagtgtgcagaccctactgccctctcaaacgaaaccatcggaattatcttcaaacatggcgatgatcttcggcaggacatgctgatcctgcagatcttacggatcatggaatctatttgggagacagagagcctggacctgtgtctgttaccctacggctgtatcagcaccggagacaagataggtatgatcgaaatcgtcaaggacgctacaacgatcgccaagatccagcagtcgacagtgggtaatactggagcgtttaaagacgaggtgctaaaccattggctaaaggagaagagcccaacagaggagaagtttcaggctgctgttgaacgatttgtgtatagctgcgccggttattgtgtcgctaccttcgttctcggcattggcgaccggcataacgataacattatgattaccgagacaggaaaccttttccatatagacttcggccacatcctgggcaactacaaatcctttcttggaattaataaggaacgtgtcccgtttgtgttaacgccagacttcctctttgtgatgggaactagtgggaaaaaaaccagtcctcatttccagaagttccaggatatttgtgtgaaggcgtatttggcattaagacaccacacaaatctgttgatcatcttgtttagcatgatgctgatgactggaatgccccagctgactagcaaggaagatatagaatacatccgagacgcactgacagtcgggaagaatgaagaagacgctaagaagtactttctggaccagatcgaggtctgtcgagataagggatggactgtgcaatttaactggttcctgcatctcgttctcggcatcaagcagggcgagaaacactcggcctag

SEQ ID NO: 30064 - DNA, 3309 bp, Artificial Sequence
  Description of Artificial Sequence: Synthetic coding sequence
atggagctcgagaattataagcagcctgtagttctgcgggaagacaactgccgcaggcggagacggatgaagccacgcagcgcagccgcatcattgagcagtatggagctcatacccatagagtttgtgctgccaacatcacaacggaagtgcaaatctcctgagactgctctgttgcacgtggcaggacatggtaatgtagagcaaatgaaagcccaggtgtggctcagggcattggagaccagtgtggccgcagacttttaccacagactggggccacatcattttctgcttttataccagaagaagggacagtggtatgagatttacgataagtaccaagtcgtgcagactctggattgtttgcgatattggaaagctacacacagatcacctggacagatccacttggtgcagaggcatcccccatcagaagagagccaagccttccagcgccagttgacagcactcattggctatgacgttactgatgtgagcaatgtgcacgacgacgagctggagttcacgaggaggggcctggtgacaccccgaatggcggaggtggcttctagggacccgaaactgtatgcaatgcacccgtgggtaacttctaagcccttgcccgaatatttgtggaagaagatcgcaaacaactgtatctttatcgtaatccacaggagcactactagccagacaattaaagtgagccctgatgatacgccaggcgcaattttacagtcatttttcacgaaaatggccaagaagaaaagtctcatggatatacccgaatcacagtcggagcaagattttgtgctacgcgtgtgcggtcgagatgagtacctcgtgggggagaccccgattaagaatttccaatgggttaggcactgcctgaaaaacggcgaggagatccatgtcgtcctcgatactcctccagaccccgctctggacgaggtgaggaaggaagaatggccactggtcgatgattgcacaggggtaaccgggtatcatgagcagcttaccattcatggaaaggatcacgaatccgtctttacagttagcctgtgggactgcgataggaagttcagagttaagatcagggggatcgacatccccgtcttacctcggaacactgaccttacggtcttcgtggaggcaaacatccagcacggtcagcaggtattatgccagcggaggacgtcccctaagcccttcaccgaggaggtgctgtggaatgtgtggctcgagttctctataaaaattaaggatctgccgaagggagctctactgaatctgcagatatactgcggcaaggcacctgcactctcttcaaaggccagtgctgaatccccatccagcgagtccaagggaaaagttcagctcctgtactacgtcaatctgctgttaatcgatcaccgtttcctcctgcgcaggggagaatatgtcctgcatatgtggcagatctccgggaagggcgaggaccaggggtcttttaatgctgacaagcttacaagtgccaccaacccagacaaagaaaattcgatgagtatttcaatcctcctggacaattattgtcacccaatagcgcttccaaagcaccagcctacacctgacccggagggagacagagtccgggcagagatgccaaatcagctccggaaacagttggaggctattatcgccaccgaccctctgaaccccctcaccgcagaggataaggaattgctgtggcacttcagatacgaatccctgaagcatcctaaggcctaccccaagctattttctagcgtgaagtggggtcagcaggagatagtagcgaaaacctatcagctacttgccaggcgggaagtgtgggatcagagtgcgctagatgtgggcttgaccatgcagttgctggactgcaacttttcggacgaaaatgtcagggctattgcagttcaaaagcttgaatccctggaagacgacgatgtactgcattacttactgcagctagtccaggctgtgaagttcgagccataccatgactccgctttggcgaggtttctgctgaagcggggattgcggaacaagagaattggccactttttgttctggttcctacgatctgaaatcgctcagtcgcggcactaccagcagcgttttgcggttatactcgaagcatatctgcgtgggtgcggcactgccatgctccacgattttactcagcaggttcaggtcattgaaatgctgcagaaagtaaccctggatattaagtcattaagtgccgagaaatatgacgtttcctcacaagtaatttcccagctgaaacaaaagctcgaaaacctacagaacagccaactgcctgagagttttagagtgccatacgatcccggactgaaagctggcgcactagccatcgagaagtgtaaagtgatggccagtaaaaagaaacctttgtggttggaattcaaatgtgccgatcccacagctctttctaacgaaaccatagggattatcttcaagcatggcgatgatctccgtcaggacatgttaattctccagatactccggatcatggaaagtatctgggaaacggaaagcttagacctgtgtttattaccttacggttgcatcagcacgggagataagatcggcatgatagagatcgttaaagacgccacaactatagctaagatccagcagtctacggtgggcaacacgggtgcctttaaggacgaagtgctgaaccactggctcaaagagaagagcccaaccgaggaaaaattccaagccgctgtcgaacggttcgtgtactcatgcgcaggctactgcgttgctaccttcgtactcggtataggagaccgacacaatgacaacatcatgatcactgagaccgggaatctttttcacattgacttcggacacatcctgggtaactacaaaagcttcctcggcatcaacaaagaacgcgtcccgttcgtactaacacccgatttcctgttcgtaatggggacatcaggtaagaaaacctcaccacacttccagaaatttcaggatatttgcgtgaaggcatatctcgccctgcggcaccataccaacttgcttatcatcttgttctctatgatgcttatgacagggatgccccagctgacatcaaaagaggatattgagtatattcgcgacgctctgacagtcggtaagaacgaggaggacgccaagaaatacttcctcgatcagattgaagtttgccgggataagggctggactgttcagttcaactggttcctgcatctcgtcctggggataaaacagggggaaaaacattccgcctag

SEQ ID NO: 30065 - DNA, 3309 bp, Artificial Sequence
  Description of Artificial Sequence: Synthetic coding sequence
atggaacttgagaactataagcaacccgttgtactgagggaagataactgtagaaggcggagaagaatgaagccaagatctgcggcagcctccctgtctagcatggagctaataccaattgagttcgttcttcctactagccagcgtaagtgtaaaagtccagagaccgccttgctgcatgttgccggtcatggcaatgtggagcagatgaaagcgcaggtctggctacgcgcactggaaacttccgttgccgcagacttctatcaccggctgggcccacatcattttctactgctgtatcaaaagaaaggtcaatggtacgaaatttacgacaagtaccaggtcgtccagactctggattgcctgcgatactggaaggccactcacaggagtcccggacagatccatcttgtccagagacacccaccatctgaagagtcacaggccttccagcgccaactcacggccctgatcggatacgacgtgacagatgtgtctaatgtgcacgatgacgagctggagtttacccgcagaggacttgttaccccccgtatggccgaggtggcctccagagatccgaagttatacgccatgcacccttgggtgaccagtaaacctctgcccgaatatctgtggaaaaaaatcgccaataattgtatctttatagtgattcatcgctcaaccacctcccagacaatcaaagtgagccccgacgatacccctggggcaatactccagagcttttttacaaaaatggctaagaagaaatcattaatggacatcccagaaagccagtccgagcaggactttgtcctccgggtttgtggccgagatgaatacttagtaggagagacacctatcaagaatttccagtgggtaagacactgcttgaagaacggagaagagattcacgttgttcttgacactccccctgaccccgcattagatgaagtgaggaaggaagagtggccgctggtcgacgattgcactggggtcacaggctatcacgaacagttgaccattcatggtaaagatcacgaatctgtttttaccgtgagtctgtgggactgtgatcgaaaattccgcgtcaagattagaggcatagacatccccgttctgccccgaaacactgatctgaccgtctttgtagaagctaatatacaacatggccagcaggttctgtgtcagcgcagaacaagtccgaaacccttcaccgaggaggtactttggaacgtgtggctagaattttcaatcaaaataaaagatttaccgaagggggcactcctgaatctacagatttattgcggaaaggcccctgccttatcaagtaaggctagtgccgagagccctagcagtgagtctaaaggaaaggtgcaactgctttactacgttaacctgctccttatagaccatcgcttcctcctgcggagaggggagtacgtactgcatatgtggcagatctcggggaagggcgaggatcaagggtctttcaatgcagacaagttaacctccgccacaaatccagacaaggagaacagtatgtctatatctatccttctggataactactgccatcccattgccctgcccaaacaccagcccaccccggatccagagggcgatagggttagagcggagatgcccaatcaactgcgcaaacagctggaggccatcattgccaccgaccccctgaacccactcacagccgaggacaaggagctgctatggcacttcaggtatgagtccttaaaacatccgaaagcctatcctaagctgtttagtagcgtgaaatggggccagcaggaaatcgtggccaaaacatatcagctgctcgctagaagagaagtttgggatcagtcagcactggatgtgggccttactatgcagctattggattgcaatttctccgatgaaaacgttcgtgccatcgccgtacagaagctagagtcacttgaggatgacgatgtgcttcactacctcctccagctcgttcaggccgtgaaatttgagccataccatgacagcgccctggcccgatttttgttaaaaaggggtcttaggaataagagaatcggccacttcttattctggttcctgaggagcgagatagctcagtcaagacactaccaacagagattcgctgtgatcttggaagcatacctgagagggtgcggtaccgccatgctccacgattttacgcagcaagtccaagtgatcgagatgctccaaaaggtcacacttgacatcaagtccttatcagccgagaaatacgatgttagtagtcaggtcatttctcagctgaaacagaaattggagaatctccagaatagccaactgcccgaaagctttagggtcccatacgatcccggactcaaagctggcgctctggccatcgagaagtgcaaagtgatggcttccaaaaagaagccactgtggctggagttcaaatgtgcagatccgactgccctgagtaacgagactatagggatcatttttaagcacggcgacgatctacggcaggacatgctgatactgcagatcttgcggatcatggagtcaatttgggagactgaatctctggacttgtgcctcttaccgtatgggtgcatcagcacaggagataagattggcatgattgaaatcgtcaaggacgcaactaccatcgccaaaatccaacagagcaccgttggtaataccggcgctttcaaagatgaagttctgaaccattggctaaaggaaaaatccccgactgaagaaaaattccaggcagctgtcgaacgatttgtgtatagctgcgctggctattgcgttgctacttttgtccttggaattggcgatcgtcataatgacaacatcatgatcacagagaccggcaatctgttccacatagactttggtcacatcctgggcaactacaaaagctttcttggcattaacaaggagagggtacccttcgtgctaacaccggattttcttttcgttatgggtaccagcggaaaaaagacctccccccacttccaaaagttccaggacatatgcgttaaagcctaccttgcacttcggcatcatacaaatctgctgatcattctcttcagcatgatgctgatgacagggatgccacaattaaccagtaaggaggatattgagtatataagggacgctttaacggtgggaaaaaatgaggaggatgctaagaagtatttcctggaccaaattgaggtctgccgtgacaagggatggacggtccaattcaactggttcttgcatttagtgctcggcattaaacagggtgagaagcatagcgcatag

SEQ ID NO: 30066 - DNA, 5061 bp, Artificial Sequence
  Description of Artificial Sequence: Synthetic coding sequence
atggctcagatctcttctaattctggcttcaaggagtgcccaagttctcacccagaacctacacgcgcaaaagacgttgataaggaggaggcattacagatggaggcagaagccttggccaagcttcaaaaagaccgccaggtgaccgacaatcaaagggggtttgagctctcctccagcacacggaagaaagctcaagtatacaacaagcaggattatgatctgatggtgtttccggagtcagatagtcagaagcgcgctcttgatatcgatgtggagaagctgacccaggccgaactggagaagctgttactcgatgacagtttcgaaactaagaaaacccctgtgttaccggttactccaatcctttctccatctttcagcgcacaactctattttaggcctacaatccaacgcggacagtggcccccaggacttcccggtccctcaacctacgcgctcccgtccatctacccgtccacctatagcaagcaggctgctttccagaacggcttcaatcctcggatgcctaccttcccttctaccgagcctatctatctaagcctgcctggtcagtcaccctatttcagctaccccttaactccggctaccccatttcatccacagggttcattgccaatctacagacccgtggtcagtacagatatggcgaaactatttgacaaaatcgcctctacaagcgaattcctaaaaaacggaaaggctcgtaccgacctggagataacagactccaaagtctccaaccttcaggtaagtccaaaaagcgaagatatttccaaatttgattggttggatctggatcctttgtccaaaccaaaggtggacaacgtggaagtcctcgatcatgaggaggagaaaaatgtatcgtcactgctcgctaaagacccatgggatgcggttctcctcgaggaaagatctaccgccaattgccatctggaaaggaaggtgaatgggaaatccttatcggtcgccactgtcactagaagtcagagcttgaacatccgcacaacccagctggcaaaggcacagggccatatatcgcagaaagaccctaacggaacttcatctctgcctaccggcagttcacttctgcaggaagtcgaggtccagaatgaagagatggctgccttctgccgcagcatcacaaaactgaaaacaaaatttccatatacaaaccatcggacaaaccctgggtacctcctgagtccagtgacagcccagcggaacatctgtggggaaaatgcttcggtcaaggtgagcattgatattgagggcttccagttgccagtcaccttcacttgcgacgttagcagcaccgtggagattattattatgcaggcattgtgttgggttcacgatgatttgaaccaggtggatgtaggatcttacgttctcaaggtctgtggtcaggaggaagtgttgcagaataaccactgcttaggctcccacgaacacatccagaactgtaggaagtgggacaccgaaatccgcctccagctgcttactttttcagctatgtgccagaatctggcccgaaccgctgaagacgacgagactccagtcgacttaaacaagcatctgtaccagattgaaaagccttgtaaagaagccatgaccaggcacccagtggaagaattattagattcctatcacaaccaggtggaactcgctctccagattgagaatcagcaccgcgctgtagatcaggtcattaaggcggtacgcaagatatgctctgccctggatggtgtggagaccctggcgattacggagagcgtgaagaagctcaagcgagcggtgaatctcccccgatccaagacagctgatgtgacaagcctttttggaggggaggacacttccagatcttcgactagaggctcgctgaacccggagaaccctgtccaggtgagcataaaccagctgaccgcagctatctacgatctgttgcggctgcatgccaatagtggtaggagtccaactgactgcgctcagagttcaaaatctgtgaaggaggcttggacaaccaccgaacagttgcagtttaccatctttgcggctcacggtattagctctaattgggtgagtaattacgagaaatactacctgatttgctccttgtcccacaacggaaaagaccttttcaagcccattcagtctaaaaaagtcggaacctataaaaatttcttctacttaatcaagtgggatgaacttattatttttcctattcagataagccagctgcccctcgagtcagtactccacctcacactgttcggaatcctcaaccagtcatcaggcagttcccctgactctaataagcagagaaagggaccggaagccttggggaaggtgagtctgccactcttcgatttcaagcgctttttgacatgcggcacaaaactgttgtacttatggacgtcctcacacacaaacagcgtgccaggtaccgtcaccaaaaagggatacgtgatggaacggattgttctgcaggtcgacttcccgagtcccgcttttgacattatttacacaacgccccaggtcgatcggtcaattatccagcagcacaatctggagactctcgaaaacgatattaagggcaaattgctggacatcctccacaaagattccagcctcgggctttctaaagaagataaagctttcctgtgggagaaacggtattactgcttcaagcacccaaactgcctgccaaagatcctggcaagtgcaccaaattggaagtgggtcaacctagctaagacttattcactgttacaccaatggccggcactgtaccccctcatcgcccttgagctgcttgattccaaattcgctgatcaggaagtgaggtctctcgcagtgacctggatcgaagccattagcgacgatgagcttacagatctcctgccacagttcgtacaggccctgaaatatgaaatctatctcaactccagtctagtccagttccttctgagccgagccttgggaaacatacagatcgcccataatctctattggctcctgaaggatgccctgcacgacgttcagttttcaacgaggtatgagcacgtgctcggtgctctgctgtctgtgggagggaagcggttgagagaagagctcctgaagcagacgaagctggtccagttattaggaggcgttgcagaaaaagtccgccaagcttctggatcagcaaggcaggtggttctccagcggagcatggagcgcgttcagtcatttttccagaaaaacaagtgtagactgccattgaagcccagtctggtcgccaaggaactcaatattaagagctgcagcttcttctcttcaaacgccgttcctctcaaagtgactatggtcaatgcggatccgatgggcgaggaaattaatgtgatgttcaaggttggtgaggatctgcgccaggacatgctggcccttcagatgataaagatcatggataaaatctggcttaaggagggtctggatctgcgcatggtgattttcaagtgcttaagcacaggtagggatcggggaatggtggaactggtgccagcctccgacaccctacggaagatccaggtcgagtacggggtgaccggttcctttaaggataagcctctggctgagtggctccgaaagtataatccctctgaagaagagtatgaaaaggcttccgagaatttcatctactcatgcgctggctgctgcgtggccacctacgtcctgggcatatgcgatcgccacaacgataacattatgctccgatcaaccgggcacatgttccacattgactttggcaagttcctgggtcacgcccagatgttcggttccttcaaaagagatcgtgcaccctttgtgctcacaagcgatatggcgtacgtcatcaatgggggagagaagcccactataaggtttcagttattcgtggacctttgttgtcaagcgtacaacttgataagaaaacagacgaatttattcctcaatctcctgtcccttatgattccatctggtctgcctgagctgacctccatccaagacctcaaatatgtgcgggatgccttgcaaccgcagactacggacgccgaggcaactatctttttcacccggctgattgagtcgtccctgggttccatcgctaccaagtttaatttctttattcataatttggcccagttgcggttcagtggccttccctccaatgacgaacccattctaagtttctcccctaaaacatactccttccgacaagacggcaggattaaggaggtgagcgtgtttacgtatcataaaaagtataacccagacaagcactacatttatgtagtgcgcatcctccgggagggacagatcgagccatcgtttgtgttccgaactttcgatgaattccaggagttgcataacaagctctccataatttttcctctctggaaactgccaggattcccgaatcgcatggtactgggccgtacgcacatcaaagacgtcgccgctaagcgcaagatcgaactaaacagctacttacaatctctgatgaacgcgtccactgatgttgctgagtgcgacctagtttgtactttcttccacccgctgttaagggatgagaaggccgaagggattgcaaggtcagctgacgccggatccttctctccaacccctggccagatagggggtgctgtgaaactgagtatatcctatcgcaacgggactctctttatcatggtaatgcatatcaaggatctggtgaccgaggacggggcagaccccaatccctacgtgaaaacttatctactgccagacaaccataagacctccaagcgtaagactaagataagtcgcaagacccgaaatcccacatttaatgaaatgctggtatactccggctattcaaaggaaactctcagacagagagaactgcagctgtcagtgttgtcagccgagagcctgagggaaaatttcttcctcggaggagtgacactcccgcttaaagattttaacttgtcaaaggagactgttaaatggtaccagctgaccgcggctacctacctctag

SEQ ID NO: 30067 - DNA, 393 bp, Artificial Sequence
  Description of Artificial Sequence: Synthetic coding sequence
atggcacagattagctctaactcaggatttaaagagtgccctagctcacacccggaacctactcgcgctaaggacgtggacaaagaagaggccctccagatggaggccgaggccctggctaaactccagaaggacaggcaagttaccgacaaccaacggggatttgaactgtcaagctctacccgcaaaaaggctcaagtgtacaataagcaggattacgatctaatggtcttcccggagagtgactcccaaaaacgagctctggacatagacgtcgaaaagttgacacaggcagagctagaaaagctgttactcgacgatagtttcgaaacgaaaaagactccagtattgccggttactccaatattgagccccagttttagtgcacagtag

SEQ ID NO: 30068 - DNA, 1452 bp, Artificial Sequence
  Description of Artificial Sequence: Synthetic coding sequence
atggcccaaatctcaagcaattctggtttcaaggagtgcccctctagtcaccccgagcccacaagagccaaggacgtcgataaggaggaggcacttcaaatggaggcggaagcactggcgaagctacaaaaagaccggcaggtgacagataaccagagagggtttgaactgtctagcagcaccaggaaaaaggcacaagtgtataacaaacaggattacgacctcatggtgtttcctgaatctgacagccagaagcgggcactggatattgacgtcgaaaagctcacacaagctgagttggaaaaactgctgctcgatgacagtttcgagactaaaaagacacctgtgttacctgtgaccccaatcctatcccccagcttttccgctcagctttatttcaggcctaccattcagcgtggacagtggccccctggcttacctggtcccagtacttatgcccttcccagcatctacccttctacgtattccaaacaggccgcattccagaatggcttcaaccctagaatgcccacttttccttctacagagccaatttaccttagcctccctggtcagagtccatacttttcctacccccttacgcctgccacccctttccatccgcagggttcgctcccgatttatcgacccgtggtgagtacagacatggctaaactgtttgacaagattgcatctacttcagagtttctgaagaatggcaaagctagaacagatttggaaatcacggacagcaaggtctctaacctgcaggtcagccccaagtccgaggatatttccaagttcgactggctcgacttggacccactcagcaaacctaaggtagacaatgttgaagtcctggatcatgaagaggagaaaaacgtcagctccctcctagccaaagatccatgggacgctgtccttctggaggaaaggtctacagccaactgccatctcgagaggaaagtcaacggcaagtctctgtcggtggcgacggtcacccgaagtcaatcactgaacattcgtaccacccagctggccaaagcgcagggtcatatttctcaaaaggaccctaatgggaccagctcgctcccaacaggatcatccttgctccaggaggtggaggttcagaatgaagaaatggctgcattttgcagatctataacaaagttgaaaaccaagtttccctacacgaaccacaggaccaaccccggttatctcttaagccctgtgactgcccagcggaatatatgcggggagaacgccagcgtcaaagtcagcatcgacattgaagggttccagttgcctgtaacatttacttgtgatgtctcgtcaacagtagagataattattatgcaagcactgtgttgggtccacgacgatctcaaccaggtcgatgtgggcagttatgttttaaaagtgtgtggtcaggaggaggtgttgcagaaatag

SEQ ID NO: 30069 - DNA, 3921 bp, Artificial Sequence
  Description of Artificial Sequence: Synthetic coding sequence
atggcagctttctgtaggtcgataacaaagttgaaaacaaaattcccctacaccaatcacaggaccaacccgggttacctgttaagccctgtgaccgcccaacgcaacatctgcggtgagaatgcctcggtgaaggtgagtatcgatatagaaggcttccaactaccagtgacattcacatgtgacgtctcctccaccgtcgaaatcatcatcatgcaggccctgtgctgggttcacgatgacctgaaccaggtggatgtgggctcttacgtgctgaaggtgtgcggacaggaggaggtgctacaaaacaatcactgtctaggctcccatgaacatatccagaactgcaggaagtgggacaccgagatacgactgcagctgctcactttttcagctatgtgccagaacctagcacggacggctgaagacgacgagactcctgtggatctcaataaacatctctaccaaatcgagaagccttgcaaggaggcgatgacacgacacccagtggaggaattgctggattcttatcacaaccaggtggagctggctctccaaatcgagaaccagcatcgcgctgttgaccaagtgataaaagcagtgcggaaaatctgttcagcactcgacggcgttgagaccctcgcaataaccgaatccgtgaaaaagcttaagcgtgccgtcaatctcccccgatcaaaaaccgcagatgtgacttctctgttcggtggcgaggatacgtccaggtcatcaacacgcggatctttgaatcccgaaaaccccgtgcaggtttctataaaccagttgacagccgctatatacgacctgctcagactgcatgccaacagcggtcggtcacctacagattgtgctcagagtagcaagagtgtgaaggaagcctggacaactacagagcaactccaattcactatctttgccgctcatggcatcagttcaaattgggtgagtaactatgaaaaatactacttaatttgctccttgagtcataacggtaaggatctcttcaagcctatccaatccaagaaggtcggaacttacaagaattttttttacctcatcaagtgggatgaattgatcattttccctatccagattagtcagttgcccctcgagagcgtactgcacttgaccctattcgggatcctaaatcagagttccggcagtagccccgattctaataagcagcgcaagggcccagaagcgttagggaaagtcagcctgcctctgttcgactttaagcgctttctcacatgcggtacaaagctcctctacctgtggacttcaagccataccaactcagttcctgggaccgtgactaaaaagggctatgtgatggagcgcatcgttctacaggtggacttccccagcccggcatttgatatcatttacaccactccgcaagtggatcgcagcatcatacagcaacacaatctggaaactttggaaaacgatatcaagggcaagctgctggatattctccacaaggattccagccttgggctgtctaaggaagacaaagccttcctgtgggagaagcgctactactgttttaagcacccaaattgcctgccgaagatcctggcgagtgcccctaactggaaatgggtgaatctggccaaaacatactctctgctgcatcagtggccagctctgtatcctctcattgccttggagctcttggattctaagtttgctgatcaagaagtgagatctctcgctgtcacatggatcgaggctataagcgacgatgagcttaccgacctgttgcctcagtttgtgcaagccttgaaatatgagatatatctcaactccagtctcgtccagttcctgctgagccgcgctttaggcaacattcagatcgcgcacaacctgtattggctactcaaggacgcgctgcatgacgtgcagtttagcacgaggtacgaacacgtgttgggagccctcttgtccgttggaggaaagaggctgcgtgaggaactgcttaaacaaaccaagcttgtccagctgctcggaggagttgctgaaaaggttaggcaagccagtggttccgccagacaggtggtactccagcggagtatggaacgtgttcaatccttttttcagaaaaataaatgccgcctgcctctgaaaccgagtctcgtggcaaaggagcttaatatcaagtcctgcagtttctttagctctaacgctgtcccactgaaggtaaccatggttaacgcagatcctatgggcgaagagattaacgtcatgtttaaggtgggtgaagacttgcgacaggatatgttagctttacagatgataaagatcatggacaaaatttggcttaaggagggcctcgatctacgcatggtaatattcaaatgtctgtcaactggtcgagaccgcggaatggtggagctcgtgcccgcatccgataccctgaggaagattcaggtagagtatggagtcaccggaagctttaaggataagcctctggctgaatggcttaggaagtataatcccagtgaagaggagtacgagaaggcttccgaaaacttcatctactcctgtgcaggctgttgtgtggcgacatatgttctgggaatctgtgacagacacaacgacaacatcatgctgcgttcaaccggccatatgtttcacatagatttcggcaagttcctggggcatgcacagatgttcgggtcctttaaacgcgacagagcacctttcgtcctgacatctgatatggcctacgttatcaacggaggggagaagcccacgatccggtttcagcttttcgtggacctctgttgccaagcttacaatctcatcagaaagcagactaatctgtttctgaatctccttagcctcatgataccgagtggcttgccagaactgacttcaatacaggacctaaagtacgtgagagacgcacttcaacctcagacaactgacgccgaggctaccatcttttttactcgattgattgagagtagtctcggatccattgccactaagttcaacttctttatccataacctggcccagttacgcttcagcggcctcccttctaatgatgaaccgattctttctttttctcccaagacgtactctttccgacaggacggccgaattaaggaagtgtctgtctttacctaccacaaaaaatataatccagacaagcattatatctatgtggtcagaatcctgcgggaaggccagattgaaccaagctttgtctttaggacctttgatgagtttcaggagctccacaataagcttagcatcattttcccactctggaagctccctggcttcccaaacagaatggttctagggagaacccacattaaggacgtcgcagcaaagcgtaagattgagctgaacagttatctccagtccctgatgaacgcttcaaccgatgtggccgagtgtgacctggtgtgtactttttttcacccactgttgcgggatgaaaaagccgaaggaatcgccagaagtgctgatgctgggtctttttctcccaccccgggacaaatcggcggagctgtaaaactgtctatctcataccgaaacgggacactattcattatggtcatgcatattaaggatctggtcactgaggatggagcggatccaaacccctacgttaaaacctatttattgcccgataatcacaaaacatccaaacgcaagactaagataagcaggaagacccggaatcctaccttcaatgaaatgttagtttacagcgggtattctaaagagacccttcggcagcgagagctgcagctgtctgtgttgtctgccgagagcttaagagagaacttctttctcggaggagtgacccttcctctcaaagatttcaacctaagcaaagaaacagtgaagtggtatcagctcaccgccgctacctacctgtag

SEQ ID NO: 30070 - DNA, 1947 bp, Artificial Sequence
  Description of Artificial Sequence: Synthetic coding sequence
atggcacagatctcaagtaactctgggtttaaggagtgcccttccagtcatccagaaccaacaagagcaaaggatgtggacaaagaggaagcgctgcagatggaggcagaagcacttgctaagctgcagaaggaccggcaggtcaccgacaatcaacgcggattcgaactgtcgtcctctaccagaaagaaagcccaggtctataacaagcaggattacgacctgatggtctttccggaaagtgatagtcagaagcgtgccttggacattgacgtcgagaaactaactcaggccgagctggagaagttgctgctagatgacagtttcgagacgaagaaaacaccagtgttgcctgtgacgcccatactgtcaccttcctttagtgctcaactgtatttccggccaactatccagcgcggtcagtggcctcctggcctgcctggcccaagcacctacgcccttcctagcatatacccttcaacctattcaaagcaggcagccttccagaacggctttaaccccagaatgcccactttcccttctaccgagcccatttacctgagtctgcccggacagagcccctacttctcgtaccccctcacacccgctacccccttccacccacaggggtctcttcccatttacagacctgtggtaagcacagacatggcaaagctctttgacaaaatcgccagtactagcgaatttttgaagaacggcaaagctcgcaccgacctggagatcactgatagcaaagtgagcaacttacaagtgagtcctaagtccgaggatataagcaaattcgactggctcgatctggacccattaagtaaacccaaggtggacaacgtggaagtccttgaccacgaagaggagaagaatgtgagctcgctcctggctaaagacccgtgggacgcagttttactcgaagagcggtccacagccaattgccatctggagaggaaggtcaacggcaagtccctatccgttgccaccgtcacccgcagccagtccttaaatatccgcaccacgcaactcgcaaaggcccagggacacatttcccagaaggatccaaacggtacttcttcgcttcccacaggatcctcacttctgcaagaggtcgaagttcaaaacgaggagatggctgcattctgtcgctctatcactaagttaaaaacaaaatttccatatacaaaccacaggactaatcctggctatctgctgtctcccgtgaccgcacagaggaatatttgcggagagaacgccagcgtaaaggtctctattgacatcgaaggtttccagcttcccgttacctttacctgcgatgtgagttccacagtagagatcatcataatgcaggctctatgttgggtgcacgacgacttgaaccaggttgacgtcggcagttacgtgctaaaggtttgtggacaagaggaagtgctgcagaacaaccactgcctgggctctcacgaacacatccagaactgccgaaagtgggatactgagattcgtttgcagctcctgacttttagcgcgatgtgtcagaacctcgctagaacggccgaggacgacgagacaccagtagatctgaataaacatctttaccaaatcgagaaaccgtgtaaggaggcgatgactcggcaccccgtggaagaactgcttgattcatatcacaatcaggtggagctcgccttgcagattgaaaaccagcatagagcggtagatcaggtgatcaaggccgtccgaaaaatctgcagtgccctggacggagtggagactctcgctatcaccgaatctgtaaaaaagctgaagcgagcagttaacctgcctagaagcaagacagccgatgtcacctctctctttggcggagaggacaccagccgaagttctacccggggtagccttaaccctgagaacccagtgcaagtgtcaattaatcaactgtag

SEQ ID NO: 30071 - DNA, 2664 bp, Artificial Sequence
  Description of Artificial Sequence: Synthetic coding sequence
atgggagaggctgagaagtttcattatatctactcatgtgacctagatatcaatgtgcagttgaagatcggttctctggaaggaaaaagagagcagaagtcgtataaggcagtcctggaagatcctatgctgaaattttctggattgtaccaagaaacctgctctgacctatacgtcacctgccaagtgtttgcagaggggaaacctctagccctgcctgtacgaacttcttataaggcgttctccactcggtggaactggaacgagtggttaaagttgccagtcaaataccccgacctgccaagaaacgctcaggtagcattgaccatttgggacgtgtacggccctggaaaggccgtgccagtggggggtacaacagtgtctctctttggcaagtacggcatgtttcgccagggcatgcatgatctaaaggtttggcccaacgtagaggcagacgggagtgagcccacaaagactcccggacggacctccagcaccctgtcggaggatcagatgtcacgtctcgctaagcttaccaaagcccatcggcagggccacatggtgaaagtcgactggctggacaggctgactttccgtgaaatcgagatgattaacgagagtgaaaagcggtccagcaatttcatgtacctgatggtggaatttaggtgtgtaaaatgcgatgataaagagtatggtatagtctattacgagaaagacggagacgagtctagtccaatcctgaccagcttcgaactggtcaaggtgcctgatccccagatgtcaatggagaacctggtggagagtaaacaccataaactggcccgttccctcaggtcaggcccttccgatcatgatctgaaacccaatgctgctacacgcgatcagctgaatattattgtttcctatcctcccaccaagcaactgacgtacgaagaacaagatctcgtttggaagttccggtattacctcaccaaccaggaaaaggcactcactaagttcctcaagtgcgtaaattgggatcttccacaggaagccaaacaggcactcgaattgctcgggaaatggaagcccatggatgtggaagacagcttggaactgctatcttcacattacactaacccaaccgttagaaggtacgccgttgcccgtctgaggcaggcagacgacgaagacctcctgatgtatcttcttcagctcgtgcaggccttgaagtacgagaatttcgatgacataaagaacggcctggaacccaccaagaaggacagccaaagctctgtctctgagaatgtgagcaattccggcatcaactccgcggaaattgattcctcccagatcataacttcccccctaccatctgtgtccagtcccccaccggcatcaaagacaaaagaggtgcccgacggggagaatctggagcaggatctgtgcacctttctcatctcacgggcatgtaaaaactcgactctcgctaactatctttactggtacgtaatcgtggaatgcgaagatcaggatacccagcagcgcgaccctaaaacacacgaaatgtatctgaatgtaatgcgcaggtttagccaggccctgctcaagggggacaagagcgtaagagtaatgagatccctgctagccgctcagcagacctttgttgataggctggtgcatttgatgaaggccgtccagcgggaatctgggaatcgtaaaaagaaaaatgaacggctccaagctctactcggcgataatgaaaaaatgaatctttctgatgtggaactcatccctctgccacttgaaccccaggtgaagatcagaggcattattccagagaccgccacactgtttaaatctgcactcatgccagcccagctgtttttcaagacggaggacggtggaaaatatcccgttatcttcaagcatggcgatgatctgagacaggaccaacttatactacagatcatcagcctcatggataaactgttgcgcaaggagaacttagacctgaaactgacaccatacaaggtccttgccacctctacaaaacacggattcatgcagtttattcaatccgttcccgtagcggaagtactggacacagagggcagcatccagaattttttcagaaagtacgctccgagtgaaaacggcccaaatggcatcagtgcggaggtgatggatacttacgttaagtcctgcgccggatattgcgtaatcacatacatacttggcgtaggagacaggcatcttgataatcttctactgacgaagactggcaaactgtttcatattgacttcggctacatcctaggtcgggatccaaaacccctcccaccgccaatgaaactgaataaagagatggtggagggaatgggtggtacgcagagtgagcagtatcaggagttcaggaagcagtgttatactgcattccttcacctccgcagatattcaaacctgattctgaacttgtttagcctgatggtggatgcaaatattcctgatatagcgctggagcccgataaaactgtgaagaaggtacaggataagtttaggctcgacctgtctgacgaggaagccgttcactatatgcaatcactcattgacgagtctgtacacgccctcttcgccgctgtggtggagcaaattcataagttcgcacagtactggaggaagtag

SEQ ID NO: 30072 - DNA, 2475 bp, Artificial Sequence
  Description of Artificial Sequence: Synthetic coding sequence
atgggggaggctgagaagttccactacatttatagttgcgaccttgatattaatgtccaactcaaaatctggaacgaatggttgaagctgcctgttaagtacccagacctcccacgcaatgctcaagtggctctgaccatctgggacgtgtacggtcccggaaaagctgttcctgtgggagggacaaccgtctcattatttggcaagtatggaatgtttcgtcaggggatgcacgatctaaaagtgtggccaaatgtcgaggccgatggcagcgaacctacaaaaacacctggtcgcacatcgtcaacattaagcgaagaccagatgtctcgactggcaaaacttactaaagcacaccgacaggggcacatggtgaaagtggattggctggatcggctcacattcagagaaatcgagatgattaacgagagcgagaagcgctcaagcaatttcatgtacctaatggtggaattccggtgcgtgaagtgtgatgacaaagagtacggaatagtttactatgagaaagacggcgatgagagctccccaattctgacttcgtttgagcttgtgaaggtcccggaccctcaaatgtccatggagaatctggtggaatcaaaacatcacaagcttgcaaggtccctccgcagcggcccaagcgaccatgacctgaagcctaacgccgctacccgagaccagctgaacattatcgtgtcataccctccaactaagcagctgacctatgaggaacaggatttagtctggaagtttaggtattatttgacaaatcaggaaaaagcattgactaaattccttaagtgcgtgaactgggatttgcctcaagaagcgaaacaggccctggaactactggggaaatggaaaccaatggatgtggaagactcactggaacttttgagcagtcactacaccaaccccacagtccggaggtacgctgtggctagactgcggcaggccgacgatgaagaccttcttatgtacctgctgcaactggtgcaggctttgaaatatgagaattttgacgatatcaagaatggtctcgaacccaccaagaaagactctcagagctcagtctctgaaaatgtgtctaactctggaatcaattccgccgagatagactctagtcagatcattacatcccccctccctagtgtctcaagtccaccacctgcatcaaaaactaaagaagtacccgatggagaaaatctcgaacaggacttgtgcacctttttgatcagtagggcgtgtaagaatagcaccctcgctaattatctctactggtatgtgatcgtagaatgcgaggatcaggatactcagcagagagatccaaagacacatgagatgtacctcaatgtgatgagaagattctctcaagctctgctgaagggcgacaaatcagtccgggtgatgaggtcccttttggccgcacagcagacattcgtggatagactcgtgcatctaatgaaagccgtgcaaagagaaagtggcaaccgtaagaagaaaaatgagaggctgcaggcccttctaggagacaacgagaagatgaacctcagtgatgtggaactgattcccttgcccctggagccccaagtgaagattagaggcatcatccctgaaacagccacactctttaagagtgccctcatgcccgcacaacttttcttcaaaacagaagatggcggtaagtacccggtgatctttaagcacggagacgatctcaggcaggaccaactgatccttcagattatatcgttgatggataagttgctgcggaaggaaaacctggacttgaaactgactccatacaaggtgttggctacctcaaccaaacacggtttcatgcagttcatccaatcggtcccagtggccgaagtcctcgataccgaaggttctattcagaatttcttccggaaatacgcccctagcgaaaacggcccaaacggaatctccgcagaggtaatggacacatacgtgaagtcctgtgctggctactgtgtgatcacctacatcttgggagtcggtgataggcatttggacaacttattactcaccaaaaccggcaagttgttccatattgattttggctacatcctcggtagggaccccaagcccctgcctccccctatgaaactcaataaagagatggtggaggggatgggaggtacacagtccgagcagtaccaggagtttaggaagcagtgctacaccgccttccttcatctacgacggtacagcaacctcatcttgaacttattttccctgatggtagacgcaaacatcccggatatagctttggagccagataagacagtaaaaaaggtgcaggacaaatttagactggatttgtcagatgaggaggccgtgcattacatgcaatctttaatagatgagtctgtccatgctctgtttgccgctgtggtggagcaaatccataagtttgcccaatattggaggaagtag

SEQ ID NO: 30073 - DNA, 2175 bp, Artificial Sequence
  Description of Artificial Sequence: Synthetic coding sequence
atgtcggccgagggataccaatatcgagcactgtacgattataaaaaagaaagggaagaggacatcgacttacacctcggtgacatacttacagtaaacaaaggttctctggtagcactgggcttctctgatggacaggaggctcggccagaggagattggatggcttaacggctataatgaaactacaggagagcggggtgactttcctggaacctacgttgagtacatcggaagaaaaaagatctcacctcccacacccaagccacgacccccacggccactgcccgtggcgcctggaagctccaagactgaagctgatgttgagcagcaggctctcaccttgcctgacttggccgaacaatttgcacctcccgacatcgcgcctcctcttctcattaagctcgttgaggccatagagaagaaggggctagagtgcagcaccctctataggacacagtcctcttcaaacctggcagagctgaggcaactgttagattgtgatactccctctgttgacctggaaatgatcgacgtacacgtactcgctgacgcttttaagagatatttgctcgatctacctaacccagtaatcccagcggcagtgtactctgaaatgatttcattggcgccagaggtacagagttccgaagagtatatccagctcctgaagaagctgattaggtccccatctatcccacatcagtactggctaacacttcagtacctgctgaagcatttttttaaactgagccagacttcttccaagaaccttttgaatgccagagtcctatctgagattttcagccccatgctcttcaggtttagcgccgctagcagcgacaatactgaaaaccttattaaagtaatcgagattctgatttcaacagaatggaatgaaaggcagccagcgcctgccctgcctcccaagcctcccaagcctacaacagtggctaacaatggtatgaataacaatatgtccctgcaagacgccgagtggtactggggagatatctctcgggaagaagtgaatgagaagctaagagacacagcggacggcacattcctggtgagagatgcttctaccaagatgcacggcgattacacgctgactctgcgcaagggaggcaacaacaagctaatcaagatttttcatagggacggcaaatacgggtttagcgaccctctgacattcagtagcgttgtagagctgattaaccactatagaaacgagagtttggcccagtacaatcctaagttggacgtgaagctgttgtacccggtgtcaaagtatcagcaagaccaggtggtaaaagaggacaacattgaagccgtgggcaagaagcttcatgagtataatacccaatttcaggagaagagccgcgaatatgaccggttatatgaggaatacacacgcacaagtcaggaaatccagatgaagcggacggcaatagaggctttcaacgagactatcaagatttttgaggagcagtgccagactcaggaaaggtatagcaaagagtatatcgaaaagttcaaaagagagggcaacgaaaaggaaatccagcggattatgcataattatgacaaattaaagtcgaggatctctgagataattgatagcaggcgcagactggaagaagacttgaaaaaacaggcagccgagtatagggagattgataaaaggatgaattcaattaagccggatcttatccaacttcgaaaaacaagagatcaatacctgatgtggttgacccagaaaggggtgcggcagaagaagctgaatgaatggttgggtaacgaaaatacagaggatcaatattccctggtcgaggatgatgaggacctgccacatcacgatgaaaagacgtggaatgttggcagctccaatcgcaacaaggcagagaatctgcttagaggaaagcgtgacggtacgtttctcgtccgagaatctagtaaacagggatgctatgcctgttcggtcgtggtagacggggaggtgaagcactgtgtcattaacaaaactgccaccggctatggttttgctgagccctacaacttgtattccagtctgaaggagctggtcctgcattatcagcacacctccctggtgcagcataatgacagcctgaatgttacactggcctatccagtgtatgcgcagcaacgtagatag

SEQ ID NO: 30074 - DNA, 1275 bp, Artificial Sequence
  Description of Artificial Sequence: Synthetic coding sequence
atgcataacctccaaactctgccaccaaaacctcctaagcctactactgtggcgaataatggaatgaataacaatatgtccttgcaggatgctgagtggtattggggcgacatttccagagaagaagttaacgagaaattaagagacacagcggatggaacattcctggtaagggacgccagcacaaagatgcacggcgattataccctcactctgcgaaaaggaggcaataacaagcttatcaagattttccaccgtgacggaaagtatggatttagcgacccgttgacatttagctcagttgtggaactgataaaccactaccgaaacgagagcttagcccaatacaaccccaagctggacgttaaactgttgtatcccgtgtcaaagtatcagcaggatcaggtggtcaaagaagataatatcgaagccgtagggaaaaagctccatgagtacaacacgcagttccaggaaaagagccgtgagtacgatcggctgtatgaagaatacacacgaacaagccaggaaatccagatgaaaagaacggccatcgaagcgttcaatgagacgattaagatctttgaggaacagtgccagactcaggaacggtatagcaaggaatatatcgagaagtttaagagagagggaaacgagaaggagattcagaggattatgcataattatgacaagttgaagagcagaatttccgagatcattgactccaggcggaggctggaagaggacctgaagaagcaggccgcagaataccgggagatcgacaagaggatgaattcaatcaagccggacctgattcaattaaggaagacgagggatcaatatcttatgtggctaacccagaaaggggttaggcagaagaaattaaacgagtggctggggaacgaaaacaccgaagaccaatactcacttgtggaggatgatgaggatctcccacaccatgatgagaagacttggaacgtgggctcctccaacaggaataaggctgaaaatctgctgcggggaaaaagggatgggacgttcctcgtccgagagtccagcaaacaggggtgttatgcctgtagtgtcgtggtcgacggtgaggtgaaacattgcgtgatcaacaagaccgctaccgggtacggattcgccgaaccgtacaacctgtactcttcactgaaggagttagtgttgcactaccagcataccagcctggtgcagcataacgattccctgaatgtgactcttgcctaccctgtctacgctcagcagcgccgttag

SEQ ID NO: 30075 - DNA, 1365 bp, Artificial Sequence
  Description of Artificial Sequence: Synthetic coding sequence
atgtacaatactgtgtggaatatggaagatttggaccttgaatacgccaaaacagacatcaattgtggcaccgatctgatgttctatattgaaatggatcctccagctctgccgccaaagccccctaagccaactactgtggcaaacaatggtatgaataataatatgtccctgcaagacgccgagtggtactggggggacattagtcgggaagaagttaacgagaagctaagagacacagcagacggtaccttcctggttcgcgacgccagcaccaagatgcacggcgattacacactgaccctgaggaaaggcggtaataacaagttaatcaaaatatttcatagggacggtaaatacggcttttcagaccccctgacgtttagcagtgtcgttgagctcattaatcattaccgcaatgaatcactcgcacagtataatcccaaactagatgtcaaattgctctatcccgtctccaaataccagcaggatcaagtggtaaaggaagacaatatcgaggcagtgggcaagaagctgcacgagtacaatacccagttccaagagaaatccagggaatacgaccgtctgtacgaggagtacaccagaactagccaggaaattcagatgaaaagaacagccatcgaggcattcaacgaaaccataaagatctttgaagagcagtgccagacccaggagcgatatagtaaggaatacatcgaaaaattcaagagggagggcaacgagaaagagattcagaggataatgcacaactatgataaactgaaatctcgcatcagcgaaataatagatagccgtcgcaggctggaagaagatctaaagaagcaggccgctgaatatagagaaattgataagcgaatgaattcgataaagcccgacctcattcagttgcgcaaaacccgagatcaatacttgatgtggctgactcagaagggcgtgaggcagaaaaaactaaatgagtggctgggtaatgagaataccgaggaccagtacagcctggtcgaggacgatgaagatctccctcatcacgatgagaagacttggaacgtcggcagttctaatcggaataaggctgaaaatctcttaagaggcaaacgcgacggaacttttcttgtgagggaatcctcaaaacagggctgttacgcgtgttctgttgttgtggacggggaggtgaagcactgcgtcattaataagaccgcgacaggctatggattcgcggagccgtacaacctctactcgagtttgaaggaactcgtgctccactatcaacatacaagcttagttcagcacaatgactccctaaatgtgactcttgcttaccctgtctacgcccagcagcggcgatag

SEQ ID NO: 30076 - DNA, 2199 bp, Artificial Sequence
  Description of Artificial Sequence: Synthetic coding sequence
atgagtgcggagggttaccagtatcgggctctttatgattataagaaagaaagggaagaagatattgacctgcatcttggtgacattctgacggtgaacaagggttctctggtcgctttggggttcagtgatgggcaggaggccaggcccgaggagattggctggttaaacggatacaacgagacaactggagagcgaggcgacttccctggtacatatgtggaatatatagggaggaagaagatctcccctcctactcccaaacctcgaccacctaggcctctgccagtcgccccaggatcgtcaaaaacagaggcggacgttgagcaacaggccctcacattgcccgacttagcagaacaatttgcacctccagatatagcacctcccctcttgataaaactggttgaagcaatagagaagaaggggctggagtgtagtaccctgtaccgtacccaatctagcagcaacctcgctgagctcaggcaactgctggattgtgacacaccaagcgtggacctggagatgatcgacgtgcacgtgctcgccgatgcttttaaacgatatctgctggacctccccaatccggtgatacctgcggctgtgtattccgagatgatatctctggctcctgaggttcaaagcagcgaggaatacatccagctcttaaagaagctgatccgcagtccttctattcctcaccagtactggctgacattgcagtacctcctgaagcatttttttaagctttctcagacttcctctaagaacctcttgaacgctcgcgttctttccgagatctttagccctatgctttttcgtttttccgcagcctcttctgacaataccgagaatttgattaaagtgattgaaatcctgatcagcacagaatggaatgagagacaacctgcacccgcattaccccctaagccccctaagccaacaacagtggcaaataatggtatgaacaacaacatgtccctccaggatgcagagtggtactggggtgacatcagtagagaagaggtaaacgagaaacttagagacaccgccgatggcactttcctagtgagggatgcgtccacaaaaatgcacggggattacaccctgaccctccggaaagggggaaacaacaaactgatcaagatctttcaccgcgatggaaaatacggcttctctgacccacttacattctctagcgtcgttgaactcatcaaccactatcggaatgagtcattagctcaatacaaccctaagctagacgtgaagctcctgtatcctgtgagcaagtatcagcaagatcaggtggtgaaggaagacaacatcgaagccgtggggaagaagctccacgagtataacactcaattccaagagaaatcccgcgagtatgatcggctgtatgaggagtacaccaggacatcacaggagatccagatgaagcgcacagctatcgaggcctttaacgagacaatcaagatcttcgaggaacagtgtcagacccaggagcgatattccaaagagtatattgaaaagttcaagagagagggcaacgagaaagagattcagaggatcatgcacaactatgacaaactcaagtcccggatcagcgaaattatcgactcaaggagacgcctggaggaagatctaaaaaaacaggcagccgaatatcgggagatagataaacgcatgaattctattaaacctgacttgattcagctgcgaaaaacacgcgatcagtatttaatgtggctcacacagaaaggggtacgccagaagaagctcaatgagtggttaggtaacgaaaataccgaagaaaactttctcagctgcctgccctctcagtactcattagtggaggatgacgaggaccttccccatcacgacgaaaagacctggaacgttggctccagcaatcggaataaggctgagaatctcctaagggggaagcgagacggcaccttcctcgttcgtgagagctcaaaacaaggttgctacgcctgtagcgtcgttgttgacggggaagtgaagcattgcgtcatcaacaaaacagcaacaggctacggattcgcagaaccttataatctctactctagtttaaaggagctggtgctgcactatcagcacacatcactggtccagcataacgactccctgaatgtgactctggcctatccagtctatgctcaacaacggagatag

SEQ ID NO: 30077 - DNA, 2175 bp, Artificial Sequence
  Description of Artificial Sequence: Synthetic coding sequence
atgagtgccgaagggtaccagtaccgggcactatacgattataaaaaagagcgagaggaggatatcgaccttcacctcggcgatattttgaccgtcaacaaaggatccctggtggctctgggatttagcgacggacaggaagcccgtccggaagaaatcgggtggttgaatggctataatgagacaactggggaacggggagacttccctggtacgtatgttgaatacatcgggagaaaaaagatcagtccaccaactcccaaaccacgccctcccagacctctgcccgttgccccaggctcttctaagaccgaggcagatgtggagcagcaggccctgacactgccagacctcgcagaacaattcgccccacctgacattgcaccacctcttctgatcaaacttgtggaggccatcgaaaaaaaaggactggaatgttctacactgtacagaacacagtctagttcaaatctggcagaactccgccagttactggactgtgacaccccctccgtggacctcgagatgatcgatgtgcacgtgctagcagatgctttcaagcggtatctactcgatcttcccaatcctgtgattccagctgctgtatactccgagatgattagtctggcccctgaggtacagagcagcgaagaatatatccagttactgaaaaagttgatccggtccccttctattcctcatcagtactggctcacattgcaatatcttctgaaacatttcttcaagctgagccaaacaagctccaagaacctgttaaatgctcgcgtgttaagcgagatattctctcctatgctattccgatttagtgcagcttccagcgacaataccgaaaacctgatcaaggttattgaaattctgatcagtaccgagtggaatgaaaggcaacctgccccagcccttccaccgaagcctcctaaaccaactaccgtcgctaacaacgggatgaacaacaatatgagtctgcaagatgccgaatggtactggggagatatcagcagggaagaggttaatgagaagctgcgcgacacggccgacggcacattcttagtccgcgatgcatcgaccaagatgcacggcgactatacactgaccctaagaaaagggggtaacaataaactgatcaaaatatttcaccgcgacgggaagtacgggtttagcgatcccctaaccttcagttccgtcgtggagcttataaaccactacaggaatgaatccttggcccagtacaatcccaagttggacgttaagcttttgtacccggtttccaagtaccagcaggaccaggtcgtgaaagaagacaacattgaggctgtgggtaagaagcttcacgaatataacacgcagtttcaagaaaagagcagagaatacgacagactgtacgaggaatatacaaggaccagtcaggagatccagatgaaaaggactgccatagaggccttcaatgaaacaatcaagatattcgaggaacaatgccaaacccaggagaggtactcgaaggaatatatcgaaaaattcaagcgagaagggaacgagaaggaaattcaacgcatcatgcacaattacgacaaactgaagtctaggatctcggaaattattgatagccgcaggcggctagaagaagatctcaaaaagcaggccgcagaataccgggagatcgacaagagaatgaatagtattaaaccggatttgatacagctaaggaagacccgcgatcagtacctgatgtggctgacccaaaagggtgtgaggcagaaaaaactcaacgaatggctgggcaatgagaacacagaggaccagtactccctggtggaggatgatgaagatctaccacaccatgacgaaaaaacatggaacgtgggaagcagtaatcggaacaaagccgaaaacttgctgaggggcaaacgcgatggaacctttctggtccgcgaatcaagcaaacagggctgttacgcctgttcagtggtcgtagatggggaagtaaaacactgtgtaataaataaaaccgccaccggatacggattcgccgaaccatacaatttgtactcctctctaaaagaacttgtccttcactatcagcacacctcactggtgcagcataatgacagcctgaacgtgaccctagcataccctgtctacgctcaacagcgtcggtag

SEQ ID NO: 30078 - DNA, 414 bp, Artificial Sequence
  Description of Artificial Sequence: Synthetic coding sequence
atgcatggggattatacactcaccctccgaaaaggcggaaataataagctcattaaaattttccaccgcgacggtaagtatggcttctcagaccctcttaccttttcttccgtggtggaactgattaaccactacaggaatgagtctctggcacagtacaaccctaaactggatgttaagctgttatatcccgtctccaagtaccagcaggaccaagtggtgaaggaagataatatcgaggctgtagggaagaagcttcatgagtataatacccagtttcaagagaagtcccgtgagtacgacaggctgtacgaagagtacacacggacaagccaggagattcagatgaagcgaactgctattgaggccttcaatgaaaccatcaagatcttcgaagagcaatgccagacctag

SEQ ID NO: 30079 - DNA, 2175 bp, Artificial Sequence
  Description of Artificial Sequence: Synthetic coding sequence
atgtccgcagaagggtatcaataccgggctctatatgattacaaaaaggaaagagaggaagacattgatctgcatttaggcgatatattaaccgtgaacaagggtagtctggtggctctgggctttagtgacggccaagaggctcgacccgaagagatcggctggttaaacggttataatgagaccactggtgaaagaggcgatttcccaggcacatacgtggaatacattggacgcaagaagatctccccgccaacccccaagcccaggccacccagaccactgcccgtggctccaggatcctccaagaccgaggctgacgtggagcagcaagcactcacattgccagacttggcagaacagtttgccccacctgacatcgcgccaccactgctgattaaactggtggaagccatcgaaaagaagggcctggaatgttcaactctgtaccgcacccagtccagctcgaaccttgccgagctgcggcagctgctcgactgcgatacacccagcgtcgatttagaaatgatcgacgtgcatgtgctggcagacgcattcaagaggtatctgctggatctgcctaaccccgtgattcctgccgcagtgtatagcgaaatgatttccctggccccagaagtacagagtagcgaagagtacatccagctgctgaaaaaactcataagatcgccgtccatcccacaccagtactggcttactttgcagtacctgttaaaacatttctttaaactcagccaaacctcaagcaagaacctgcttaacgccagggttctctctgaaattttcagccctatgctgttcaggttttctgcggcaagctccgataacacagaaaacctgattaaagtgatcgaaatacttatctctaccgagtggaacgagcgtcagcctgcgcctgccctaccgcctaagccccctaaacccaccacagtagctaacaatggaatgaacaacaatatgtctctacaagatgccgagtggtactggggggatatctctcgtgaagaggtaaatgagaaattgagggacacagcagacggtacattcctggtgcgagatgcgtctacgaagatgcatggggactataccctcacactccgcaagggtggcaacaacaaactcattaaaatctttcatagagacggtaagtacgggtttagtgatccattgactttctcatccgtcgtggaactcatcaaccactatagaaacgagtcactggcgcaatataatcccaagctggacgtcaagctgctctatccagttagtaagtaccagcaggaccaggtggtcaaggaggataacattgaggccgtgggtaagaagttacatgaatataatacccagtttcaggaaaagtcacgagaatacgacaggttgtacgaggaatatacaaggactagccaagaaattcagatgaaacggaccgccatcgaagcattcaatgagaccatcaagatttttgaagaacagtgccaaacccaggagcgctactccaaggaatacatagaaaaattcaagcgggagggcaatgagaaggagatccagcgaatcatgcataactacgacaaactgaaatcacggatttcggaaattatcgatagtaggcgcagactagaggaagacctgaaaaaacaggctgctgagtatcgagagatcgacaaaaggatgaactctattaagccagatcttattcagctgagaaaaacaagagatcagtatctgatgtggctgacgcagaaaggtgtcagacagaaaaaactgaatgagtggcttgggaacgagaataccgaggaccagtattccctggtcgaggacgacgaagaccttcctcaccacgacgagaaaacctggaatgtgggttcctccaacaggaacaaggctgagaacctgttgcggggaaagagggacggcacatttctcgtacgagagagttctaagcagggctgctacgcgtgctcagtggtcgttgacggcgaagtgaaacattgtgttatcaataagaccgccaccggctacgggttcgcagagccttacaatctctactccagtctgaaggaactggttcttcattaccagcacacctcactggtccagcacaacgattccctgaatgtgacccttgcatatcccgtgtacgcacagcagcgaaggtag

SEQ ID NO: 30080 - DNA, 1224 bp, Artificial Sequence
  Description of Artificial Sequence: Synthetic coding sequence
atgctatttgacaaggtgaaggctttcagcgtgcagctcgacggcgctacggcgggtgtcgagcctgtgttttccggtggccaggccgtggcaggccgagttctcttagaattatcttctgcagctcgcgttggcgctttgcgcctcagagctcggggtcgcgcacatgtgcattggaccgaatcaaggtctgccggatcaagtactgcttacacgcagtcctactccgagagggtcgaggtggtgagccatagggccacgcttttagcacccgacactggtgagaccactactctacctcctggaaggcacgagttcttgttcagcttccaattgccccctactctggtcacttcttttgagggcaaacacggcagtgtgcgttattgtattaaggccaccttacacagaccctgggttcccgctcgaagagcaagaaaagttttcacagtgattgaaccagtggacattaacaccccagctctgctggccccacaggccggtgcacgggagaaggtcgccaggagctggtactgcaatcggggactggtttcgctatccgccaagattgataggaagggatacactcctggggaagtaataccggtcttcgcagaaatcgataacggttccacccgtcccgtcctgccgcgagcggcagtggtccaaactcaaacattcatggcgagaggcgcacgtaagcaaaagcgagcagttgtcgcgtctctggccggagagcccgtgggacctggccagcgcgcactatggcaaggaagggcccttcgtatacctcctgtgggcccatcaatccttcactgcagagttctgcatgtggattatgccctcaaggtgtgcgtagatatcccaggcacatccaaactgctgttagagttgcctcttgttatcggaactattccattacacccctttggttctcgatcaagctcggtcggctcacatgcaagtttcctgctggattggaggctgggtgctctgcctgagagaccggaagctcccccagagtacagcgaggtcgtggcagataccgaggaagcagccctcggacaaagccctttcccccttccccaggaccccgatatgtccctggaggggccattcttcgcttatatccaggagttcagatacagaccgccacctctgtactcagaggaggatcctaatcccttgcttggtgacatgcggcctagatgcatgacttgttag

SEQ ID NO: 30081 - DNA, 1386 bp, Artificial Sequence
  Description of Artificial Sequence: Synthetic coding sequence
atgtataacactgtatggtctatggatcgggatgacgcagactggcgggaagtgatgatgccttattctacagagctaattttttatatcgagatggaccccccagctctcccacccaaaccccctaaaccaatgacatctgccgttcctaatgggatgaaagactccagcgtgtcacttcaggatgctgagtggtactggggcgatatcagcagagaagaagtgaacgacaagttgagagatatgcctgacggcaccttcctggttcgcgatgcaagcactaaaatgcaaggcgactacacattgaccctgcgcaaagggggaaacaacaagcttattaagatataccatagggacggtaagtatggattctccgaccccctcacctttaactcagtcgtagagctgatcaatcattaccaccacgaaagccttgcccagtacaatcccaaattggatgtgaaactgatgtaccctgtctcccggtatcagcaagatcaactggtgaaggaggacaatatagacgctgtggggaagaagctccaggagtaccattcccagtaccaggagaaatccaaggagtacgaccggctgtacgaagagtataccaggacttcccaggagatccagatgaagaggactgcgatcgaagctttcaatgaaactattaagatttttgaggagcagtgccacacacaggagcagcactccaaagagtacattgaacgcttccgcagagaaggcaacgaaaaggaaattgagagaattatgatgaactatgacaagctgaagtcaagactgggcgaaattcacgacagcaaaatgagattggaacaagacctcaagaaccaggcattggacaaccgtgagatagataagaaaatgaatagcatcaaaccggacctgattcagttgcgaaaaatacgggaccagcacctggtgtggctgaatcataaaggagtgagacagaaaaggctcaacgtgtggctgggaatcaagaacgaggacgccgatgaaaactacttcatcaatgaagaggacgagaacctgccccattacgatgagaagacttggttcgtggaagacataaacagagtccaggctgaggacctgttatacggcaagcctgacggtgcctttcttatacgggaaagctctaagaagggttgttatgcgtgctcggtggtggctgatggagaggttaaacattgtgtaatatatagcaccgcgagggggtacggttttgccgagccttataatctttactcaagcctcaaggaattagttttacattaccagcagacgagcctggtccagcacaatgacagtctgaatgtccgcctggcttaccccgttcacgcccagatgccaagtctctgccggtag

SEQ ID NO: 30082 - DNA, 1101 bp, Artificial Sequence
  Description of Artificial Sequence: Synthetic coding sequence
atgtacaacaccgtttggtccatggaccgcgatgatgcggactggagagaagtcatgatgccgtacagcactgagctcattttctacattgaaatggacccacctgcagcggaagtgaatgacaaattgcgagatatgcccgacgggactttcctggtgagggatgcatcaactaagatgcagggagactacacactaacattaagaaagggcggaaataataaacttattaagatatatcatagggacggtaagtacggctttagcgaccctctcaccttcaactcagtggtggagctaataaatcactaccatcacgagtctctcgcgcaatacaaccccaagctcgacgtaaaactcatgtatccagtttcaagatatcagcaggatcagctggtgaaggaggataacatcgacgctgtaggtaagaagctccaggaataccattcccagtaccaagagaagagcaaggaatatgatagactctatgaagaatatacacgtacatctcaggagattcagatgaaaaggacagcaattgaagcctttaacgagacaataaagattttcgaagagcaatgccatactcaagagcagcattcgaaggaatacatcgaacggtttaggcgcgagggtaatgagaaggagatcgagcggtggctgaaccacaagggtgtccgtcaaaaaaggctgaatgtgtggctggggattaagaatgaagatgcagacgagaattacttcatcaacgaagaggacgagaacttaccgcattatgacgaaaaaacctggttcgtggaggacatcaatagagtacaagccgaggatctgctgtatgggaagccggatggcgcattcctgatccgggaatctagtaagaagggctgctacgcctgttccgtggtcgcagacggcgaagtcaaacactgtgtgatatactctactgcaagagggtacggtttcgctgaaccatataatctgtacagctcgcttaaagagctcgtactgcattaccagcagacctccttagtgcagcataatgacagcctgaacgtccgcctggcctatccggtgcacgctcagatgccttcactctgccgttag

SEQ ID NO: 30083 - DNA, 1209 bp, Artificial Sequence
  Description of Artificial Sequence: Synthetic coding sequence
atgtacaacacagtttggagcatggaccgagatgacgcagattggcgtgaggtcatgatgccctactctacagaattgattttctacattgaaatggacccacccgcactcccaccaaagcccccaaaacccatgacaagtgcggtgcccaatgggatgaaggacagttccgtgtccctgcaagatgccgagtggtactggggtgatatcagccgggaagaagtgaacgacaaacttagggatatgccggacggcacttttctggtccgcgacgcaagtaccaaaatgcagggtgactatactctgacgttgcgtaagggcggaaacaacaaacttattaagatctatcaccgggacggaaagtatgggttttcagaccctctgacctttaattccgtggtcgagctaataaatcattatcatcatgaatctctcgctcagtataatcctaagctggatgttaaactgatgtaccctgtgagtagataccagcaagatcagctggtcaaagaagacaacattgatgcagtggggaagaagctgcaggaatatcattcacaatatcaggagaagtcgaaagagtacgacagactgtacgaggagtacacgcgaaccagccaagaaatacaaatgaagcgcacagcaatcgaagcttttaacgagaccattaagattttcgaggaacagtgccatactcaggagcagcactccaaagagtatattgagaggtttcggagggaaggcaatgagaaggaaatcgagaggtggctgaaccacaaaggcgtgagacaaaaaagacttaacgtctggctcggaattaagaacgaggatgcagatgagaattattttattaacgaggaggacgagaacctacctcactacgacgaaaaaacatggtttgtggaggacataaatcgggtccaagccgaagatctgttatatgggaagccagacggagcctttttaatcagggagtcatctaagaagggctgctatgcctgtagcgtggtggccgacggtgaggtgaagcactgtgtcatctactccacagccaggggttatgggtttgccgaaccctacaatttgtatagctccctgaaagagctcgtgcttcactaccagcagaccagcttggtgcagcataacgacagcctgaatgtgcggcttgcttacccggtacatgctcagatgccctcgctgtgtaggtag

SEQ ID NO: 30084 - DNA, 1386 bp, Artificial Sequence
  Description of Artificial Sequence: Synthetic coding sequence
atgtacaacacagtctggagcatggatcgcgatgacgccgattggcgggaagtcatgatgccttattcgactgagctgatcttctatatcgagatggatcccccagctctcccacccaagccccctaagccaatgactagcgccgtcccaaacgggatgaaggacagcagtgttagtctgcaggacgccgaatggtactggggcgacatttccagagaggaggtcaacgataaattgagggatatgcctgatggcacttttttagtgagagatgcaagcactaaaatgcagggtgattacaccttgaccctacgaaaagggggaaataacaagctcattaagatttatcatcgcgatggtaagtacggcttttctgaccccctgacgttcaactccgtggtggagctcatcaatcactaccaccatgagagcctcgcccagtacaatcctaaattagatgtaaaactgatgtaccccgtctcacggtaccagcaggaccagttggtgaaggaggacaacatcgatgccgtaggaaaaaaactgcaggagtaccactcacagtatcaggaaaaatccaaggagtacgaccgattgtacgaggagtacacccggaccagtcaggagatacaaatgaagcgcactgccatcgaggcgtttaacgaaaccattaagatttttgaggagcaatgtcacacacaggaacaacactctaaagaatacatcgaaagattccggcgagagggtaatgaaaaggagatcgagagaattatgatgaattacgacaaacttaaatctaggctcggcgagattcacgattcaaaaatgagactggaacaggacctgaaaaaccaggccctcgacaatcgcgagatagacaagaagatgaattctattaagccagatctcatccagctaaggaagatacgcgaccagcacctggtttggctgaaccataaaggagtccgacagaaaagactgaatgtgtggttagggatcaagaacgaggacgcagacgagaattactttatcaatgaagaggatgagaatctgccacactatgatgagaagacttggtttgtcgaagatatcaacagggtgcaggctgaggacctcctctacggcaaacccgatggagcctttctgatccgcgagagttccaagaaaggctgctacgcgtgttcagtggttgctgacggcgaggtcaaacactgcgtgatctattcaacagcaagagggtatggctttgctgagccctacaatctctacagctcgttgaaggaactggtgttgcactatcaacagacctcactggtgcaacataatgattcattgaacgtgaggttggcctacccggttcacgcacaaatgccctccctgtgtcgctag

SEQ ID NO: 30085 - DNA, 1386 bp, Artificial Sequence
  Description of Artificial Sequence: Synthetic coding sequence
atgtataatacagtatggagtatggaccgagacgacgccgactggagggaggtgatgatgccttactctacagaattaatattctacatcgagatggatcctcccgctctgccccctaaaccccctaagcctatgacctccgcagttcccaacggcatgaaagattcttccgtgtcattacaggatgccgagtggtactggggcgacatcagtagggaagaggtgaacgacaagctgcgggacatgcccgacggaaccttcttggtgagagatgccagcaccaagatgcagggtgattacacactcacgctaaggaaggggggaaacaacaagctaatcaaaatatatcatcgggacgggaagtacggtttcagcgaccctttgacgttcaactcagttgttgagctcatcaatcactaccaccatgagagtctggctcagtataatcctaagctcgacgtgaagctgatgtatccggtgagccgttaccagcaggaccagcttgtgaaggaagacaatatagacgcggtcggtaaaaagttgcaggagtaccatagccagtatcaagagaagagcaaggagtacgacagactttacgaagaatatactcggaccagtcaagagattcagatgaagagaacagccatcgaggcctttaatgaaacaatcaagattttcgaagagcagtgccacacacaggaacagcactccaaggaatacatagagagatttcgtcgagaaggaaatgagaaagagatcgagaggatcatgatgaattatgataagctgaaatctagactgggcgagattcacgactccaagatgcgccttgaacaggatctgaagaaccaagcgctcgacaatcgtgaaattgataaaaaaatgaatagcatcaagcccgatctgatccagcttcgcaaaatacgtgaccagcatctcgtatggttgaaccacaagggcgtacgccagaagcgcctgaacgtttggttggggataaaaaacgaggatgccgacgaaaactatttcattaacgaagaggacgaaaacctgccccattacgacgagaagacatggttcgttgaagacattaatcgggtgcaggccgaggatctgctctatggaaaacctgacggagcatttctgattagagaatcttcaaagaaaggctgctatgcctgtagcgtggtggcagacggcgaagtgaaacactgtgtgatttacagcaccgccaggggctacggatttgcggaaccctataatttgtacagttctctgaaggagttggtccttcattatcagcagacttctttggtgcaacacaatgacagcttgaacgtgagacttgcctatccagtgcacgcccagatgccatctttatgccggtag

SEQ ID NO: 30086 - DNA, 1209 bp, Artificial Sequence
  Description of Artificial Sequence: Synthetic coding sequence
atgtataacactgtatggtccatggatcgcgatgacgctgattggagggaagtgatgatgccgtactcaacggagttgattttttatattgaaatggaccccccagccctgccacctaaaccgccaaagcccatgacttcagctgtgccaaacggtatgaaagactcatccgtgagcctgcaggacgccgaatggtactggggagacatctctcgcgaagaggtcaatgacaagttgagagatatgccagatggcacatttctcgtgcgcgatgcatccactaagatgcagggcgactacacactgacactacgtaagggaggcaataacaaactgatcaaaatctaccaccgcgatggcaaatatggattctccgacccactgactttcaactctgtagtagagttaatcaatcactatcatcacgagagcctggcacagtacaacccgaagttggatgtgaagctgatgtaccctgttagccgctatcagcaagaccagttagtgaaggaagacaatatcgacgcagtaggcaagaaactgcaggaataccactcgcagtatcaggagaagagcaaagagtacgatagactctatgaggagtacacgagaactagccaagagatacagatgaagcgtacggccattgaggcgttcaacgaaacgattaaaatttttgaagagcagtgtcacacccaggaacagcatagcaaagagtacatcgagcggtttcggagggaaggaaacgaaaaagaaattgagcgttggctgaatcataaaggtgtacgccagaagagactgaacgtgtggctgggtataaagaatgaagacgctgacgaaaattatttcatcaatgaggaagatgaaaatcttccccattacgatgagaaaacctggttcgttgaagacattaatcgggtgcaggcagaggatctcctctatggtaagcccgatggtgcctttctaattagagaatcatccaagaagggatgctatgcgtgctcagtggtggctgatggggaggtgaaacattgcgtgatatactcaacagctaggggctatgggttcgcggaaccctacaacctttattcatccctcaaggaactggtgctgcattaccagcagacatcgctggtgcaacacaacgattcactgaacgtcagacttgcatatccagtgcacgcccagatgcccagcctttgcaggtag

SEQ ID NO: 30087 - DNA, 621 bp, Artificial Sequence
  Description of Artificial Sequence: Synthetic coding sequence
atgtataacacagtctggtcaatggacagagacgacgctgattggagggaggtgatgatgccatacagcaccgaactcatcttctacattgaaatggaccccccagctctgcccccaaagccgccaaagcctatgacctctgcggttcccaacggaatgaaagactcttctgttagcctacaggacgcggaatggtattggggcgacatttctcgcgaagaggtgaacgacaaactgagggacatgccggacggaacctttttggtgagggacgcctccacaaagatgcaaggtgattatacccttaccctaagaaagggcggaaacaataagttgataaaaatctatcacagggatgggaaatatggatttagtgatcccctcacctttaattccgtggtcgagcttatcaaccactaccaccatgagagcttggctcaatacaaccccaagctggatgttaagctgatgtaccccgtgagtagataccagcaagaccagttggtgaaagaggataatatcgacgcagtcggtaaaaaactgcaagagtatcactcacaatatcaggagaagagtaaggagtatgataggctgtacgaagagtacacccggaccagctag

SEQ ID NO: 30088 - DNA, 1524 bp, Artificial Sequence
  Description of Artificial Sequence: Synthetic coding sequence
atggggccaagccgcctggtccgcggacccaggcctcagggcatgcgttctccctataggcgtccaggcatgggatggcctagacccagattccccaggatgtttaagtgctctaggcgccgatatcagcaggggctgcgcggacgaacggcctcctcagctgctataaacccagccacccgggctatgggaataaacaacactcatacagacaccacaatcgtctggatctttcctccacaggccctaccccctaagccaccaaaacctatgacttctgctgtgcccaatggaatgaaggactccagcgtttcattgcaagacgccgagtggtattggggcgacatctcaagagaagaggtgaacgacaaactccgggacatgccggatggaacttttttggtccgcgatgcgtcgactaagatgcagggggattatactttaaccttgcgaaaaggaggcaacaacaagctgataaagatctaccaccgggatggcaaatatggttttagcgacccgttgacttttaactcagtggtcgaactcattaatcattaccaccacgaatcactcgcacagtataaccccaaattagatgttaagctgatgtaccccgtgagcaggtaccagcaggaccagttggttaaggaagataacatcgatgctgtgggcaagaaactgcaagaatatcactcccaatatcaggagaaaagtaaagagtacgacagactctatgaggagtacacccgcacttcccaagaaatccagatgaagcgcaccgccatcgaggctttcaacgaaacgatcaaaatatttgaagagcagtgccacacccaggaacagcacagtaaagaatacattgagcggttccggagggagggcaatgagaaggaaattgagcgaatcatgatgaattatgataaactgaaatcacgattgggtgagatccacgactctaagatgcgcctggaacaggatctgaaaaatcaggccctcgataacagagagattgataaaaagatgaacagcataaaaccagatctgatccagctgcggaaaatccgggatcaacacttagtctggctgaaccacaagggcgtcagacagaagaggctgaatgtgtggcttgggatcaaaaacgaagacgccgacgagaattattttatcaacgaggaggatgaaaatctcccacattatgatgaaaagacatggtttgtagaggatataaatcgggtgcaagccgaggatctgctttacggcaaacccgatggcgctttcctgattcgggaatcctcaaaaaaagggtgctatgcatgttccgttgttgccgatggggaggtcaaacattgcgtgatttacagcacggccaggggttatggtttcgcagagccctataacctgtattctagcctgaaggagctggttctacattaccaacagacctccctggtgcagcacaatgactctctaaatgtgaggcttgcctaccccgtgcatgcacaaatgccctcgttgtgtcgatag

SEQ ID NO: 30089 - DNA, 2643 bp, Artificial Sequence
  Description of Artificial Sequence: Synthetic coding sequence
atgcaaccaggtgctaccacatgtaccgaggatcggatccagcacgccctcgagcgatgtctgcatggactgtccttaagtcgaagatccacatcctggagtgcgggtctgtgcctgaattgttggagcttgcaggagctcgtaagccgggacccgggtcacttccttatactgctggagcagatcctccagaagaccagagaagttcaggaaaagggcacttatgatttactcaccccactagccctgctcttttattctaccgtgctttgcacaccccatttcccccctgattctgacctgctgctgaaggccgcatccacttatcacagatttcttacctggccagtcccttactgttctatctgccaggaattactgacattcatcgacgccgaactaaaggcgcctggcatatcttatcagagactggttagagctgagcagggcctacctatccgcagccatagaagctcaaccgtgaccgttctgctgttaaatcctgttgaggtacaagcggagttccttgcagtcgccaacaagctgagcactcccggtcacagtccacactccgcctatacaaccctgttgctccatgccttccaagctacattcggagctcactgtgatgtgcctgggcttcactgtcggttacaggcgaagactctcgctgaactggaggacattttcacagaaacagccgaggcacaggaattggcctccgggatcggtgacgccgcagaggctagaaggtggctgcgtacgaaactgcaggccgttggcgaaaaggccggatttccgggtgtgttagatactgcgaagccgggaaagctccacacaatcccaatccccgttgctaggtgttatacctactcctggtcccaggatagcttcgatatcctacaagagatcctgctgaaggagcaagaattactgcaacctggaattcttggggacgacgaggaggaggaagaagaagaagaggaggttgaagaggacctggaaacagatggacattgcgctgagagggatagtcttctgtccacgagcagcctcgctagccacgacagtaccctgtctctggcttccagccaggcttctggcccagcactcagcaggcatttgcttacttccttcgtgtccggcctgagcgatggaatggactcagggtacgtggaggattcggaggagagctcatcagagtggccttggcgccgtggctcgcaagagaggcggggtcatcgtcgacctggccaaaagtttatacgcatctacaagctgtttaagtccacatctcagctggtccttagaagagactccagatccttggaagggagtagcgataccgcccttccccttagaagagctggaagtctgtgcagccctttagatgaaccagtgagcccgccttcccgtgcacagaggtctaggagtttgccccagccaaagctgggaacccagctgccttcttggctactggccccagcctctcggccacaaaggcgacgcccatttctcagtggcgacgaggaccccaaggcctctactctccgcgttgttgtctttggttcagaccggatttccggaaaggttgccagggcctactctaatctgaggaggttggagaataacagaccactccttactcgtttctttaaactgcagttcttttatgtgccagtgaaacgctcccatggaacttcccctggcgcttgtcccccacctcggagccagaccccctcccctccaacagattctccgagacacgcaagccctggcgagctgggcacaaccccttgggaggagtccacaaacgacatctctcactacctgggcatgcttgacccctggtatgaacgcaatgtgctgggcctgatgcatctgcctcctgaagttctctgccaacagtctctgaaggctgaagcgcaggcactagagggttccccgactcagctacctattctggccgatatgctgttgtactattgtcgatttgccgcacgtccggtgctcctgcaagtgtatcagaccgaactgacttttattacaggagagaagacaactgaaatcttcatccatagcctcgagttgggccacagcgcagccactagggctatcaaggcttcaggtccgggatctaaacgactggggatcgacggggaccgggaggctgtgcctctcaccctgcaaataatctactccaagggagcaatcagtggtagatcccgatggtcaaacctggagaaggtgtgtacttcggtcaatctgaacaaggcctgtaggaaacaagaagaactggactccagcatggaggccttgacccttaatttgacggaggtcgttaagcggcagaattcgaagagcaagaaggggttcaatcagataagcacgtcgcaaatcaaggtggacaaagtgcagataattggctctaatagttgcccgttcgccgtttgcctggaccaggacgaacgcaaaatcttgcagagcgtggtgcgctgcgaagtctcaccctgttataaaccagagaagagcgacctgtcaagccctcctcagactcctccagacttgcccgctcaggcagctccagatctctgttcactgttgtgccttcccatcatgactttttctggggctctgccctag

SEQ ID NO: 30090 - DNA, 2643 bp, Artificial Sequence
  Description of Artificial Sequence: Synthetic coding sequence
atgcagccaggagctactacctgcaccgaagacagaatacagcacgcactggagcgctgtctacatggactatcattgtcaagacgaagtacctcctggagcgccggactgtgccttaactgctggtcactgcaagaacttgtatcccgggatcctggtcacttcctgattttgctggagcagattctgcaaaaaacccgcgaagtccaggagaaggggacctatgatctgcttactcctctcgccctcctgttttactctactgtgttgtgtaccccccacttcccccctgatagtgacttactgctcaaggctgcttcaacctaccatcggtttctgacctggcctgtgccttactgtagcatctgccaagaactcctcaccttcatagacgccgagctaaaggctccaggaatctcctaccagcgcctggtgcgcgcagagcagggtttgcccattcggagtcataggagttcaaccgtgactgtcctcctccttaaccctgtcgaagttcaggcagaatttctcgccgttgccaataaactgtctacaccgggtcacagcccccactcagcctataccacactcctcctgcatgccttccaggctaccttcggggctcactgtgacgtgcccggtctgcactgccggctccaggctaaaacgctagctgaactggaagacatttttactgaaactgccgaggcccaggagctggctagcggtatcggagatgccgcagaggcaagacgctggttgcgcaccaaacttcaggccgtgggagaaaaggccggatttccaggggtgctggatactgccaagcctggaaaacttcatactatacccatacctgtggccagatgctacacttatagctggtcacaggatagcttcgatatcttacaggagatcctgttgaaggaacaggagttgcttcagcctggaattctaggcgacgacgaggaggaggaggaggaagaggaggaggtggaggaggatctggaaacagacggtcattgcgcagagcgggactcactgctgtctacatcttcactcgcgtcacatgactccaccttgtcactggcgagctcacaggcctccgggccagctctatctcgccatctattgacatcttttgtctcgggactgtcggatgggatggattccgggtatgtcgaggattcggaggagtcgagctctgaatggccctggaggcgaggtagtcaggagcgacgaggccaccggagaccgggtcaaaagttcatccggatttacaaactatttaaatcaactagccagctggtgctccgtcgtgatagccgatccctcgagggttctagtgataccgcgctgccactccgtcgcgcagggtccctgtgcagcccactggatgagccagtgtcaccaccctcacgagctcaacgcagccggtcactgcctcagcctaaactgggcacacagctgccatcatggctattagcccctgcatcccgccctcagcggcgtagaccctttctgtctggagacgaagacccaaaagccagcaccctccgtgtagtggtttttggaagcgacaggatcagcggaaaggttgccagagcctactcaaatctgaggcgcctcgagaataataggccccttctcactcggttcttcaagctccagttcttttacgtgcctgtgaaaagatcacacgggacctcccccggtgcatgtccacctcccagatcccaaactcctagcccccctacagatagcccaagacacgctagccccggagagctcggaacgaccccgtgggaagagagcacgaatgacatttcccactaccttggaatgctggatccatggtatgaacgtaacgtgctgggactgatgcacttgccacctgaagtgctgtgccagcagagcctgaaagccgaggcccaagccctggagggatcccccacccagctgccaatcctcgccgatatgttgctatactattgtcgcttcgccgctaggcccgtgttgcttcaggtgtatcaaacagaactaactttcataaccggtgagaagactaccgagattttcatacactccctggagctgggacactctgccgctacacgggctatcaaggcttctggacctggaagcaagaggctggggattgatggggaccgtgaggctgttcccctcaccttgcagattatttactcgaagggcgcaatatctggtagatctcgatggtctaatttagagaaggtctgtacctccgtaaatctcaacaaggcctgcaggaagcaagaggagttggattctagcatggaagcgttgacgctgaacctcacagaagtcgttaagaggcagaactccaagagcaaaaaaggcttcaatcagatttccacatcccagatcaaagttgataaagtgcagatcatcggaagtaactcctgcccatttgccgtttgcttggaccaagatgaacggaaaatccttcaaagcgttgttcgctgtgaagtgtctccctgctacaagcccgagaagtctgacctcagctcacccccacaaaccccacctgacttgcctgctcaagctgccccagacttatgttctttactgtgtctcccaatcatgacgttctctggcgctctcccatag

SEQ ID NO: 30091 - DNA, 447 bp, Artificial Sequence
  Description of Artificial Sequence: Synthetic coding sequence
atgaaactgcttgtcttggccgtgttgctcaccgttgccgctgcagattcaggcatcagccccagagcggtgtggcagtttaggaagatgatcaagtgtgtaattccaggtagcgatcctttcctggaatataacaactacggttgctactgcgggctgggcggaagcggaacccccgttgacgaacttgacaaatgctgtcaaacgcacgataactgttacgaccaggccaaaaaattggacagttgtaaatttctcctggataatccttatacacacacctattcgtactcctgttctggttcggctatcacgtgttctagtaagaacaaggagtgtgaagcgtttatttgtaactgcgacaggaacgcagcaatatgtttttcaaaggcaccatataataaggctcataaaaacctggacaccaaaaaatattgtcaaagctag

SEQ ID NO: 30092 - DNA, 435 bp, Artificial Sequence
  Description of Artificial Sequence: Synthetic coding sequence
atgaagacactgctgctgctcgcggtgattatgatctttggattacttcaagctcacggaaaccttgtcaactttcaccgaatgataaagctgaccactggaaaggaagctgcactgagctacggattttacggctgccattgcggtgtgggcggaaggggcagccccaaggacgcaacggacagatgctgcgttactcacgattgctgctataaacgactggagaaacggggatgcggaaccaagtttctgagctacaaattttccaactctgggtctcgcatcacatgtgctaagcaggactcatgccggtcccagctttgcgaatgcgacaaggcagcagccacctgcttcgcaagaaataagacaacctataataagaagtaccagtattactcaaacaagcactgcaggggaagcacacctaggtgctag

SEQ ID NO: 30093 - DNA, 435 bp, Artificial Sequence
  Description of Artificial Sequence: Synthetic coding sequence
atgaagacgctgctgctgctggctgtgatcatgatcttcggcttgctgcaagcacacggtaatctcgtgaatttccataggatgatcaagctaactactggcaaagaagcagcactgagttatggattctacggctgccattgcggagtgggtgggcgaggcagccccaaggacgccaccgatagatgctgcgtgactcatgattgttgctacaagcgactcgagaagaggggatgtggaacaaagtttctgtcttacaagttctctaattccggttctcgtatcacgtgtgccaagcaggattcgtgtagatcccaactttgcgagtgcgacaaggccgctgctacatgttttgccaggaacaagacaacctataataaaaagtaccagtattacagcaacaagcactgccggggtagcacccccaggtgctag

SEQ ID NO: 30094 - DNA, 438 bp, Artificial Sequence
  Description of Artificial Sequence: Synthetic coding sequence
atggagttagccctcctgtgtggcctggtagtcatggcaggcgtcatccctatccagggaggaatcttgaatctgaacaagatggtgaaacaggttaccggcaagatgcccatcctctcatactggccctatgggtgtcattgcggcctcgggggacggggtcaaccgaaagatgccacggactggtgttgccagacccacgactgttgctacgaccacctcaagacccagggatgctctatttacaaggattattaccgctataacttctcccagggaaatatccactgctccgacaaggggtcttggtgtgagcaacagttatgcgcttgcgataaggaagtggcattttgtctgaagagaaatctggatacctaccaaaaaaggctgaggttctattggaggccgcactgtcggggtcaaacccccggttgctag

SEQ ID NO: 30095 - DNA, 429 bp, Artificial Sequence
  Description of Artificial Sequence: Synthetic coding sequence
atgaagtcgccccacgtgttggtcttcctctgtcttcttgttgctctggtcacaggcaatctggtgcagttcggagtgatgattgaaaaaatgacgggtaaatccgccctgcagtataacgactacggctgttactgcggcataggcggatcacattggcccgtggatcagaccgactggtgttgccacgctcatgactgttgctacggaagactagaaaaacttggttgcgaacccaagcttgaaaagtatttgtttagcgtatccgagcgcggtatcttctgtgccggtagaaccacttgccagcggttgacttgtgagtgcgacaaaagggctgcactgtgtttccgtaggaatctgggcacatataataggaagtatgctcactacccgaacaaactgtgcaccggcccaacccctccatgttag

SEQ ID NO: 30096 - DNA, 636 bp, Artificial Sequence
  Description of Artificial Sequence: Synthetic coding sequence
atggctgatggggctaaagctaatccgaaaggcttcaaaaaaaaggtcctggaccgatgcttcagcggatggcgcggaccacgctttggcgcaagttgcccatcaagaacatcccgcagttcactgggcatgaaaaagttctttacagttgcgatcctggcagggagcgtgttgtcaactgcacatggctctctgcttaatctgaaagctatggtggaggccgttacaggccgatccgcgatcctctctttcgtcgggtacgggtgctattgtggactgggcggacggggtcagcccaaggatgaagtggattggtgctgccacgcccacgattgttgctatcaggagttgttcgaccaaggatgtcatccatacgtggaccactacgatcataccatagagaataatactgagattgtttgtagcgacctcaacaagacggaatgcgacaaacaaacctgtatgtgcgacaagaatatggtcttgtgtctcatgaatcagacctaccgagaggaatatcgcggttttttgaacgtttattgccaggggccaacacccaactgttctatttatgaaccaccacccgaagaagtgacttgtagtcaccagtcccctgcccctcccgcacctccctag

SEQ ID NO: 30097 - DNA, 936 bp, Artificial Sequence
  Description of Artificial Sequence: Synthetic coding sequence
atgccggcaccccgtgcacctcgcgcattagccgcagccgctcctgcgtccggaaaagctaagctcacccacccaggtaaagccattctggctggaggactggcaggcggtatcgagatatgcatcacctttccgacagagtatgtcaagactcagctgcaactcgatgaacgatcacacccacctcgatataggggtattggcgactgcgtgagacaaaccgtgcggtcgcacggtgtgttgggcttgtacagaggcttgtcatctctgttgtatgggagcattcctaaggctgctgtgcggtttgggatgttcgaattcttgtctaatcatatgcgggacgcccaagggcgattggatagtacacgcggtttgttgtgcgggctgggcgctggcgtggcggaagcggtagtggtggtgtgcccaatggagacaattaaagtcaaatttattcacgaccagactagccctaatccaaagtatagaggattctttcatggcgtcagggagattgtacgcgagcaaggcctgaagggcacttatcaaggtctgacagccacggttctgaagcagggcagcaaccaggccattcgtttcttcgtcatgacctcactcagaaattggtaccgaggcgacaaccccaataagccaatgaatccacttatcacaggagtgtttggcgctatcgctggcgcagcctccgtattcggtaatacaccactcgacgttataaagacacgcatgcagggactggaggcacacaaatatcggaacacatgggactgcgggctgcagattctgaaaaaagagggattgaaggctttttacaaaggcactgtgccacgtttgggtagggtgtgtctcgatgtagctattgtgttcgttatttacgatgaggttgtcaaactcctcaataaagtgtggaaaacagattag

SEQ ID NO: 30098 - DNA, 2250 bp, Artificial Sequence
  Description of Artificial Sequence: Synthetic coding sequence
atgtcttttattgacccttatcaacacattattgtggagcaccagtactcccacaagttcaccgtggtagtccttagagccacaaaggtcacaaaaggcgctttcggggacatgctcgacacccctgatccctacgtggagctgttcatttcaacaacgcctgattccagaaaacgaactagacatttcaacaatgacattaacccagtttggaacgaaacatttgagtttatcctggacccaaaccaggaaaatgtactagagatcacgttgatggacgccaactacgtgatggatgagacgcttggcaccgccacctttaccgtaagctcaatgaaggtgggcgagaagaaagaggttcccttcattttcaatcaggtcacagagatggtgcttgagatgtccctcgaagtatgttcgtgtcctgatcttcgattctccatggctctttgcgatcaggaaaagactttcaggcagcagcggaaggaacatatacgcgaatccatgaagaaactcttaggccctaagaacagtgaagggctgcattctgcaagggatgtgcccgtggtggccattctggggagcggtgggggtttccgtgctatggtggggttcagcggtgtcatgaaggctctgtacgaatccggcatactggactgtgccacctacgtcgcaggactgtccggctccacttggtacatgtctactctgtactcacacccagatttccctgagaaggggccagaggagatcaatgaggagctaatgaagaatgtgtctcacaatcctctgctgttgctgacaccccaaaaggttaaaagatacgtcgaaagcctgtggaaaaagaaaagtagtggccaacctgtgacgttcaccgatatctttggaatgctgattggcgaaactctgatccacaatagaatgaacaccaccctgagctctttaaaggagaaagtgaacaccgctcagtgtcccctgcccctcttcacgtgcctgcatgtgaagcccgacgtgtcagagttgatgttcgccgactgggtggaattcagcccatacgagattggaatggccaaatatggcacctttatggcaccagatttgtttggctccaagttcttcatggggactgttgtgaagaaatatgaggaaaatcctttacatttcctcatgggcgtgtggggttccgctttctcaattctcttcaaccgagtgctgggggtaagtggctctcagtcccggggaagcaccatggaggaggagctagaaaacattaccacgaagcacattgtgtccaatgattccagtgatagtgatgatgaatcacatgaaccaaaggggacggaaaatgaggacgccggttccgactatcagagcgataatcaggcttcctggatacaccgcatgatcatggcccttgtgagtgattccgcccttttcaatacccgagagggaagggcagggaaggtacataatttcatgctggggcttaatctgaatacatcataccccctatcccccctcagcgatttcgcgacacaggacagctttgacgacgacgagctcgatgccgcagtcgccgatcctgatgagttcgagcggatctacgagccactagacgtgaagtccaagaagatacatgtggttgatagcggcctcactttcaacctgccttatccactaatactgcggcctcagcgtggagtggatctgattataagctttgattttagtgctaggccttccgattcttcgccaccatttaaggagctgcttctggcggagaagtgggccaaaatgaacaagctacccttccctaagatcgacccatacgtgtttgaccgggagggcctaaaagagtgctatgtgttcaagccaaagaatccagatatggagaaagattgccctacaatcattcatttcgtgcttgctaatattaattttaggaaataccgtgcgcctggagtcccccgtgagactgaggaagaaaaggaaattgccgactttgatatcttcgatgaccctgagagccctttcagtacatttaacttccagtacccaaatcaggctttcaagagactgcatgacctcatgcattttaacacactgaataatatcgatgttatcaaggaagctatggttgaaagtattgagtatcgcaggcagaatccctctcgttgttcggtcagccttagcaacgtggaggctcgcaggttcttcaacaaagagtttctctccaaacccaaggcttag

SEQ ID NO: 30099 - DNA, 150 bp, Artificial Sequence
  Description of Artificial Sequence: Synthetic coding sequence
atgagctttatcgacccctaccagcacatcattgtagagcaccaatattcccacaagttcactgtagtggtgttgagagcaaccaaagtcacgaaaggagcctttggggacatgccaaaggtgaccaaaggggcttttggggacatgtag

SEQ ID NO: 30100 - DNA, 2070 bp, Artificial Sequence
  Description of Artificial Sequence: Synthetic coding sequence
atgtcgttcattgatccctatcagcacatcatcgtcgagcaccaatactcccataaatttaccgtcgtcgtcctgagggcgactaaggtcactaagggagccttcggcgatatgctcgacacgccagacccctacgtcgagctgtttattagcactacccccgacagccgcaaacggactcgtcatttcaacaatgacattaaccccgtttggaacgagactttcgagttcattctagaccctaaccaagagaacgtcctagagattacgctaatggacgctaactacgtgatggatgagacccttggtacagccacattcaccgtatctagtatgaaggtgggggaaaagaaggaagtgcccttcatctttaaccaggtgcccgtggtagcaatccttggctccggcggaggcttcagggcgatggtgggctttagtggtgtgatgaaggcattgtacgagagcggcatcctggattgtgcaacctacgttgcaggactgtccggctctacttggtacatgagcaccctgtactcacatcccgattttcccgagaaagggccagaggagattaatgaggagctgatgaaaaatgtttcacacaacccccttcttcttttaactccacagaaggttaagcgttatgtggagtcactttggaaaaagaagagctccggacagcccgtcactttcaccgatatttttggaatgcttattggcgagaccctaatccacaatcgcatgaacaccactctttcaagccttaaagagaaggttaatacagcacagtgcccgctgcccctgtttacctgcttgcacgtgaagcctgatgtgagtgagcttatgtttgcggactgggtggaattttcaccatatgagatagggatggccaaatacgggacatttatggccccagatctgttcggcagtaagttctttatgggtaccgttgtcaagaaatatgaagaaaaccccctccacttcctaatgggggtttgggggtccgcattttccattctgttcaatcgagtgttaggcgtgagtgggtctcagtccagaggaagcaccatggaggaggaacttgaaaacatcacgacgaagcacatcgtgagcaatgactcctctgatagtgacgacgaaagccatgaacctaaggggaccgagaatgaggacgccggttccgattaccaatctgataatcaagcctcctggattcaccgcatgattatggccctggtcagtgatagtgctctttttaatacccgagagggaagggccggaaaggtccataactttatgttgggactcaaccttaacacctcataccctctgtcacccctttctgatttcgctactcaagattcctttgacgacgatgagctcgacgccgcagtggccgaccctgacgagttcgaaagaatctacgagcccctcgacgttaagagcaagaagatccatgtcgtcgacagtgggctcactttcaacctgccttacccccttattctccgccctcagaggggcgtggacctgatcatctccttcgacttctctgccagaccgtcggattcttctcccccattcaaggagcttctattggccgaaaagtgggctaaaatgaataagttgccgttcccaaaaattgatccctatgtgtttgaccgagaggggctcaaagagtgctatgtgtttaaaccaaaaaatccagacatggaaaaggattgcccgacaataatccattttgtgctggctaacattaactttcgaaagtaccgagcccctggcgtgccccgtgaaaccgaggaggagaaagaaatcgctgacttcgacatattcgatgaccccgagagcccgtttagtacgttcaattttcagtaccccaaccaggcattcaagcggttgcatgatttgatgcatttcaatacacttaataatatagacgtcattaaagaggcaatggtggagtccatcgagtaccgaaggcaaaacccatcacgctgttccgttagcctgtccaatgtcgaagctaggagattctttaacaaggagttcctctctaagcccaaagcctag

SEQ ID NO: 30101 - DNA, 2346 bp, Artificial Sequence
  Description of Artificial Sequence: Synthetic coding sequence
atggctgtagccgaagtgtcccggacttgcctcttgaccgtgcgggtccttcaggcccaccgtttaccgtccaaggacctagtgaccccatcagattgctacgtgaccctgtggttacccaccgcatgttcacaccgccttcaaaccagaactgtgaaaaacagctcctcccccgtttggaaccaatccttccacttccggatacacaggcaactgaagaatgtcatggagttgaaggtgttcgaccaagatctggtaacaggggacgaccccgtgctctctgtgctgtttgatgcaggtaccctgcgggctggcgagtttaggagagagtcattttctctcagtccccaaggggaggggagactcgaggtggagttcagactccagagtctcgcagataggggcgaatggctggtgagcaacggagtccttgttgccagagagctttcgtgtcttcacgttcagctggaagagaccggagatcagaagtcttccgagcatcgcgtgcagctggtggtacctggcagctgcgagggtcctcaagaggcctctgtgggaactggaactttccggttccactgcccagcttgttgggagcaagagctgagcatccgccttcaggacgctccagaggaacagctgaaggccccactgagcgctcttccgtcaggacaggtagttaggctggtcttcccaaccagtcaggaaccactcatgagggtcgaactcaagaaagaggcgggtctgagagaactggcagtccgactcggcttcggaccatgcgctgaagaacaggctttcctgtccaggcgtaagcaagttgtggctgccgcacttagacaggcattacagctggatggggacttacaagaggatgagatccccgtagtcgccattatggccacgggcggtggcattagagctatgacatcgctgtatggtcagctggcaggccttaaggaactaggcctgctcgattgcgtgtcttacatcacaggagcttcaggctccacttgggctctggctaatttgtacgaggatccagagtggagccagaaagacctggcgggtcccaccgaacttttgaaaacacaggtgaccaaaaacaagcttggcgttctggccccttcccagcttcagaggtaccgccaagaactagccgagcgtgccagattgggctatccctcgtgctttaccaatctctgggcactcattaacgaagccctactgcatgatgaacctcatgatcataaattgtctgaccagcgcgaggccctcagtcatggccaaaaccctttgcctatctactgcgcattaaacacgaaaggtcaatctttgacgacatttgagttcggggaatggtgcgagttcagcccctatgaagtcggttttccaaagtatggagccttcatcccatcagagctgttcggctccgagttctttatgggccagctcatgaagcggctcccagagtcccgtatctgtttcctcgagggcatttggagcaacttgtatgcagcgaatctccaggacagcctgtattgggcctctgagccatctcagttttgggatcgctgggtaagaaaccaggctaacctcgataaggagcaggttccgctgctaaagattgaggaaccaccttcgaccgcgggacgtatagcagagttcttcacggacttgctgacgtggcggcctcttgcacaggccacccataatttcctgaggggacttcattttcacaaagattatttccagcatcctcatttcagcacatggaaagccactacattagatggcctgcctaatcaactaaccccaagcgagccccacctctgcttgctggacgtggggtacctaatcaatactagctgcctccctctactgcaaccaaccagagacgtcgatctcatcctgagcctggattataacctacatggggcatttcagcagctgcagcttttgggcaggttttgtcaggaacagggtatcccttttccgcctatcagcccctcccctgaagaacagttgcagccaagagaatgccatacattctcagacccgacctgtccaggcgctcccgcagtgctgcacttcccgctagtttctgacagtttccgagagtattccgcccctggcgtacgccgaacccctgaggaagccgctgcaggggaagtgaatttgagttctagtgatagtccataccactataccaaagtgacctactctcaggaagacgtcgacaaactacttcatctcactcactacaatgtgtgtaacaaccaagaacaacttctggaggccttaagacaggccgtgcagaggaggaggcagcggaggcctcattag

SEQ ID NO: 30102 - DNA, 417 bp, Artificial Sequence
  Description of Artificial Sequence: Synthetic coding sequence
atgaaggggcttctgcctctggcctggtttctggcctgctctgtccctgctgtccagggaggtttactggacctgaagtcgatgattgagaaggtcacgggaaagaacgccctgaccaactacggtttttacgggtgctattgcggttggggaggcagagggaccccgaaagacggcaccgactggtgctgttgggctcatgatcactgctacggtcgcttggaagaaaaggggtgcaatatacgaacccaatcttataagtaccggttcgcgtggggcgtggtgacatgcgagcccggtccattctgccacgtcaacctctgcgcatgtgacagaaagctggtatactgtctgaaacgcaacctgaggtcgtataaccctcagtaccaatatttccccaatatattatgctcctag

SEQ ID NO: 30103 - DNA, 2421 bp, Artificial Sequence
  Description of Artificial Sequence: Synthetic coding sequence
atgcagttctttgggaggcttgtcaataccttttccggcgtaacaaacctgttttccaatccattcagggtgaaggaggttgcggtagccgactacacatcctctgatagggtgagagaagaagggcagctgattctgttccagaatacgcctaaccgtacctgggactgcgtactcgtaaacccaaggaacagccagtcagggtttcgcctgttccagctcgagctggaggctgatgctctggttaatttccatcaatacagttcccagctccttccattctacgagagttcgcctcaagtgcttcatactgaggtgctgcagcacctcactgacctcatacgcaatcacccatcttggagcgtagcccacctggccgtggagctgggaattcgagaatgttttcaccactctagaatcatatcgtgtgcaaactgcgccgaaaatgaggaggggtgcacccccctccatttggcctgtaggaaaggcgatggggaaatcctggtcgagctcgtgcagtactgccacactcagatggacgttaccgattacaaaggagagactgtctttcattacgcagtgcagggggataactcccaggtcttacaactgctgggcagaaacgccgttgctgggttaaatcaggttaataaccagggcctgactcccctccacttagcgtgtcagctgggaaaacaggagatggtgagggtgcttctgctgtgtaatgctaggtgtaatatcatgggaccgaatgggtaccctattcattctgctatgaaattcagccaaaaaggctgcgcagagatgataatcagcatggactcatctcagatccacagtaaggatccgaggtacggtgcaagccctctgcactgggcgaaaaacgcagagatggctagaatgctgctcaagcgtgggtgcaatgtcaattccacaagctccgcagggaatacggcgctgcatgtggccgtcatgcggaatcgcttcgactgcgccattgtcctactcacccatggtgcaaatgcagatgctcgaggggaacatggtaatacccctctgcacctggctatgagcaaggacaacgtagagatgatcaaagctctgattgtattcggggctgaagtcgacaccccgaacgatttcggcgagaccccaacttttcttgcctccaagatcgggaggctggtgacccgcaaggcgattctgacgcttctgaggaccgtcggagccgagtattgtttcccgcctattcacggcgtccccgcagagcagggcagcgccgctccccaccatccctttagccttgagcgggcacagcctcctccaataagcctgaacaacctggagttgcaggatctcatgcacatctctagagcccgaaagccagctttcatcctcggcagtatgcgcgacgagaaaagaacccatgatcacctgctgtgcttggacggaggtggggtgaagggcttaattatcatccagctgctcattgcaatcgagaaagcgagcggggtcgccactaaggatctcttcgactgggtggcaggcacttcaaccgggggtattttggccctggctatccttcactctaagtctatggcctacatgcgcggtatgtacttccggatgaaggacgaggtgttcagaggctctagaccatatgagagcggccctctggaagaatttctcaaaagggaatttggagagcacaccaaaatgactgacgttaggaaaccaaaagtgatgctgacgggcacgctttctgatcgtcagccagccgagttgcatctgttccggaactatgacgctcccgagaccgtacgcgagcctagattcaatcagaacgtcaatctgcggcctcctgctcaaccctctgaccagctggtgtggcgggctgccaggagttcaggcgctgccccaacctacttcagacccaatggtagatttcttgatggcggactgctggctaacaatcctactttggacgctatgaccgagatccacgaatataatcaggacttgataagaaaagggcaagccaacaaggtcaaaaaactttctatcgttgtgagcctgggcactgggcgaagcccacaggtaccagtgacttgcgttgatgtctttagacccagcaatccttgggagttagcaaaaactgtatttggtgcaaaagaactgggaaagatggtcgtggactgctgcaccgaccccgacggccgagccgttgaccgagccagggcctggtgtgaaatggtagggattcagtatttcaggctaaaccctcagctagggactgacattatgctagatgaagtcagtgatactgtcctggtgaatgctttatgggaaaccgaggtgtacatttacgaacatcgggaagagttccagaaactgatccaattgctactgtccccctag

SEQ ID NO: 30104 - DNA, 1284 bp, Artificial Sequence
  Description of Artificial Sequence: Synthetic coding sequence
atgcagtttttcgggaggcttgtcaataccttttctggagtgaccaatctgtttagcaatccattcagggttaaggaagtagccgtcgccgactacaccagctccgatcgcgtccgcgaggagggtcagttgatccttttccaaaatactccaaaccgcacatgggattgcgtattagtcaacccaagaaacagccagagcggcttcaggtgtgccaattgcgctgagaacgaagaaggctgtacgccgctccacctcgcctgtaggaagggcgatggggagatattggtggaattggtgcagtactgccacacccaaatggatgtgacggattataaaggagaaaccgtgttccattatgcagttcagggggataactcccaggtattgcagctgttggggcgaaatgccgttgccggtctgaaccaagtgaataaccagggcttgactccccttcacttagcctgccagctcggtaagcaggaaatggtgagagttctgttactttgcaacgccagatgtaacataatgggcccaaacggctaccctatccattcagccatgaaatttagccaaaagggctgcgctgagatgataatctcgatggattctagccagatacattccaaggatcccaggtatggagcttctcctctccattgggcaaaaaatgcagaaatggcgcgaatgctcctcaaaaggggctgcaatgtaaatagcacgagctcggctggcaatacagccctccacgtggctgtcatgcgcaatagattcgattgcgccatagtgctgcttacacacggcgctaatgctgacgccaggggggagcatgggaataccccacttcacctggcaatgtccaaggataacgttgagatgatcaaagctctcatcgtgtttggcgctgaggtcgataccccaaacgactttggcgaaacccccacctttctggcaagcaaaattggacggctagtcactaggaaagccatattgacccttttacgaacggtgggtgccgagtattgcttcccgccaattcacggggtcccagccgaacaggggtcagcggcacctcaccacccctttagcctcgagcgtgctcagccaccgccaatttccttgaacaacttgggttcccacccaagccaggccggttggtgggcttggggggctgcctctgatggcaccacaggaagccatgcacacctgactggaccagaggcctcagtacaccctggactgcatgagggccgagaggccgatcgccagaacatggaatcctag

SEQ ID NO: 30105 - DNA, 2259 bp, Artificial Sequence
  Description of Artificial Sequence: Synthetic coding sequence
atgcagtttttcggacggcttgtgaatacattcagcggcgtgacgaacttgtttagtaaccctttccgcgtcaaagaagtagctgtggctgattatacctccagcgatagggttcgtgaagaagggcagctcatcctatttcagaatacccctaaccggacctgggattgtgtgctcgtgaaccccagaaactcacagtcagggtttcgcctgtttcagctggagcttgaagctgatgccctcgtcaattttcaccaatattcttctcagctactccccttttatgagtcatctccccaggtgctgcataccgaggtactgcagcacctgaccgatctaatccggaatcatcctagctggtcagtggctcatctagccgtggaactcggaatccgggaatgtttccatcattctcgaattatatcttgtgcaaattgcgctgagaacgaggagggctgtacccctctccacctggcctgtcggaaaggtgatggggagatcttggttgaattagtgcagtactgccatacccagatggatgttaccgactacaagggcgagacagtcttccattacgccgtgcaaggcgataactctcaggtgctgcagcttctaggtcgcaacgcagtggccggactgaaccaggttaacaatcaaggccttactcccctgcatttggcatgccagttaggaaagcaggagatggtaagagtgttgctgctgtgtaacgctcgatgtaacataatgggccctaacgggtatcccatccactccgcaatgaaattttcccagaagggctgtgccgaaatgatcatctctatggactcatctcagattcactcaaaggaccccagatacggggcatcacccctccactgggcgaaaaatgcagagatggcgcgaatgcttcttaagaggggatgtaacgtcaactcgacatcctccgctgggaatactgccttacacgttgccgtgatgcgcaaccgtttcgactgtgctatcgttctgctgacacacggggctaacgccgatgcgaggggagagcatggaaatactcccttacatctggcaatgtcaaaagacaatgtggaaatgatcaaggcgctaattgtgttcggggctgaggtggacacaccaaacgatttcggggagacaccaaccttcctggccagcaaaattgggcgtcagcttcaggatttaatgcacattagccgggctaggaaacccgcatttatcctgggcagcatgagggacgaaaaaaggacacacgaccatctactctgtttggatgggggtggcgtgaaaggcttaattattatccaacttctgatcgctattgagaaagcttctggagtggccacaaaagatctcttcgactgggtcgcagggacaagtactgggggaatcctggctctagcgatactgcattccaagtccatggcatacatgagaggcatgtatttccgtatgaaagacgaagttttcagaggtagccggccatatgaatccgggcctctcgaggagtttcttaagcgcgaatttggcgagcacaccaaaatgacagacgtccgaaaaccgaaggtgatgctgaccgggacactgagcgacagacagccagccgagcttcatctatttcggaattacgatgctcccgaaacagtacgcgagccaagattcaaccagaacgtgaatctgaggcccccagctcagccaagtgatcagctggtgtggagagccgcacgctcttccggggctgcacccacttactttcgtccaaacggcaggttcttagatggcggactgcttgcaaacaaccctactctcgacgccatgactgaaatccacgagtacaaccaggacctcattcgaaaaggccaagcgaataaggttaagaagctgtctatcgtggtgtctctcggcacaggccgaagtccacaggtgcctgtgacttgtgtggacgtcttcaggccaagcaatccctgggagctggccaagactgtgtttggtgcgaaggagctgggcaagatggtggttgattgttgcacagatcccgatggcagggctgtggaccgagctagagcctggtgcgaaatggtgggcatccagtatttccgcctgaatcctcagctgggtaccgacattatgctagatgaagttagcgacacagttcttgttaacgcactatgggagacagaggtatacatatacgagcacagagaagaattccaaaagttgatccagttactgctgtccccctag

SEQ ID NO: 30106 - DNA, 1440 bp, Artificial Sequence
  Description of Artificial Sequence: Synthetic coding sequence
atgcagttctttggccgtctggtcaacacgttctcgggggtgactaacctgtttagtaatccattcagggtgaaggaggtcgccgtggcggactatactagtagcgaccgcgtccgcgaggaagggcagcttatcctatttcagaatacgccaaaccgaacttgggattgcgtcttggtcaacccccgtaattctcagtctgggttcaggctgttccagctcgaactggaggctgacgcgttggtgaatttccatcagtacagctcccagctgcttcccttctacgaaagctcaccacaggttctgcatacagaggtgctgcaacacttaacagatttgatccgaaatcacccctcgtggagcgtggcacacctcgccgtggagttgggtattagggagtgttttcatcattcccggattatttcatgtgctaattgtgcagagaacgaagagggatgcactcccctgcatctagcctgtcgcaaaggcgacggggaaatcctggtagagctggttcagtattgtcacacacagatggatgttacagactataagggcgagaccgtgtttcattacgcagtgcagggcgataattcccaggtacttcagctcttagggagaaacgcagtggcaggcctgaaccaggtgaataatcaggggttgactcccttacacttggcctgccagttaggtaaacaggagatggtgcgagttctactgctctgcaacgccaggtgcaacatcatggggcctaatggctacccgatccactctgccatgaagttctctcagaagggttgcgcggagatgatcatctcaatggactctagccagattcatagtaaagaccctcggtacggggcttccccactgcactgggcaaagaacgccgaaatggccaggatgctcttaaagcgaggatgcaacgtgaactccaccagctctgctgggaatacagcccttcacgtggcagtgatgcgtaaccggtttgattgtgccattgtgctgctgacccacggcgctaatgcggacgccaggggcgagcatgggaacactccattgcacctggccatgtccaaggacaatgtggagatgataaaggcccttatcgtcttcggtgccgaggttgacacaccaaacgattttggcgaaacaccaacatttctggcatccaaaattggtaggctcgtcactaggaaagcaattctgactctgctcaggaccgtcggcgcagaatactgctttccgcctattcacggagtcccagccgaacagggaagtgccgcaccacaccatccgttcagcctggagcgagcccagcctccacccataagcctgaataacttagagcttcaagacctaatgcatatcagccgggcacggaaacctgcctttatcctgggaagcatgcgcgacgagaaaagaactgacagaacttag

SEQ ID NO: 30107 - DNA, 2259 bp, Artificial Sequence
  Description of Artificial Sequence: Synthetic coding sequence
atgcagttttttggccgactcgtaaacacattctcaggagtcacgaacttgttttccaacccattccgcgtgaaggaagtggccgttgctgactacactagtagcgatagagtgcgggaagaaggtcaactcattctctttcagaacacaccaaaccgcacctgggattgcgtgttagtgaacccccgaaattcccagagcggctttcgactgtttcagttggagctcgaagccgacgccttggtgaactttcaccaatacagttcccaactgcttccgttctacgagtcatccccacaggtgcttcacaccgaagttctgcagcacctcaccgaccttatcagaaaccatccaagctggagcgttgctcatttagctgtggaactggggatccgggaatgttttcaccactcccggataatttcatgtgccaattgtgcagagaacgaggagggctgcacccccctacatcttgcttgtcgcaagggagatggagagatcctggtcgagctggtccaatattgccatacccagatggatgtgactgattataagggcgagaccgtattccactatgctgttcagggcgacaacagccaggtgctgcaacttttaggcaggaacgccgtggccggactcaatcaggtgaacaatcaagggctaacgcctctgcacctcgcttgccagctgggtaagcaggagatggtccgagtactgttattgtgtaatgcccgatgcaacataatgggccctaacgggtatcccatccactctgcaatgaaattttcccagaaaggatgtgccgagatgataatcagcatggacagcagtcagatccattcaaaagacccgcgttatggcgcaagccctctacactgggctaaaaatgctgaaatggcacgcatgctgctcaaacggggatgcaatgtgaatagtactagctcagccggaaataccgcgctgcacgtagccgtgatgcgtaacaggtttgactgcgcaattgttcttctgacccatggcgctaatgccgacgctcgtggggaacacggcaataccccactgcacctcgctatgtcgaaggataatgttgaaatgatcaaggccttgatagtgtttggcgctgaagtggacactccaaacgatttcggcgaaacaccaaccttcctcgcatcgaaaattggacggcagctccaagacctgatgcacatcagtagggcaagaaagcctgcattcatcctgggttcaatgcgcgatgaaaagagaacacacgaccatctgctgtgcctggatggaggcggagtgaagggtttaatcattatccagttgcttattgccatcgagaaagcatctggggttgccaccaaagacttattcgactgggtggccggaaccagtactggtgggatcttagctcttgcaattctgcatagcaagtcaatggcctatatgcgtggtatgtacttcaggatgaaggacgaggtttttaggggctctcggccttatgagtctggtccgctggaggagtttcttaagagggagtttggcgagcataccaagatgactgacgtgcgaaagcccaaagtgatgcttactggaactctgagcgacagacaacccgctgaacttcacctgttccggaactacgatgctcctgaaacagttcgggagccacgatttaaccagaacgttaacctgaggccacctgcccagccttcggaccaactcgtatggcgcgcagcacggagctccggagccgctcccacctacttcagaccgaatgggagattcctagatggagggctcctggccaacaacccaacgctggatgccatgactgaaatccatgaatacaaccaggacttaatccgaaagggccaggccaacaaagtgaaaaaactgtcaatcgtcgtgtccctgggcacagggagaagtccccaggtgccagtgacctgcgtggatgtcttccgtccatcaaacccctgggagttagcgaagactgtttttggagccaaagagctaggtaaaatggtggtggactgctgtaccgatcccgatggaagagctgttgatcgggctcgggcttggtgcgagatggtcgggatccagtactttcgcctgaaccctcagctgggcacggatatcatgctagacgaggtgtccgataccgtgttagtgaatgcattatgggagactgaggtgtacatctacgagcatcgggaagagttccagaagttgatccagctcctgctcagcccctag

SEQ ID NO: 30108 - DNA, 2004 bp, Artificial Sequence
  Description of Artificial Sequence: Synthetic coding sequence
atgcagtttttcgggcgactagtaaacacatttagtggcgtcacgaatttattttctaatccattcagagtaaaggaagtggccgtggccgattacacaagtagtgacagagtaagggaggaagggcaactaattttatttcagaacactccaaatcgcacctgggattgtgttctggttaatccaagaaacagccagtccggtttcaggctcttccaattggagttggaggcagatgctttggttaacttccaccagtatagctcacagctgggcaagcaggagatggttcgtgtccttcttttatgtaacgcgcgatgcaacattatgggaccaaacggttacccgattcattcagctatgaaattctcacagaaaggctgtgccgagatgataatttccatggacagcagccaaatacactccaaggaccccaggtatggcgcttccccactgcattgggctaaaaatgcagaaatggcgcgaatgttgcttaaacgcggatgcaatgtaaattccaccagcagcgcaggcaacaccgccctccacgtggctgtgatgcggaaccggtttgattgcgccattgtattgctcacgcacggagccaacgccgacgcccgaggtgaacacggcaacactcctctgcacctcgccatgtcgaaggacaatgtcgagatgattaaagctctgatagtatttggcgcagaagtcgacaccccaaatgacttcggagagacaccaacattcctggccagcaagataggcagacttgtgacccggaaagccattctcaccctcctgaggactgttggcgcagagtattgctttccgcctatccatggggtcccagccgagcagggttccgctgctcctcaccatccctttagcctagaacgcgctcaaccccctccaatctccctgaacaaccttgagctgcaggacttgatgcatatcagccgagcccgaaagcctgcttttatactgggatccatgagggacgagaagcggacacacgatcacttgctctgcctggacggcggaggcgtaaaagggctgatcatcattcagctgttgatcgccattgaaaaggcgtcaggggtggccacaaaggacctttttgattgggttgccggaacctccacaggtggcattcttgctctggctattcttcacagtaagtctatggcctacatgcgcggtatgtattttcggatgaaggatgaagttttccgcggatcgcgcccatacgagtcaggtcccttggaagagttcctcaagagagagtttggcgagcacactaaaatgactgacgttagaaagcctaaagtcatgctaacagggaccctgtctgacaggcagccggctgagctgcacttgtttcggaactatgacgcacctgaaacagtgagggaaccaaggttcaatcagaacgtgaatctgaggccacccgcacagcccagtgaccagctagtttggcgcgctgccagatcatcaggcgcagcacctacgtacttccgcccaaacgggagatttctggacggtggcctgttggccaataaccctactttggacgccatgaccgagatccacgagtacaaccaggatctgattcggaaagggcaagcgaataaagtgaagaagcttagtatagtagtaagtctggggaccggtcggagccctcaggttccggtcacatgcgtggacgtcttccggcctagcaatccctgggaacttgccaagaccgtgttcggtgcaaaggaactcggcaaaatggtggtggattgctgcacggacccggacggcagggccgttgatagggccagagcctggtgtgaaatggtggggattcaatactttcgactgaatccccagctcggtaccgacatcatgctggatgaagtgagcgacactgtgctggtcaatgctttgtgggagacggaagtctatatttatgagcaccgagaagaatttcagaagctgatccaactactgctttccccttag

SEQ ID NO: 30109 - DNA, 501 bp, Artificial Sequence
  Description of Artificial Sequence: Synthetic coding sequence
atgcaattcttcggaaggctggttaacacattttcaggcgtgacaaatcttttttcaaacccattccgggtgaaagaagttgccgtggccgactacacatcttctgacagagttagagaggaagggcagctgatcctatttcagaacacacccaaccggacatgggattgtgtgctagttaatcctaggaatagccagagcggtttcagatgtgccaactgcgccgagaacgaggaaggctgtacaccgttacacctcgcctgcagaaagggcgacggagagattctggtggaattagtccagtattgtcacacccagatggatgtgactgactacaaaggagaaacagtgttccactatgccgtgcagggcgacaactcccaagtactccaactgctgggtcgtaacgcagttgccggactgaaccaggttaacaaccagggactgactccactccacctggcatgccaactgggcaaacaggaaatggtcagggtatag

SEQ ID NO: 30110 - DNA, 1299 bp, Artificial Sequence
  Description of Artificial Sequence: Synthetic coding sequence
atgcagttctttggtcggctcgtgaacacattcagtggcgttaccaatctgttttctaatccattcagagttaaggaggtggcggtcgctgactatacaagctctgacagggtgcgcgaggagggtcaactcattctgtttcagaatacccctaatcggacctgggactgcgtgttggttaacccacgaaatagccaaagcggcttccggttatttcaactcgagctcgaggccgatgccctggtgaactttcatcagtactcatcacagctacttcctttttacgagagctctcctcaggtgctgcataccgaggtgttgcagcatctaacggaccttataagaaaccacccaagctggtcagtggctcaccttgccgtcgagctgggcatcagagagtgcttccaccattcccgcattatccgcgtgcgctccgctcatcaggttccaggcctgtgggagctgatttcgacccaccacgagatcgagttctcccagccacctcaggccgtacccatcgccaggagaactcgcagggccgctcacccctgcacatggcctgccgcaagagtgatgggccgttcttggtggtcgtggtgctccacagctacgttgcgttggatgtctccaaccacccgggaacggccaagctccattatgcttagccgagtgacgattcttcggtgctgtagatgcgcagaaatgatcatttctatggatagctcccagattcacagcaaagatccacgctacggagcctctccactgcattgggccaagaacgctgagatggcacgcatgctgctaaagaggggctgtaacgtgaatagcaccagttcagccggaaataccgcactacacgtggctgttatgcgcaatagatttgactgtgcgatcgtgctcctgacacacggagctaacgcggatgctaggggcgagcacgggaatacaccgctgcacctggccatgtccaaagataacgtagaaatgattaaggccctgatcgttttcggggctgaagtggataccccgaatgactttggggaaactcccactttcctcgcgtccaagataggacgcctggtaacaagaaaggcaatacttaccctgctcagaacagtgggcgctgagtattgctttccacctatccatggcgtccccgctgaacaagggtccgcagcaccccatcatcctttcagtctcgagagagcgcagccccctccaatcagcctgaacaatctggggtctcacccttcccaagctggctggtgggcgtggggggctgcgagtgatgggtag

SEQ ID NO: 30111 - DNA, 243 bp, Artificial Sequence
  Description of Artificial Sequence: Synthetic coding sequence
atgcagttctttgggaggttggtcaacacctttagtggcgtgacaaacctttttagcaaccctttccgcgtaaaggaagtggcagttgccgactacacctctagcgatagggtgcgagaggagggtcagctcatattgttccagaatactccgaatagaacctgggactgcgtcctggtgaaccctcgcaacagccagtcaggtttcagattattccagttagagctcgaggcagacgcttag

SEQ ID NO: 30112 - DNA, 498 bp, Artificial Sequence
  Description of Artificial Sequence: Synthetic coding sequence
atggggccactgccggtgtgtcttcccataatgctccttctcctgctcccaagtttgctcctattgctattgctccccggacctgggtccggcgaagcctcgagaatccttagagtccaccgcagagggatccttgagctggcaggtaccgtggggtgtgtgggacccaggacacccattgcctatatgaagtacggttgcttctgtggactgggaggccacggacagcctagggatgcgattgattggtgctgccatggccacgattgttgttacacacgggctgaagaagctggctgtagtcccaaaacagagagatactcctggcagtgtgtgaaccaatcagtcttatgcggacccgctgagaacaagtgccaggagctgctgtgcaaatgcgatcaggagatcgcgaactgcttagcccagacagagtataatctgaaatacctgttttacccccagttcctttgcgagcccgatagcccaaagtgtgactag

SEQ ID NO: 30113 - DNA, 498 bp, Artificial Sequence
  Description of Artificial Sequence: Synthetic coding sequence
atgggacccttgcctgtgtgcttaccaattatgttgttactgcttctgccatcactgctcctcttgctcctgctgccaggtccaggcagtggtgaagccagtaggatcctgagagtccaccgccgaggcatcctggagctggcagggacagtgggatgtgtgggaccaagaacccccattgcctatatgaagtacggctgcttctgcggactgggtggccacggtcaacctagggacgccatcgattggtgttgccacggccatgactgctgctacactagggcagaggaggcaggctgttcccctaaaaccgagagatatagctggcagtgcgtgaatcagtctgtcttgtgtggtcccgctgagaataaatgccaggaactgctatgcaagtgcgatcaggaaatagcaaactgcctggctcagacggagtataacctgaagtacctgttctacccgcagtttctgtgcgagccagatagccccaaatgcgactag

SEQ ID NO: 30114 - DNA, 570 bp, Artificial Sequence
  Description of Artificial Sequence: Synthetic coding sequence
atggcactgctgtccagacctgccttgacgcttctgctgcttctaatggctgcggttgtgaggtgtcaggaacaggctcagactactgactggcgggcaacactgaagaccattcggaacggagtgcacaagatcgatacatatctgaatgcggcactcgatctcctgggaggagaggacggactgtgccaatacaagtgcagcgatgggtcaaaaccatttccaaggtatggctataagccaagtcccccaaatggctgcggcagcccactgtttggggtgcacctgaatattggaatcccgagtctgactaagtgttgcaaccagcatgacaggtgttatgagacatgtggaaagagcaagaatgattgcgacgaggaattccaatattgtctctccaagatctgccgggacgtgcagaagacattgggactgacccagcatgttcaggcgtgtgagacaaccgtagagctcctgtttgactctgtgatccatttaggctgtaaaccttacctcgatagccaaagagccgcatgtcggtgccattacgaggaaaaaaccgatctatag

SEQ ID NO: 30115 - DNA, 213 bp, Artificial Sequence
  Description of Artificial Sequence: Synthetic coding sequence
atggctctgctctcccggcctgccctcaccttgctgttgcttttaatggccgcagtggtccgctgtcaggagcaggcgcagactacagattggcgcgctacactgaagacaatccggaacggcgtgcataagatcgatacttacctgaacgcggcacttgacctgctgggaggggaggatggactctgccagtacaaatgctctgatgcttag

SEQ ID NO: 30116 - DNA, 588 bp, Artificial Sequence
  Description of Artificial Sequence: Synthetic coding sequence
atgaagcttgccagcggtttcctagtgctgtggctgtccctgggcggtggattggcccaaagcgatacttctccagatacagaggagagttactccgattggggcttgaggcatcttcggggatcattcgaaagtgtgaactcctatttcgacagcttcctagagctgctgggcggaaaaaacggagtgtgccagtacagatgccggtacggcaaagcgcctatgcctcgccctggctacaagccacaggaaccaaatggctgcgggtcctattttctgggcctgaaggtgcctgagtccatggaccttggtatcccagctatgacaaaatgctgcaatcagctggatgtgtgctatgacacgtgtggagccaacaagtaccggtgtgatgccaaattccgctggtgtctccactccatctgctctgatctcaaaagatctcttggatttgtttcgaaagtagaggccgcatgtgactcgctcgtggatacagtgttcaatactgtctggactctgggttgcaggcccttcatgaacagccagagagctgcttgtatttgtgccgaggaagagaaggaggagctgtag

SEQ ID NO: 30117 - DNA, 3876 bp, Artificial Sequence
  Description of Artificial Sequence: Synthetic coding sequence
atggctggcgctgctagcccttgcgctaacggatgcggaccaggcgcacctagtgatgcagaggtactgcatctgtgtagatctctggaagtgggtacagtgatgaccctcttctacagcaagaagagccagcgccctgaacggaagaccttccaggtgaaattggaaacaaggcagattacttggtccagaggagctgacaaaattgaaggcgctatcgatataagggagatcaaggaaattcgtcctggcaagacatctcgcgactttgaccgctaccaggaggacccagcattccgcccagaccagagccactgttttgtgattctctacggtatggaatttaggctgaaaactttaagtctccaggcaacttctgaggatgaggttaacatgtggataaagggactaacctggctgatggaggacacattgcaagcccctacgcctctccaaatcgagcgctggctacgaaagcaattctattcagttgatcgcaacagagaggatagaatttcggccaaggacttgaaaaacatgcttagccaggtcaattaccgagtcccaaacatgcgatttcttcgagaaaggctgacagacctagaacagcgaagtggcgacataacctacggccaatttgcgcagttgtatagaagcctgatgtacagcgcacagaaaaccatggacctcccgttcctggaggccagcaccctgcgcgctggagaacgccctgaactctgccgcgttagcctgccagagtttcagcagtttctactagattatcagggcgagttatgggccgttgatagacttcaggttcaggagttcatgttgagtttcttgcgagaccctctgagggagattgaagaaccctatttcttcctcgacgagttcgttaccttcctgttttctaaagaaaacagtgtgtggaattcccaattggatgctgtttgtcctgatacaatgaataacccgctgagccactattggatctcttcgagccataatacttacctgaccggagaccaattcagttcagaatcttcccttgaggcgtatgcaagatgtctcaggatgggatgtcgctgcatcgagctggactgttgggacggacccgacggcatgcctgttatctaccatgggcacacgttgactacaaagattaaatttagcgatgtgcttcacaccatcaaagagcatgctttcgtggcttcggaatatccagtgattctgagcatcgaggaccactgtagcatcgcccaacagcggaacatggcacagtactttaagaaagtgctaggtgacacactgctcaccaagcccgtggagatctccgcagacggattgccatcacctaaccagctgaaacgcaagattcttattaagcataaaaagctcgcagagggtagcgcatatgaggaggtgccgacctccatgatgtattccgaaaacgatatctctaattcaatcaaaaatgggatactgtacctggaggatcccgtcaatcacgagtggtacccacactattttgtcctgactagctcgaagatttattatagtgaagaaacgagctcagaccaggggaacgaagacgaagaggagcccaaggaagtctctagtagtaccgaattgcacagtaacgagaaatggttccacggaaaactcggggcaggtcgggatggacgacatatcgcggagcggctgctgaccgaatactgcatcgaaacaggagcacctgatggttctttcttagttagagagtctgaaacattcgtaggagactatacactcagtttttggaggaatggtaaagttcagcactgcaggatccattctcgacaggatgctggaacaccgaaatttttcctcacagacaatctcgtgttcgactccctttacgatcttatcacgcattaccagcaggtaccactgcggtgcaacgaatttgagatgaggttgtcagaacctgtcccccaaaccaacgctcacgagagcaaagagtggtaccatgcttcgctgacgagagcacaggcagagcacatgcttatgcgcgtgccacgtgatggggcattcctggtacggaaacgtaacgagcccaactcctacgccatcagcttcagagcggagggaaaaattaagcactgtagggtgcagcaggaagggcagacagtcatgctggggaactccgagtttgacagtctagtcgatttgatcagttactatgaaaaacatcctctgtacaggaaaatgaaactgcgctatccaatcaatgaagaagccctggagaagatcggaacggccgagcctgattacggtgccctgtacgaaggacgaaacccaggcttttacgtcgaggctaatcctatgcctaccttcaaatgcgcagtcaaggcgctattcgattataaggctcagagagaggatgaacttacatttataaagtctgcaataattcagaatgtggaaaagcaggaaggcggatggtggcgaggtgactacggtgggaagaaacagttatggttcccaagtaattatgtggaggaaatggtaaatcccgtcgcattagagccggagagggagcatttggatgagaactctccactcggggacctcctgcgaggcgtactcgatgtgcccgcttgccagatcgccattcgtccagagggcaaaaacaaccgactgttcgtgttctcaattagtatggcttcagtagcccactggtccttggacgtggccgctgacagccaagaggaattacaggactgggtgaagaagattagggaggtcgctcagaccgcagacgccagattaacagagggaaaaattatggagaggaggaaaaagatcgctctggagctgtccgagctggtggtgtattgcagacctgttccattcgatgaagaaaaaattgggacggagagggcctgttaccgggacatgagtagttttccggaaacaaaggcagaaaagtacgtgaacaaggctaaagggaagaagtttttacaatataaccgactgcagctctccagaatttaccccaagggacagcgcctcgactcatccaattacgaccctctccccatgtggatctgcggtagccagttagtcgctctcaattttcagactccagacaaacctatgcagatgaaccaagctctattcatgacaggacgccattgtggctacgtgctccagccttctacaatgcgtgacgaggcctttgatccattcgacaaatcaagtttacgcggacttgaaccctgcgccatttcgatcgaggtacttggcgctcgtcaccttcctaaaaacggcagggggattgtgtgtccctttgtggagattgaagtggcaggggcagaatacgactctacgaaacagaaaactgaatttgtggtggataacggactcaacccagtctggccagcgaagccgttccactttcaaatcagtaatcctgaattcgcctttttgcgctttgtcgtgtatgaggaagatatgttctctgaccagaactttctggctcaagccaccttccctgttaaagggctgaagaccggctatagagccgtccctctcaagaataattactccgaagacttggagcttgcgtccctgttgataaaaatcgacatcttccccgcaaaacaagagaacggcgatctgtctccattcagtgggactagtctgagggagcggggttccgacgctagcggacaactatttcacggcagagccagggagggttcttttgagtcgaggtaccagcagccatttgaagacttccggattagccaggaacacttggccgaccatttcgactcacgagagcgcagagcccctcgtagaacacgtgtaaacggtgacaaccggctgtag

SEQ ID NO: 30118 - DNA, 3873 bp, Artificial Sequence
  Description of Artificial Sequence: Synthetic coding sequence
atggccggagccgcttcaccctgcgccaacggctgtggacctggcgctccttccgatgccgaggttcttcacctttgccggagtcttgaagtcggaactgtcatgacactattttactccaaaaaatcacaacggccagaaaggaagacttttcaagtgaaattggagactagacagatcacatggtctcgcggtgcggacaagatcgagggagccattgatatcagggagatcaaagaaattcgaccgggaaagacctcacgcgactttgatcgttatcaggaggacccagccttcagacccgatcaatctcattgctttgtgatcctctacggcatggaatttcgcttaaaaacactgagcctccaggccacctcggaagacgaggtgaacatgtggattaaaggtttgacctggctcatggaggacactttgcaggcgcctacaccactgcagatagaaagatggctccgtaagcagttttacagtgtcgataggaaccgcgaagataggatttccgctaaggacttaaagaatatgctctcccaggtcaactatcgagtcccaaacatgcgctttcttagagaacggttaacagacttggagcagagatcgggagatatcacatatggtcaattcgcccaactgtacagatcattaatgtattcggctcagaagaccatggatctgcccttcctggaggcatcaacgctgcgagctggcgagcgccctgaactgtgtcgggtaagtttacccgaattccaacaattcttgttggattaccagggggaactttgggccgttgacaggttgcaggtccaggaatttatgctttcctttctgcgggatccgctcagggagattgaggagccctatttcttcttggacgagttcgtcaccttcttgttttcgaaggaaaacagcgtgtggaactcacaattggatgctgtctgcccagacacaatgaataaccctctgtctcattattggatttcctcatcccacaacacatacctgacgggagaccaatttagcagcgaatcctcccttgaggcctacgcacggtgcttgcgcatggggtgccggtgcattgaactcgattgttgggatgggcctgatgggatgccagtgatttaccatgggcacaccctgacgactaaaatcaagttcagtgacgtgttgcacacgatcaaagaacatgccttcgttgctagcgagtaccccgtgatcctgtccattgaagatcattgttcgatcgcccagcagagaaacatggcccagtacttcaagaaggtgctaggtgatacactgctgaccaaacctgtagaaatctctgcagatggcctgcccagcccgaaccagctaaagcgaaaaattcttatcaagcataaaaagctcgcagaaggcagcgcttatgaagaggtgcccacgtcaatgatgtatagcgagaacgacattagcaattcaattaagaacggcattctctacctcgaggacccggttaatcatgaatggtatcctcattacttcgttttgacgtccagcaaaatttattactctgaagagacaagttccgatcaaggcaatgaggacgaagaagagcctaaggaagtatccagcagcaccgaacttcactccaacgaaaagtggttccacgggaagttgggagctggcagggacggccgacatatcgctgagcgacttttgacagagtattgtatcgaaacaggagcacctgacggctcatttctagtaagagaatcagaaaccttcgtgggagattataccttgagcttctggcggaacgggaaggtgcagcactgccgcatacactctcgccaagatgctggcaccccaaaattttttttgaccgataatttggtgtttgattccctctacgatttgattacccattatcagcaggtccccctgcggtgtaacgaattcgagatgcgattgagtgagcctgtgccccagaccaacgcacatgaatcaaaggaatggtatcacgcctcactcacgagggctcaggcagagcacatgctgatgagagtcccaagagatggggcatttctcgtgagaaaaaggaacgagcccaattcatatgccatttccttcagggctgaaggaaagatcaagcattgtagagtgcagcaagaaggccagactgtgatgcttggaaactctgaatttgacagtcttgttgatcttatatcatactacgaaaaacaccctttatacaggaagatgaagcttagatatcccattaatgaggaggccctggagaagattggaaccgccgaaccagactacggggctttgtacgaaggcagaaatcccggtttttatgttgaggccaaccctatgcccacctttaaatgtgctgtcaaagccctcttcgactacaaggcccaaagggaagatgagctaacattcatcaaatctgcaatcatccagaatgtggaaaaacaagaggggggatggtggcgtggcgattacggtgggaaaaagcagctgtggtttccttcgaactatgtagaggagatggtgaacccagtggcacttgagccagagcgcgaacacttagatgagaatagccccctaggagacctgctccgcggagtgctggacgtacctgcgtgccaaatcgcgattcggccagagggcaaaaacaacaggttgtttgttttcagtattagcatggcatccgtcgctcactggtctctggacgtcgccgctgatagccaagaggagctccaggactgggtgaagaaaatccgcgaagtagcacaaacggcggacgccagactgactgaaggtaaaatcatggagcggagaaaaaaaatcgccttagagttgtctgaactggtggtgtattgtcgcccagtgccttttgacgaggaaaagatcggtaccgaacgggcatgttaccgggacatgtcttcctttccggagaccaaagcagagaagtatgtcaataaagccaaagggaagaaattcctccaatacaatcgcttgcagctctcccggatctaccctaagggccagcggttggacagttctaactacgaccctctgcctatgtggatttgcggttcacagctggtggctttgaacttccagacaccggataaacctatgcaaatgaaccaagcactcttcatgaccgggaggcattgcgggtatgttttgcagccctccactatgagggatgaggcgtttgatccatttgacaaatcttcacttcggggacttgagccatgcgcgatcagcattgaagtcttgggtgcccgacacctacctaagaatggcagaggtatcgtgtgtccctttgtcgaaattgaggtggctggagccgagtatgacagtacaaagcagaaaaccgagttcgtcgtggataacggactcaatccagtctggccagctaaacccttccattttcaaatatcgaatcctgagttcgcgtttctgcggtttgtggtatatgaagaggacatgttcagtgaccagaatttcttagctcaagcaaccttccccgtaaaggggttaaaaaccggctatcgggctgtacccctgaagaacaattattccgaggacctggaactcgcctcactgctgatcaagatcgatatctttcctgccaaggagaatggtgatctctcccccttctctggcaccagcctgagagaacggggttcagatgcttctgggcagctgttccatggtcgggcaagggaggggtcttttgaaagtcgataccagcagccattcgaagacttcagaatctcccaggagcatctcgccgatcacttcgatagccgggaaagacgggctcctcgcagaacaagggttaatggggataataggctgtag

SEQ ID NO: 30119 - DNA, 3876 bp, Artificial Sequence
  Description of Artificial Sequence: Synthetic coding sequence
atggccggagccgcttcaccatgcgccaatggatgcgggccaggggctccttccgatgcggaggtcttgcacctttgcaggagtctggaggtgggaacagtgatgactctgttctatagcaagaagagccaacggcctgagcggaaaacattccaagtgaaactcgagacccggcagataacatggagtcgcggagcagataagattgaaggcgctattgacatccgggagattaaggagatcaggcccggtaagacaagtcgggattttgatcgatatcaggaagaccctgcattcagacctgaccaaagccactgttttgtaatcctctatgggatggaattccggctgaagactctgagcctgcaggccacgagcgaagacgaagtaaatatgtggattaaaggactcacctggctcatggaagatacactccaggccccaaccccccttcagatcgagaggtggctgcgaaagcagttctattctgtcgatcgcaaccgcgaagaccgaatcagcgctaaagacttgaaaaacatgttaagtcaggtgaattatcgcgttccaaatatgaggttcctcagagagagactcaccgacttggagcagaggtctggcgatattacgtatggccagtttgcacagctgtaccgcagcctcatgtatagtgcacaaaaaaccatggacctgccatttcttgaagcatcaaccctcagggccggtgaacgaccagagctctgtcgcgtatctctgcctgaatttcagcagttcttactcgactaccagggggaactgtgggctgttgaccgactacaagtccaggaatttatgctcagtttcctgcgagatccccttagagaaatagaggagccctatttctttttggacgagttcgttactttcttgttttctaaagagaacagcgtgtggaactctcagctcgacgcagtttgtcccgataccatgaacaatcctttgtctcattattggattagctccagccataacacctatctgacaggtgatcagttcagcagtgaatcttcattagaagcttacgccaggtgcctccggatgggctgtcgctgcatcgagctcgactgttgggatggcccagatggaatgccagtgatttaccatgggcatacactgactaccaaaatcaaattcagcgatgtgcttcacacaattaaggagcacgcttttgtggcctctgagtatcctgtgatcctgtctatcgaggatcactgctctatagctcaacaaaggaatatggctcagtactttaaaaaagtactcggtgatactctgctcaccaagcccgtcgagataagtgccgatggccttccttctcctaaccagctgaagaggaagatcctgattaaacataaaaaactagccgaaggtagcgcttacgaggaggtaccaaccagcatgatgtatagcgagaacgatatctctaactcgatcaaaaatggtatcctctatctcgaggatccggtcaaccatgagtggtatccccactatttcgtcttgacttcttccaaaatttattactccgaagagaccagctccgatcagggcaacgaggacgaagaagaaccaaaggaagtttcctcttcaactgaactgcactccaatgaaaaatggttccatggcaagctgggggctggcagggacggcaggcacatcgcggagcgcctattgacggaatattgtattgaaactggggctccagatggatcttttcttgttcgagagagtgaaaccttcgtcggagattatacactcagcttctggcgcaatggcaaggtgcagcactgtaggatccattcaagacaggacgctggaacaccgaaattctttttgactgacaacttggtgttcgacagtctctacgatctgataacacactatcaacaggtacccttgcgctgtaacgagtttgagatgagactctcagagccagtgccccagactaatgcacatgaatctaaagagtggtatcatgcttccctcacgagggcccaggctgagcacatgctgatgagggtgccacgcgacggagccttcctggtccgcaaaagaaatgagcccaattcttacgccattagcttcagggccgagggtaaaatcaagcattgccgcgtgcagcaggaagggcagactgtgatgctaggcaattccgaatttgactctttggtggacctgatctcttactatgagaaacaccctctctatcgcaaaatgaagcttcgataccccatcaacgaggaagcgctggagaaaatcggtaccgctgagcccgattatggcgctctgtatgaaggtagaaaccctggattctatgtggaggccaaccccatgccaacttttaaatgtgcggtgaaagccctctttgattacaaagctcagagggaggatgaattgacatttataaaaagcgctattatccagaacgtagagaagcaggaaggcggttggtggcgcggagattatgggggaaagaagcaactctggtttccaagtaactacgttgaggaaatggttaatccagtggccctcgagcccgagcgggaacacctcgacgagaacagcccgctgggggacctccttcgcggagtgctggacgtccccgcttgtcagatcgcaatacgtcccgagggcaagaacaatcgcttgttcgtcttcagcatctcgatggcaagtgtcgcacactggagtcttgacgtggccgcagattcacaagaggaactgcaggattgggtgaaaaaaatacgtgaggtggctcagaccgctgatgcacgcctgaccgagggcaaaatcatggagcggcgaaaaaagattgcgttggagctatccgaactggtggtgtactgccgaccagtcccgttcgacgaggaaaaaattggaaccgaacgtgcttgctatagggatatgtcttccttcccagaaactaaggccgaaaaatacgtcaataaagctaaaggaaaaaaatttctccaatacaaccgcctgcagctttcgcgaatttacccaaagggccagcgccttgacagttcaaactacgatccattgccgatgtggatttgcgggtctcagttagtagcactaaactttcaaaccccagacaaaccgatgcagatgaatcaggcactgtttatgactggaaggcactgcggatatgtcctgcaaccatcgacaatgcgagatgaagccttcgatccatttgacaagtcgtctctaagaggcctggaaccttgtgctattagcatcgaggtcctgggggctcggcacctacctaagaacggccgaggtattgtttgccccttcgtggaaattgaagtcgccggagccgaatatgactctaccaagcagaagactgagttcgtcgtagacaatgggctaaaccctgtgtggccagctaagcctttccacttccagattagcaatccagaatttgcctttctacgcttcgtagtatacgaggaagacatgttcagcgatcaaaacttcctagcccaagctacatttccagtcaaggggttgaagacgggctaccgcgcagttcctctcaaaaataactactccgaagatctcgagctggcctccctcctaattaagatcgatatctttcctgctaagcaggaaaatggcgatttaagcccattctcgggcacatcactgcgcgagcgcggatccgacgcaagcgggcagttgttccacgggagagcccgagaaggaagcttcgaatcaagatatcagcagcctttcgaggactttcgaataagccaggagcacctggccgatcacttcgactcccgggagcggagagccccacgcaggactcgggtcaatggggacaatcgactatag

SEQ ID NO: 30120 - DNA, 3798 bp, Artificial Sequence
  Description of Artificial Sequence: Synthetic coding sequence
atgtccactaccgttaatgtcgatagcctcgccgaatacgagaagtcacagattaaacgagcgctcgaactgggaacggtcatgactgtgttcagctttcgcaaatccacaccagaacgtaggacagtccaggtgattatggaaacgaggcaagtggcatggagcaagaccgcagataagattgagggttttctcgacatcatggaaataaaggaaattagaccaggaaagaacagcaaagatttcgaacgcgcaaaagctgtaaggcaaaaggaggactgctgttttacaatactgtacggaacacagtttgtgctgagtactctcagcctcgccgcagattcaaaagaggacgcggtgaactggctgagcggcctgaaaatccttcatcaggaggccatgaatgcctctaccccaaccattatagaaagttggcttcgcaaacaaatctatagcgttgatcagacgcgacgtaattcaatctctctgcgcgaacttaaaacaattctgcccctgattaatttcaaggtttcaagcgccaagttcctgaaagataagtttgttgagattggagcacacaaggatgaactgtcattcgagcagtttcatctcttttacaaaaaattgatgtttgagcagcaaaagtccattcttgatgaatttaaaaaggacagctccgtatttatattgggtaatacggaccggcctgacgcaagcgctgtgtatctgcacgatttccaaagatttctgatccacgagcagcaagagcactgggcccaggatttgaataaggtcagagaaagaatgacaaagttcattgacgataccatgcgggaaaccgccgaacccttcctctttgtagatgaattcctgacttacctgttcagcagggagaactccatatgggatgagaaatatgatgcggtcgacatgcaggacatgaacaatcctctgagccactattggatcagttcttcccataatacctacttaaccggagatcagcttcgctctgagtcatcaccagaggcctacatcagatgcctccggatggggtgtcggtgtatcgagctcgactgttgggatggccctgacggcaagccagtcatctaccatggttggactagaacgactaaaatcaaatttgatgacgtggtgcaggccatcaaggaccatgcatttgtcacatcaagcttcccagtcattctgtcaatagaagaacattgtagcgtcgagcaacaacgccacatggctaaggcctttaaggaggttttcggtgatttattgctgactaaaccgacggaggcctctgctgaccagctcccatcaccgagccagctgcgggagaagattatcatcaagcacaaaaaactcggacctagaggcgatgtcgatgtgaacatggaggacaaaaaagatgagcacaaacagcagggagaactgtacatgtgggactcaatcgatcagaagtggactcgccactattgtgccattgccgacgcaaagctgtcgttctccgacgacatcgaacagacaatggaggaggaagtcccacaggacataccacccacagagctgcacttcggggaaaaatggttccacaagaaggttgaaaagcgaactagcgctgaaaaacttctgcaggaatactgtatggaaacaggcggaaaggacggaacattcctcgtgagagagagcgagacgtttccgaatgactacacactgtccttttggcgttcagggagagtccagcattgcaggatacggtccaccatggaaggcggaacactcaagtattatttgaccgacaatctgacctttagttcgatctacgccctcattcagcattaccgagaaacccacttgcggtgtgcagaatttgagcttcggttgacagacccggtcccaaacccaaatcctcatgaatctaagccctggtattatgattctctgtcccgcggagaggccgaagacatgctgatgcgcatccccagagacggggctttcttgatcaggaaacgtgaggggagcgactcatacgccatcacctttcgcgctagaggaaaggtgaagcactgtcggatcaatagagacggcagacatttcgtgctaggaacctccgcttactttgagtcactggtcgaactggtgtcctactacgagaaacattccctttacaggaaaatgcggctgagatacccggtgactcccgaattgctggagcgctacaatatggaacgggatataaactccctctatgacgtttcccggatgtacgtagatcctagtgagataaacccctcaatgccacagaggaccgtgaaggccttgtacgattacaaggcaaagagatccgatgagctgtccttttgtaggggtgcattaatccataacgtttccaaggagcccggaggttggtggaaaggcgattacggtactagaattcagcagtactttcctagtaactatgtggaggatatttcaacagcagactttgaggagcttgaaaagcagattatcgaggacaatcccttggggtcgctctgccgtggcatccttgacctgaacacctacaacgtcgtgaaagccccacagggtaagaaccagaaaagtttcgtcttcatcctagaaccaaagcaacaaggggaccctcccgtagagttcgcaacggacagggtggaagagttgttcgaatggtttcagtctatccgggagattacatggaagattgacacgaaggaaaacaatatgaaatactgggagaaaaaccagtcgattgcaatagaactgtccgacctggttgtttactgcaaaccgaccagtaaaaccaaggacaatttagaaaaccccgacttcagagaaattcggagctttgtggagactaaggcagacagcattattcgccaaaaacctgtggaccttctgaagtacaaccagaaaggccttaccagagtgtacccaaaggggcagcgggttgattcctctaattacgatcccttccgcctttggctgtgtggctctcagatggtggcattgaacttccagactgcagacaaatacatgcagatgaaccacgctctcttcagtttgaacgggaggacaggctacgtgctgcaacccgaatctatgcgtaccgaaaagtatgacccaatgcctccagaaagccagcggaaaattctcatgactctcacggtgaaagtcctaggcgctcgccatctcccaaagctaggaaggtctatcgcctgtccattcgtggaggtggagatttgcggggcagaatatgataataataagttcaagactactgtggtgaacgacaacggtctgtcccctatctgggctcctacccaggaaaaggtaacatttgaaatttacgaccctaatttagcttttctgaggtttgtggtgtatgaggaggatatgttcagtgaccctaatttccttgcccacgctacttaccctatcaaggccgtcaaaagtggcttcaggagcgtcccactgaaaaacggttacagcgaggatatcgagctcgcttccctgctcgttttttgtgaaatgcggccagtgcttgaatccgaagaagagctctattcgtcttgtcgtcagcttagacgacggcaagaagagctgaacaatcagctgtttctctatgacacgcaccagaacttgcggaatgccaaccgcgacgcccttgtcaaagagtttagtgtgaatgagaaccaattgcagctttatcaagagaagtgcaataagcgccttcgagagaagcgtgtcagtaatagtaagttctacagctag

SEQ ID NO: 30121 - DNA, 2916 bp, Artificial Sequence
  Description of Artificial Sequence: Synthetic coding sequence
atgtctctcaaaaatgagccacgtgttaacactagcgctctccagaaaatcgcagctgatatgagtaacattattgagaatcttgatacaagagagttacatttcgaaggggaggaagtggactatgacgtcagccctagtgatccaaagatacaagaggtctatatccctttcagtgccatatacaacactcaggggtttaaggaaccaaatatccaaacttacctcagtggttgcccgattaaggctcaggttctggaggtggagagattcacatccaccacacgcgtaccttcaatcaatttgtacactatcgagttgacccacggcgagttcaaatggcaggttaaaaggaagttcaaacatttccaggagttccatagagagctcctgaaatataaggcattcatccgaatcccaataccaacaaggcggcacactttcaggcggcagaacgtgcgggaagagcccagagaaatgccaagcctcccacggagtagtgaaaacatgatccgagaagaacaatttttgggtcgccgtaaacaattggaagactacttgactaaaatcttaaaaatgcctatgtaccgaaactatcatgcaaccacagaatttttggatatctcccagctgtctttcatccatgacctggggccaaaagggattgaagggatgattatgaaacgtagcggcggtcatcggatcccagggctcaattgctgcgggcagggcagggcttgctaccggtggtccaaaagatggttaatcgttaaagactcatttctgctctacatgaagcccgatagtggcgctattgcctttgtgctcttggtggacaaggaatttaaaatcaaagtcggtaagaaggaaaccgaaacaaagtacggtattcgcatcgacaatctttctaggacactgatccttaagtgtaattcctaccgccatgccaggtggtggggaggagcaatcgaggaatttattcaaaagcacggcactaatttcctgaaggaccacagattcggatcttatgccgcaattcaggagaacgcactggccaaatggtacgtaaatgcgaaggggtactttgaggatgtggccaatgctatggaggaggcaaacgaagagatatttattaccgactggtggctatctcccgagatttttcttaagcggcctgtcgtggaaggaaaccgctggcgcctggattgtattctcaaacgaaaagcacagcaaggcgtgcgtatattcattatgttgtacaaggaggtggaactggccctaggcataaacagcgagtacacaaagcggacccttatgcggctgcacccgaacatcaaggtgatgagacacccggatcacgtatcctctaccgtgtacttgtgggctcatcacgaaaagctggtaattatagatcaatcagtcgcttttgtgggcggaatcgaccttgcctacggccgatgggatgataacgaacatcgcctaactgatgttggatctgtcaaacgggttaccagcggcccaagcttggggtctctgcccccagccgctatggagtctatggaatccctcagactgaaggataaaaacgaacccgtgcaaaatctgccaatccagaaaagtattgacgatgtagatagtaagctgaagggtatcggaaagccacgtaagtttagtaaattttctctgtacaagcaactccaccgtcaccacctccatgacgccgactctatcagcagcattgactcaacttcttcttacttcaaccactaccgcagccatcataatctcatccacggattgaagccccattttaagctctttcatccaagctccgagtcagagcaggggttaacgcggcctcatgctgatactggaagtattagatccctgcagaccggtgtcggagaactccatggcgaaactcgtttctggcacggtaaggattactgcaacttcgtattcaaggactgggtacagctggataaacctttcgcagatttcatcgacaggtactccacgcctcgcatgccctggcacgacattgccagcgcggttcacggcaaggctgctagggacgtagccaggcactttattcaacgctggaacttcaccaaaattatgaagagtaaatataggagtctgtcctacccgttccttctgccgaagtctcagactacggcccacgaacttagataccaggtgcctggatctgtgcacgctaatgtacagctgcttcggtcagcagctgattggtcagcagggattaagtatcacgaggagagcatacatgccgcttacgtgcacgtgatcgagaatagtcggcactatatttacattgagaatcaattctttattagctgcgccgacgacaaggttgtctttaataagatcggagacgccatcgcacagaggatcctgaaggcacaccgggagaatcagaagtatcgcgtctatgtagtgattcccctgctgcccggtttcgagggagatatctccacaggaggtgggaacgccttgcaggccatcatgcatttcaattataggacgatgtgcaggggagaaaactccatcctgggacaactgaaagccgaacttggcaatcagtggatcaactatattagtttctgtggcttgcgtacgcacgcggaactggaaggcaatctcgtaaccgaactgatctatgtgcacagcaaactccttattgctgacgacaacacagtaatcattggttcagcaaacatcaacgacagaagtatgctcgggaaaagagacagcgaaatggctgtgatcgtgcaggatactgaaacagtgcccagcgtaatggatggtaaagaatatcaagctgggcgatttgccaggggcctcagactgcaatgttttagatcaaagatgacacctggagtggaagatccctag

SEQ ID NO: 30122 - DNA, 1794 bp, Artificial Sequence
  Description of Artificial Sequence: Synthetic coding sequence
atgagcttaaagaatgagccccgtgtgaatactagcgcgctgcagaagattgcggctgatatgtccaacatcatcgagaatctcgacactagagagcttcattttgagggcgaagaagtagattacgacgtgtccccaagtgaccctaagattcaggaggtgtacatcccttttagcgcaatttataacacccaaggcttcaaggaacccaacatccagacttacctaagtggctgtccaattaaggcccaggtcctggaagtggaacgcttcaccagcactacacgtgtcccctcaattaatctgtacacaatcgagctgacccacggggagttcaaatggcaagtaaagcggaagtttaaacatttccaagaattccaccgtgagttgttgaaatacaaagccttcattcggattcccatccccacgcgacggcatacctttcggagacaaaacgtcagagaggagcctagggagatgccatccttaccacgtagctccgaaaacatgatacgcgaggaacaattcctcggccgtcggaagcaactagaggattacctgactaagattcttaagatgcctatgtatcgcaattatcatgcaacaactgaattccttgatatcagccaactgagttttatccacgatttgggccctaaaggaatcgaggggatgatcatgaaacgcagtggcggtcatcggattcccggtctgaactgctgcggccaggggagggcttgctataggtggagtaagcggtggctgattgtcaaagatagctttctgttgtacatgaaacccgatagtggggctatagcctttgttctcctcgtggacaaggaattcaagatcaaggtaggaaagaaagaaactgaaactaaatacggcatccgcattgacaatctgtctagaactctcatccttaagtgcaacagctaccgccatgccaggtggtggggtggggcaatcgaagaattcattcaaaaacacggcaccaatttcctcaaggaccacaggttcggatcttacgccgcaattcaggaaaatgcgctggccaagtggtacgtgaacgccaagggttacttcgaggatgtcgccaatgcaatggaggaggcaaatgaagagatcttcatcaccgactggtggctgtctcccgaaatttttctcaagcgcccagtcgtggagggcaatcggtggagattggactgtattctcaaacggaaggcgcagcagggtgttaggatcttcattatgttatataaggaggtagagctggcccttggaatcaattccgaatacacaaagagaaccctgatgcgcctgcaccccaatataaaagtgatgcgccatcctgaccacgtgtctagcacagtgtacctgtgggcccaccatgagaagctcgtgatcatcgaccagtcggttgcatttgttggtggtatcgacctagcctatggcaggtgggatgacaacgagcaccggctcactgacgtggggtcggtgaagagagtgacaagtgggcctagcctgggaagccttccaatacctggcccttcggtggtgtatcgccaggtctgggagtcctgcatgggtaaacctgactctggcatggagcggacgactgctatttccagtagcaaaactggatttaacttaattaatcttctcctgatttctttgaccggcaccccaagacctgggtgccccggaatgacgctgccgctccaatctacagggaggcgattggttatgtggcacgtcacttcgtccagcgccggaacgagccagaagctgtag

SEQ ID NO: 30123 - DNA, 3225 bp, Artificial Sequence
  Description of Artificial Sequence: Synthetic coding sequence
atgtcactgaagaacgaaccacgggtaaatacaagcgccctccaaaaaatcgccgctgacatgtccaatataattgaaaatctcgacaccagagagctacatttcgagggagaggaggttgattatgatgtcagcccttccgatcctaaaatccaggaggtttatattccattctccgctatatacaatacccaggggttcaaagaacctaacattcagacttatctgtctggatgtcctattaaagcgcaggttctggaggtggagagattcacgtctaccactagagtaccttccataaacctgtataccattgagctgacccacggcgagttcaagtggcaagtcaagcggaagttcaagcattttcaggagttccacagagagctgctgaaatataaagcattcattaggatccctatcccaacccgtaggcacacctttcgacggcaaaatgttagggaagaaccccgagaaatgcccagtctgcccaggagtagtgaaaatatgatcagggaggaacagtttcttggccgaagaaagcagttggaggactatctgaccaagattctaaagatgccgatgtatagaaactaccacgcaacaactgaatttctggatatcagtcagctctccttcattcatgatttgggcccaaagggaattgagggtatgatcatgaagaggtccggcggacacagaatccccggacttaactgctgcgggcagggaagagcctgttatagatggagcaagagatggttaatcgtcaaggattccttcctgctctacatgaagcccgactctggcgcaatcgcttttgtcctgctcgttgataaagagttcaaaataaaggtgggcaagaaggaaactgagactaaatacggaatcagaatcgataacctaagtagaactctcatactgaaatgcaacagttatcgccacgcccgatggtggggaggggctatcgaggaatttatacaaaagcatggtactaactttctgaaagaccaccggtttgggtcatacgccgcaatccaagaaaatgcgctcgcaaagtggtacgtgaatgctaagggctattttgaagatgtggctaatgccatggaggaggcaaatgaagagatttttataactgattggtggctgtctcctgagattttcctgaagcggccagtcgtcgagggcaaccggtggcggctcgactgcatcttgaaaaggaaagcccaacaaggcgtgagaattttcatcatgctttataaggaggttgagctggctcttgggatcaattccgagtacactaagcggacccttatgcgactgcatccaaacatcaaagtgatgcgacaccccgaccacgtgtcttccactgtatacctgtgggcacaccacgaaaagcttgtgatcatcgaccaatcggtggcctttgtggggggaattgacctcgcctacgggaggtgggacgataacgaacaccggctgacggatgttggcagcgtgaagcgagtgaccagcggcccatccctgggctctctgccccctgctgctatggaatccatggaaagcttgcgtttaaaggacaagaacgagcctgtgcagaacctgcccatccagaagtctattgatgatgttgattcaaagttgaaagggataggtaagccaaggaaattttcgaagttttcactgtataagcaactgcaccggcaccatcttcatgatgctgattcaatttccagtatcgattctacctccagctatttcaatcactaccggtcacaccataatcttattcatggcctgaagccccatttcaagctgtttcatccttcgtccgaaagcgagcaaggtttgacaaggccacacgcagacaccggtagtatcagatcccttcagaccggtgtgggggagttgcatggagagacccgtttctggcacggcaaggactactgcaatttcgtgttcaaggactgggtgcagctggacaaacctttcgcagactttatagatcggtattcaacaccgaggatgccttggcatgacatcgcctcggccgtgcatggcaaggctgccagagatgttgcaaggcactttatacaaagatggaatttcacgaagatcatgaagtccaagtaccgctccctgtcgtacccctttttgctgcctaagtctcagaccaccgcccatgagttacgttatcaggtgcccggtagtgtccatgctaatgtccagctgctgagatccgccgctgattggtccgctggcattaagtatcatgaagaatccattcatgccgcttacgtgcacgtgatcgagaactctcggcattacatttatatcgagaaccaattcttcatctcttgcgcagacgacaaagtagtctttaataagataggggatgctattgcacagcgtattctgaaagctcaccgggagaaccagaaatacagagtgtacgtcgtcattccgctgctacccggtttcgagggggacattagcaccgggggtggaaacgcccttcaggccatcatgcactttaattacagaacaatgtgtagaggggagaattcaatcctcggccagctaaaagctgagctgggcaaccagtggattaattacatcagcttttgtgggctgcgcacacatgctgaacttgaaggcaacctggtgacagagttgatctacgtgcatagtaaacttcttatagctgacgataacacagtgattattggctcggccaatattaacgaccgcagtatgcttggaaaacgagacagcgagatggccgtcattgttcaggatactgagaccgtgccatcggtaatggacggcaaagagtatcaagccggtaggtttgccagaggcctacggctgcagtgcttccgggttgtccttgggtatttagacgaccctagtgaggacattcaggacccagtgtcagacaagttcttcaaagaggtctgggtgagcactgcagctcgaaatgccacaatttacgataaggtgtttagatgcttaccaaacgacgaagtacacaatctgattcagctcagagacttcatcaacaagcccgtgctcgccaaggaggaccccattagggccgaggaagagctgaagaagataaggggatttctggtgcagtttcctttttacttcctgtccgaggagtctctgctgccctcagtcggaacaaaggaagcgattgtgcctatggaagtctggacctag

SEQ ID NO: 30124 - DNA, 3111 bp, Artificial Sequence
  Description of Artificial Sequence: Synthetic coding sequence
atgagcttgaaaaatgaacctcgagtcaatacatccgctcttcagaaaatcgccgctgacatgtccaacatcatcgaaaacctggatactcgggagctacattttgagggagaagaggttgactatgacgttagcccaagtgatccaaagatccaagaagtgtatatccctttctcggctatttacaatacgcagggcttcaaggagcccaacatacaaacctatctgtccgggtgtcctattaaggctcaggtgttagaagtggaacggtttactagcaccaccagggtaccaagcatcaatctgtacaccatagagctgacgcacggcgagttcaaatggcaggtgaagaggaaatttaagcattttcaggaatttcatcgcgaactcctcaagtataaagcctttatcagaatacctattcccacccgacggcacacattcaggcggcaaaacgtgcgggaagagcctagagagatgccctccttaccacgttcttccgagaatatgatccgagaggagcagtttctggggcgtaggaaacaacttgaggattatctcacaaagatcctgaagatgcctatgtaccgcaactaccacgctaccacagagtttcttgatattagccaattatcattcattcacgatctaggccctaaggggatcgaagggatgatcatgaagcgaagcgggggacacagaatcccaggcttgaattgctgcgggcaagggagagcctgctatcgttggagcaaacggtggctgatcgtgaaagacagctttctgttgtacatgaagcctgactcaggtgctatcgcgtttgtgctccttgtcgacaaagaatttaagattaaggtgggaaaaaaagagacggagaccaaatacggcattcgcattgataacctgagccgaactttgattctgaagtgcaatagttacaggcatgcgagatggtggggtggtgccatcgaggagtttattcagaagcacgggacaaattttcttaaagatcatcgctttggaagttacgctgctatacaggagaacgccctggccaaatggtatgtgaacgcgaagggttacttcgaagacgtggccaacgctatggaagaggctaatgaagaaatattcatcaccgattggtggctatctcccgagatctttcttaagcggcctgtcgttgaaggcaatagatggagactggactgtattctcaagaggaaggcacagcagggcgttagaatcttcattatgctctataaagaagttgagttggctctgggcatcaattccgaatacacgaaacggacccttatgcgtctccacccgaatatcaaagtcatgaggcaccctgaccatgtgtctagcaccgtatatctgtgggcccaccacgaaaagctggtaattatagatcagagtgtggcctttgtcggcggaatcgacctcgcctacggcaggtgggacgacaacgagcatcgtttgacagacgttggatcagtaaagcgtgtcacaagcggaccatcactgggcagtctccctcctgccgcaatggaatccatggaaagtctgagactgaaggacaagaacgagcctgtgcaaaatttgcctatacagaagtcaattgacgacgtcgattcaaagctgaaaggcatcgggaaacctcggaagttctccaagttttccctctacaaacaacttcaccgtcaccatctgcacgacgcggactctatctcctctatagattccactagcaacacgggcagcattcggagtctgcagaccggagtgggcgagctccacggagagaccagattctggcatgggaaggactactgtaacttcgtgttcaaggactgggtccagctggacaagccttttgccgattttatcgaccgctattcaacccctaggatgccatggcacgacatcgcaagtgcggtgcacgggaaagccgcacgagatgttgctagacatttcatacagcggtggaacttcactaaaattatgaagagcaaataccggtccctgtcatatccatttttactgcctaagtctcagaccacagcacacgagttgcgttaccaggttcccggatcggttcacgcaaacgtgcagttgctgcgatccgccgcagactggtcagcgggtattaagtaccacgaagaaagcattcatgccgcttacgtgcatgtgatcgagaattcgcgccactacatctatatcgaaaaccagttcttcatatcatgcgcagatgataaagtggtttttaataagatcggggatgccattgcgcagagaattttgaaggcccacagagagaatcagaagtatcgcgtctacgtggtgattcctctgctcccagggtttgagggtgacatatctaccggaggcggtaatgcacttcaggctatcatgcatttcaactaccgcaccatgtgtaggggggagaatagtatactagggcagcttaaggccgaactgggaaatcaatggattaactacatttctttttgtggtctcagaactcacgcagagttggaaggaaacctcgtgacagaattgatctacgtgcactccaaacttttgatcgcagacgataatactgtaataatcggatccgccaatatcaacgacaggagcatgctggggaaacgcgactctgagatggcagtgatcgtgcaggacaccgaaactgtcccctcagtgatggacgggaaagagtatcaggccggtagattcgcccgaggcctgcggcttcaatgcttcagagtggtcctggggtatttggacgatccatcagaggacattcaagacccagtgagcgataagtttttcaaggaggtctgggtgtccacggccgctcggaacgccaccatctacgacaaagtcttccggtgcctccccaacgatgaagtgcataatttaatccaattgcgcgacttcattaataaacccgttctggctaaagaagaccctatccgtgccgaggaggaattgaaaaagatccgtggttttcttgttcagttccctttctactttctgagcgaggagtccttactacccagcgtgggcaccaaggaagctattgtgccgatggaggtgtggacatag

SEQ ID NO: 30125 - DNA, 429 bp, Artificial Sequence
  Description of Artificial Sequence: Synthetic coding sequence
atgagcctgaagaacgagccaagagtcaatacgtctgccctgcaaaagatcgccgcagatatgtcaaacatcatcgagaatctcgatactcgggaactacactttgaaggcgaggaggtggattacgacgtgtccccatccgaccccaagatacaggaagtgtacatcccatttagtgctatttataacacacaaggattcaaagagccaaatattcagacctatctgtctggatgcccaataaaggcacaggtgctagaggtggagcggttcacctctacaactagggttccaagcatcaacctgtacaccattgaactcactcatggggagttcaaatggcaggtgaagcgaaagttcaaacactttcaagaattccacagagagcttctcaagtataaagcttttatccgtattcctattccatag

SEQ ID NO: 30126 - DNA, 2580 bp, Artificial Sequence
  Description of Artificial Sequence: Synthetic coding sequence
atgtacagtggagctgggccagccctcgctccgcctgcaccccctccgcctatacagggctacgcttttaaaccgccaccaagacctgattttggaacaagcggtcggacaattaaacttcaagccaatttctttgagatggatattcctaaaattgacatctaccactatgagctggatataaagcccgagaagtgtcctcgtagggtgaatagggagatcgtcgagcatatggtgcagcattttaagacacagattttcggagatagaaaaccagtcttcgatggacgcaagaatctctacaccgcaatgcctctacccatcgggagggacaaagttgagctggaagtgaccctcccgggagaaggcaaggacagaattttcaaggtttctattaaatgggtgtcctgtgtgagcctgcaggcattgcatgatgctttaagcggcaggttgccctccgtgccattcgagacgatccaggctttggatgttgtgatgcgacatctgcccagtatgcggtacacccccgtggggcgtagcttttttaccgcttcagaggggtgctcaaacccattaggaggcggacgggaggtctggttcggcttccaccagagcgtgcggcctagtctctggaaaatgatgcttaacatagatgtttcggctacagccttttacaaggcccaacctgtaattgaatttgtctgtgaggtgcttgatttcaagtctatcgaagaacaacagaaacctctgactgattcccagcgtgtgaaattcacgaaggagattaaaggtctgaaggtggaaatcacccattgtggacaaatgaagcggaagtacagggtctgcaacgtcactcgtaggccagccagtcaccagacctttccgttgcagcaggaatcaggccagaccgtggaatgcacggtggcccagtacttcaaggaccgccataaactcgtcctgcgttacccacatctgccttgccttcaggttggccaggaacagaagcatacttacctccctcttgaagtttgcaacattgtggcgggacagcgctgtatcaagaagctcacggataaccagacatccacaatgatcagagccaccgctcggtccgcccctgacaggcaggaagagatttccaaacttatgaggagtgcctcattcaacactgacccctacgtccgcgaatttggcataatggtgaaagacgagatgacagatgtgacaggccgtgtactccaacctcccagcatcctctatggcggaaggaataaggctatcgccacaccggtgcagggcgtgtgggacatgaggaataaacagtttcacactggtattgagattaaggtctgggcaattgcctgttttgcccctcaacgacagtgtactgaggttcatctcaaaagcttcacggagcagctccggaagatctctcgagacgctggcatgcctatacaagggcagccctgcttttgcaagtatgctcaaggggcagacagcgtcgagcccatgttccgccacctgaagaacacgtacgcaggtctgcagcttgtggtggtgatacttcctggcaagaccccggtctatgccgaggttaagagggtgggtgacacggtgctgggcatggctacccagtgtgtccagatgaagaatgtacagcgcaccaccccccagacgctgagtaacctctgtctgaagattaatgtcaaactagggggagtgaataacatcctcttgccgcagggacgtccacccgtctttcaacagccagtgatattcctgggcgcagacgtcacccacccacccgcaggagacggaaaaaaaccttcgatagctgcagtagtaggcagtatggatgcccaccccaacagatattgtgcaaccgttcgggtccagcagcacagacaggagattatacaagacctcgctgccatggtcagggaattgcttattcagttttacaaatctactagatttaaacctactcgcattattttctacagagatggggtaagcgaaggacagtttcagcaggtactgcaccacgagctcctagctattcgcgaagcctgcattaagctggaaaaagattaccagcccggaataacctttatcgtggtgcaaaaacgacaccacactaggctgttttgtacagataagaatgagagagtgggtaaaagcggcaacattcctgccggaacaacagtggatacaaaaattacacaccctaccgaatttgacttttacctgtgctctcatgcgggaatacagggaaccagtcggccttcccactatcacgtgctctgggacgacaatcgcttctcatcggacgagttgcagattctgacataccaactgtgtcacacttacgttcgttgtacaagatctgtaagtatccctgctcctgcctactacgcccatctcgtggcgtttagggctcgttaccacctggtcgataaagagcacgattctgcggagggttcacatactagcggtcagtctaatggtagagaccaccaggctcttgccaaagccgtgcaggtccatcaggacaccctgaggacaatgtattttgcttag

SEQ ID NO: 30127 - DNA, 1926 bp, Artificial Sequence
  Description of Artificial Sequence: Synthetic coding sequence
atgttgagtgggatcgaggccgcagccggagagtacgaggactccgaactgaggtgtagagttgctgtggaagagctgtctccaggtggccaaccaaggcgcagacaggcactgaggacggcagaactgtccctggggaggaacgaacggcgagaactaatgcttcgcttacaagcccctggacccgctgggaggccaagatgcttcccgctgagggccgcacgactatttacaagatttgcggaagccggaagatcgacactgcggctccctgctcatgacacccccggtgctggcgcagtgcagctgctgctgtctgattgccccccagatcgtctgcgcagattcctgagaactttgcgactgaaactggccgcagctcccggtcctggacctgcttccgctcgagctcaattgctcgggcctagaccccgtgactttgtcaccatctctccggtgcagccagaggagcgacggttgcgggctgccacaagggtgcccgacaccacgctggtgaagcgcccagtcgagccacaggcaggagctgaaccatcaaccgaggccccaagatggcccctccctgtaaaaagattgtctctcccatctaccaagccccaattatccgaggaacaggccgctgttctcagagcagtgctgaagggccaaagtatctttttcacgggaagtgcaggtactggcaagtcctatctcctcaagcgaatccttggatcattaccccctacaggtactgttgcgactgcctccacaggtgtcgccgcttgccatataggaggaactaccctgcacgcttttgcaggcattgggtccgggcaggctccactcgcccagtgtgtcgcgctggcccagcggcctggcgtgaggcaaggttggctgaactgtcagcgtctcgttatagatgagatcagtatggtggaggccgacctatttgataaactggaagcagtcgccagggcagttagacagcaaaataagcctttcgggggaatccaattgatcatatgcggcgacttcctgcagctgccacctgtgacaaaaggctcccagccccctaggttctgtttccagagcaaatcttggaagcggtgcgttcccgtcaccttagagctgacaaaagtgtggcgccaggccgatcagacatttatctctctgctgcaggcagtgcgccttggcagatgttctgacgaggtgacacggcagcttcaggcaacagcctcacataaagtaggtagagatggtatcgtcgcaacccggttgtgcacacaccaagatgacgtggcgctgacaaacgaacgcagactgcaggagctgcccggtaaagtgcaccggtttgaggctatggattccaacccagagttggcctctacccttgacgctcagtgtcctgtgtcacagcttttgcaattgaagctgggtgcccaagtgatgctggtcaaaaacctctcggtttcacgcggtctggtcaatggggcaagaggagttgtagtagggttcgaggcagaaggcagaggcttgccccaggtgagatttctgtgcggcgtcactgaggtgatccacgccgatcgatggacggttcaagcaacaggtggacagctcctgtcacggcaacaactgccgctgcagctcgcttgggccatgtccatccacaagtcccagggtatgaccctcgactgtgtcgaaatttctctgggccgagtattcgcatctggtcaggcctatgtggcactctctcgcgctcgctccctccagggcctgcgggtcctggatttcgacccaatggctgtgcggtgcgatcccagagtgcttcacttttatgctaccctgcggagagggagatcgttaagcctggaaagtcctgatgacgacgaggctgcatccgaccaagagaatatggaccccattctgtag

SEQ ID NO: 30128 - DNA, 2124 bp, Artificial Sequence
  Description of Artificial Sequence: Synthetic coding sequence
atgctgtccgggattgaagctgctgccggtgagtacgaagactccgagctgcgatgtcgggtggccgttgaggaattgtcccctggcggacaacctcgtcggcgacaggccctgaggacagccgaactgagtctaggccgtaatgagaggcgcgagttaatgctaaggctgcaggctcccggtcctgccggaaggcctaggtgtttccctctgagagctgcacggctgtttacccgattcgcagaggccggtagaagcaccctgagattgccagcgcatgatactcccggagcaggcgctgtgcagttgctgctaagtgattgtccaccagacaggctgcggagattcttacggacactgcgcctcaaattagcagctgcacctggacccggaccagctagtgccagagcccagctcctgggtccgaggccaagggacttcgtgacgatctctcccgtgcagccagaggaacgcaggctcagggcagcgactagagtccctgataccacgcttgtcaagaggcccgtagagccgcaggccggagctgagccaagtacagaagcacctcgatggcctctccctgtcaagaggttgtccctaccctctaccaaaccccagctgagtgaggaacaggccgctgtgctgagagccgtgcttaagggccagagcatctttttcaccggaagtgccggaactggcaagtcatatctcttaaaaagaatcctcggttccttaccccctacaggcaccgtcgctactgccagtacgggagtggccgcatgccatattggcggaacaacgttgcatgccttcgctgggatcgggtccggtcaggctccactggcccaatgcgtcgcactagcccaacgcccaggcgtccgccaagggtggctgaattgccagcggctcgtgatagacgaaatttcgatggttgaagctgatctgttcgataaactggaagctgttgcacgagctgtgagacagcaaaataaaccgttcggcggtatccagctgatcatctgcggtgacttcttacagttgccgccagttaccaagggcagtcagccccctcggttttgttttcagtccaaaagttggaaaaggtgcgtgcctgttacgcttgagttgactaaagtatggcggcaagctgaccagaccttcattagcctgctgcaggccgtaagacttggccgttgtagtgacgaggtgacacgccaacttcaggccacagcaagtcacaaggtgggtcgggatggaatcgtagctacccggttatgcactcaccaggacgatgttgccctcacgaacgaacgcagactgcaggagctcccgggaaaggtacacagattcgaggcgatggacagcaacccagagctagcttccacactggatgctcagtgcccagtctcacagctcctccagctcaagctgggcgcacaggtaatgctggttaagaatctctccgtgagtcgcggattggtgaacggcgctcggggagtagtcgtgggtttcgaggccgaggggaggggtttgccgcaggtcagattcctgtgtggagtgaccgaggtcattcacgctgacaggtggactgtccaagctaccggaggccaactcttgtccagacaacaactgcccctgcagctggcatgggctatgtcaatccacaaaagccagggaatgactttagactgtgtggagatctccttgggccgtgtcttcgcctctggacaggcctacgtggcgctttctagggcaagatctttgcagggcctccgggtgctggacttcgaccccatggccgtgcgctgtgacccacgagtccttcatttctacgctactctacgaagaggaagatccctctcgctggccgctgaagggaggggtaacgaggaccggtgcagcggttctagtattcgtgccttgggcggtgactggtgggggctgcggcttggggctgcttcaaagcagcgaaccgagttgagatgtgtgagtacagcccgtccatccttagcgcagcctagaacgaacacactgcagagcctgacaaaggaacacaagcttcagaatgtgcacccgtactttaaactcctgtttcagggaattaactcagtgtggggccattag

SEQ ID NO: 30129 - DNA, 1926 bp, Artificial Sequence
  Description of Artificial Sequence: Synthetic coding sequence
atgctcagcggcatcgaggcagcagccggagagtatgaggattctgaactgagatgtcgcgtggcagtagaagaactgtcgccagggggtcaacctcgtcgaagacaggccctgcgtacagcagagctgtccctcgggcgaaatgagagaagggagcttatgctccggctccaagccccaggccctgccggtcggccaagatgcttcccactgagggccgcacgactcttcacgagattcgcagaagctggccgatccacgctgaggctgccagcacacgacacgcccggtgccggagccgtgcagttgctgctctcggactgcccgccagataggcttcgtagattcctccgcactttacgcctaaaattggctgcagccccaggtcccggacccgcttccgctagggctcagcttttggggccacgccctcgcgactttgtcaccatttcccccgtgcagcctgaagagagacgactgagggcagctactcgcgtacccgacaccacactcgtcaaacgccctgttgaaccgcaggccggagccgaaccctccactgaggctccacgctggcccctgcccgttaaaaggctgtccctaccgtcgacaaagccccagctctcggaggagcaagcagccgtcctgcgagccgtcctaaaaggacagtctatcttcttcacggggtcagccggtacagggaaatcctatctgctgaaaaggattctgggcagccttcctcccacaggtaccgttgccacagcctcaacgggagtagccgcttgccacatcggaggcactaccctacacgcttttgcaggcataggcagcgggcaagccccactggctcagtgcgtcgccctggcccagcgacctggggttcggcagggatggttaaattgtcagcggctggtcattgacgaaatctccatggtggaagcagacctattcgacaagttagaggccgtggcccgtgccgtccgccagcaaaacaaaccttttggaggcatccagttgataatttgcggagactttttacagctccccccagtcacaaagggatcccagccgcctaggttctgcttccagtcaaaaagttggaagcggtgtgtgccagtgacgctcgagcttaccaaggtctggcgccaggcagatcaaaccttcatcagcttgttgcaggcggtgcgcctgggccgttgcagcgacgaagtcacacggcagcttcaggccaccgcatctcacaaagttggccgagatggtatagtggcaacccggctttgcacacaccaggacgatgtggcccttacaaatgaacgcagactgcaggaattgcccggtaaggtacataggttcgaggcaatggatagcaatccggagttggcatctaccttggatgctcagtgcccagtgagccaactgttgcagctcaagctgggagctcaggtgatgctggttaagaatctgagcgtgtccaggggtttagtaaacggggctcgcggagtggtcgtgggctttgaggccgaaggaagaggcttgccccaggttcgatttctatgcggcgtcacagaagtcatccacgccgatcgatggacggtgcaggctaccggcggacagctcctgagtaggcagcagctgcccttgcagctggcttgggcaatgagcatacataagtctcagggaatgacacttgactgtgtagagatttccttgggtcgcgtatttgcaagcggacaggcctatgtcgctctatcccgcgctagatcgctacagggcctgagggtactcgatttcgaccccatggccgttcgctgtgatcctagagtactgcatttctatgcgacgctgcgacgcggtcgaagcctttctcttgagtctcccgatgacgacgaggccgcaagcgaccaagagaacatggatcccatcttatag

SEQ ID NO: 30130 - DNA, 801 bp, Artificial Sequence
  Description of Artificial Sequence: Synthetic coding sequence
atgctgtccggaattgaggctgctgctggggaatatgaagattccgagctaaggtgtagggtggccgtagaggagctgagccctggcggacaaccacggaggcggcaggctctgcgcaccgcggagctctccctcgggaggaacgagcggagagaactcatgctcagactgcaggcgcctggcccagctggtcgccctagatgcttcccactgcgagccgcaagactgtttacaagatttgcggaggcaggcagatctaccctgaggctacctgcccacgataccccaggagcaggagcggttcagctgttgctgagcgactgcccccctgacagactacggagattcctgcgcaccttgaggctgaaattggcagccgcaccaggaccaggaccagccagtgcgagagcccaactgttgggtcccagaccaagggattttgtcacgatttcccccgtacagccagaagaacgcagactgcgggcagctacccgggtgccagacaccacactggtgaaacggcctgtagaaccccaggctggagcagagccatctacagaagcaccccgttggccccttcctgttaagcggttgagcctgcctagcacgaagcctcagctgagtgaggagcaggccgcagtgcttcgggctgtcctgaagggccagagcatcttttttactggcagcgccggttccgggggacgggaggaggtcggaggccagtggtggggagggattgaagagcaaggcgatctttctaacttcgccccagtacaggaacagggatcccacatatgttag

SEQ ID NO: 30131 - DNA, 987 bp, Artificial Sequence
  Description of Artificial Sequence: Synthetic coding sequence
atgtcgatgttggcggagaggcgcaggaagcagaagtgggcagtggacccccaaaataccgcctggtcaaacgacgactctaagtttggacagcgaatgctagagaagatgggttggtcgaaggggaagggcctgggggcacaagaacagggtgccacagaccatatcaaagttcaggttaagaataatcacctgggtttgggcgctaccatcaataacgaagataactggatcgcccatcaagacgactttaatcagctgcttgcggagctcaatacgtgccatggccaggaaaccaccgattcctcagacaaaaaggagaaaaagtccttttccctggaggagaagtccaagatctctaaaaatcgcgttcactacatgaaatttacaaaaggtaaggatttgtccagtcgctccaagacggatctggattgtatctttgggaagaggcagtccaagaagacgcctgaaggggacgcgagcccttccacccctgaggagaacgagaccaccacaacaagcgccttcaccattcaggagtacttcgctaagcggatggctgctttgaagaacaaacctcaagtccccgtgcctggctctgacatatctgaaacacaggtagagagaaagcggggtaagaaaagaaacaaggaggcaaccggaaaagacgtggagagttaccttcagccaaaagcgaagagacataccgaagggaaacctgaacgtgccgaggcccaggaaagagttgcgaaaaaaaaatcagcaccagcggaggagcagttgcggggtccatgttgggaccagtccagtaaggcaagtgcacaggacgccggtgatcacgtgcagccccctgagggtagagatttcacgctgaagcccaaaaaaaggagagggaagaaaaagttgcagaagccagtagaaatagccgaggatgcaactctggaggagacactggtgaaaaaaaagaagaagaaagacagtaaatag

SEQ ID NO: 30132 - DNA, 519 bp, Artificial Sequence
  Description of Artificial Sequence: Synthetic coding sequence
atgctcgccgagaggagaagaaagcagaaatgggctgtggatccacagaataccgcgtggagcaacgacgatagcaagtttggccaacgtatgttggaaaaaatgggctggtctaagggtaagggattaggtgcgcaggaacagggcgcaaccgaccatataaaggtccaagtgaaaaacaaccaccttggacttggcgctaccataaacaacgaggataattggattgcacaccaggatgatttcaaccaactgctagccgaattgaatacatgtcacggacaggaaacgactgactcatcagataaaaaggagaagaagtcattctctttggaggagaagtctaagatatctaaaaatcgggttcattatatgaaattcacaaaaggtcggtgtcagtccctgcattcgcggggagagaggaaccacgacaaccagcgcctgcaccatcccggagtgctttgccaggcggacggctccaccgaagagcaggctccagggtcctcctcccgggtctag

SEQ ID NO: 30133 - DNA, 525 bp, Artificial Sequence
  Description of Artificial Sequence: Synthetic coding sequence
atgtcgatgcttgctgagaggagacgtaagcagaagtgggctgtggacccacaaaataccgcttggtccaatgacgattccaaatttgggcaacggatgctggagaagatgggctggtctaaaggtaaagggctcggtgcccaagaacagggcgcaaccgaccatatcaaggtgcaggttaaaaacaaccacttaggcctaggggctacaattaataacgaggataattggattgcccatcaggacgactttaatcagctcttagcagaacttaatacgtgccacggtcaggagacaactgatagctccgacaaaaaagagaagaaaagctttagcctcgaggagaaatctaaaatctcaaagaatagagtacactacatgaaattcaccaagggtaggtgccagtctttgcactcccgcggtgagcgcaatcacgataaccagcgccttcatcatcccggtgtactctgtcaggctgatggatctactgaggagcaggccccaggctcttcctcgagggtctag

SEQ ID NO: 30134 - DNA, 972 bp, Artificial Sequence
  Description of Artificial Sequence: Synthetic coding sequence
atgccagtacatagtcgcggagacaagaaagagaccaatcaccatgatgagatggaggtggactacgctgagaatgagggttcctctagtgaagacgaggacacagaatcctcctctgtgtcagaggacggggattccagtgaaatggatgatgaggattgtgagcgtcgaagaatggagtgtctggatgagatgagtaatctggagaaacaattcacggacttgaaggaccagctgtataaagagaggctgtctcaagtcgacgccaagctccaggaagtcattgccggtaaggctccagaatatttggagcccctggctacattgcaggagaatatgcagatacggactaaggtggcagggatttacagagagctgtgtctggaatccgtgaagaacaaatacgagtgcgaaattcaagccagccggcagcattgtgagtccgagaagctcctgctatacgatacagtacaaagtgaattggaagaaaagatccgcaggctggaggaggatcggcattccatagatattaccagcgaactgtggaacgatgagctacagagcagaaagaagcgaaaagacccattctcccctgacaagaagaaacccgtcgtggtttccggcccatatatcgtttatatgctgcaagatctggatattttagaagactggaccacaatacgaaaagcaatggcgaccctcgggccacaccgcgtaaagaccgagcccccagtcaagttggagaagcatttacactctgctcgatccgaagaggggaggctgtactatgacggcgagtggtatatacggggacagacaatttgcatcgacaaaaaggacgaatgtccaacctccgctgttattaccactattaaccatgacgaagtgtggttcaagcgcccagacggctcaaaatccaagctctacattagtcaactgcagaagggtaagtattccattaaacattcgtag

SEQ ID NO: 30135 - DNA, 666 bp, Artificial Sequence
  Description of Artificial Sequence: Synthetic coding sequence
atgcccgtgatgcgactgttcccgtgcttcttgcagctgctagcaggcctcgcgctccctgcggtgcccccacagcagtgggccctgtcggccggaaatggctcctctgaagtggaggtcgttccattccaggaagtgtgggggagatcttattgccgcgctctagagcgtctcgtggatgttgtatccgaatacccaagcgaggttgagcacatgttcagcccatcctgtgtgagcttactgaggtgcacagggtgttgtggcgacgagaacctccactgcgtccccgttgaaaccgcaaacgttaccatgcaactgctgaaaattagatcaggcgaccgccctagttacgtggaactgacgttcagtcagcacgtcagatgcgagtgcagacatagcccagggagacagtccccagatatgcctggcgattttcgagctgatgccccttccttcctcccccctcgtcgctccttgcctatgctgtttcgtatggagtggggatgtgccctcactggcagtcaatctgcagtttggcccagttcacccgtgccagaagaaatccctcgcatgcaccccggtagaaacggcaaaaaacagcagcggaagccactgcgggagaaaatgaaaccagaacgatgcggagatgcagtcccaagaagatag

SEQ ID NO: 30136 - DNA, 450 bp, Artificial Sequence
  Description of Artificial Sequence: Synthetic coding sequence
atgccagtcatgagactgtttccctgctttctccagctgttggctggactcgccttgcctgccgttcccccacagcagtgggctctctctgccggaaatggttcgtccgaggtcgaagtggttccctttcaggaagtgtgggggagaagctactgtagagctctcgaaaggctggtggacgtggtctcagagtaccccagcgaagtcgagcacatgttttcccccagctgtgtgtccctcctcagatgtacaggatgttgcggggacgaaaacctgcattgtgtgccagtggaaaccgccaatgtgacgatgcagttgctgaaaattagaagtggcgaccgaccaagctatgttgaactgacttttagccagcatgtcagatgtgagtgtcggccattgagggagaaaatgaagcccgaaagatgtggcgacgctgttccaagaagatag

SEQ ID NO: 30137 - DNA, 513 bp, Artificial Sequence
  Description of Artificial Sequence: Synthetic coding sequence
atgccagtgatgcgtttgttcccttgcttcctgcagctgctcgccggacttgctttgccagccgtgcctcctcagcagtgggcgctgtctgccggtaacggatcctctgaggtagaggtggttccatttcaagaggtgtgggggcgttcctactgtcgggcattagaacgacttgttgatgtggtgtcagagtaccccagcgaggtggaacacatgttctcaccaagctgtgtcagccttctgcgctgcaccgggtgttgtggggatgagaatctgcactgtgtgcccgtcgagactgcgaatgtcacaatgcagctactcaaaatcagatccggggataggccgtcctacgttgagcttacattcagccaacacgttagatgcgaatgccggccattaagagagaagatgaagcccgaacggaggcgcccaaagggacggggtaagagacggagagaaaagcagcgcccaactgattgccatctgtgtggagacgcagtacctcggagatag

SEQ ID NO: 30138 - DNA, 477 bp, Artificial Sequence
  Description of Artificial Sequence: Synthetic coding sequence
atggctctggaagtactgatgctcctggccgtcctgatctggaccggagccgagaatttacatgtgaagatttcctgctctctggattggctgatggtctctgttatacccgtcgccgagtctaggaacctgtacatctttgccgacgagctccatctaggcatgggctgccctgccaaccggatacatacctacgtgtacgagttcatttatctagtgcgggattgcggtatccgaaccagggttgtctctgaggagaccctcctctttcagacagagctgtatttcaccccacgtaacattgatcacgatccccaggaaatacacctggagtgcagtacatctcgcaagtctgtctggctcacacccgtgagtactgaaaacgagattaagttggaccctagccctttcattgccgattttcagacaacggccgaggaactcggccttctttcttcctctcccaacttgttgtag

SEQ ID NO: 30139 - DNA, 1188 bp, Artificial Sequence
  Description of Artificial Sequence: Synthetic coding sequence
atgagagctctgctggccagattgctcctctgcgttcttgtcgtctctgattctaaagggagtaatgagctgcatcaggtgccctataaatcaaagacctgctacgaaggtaatggtcacttttaccggggaaaggcgtctacagacaccatggggcgaccctgcttgccatggaactctgcgacagtgctgcagcagacatatcatgcccacagaagcgacgccctgcagctgggcttggggaaacacaattactgtagaaatcccgacaacaggaggcgtccgtggtgctacgtccaggttggattgaagcttctggtacaggagtgcatggttcacgattgcgccgatggcaagaaaccaagcagtcctcctgaggagctaaaatttcaatgtgggcaaaagacactaagacctagattcaagatcatcggcggagagttcaccacgatcgaaaaccagccatggttcgcggctatctaccgtaggcatcggggaggctcagtcacctacgtctgcggcggtagtcttatcagtccttgttgggtcatatctgccacacactgtttcatcgattaccctaagaaggaggattacattgtctacctcgggaggagcaggctcaacagcaacacacagggggagatgaaatttgaagtggaaaatctgatcctgcataaggactatagcgccgacacccttgcgcaccataacgatatcgccttgctcaagatacgaagtaaagagggacggtgtgcgcagccctcacgaactatccagacaatttgcctaccttcgatgtataacgaccctcagttcggcactagttgcgaaataaccgggtttggcaaggagaactcaacagactacttgtatcctgagcagctgaagatgaccgttgtcaagttgatcagtcatagagagtgccaacaacctcattactatggctccgaagttacaaccaaaatgctctgcgcagcggatccccagtggaagaccgactcttgtcaaggcgattcaggcggtccgctcgtctgtagtcttcagggaagaatgaccttaactggtattgttagttggggcagggggtgtgccctcaaggataaacccggagtctatactcgcgtgtcgcattttctcccctggatccgctcacatactaaggaagagaatggactcgccctttag

SEQ ID NO: 30140 - DNA, 1188 bp, Artificial Sequence
  Description of Artificial Sequence: Synthetic coding sequence
atgagagccctacttgctagacttctcctctgcgtgctggtagtgtctgatagcaagggctctaacgagctgcatcaggtaccttataagtctaaaacgtgttacgaaggcaacggacacttttacagaggaaaagcgtccaccgataccatgggccgaccttgcctgccgtggaacagcgcaacggtgttgcagcagacctaccacgcacaccgaagtgacgcactgcaactgggtctagggaaacataattattgtcgaaatccagacaacagaagacggccatggtgctacgttcaggtcggcttaaagctgctggtccaggaatgcatggtgcacgattgtgctgatggtaaaaaaccttcctctccgcctgaagaactgaaattccagtgcggccaaaaaacgttgaggccgagatttaaaattatcggaggtgagttcaccactattgagaatcaaccctggttcgccgcaatttaccgacgccaccgtggaggcagtgtaacatatgtgtgcggcggaagtctgatatccccctgctgggttatctcagcgacgcattgttttatcgattatccaaagaaggaggactacatcgtgtacctaggccgaagcagactaaattcgaatacccagggggagatgaagttcgaagtagagaatctcatcctgcacaaggattactctgctgatacgttggcgcatcataacgatatcgccctcctgaaaattaggagcaaggagggccgttgcgcccagccctcaaggaccatccagaccatctgtctcccgtcaatgtataatgacccccaattcgggacgtcttgtgaaattactggtttcggcaaggaaaatagcactgattatctgtaccccgagcagctgaaaatgacggttgtaaagctgataagccaccgcgaatgccaacaaccacactattacgggagcgaggtcaccacgaaaatgttgtgtgctgccgaccctcagtggaaaaccgattcctgtcagggcgactccggcggtcccctggtgtgtagcctgcagggtaggatgacattaacgggtatagtgtcatggggcaggggatgcgccttgaaggataagcctggtgtgtacactcgcgtatcccacttcttgccttggatccggagtcataccaaagaggagaacggactggcattgtag

SEQ ID NO: 30141 - DNA, 1296 bp, Artificial Sequence
  Description of Artificial Sequence: Synthetic coding sequence
atgcgggcactgctcgcaaggctactgctgtgtgtcctggtggtttccgatagcaagggtagcaacgaattacatcaagtgccctcaaattgcgattgtctcaacggtggcacttgtgtttctaataagtatttctcaaacatacattggtgtaactgcccaaagaagtttggagggcaacattgcgagatcgacaagagtaagacttgctacgagggcaatggacacttttatcgaggtaaagcgagtacagacaccatgggccgtccctgtcttccttggaactcagcaacggttctgcaacagacttaccacgcccataggtctgatgccctgcagttaggcttgggaaagcacaattattgtagaaatcccgataataggcggaggccatggtgctatgtgcaggtgggactgaagcttcttgttcaagagtgcatggtccacgactgtgccgatggaaagaagccgagttcccctcccgaggagctgaagttccaatgtggacagaaaacattacggccacgttttaaaatcatcgggggagaatttaccaccatcgaaaaccagccatggtttgcagctatttatagaaggcacaggggaggctcagtaacttatgtatgcggaggatctctcatctccccatgctgggtcatctctgccacccactgtttcatcgactatcccaagaaagaggattacatcgtgtacctgggcaggtctcgcctgaattcaaatactcaaggcgagatgaaattcgaagtagaaaatctcatactgcacaaagactacagcgctgatacactcgcacatcataacgacattgctctgctaaagatacgctccaaggaagggagatgcgcacaaccaagccgaacaatccagactatatgtctccccagtatgtataatgacccgcagttcggcacttcttgcgagattaccgggtttgggaaggaaaattccaccgactatctgtaccccgagcagctgaagatgaccgttgttaaactgatctcgcatcgggagtgccagcagccccattattatggaagtgaagtaaccacaaaaatgctgtgcgcagcagacccccagtggaagacggactcttgtcaaggcgattctgggggaccgttggtgtgtagtcttcagggcagaatgacactaaccggcattgtgtcatggggcagaggttgcgcactgaaggacaaacccggagtgtatacacgcgtatctcatttcctgccttggattaggtcccacaccaaggaggagaatggcctggccctttag

SEQ ID NO: 30142 - DNA, 1245 bp, Artificial Sequence
  Description of Artificial Sequence: Synthetic coding sequence
atggtttttcatttaagaactaggtacgaacaggcaaattgcgactgcctaaatggtggcacctgcgtctctaataaatatttttccaacatccactggtgtaactgtcccaaaaaatttggcggacagcactgcgagatcgacaagagcaagacctgttatgaaggcaacggtcatttctaccgaggaaaagcttctaccgacactatgggccgaccttgtttaccctggaacagcgcaactgtactgcagcagacctatcacgcacataggagtgatgcactgcagctcggcctgggaaagcacaactattgcagaaaccctgacaacaggaggagaccatggtgttatgtgcaggtcggactcaagcttttggtgcaggagtgtatggtacatgactgtgccgacgggaagaagccgagctcccctccagaggaactgaagttccagtgtggccagaaaacattgcgaccgagattcaagatcatcggcggagagttcaccacaatagagaatcaaccctggtttgcggctatctataggcgacataggggagggagcgtgacctacgtatgcggcggatccttgatcagcccttgctgggtaattagtgctacacactgttttattgattatcccaaaaaggaggactatatagtgtatctgggtcgaagccgactgaacagcaacacccagggggagatgaagtttgaggtggagaacttgatcttacataaggattacagcgctgatacgcttgcacaccataacgatattgctctgctgaagatccgaagtaaagaaggcagatgtgcccagccttcccggaccattcagaccatttgtcttccgagcatgtataacgatccccagtttggcaccagctgtgagatcacaggtttcggaaaggaaaatagcactgactacctgtatccagagcaacttaaaatgacagtggttaagttgatctctcaccgtgagtgtcagcagccgcattattacggatccgaggttacaaccaagatgctttgtgctgcagacccccagtggaaaactgacagctgtcagggcgactctggaggcccactcgtctgttcgctgcaaggcaggatgactctgacaggaatcgtgtcgtgggggagagggtgtgcgttgaaggacaaacccggtgtctacacgagagtcagccatttcctcccttggatccgatcccacaccaaggaagaaaacggactggcgttgtag

SEQ ID NO: 30143 - DNA, 3984 bp, Artificial Sequence
  Description of Artificial Sequence: Synthetic coding sequence
atggaagctccactgcagacaggaatggtgctgggagttatgatcggagccggagtagctgtggttgtgaccgccgtgctgatactgctcgtcgtgagacgactccgcgttcccaaaacccctgctccggatggtccacgttatcggtttcgtaaacgagacaaggtgcttttttatgggagaaaaatcatgagaaaggtctctcagtctactagctccctggtggatactagtgtgtcagcgactagcagacctcgtatgaggaagaaattgaagatgcttaatatcgccaaaaaaatactcaggatacaaaaggagactcccaccctgcagagaaaggagcctccccctgcagtgctggaggctgatcttactgaaggcgacctcgcaaatagtcaccttccttctgaggtgctctatatgctgaagaacgtccgggtcctgggacacttcgagaagcccctgttcctcgagttgtgtcggcacatggtgttccagcgcctcggccagggagattacgtgttccgccctgggcaaccagatgcatctatatacgtggttcaggacgggctgctggagctttgcctccctggtcctgatggcaaggagtgtgtggtaaaagaggtggtccctggggacagcgtaaattccctattatccatcctcgacgtgatcactggacaccaacatccccagagaacggtgagcgctcgcgcagccagagactccacagtcctgcgcctcccagtcgaggcttttagtgctgtgttcacaaagtacccagaatccctcgtgcgggtggtgcaaatcatcatggtacgactgcagcgagtgactttcctcgctttacacaactatctgggtcttacaaacgagctgtttagccacgagatccagccgctccggttattcccgtcccctggcctccctacccgcacaagccctgtgcgcggaagcaagcggatggtcagcaccagcgccaccgatgaacctcgagagacccccggacgaccaccagaccccactggcgcaccccttcccggtccaacaggagatcccgtgaaacctactagtctggaaacacccagtgctcctcttctatctcgctgcgtctctatgccgggtgacataagcggcctacaaggcggaccacggtccgacttcgatatggcttacgaaagggggaggatttctgtgtcactccaagaagaggcttcgggagggtccttagcagctccagcacgaactcctacccaagagcccagggaacagcctgccggtgcctgtgagtatagctactgtgaggatgagagcgccactgggggatgcccattcgggccttatcaggggaggcagacgagtagcattttcgaggctgcaaagcaagagttggccaagctgatgcggattgaggatccctcattattaaattccagagtgctgctgcatcacgctaaagcaggaacaattattgcgaggcagggggatcaggatgtcagccttcactttgtactgtggggttgcctccatgtgtatcaacgcatgattgacaaagccgaagatgtgtgcctgttcgtggcgcagccaggagagttggtcggacagttggcagttcttactggcgaacccctaatcttcactctgagagcgcaaagagattgcactttccttcgcataagcaaatcagacttttacgaaatcatgcgcgcacaaccatccgtggtgctgtcagcagctcatactgtggccgctcggatgagcccattcgtccgccaaatggacttcgctatcgattggaccgccgtagaagcaggtcgcgcattgtatcgccagggagaccgtagcgactgcacatacattgtcctcaacggaaggttacgttctgtgatccagcggggaagtggaaagaaagagcttgttggggaatatggaaggggggacttaattggggtggttgaggcccttacgagacagccaagggcaacgacggttcatgccgtgagggacaccgaattggccaaactgcctgaaggcaccctagggcatatcaagcggaggtatcctcaggtagtgacacgactcatccatctgctgagccagaagatactgggaaacttacagcagttgcagggcccattcccagccggatccgggctcggagtgccccctcacagtgagctcacaaatccagcctccaatctggccaccgtagctatactgcctgtctgtgccgaggtgcccatggtcgcttttacgttggagctgcagcatgccctgcaggctattggacccacactgctcctgaatagtgacataattcgtgccagactgggagcgtccgctctggacagcattcaagaatttcggctgagcggatggctggcccagcaagaggacgctcatcgcatagtgctgtatcagaccgacgcgtcattgacaccctggaccgtgagatgcctgagacaggcagactgcatcttgatcgtgggacttggcgatcaggagccaaccctgggccaactggagcaaatgctcgagaatacagccgttcgagctctaaaacaactggtactgttgcaccgagaagagggcgcaggcccaacccgcaccgtggagtggctgaatatgcgatcttggtgttcaggccatctccacttgcgctgtccccgaagactcttttctagacggtctcctgctaaactgcacgagctgtacgagaaagtgttcagccggagagctgataggcacagcgatttttctaggttggcacgcgtgcttaccggaaacacgatcgcactggtgctgggaggaggcggagctcgaggatgttctcatataggtgtactgaaagctctcgaggaagccggtgtcccggtcgatctggtgggtggaacatctataggcagtttcattggcgcattatacgcagaagaaagatcggcctcaaggacaaaacagagagccagggagtgggcaaaaagtatgacctccgtcctggaacccgtcctcgatctgacatatccggtgaccagcatgtttacaggttccgctttcaatcgctcaatacaccgcgtgttccaggacaagcagatcgaggacctgtggctcccctacttcaacgtgactaccgacattaccgcctcagcaatgcgggtacacaaggatggaagcctgtggcgatacgtgcgggcatcaatgacactgtccgggtatcttccgcctctatgtgaccccaaagatggacacctgctgatggatgggggttatataaataatctgccggctgacattgctcgatccatgggggcaaagacggttattgccatagatgtgggctcgcaagatgagaccgacttaagtacctatggcgatagcttgagtggctggtggctcctctggaaacgcctgaatccctgggcggacaaggtgaaggtccctgacatggccgaaattcagagtcgcctcgcatatgttagctgtgtccgccagctggaggtggtgaaaagttcttcctactgtgaatacctgcggccacccatcgattgcttcaagaccatggacttcggcaaatttgatcagatatatgatgtgggctatcagtacggaaaggctgtcttcggaggctggagtcgcggtaatgtgatcgagaaaatgttgacagaccgcaggtcgacagacttgaacgaatcacggagggctgacgtgcttgcctttccctcgtctggctttaccgacttggctgaaatcgtttcccgtatcgagcctcctacgagttacgtctcagacgggtgcgctgacggagaggagtcagattgtctgactgaatacgaagaagatgccggtcctgattgttcgcgcgatgagggaggcagtcctgagggggcatccccatccaccgcttcagagatggaagaagaaaagtccattctaaggcagaggagatgtctgccccaggagcccccagggtcagcaacggatgcgtag

SEQ ID NO: 30144 - DNA, 846 bp, Artificial Sequence
  Description of Artificial Sequence: Synthetic coding sequence
atgggccatccaccactattacccctgctgctgctccttcatacatgtgtacctgcttcctggggacttcggtgcatgcagtgtaaaacaaatggggactgcagagtggaggagtgcgccctgggtcaggatctgtgtaggactacaattgtcaggctgtgggaagagggcgaggaactggagctcgttgaaaaaagctgcacacacagcgaaaagactaatcgaactctgtcctatcggaccggtcttaagattacaagccttactgaagtggtctgcggtctcgatctgtgcaatcagggcaattccggccgtgccgtcacgtatagcagatccaggtacctcgagtgcattagctgcggtagctctgacatgagctgtgagagagggcgacaccagagcctgcagtgcaggtctccagaagaacagtgcttggacgtggtgacacactggattcaggaaggcgaagaggggcgacctaaagatgatcgtcatttgagaggttgcggctaccttccaggctgtcctggatcaaacggctttcacaataatgacaccttccattttctcaaatgttgtaacaccacaaaatgtaacgaggggcctattctagaactggagaacttaccacagaatggtcgacagtgttactcatgcaaaggtaactccacacacggatgttcctctgaagaaacttttttgatcgactgcaggggaccaatgaaccagtgtctcgtggccaccggaacccacgagaggtctctgtggggctcttggctgccctgtaagtctactacagcactgcgcccaccatgctgcgaggaggcccaggcgacccacgtctag

SEQ ID NO: 30145 - DNA, 1008 bp, Artificial Sequence
  Description of Artificial Sequence: Synthetic coding sequence
atgggccacccacccttgttgccgctgttactgttgctccacacgtgtgtgcccgcttcatgggggttgcgctgcatgcagtgtaagacgaacggcgactgtcgggtggaggagtgcgcactgggtcaggacctgtgtcgtacaactattgtaagactctgggaggaaggcgaagagctcgagctggtcgaaaagtcatgcacacattccgagaagacaaaccgtacactgtcatatagaaccggactgaagatcacaagcctaacagaggttgtctgcggtttggatttgtgcaaccagggcaatagcggcagagctgtgacttactcgcggagccgatacctcgaatgcatatcttgcggttcaagtgacatgagttgtgagaggggccgacatcagtcactgcaatgccggagccccgaggagcagtgcctggatgtggttacccattggatacaggagggcgaagagggtcggccaaaggacgatcggcacctgagggggtgtggttacctaccgggttgtccaggatccaatgggttccataataacgataccttccacttcctgaagtgctgcaacactactaaatgtaatgagggcccaatccttgaactggaaaacctaccccagaatgggcgtcagtgctattcttgtaagggcaactcaacgcatgggtgcagctctgaggagacctttctcattgactgccgcggacctatgaaccagtgtctggtggctactggaacacatgagccaaagaatcagtcatacatggttcggggttgtgctacagcttcaatgtgccagcatgcacaccttggggatgcgttcagcatgaaccatatcgacgtgtcttgttgcaccaagagcggatgcaaccaccctgatttggacgttcagtacaggtctggggcagccccacaaccaggcccagcccatctgagcttgacaatcactctgctgatgactgcaagactgtggggcggaacgctgctgtggacctag

SEQ ID NO: 30146 - DNA, 1038 bp, Artificial Sequence
  Description of Artificial Sequence: Synthetic coding sequence
atgtcactgtttggcctgctgttgctgacctccgcactagctgggcaaagacagggaacccaggccgaatccaacctaagctccaaattccagttttcaagcaacaaggagcaaaacggagtccaggatcctcagcatgagaggataatcaccgtcagcaccaatggctcaattcactcccccagatttcctcacacataccctagaaataccgtactagtgtggaggctggtggctgtagaagagaatgtgtggatacagctgacattcgatgaacgatttggccttgaggatcctgaggacgacatctgtaagtacgattttgtggaggtggaagaacccagtgacgggaccatacttggcagatggtgcggcagcggaactgtgccgggtaagcagatttcaaagggcaaccagatcagaattcggtttgtgagtgacgaatattttcccagtgaacccggattttgcatccactacaacatcgttatgccacagttcactgaggccgtctcaccctcggttctccccccaagtgctctgcctctggatctattaaacaatgcaattactgccttttcgacactggaggaccttatcaggtatttggagcccgaacgctggcagttggacctggaagatctttaccggccaacgtggcaactgcttggaaaggccttcgtgttcggcaggaaatcccgggtggtcgaccttaacctattgacggaagaggtccgcctgtattcctgcacccctcggaacttctctgtgagcatcagggaagaactgaaacggacagataccatcttctggcccggttgccttctcgtcaagcggtgtggagggaattgcgcttgttgtctccacaattgtaatgaatgtcagtgcgtgccttccaaggtgaccaaaaagtaccacgaggttctacagctgagaccgaaaaccggagtaagagggctccacaaatcactcaccgacgtcgctcttgaacatcacgaagaatgcgactgcgtatgccggggttctacgggagggtag

SEQ ID NO: 30147 - DNA, 549 bp, Artificial Sequence
  Description of Artificial Sequence: Synthetic coding sequence
atgccccagttcaccgaggcagtgtctcccagcgtcctccccccttcggccttgccactggacttgctaaacaatgcaattactgccttttcaacattagaagacctcatcaggtacttagagcccgagcgctggcagcttgatttggaagatttatatagaccgacgtggcagctccttgggaaagcctttgtgttcggccgtaagagtcgagtggtggacttgaacttgctgacagaggaagtgcgactgtatagctgcacccccagaaacttcagtgtcagcatcagagaagaactcaagcgcacagacactatcttctggcctggatgcttacttgtgaaacgttgtggcggaaattgtgcctgttgtttgcataactgcaatgaatgccagtgcgtcccctctaaggttaccaaaaaataccatgaggttcttcagttgagaccaaaaacgggggtaaggggactgcacaagtccctgacagacgtggcccttgaacatcatgaggagtgtgactgcgtctgccggggatccacagggggatag

SEQ ID NO: 30148 - DNA, 573 bp, Artificial Sequence
  Description of Artificial Sequence: Synthetic coding sequence
atgatgcaatatacttggctgctgacaaaacagttcacggaggccgtttcaccctccgtattgccgccatccgctctgccacttgatttgcttaacaacgctatcacagcgttttcaacacttgaggatctcatcagatacctggaaccagaacggtggcagctggatctggaggatttgtaccggccaacttggcaacttctcggcaaggccttcgtttttggaagaaaatcaagagtggttgatctcaatttgctaacggaggaagtacggctttactcatgcaccccccgaaacttctctgtgtcaatccgggaagaactgaagagaacggacaccattttttggcccggttgcctgctggtcaaacgatgcgggggtaactgtgcctgctgtctgcataactgcaacgagtgtcagtgcgtgccatcgaaggtgactaaaaaataccacgaggtgctgcaactgcggcctaaaactggtgtgcggggtttgcataagagcctcaccgacgttgccctcgagcaccacgaggagtgtgactgcgtgtgccggggttccactggcggttag

SEQ ID NO: 30149 - DNA, 504 bp, Artificial Sequence
  Description of Artificial Sequence: Synthetic coding sequence
atgagtcttttcggactgctactcctgacaagtgccctggcgggtcagagacagggcacacaggctgagtccaacctcagctcgaagttccagttttcctctaataaagaacagaacggcgtccaggacccgcagcatgagcggattattacagtttctacaaatggtagtatccactcccctagattcccgcatacgtatccacgaaacaccgtgctcgtttggagactggtggccgtggaagaaaacgtgtggattcagctgactttcgacgaacgattcggattggaagacccagaagatgatatttgcaagtacgactttgtcgaagtggaggagccatctgatggtacaatactcggaaggtggtgcggcagtggcaccgtgcccggtaaacagatctctaagggtaaccagattcgtatccggtttgtttcagatgagtattttccaagcgagccaagcaaccggggtggcaaaataatccaactccatacctcctag

SEQ ID NO: 30150 - DNA, 2217 bp, Artificial Sequence
  Description of Artificial Sequence: Synthetic coding sequence
atgcagcccaggtgggcccagggtgccaccatgtggttgggagtgttgctgactctgctgctgtgtagttctctagaaggacaggaaaactcattcaccatcaatagcgtcgatatgaaatcacttccagattggacggtgcagaatggtaagaatttgactctccagtgcttcgctgacgtaagtactacatcccacgtaaaacctcagcaccagatgctcttctacaaggacgatgtgcttttttacaacatctcatccatgaaatcaaccgagagttatttcatcccggaagttagaatctatgatagcggcacctacaagtgtaccgttattgttaataacaaggagaaaactaccgccgagtaccaggtactcgtggaaggcgtgccctccccgagagtgacactggacaagaaagaagctatacaaggaggcatcgtgagggtcaattgctccgtgccagaggaaaaagcaccgatacacttcaccatcgagaagcttgaactcaatgagaagatggtgaaactcaaaagggagaaaaactccagggatcagaactttgtgatcttggaattcccggtcgaggagcaggatagggtgctgtcatttcgatgccaagccagaatcatctctggaatacacatgcagacaagcgaatctactaaatctgagctggtgacagtgactgagtctttctcaacacccaagttccacattagccctaccggcatgatcatggaaggggctcagcttcacatcaagtgcacaatccaagtgactcatctggcgcaggagttccctgaaatcatcatacagaaagataaggctatagttgctcataaccggcatggtaacaaggccgtatactcagtaatggctatggttgaacattcgggcaattacacatgcaaggtggagtcttcacgaatctccaaagtgagttctatagtcgtgaacatcacagagctttttagcaaaccagagttagagtcttcgttcacacacctggaccaaggcgaaaggctaaatttgtcatgctctatccccggagctccgcctgctaactttacaatccagaaagaggacactatagttagccagactcaggacttcaccaaaattgcttctaagtccgattcggggacgtacatctgtactgccggtattgacaaggtcgtcaaaaaatctaacacagttcagatcgttgtgtgtgaaatgctctctcagccacgcatttcatacgacgcccagttcgaagtcataaaaggacaaactattgaagtaaggtgcgaatccattagcggcacactccccatctcttatcagctgctcaagactagtaaagtgctcgagaatagcacgaagaacagcaatgaccctgccgtattcaaggataaccccaccgaggacgtcgaataccaatgtgtggccgataattgtcattcccatgccaagatgctctctgaggtattgagggttaaggtaattgctccagtggatgaggtgcagatttccattttgtccagtaaagtggttgaatccggagaggatatcgtccttcagtgcgctgtgaacgaaggttctgggccaatcacatataaattctacagagaaaaagaagggaagccgttttaccagatgactagtaacgccacgcaagcattctggaccaaacaaaaggccagcaaggaacaagagggagagtattattgtaccgcgtttaatagagctaatcatgcatcttctgtgccgagatcaaagatacttactgtgcgtgttattttggcaccctggaagaagggattgattgccgtcgtgatcattggtgtaatcatagccttattgatcatagcagccaagtgctacttccttagaaaggcgaaagccaagcaaatgcccgtggagatgtcccgccctgccgtgcctctcttgaactccaataacgagaagatgagtgatccaaacatggaagctaatagccactacggccacaatgacgacgtgagaaaccacgcaatgaaacccataaacgacaacaaggaacctctgaactcggacgtccagtacacggaggtacaagtcagttccgccgaaagtcataaagaccttgggaagaaagataccgagacggtctatagtgaggtgcgaaaggccgtccctgatgctgtggagagccgatattcacgaacggaaggatccctggacgggacatag

SEQ ID NO: 30151 - DNA, 636 bp, Artificial Sequence
  Description of Artificial Sequence: Synthetic coding sequence
atgaggaccctcgcctgtctgttacttctcggctgcggatatctcgcccatgtacttgccgaggaagcggaaatcccacgagaagtcatcgaacgtcttgccaggtcccagatacactctatcagggatctccagaggttacttgaaatagacagtgtgggaagcgaagactctctggatacatctctcagagcacacggggtgcacgcgacaaagcacgtgccagaaaagcgtcccctgcctatccggcgtaagagatctatcgaggaagccgtcccggcagtctgtaagacccgcactgtgatttatgagattcccaggagccaagtggaccccacatctgccaacttcttgatctggccaccttgcgtcgaagtgaaacgctgcaccggttgctgcaacacttctagcgtgaagtgccagccctcacgcgtccatcaccggagcgtcaaagtcgctaaggtcgaatatgtgcggaagaagccaaaactcaaggaagtgcaagtaaggctcgaggagcatttggagtgtgcctgcgcaaccacttcactgaacccagattatagggaggaggacactggacgtccaagggagtccggaaaaaagagaaaacggaagaggctcaagcctacttag

SEQ ID NO: 30152 - DNA, 591 bp, Artificial Sequence
  Description of Artificial Sequence: Synthetic coding sequence
atgcgtactctggcatgtctgttattactgggctgcgggtacctggctcacgtgctggctgaagaggccgagattcctagagaggtaattgagcggctggctagaagccaaatacacagtattcgcgatctgcagaggcttcttgaaatcgactccgtgggctccgaggactcgctggacacctcacttagagcacatggtgtccacgctactaaacatgtgcctgagaaacggccacttcctatccggagaaagcgctcaatagaggaggccgtgccagccgtctgtaaaactaggacggtcatctatgagataccccgatctcaggtggaccccacgagtgccaactttcttatttggcctccttgcgtggaggtcaagcggtgtactgggtgctgtaatacatcatcagtcaagtgccagccgtccagagtccaccataggagcgtgaaggtggccaaggtcgaatacgtccgtaagaagcctaagctgaaagaagtccaggttcgacttgaggaacacctggagtgtgcctgtgcaactacttctctgaaccccgactatcgggaggaggacacagatgttagatag

SEQ ID NO: 30153 - DNA, 162 bp, Artificial Sequence
  Description of Artificial Sequence: Synthetic coding sequence
atgcggaccctcgcctgtctgctcctcctaggatgcggatacctggcacacgtgctggccgaggaagccgaaatcccgcgagaagtgatagaacgactagctagatctcagatccacagcattcgggacctacagcgactcctagaaatagactccgtctag

SEQ ID NO: 30154 - DNA, 3270 bp, Artificial Sequence
  Description of Artificial Sequence: Synthetic coding sequence
atggggacaagccatcctgcttttctggtccttgggtgcctcttgactggcctttcgctcatcctgtgccagctgagcctgccgagtattctgccaaatgagaacgagaaggtcgtacaactgaactcatctttttcgcttaggtgtttcggcgaaagcgaagtgtcttggcagtatcctatgagtgaagaagaatccagcgacgtagagatccgcaatgaagagaacaacagcggattgtttgtgaccgttctagaagtgtcatccgcaagcgccgctcatactggtttgtacacatgttactacaatcacacccaaacagaggagaacgaattggaagggaggcacatatatatttatgttcctgaccccgacgtcgccttcgtgccattgggcatgacagattatctggttatcgtggaggatgacgattccgccataatcccttgtcggactacagaccccgaaacacccgtgacactacacaactcggaaggcgtcgtgcccgcatcatatgactctcggcaagggttcaacggaaccttcacagttggtccctatatttgcgaagctactgtcaaaggaaagaagttccagacaattccttttaatgtttacgcattaaaggctacatctgagcttgacctcgaaatggaggcactaaaaactgtctacaagtccggggaaacaatcgtggttacttgcgcagtgttcaataatgaagttgtagacttgcagtggacctaccccggagaagtgaaaggcaagggtatcactatgctggaagagatcaaagtgccctctatcaagttggtgtacaccctcacggttccagaagcaactgtcaaagacagtggcgactacgagtgtgcggctcgccaggccactagagaggtgaaggaaatgaagaaggtgacaatcagcgtgcacgaaaagggatttatcgagattaagccaacgtttagtcagttagaggctgtcaacttacatgaagtgaaacattttgtcgtagaagtgagggcatatcctccaccacgcatcagttggctgaaaaacaatctgaccctcatcgagaacctcaccgaaatcactaccgatgttgaaaagatacaagagattcgctaccggtccaagctcaaactaattagggccaaagaagaggattctggacactatactatcgtggcccaaaatgaggatgccgtcaaatcctatacatttgagttactcactcaggtcccttcttccatcctggatctggtagacgaccatcatggaagtactggtgggcagacagtacgctgcacagctgagggtactcccctgccagacatagagtggatgatctgcaaggatattaagaagtgcaataatgagacatcttggaccatcctggccaacaacgtatcaaatattattaccgagatccacagcagagacaggtcaacggtggagggtagagtgacgtttgctaaagtagaggagacgatagcggtacgctgcttggctaagaacttacttggtgctgagaacagggagctgaaactggtagccccaacactacggagtgagcttaccgtggcagccgctgtgttagtgctgcttgtcatcgtcatcattagccttattgtgttggtcgtcatttggaagcagaaaccaagatatgagatccgttggagagttatcgagtccataagtccagatggacacgagtacatatatgtggaccccatgcaacttccttacgacagtagatgggagtttccaagagacgggttagtgctgggcagggtgttgggctccggcgcattcggcaaagtagtggaagggaccgcctatggactgagccgctcgcagcctgtcatgaaagtggctgtcaagatgctaaagcccacagccagatcgagcgaaaaacaggccctgatgtctgagctcaagattatgacgcacctggggcctcacctgaatatcgtgaacctgcttggcgcatgtacaaaaagtggccctatatacatcattacggaatactgcttttacggcgatcttgtcaattacttacataagaatagggactcattcctgagtcaccatcctgagaaacctaaaaaagaactggacatttttggtctgaaccccgctgatgagtccacaagatcttacgtcatcctttcatttgagaataatggggactatatggacatgaaacaggccgacaccactcaatacgtgccgatgctagagcgcaaggaggtttccaaatactcagacattcagcggtccctttacgaccgcccagcctcatacaaaaaaaagtctatgcttgattcggaagtcaagaatctcctcagtgatgacaacagtgaaggactgacactccttgacttgttgtcattcacctaccaagtggctcggggtatggagtttctcgcctctaaaaactgcgttcaccgcgatctggccgctaggaacgttctgctcgcacaaggcaaaattgttaagatctgtgattttgggttagcccgagatattatgcatgatagtaactacgtttcaaagggttctacgtttctcccagtgaagtggatggcgcctgaatctattttcgataacctctatacgactctgtcggatgtgtggtcctatggcattttactgtgggagatcttctccctcggaggtacgccttatcccggaatgatggtggactcaacgttttacaacaagatcaaaagcggttacaggatggcaaagcccgatcacgctacctctgaggtctatgagatcatggtcaaatgctggaactctgagcccgaaaaacgtccttcattctaccatctatccgaaattgtggagaatcttctcccgggacagtacaaaaagtcttatgaaaagatccatctggattttctgaaatctgaccacccggcagtggcacggatgcgcgtggacagcgacaatgcttacatcggtgtaacctacaagaacgaagaagataaactaaaggattgggagggcggtttggatgaacagaggctctctgcggactctggctacatcatccccctccctgacattgacccagtacccgaggaggaggatctgggaaagcgaaaccgccattctagtcagacgagcgaggagtctgcaattgaaaccgggtcctcctcctccacttttataaagagagaagatgaaactatcgaggacatcgatatgatggacgacatcgggatagatagctctgacctggtggaagatagtttcctgtag

SEQ ID NO: 30155 - DNA, 480 bp, Artificial Sequence
  Description of Artificial Sequence: Synthetic coding sequence
atggggacttctcaccctgcatttttagtgctcggctgcctgctcaccggcctttccctcatattgtgccagttgagtcttccttctattctcccgaacgagaacgaaaaggtcgtgcagttgaattcttccttttccttgagatgctttggagagtccgaggtgtcctggcagtaccctatgtcagaagaggagtctagtgacgtggaaatacggaacgaggaaaataactctggactgtttgtaaccgttctggaggtgtctagcgcatctgcagcacatacgggactttacacatgttactacaatcacacccagacagaagagaatgaactggaaggtagacacatctatatttacgtgcccgatccagacgtagcatttgttcctttgggcatgactgattaccttgtcatcgtggaggacgatgattcagccattataccttgtcggacaacagaccctgagacacctgtgtag

SEQ ID NO: 30156 - DNA, 477 bp, Artificial Sequence
  Description of Artificial Sequence: Synthetic coding sequence
atggggacatcacaccccgcattcctggtccttggatgcctgctaactggcctgtcacttatcttgtgccagctgtctttgccatctatcctgcccaacgaaaatgagaaggtggtgcaactgaattcgtcgtttagcctgaggtgtttcggcgaatcggaagtgagttggcagtacccaatgtccgaagaggaatcttctgacgtggagatcagaaacgaagaaaataactctggtctgttcgttaccgtgctggaggtgtctagcgcttctgcggctcacaccgggttgtacacctgctactacaaccacactcaaactgaggaaaacgagctggaggggagacatatttacatttatgtccccgacccagatgtcgcttttgtcccactcggaatgaccgactacctggtgattgttgaggatgatgattctgccattattccttgcagaacaactgatcctgagactccttag

SEQ ID NO: 30157 - DNA, 657 bp, Artificial Sequence
  Description of Artificial Sequence: Synthetic coding sequence
atggggacctctcatcctgccttcctggtgctcgggtgcctcctcaccggtcttagcctgattctctgccagctttctctgccctctattctcccgaatgagaatgaaaaagttgtacagctgaacagctcttttagtttacgctgcttcggggaatctgaagtgagttggcagtacccaatgagtgaggaagagtcctcagacgtagagattcggaatgaagaaaacaacagcggcctatttgtgactgtcctggaggtgagtagtgcatccgctgcccacaccggcttatacacatgttactataatcacacccagactgaagaaaacgaactggaaggcagacacatctatatctacgtgcccgatcctgacgttgctttcgtacccttaggtatgaccgattacctggtcatagttgaagacgacgactcagcgattatcccttgccgaactactgatccagaaacacctgtcacgctgcataattccgagggggttgtgccagcctcctatgattctcgccaggggttcaatggcacattcacagtggggccttacatctgtgaggctacagtgaaagggaagaagtttcagactatccctttcaacgtgtatgcactcaaaggcacgtgcatcatttcgtttctgctctag

SEQ ID NO: 30158 - DNA, 465 bp, Artificial Sequence
  Description of Artificial Sequence: Synthetic coding sequence
atgggcactagccatccagccttcctggtgctcggctgtctgctcaccgggctgtccctcattctgtgccagctatcccttccaagcatactgcccaacgagaatgaaaaagttgttcaactgaacagtagtttttccctgcgctgtttcggtgagagcgaagttagctggcagtaccccatgtcagaagaggagtcctccgacgtggaaatacgcaacgaggagaacaattcgggcctgttcgtgactgtccttgaggtgtcctccgcatcagcggctcacactgggctttacacatgctattataatcatactcaaactgaagaaaacgagctagaggggcgtcacatttacatctacgtgcccgacccagatgtggcgtttgtgcctctggggatgaccgattatctggttattgtagaggacgacgatagcgccatcattccctgcagaaccaccgactag

SEQ ID NO: 30159 - DNA, 3321 bp, Artificial Sequence
  Description of Artificial Sequence: Synthetic coding sequence
atgcggcttcctggcgcaatgcctgcactcgctttgaagggagagctattgctattatccttgctgctcctgctcgagccgcagatcagccagggattggttgttacacctcctggcccagagctggtgctcaatgtgagctctaccttcgtgttaacgtgttcaggctccgccccagtggtgtgggaacggatgagccaggaaccacctcaggaaatggccaaggctcaggacggaacgttttcctctgttctgaccctgaccaacttgactgggctcgacacaggagaatacttctgtacacataacgatagtcgagggctggagacggacgaaagaaaacgcctgtacattttcgtcccagaccccactgtaggatttttaccgaacgatgcagaagaattattcatttttctgaccgaaattacggaaattacgattccttgccgggttactgatccacaactcgttgtcacactgcacgaaaaaaaaggcgatgttgctttgcccgtgccctacgaccatcagagaggcttttcaggtatctttgaggatcgatcctacatttgtaaaacaaccattggtgatcgggaagttgactcggacgcgtactatgtgtaccgtctgcaagtctccagtattaatgtttccgtgaatgcagttcaaaccgtggtcagacaaggggaaaatatcaccttaatgtgcatcgtgattggcaatgaagtcgtcaacttcgagtggacctatcctcggaaggaatcaggtcgcctcgttgagcccgtgaccgactttctgctggacatgccctaccacatccgaagtatcctccacatccccagcgcagagctggaggactccggaacatacacgtgcaacgtcacagaatctgtgaacgatcatcaggacgaaaaagcaattaacattacagtggtggaaagtggctacgtcagattactgggagaagtcggcacactgcagttcgcagaactgcacaggagtcggacactccaggtagtgtttgaagcatatccacccccaactgtgctatggttcaaggacaaccgcaccctcggagactcatccgccggtgagatcgccctttcgacccgcaatgtgtctgaaacccgctacgtaagcgagttaaccctcgtccgagtgaaggtggcagaagcaggacattataccatgagggcattccatgaagatgctgaagttcagttatcatttcagctccaaattaatgtgcccgtgcgggtgcttgaactttccgaaagccacccagacagtggagaacagactgtgaggtgccgaggaagaggaatgccccagccgaacatcatatggagcgcctgccgtgatttaaaaagatgccctcgggagcttccgccaactctgctcggcaatagttctgaggaagagagccaattggaaaccaatgtgacatattgggaggaagagcaggagttcgaggtcgtgtccaccctgcgccttcagcacgtagatcgtcctctgtcagtgcgctgcaccctgcgtaacgcagtcgggcaggacacgcaggaagttattgttgtcccccactctctcccttttaaggtcgtcgtgatcagtgccatactcgccctggtggtactcacgatcatcagtttgataatcctgatcatgttatggcagaaaaagccaaggtacgagataaggtggaaagtgatcgagtcggtgtccagtgatgggcacgagtatatctatgtagacccgatgcagctgccatatgactctacatgggagctgccacgagaccagttggtgctgggcagaactctgggctctggtgctttcggccaggtagtcgaggccacggcacatggattgagccactcacaggcaaccatgaaggttgcggtcaaaatgttgaagtctacagctcgatccagcgagaaacaggcgctgatgtcagagctgaagattatgtcacacctcggccctcatctgaatgttgttaaccttctcggtgcctgcaccaagggaggacccatttatatcataacggagtactgcagatatggagatttggtggactatctacaccggaataagcatacctttctccagcatcactccgacaagagaagacctccttctgccgagctgtactccaatgcgctgccagtgggcctgcccttgcctagtcacgtgtcgctcacgggagaatccgacggtgggtacatggatatgagcaaagacgagtctgtcgattatgtgccaatgctggacatgaagggcgatgttaagtacgccgacatcgagtcttccaactatatggccccatatgataactacgtgcccagcgccccagaacgcacatgtcgggcaaccctgataaacgaatctcccgtgttgtcctatatggacctggtgggcttctcttatcaggtggctaatggaatggagtttcttgcctccaagaactgtgtccatagggaccttgcggctaggaacgtgttgatctgtgaggggaaactcgtgaagatctgtgactttgggctagctcgggacataatgcgggacagtaactatatatccaaaggttctacctttctgccacttaagtggatggccccagagtcgatctttaacagcctgtatactacactctccgatgtttggtcctttggtatccttctgtgggaaattttcactctgggagggacaccctatcctgagctacccatgaacgagcagttttataacgctataaaacggggttacaggatggcgcagccagctcatgcctctgatgagatctacgagattatgcagaagtgttgggaggagaaattcgagattcggcctccatttagccaactggtactgctcctcgaaagactgctgggggaaggatacaagaaaaagtaccaacaggtcgatgaggagtttctccgctctgaccacccagccattctgcgttcacaggcgcgtctccccggttttcatggtcttagatcgcctctagatacaagcagtgtactatacactgcggtgcaaccaaatgagggcgacaatgactacattatccccttgcctgatcccaagccagaagtggcggatgagggccctctggagggatctccgagcctggcaagtagcacactaaacgaggttaatacctcgagcaccattagctgtgacagcccactggagccccaagacgagcccgaaccggaaccccagctggagctgcaggtagaaccagagccggaattggaacagttacccgatagtggatgccccgcacctagagcagaggcagaagatagttttttgtag

SEQ ID NO: 30160 - DNA, 525 bp, Artificial Sequence
  Description of Artificial Sequence: Synthetic coding sequence
atgaggctacctggagccatgcccgctttagcattgaaaggtgagcttctgctgctgtccctgctgttgctgttggagccccagatcagtcagggcctggtggttacccccccaggcccagaactggtgctgaacgtaagttctaccttcgttctcacctgcagtggaagtgcccctgtggtgtgggaaaggatgtcacaggagcccccacaggaaatggctaaggcccaggacgggaccttttcaagcgtgctgacgttgactaatctcacaggcctcgatacaggagaatacttctgcacacacaatgactctaggggtctggagacagacgagcggaagaggttgtatatttttgtgcccgatccaactgtggggttcttgccaaacgacgctgaggagctgttcatatttttaaccgagattacagagattactattccgtgtagagtgacggacccacaattagtggttacactgcatgaaaagaagggagatgtcgcgctccccgtgccgtatgattag

SEQ ID NO: 30161 - DNA, 2331 bp, Artificial Sequence
  Description of Artificial Sequence: Synthetic coding sequence
gctgccagcgagccagatacggccggatctgtgcgcggtttacccacagctcattgtcctgtggtcgataatcggaccctaggtgacagcagtgccggagagattgctttgtccacacgtaacgtttcagagacacgctacgtgtccgagttaaccctcgtgcgcgtgaaagttgccgaggcaggccactacaccatgagagccttccacgaggatgcagaagtccagctcagcttccagctgcagatcaatgttcccgtgcgtgtcctggagctttctgaatcccaccccgactcgggggaacagacggtgcggtgccgcggtcgtggcatgcctcagcctaacatcatctggagcgcctgccgggatctgaaacgatgtcccagagagcttcccccaactctcttgggtaactccagtgaggaggaatctcagctggagactaacgtcacatactgggaggaagagcaggaattcgaggtggtgtccacacttcgccttcagcatgtcgaccgtccccttagtgtgcgatgtacattgagaaacgccgtcggccaggatacacaggaagtcatagtcgtgcctcactctctcccgtttaaggttgttgtgatcagcgccattctcgcgcttgtggtcttaactattataagcctgattatactgatcatgctgtggcagaagaagccacgctacgaaatacggtggaaagtgattgaatcagtgtcaagcgacgggcatgaatacatttacgtagacccaatgcagctgccctatgactccacatgggagctccccagagaccagctggtcctgggtagaaccctaggcagcggtgctttcggacaggttgttgaggctacagcgcacggcctgtctcacagccaagctaccatgaaggtagccgtaaagatgcttaaaagtacggctaggtctagcgagaaacaggccctcatgtccgagctcaagataatgtcacatttaggaccccatctgaacgtggtcaatctcttgggagcctgcactaagggaggcccaatctatattatcacagagtattgtaggtatggcgacttagtcgattacctgcatcgcaataagcacaccttcctccagcatcattcagacaaacgacgcccaccgagcgctgaactctactctaacgctttgcccgtcggcctccccctgcccagccatgtttcgctaaccggcgaaagcgatggtggctatatggatatgtctaaggacgagtccgtggactacgttcccatgctggatatgaagggggacgtaaagtacgctgatatcgagagttctaattacatggctccctacgacaactacgtgccgtcagctcctgaacgcacatgtagggccacgctgatcaacgagagtcccgtgcttagctacatggacttggtgggattctcctaccaagtagctaacggcatggagttcctggcctcaaaaaattgtgtgcacagggatcttgctgctcgcaatgtcctgatctgcgaagggaagctggtgaagatctgcgatttcggcttggcacgcgacattatgcgggacagcaattatatttcaaagggaagtacctttctgcctttaaagtggatggccccagaatctatattcaacagcttgtacaccaccctgtcggatgtgtggtcttttggcattctgctatgggagatcttcaccctgggcggaaccccctaccccgagctgcccatgaatgaacagttctataatgcaattaaacggggttatagaatggcccagccagctcacgcctctgacgaaatctatgaaatcatgcaaaagtgctgggaagagaaattcgaaatcaggccccctttctctcaacttgtgctgctactcgagagactcttaggagagggatacaaaaagaaataccaacaggtcgatgaggaattcttacggtccgaccacccagcaatactcaggtcgcaggctcgccttcctggattccatggacttaggagccctctcgatacttcttctgttctgtacacagcagtacagccaaatgaaggagacaacgattacattatccccctccctgaccctaagcccgaggtggctgacgaaggaccattggaagggtccccttctctggcctcttctaccctgaacgaggttaatacaagctctactatcagctgtgacagcccactcgaaccacaggacgagcctgaacccgagccccagttggaactacaggtggagccagagccggagctagagcagctgcctgacagcgggtgtccagcccctagagcagaggcagaagacagcttcctgtag

SEQ ID NO: 30162 - DNA, 891 bp, Artificial Sequence
  Description of Artificial Sequence: Synthetic coding sequence
atggggttatcacacagcaaaacccacctcagagtcataaaagtggctccactccagaataaggaggtcgaaactccttctgcaggacgcgtggattttgcatttaatcagaacctggaagagaagaccagctatagtttggccaggctgcaggatcagaacaaagcactggagggccagctgcctcccctgcaagagaactggtatggccgatattcaactgcatcacgcgatatgtacttcgatatccccctagagcaccgggagaccagcatcatcaaaaggcacccaccacaaagactgcagaagctggagccaatcgacttacctagggtgatcactagcggtaggttactcagccagagagaagctcggacaatgcacaaagcgaaacaagtcctcgaaaagaaaatgcagacccctatgtacacaagtgaaaatcgccagtacctgcataagatgcaagtcttggaaatgatcaggaagaggcaggaagctcagatggagttaaaaaaatcccttcacggtgaagcccgtattaataaacagtctcccagggaccacaaagccaagaaaacgcttcagagcacacctaggaatgacgatcacgacctgctgacaatgcttcccgacgagattctcaataggggcccaggcaactccaagaacaccgaattcctgaagcatcaggcagttaacaactactgtccatggaagatcgggaagatggagacctggttgcacgaacaggaagctcagggccagctcctctgggatagctccagttctgactctgacgagcaaggaaaagatgaaaaaaagcccagagctctggtacggacacggactgaacggatccctttgtttgacgagttctttgaccaggagtag

SEQ ID NO: 30163 - DNA, 1734 bp, Artificial Sequence
  Description of Artificial Sequence: Synthetic coding sequence
atgcctgagggggcacaggggctgtcacttagcaaaccttcacccagtctgggatgtggccgaagaggagaagtctgcgactgtggcaccgtatgtgaaacccggacggctcccgctgcgcctaccatggcatcaccccgagggtctggtagctccacaagcctgagtacagtaggcagtgagggggacccagcgcctggaccgaccccagcatgctctgccagccgccctgagcccctacccggaccccctattcgactgcatctgtcacccgttggcattcctggctcggcccgacccagcagattggaaagagttgcacgcgaaatcgtggagactgaacgcgcttatgtaagggatctgcgctctatcgtggaagattatctcggtcctctgctggacggcggagtgctgggcttgagtgtggaacaggtgggaactctgttcgcgaacattgaggacatctacgagttctccagcgaactcctcgaagatctggagaatagcagctcggcaggcggaattgccgagtgcttcgtgcagagatctgaggatttcgacatctacaccttgtactgcatgaattatccttcgtccctggctctgttgcgagagctgagtctaagtcccccagccgcactgtggttgcaggaacgccaggcccaactgcgccacagcctgcctctccaaagctttctgttgaaaccagtgcaacgaatcctgaagtaccatctgctgctgcaagaattaggcaagcactgggccgagggcccagggactgggggacgcgaaatggtggaggaggccatcgtgagtatgactgccgttgcttggtacataaacgatatgaaacggaaacaggagcatgcagcccgtctccaggaagtgcagaggcgcttaggtggctggaccggccctgagctctccgccttcggggagctggtgttggaaggagcctttcgcggtgggggagggggaggacccaggctgaggggcggagagaggttactgtttctcttttcacggatgcttttggtcgccaagcgaaggggactggaatacacctacaaagggcacatattctgttgtaacctgtccgtatcggagtcgcccagagaccctctgggctttaaggtatcagatctgactattcctaaacatcggcacttgctgcaggccaagaatcaggaagaaaaaagattgtggatccactgtctccagcggttgttcttcgaaaaccacccagcctcaatcccagctaaagcaaaacaggtcctgctggaaaacagtctgcactgtgccccaaaaagtaagccagtgctggagcccctcacacccccactgggttctccacgcccacgggacgcacgctcttttacccccggaaggagaaatacagcgccatctccaggcccatcggtgataaggcgcggaagaaggcaaagcgaaccagtgaaggacccttatgtgatgttcccgcaaaatgccaaacccggttttaagcacgcaggctctgagggcgagttatacccgcctgaaagccagccccctgtcagcggatccgcccctcctgaggatctcgaagacgcgggaccccctactctcgacccttcgggcacatcaatcacggaagaaatattagaacttctgaatcaaaggggcctacgggatcccggagaatctatgggcctgcaccgggcacagggcgctcctgatgcgccattccatatgtag

SEQ ID NO: 30164 - DNA, 4161 bp, Artificial Sequence
  Description of Artificial Sequence: Synthetic coding sequence
atgcctgagggtgcacagggcctcagtttatctaagccaagtcccagcttgggttgcggaaggcgtggcgaagtgtgcgattgtgggaccgtttgcgaaaccaggactgctcctgctgcccctacaatggctagccctagggggtctggctccagcacctccttgtctacagttggaagtgaaggggaccccgcacctggcccaactccagcctgcagtgcgtcaagaccggaaccactcccgggaccacccattcgacttcatctgtcgcccgtgggcatccccggaagcgcgagacccagtaggcttgagcgagttgcaagggaaatcgttgaaaccgaacgcgcatatgtgcgcgacctgcggtctatagtggaggactacttgggaccactgttagacggaggagtgctaggcctgagtgtggagcaggtgggcaccctctttgccaatatcgaggacatttatgagttcagcagtgagctgctggaggacttggagaatagctcctccgctggcggaatcgcagagtgtttcgttcaacgatcagaggattttgacatctatacactctactgtatgaattacccttcctccctggccctcttaagggagctgtcactgtctcccccagcagccctgtggctccaagagcggcaggctcagttacgacactcattgccactccagagtttcttacttaagcctgtacagcggattctcaagtatcacctgctgcttcaagagctgggaaaacattgggccgagggtcccggtacggggggtcgcgagatggtggaagaggctatcgtatctatgaccgccgttgcgtggtatatcaacgatatgaaaagaaagcaggagcacgccgctcggctccaggaggtgcagcgtagacttggaggttggacaggccctgaactctccgctttcggggaactcgttctcgaaggcgctttcagaggaggtggtgggggtgggccaaggctgcgcggtggggaacgactactgtttttattcagccgcatgctcctggtggccaagaggagaggccttgagtatacatacaaagggcacattttttgttgtaatctctcggtgtccgagagcccaagggacccgcttggttttaaggtgagcgatttaaccataccaaaacacaggcacctgttacaggccaaaaatcaggaggaaaagcggctttggatccattgcctccaacggttgttcttcgaaaatcatccggcaagcatccccgcaaaagccaagcaagtcctgctggagaactcactgcattgcgcaccaaagagcaagccagtgttggaacctctgacaccaccactggggagccctcggcctagagatgccaggtctttcacccccggacggagaaatacggccccaagccccggaccttctgtgattagacgcggaaggcggcagtctgagcccgtgaaggatccttacgtaatgttccctcagaacgcaaagcctggcttcaagcatgccggaagtgagggggagctgtatccacctgagagccagccccctgtatcgggttccgcccctccagaggatctggaagacgccggaccccctaccttggacccaagcggaaccagtattacagaggagatcctagaactgctgaatcaaaggggtctgcgcgaccctggtccttccacccacgatattcccaagttcccaggcgattcccaggtgcctggggacagcgagacattgacatttcaggcacttccctcacgcgatagctccgaggaggaggaggaggaggaggagggactggaaatggatgagaggggaccttctccactccacgtcctggaaggcctggaatcatcaattgccgcagagatgccatccattccttgcctgacaaagatccccgacgtgcctaatcttcctgaaattccctctagatgtgagatccctgaagggtcccgcctccccagcctgagcgacataagcgacgttttcgaaatgccgtgtctacctgcaatcccatcagtcccaaacacaccgtctttgtccagcacacctactctgtcatgtgatagctggctacaggggccattacaagaaccggcagaagcccctgcgacccgccgagagcttttttcagggagcaatcctgggaagcttggtgagccaccgtcggggggaaaggccggtcctgaggaggacgaggagggtgtctcttttacagattttcagccccaagacgtcacccaacaccaagggtttcccgacgagctggcgttcaggtcttgctcggagatccggtcagcctggcaggccctggagcagggccagttggcacgcccaggcttccccgagccactgctcatcctcgaggattctgatctgggcggtgacagcgggtccgggaaggcaggcgcacctagctcagaaaggactgccagccgtgtgagggagttggccaggctctattcagagcggatccaacagatgcaacgagctgaaaccagggcctccgctaacgcacccagaaggaggcccagagttctcgcgcaaccgcagccctccccttgccttccgcaggagcaggcagagcccggtctgctgcctgccttcggccatgtgctggtatgcgagctggcattccccctcacgtgcgctcaggagtctgtgcccctgggtcccgcagtttgggttcaagccgctatcccactgtccaaacagggcggatcacctgacggccagggtttgcacgtgtcaaacctgcccaaacaggatctgcccggaatccacgtgagcgccgcaactctgttgcctgagcaaggtggatctagacacgtgcaggccccagccgctacccccctacctaaacaagagggacccctgcatctgcaagtgcctgctttgacaaccttctctgatcaagggcacccagagatccaagtgccagctactacccccctgcctgagcaccgctcccacatggtgataccggctcccagcactgcattctgtccagaacagggccactgtgccgacatccacgttcctactacccccgctctgcctaaagaaatatgctccgactttaccgtctccgtcacaacacccgtgcccaagcaggaggggcacctggatagcgagtctccaacgaatatacccctgacaaagcagggtggttcccgagacgttcaagggccagacccagtgtgtagccaaccaatacagccgctgtcttggcacggcagctccctggaccctcaagggcctggagatacactgcctccgctaccctgccacctgccagacttgcagattccaggaacctccccgctgcccgcacacggctcccacttagaccacagaattcctgccaacgcccctctctccttatcccaggaactgccagatactcaggttcctgccaccacgcctctgccattaccccaggtgttgactgacatctgggttcaggcactccctacttccccaaaacaggggagcttgcccgacatacagggcccagcagccgcacctcctctgcctgagccctcactgactgacacccaggtgcaaaaactcacaccatctctggaacagaagtccctcatagatgctcacgtacctgccgctacccccctccccgagcgcggaggaagtttagatatccaggggctgtccccaactcctgtgcaaactacaatggttctttccaaaccgggaggctccctggcctcacatgtggccaggctcgagtcctctgatctgacaccccctcactccccacctccctcctctagacagctcctagggcctaacgcagctgcactgagcaggtatctggccgcatcatacatcagccaaagcctcgctcgacgccagggacccggtggcggagcacctgccgcatctagagggagttggtcgagtgcccctaccagtcgagcttcctcaccaccccctcaacctcaaccccctcctccgcctgcgaggcgcctgtcctacgcaacaactgtcaatatccatgtcggcggtggcggtaggctgcgccctgccaaggcacaagtcagactcaatcaccccgctctgctggcatccacccaggaaagtatgggcctgcacagagcacagggcgcaccagacgcgcctttccacatgtag

SEQ ID NO: 30165 - DNA, 1734 bp, Artificial Sequence
  Description of Artificial Sequence: Synthetic coding sequence
atgcccgagggtgcacagggcctgagcctgagcaaaccatctccgtcgcttggatgcggcaggagaggcgaggtttgcgattgtggaactgtctgcgaaacccgcaccgcccctgctgccccaacaatggctagcccaagagggtccggatcatcgacctctctaagcactgtggggtcagagggcgatcctgcccctggccctacaccagcctgttcagctagcaggcctgaaccactgcccggacctccgatccgtctccatctgtcacctgtggggattccaggctccgcaagacccagccggctggagcgcgtggctcgtgaaatcgtggagacggagcgcgcatacgtgcgcgacctgcgaagcatagtcgaagactaccttgggcctctcctcgatggcggagtgctgggcctcagcgtggaacaggtaggaactctctttgcaaatatcgaagacatctacgaattttcaagtgaacttttggaggaccttgagaatagcagttctgccggtggcatcgcagaatgctttgtacagcggtctgaagattttgatatctatactctgtactgtatgaactacccatcatcactggcccttctgcgggagctgagcctttccccacccgcagcactgtggctgcaagagcgccaggcacagttacgccatagtctcccacttcagtcctttttgcttaaaccagtgcaaagaattcttaagtaccacttgctcttacaggagttgggcaaacactgggccgagggaccgggtaccggcggtagagaaatggtcgaggaggccattgtatccatgactgccgttgcttggtatattaacgacatgaagcggaaacaggagcatgctgcgagactccaggaggtacagagaaggctaggaggatggaccggaccggagctttcagctttcggggagctggtgctggaaggcgcattccggggagggggagggggtggccctaggctgaggggtggcgagcgtctgctgtttctttttagtcgcatgcttctggtggccaagaggagggggcttgagtatacatataaaggacatatattctgttgtaacctctctgtgagtgaaagcccacgggaccccctcggctttaaggtgagtgacctaaccatacccaaacacaggcatctactgcaagccaaaaatcaggaggaaaaacgtctgtggatccattgtcttcagcggctgttctttgagaaccacccagcatctatcccagccaaagcgaaacaggtactcctcgagaatagtctacactgcgcacccaagtccaagcccgtgcttgagcccctcacacctcctctcggcagtcctagaccacgggacgcgaggtcgttcacccctggacggaggaacaccgccccatccccagggccttcagttatccgcaggggtagaagacagagtgaaccagtcaaagacccttatgtaatgtttccacagaacgcaaaacccggattcaaacatgctgggtctgagggagagctgtacccgccagaaagtcagcctcccgtatctgggtctgcccctcccgaggacctggaagacgccggaccgccaacactggacccatcaggtaccagcataactgaagaaatcctggagcttctgaaccaaagaggcctgagagatcccggtgaaagtatgggcttacaccgggctcagggagcccctgacgcgccatttcatatgtag

SEQ ID NO: 30166 - DNA, 4074 bp, Artificial Sequence
  Description of Artificial Sequence: Synthetic coding sequence
atgccggaaggggctcaggggctcagcctgtcgaagcccagccctagtctgggttgcggaaggagaggcgaagtctgtgactgcggtaccgtctgcgagacacgtactgcacccgcagcaccaacaatggcctcacccagaggttcagggtctagtacctctcttagtactgtcgggtctgagggagaccctgctcccggacccacccctgcatgctcggccagtcgacctgagccactgcctggcccacccatccgactgcacctgtctccagtgggcattcctgggagcgcaaggccctcacgcctggagagagtggcacgtgagattgtggagaccgagcgcgcatacgtcagggatttaagatctattgtggaagactatctgggtcccttgctggacgggggtgtgctcggccttagtgtggagcaggtcgggacgttattcgctaatatcgaggacatttacgagttctccagcgagctgctggaggatctggaaaactcaagcagcgccggaggaatcgcagagtgctttgtgcaacggtcagaggactttgacatctacaccttgtactgcatgaattaccccagttctctagccctgttgcgggaactcagcttatcaccccctgctgccctgtggcttcaggaaaggcaagcccagctgcgccattccttgccactccagtctttcctactgaagcccgtgcagaggattctgaagtatcatcttctcctgcaggaattgggtaaacattgggctgaaggaccgggtactggtgggcgtgaaatggttgaggaggctatcgtgtccatgacggcggtggcatggtacattaacgatatgaaaaggaaacaggagcatgccgctcggctgcaggaggtacagcgacgactgggcggatggaccggcccagagctgagtgcttttggagaactggttctcgaaggcgcttttcgaggcggaggtggtggcggtccacggctacgtgggggtgagcgactcctctttctcttctcccgaatgcttcttgtggctaagagaagaggtctcgagtatacgtataaaggtcatatcttctgctgtaatcttagcgtatccgaaagtccacgagatcccctggggttcaaggtgagcgacctaaccatcccgaagcatcgtcatctgctccaggccaaaaaccaggaggaaaaacgactgtggatccactgcttacagcgattgtttttcgaaaaccatcccgcttctatcccagcaaaagccaaacaggtattacttgaaaattcgttacactgcgctccgaagagcaaaccagtgttggaaccgctcacaccgcctctgggttctcccagacccagagacgcacgttcctttactcccggtaggcggaacacagcgaaacctggcttcaagcacgcaggctctgagggggaattatatcccccagaatcccagccacctgtgagtggcagcgcccctcctgaagacttggaggacgcgggacccccaaccctggatccttctggaacttctattaccgaagaaatattggagctgctgaatcagagagggctgagggaccctggccctagtacccatgatataccgaagttccctggcgacagccaggtacccggagatagcgagacgctgaccttccaggcgctcccaagcagggacagttcagaggaagaagaagaggaagaggagggcctggagatggatgagcggggacctagcccactacacgtcctggagggtcttgagtcctcaatagccgcagagatgccttctattccctgtctgacaaaaatccctgacgtgccaaacctgccggagatcccctcaaggtgcgaaattccagagggctcccggctcccctccctgtcggacatatccgacgtgttcgaaatgccgtgtctacccgctatcccttccgtccccaacactcccagcttgagttccacacccaccctgagctgtgacagctggcttcagggcccattacaagagcccgcagaggctcctgctactaggagagaactgttttctggcagcaatcctgggaagttgggcgaacccccttcgggtggtaaagctggtcctgaggaggatgaggaaggagtctctttcacagacttccaaccgcaggatgtaacccagcaccagggcttcccggatgaattggcttttcgctcctgttccgaaatccgcagtgcatggcaagcactcgaacaggggcagctcgctcgtccaggatttcccgaaccactcctgatactggaggacagcgacctcggcggagacagtgggtctggcaaagcgggagccccatcatcggaacgcacagctagtagagtgcgcgagctagcaagactatattccgagagaattcagcaaatgcagcgagctgagacccgagcctctgcaaacgcaccaagaagacggcctcgcgtcctagctcagccacagcccagtccctgcttgccacaggaacaagcagaaccaggacttctccctgccttcggccatgtgcttgtctgcgagctggcctttcctctgacctgcgcacaggaatccgtgcctctcgggccagctgtatgggtgcaggccgcaattcctctgagtaagcagggaggctctcctgatggccaaggattgcatgtgtctaacctccccaaacaggacctgccgggtatccacgtaagcgctgctacgttgctccccgaacaggggggttcccgccatgtccaggctccggcagccactcccctccctaagcaggagggccctcttcatctgcaggtccctgcactcacaaccttttccgaccaagggcaccccgaaatccaggtgcccgctacaaccccccttcccgagcaccgctctcatatggtcatcccagcacccagcaccgcattctgcccagaacaggggcattgtgccgacatccatgtcccgaccacaccagcgctgcccaaggaaatatgctccgattttacggtgagcgtgaccacaccagtcccgaaacaggaaggccacctcgactcggaatcccccacgaacatcccactgaccaagcagggcggatcccgagatgtacaaggcccagatcctgtgtgctctcaaccaatacagccattaagctggcacggcagttcactcgaccctcaaggccctggcgacaccctcccacctctgccctgccaccttcctgatttacaaatacccggaacttcacctctccccgctcatgggtcccacctggaccaccggataccagcgaacgctcccttatccctgtctcaggaattgcctgatacacaggtgcctgcaaccaccccactgcctctcccacaagtgctcaccgatatatgggtccaagcgctgccaacatcccctaagcagggtagtttaccggatatacaggggccagcggcagcaccacccttgccagagccaagcctgacggatacccaggtccaaaagctcaccccgtccttggaacagaaatctctgattgacgctcacgtgcctgccgctacacctctcccagaacgagggggtagcctggacatacagggtctgagccccacccccgttcagactacaatggtactgtctaagccgggaggcagtcttgcaagccacgtagcacgtcttgaatcaagtgatcttactcctccccactccccgcctcctagcagcagacagctactgggacctaacgccgcagccttgtcaagatacctggccgcttcatacatctctcagagcttggcgagaagacagggccctggcggtggggctcctgccgcaagtcgaggctcttggtcgtccgctcccacctctagggcttcaagccctccaccccaaccacagccacccccacccccagccagaagacttagttacgccaccactgttaatatacacgtcggaggcggaggccgtctccggccagcgaaggctcaggttaggctcaaccaccccgctctcttggctagtacccaggaaagtatgggccttcacagggcccagggcgctccggacgccccatttcatatgtag

SEQ ID NO: 30167 - DNA, 597 bp, Artificial Sequence
  Description of Artificial Sequence: Synthetic coding sequence
atgcctgagggagcccagggattgagtctgtccaagcctagtccgagtttgggctgcgggaggagaggggaggtgtgtgattgcggcacagtttgtgagacacggaccgcagcgccagccgcaccaactatggcctcaccaagaggctcaggatccagcaccagtctgagcacagtcgggtccgaaggagatcctgcaccaggccctactccggcttgtagcgcgagtcggccagagccactgcccggacccccaattcgtttacacctatcacctgtgggaatcccagggagcgcccgtccaagcagattagaaagggtggcacgcgaaatagtagagacagagcgggcatacgtgagagacctgagatccatcgtggaagactatctcggaccacttctggatggaggggttctcggtctatcagtggagcaagtgggcactctgttcgctaacattgaggatatctacgaatttagcagcgaattgctggaggatctggagaatagctcaagcgccggaggaatcgctgagtgctttgttcagcgctctgaagactttgacatatacaccctgtactgtatgaattacccttag

SEQ ID NO: 30168 - DNA, 3714 bp, Artificial Sequence
  Description of Artificial Sequence: Synthetic coding sequence
atgcccgaaggcgcacagggcctgtctttgtccaagccaagtccctccctgggatgtggaagacggggtgaagtctgcgactgcggtacagtttgcgagacaaggactggcagtgctagacccagcaggctggagagggttgcccgtgagatcgtggagaccgagcgagcctacgtgagggacttaagatctatcgtggaagactacctgggccctctgctggacggaggggtgctgggattatctgttgaacaagtcggtacactgtttgctaatatagaggatatatacgagttcagttcagagttgctggaggaccttgagaactctagctccgcagggggaatcgctgaatgtttcgtgcagcgatcagaggactttgatatctacacactgtactgcatgaactacccaagctcactggccttgctgagggaattgagtctgtcccctcccgctgccctttggttgcaggaacgccaggcgcagctaaggcatagcctgccccttcagtcttttttgctcaagccggtccagcggatcctgaagtaccatctcctgttgcaggagctagggaagcactgggctgaaggcccaggtacagggggaagggagatggtggaagaggcaattgtctcaatgacagcagtggcctggtatatcaacgacatgaagcgaaaacaggaacacgctgctcgcctgcaggaagtccagagacggttaggtggctggactgggcctgaactatcagcctttggggaactggtgctggaaggcgcttttaggggaggcggaggaggaggacctagacttcgaggcggtgagaggctgcttttcctattctctagaatgctgctagtggctaaacgccgagggctggaatatacctacaagggtcacattttttgctgcaatctgtctgtgtctgaaagtccaagggatccgctgggctttaaggtaagcgacctaaccataccaaaacatcggcatttactgcaagccaaaaatcaggaggagaagagactgtggatccactgcctgcaacgcctattcttcgaaaatcatccagccagcatccctgctaaggcaaagcaagtcttgttagaaaactccctgcactgcgcacctaaatccaaacccgtgcttgagccactgacacccccactgggctctccaagaccccgagacgcccgttcctttacacctggcaggcggaatacagccccaagccctggcccttcagtgattaggagaggcaggagacaaagcgagccagtgaaggatccctatgtcatgtttccgcaaaatgctaaacctggcttcaagcatgctggatccgaaggagaactgtatccccctgagtcccagccgccagtgtcaggctcagccccacccgaggacctagaggacgccggtccaccgaccctcgacccatccggcacttcaatcacggaggagatcctagaactccttaatcagagaggcctccgggaccctggcccaagcacgcacgacatacccaaattccccggagattctcaggtaccaggagatagtgaaaccttgacctttcaggccctgccgagtagggacagttcggaggaggaagaggaagaggaagaggggctggagatggatgaacgcggaccttcacctctccacgtactcgaaggcttagagtccagcatcgcagccgagatgccatctatcccctgcctgacaaaaattcccgacgtgcctaatctccctgagatccccagtcggtgcgagatccccgaaggaagccgactcccaagtctgtctgacatatcagatgtgtttgaaatgccctgcctgcctgccattccttccgttcctaatactccttctctatcgtcaactccaacactctcctgcgatagttggcttcagggaccactgcaggaacctgcagaggcccctgccacccgtcgcgaactgtttagtggtagcaatcccggtaagctgggagaacccccaagtgggggtaaagcagggccagaggaggatgaggaaggagtcagcttcaccgattttcagccacaggatgtgacccagcaccagggtttccccgacgagctcgcgttccgctcttgcagcgagatcagatctgcctggcaggcactggaacagggccaactcgcgaggcccggatttcccgaaccgctcctcatcctggaggattccgaccttggcggagactcaggaagtggcaaggctggtgcaccctcttccgaacgcaccgcctcaagggtgcgtgagttggcgaggctgtattccgaaagaatccagcaaatgcaacgggctgaaacacgcgctagcgcaaatgctccccgacggagacccagggtcttggcacagccccagccatcaccatgcttgccccaggagcaagctgagccaggactcttacctgcctttggccacgtgctggtctgcgagttggcattccctctgacttgtgcccaggagtcagtacccctcgggccagcagtatgggtgcaggccgctatccctctgagcaagcaaggcggatcacccgacggacagggccttcatgtgtctaacctaccgaagcaggacctacccggaatacacgtctcggccgcaacactgcttccagagcaaggagggtctagacatgtgcaggctcctgccgcaactccactacccaagcaggagggtcctttacacctgcaggttcccgcactgaccaccttttctgatcagggtcaccctgagattcaggttcctgccactacccctcttcccgagcatcgcagccacatggtgattcctgccccaagcactgccttttgccctgagcagggccactgtgctgatattcatgttccaaccacacccgcactgcccaaagaaatttgctctgatttcactgtctctgtgactacccccgttcccaagcaagagggtcacttggatagcgagtctccaaccaatatcccgcttactaagcaaggagggtctagagacgtgcagggcccagacccagtgtgctcccaacctatacagcctctgtcttggcatggttcatctctcgatccacagggtcccggagacactttgccccctctgccttgtcacctcccagacctgcagattcctggtactagcccgctgcctgcacatggaagccacttggatcatcgaatcccagccaatgctcctctctcactctctcaggagctgccagatacacaggtcccagccacaacaccccttcctctgcctcaagtgttgaccgacatttgggtccaggcactgcccacttctccaaaacagggaagccttcctgacatccagggcccagcagctgccccaccgcttccagaacctagcctgacagatacccaggtgcaaaagctgactccgtccctcgagcagaaatccctgattgatgcccatgtcccggcagccactcctctgccagagaggggtggctctctggatatccaagggttgagccctacgcctgttcagacgaccatggttctgtcaaaaccagggggttcactcgcatcccatgtggctcgtaatctatgggctttcacagggcctagaggcctgctaatgccaccttcaacttgtgagcctggccatgaggcgtctcttaagcaggggttccagcccgatgccatcgatccacagaacctgacttggaagagcaggcattag

SEQ ID NO: 30169 - DNA, 1128 bp, Artificial Sequence
  Description of Artificial Sequence: Synthetic coding sequence
atgatgaagaaaaataactctgcgaagcgtggccctcaagacgggaatcaacaacctgcgcctccagagaaggtgggttgggtgaggaagttctgtggcaaaggaatttttcgcgagatctggaaaaatcggtacgtagtactgaaaggagaccaactgtatatcagtgaaaaagaggtcaaggacgaaaagaatatccaagaggtttttgatctcagcgactatgaaaaatgtgaagagctgagaaaaagcaaatcaaggtccaagaaaaatcactcaaaatttacattagcacacagtaaacaacctggcaacaccgcaccaaatttgatatttctggccgtgtcccctgaggaaaaggaatcctggattaacgctctgaattccgccattacgcgagctaagaatcgtattttggatgaggcgtcgaccagcacctcggatggcatgcttacactggacctgatccaggaagaagatccaagccccgaggagcctacctcctgcgccgaatcctttagggttgatttagacaaaagcgtggctcagctggcgggttcgcggaggagggcggatagcgaccgcattcagccgtccgcggatagggcttcctctctttcaagaccctgggagaagaccgataagggagccacctacacaccacaggcgccaaaaaagcttacccccaccgaaaagggaaggtgcgcttccctggaagaaatattgagccagcgagatgccgcaagcgcacggaccctgcaactccgcgctgaagaaccgccaaccccagccctgcctaacccaggccagctgtcccgcatccaggacctggtggccaggaaactagaggaaactcaggagttattagccgaagtccagggcctgggagacgggaagagaaaggccaaagacccaccacgcagccctccagattcagagtccgaacaattgctcttggaaactgagcgccttctcggggaggcgtcatctaactggtcgcaggctaagagagtcctgcaggaggtccgcgagctgagagatctgtaccgccagatggatctgcagacccctgactctcacctgcggcaaacaacccctcattcccagtacaggaaaagtctcatgtag

SEQ ID NO: 30170 - DNA, 1230 bp, Artificial Sequence
  Description of Artificial Sequence: Synthetic coding sequence
atgatgaagaagaataacagtgccaagcgtggaccccaggacggaaaccagcagcctgcccctccagaaaaggttggctgggtgaggaagttttgcgggaagggcatttttcgggaaatatggaaaaatcgctacgtggttctgaagggcgatcaattgtatatctccgaaaaagaggtgaaggacgagaaaaatattcaggaggtctttgacttgagcgactatgaaaaatgtgaggagcttaggaaatccaaaagcaggtccaaaaaaaatcactcaaaattcacgttagcccatagcaagcagccgggaaacacagcacctaatctgatattcctggcggtgagccccgaggagaaggagtcttggatcaatgccctcaactcagctattacccgtgcaaaaaacaggattctggacgaagtgacagttgaggaggatagctatcttgcacatcccacgcgagaccgggcaaagatacagcactctaggcgaccacccaccagaggtcatctgatggctgtggcctctacatccacatcagacggaatgctgactcttgatctgatccaggaagaagatcccagtcccgaggagccgaccagctgtgcagagtcatttagggttgacttggacaagagtgtggcgcagctagcagggtcccgcagaagggccgactctgacaggatacagccatcagccgatcgggctagttccctgagtcggccatgggagaaaaccgataagggcgctacatacacgccacaggcacccaagaaactgacgcctaccgaaaaggggaggtgcgcatctctggaggagattctgagccagcgcgacgctgccagtgcccgtacactgcagttacgcgctgaagaacctcctacacccgctctgcctaaccccggacagctatcacggatccaggacctcgtcgcgaggaagcttgaggagactcaggagttgctagcggaggttcagggtcttggtgacggcaagcgcaaagccaaggatccccctcggagcccgcctgacagcgagtccgagcagcttctgctggagaccgagcggttattgggggaggcaagttcaaactggtcccaggctaagcgagtgctacaggaggtgcgcgagctacgcgatttgtacaggcagatggatctccagacacccgactcccacctgcgccaaactacaccacactcacagtacaggaagtctctcatgtag

SEQ ID NO: 30171 - DNA, 681 bp, Artificial Sequence
  Description of Artificial Sequence: Synthetic coding sequence
atgctgacactggacctcattcaggaagaagatccatcccctgaggagccaacaagctgtgcggaatccttcagggtcgatttggataagtctgtcgcacaacttgctgggagccgccgaagggctgatagcgaccggattcagcctagcgcagaccgcgcatcttcattaagtcgcccttgggaaaagactgataagggggcaacttacacccctcaggcacccaaaaaactgacccccacagaaaaaggacgctgtgcctccttagaagaaattttgtctcagagggatgctgctagcgctcgcaccttgcagctcagagccgaagaaccacctacgccagccctgccaaacccaggtcaactgtctcgcattcaggacctggtggccaggaaactggaagagacccaggaactgctcgcagaagtccagggattgggggacggcaagcgtaaggcgaaagatccgcctcggtcccccccagacagtgagagcgagcaattgctcctcgaaactgaaaggcttctgggggaagcatcatcaaactggagccaggctaaacgagtactgcaggaagttagggagctgcgagacctatacaggcaaatggacttacagacgccggattcacacttaagacaaactaccccccactcacaataccggaaatctcttatgtag

SEQ ID NO: 30172 - DNA, 675 bp, Artificial Sequence
  Description of Artificial Sequence: Synthetic coding sequence
atgccatcaactctcccttcccccgaacctcggaccgtttcctggatgtcaacgtctctgcaggtgacagtggaggaagacagctatctcgcccacccaacccgcgatagagcaaagatacagcacagccgacgtcccccaactcgcggacatctgatggccgtcgcctccacctccacgtctgatggtatgttgactctcgacctcattcaggaggaggatccttctccagaggaacccactagctgcgcggaatcctttcgggtcgacctcgataagagcgttgctcaactggctggctcccgacggagggcagactccgatcgcattcagcccagcgctgacagggcctctagcctgtcaagaccgtgggagaagactgacaagggtgccacatacacaccccaagcccctaagaagctcaccccgacggagaagggcaggtgcgcaagtctagaagaaatactgagccaacgcgatgccgcaagcgcacggaccctgcagctacgagctgaggagccccctacacccgctctaccgaacccagggcagctgagcagaatccaggatctggtggctcgtaagctggaagaaacccaggagctgctcgctgaggtgcagggactcggcgacggcaaaagaaaggcgaaggatcctccacgcagccctccatag

SEQ ID NO: 30173 - DNA, 384 bp, Artificial Sequence
  Description of Artificial Sequence: Synthetic coding sequence
atgactgcagcggcaacagccactgtcctgaaggagggcgtgttggagaagcggagcggaggcctgcttcagctctggaagaggaaacgatgcgtgctcaccgaaaggggtctccaactctttgaagccaagggcactgggggtcgcccaaaggaattgtcctttgcgcgaatcaaagcggttgaatgtgtggagagtacagggaggcacatttactttactctcgttaccgagggaggcggagaaatagacttcagatgcccgttagaagaccccggatggaacgcacagatcacccttggcctggtcaaattcaagaaccagcaggctatccagacggtacgcgctcggcagtctctgggcactgggaccctcgtcagctag

SEQ ID NO: 30174 - DNA, 384 bp, Artificial Sequence
  Description of Artificial Sequence: Synthetic coding sequence
atgacggcagctgccaccgccactgtgctgaaagagggagtcctcgagaagagatcaggtggcctgctccagctatggaaaaggaaacgttgcgttctcaccgaacgcggactccagttatttgaagcgaaaggcacaggcggacggccaaaggaactgtcattcgcccgaatcaaggcagttgagtgtgtggaaagtaccgggaggcatatatactttaccttagtcacagaaggcggaggggaaatagacttccggtgccctctcgaagaccctggctggaatgcgcaaataaccctcggccttgtcaaatttaaaaatcagcaagccatccagaccgtgagggcacgccagtccctgggaacaggcaccttggtcagttag

SEQ ID NO: 30175 - DNA, 1710 bp, Artificial Sequence
  Description of Artificial Sequence: Synthetic coding sequence
atgtctttcggcatccttaaaccagacttgcgtattgtgttcgttcacaacaaagcggtcatttggcagaagtcccgggtctcagatcataaaatggctctgatgtccgtcctgggcaccgcagtgatgaacaatatggagagcttccaatatcactctgaggagagtcagatctacctgagtggttttttgcctaaatgtgatgcggaccactcctttacgtctctgtctactcccgagagaagtttcatattcatcaattctagacctgtacaccagaaggatatactcaaactgatacgccatcactacaacctgaaatgcttaaaagaaagcacccgcctgtacccggtgttcttccttaagattgacgttcctaccgcagatgtggatgtgaacctcacgccagataagtctcaggttctgctgcagaacaaagaatcggtgctcatcgctctcgagaacttaatgaccacatgctacgggcctctgccctcaactaactcatatgaaaataacaaaaccgacgtaagcgcggcagatatagtgctgagtaaaaccgcggagaccgatgtgttgttcaataaagtggagtccagtggcaagaactactccaatgtggacacctcggtaatcccatttcagaatgacatgcataatgacgagtcagggaagaacacagatgactgtctcaaccatcagatatccatcggagacttcgggtatgggcattgcagtagcgagattagcaacattgacaaaaacaccaagaacgcctttcaagacatttccatgtctaacgtgagttgggaaaatagccagacagagtattctaagacttgtttcatttcttccgttaagcacacccagtctgagaatgggaacaaggaccacattgacgagtccggtgaaaacgaggaggaggctgggcttgagaattcatcagagataagtgcagatgaatggtcaagggggaacatcctcaaaaactctgttggcgagaacatcgaacccgtaaaaatcctcgtcccagagaagtcactgccttgcaaggtgagtaacaataattacccaattcccgagcagatgaacttaaatgaagacagttgcaacaaaaagtccaatgtgattgataataaatccggcaaagtcaccgcttatgatttgttgtccaatagggttattaagaagcccatgtctgcgtcagcactgttcgtgcaagatcataggcctcaatttctgattgagaaccctaagacttcactggaagatgccacactgcagatagaggagctgtggaagacgctcagtgaagaggaaaagctcaagtacgaagaaaaggccacaaaggatctcgagcgttataattctcagatgaagcgcgctatcgagcaggaaagtcaaatgagccttaaagatggtaggaaaaagatcaaaccaacttcagcgtggaacttagcacaaaaacacaagctgaagacttctctttctaaccagcctaagttggacgagctgcttcagagtcagatcgagaaaaggcgttcccagaacatcaagatggtgcagatacctttcagcatgaagaacttgaaaattaacttcaaaaagcagaacaaagttgatttggaggaaaaggacgagccctgtctcatccacaacctcagatttccagatgcttggctgatgacttccaagaccgagagcttctag

SEQ ID NO: 30176 - DNA, 2271 bp, Artificial Sequence
  Description of Artificial Sequence: Synthetic coding sequence
atgtcctttgggatactcaagcctgatctgcggatcgtatttgtccacaataaagccgtgatatggcaaaaatcaagggtgagtgaccataagatggccctcatgtctgttcttggcaccgccgtgatgaataatatggagtcctttcaatatcacagcgaggagagccagatttacctctcgggcttcctgcccaaatgcgatgccgaccacagttttactagcctgagtacacctgagcgctccttcattttcatcaattcccgcccagtgcaccaaaaagacatattgaagttgattaggcatcattataacctcaaatgtctgaaggagtccactaggctctatcccgtgtttttcctcaaaattgacgtgcctacagccgacgttgatgttaacctcacgcctgacaagtctcaggtgctgctacaaaacaaagagtctgttctcattgccctggaaaatcttatgacaacctgctacggccctctgcccagcacaaacagttacgaaaataataaaacggatgtgagtgccgctgatatcgtgctctcaaagactgcggaaacggacgtgctctttaataaagtggagtcttccggcaaaaactattcaaacgtggataccagtgttatcccattccagaatgatatgcataacgacgagagcggcaagaacacggatgactgcctgaaccaccagataagcattggggatttcggctatggccattgctccagcgagatcagtaatatcgataaaaatactaaaaatgcttttcaggacatctcgatgagcaatgtgtcatgggaaaatagccagacggagtactcaaagacatgctttatctcctccgttaaacacacacagtctgagaatgggaataaagaccacatcgacgagagcggggagaacgaggaagaggcgggattggaaaattccagtgaaatttccgccgatgaatggagcagaggaaacatactcaagaacagcgtaggagaaaatatagagccggtgaagattctggtgcctgagaagtccctgccctgcaaggtttctaacaacaactaccccatccccgagcaaatgaatctgaacgaagatagttgtaataagaagtctaacgtgattgataacaagtctggaaaagtcacggcctatgacctgctttccaacagagtgattaaaaaaccaatgtctgctagtgcgttgtttgttcaggatcaccgtcctcagtttctgattgagaatcccaaaacctctctggaagatgccactctgcagattgaggagctatggaagaccctaagcgaggaggagaagctcaagtatgaggagaaagctacgaaagatctggagagatataatagccagatgaagagggccattgagcaggagtcacagatgtccttaaaggatggccgaaagaaaatcaagcctaccagcgcctggaacctggcccagaaacacaagctgaaaacttcacttagcaaccagcccaaactcgacgagctgctccaatctcagatcgaaaaacgacggtcccagaatattaagatggtccaaataccttttagcatgaagaatctaaagatcaacttcaagaaacagaataaagtggatttggaggagaaagatgagccttgccttatccacaatctccggttcccagacgcctggttgatgacatccaagaccgaagttatgctgctgaatccgtaccgcgttgaggaggcgctgctcttcaagcgcctgcttgagaaccacaagttgccggctgaacctctggaaaaaccaatcatgctgaccgaatcacttttcaatggctcccactacttagacgtcctgtataagatgaccgccgatgaccaaaggtatagcgggtcaacttatcttagcgatccgcgattgacggctaatgggtttaagataaagctgatccccggagtgagtatcaccgagaattatctggagattgaagggatggcgaattgcttacctttttatggagttgccgacctgaaggagatcctgaacgcaatcctgaacaggaatgctaaggaggtgtacgagtgcagacccaggaaagttatatcctatcttgaaggagaggctgtgaggctgagtcggcagctgcccatgtacttgtctaaagaggatatccaggacattatttataggatgaaacaccagtttggcaatgagatcaaagaatgcgtccacggcaggcccttctttcaccacctgacctacctgccagaaaccacctag

SEQ ID NO: 30177 - DNA, 222 bp, Artificial Sequence
  Description of Artificial Sequence: Synthetic coding sequence
atgaaacagctgcccgcagcaaccgtgagactgctttcgagcagccagattataacatccgtggtaagcgtggtgaaggagttgatcgagaacagcctcgacgcaggtgccacaagcgtagatgtgaaacttgagaactacgggttcgacaagatcgaggtgagggacaatggggaaggcatcaaggccgttgacgcccctgtcatggctatgaagtactag

SEQ ID NO: 30178 - DNA, 585 bp, Artificial Sequence
  Description of Artificial Sequence: Synthetic coding sequence
atgaagcagctgcctgcagcaactgtacgcttattaagctctagccaaatcatcaccagcgtggtctctgtcgtcaaggagctgatcgaaaactctcttgacgctggagctaccagtgtggatgtgaagctcgagaattacggtttcgataaaatagaggtgagagataatggtgaagggattaaagctgtggatgcccctgtaatggccatgaagtattatactagcaagatcaacagccacgaggatttagagaatctaacgacgtatggattccggggtgaggctctgggcagcatctgctgtattgccgaagtactgatcaccacaagaactgcagctgacaatttctctacccagtacgtcctagacgggtcaggccacatcctcagccagaaaccttctcacctgggacaggggacgactgtgaccgcactgcggctgtttaaaaacttaccagtccgcaagcagttctattccacagccaaaaagtgtaaggacgaaattaaaaaaatccaagatctgctcatgagcttcggcattctgaaacccgacctgcggattgtgttcgtacacaacaagtag

SEQ ID NO: 30179 - DNA, 2271 bp, Artificial Sequence
  Description of Artificial Sequence: Synthetic coding sequence
atgagttttggaatcctcaagcccgatcttcggatcgtcttcgtgcacaacaaggcagtgatctggcagaaaagtagagtgtccgatcacaagatggcactcatgagcgtgctgggaacagcagtgatgaataatatggaatctttccagtaccacagtgaggagagccagatatacttgtcaggttttctcccgaagtgcgacgcggatcattcatttacgtctctgtctaccccagaaaggtccttcattttcatcaacagccgcccagtgcaccagaaggatatcctgaagctgatcagacatcactacaatctaaagtgcctgaaagaatcaactcggctctatcccgttttcttcctgaaaatagacgtccccacggccgacgtggatgtgaaccttacccccgataagagccaggttttgctccagaataaagaaagtgttctgatagcacttgaaaatctgatgacgacctgctacggtccattaccatccacaaattcgtacgagaacaacaagactgatgtctcagccgctgatatcgtattgagcaaaaccgccgagacagatgtgctgtttaacaaggtcgagtcgtccgggaagaactactccaatgtggatacgtctgtcattcccttccaaaatgatatgcataacgatgagagcggcaagaacacggatgactgcctgaaccaccaaatctccataggcgatttcggctatggtcattgtagttctgaaatcagcaacatagacaagaacactaaaaacgccttccaggacatttccatgtctaacgtctcttgggagaatagccagacagaatacagcaaaacgtgcttcatcagctctgtcaaacatacccagagtgagaatggcaacaaagaccatattgacgagtctggagagaacgaggaggaagccggactggaaaacagtagcgagatctccgccgatgagtggagcagggggaatatcctgaaaaattccgttggcgaaaacatcgagcctgtgaaaatcctggttcctgaaaagagtttgccgtgcaaggtctctaacaacaattatccaattcctgagcagatgaatctcaacgaggactcttgcaacaagaagtctaacgtgattgataacaaaagtggaaaggttaccgcttacgatctgctgtcaaatcgcgtgatcaaaaaacccatgagcgcatcagccctgttcgtccaagatcataggcctcagtttctgatcgagaatcccaaaaccagtctcgaggacgccaccctgcaaatcgaggagctgtggaagaccctgagcgaagaggagaagctgaaatacgaagaaaaggcaactaaagatctcgagagatataatagtcagatgaagagggcaatcgagcaggagagccagatgtctctgaaggacgggaggaagaagatcaaacctacaagcgcatggaacttggcccagaagcacaagctgaagacctcactttctaaccagcctaagctggatgagctgctgcagtcacagattgaaaagagacggagtcagaatatcaaaatggtgcagatccccttctctatgaagaacctgaagatcaatttcaaaaagcagaacaaggtggacttggaagaaaaggacgagccttgtctgattcacaacttgcgattcccagatgcttggcttatgacatcgaaaactgaagtgatgctccttaatccttaccgggtggaggaagcacttctttttaagcggctgctggagaaccacaaactccccgcagaaccgctggaaaagccaattatgctgaccgaatcactgttcaatggatcccactacctggatgtgctgtacaagatgaccgccgacgaccagcgctattccggctcaacttatctgagcgaccctcgccttaccgccaatggtttcaaaataaagcttattcctggcgtgtcaataaccgaaaattatctcgaaatcgaaggcatggcgaattgcttgcccttctacggcgttgccgaccttaaggaaatcctgaacgcaatcctcaaccggaatgctaaggaggtgtatgaatgtcgccctaggaaggtgatcagctaccttgaaggagaggctgttaggctcagtcggcagctccctatgtacctgagtaaggaggacatccaggacatcatatatagaatgaaacatcagttcggaaacgaaatcaaggaatgcgtgcacggtagaccctttttccatcatctgacctatctgcctgaaactacctag

SEQ ID NO: 30180 - DNA, 2799 bp, Artificial Sequence
  Description of Artificial Sequence: Synthetic coding sequence
atgaagcagctgccagccgctactgttagattgttaagtagtagccagataattacatcagtcgtttccgtggtgaaggagctgatcgagaactccttggatgcaggagccacatccgtggacgttaagctggaaaactacggcttcgacaaaattgaggtcagagacaatggcgaaggaatcaaggctgtggatgcccctgtgatggctatgaaatattacacctccaagatcaatagccacgaggacctcgaaaacctcactacatatggctttcggggagaggctctgggcagtatttgctgtatcgctgaggtattgattaccacaaggacagccgctgacaatttctccacgcagtacgtattagacggctctggccacatcctgtcacagaagcctagccacctgggccaggggacaacagttaccgcactgcgcctgtttaaaaatctgccggttcgcaagcagttctacagtacagctaagaagtgcaaggacgagattaagaaaatccaagacctcttgatgagtttcgggatactcaaacccgacttgaggatcgtttttgtccataataaggcagtgatatggcaaaagagccgggtgagcgaccataaaatggctcttatgagtgtgttgggaactgccgtgatgaataacatggagagtttccaatatcactccgaagagagtcagatctatctgagcggattcttgccgaagtgcgatgctgaccattcattcacatctctatcgactcctgaacgttctttcatatttataaacagccgaccggtgcaccagaaggatatccttaagctgatcagacaccattataacctcaagtgcctgaaagagagtaccaggctgtatcctgtcttttttctgaaaatcgacgtccctaccgcagatgttgacgtgaatcttacacccgacaaaagtcaggtgttactacagaataaagagtcagttctgattgcactcgagaaccttatgaccacatgttacggacccctgccaagcactaacagctacgagaataataaaactgatgtgagcgccgctgacatagtgctgtcgaaaacggccgaaacggatgttctctttaataaggtggaaagtagcggcaagaattacagcaacgtggacaccagtgtgattccctttcagaatgacatgcacaacgacgaaagcggcaagaacaccgacgattgtctcaaccaccagatcagcatcggggattttgggtatgggcattgctcctcagagattagtaacatcgataaaaatacaaaaaacgcatttcaggatatctccatgagtaatgtaagttgggagaactcccagactgagtattctaaaacttgttttatatcatcagtaaagcacacgcagtccgagaacggtaataaggaccacatcgatgagtctggtgagaacgaagaagaggctggattagagaacagttctgaaatctcagcggacgagtggagcaggggtaacatactgaaaaattccgtaggcgaaaatatcgaaccagttaaaatcctggtgcctgagaaaagtctgccctgtaaagtcagcaataacaactacccaatccctgagcagatgaacctcaacgaggactcctgtaataagaaatccaacgtcattgataataagtccgggaaagtgacagcgtatgacctgctgtctaaccgcgttataaaaaagcctatgtctgcctccgcactatttgtgcaggatcatcggcctcagtttctgattgagaatcccaaaaccagtttggaggatgctacattgcagattgaggagctgtggaagacgctgagcgaggaggaaaaactgaaatacgaggagaaagcaaccaaggacttggagagatacaatagtcaaatgaagcgcgcaattgagcaggaaagccaaatgtccctgaaggatggtagaaaaaagattaagccgacatctgcttggaatttggcccagaaacataagttgaaaacctccttgagcaatcaacctaagctggacgaactccttcagtctcagatcgaaaaacgtaggtcccagaatatcaaaatggtccagatcccctttagtatgaagaatctgaaaatcaacttcaaaaaacagaataaagtcgatctagaggagaaggacgagccctgcctcattcataacctgcgctttcccgacgcatggcttatgaccagcaagaccgaagttatgctgctcaacccctatagggtggaggaggccctcctcttcaaacgactcctggagaaccacaaactgccagctgagcctttagagaagcccataatgctcacggaatctctgttcaatggcagccactatctcgatgttctttataaaatgacagccgatgatcagcggtacagcggtagcacctatctgtctgatcccaggctaactgcaaatggcttcaagataaagttaatccccggtgtgtccattacagagaactatctagagattgaggggatggccaactgtctgcccttctacggggtggccgacctgaaggaaatcctgaacgcaattctgaaccggaacgccaaagaagtttatgaatgccgaccaaggaaggttatttcttatctggagggcgaggccgttaggttatcccgccaactgcctatgtaccttagtaaggaggacattcaagacatcatctatcggatgaaacaccaatttggcaatgaaatcaaggagtgtgtccatggcagacctttttttcatcacctgacatatttgccagagacaacatag

SEQ ID NO: 30181 - DNA, 135 bp, Artificial Sequence
  Description of Artificial Sequence: Synthetic coding sequence
atgaagcagctgccagccgcaacggttcgcctactgtcatccagccagatcatcacatctgttgtgtccgtggtgaaggaactcatagaaaacagtcttgatgcaggggctacgagtgtggatgtgaaactgtag

SEQ ID NO: 30182 - DNA, 2313 bp, Artificial Sequence
  Description of Artificial Sequence: Synthetic coding sequence
atgaagcagctgcccgcagccaccgtgcgactcctgagctcaagtcagatcataacatcagtggtgagtgtcgtcaaggaactgattgagaacagtctcgatgccggagccacgagcgtggacgtcaaacttgaaaattacggatttgacaagattgaagtacgcgataacggagagggcatcaaagctgtcgatgcccctgtgatggccatgaagtactatacatccaaaatcaattctcacgaagacttggaaaaccttacaacatacggattccgaggcgaagcccttggatcgatctgctgtattgcggaggtgttgatcaccacccggacagcggcagataatttcagcacacagtacgtgttggacggctctggtcatattctttctcagaagccaagccacctcgggcagggtacaaccgtaaccgcccttaggttgtttaagaaccttccagtgcggaaacagttttattccacagccaagaagtgcaaagacgagataaagaaaatacaagacctgcttatgtcttttggcattctgaaaccagacctgcggatcgtctttgtgcacaataaagccgtgatttggcagaaatctcgcgtgagcgatcataaaatggcactgatgagcgttttaggaactgcggtgatgaacaatatggagagcttccaataccactctgaggagagtcagatttacttgagtggctttctgccaaagtgcgatgctgatcacagttttacatccctatctaccccagaacgttcgtttatcttcataaacagccgccctgtgcatcaaaaggacatccttaaattgattcgtcaccattataaccttaagtgtcttaaagagagcactcggctttacccagtcttttttctgaaaatcgacgtgccaacagctgacgtggacgtcaacctgacccccgataaatcacaggttttgttgcaaaacaaggaatctgttcttatcgcccttgagaatctgatgacaacctgttatgggcctctcccctctaccaacagctacgaaaacaacaaaactgatgtgtccgccgctgatatcgtcctgtctaaaaccgctgaaactgatgttctatttaacaaagtggagtcttccggcaaaaattacagcaacgtggacactagtgtcatcccgtttcagaacgacatgcataatgacgaatctggcaaaaacaccgacgattgtcttaaccatcagatttctatcggggactttgggtatggccactgttctagcgagatcagtaacatcgacaagaacacgaagaacgcattccaggatatcagcatgagcaacgtttcttgggagaacagtcagaccgaatacagcaagacatgtttcatcagctcagttaagcatacacagtccgaaaacggaaacaaggaccatatcgacgagtctggcgagaacgaggaggaagccggtttggagaattcttcagagatatctgcagacgagtggagtcgaggtaacattctcaagaattccgtgggagagaacattgaacctgtcaaaatactagtccctgagaaatcgcttccttgcaaagtgagcaacaacaattacccgattcctgagcagatgaacctaaacgaggacagttgtaacaagaaatccaacgttatagacaataagagcggaaaagtcacagcatacgacctcctgagtaaccgggtgataaagaagcctatgtctgcctccgcccttttcgtgcaggatcaccgccctcaatttttaatcgagaatcctaagacctctctggaggacgccacattacaaatcgaggagctttggaagactctgtcagaggaggagaagctgaacttattcaacgggtcgcactacttggatgtgctgtataaaatgacggcagacgaccaaaggtattccgggagtacatatttgagcgacccaaggctcaccgctaacggcttcaagattaagctgatcccaggtgtatccatcacagagaattacctggagattgaaggtatggccaactgcctgccattctacggggttgccgacttaaaggaaatccttaacgccatcttgaataggaatgctaaggaagtgtatgaatgccggccaagaaaggttatcagttatttggaaggggaagccgtaaggctgagccgccagctgcctatgtacctcagtaaagaggatattcaggacatcatttaccgaatgaaacaccagtttggaaacgagatcaaagagtgtgtccacggcagaccgttcttccaccacctcacgtacttacctgaaactacttag

SEQ ID NO: 30183 - DNA, 2682 bp, Artificial Sequence
  Description of Artificial Sequence: Synthetic coding sequence
atgaagcagttgcctgccgcaaccgtgcggctgctctcatctagccagataataacatctgtggtctccgttgtgaaagagctgatcgaaaactcactggacgctggcgctacctccgtcgacgtcaagctggagaactatggattcgacaagattgaggtaagagacaatggtgaggggatcaaggcagtcgacgctcccgtcatggctatgaagtactatacatcaaagataaactctcatgaggacctcgagaatcttacaacctacggatttagaggcgaggcactgggatccatctgttgtatcgcagaagtcttgatcacgacgagaacagcggcagataacttctccacacagtacgtgctggacggatccggccatattctgtcccagaagccatctcaccttgggcagggaactaccgtcactgccctcaggctgttcaaaaatctgccagttagaaaacagttctattcgacagctaagaagtgcaaggatgaaattaaaaaaattcaagacctgctgatgtccttcggaatattgaagcccgatctgaggattgtgttcgtacacaacaaaatatatctgagtggcttcctgcctaagtgcgatgccgatcatagcttcacatctctgtctactcccgagcgtagttttatttttattaactccaggcccgtacatcagaaagatatcctgaaactaattaggcaccattataacctgaagtgtctcaaggaatcaactcgactgtatcccgtgttcttcctgaagattgatgtccccactgcagatgtggatgttaatctgacacccgacaagagccaggtgctgctgcagaataaggagagcgtgttgatcgccctggagaacctgatgaccacctgttacggacccttaccatcaaccaacagttacgaaaacaacaagacagacgtcagtgccgctgatattgtgctgtcaaagacagccgaaacggatgtactgtttaacaaggtcgaaagcagcggtaaaaactactccaacgtggacacttcagtgataccattccagaatgacatgcacaatgatgagtccggcaagaataccgacgattgcctgaatcaccagataagcattggggactttggatatggccactgctccagcgaaatcagcaacatcgacaaaaatacaaagaatgcctttcaggatattagcatgtcaaacgtgtcgtgggaaaatagccagacagagtactccaagacatgttttataagctctgtgaagcacacccagtccgagaacgggaataaggatcacattgatgaatccggtgagaatgaagaagaggccggactggagaactcttcagagatctccgctgatgaatggtctagaggtaatatattgaagaactcagtcggggagaacatagagccagtaaaaatcctcgtgccagaaaagtcattaccttgcaaggtgtctaataataattatcctatacccgaacagatgaacctaaacgaagactcttgcaataagaagagtaatgtgatcgataacaagtctgggaaagtgaccgcctacgacctgctgtctaatcgcgtgataaagaaacccatgtctgcctcagctttattcgtccaggaccatcggcctcagttcttaattgaaaacccgaagaccagcctggaggacgccacgctccagatcgaggagctctggaagaccctctctgaagaggaaaaacttaagtacgaggagaaagccaccaaggacctggagagatacaactcccagatgaagcgggcaatcgagcaagaatcacaaatgagcctcaaggatggccgtaagaaaatcaagcctacgagtgcttggaatctcgcacagaaacataagctgaagacaagcttatctaatcagccaaaattggatgaattactgcagtcgcaaatagaaaagcggagaagtcagaacatcaagatggtgcagattcccttttctatgaagaatctgaaaattaatttcaagaagcagaacaaggttgacctcgaggaaaaggatgaaccctgcctgatccataacttgcgattcccagacgcttggttaatgacaagcaaaacagaggtgatgttgctgaatccctatagagtggaggaagctctcctttttaaacgccttctggagaaccataaactccctgccgaacctctggagaagcccattatgttgacagagtctctgtttaacgggtcccactatctggatgtgttgtacaagatgacagctgacgatcagcgctactcaggttccacctatctgtctgaccccaggctcaccgccaatggcttcaagatcaagctgatccctggcgtgtctatcaccgaaaactacttagagatcgaagggatggccaattgtctcccgttctacggcgtcgctgatctgaaagagattcttaacgccatattgaacagaaacgccaaagaggtgtacgagtgccggccacgcaaagtgatttcctatctagaaggggaggccgtgcggctcagcaggcaactgcccatgtacttatcaaaagaagatatccaagatatcatctacaggatgaagcaccagttcggaaacgagataaaggaatgtgtgcatggcaggccattctttcaccatttaacctatctgccagagactacctag

SEQ ID NO: 30184 - DNA, 2589 bp, Artificial Sequence
  Description of Artificial Sequence: Synthetic coding sequence
atggaaagggcggagtccagtagtacggaaccagccaaggccataaaacccatcgatagaaaatctgttcatcagatttgctcgggccaggtggtcttgtcactctctacagccgtcaaggagctggttgaaaacagtctggacgctggagcgaccaacatcgacctgaaacttaaggactacggggtggacctcattgaggtgagcgacaacggatgtggtgtcgaggaagaaaacttcgaggggctgacacttaaacaccataccagtaagattcaggagtttgcggacctcacacaggtggaaacatttgggttcaggggagaggccctctcttcactgtgtgcactttcagatgtaactatttcgacctgtcacgctagtgctaaagtggggacccggctcatgttcgatcacaacggcaaaattatacaaaaaacaccataccccagacctaggggaacgacagtgagcgtccaacaactgttctctaccctgccagtccgccataaagaatttcaaaggaacataaaaaaagaatacgcaaagatggtccaggtgcttcacgcctactgcatcatttccgccggtatcagagtgtcatgtaccaatcagctgggccaagggaagcgtcagccagtcgtgtgtacaggaggctctccaagcatcaaggagaacattggaagtgtcttcggacagaagcagctgcagtccctgattccatttgtgcagttacccccatcagatagtgtttgcgaagaatacggcctgagctgctccgatgccctgcacaatctcttctatatcagcgggttcatctcccagtgcacacacggagtggggaggtccagcacagaccgacaattttttttcattaatcgccgaccttgcgatcctgcaaaggtgtgccgattagtcaacgaggtctaccacatgtacaacagacaccagtatccctttgtggtcttgaatatttccgtagacagcgaatgcgtcgacattaacgtgacccctgataagcgccagatacttctgcaggaggagaagttgctgctcgcagtgctaaagacctctctcattggcatgttcgattcagacgtgaataagctgaacgtatcccagcagcctctgctcgacgtcgaggggaacttaatcaagatgcacgccgcagaccttgagaaacctatggtggagaagcaggaccaatcacctagcctgcgtaccggtgaagagaagaaagacgtgtccatatccaggctgcgcgaggccttttccttgcggcacacgacagaaaacaaaccacactcccctaagaccccagagccacgcaggtccccactgggccaaaaaagaggcatgcttagctctagtacgtctggtgccatcagtgacaagggcgttctcagaccacagaaagaggccgtcagttcatctcacggtcccagcgatcccactgatagagcagaggtcgagaaagacagcggtcatgggagtacctcggtggattcagaaggcttttccattccggatactggctcacactgttccagcgaatatgccgcttctagcccgggagacaggggatcccaggagcacgtagattctcaagaaaaggcacccaaaactgatgattcatttagcgacgttgactgtcattcaaatcaggaggacacaggatgtaagttcagggttctgcctcaaccgactaacctcgctacgcctaacaccaagcgcttcaaaaaagaagaaattttgtccagctcagacatctgtcagaaattggtgaatacgcaggatatgagcgcatctcaggttgacgtggccgttaaaattaacaagaaagttgttccactagacttttccatgagctccctggccaagcgcatcaaacagctccaccacgaggcccaacagtcagagggcgagcagaattaccgtaagttcagggcaaaaatctgtcccggagagaaccaggctgcggaagatgaactccgaaaggaaatttctaagactatgttcgctgagatggagatcataggacagttcaacctgggctttatcatcacaaagctgaatgaggatatatttattgtcgatcagcacgcgacggacgaaaagtataattttgagatgctgcagcagcataccgtgctacaaggccagagactaattgcccctcagaccctgaatctgacggctgtaaacgaggccgtccttattgaaaacctcgagatcttccggaagaacggctttgattttgtaatagacgaaaatgctccagtaaccgaacgcgcaaaactaatcagtctacctacaagtaaaaactggacttttggaccccaagatgtggacgagctcatatttatgctgagcgattcaccaggggttatgtgccgcccttcgcgggtcaaacagatgttcgccagtcgcgcttgtcgtaagtccgttatgattggtacggcactcaatacatcagaaatgaagaagctgataactcatatgggggagatggaccacccctggaactgtcctcatggacggccaactatgcgacatatcgcaaacctgggggtaatcagccagaattag

SEQ ID NO: 30185 - DNA, 1386 bp, Artificial Sequence
  Description of Artificial Sequence: Synthetic coding sequence
atggaaagagccgagtctagcagcactgaaccagcaaaggctataaaacccatcgaccggaagtcagttcatcaaatctgctccggacaggtcgtactgagtcttagcacggcagtaaaggagctggtggaaaatagtcttgatgccggtgctaccaatatcgacctcaagctgaaagattacggtgtggatctcatcgaggtctccgataacggctgtggagtggaggaagagaatttcgagggtctgactctcaaacaccatacatcaaagatccaagaattcgctgacttgacccaggtggaaactttcgggttcagaggcgaagccttatcctcactgtgcgccttgtccgacgtgactatttctacctgtcatgcttccgctaaggtagggacccgcttaatgtttgatcataatggcaaaattatccaaaagaccccatatcccagaccaagaggcacaactgtgtccgtgcagcagctctttagcactctgcccgttcgacacaaggaattccagcggaacattaaaaaagagtacgctaaaatggtgcaggttctccatgcctattgcatcatcagcgctggaatccgagtcagctgtacgaatcagctcggtcaaggaaaacgccagcccgtcgtatgtaccgggggatcaccctcaatcaaagagaacattggctcagtgttcggccagaagcagctgcaatcgctgatcccatttgttcagctgcccccatctgactcggtgtgcgaagaatacggcctcagctgcagtgacgcccttcacaacctgttttataaaactatgtttgctgaaatggagataatcggacaatttaacttgggattcatcattaccaaactcaatgaggacatatttatcgtggatcagcacgcaacggacgaaaagtacaattttgaaatgttgcagcagcataccgtccttcaaggacagcggctgattgcaccccagacccttaaccttacagccgtgaacgaagccgtccttatcgaaaatctggagatctttagaaagaatggctttgattttgtaatcgacgaaaacgcaccagtcacagaacgtgctaagctcatcagtttgcccacctcgaaaaattggaccttcggccctcaagacgtggacgagcttatcttcatgctttccgacagtccaggggtgatgtgtcggccaagccgcgtcaaacaaatgttcgccagccgagcttgtcggaagagcgtgatgatagggaccgccctcaatacaagtgaaatgaagaaactcattacgcacatgggcgaaatggatcacccttggaattgcccccacgggagacctacaatgagacacatagctaacctgggggtgatttcacagaattag

SEQ ID NO: 30186 - DNA, 2448 bp, Artificial Sequence
  Description of Artificial Sequence: Synthetic coding sequence
atggagcgggcagagtcttcaaggtctaagctaaaggactacggcgttgatctaattgaagtcagcgataacggctgtggagtcgaagaagagaactttgaaggactgaccctgaagcatcatacatcaaagattcaggagtttgcagatttgacccaggtcgaaacattcggctttcggggagaggccctgagtagtctctgcgctctgagtgatgtgactatttccacgtgccatgcctctgctaaagttggaacaaggctcatgttcgatcacaacgggaaaatcatacaaaaaacaccatacccacgtccacggggtacaaccgtgtccgtgcagcaactgttttccaccctccccgtcagacataaggagttccagaggaatattaagaaagaatacgcgaaaatggtgcaagtgctgcacgcgtattgtattatctctgctgggataagagtgagctgtacgaaccagttgggtcaggggaaaagacagcctgtcgtgtgtaccgggggaagtccttcaattaaggaaaatatcggaagcgtttttggccagaagcaactgcagtccctgatccctttcgttcagttgcccccaagtgacagtgtatgtgaggagtacggtctgtcctgctcggacgccctgcataatttgttttacatcagtggctttatctcccagtgcacgcatggggttggtagaagctccaccgatcgacagttcttctttattaacagaaggccctgcgatccagctaaggtatgtcgactagtgaacgaagtttaccatatgtacaatagacatcagtatccattcgtggttctgaacatcagcgtagactccgagtgcgtggatataaatgtgactcctgacaaacgccagatattattgcaagaggaaaaacttttacttgccgtactgaagacttccctgattggcatgttcgattccgacgttaacaaactgaatgtttcacaacagcccttgctggatgtggagggaaatttgataaaaatgcacgcagcggatctagagaagccaatggttgaaaaacaggatcaaagtccatccctgcggaccggcgaagaaaaaaaggacgtctcaataagtaggctgagagaggcgttcagtctgcggcataccaccgaaaataagccgcattcccccaaaacacccgagccccgaagatccccattggggcagaaacggggtatgcttagctcaagcaccagcggggctatctctgataaaggcgttttacggcctcagaaggaggccgtgtcatccagccacggaccctctgacccaacagatcgcgcagaggttgaaaaggattccggccacggtagcacttccgtcgattccgagggcttctcaataccagatactggctcgcattgttcttcagagtatgccgcttcttctccaggggacaggggctcccaggagcacgtcgattcccaggagaaagccccaaagacagatgattctttcagcgatgtggactgtcactctaaccaggaggacactggctgtaaattcagagtgttaccacagcccacaaacctcgcgaccccaaacactaaacgctttaaaaaagaggaaattttatctagctcggacatctgccagaagttggttaacacccaggacatgagcgccagtcaggtggatgtagctgttaagattaacaagaaggtcgtgcccctggacttttctatgagctcactcgccaaaaggatcaagcagctgcatcacgaagcacaacagagcgaaggagaacagaactataggaagtttcgtgcgaagatctgtcctggagaaaatcaggcagccgaagatgagttgagaaaggagatcagtaagacaatgtttgcagagatggagatcattggtcagttcaacctcggcttcatcataacaaaactcaacgaggacatattcatcgtcgatcagcacgctacggatgagaaatacaactttgaaatgctgcagcagcatacagtgctacagggacagcgcctgattgctccacagactctgaatttaaccgccgtaaacgaggcagtgctgatcgagaatctcgagatctttcgcaagaacggtttcgacttcgtcatcgacgaaaacgcaccagtgactgagcgggctaaattgatctcactacccacatccaaaaactggacttttggaccacaggatgttgatgagcttattttcatgcttagcgacagccccggagtgatgtgccggccttcacgcgtgaaacagatgtttgcatcccgcgcatgtcgaaaaagtgtgatgatcggaacggcactgaacacatcggaaatgaagaaactgatcactcatatgggggagatggaccatccctggaactgccctcatgggagacccacaatgcgtcatatcgctaacctgggcgtcatcagtcaaaactag

SEQ ID NO: 30187 - DNA, 1719 bp, Artificial Sequence
  Description of Artificial Sequence: Synthetic coding sequence
atggagagagctgagtccagcagcactgaacccgcaaaagcgatcaaaccaatagaccgcaaaagcgtgcaccagatttgtagcgggcaggtggtgctgtcactgagcacagcggtgaaggagctagtggaaaattcattagacgccggtgctaccaacatcgacctgaagctgaaagattatggagtggatctgatagaagtgtctgacaatggctgcggggtcgaagaagagaatttcgagggtttgaccctcaagcaccacacatcaaaaatccaagagtttgctgatctcacccaggttgagacatttggctttcggggagaggcactaagctcgctctgtgctctttccgacgtgaccatctctacatgtcatgcctctgccaaagtgggaactcggctgatgttcgaccacaacgggaagataatccagaaaacaccttaccctcgtcctagagggacaaccgtaagcgtccaacagctgttctcaacccttcctgtgcggcacaaggagttccagcgaaacattaagaaagagtacgctaagatggtccaggtgctccacgcttactgcatcataagcgccggaatcagggtgtcctgcactaaccaacttggacagggtaaacgacagccggtggtgtgcacgggcggaagcccttctataaaggagaatattggaagtgttttcggacagaaacagctgcagtccttgataccattcgtgcagctgcccccaagcgactccgtttgcgaggaatacggactctcatgttccgatgctctacacaatctgttctacattagtgggttcatctcccagtgtactcacggggtggggagaagctccacagaccggcagtttttcttcataaacagaaggccctgcgaccccgctaaagtgtgccgtctcgttaacgaagtttaccacatgtacaacagacaccagtatccctttgtggttttaaacatttccgtggactccgaatgcgtagatattaatgtgaccccagacaagagacagattctgttgcaagaagagaagctcctgctcgcagtactgaagacaagcttgatagggatgttcgactctgatgttaacaaactgaacgtgagtcagcagccactcctggatgttgagggcaaccttattaagatgcacgctgccgacctggaaaaacctatggttgagaaacaggatcagtctccatctctgaggaccggcgaagaaaagaaagacgtcagcattagtagattgagggaagccttttctctgagacatacaacagagaacaagccccatagtcctaaaacacccgagcctagacggtcaccacttggccaaaaacgagggatgctgagttccagcacgtcaggcgcaataagcgacaagggcgtcctgcgcccacaaaaggaggctgtctcttcatcacatgggccaagtgatcccacagaccgtgctgaagtagaaaaagattctgggcacgggtccacctccgttgattcagagggttttagtatccccgacactggaagccactgtagcagtgagtatgccgcaagtagcccaggggatcgtggcagccaggaacacgtagatagccaggagaaggccccaaagacggacgacagcttttccgacgtcgattgccactctaatcaagaggatacaggcctgaaaacaggcccatctgaccccaggacttcaatgaactag

SEQ ID NO: 30188 - DNA, 2271 bp, Artificial Sequence
  Description of Artificial Sequence: Synthetic coding sequence
atgtggggacgtcggagaaagctgagacggctgaacgacgtgaccatctcaacctgccatgcgtctgctaaggtgggcacgagacttatgtttgaccacaatggcaagatcattcagaaaactccatatcctaggcccaggggcaccacagtgagtgtgcaacagctgttctctactctgccggtcagacacaaagaatttcagcgcaacatcaaaaaggagtacgctaaaatggtgcaagttctccatgcttactgcattatctcggcaggtatcagagtgtcttgtacaaaccagctggggcagggtaaacgccagcctgtggtgtgtaccggagggtccccaagtatcaaggagaatatcgggagcgtttttggacagaagcaactccagtcgctgattccgtttgtgcagctcccgccatcagatagcgtgtgcgaagagtacggattaagctgcagcgatgctcttcacaatctgttttatatctcgggcttcatcagccaatgcacccatggggtcggtagaagttccaccgaccgtcagttttttttcattaatagaagaccttgtgatcctgctaaagtttgccggttggtcaatgaagtttatcatatgtataatcggcatcagtatccctttgttgtgctgaatatatcggttgacagcgagtgtgtggatatcaacgtgacccctgataagagacaaatactgcttcaggaggaaaaactgctgctggctgtgctgaaaacgtcattgatcgggatgtttgactctgacgttaataaactcaatgtgtcccagcagcctttgctggacgttgagggaaatctcattaaaatgcacgcggcagacctggagaaacctatggtggagaagcaggaccagtcccctagcttacgcactggggaagagaagaaggacgtatccatctctaggctgcgggaggcttttagtttgcgacataccactgagaataaaccccattcgcctaagacccccgagcctagaagatccccgcttgggcagaagcgcggaatgttgtcctcgagcacatccggggcaatcagcgataagggagttctcagaccacagaaggaagcagtgagttcatctcatggccctagcgatcctacagaccgcgcagaggtggagaaagattccggccacggctctacctcggtggatagcgaagggttctctatccctgacacaggatctcactgctcatccgaatacgcggcaagctcgcccggagataggggttcccaggagcacgtggatagccaggagaaggcgccaaagactgacgacagttttagcgacgtagactgccacagtaaccaggaagacacaggctgtaagtttagagtcttgccacaaccaaccaatctcgcaacccccaacactaagcgatttaaaaaagaagagatactgtcatctagcgacatatgccaaaagttggtcaacacccaggacatgtccgcgagccaagtggatgtcgctgtgaaaatcaataagaaggtcgtccctttggatttttcgatgtcgtcactggccaagcgcattaaacagctgcatcatgaagcgcagcaatcagaaggggaacagaactatcgaaaatttcgagctaaaatctgccctggagaaaatcaggccgcagaggacgaactacggaaagaaatatccaaaaccatgtttgccgagatggaaattataggacagttcaaccttgggttcataattacaaagctcaacgaggatatattcattgtcgatcagcacgccactgacgagaagtacaacttcgagatgcttcagcagcacactgtcctgcagggacaaaggcttattgcccctcagactctgaacctcacagcagtcaatgaggcggtccttattgaaaatcttgagatttttcgcaaaaatggctttgactttgtcatcgacgagaacgctccagtcacggagcgggctaagctcatctcactgcctacctctaaaaattggacctttggtcctcaagatgttgacgaactcattttcatgctctctgactccccgggtgttatgtgccggccaagtagggtaaagcagatgttcgcgtccagagcgtgcagaaagtctgtgatgatcggaacagctttgaacacctcagaaatgaaaaaactcatcacccacatgggagagatggaccatccctggaattgcccccacggacgtccgactatgaggcacatcgcgaatctgggtgtaatttcacagaactag

SEQ ID NO: 30189 - DNA, 1812 bp, Artificial Sequence
  Description of Artificial Sequence: Synthetic coding sequence
atgtctgccgctgtgacagccggaaagctggcgagggcacccgcagaccctggtaaggccggagttcccggtgtggccgctccaggcgcacccgcagcagcccctcccgcaaaagaaatccccgaagtgctcgttgaccccaggtctaggagacgctatgtaagggggagatttctggggaaaggcggtttcgccaagtgttttgagatctcagatgccgatacaaaggaggtctttgctggcaaaattgtgccgaagagcttactactcaagccacaccagcgggaaaagatgtccatggaaatctctatccacagatcactggcccaccagcacgtggtcggattccatggcttttttgaagataacgactttgtgttcgttgtcctggagctctgccgcagaagatctctgctggagttacataaacggcgaaaggctcttaccgaacctgaagccagatactatttgagacagatcgttctgggatgccaatacctgcacagaaacagggtgatccacagagacctgaaactcggcaatctgttcctgaacgaagacctggaggttaagattggagactttggcctcgccactaaagttgagtatgacggagaaagaaagaagaccctatgtggtaccccaaactacattgctcccgaggtgttatctaagaagggacattccttcgaagttgacgtatggagcatcggatgcatcatgtacaccctgctagttgggaagccccctttcgagacctcctgccttaaggagacatatctgaggataaaaaagaacgagtacagtatccctaaacacatcaatccagtggcggcatcacttattcagaaaatgttgcagactgatccgaccgcacgccctaccattaatgagctgttaaatgacgaattcttcacaagcggatatattcccgcacggctcccaatcacatgtctgacaatcccaccacggttcagcatcgcaccctcctctcttgacccttccaacagaaaaccgctgacagttctcaacaagggcctggagaacccgctgcccgaacgccctagagagaaagaagaacccgtcgtgagggaaaccggagaagtggtggattgtcacttgtctgacatgctccagcagcttcactctgtcaatgctagtaaaccatcagaacggggactagtcaggcaagaagaggccgaggatcccgcatgcatccccatcttttgggtttccaagtgggtagattactccgacaagtatggcctagggtaccagctgtgcgacaattctgtgggggtgctcttcaacgactccactcgcctgatcctgtataacgatggagacagccttcagtacattgagcgggacgggaccgagtcctacctgaccgtgtcttcacaccctaattccctgatgaagaagatcactctgctcaagtactttcggaactacatgtctgagcacctcttgaaagccggtgctaacatcacaccccgagaaggcgacgagctagccaggctgccctatctgagaacctggttccggacccggtcagctataatcctgcatctaagtaatgggagcgtgcagataaacttctttcaggaccacacgaagttaattctatgtcctctgatggcagccgtcacttatatcgacgagaagcgggattttaggacatataggctgagcctgctggaggagtatggctgctgtaaggagttggcttcaagactaaggtacgcacggaccatggttgacaagctgttgagcagcagatctgcctccaataggctcaaagctagctag

SEQ ID NO: 30190 - DNA, 744 bp, Artificial Sequence
  Description of Artificial Sequence: Synthetic coding sequence
atgtccgctgctgtgaccgccggaaaactggcacgtgctcctgccgatccaggaaaagctggagtgccgggagtggcggcacccggtgcgcctgcggctgccccacctgctaaggaaatacctgaagtgctggtggatcctcggtctcgcagacgatatgtgagaggaagattcctgggaaaagggggatttgccaagtgttttgaaatcagtgacgccgacacaaaagaggtgttcgccggaaagatcgtacccaaaagcctgctactcaagccccatcagcgagagaaaatgtccatggaaatctccattcacaggtctctggcccaccagcatgtggtcggattccatggcttctttgaggataatgattttgtgtttgtggtgttggagttgtgtcgaaggaggagtttattagagttgcacaagcgtcggaaagcactgaccgagcctgaggcccgttattacctccgacaaattgtacttggctgccagtatctgcatcgcaatcgggtaatacacagggacctgaagctgggaaacctgtttctgaacgaagacctggaggtgaaaataggagactttggtctagcaaccaaagtagaatatgacggcgaacgcaaaaagaccctctgcggcacgcccaattatattgcgccagcggtaccatgcctgcaatgtgctccccaacctcggtggcttgggagagcagcctcttctctccaagtcggagttgctgtttag

SEQ ID NO: 30191 - DNA, 1521 bp, Artificial Sequence
  Description of Artificial Sequence: Synthetic coding sequence
atgtctatggagatttctatacacaggagcctggctcatcagcacgtggtgggcttccatggttttttcgaggacaatgactttgtctttgtagtcctggagctttgtcgcaggcggtccctcctcgaactgcacaagcgccgtaaagctttaacagagccagaagcccgatactacttgcgccaaatagtcttaggctgtcagtacctacatcggaacagggtgatccatcgagacctgaaattgggtaacctgttccttaatgaagacttggaagtgaaaatcggagattttgggctggcaaccaaggtggagtacgatggggagcgaaagaagacactgtgcggtacacccaattatatagcccctgaggtgctgagtaagaagggccattcattcgaggtggacgtctggagtatcggatgcataatgtacactcttctggttggcaaacctccttttgagacttcatgcctcaaggaaacttatcttaggatcaagaagaatgagtactcaatccccaagcacatcaatcctgtcgccgcttctttgatccagaagatgttgcagacagaccccaccgccagacctacaattaatgagcttcttaacgacgaattttttacatctggatatattccagcgaggcttccaatcacatgcttgaccatccccccacggttttctatcgctccctcgtcattagatcccagtaatcggaagccattgaccgttcttaacaagggacttgagaatccactgcctgagcgaccgagggagaaggaagagcccgtagtgcgggagacaggggaggtagtggattgccacctgtctgacatgctgcaacagcttcattcagtgaacgcctcaaaaccttccgagaggggactcgttcgacaggaggaggcagaggaccccgcttgtattcccatcttttgggtgagcaagtgggttgactatagcgacaaatatgggcttggatatcagctgtgtgacaattcagttggggtcctcttcaacgacagtacccggctgatcctgtataacgacggagactctctgcagtatatagagcgcgatggcactgagtcctatttaacggtgagcagccacccgaattctttgatgaagaaaatcacccttctaaaatacttcagaaattacatgagcgagcacctgttaaaggcaggggctaatatcaccccccgtgagggcgatgagcttgcaaggcttccgtatctcagaacatggtttaggactcggtctgctatcatcttgcacctctcaaatgggtccgtccagattaactttttccaggaccacaccaagcttatcctgtgcccactgatggcagcagtgacctatattgatgaaaagcgtgacttcaggacctatagactctctttactcgaagaatatggatgctgtaaggaattggccagtaggctgagatacgcgagaaccatggtcgataagctgttgagctcccggagcgcctccaacaggcttaaagcgagttag

SEQ ID NO: 30192 - DNA, 1941 bp, Artificial Sequence
  Description of Artificial Sequence: Synthetic coding sequence
atggagcccgctgcaggattcttgtctccaagaccttttcagagagccgcagcagcacccgcaccacccgcaggcccaggcccacctccatccgcccttcggggtcccgaactggaaatgctggccggattaccaacatccgaccctggacgtttaatcacagacccccgaagcgggagaacatacttgaagggacgtctgctcgggaaaggaggttttgccagatgttacgaggctactgacacagagaccgggtcagcctatgctgtgaaagttatcccacagagtagagtggccaagccacatcagcgggagaagatcctgaacgaaattgagctgcaccgtgacctccagcaccgccacattgttcgattcagccatcattttgaggatgccgacaacatctacatctttttggagctgtgttcccggaagagtctcgctcacatttggaaagctcggcacactctcttggagcccgaggtgcgttattatctcaggcagatactgtcaggtctcaaatatctccaccagaggggaattctacatagggacctcaaattgggtaatttcttcataacagaaaatatggaactcaaagtcggagactttggcttggctgcaaggctcgaacccccagagcagcgcaagaaaaccatatgtggtacccctaactacgttgcacccgaggtgttgctacggcaaggacatggccctgaggccgatgtgtggagcctcggatgtgtaatgtacacgctgttgtgcggctcgccacccttcgagactgccgacttgaaagagacctatcgatgtatcaaacaggtgcattacacactacccgcatccctctctctgccagctcgccagctgttggccgcaatacttagagcgtcccctcgggatcggccatctatcgatcagatacttcggcacgactttttcactaaaggatatacgccagatagactacccattagtagttgcgtgacagtgcctgatttaacaccacccaatcccgctcggtctttatttgccaaggtgactaagagtctgttcggtcgcaaaaaaaagtctaaaaatcatgcacaggaaagggatgaggtgagtggcctcgtgagtggcctcatgcggacaagcgtgggtcaccaggatgccaggcccgaggctccggcagccagcggccctgcccctgtctctctggttgaaacagcacccgaagacagctccccccgaggaaccctcgcctcttccggcgatggcttcgaggagggactgacagttgcgacagtggtcgagtctgcactgtgtgccctgcgcaattgcatcgcctttatgcctccggctgaacaaaacccagcacctctagcacagccagagccactggtgtgggtcagcaaatgggtggactactcaaataaatttgggttcggctaccagctgtccagtcggagagttgccgtgcttttcaacgacggcactcacatggccctgagcgctaacagaaaaacagttcactacaatccgacaagcacaaagcattttagcttctctgtgggggctgtgcctagagcactgcaaccccagctgggaattctgcgttattttgcctcctacatggaacagcacctcatgaagggcggagacctgcctagcgtagaagaggtcgaagtgccagctccgcctctgcttctgcaatgggtgaaaactgaccaggccctcctaatgttgttttcagatggtactgtccaagtaaacttctacggtgaccatactaaactgattctgagtggatgggagccgctgctggtgacttttgtggcgagaaacagaagcgcttgcacctatttagcatcacaccttcgccagctggggtgtagccccgatctgagacagaggctaagatatgccttgcggcttctcagggaccggagcccagcgtag

SEQ ID NO: 30193 - DNA, 1866 bp, Artificial Sequence
  Description of Artificial Sequence: Synthetic coding sequence
tctaggcagcggcacgcacggcctggtccaggcggtaccgagaaacccggaccaaggtgtgatgcccctgccgcttggtcactacctcccgtgtcgtgtctccggacatacctgaaggggcgactgctggggaagggaggctttgcacgttgttacgaggccacagatacagagactggctcggcatatgcagtcaaggtcataccccaaagccgagtcgcgaagccccatcagcgagagaagatactcaatgagatcgaactgcacagagacctccagcatcgacacatcgtgcggtttagtcaccatttcgaagacgccgataacatttacatcttcctggagctttgctcgcggaagtctcttgcccatatttggaaggcacggcacaccctgctggagccagaagtgcgttactacttgcgacagatattgtctggcctcaaatatcttcaccagaggggcatcttgcatcgcgatctcaaactgggcaactttttcatcactgaaaatatggaattgaaagtgggcgacttcggtttggccgctcgtctagagccgccagaacagcgaaagaagaccatctgtggaacgccgaactacgtagccccagaggttttgctgaggcagggacacgggcctgaggccgatgtatggtcgcttggctgcgtgatgtacactctgctctgtgggagccctccttttgaaacggcagatttgaaggaaacttaccggtgtattaaacaggtgcactacacactgcccgcatcactgtctctgccagcgaggcagcttctggcagctattctccgtgctagccctcgagataggcctagcattgatcagatactccgacacgatttttttaccaaagggtataccccagacaggctcccaataagtagttgcgtaacagtgcccgacctcacccctccgaatcccgctcgttctctgttcgccaaggtaaccaaatctctgttcggaagaaaaaagaagagtaagaaccatgcacaagagagggatgaggtcagcggactcgtgagtgggttgatgaggacaagcgtgggacaccaagatgctcgaccagaggctcccgcagctagtggaccggctccagtctctctggtggaaaccgctcccgaggacagtagtcctcgaggaactctcgcttcgtccggggacgggttcgaggagggactcacggtggccactgtcgttgagtctgcgctgtgtgcactgcgcaattgcatcgctttcatgcccccagctgagcagaatcctgctcctttagcacagccagagcctttggtctgggtaagtaaatgggtggactactctaataagtttgggttcgggtaccagttgtcaagtcgtcgcgtcgcagtgttattcaatgacggtacacatatggccctgagtgctaaccgcaaaaccgttcactacaaccccactagtactaaacacttttctttttcagttggggctgtgcccagagcgctccagccccagctgggaatactgaggtattttgcctcctacatggagcagcatctcatgaaggggggagatctcccatcagtcgaggaagtggaggttcctgcaccgccactcctcctgcaatgggtcaagaccgaccaggccctgctaatgctgttttctgacggtacagtccaggtgaacttttatggcgatcacacaaaacttatcctttctggatgggagcccctgttggttaccttcgtggctagaaaccggtcggcctgcacatatcttgcctcgcacctgcgccagttaggctgctcacctgatctgaggcaacggcttaggtacgccctgcgacttctccgcgacagaagccctgcctag

SEQ ID NO: 30194 - DNA, 2913 bp, Artificial Sequence
  Description of Artificial Sequence: Synthetic coding sequence
atggccacttgtataggcgagaaaatcgaggacttcaaagtcggaaatctgctgggcaaaggtagttttgccggagtttaccgcgcagaaagcatccatacaggtctcgaggttgctatcaaaatgattgataagaaagccatgtataaggcaggaatggttcagcgtgtccagaacgaggtgaagatccattgccaactgaaacacccctcaatattggagctgtacaactatttcgaggactcaaattatgtttacctggtgctggagatgtgccacaacggcgaaatgaacagatatctgaagaaccgtgtgaaacctttttccgaaaacgaggccaggcactttatgcatcagattatcactggaatgctctatctccacagtcacgggatactgcatcgggaccttacactatccaatctccttctgactcgcaacatgaacataaaaatcgcggattttggactggccactcagctgaagatgccacacgagaagcactatacactctgcggcacacccaactacatttctcctgagattgccacaagaagcgcacatggtctcgagagcgatgtctggagcctcgggtgtatgttctacactctgttgattgggcgtccaccctttgacaccgatacggtcaagaacacgctaaataaggtcgtgctggctgactacgaaatgccgtcattcctctccattgaagccaaggatctgatacatcagctgttgcggaggaatcctgcagaccgcctctctctctcctccgtgctcgatcacccctttatgtccaggaatagctctacgaagagcaaggacttggggactgtggaagattctatagatagtgggcacgcaactatatctaccgccattaccgccagcagctctacttctatatcgggatccctgttcgataagagaagactgctgatcgggcaaccgctgccgaacaaaatgactgtttttccaaagaacaagtcttccacggatttctctagcagtggggacggaaattccttttacacacagtggggaaatcaggaaacgtcaaactctgggagaggaagggtcatacaggatgccgaggaacggccacacagcaggtacctgagacgggcatattccagcgatagatccggtacatctaactctcaatctcaggctaaaacctacactatggaaaggtgtcacagtgctgaaatgttgtcagtctcaaaacgctcaggaggcggtgagaacgaggagcgctattcaccaacggacaacaacgcaaatatcttcaacttctttaaagaaaaaaccagctcgtcctcaggcagctttgagagaccagacaacaaccaagctctcagcaaccacctgtgcccagggaagacgccatttcctttcgcggatcctacacctcagacggagaccgtgcagcagtggtttgggaatctacagataaacgcacacctcaggaagaccacggaatacgattcaattagtccaaatcgggactttcaggggcaccccgatctacagaaggacaccagcaagaacgcctggacagatactaaggtaaaaaagaattcagatgcttccgataatgcccactccgtgaaacaacaaaataccatgaagtacatgaccgccttgcacagcaaacctgagatcatccagcaggaatgcgtctttggcagcgacccgctatccgagcagtctaagacccgcggaatggagcccccatggggttaccaaaatcgcactcttagatctattacttcccctctggtggcccatcggctgaagcccattcgacagaaaaccaagaaagctgttgtctctattctggactccgaggaggtgtgtgtggaactggtcaaagagtacgctagccaggaatacgtgaaggaggtccttcagataagctcagacggaaacaccatcacaatttattaccctaatggaggacgcggattccccttggcggacagacctccatccccaaccgataatatatccagatactccttcgacaatctgccggaaaagtactggcgcaagtatcaatacgccagccgtttcgtacaactggtcaggtccaagtcacctaaaattacatactttacccggtacgccaagtgcattttgatggagaactctcctggagctgactttgaagtgtggttttacgatggtgtcaagatccacaagacagaagattttatccaggttatcgagaagacggggaagtcttacacgttgaagtccgagagcgaggtgaactcattgaaggaagagattaaaatgtatatggaccacgccaatgaaggccaccggatctgcctggctctggaatccataatatctgaggaagaaagaaagacacgctctgccccttttttcccaataataatcggccgtaagcccggatccacaagctctcctaaggcgctgtctcctcccccatccgtggactccaactatcccacacgggagcgtgccagctttaatcgaatggtcatgcacagtgctgcttcccctacacaggctcccatattgaatccatctatggtcacaaacgaagggctcggcctcacaacgactgccagcggcacagatatatcctcaaatagcctcaaggactgcctcccgaagagcgctcagctgctgaagtcagtattcgtgaaaaatgttggctgggcaacacaactgaccagtggggctgtctgggtacagtttaacgacggcagccagcttgtggtgcaggccggagtgtcgtcaatcagctacacatctcccaatggacaaactacacgatatggagagaatgaaaaactgcccgattacatcaaacagaaacttcagtgcctgagttcaattcttttgatgttcagtaatcctacacccaatttccactag

SEQ ID NO: 30195 - DNA, 2817 bp, Artificial Sequence
  Description of Artificial Sequence: Synthetic coding sequence
atggctacctgtattggtgaaaaaatcgaggactttaaggtggggaatcttttagggaagggcagctttgctggcgtgtaccgcgctgaatcaatacacacgggactcgaagtggcaataaagatgctttacaactactttgaagatagcaactacgtgtatctcgttttggaaatgtgccataacggtgagatgaacagataccttaagaaccgtgtgaaacccttttccgagaacgaggcccgacatttcatgcaccaaatcattacaggaatgctgtacctccattcgcatgggatcctgcacagggacctgacactgtccaatctgctacttactcgcaatatgaacatcaagatcgcagacttcggcttggccacccagttgaaaatgccccatgagaaacactataccttatgtgggactcctaactacatatctcctgagattgcaacgcggagcgctcacgggctggaaagcgacgtttggtccttgggctgtatgttctacactctgcttatagggaggcccccttttgataccgacacagtgaagaataccctgaacaaagtggtgttagctgactacgaaatgccatccttcttgtccatagaggctaaggaccttatacatcagttacttaggcgtaatcctgctgaccgtctgtcattatcttccgttctggatcaccctttcatgtccagaaatagctctaccaaaagtaaggacctgggcaccgtggaagattctatcgacagcggtcacgccaccatctctactgcgatcacagcgtccagctccacatcgattagcggatccctttttgataaaagacgccttctgatcggacagcctctgccaaataagatgactgtgttccctaaaaacaaatcctcaacagacttttcgagctcaggggacggtaatagcttctacacccagtggggtaatcaggagaccagcaacagcggccgaggcagagtgatccaggacgctgaggaacgcccacactccagatacctgcgacgcgcatactcttctgatcgcagcggcactagcaactcccagtcgcaggccaagacctacacaatggagcgctgccactcggccgaaatgctgagcgtttcaaagcggtcaggcggtggcgagaacgaggaaagatatagtcccacagacaacaatgcgaatatcttcaacttcttcaaagaaaaaacctcctcatcctcagggagctttgaaaggccagataataatcaggctctgtccaatcacctgtgtccaggcaagacgccttttccattcgcggatccgactccccaaacggaaaccgtgcaacaatggttcggaaacttgcaaataaacgcgcacctacgaaaaactaccgaatacgattccatttctcccaacagagattttcaaggacaccccgatctccaaaaggacacatctaagaatgcttggacagacaccaaggtgaaaaagaatagcgacgcctcagacaatgcccattcagtaaagcagcagaatactatgaagtacatgacagccctgcactctaaacccgaaatcattcagcaggagtgcgtgttcggctcagacccattgtcagagcagagcaagacacgaggcatggagccaccatgggggtaccagaatcgtacattacggagcatcacttctcctctggtggcccataggctgaagccaatacggcaaaagactaaaaaggctgtggtgtctatcctcgattctgaggaagtgtgcgtcgaattagtaaaagagtatgcctcacaggagtatgtgaaagaagtcctccagatctcctcagatggcaatacaatcacaatatactaccccaatggtggacgcggatttcccctggctgatagaccaccatcgcccacagacaacattagtcggtacagcttcgataacctaccagagaagtattggcggaaataccagtacgccagcagatttgtccaattggtacgatccaagagtcctaagatcacttactttactaggtacgccaagtgcattcttatggagaattctccaggcgctgacttcgaggtctggttctacgatggtgtgaaaattcacaagacggaggattttatccaggtgattgaaaagacagggaagtcttatacattaaagagcgaatctgaagtgaactctctgaaagaagagatcaagatgtacatggaccatgcaaatgagggccacagaatttgtctcgctctcgaatctatcataagcgaggaagagcgcaagacaagatccgccccattctttcccattataattggacggaagccaggctccacgtcatcccctaaagcactgtccccaccacctagtgtggactccaactatcctacaagagaaagagcctccttcaatagaatggtaatgcactccgctgccagccccactcaagccccaatactaaatcctagcatggtgactaacgaaggcctgggcttaactacgaccgcatcaggtacggatattagctccaactccttgaaggactgcctccccaagagtgctcagttactaaagagcgtgttcgtgaaaaatgttgggtgggccacccaactgacaagtggagctgtttgggttcaatttaacgatggatcccagttagtcgtacaagcaggagtgtcttctatatcttatacctcacccaacgggcagacaacacgctacggagagaacgagaaactgccagattatattaaacagaaattacagtgcctgagcagtattcttctgatgttttcaaaccccacacctaactttcactag

SEQ ID NO: 30196 - DNA, 2790 bp, Artificial Sequence
  Description of Artificial Sequence: Synthetic coding sequence
atgatcgacaagaaagcaatgtataaggcgggaatggttcagagagtgcagaatgaagtcaaaatacactgccagctgaaacacccctccatccttgagctctataattactttgaggattcgaactacgtgtatttggttctcgaaatgtgtcacaacggcgagatgaatcgatatctcaaaaaccgcgtgaagccttttagcgagaatgaggcaaggcacttcatgcaccaaatcataactgggatgctgtatctccactcacatgggatactgcaccgcgatctgaccctgagcaatctcttactgacaaggaacatgaacatcaagatagcggactttggccttgccacccagctgaagatgccacacgaaaagcactacactctgtgtgggacccccaattacatttctcctgagatcgctacacggtccgcccacgggctggagtcggacgtttggagtctgggctgcatgttttacaccctgctcatagggagaccaccctttgataccgatactgtcaagaacactctgaataaggtggtgctggcagattatgagatgccaagctttctgtcaatcgaagccaaggatctgatccatcagcttttgaggcgtaacccagccgaccgacttagtctgtcttcagtattggaccacccattcatgagccggaattcttcaaccaagtccaaggatctcggtacggtagaggactccatcgattcagggcacgcgactatttccacagctataactgcatctagctccacgagcatcagcgggagcctatttgacaagcgaagacttcttattggccagccgcttcccaacaagatgacggtcttccctaagaacaagtcaagtacagacttctcttcttccggggacggaaattccttctatactcagtgggggaaccaagagactagcaatagtgggagagggagagtgatacaggacgctgaggaaaggccccattcccgatacctgcgaagggcttactcatctgatcggtctggtacttctaactctcaatcccaggcgaagacctataccatggaacgttgccattccgctgagatgttatcagtatctaagcggtctgggggtggagagaacgaagagagatatagccccactgataataatgctaacatctttaattttttcaaagaaaaaacatcgtcctctagcggtagtttcgagcgaccagacaataaccaggccctttccaaccacctttgtcccggtaagaccccatttcccttcgctgatccaacccctcaaactgagacagtgcagcaatggtttgggaacctccaaataaacgcccaccttcgcaaaactacagagtatgacagtataagtcctaatcgcgatttccaggggcaccccgacctacaaaaagatacatccaaaaatgcatggactgacactaaggtgaagaagaactccgacgcctcggacaatgctcacagcgtcaagcagcaaaacacaatgaaatacatgacggccctccattccaaaccagaaatcatccagcaggagtgtgtgttcggatccgacccactctcagaacagtcaaagacccgtggtatggagcctccttgggggtaccaaaacaggaccttgcgttccatcaccagtccattggtggctcataggcttaaaccaatccgtcaaaagaccaaaaaagccgtggtgagtatccttgatagcgaagaagtgtgcgtggagctcgtcaaggaatacgcgtcccaggaatatgtgaaagaagtgcttcaaatatcaagcgacggaaacaccatcactatctactatcctaacggcggtcggggtttcccgctggccgatcggccaccatcacctaccgataatatatctagatattcgttcgataatctgccagagaaatattggcgtaaataccaatacgcctcccgttttgtccaactcgtccgctccaagtcacccaagattacctacttcactcggtatgcaaaatgcattctcatggagaacagtccaggggctgatttcgaagtgtggttttacgatggggttaaaatccataaaaccgaggacttcattcaagtgatcgagaaaaccggcaagtcatacacccttaagtccgagagtgaagttaacagtttgaaggaggagattaaaatgtacatggatcacgctaacgaagggcaccgaatctgtctggctcttgagtccatcatctcagaagaggagcggaagacgcgatctgctcccttttttcctataattattgggcgaaagccaggctctacaagtagtcccaaggcactgagcccccctcccagtgtagatagcaattacccgactagagagcgggcaagtttcaacagaatggtgatgcatagtgcggctagtcccacacaggcccctattctcaaccccagtatggtgactaatgaaggattgggactcactaccaccgcatccgggacagacatctcgagcaattccctgaaggattgtctgcctaagagtgcacagcttttgaagtccgtcttcgtgaaaaacgtggggtgggccactcagttaacttctggcgctgtgtgggtccagttcaatgatgggagccagcttgtggtgcaggcgggagttagctcaatcagctacacatcccccaacggacagaccacgagatacggagaaaatgaaaaacttccagactacattaaacagaaacttcagtgtctgagctccattcttttgatgttcagcaacccaacccctaactttcattag

SEQ ID NO: 30197 - DNA, 1752 bp, Artificial Sequence
  Description of Artificial Sequence: Synthetic coding sequence
atggcagcacgccgtcggaggtccacaggcggaggtagggctcgggcattgaacgaatccaagagagtcaacaatggcaataccgcccctgaggattccagcccggcaaaaaagacccgccgttgtcaaagacaggagtccaagaagatgccagtggccggaggcaaggcaaataaagaccggacggaagacaagcaggacggcatgcccggaagatcctgggcctctaaacgcgtgagtgagagcgttaaggccctgcttttaaaagggaaagcaccagtggatcccgaatgtacagccaaagtgggtaaggcccatgtttattgcgaaggtaatgatgtgtatgatgttatgctgaatcagaccaacctgcagttcaacaacaataaatactatctgattcagctgctagaagacgatgcccagcgaaacttctcggtgtggatgaggtggggccgtgtggggaagatggggcaacactcccttgttgcctgcagcggcaacctgaacaaagctaaagagatcttccagaagaaatttctggacaaaaccaagaacaactgggaggacagagagaagttcgagaaggtgccgggtaagtatgacatgctgcaaatggactacgctaccaacacacaggatgaagaagagacgaagaaggaagagagcctgaaatctccccttaaaccagaaagccagttagatctccgagtgcaagagctcataaagctgatatgcaacgtccaggctatggaagagatgatgatggaaatgaagtacaatacaaaaaaggccccacttgggaaacttacggtcgctcagattaaggccggatatcagagcttaaaaaagatcgaggattgtattagagcagggcagcacggcagagccctgatggaggcctgcaacgaattctatacccgcattccccatgatttcggattgcggacaccaccgttgatccgaacacagaaagaactaagtgaaaagatccagctcctcgaggctctaggtgacattgagattgcgatcaagctcgttaagaccgagcttcagtcccccgagcatccccttgaccagcactatcgcaacctgcactgcgcacttaggccactggaccatgagtcttatgagtttaaggttatcagccagtatttgcagagcactcatgcccctactcattccgactacaccatgacactgctggatctcttcgaagtcgaaaaggatggcgagaaagaagccttcagagaggacctgcacaaccggatgcttttgtggcacgggtctcgcatgagcaactgggtggggatcctgagccacggactgcgaattgctccacccgaagctcctattaccggctatatgtttggcaagggtatctactttgcggatatgagcagcaaatccgcaaactattgctttgccagtcgcctgaagaataccggactgctcctgctgtctgaagtggctctcgggcagtgcaatgagctcctggaggcaaaccccaaggccgagggcctgcttcagggcaaacactccaccaaaggcctgggcaaaatggctccctcctcagctcactttgtaacgctgaacgggtccacagttcccctcgggccagcatcagatacaggcattctgaaccccgacggctatactctcaactacaatgaatatatcgtgtataacccgaaccaagtgagaatgcggtatctcttgaaagtgcagttcaattttctgcaactgtggtag

SEQ ID NO: 30198 - DNA, 1713 bp, Artificial Sequence
  Description of Artificial Sequence: Synthetic coding sequence
atggccgctcgccgacgccgttccacaggaggaggcagagccagggcgctgaatgaatccaaacgcgtaaacaacgggaacacagctcctgaagacagttctcccgcaaagaagactcgtcgttgccagcgtcaggaatctaagaagatgccagtggctggaggcaaagcaaacaaggataggacagaggataagcaagacgagagtgtgaaggctctgctgctgaaagggaaagccccagttgatcccgaatgcaccgcaaaagttggcaaggctcatgtgtactgtgagggcaatgacgtatacgacgtgatgcttaatcagaccaatcttcagttcaacaacaataagtactacctaattcagctgctggaggacgacgcccaacggaatttctctgtgtggatgagatggggcagagtgggcaagatgggtcagcattcactcgtagcgtgctccggtaacctcaataaggccaaagaaatattccaaaaaaaattcctggacaagaccaaaaataactgggaagacagagaaaaattcgaaaaagtcccagggaagtacgatatgctccagatggattacgccaccaacactcaggatgaggaagagacaaagaaagaagaatcactgaagtctcctctgaagccagagagtcagttggacctgcgtgtgcaagagctgatcaagctgatctgcaatgtgcaggcaatggaggagatgatgatggagatgaagtataatacaaagaaggcccctctggggaaactgaccgtagctcagattaaagccggataccagtctctcaagaaaattgaagactgtattagagctggacaacatggccgtgctttgatggaagcctgtaatgagttttatacacgcatcccccacgattttggcctccgtacccctcccctaatccggacacaaaaggagttgtcagagaagatacagttgttagaggctctgggagacatcgaaatcgccataaagctggtgaaaacagaactgcagagtccagagcatccgttggatcagcattatagaaaccttcactgtgcccttaggcctctcgatcacgaaagttacgagtttaaggtgatcagccagtacttgcaatccactcatgcacccacacattcagactataccatgacattgctggatctattcgaggtggaaaaggatggggagaaagaggcctttagagaggatctgcataaccggatgcttctgtggcacggctcccgcatgtcaaactgggtcggcatattgagccacggactgagaatcgcacccccagaagctcctattacaggctacatgttcggtaagggaatctatttcgccgacatgtcttcaaagtcagccaattactgttttgccagcaggctaaagaacacagggcttctgctcctaagtgaggttgcactgggtcaatgcaacgaacttctggaggccaaccccaaagccgagggactcttgcagggcaagcactcaaccaaaggcctcgggaaaatggccccttcaagtgcccatttcgtcaccctcaatggatctaccgtccccctgggacctgcctccgatactggtattctgaaccccgatggatatactttgaactataatgaatacattgtgtataacccgaatcaggtccggatgcgatacctcctgaaggtgcagtttaacttccttcagttatggtag

SEQ ID NO: 30199 - DNA, 1623 bp, Artificial Sequence
  Description of Artificial Sequence: Synthetic coding sequence
atgtcgctgttgttccttgccatggccccaaaacccaagccatgggtgcagacagagggaccagagaaaaagaaaggacgccaggccggtagagaagaggacccttttcgctcaacagccgaggctctgaaagctattcccgctgaaaaaaggattataagggtggacccaacatgtcccttgtccagtaacccagggacccaagtctacgaggactacaactgtactctgaatcagaccaatattgaaaacaataataacaagttctatataatccagctcctgcaagacagtaacagatttttcacttgctggaatcactgggggagagtcggggaggttggacaaagcaaaataaaccactttaccaggcttgaggacgctaagaaagactttgaaaaaaagtttcgcgagaaaaccaagaacaactgggccgaacgggaccactttgtgtcccaccccggtaagtatacactaatcgaggtacaggcagaggacgaagcacaagaagccgtggtgaaggtggatcgtggtcccgttagaactgtcaccaaaagagtccagccatgttccttggaccccgctacccagaaactgatcaccaatatcttttctaaagaaatgttcaaaaacacaatggctttaatggacctggatgtgaaaaaaatgccgctaggtaagctgtccaaacaacagattgcacgcggtttcgaagctctagaagctttggaagaggctctcaaggggccaacagatgggggacagagcctcgaggagctgagctcccacttctatacagtgatccctcacaattttggacatagtcaacctccaccgattaactcgccagagctcctacaggctaagaaggacatgctgctggtgctagctgacattgagctcgctcaggcactccaggctgtgtccgagcaggagaaaacagttgaggaagtgccacaccccttagatcgcgactaccagttactgaagtgtcagctacagcttctagattcaggagccccagaatacaaggttatccaaacatacttagagcagaccggttcaaaccaccgatgcccaaccctgcagcatatttggaaggttaaccaggagggagaggaagatagatttcaggcccactctaagctgggaaaccgcaagctcctgtggcacggcacaaatatggctgtggtggcagccattttgacttcaggcctccggatcatgccacatagcggcggaagagtcggaaagggcatttatttcgccagtgagaactcaaagtccgcgggttacgttattggaatgaagtgtggagcccatcacgtgggctacatgttcctgggcgaagtggcccttgggcgagagcaccacattaacacagacaacccaagtctgaaatcacctcctccaggattcgacagtgttatcgcaaggggccacaccgaacccgacccaacccaggataccgagctcgagttggatggccagcaggttgtagttcctcaggggcaacctgtaccatgtcccgagttctcttctagcaccttcagtcagtcagaatatcttatctaccaggagagtcaatgtaggctgagatacctgttagaagtccacctttag

SEQ ID NO: 30200 - DNA, 1602 bp, Artificial Sequence
  Description of Artificial Sequence: Synthetic coding sequence
atggcgccaaagcctaagccatgggtccagactgagggaccggagaagaagaaaggtcgccaagctgggcgtgaggaggatccattcagaagtacagcagaggcattgaaagcaatcccggcagagaagaggataatacgagtggaccctacgtgtccgttaagcagcaaccccggtacacaggtgtatgaagattacaattgcactttgaaccagaccaatattgaaaacaacaacaataagttttatataattcagttgcttcaggattcaaaccggtttttcacctgctggaaccattggggtagagtaggagaagtgggccagagcaaaataaatcactttactcgcctagaggatgcaaagaaggatttcgagaaaaaatttagggagaagacaaagaataattgggcagagagggaccacttcgtcagccaccccggaaagtatacactgatagaagtgcaagcagaggacgaagcacaggaggcggttgtcaaagtggaccgagggccagtgaggacagtcacaaaacgggtgcaaccatgctccctggacccagctacccagaaactaattaccaacatattctcaaaggagatgttcaaaaacacaatggctttgatggatctggacgttaagaagatgcccctgggtaaactgagtaagcagcaaatagcaagagggttcgaagcccttgaagccctggaggaggcactcaagggccctaccgacggaggtcagtcattggaggaactgagctctcacttttacactgttattcctcacaactttggtcactctcagcctccacccattaatagtcccgagttgttacaagctaagaaagatatgctcctggttcttgccgatatcgaattggcccaagcactccaagcggtgtccgagcaggaaaaaaccgtggaagaagtcccgcacccgctagatcgcgattatcagctactgaaatgccagctgcagctccttgatagcggggcacctgagtacaaagtaatccagacatacttagaacagactggttcaaaccacagatgccctacgttgcagcacatctggaaggtcaaccaggaaggggaagaagatcggttccaggcacatagtaagctaggaaataggaagcttctttggcacggcaccaatatggccgttgtcgccgctatcttgacaagcggcctaaggatcatgccccactcggggggacgggtcggtaagggaatctactttgcatcagagaactccaagtccgcaggctacgtgattggaatgaagtgcggcgcacaccatgtgggctatatgttccttggcgaggtggcactaggcagagagcatcacatcaacactgacaacccaagcttaaaatccccgcctcctggcttcgacagcgtcatcgcacgcggacacacagagcctgacccaacccaggacaccgaattggagttggatggccaacaagtggttgtacctcagggccaaccagttccttgtcccgagttttctagttctaccttctctcagagcgaatatctgatctaccaggaatcgcagtgtcggctgagatacttactcgaggtgcatctgtag

SEQ ID NO: 30201 - DNA, 1602 bp, Artificial Sequence
  Description of Artificial Sequence: Synthetic coding sequence
atggcaccaaagcccaaaccatgggtacagacggaaggcccagaaaagaagaagggcagacaggctggcagagaggaagatccttttcgctcaacagccgaggcacttaaggctatcccagcagagaagaggatcattagagtcgatcctacctgtcccctgtcgagtaatccagggacccaagtgtacgaggactataactgtactttgaaccagaccaacatcgagaataacaataacaagttttacatcatacagcttttgcaagactctaatagattcttcacatgctggaatcattggggaagagttggcgaagtaggacagtcaaaaattaaccactttaccaggctcgaggacgctaagaaagactttgagaaaaaatttagagaaaaaacgaaaaacaactgggcagagagggatcattttgtgagccatcctgggaaatacacgctgattgaagtacaggcggaagacgaggcacaggaagcggtggtcaaggtggatcggggaccagtccgaaccgtgaccaaacgagtgcagccttgcagcttggaccctgctacccagaagctgattaccaacattttttcaaaagaaatgttcaagaacactatggcccttatggatctcgacgtgaagaagatgcccctcggaaagttgtccaaacagcagattgctagaggattcgaggccttggaggcgctagaagaggccctcaagggcccaacagatgggggacaatctctggaggagttgtcatcccacttctacaccgtcattcctcacaatttcggtcacagccagccacctcccataaatagtcctgagttgctgcaggccaaaaaggatatgcttctggtgttggcagacatcgagctggctcaggccctgcaagccgtgtccgagcaggaaaagaccgtggaggaagtcccccaccccctggatcgcgactaccagctgctcaagtgccaacttcagttgttagattctggtgcccctgagtataaggtgattcagacttacctcgaacagacagggtctaatcatcgctgcccaacccttcagcacatatggaaagtgaaccaggaaggggaagaagataggtttcaggcacattccaaactcggcaaccggaaactcctttggcatgggacgaacatggccgtggtagccgcaattctgacctcgggcttgcggatcatgcctcattccggtggaagggtggggaaaggcatctactttgcctcagaaaacagcaagagcgctgggtacgtgattgggatgaagtgtggagcacaccacgttggctatatgtttttaggtgaggttgccctcggacgagaacatcacatcaataccgacaatccttcattaaaatctcccccaccaggtttcgacagtgtcatcgccaggggccacaccgagcccgaccccacccaggacaccgagttggagctcgatggtcaacaggttgtggtgcctcagggccaacctgtgccctgtcctgagttcagcagtagcactttcagccagagcgaatacctgatctaccaggagtcccaatgtcgcctgcgatacttgctggaggttcacctgtag

SEQ ID NO: 30202 - DNA, 999 bp, Artificial Sequence
  Description of Artificial Sequence: Synthetic coding sequence
atggcccctaagcctaagccttgggtccagaccgagggtccagaaaaaaagaaaggccgtcaggctggtcgggaagaggatccgtttaggagcactgccgaggctctgaaagctattccagctgagaaacgcataatcagggttgatcctacgtgtccgctttccagcaaccctggcacccaggtttacgaggactacaattgtactctcaatcagacaaatatagagaacaataacaataagttttatataatccagttgcttcaggactctaatcgtttcttcacttgttggaatcactggggaagggtgggtgaggtgggccagtccaagattaaccatttcacgcgcctggaggacgccaagaaagattttgagaagaagttccgcgagaagacaaaaaataactgggcagaacgcgaccacttcgtcagtcatccaggaaagtatacccttatcgaggtgcaggcagaggatgaggcgcaggaggctgttgtcaaggtggacaggggccctgtgaggacagtcacaaaacgtgtgcaaccctgctccctggaccctgccacccagaagctcatcacgaacatctttagcaaggaaatgtttaaaaatactatggccctgatggacctggacgtaaaaaagatgcctctgggcaagctgagtaagcagcaaatcgctcgtggattcgaggctctcgaggcccttgaagaggctctaaaggggccaaccgatggcggtcagtctcttgaagagttgtcaagccatttttataccgtgattccccacaacttcggacacagccaaccacctcctatcaacagccctgagttgctccaagctaagaaggatatgctccttgtactggccgacattgagctagctcaggctttgcaggcggtttcagagcaggagaaaaccgtcgaggaagtacctcatcccctggacagagattaccagctattgaaatgtcagctccagctgcttgactctggttag

SEQ ID NO: 30203 - DNA, 5174 bp, Artificial Sequence
  Description of Artificial Sequence: Synthetic coding sequence
atggtcatggggattttcgccaattgtatcttctgcttaaaggtcaagtatctcccgcagcagcaaaaaaaaaagctccaaacagacataaaagagaacggaggtaaattttcattctctctgaatcctcagtgcacccatattatattggacaacgcagatgtactgagtcagtatcagctgaactccattcagaagaatcacgttcacatcgctaatcccgacttcatttggaaatccatacgagaaaaacggctcttggacgttaagaactatgacccctacaaacctctggacatcacacctccgccagatcagaaagcttcgtcgagcgaggtgaaaacagaaggcctatgccccgattccgcaacagaagaggaggacactgttgagctcaccgaattcggaatgcagaatgttgaaatccctcatctgccacaggacttcgaggtggccaagtacaacacgctagaaaaggtgggaatggaaggcggacaggaggccgtcgtagtggagctgcaatgcagtcgcgactctcgcgactgccctttccttatttcatcacacttccttctggatgatggtatggagacacgtaggcagttcgccatcaaaaagacaagtgaagatgcatctgaatactttgaaaactacatcgaggagttgaagaaacagggattcctgcttcgggaacacttcactcccgaagcaactcagctcgcctcggagcagctacaggcactgctgcttgaggaagtgatgaacagttcgacactatctcaggaggtgtcagacctcgtggaaatgatctgggccgaagccctgggccacctggaacacatgctgttaaaaccagttaaccgcatttccctgaatgatgtgagcaaggccgaggggatcctcctgctggtgaaggccgcattgaaaaatggagaaaccgccgagcagttgcagaaaatgatgaccgagttttatcggctgattcctcataaagggacaatgcccaaggaggtgaacctcggattactggccaaaaaggcagacctatgtcagcttatcagggatatggtgaacgtgtgtgagactaacctgtctaaacccaaccccccatctctcgctaagtaccgcgcactgcggtgcaagatcgaacacgttgagcaaaataccgaggaatttttgagagtaagaaaggaggttctgcagaatcatcacagtaaatcaccagtcgatgttctccagattttccgagtcggcagggtgaacgagactactgagttcctttccaaactgggcaatgtccgcccattgttacatggtagccctgtgcaaaacatagttggtatcttgtgccgcggacttctccttcccaaggtcgtggaggatagaggagttcagagaactgacgtgggtaatctgggctctgggatttattttagcgactcgctttcaacctccatcaagtactcccaccccggagagaccgatggcactaggctgctgctgatctgtgatgtcgcgctgggcaagtgtatggatctgcacgagaaggattttagtcttactgaggcgccacctgggtacgactcggttcacggggtaagccagaccgcgtctgtaaccaccgatttcgaggatgacgagtttgtggtctataaaaccaaccaggtgaaaatgaaatacattatcaaattcagcatgccaggagaccagatcaaggattttcatccttctgatcataccgagcttgaggagtatagacccgagttctcaaacttctctaaggtggaagattaccagcttcctgacgccaagacatcaagcagcactaaagcaggactccaggacgccagtgggaatctcgttcctctggaagatgtccacattaaaggccgaatcattgataccgtggcccaggtgatagtctttcagacttatactaacaagtcccacgtgcctattgaagccaagtatatctttcctctcgacgacaaagccgctgtctgcggcttcgaggcctttattaatggtaagcacatcgttggtgagatcaaggagaaggaggaagcccagcaagagtacctggaggccgtgacacaaggacatggcgcttatcttatgtctcaggatgccccagatgtatttaccgtgagtgtaggcaacctgccaccaaaggcaaaagtgctaatcaagatcacttatatcacagaactgtcaattctgggcacagtgggcgtcttttttatgcctgccacagtggctccatggcagcaagacaaagccctgaacgaaaacctgcaggacactgtggagaaaatttgcattaaagagattgggaccaagcagtctttttctctgaccatgagcatcgagatgccttatgtcattgagttcatcttttccgatacccatgaactcaaacaaaaaagaactgattgcaaagctgttatatccaccatggagggaagctctctggattcttctggattttcactgcatatcggtctttcagctgcttatctcccccgtatgtgggtggagaagcacccggagaaagaatcagaggcatgtatgttagtctttcagcctgatcttgacgttgatctgcccgacttggccagcgaaagtgaggttattatctgtctagattgttcctccagcatggaaggggttaccttcttgcaagccaagcagatcgccctgcatgcactcagcttggtgggtgaaaagcagaaagtgaacatcattcagtttggaactggatataaggagctatttagctaccccaagcatataacatctaacacaatggctgcggagtttatcatgtctgccacgcccactatgggcaatactgacttctggaagactctgagatatttgagcctgctttatcccgcaagggggagtaggaacattctcctggttagtgatggccaccttcaggacgaatctttgacactgcaacttgttaagcggtctcgaccccatactcgcctgttcgcgtgcgggatcggaagtacggcaaataggcacgttctcagaatcctttcacaatgtggggcaggagtatttgaatactttaacgctaagagtaaacattcttggagaaaacagatcgaagatcaaatgacccgattatgttctccctcttgccactccgtgtcagtcaaatggcaacaactaaatcccgatgttcccgaggccctgcaggctcctgcccaggtgccttcccttttcttaaacgatcggctcctggtgtatggcttcatccctcattgtactcaagctacactgtgtgccctgatccaggagaaggagttccgcaccatggtcagtacaacagaattacagaagacgactggcaccatgatccacaaattagcggcacgggctctgatcagagactacgaggacggcatcctacatgagaacgagaccagccatgaaatgaaaaagcaaaccctgaagtccctgataatcaaactgagtaaagaaaacagcctgatcactcagtttacaagtttcgtcgcagttgaaaaacgggacgagaatgagtctccttttccagacattcccaaagtgagcgagctgatagccaaggaagacgtggattttctgccttatatgtcctggcaaggagagccccaggaagccgtgagaaatcagtccctgctggcaagcagcgagtggcccgagttgcgcctctccaagcgtaaacaccgtaagatcccgttctcaaaaagaaagatggaactgagccaacccgaggtatctgaagactttgaggaggacggcctgggcgtcctccccgctttcacatccaacttggaaagggggggtgtggaaaagctgttagacctctcttggaccgagtcttgcaagcccactgccactgagcctctctttaagaaagtatccccctgggagacatcgacctcaagcttttttcccatcttggcccctgccgtcgggtcctacttgcctcctacagcgagggcacatagccccgcttctttatcctttgcctcttatagacaggtagcctcattcggttccgctgcaccaccacgtcagtttgatgcatcccagttcagccaaggcccagtgcctggcacctgtgccgactggatcccgcaatccgcgagttgtccgaccggcccaccccagaatcctccctctagcccctactgtgggattgttttctcaggcagttccctctcgtccgcccagagcgctccactacagcacccagggggatttactacccgcccttccgccggaacgttcccagagctggacagcccccagctgcatttttctctcccaacagacccagatccaattcgaggttttggcagctatcacccttccgcatcttctccctttcattttcaacctagtgcagccagcttgactgcgaacctccggcttcccatggcttctgccctgcctgaggcactttgcagtcagtcaaggactactcctgtggatctttgccttctggaggagtctgtgggtagcctggaaggtagcaggtgtccagtgttcgcatttcaatctagtgacactgagtctgacgagctttccgaggtcttgcaggattcatgctttctgcagatcaaatgcgacactaaggatgatagtatactctgtttcctggaagtgaaagaggaggacgaaatcgtgtgtatccaacactggcaggatgcagtcccctggaccgagctgctgtctttacagacagaggacggattttggaagctgacgcccgaactcgggttgattctgaatcttaatacaaacgggctgcactccttcttaaagcagaagggaatccagtccctgggggtgaagggcagagaatgtctgctggacttgatcgccactatgctggtgcttcaatttatacgtactagactggaaaaggaaggaatagtttttaaaagtctcatgaagatggacgatgcatcaatctccagaaacattccctgggccttcgaggctattaagcaggctagtgagtgggttcgtaggactgagggccagtacccgagcatttgtcccaggctggaattgggtaacgactgggactccgcaactaagcagttgcttgggctacaacccatctcgacggtgtctcccctccacagggtccttcactattcgcagggcta

SEQ ID NO: 30204 - DNA, 1911 bp, Artificial Sequence
  Description of Artificial Sequence: Synthetic coding sequence
atgaatccttcagctcctagctaccctatggcgtcactgtatgtgggcgatctgcatcccgatgtgaccgaagccatgctttacgagaagttctccccagcaggaccaatattgtctattcgtgtttgtcgcgacatgatcactagaaggagcctcggatacgcatacgtgaacttccaacagccggctgacgctgagcgtgccctagacacaatgaacttcgacgtgattaaaggtaagccagtgaggattatgtggtcacagcgggatccgtctcttaggaaatccggagtgggaaacatctttattaagaaccttgataaatctattgataacaaagcactgtacgatacattctccgcatttggaaatatcctttcttgtaaggtagtgtgcgacgagaatgggtccaaaggttatggctttgttcatttcgagacgcaggaggctgcagagcgcgctatcgagaaaatgaatggtatgctcctgaacgatcgcaaggtctttgtaggtagattcaaaagccgcaaagaacgcgaagcagagctcggggctcgtgccaaagagtttacgaatgtgtacatcaagaactttggagaggatatggatgacgagagattaaaagatctgttcgggaagtttgggcctgccctgagcgtgaaggtgatgactgacgagagcggaaagtccaaaggtttcgggttcgtctcatttgagaggcatgaagatgcccagaaagccgtggacgagatgaatggcaaggagctgaatggcaaacagatctacgtgggtagggcacaaaaaaaagtggaaaggcagacagaactgaagaggaagtttgagcagatgaagcaggacagaattacccggtaccaaggtgtcaacctgtatgtcaagaacttagacgacggcatcgacgacgagcgactgcgcaaagaattcagccctttcggtaccattacctctgcaaaagttatgatggagggtgggaggtctaaaggatttggttttgtgtgcttctcttcccccgaagaggccaccaaggccgtaacggaaatgaacggcagaatcgtggcaacaaagcccttgtacgtcgctctcgctcaacggaaggaggagcggcaggcccatctgacaaaccagtacatgcagcgcatggcgagcgtgcgcgcagtcccaaatcccgtgatcaacccatatcagcctgctccaccgtccgggtactttatggctgccataccccagacacagaacagagcagcttattatccgccatctcagatcgcccagcttagaccctctcctcgatggaccgcacagggcgcaaggcctcacccgttccagaatatgccgggagcaattaggcctgcagccccacgtcctccgttctcaacaatgcgcccagcttcctcccaggtgcctcgtgtaatgtctacccagcgcgtggctaatacatccactcagaccatgggcccaaggcctgcagcagcagcagctgcggctactcccgctgtacggaccgtgccacagtataaatacgccgctggagtgaggaatccacaacagcatctgaatgcacagccccaggttacaatgcagcaacctgcagtgcacgtgcaaggccaagaacctctgaccgcctcaatgcttgctagtgcccctccccaggagcagaagcaaatgttgggagagaggttgtttcccctgatccaggctatgcatccaacgctcgccggaaagatcactgggatgctgttggagatagacaattctgaactcttacatatgctcgagtccccggaatccctccgctccaaggtggacgaggcagtggccgttcttcaggcacatcaggccaaggaagcagcccagaaagctgttaattccgcaaccggtgttcctacagtttag

SEQ ID NO: 30205 - DNA, 1644 bp, Artificial Sequence
  Description of Artificial Sequence: Synthetic coding sequence
atgaatcccagcgccccaagttacccgatggcaagcctttatgttggagatctgcatcctgacgtgaccgaggcaatgctgtacgaaaagtttagtccagccggaccaatcctgtccatcagagtctgtcgcgacatgattacccggaggtccctggggtatgcttacgtcaacttccaacaaccggcagatgccgagagagctctagacaccatgaactttgacgtcatcaagggcaaacccgtgaggataatgtggtctcagagggacccgtcgttgcgtaaatccggcgtcgggaatattttcatcaagaacctggacaagtctatcgataataaggccctgtacgacacattttcagcctttggcaacatcctgtcatgtaaggtcgtctgtgatgagaatggctctaaaggttacggttttgtccatttcgaaacacaggaagccgcagaaagagctattgagaaaatgaacggaatgcttctgaatgatcgcaaagtctttgttggacgctttaagagtaggaaggagagagaagccgagctgggggctagggccaaagagttcactaatgtctacatcaaaaactttggagaggacatggacgatgagcggctgaaagacctgttcggaaagttcggccctgccctatcagtcaaagtcatgacggacgagtcaggcaagagtaaagggtttggctttgtctcatttgagcgccacgaagatgctcagaaagcagtggatgagatgaatgggaaggaactgaacgggaaacaaatttatgttggacgcgcacagaagaaagttgagcggcagactgaactgaagagaaagtttgagcagatgaaacaggaccgcattactagataccaaggggtcaatctgtacgtcaaaaatctggatgatgggatcgacgacgagcggctccgcaaggaattttcccccttcggaacgattaccagcgccaaggtcatgatggagggaggacgcagcaaaggcttcgggttcgtgtgcttttcgtcccccgaagaggccactaaggcagttacggagatgaatggaaggatagtggccaccaagccactttacgtggcactggcccagaggaaggaagaaagacaggcacatctgaccaatcagtacatgcagcgaatggccagcgtcagggccgtgcccaacccagtcataaatccctatcagccagcccctccatctggttacttcatggcagccatcccacagacacaaaatagggcagcatattaccccccttctcaaatcgcacaactgcggccttccccaagatggaccgcccagggagcaaggcctcaccctgccgttcacgtccagggacaagaacccctgactgcttctatgttggcgtcagcccctcctcaggagcagaaacagatgctgggcgaacgccttttccccttgatccaggcgatgcacccgaccttggccggaaaaatcaccggaatgcttctggagatcgacaattccgagcttctgcacatgctcgaatcacccgaaagccttcgatccaaagtggatgaggcggtcgcagtgttacaagcccaccaagctaaggaagcagcccagaaggccgtgaatagcgcaacaggggtcccgacagtgtag

SEQ ID NO: 30206 - DNA, 129 bp, Artificial Sequence
  Description of Artificial Sequence: Synthetic coding sequence
tgaatgctggagtcccctgagagtctgcgctccaaagtcgacgaggccgtcgccgtacttcaagcccaccaggctaaggaggcagcccagaaagcagtgaactcagctactggtgtgccaaccgtgtag

SEQ ID NO: 30207 - DNA, 117 bp, Artificial Sequence
  Description of Artificial Sequence: Synthetic coding sequence
atgaacccgtccgcaccgagctaccctatggcctctctgtacgtcggtgaccttcaccctgacgtgactgaagctatgctctacgagaagttctcacccgcaggccctatcctgtag

SEQ ID NO: 30208 - DNA, 357 bp, Artificial Sequence
  Description of Artificial Sequence: Synthetic coding sequence
atgaatcctagcgctccaagctacccgatggcttccctttatgtgggagacctccaccctgatgtaaccgaggcaatgctgtatgagaagttctcacccgctggccctattctcagtatccgtgtttgtcgggacatgattacccgacgttccctgggatacgcctacgtcaattttcagcagcccgcagatgctgaacgggctctggataccatgaatttcgatgtgattaagggtaaacccgtgaggatcatgtggtctcagcgggacccaagcctgagaaaatcgggtgtgggcaacatcttcattaagaatttggacaagagcatagataataaagccctgtacgatacttag

SEQ ID NO: 30209 - DNA, 132 bp, Artificial Sequence
  Description of Artificial Sequence: Synthetic coding sequence
atgaatccctccgcaccctcataccccatggccagcctgtatgtgggcgacctccaccctgacgtgacagaagccatgctatacgagaagttctccccagctggaccgatcttaagcatcagggtgtgttag

SEQ ID NO: 30210 - DNA, 510 bp, Artificial Sequence
  Description of Artificial Sequence: Synthetic coding sequence
taggcatccagccaagtgcccagagtgatgtcaacccagcgtgtagcaaataccagcacgcagaccatgggccctaggccagctgcagctgcagccgctgctacccccgctgtgcgcaccgttccacagtataagtacgcagccggagtgcggaatcctcaacagcacctgaacgcacagccacaggtgacaatgcagcagcccgcagtgcatgtccaggggcaggagcccctgacggcttctatgcttgctagcgccccacctcaagaacaaaaacagatgctgggggaaagactgtttcctctgattcaggccatgcaccctacactggctggcaagattactggtatgctgttagagattgacaactcagagttgttacacatgttagagagtccggaaagccttaggtccaaggttgatgaggcggtagcagtgctgcaggcacaccaagccaaagaagctgcacagaaagccgtgaacagtgctaccggggtgcccactgtgtag

SEQ ID NO: 30211 - DNA, 186 bp, Artificial Sequence
  Description of Artificial Sequence: Synthetic coding sequence
atgaacccctctgcacctagctaccccatggcctccctctacgtaggggaccttcacccagatgtgacagaagccatgttgtacgaaaaatttagtcccgctggaccaattctcagcattagggtatgtagggacatgatcacaaggcgttccctggggtatgcatatgtgaattttcaacaatag

SEQ ID NO: 30212 - DNA, 390 bp, Artificial Sequence
  Description of Artificial Sequence: Synthetic coding sequence
atgaatccttcggctccctcttatccaatggcctcactctatgttggtgacctgcatcccgacgtcactgaggccatgctgtatgagaagttttcccctgccggacccatcttgtccatccgcgtttgccgtgatatgataacacgaaggagcctgggttacgcctacgtgaatttccagcagccagcagatgccgagcgagctctggacaccatgaattttgatgtgataaagggtaaacccgtgaggattatgtggagccagcgcgaccctagcctcaggaagagcggagtggggaacatcttcataaagaacctcgacaagtcaatcgataataaagcgttgtacgatacgttcagtgcctttggtaatattctgtcctgcaaatag

SEQ ID NO: 30213 - DNA, 552 bp, Artificial Sequence
  Description of Artificial Sequence: Synthetic coding sequence
atcagacccgctgccccacgtccacctttcagtacaatgcgaccggcttcgtctcaggtgcccagggttatgagtactcagcgtgtcgcgaatacaagcactcagactatgggcccacgccctgcagccgctgctgctgccgcaactcctgctgtgcgcaccgtccctcaatacaagtatgcagcaggagtgcgcaacccccagcagcacctgaatgcccagccccaggtgacaatgcaacagccagctgtgcatgttcaggggcaggagccactgacggctagtatgctcgcatctgcacccccacaagaacagaaacaaatgctgggagagcggctgttcccactgatccaggctatgcaccccacgttagcagggaaaatcactggaatgctactggagatcgacaactctgaactactccacatgctggagtctcctgagtctctgagaagcaaagtggacgaggcggtggctgtcttgcaagcccatcaagcgaaggaggctgctcagaaagctgttaacagcgccaccggagtgcctacagtttag

SEQ ID NO: 30214 - DNA, 228 bp, Artificial Sequence
  Description of Artificial Sequence: Synthetic coding sequence
atgaatcctagcgccccttcctaccctatggccagcctctatgtgggagacttgcaccccgacgtcaccgaggccatgctttacgaaaaattcagtcctgcaggacctatcttgagcatccgggtttgccgggacatgatcacgagacgaagccttggttatgcctacgtgaacttccagcagccagctgacgcagaacgggcactggatacaatgaatttcgactag

SEQ ID NO: 30215 - DNA, 1008 bp, Artificial Sequence
  Description of Artificial Sequence: Synthetic coding sequence
atgagcaagagaaaggccccacaagaaaccctgaacggcggaattaccgatatgttgacagagctggctaacttcgagaaaaacgtttctcaggcaatccataagtataacgcttatcgcaaagcagcctctgtgattgcaaaatatccacataagataaagtcaggtgctgaggccaagaagctgccaggcgttggaacgaagatcgctgaaaaaatcgacgaattcttagccactggcaaactccgcaagctcgaaaagattcgtcaagatgacacttcctcaagcatcaactttctaacacgggtgagcgggataggcccttcggctgcaagaaagttcgtggatgaggggattaagaccctcgaggatttgaggaagaacgaggataaactgaatcatcatcagcggataggcttgaaatacttcggagacttcgagaagagaatccccagggaagagatgctgcagatgcaggacatagttttgaacgaggtcaagaaggtggattcagaatacatagccacagtctgcggctcttttagaagaggcgcagagtcttccggcgatatggatgttttactaacgcacccttcatttacaagcgagagtacaaagcagcctaaactgcttcatcaggtcgtagaacaattgcaaaaagtacactttattaccgatacattgagcaaaggagaaactaaattcatgggggtctgtcagctcccatctaagaacgacgagaaagagtaccctcaccggagaatcgatatccggttaatcccgaaagatcagtactactgcggggtgctctacttcacaggtagcgatatcttcaataaaaatatgagagcccacgcgttggaaaaaggcttcaccattaatgaatatactatccggccactgggcgtgacaggggtggcaggagagcctctgcctgtggattctgagaaagatatctttgattacatccaatggaagtaccgggagcctaaggatcggagcgaatag

SEQ ID NO: 30216 - DNA, 720 bp, Artificial Sequence
  Description of Artificial Sequence: Synthetic coding sequence
tgaggcgacttcgagaagcgcatccccagagaggagatgctacaaatgcaggatatagtcttgaatgaggttaagaaagttgatagcgagtacattgctaccgtctgtggaagctttcggagaggcgcagagtcttcaggcgacatggacgtattattaactcatccttctttcaccagcgagtccacaaaacagccaaagttgttgcaccaggtggtggaacagctgcagaaagtccactttattaccgacaccttgagcaaaggcgagaccaaatttatgggcgtctgccaattaccatctaaaaatgacgaaaaagaataccctcatcgcagaatcgatataagactgattccaaaagaccagtattactgtggagtcctatacttcacagggagcgacatcttcaacaagaacatgcgagcacatgcattagagaaagggtttaccatcaacgagtacactatccgtcctctgggcgtaaccgttctgcaagccactagggaggacttgatgcacaatatgctgcttggcccacagctgaaggctattaaggagctgcaggaaaacccctgtcagtggattgtgaagaaaacctcactgatcaccagcagcgggaacacgggtaatccaaggacaggcgctaatgaggcttgtattcttcctggaagacataaccccattggcgtgttaatctattttctcacatttgccatgtag

SEQ ID NO: 30217 - DNA, 843 bp, Artificial Sequence
  Description of Artificial Sequence: Synthetic coding sequence
atgagcaagagaaaagctccgcaggagactttgaatggcggtatcacggacatgttaaccgagctggctaactttgagaaaaacgtttcacaggcaatccacaagtataacgcataccgaaaggctgccagtgtcattgctaaatacccacacaaaatcaaatctggagccgaagcaaagaaactgcccggtgtgggaaccaagatcgctgagaagattgacgagttcctcgcaacaggcaaacttcgaaagctcgagaagatacgacaggatgatactagtagctccatcaatttcctgaccagagtgtccggtattgggccatccgctgcaagaaaattcgttgacgaagggataaaaaccctggaaggcagccagctggactcatgtcccgtgaagggccatttaaacgggaccgaatcgcttttggacttgatctgggacgtaatgacaatcttgaagctgaaaaacgcagacctcaggaagaatgaagacaaattgaatcatcaccagagaattggactgaagtactttggtgacttcgagaaaagaattcccagggaagagatgctgcagatgcaagacattgtactcaacgaagtgaaaaaagtggactcagagtatattgccacggtgtgtggctcatttcgacgcggagcggagtcctctggcgacatggatgtgctcctgacccatcctagctttacgagcgagtccacaaagcagccaaagctactccatcaagtcgtcgaacagctgcaaaaggtacactttatcaccgacacactgtctaaaggcgaaactaaatttatgggcgtgtgccagcttccatcaaaaaactag

SEQ ID NO: 30218 - DNA, 714 bp, Artificial Sequence
  Description of Artificial Sequence: Synthetic coding sequence
tgagaaaagatcgatgaatttctggcaactggtaaattgcgcaaactagagaaaatccggcaggatgatacatcctcttctattaattttttaacgagagtatccggtattggaccaagcgcagccagaaagtttgtggatgaggggatcaagaccttagaagatcttcgcaagaacgaggacaagctcaatcaccaccagcgaatcggcctgaagtacttcggcgattttgagaaaagaatcccaagagaggaaatgctacaaatgcaggatatagttctaaatgaggtgaaaaaagtggactccgagtacatcgctactgtctgcggttcctttagacgcggagccgagtcatccggagacatggacgtgcttcttacccatccatcttttaccagtgaaagtacaaagcagggggtgtgtcagctgccctcaaagaatgacgagaaagagtaccctcacagacgaatcgatatccgcctgatccctaaggatcagtattattgcggggtcctctacttcacaggaagcgacatctttaataaaaacatgagagctcacgccctggagaagggcttcaccataaatgaatatactattagacctttaggggtaacaggcgtggccggagaaccgctgcccgtggacagtgaaaaggacatcttcgattacatccagtggaagtatcgggagcccaaagacagaagcgaatag

SEQ ID NO: 30219 - DNA, 546 bp, Artificial Sequence
  Description of Artificial Sequence: Synthetic coding sequence
atgctccagatgcaagatatcgtgctgaacgaggtgaaaaaggtggactcagagtacatagctacggtatgcggcagcttcaggagaggcgctgagtcaagcggcgatatggatgttctactcacacacccctcattcacctccgagtctaccaaacagcctaagctcttacatcaagtggtcgaacagctgcagaaagtccactttattaccgataccctgagcaaaggagaaaccaagtttatgggtgtgtgccagcttccaagtaagaatgacgaaaaggagtatccgcacaggaggattgacatccgtctgatcccgaaagatcagtattactgcggcgtcctctacttcactggttctgatatctttaacaaaaacatgcgggcacacgctttggaaaaagggttcactatcaacgagtatacaatcaggccactcggtgtgaccggggtcgcgggagagcccctgccggtggactccgagaaagacatattcgattacatccagtggaagtatcgggagcccaaagaccgaagcgaatag

SEQ ID NO: 30220 - DNA, 1728 bp, Artificial Sequence
  Description of Artificial Sequence: Synthetic coding sequence
atggacccacgaggcatcctaaaagcctttcctaagcgacagaaaattcacgcggatgcatcctctaaagtgcttgccaagattcctagacgggaagaaggcgaggaagccgaggagtggttgagttctctgcgcgctcacgtcgtcagaaccggtattgggagagcaagggcagagctgttcgaaaagcagatcgtccagcacgggggacagttatgccctgcccaaggacccggagtgactcacatcgttgtcgacgagggaatggattatgagcgcgcactacgcctgttgcgcctccctcaactcccccctggcgctcaattagtcaagtccgcctggctttcattgtgcctccaggaaagaaggttagttgatgtggctgggtttagcatctttatacccagtagatatctggaccatccgcagccttcaaaggccgaacaggacgcttctatcccaccagggacacacgaggccctgctgcagactgctctcagcccccctcccccacctaccaggcccgtgtcccctcctcagaaggccaaggaggctcctaacacacaggcccagccaatctctgacgatgaggccagtgacggagaagaaacacaggtcagtgccgctgacctcgaagcgctgatcagcggccactatcctaccagcctcgagggagactgtgagccttccccagcccctgccgtgctggacaaatgggtctgcgcccagccatcttctcagaaagcaaccaaccacaatctacacatcaccgagaaactcgaggtgctggctaaggcatacagcgtacagggcgacaagtggagagcactgggctacgccaaggctatcaacgcgctcaagtcttttcacaaacccgtgaccagctaccaggaagcctgtagtatccctggcataggtaagaggatggctgagaagataatcgagatactcgagtccggccatttgagaaaactcgaccatatttccgagtctgtgccagtgttggagctgttctccaacatctggggcgctggcacaaagaccgcccaaatgtggtaccaacagggcttccgaagcctggaagacatcagaagccaagcctccctcactacccagcaggcaatcgggctaaagcactattctgattttctcgaaagaatgcctcgcgaggaagccaccgagattgagcaaaccgtacagaaggccgctcaggcttttaattcggggctgctctgcgtggcctgcgggtcttaccgacgagggaaagctacttgcggagacgtcgacgtcctgatcacacatcctgacggcagatctcacagggggatcttttcccgactactggatagtctcaggcaggagggctttttgaccgatgatcttgtctcgcaggaggagaacggccaacagcagaagtatttgggagtttgccgcctgccaggtcccggaaggcgccatagaagattagacattatcgtcgtaccatactctgagttcgcctgcgcacttctttactttacaggaagcgcccactttaatcgtagtatgcgggctctggccaagaccaagggcatgtctctgagtgaacacgctctgtctaccgccgtcgtgcgaaacacacacggttgcaaggtaggcccagggagagttctgccgacccccacagagaaagatgtctttcgcctcctgggactaccttatcgagagcctgccgagcgcgattggtag

SEQ ID NO: 30221 - DNA, 897 bp, Artificial Sequence
  Description of Artificial Sequence: Synthetic coding sequence
atgcaccaccagaagtatttgcaacggttcctcggtggcaagcgagagaaaaaacagaaggaggcttgtagtatcccgggtattggtaaaagaatggccgaaaaaattattgaaattctggaaagcgggcacctgcggaagctcgatcacatttccgagagtgtcccagtactggagttattcagcaatatatggggggctgggactaaaacggcacagatgtggtaccaacagggctttcgtagcctcgaggatattagatcacaagcatcattgactacacagcaggccatcggactgaagcactatagtgattttttagagaggatgccacgagaagaggctaccgaaatagagcaaactgtccaaaaggcagcccaagcttttaactcagggctcctttgtgttgcgtgcggatcctaccgccgtgggaaagcaacctgtggagacgttgatgtgctaatcacacacccggacggccgatcccaccggggtatcttctctcggttattagattcgctcagacaggaggggtttttaaccgacgatcttgtctcacaagaggagaacgggcagcagcaaaaatacctaggggtgtgtcgtctccctggccctggcagacggcatagacgattggatattatcgttgtgccatatagtgagttcgcctgtgcccttctctattttactggctccgcccacttcaatcgctccatgcgggcactggctaaaacgaaaggtatgagtctttcagaacacgctctgtctaccgccgtggtgcgtaatacccacggatgtaaggtggggcctggcagagttctgccgacccccaccgagaaggacgtcttcagactgttgggcctcccctacagggagccagccgaacgagattggtag

SEQ ID NO: 30222 - DNA, 1548 bp, Artificial Sequence
  Description of Artificial Sequence: Synthetic coding sequence
atggatccccgaggcattctgaaggcttttcccaaacggcagaagattcacgccgatgccagctctaaagtcttagctaaaatacctaggagagaggagggtgaagaagcagaagagtggcttagctctctgcgcgcacacgtcgtgcgtacaggtataggcagggctcgcgcagagctgttcgaaaaacagattgtgcagcacgggggacaattgtgtcctgcccagggtcccggagtgacccatatcgtggtcgacgaaggcatggattacgagagagcactaaggcttctgaggttgccacagctccctccaggagcgcagttagtaaaaagtgcatggctgagtctgtgcctgcaggaacgtcgcctagtggacgtggctggattctccattttcattccttcaagatacttagaccatccacagccatcaaaggccgagcaggacgcaagcattccacccggtacacacgaggcgctgcttcaaacggccttaagccctcctccacctccaacacgccctgtctccccgccacagaaggccaaggaggccccaaatacccaggctcagccaataagcgacgacgaggcgtcagacggcgaagagacgcaggtgtctgccgcagacctggaggccttaataagcggacattatcctacatcactggaaggcgattgcgaaccgtctcctgcgcctgccgtgctggataaatgggtctgcgcacaacccagcagtcagaaggccaccaatcataatctacatattactgaaaagctcgaggttctggctaaggcctacagcgtgcagggggacaaatggcgcgcactgggatacgctaaggcgatcaacgctctgaagtcttttcacaaacccgttacaagctaccaggaagcctgctccatcccgggaattggcaagcgtatggccgagaaaatcatcgaaatcctcgaatccggacatctacggaaattagaccacatctcagagtccgttcctgttctggagctgttttccaatatctggggcgctgggacgaaaactgctcagatgtggtaccagcagggattccggagcttagaggacatccggtctcaggccagcctgaccacgcagcaggccattggtctaaaacactacagtgatttcctggaacggatgcctagggaagaagccaccgagatcgaacagaccgtgcagaaagccgcacaagcatttaattctggtctgctgtgtgtggcctgcgggtcctacagacggggaaaggctacgtgtggtgacgtcgacgtgcttatcacacatcccgatggtaggagccataggggtattttctccagactgctggactccttgcgtcaggagggcttcctgactgacgatttggtgagccaggaggagaacggccagcaacaaaagtacttgggagtgtgccgtctgccagggcctgggcgtagacaccgtcggttagacatcattgtggttccctacagtgagttcgcctgtgcgctccaggggggagcttggccatccgcagcccatagccactag

SEQ ID NO: 30223 - DNA, 903 bp, Artificial Sequence
  Description of Artificial Sequence: Synthetic coding sequence
atgcttatgcaccaccaaaaatacttacagcggttcctgggaggcaagcgagagaaaaagcagaaagaagcatgctcaatacctgggattggcaaacggatggcggaaaaaattattgaaatcttggaatcggggcatcttcgtaagttggaccatatcagcgagtccgtaccggtactagagctattttcgaatatttggggggctgggactaagactgctcagatgtggtaccagcagggattccggagcctagaggatattcggagtcaggcttcactgactacgcagcaggcaatagggctgaaacactacagcgatttcctggaaaggatgcctagggaagaggcgacagagatcgagcagaccgtgcagaaagcagctcaggccttcaactccgggttgctatgtgtcgcctgcggcagctacagacgcggaaaagcaacgtgtggagatgtggacgttctgatcacacatccagatggacgctcacatcgcggaatcttctctagactcctggattccctgcggcaggaaggattcttgacggacgacctcgtgtctcaggaagagaacgggcagcagcagaagtacctgggagtgtgtagactcccaggccctggccgtaggcacagacgcctggacattatagtggtgccctactctgaattcgcttgcgcattgttgtattttacgggaagcgcgcacttcaataggtccatgcgagccctcgcaaagacaaaaggtatgtctctgtctgaacatgcattgtccaccgctgtggtgagaaatacccacggatgtaaggtggggccaggaagagtgctgccaacgccaacagaaaaggatgtttttaggctgctggggctaccctatagagaacctgctgagcgggactggtag

SEQ ID NO: 30224 - DNA, 1728 bp, Artificial Sequence
  Description of Artificial Sequence: Synthetic coding sequence
atggacccaagaggtatactgaaagctttccctaaaaggcagaagatccacgcggacgcttcatccaaagtgctggctaaaatccctcgaagggaggagggcgaggaggcggaagagtggctgagcagcctgagggctcatgtggtccgtactggaatcggcagagccagagctgaactctttgagaaacagatcgtacagcacggaggccagctgtgtccagcccagggacctggggtgactcatatagtcgtcgacgagggtatggattatgagagagcactcaggctcctgagactgccgcaactgccacccggagcacaacttgtcaaatccgcttggctctctctgtgtctccaggagcggagactggtggacgtggctggcttctccatctttattccttctagatatttagatcatccccagccctccaaagcagaacaggacgcttccataccgccaggaactcatgaagcgctcctccagactgccctctcaccaccgcctccgcctaccagaccagtgagccctccacagaaagctaaggaggcaccaaacacccaggctcagcccatcagcgatgatgaagcaagcgacggcgaagagactcaggtttcagccgctgacttagaggcccttatttcgggacactatcccacctcacttgagggggactgcgagcccagtcctgcgcctgccgtcttggataaatgggtgtgtgctcagccctcaagtcagaaagcgacgaaccacaacctacacattaccgagaaactggaagtactggccaaagcctactccgtgcagggggataagtggagggccctgggttatgccaaggccataaacgctttgaagtctttccacaagccagttacctcataccaagaggcttgttctatcccaggcattgggaaacgtatggcagagaaaattatagaaatcctggagtctggccacctcagaaagcttgatcatatatctgaaagtgtccctgtcctcgagttattctccaatatttggggcgcaggtaccaaaaccgcccagatgtggtatcagcagggtttcagaagtctggaggacatcagatctcaagcctcattgacaacacagcaggcaatcggactcaaacactatagtgatttcctggaacggatgcctagggaggaggctaccgagatcgagcaaacggtccagaaagcagcccaggcattcaattcaggcctgctatgcgtagcttgcggatcctatcgccgagggaaagctacctgtggcgacgttgatgtcctgatcacccacccagatgggaggtcccatagagggatcttctccaggcttctggatagtctgaggcaggaaggctttctaacagatgacctcgtgtcccaggaggaaaacgggcagcagcagaaatacttgggcgtgtgtcgcctgcctggaccgggtcgccgacataggagacttgacattattgtagtgccctactccgagtttgcctgtgcgttgctctacttcactggctccgcacatttcaacagatctatgcgggcactagctaagaccaagggcatgtccctgtcagagcacgccctgagcaccgcagttgttcgcaatactcacggatgtaaagtgggcccaggtcgtgtgctgcctaccccaaccgagaaagacgtgtttcgcctgctggggctcccctacagagagcctgccgagcgcgattggtag

SEQ ID NO: 30225 - DNA, 516 bp, Artificial Sequence
  Description of Artificial Sequence: Synthetic coding sequence
atggattacgagcgcgctctccggctgctgcgcctaccacagctcccccctggcgctcaattggtgaaaagtgcctggttgagcctgtgtctccaggagcgaaggctcgtggatgtcgccggtttctcaattttcatcccatcaagcccttcccttatgatgaaacccgtcatgggcaaaaaacccagattagttcagctgatctggaaaccttcgagcgtcgctaccacccccccaccactcagagagatcgtctccctcgcccaaccactcctaagctggattagcgggtcagtccatagcccacaggctagacgccgacctatcacaacgtccattagtcagcggtcatggaagttttggccgaaaccaacagtattccgggaaacaagcggcggaccatgggcgatgcctcgcccaagtatgccaagccgcgcttctatcagcctcagtccaaggacacgcagacctgctgtgagtttgggcctgggatctgggtggctcagaaaatcttag

SEQ ID NO: 30226 - DNA, 747 bp, Artificial Sequence
  Description of Artificial Sequence: Synthetic coding sequence
atggaggctttgtgtgtgtgctctctgatgcccctccactggtcttggatactgaccgccagccacctggctgcgttctttcaaggcttccgatccctggaagatatccgatcacaagcctctctgaccactcagcaagctattgggctcaagcactactctgactttctggaaagaatgcccagggaagaggcaactgagattgaacagactgtgcagaaggccgctcaggctttcaattcggggctgctgtgcgtcgcttgtggaagctaccggcgaggtaaagcgacctgtggcgacgtcgacgtgcttataacacaccctgatggccgttcacaccggggaattttcagccgactcctggactccctccgccaggaggggtttttgacggacgatctcgtttcccaggaggaaaacggacagcagcaaaagtatctgggagtatgccgtctgcctggacccggtcgcagacacaggcggctggatatcatagtagtgccatattctgaatttgcctgtgctctgctttattttacaggtagcgcccactttaaccgaagcatgcgggcattggctaaaactaaaggtatgtccctttcagaacatgcgctcagcacagccgtcgtgagaaatacgcatggatgtaaggtgggccctggcagagtcttgcccacacctaccgagaaggatgtttttcgcctcctcggcctgccatatcgtgaaccagctgaacgcgactggtag

SEQ ID NO: 30227 - DNA, 1728 bp, Artificial Sequence
  Description of Artificial Sequence: Synthetic coding sequence
atggatcccagagggattctgaaggccttcccaaagcgacagaaaatccacgccgatgcatcctcaaaagtgcttgccaagatccctagaagagaagagggtgaagaggctgaggaatggctcagtagcttaagggcacacgtggttaggacaggaatcggcagagcaagggcagagttgtttgagaaacaaatcgtgcaacacgggggacagctctgcccggctcagggccctggtgtgacgcacatcgtggttgacgagggaatggattatgagcgcgctttgagactgctgcgccttccccagttacccccaggagctcagttagtgaagtctgcatggctgagtttatgccttcaggagcgtcgcttagtggatgtggcgggattttcaatatttattcccagcagatacctggatcacccacaaccctctaaggccgagcaagatgcctccatcccacccggaacccatgaggctcttctgcagaccgccctgtcccctcctccccctcccacgaggcctgtgagcccaccacagaaagccaaagaagcacccaacacccaggctcagcctatttctgatgacgaagccagcgatggggaggagacacaggtcagcgccgcagatctggaagcactgatatctggtcactatcccacctccctggagggggattgcgaacctagtccagcccctgccgtgctggataaatgggtgtgcgctcaacccagcagccagaaggccaccaatcacaacctgcacatcaccgagaagttagaggtgctcgctaaggcatactccgtccagggcgacaagtggcgcgctctgggatacgccaaagcaataaacgcgttgaagagtttccacaaacctgttaccagttatcaggaggcttgcagcatacctggcataggcaaaagaatggctgagaagatcatcgagattctggagagcgggcaccttaggaagctcgaccacattagcgaaagtgtgccagtactagagctgttcagcaatatctggggagccggaacaaaaacagcccaaatgtggtatcaacagggcttcagatccctcgaggacatccgcagccaggctagcctgacaactcagcaggcgattgggctgaagcactacagcgacttcctggagaggatgccgagagaggaggcgacagaaattgaacagacggtccaaaaggcggctcaggcctttaattcgggactgctctgtgtcgcctgtggcagttacaggcgagggaaagccacttgcggggatgtagatgtgctgatcacccacccagacggccgatcacatagaggtattttttcgagattgctggactctctgcggcaggaaggtttcttgacagacgatttggtcagccaggaagagaacgggcagcagcagaaatatcttggcgtgtgccgcttgcctggcccaggtcggcgtcaccgcagattggatatcatcgttgtcccgtattctgagtttgcctgcgccctgctgtacttcaccggcagcgcgcatttcaacaggagcatgagggcgctcgctaagacaaagggtatgtctctgtcagagcacgccctgagcacggccgttgttcgcaacacgcacgggtgtaaggtgggcccaggacgggtactgcctacaccaaccgagaaagatgtattcagactccttggcctgccctatcgagagccagcagaacgcgactggtag

SEQ ID NO: 30228 - DNA, 1464 bp, Artificial Sequence
  Description of Artificial Sequence: Synthetic coding sequence
atggactacgaaagagcactgcggctcctgaggctacctcagctgcctcctggcgcacagctggtgaaaagtgcttggctctctctgtgtctccaagagcggaggctcgtcgatgtggccggtttttccattttcataccctctcggtatctggaccatcctcagccaagcaaagctgagcaagacgcatcaattccacccggaacccacgaagctctcttgcagacagctcttagtcctcccccaccccctactagacccgtctctccaccacagaaagccaaggaagctcctaatacccaggcgcagcctattagcgacgatgaggcctccgatggcgaggaaactcaggtgtcagctgcagatctcgaagctcttattagcgggcattaccctacttccctggagggggactgcgagccctctcccgctcccgcagtgctggacaaatgggtctgcgcgcagccttcatctcagaaggctacgaatcacaacctccacattacggagaaacttgaggtcctggcaaaagcatactctgtgcagggcgacaaatggagggctttgggttatgcaaaagccatcaatgccctgaaatcatttcacaagcccgtgaccagttaccaggaagcctgctccattcctggcatcggaaaacgcatggctgaaaagataatcgagatcctggaatctgggcacctgcgtaaactcgatcacatcagtgagtccgtacccgtgctcgagctcttttctaatatctggggagccggaaccaagactgctcagatgtggtaccagcagggattcagatctctggaagatatccgctcacaggcttctctgactacccagcaagcaatcggcctaaaacattattcagacttcttggagcgcatgcctcgggaagaggcaaccgaaattgagcagaccgtacagaaggccgctcaggcattcaattcaggccttctctgtgtagcctgcggctcttatcgacgaggcaaagccacttgtggagacgtcgacgtgctgataacacaccctgatgggaggtctcacagaggcatcttctcacggctcctcgactccctccgccaggagggattcttaacagacgacttggtgtcccaggaagagaacgggcagcaacaaaagtaccttggtgtgtgcagactgccagggccagggaggcgtcatcgcaggctggacatcattgtcgtgccttactctgaattcgcttgtgccctgttatacttcacgggctcagcccattttaaccgttctatgcgggctctcgcgaagactaaaggaatgtctctgtcagagcatgctttatctacggctgttgtccgaaatacgcatggctgcaaggtcggtcctggccgagtcctgccaactccaaccgaaaaagacgttttccggctgttagggctgccttaccgagagcccgcagagagagattggtag

SEQ ID NO: 30229 - DNA, 1548 bp, Artificial Sequence
  Description of Artificial Sequence: Synthetic coding sequence
atggaccccagagggatcctgaaagccttccccaaacgacagaagattcatgcagatgcatcctcaaaggtgctcgctaaaatcccccgacgggaagaaggtgaagaagccgaggaatggctgtcttccctccgcgctcatgtggtccgaaccggcatcgggagagccagagcagaactatttgagaaacagatcgtgcaacacggcggacagctgtgccccgctcagggtcccggtgtgactcacatcgtcgtcgatgagggtatggactacgaaagggctttgagactgctgagactgccacagctgccgcctggcgcacagctcgtgaagtccgcctggcttagcctgtgcctgcaggagcgcaggctcgttgacgtagccggattcagtattttcattccgtccaggtacctggatcatccacagccatccaaggccgaacaagacgcatctatcccacccggtactcacgaggctctactgcagactgctctgagccctccccctcccccaacccgacctgtcagtccaccgcagaaagctaaagaggcacccaacacgcaggctcagccgatttcagatgacgaggcctccgatggggaagagacccaagtctctgccgcagatctggaggctctgattagtggacactaccccacgtcactggaaggggactgtgaaccctctcccgcacccgcagtgttggacaagtgggtgtgtgctcaaccgtcctcccagaaggccacaaatcacaatctgcacataactgagaagctcgaggtccttgcaaaggcttattctgtgcaaggggacaagtggcgcgctctggggtatgctaaggctatcaatgcgctgaaatcatttcacaaacctgtgacttcataccaggaagcctgcagcatccctggaattggcaagcgcatggcagagaagattatagaaattctcgaatccgggcacctgaggaaattagaccatatctcagaatcagtccccgtcttagagttattctcgaatatttggggggctgggaccaaaaccgcccagatgtggtaccagcaggggtttaggagcttggaggacatccgatcccaggcctccctaaccacacagcaggcaattggcctcaaacactattccgacttccttgaaagaatgccccgtgaagaagcgaccgagattgagcagacggtccagaaggcggcacaggcctttaactcagggctgctctgtgtggcgtgtgggtcttacagacggggaaaagcaacttgtggggacgttgatgtcctgatcacgcacccggatgggaggagtcatcgcggaattttttctaggttactggacagtctccggcaggagggcttcttaactgacgatctggtgagtcaagaggagaacgggcagcaacagaagtatctgggggtctgccgactcccgggtcctggtcgtaggcaccgccgattagacatcattgtagtaccttacagtgagttcgcttgtgcgttgcagggaggagcttggcccagtgcggcacattcccactag

SEQ ID NO: 30230 - DNA, 810 bp, Artificial Sequence
  Description of Artificial Sequence: Synthetic coding sequence
atggacccccgagggatcttgaaagctttcccgaagcggcagaaaatccatgccgacgcgagtagtaaagtgctggccaaaattcctcgcagggaagagggggaagaggcggaggaatggctcagctcgctcagagcacacgttgtgcgcacaggaataggcagagccagagctgagctgtttgaaaagcagatcgtccaacatgggggtcaactgtgcccagcgcagggcccaggagtgactcatatcgtcgtggacgagggcatggactacgaaagggccttacggctgctgagattgccgcagctccctccaggcgcacaactcgtaaagagcgcgtggctgtcactgtgcttgcaggaacgacggcttgtcgacgtggcgggtttctctatctttatcccctcaaggtacctcgatcatccacagcctagcaaagcagagcaggatgcttctatccccccagggacgcacgaggccctgctccagactgcactatcccctcccccaccgccaacgagaccagtgtccccaccacaaaaagcaaaagaggccccaaatacacaagcccagcccatctcagatgacgaagccagcgatggcgaggagacacaggtatccgcagctgacttggaggccctgatcagcgggcactatcctactagccttgagggcgattgcgaaccctcccccgcacctgcggtccttgacaagtgggtgtgcgcccagccctcaagtcagaaggctaccaaccataatctgcatataacggaaaaattggaagttctagcaaaggcttatagtgtctag

SEQ ID NO: 30231 - DNA, 1413 bp, Artificial Sequence
  Description of Artificial Sequence: Synthetic coding sequence
atggatcccaggggcatattgaaagcctttcctaaaagacaaaagatccatgctgacgcatcaagtaaggtgctggctaagataccaaggcgggaagaaggggaagaggccgaggagtggctgagctctctcagagcgcacgtggtgagaaccggtatcggccgagctagggcagagctctttgagaagcaaatcgtccagcacggcggacagctctgccccgcacaaggccctggcgtgacccacatagtggtagacgaagggatggactacgagcgcgctttgcggctcctccgtctgcctcaattgccaccaggcgcacaactggtcaaaagcgcttggttgtcgttgtgcctccaggagcggaggctggtagacgtggctggctttagcattttcatccctagccgctatctggaccatcctcagccatccaaggctgagcaggatgcctccatccctccgggtactcatgaggcactattgcagaccgccctgtctcctccccctcctcctacccgaccagtctccccaccgcagaaagctaaggaagccccaaatacccaggcccagccgatctctgatgacgaggccagcgacggagaggaaacccaagaggcctgtagcattcctggcatcggaaagcggatggctgagaaaattatagaaattctagaatcgggtcatttacgcaagctggatcacatctcagagtcagtgcctgtgttagaactgttcagcaatatatggggggcagggactaagacggcccaaatgtggtatcagcaggggttccgcagcctggaagacataagatctcaagccagcctcaccacccagcaggctattggcctgaagcattattctgatttcctggaacggatgccacgcgaagaagcaacagaaattgaacagacagtccaaaaggctgcacaggcatttaattctggcctgctgtgcgtggcttgcggttcatacaggagaggcaaggccacatgcggtgacgttgacgtcctgatcacgcatccggatggacgtagtcatcgtggaattttctcacgattactagacagcctgcggcaggaagcagttccgtcggtgggccctgggttccttacagacgacctggtgtctcaggaggagaatggacaacaacagaaatacctcggcgtctgccgccttcccggaccgggacgtcgacatcgtagattggacattatcgtagtgccctattcagagtttgcttgcgcccttctgtattttactggtagcgcgcacttcaaccgtagtatgagggcacttgctaagactaagggaatgtcgctgagtgagcacgctctctccaccgccgtcgtgagaaatacccacgggtgcaaggttggcccaggcagggttttacctaccccgacctag

SEQ ID NO: 30232 - DNA, 1005 bp, Artificial Sequence
  Description of Artificial Sequence: Synthetic coding sequence
atggatcctcggggaattcttaaagccttccctaaacggcagaaaatccacgccgatgcgagttccaagccctcctgcgcttcagctcttcggtgcctctgccctgaaagcgatattggggcagacagcgcgtgccccggaccggctgagtggctctcctccctgcgcgcacatgtggtccgcactggcattgggagggcacgggctgagctgttcgaaaagcagatcgtgcaacacggagggcagctctgtccggctcagggcccaggagtcacacacatcgtcgtggacgagggcatggactacgagcgcgctctgcggctcctgagacttccccaactccctcccggagctcagctggtgaagagtgcatggctcagcctttgcctccaggagagaaggttagttgatgtggctggatttagcatttttatcccttcacgttacctcgatcatccccaaccatccaaagcagagcaggacgcctccatcccccctggcacccacgaggcccttctccagacagcgctgagtccaccacccccaccaacacggcctgtctccccccctcagaaggctaaggaagctcctaacactcaggcacaacccatcagtgacgatgaggcttctgatggtgaggaaacgcaggtgtctgccgctgatctggaagcactcattagcggacactaccccacctcattggaaggagattgcgaacctagccccgctcccgctgtccttgataagtgggtctgcgcccagccaagcagccaaaaggcaacgaaccacaacctgcatattaccgagaagttggaggtgctggcgaaggcatatagcgttcagggcgacaagtggcgggctctgggatacgccaaagccatcaatgctctgaaatcttttcataaacccgtgacatcataccaggaggcatgttccattccaggtatcggaaaaagaatggctgaaaaaatcattgaaattctcgaatcaggccacctcaggtag

SEQ ID NO: 30233 - DNA, 657 bp, Artificial Sequence
  Description of Artificial Sequence: Synthetic coding sequence
atgcaccaccagaaatacctgcaaaggtttttggggggaaaaagagagaagaagcagaaagaggcttgtagtattcctggtattggcaaacgtatggctgaaaagatcattgagatacttgaaagcggccacctccgcaagctggatcacatttctgagtcagtgcccgtgctagagctgtttagcaatatctggggagccggaactaaaaccgctcagatgtggtatcagcagggcttccgctctcttgaggacatcagaagccaggcctctctcacaactcaacaggcaattggcttgaagcattatagcgactttcttgaacgaatgccaagagaggaagcaacagagattgaacagacggtgcaaaaagctgcccaagcattcaactcgggtctgctgtgtgtggcctgcggatcctacaggcgaggtaaggcgacttgtggcgatgtcgacgtgctcataacccatcccgatggacgcagtcatcgcggtattttctctagactgctcgactctttgaggcaggaggggtttctcacagatgacctggtgagtcaagaggagaatggacagcaacagaaatacctcggagtgtgtcgactacccggaccaggacgccgtcataggcgtctggacatcatcgttgtgccctag

SEQ ID NO: 30234 - DNA, 567 bp, Artificial Sequence
  Description of Artificial Sequence: Synthetic coding sequence
atggatccaagaggtatacttaaagcatttccaaagcgacagaagatccacgccgatgcttcttccaaggtactcgcaaagatccccagacgtgaggagggcgaagaggccgaggagtggctgtcctcactacgtgcccatgtcgtgcgcactggaattggcagggcacgagctgagcttttcgagaaacaaattgtacagcacgggggacagctctgcccagcccagggtcccggagtgacacacattgttgtagatgagggtatggattacgagcgcgctcttagactgctcaggcttccacaactgcctccgggagcacagctggtcaaaagtgcgtggctgtcactgtgtctgcaagaaagacgcctggtggacgtggcaggcttctccatttttattcccagtaggtatctcgatcaccctcagccgtcaaaagccgaacaggacgcaagtataccgccaggcacacacgaagccctattacagaccgcgctgagtcctccacctccgcctacacggccagtttcacccccacagaaggccaaggaagctcctaacacgtag

SEQ ID NO: 30235 - DNA, 516 bp, Artificial Sequence
  Description of Artificial Sequence: Synthetic coding sequence
atggattatgagcgcgcactgcggctccttcgcctgcctcagctgccacctggcgctcaactcgtcaaatccgcatggctgagtctgtgtctgcaggaaagaagactggtggatgtcgcaggcttttcaattttcattccttcctccccaagcttaatgatgaagcctgtaatgggtaagaaaccccgtctggttcagcttatatggaaaccgagctccgtggcaaccactcctcccccactaagagaaattgttagccttgcccagccattgctctcttggatcagtggcagcgtccacagtcctcaggcccgaaggcgacccatcactacctccattagtcaaagatcttggaaattctggcctaagcctacggtatttcgcgagacgagcggtggaccctgggctatgcccaggcctagtatgcctagccgggcttcaatatcattgagcccgaggacccggaggccagcagttagtcttgggttagggtctggctggctgcgtaagagctag

SEQ ID NO: 30236 - DNA, 459 bp, Artificial Sequence
  Description of Artificial Sequence: Synthetic coding sequence
atggactacgagcgcgctttgcgtttgcttagattacctcagctcccacctggtgctcagttggtgaaatctgcctggttatctctgtgtctgcaggaacgccgtctggtggatgtggccggattcagcattttcatcccatcctcccctagcttaatgatgaaacctgtcatgggcaagaagccaaggctcgtgcagctgatctggaagccttctagcgtggcgaccactccaccccctctgcgcgaaatagtgagtctggcccagcccctgctctcgtggatcagtggctcggtccattctccccaggccagaagacgccctatcacaacctccatttcccaaaggtcctggaagttctggcctaaaccgaccgtattccgggaaacctccggcggtccttgggccatgccccgaccgtctatgcccagcagagcgtcaataagtctgtccccctag

SEQ ID NO: 30237 - DNA, 939 bp, Artificial Sequence
  Description of Artificial Sequence: Synthetic coding sequence
atgcatcatcagaagtaccttcagcgtttcctaggcggaaaaagggaaaagaaacaaaagccgatcagcgacgacgaggccagcgatggagaggagacccaggaagcctgcagcattcctggtatcggcaagcgcatggctgagaagattatcgaaatattggagtcagggcacttgagaaagctagatcatatcagcgaatcagtgcccgtgctcgaattgttcagtaacatatggggcgctggcaccaaaactgctcaaatgtggtatcagcagggtttcaggtctctcgaggatatccggtcgcaggctagcctgacaactcagcaggccattggcttgaagcattacagtgatttcctggaaagaatgcccagagaggaagccaccgagattgagcaaacagttcagaaggcagcgcaggctttcaattctggcctgctgtgcgtggcctgcggatcttaccgtcgtgggaaagctacctgtggtgatgtggatgttctgatcactcatcccgatgggaggtcacaccgcggaattttttcgaggttactggatagcctaagacaggaggggttcctgaccgatgacctggtcagccaggaggagaacgggcagcaacagaaatacctcggagtctgcagactccctggcccaggacgacggcatcgtcgactggatataattgtggtcccatattcagagttcgcttgtgctctgctctacttcacaggtagtgctcacttcaacaggagcatgcgggctctggccaagacaaaggggatgtccctgagcgaacatgctctgagtacggccgtggtgagaaacacacacggctgtaaagtcgggccaggtcgcgtcctccccacacccaccgaaaaagatgtctttcgcctgctaggcctcccctaccgtgagcccgcagagagagactggtag

SEQ ID NO: 30238 - DNA, 1401 bp, Artificial Sequence
  Description of Artificial Sequence: Synthetic coding sequence
atggccgaccagctgtacctcgaaaacatcgatgagttcgtgacagatcaaaacaaaattgtgacctacaaatggttaagttacaccctgggagtccatgtcaaccaggcaaagcagatgctttacgactacgtagaaagaaagagaaaagaaaactccggggctcagctacacgtaacatatctcgtgtccggctcgctgatacagaatggtcatagctgccataaggtggcagttgttagggaggataaactggaagcggttaaatccaagctggcagtgactgccagcatccatgtgtattctatccagaaggcaatgttgaaggatagcggccctctgtttaataccgactacgatattcttaagtctaacctacaaaattgctccaagttcagcgccatccaatgcgcagccgcagtgccgagagccccagcggagtcaagctccagcagcaagaagtttgagcagtcccatctgcatatgagttcagagacgcaagcaaacaacgagctgaccaccaacgggcatggaccacctgcctccaaacaggtgtctcagcaaccaaaaggcattatgggaatgtttgcctccaaggccgcagcaaaaactcaagaaaccaataaggaaactaagaccgaagcgaaagaggtgacaaacgcctcagccgctggcaataaagctcccggaaaaggcaacatgatgtccaatttctttgggaaggccgcaatgaataaatttaaggtcaacctcgattctgagcaggcagtcaaagaggagaaaatagtagaacagccaacggtgtccgttacagagcctaaactggctaccccagctgggttaaagaaaagtagtaaaaaggctgagcccgtcaaggttctgcagaaagagaaaaagcgtgggaagagagtcgcgttgtctgatgatgaaaccaaggagaccgagaatatgcgcaaaaaacgcaggaggatcaaactccccgagagtgacagctctgaagacgaggtgtttccagattcaccaggtgcgtacgaagccgaatctccatcaccccctcctccgccatcacccccacttgagccagtgcccaagacggaacccgagcctccatctgtgaagagctcttccggggagaataaaagaaagcggaaaagagtgttgaagagcaaaacatatctggacggcgagggttgcattgtcaccgaaaaagtatacgagtcagagtcatgtacagactcagaggaggagctgaatatgaaaacatcctccgtccacaggccccctgcaatgactgtgaaaaaggaacctcgcgaagaacgaaaggggcctaagaagggcaccgccgctctgggcaaggccaatcgtcaggtgtcgataacaggatttttccaaaggaagtag

SEQ ID NO: 30239 - DNA, 1284 bp, Artificial Sequence
  Description of Artificial Sequence: Synthetic coding sequence
atgctctatgactatgtggagagaaagaggaaagagaacagcggtgcacagctccacgtgacatacctcgtcagtggatccctaattcaaaacgggcattcatgtcacaaggtggccgtagtacgggaagacaaattagaagccgtgaagtcaaagttagcggtgaccgcgtctattcatgtctatagcatccagaaggctatgctgaaggatagcggtccgctgttcaatactgattatgacattctgaaatccaatctccagaattgctcaaagttcagcgccatccagtgcgcggcagcagtcccaagggcacccgctgagtcttcgtcttccagcaagaaatttgagcagagtcacctacatatgtcatccgagacacaggccaacaatgagctgacaacgaacgggcacggcccacctgctagcaagcaagtctcccagcagcccaaagggattatggggatgttcgctagtaaagccgcagctaagactcaagagactaataaggagaccaagaccgaagccaaagaagtaaccaatgcgagtgcagccggaaacaaagccccagggaaaggcaatatgatgtcgaatttcttcggcaaagcagccatgaacaagttcaaagtgaatctggacagtgagcaggctgttaaagaagaaaaaatcgtggagcagccaactgtcagcgtgactgaaccaaaacttgcaaccccggctgggcttaagaagtccagcaaaaaggccgagccagtgaaggtccttcaaaaggagaagaaacggggaaagagagtcgccttatccgacgacgagaccaaggaaacggagaatatgaggaagaagaggaggcggatcaagctgccagagtccgactcttccgaggacgaagttttccccgacagtcctggcgcatacgaggcagagtctccaagcccgcctcccccaccatcaccaccgctagagcccgtccctaaaacggagccggagcctcctagcgtcaagagttcttcaggcgaaaataaaagaaagcggaaacgagtgctgaaaagtaaaacgtatttggacggggagggttgtattgtcaccgagaaggtttacgagtccgagtcgtgtacagacagcgaggaggaactgaatatgaaaacgtcatccgtgcatcgcccacccgcaatgaccgtgaagaaggagccacgagaggagagaaaaggacccaagaagggcaccgctgctttgggcaaggctaacaggcaggtatccattaccggtttttttcagagaaaatag

SEQ ID NO: 30240 - DNA, 1083 bp, Artificial Sequence
  Description of Artificial Sequence: Synthetic coding sequence
atgctgaaagatagtggaccacttttcaatactgactatgacattctcaagagtaacctccagaattgcagcaaattttctgcaattcagtgtgccgctgcagtgcccagagcacccgctgaatccagtagctcctcaaagaaattcgagcaaagccatctgcatatgagctccgagacccaggcgaataatgagctgaccaccaatgggcacggcccaccagctagtaaacaggtgagtcaacaaccaaagggtatcatgggaatgttcgccagcaaggctgcggctaaaacacaagagacaaacaaggagaccaagaccgaagctaaagaggtcactaacgcctctgccgcaggaaacaaggcacctggaaaaggaaatatgatgtccaactttttcggtaaggccgcaatgaacaaattcaaagttaacctggactccgaacaggctgttaaggaggaaaagatcgtggagcaacccactgtgagcgttaccgagcctaagctggcaactccagcagggctgaaaaaatcctctaagaaggccgaacccgtgaaggtactgcaaaaggagaagaagaggggcaagagagtagccctctctgatgatgagacgaaagaaaccgagaatatgagaaaaaaacgccgaaggatcaagctgcccgagagcgattccagtgaggatgaagtgttccccgatagtcctggagcctatgaagccgagtccccctcgcctccgccacccccttcaccaccactcgagcccgtccctaaaaccgaaccagaaccaccgagtgtaaagtcttcctccggtgagaataagcgtaagcgaaagagagtcctcaagtcaaaaacctacctcgatggagaaggctgcattgtaacagaaaaggtctatgagtccgagagctgtactgattcagaagaggagctgaatatgaagacgtcgtccgttcacagaccacccgctatgaccgtcaagaaggaaccacgggaagaaagaaagggtcccaaaaagggcactgcagcccttggaaaggctaacaggcaagtcagcattacaggattctttcaaagaaagtag

SEQ ID NO: 30241 - DNA, 804 bp, Artificial Sequence
  Description of Artificial Sequence: Synthetic coding sequence
atggcggatcagctctacctagagaatattgacgaattcgtgaccgatcagaacaagatcgttacatacaagtggctatcgtataccctcggagtgcatgtcaaccaagcgaaacagatgctatacgactatgtcgaaaggaagagaaaggaaaactctggcgcacagctgcatgttacctatttggttagtggttctctcatccagaatgggcattcctgtcataaggtggccgtggtgcgggaggataagctcgaggctgtgaagagcaaactggccgtgaccgcgtcaatccacgtctacagtatccagaaagcaatgctgaaggactcagggcctctcttcaacacagactatgacattctcaaatctaatctgcagaattgttcgaagttttctgcgattcagtgcgcagctgctgtccccagagcaccggctgaaagctcttcatctagcaaaaaatttgaacagtcacacctgcatatgtcatctgaaacacaagccaataatgagctcacgacaaatgggcacggccctcccgcatcgaagcaggtttcacaacagccgaagggaattatgggcatgttcgcttccaaagctgctgcaaagacccaagagaccaacaaggagacaaagactgaggctaaggaggtaacgaacgcctcagccgctggcaataaagctcctggcaagggtaacatgatgtctaacttttttggtaaagcagcaatgaataaatttaaagtcaacctggactctgagcaggcagttaaagaagagaagatcaaagagaagaaacggtag

SEQ ID NO: 30242 - DNA, 1566 bp, Artificial Sequence
  Description of Artificial Sequence: Synthetic coding sequence
atgggggaagtggaggcgcctgggagactgtggttggaaagtccgccaggcggagcccctcctatctttcttccttccgatggacaggctctggtgcttggcaggggtcctctcacacaagtcacagaccggaagtgttcgcgcactcaggtggagctcgtagccgatcctgagacccgaactgtggccgttaaacagctcggggtgaatccatctacaactggcacacaggagctgaaacccggtctcgaagggtccctgggggtcggtgacactctgtacttggtgaatgggctgcacccgcttactctcagatgggaagagacacgaacacctgagtctcaaccggatacccccccagggacacctcttgtgtcacaggatgaaaagagagatgcagaactccctaagaagagaatgcgaaagtccaatcccggttgggaaaaccttgaaaagctactcgttttcacagccgctggggtcaaacctcagggcaaagtcgctggattcgacttggacggcaccttgattacaaccaggagcgggaaggtgtttcccaccgggccaagcgattggagaatactttacccagagatcccaaggaagctcagggaactggaggcggagggttataaacttgtcatcttcactaatcaaatgtccattggcagaggcaagcttcctgccgaggagttcaaggccaaggtcgaggcagtggttgaaaagctgggggttcctttccaggtccttgtcgccactcatgctggtttataccggaagcccgtgaccggcatgtgggaccacctgcaggaacaagccaacgacgggactcctattagcattggagactctatctttgtaggagatgcagccggtcggccagccaattgggcccctggaaggaagaaaaaggatttcagctgtgccgatcggttgtttgcactcaatctcggactccctttcgctacccccgaagaattctttctcaaatggcccgcagccggattcgagctaccggcattcgatccacgaacagtgtcccggtccggcccactctgtctcccagaatcccgtgccctgttgagcgcttcacccgaagtcgtggtggcagtcggctttcctggtgccggaaagtcgacatttctaaagaagcacctggtctcggccggatatgtgcacgttaatagggacacactcggttcctggcaacgctgcgtgacaacctgcgaaaccgccctaaagcaggggaagagggtcgccatcgacaataccaaccctgatgccgcttctcgtgctcgctatgtgcagtgcgccagagctgctggagtgccatgtcggtgcttcctctttacagccaccctcgagcaggcgcgacacaataataggttcagagaaatgactgactctagccacattccagtctcggatatggtgatgtacgggtaccgcaaacagtttgaggctccaacactggccgagggcttctctgcgattctggagatcccgttccggctgtgggtggaacccaggcttggtaggttgtactgccagttctcagagggttag

SEQ ID NO: 30243 - DNA, 699 bp, Artificial Sequence
  Description of Artificial Sequence: Synthetic coding sequence
atgttgggtgcaatgttccgggctggcactcccatgccaccaaacctaaattcccaagggggagggcattattttatcgacagggatggaaaggcctttcgtcacatcctcaacttcctgagactcggccgactagatcttcctcgtggatatggagagaccgccctccttagagctgaagcagacttttaccagatcagacccctgctcgacgctctgcgggaactggaggcttcccagggcacacctgcacctaccgccgcattgttacacgcagatgtggacgtgagccctcgcttggtgcactttagcgcccgacggggacctcaccattacgaactttccagcgtgcaggtggacacttttagggctaatcttttttgtaccgattccgaatgtctgggggctcttagggcgaggtttggtgttgcctccggggatagggctgagggttcaccgcattttcacctcgagtgggccccaaggccggtggaacttcccgaagtggaatacggacggctagggttacagcctctgtggaccggcggaccaggcgagagacgggaagtggttgggacccccagtttccttgaggaggttctgagggttgctttagagcacgggtttcgcctggattctgtctttcccgaccccgaggacctgctaaattcgaggtccctcaggtttgtcagacattag

SEQ ID NO: 30244 - DNA, 5157 bp, Artificial Sequence
  Description of Artificial Sequence: Synthetic coding sequence
atgaaccaaaatacaaccgaaccggtggccgctacagaaaccctagctgaggtgccagagcatgtgctgaggggcttgcccgaggaggtgcgactgtttccaagtgctgttgataaaacaagaatcggtgtctgggccaccaagcccatcctaaaagggaagaaatttggacctttcgtgggcgataagaagaagcgctcacaagtcaagaacaacgtgtacatgtgggaggtgtattatcccaatctcgggtggatgtgcatcgatgcaacagatcctgagaaggggaactggctccgatacgttaattgggcgtgctccggtgaggaacagaatctgttcccgctggaaataaatagagccatctattataagacactgaagcccattgcgccaggggaggagctgcttgtgtggtataatggcgaggataatccggaaatcgccgctgccattgaagaagagagagcctcagcgaggtctaaaaggtcttcgccaaagagccgcaaggggaagaagaagtctcaggagaacaagaataagggcaacaagatccaggacatacagctcaaaacctcggagccagattttacctcggccaacatgcgtgactccgccgagggcccaaaggaggacgaggaaaaaccttccgcaagcgcactcgaacagcctgctaccctgcaagaggtcgcaagccaagaagttcctccagagttagccactcccgctccagcttgggagcctcagccagagcctgatgagcgcctagaagccgcagcttgtgaggtgaacgacttgggtgaagaggaagaggaggaagaggaggaagacgaggaggaggaagaagatgatgacgatgacgaactggaggatgagggcgaggaggaagcctccatgccaaatgagaattccgtgaaagagccagagattcgctgcgatgaaaaaccagaggacttactggaagaaccaaagaccacgtcagaagagacactcgaggattgttccgaggtgacccctgccatgcagatacctagaaccaaggaagaggctaatggcgatgtgtttgagactttcatgttcccctgccaacactgtgaacggaaatttaccaccaagcagggtctggagaggcatatgcatatacacatctccacagttaatcatgcgttcaagtgtaagtactgcggcaaagcattcggcacgcagattaaccggagacgccacgagaggagacatgaggccggactcaaaagaaaaccatcccagacactacagcctagtgaggatttggccgacggaaaggctagtggggagaatgtggcctcaaaagacgactcatctcccccttcactgggcccagactgtctcatcatgaattccgagaaggccagccaggataccatcaattccagcgttgtagaagagaatggagaagttaaagagctgcatccttgcaagtactgcaagaaggtgttcggaacacacaccaacatgaggcgacaccagagacgcgtccacgagcggcaccttatacctaagggagtcagacgaaaaggcggactggaagagccacagccgccagcggagcaggcacaggctacccagaatgtgtacgtaccttcgaccgagcctgaggaggagggggaagcagatgacgtgtacatcatggacatctcctcaaatatctctgagaacctcaactactacattgatggaaagatccaaacaaataacaacacctctaattgcgatgttatcgagatggagagcgcatcagcagacttgtatgggataaactgccttcttacaccagtcactgtcgaaataacccagaatattaagactactcaggtccctgtcacagaagaccttcctaaagagccacttggctccactaattccgaggcgaagaagcgcaggacagctagtcctcccgcactccccaaaatcaaagctgaaacggactccgatccaatggttcctagctgttctctctccctgcctctatccatatccactaccgaagcagtcagcttccacaaagagaagagcgtctatctgtccagcaagctgaagcaactccttcaaacgcaggataagctcacaccagccggaatttccgcaacagaaattgctaaactaggacctgtatgcgtaagcgcgcctgctagtatgctgcccgtgacatctagtcggtttaaacgcaggacttcctcacctcctagcagtcctcagcactcacccgcacttagggacttcgggaaaccctccgatggtaaggcggcatggaccgacgcaggactgactagcaaaaaaagcaagcttgaaagtcatagcgacagcccagcctggtcgctgagcgggagagacgagagagaaaccgtcagtccaccatgctttgatgagtacaaaatgagcaaggagtggaccgcttcctccgccttcagctctgtgtgcaatcagcagccactggatctgtcaagtggagtgaaacagaaggcagaaggcaccggtaaaactcctgttcaatgggaaagtgtcctcgatcttagtgttcacaagaaacactgttcagatagcgagggaaaagagttcaaggagtcacactccgtgcagcctacctgcagcgccgtcaaaaaaagaaaaccaactacatgtatgttgcagaaagtcctgttgaacgaatacaacggcatcgatttgcccgtcgagaaccccgctgatggcaccaggtccccctctccttgtaaatcactagaggcccaaccagatcccgatctggggccaggctctggcttcccggcacctaccgtagaatcaaccccagatgtctgtccctcaagtccagccctgcagactccttcactgagcagtggccagctcccccctctgctgatccccactgacccgagttcgccacccccttgtccaccagtcctcaccgtggctacgccaccacctccgttgttacctaccgttccgttaccagctccgtctagtagcgccagtccccacccttgcccctccccactaagtaacgccaccgctcaaagcccactccctatcttgagtcctaccgtgtctcccagccccagccccatccctccagtggaaccgctcatgagcgccgcttcacccggaccccctacgctatccagctcctccagctccagtagcagcagctcctcattctctagcagctcttcatcctcctctccctcccctcccccactgtcagccatctcttcggttgttagctctggcgacaatctagaggccagtcttccaatgatatcatttaaacaggaagagctagagaatgagggattgaaaccgagagaggaaccgcaatcagccgcagagcaagacgtggtcgtccaggagacatttaacaaaaacttcgtctgcaatgtgtgtgagtctccctttctaagtatcaaggatctgaccaaacatctcagcattcacgcggaagagtggccctttaagtgtgagttctgtgtgcagctgttcaaagacaagacagatctgtctgaacatcggttcttattgcacggcgttgggaatatattcgtgtgcagcgtgtgtaagaaggaattcgcatttttgtgcaacctccagcaacaccagagagacctgcaccctgataaggtctgcacccatcacgaattcgagtctgggacccttagaccccagaattttacagacccatctaaagcacacgtggagcacatgcagtctttacctgaagaccctttggagactagcaaggaggaggaagagttgaatgatagttcagaagagctctataccacaattaagatcatggctagtggtataaagaccaaggatcccgatgtgcgcctggggctcaaccaacactacccctcgttcaaacccccaccttttcagtaccatcaccggaaccccatgggtatcggggttaccgccacgaacttcaccacgcacaacatcccccagaccttcaccacggccatccgctgcactaagtgcggaaaaggggtggataatatgcctgaactgcataaacatatcctggcatgcgcctccgcatccgataaaaaaaggtacacccccaagaagaatccagtgcccctcaaacagacggtacagccaaaaaatggcgtggtggtgcttgataattccgggaagaatgcgttccggagaatgggccagccaaaacgcctcaatttcagcgtagagctgtccaaaatgtcaagcaacaaactcaagctcaacgcattgaaaaagaaaaatcagctggtgcaaaaggcaattctccaaaagaacaagagcgcaaaacaaaaggctgacctgaagaatgcctgtgagagttcctctcacatttgcccatactgcaatagagaatttacatatattgggtccctcaataagcacgccgcattctcttgtcccaaaaagcccctgagcccacccaaaaaaaaagtctcccattccagtaagaaaggcggtcacagttcaccagccagctctgacaagaattcgaattcaaatcacaggaggaggacggccgatgccgaaatcaaaatgcagtccatgcaaacccctctgggtaagacaagagcacggagttctggccctactcaagtacccctgccctcctcctcgtttcggtcaaaacagaacgtcaaatttgccgcatccgtgaaaagcaagaagccgtcttcaagtagcctgagaaattctagtccaattcgaatggctaagattacccatgtggagggtaaaaaaccaaaggcggtggcaaagaatcattctgcccaattatcaagcaagacgtccaggtcactgcatgtccgggtgcagaaaagcaaagccgtcctgcaatccaagtctactttggcgtccaagaagagaactgatagattcaatatcaagagccgcgagcgcagtggaggaccagtgacccggtctctgcaacttgcggcagctgccgacttgagcgaaaacaaaagagaggatggcagtgccaaacaagaactcaaggacttcagctactccttaaggctggcctcccggtgttcaccccctgccgcaccgtatataacccgacaatatcgcaaggtgaaggcaccagctgctgcccagttccagggccctttcttcaaagaatag

SEQ ID NO: 30245 - DNA, 5049 bp, Artificial Sequence
  Description of Artificial Sequence: Synthetic coding sequence
atgaatcagaacaccaccgaacccgttgcagccaccgagacactcgctgaagtgcccgagcatgttcttaggggcttacccgaagaggtgagactgtttccttcagccgtagacaagaccaggatcggggtatgggcgacgaagcctatcctgaaaggcaagaaattcggacctttcgttggtgacaaaaagaagagatctcaggtcaaaaacaatgtgtacatgtgggaagtctattatcccaatctgggttggatgtgtatcgacgctactgaccctgaaaagggcaactggctacggtacgtgaactgggcttgctcaggcgaggagcagaacttgtttcccctggagatcaacagagccatctactataagacacttaagcctatcgctccgggtgaggagttgctggtgtggtacaacggggaagataaccccgagatagctgcagcgatcgaggaagagagggcctcagccagaagcaaaaggagctcccctaaatctcgtaaaggcaaaaagaaatctcaggagaacaaaaataaaggaaacaagatccaggacattcaactgaagacatccgaacccgacttcacatctgcgaatatgcgcgattccgccgaagggcctaaagaagacgaggagaagcccagcgccagcgcccttgagcaacctgcgacgctgcaggaggtggcctctcaggaggtgcccccagagctggcgacacccgctccagcatgggaaccgcagcccgagccagatgaacgtcttgaagccgcagcttgcgaagttaacgatttgggagaagaggaagaagaggaggaggaggaggatgaagaagaagaagaagacgatgacgatgatgagttggaggatgagggcgaagaggaagcctctatgcccaatgagaacagcgtgaaagagcccgaaatacggtgcgatgaaaagcccgaagatctgctcgaagaacccaaaactacgtcagaagagacattagaggactgttcagaggtcaccccagctatgcagatcccaaggaccaaagaagaagcaaatggtgacgttttcgaaaccttcatgtttccatgccaacattgcgagaggaagtttaccacaaagcagggactagagaggcacatgcacatccatatcagcactgtcaaccatgctttcaagtgtaagtattgtggaaaggccttcggaactcaaatcaacaggcggagacacgagcgtcggcatgaagccggtctgaagcgaaagccctctcaaactctgcagccgagcgaggacctcgctgacgggaaggcttccggcgagaatgtcgccagcaaggacgacagttcccccccatccttgggacctgactgtttaataatgaattcggagaaggcgtctcaggacaccataaattcatctgtggtcgaagagaacggagaggttaaggagctgcacccatgcaaatattgcaagaaggttttcggcacacacacaaacatgagaaggcatcagagaagggtgcatgagcgccatctcattccaaagggcgttcggaggaagggtggcctcgaagaacctcagcccccagcggaacaggcacaggcgacacagaacgtgtacgtgcctagcaccgaacccgaggaggagggagaggcagatgatgtctatatcatggatatttcaagtaacattagcgagaaccttaattattacattgacggcaagatccaaacaaataataacacaagcaactgtgacgtcatcgaaatggaatccgccagcgccgacctatatgggattaattgtcttttgacaccggtgaccgtcgagatcactcagaacatcaagaccacccaggtgccagtcacggaggatttacctaaggaacccctgggcagcacaaatagtgaagcaaaaaaaagaaggaccgcttcccccccagccctgcctaagatcaaggcggagactgattccgacccgatggtacccagctgctctctatctttgccactatcaatttctaccaccgaagccgtgagctttcataaggaaaagtccgtctatctttcttcaaagctgaagcagctgctccagacacaggataagttgaccccagcaggaatctccgctactgaaattgccaagctcggcccagtttgtgtttccgcccctgcatccatgttgcccgtgaccagctccaggttcaaaagacgcaccagctcccccccatcctccccacaacattcgcccgcattaagggactttggcaagccctccgacggaaaggcagcctggaccgatgccggactcaccagcaagaaatctaagctcgagagccatagcgatagccccgcttggtccctgtcagggcgtgacgagcgagagacagtttctcctccctgcttcgatgagtataagatgagcaaagagtggacggcttcttcggcattctccagcgtatgcaaccaacagcccctggacttgagttccggcgtgaagcagaaggctgaaggaactggtaaaacaccagtgcaatgggaatcagtgctggacctctccgtgcataagaagcactgtagtgacagcgaaggtaaggagttcaaggagtctcactcagtccaacctacctgctcagccgtcaagaagagaaagcccacaacgtgtatgctccagaaagtgctgcttaatgagtacaacggcatcgatcttccggttgagaatcccgctgacgggactaggagccctagtccctgcaaatcgctggaagctcagccagatcccgacttgggtcctgggagcggctttcccgctcccacagtcgagtccactccagacgtgtgtccttcttcaccagccctgcagacaccctccctatcgagtgggcagcttccacccctattaattccgactgacccatcttcccctcctccttgtcctccagtgctcacagtggcaacaccccctccacccctgctcccaaccgtcccgttacctgccccttcaagctccgcttctcctcacccctgcccttcacctctatctaatgccacggcccagtcccctctccctatcctgtccccaacagtttccccatcccccagtcctattcctccagttgagccactgatgagcgccgctagcccgggaccaccgaccctgtcatcttcctcatcttcaagtagttctagctctagttttagcagctcatcatcgagcagctcccccagtccgcctccactgagtgctatatcatctgtggtctcatccggagacaacctcgaggcaagtctcccaatgatttccttcaagcaagaggagctcgaaaatgagggactaaagcccagggaggagccgcagagcgctgctgagcaagatgtggttgttcaagagaccttcaataagaatttcgtttgtaatgtgtgcgagtctccatttttgagtatcaaagacctgaccaaacacctgagtattcacgcggaggaatggccattcaaatgtgaattctgcgtgcaattgtttaaggataagaccgacctctcagaacatcgcttcctgctgcacggggtgggcaatatctttgtgtgcagcgtctgcaagaaggaattcgcattcctgtgtaacctacaacagcaccagagggacctgcatcctgacaaggtctgcactcatcatgagttcgaatcagggactctaagaccgcagaatttcaccgacccatcaaaagcacatgtggagcatatgcagtcactcccagaggatcccctggaaacgagtaaggaggaggaggagcttaacgactcctccgaagagttgtacaccacaatcaagatcatggcaagcggaatcaaaacaaaggatccagacgtacggcttggcctgaatcagcactacccaagctttaaaccgccaccatttcagtaccatcacagaaacccaatgggaatcggtgtgacggccaccaatttcactacccacaacatccctcagaccttcaccaccgccataaggtgtactaagtgtggtaagggcgtcgacaatatgccagagctccacaagcacatcctggcttgtgcatcagcttccgataagaaaaggtacacccccaagaagaatccggtgcctctgaagcaaactgtgcagcccaagaatggtgtggtcgtgctggataacagcggaaagaacgcctttcgcaggatggggcaacccaagcgcttgaattttagcgtggagttgtccaagatgtcatctaacaagttgaagttgaatgctttaaaaaaaaagaaccagttggtacagaaagcaattctacagaaaaacaaaagcgctaaacaaaaggccgacttgaaaaatgcctgtgagagttcctcccatatctgtccatattgcaatagggaatttacctacatcgggagcttgaacaaacacgcagcattcagctgccccaagaaacctctgtcgcctccaaaaaagaaggtatcccattcctccaagaaggggggtcatagtagtccagcctcaagcgataaaaactccaactccaaccatcgccgaagaacagccgatgccgaaattaaaatgcaatctatgcagacacctctcggtaagacaagggcccgatcgtctggtcccacgcaggtgccgctgccaagctcaagtttcagatcaaagcagaatgtcaagttcgctgctagcgtcaaatcgaagaaaccatcttccagcagtttgcgcaacagcagcccgattaggatggcgaaaatcacccatgtggagggcaaaaagcccaaggccgtggccaaaaatcacagtgcccagctgtccagtaagacatcgaggtctttgcatgtccgtgtgcagaagtccaaggccgtgctccagtcgaaatctaccttggcctctaagaagcgcactgatcgcttcaatataaagtcccgcgaacgctcagggggacccgtgacaaggtccctgcagctcgctgctgccgcagacctctccgaaaacaagagagaagacggctccgctaaacaggaactgaaagacttccgaaattttctctag

SEQ ID NO: 30246 - DNA, 4446 bp, Artificial Sequence
  Description of Artificial Sequence: Synthetic coding sequence
atgcgcgacagcgctgaaggacccaaagaggacgaagagaaaccaagcgccagcgccctggagcagcccgcaactctccaggaggtagcatcacaagaagtgcccccagaattggcgactccagccccagcgtgggagccacaaccggaacctgatgagaggctggaggcagccgcatgcgaagtaaacgacctgggtgaggaggaggaggaggaagaagaagaggatgaagaagaagaggaggacgatgacgatgatgagctcgaggacgaaggggaagaggaggcttctatgcctaatgagaactctgtcaaagaaccagaaattcgatgtgacgaaaaacctgaggacctgttagaggaaccgaaaacaacttcggaagaaacgttagaggactgtagtgaggtgaccccagcaatgcaaatcccaagaacaaaggaagaggcaaacggcgacgtttttgagacctttatgttcccatgccagcattgcgaacgtaaatttactaccaaacagggtctcgagcgacacatgcacatacacatcagtacggtaaatcatgcattcaaatgtaagtattgtggcaaagctttcggaacccagattaacagaaggcgacatgagcggagacatgaggcaggactgaagagaaagcccagccagaccctacaaccctccgaggacctggccgatggcaaggcatccggcgaaaatgtggccagcaaggacgacagctcgccaccctcacttggccctgactgcctgattatgaatagcgagaaagcctcccaggacacaattaattcttcagtggtagaagaaaacggcgaggtcaaggaacttcacccctgtaagtactgtaaaaaagtttttggcacacatactaacatgcggagacatcagcgcagggtccacgagcggcacctaatccctaagggcgtgaggagaaagggcggtcttgaagaacctcagcccccagcggagcaggcccaggcaacacagaatgtctatgtccctagcacagaaccagaggaggagggtgaagctgatgatgtatacattatggacataagcagtaacatttccgagaatctaaattattacattgatgggaaaatccagacaaataacaacacgagcaactgtgacgtgattgaaatggagtccgctagtgccgatctgtacggaatcaattgtcttttgactcccgtgaccgtggaaataactcaaaacatcaagacaacacaagtgcccgttactgaagacttgcccaaggagccattaggatccacaaactccgaggccaaaaaaaggcggaccgcgagtcctcccgctctgcctaaaattaaagccgagactgattccgatcccatggtccccagctgctcattgagcctgccgctttccatttcaaccaccgaggcagtgagtttccataaagaaaaatctgtgtatcttagcagcaaattgaagcagcttctgcagacacaggataagctgacacctgccggtataagcgctaccgaaattgctaaactcggcccagtttgcgtgtctgccccagcttctatgctaccagtgaccagttcacgcttcaagaggagaaccagtagccccccatcttcaccccaacacagtccagctctgagagacttcggaaaaccttcagatggcaaggctgcatggacagatgccggtctcacctctaaaaagtctaagctcgagagtcactccgactcacccgcttggtcactgagtggcagagatgagcgggagaccgtttcacctccctgtttcgatgaatataagatgtcaaaggagtggactgcttcatcagctttttcctccgtatgcaaccagcaaccattggatttgtcatccggcgtgaagcagaaggcagaaggaacgggcaagaccccggttcaatgggagtccgtacttgatctttccgtgcacaaaaaacactgttctgatagcgagggtaaagagtttaaagaatcccacagcgtacaaccgacctgctccgctgttaaaaagcgcaaaccaaccacctgcatgctccagaaagtcttgctgaacgagtataatggtattgatctgccggtggaaaatccagccgatggcacccgttctccctcaccttgtaagtcactggaagctcagccagaccccgacctgggaccaggttctggatttcccgcacccacagtcgagagcacaccggatgtgtgtccgtccagtccagccctccaaactcccagcttgtcttcaggtcagctgccgcctctgctgataccaactgatccatcttcaccgccaccctgcccccctgtgctgacagtggctactccccctccaccattactcccaactgttcctcttcccgctccgagcagcagcgcatctccacacccatgccccagccccctgagcaacgccacggctcaatctcccttgccaattttgtctcccaccgtaagtcctagtccctcgccgatccctccggttgaacctcttatgagtgccgcttccccagggccaccaacactgagttcatcctcttcgtcatcttcatcctcttcatccttttcttcttcctcctccagtagctccccatctcccccacctctctccgcaatctcgtcagtggtcagtagtggggacaacctggaagcaagtctccccatgatatcttttaaacaggaagagctagaaaacgagggtctcaagccccgagaggaaccacagtccgcagctgaacaggacgttgtggtgcaggagacattcaataagaatttcgtgtgtaacgtctgtgagagcccctttctttccataaaggaccttacaaaacatctgtctatccatgctgaggagtggcccttcaagtgtgaattttgcgtgcagctatttaaagataaaaccgacttgagtgaacaccgattcttgttgcacggggtggggaacatttttgtgtgcagcgtttgcaaaaaagagtttgcatttctgtgtaacctgcaacagcaccagcgggatctgcatccagacaaagtgtgcacccaccatgaatttgagtccggaaccttacgaccacagaatttcacagacccttctaaggctcatgtggagcatatgcagagccttcctgaagacccccttgagacatccaaagaggaagaagaactgaacgactcttccgaggaactgtatacaaccattaagataatggcatcgggcattaagaccaaagaccctgatgtgcgtttggggctcaaccagcattatcctagtttcaagccaccaccgtttcagtaccaccatcgcaacccaatgggaattggggttactgccaccaatttcaccacacataacatccctcagaccttcacaacagccatccgctgtacaaagtgtggcaagggggtcgacaacatgcccgagcttcataaacacatcttagcttgcgcttctgcctccgataagaaacggtacactccaaaaaagaaccctgtcccactgaaacagacggtacaacctaagaatggagtggttgtcctcgataactccgggaaaaacgcattccgccgaatgggccagcctaaacgtctgaacttcagcgtggagttgagtaagatgagttcaaacaagctgaaattaaacgcactgaagaagaagaatcagctggtccaaaaagccatcctgcagaagaacaaatcagcaaaacagaaagccgatctcaagaatgcttgtgaatcaagcagccacatttgtccgtattgtaaccgcgaattcacctacattgggagtttaaataaacacgccgctttcagctgccctaagaaaccgttgtcaccgcctaagaagaaggtttcccacagctcaaagaaaggaggccacagttcacctgctagcagtgacaagaattctaacagcaatcacagaaggcgaacagccgatgctgaaataaaaatgcaatctatgcagacccccctgggaaagactcgagcccgaagctcgggcccaacgcaagtccccctcccaagctcctcttttcgttccaagcagaacgtgaagttcgccgcatcggtaaaaagcaagaagcctagcagctcttcgctcaggaactcatcccctataagaatggcaaagataactcacgtggaaggtaaaaagccgaaggcagtggctaagaatcattccgcgcagctatccagcaagactagtcgctctctgcatgtcagggtgcagaaatcaaaagccgtgctgcagagcaagtccaccctggcctccaagaagcgcacagatcggtttaatattaagtcacgcgaacgctccggtgggcctgtgacccggtcactgcagctcgccgctgcggcagacctctccgaaaacaagagagaggacggatcggctaagcaggaactgaaggatttcagaaactttctatag

SEQ ID NO: 30247 - DNA, 681 bp, Artificial Sequence
  Description of Artificial Sequence: Synthetic coding sequence
atgaatcagaacacaaccgagccagttgcagccacagaaaccctcgcggaggtcccggagcatgtgctgaggggcctgcccgaggaagtgcgactttttccttccgctgtggataagacacggataggagtgtgggctactaagcctatcctcaaaggcaagaaattcgggccatttgttggagataagaaaaaaagaagtcaggtgaaaaataatgtctacatgtgggaggtgtattacccaaatttaggctggatgtgtatcgatgccactgaccccgaaaaaggcaactggctgcggtacgttaactgggcttgctctggggaggagcagaatctttttcctctagaaataaaccgcgctatctactacaagacattgaaacccatagcccctggggaagaactgctcgtttggtataacggcgaggacaacccagaaatcgcagccgctattgaagaggagagggccagcgccaggtctaagcgatccagcccaaagtcccggaaagcaactgctagcgcctggagacctgacgcccttcaccagcgacctaggacaagcccgggttcaattggacgatctaaactgcaattgcagcctagtagccgtgatcactccagtaagagcaggcattccggatgctccttgacggcccctgaggttacgtggaatcagtag

SEQ ID NO: 30248 - DNA, 5048 bp, Artificial Sequence
  Description of Artificial Sequence: Synthetic coding sequence
atgaatcagaacacaactgagccggtggctgccactgagacattagctgaggtccctgagcacgtcttgagggggcttcccgaagaagtccggctgtttccctctgccgtggataaaaccagaataggcgtatgggcgacgaaacccatcctgaagggtaagaaattcggaccattcgtaggagacaagaagaagaggagccaggtcaaaaacaatgtctacatgtgggaggtgtattatccaaacttagggtggatgtgtatagatgccactgaccccgaaaagggtaactggctccgctatgtgaattgggcatgtagtggagaggagcaaaacttgtttccactcgagatcaatcgggcaatatactataaaaccctcaaacccatcgcacctggcgaggagttgctcgtctggtacaatggagaagacaatcctgagatcgccgctgccattgaggaggaaagggcttcagcacgttccaagagaagttcacccaaatcccgaaagggcaagaaaaaatcccaagagaataaaaacaagggcaataagattcaggacatccagctgaagacttccgagccagattttacatctgccaacatgcgggatagtgctgagggcccaaaagaggatgaggaaaagccatcagcttctgcgctcgagcaaccagcaacactgcaggaggtggcctcccaggaggtcccccctgagctcgcaaccccagctcctgcatgggagccccagcctgagcccgacgagaggcttgaggccgctgcgtgcgaagtgaatgacctgggcgaagaagaggaggaggaggaggaagaggatgaagaggaagaggaagacgacgacgacgacgagctagaggacgaaggggaggaagaagcctcaatgcccaatgagaactccgtaaaagagcccgagatccggtgtgatgagaaacccgaagatctccttgaagagcccaagactacatccgaggaaacgttggaggactgtagcgaggtaactccagccatgcagattccacgcactaaggaggaggcaaatggggacgtctttgaaacgttcatgttcccttgccagcactgcgagagaaagttcaccacgaagcagggcctggagaggcatatgcacatacacatctcaaccgtgaaccacgccttcaagtgtaaatactgcgggaaggcatttggaacacagattaataggcgcagacatgagcgacgccacgaggccggattgaaacgcaagccgtctcagacactccagccttccgaggacctggctgacggaaaggccagcggtgagaacgttgcttccaaagacgattcctccccacctagcttgggacccgattgccttatcatgaattcagagaaagcgagccaagacacgatcaactccagcgtcgtggaagagaatggcgaggtgaaggagttgcatccctgtaagtactgtaaaaaagtgttcgggacacatacaaacatgcgaagacaccaacgacgggtgcatgagaggcatctgattcccaagggggttaggcgcaagggcggactggaggagccacagcctcccgctgagcaggcacaagcgacacaaaatgtgtatgtacccagtactgagccagaggaggagggcgaagctgacgacgtgtacattatggatatcagcagcaacatcagcgagaatttgaattattacattgacggcaaaattcaaaccaataacaatacctctaattgcgacgtcatagagatggaaagcgccagcgcagatctttacggcatcaactgtctcctcaccccagtgacagtagaaattacccaaaatatcaagaccacacaggttcccgtgacggaggatctccctaaagagccactggggtccactaattctgaggccaagaaaaggaggactgcttctccacctgcattgccaaaaattaaggcggaaacagactccgatcccatggtacccagctgcagtctgagcctcccactcagcatctccacgacagaggccgtatctttccacaaagaaaaatcggtgtacctgtctagcaagttgaaacagttgctgcagacacaggacaaacttacccctgcaggaataagtgcgaccgagatcgcaaagctaggtcctgtgtgcgtctcagcgccagcttctatgctccctgtcacaagttccagatttaaaagacgaacctcctctccaccaagctcgcctcaacatagtccagccctgagggactttggaaaaccttctgacggtaaggccgcttggacggatgccggtctgacaagcaagaagtccaagctggagagccactctgattctcctgcctggtccttgtctggaagagatgaacgagaaactgtctctcctccctgtttcgatgagtacaagatgtccaaggagtggacggcctcatccgcattttcctctgtctgcaaccagcagcccctggatctgtcgagcggggttaagcagaaagctgaaggcacgggcaaaacccccgtgcagtgggaatctgtgctggacctgtctgtgcacaaaaagcactgcagtgactctgaaggaaaagagttcaaggagtcccatagcgtgcaacctacgtgctctgccgtaaagaagcggaagcctactacatgcatgctccagaaggtccttctgaacgaatacaacggcatagacctgcctgtggaaaaccctgccgatgggacccgaagccccagcccatgcaagtccttggaagcccagcctgaccctgatctcggaccgggatccggctttcctgcgcctaccgtcgagtcaactccggacgtgtgcccgagttctccagccctacagacgccaagcctgtcttcaggtcagttacctcccctccttattcctactgaccctagcagcccacccccttgcccacccgtgcttacggttgccaccccaccacctcccctattaccaacagttcccctgcctgcacccagctcctccgcttccccacatccatgccccagtcccctgtcaaacgctactgcgcaatcaccactcccgattctctcccctaccgtgtcaccatccccgagccctatcccaccagtcgagcctcttatgtcagcggcaagtcccggacctccaaccttgtcaagcagctccagctcttctagctcgtcctctagcttcagcagctcttcatcaagcagctccccctccccacctcccctcagcgctatttccagtgtcgtgtctagtggcgataacctggaggcatctctgcccatgataagctttaagcaggaagagctggagaatgagggcctgaagccgagagaagagcctcaatcggccgctgagcaggatgtggtggtgcaggagaccttcaataagaacttcgtgtgcaatgtgtgcgagtctcccttcctctccattaaagatttgactaaacacctttccattcacgcggaagaatggccgtttaagtgcgagttctgtgtacaactcttcaaggataagacagacctgtcagaacaccgttttcttctgcatggcgtcggaaatatcttcgtgtgcagtgtctgcaagaaggagttcgcctttctgtgcaatctccaacagcaccaacgagacctgcatccggataaagtttgcactcatcacgagtttgagtctggaacattgcggcctcagaactttaccgacccctcaaaggcccacgtcgagcacatgcagagcctccctgaagaccccctagagacgagcaaggaggaagaagagctaaacgattcttcagaagaactgtatactacgatcaagattatggcttccggaataaagacgaaagaccctgacgttcgactggggcttaaccagcactacccaagcttcaaacccccacccttccagtatcatcatagaaaccccatggggatcggggttaccgctaccaatttcacaacgcacaatattcctcagaccttcaccacagccatcagatgcacgaaatgcggcaaaggtgtggacaacatgccagaactccacaagcatattcttgcctgtgctagcgcgtccgataagaagcggtacaccccaaagaagaaccctgttccccttaaacagaccgtgcagcccaaaaatggagtcgtcgtccttgataactctggcaagaacgcctttagacggatggggcagcccaaacgtctcaacttctctgtagagctgagtaagatgagctcaaataagctgaaactgaatgccctgaaaaagaaaaatcaactggtgcagaaagcaatcttgcaaaaaaacaaatctgccaagcaaaaagcagatttaaaaaacgcgtgtgaaagttcaagtcacatttgcccgtattgtaatcgtgagttcacgtacattgggagcctcaacaaacacgcagctttttcatgtcccaaaaagcctctctcccctccgaaaaagaaagtgagccactccagtaaaaaaggtggacacagttctcctgcctcatcagacaaaaactccaactctaaccaccgacgtaggaccgcggacgcggagatcaagatgcaatctatgcagactcctctggggaaaactcgagctcgtagctcaggacccacacaagtccctctcccctcatcttcatttcgatccaagcagaatgtgaagttcgcggcatctgtcaaatcaaaaaagcccagttccagtagtctaaggaattccagcccaattcgcatggccaagataacccatgtcgaagggaaaaaacccaaagcggttgccaagaaccatagtgcccagctgtcttctaagacaagtaggtctctacacgttcgcgttcagaagtcaaaggcagttcttcagagcaaatccactctggctagtaaaaaaagaacggataggttcaacattaagtccagggagcggtcggggggacctgtgacccgctcccttcagctcgccgctgcggcagatctctcagaaaataagcgtgaggatggctcagccaagcaggaactcaaggacttcagatgcttcctgta

SEQ ID NO: 30249 - DNA, 237 bp, Artificial Sequence
  Description of Artificial Sequence: Synthetic coding sequence
atgcgcgattcagccgagggccctaaggaggatgaggaaaaacctagcgcaagcgctctggaacaacccgcaaccctgcaggaagtggcatcacaggaagtgccaccagaacttgccactcctgcccctgcttgggagcctcaacctgagcctgatgagagactggaggctgccgcttgcgaagttaacgatttaggagaagaagaggaggaggaggaggaggaagacgaggagtag

SEQ ID NO: 30250 - DNA, 4446 bp, Artificial Sequence
  Description of Artificial Sequence: Synthetic coding sequence
atgagggactccgcagagggacctaaagaggacgaggaaaagccgtctgcttcggctttggagcagcctgcgaccctccaggaggttgcctcccaagaagtgcccccagagcttgccactccggctccagcctgggagccacagcccgagcctgatgagcggctcgaagctgcggcatgcgaagtaaatgatctgggcgaagaagaggaagaggaggaggaggaggatgaggaggaagaggaggatgacgacgacgacgaattggaggacgaaggggaagaggaggccagcatgccaaacgagaatagcgttaaggaacccgaaatccggtgtgatgagaaaccagaggacctgctggaggaacccaagactactagcgaggagaccctggaagactgcagcgaggttacaccagccatgcagatccctagaactaaggaggaagccaatggagacgtcttcgaaacgtttatgttcccctgccagcactgtgagagaaagtttacaacaaagcagggcctagagcgacatatgcacatacatatatccacagtgaaccacgcctttaagtgtaaatactgcgggaaggctttcggaacccagataaaccgtcgcaggcatgaaagacgacacgaggccggactgaagcggaagccatcacagacactgcagcctagtgaggaccttgcagacgggaaagcctcgggtgagaatgtggccagcaaagacgactcctcacctccaagcctgggcccagattgtcttataatgaactccgagaaagcatcccaggacacgattaatagtagtgttgtggaggagaatggggaggttaaagagctccatccctgcaaatactgtaaaaaggtctttggtacacatactaacatgagaagacatcagcgtagggtgcacgaacggcatcttataccaaaaggcgtgaggcgcaaaggaggtctggaggagccccaacctcctgccgagcaggcccaggctactcagaatgtctacgtgccgagcaccgagcctgaagaggagggcgaggccgacgatgtgtatatcatggacatatcttccaatatctcagaaaatctgaactactatattgacgggaagatccagaccaacaacaacacgtctaattgtgacgtgatagagatggagtcagctagcgctgacctgtacggcatcaattgtctcctgacaccggtgacagtagagatcactcagaacatcaagacaactcaggtacctgtgacggaagacctcccaaaagagccactagggagtaccaacagcgaagccaagaagcgaaggactgcttccccgccagctctgccaaaaatcaaggctgagaccgacagcgatcccatggtgccatcctgctccttgagccttcctttgagtatctccacaaccgaggcggtgagttttcacaaagagaaaagcgtgtatttgagtagcaagctgaagcagctactacagacgcaggacaaattgacgcccgcaggcatctctgccacagagatcgctaagctaggacctgtgtgcgtgtcagcccctgcctccatgcttcccgtcacatcctcaaggtttaaaagacgtacaagcagcccaccttccagcccccagcattcacctgcccttcgggattttggaaagcccagcgatggcaaagcagcgtggactgacgccggactgacttccaagaaatcaaaactcgagtcccactctgacagtcccgcttggagcctatcagggagagacgagagggaaaccgtaagcccaccttgcttcgacgaatataagatgtctaaagaatggacagccagttctgccttctcatcagtttgtaatcagcagccccttgatctatcctcaggcgtgaagcagaaggccgagggaacaggtaaaactcctgttcagtgggaatccgtgctggaccttagcgtccacaaaaagcactgctcggactcagaaggaaaagagtttaaggagtcgcactccgtccaacccacttgcagtgccgttaagaagaggaagcctacaacttgcatgttacaaaaggtcctgcttaatgaatacaacggcatagatcttcctgtagagaaccccgcagacggcacacgctctccaagtccctgtaaatctctggaggctcagcctgacccagacctcggccctgggtcggggtttcctgcccctaccgtggaatcaacacccgatgtgtgtccctcaagccccgcactgcagacgccttctttgtctagtggccagctgcccccactgctcatccccacggatccgtcttccccacccccttgtccgcctgttttgacagtagccaccccaccaccacctctgcttccaaccgtgcccttgcccgctccctcttcttccgcaagcccacacccttgtccttctccactgtctaatgccaccgcccaatccccgttgcctatcctctcaccgactgtgtcacccagtccttcccccatacctccagtggaacccctgatgtccgctgcatctcccggtcctccaactctttcgagttcaagcagttcatcttcatccagctccagtttctcatcatccagctcatcgtcatctccatcgcccccacccctgtctgcaatcagctccgtagtctcatctggggataacctcgaagcatccctaccgatgatctcattcaagcaggaggaattagagaacgagggcttgaaaccacgcgaggagccacaaagtgcggcagaacaagacgtcgtggttcaggaaacatttaacaaaaactttgtgtgcaacgtgtgcgagagtcctttcctgtcgatcaaagacctcacgaagcacctgagtatccatgcagaggagtggcctttcaaatgtgaattttgtgtccagctcttcaaggataaaacagacctttcagagcacaggttcctcctgcatggagtgggaaatatattcgtgtgcagtgtgtgcaagaaggaattcgccttcctttgcaatttgcagcagcaccagcgggacctgcacccagataaagtttgcacacaccatgaatttgaaagcgggactctacgcccacaaaatttcaccgacccttctaaggcccatgtagagcacatgcaaagccttcccgaagatcccctggagacttctaaagaggaggaggagctcaatgattcctctgaggagctgtacaccaccatcaaaattatggcatcgggcattaagactaaagatcctgacgtgaggcttgggcttaatcagcactatccgtctttcaagccgcctccctttcagtaccaccatcgaaacccgatgggtataggtgtgaccgctaccaactttactacccacaacataccccagacctttaccacagccatacgctgcacaaagtgtggtaaaggggtcgacaatatgccagagctccataaacatattctcgcgtgtgccagtgcctcggacaagaagaggtatactccaaaaaaaaacccagtcccactcaagcagactgtgcaacctaaaaatggggtggtggtcctcgataatagcgggaaaaatgcatttcgcaggatgggacagccaaaaaggctgaacttctctgtggagctaagcaaaatgagctccaataagctcaaactaaatgccctgaagaagaagaaccaattagtgcagaaggccatactgcagaagaacaagtctgcaaagcagaaggccgacctgaaaaacgcttgcgagtccagctcacatatctgtccctactgcaacagggagttcacctatatcggcagcttgaataaacacgccgcttttagctgccccaagaaaccactgtctccgccaaagaagaaggtctcccacagctcaaaaaagggtggacacagctcaccggcttcaagcgataagaacagcaactcaaaccatcggagaaggactgctgacgctgagattaaaatgcagagtatgcagaccccactaggcaaaacccgcgcacggagcagcgggccaacgcaggtcccattgccaagcagcagcttccgtagcaagcagaacgtaaaatttgcagccagcgttaagtcgaaaaaaccctccagttcttccctcagaaacagcagccctattagaatggcaaaaatcacacacgtcgagggaaaaaagcctaaggctgtggctaaaaatcactctgcccaactttcctctaaaacatcccgatctttgcacgtccgtgttcagaaaagcaaagcagtcctccaaagtaagagcactttagccagtaagaagagaactgaccgctttaacataaagtctagagagaggagtggaggtcctgtaacaagatcccttcagctcgccgcagcggctgatctgtccgagaacaagcgcgaggacggctcagccaagcaggagttgaaggactttcgaaattttctgtag

SEQ ID NO: 30251 - DNA, 675 bp, Artificial Sequence
  Description of Artificial Sequence: Synthetic coding sequence
atgagctcatatttcgtcaattccacttttcccgttacattggcctccgggcaggagtcttttctgggccagttgccactgtactcctctggttacgctgatccgctgcgccactatcccgctccatacggtcccggtcccggacaagacaaaggattcgccacttcaagttactatcctcccgctgggggagggtacgggagagctgctccttgcgattatggccctgcccctgcattctaccgcgaaaaagaatctgcttgcgcactgagcggtgccgacgagcagcctcctttccacccagagccaaggaaatctgactgcgcgcaggacaagagcgtttttggagagactgaggaacagaagtgttcgacacccgtgtacccttggatgcagaggatgaactcctgtaatagcagcagctttggtccctcaggcaggaggggtcggcagacctatacccgctaccagactctggaattagagaaagagtttcactacaatcgctacctgactaggcgcaggcggatcgagattgctcatgccctgtgcctaactgagcgtcagataaagatatggtttcagaataggcgaatgaaatggaagaaagagagcaaattactgtctgcttctcaactgtcggcagaagaagaggaagagaagcaagctgagtag

SEQ ID NO: 30252 - DNA, 2496 bp, Artificial Sequence
  Description of Artificial Sequence: Synthetic coding sequence
atgaccgaattgaaagccaaggggcctagagccccacatgtggctggtgggcctccctctccggaggtgggctctcccttgctgtgcaggcccgcagccggacccttccccggaagtcagacttctgacactctgccagaggtgtcagcaatccccatcagtctagatggacttctgtttccacgtccatgccagggtcaggacccgagcgacgagaagacccaagaccagcagtctctgtcagacgtggaaggagcctactcccgcgctgaagccacacgcggtgcaggcggaagttcttcttccccacctgaaaaggactccggactgctggattcggtgctagatactctgctcgctccatctgggcctggtcagtcccagcccagcccaccggcatgtgaggttacatcgtcctggtgcctcttcggaccagaactcccagaggatccccctgccgctcctgccacccagagagtcctgagtccactcatgtccaggtcagggtgcaaggtgggcgacagttctggtactgctgctgctcataaagtgttgccaagaggtctatcccccgctaggcagctccttctccctgctagcgaatccccccactggtccggcgctcccgtgaaaccttcccctcaagcagcagcggtggaggttgaggaggaggatggaagcgagtcagaggagtcagctggccctcttctcaaaggtaagcctcgcgctttgggaggagcggctgcaggtggcggtgcagccgctgtgccaccgggagccgcagccggtggagtggcactggtgcctaaggaagactcaagatttagcgcaccaagagttgctctcgtcgagcaggacgcgcctatggcaccaggcaggagtcccctggccaccaccgttatggactttatccacgtgcccattctccctcttaaccacgcactgctagctgctaggacgcgccaactcctagaagatgagagctatgatggcggtgccggtgcagcctctgcatttgcccctccccgatctagcccctgtgcaagctcgacccctgtcgctgtgggcgactttccggactgtgcctatccaccagacgccgagcctaaggacgatgcgtatccgttatacagcgattttcagccaccagccctcaagatcaaggaagaggaagagggagctgaggctagcgcccgaagtcctcgcagctatctggtcgccggagctaaccccgctgcttttccagactttccactaggaccccctccccctctgccaccccgagctactccatctagaccaggcgaagccgcagttacagctgcgccagcaagcgcatccgtatccagtgcgtctagttcaggcagtacacttgagtgtatcctatacaaagctgagggggctcccccacagcagggccctttcgccccacccccttgcaaagctcctggagcttccggctgcctgctgcctcgcgacggccttccaagcacctccgcctccgccgctgcggctggggctgcaccagcactctatcccgcactggggctgaatgggcttcctcagcttggataccaagctgctgtgctgaaggaggggttgcctcaggtatatcccccatacctgaactacctgcgcccagattccgaggcctcccaatctcctcagtactctttcgagtcgctgcctcaaaaaatttgcctcatctgtggcgatgaggccagcggctgtcactatggtgtgcttacatgtggcagctgcaaagtgttcttcaaaagagcaatggaggggcagcacaactatctatgtgctgggcgtaacgattgtatcgttgacaaaatcaggagaaagaactgccccgcttgccggctaaggaagtgctgtcaggcaggaatggtcttggggggtttccggaacttacacatcgatgaccagataacactgatccaatattcctggatgagtctgatggtgtttgggctgggatggcgctcctacaagcacgtttccggccagatgctttactttgctcccgatctcatcctcaatgagcagaggatgaaggaatcgagtttctactcgctgtgtctgacgatgtggcagattccacaggagttcgtgaagttgcaggtgtcgcaagaagagtttctatgtatgaaggttctcctgctcctgaataccattcctctggaggggttgaggagccagacacagttcgaagagatgagatcttcgtacatcagagaactcattaaggccatcggcctcagacagaagggagtggttagctcctcacaacgcttctatcagctgaccaagctgctggacaacctgcatgatctggtgaaacagcttcacctttactgtctcaatacttttattcagtctcgtgcccttagtgtcgaatttcccgagatgatgtctgaggtcattgcagcgcagctccccaagatcctagctggcatggtcaagccattactttttcataaaaagtag

SEQ ID NO: 30253 - DNA, 2802 bp, Artificial Sequence
  Description of Artificial Sequence: Synthetic coding sequence
atgaccgagctcaaggctaaaggaccgcgagccccacacgtcgcgggaggccctccctctccagaggtcggatccccactgttatgcaggcctgccgctgggcctttcccgggaagtcaaacgagcgacacattgccggaggtgtcagccattccaatcagtctagatgggcttctattcccacgaccgtgccagggccaggacccaagcgacgagaagacccaggaccagcaatcactctctgatgtggagggcgcttattcccgcgcagaggccactagaggtgccggaggtagtagctccagtccgccagagaaagatagcggactgcttgacagcgttctggacacactactcgccccaagtggacccggtcagagtcagccctcgcccccagcctgtgaggtcacgagttcttggtgcctgttcggaccagaactgcctgaggaccccccagccgcacccgctacgcagcgggtcctctcccccttaatgagcagatcggggtgcaaagttggtgattcctccggcactgctgccgcacacaaggtcctcccacgtgggctctcgccagccaggcagctgcttctgccggcttctgagagcccccattggtctggtgctccggtgaaaccatcaccccaggcagcagcagtggaagtggaagaggaagacgggagtgagagtgaggagtccgcgggtcccctgctcaaaggaaagcccagagcactgggcggagctgccgctgggggaggggctgccgcagtgccgcctggcgcagcagctggtggggtggctctagtcccaaaagaagacagtagattcagcgctcctagagttgctctggtggagcaggacgcccctatggccccaggtcgatcaccactagcgaccacagtgatggactttatacacgtacccatcctgcctctcaatcacgccctgctcgcagctcgcactcgccagttgttggaagatgagtcctacgatgggggagcaggtgctgcatccgctttcgccccacccagatcctcgccctgcgcctcttctacaccagtcgcagttggggattttcctgattgcgcctatccccctgacgccgagccaaaggacgatgcttaccccctgtatagtgatttccagcccccagcccttaaaatcaaggaagaagaagagggggcagaagcctctgctaggtcccccagaagctatctggtagcaggcgcaaatccagccgcattccccgacttccctctaggacctcccccacctcttcccccaagggccacgccgagtcgccctggggaggctgcggtcacagcggctccagcctcagcctctgtgagcagtgccagcagtagtgggagcacactcgagtgtatactctacaaagccgaaggagctccgcctcagcaggggccattcgccccacctccatgcaaagcgcctggcgcttcaggctgtctgttgcctcgggatggactgcctagcaccagtgcgagtgctgctgccgcaggcgctgcccctgcactgtacccagccctaggactgaatggcttacctcaactgggctatcaagccgctgttcttaaggaaggcctgccccaggtgtatcccccttatctgaattacctgaggccagatagcgaagcatctcagtccccccagtactcattcgaaagtttgcctcagaaaatttgtttgatttgcggagacgaggcatccggatgccactacggggtgctgacttgcggcagctgcaaggtattttttaagcgcgcaatggagggacaacacaattacctctgcgctggaagaaacgactgcattgtcgataaaattcggagaaagaactgtcctgcctgtaggctcaggaagtgctgccaggcaggcatggtccttggcggacggaaatttaagaagttcaataaagtcagagtggtcagggccctggacgctgtggccttaccccagcctgtcggtgtcccaaatgagtcccaagcactctcccagaggtttactttctctcccggacaggacatccagctaatccccccactgattaacttgttgatgtctatcgagcctgacgtgatttacgccggtcacgacaatactaagcccgatacaagcagctctcttctgacttccctgaatcagttaggggagcgccagctgctatccgtagttaagtggagcaagagccttccgggattccgaaatttgcatatcgacgaccagataaccctaattcaatacagttggatgagcctgatggtgtttggactcggatggaggagctataagcacgtgtctgggcaaatgctgtacttcgcaccggatctcattcttaacgagcagcgaatgaaggagagttctttttattccttgtgtctgacaatgtggcaaatccctcaagaattcgtgaaattacaggtgtctcaggaggagttcctgtgcatgaaggtactcctgctcctgaacaccattccacttgaaggattgcggagccagacccagttcgaggagatgagatcatcctacataagggagttaatcaaagccataggactgcggcagaagggagtcgtttccagcagtcagcggttttaccagctcactaaactccttgacaatctccatgatcttgtcaagcagctgcacctctattgtctgaataccttcatacagtctcgggctctgagcgtggagtttccggaaatgatgtcagaggttattgccgctcagctacctaagatacttgcgggtatggtgaagcctctcctgttccacaagaagtag

SEQ ID NO: 30254 - DNA, 2088 bp, Artificial Sequence
  Description of Artificial Sequence: Synthetic coding sequence
atgactgaactgaaggcaaagggacctcgagctccgcacgttgctggaggacccccttctcctgaagtgggcagtccattactttgtcggccagcggcagggccattccccggaagccagaccagcgatacactgcctgaggtcagcgccatacccatttcccttgatggactgctgttcccacggccatgccaggggcaggaccccagcgacgagaaaacccaggatcagcagagtctttccgatgttgagggcgcatattcaagggcagaggccacaaggggcgctggaggtagctccagcagccccccagagaaagactctggactcctggactcagtgctcgataccctgctcgcaccctcaggacccggacagagtcagccgagccctcctgcttgcgaggttacgtcttcttggtgcctctttgggcctgagctacccgaagatccaccagctgcccctgcaacacagagggtgctcagtcccttgatgagtagatccggatgtaaagtgggagactctagtggcacagccgctgctcataaagttttgcctagaggactgtccccggcacggcagttgctgctgcctgccagcgagtcaccgcactggtctggcgctcccgtgaaacccagccctcaagctgcagccgtcgaagttgaggaggaggacggatctgagagcgaggaaagcgctggccctctgctgaagggtaagcctagggcccttggaggtgccgctgctgggggaggggctgccgcagttcctccaggggctgcagctggcggtgtggccctggtgccaaaggaagattcgagatttagcgcccctcgtgttgctttggtagaacaggacgcccctatggcaccaggccgaagcccgttggccactactgtgatggacttcatccacgtgccgattcttcctctaaatcatgcactcctcgcagctagaactaggcaactgcttgaagatgagagttatgatggaggcgcaggggctgccagcgccttcgctccccctagatcttctccttgtgcgagttcaacccccgtggctgtgggcgacttccccgactgtgcctatcctccggacgcggagcccaaggatgatgcctacccgttatacagcgatttccagccaccagccttgaagatcaaggaggaagaggagggggctgaagcctcagctagatctcctcgatcttatctcgtcgccggagctaaccccgctgcttttccagactttccgctgggccctccacctcccctgccacccagagcaactcccagccggcctggggaagcagccgtgactgccgcacctgctagcgcctctgtgagctcggcctctagcagcgggagcactctggagtgtattctgtataaggcagagggggctcccccacagcagggtccatttgcccctcccccttgcaaggctcctggagctagcggatgccttttgccgcgtgacggtttaccttctacttccgcttccgcagctgctgccggagcagcaccagctctgtaccccgctctcggcctcaacggtctgcctcaactcgggtatcaggcagccgtgttgaaagagggtcttcctcaggtttatcctccctacctaaattacttaaggcctgactcagaggcatctcagagtccgcagtactcatttgaatctcttccacagaagatttgtttgatttgcggggacgaggccagcggctgtcattatggggtgctcacttgcggctcttgcaaggtgttctttaagagagcaatggaaggccagcacaattatctgtgtgcgggtaggaacgactgcatcgtggacaagatacgcagaaagaactgtcccgcatgcagactcagaaagtgttgccaggccggtatggtcctagggggatttcgaaacctgcacatcgatgaccagataaccctgattcaatattcctggatgagcctgatggtgttcggacttgggtggcggtcgtacaagcacgtgagtgggcaaatgctttacttcgccccagatcttatcctcaatgattctttcggcagggctactaagtcgaatccagtgtag

SEQ ID NO: 30255 - DNA, 2295 bp, Artificial Sequence
  Description of Artificial Sequence: Synthetic coding sequence
atgacagaacttaaagcaaagggaccacgagcgcctcacgtggctggcggaccaccatctccagaggtcgggtctccgctgctgtgtcgacctgccgctggcccattccctggtagccagacatctgacactctgcctgaggtttctgcaatcccaatttccctcgatggcctgctgtttcctagaccatgtcaaggacaggacccttccgatgaaaaaacccaagatcagcagtcattatcagatgtggagggggcttactcacgagccgaagctactaggggagcgggaggctcctccagcagcccgccagaaaaggattccggactgctcgactccgttcttgatactctgctggcccctagtgggcctggacagtcccagcccagcccaccagcttgcgaagtcacttcctcatggtgcctgttcggacccgaattgccggaagatccgccagctgcccctgcaacacagagggtgctctcaccactgatgtctcgctccggttgcaaggtgggtgacagtagtgggactgccgctgcacacaaggtgctccccagaggactctcccccgcaaggcagctcttgctgcccgcttccgaaagccctcattggtctggtgcccctgtcaagccttcaccccaggcagcagccgtcgaagtggaagaagaggacgggtccgaaagcgaggagtccgctgggccattactgaaagggaaacccagggctctcggcggagctgccgctggcggaggcgctgcagctgtgcctcccggtgcagcggctgggggtgtagccctagtccccaaagaggattccaggttcagcgctcctagggtggcactggttgagcaggatgcacccatggcccctggcaggtcacctctggcaacaacagtgatggactttattcacgttccgatcctaccgctgaaccacgctttgctggcagcccgtacccgccagctcttggaggacgaatcatatgatggtggggctggcgctgcctcagcgttcgctccaccaagaagtagtccatgcgcctcaagcactcccgtcgcggtaggcgattttccagattgcgcttatccacccgatgcggagccaaaggacgacgcataccccctttactctgacttccaacctcccgcattgaagataaaggaggaggaggaaggcgctgaggcctccgccagatcccctagatcgtatcttgtggctggagctaaccctgccgcattccccgatttccctctgggtcctccaccacccctaccaccacgcgcaacaccatccagacctggtgaagctgccgtgacagcagcacccgcaagtgccagtgtttctagcgcatccagctcgggcagcacactggaatgtattctgtacaaggccgaaggtgcacccccacaacagggacctttcgccccaccaccttgtaaagcccctggtgcaagcggctgccttctccccagagatggactcccctcaacaagcgcatctgctgccgctgcaggggctgcccctgctttgtatcccgcactcggtctcaatgggctgccacaattaggctatcaggctgctgttttgaaggagggactcccacaagtctatcccccatacctcaactacctgcgtcccgattccgaggccagccagagccctcagtactcttttgagtccctcccccaaaaaatttgtctcatctgtggggatgaggcttctgggtgtcactacggggtgttgacgtgcggcagctgtaaggtattcttcaagcgagccatggaggggagaaaattcaagaagttcaacaaggtgcgcgtcgtgagggccctagatgccgtcgccctgccacagcctgtgggcgtcccaaacgagagccaggccttgtcccaacgcttcacattcagcccaggacaggacatccagcttatccccccacttattaatttgctgatgagcatcgaacctgacgttatttatgctgggcacgataataccaaacccgacacttccagcagtctgctcacctcactgaaccagcttggagagaggcagctgctctccgtggttaagtggtctaagagtctgcctgggttcagaaacctacacattgacgaccagatcaccttgattcagtatagctggatgtccctgatggtcttcggattgggctggcgctcatataagcacgtatccggacaaatgctttacttcgcccctgatctgattcttaatgagtcgcaccgctctcttagtagtttcaagctggcgaaaaaatcatcttcagtttag

SEQ ID NO: 30256 - DNA, 1020 bp, Artificial Sequence
  Description of Artificial Sequence: Synthetic coding sequence
atggagggccagcacaactatctgtgtgccggacgtaacgattgcatagttgataaaattcgcaggaagaattgtcctgcttgtaggttgcgcaagtgttgccaggctggaatggttctcggcggaagaaaatttaagaagtttaataaggtgagggtggtaagggcactggatgctgtggccctgccccagcctgtgggagtgcctaatgagtcccaagctctgtcacagagatttactttttccccagggcaggacatacagctgatacctccattaataaatctccttatgagcatcgaacccgatgtcatttatgcaggtcatgacaacaccaagccagatactagttctagtctattgacttccttgaaccaactgggagaaagacaactgctctccgtggtaaaatggtctaaaagcttgcctgggtttcgcaacctacatatcgatgatcagataacccttatccagtacagctggatgagcctcatggtgttcggactgggctggcgcagctacaaacacgtctctggccagatgctctatttcgctccggatctgatcttgaacgagcagagaatgaaggaaagtagcttctatagcctatgcctaactatgtggcaaatccctcaagagttcgtgaagctgcaggtctctcaggaggagtttctatgtatgaaagtcctccttctgctcaatactattcctcttgaaggcctaaggagtcaaacgcaatttgaagagatgagaagtagttacattagggagcttatcaaggctattggacttcgacagaaaggtgtggttagctccagccagcggttttaccagctcacaaaattgctcgacaatttacatgacctggtgaagcagttgcacctgtactgcctgaataccttcatacaatctagggcattatccgtggagttccccgagatgatgtccgaagtgatcgcagcccagttgcccaagatccttgcaggcatggtaaagcccctcctctttcataaaaagtag

SEQ ID NO: 30257 - DNA, 2412 bp, Artificial Sequence
  Description of Artificial Sequence: Synthetic coding sequence
atgaccgagttgaaggctaaaggacccagggcacctcatgtggcagggggacctccctcaccagaagttggctccccgctgttgtgtagacccgcagcagggccatttccagggtcccagacttccgacactctccccgaggtgtctgcaatacctattagcctcgatggtcttctgtttccccgtccatgtcagggccaggacccaagtgatgagaaaactcaggatcagcagtcactctctgacgtcgaaggtgcatatagtagggctgaagccacgcgaggggctggaggtagctcatcatccccccctgaaaaagatagtgggctgctggatagcgtgctggacaccttattggcccctagcggcccaggacagagtcagcccagccctcccgcatgcgaggtgacttcctcttggtgtctttttggtccagagctgccagaggatccaccagctgcccctgcaacccagagagtattatccccattgatgagtcgcagcggttgcaaggtaggcgatagtagtggcactgcggcagcacacaaggttctgcctaggggcttatctcctgctcgccaacttctactgcctgccagtgagagtccgcattggtcaggagccccagtgaaaccgagcccccaggccgctgccgtagaggttgaggaagaggatggctccgagtcagaagaatcagccggaccactgttgaaaggtaaacctcgagcccttggaggagcagcggcagggggtggtgccgctgctgtgcctccaggcgctgctgctggcggtgttgcattagtaccaaaggaggactcccgtttctcagcccctagagtggccttagtggagcaagacgcgcctatggcccctgggcgaagcccactggccaccacggtaatggattttattcatgtgccaattctccccctcaatcacgcccttttggccgcaaggacacggcaactgcttgaggatgaatcatacgacggaggcgcaggagctgcatctgcattcgcccctcccagatcttccccttgcgcctcctctacgcctgttgccgtgggtgattttccggactgtgcctatcctcccgacgcggagccgaaggatgacgcctaccccctgtattccgatttccaaccccctgcccttaagatcaaggaagaggaagagggcgcagaggccagtgcacgctccccgcgatcttatctcgtcgccggagccaatcccgcagctttccccgactttcccctcggcccacccccaccccttccgcctagggccaccccatcgaggccgggtgaagccgctgtgactgcggctcccgcttccgcctccgtctcatccgcctctagctcgggaagtaccttggaatgtatattgtataaggcagagggggctccccctcagcaggggccttttgcccctcccccatgtaaagccccaggtgcttccggatgtttgctgccaagagacggtcttcccagcacttccgccagcgccgctgctgcgggtgccgctcctgccctctaccctgcgctgggattaaacgggttgcctcagttagggtaccaagccgcagtgctaaaggagggcctccctcaggtttaccccccttacctaaactatctgcggcctgattctgaggcctcacagtccccacagtattcttttgagtcattaccacagaagatttgtctgatttgtggagatgaggcttccggttgtcactacggtgtgcttacttgtggtagttgcaaggtgttttttaaacgcgctatggaggggcagcacaactacctctgtgctggcaggaacgactgcattgttgacaagattagacggaaaaattgccctgcatgcaggctccgcaagtgctgtcaggccggtatggtcctgggaggccgtaagttcaaaaaatttaacaaggtgagggtggtccgtgcacttgacgcagtagcattgcctcaacctgttggcgtgccgaatgagtcgcaagcactgtcccagcggttcactttttcccctgggcaggacattcagctgatcccacccctgatcaacttattaatgagcatagagcctgatgtgatctatgcgggacacgataacactaagcccgatacgagctccagtttactaaccagcctgaatcagctgggggaacgccaactgctcagtgttgttaagtggagtaaatcactgcccggattccgcaacttgcatattgatgatcaaatcacattgatacagtactcatggatgtctctcatggtcttcgggctggggtggagatcttacaagcatgttagcggccagatgctttactttgcacctgacctcatcctgaatgaaagccaccgctcccttagctccttcaagctcgccaagaagtctagttcagtttag

SEQ ID NO: 30258 - DNA, 2073 bp, Artificial Sequence
  Description of Artificial Sequence: Synthetic coding sequence
atgacggaactgaaggctaaagggccaagagctccccacgtggctggcggacccccatctcccgaagttggatccccactgctttgtagaccagctgccggacccttccccggatcacagacttctgacaccctgcctgaagtttccgcaattccaatatcacttgacggcctgctgttccccaggccatgccaagggcaggacccatccgatgaaaagacccaggaccaacaaagcctttctgatgtcgaaggcgcttattcacgagccgaggcaacacggggagcaggtggttcatcgtcctcaccacctgaaaaagacagcggcttgctcgactcagtgctggacactctgctggcgccttcgggcccagggcagtcccagcccagtccccctgcctgcgaggtcacctcaagttggtgcctctttggcccagagctgcctgaagatccccctgccgctcccgcaacacaacgtgtgttatcccccctcatgtcacgcagcggctgcaaggttggggattctagcgggacggccgctgcccacaaggtcttacccagaggactgtctcctgcacgacaattgctgctccctgcctctgaatcacctcattggagtggcgcaccagtcaagccttcacctcaggctgcagcagttgaagtggaagaagaagacggatctgaaagcgaggagtcggctggccctcttctgaaaggaaagccgcgagcccttggaggggctgcagcgggaggtggcgctgcagcagtgccacctggggcagctgctgggggtgtcgcattggttcccaaggaggattcccggttttccgcaccaagggtagcccttgtagagcaagacgcgccaatggcccctggaagatctccactcgccacgaccgttatggactttattcacgtcccaatcttgcccctcaaccacgcactcctggctgcaagaactcgccagttactggaagacgaatcctacgacggaggagcaggtgccgcatcagccttcgccccacccaggtcctccccttgtgcaagtagcacaccggtcgccgtcggagactttcccgattgcgcataccctccggatgccgaacctaaggacgatgcgtacccgttatacagtgacttccaaccgccagccctaaaaatcaaggaggaagaagaaggggctgaagcctcagctagatccccacgcagctacctcgttgcaggggctaatcccgctgcctttcccgattttcctctaggtccacctccccctctaccacctcgggcaactccgtctcggcctggggaggccgcagtgactgcagccccagcctctgcctctgtatcctctgcctcttcatccggcagcacacttgaatgcatcctgtacaaagcagaaggggcaccaccacagcaggggccatttgctccccctccctgcaaagccccaggcgcaagcgggtgcctgcttccacgggacggccttcccagtacctcagcttcagcagcagcggcaggtgcagctcctgctctttaccccgctcttggacttaacggcttgcctcagcttggttaccaggcggctgtgctcaaggaagggcttccccaagtgtacccaccttatcttaactatctccggcctgatagcgaggccagtcaatcaccacagtacagcttcgagtctctcccacagaagatttgcctgatctgtggggatgaggcttccggatgccattacggggtgctcacttgcggctcttgcaaagtattttttaaacgggctatggaaggccaacacaattacctgtgcgctggaagaaatgattgtatagtggataaaatccgcagaaaaaattgccctgcctgtaggctcagaaaatgttgtcaggctggcatggtcttaggaggctttcggaatttgcacatcgacgatcagatcaccctgattcaatattcctggatgagccttatggtcttcgggctgggttggcggagctacaaacacgtctccggacaaatgctgtacttcgcacctgacctcattctcaacgaggagtcaatagtgacaagttag

SEQ ID NO: 30259 - DNA, 1410 bp, Artificial Sequence
  Description of Artificial Sequence: Synthetic coding sequence
atggacgtggagaacgagcagatcttaaacgtgaaccccgctgaccccgataatttaagcgatagtctgttttcaggcgatgaggagaacgccggaactgaggagatcaagaacgagatcaatgggaattggatctctgctagctccattaatgaggcccgtatcaatgctaaagccaaaagaaggctcagaaaaaacagctctcgagactcagggcgaggggatagcgtgtccgatagtggcagcgatgcccttcgctcagggctgacggtccctacctccccgaagggccgattgctggacaggcggtcacggtctggaaaagggcgaggactaccaaagaaaggaggtgctggtggcaagggcgtgtggggcactcctggacaggtttatgacgtggaagaggtcgacgtgaaagaccctaactacgatgacgaccaggaaaactgtgtctatgaaacggtggtgctcccactcgatgagcgggcttttgaaaagactcttacacctatcatccaagaatattttgaacacggcgatacaaacgaagtggccgagatgttgagagatctgaatttgggcgaaatgaaaagtggcgtaccagtcctagcagtgtccctggcattggagggcaaagcctctcacagggagatgacgagcaagttgctaagcgatctctgcggaacagtcatgagcacaactgacgtggaaaagtcctttgataagctgctgaaggatctgccagaactggccttagacacccctcgggctcctcagctcgtcgggcagtttattgccagagctgtgggggacggcattctgtgtaatacatacattgacagttacaaaggcacggtggattgtgtgcaggccagagcagcccttgacaaggctactgtgcttttgtctatgagtaagggcggaaaaagaaaggatagtgtttggggctccggcggaggccagcagtcagtgaaccacttagtgaaggagatcgatatgttattgaaggagtatttactttctggcgacatctctgaggctgagcattgcttgaaggagttggaggtccctcattttcatcatgagctcgtgtacgaggctattattatggtgctcgagtcaacgggggagagtacttttaagatgatcctagatttactgaagtcactgtggaagtctagtaccataaccgtggatcagatgaagcggggttatgagcgcatctacaatgagattcccgacattaatcttgatgtgccccattcctactctgtgctggagcgctttgtggaggagtgcttccaggctggaataatcagtaaacagctgcgagatctgtgcccaagccggggacgtaaaagatttgtgagcgagggggacggaggtcgcctgaaacctgagtcctattag

SEQ ID NO: 30260 - DNA, 1377 bp, Artificial Sequence
  Description of Artificial Sequence: Synthetic coding sequence
atgactaaatatccggataacctctctgattccctgttcagcggcgatgaggaaaatgctggcacagaagagatcaagaacgagatcaacggtaattggatcagcgcctcttccataaatgaggctcggattaacgcaaaggcgaaacgtcgtttacgaaaaaattcaagtcgagatagtggccgtggcgactccgtgtccgactcaggtagcgacgccctgcgttctggccttacagtccccacttcacctaaggggaggctgctggaccggaggtcaaggtcagggaaaggcagaggcctgccaaaaaagggcggagctggcggaaaaggggtgtgggggacgcccggacaggtgtacgacgtagaggaggttgacgttaaggacccaaactatgatgatgaccaagaaaattgtgtgtacgaaacggttgtcttaccactcgacgagagggccttcgagaaaacattgacaccgatcattcaagaatacttcgagcatggagacaccaacgaggttgctgagatgctcagagatctcaatttaggcgaaatgaaatccggcgtgcctgtcttggctgtctccctggcgctggagggcaaagcttcccatagagaaatgactagcaagttacttagtgatttgtgcggtactgtgatgtccacgaccgacgtcgaaaaaagttttgacaagctcctgaaagaccttccagagctcgctctcgatacacctcgcgcacctcagctggtcgggcagttcatcgctcgggcagttggcgatggcatactttgcaatacttatatcgactcatacaagggaaccgtagattgcgtgcaggccagggccgctttagataaagctactgttctcctgtctatgtcaaagggaggaaagagaaaagactcagtgtgggggtcgggtgggggtcagcaaagcgtcaaccaccttgtaaaagagattgacatgctactaaaggagtatcttttatctggagatatctctgaagcggaacattgtctcaaagagctagaggttcctcacttccaccacgagcttgtgtacgaagcgattattatggtgctggaatccacgggtgaatcaacctttaagatgatactcgatctgctgaaatccttatggaaatctagtaccatcacagtcgaccaaatgaaacgagggtatgaaaggatttataatgagatcccagacattaacctggacgtgccccactcttatagcgtgttggagcgtttcgtcgaagagtgttttcaggctggcattattagtaagcaactgcgggatctctgccccagccggggaaggaaaagattcgtgtccgagggtgacggcggaagactgaaacctgagagctactag

SEQ ID NO: 30261 - DNA, 696 bp, Artificial Sequence
  Description of Artificial Sequence: Synthetic coding sequence
atggacgtcgaaaacgaacaaatattaaacgttaaccccgcagagaatgcaggcacggaggaaataaagaatgagatcaacggcaactggattagcgccagctccataaacgaggcacgcattaatgccaaggccaaacggagattacgtaagaattcctctcgagactctggcagaggcgattccgtgagcgactccgggtcagatgccctacgttcagggcttacagtgccaacgtcccccaagggtcggctgctcgatagaagatctcgtagcggcaagggcagaggtttacccaaaaaaggcggagcaggcggtaagggcgtatggggcacccccggtcaggtgtatgacgtagaggaggttgacgttaaggaccccaactatgacgacgaccaggagaactgtgtgtatgagactgtggtacttccgcttgatgagcgcgcatttgaaaaaactctgactccaattattcaagagtattttgagcatggggatacgaacgaggtggcagagatgctgagagatttgaatctgggagagatgaaatccggtgtcccggtcctggctgtcagtctggctctagaggggaaggcatcccaccgggagatgacttcgaagctgctatcggatctgtgcggcactgttatgtcaacaacggatgtcgagaaatcatttgacaagctactgaagtag

SEQ ID NO: 30262 - DNA, 786 bp, Artificial Sequence
  Description of Artificial Sequence: Synthetic coding sequence
atgtttgaggccaggctggtgcaaggcagtattttgaagaaggtgctggaagctctcaaggatctgatcaatgaggcgtgctgggacattagctcttctggcgtgaaccttcagagcatggactcctctcatgttagcctcgttcagctaactttacggtccgagggatttgatacttaccgatgtgataggaacctggccatgggcgtaaatttgacctcaatgtcaaagatactaaagtgtgcagggaatgaagacatcatcactcttcgggctgaagataatgctgacacacttgccctggttttcgaggcacccaaccaggagaaggtcagtgactatgagatgaagttgatggatctggacgtggagcagctgggtatcccagagcaggaatatagttgtgtcgtgaaaatgcctagtggagagttcgccagaatctgcagggacctctcccacatcggggacgctgtggtaatttcatgtgcaaaggatggggtgaagttctcagcttctggcgaactagggaacggaaatattaagctttctcagactagtaacgttgataaggaggaagaggccgtcaccatcgaaatgaacgagccagttcagctgacatttgcactgcgctacctgaactttttcactaaggccacccctctctctagtaccgtcacactctctatgtctgctgacgtgcccctcgtggtggagtacaaaattgcagatatgggtcacctgaaatactatcttgcccctaagatagaggatgaagagggttcatag

SEQ ID NO: 30263 - DNA, 786 bp, Artificial Sequence
  Description of Artificial Sequence: Synthetic coding sequence
atgtttgaggcaagattggtccagggaagtatcctaaagaaagtgttagaagccctgaaggatcttattaacgaggcatgttgggacatttctagctctggtgttaatctgcaaagcatggattcaagccacgtttcccttgtccagctgactctgagatctgaagggtttgatacctaccgttgcgatcgcaacctggccatgggggtcaacctgacctccatgagtaaaatcctcaagtgtgcaggaaacgaagacatcatcacccttagggctgaggataacgccgacacactcgctctcgtgtttgaagcccctaaccaggaaaaagtttctgactacgagatgaaactgatggatctggacgttgagcagcttggtattccagaacaggagtattcttgcgtggtgaagatgcccagtggggagttcgcaagaatttgccgagacctgagccacattggcgatgccgtggtgataagctgtgcgaaagatggcgtgaagttcagcgcaagtggcgagctggggaacggcaacattaaactgagccagacctccaacgttgataaagaggaagaggccgtgaccatcgaaatgaacgagcccgtccagctgacattcgctctgcggtacctgaacttttttaccaaggcgacccccctgtcaagtaccgtaacactatctatgagtgctgatgtccctttggtcgttgaatataaaattgccgatatggggcacctgaaatattacctggctccaaagattgaggacgaggagggttcctag

SEQ ID NO: 30264 - DNA, 1140 bp, Artificial Sequence
  Description of Artificial Sequence: Synthetic coding sequence
atgtcttcgccctctctttcggatttgggcaaaagggagccagctgcggctgctgacgagagaggaacacagcagcgacgtgcttgtgctaatgccacttggaattctatccacaacggcgtgattgccgtgttccagagaaaaggactcccagaccaggagctgttttctctgaacgagggcgtgcggcagctgctcaagacagaactgggatcgttcttcactgagtacctgcagaatcagcttctgacaaaaggtatggtgattctgcgcgataaaatccgcttctacgaggggcagaaactgcttgactcgttggccgagacatgggatttctttttctctgacgtactgccaatgttgcaggcaattttttacccagtacagggaaaggaaccgagtgtgcggcagctggccctgttacacttccggaacgcgattacactgtctgtaaagttggaagacgcgctcgctagggcccatgcaagagtgcctccagcgattgtacaaatgcttcttgttctgcaaggggttcacgagagtaggggcgtgactgaagactatctgcgtctagagacactcgtgcaaaaggtggttagcccatatctgggcacatatgggctccacagcagcgagggcccattcacccattcttgcatcctggagaaaagactgttaaggagaagtagatcgggggacgtcctagctaagaacccagttgtgagaagtaagagctataacaccccgctgctcaatcccgtacaggaacacgaggctgaaggcgctgctgcaggcggaaccagcattaggaggcactcagtttccgagatgacctcatgtccagagccccagggcttctctgacccacctgggcagggtcctacaggcacctttcgctcatcacctgcgccacacagcggaccttgtcctagtcggttatatccaacaactcagccacccgaacagggtctggatcccacacggtcttccctaccgaggtcctctccagagaatctagtggatcagatacttgaatccgttgactccgattctgagggaatcttcatcgactttggtagaggcagaggctccggtatgagcgatctggaaggctctggaggcagacagtccgtggtgtag

SEQ ID NO: 30265 - DNA, 1167 bp, Artificial Sequence
  Description of Artificial Sequence: Synthetic coding sequence
atgagaactctcagacgcctgaaattcatgagtagcccttccctgtcggatttgggtaagcgtgagcctgctgcggcagcagacgagcggggtacgcagcagcggagggcttgtgcaaatgcaacctggaattctattcacaatggggtcattgcagtgtttcaaagaaaaggattgcctgatcaagagcttttttcgctcaacgagggagttcgtcaactgttaaaaactgagcttgggtccttttttactgaatatctgcagaaccagctgctgacaaaaggcatggtcatcctgagggataaaattcgtttttacgaggggcaaaaactgctggactcactggcggagacatgggatttcttcttcagtgacgtcctgcccatgttgcaggccatcttctaccccgtgcagggcaaggaacctagtgtacgccaactggcccttcttcatttcagaaatgcgataacactgagtgtgaaactggaagatgctctggcacgcgctcacgcacgagtgccaccggcaatcgtccagatgctgttggtgctccagggagttcacgaatcacgcggagttacggaagattacctcaggctggagactctggtgcagaaagtggtgtccccctatctgggcacctacggattacattcatctgaggggccttttacccactcttgtatcctcgagaaacgtctcctgagaaggtcccgatccggagacgtgttagctaagaacccagttgtgcggagtaaatcttacaatactcccctgctcaatccagtgcaagaacatgaagctgaaggtgcagctgctggtggcacttccatccggagacattctgtaagtgagatgacatcctgccccgaacctcaaggtttttcggacccacctggccaaggcccaacgggcactttccgctcgtccccggctccacacagcggaccttgcccgtcaaggctctaccctactacccagccccctgagcaagggctggaccctactcgcagtagcttgcccagatcttctccggagaatctcgtggatcagatcctggaatctgtagactctgattctgagggcattttcatcgactttggcaggggcaggggtagtggcatgtccgatctggagggctccggcggtagacagtcagtcgtgtag

SEQ ID NO: 30266 - DNA, 804 bp, Artificial Sequence
  Description of Artificial Sequence: Synthetic coding sequence
atgtccagcccatccctctccgatttgggcaaacgcgagccagcagccgctgctgacgaacgcggtacccagcagagacgggcatgcgcaaacgcaacatggaacagcatccataacggtgttatcgcggtgtttcagcgaaaaggcctgcctgatcaggaactttttagccttaacgagggtgtgcgccagctcctcaaaacagaactcggttccttctttacagaataccttcaaaatcagctgctaactaagggtatggtaatactgagggacaagataaggttctacgagggacagaagctactcgactctctcgccgaaacttgggactttttttttagcgacgtcctgcctatgttgcaggctatcttttatcctgtgcagggcaaggaaccttctgttaggcagctagccctgcttcactttcgaaatgccatcacactgagcgtgaaactggaggacgccctggcaagagcccatgctagggtgcctcctgctatcgtgcagatgctcctggtactccagggcgtgcatgaatctagaggtgtgacggaagactacctcagactggagaccctggtgcagaaggtggtgtctccatacctcggcacatacggactccattcttcggaggggccattcacccattcttgcatccttgaaaaacggctgctcaggagatctcgtagtggggatgtactggctaagaatcccgtcgtcaggtcgaagtcgtacaacactcccttgctgaaccccgtccaagagcacgaagcggagggagcggctgcgggaggaacctag

SEQ ID NO: 30267 - DNA, 681 bp, Artificial Sequence
  Description of Artificial Sequence: Synthetic coding sequence
atgtcctcccccagtctctcggaccttgggaagagggaacccgcagccgcagccgacgaacgaggcacccaacagcggcgtgcctgcgctaacgcaacatggaatagcatccataacggagtgattgccgtgtttcagcgcaaaggcttgccggatcaggagcttttctcactgaatgagggagtgcggcagctgctcaagactgaactgggctcgttcttcacggaatacctgcagaaccaactcctcacgaagggtatggttattctccgcgataaaattcgattttatgaggggcaaaaattgctcgactctctggccgagacgtgggatttctttttttctgatgtgctgcccatgctgcaggccatattctaccccgtccaggggaaggagcccagcgtccgtcagctagctctgctgcatttcagaaacgcaattacacttagtgtgaaactcgaggacgccctcgcccgagctcatgccagagtcccgcctgctatagtgcaaatgcttctcgtgctgcaaggtgtgcacgagtctcggggtgtcacagaagattatctgcgcctcgagactttggtgcagaaagtagtgagtccctacttggggacttacggacttcatagttccgaaggcccatttactcatagctgcattctcgaaaagagattactgtag

SEQ ID NO: 30268 - DNA, 1236 bp, Artificial Sequence
  Description of Artificial Sequence: Synthetic coding sequence
atggtttgcctggaactgtcccagcgcgaggcatgggggtcaggctcccccgaaaaaatgccagctcagcctgaggggctctaccgcctgaagttcatgagcagcccttcccttagcgacttgggaaaaagggaaccagcagctgcagccgatgagagagggactcagcagaggagggcctgtgcaaatgcaacctggaattcaatccacaatggggtgatagccgtattccagagaaaaggtctgcccgaccaggagctgtttagcctgaacgagggcgtcagacagctcctgaagactgaactaggcagctttttcacagaataccttcaaaaccagttgctgacaaagggcatggtcattcttagggacaagattagattttacgaggggcaaaagctactggactctctggcagagacttgggacttttttttcagcgacgtactgcctatgctccaggctatcttctaccctgttcagggaaaggagccatctgtgcggcagctcgccctcctgcacttccggaacgcaattactctgagtgtcaaacttgaggacgccctggcacgagctcacgcacgggttccgccagccattgtgcagatgctcctggttcttcagggcgtgcacgaatctcgcggagtgactgaagattatctccgtctagaaacccttgtgcagaaagtggtgagtccctatctgggcacctacggtctacatagcagtgaaggaccattcacacattcctgtatcctggaaaagcgactcctccgacggagtaggtcaggagacgtcctggccaagaatccagtagttaggtccaagagttataatacgcctttactcaatcccgtgcaggagcacgaagcagagggtgctgccgctgggggtaccagcatcaggaggcacagcgtgagcgaaatgactagctgtccagagccccaaggattcagcgaccctccaggccagggaccgacgggtaccttccggtcaagcccagcaccccattcagggccatgtcccagcaggctatatcctactacacaacctccagaacaaggactggatcccacacgaagttcccttccgcgatcaagtccagagaatcttgtggatcaaatcctcgagagcgtggactccgactctgaagggatctttatcgatttcggtcgcggacgcggttcagggatgagcgacttggagggaagtgggggaaggcaatcagttgtctag

SEQ ID NO: 30269 - DNA, 2649 bp, Artificial Sequence
  Description of Artificial Sequence: Synthetic coding sequence
atggagcccgcaccggcaagatcacctaggccccagcaggacccagctcgacctcaagagccaacaatgcctccgcctgaaactccctccgagggcagacagcctagtccatctccatcacctacagagagggcacccgcatcagaagaagagttccagttcctgcggtgccaacaatgccaggcagaggcgaaatgccctaagctgctgccctgcctccacaccctgtgctctgggtgcctcgaagcgtcgggcatgcaatgccccatatgccaggctccttggcctctaggggcagacactccggcactcgataacgtatttttcgagtccctgcaacgcagactaagcgtttaccggcagattgtagacgcacaggcggtctgtactcgttgtaaggagagtgccgatttctggtgctttgagtgtgaacaactgctctgcgcgaagtgctttgaggcacatcagtggttcttgaaacacgaagctcgccctctggctgagcttcgaaaccaatccgtccgggaattcctcgacggtacaaggaaaacgaacaatattttttgctcaaatccaaatcataggacaccaacacttacttctatttattgcaggggttgctccaagccactgtgttgtagttgcgcattactggacagctctcactccgagttgaaatgtgatataagtgctgaaatacagcaaagacaggaagagttggatgccatgactcaggctttgcaggagcaagacagtgcgttcggggcagttcacgcgcagatgcacgccgcagttggacaactgggacgagctcgtgccgaaacagaggagctgattcgggagcgggttcgtcaggttgttgcccacgttcgcgcacaggaaagagagctgttagaggctgtggacgcgcgttatcagcgggactacgaagaaatggccagtagactaggaagactggacgcagttctgcaacgaatacgaactggtagcgcactggttcagaggatgaaatgctacgctagcgaccaagaagtcctagatatgcacgggttcttaaggcaggccctctgtaggctcagacaggaggagccccaaagcctgcaggctgccgtgcggactgatggcttcgatgagtttaaggtgcgcctacaggatctgtcttcctgtatcacacagggaaaggacgctgccgtctccaagaaagccagcccagaggctgcttccacgcccagagacccaatcgacgtggatctgccggaagaagcagagcgcgtgaaagcacaggtccaagccctcggtctggcggaggcacagcctatggccgtagtgcagtcggtacccggtgcccaccctgtccccgtctacgcattctctatcaaaggaccttcatacggcgaagatgtgtcaaataccactactgcccagaaacgcaaatgcagtcaaacacagtgccctaggaaggtgatcaagatggagtctgaggaggggaaggaggccagactggcccgatctagccccgagcagcccagaccatctacaagtaaagccgtgagtccccctcaccttgatggcccaccgagtcctcggagtcccgtaatcggaagcgaggtattcttgccaaattcaaaccatgtggccagtggcgcaggcgaggcggaggaacgagtagtggtaattagcagtagtgaagattcagatgcggaaaattcttcaagcagggagctcgatgactcttcaagcgagagcagtgacctgcagctggagggaccatccactctcagggttttagatgagaacctcgcagatccacaagctgaggacaggcccctggtctttttcgatttgaaaatcgataatgaaacgcaaaaaattagccagttggcagccgtgaatcgagaatccaaattcagagtagttatacagcccgaggccttctttagcatatatagcaaggcagtatcccttgaggtcgggttgcaacactttttgtcttttctaagctctatgagacgtccaatcctggcatgctacaagctgtgggggccaggtctgccgaactttttccgtgccctcgaggatataaaccgcctttgggaattccaggaggcaatctctggctttctcgctgccttgccactaattcgcgagcgagtgccaggggcaagttcctttaagctgaagaacctcgcccaaacatatttagccagaaacatgtctgaaagaagcgcaatggctgcagtgctggccatgcgggatctctgtcgcctgctggaggtgtcacctggccctcagctcgcacaacacgtctaccctttcagtagtctccagtgctttgctagtctgcagcctttggtgcaggcagcggtcctgcccagggccgaggccaggcttttagccctacataacgtgtccttcatggagcttcttagcgcccatagacgagatcgacaggggggactaaagaaatatagtcggtatctgagcctgcaaacaacaacgctccccccagcacagcctgccttcaatctccaggcgctgggaacttattttgagggactgctggaaggacccgctttggcacgagccgagggcgtcagcacgcctttagccggtaggggtctcgctgaaagggcgtcccagcagtcctag

SEQ ID NO: 30270 - DNA, 2490 bp, Artificial Sequence
  Description of Artificial Sequence: Synthetic coding sequence
atggagccagcccctgctagatcgcccaggccccagcaggaccccgctcggcctcaggagcctaccatgccccctcctgagacaccatctgagggcagacaacctagccccagtccctcgcctaccgaacgtgcgccagcatcagaagaagagtttcaatttctgaggtgtcaacagtgccaagcggaggctaaatgccccaagttgctgccatgtctgcacaccctatgtagcggctgtctcgaggcttccgggatgcaatgtcctatctgccaggccccatggccactgggggctgacacccctgcattagataacgtcttctttgaatcattgcagcggagactctcagtgtaccgtcagatcgtggatgctcaggccgtctgcacccgctgcaaggagagcgcggacttttggtgctttgagtgtgagcagctactgtgcgcaaaatgctttgaagctcaccaatggttcttaaaacacgaggcacggccactggccgagctcaggaatcagagcgtgagggagtttctggacggcactcgcaaaacaaacaacattttctgtagcaatccaaaccacagaacccccacactgactagcatttactgtagagggtgctcgaaacccctgtgttgctcctgtgcgctgttagattcttctcactccgagctaaagtgtgatatatccgccgagatccaacaacgtcaggaagaattggatgccatgactcaggccctgcaggagcaggacagcgccttcggagcagtgcatgctcagatgcacgctgctgtgggccagctggggcgagccagagccgaaacagaggaactaatccgcgagcgggtgcggcaggtggtagcccacgtcagggcacaggagcgggagttgttggaggctgttgacgctcggtatcagagggattacgaggaaatggcatcacgactcggcaggttggatgctgtcttacaacgcatcagaaccggctccgccctggtgcaacggatgaaatgttatgcatcggatcaggaggtgctcgacatgcacggatttcttaggcaggcattatgtcggttacgacaagaggagccacagagtctgcaggcggctgtgaggaccgacggcttcgacgaatttaaagtgcgcctgcaggaccttagcagctgtattacacaaggtaaggacgctgcagtgagtaaaaaggcgagtccggaagcagcttcgactcctagagaccctattgatgttgacttgccagaggaagctgagagggttaaagcccaggtgcaggcactgggcctggcagaagcgcaacctatggccgtggtgcagagtgttcctggggctcaccctgttcctgtttatgccttttccatcaaagggccatcctacggagaggatgtatctaataccactaccgctcaaaaaaggaaatgtagccagacccagtgtccgcgtaaggtgatcaagatggaatccgaggagggaaaggaggctcgattggccagatccagtcctgaacaacccaggccatccacctcgaaagccgtgtcccctccacacctggatgggccaccttcgccccgtagtccagtcatcggatctgaagtgtttctacctaatagtaaccatgtggcgtccggcgctggcgaggccgaggaacgggttgtggtcatttcctcatctgaggatagcgatgcggagaacagttgtatggagcctatggaaactgccgaaccacagtcttcccccgctcattcctccccagcccactcctctcccgctcactcttctccagtgcagtctctcctgagagcgcaaggggcaagctccttgccttgcggaacctatcaccctccagcatggccccctcaccaaccagcagaacaagcagcaacccctgacgcagagcctcacagtgaacctcctgaccaccaggagagaccagcggtacatagaggtattcggtacctgttgtaccgcgcacaaagagctataaggttgaggcatgcccttcgtctacatccccagcttcaccgtgccccaattagaacctggtcaccccacgtggtgcaagctagcaccccagcgataacagggcctctgaaccaccccgctaacgcacaagagcatccagctcagttacaacgcggaatctctccaccacacagaattcggggagctgttcgcagccggagccggtcccttcggggtagcagccatttaagtcagtggcttaataatttcttcgccctacccttttccagtatggcgtcccaattagacatgagtagtgtggtgggagctggggagtcacgcgcacaaactttgggcgcaggcgtccctcccggtgattccgtacggggatccatggaggcttcccaggtacaggtgccgttagaagcaagcccaattacttttcctcctccatgcgcaccagagagaccccctatctctcccgtgccaggcgctagacaggccggactctag

SEQ ID NO: 30271 - DNA, 2346 bp, Artificial Sequence
  Description of Artificial Sequence: Synthetic coding sequence
atggagcctgctcccgctcggagcccacggcctcagcaggacccggctaggcctcaagaacctaccatgccaccacccgaaaccccgagtgaaggcaggcagccatctccctcgcccagtccaactgagcgagctccagcttccgaggaggagtttcagttcttacggtgccagcagtgtcaagccgaagccaaatgcccaaagctgctgccctgcctgcacactctgtgcagcggatgtctcgaagctagcggcatgcagtgccctatttgtcaggccccttggcccctgggtgcggatacgcccgctctggacaacgtgttttttgagagcctgcaacggagactaagcgtctatagacaaatcgtggatgcccaggctgtctgcacccgctgtaaggaaagtgcagacttctggtgttttgagtgtgagcaacttctctgcgcaaagtgcttcgaagcacaccagtggtttttaaagcatgaagctcggcctttggccgagctacgcaatcaatcagtgcgcgagtttctggacggcacaagaaagactaataacattttttgctcaaatcctaatcacaggacacctacattgaccagcatctactgccggggttgctccaaacccctgtgctgctcctgtgcccttttagactcaagccattctgagctcaagtgcgacattagcgccgagatccagcagaggcaggaagagttagatgcaatgacccaggcgctgcaagagcaagattccgcttttggagctgtgcacgcccagatgcacgccgcagtgggccaactgggtagagctcgggctgagaccgaagaactaattcgcgaaagggtgcgccaggtagtagctcacgtgcgcgcacaggagagggagctactggaagctgtggatgcaaggtaccagagagattatgaggagatggcttcccggcttggaagactggacgcggtcctccaacgcattaggactggaagcgccctggtacagcgaatgaaatgctatgcttctgatcaggaagtgctagatatgcacgggtttctcaggcaggctctatgtaggttaagacaggaggagccgcaatctctccaagctgctgttaggaccgacggcttcgacgagttcaaggttaggctgcaggacctctcctcttgcattacacagggcaaggacgccgctgtttctaaaaaggcttctcccgaggctgcaagcacccctagggatccaattgatgttgacctcgatgtatccaataccacgaccgctcaaaagagaaagtgctcgcagacccaatgtcccagaaaagtcattaaaatggaatctgaggagggtaaggaagctcgtcttgccagatcctccccagagcaacctcgaccctcaacctccaaagctgtcagcccaccacacctcgatggaccaccctcaccgaggtcacccgtgatcggctctgaggtcttcctccctaatagcaaccacgtggcctctggagccggagaagccgaagagagggtggtggtgatctcctcttccgaagattccgatgctgagaactcgtgcatggagccaatggagactgcggagcctcaatcgtcccccgctcactcctcacccgctcacagcagcccggcacatagttctcctgtacagagtcttctgcgggctcaaggggcttcctcgcttccctgcggtacttaccacccgcctgcctggccccctcatcagccagccgaacaggctgcaaccccggacgcggagccccatagcgaaccccctgatcatcaggaacggcctgctgtacaccggggtatcagatacctgctctaccgggcacaaagagccattagactgcggcacgcattgaggctgcacccccagctccacagggctccaattcggacttggagcccccatgtcgtgcaggcaagcactccggcaatcacaggcccacttaatcaccccgcaaacgcccaggagcaccccgctcagctccagcggggtatttctcctccgcatcgaatcagaggcgcagtgagatctcgtagcaggtctctccgcggatcaagtcacctcagccagtggctgaacaattttttcgctctgcctttcagctcaatggccagccagttggacatgtcatctgtggtaggggctggggagagcagagcccagactctgggtgctggcgtgcctcctggagattccgtgcgtggttctatggaggcctcacaggtgcaagtgccactggaggcttcacctattacctttcccccaccatgcgctcccgagcgcccacccatttcaccggttcccggagccagacaggctggactctag

SEQ ID NO: 30272 - DNA, 1272 bp, Artificial Sequence
  Description of Artificial Sequence: Synthetic coding sequence
atggaacctgcccctgcaaggagccctaggccccaacaggatccagcccgaccccaggagcccactatgcccccacccgaaacaccctcagaagggaggcaaccctctccgagcccgagtccaacagaaagggcacccgcttcagaggaggagtttcagttcttgcggtgtcaacagtgccaggctgaagctaagtgcccaaaattgctgccgtgtctgcataccttgtgttccggctgcctggaagcctccggcatgcaatgtcctatatgtcaggccccttggcccttgggcgcagatacacctgctctggataatgtcttttttgaaagcctgcagagacgtctaagtgtatacagacagatcgtagatgcccaggctgtctgtacccgatgtaaagagagcgcggacttctggtgttttgagtgcgaacagctgctatgtgcgaaatgttttgaagcacaccagtggtttctcaagcacgaggcacgccctttggcggagctccggaaccagtccgttagagagttcctggacgggactcggaaaaccaacaacattttttgctccaatccaaatcacaggacaccaactttaacctccatctattgtcgcggttgctcgaagccactctgttgcagttgcgccctgcttgacagtagccattccgagctgaagtgcgacatatctgctgagatccagcaacgccaggaggaactggatgctatgacccaggccttacaggaacaggatagtgcattcggggcagttcacgcacagatgcatgcagccgttggccagctgggaagagctagagctgagacagaagagctcatacgtgaaagggtacgccaggtggttgcacatgttcgtgctcaggaaagggagctgctggaggccgtggacgcacgttaccagagagattacgaggagatggcttcacgattgggaagactggatgcagtgttacaaagaatccgcaccggctcagccctggttcaaaggatgaagtgctatgcatcggatcaggaggtgctggatatgcatggatttctccgtcaggcactgtgtaggcttcgccaggaagagccccagtctcttcaggccgctgtaagaacagacggttttgatgagtttaaggtgcggttgcaggatctttcatcctgtattacacaggggaaggacgcagctgtttcgaaaaaagcctctccagaagctgcctctacacccagggaccccattgacgtagatctgcgaaacgccctgtggtag

SEQ ID NO: 30273 - DNA, 1308 bp, Artificial Sequence
  Description of Artificial Sequence: Synthetic coding sequence
atggagcctgcccctgctcgctccccaagaccacagcaagaccctgcacgaccacaggagcctaccatgccaccccctgagacaccatccgagggcaggcagcccagtccctctccatctcccaccgaacgggctccagctagcgaggaagaattccaattcttaagatgtcagcaatgtcaggcagaggccaagtgcccgaaattgctcccctgtctgcataccctgtgctcaggttgtctggaggccagcggaatgcaatgccctatctgtcaagccccttggccgctcggggcagataccccagctctggacaatgtgtttttcgagagcctgcaacgcaggttatccgtttaccggcagatcgtggatgcccaggctgtttgtacaaggtgtaaggagtctgctgatttctggtgcttcgagtgtgaacagcttctctgcgcaaagtgcttcgaggcacaccagtggttccttaaacatgaagcgaggccactcgctgagctccgtaatcagagcgtgcgggaatttctggacggaactagaaagactaacaacatattttgctcgaaccctaatcatcggacgccaacactgacatccatatactgcagggggtgttctaagccactgtgttgcagctgcgcattgctggactccagccattccgagctgaagtgtgacatctctgccgagatccaacagcgccaggaagaattggacgccatgacacaagcgttacaggagcaggatagcgcatttggtgctgtccacgcccagatgcatgctgccgtcgggcagctgggcagagcgagggccgagaccgaagaactcatccgggaacgcgtgaggcaggtggtcgcccacgttagagcacaagaacgtgagctgctcgaggccgtggatgcaagataccaaagggactatgaggagatggccagtcgactcggcagattggatgcagtattgcagcgcatcagaacaggttctgcccttgtgcaacgcatgaaatgttacgcctcagaccaggaagtcttagatatgcacggctttctgcgacaagccctgtgtagattgcgtcaggaggagccccaaagtttgcaggccgctgttcgtacagatggattcgacgagttcaaagtaaggttgcaagatctgtcttcctgcattacccaaggcaaggatgctgcggtgtccaaaaaagcgtcacccgaggctgcctctacacctcgagacccaatcgatgtagacctgctaccgcctcccgcacatgccctaactggcccagctcaatcgtcaacacattag

SEQ ID NO: 30274 - DNA, 1902 bp, Artificial Sequence
  Description of Artificial Sequence: Synthetic coding sequence
atggaacccgctcctgctaggtctcctaggcctcagcaggacccggcaagacctcaagaacccacgatgccacctcctgagaccccgagcgaaggaagacaaccctcacccagcccctcccctaccgaaagagcgccagcctctgaggaagagttccagttccttcggtgccaacagtgtcaggctgaagccaaatgcccaaagctgcttccttgcctccacactctatgttccgggtgtcttgaggccagcgggatgcagtgccctatttgtcaggccccatggccattgggcgctgacacgcctgccctggacaatgtctttttcgaatctctgcaacggaggctctcggtttacagacagatagtcgacgcgcaggccgtgtgcaccaggtgtaaggaatcggcggacttctggtgctttgagtgcgagcagctcctctgtgctaaatgttttgaggcccaccagtggttcttaaaacacgaggctagacccttggcggaactgaggaaccagagcgtgcgcgagttcctggacggcaccagaaaaacaaataatatattttgttcaaacccgaaccacaggacgcctaccctcacttccatctactgcaggggatgttctaaaccactgtgttgctcatgcgccctgttagatagctcacacagcgagctgaaatgcgacatatccgcagaaatccagcaacgtcaggaagagctggatgccatgacccaggccctacaggaacaggactctgcatttggggctgtacatgcgcaaatgcacgcagccgtgggccagcttgggagagctcgcgctgaaactgaagagctgattagggaacgggtcagacaggtggttgcccacgtacgggcacaagaacgggaactgctggaggctgttgacgctcgctaccagagagattatgaggaaatggcgagtagacttgggcgtctggacgcagttttacagagaatccgcactggcagtgcgctggtgcagcggatgaagtgctacgcatcagaccaagaggtgctcgacatgcacggcttccttagacaggccctttgccgattgcggcaggaggagccccaaagtctccaagctgctgtgcgtacagatggctttgacgagttcaaggtcagacttcaagatctcagctcctgcatcacacaggggaaggatgctgcagtatccaagaaagctagcccagaagccgctagtacgccccgagacccaattgatgtcgacttgccagaggaggcggagagagtcaaggcccaggtacaagcactgggactggctgaagcccagcctatggctgttgttcaatccgtacctggagcccatccagtgcctgtctacgccttctctatcaagggtcctagctacggtgaggacgtctcaaacactacaacagcacagaaaaggaaatgttctcagacccagtgcccccgtaaagtcatcaagatggagtccgaggaggggaaggaggctcgcttggcacggtcatctccggagcagcccagaccttctaccagtaaagccgtatcccctccacacttggatgggcctcccagcccacggagtcctgtgatcgggtctgaagtcttcctgcccaactcaaatcatgtggcatctggcgcaggggaagccgaagagcgggtggtagttatttcgagttcagaagactcggacgctgagaactcgtcaagcagggagctcgacgactctagctccgaatcatctgacttgcagctggagggaccctccacccttcgcgtgctggacgagaaccttgccgacccacaggctgaagatagaccactcgtctttttcgacctcaagattgacaatgagtccgggttttcttggggatatcctcacccattcctgatttag

SEQ ID NO: 30275 - DNA, 1332 bp, Artificial Sequence
  Description of Artificial Sequence: Synthetic coding sequence
atggccgtagtgcagtcagttccaggcgctcaccccgtgccggtttatgctttcagtatcaagggcccttcctacggggaggacgtgtccaataccaccacagcccagaaacggaagtgttctcagacacagtgtccgagaaaagtgattaagatggagagcgaagaaggcaaagaagctcgcctcgcccgtagctcgcccgaacagcctagaccttccacctcaaaagccgtgtcacctccacacctggatggccctcccagcccaagaagccctgtcattggtagtgaagtgttcttacccaattcaaaccacgtagcctcgggagcgggagaggcggaggagcgggtcgtcgtgatttcaagtagcgaagactcagacgctgagaatagtagttcacgggagctcgatgactcatcgagcgaaagcagtgatctgcagctggaggggccatccaccctcagggttcttgacgagaatctagctgacccacaggcggaggaccggcctttggttttttttgatctgaagattgacaatgaaactcagaaaatctctcaattggcagctgtgaaccgcgagtccaagttccgcgtcgttatccagccagaggcctttttttccatctatagcaaggccgtcagcctggaggtgggactgcaacatttcctatctttcctgagcagcatgagaagacccatcctggcctgctacaaattgtggggccctggtctgcccaatttcttccgtgccctcgaggacataaatcggctgtgggagttccaggaggccattagtggattcctcgcagccctgccactgatccgtgaaagggtgcccggtgcctcatccttcaagttgaaaaatctagctcagacttatctggctaggaatatgagcgagcgaagcgccatggccgcagtgttagccatgcgggatctgtgtcggcttttggaggtgtcccctggccctcagctggcacagcatgtgtaccccttttccagcctgcaatgtttcgcatcactccaacctttagtgcaggctgccgtgcttccgcgagctgaggcccgacttcttgctctccacaatgtttcgtttatggagcttctgtccgcccatcgacgagatagacaaggaggattgaaaaagtacagcagatatttatccctccagactacgaccttgccgcctgctcagcccgcttttaacctccaggctttaggcacctacttcgagggactactcgagggcccagccttagccagggctgaaggggtgtctacccctcttgccggacgcggattggccgagcgcgctagccagcagagctag

SEQ ID NO: 30276 - DNA, 2598 bp, Artificial Sequence
  Description of Artificial Sequence: Synthetic coding sequence
atggagcccgcacctgctaggtcacccagaccgcaacaggaccccgcaaggcctcaagaacccaccatgcctccaccggagaccccaagtgagggtcgccaaccaagcccttcccctagtcccacggaacgggctccagcgtctgaggaagagtttcagtttctcagatgccaacagtgtcaggcggaagccaagtgtccgaaactgctcccatgtctgcacaccctgtgcagtggatgcctggaggccagcggcatgcagtgtccaatctgccaggctccttggcccctcggggctgatacccccgctctggataatgtgttcttcgagtcactgcagcgacgcctcagcgtgtatagacagattgtggatgctcaagccgtttgcactcgatgtaaggagagcgctgatttttggtgcttcgagtgtgagcaattgttgtgcgcaaaatgttttgaggcgcatcagtggtttctcaaacatgaggccaggcccttggcagagttgcggaaccagtctgttcgggaattcctcgacgggactcgtaagaccaacaatatcttctgctctaatccaaatcaccgtacacctacacttacctcgatctattgcagagggtgctcaaagcccctgtgttgctcgtgcgccttattggattcatcccactctgagttgaagtgcgatatatcagccgagatccagcaacgacaggaagagctggacgctatgactcaggccctgcaggagcaggatagtgcttttggcgcagtacatgctcaaatgcacgcagccgtgggccagctggggcgagctcgtgcagaaacagaggaactcattagggagcgggtgcgacaggtagttgcgcacgttagggcgcaggaacgtgagctgctcgaggctgtggacgccaggtatcagcgcgattacgaagaaatggcctcacgcctggggaggttggatgccgtcctccaaaggattcgcaccggatctgcattggtgcagcggatgaagtgttacgcttctgaccaggaggtactggacatgcacggcttcctgagacaggccttgtgtagacttcgtcaggaggagcctcagtctctccaggccgcagtccggacagatggattcgatgaattcaaagttagactccaggacctgtcctcctgtattactcagggcaaggatgcagctgtgtccaagaaggcttcacctgaggctgctagcactccaagagacccgattgacgtggacttacctgaagaagctgaaagagtcaaggcacaagtgcaagccctggggctggcggaggcacagcccatggctgtagtgcaatcagttcctggcgcacacccggttcccgtgtatgctttctctatcaaaggccctagttacggagaagacgttagcaacaccacgaccgctcagaagaggaaatgttcccagacccagtgtccacggaaggtcatcaagatggaatcggaggaaggtaaggaggcaagactcgccaggtcttcccccgaacagcctcggccaagtactagcaaggctgtgtccccaccacacctcgatggacccccttcacccagatctccagtgataggttcggaagtgttccttccaaattccaatcatgtggcttccggagcaggtgaggccgaagagagggtggtggtgatcagctctagcgaggacagtgatgctgagaactcgagctcacgcgaactggatgatagcagctccgagtcctcggatctacaactggaaggcccatctacacttagggtattagatgagaacctcgctgacccccaggccgaagatcgtcccctggtcttcttcgatctgaagatcgacaacgagactcagaagataagtcaactggccgcagtaaacagggagtctaagttcagggtggtcatccaacccgaagcgtttttttcttttctgagctctatgagacgacctattctcgcttgctataaactgtggggtcccggacttccaaattttttcagggccctggaggacattaatcgactttgggagtttcaggaggctatctccgggttcctcgctgccctgccactcatccgtgaaagggtgcctggcgcttcaagttttaagctgaagaatctggcgcagacttatttggctcggaacatgagcgaacggtcggctatggccgcagtccttgcgatgcgggacctttgccggctgctagaggttagtccgggaccacagttggcacagcacgtatatccattttccagtctgcaatgctttgctagtctgcagccactggttcaagccgctgtcctgccccgtgccgaggcaaggttgttagcgctgcacaacgtgagctttatggagttgcttagtgctcatcggagagaccgccaaggtggtctgaagaagtactctcgctatcttagcctacagaccaccacactgccgccagcacagcccgcatttaatctgcaggctctcgggacgtacttcgagggcctgctggaggggcctgctctagctcgcgctgagggggtctccactccccttgcaggacgcggactcgcagagcgggcttctcagcagtcttag

SEQ ID NO: 30277 - DNA, 1836 bp, Artificial Sequence
  Description of Artificial Sequence: Synthetic coding sequence
atggagccagccccagcgagaagccctagaccacaacaggaccctgcaaggcctcaggagcctactatgcctccaccggagaccccctcagagggtagacagccatcccctagtccaagcccaaccgaacgggctcctgcgtccgaggaagaattccagttcctgaggtgccagcaatgccaggcggaggcaaagtgtcctaagctgctcccgtgccttcacactctgtgctcaggctgcttagaagcgtccggtatgcagtgccccatttgccaggctccctggccgttaggagctgatacacccgctctggacaacgtattctttgagtccctccaacggcgactctccgtctacagacagatagtcgatgcacaggctgtctgcacccggtgtaaagagagtgccgatttctggtgcttcgagtgtgagcagctcttgtgtgctaagtgtttcgaggcacatcaatggtttctcaaacatgaggcgcgtcccctggctgagctgcgcaaccagagcgtcagagaattcctggacggcaccaggaagacgaacaacattttttgctcgaatcctaaccatcgcactccaacgttgacgtctatttattgtcggggatgcagtaaacctctctgctgttcatgtgcattgttggactcttctcactctgagttgaagtgcgacatttcggcagaaattcagcagaggcaggaggaattggacgccatgacgcaagcgctccaggagcaggactccgcattcggtgctgtacacgctcaaatgcacgcggctgtagggcagctgggcagggcaagagccgaaacggaggaactgattagagaaagagtccgacaggtggtcgctcacgtccgcgcacaggagagagaattactagaggctgtggacgcacggtaccagagggactacgaagaaatggcctcacggctaggcaggctagatgcggtcctgcagcgcattcggactggatcggccttggtccagagaatgaagtgctacgcctctgatcaggaggttttggacatgcacgggtttttgcgccaggccctgtgtaggctgaggcaggaagagcctcagtcactgcaggctgccgtgcgcacagacggattcgatgaattcaaagtgagattgcaggacctgtcctcatgcataactcagggcaaagacgccgcagtctccaagaaggcttctcccgaagccgcatctacaccaagagacccaatagatgtggatctgccagaagaagccgagcgggtgaaagcacaagtgcaggcactgggcctggcagaagcccagccgatggctgtagtccagtctgtaccaggggctcaccccgtgccagtgtatgcgttctccatcaaggggccatcgtacggcgaagacgtgtccaacacaactacagcacagaagcggaaatgttctcagacgcagtgccctcggaaggttattaagatggaatcagaagagggaaaggaggcccgactggctcggtcatctccggagcagcctaggccatctacctctaaggctgtatctccacctcatcttgatgggccaccttcacctaggtcgcccgtgatcggctctgaagtgttcctcccaaactccaatcacgtggcaagcggggcaggagaggccgaggagcgcgtggttgtgatctctagcagtgaggacagtgacgcagaaaactcagtgtccggcccagaggtgcaaccccgaacccctgcaagccctcactttcgttctcagggcgcacagccacagcaggtgaccctgcgtttagccctgaggctgggtaatttccccgtgcgtcactag

SEQ ID NO: 30278 - DNA, 1683 bp, Artificial Sequence
  Description of Artificial Sequence: Synthetic coding sequence
atggagcccgctcccgctaggagtccacgtccccagcaggaccccgctcggcctcaggagccaaccatgccccctccagagacccctagcgagggcaggcagccgtcgcccagtccttctcccactgagagggcccctgcctctgaagaggagttccaatttttgcgctgccagcagtgccaggctgaagctaagtgccctaagctgctcccctgtctacatacactgtgtagtggttgcctggaagcaagcggcatgcagtgccccatttgtcaggctccgtggcccctgggagccgacacacccgcactggacaacgtattctttgagtcactccagcggaggctttccgtgtataggcagattgtcgatgcgcaggccgtgtgcacccgatgtaaagagagcgccgacttttggtgtttcgaatgcgagcagttgctgtgcgccaagtgctttgaggcgcatcagtggtttctgaagcacgaagctcgccctttggcagagctgaggaaccagagcgttcgggagttcctagatggtacacgtaagacaaataacatcttctgttcaaatccgaaccaccggacacccaccctcacctccatttactgtaggggatgcagtaaacctctttgctgttcttgcgccctgcttgattcttcgcactccgaattaaaatgcgacatctctgccgagatccagcagcggcaggaagagctggacgctatgacacaggcccttcaggagcaggacagtgcatttggagccgtacatgcccagatgcacgctgctgtggggcaactcggccgtgctagggcagaaaccgaggaactcatccgcgagagagtgaggcaagtggtagctcacgtgcgagcccaagaaagagaactccttgaggccgtggatgctcggtatcagcgcgattatgaggagatggcatcacggctgggacgcctggacgccgtgctgcaacggatcagaaccggtagcgcgttagtccaaagaatgaaatgctatgcttcagaccaggaggtcctggatatgcacggcttcctgcggcaggccctgtgccgcttgcgtcaggaggagccgcaatcactacaggctgcagtgcgaactgatggattcgacgagttcaaggtcagacttcaggatcttagttcttgtatcacccagggtaaggatgccgctgtgagtaagaaggcctcccccgaagcagcaagtacaccccgagacccaattgacgtggacctacctgaagaagcagaaagagtgaaagctcaagtgcaggcattggggcttgcagaagcccagcccatggccgtggtgcagagcgtccccggtgcccaccctgtcccagtttacgccttctccattaaaggcccaagttacggtgaagacgtgagcaatacaactacagcccagaaacgaaaatgctctcagacccagtgcccacgcaaggtgattaaaatggagagcgaggaaggcaaagaggcgaggttggcacggtcttcccccgagcagcccagaccctcaacatcaaaggccgtgagtccaccacatctcgacggcccaccatctcctcgtagccctgtaattggtagcgaggtgttcctgcctaactccaaccacgtggccagcggcgcaggcgaagcaggcagggagaggaacgcactttggtag

SEQ ID NO: 30279 - DNA, 1758 bp, Artificial Sequence
  Description of Artificial Sequence: Synthetic coding sequence
atggagccagcgccagcccgtagtccaagaccccagcaggacccggctaggccccaggagcctacgatgccaccccctgaaacccccagcgaggggaggcagccaagcccaagtcctagccccacagaacgagctccggcatccgaggaagaattccagtttttgcgctgtcagcagtgccaggcagaagccaaatgcccaaagctcctgccgtgtttacacactttgtgttccggttgtctggaggcctcaggtatgcaatgcccaatttgccaggctccctggccgctcggggcagacactcctgccctggataacgtattcttcgagtcgctgcagaggcgtttgtccgtatacaggcaaatcgtagatgctcaggcagtgtgtacgcgatgtaaggaatccgccgatttttggtgctttgagtgtgaacagctcctatgcgccaaatgttttgaggcccatcagtggttcctcaaacacgaggccagacctcttgccgagttaaggaatcagtcggtccgagaatttctggacggtacacggaaaaccaacaacatattttgctccaaccccaatcataggactccaacccttacttctatctattgtcggggatgcagcaagcctctttgctgtagctgtgcccttctggactcttcgcactctgaactgaaatgtgatatttctgcggaaattcagcagaggcaggaagagctggacgccatgacacaagcgcttcaagagcaggattcagcatttggcgctgtgcacgcacagatgcacgccgctgttggccagttagggagggccagagcagagaccgaagaactaatcagagagagagtccggcaggtcgtagcacatgtgcgagcacaagaaagagaacttctagaggccgttgacgcacggtaccagagggactacgaggagatggcaagccgattaggcagactcgatgccgtgctgcagagaattagaacaggttctgccctcgtccagaggatgaaatgttacgcttcggaccaggaggtactggatatgcacggattcctcagacaggctctctgccgccttagacaagaagaaccccaaagcctccaggcagccgtgagaactgacggtttcgatgaatttaaggtgaggttgcaagacctgtcttcgtgcattacccaggggaaggatgccgctgtcagcaagaaagcatccccagaagcagcatcgactccgagggaccctattgacgttgatctggacgtctccaataccaccaccgcccagaaaaggaagtgctcccagacccagtgccccagaaaagttatcaagatggaatcagaggaggggaaagaagccaggcttgctcggtcgtctccagaacagcctagaccatctacttccaaagcggtctcaccccctcacctggatggcccacccagccctaggtcaccagtcatcgggagcgaggtctttttgccaaattctaaccatgtggcttcaggcgctggggaggccgaagagcgggtggtggttatatcaagcagtgaagattctgacgccgagaattcctccagccgagaattggatgactcttcttccgaatcaagtgatctgcagctggaaggaccatctacgctgcgggtgctggacgagaatctggccgatccccaggccgaggaccgccctttagtgttctttgatctaaagatcgacaacgagtccgggttttcatgggggtacccccatccttttttgatttag

SEQ ID NO: 30280 - DNA, 483 bp, Artificial Sequence
  Description of Artificial Sequence: Synthetic coding sequence
atgcagcccgcttcagccaagtggtatgatcgcagggattacgtcttcatagagttctgcgtggaggacagcaaggacgtcaatgttaatttcgaaaaaagcaaactgacttttagttgcttgggaggcagcgacaactttaagcacctgaacgagatcgatttgttccactgcattgatcctaacgactccaaacacaagcgcactgacaggtcaatcctgtgttgccttaggaaaggggaatctgggcagtcttggcccaggcttacaaaggaaagagccaaactgaattggcttagtgtggattttaataattggaaggattgggaggatgacagcgatgaggatatgagtaactttgatcgtttctctgagatgatgaataacatggggggagacgaggacgtcgatttacctgaagttgatggagcagacgatgactctcaggactctgatgacgagaagatgcccgacctggaatag

SEQ ID NO: 30281 - DNA, 3141 bp, Artificial Sequence
  Description of Artificial Sequence: Synthetic coding sequence
atgcagaagccaagtggtctgaaaccccctggtaggggcggtaagcactcatcaccaatgggtaggacctcaaccggttctgcttctagcagtgccgctgtagccgcttctagtaaggaaggcagtcctctccacaagcagtcctcaggtccaagcagtagccccgctgcagccgcagctcccgagaagcctgggcctaaagccgctgaagtgggagacgactttctgggcgattttgtagtgggagaacgagtgtgggtgaacggcgtgaagcccggagtagtccagtatctgggggagactcagtttgccccaggtcagtgggcaggtgtcgtgttggatgacccggtgggcaagaacgatggtgccgtcggcggagtgagatacttcgagtgtccggctcttcaggggattttcaccaggcctagtaagctgacaaggcagccaacagctgaaggatcagggtcagatgcccattctgtggagtctcttaccgcacaaaatctatcactgcatagcgggacagcaacgccaccactcacctcgagggtgattcccctgcgggagtcagtcttaaactcttccgtgaagaccggaaacgagagtggcagcaatctcagtgacagtggaagcgtaaagagaggcgagaaggatctgcgcctaggcgatcgcgttctggtggggggtactaagactggtgttgtgaggtacgtcggagagaccgatttcgccaagggcgaatggtgtggggttgagcttgacgaaccactgggtaagaatgacggagctgtcgctgggacaagatacttccagtgtcccccaaaatttggccttttcgcccctatccacaaggttattagaattggcttcccgtctacaagccccgctaaagccaagaagaccaaacggatggccatgggcgtgtcagctctgacccactcaccatcctcctcatcaatcagttctgtgtccagcgtggccagtagcgtggggggacggccttctcgaagtggcctgctgacagagacctcaagtcggtatgcaagaaaaatttcgggaactacagctctgcaagaagcgttgaaagagaaacaacagcatatcgagcagctcctggcagagcgggacctcgaaagggcggaggtagccaaagcaacctcgcacatctgcgaggtcgaaaaagaaatcgctctcctgaaagcccagcacgagcaatacgtcgctgaagccgaggagaaacttcagcgggcacgactgcttgtcgaaagcgtgcggaaagagaaagtggatctgtcaaaccagctcgaagaggaaagaaggaaggtggaagacctgcagtttcgcgtggaggaagagtcaattacgaaaggggatctcgaaacacagacccagctcgaacacgctcggattggagagctggaacaaagccttctgcttgaaaaggctcaggctgagaggctgctgcgggaactggctgataaccgccttacaaccgtcgctgagaaatctcgcgtcctccagctggaagaggaacttaccctgcgacggggtgaaatcgaagaactgcaacagtgccttctgcactctgggccacccccacctgaccaccccgatgccgctgagatcctcagactccgggaaagactcttatccgccagcaaggaacatcagcgggaatctggagtcttgagagacaaatacgagaaggccctgaaagcttaccaggcagaagtggataagctccgggcagctaatgagaaatatgcccaggaggtggctggtttaaaagacaaggtacagcaggccacctccgagaacatggggttgatggataattggaagagtaagctggactcactggccagcgatcaccagaagagcttggaggacctgaaagctacattgaattccggacctggcgctcagcagaaagagatcggagaactgaaagccgttatggaggggatcaaaatggaacaccaacttgagctggggaatctgcaggcaaaacacgatctcgaaacggcaatgcacgtcaaggagaaggaagccctacgggagaagctgcaggaggctcaagaagaactggctgggcttcagcgccactggagggctcagctcgaagtgcaggcatctcagcatcggttagaactgcaggaagcccaggatcagaggcgcgacgctgagcttagagtccacgagcttgagaaactcgatgtcgaatatagggggcaggcccaggccatcgaatttcttaaagaacagattagcctggcagaaaagaaaatgctggactacgagaggttgcagcgggctgaagcgcagggcaaacaagaggtggaaagtctccgggagaagctccttgtggccgagaaccgcctgcaggcggtggaggcgctgtgttcaagtcaacatacgcacatgatcgaatccaatgatatcagtgaagaaaccattcgaactaaggagaccgtggagggactgcaggataagcttaacaaacgggataaagaagtgacagcccttacctcacaaaccgagatgcttagggctcaggtctcagcactagagtcaaagtgtaaatctggtgagaagaaagtagatgcccttctgaaagagaagagacgactcgaagctgagctggaaactgtcagcagaaaaacacacgacgcaagcggacagctggtcctcatctcccaggagctgcttcggaaggaaagatccctgaacgaactcagggtactgcttcttgaagccaatcgccacagtcctggccctgaaagggacctgagcagggaggtccataaggccgaatggcgtattaaggagcagaagttgaaagacgacatccgagggctgcgcgagaagttaaccggactcgacaaggaaaagtccctgtctgatcagagaagatacagtctgatagaccgaagcagcgcgcctgagttgctccggttacagcatcagctgatgtccactgaagatgccctccgggacgctctcgaccaggctcagcaggttgaaaagttaatggaggccatgcgctcctgcccagacaaagcacagaccatcggaaactcaggaagcgctaacggcatccaccagcaggacaaagcacaaaagcaggaggataagcactag

SEQ ID NO: 30282 - DNA, 1800 bp, Artificial Sequence
  Description of Artificial Sequence: Synthetic coding sequence
atgtctcggtctctattactgtggtttctcttatttctgctgctgttacccccattacccgttctgttagccgatccgggagccccaactccagtcaatccctgctgttactacccttgccagcaccaaggaatttgtgttaggttcggacttgatagataccaatgcgactgtactcgcacaggctattcggggcctaattgtacaatcccgggactgtggacctggctcagaaactcactgcggccttccccatcttttacacactttctgttgacacacggtaggtggttctgggaattcgtgaatgcaacatttatccgggagatgctaatgcgcctcgtcctcacggtccggagtaacctaatcccaagtccaccaacttacaatagtgcgcatgactacatctcctgggaatcattctccaatgtgtcttattacaccaggatactcccttctgttcccaaagactgtcctaccccaatggggactaaggggaaaaagcagttgccagacgcccaactcctagctcgtagattcttactcagacgtaagtttattcctgatccccaaggaactaatttgatgttcgccttcttcgcgcagcactttacccaccagttcttcaagacttctggaaagatgggtcccggatttaccaaggcactcgggcacggtgtggacctgggacacatttatggagataacctcgaacggcagtatcagcttaggctctttaaagacggcaaattaaaataccaagtcctggatggagagatgtatcccccttcggtcgaggaggcacccgtattgatgcactatcccagaggtattccaccccagtctcaaatggctgtcggccaggaggtattcggtctcctaccaggcctgatgttatatgccacactctggctgcgcgaacacaatcgcgtctgcgacctcctcaaagccgagcacccaacatggggcgacgagcagttgtttcagacaactcgccttatactgatcggggaaaccataaagatcgtgatagaggaatacgtacagcagctgtctggctatttccttcagctgaagtttgacccagagctcctgttcggcgtgcagtttcagtatagaaacagaatcgctatggagttcaatcatctgtaccattggcatcccctcatgccggactcattcaaagtcggcagccaggaatactcttatgagcagtttctgtttaacacatccatgctagtcgattacggtgtcgaggctctggtagatgccttttcacgccagattgccggtaggattggcggaggcaggaatatggatcatcatatccttcacgtcgctgtggatgtgatcagagagagcagagagatgaggctacagccctttaacgagtacaggaaaagattcgggatgaaaccttatacctcgtttcaggagctggtgggggaaaaggagatggctgccgaactggaagaactgtacggtgacatcgacgccctcgagttctatcccggattgctgttggagaagtgccacccaaactccatattcggcgaatctatgatcgagatcggagcaccattttccctcaaaggactcctgggaaaccctatttgctcccctgaatactggaagcctagtacatttggaggcgaggtgggatttaacatcgtgaagaccgctacactgaaaaagctggtctgtctcaatactaagacatgtccatacgtgtcttttagagttcccgatgcatctcaggacgatggacccgctgtggagcggcctagcacggaactttag

SEQ ID NO: 30283 - DNA, 1473 bp, Artificial Sequence
  Description of Artificial Sequence: Synthetic coding sequence
atgctaatgcgccttgtcctaacggtaagaagtaatttgataccttcccctcctacttataacagcgcccatgattacatttcatgggaatccttttccaacgttagctactatactaggatcttaccttccgtacccaaagattgcccaacacctatgggtaccaagggtaaaaagcagctgcctgatgctcagctcttggccaggagattcctccttcgaagaaaattcataccagatccccaggggaccaatcttatgtttgccttcttcgcccagcactttacgcaccaattttttaagacctccggtaaaatgggtccaggctttactaaggccctgggccacggagtggacttgggccacatttacggagacaatctggaaagacaatatcagctgagactgtttaaagacggaaaattaaaataccaggtcctggatggcgagatgtacccacctagtgttgaggaggctccagtgctcatgcattacccacggggaatccctccgcaaagccagatggcggtgggccaggaggtattcggtctcctgccagggctgatgctttacgctacactctggctgcgggagcacaacagggtctgtgacctgctgaaagctgaacacccaacctggggcgatgaacagttattccaaactacgaggcttattctgataggcgagacgataaaaatagtcattgaggagtacgtacagcaactgtccggttactttcttcagcttaaatttgatccagaactgctgtttggcgtgcagtttcaatacagaaaccggatagcaatggagttcaaccatttatatcactggcatccactcatgccggacagctttaaggttggttcacaggagtactcctatgaacagttcctgttcaatacttctatgctggtcgactatggcgtcgaagcgctggtagatgcgttctctcgtcaaatcgccggacgaatagggggagggagaaacatggatcatcacattcttcacgtagccgtcgacgtgataagagagtcccgggagatgcgcctgcagccttttaatgagtaccgaaaaagattcggcatgaagccctacacctccttccaagagctggtcggcgagaaagaaatggcggcagagctggaggagttgtacggggatattgacgccttagagttctatcccggacttctgctcgagaagtgtcacccaaatagcatttttggtgagagtatgatcgaaattggcgctcctttttccttgaaggggctgctcgggaatccaatttgctcgcccgaatactggaaaccctccacctttggcggtgaggtcggatttaacatcgtcaaaactgccacactcaagaagctggtgtgcctgaacaccaagacctgtccatatgtgtccttcagagtgcccgatgcttctcaggacgacggtccagcagtggagaggccctctacggaactatag

SEQ ID NO: 30284 - DNA, 471 bp, Artificial Sequence
  Description of Artificial Sequence: Synthetic coding sequence
agcctattgctttggtttttgttgtttctgctgctcctacctccactgcccgtgttgttagcagacccgggagctccgacaccggctggtctgtggacctggctccgcaactcactgaggccgtccccctcattcacccacttcctgctcacccatgggagatggttctgggagttcgtaaatgcaacgtttattagagaaatgctgatgcgtctggttcttaccgttagatctaatctgatcccaagcccccctacgtacaactccgcccacgattatatttcttgggaaagctttagcaatttctttaagaccagtgggaagatgggccctgggttcacgaaggccctgggccacggcgtggatttgggccatatttatggagataatctggagagacagtatcagctcagactttttaaagatggcaagctgaagtaccaggtgttagacggagagatgtatccatag

SEQ ID NO: 30285 - DNA, 1614 bp, Artificial Sequence
  Description of Artificial Sequence: Synthetic coding sequence
atgaggaagccccgtctgatgaatccctgttgctactatccatgtcagcaccagggcatatgtgtcagattcgggctggaccggtaccagtgcgattgcactaggactggttactctggcccaaactgtacaatacctggcctatggacctggttaaggaacagcctgagaccttctccaagtttcacacacttcctcttgacccacgggcgatggttctgggaatttgtcaacgccacctttatcagggagatgctgatgcgcctggtcctgacggttcgctctaatttgatacctagtccccctacctataatagtgcccacgactacatatcctgggagtctttcagtaatgtcagttactatacacgtatactgccatctgtgccaaaagactgtccgacgcccatgggcaccaaaggaaagaaacagctgcccgatgcccagctgttggcccgaaggtttctcctgaggagaaaatttattccagatccccagggaaccaatctgatgtttgccttttttgcccaacatttcactcaccagttttttaaaacatcaggcaagatggggcctggattcacgaaggccctcgggcacggggtagacctggggcatatctatggagataacctcgagaggcaatatcagctgcgtctattcaaggatggtaaactgaaatatcaggtgctggatggcgagatgtatcccccttcagtggaggaggccccagttctgatgcactacccgagagggatcccccctcagtcacagatggccgtcgggcaagaggtgtttggactcttgcccggactgatgctgtatgccaccctctggttacgcgaacacaacagagtgtgtgatttattaaaggcggagcaccctacctggggggacgaacagttgtttcagaccaccagacttattctgatcggggagactattaaaattgttattgaggaatacgtccagcaactgagcggatatttcctgcagctgaagtttgaccccgagctcctgttcggcgtccaattccagtacaggaaccgaatcgcaatggaatttaatcatctgtatcattggcatccgctgatgcccgattctttcaagatcggtggaggcaggaatatggatcatcatatcctacacgtcgcggttgacgttatacgggagtcgcgtgaaatgagactgcagccattcaatgagtaccggaagcgatttgggatgaagccatacacaagttttcaggaacttgtaggggagaaggaaatggccgcagaactggaagagctctatggggacatcgacgcactcgagttctaccctggcctattactggagaagtgtcaccccaactcgatcttcggcgaaagcatgatagagataggcgcacccttctctcttaagggccttttagggaatccaatctgctcccctgaatattggaaaccctccacctttggcggtgaagttggcttcaacatagtgaagacggctactctcaaaaaactggtctgtctcaacacaaagacatgtccatacgtgtcattccgggtcccggatgcttctcaggacgacggccctgcagtggagagaccctccacagaactttag

SEQ ID NO: 30286 - DNA, 1815 bp, Artificial Sequence
  Description of Artificial Sequence: Synthetic coding sequence
atgttagcaagggcgttattgctctgcgctgttctagcgctgtcacatacagcgaacccatgctgcagtcatccctgtcaaaaccggggagtctgcatgagtgtggggtttgaccaatacaagtgcgactgtacacgcactggtttttatggggagaactgctccacgccagagtttctgactcggatcaaactgttcctgaagccaacccccaataccgtccattatattctcactcactttaaggggttctggaatgtcgtcaataacatcccatttcttcggaacgcaattatgtcttatgtgcttacatctagatcgcacctgatcgactccccgccaacatataatgcagactatgggtacaagtcctgggaagcattctctaacctgtcttattacactagggcattgcctccagtacccgacgattgccccactccactgggggtgaagggcaaaaaacagctgccagactctaacgagattgtggaaaagctactgctccgtcgaaaatttatccccgacccacaaggtagcaacatgatgttcgctttcttcgcacagcacttcacccaccaattcttcaagaccgatcacaagcggggacctgcgttcaccaatggcttgggccacggcgtggacctgaatcacatttatggcgaaactctcgcccgacagcgtaaattgagactctttaaagacggtaaaatgaagtaccagattatagacggtgagatgtaccccccaaccgtgaaagatactcaggccgaaatgatctatccccctcaagtacctgaacacttgcggttcgccgttggccaggaagtgtttggtttagtgcctgggctcatgatgtatgcaacaatttggcttcgagagcacaacagagtgtgtgatgtgctcaagcaagaacatcccgagtggggtgacgagcagctgttccagacatctcgacttatcttgatcggggagacaattaaaatcgttatcgaggactacgtacaacacctctctggataccatttcaaacttaagtttgacccggaactccttttcaataaacagtttcagtaccagaataggatcgcagccgaattcaatactctctaccattggcaccctttactccctgatacatttcagattcacgatcagaagtacaactaccagcagttcatctacaacaactccattttgctggagcacggtatcacacaatttgttgagagcttcactcgtcagatagccggacgagtcgccggtgggaggaatgttcccccagccgtgcagaaggttagtcaagcctctatagaccagtcccgacagatgaagtatcagagtttcaacgagtatcgtaagaggtttatgttaaagccttatgaaagctttgaagaactgacaggtgagaaggagatgtctgcggagctggaggccctttatggagatatcgatgccgttgaactatatcccgctctcttggtggagaaacctcgccctgatgcaatttttggagagacgatggtggaagttggagccccattcagtctgaagggactgatgggcaacgtcatctgtagccccgcttactggaaaccctccaccttcggtggcgaggtcggtttccagatcataaacaccgcaagcatccaatccctgatctgtaacaacgtgaaaggatgcccctttacatcgttttcagtgccggaccctgagctgatcaaaactgttacaatcaatgcaagctcttcccgttcaggtctggacgatattaaccctacagtactacttaaggagaggtccactgagctgtag

SEQ ID NO: 30287 - DNA, 1614 bp, Artificial Sequence
  Description of Artificial Sequence: Synthetic coding sequence
agtttagtccctgctaccaactacatctataccccactgaaccagctgaaagggggaacaattgtcaacgtgtatggcgtggtgaagtttttcaagcccccttatttgtcgaagggcacagactactgtagcgttgtcactatcgttgatcaaactaacgtcaagcttacctgtctgttgtttagcggaaattacgaggcactgcccataatttataagaatggcgatatagtgcgttttcaccggttgaagatccaggtctacaagaaggaaacccagggaattacgagctctggctttgcttcactgaccttcgagggaaccctcggggctcccattatccctcgaacgtcctctaaatacttcaacttcactaccgaggaccacaaaatggtggaggctcttcgggtgtgggcctccacccacatgagcccatcgtggacactcctgaagctttgtgacgtccagcctatgcagtatttcgaccttacttgtcagctgcttggaaaggcagaggttgacggcgcttcctttttgctcaaggtatgggacggaaccagaacacctttccctagttggagagttctgatacaggatctagtccttgagggagacctgtcccacattcaccggctacagaaccttactattgatatcttggtttatgacaaccatgtgcacgtggcccgatctttaaaggtcggatcttttctccgcatctactctcttcacacaaaattgcagtcgatgaactccgagaaccagaccatgctgagtcttgaatttcatctacacggcggaacaagctatggacgtggcattagagtgctcccagagagcaactctgatgtggatcagttaaagaaagatctcgagtccgccaatcttaccgccaaccagcattccgacgtgatttgtcagtcggaacctgacgactcatttcccagttccggcagtgtctccctatatgaagtcgagcgctgtcagcaattgtcggccactatcttgaccgaccaccaatacctcgaaagaacacccttatgcgctattctgaagcagaaggctcctcagcagtacaggatccgcgcaaagttgcggagttataagcctaggagactgtttcagagcgtgaagttgcattgtccgaagtgtcatctgttgcaggaagtgcctcatgagggcgacctggacataatttttcaggacggcgctacaaagacaccggatgtcaagctgcagaatacatccctgtacgactcaaaaatttggaccacaaagaatcaaaaaggccgtaaagtggctgtgcatttcgttaaaaataatggaatactacccctgtccaacgagtgtttgctgcttatcgaaggaggtactttgagcgaaatctgtaaactatccaacaagttcaattcggtcatccctgtgaggagcggtcacgaggacctcgagcttctggatctgagtgcaccttttctcatccagggtaccatacaccactatggctgcaagcaatgttcaagtctgcgatcaatacagaatcttaatagcttggttgacaaaacatcctggattccctctagcgtggccgaggaactggatatcgtgctccagtag

SEQ ID NO: 30288 - DNA, 1905 bp, Artificial Sequence
  Description of Artificial Sequence: Synthetic coding sequence
atgtcactggttcctgctacaaactacatctacactcctctgaaccagctcaagggcggtacaatcgtgaacgtctatggggttgtaaaattcttcaaacccccatacttgagcaaaggcaccgattactgttctgtcgtgaccatagtcgatcaaaccaatgtgaaacttacatgcctcctgttctccggaaattacgaagcattgcctatcatatataagaacggggatatcgtgcgtttccacaggctgaagattcaagtttacaagaaagagactcaaggtatcacgagcagtgggttcgcatctttaacttttgagggcacactgggggctcctatcatcccccgtacctctagcaagtacttcaactttaccaccgaggaccacaagatggttgaagcccttagggtctgggcctccacccatatgtccccttcctggacactcctaaagctttgtgatgtgcaacctatgcagtattttgacctcacctgccaactgctcggcaaggcagaggtagatggcgcaagcttcctgctcaaggtgtgggatgggacccggactcctttcccttcatggcgcgtgctcatccaagacttggtcctagagggcgacctgtctcacatacaccgactacaaaacctgacaatagatattctcgtgtacgataatcatgtgcacgttgcgaggtcgctgaaagtcggctcattcttacgtatatatagccttcacaccaagctgcagagtatgaattccgagaaccagaccatgttgtcactggagttccacctgcatggcggtacgagctacggcagaggcattcgcgtgttgcccgagtcaaattctgatgtggatcagctgaagaaagacctggagtcggcaaatctcacagctaatcagcattctgatgtcatatgccagagcgagcccgacgactcatttcctagctctggttccgtttccttatatgaggtcgagcggtgtcagcagctttccgctaccatcttgactgaccatcagtatctggaaaggactcctctgtgcgctatcctaaagcagaaggccccacagcagtaccggatcagagcgaaactgcgttcttacaaaccaaggaggctgtttcagtccgtgaaactacactgtccgaaatgtcatttgctgcaggaggtcccccacgagggagatctcgatattatcttccaagatggggcaaccaagacaccagatgtcaaactgcagaatacgtcgctgtacgactccaaaatatggactaccaaaaatcagaaaggcaggaaggtagctgtccacttcgttaagaataacgggattcttcctctgtctaacgagtgtctcttactcatagagggcggtactttgagtgagatttgcaaactgtcgaataaatttaatagcgtcatacccgtccggtcggggcatgaggacctggaattgctggatctatctgccccatttctcattcaggggactatccaccactacggttgtaagcagtgttcatctctcagaagcattcagaacctgaacagtcttgtggataagacatcctggattccctccagcgttgccgaagctctgggtatagttcccctccagtacgtattcgtaatgacctttactctggacgatggcacaggcgtgcttgaagcctacctgatggatagcgacaaattcttccagatccccgcatcggaagtccttatggatgacgacctgcagaagtcagtggatatgatcatggacatgttttgcccccctggcatcaagatcgacgcctacccatggctggaatgcttcatcaaaagttacaacgtgaccaacgggacagacaaccagatttgttatcagatcttcgatacaacagtggccgaggacgtgatctag

SEQ ID NO: 30289 - DNA, 1023 bp, Artificial Sequence
  Description of Artificial Sequence: Synthetic coding sequence
ctgagtctcgtccctgccacaaactacatttacaccccattaaatcagctgaaaggtggaaccatagttaacgtgtacggggtggttaaattcttcaaaccgccatatctatccaaaggtacagactattgtagtgtcgtgacaatcgtagaccagacaaacgtcaaattgacttgtttactattttccggcaactatgaggcactaccaattatttacaagaacggagatatcgttcgtttccacagactgaagattcaggtatataagaaggagactcaaggcatcacgtctagtggcttcgccagcctgaccttcgaagggacacttggcgctccaattattccaaggaccagctctaaatattttaatttcactacagaggatcacaaaatggtagaagcactcagagtatgggcttcgacgcatatgtctccatcctggacactcttgaaactatgtgatgtccagccgatgcagtacttcgaccttacatgtcagctactgggcaaagctgaagtggacggagcctccttcctcttgaaagtctgggacgggacccgtacccccttccctagctggcgcgtcctgatacaggacctggttctggaaggcgacctgtctcacattcaccgcctacagaatctgaccatcgatatcctggtttatgacaatcatgttcacgtggcacggagcttgaaggtcggttctttccttcgtatctacagcttgcatactaaacttcaaagtatgaactccgaaaatcagactatgctgtcacttgagttccacctgcacgggggaacctcttatggaagaggcattcgtgtcctgccagagagtaatagcgacgttgatcagctaaagaaggacctagaatcagctaaccttacagccaatcaacattcggacgtcatctgccaaagcgagccagacgattcattccccaatggcgtttcgctgaggcccccaggttggtccagcgtcgccaggagccggctgattgctgcatctacttcttag

SEQ ID NO: 30290 - DNA, 1512 bp, Artificial Sequence
  Description of Artificial Sequence: Synthetic coding sequence
atggtcgaagcgctccgggtctgggccagtacccacatgagcccttcatggaccctgttgaagctctgcgacgtccagcctatgcagtactttgacctgacttgtcagctcctgggcaaagcagaggtcgatggtgcaagcttcctgttaaaggtctgggatggaaccagaaccccttttcctagctggagagttttgatccaggatcttgttttggagggcgatctgtcccatatccatcggctccagaatctcaccatagacatcctagtgtacgacaaccatgttcatgtggccaggtctctcaaagtgggatcctttttgagaatatatagtctgcacacgaagcttcagagcatgaatagtgagaatcagacaatgcttagcctggagttccacctgcacggcggtactagttacggaagagggatcagggtgctgccggaatccaactccgatgttgatcagctgaaaaaagacctggaatcggcaaaccttacagccaaccagcacagtgatgtgatctgccagtcagaacccgacgattccttcccttctagcggaagcgtgagcttgtacgaggtcgagcggtgccagcagctgtcagcaacgatcctaactgaccatcagtatctggagaggacccctctgtgtgccatcctcaaacaaaaggcacctcaacaataccgaatccgggcaaaactgaggagctataaacccaggcgcctatttcagtccgtaaagcttcactgcccaaagtgtcaccttttgcaggaggtcccccatgaaggggatcttgatattatttttcaggacggcgcaacaaaaacgcccgatgtcaaactgcagaatacttcgctgtacgattctaaaatttggacaaccaaaaatcaaaaggggagaaaagtcgctgtgcattttgtgaagaacaatggcatcttgcctctgtccaatgagtgcctgctcttgatagagggcggtacattgtcagagatttgtaagcttagtaacaagttcaatagtgtcattcccgtgcggagcgggcacgaggacttggagctcctcgacctctccgcccctttcctgatccagggtacgattcaccactacggttgcaaacagtgttcaagtttgaggtctatacagaacttgaattccctggtggacaagacaagctggattccaagcagcgtcgctgaagctctgggaattgtacctctccagtatgtttttgtcatgaccttcacgcttgacgacggaacaggagtgctagaagcatacctgatggatagcgataaattcttccaaattccagcttccgaagttctgatggacgacgatcttcagaaatctgtggacatgattatggatatgttctgccctcctggaattaaaatcgacgcctatccttggcttgaatgttttatcaaatcctacaacgttacgaatggaactgataaccagatctgctaccagatctttgataccactgtcgctgaggacgtgatctag

SEQ ID NO: 30291 - DNA, 1380 bp, Artificial Sequence
  Description of Artificial Sequence: Synthetic coding sequence
ctgtccctggtgccggctacgaactacatatatacccctctgaatcagctcaaaggcggaaccattgtgaatgtttatggagtggttaaatttttcaagccaccatacctctctaaaggaaccgactattgtagcgtcgtgactatagttgatcaaaccaatgtgaagcttacttgtctgctctttagcggcaactatgaggcacttccaattatttacaaaaatggggatatcgttcgcttccacaggctcaagattcaggtatacaagaaagagactcagggaataaccagctccggcttcgcaagcctgacttttgagggcaccttaggtgcacctatcataccgagaactagctctaaatattttaacttcactacagaggatcataaaatggtggaggccttgcgcgtgtgggcatccacccacatgagcccttcttggaccttgctgaaattatgcgacgtgcagcctatgcaatatttcgacttaacctgccagctgctgggaaaggccgaagttgatggcgctagctttctcctcaaggtttgggatggaaccagaactccctttccttcatggagagtgctgattcaagacttggtgctggagggtgacctgtctcacattcatcggttgcaaaatttaactatcgacattttggtgtatgataaccacgttcatgttgccagatcgttaaaagtggggagttttctcaggatatattcactgcacacgaagttgcagagcatgaattccgaaaaccagaccatgctgtctctagaattccacctgcacggcggtactagctatgggagaggaattcgagtactccctgaaagtaattcagacgtggaccagttaaagaaggatctggaaagcgccaatttgaccgccaaccaacattccgatgtcatctgccagtccgagccagatgactccttcccgagctccggtagtgtgagcctgtacgaggtagagcgctgccagcaactgtccgctaccatcttgaccgatcaccaatatctggagagaacaccattatgtgctatacttaaacagaaggctccccagcagtacagaattcgggcaaagctgcggagctacaagccgcgacggctgtttcagtctgtaaaattgcactgccctaagtgtcacctgctgcaggaggtgccacacgaaggcgacctcgatatcattttccaggatggcgcaactaagactcctgatgtaaagctgcagaacacgtctctgtacgactccaaaatctggaccacaaaaaatcagaaaggacgcaaggtggccgttcattttgttaaaaacaatggcattctacccctgtccaacgaatgcttactgcttatcgaagtgttactttag

SEQ ID NO: 30292 - DNA, 249 bp, Artificial Sequence
  Description of Artificial Sequence: Synthetic coding sequence
atgtcactcgtgcccgctacgaattacatctatactcccctcaatcaactgaagggcggtacgatcgttaatgtgtacggagtcgtaaaattcttcaaacccccttatctgtccaaggggacagactactgttccgttgtgacaatagtggatcagaccaatgtgaaactgacatgccttttgttttctggaaactatgaagcactcccgattatatataagaacggcgacatcgtccgcttccattag

SEQ ID NO: 30293 - DNA, 1557 bp, Artificial Sequence
  Description of Artificial Sequence: Synthetic coding sequence
ctctccttggttccagcaactaactacatatacacacccctgaaccagttgaagggcggaactatcgtgaacgtgtacggcgttgttaagttcttcaaacctccttatcttagcaaggggacagattattgcagcgttgttactatagtggatcagactaatgtgaagctgacgtgcttactatttagcggtaattacgaggcactgcctattatttacaaaaacggcgacatagtgcgttttcaccgtctgaaaatacaggtgtataagaaggagacacaaggcattacaagtagcggcttcgcctccctgacatttgagggcactctgggtgcgcctatcatccctcgtacttctagcaagtacttcaacttcactacagaggatcacaaaatggtagaagccctccgtgtgtgggcctcaacgcatatgagcccatcgtggacactattgaaactgtgtgacgtacaaccgatgcagtattttgacttgacatgtcagctgctgggtaaagcggaggtggacggggcaagtttcctcttgaaggtgtgggacgggacccggaccccatttccctcatggagggtgctgatccaggatctggtgctcgaaggcgatttgtcgcacattcataggttacaaaacctgacgatagacatcctggtatatgataaccacgtgcatgtggcaaggtctttgaaagtgggctccttccttagaatatatagcctgcacactaagctacagtcgatgaactctgagaaccagacaatgctctctctggaatttcatttgcacggtggaacaagctacgggagaggcatcagggtccttcctgagtcgaacagcgacgtggatcagctgaagaaggatctggagtcagccaacctgaccgccaatcagcatagtgacgtcatttgtcagagcgagcctgacgactcattcccctcgtcagggtccgtatccctgtatgaagtggaacggtgccagcagctgagtgccaccattcttacagatcatcagtatctggagcgcacccctttgtgcgccatattgaaacaaaaagccccacagcagtaccggatcagggctaagctcaggtcctacaaaccccgacgcctgtttcaatctgtcaagctacactgtcccaagtgccacctcctgcaggaagtgcctcacgaaggcgatctagacattatttttcaagacggggctacgaaaactccagacgtgaagctccagaatacctctctgtatgattctaaaatttggaccaccaaaaatcaaaagggtcgaaaagtcgctgtacacttcgtgaaaaataacggcattttgccactgtctaatgagtgtctgctgctgatagaaggtggcacattaagcgagatctgcaagctatcaaataagtttaactcagtgataccagtgaggagtggccatgaggacctggaactcctggacctcagtgctccctttctgatccagggaactatccaccactacggcactggatactgtaccccaccaatctgcgtttgctacgatctctacacctag

SEQ ID NO: 30294 - DNA, 1374 bp, Artificial Sequence
  Description of Artificial Sequence: Synthetic coding sequence
agcccggaagacccgagatccaagcacaaatttaaaatccatacctatggcagtccaacattctgcgatcactgtggctccctgctctacggattgatccaccagggtatgaagtgtgatacctgtgacatgaacgttcataagcaatgcgtaatcaacgtgccaagtctgtgtggaatggaccacactgagaaacgaggcaggatctacctcaaagctgaggtagcggacgagaagctgcatgttacagtaagggatgcgaagaatctcatacctatggacccaaacgggctttctgacccctacgttaaactcaagctgatacccgatcccaagaacgagtccaaacagaagactaagaccattaggtcaacactcaatccacaatggaacgagagcttcacttttaaattgaagcccagcgacaaagaccgccgactgagtgttgagatttgggattgggaccgaacaaccaggaacgacttcatgggttcactgagcttcggggtgtccgagctgatgaagatgccagcatctggctggtacaaactgttaaaccaagaggagggcgaatattataacgtccctatccccgagggcgacgaagaaggcaatatggagcttcgtcagaagtttgagaaagcgaaactgggccctgccggtaataaggtcatttctccttcagaagatcgcaagcagcccagtaataacctagatagagttaaactgaccgatttcaattttcttatggtcttaggtaaaggatctttcgggaaagtgatgttggcggataggaaaggcaccgaagaactgtatgccattaagatattaaagaaggacgtcgtcattcaggatgatgacgtggaatgcacgatggtagagaaacgcgttcttgctctgcttgacaagcccccatttctcacacagctccatagctgtttccagacagtggacaggttatactttgtgatggaatacgtaaacggaggcgacctcatgtatcacattcagcaggttggcaagttcaaggagcctcaagctgtgttctatgcagcggaaatctcaatcggactattcttcctgcacaaacgcggaatcatctacagggacctgaaattggataacgtcatgttggactctgagggacatattaaaattgccgatttcggcatgtgcaaggagcacatgatggatggggttaccaccagaaccttctgtggcactcctgactatatcgcacctgagattatcgcctaccagccttatggcaaaagtgttgactggtgggcttatggcgtgctcctctatgagatgctcgcgggtcaggtgatgttctgttatatattcatgttcgtgtattgttgcgtcatgtag

SEQ ID NO: 30295 - DNA, 2019 bp, Artificial Sequence
  Description of Artificial Sequence: Synthetic coding sequence
atggccgatgtttttcccggaaatgatagcacggcctcacaagatgtggctaaccggttcgcgaggaagggagccctgagacagaagaacgtacatgaggtgaaggatcacaagtttatcgcgagattctttaagcaacccacattttgttcacactgcacagacttcatctgggggtttggtaagcaagggttccagtgccaggtatgctgtttcgttgtgcacaagaggtgtcatgaattcgtgacttttagctgtcccggagcagacaagggacctgacacagatgatccaagatcaaagcataaatttaaaatccatacgtatggctcaccgactttttgcgaccactgtgggtcgcttctgtacggcctgattcatcaagggatgaaatgcgacacatgcgacatgaacgtgcataagcaatgcgtgataaatgtgccttcgctgtgtggtatggatcatacagagaagcgcggacgaatctaccttaaggccgaggtggctgatgagaaactgcacgtgacagtgcgcgacgctaaaaacctcattccgatggatccaaacggacttagcgatccgtacgtgaagctgaagctgattcctgatccaaagaatgagtctaaacaaaaaaccaagacaattcggagtaccctgaatccccagtggaatgagtcttttacctttaaattgaaaccttccgacaaagatcggaggctttctgtggagatctgggactgggataggacgacacggaatgactttatggggtctctatcgtttggcgtatcggagctgatgaaaatgcctgcaagcgggtggtataagctcttaaaccaggaggagggagagtattataacgtgcctattcctgaaggggatgaggaggggaatatggaactgcgacagaagttcgaaaaagccaaacttgggccagctgggaataaggtgatcagcccctccgaagaccgaaaacaacccagcaataatctcgatagggtcaaactgacagatttcaatttccttatggttctcggcaaaggctccttcggaaaagtgatgctggctgacaggaaaggcaccgaggaactctacgccatcaaaattttaaaaaaggatgtcgtgatccaagatgatgatgtagaatgcactatggtagaaaaacgggtcttggcccttcttgacaagccgcctttccttacccagctgcacagctgcttccagaccgtggaccgcctttactttgtaatggaatacgttaacggaggggatctgatgtaccacattcagcaggtggggaaattcaaggagccacaggcagtgttttatgctgctgagatttcaataggattattctttttacacaagcgcggaattatttatcgagaccttaagctcgataacgtcatgctcgacagtgaaggtcacattaagattgccgacttcgggatgtgcaaggaacatatgatggacggtgtgaccacccggacattttgtggaacaccggattacatcgctccagaaataatcgcttatcaaccatacggaaagtcagtggattggtgggcttacggcgttctgctatatgagatgctggcaggccagcctcccttcgatggcgaagatgaggatgaacttttccaatctataatggagcataacgtgagttatcctaaatccctgagcaaagaggcagtatccgtctgcaagggattgatgaccaaacatccagctaaacgccttggatgtggtccggagggcgagcgtgatgtcagggagcatgcgttttttagacgtatcgattgggaaaaacttgagaaccgagaaattcagcccccattcaagcccaaggtctgcggaaagggggctgagaattttgataagttttttactcggggacagccagtgctcactccacccgaccagctcgtgatagcaaacatcgatcagagcgacttcgagggcttttcgtatgttaacccccagttcgtgcatcccattctgcagtcagcagtttag

SEQ ID NO: 30296 - DNA, 2022 bp, Artificial Sequence
  Description of Artificial Sequence: Synthetic coding sequence
atggccgaccctgccgcaggccctccaccgtctgagggagaggagtctacggtcaggtttgccagaaagggagccctccgtcagaaaaatgtccatgaggtgaaaaatcataagttcacagctaggttttttaagcagcctacattctgcagccattgcacggattttatctggggtttcggcaaacaggggtttcagtgtcaggtttgctgcttcgtggtgcacaagagatgccatgaattcgttacattcagctgcccgggtgccgacaagggccctgcctcggacgaccccagatcaaagcataagttcaaaattcacacgtatagtagcccaaccttttgcgaccactgtggatcactgttatacggcctcatacaccagggaatgaagtgcgacacttgtatgatgaatgtacataaacggtgtgtgatgaatgtgccaagtctgtgtggtaccgatcacacagagagaagaggcaggatatatatccaggctcatatcgatagggacgttttgatcgtgctggtgagggatgccaaaaacctggtccccatggacccaaatgggctgtctgacccctatgtgaaacttaaattaattcctgatccgaaatccgagtctaagcagaaaacaaagacaatcaaatgctctctgaacccagagtggaacgagacattccgttttcagcttaaagaatccgataaggatcggagattgtctgtggagatctgggactgggatcttacgtctaggaacgacttcatgggaagcttgtcttttggaatctctgagctccaaaaggcctccgttgatggatggttcaagctgctgagccaagaggaaggagaatattttaatgtgcctgtccccccagaggggagtgaggctaatgaagaactgagacaaaaattcgagcgcgctaagataagtcaaggcaccaaagttcccgaagaaaaaacaactaacaccgtgagtaaattcgataataacgggaatagggatcggatgaagctgacagactttaattttctcatggttcttggaaaaggatccttcggaaaagtgatgcttagtgaaagaaaagggacagacgagctgtatgccgtgaagatattgaaaaaggacgtcgttatccaggatgacgacgtggagtgtaccatggtggagaaaagggtcctggccctccccggaaaacctccatttttgacacagctgcactcttgctttcagacaatggatcgtttatacttcgtaatggaatacgttaacggaggggacctgatgtaccatatacaacaagtgggtcgattcaaggaaccccacgctgtattctatgcggctgaaattgcaattggcttgttttttttacaatcaaaagggatcatctatagagatcttaagttggacaatgtaatgctagattcagaggggcacataaagatagcagactttggaatgtgcaaagagaatatctgggacggcgtgacaaccaagaccttttgtggcacgccagattacattgctcctgaaatcatcgcataccagccctacgggaaatccgtggactggtgggcctttggagtgctactttatgaaatgcttgcaggacaagccccatttgagggtgaggacgaagatgaactttttcaatccatcatggaacataatgtggcataccccaaaagtatgtctaaggaggctgtcgctatttgtaaaggattgatgactaaacaccccggaaagagattgggatgtgggccagagggagagagggatatcaaggagcacgctttttttcggtacattgactgggaaaaacttgagagaaaggagatacaaccaccttacaagcctaaggcctgtggacgaaatgccgagaatttcgaccggttcttcactcgccacccccctgttctgacacctcccgaccaagaggtgatacggaacattgaccaaagcgaatttgagggctttagctttgttaactccgaatttttgaaacccgaggtcaagagttag

SEQ ID NO: 30297 - DNA, 2016 bp, Artificial Sequence
  Description of Artificial Sequence: Synthetic coding sequence
atggccgaccccgctgccggacctccaccttctgaaggggaagaatccaccgttcggttcgcccgaaagggtgccctccgccaaaaaaatgtgcacgaggtgaaaaatcataagtttactgccaggttctttaagcagcccacattctgttcccactgtacggacttcatttggggcttcgggaagcaggggtttcagtgtcaagtgtgttgctttgtcgttcacaagcgatgtcacgagtttgtgacgttttcgtgtcctggggctgataagggaccggcttctgacgaccccagatctaaacataagtttaagatacacacgtacagctcccccacattttgcgaccactgtgggagcctgctgtacgggctcattcaccagggtatgaagtgtgatacctgtatgatgaacgttcacaagcgctgcgtgatgaatgttccgagtctctgtggaactgatcacaccgagcggagagggaggatttacatccaggcccacatcgacagagacgttctgatcgttctagtaagggacgctaaaaacttagtgcctatggatccaaatggtcttagtgacccctacgtgaagctcaagctgattcccgaccctaaatctgagagcaagcagaagaccaaaacgatcaaatgcagtctcaacccggagtggaatgaaactttcagatttcagctcaaggaaagtgacaaggataggcggctttctgtggaaatatgggactgggatctgactagccggaatgacttcatggggagcctatcatttggaatatctgagctgcagaaggcatccgtggatggatggttcaaacttctgtcacaggaagaaggcgagtacttcaacgtgcccgtgcctccagaaggatctgaagctaatgaggagctgcggcagaagttcgagcgcgctaagatctctcagggtacaaaggttcccgaggagaagaccaccaacacggtatctaagtttgataacaatggcaacagagatagaatgaaattgacagacttcaactttctaatggtcctaggcaaggggagctttgggaaggttatgctttctgagcgaaagggcactgacgagctgtacgctgtgaagatcctgaaaaaagatgtcgtcattcaggatgacgacgtcgagtgcacgatggtggaaaagagagtgcttgcattgcccggaaagcctccattcctgacacagctccatagttgtttccagacaatggaccggttatattttgtgatggagtacgtgaacggtggagacctgatgtatcacatccagcaagtgggacgattcaaggaacctcatgctgtgttttatgccgctgaaattgcgatcggactcttctttctgcagagcaaaggaatcatctatcgggatctgaaattggataacgtaatgctggattccgaaggtcatattaagatcgcagatttcggcatgtgcaaggagaacatctgggacggcgtgactacaaagactttttgcggcactccagattatatcgcacctgagatcatagcctaccagccctacggtaaatcagtggactggtgggcatttggagtactgctgtacgagatgttagctggccaggccccatttgagggggaggatgaggacgagcttttccagagtattatggagcataacgtggcttacccgaaaagtatgagtaaggaggctgtcgcgatctgtaaagggttgatgacaaagcatcctggcaagcggctcggctgtggcccagagggtgagcgggatattaaagagcacgcatttttccggtatattgactgggaaaaattagaaagaaaggaaatacagccaccctacaagccaaaagctcgtgacaaaagggatacaagtaatttcgacaaagaattcacccgccagccggtggagctcacacccacggataagctttttattatgaacctagaccagaacgaattcgcaggatttagttataccaaccccgagttcgtgatcaacgtgtag

SEQ ID NO: 30298 - DNA, 786 bp, Artificial Sequence
  Description of Artificial Sequence: Synthetic coding sequence
atgcgtgagtctgccctggaacggggacccgtcccagaggccccagcaggaggaccagtacacgccgtaactgttgttacactcctcgaaaaactcgcttccatgctggagacactccgagaaaggcaggggggacttgcccgtcgacaggggggtctcgccggtagtgtgcggaggattcagtcaggcctgggcgcactctccagatctcacgacacaacctcaaatacgctggcacagttgctcgccaaagcagagagggtctcatcacacgccaacgccgcacaggagagagcagtcagacgtgccgctcaagtccaaagactcgaagcaaaccatggactgttagtggctcggggaaaacttcatgtgttgctgttcaaagaggagggggaggtgcctgcctctgcttttcagaaggccccagagcctctaggtccggcagatcagagcgaactcggccctgaacagcttgaagcggaggttggcgaaagctccgacgaggagcctgtagagtcccgagcccagcggctgaggcgcaccggactgcagaaagtgcagagtctgcgaagagcgctctctgggagaaaaggaccagcagcgccaccccctactcccgttaaaccacctcggctcggccctggcaggagtgcagaggcacagcccgaggctcaaccagcattagagccgactctggagcccgaaccacctcaggacacagaggaggatcctggaaggcctggcgcagctgaggaggccctattgcaaatggagtcagtcgcctag

SEQ ID NO: 30299 - DNA, 2214 bp, Artificial Sequence
  Description of Artificial Sequence: Synthetic coding sequence
atggttgtgttcaatgggttattgaaaattaagatttgtgaggctgtctcccttaaacccaccgcgtggtctctgcgacacgccgtgggccctcgtccccagacctttttactagatccatacatagctctgaacgtggacgactcacgcatcggacagaccgcgaccaagcaaaagacgaattctcccgcatggcacgacgaattcgtaaccgacgtgtgcaatggcaggaagatcgagttggctgtattccacgacgccccaatcggctatgacgatttcgtggcaaactgtacaattcagtttgaggagctgttacagaacggatccaggcactttgaagattggattgatttagaacctgaggggagggtttatgtgattatcgacctcagcggctcaagtggtgaggccccaaaagacaacgaagagagggtcttcagggagaggatgcgaccacgtaagcgccagggtgcagttcgacgcagagttcaccaggtgaacggacataaatttatggctacctacctccgccaacccacttactgctctcactgccgcgacttcatatggggtgtaattggtaagcaaggctaccagtgtcaggtgtgtacttgtgttgtgcacaagcggtgccatgagcttatcattacaaaatgcgcagggctaaaaaaacaggagacccccgaccaggttggaagccaacggttcagcgtgaatatgccccacaagttcggcatccacaattataaggttccgacgttttgtgaccattgtggctcactcctgtgggggctgctccgtcagggactgcaatgtaaggtgtgtaaaatgaatgtccaccgacgttgtgaaaccaatgtggccccaaattgtggggtggacgctaggggcatagccaaggtccttgcagacttgggggtcacgcccgataaaattactaattcaggacagcgaaggaaaaagttgattgcaggggcagagtcaccccagcccgctagcgggtcaagcccatctgaggaagaccggagcaagtctgcacctacctctccttgcgaccaggagattaaagaactcgagaacaatatccgtaaagccctttcattcgataaccggggtgaggagcatagggccgctagttcaccagacggacagctgatgagccccggagaaaatggagaggtcagacagggtcaagccaagcgcctcggcctggacgagtttaacttcatcaaggttctgggtaagggttccttcggcaaggtgatgctcgctgaacttaagggaaaggatgaagtctacgccgtgaaagtcctgaaaaaggatgtgattttacaggatgacgacgttgattgtactatgacagaaaaacgcatcttagcgttagctaggaagcacccttatcttacgcaactatattgctgcttccagaccaaggatcggctgtttttcgttatggagtatgttaatggcggtgacttaatgtttcaaatacaaagatcccgaaagttcgacgagccacgctctcggttctatgccgctgaggtaacctcagctcttatgtttctgcaccagcacggggtgatctaccgagacctcaaactcgacaatatcctgctcgatgccgagggacattgtaagctggccgacttcggcatgtgtaaggaaggtatcctaaatggagtaaccacaaccactttctgcgggacacccgattatatagctcccgagatactgcaagagcttgagtatgggccaagcgtagactggtgggcactgggggtactgatgtacgagatgatggccggacagcctccgttcgaagcagacaatgaggacgacctgtttgagtccatcctacacgacgatgtgctgtatccggtttggctcagtaaggaagccgtcagcatcctcaaagcctttatgactaagaatccccataagcgtctgggctgcgtggccagtcagaacggagaagacgccatcaaacaacacccatttttcaaggagatcgactgggttctcctggagcaaaagaaaatcaagcccccattcaaaccccgtatcaaaaccaaaagggatgtgaacaattttgaccaggacttcacccgcgaagagccagtcttgactctggtcgatgaagctatagttaaacaaattaatcaggaagagttcaagggtttctcttatttcggtgaggatttgatgccttag

SEQ ID NO: 30300 - DNA, 384 bp, Artificial Sequence
  Description of Artificial Sequence: Synthetic coding sequence
atggtcgttttcaatggtctgctgaaaattaagatatgcgaggccgtctccctaaagccaacagcctggagcctccgccacgccgtggggcctcggcctcagactttcttgctcgacccatacattgccctgaacgtggatgattcaagaattggacagaccgcgaccaaacagaagactaattcgccagcctggcacgacgaatttgtcaccgacgtttgcaacggccgtaagatcgagttggcagttttccacgacgctccaatcggctacgacgactttgtcgcaaactgcacaattcagtttgaagaactcctccagaatgggtctcgtcactttgaggattggatagatctggagcctgagggacgcgtgtacgtttag

SEQ ID NO: 30301 - DNA, 2094 bp, Artificial Sequence
  Description of Artificial Sequence: Synthetic coding sequence
atggcaggcttgggacccggagtgggagacagcgaaggcggacctcggccattgttctgtcgcaaaggagccctacggcagaaggtggttcatgaggtgaagagtcacaagtttaccgctcgtttttttaagcagcccacattctgttcgcactgcactgacttcatttgggggatcggtaagcagggcctacaatgccaggtgtgctcatttgttgtccataggagatgccacgaatttgtcactttcgagtgccctggagctggcaagggaccacagacggacgacccaagaaataagcacaagttcaggctccactcatacagttccccaactttttgtgaccactgtgggagtctgctatacggtctagtacatcagggaatgaaatgttcatgctgcgaaatgaacgtgcacaggcgatgcgtgcgctctgtgcccagcctatgcggcgttgatcacacggagcgccgtggtcgactacagcttgagatccgcgctccgacagctgacgaaattcacgttactgtgggcgaagccaggaacctgatccctatggatccgaacggcttaagcgacccctacgtgaagctcaaacttattcccgaccctaggaacctgacgaagcaaaagaccagaaccgtaaaagctactcttaatcctgtgtggaacgaaacctttgtgttcaatctgaaacctggggatgtggagaggaggctctccgttgaagtgtgggactgggatagaacaagccgcaacgactttatgggggctatgtcctttggcgtctccgagcttctgaaggcacccgtcgacggctggtacaaacttctcaatcaggaggaaggcgagtactacaacgtgccggtggccgacgccgacaattgctccctcttgcaaaaatttgaggcttgtaattatcctctggagctctatgaacgggttaggatgggaccatcgtcaagccctattccatctccttctccatcccctactgatcctaagcgctgcttctttggggcaagtcccggtcgactgcatatttctgatttttccttcctcatggtgctgggaaaggggagctttggcaaggttatgcttgcagagcggcgaggtagtgatgagctgtacgctatcaagatcctgaagaaagacgtgatcgtccaagacgacgatgtcgattgcactctcgtggaaaaaagggtgctcgcactcggcggtcgtggcccaggaggcagacctcacttcctaacacagttacacagtaccttccaaacgcctgatcgcctctatttcgtcatggagtatgtgaccggcggagacttaatgtatcacattcagcagttggggaaatttaaggagccgcatgctgccttttacgccgcagaaatagccattgggctgttcttcctacacaaccaggggattatctaccgggacctgaagctggacaacgtgatgctcgacgcggaggggcacatcaagataaccgacttcggcatgtgtaaggaaaacgtgttccccggaaccaccacgcgtactttctgtggtacccccgattacatcgccccagaaatcatagcttatcaaccttatggaaagagcgtggactggtggagcttcggagtccttctctatgagatgctcgcagggcagcctcctttcgatggcgaggacgaggaggagctgttccaggcaataatggagcagaccgtcacttacccgaaaagcttaagtagggaggctgtagccatttgcaaaggctttctaactaaacaccctggtaagaggctcggatccggccctgacggtgagccgaccatcagggcccacggattttttaggtggatcgattgggaaagactagagcggttggaaatccccccacctttccgaccccgaccctgcggaagatccggagaaaactttgataagtttttcaccagggccgcacccgcattaacacctccggaccggctcgttctggcttctatagaccaggcagatttccaggggtttacttatgttaaccccgattttgtgcaccctgacgcacgatcgccaaccagccctgttccggtgcctgttatgtag

SEQ ID NO: 30302 - DNA, 984 bp, Artificial Sequence
  Description of Artificial Sequence: Synthetic coding sequence
atggcgggtcttgggccaggtgtcggggactcggagggcggacccagaccactgttctgtcgcaaaggggcactgcgccaaaaggtagtgcacgaggtgaagagtcataaattcacagcgaggttttttaaacagcccactttctgctcccattgcacagatttcatctgggggatcgggaagcagggactgcagtgtcaggtctgctccttcgtggttcacagacgctgccatgagttcgtgacattcgagtgccctggagctgggaagggaccacagacagacgaccccaggaataaacataagttccgcttgcacagttacagctctcccactttctgtgatcactgtgggtccctcctctacggactggtgcaccagggtatgaaatgcagctgctgcgaaatgaatgtgcaccgccgatgcgttcggtccgtaccttcactatgcggagtggatcacactgaacgaaggggcagactgcagcttgaaattcgagctccaacagcagacgaaatccatgtgaccgtgggagaggcacgtaatctaatccctatggaccctaacgggctttcagatccctatgtgaaactcaagctaatcccagaccctcgtaatctgacaaaacagaaaaccaggactgtgaaagccacactcaaccctgtgtggaacgaaacctttgtcttcaatctgaagcctggcgacgtggagcgcaggctgtccgtcgaagtgtgggattgggaccgtacatctagaaacgattttatgggggctatgtcattcggcgtgagtgagttgcttaaagcccctgtcgacggctggttggtgacaaccccatggaactgcatgtcaggctgtgggtgggcacccctcccactgccaagtcctcccctgcccctggtccctcccacccctagcgcagcttcgtccgggagagtgcaggatgcctgtacaagcccaactagtgcgagtagttggttttag

SEQ ID NO: 30303 - DNA, 2133 bp, Artificial Sequence
  Description of Artificial Sequence: Synthetic coding sequence
atggcaggactgggtcctggagttggtgattccgaaggcggacctagacccctgttctgccggaagggagccctgaggcagaaagtcgttcatgaggtgaagagtcataagtttacggccaggttctttaagcagcccacgttctgttcccactgtacagacttcatttgggggatcgggaaacagggccttcagtgtcaggtatgcagcttcgttgtccatagacgttgccacgagttcgtaacatttgagtgtcccggtgccggaaaggggcctcagaccgatgacccaaggaacaagcacaagtttaggctgcattcatacagctcccctactttctgtgatcactgcggctcactactgtacgggctggtgcaccagggcatgaaatgctcttgctgcgagatgaatgtccatcggaggtgtgttcgttctgtaccgtctctctgtggggtcgatcacacggaaaggagaggccgtctccagttggaaatcagggctccaactgccgacgagatccacgtgacagtaggcgaggctcggaaccttattccaatggacccgaatggcctcagcgatccatacgtgaaattaaaactcatccctgacccacggaatttaaccaaacaaaagaccaggacagtgaaggctaccttgaaccccgtttggaacgaaacattcgtgtttaacctcaagcccggtgacgtcgagaggagacttagtgtggaggtatgggattgggacagaaccagcaggaatgacttcatgggagcaatgagcttcggtgtgtccgaattactaaaggcgcctgttgacggttggtacaagctgctgaaccaggaagagggggaatattacaatgtcccggtggcagacgctgataattgctctctcctgcaaaaattcgaagcctgcaattatcctcttgaattgtatgagcgggttagaatgggtccctccagctcccctattccctcgccctctccatcgcctacggatcccaaacggtgttttttcggagcgagcccgggtcgactgcacatttctgatttctcctttctgatggtgctaggaaagggctctttcggcaaggtcatgctcgctgaaaggaggggctctgacgaactatatgctattaaaatcttgaagaaggacgtcattgtgcaagatgacgacgtcgactgcactctggtggaaaaacgtgttctggccctaggcggtagaggccctggaggcagacctcattttctcacgcaactgcactctacattccagactcccgatagactctactttgttatggaatacgtgacgggcggtgacctgatgtaccatattcagcagctgggcaagttcaaggaaccccacgcagctttctacgctgccgaaattgctatcggactgttcttcttacacaatcaggggataatctacagagacttgaaactggacaacgtgatgctggatgccgaaggacacatcaagatcacggatttcgggatgtgcaaggagaacgtattccctggaacaaccaccagaactttctgcgggacccctgattacatagctccggaaatcatcgcttaccaaccctacggcaagagcgtggattggtggtcatttggcgtactgctttacgagatgctggcagggcaacctcctttcgatggcgaggatgaagaagagctgtttcaagcaattatggagcagactgtcacctaccccaagtccctgtcacgggaagctgttgccatatgcaagggattcctaacaaaacaccccggtaaacgtctgggcagtggtcccgatggcgaacctacaatccgggctcatggttttttccgatggatcgattgggaacgactagagcgcctggaaattccccctccctttcggccaagaccttgcggacgtagcggagagaattttgacaagtttttcacccgtgcagccccagctctgacgcctcccgatcggcttgtcctcgcaagcatagaccaggccgacttccaaggcttcacttacgtcaatcccgattttgtgcacccagacgcgaggtctccaacatctccagtgccagtccctgttatctcttgtacgcctgccttccagttgtgtcccagaggattctag

SEQ ID NO: 30304 - DNA, 1647 bp, Artificial Sequence
  Description of Artificial Sequence: Synthetic coding sequence
atgccccgaatatgtgacctcagggtcagtagacggtgggaaggtccgccagatggacggtgcgaaatgaatgttcaccgcagatgtgtgcgatccgtgcctagcctttgcggagtggatcacaccgagcgtaggggcaggctgcaactagagatccgcgctcccacggcggatgagatacatgtgaccgttggggaggcccgaaacctgattcctatggaccctaacggcttaagcgacccttatgtcaagctgaaattgattcccgacccccgaaatttgaccaagcagaaaactcgcaccgtgaaggcaaccctgaaccctgtgtggaatgagactttcgtgttcaatctcaaacccggagacgtggagaggcggctttcagtagaagtgtgggactgggaccggacaagcaggaatgacttcatgggggctatgagtttcggtgtctccgagctactaaaagcgccagtcgacgggtggtataaactccttaatcaggaagagggggagtattataacgtacctgtggccgatgcagacaattgcagtctgttgcaaaaatttgaagcttgtaactatcccctcgagctctatgaaagagtgcgaatgggcccatcttcctctccaatcccgagcccatccccctctcctacagatccaaaaagatgctttttcggggcttcacctggtaggctgcatatttccgacttcagcttcctgatggttctgggtaagggaagctttggaaaggttatgcttgccgaacgaagagggtccgacgaactgtacgcgatcaagatcctgaagaaggacgtgatcgtgcaagatgacgacgtggattgtacactggtggagaaaagagtacttgccctgggcggaaggggtcctggagggaggccccatttcctcactcagcttcactcgacctttcaaactcctgatcgactgtatttcgtgatggagtacgtcaccggaggcgacctgatgtatcacattcagcaactgggtaagttcaaggagcctcatgctgccttctacgcggctgagattgccattggcctgtttttcttacataatcagggcattatctaccgagacctgaaattggacaacgtgatgctcgacgcagaaggtcatataaagattaccgactttggaatgtgcaaggaaaacgtgtttccaggtacaacaacgcgaactttctgtgggactcccgactacatcgcgccagagatcatagcataccaaccctacggaaagtctgtggattggtggtcgtttggtgtgttgctctatgagatgctggccggacagtttcttacaaagcacccgggtaaacgcttaggcagtggcccagatggtgagcctactatccgggcacacgggtttttcagatggatcgattgggagcggctcgagcgattggagatccccccacctttccgcccaagaccgtgtgggcgtagcggggagaacttcgataagtttttcacacgcgcagcgcctgcattgacacctccagaccgcctcgtcttggcgtctatcgatcaggccgatttccagggcttcacatacgtgaatcctgatttcgtgcaccccgacgctcgcagtccgaccagtcctgtgcccgtgcctgtaatgtag

SEQ ID NO: 30305 - DNA, 1779 bp, Artificial Sequence
  Description of Artificial Sequence: Synthetic coding sequence
atgccctcgaggacaggcccaaaaatggagggatctggcggtcgggtcagattgaaagcacattacggtggcgacattttcatcacatccgttgatgccgctaccacttttgaagagctgtgtgaagaggttcgagacatgtgtaggctgcaccagcagcacccattaactctgaagtgggtagactctgagggcgacccctgtacagtgagcagtcagatggagctggaggaagcctttagactcgcacgccagtgccgcgacgagggtctcatcattcacgtttttccaagtacccctgagcagcctggactgccttgccccggagaggacaaaagcatttaccgaaggggggctagaagatggcgaaaactttatcgtgccaacggccatctatttcaggcgaagcggtttaatagaagggcatactgcggccagtgtagtgaacggatctgggggctcgcccgtcagggctacagatgtatcaattgtaagcttttagttcataagcgttgccacggtctggtgccgctgacctgcagaaaacacatggattccgtgatgcccagccaggaaccccctgtggatgacaagaatgaggatgccgatttaccttctgaagaaaccgacggtatcgcctatatctcttcatctcgtaagcacgactccattaaggatgactctgaggaccttaaaccagtaattgacggcatggacgggattaaaatcagccagggactgggcctgcaggactttgacttgataagggtcattggacgcggatcgtatgctaaggttctgttggtcagactgaaaaagaatgaccaaatttatgccatgaaagtcgtgaagaaagaactggtgcacgacgatgaagatattgattgggtgcaaacggaaaaacatgtgtttgagcaagctagctccaatccctttctggtgggcctgcattcttgttttcagaccaccagtcggctgttcctcgttatagaatacgttaatggcggagatttgatgttccacatgcagcgacagaggaagctgcccgaggaacatgcacgattttatgccgctgagatttgcattgccctgaacttcttgcacgaacgcggaataatatacagagacctgaagttggataacgttttgctggacgccgatggtcacatcaaactaaccgattacgggatgtgtaaggaaggcctgggcccaggtgatacaacttcaaccttctgtggaacacccaattatatagctcccgagattctgaggggtgaggaatacggcttttccgtggactggtgggctttgggcgtcctgatgttcgagatgatggccggtcgatcccccttcgatattatcacagataatccagacatgaataccgaggactatcttttccaggtcattctagagaaaccgattcgcatccccaggttcctttcagtcaaggcctctcacgtcctgaagggtttcctgaacaaagaccccaaggagcgcctggggtgccgacctcagacaggcttctccgatattaagtcacatgcattttttcgatccatcgattgggatctgcttgaaaaaaaacaggcgctgccacctttccagcctcagattacagacgattacggacttgataactttgacacccaatttacatctgagcccgtccagttgacccccgacgatgaggatgctataaaacggatcgaccagtccgaattcgagggcttcgaatacattaatccgctgctgttgtccacagaagaatctgtctag

SEQ ID NO: 30306 - DNA, 1230 bp, Artificial Sequence
  Description of Artificial Sequence: Synthetic coding sequence
atggattccgttatgccttctcaggaacctccagtggacgataaaaatgaggacgccgacttgccctccgaggagaccgatggtattgcctacattagctctagccgcaagcatgattccattaaggacgattccgaagatctgaaacctgtgattgacggtatggacggtattaagattagtcaaggcctgggactgcaggacttcgacctaatcagggtgatcggcagaggctcctacgctaaggtccttctcgtccggctgaagaagaacgaccaaatctacgctatgaaggtcgtcaagaaagagcttgtgcatgacgatgaggatatcgactgggtgcagacggaaaaacacgtctttgagcaggcatctagcaaccccttcctagttggcctgcattcttgctttcagacaacctcccggctgtttctggtgatcgagtacgtgaatggaggagacctgatgtttcacatgcaacgccaacgcaagctgccagaggagcacgccagattttacgccgcagaaatatgtatcgccctaaattttctgcatgaaaggggaataatctatagagaccttaagctagacaatgtacttcttgatgccgacgggcatataaagctgacagattacggcatgtgcaaagagggtctgggtcctggggatacaacatcgactttttgcggaactcccaattatatcgcccctgaaatattgcggggagaggagtacgggttcagtgtcgactggtgggcgctcggggttctgatgttcgaaatgatggcaggcaggtcacccttcgatatcatcacagataatcctgacatgaatactgaagattacctcttccaggtgatcctggagaagccgatccgaattccaagattcctttctgtaaaggctagccacgtgctgaagggattcttaaataaggatcctaaggagcgccttggttgtcggccacagacagggttttcggacattaagtctcatgcttttttccgaagtattgactgggacctgttagagaagaagcaggccctcccgccatttcagcctcagataacagacgactacgggctcgacaatttcgatacacagttcacatctgagcctgtgcaactcactcctgatgacgaagacgccattaaacgtatcgatcagtcagagtttgagggcttcgaatacattaaccccctgctgttgtctaccgaagagagcgtctag

SEQ ID NO: 30307 - DNA, 1230 bp, Artificial Sequence
  Description of Artificial Sequence: Synthetic coding sequence
atggactctgttatgccgtcccaagagccccctgtggacgataaaaacgaagatgcggatcttcccagcgaggaaactgatgggattgcatatattagttctagcagaaaacatgatagtattaaggacgattccgaggatctgaaaccagtcatcgacgggatggatggtatcaaaattagtcagggcctgggcttacaggacttcgacctcatccgcgttatcgggaggggttcttatgccaaagtgctgctggtaaggctgaagaagaacgaccaaatttacgcaatgaaggttgttaagaaggaacttgtacacgatgacgaggatattgattgggttcagactgagaagcatgttttcgaacaggcgtcttccaaccccttcctggtgggacttcattcctgcttccaaaccacctccagactgtttctcgttatcgaatatgtgaatggaggagatctaatgtttcatatgcagagacaacgcaaacttccggaggagcatgccagattttatgctgcggaaatttgtattgctctgaacttcctacatgaacgtggtataatctacagggatttaaagctggataatgtcctgttagacgcagatggccatatcaaactgactgattatggaatgtgtaaggaagggctggggccaggggatactacttctaccttttgcggcacccctaactacatcgctcccgagatcttgcggggtgaagagtacggcttctcggtggattggtgggctcttggggttcttatgtttgagatgatggccggaaggagcccttttgatatcattacagataaccccgatatgaacaccgaagactacctgttccaggtgattctcgagaaacccattaggattcccagattcttgtccgtaaaagccagccacgtactgaagggattcctgaacaaagatcctaaagaaagactagggtgccgaccacagaccggtttcagcgacatcaaaagccacgccttcttcaggtccattgattgggacctgctcgagaaaaaacaggcattgcccccttttcagccccagatcaccgacgactacgggctcgacaactttgacactcagttcaccagcgagcccgttcagctgactcctgatgacgaggacgcaattaagcgcattgaccagtccgaattcgagggatttgagtatatcaatcctctgctcctaagcacagaagagtctgtgtag

SEQ ID NO: 30308 - DNA, 1467 bp, Artificial Sequence
  Description of Artificial Sequence: Synthetic coding sequence
atgctgacccccagaactgatgaaagcatttatcgacgcggagcaagaaggtggaggaagctgtacagagcgaatggacatctgttccaggctaaaaggtttaataggagagcctactgtggacagtgttctgagcgcatttggggtctggctcgccagggttaccgctgcattaattgtaagcttctggtgcataaacggtgtcatggactggtgccgctcacctgccgaaagcacatggattcggtcatgcctagccaggagccccctgtggacgataaaaacgaagacgccgacttgccttccgaagaaaccgatggaatagcctatattagctcctctcgtaagcatgactctatcaaagacgactccgaggatctcaaaccggtgatagacggtatggatgggatcaagataagccagggattgggcttgcaggactttgatctcatccgcgtcatagggcgaggcagctacgcgaaagtactgctcgtacgccttaagaaaaacgaccagatatatgccatgaaagtcgtaaaaaaagaactggtacatgatgatgaggacattgattgggttcagacagagaaacatgtgtttgaacaagcttcaagtaaccccttcctcgtgggcctgcactcctgctttcagacaaccagcagactgttcctggtcatcgaatacgtcaacggcggtgatctgatgttccacatgcaaaggcagcggaaactccccgaagagcatgcacgattctatgccgctgagatttgcatcgcgctcaattttctgcatgagaggggcattatatatagagatcttaaactggataacgtcctgttggatgcagacggacatattaagctgactgactatggtatgtgtaaggaggggttgggcccaggggatactacaagtacattctgcggcacacctaactatattgcccctgagatcctgcgcggtgaggaatatggattttccgtagattggtgggcgttaggggtcctcatgtttgaaatgatggctggtagatctccgttcgacattattaccgacaatcccgatatgaataccgaggattacctgttccaggtgattttggagaaaccaatcaggatccccagattcttatccgtgaaggcatcacacgtgctcaaggggttcttgaacaaggaccccaaggagaggttggggtgccggcctcaaactggattttctgatatcaaatcacacgcatttttccgctcaatcgattgggaccttctggagaagaagcaggccttgcccccttttcagcctcagatcacagatgattacggactagacaactttgatactcaatttacgtctgagcctgtgcagttgacaccagacgacgaggatgctatcaaaagaatcgatcagtcagaatttgaagggttcgagtatatcaaccctctgctgctctctaccgaagagtccgtgtag

SEQ ID NO: 30309 - DNA, 78 bp, Artificial Sequence
  Description of Artificial Sequence: Synthetic coding sequence
atggactctgtgatgccaagtcaagaaccacctgtggacgacaagaacgaggacgctgatctaccatcggaggagtag

SEQ ID NO: 30310 - DNA, 249 bp, Artificial Sequence
  Description of Artificial Sequence: Synthetic coding sequence
atggatagcgtaatgccatctcaggagcccccagtggacgataagaacgaggatgccgatttaccaagtgaggaaacagatggaatcgcttatatcagcagttcccggaagcacgactcaatcaaagacgactcagaagatctaaagcctgtcatagatggcatggacggaatcaaaatttcccaaggactgggcctgcaggatttcgatctcatccgtgttatcgggaggggttcctacgccaagtag

SEQ ID NO: 30311 - DNA, 297 bp, Artificial Sequence
  Description of Artificial Sequence: Synthetic coding sequence
atggatagcgtaatgccatctcaggaacctcctgtggacgacaaaaacgaggacgcggacctgccatctgaggagacagacggtattgcctatattagctcttctaggaagcacgactcgataaaggatgacagtgaagatctgaaacccgtgattgacggaatggacggaatcaagattagccagggcctgggtcttcaagacttcgatttgattcgtgtaatcggacgtggaagttatgccaaagtgctgttagtacgactgaaaaagaatgaccagatttatgcgatgaagtag

SEQ ID NO: 30312 - DNA, 330 bp, Artificial Sequence
  Description of Artificial Sequence: Synthetic coding sequence
atggactccgtcatgcctagccaggaaccccctgtggatgacaagaatgaggatgccgacctgcccagcgaagaaacagatggaatcgcgtacattagctcttccagaaagcacgactcaattaaagatgattcagaagacctaaaaccggtgattgacggcatggatggaattaagatttctcagggactgggtttacaagactttgatctgatcagagtcatcggaaggggtagttacgcgaaggttttgctagtgaggttaaagaagaacgaccagatctatgctatgaaagttgtaaagaaagagctcgtgcacgacgacgagtag

SEQ ID NO: 30313 - DNA, 141 bp, Artificial Sequence
  Description of Artificial Sequence: Synthetic coding sequence
atggattctgtgatgcctagtcaagagccacctgtggatgacaaaaacgaagacgctgatttacccagcgaagagactgatgggattgcctatatttctagcagccggaaacacgacagcattaaggacgacagcgagtag

SEQ ID NO: 30314 - DNA, 222 bp, Artificial Sequence
  Description of Artificial Sequence: Synthetic coding sequence
atggactctgtgatgccaagccaggagccgcctgttgatgacaaaaacgaagacgctgatctcccctctgaggaaaccgacgggatagcctacattagttcaagccggaaacacgactcaatcaaggacgattctgaggatctgaagcctgtgatagatggaatggatggcatcaagatctctcaggggctagggttacaggacttcgatttgattaggtag

SEQ ID NO: 30315 - DNA, 66 bp, Artificial Sequence
  Description of Artificial Sequence: Synthetic coding sequence
atggattccgtaatgccttcccaggagccccctgtggatgacaagaatgaggacgctgacctgtag

SEQ ID NO: 30316 - DNA, 216 bp, Artificial Sequence
  Description of Artificial Sequence: Synthetic coding sequence
atggacagtgtgatgccaagccaggaaccccctgttgacgacaaaaacgaggacgcggatctaccttctgaggagactgatggtatcgcttacatctcaagtagcagaaagcatgacagcatcaaggatgattccgaagatctgaagcctgtcatagacggtatggacggaatcaagatttcgcaaggactgggccttcaggacttcgatctgtag

SEQ ID NO: 30317 - DNA, 417 bp, Artificial Sequence
  Description of Artificial Sequence: Synthetic coding sequence
atgatctcactgaccgacacccaaaaaattggaatgggactgaccggctttggcgtgttcttcctatttttcggaatgatcctattttttgataaagccctactggctatagggaatgtgctcttcgtggctgggctggcgttcgttatcgggctagagcgtacttttaggtttttctttcagaaacataaaatgaaggccacaggattcttcctgggcggtgtgtttgtcgtgttgatcggctggccactaatcggtatgatcttcgaaatatacgggttcttcctcctcttcaggggcttttttccagtggtggtggggtttatccgccgagtccctgtattgggtagcctgctcaatttacccggaattagatcatttgtggataaagtgggggaatctaataatatggtttag

SEQ ID NO: 30318 - DNA, 702 bp, Artificial Sequence
  Description of Artificial Sequence: Synthetic coding sequence
atggatagccctgaggatgccgatctgttccacagtgaggaaatcaaggctcccgagaaggaggagttcctggcttggcaacacgacctggaggttaacgataaagcccctgcacaggccagaccaaccgtatttaggtggacggggggaggcaaggaagtgtatttgagtggcagcttcaacaactggagcaagctgcccctgacaaggagtcataacaacttcgtagccattttggacctgcctgagggggagcatcagtacaagttctttgttgacggacagtggacccacgatccatccgagcccatagtgacaagccagcttgggactgttaacaacatcatccaagttaaaaagactgactttgaagtttttgacgctctcatggtggatagccagaagtgttcagacgtctcagagttgtcatcctcgccccctggcccttaccaccaggagccatatgtgtgcaaaccagaggaacgttttcgcgcacctcccatcctgccgcctcacctgctgcaggtaatcttgaacaaggatacaggcatctcatgtgacccagcattgctaccggagcccaaccatgttatgctcaaccacttatatgctctgagtataaaagacggagtcatggttttatccgccacacaccgctataagaaaaagtacgtcacaaccctgctttacaaaccaatctag

SEQ ID NO: 30319 - DNA, 813 bp, Artificial Sequence
  Description of Artificial Sequence: Synthetic coding sequence
atgggaaatacctccagcgagcgcgctgcattagagcggcacggtgggcataaaacacctagacgggatagcagtggcggaaccaaggacggcgacaggcctaaaatcttaatggactctccagaggacgccgacctgttccatagcgaagagatcaaagcccctgaaaaagaggagttcctggcatggcaacatgatctggaagtgaatgataaagctccagcccaggcgaggcccaccgttttccggtggactggagggggtaaggaggtctacctaagcggctcgtttaacaattggtccaagttgccacttacacggtctcataacaattttgtggcaatcctggacctgcccgagggagagcaccagtacaaattcttcgtggacggacagtggacccatgacccgtctgaacctattgtgacttctcaactgggtaccgtgaataacatcatccaggttaagaaaactgattttgaggtcttcgacgccctcatggtagatagtcagaagtgttcagatgtgtcagaactgtccagttcccctcccggaccttatcatcaggaaccttacgtgtgtaaaccagaggaacggttccgtgcgccacctatcctccctcctcaccttcttcaggtgatattgaacaaggacaccggcatctcctgtgatccggcattgctgcctgagccaaaccatgtgatgctgaatcatctgtatgcccttagcatcaaggacggcgtgatggttttaagcgccacacacaggtataagaagaagtatgtcacaacactgttgtataagccaatctag

SEQ ID NO: 30320 - DNA, 12384 bp, Artificial Sequence
  Description of Artificial Sequence: Synthetic coding sequence
atggctgggtccggagccggtgttcggtgttcccttctgcggctgcaggagacactgagcgccgctgaccgatgtggagccgctctcgccggacaccagctgatcaggggactggggcaagagtgtgtgttgtcgtcctctccagcagtcctggcactccagaccagcctcgttttctcaagggattttggtctgctggtgtttgtgaggaagagcctgaattcaatcgaattcagggagtgtcgagaagagattctaaagtttctgtgcatttttctggagaaaatgggccaaaaaatcgctccttactctgtggaaattaagaacacttgcacgagcgtgtacaccaaggatcgagcagcaaagtgtaaaatcccagctctggatctcctgattaaactgctacagacattcaggtctagccgcctgatggacgagttcaagattggcgagttattctccaaattttatggggagctggccttgaagaaaaaaattcctgacaccgtactggagaaagtgtacgagttgctcggcctattgggggaagtccacccctctgagatgattaacaacgctgaaaatttgttcagagcctttctgggggagcttaaaactcagatgactagtgccgtccgggaacccaagcttcccgtactggccggatgcctgaaagggctttcttctcttctctgtaattttactaaatctatggaagaggatccacagacctcacgggagattttcaattttgtgctgaaagcaatccgccctcagatagaccttaaaagatatgccgtgccaagcgcaggacttcgtctgtttgcactccacgcgagccagtttagtacatgcctgctcgataactacgtttctctatttgaagttcttctcaaatggtgcgcccatacgaatgttgaactgaaaaaggcagcactcagcgcccttgaatcattcctgaagcaggtgagcaacatggttgcgaagaatgccgaaatgcataaaaataagttgcagtattttatggagcaattttatggcattatcaggaacgtggacagtaataacaaggaacttagcatcgccattcgagggtacggattatttgcagggccttgtaaagtaattaatgctaaggacgttgactttatgtacgtagagttaattcagagatgtaagcagatgttcttgacccagacagatactggcgacgatcgcgtttaccagatgccttctttcttgcaaagcgtcgctagtgtgctgctgtaccttgatacggtccctgaggtttacactcccgttctggagcacctcgtggtgatgcagatcgattctttccctcagtactctcccaagatgcagctcgtttgttgtcgtgctatcgtaaaagtatttctggctctggcagccaagggtcccgtgcttcgcaattgcatctccaccgtggtccatcaggggttaatccgaatctgtagtaagccagtggtgctgccaaagggtcctgaatcagaatccgaggaccacagagccagcggagaagtgcgaacaggcaaatggaaggtccctacctacaaggactatgtcgatctatttcgtcacctactgagctctgatcagatgatggattctattttggcagacgaagcattcttttcagttaatagtagttcagaaagcctaaaccatctgttatatgatgaattcgtgaagagtgtgcttaagatcgtggaaaaactcgatctgacactggaaatccagacagtcggggagcaggaaaatggtgatgaggcccctggagtgtggatgataccgactagcgatccagctgccaaccttcatccggctaagccaaaagatttttcagcctttattaatctcgttgaattctgtcgcgagattctgcccgaaaagcaggcagaatttttcgagccatgggtgtactcttttagctacgagctcatcctccaatcaacccgtctcccgcttatctcggggttctataagctcctgtctataactgttcgaaacgccaaaaaaatcaaatattttgaaggcgtctcgccaaaatccctgaaacactcacccgaggatcctgagaagtattcatgcttcgcactgttcgtcaagtttggtaaggaggtggccgtaaaaatgaaacagtataaagacgaactcctcgcctcttgtctgacttttctgctgtccttgccacataatattattgagcttgatgtgcgtgcctacgtaccagcgctacagatggccttcaaactgggattaagctatactcctcttgccgaggttgggcttaacgccttggaagaatggagcatttatatcgataggcatgtgatgcagccatactacaaagacattctcccttgcctcgacgggtacctgaagacctctgccctttccgatgaaaccaaaaacaattgggaggtgtctgccctctctcgggctgctcagaaaggcttcaacaaagtggtcttgaagcacctcaagaagacaaaaaacctgtccagcaatgaagccatatcccttgaagaaatccgaattcgcgtggttcagatgttgggcagtctggggggacaaattaataagaacctgctgacagtcacctcatccgacgagatgatgaaatcctacgtggcctgggaccgggagaaaagactgtcgtttgctgtgccctttcgtgagatgaagcccgttatatttctagatgtgttcttacctcgggtgacagagctggccctcactgcctctgatcgtcagacaaaagtggctgcatgcgaactgctacattctatggtcatgttcatgctgggcaaggccacgcaaatgcccgagggcggacagggagcccctccaatgtaccagctgtacaagcgcaccttccctgtgctcttacgcctggcctgcgacgtggatcaggtaacaagacagctctacgagccactggtaatgcagctgatacactggtttacgaacaacaaaaagttcgagagccaggacaccgtcgctctgctcgaagccattctggatgggattgtagaccccgtcgactccactctccgtgatttttgtggcagatgtattcgggagtttttgaagtggtcaatcaagcagattacaccccagcaacaggaaaagtccccagttaatacaaagtccctcttcaaaaggctgtacagcctggctctgcacccaaatgccttcaagagactgggcgcaagccttgcatttaataatatatatagggagtttcgggaggaggagagtctggtggaacaattcgtgtttgaggctctggtaatatatatggagtcactcgcccttgcgcacgccgatgagaagagcctgggcacgatccagcagtgttgcgatgccatagaccatctgtgcaggattatagagaagaaacatgtttctttgaataaagccaaaaaaaggcgccttcctcgcggtttccctccctcggctagtttatgtctcctcgacctggtgaagtggttactcgctcactgtgggagaccccagactgaatgtaggcacaagagtattgagctgttttacaaattcgtacccctgttgccagggaaccggagcccaaatctatggctgaaagatgtgttgaaagaagagggtgtgtcgtttctcattaacacattcgagggagggggatgcggtcagccatccggaatccttgcccaacctaccctgctgtaccgtggccctttctcgctccaggcaactctatgctggctggacctactcctggctgcactagaatgctacaatacattcattggcgagagaaccgtgggagctctgcaagtgttgggaaccgaagcacaaagcagcctccttaaggctgtcgcattcttcctggagtctattgccatgcatgatatcatagccgctgagaaatgctttggaaccggagcagccggaaatagaacatcaccgcaggagggcgagagatacaactattcgaagtgcacagttgtggttagaataatggagttcaccactactctgctcaatacatctcctgaaggctggaaattactgaagaaggacctgtgtaacactcatttgatgagggtcctggtccagacactgtgcgagcccgctagtatcggatttaatatcggagacgtgcaggttatggcccatttgccagatgtctgcgtgaatctgatgaaagcactgaagatgagcccttataaggacattctggaaactcatttacgcgagaagatcacagcacagtccatcgaggaattatgcgccgtaaacctgtacggccctgacgctcaggtggaccgtagtcgactggcggcagttgttagcgcgtgtaagcaactccatagggccggtctcttgcacaatattctcccatctcagagcacagatctgcaccatagtgtagggacagagctgttaagcttggtgtataaagggatagcgccaggagatgaacgacagtgtctgccctcacttgatctctcatgcaagcaactggcaagtggtttgctggaactggcctttgcgttcggcggtctgtgcgaacggctggttagcctactactcaaccctgcggtgctctctaccgccagtctgggaagctcccaggggtcagtaatccacttctctcatggcgaatacttttactcactcttttccgagacgatcaatacagagctgctcaaaaaccttgacctggctgtgctcgagttgatgcaatcctcagtcgacaacacaaaaatggtgtccgccgtcctcaatggcatgctagaccagtcatttagggagagggcaaatcaaaaacaccaggggctgaaactggccaccacaatcctccaacactggaagaagtgcgactcctggtgggccaaggattcccctctggaaaccaagatggccgttcttgctcttttagccaagattctgcaaatcgactcttctgttagttttaatacctcacacgggagctttcctgaggtttttacaacgtacatcagcctgctggcagacaccaaattagaccttcatttgaaaggtcaggctgttactctgcttccatttttcaccagtttaactggcggaagtctagaggaactgagacgggtattggagcagcttatcgtagcccattttcccatgcagtctcgggagtttcctcctggaactcctagattcaataactatgtggattgtatgaagaagtttctcgacgccctagaactcagccagtcgcctatgctcctagaactgatgacggaggtgttgtgcagggaacagcaacatgtcatggaagagttattccagtccagcttccgaagaattgcgcgtaggggatcctgcgtaacccaggttggattgctagaatccgtctatgagatgttccgcaaagatgatccacggctctccttcacacggcagagcttcgtggatcgctctctgctcacattgttgtggcattgcagccttgacgctctgagggaatttttttccacaattgtggtcgatgctattgatgtgctgaaaagcaggttcactaagctgaacgaatcaacattcgacacacaaatcacaaaaaaaatgggatactacaaaattttggacgtcatgtactcaagactgccaaaggatgatgtacatgctaaagagtctaaaatcaaccaggtgttccacggatcgtgtattactgaagggaacgaactgacaaagactctcatcaagctatgctacgatgccttcacagaaaacatggccggagagaatcaactgttggaacggaggcgcctctatcattgcgcagcttacaactgtgctataagtgtgatctgttgcgtgttcaatgaacttaagttttaccagggcttcctgtttagtgagaaacctgagaaaaaccttctgatattcgagaacctaattgatctgaagaggcggtacaatttcccagtagaggtcgaagtgcctatggagcgaaagaaaaagtatatcgagataaggaaagaagcaagggaagctgctaatggagatagcgatggcccatcttatatgtctagcctttcctatttggcagacagtactcttagtgaggagatgagccagttcgacttctcgacaggcgtgcagtcctacagctacagctctcaagatccacgtccggctaccgggaggtttaggcgaagggagcagcgcgaccctaccgtgcatgatgatgtgctggaattggagatggacgaacttaacagacatgagtgcatggcccctcttacggcactggttaagcacatgcatcggtcactgggaccccctcaaggagaagaggatagcgttcctagagacctgccgtcttggatgaagttcctccacggtaaactgggcaatccaatcgtcccattaaacatcaggctctttctggctaagctcgtgattaacacggaagaggtgtttcggccttacgccaagcattggttatcacctcttctccagctggcagcatccgaaaacaatggtggcgaaggcatccactatatggtggtagagatcgtcgctacaattctttcatggaccgggctcgcaactccgactggagttccgaaagatgaagtgctggctaaccgacttctgaatttcttgatgaaacatgtgttccatcccaagagggctgttttccgtcacaacttggaaataattaagaccctggttgaatgttggaaagactgcctgtccattccataccgtctgatctttgaaaagttctccgggaaggatcctaactccaaggataattcagttggcattcaacttcttgggatcgttatggccaacgatctcccaccctacgacccccaatgcggaatccagtccagcgaatacttccaggccctggtgaacaacatgagcttcgtgcggtataaagaggtatatgccgctgccgcagaggtacttgggcttatattgagatacgttatggagcgtaaaaacattctggaagaatcattgtgcgaactagtggctaagcagctgaagcagcaccagaataccatggaagacaaattcatcgtgtgcttgaacaaagttaccaaatcatttcctcctctagccgataggtttatgaacgcggtcttttttttgctcccgaaattccatggagtcctgaagactctatgcctggaagtggttttgtgccgcgtggagggcatgaccgagctatactttcagctgaaatcaaaggactttgttcaggtgatgagacaccgggacgatgagcgacaaaaggtgtgtcttgacatcatttacaaaatgatgcccaaacttaaacccgtggaactaagagaattgctgaacccagtggtggaattcgtttcacatcctagcaccacctgcagggagcagatgtataacatactaatgtggattcacgataattaccgagaccccgagtcggaaacggataatgatagccaagaaatctttaagctagctaaagatgtgctgatccagggactaatcgatgagaaccccggattacagttaattatccgcaatttttggtcgcatgagaccaggttgccatcaaatacactggaccgcctcttggccttgaactcactgtactcacccaagatcgaggttcatttcctgagccttgctacgaactttctgctggagatgacctctatgagtccagattatcctaaccccatgttcgagcacccactcagcgagtgcgagttccaggagtacacaattgatagcgactggaggttcagatccacagtgctcacacccatgttcgtagagactcaggcttctcagggcacgctacagacaaggacacaagaagggagccttagcgcacgttggcccgtggctgggcagatccgtgccactcagcaacaacatgatttcacacttacacaaaccgctgatggaaggtctagcttcgattggctaacaggcagctctaccgatccacttgtcgatcatacgtctccctcaagcgactctctactgtttgctcacaagaggtcggagagactccaacgggctcctctgaaatcggtgggcccagattttggaaaaaagcggttgggactgcccggtgacgaagtggacaacaaagtaaagggagccgcagggcgtacagacctgcttagacttcgtagaaggttcatgcgagatcaggaaaaactctctctgatgtacgcgaggaagggtgtcgcagaacagaaacgcgaaaaggagatcaagagtgaactgaaaatgaaacaagacgcacaagtcgtgttataccggagctacaggcacggggacctgcctgacatccaaatcaagcactcgtcactaatcacacccttgcaggccgtggcccagagggatccaattatcgcgaagcagctgttctcctcattgtttagcgggattctgaaggaaatggataaatttaaaacattgagcgaaaagaacaatatcacccagaaactccttcaggactttaacagattcctgaatactacattctccttttttccccctttcgtcagctgtatacaggacatctcttgtcagcatgccgctctacttagtctggatccagccgctgtaagcgctggctgcctcgcgtcccttcagcagccagtgggaatccggctcctagaggaggcccttctccggttgttgccggctgagcttcccgcaaagagggtgcgaggtaaggcacggctacccccagatgtactgcggtgggtcgaattagccaagctctaccggagcattggcgagtatgatgtgctaagggggatctttactagtgagattgggaccaagcagatcactcagtcagcactgctcgctgaagccaggtccgactactctgaagctgccaaacaatatgatgaggcactcaacaaacaggattgggtggatggtgagcctacggaggcagagaaggacttctgggaactggcgtctttggattgctacaatcacttggcagagtggaagtcccttgagtattgcagcacagcatctatcgacagcgaaaatccacctgatcttaataaaatctggtctgaaccattttatcaggaaacatatctgccctatatgatcaggtccaagctgaaactcctgctgcaaggggaggcagaccagtctctgctaaccttcatagataaagccatgcatggggaactccaaaaggccattctggagttacactattctcaggaactgagtctattatacctgctgcaggatgatgttgacagggcgaagtattatatacagaacggaatacagagctttatgcaaaattacagcagtatcgatgtgctcctgcaccagtctcgcctcaccaagcttcagtccgtccaagcactgacagaaatccaggagtttatttcattcataagtaaacagggcaatctgagctcccaggtgccgctgaaacgcttactgaatacctggacgaacagatatcctgatgccaaaatggatccaatgaacatctgggacgacatcattaccaatagatgtttcttcttgtccaaaatagaagaaaagttaactcctctccccgaagacaatagcatgaacgtggaccaggacggggatcctagtgacaggatggaagtgcaggagcaggaggaggacatcagtagtctgattcggtcttgcaagttctccatgaagatgaaaatgatcgactccgcgagaaaacagaacaatttctcgctggccatgaagctcttgaaagagttgcacaaggaatcaaagactcgggatgattggctggtcagctgggtacagtcttactgtaggctgtcccactgcagaagccgcagccaggggtgcagcgagcaggttcttactgtgctgaagaccgtgtctctgcttgacgagaataacgtgtctagttacttgtcaaagaatatactggccttccgcgaccagaatatactgctcggcactacatatcggattatcgctaatgccctgagcagcgaacctgcttgcctagctgaaatcgaggaggataaagcacggagaatcctagagttgtccggcagttcttctgaggattcagaaaaggtgatagccggactctaccagcgcgcttttcagcacctctcagaagcggtacaggcggcagaggaagaggctcagcctccatcatggtcatgtgggcctgctgcaggcgtgattgatgcctatatgactcttgccgacttctgcgatcaacagctgcggaaggaggaggagaacgcttctgtgatagattccgccgagctgcaggcataccccgctctcgtggtggaaaaaatgcttaaagctctgaagctgaatagcaatgaagctaggctgaagttcccgcgattattacagatcattgagaggtatccggaagaaaccctatccttgatgactaaggaaatctcatctgtgccctgttggcagtttattagctggatcagtcacatggtcgctctgcttgataaggatcaggccgtagctgtgcagcattccgtggaagagatcactgataattacccacaggccattgtttacccttttatcatctcgagtgaatcttattcctttaaggacacttcaactggacacaagaacaaagagtttgtcgccagaattaagagtaaacttgaccaaggaggagtgatacaggacttcatcaacgctctggaccagttaagcaacccagagttgcttttcaaagattggagcaacgacgtgcgggctgagttagctaagacccccgttaataagaagaatattgagaagatgtatgaaagaatgtacgcagccctgggagaccccaaggcccctgggttgggggctttcaggaggaaattcattcaaaccttcggtaaggagtttgacaaacattttggcaagggcggatctaagctacttaggatgaagctgagcgatttcaacgatattacaaacatgctcttattaaagatgaataaggactccaagccacctggcaatctcaaggaatgttccccctggatgtcggactttaaggtggagtttctgcggaacgaactggaaatccccggtcagtacgacggaagaggtaaaccattaccagaatatcatgttcgtatcgccggattcgacgagagggtcacagtgatggcctcgctgaggagacccaagaggattattattcgtggacatgatgagagagagcaccccttcttggtcaaagggggtgaagacctccgccaggaccagcgggtggaacaactgttccaagtgatgaacggcatactggcccaggactccgcctgtagtcagcgagccctgcagctcagaacatacagtgtcgtgccgatgacaagtagactggggctgatcgagtggctcgaaaataccgtcactcttaaggacctgttgctgaatacgatgtctcaagaagaaaaggcagcttatctctcggaccccagggctccaccctgcgagtacaaggactggcttaccaaaatgagtggcaaacatgatgtcggtgcctatatgctgatgtacaagggagctaatcggacagaaactgtgacaagcttcagaaaacgcgagtcaaaggttccagccgatctgttgaagcgggcattcgtgcggatgagtacctcgccagaggcttttttagcactgcgcagtcactttgcgtcgtctcatgccctgatctgtattagtcactggatcctcggtattggcgatcgacacttgaacaactttatggtcgccatggaaacaggcggtgtgataggcattgactttggccatgcgttcggaagcgccacccagttcttgcctgtgccagaattgatgccctttcggctaactaggcaatttattaaccttatgcttccgatgaaagagaccggtttgatgtactccattatggtgcatgctctcagggcctttcggtctgacccaggactgttgaccaatacaatggatgtgttcgttaaggaaccctcatttgactggaagaacttcgagcaaaaaatgctgaaaaaaggcggttcatggatccaggaaataaatgtagctgagaagaattggtacccgagacagaagatatgctatgcaaagagaaagttggccggagctaaccctgctgtgattacctgcgatgagttgctcttaggccacgagaaggcgcctgcgtttagagactacgtggctgtggccagggggagcaaagaccacaacatccgcgctcaggagccggaaagcggactgtcagaagagacccaggtgaagtgtctgatggaccaggcaaccgatcccaacattctggggaggacctgggaggggtgggagccctggatgtac

SEQ ID NO: 30321 - DNA, 12291 bp, Artificial Sequence
  Description of Artificial Sequence: Synthetic coding sequence
atggctgggagcggcgcaggcgttcggtgttcgcttcttcggctacaggagactttaagcgcagcagataggtgcggcgcagctttggctggccatcaactcattcggggactgggccaagaatgtgttctgtcttcttccccagcggtgctagccctgcagacatccctagtgttcagccgagactttggcctgcttgttttcgttaggaagtctctgaacagcatcgagttcagggagtgtcgagaagagatcctgaagtttctctgcatctttttggaaaaaatgggacagaagatcgcaccttattcggtagagatcaaaaacacctgcacctctgtgtataccaaggaccgtgcagccaagtgtaagatacccgctctggatctgctcatcaagcttctccagacatttagatcgtctcgacttatggacgagttcaaaattggcgagcttttcagtaaattctacggagagttggccttaaaaaaaaaaatccccgataccgtgctggaaaaggtgtatgagttgctgggattgctgggggaggtgcacccgagcgagatgataaacaatgccgaaaatctattcagagcgtttctgggagaactcaaaacacaaatgactagcgcagtgagggaaccgaagctgcctgtgctggcgggatgtctgaagggtctgtcctccttgctctgcaacttcacaaagtctatggaagaggatccacagacttcacgagagatcttcaacttcgttctgaaagctatccgaccgcaaatagatctgaaaagatacgcggtaccctccgctggactccgccttttcgcactccacgcttcacagttctccacatgtctgctggataattacgtgagtctttttgaggtgcttctcaaatggtgtgcccacacgaatgtggagctgaagaaagctgcgctctccgccttagaaagcttcctaaagcaagtgtccaatatggtagctaagaacgcggagatgcacaagaataagctgcagtattttatggagcagttctatgggataatccgtaatgtcgacagcaataacaaagaactctcaatagcgatccgcggatatggacttttcgcaggtccctgcaaggtcatcaatgccaaagatgtggacttcatgtacgtcgaactgattcagcgttgtaaacagatgtttctgacacagacagataccggcgatgacagagtgtaccaaatgccaagttttctgcagagcgtggcgtccgtgctcttatacctcgacacagtgccagaggtttatacccccgttctggaacacctggtggtgatgcagattgatagtttccctcagtactcgcctaaaatgcaactcgtctgctgtagagccattgtgaaggtgttcctggccctggccgctaaagggccagtgctgcggaattgcatttccactgtggtgcaccaaggcctgatccggatttgctctaagcccgtggtgctccctaaaggcccagaatccgaatcagaggaccaccgcgcatccggggaggtccgcacaggcaagtggaaggttccgacatacaaagactacgtggatttgttccgacatctcttaagctccgaccaaatgatggattctatcctggcggacgaggcttttttcagcgtaaacagctctagcgagagtctgaatcacttattgtacgatgagttcgtaaaaagcgtactgaaaattgtcgaaaagctggatctgacgcttgaaatccagaccgtcggcgagcaggagaatggcgacgaagcaccaggcgtttggatgattcccacatctgaccctgctgcaaatttgcacccggcaaagccaaaagacttttctgcctttataaacctcgtggagttctgtcgggagatcctccctgagaagcaagccgagttcttcgaaccgtgggtttactcatttagctacgagctcatcctccagtcaactcggctgccactgatctcagggttctataaacttctgtcaatcacggtgcgaaacgcaaagaaaataaaatacttcgagggagtaagtccgaaaagcttaaagcactctcctgaggaccctgaaaaatactcttgtttcgccctgtttgtgaagtttgggaaggaggtagctgtcaagatgaagcagtataaggacgagctcttggcgtcctgtttgacgttcctcctgtcactacctcacaacattatcgaacttgatgtgcgggcttatgtgccggcactgcaaatggcctttaagttggggctgagctacacacctcttgccgaggtcggtctcaacgccctggaagagtggtccatatacattgatcgccatgtcatgcaaccatattacaaagacatcctcccctgcctggacggttacttaaagacctctgcactcagtgacgaaactaaaaacaactgggaagtgagcgcactgtcgagagccgctcagaaaggattcaacaaggttgtgttgaaacatttgaaaaaaacaaagaatctgagcagtaatgaggctatttccctggaggagatacgaatcagggttgtccaaatgctcggttctctaggtggccagatcaataagaacctcctaacggtgaccagttcagatgaaatgatgaagagttacgtggcttgggacagagagaaaaggcttagctttgccgtgccgtttcgagagatgaagcccgttatcttcctcgacgtgttcctgccccgtgtcacagaactggccctgacagctagtgatcgccaaacaaaggtggcggcttgcgaacttctgcacagcatggtgatgttcatgctgggcaaagcaactcagatgcctgaggggggtcagggggctccccctatgtatcagctgtacaaacgtactttcccggtcctcctgaggctggcctgcgatgttgaccaggttactagacagctctacgaaccgttggtgatgcaactgattcattggtttactaacaataaaaaattcgagagccaggataccgtcgccttgcttgaggccatacttgacgggatcgtcgacccagttgatagcaccctgcgggacttctgtggcaggtgtattagagaatttctgaagtggagcattaaacagatcacaccacagcagcaagagaagagccctgtgaacacgaaatcactctttaaacggttatactccctggctttgcacccaaacgcctttaaacgcttgggcgcttctttggcattcaacaacatttatagagaattcagggaagaggagagtttagttgaacaattcgtattcgaagctctcgtcatatacatggagagcttagctctggcacatgccgatgagaagtctctgggaacaattcaacaatgttgtgacgctatagaccatctttgtaggattattgaaaaaaaacacgtgtctttgaataaggcaaagaaaagacggctgccaagaggctttccaccctcagcatctttgtgtctcctcgacctggtgaagtggcttctggcacactgtggacgtccacagactgagtgcaggcacaaaagtatagagctgttctataaatttgtccccctattacctgggaaccgcagccctaacctgtggctgaaggacgtcttaaaggaggaaggagtcagctttctgattaacacatttgaaggaggcggttgcggtcaaccatccggcatcctagcccagccaaccctgctgtatcggggacccttctccctgcaggccacgttgtgctggttggacctactgctggctgccctggaatgttacaatacattcattggggagcgaacggtgggcgctctccaggtgttgggcaccgaagcccagtcgtccttgctcaaggccgtggcttttttcttggaatccatcgctatgcatgacatcatcgctgccgagaaatgctttggcacgggcgcagctggcaaccgcaccagcccccaggagggagaacggtataactactcgaaatgcaccgtcgtcgtccgcatcatggaatttaccacaacacttctcaatactagcccggaggggtggaagttgctaaagaaggacctctgtaacacccaccttatgagagtgttggttcagactctgtgtgagcctgcttcaatcgggtttaacataggcgacgttcaagtcatggcccacttgccagacgtgtgtgtcaaccttatgaaagctctgaagatgagcccatacaaggatatcctggagacccacttgcgcgaaaaaattaccgcccagtctattgaggagctgtgcgccgttaatctctacggccctgacgcccaggtcgaccgcagtcgtttagccgctgtggtgtcagcttgcaagcagctgcaccgcgctggcttgctgcacaacatcctgccatcccaatccaccgatctccaccattccgttggtactgagctcctatccctggtgtacaaagggatagcgccaggagatgagcgccagtgcttgccctcgctagatctctcctgtaagcaactggcaagcggcctgttagagcttgcctttgcctttggcggtttatgcgagagactggtctccctcttacttaaccccgcagtcctgtccaccgcaagcctgggtagctcccagggttcagtgatccactttagccatggcgaatatttttactccctgtttagtgagaccattaacacggaactgcttaagaatctggatctggcggtgctagagctgatgcagagctcggttgacaatacaaaaatggtgtcagccgttctgaacggaatgctcgaccagagctttagggaacgcgcaaatcagaagcatcaaggcctgaaactcgccactacaatattgcaacactggaaaaaatgtgattcgtggtgggccaaagacagccctctggagactaagatggctgtcctggccctgctcgccaagattctgcagattgattccagtgtttcgttcaacacctctcacgggagctttcctgaagtgttcaccacttacatcagtctgcttgccgacaccaaactcgacctgcacctgaaaggtcaggcagtgaccctgcttccattcttcacatctctgaccggcggtagtttggaggaactaaggagagtgctggaacagctgattgtggcccactttcctatgcagtctagggagtttcctccaggcacccctaggtttaacaactacgtagattgtatgaagaagtttttagatgcactggaactcagtcagagtccaatgctgttggagctgatgacagaggtgctatgtcgggagcagcagcatgtcatggaggagctgtttcagagctcgtttcgaaggatcgcaaggagaggctcctgcgtgacccaggtgggtctcttggagagcgtgtacgagatgtttcgaaaagacgatcccagactgtcctttacccgacagtcattcgtagaccgctccctgctaacgcttttatggcattgtagcctggatgctttgcgcgagttcttttcaacaatagtggttgacgctatcgacgtcttgaagtctagattcacaaagttgaacgagtctacgttcgacacgcaaatcaccaagaagatggggtactataaaatacttgacgtcatgtactcgcgccttccaaaggacgatgtgcatgctaaggaatctaaaataaaccaggtgttccatgggtcttgcattacagagggaaatgaattgaccaagaccctaatcaaactgtgttacgatgcatttaccgaaaacatggctggggagaatcagctactggagcgccgacgcctataccactgtgctgcttacaactgcgccatttccgtgatttgttgcgtttttaacgagttgaaattctaccaagggtttctcttctcagaaaaacctgagaaaaatctgctgatatttgagaatctcatcgatttaaagcgtcgctataacttcccggtggaggtcgaggtgcccatggagcgcaaaaagaaatatatcgaaataaggaaggaagccagggaagccgctaacggggactcagacggtccaagttatatgagcagcctgtcttacctggcagacagcacactatctgaggaaatgtctcaattcgacttctctactggggtccagtcttattcatactctagccaggatcccaggccagccaccggaagattccgccgacgcgagcagcgggacccaacagtgcatgatgatgtgctcgaattggaaatggatgagctgaatcggcacgaatgtatggctcccctgacagcactggtaaaacatatgcacagaagcctgggcccaccacagggagaggaagactcggttcccagagacctaccttcatggatgaaatttctgcatggaaaactggggaaccccatcgttcccttgaatatcagactcttcctcgccaagctcgtcataaacacagaagaagttttccgcccttacgccaaacattggttgtcgccactcttacagctcgccgcatccgagaataacggcggtgagggaattcactatatggtagttgaaatagtggctactatcctcagctggacgggcttagccacacccacaggtgtccccaaggatgaagtgttggcgaatcgcctcctaaattttctgatgaagcatgtattccatcccaagagggccgtgtttcggcataacctcgaaatcatcaagaccctggtcgaatgctggaaggactgcctgagcataccttacagactgattttcgagaaatttagcggaaaggacccaaactccaaggataattccgtaggcatccagctcctaggcattgtaatggccaacgacctacccccatatgacccgcagtgtggtatccagtccagcgaatattttcaagcactagttaataatatgtcatttgttagatataaggaagtgtacgccgctgccgcagaggtgctaggccttatcctcaggtacgtgatggagcgcaaaaatattttagaggagagcctctgcgaacttgtggccaaacagttgaaacagcaccagaatacaatggaagataaattcattgtatgcctgaataaggtgacaaagtctttcccacccttggctgatcgatttatgaacgctgtgtttttcttgctgcccaagtttcacggcgtgctgaaaactctctgcttagaagtagtcctgtgccgtgtggagggaatgaccgagctctactttcaactgaaatccaaggacttcgtccaggtgatgaggcatagggatgatgaacggcagaaggtgtgtttagatatcatctataagatgatgcccaaacttaagcctgtcgagctgagagagctgctcaaccccgtcgtcgaattcgtcagccacccgagtacaacttgcagagagcagatgtacaatatcttgatgtggatccacgataattatagggatcctgagagtgaaacggacaatgactcccaggaaatatttaaactggcaaaggatgtacttattcagggcctgattgacgagaaccccggattgcagctcatcataaggaacttttggtcccatgagacgcgtctccctagcaacaccctggataggttacttgcactgaatagcctttacagcccaaaaatcgaggtgcactttttgtctctagccaccaacttcctgttagaaatgacctccatgtctccagattatcccaaccccatgttcgagcaccccctgtcagaatgtgagttccaggagtacactatcgatagcgattggcgattcaggtcgacagttctaacacctatgttcgtcgagacccaggcctcacagggaactctccaaaccaggacacaagaaggatccctgagtgctcggtggcccgtggccggtcagattcgggcaacacagcagcaacatgatttcacactaacacagacggccgatggcagatcttcctttgattggttaacggggtcatcgacggatcctctggtggaccacacgagcccaagttcggactcacttctgttcgctcacaagcgtagcgaaaggctgcagagagccccactgaaatccgtggggccagacttcggcaagaagagactgggtctgcccggtgatgaggtggataacaaagtgaagggagcagctgggagaactgacctgctgagacttcgtaggagatttatgcgcgatcaagagaaactatctcttatgtatgcccgtaaaggtgtggctgaacagaaacgggagaaggaaattaagtctgaattaaagatgaagcaagacgcccaggtggtactgtatagatcttatcgccacggtgacctccctgacatccaaataaaacattcttcccttattactccactgcaggccgtggcacagcgcgaccccattattgccaagcagttgttctcatctctcttttcaggaatcttgaaagagatggacaagtttaagacactgtcagagaagaataacattactcagaagttgctccaggatttcaatcgtttcctcaacaccaccttttccttcttccctccctttgtatcatgcatccaagacatctcttgtcaacatgctgccctccttagtctggaccccgcagcagtgagtgcaggatgcttagctagcctgcagcagcccgtcggaatacgcttgttggaggaggccctgctccggctcttgcccgctgagctaccagccaaaagagtgagaggcaaagctcgcctgcccccagatgtactgcgctgggtagaactcgccaaactgtacaggtctattggggaatacgatgtgctgagaggcatttttaccagcgaaattggcaccaagcagatcacccaaagcgctttgttggccgaggccagatctgattatagtgaggcagcaaaacaatacgacgaggctctgaacaagcaggattgggttgacggggaacccaccgaggccgagaaggacttctgggagctcgctagtttggactgctacaaccatttggcagaatggaagtccctcgagtattgcagcacggctagcatcgactctgagaaccccccagacctcaataaaatctggtccgagcctttctaccaggaaacttacctgccgtacatgatcaggagcaaactcaagctcttactccagggtgaagctgatcagtccctgctaaccttcattgacaaagcaatgcacggagagttacaaaaagctatcctggaactccactactctcaggaactcagcctgctctacctgttacaggatgacgttgatcgggcaaaatactacatccagaatggaatccagtcatttatgcagaactatagctctattgacgtgctgttgcatcagagtagactgaccaaactgcagtccgtgcaggcgctgacggagattcaggaattcatatcatttattagcaaacaggggaacctctctagtcaagtgccactcaaacgtttgctgaatacatggactaaccggtatcctgacgcaaagatggatccaatgaatatctgggacgacatcatcacgaatagatgtttcttcctctctaaaatagaggagaagctcacccctctcccagaggacaattcaatgaacgtggaccaagatggtgacccgtctgaccgcatggaagtgcaagaacaggaagaagatataagttctttaatccgcagttgcaaattttcaatgaaaatgaagatgatagactcggcgcgaaagcaaaataacttctctctggccatgaaattactcaaagaactgcacaaagagtcgaagacacgcgacgactggcttgtcagctgggtccagtcctactgccggctttcacactgtcgatcacgctcgcagggttgttctgaacaggtcctgaccgtgctaaaaactgtgagcttgctggacgagaacaacgtgtcttcctatctgtcaaagaacatattagcattccgcgatcaaaacatactgcttggtaccacataccggatcatcgcgaatgcattgtcaagcgaaccggcatgcctagccgaaatcgaggaggacaaagcgcgaagaatcttggagctctccgggtctagctccgaggactccgagaaagtgatagcagggctgtatcaacgggcatttcagcatctttcagaggcggtgcaagcagcggaggaggaggctcagcctccatcctggagctgcgggccagccgctggggtgattgatgcgtacatgacattagccgatttctgcgaccagcaactccgcaaggaagaggaaaacgcttcagtcattgattcagccgagctacaggcataccccgcactggttgtggagaaaatgctcaaagctctcaaactcaatagcaacgaggccaggctcaaattcccacggttactgcagatcattgaacggtaccccgaggagacactgtctctaatgacaaaggaaatctcaagcgttccctgctggcaattcatttcttggataagtcatatggtggccctactcgacaaggatcaggctgtagcagtgcagcattcagtggaagagatcactgacaactatccccaagctatagtgtacccctttattatatcttctgaatcttatagctttaaagacacaagcacagggcataagaacaaggaatttgtcgctcggattaagtctaagttggatcaggggggtgtgatacaggatttcatcaacgcccttgaccagcttagcaacccggaactgctcttcaaagactggagtaacgacgtgcgagccgagctagcgaagactcctgtcaataaaaaaaacattgagaaaatgtatgagcgcatgtacgccgctctgggcgaccccaaggcgccaggcctgggcgcattccgccgtaagtttatccaaacatttgggaaagagtttgacaagcacttcggaaaaggcggttccaagctactgcggatgaagttaagcgattttaacgatatcaccaacatgctgttgctcaaaatgaataaggacagtaagccaccgggaaatctgaaagaatgctctccatggatgtcagattttaaagttgagttcctgcggaatgaactggagatcccgggacagtacgatggtcggggaaaaccacttcctgagtaccatgttcgcattgccggattcgatgaaagggtgactgttatggcatctctgcggcgacccaaacgcattatcattcggggtcacgacgagagagaacaccccttcctggtgaaggggggagaggatctgaggcaagaccagcgggtggaacagctgttccaggtaatgaacggaatcctagcccaagacagtgcatgctctcaacgtgcactgcaactgaggacctacagcgttgttccaatgacaagcagcgatcccagagcgccaccatgcgagtacaaggattggctgaccaagatgtccggtaagcatgacgtgggagcctacatgctgatgtataagggggctaataggactgaaacggtgacatcattccggaagagagagagtaaggtaccagccgacttgcttaagagagccttcgttaggatgagcacatctcccgaggcattcttggccctgcgttcccactttgcaagctcccacgccttaatctgtatttctcattggattcttggcattggcgaccggcacctgaataattttatggtggctatggagactgggggtgtgatcggcatagactttggccacgccttcggcagcgcaacacagtttctgcccgtgcctgagctgatgccctttcgtttaaccagacagttcattaatctcatgttacctatgaaagaaaccgggttgatgtacagcattatggtacatgcactccgggcattccgatcagatccgggtctgttaacaaacactatggacgtgttcgtcaaagaaccctcttttgactggaagaattttgaacagaagatgctgaagaaggggggatcttggatccaagagattaatgtggccgaaaaaaattggtacccacgccagaagatttgctatgctaaaagaaagctggccggtgccaacccagccgtgatcacctgcgatgagttattgctcgggcacgaaaaggccccagcttttagagactacgtggccgtggccagggggtctaaagatcataacattagggcacaggagcccgagagcggcctgtccgaagaaacgcaggtcaagtgccttatggaccaggccactgaccccaatatactgggcagaacgtgggagggttgggaaccttggatgtac

SEQ ID NO: 30322 - DNA, 444 bp, Artificial Sequence
  Description of Artificial Sequence: Synthetic coding sequence
atggcagcgcaaaggctgggaaagagagtcctgagtaaacttcagagcccctctcgggctcgcggtcctggtggatcaccaggtgggctccaaaagcgtcacgctagagtgaccgtgaagtacgatcgaagggagttacagcgcaggctggacgtcgagaaatggattgacggtagattagaggagctctaccggggaatggaggccgacatgcctgacgaaattaacatagatgagctgttggaacttgagtctgaggaggagcgctccaggaagatacagggactgttaaagagttgtggcaagcctgtcgaagactttatccaagaacttcttgccaagttgcagggcttacatcgccagcccggattacgccaaccatcccctagtcatgacggcagcctgtctcctctgcaagatagagccagaaccgcacatccctag

SEQ ID NO: 30323 - DNA, 363 bp, Artificial Sequence
  Description of Artificial Sequence: Synthetic coding sequence
atggccgcacaacgactcggaaagagagttttgagcaaactgcagtctccttcccgcgcaaggggtccaggtggatcccccggaggcctgcagaagaggcatgctagagtaacagttaagtatgacaggcgtgaattacagcgaagactcgatgtggaaaagtggatcgatggcaggctggaggagctctatcggggtatgggcttactgaaatcttgcgggaagccagtcgaagatttcatccaggagttgttagcaaaactgcaggggcttcaccggcaaccaggcctccggcaaccttcgccatcccacgacggctccctgagtcccctccaggacagggctcgcacagcacatccctag

SEQ ID NO: 30324 - DNA, 2025 bp, Artificial Sequence
  Description of Artificial Sequence: Synthetic coding sequence
atggccccaggacaggcgccacatcaagcgacgccttggcgggacgcccacccattcttcttgctgtcaccagtgatgggcctgctaagcagagcttggagccggcttcggggtctcggcccacttgagccttggctggtggaggccgtgaaaggtgccgctttggtggaagctgggctggaaggcgaagccaggaccccccttgccatcccccataccccctggggtcggaggccggaagaggaggcagaggattccggaggcccaggagaagaccgggagaccctcggcctcaagactagttcatccctgcctgaggcgtggggcctgttggatgacgacgacggaatgtacggggagagggaagccacttcagttcctagaggtcaggggtcccagttcgctgacggacagagagctccactttcgccgagtctccttatcagaaccctacagggcagcgacaaaaaccctggggaggagaaagctgaggaggaaggtgttgcagaagaggagggtgtaaataagttctcttaccctcccagccatcgcgagtgttgcccagccgtggaggaggaggatgatgaagaggctgtgaagaaggaggcccaccggacgtcaactagcgcactctctcctgggtctaagccatctacctgggtgtcttgcccgggagaggaggagaatcaagctaccgaggataaacgcaccgagcggagtaagggtgcacgcaaaacaagtgtttctccacgtagttcaggatccgatcccaggagttgggaataccggagtggagaagcaagtgaagaaaaggaggagaaggctcacaaggaaaccggtaagggggaggctgcccctggaccacagagttcggcaccagcgcagcggccacaactcaaatcttggtggtgccagccatctgatgaggaggagggggaagtgaaagcactaggcgctgccgagaaagatggagaggcagaatgtcccccatgcatccctcctccctctgcttttctgaaagcttgggtttactggcccggagaagacacagaggaggaagaggacgaggaagaggatgaggattcggattccgggtctgacgaagaggagggagaagctgaagcatcctcatccacgccagccaccggtgtttttttaaagtcttgggtgtatcagccaggagaggatacagaagaggaggaagacgaggactctgataccggtagcgcggaagatgaacgggaagccgagactagcgccagcacaccccctgcatcagcattcctgaaggcttgggtttataggcctggcgaagatacagaggaggaggaagatgaagatgtcgatagcgaagataaagaggacgacagtgaagcagctctcggcgaagcagaatccgacccccacccatcacatccagatcaaagggcccatttccgcggttggggatacaggccaggcaaagaaactgaagaggaagaagctgctgaggattggggagaagcagaaccctgcccattccgcgtggccatttatgtgcctggagaaaaaccccctccaccttgggcacccccaagattgccccttagactacaaagacgcctgaaacggccagaaactcccacgcatgaccccgatcctgagacccctttaaaagccagaaaagtgcgcttctcggaaaaggttacggtccactttctggcggtgtgggcaggtcctgcccaggctgctaggcaggggccttgggaacaactggcgagagatcgaagtagatttgcacgacgtatcactcaagctcaagaagagctgtctccttgtctgacgcctgcggctagggccagggcatgggcaagattgcggaatccccctctggcccctattcccgcactgacacagacgctgccttcgtcctcggtgccatctagtcccgtgcagactacccccctctctcaggccgtagccactccttccaggtcctcagccgcagctgccgctgctctagacttgagcggaaggaggggatag

SEQ ID NO: 30325 - DNA, 1545 bp, Artificial Sequence
  Description of Artificial Sequence: Synthetic coding sequence
atgaaagccgaggaggaaggggtggcagaagaggaaggagttaataagttttcttaccctcccagccaccgtgagtgctgcccagcagtggaagaggaggatgacgaggaagcggttaaaaaggaagcgcacagaaccagtacatccgccctgagtcctggtagcaagccaagtacctgggtatcttgtccaggagaggaagaaaatcaggcaaccgaggacaaacggacagaaaggtcaaagggcgctaggaagactagtgtctccccaaggagttccggcagcgacccacgttcttgggaatatcgttcgggtgaagcttcagaggaaaaggaagagaaggcccataaggagaccggcaaaggcgaggcagccccaggaccgcagagttccgctcccgcacagcggcctcagctgaaaagctggtggtgccagccctcggacgaggaggaaggggaggtaaaagcccttggcgcagctgaaaaggatggggaggcagagtgtccaccttgcatccccccaccttcagcctttctaaaggcctgggtttattggcctggggaggataccgaggaagaagaagatgaggaagaggacgaagacagcgacagcggctccgacgaggaggagggcgaggcagaggcctcgtcaagcacacccgcaactggagtattcctgaagagttgggtatatcaacctggtgaggacaccgaagaggaggaagatgaagattcagacacaggttccgcagaagatgagagggaagccgaaacttcagcttccactcctccagcatctgcatttctgaaggcctgggtgtaccggcctggcgaggatacggaggaagaagaggacgaagatgtcgattccgaggacaaagaggacgattctgaagcggcactcggagaagccgagtctgacccccacccttcccatcctgatcagcgtgcgcacttcagagggtggggatataggcctggaaaggaaaccgaggaagaggaagctgccgaggactggggcgaggccgaaccctgtcctttccgggtggcaatctacgtgcctggggagaagcctcctcccccttgggcacccccaagactgcctctgaggttacaaaggcggctaaaaaggcccgaaactcctacgcacgaccctgatcccgaaactcctctcaaagccaggaaagtccgcttttctgaaaaagtgacagtgcactttctggcagtgtgggccggacccgcacaggcagcacgccagggtccctgggagcaactcgcacgggatcgcagccgcttcgctcggaggattacccaggcgcaggaagaacttagtccgtgcctgactccagccgctagggctcgggcttgggccaggcttagaaatcccccattggctcctatccctgctttaactcagacattgccttcaagcagcgtgccatcctcccctgtccagaccactccattgagccaggcagtggcaacaccctcgcgctcttcggccgctgctgctgccgctctcgacctctccgggagaaggggatag

SEQ ID NO: 30326 - DNA, 1899 bp, Artificial Sequence
  Description of Artificial Sequence: Synthetic coding sequence
atgccatggctcgtagaggctgtaaagggcgctgctctggtggaagccggattggagggcgaagcacggacgcctctggccatcccacataccccgtggggacgacggccagaagaggaggcggaggattccggtggacctggggaagacagagaaaccctgggccttaagaccagctcctcattaccagaggcctggggcttactggatgatgacgacggcatgtatggcgagcgggaggcaacgtccgtgcccagaggacagggtagccagtttgctgacggacagagggcaccgctgtcgccttcactgcttattcgcactcttcagggctccgataagaaccctggagaagagaaagccgaagaagaaggagtggcggaagaagagggagtaaataagttctcataccccccaagccaccgggagtgctgccctgcagtggaggaagaagacgacgaggaggcagtcaagaaagaagctcaccggacctcgacaagtgctttgtcccctggatccaaacctagtacttgggtgagctgccccggagaggaagagaatcaggcaaccgaggacaagcgtacagagcgaagcaaaggcgcaaggaaaactagcgttagccctcggagtagtggaagcgaccccaggagctgggagtaccggtcgggggaagcatcagaggaaaaagaggaaaaggcacacaaggagacggggaaaggcgaggccgctccagggcctcagtctagcgcgccagcgcagcgcccacagctgaaaagctggtggtgccagccctcggatgaagaggaaggagaggtcaaggctctaggggctgccgagaaagacggtgaagctgagtgccccccatgcatcccgccaccctccgccttcctgaaggcatgggtgtattggcctggtgaggacacagaagaggaggaagacgaagaggaggatgaagatagcgatagcggttctgatgaggaagaaggcgaagctgaggcttccagctcgacccctgccaccggcgtctttttgaagtcgtgggtgtatcagcccggtgaggacacagaggaggaggaagacgaagactcagacactggtagcgccgaagacgagcgcgaggccgagacttcagccagcacgcctccggcaagcgcatttctcaaagcctgggtttacagacctggcgaggacacagaagaggaagaagacgaagacgtagactctgaggataaagaagatgactcggaggccgctctgggggaggcggagagcgacccccatccatcgcacccagaccagcgggcacatttcaggggttggggttaccgccctggtaaagaaaccgaggaagaggaagccgcagaggactggggcgaagcagaaccgtgtccatttagagttgcaatttatgtgccgggtgagaagccaccaccaccatgggctcctccaagactcccactccgcctccaacgacggctgaaaaggcccgagaccccaacgcatgacccagaccccgagacaccgctgaaagctaggaaagtgaggtttagcgaaaaggttacagtacacttcctggctgtgtgggcaggacccgcacaagcggctagacaggggccatgggagcagctggcccgagatcggtcgcggttcgccaggcggatcacacaggctcaggaggagctgtccccgtgcctcacaccggcagcccgtgctcgggcatgggccaggcttcgtaatcctcccctcgcccctattcccgcactaacacaaacgttgccttcttcttctgtccctagtagccctgtgcaaacgacacccttgtcccaggccgtggccacaccgagccggtcctctgccgctgccgcagccgctctcgatctttccggtcgcagaggctag

SEQ ID NO: 30327 - DNA, 1671 bp, Artificial Sequence
  Description of Artificial Sequence: Synthetic coding sequence
atggcaggcgcttcagagcttgggaccggccctggcgctgcaggaggtgacggggacgacagcctttaccctattgcagtacttattgatgaactaaggaacgaagatgtgcagctccgacttaattcaatcaagaagctcagcacaatcgccctggccctgggagttgagagaacccggagtgagctcctgccatttctgactgacacaatctatgacgaagacgaagtgctcctggccttggccgagcagctcgggaacttcaccggcctcgttggtggtcctgacttcgcccactgtctgctaccccctctggagaacttagcgaccgtggaggaaaccgtcgtgcgggataaggccgtggagagccttagacagatttcacaggagcacactcccgtggctctggaggcatacttcgtgccactggtgaagaggctggcctcaggagactggtttacttcgagaacttcagcctgtgggctctttagtgtgtgttatcccagggcatctaatgcagtgaaagcggagataaggcagcagtttagaagtctgtgtagtgatgatactcctatggtacgtagagccgcagcctcaaagctcggcgagttcgccaaggtactggagctcgattctgtaaaatcagagatcgttccactatttacttctctagcctccgacgaacaagacagcgtgcgactactggctgttgaagcatgcgtatcaattgctcagctgctctcacaagatgatctcgagacactggtcatgcctactctgcgtcaagctgctgaagataaatcttggagagtcagatacatggttgctgatagattttccgagctgcagaaagcaatgggccctaaaatcaccctcaacgatctgatcccagcctttcagaatttgcttaaggattgtgaggccgaggtaagagcggctgctgcgcacaaggtgaaagagctgggagaaaatttgcccatcgaggatcgtgaaacaataatcatgaatcaaattctgccctacatcaagtgccccgatgtccgattgaatatcattagtaaccttgattgtgtaaatgaagtcatcggaatacgtcagctgtctcagtccttactcccagcaatcgtggaactcgccgaggatgccaagtggcgagttcgcctcgcgattatcgagtatatgccattgctggccggacagctgggggtcgaattctttgacgagaaactgaacagtctttgcatggcctggttggtggaccacgtgtacgctatccgggaagcagcgaccaataatctgatgaagctcgtccagaagttcggcaccgaatgggcccaaaacaccattgttcccaaggtcttagtcatggccaacgaccccaactacttgcaccggatgaccaccttgttttgtataaacgccctgagtgaagcctgcggtcaagagatcaccacgaaacagatgctgcccatcgtactgaagatggccggagaccaggtcgcgaacgttcgctttaatgtggctaagagtttgcagaagatcggacccatcttggataccaacgcattacagggcgaagtgaagccggtgctgcagaagcttggccaagacgaggacatggacgtgaagtacttcgcccaggaggccatctcagtgctagcactcgcgtag

SEQ ID NO: 30328 - DNA, 1770 bp, Artificial Sequence
  Description of Artificial Sequence: Synthetic coding sequence
atggcagcggctgatggtgatgactccctttatcctatagctgtgctaattgacgaattacgcaacgaggacgtgcagcttcgactaaattcaatcaaaaaactctccacgatcgccctggctctgggggtggagagaactcgctccgaactgttgccttttcttacagataccatatatgatgaagatgaagtcttactggctcttgccgagcagttaggcactttcacgacccttgtgggaggcccagaatacgtgcactgcctgcttccacccctggaaagcctcgccaccgttgaagagactgtggtacgcgataaggctgtggagtctctgagggccatcagccatgagcactctccttctgatctggaggcccacttcgtcccactcgtgaagagactggccggtggggactggtttacatcccgcacaagcgcttgcggcctctttagcgtgtgctatccaagagtttcttcagctgtaaaagcagaacttcgacagtactttcgaaatctctgctccgatgacacacccatggtgcgcagggctgccgcttcaaagctgggcgagtttgcaaaagtactcgagctcgataatgtgaagtctgagatcattccgatgttctcaaacctcgcctccgacgaacaggattccgtcagactgctggccgtcgaggcttgtgttaatattgcccagctactcccccaagaagacctggaggctttagttatgccaactctgagacaggccgctgaagataaaagctggcgcgttcggtacatggttgctgataaattcacagaactgcaaaaagctgttggtccagaaatcactaagactgacctagtacccgctttccagaatctgatgaaagattgcgaggccgaggtgagggccgcagcttcccataaggtgaaggagttttgtgaaaatttgagcgcagactgtagagaaaatgtgataatgagccagattctgccctgtattaaggagctggtttcggacgcaaatcagcatgtcaaaagcgcactggcatcggttatcatgggactctcacccattctcggcaaggataatactatcgagcatttgctaccattattcttggcccagctcaaagatgagtgccctgaggttcgcctgaacatcatatccaatctcgattgcgtgaacgaagtcataggaatacgccagctttcgcagtctcttctaccagctatcgtggagcttgcggaggacgccaaatggcgagttagactagctatcattgaatacatgcctctgctggctggacagttaggggtggaatttttcgatgagaagctgaacagtctgtgtatggcatggctggtggaccacgtctatgccataagggaggccgctaccagcaatttgaagaaacttgtggagaaatttgggaaagaatgggcacacgcaaccattattccgaaggtgttggctatgagcggcgatcccaactacctacaccgaatgacaacactattctgtataaacgtgttgtccgaagtgtgtggccaagacattaccaccaagcatatgctgcccactgtgctgagaatggccggtgaccccgtggcaaacgtgaggtttaacgtcgcgaaatcactgcagaagatcggaccgatcctagataatagtaccctccaaagtgaagtgaagcccattctggagaagctcacacaagatcaggatgttgatgtcaaatacttcgcgcaagaggctcttaccgtgctgtcgctggcttag

SEQ ID NO: 30329 - DNA, 1740 bp, Artificial Sequence
  Description of Artificial Sequence: Synthetic coding sequence
atggctgctgccgatggggacgactctctctacccgatcgcagtgctcattgacgagctgagaaatgaagatgtgcagctgagacttaattccatcaaaaaattgtccaccatagccctggctctgggtgtggagaggactagaagcgaactactgccctttctgactgacaccatctacgacgaggacgaagtcttactagctttggctgaacaattgggaacattcacaaccctggtggggggacccgagtatgtgcactgcctgcttccccctcttgaaagcctcgctaccgtggaaagcctgagagctatatcacacgaacacagcccttccgacttggaggcccactttgttccactcgtaaaacgccttgccggaggtgactggttcacctctagaacttctgcttgtggccttttttccgtgtgttacccacgggtgagttcggctgtgaaagccgagttgcgccagtacttccggaacctgtgcagcgacgacacccctatggtgcggagagccgctgcttcgaagctgggggaatttgcaaaagtacttgagctcgataatgtgaagagcgagataatccctatgttctcaaatctggcttccgacgagcaggattctgtccgcctgctcgcggtggaggcctgtgtgaatattgcccagctgctgccccaggaagacctggaagccctcgtgatgccgaccttgagacaggccgctgaagacaaatcttggcgagtgaggtacatggtagcggacaaattcacggaattacagaaagcagtaggcccagagataaccaaaacagatctcgtgccagcttttcaaaatctgatgaaagactgcgaggctgaagtgagggccgcagcaagccacaaggtgaaagagttttgcgagaacctgagcgcggactgtagagagaacgtgattatgtcccagatcttgccttgcatcaaagagctggtctccgacgcgaaccaacacgtgaaatccgccctcgcctctgtgattatggggctgagccctattcttggaaaagataacactatcgaacacctgcttcctctgtttttggcccagcttaaggatgaatgcccggaggtcaggcttaatatcattagtaatttggactgcgtgaacgaggtgatcgggatccgccagctgagccagtctttattacccgctatcgtagagttggctgaggatgctaaatggcgcgtacggctggccatcattgaatacatgccactcctcgcaggccagctgggagtggagttcttcgacgagaaactgaactccctctgcatggcctggcttgtcgaccacgtgtacgccattcgcgaggccgctactagtaatttgaagaaattagtggagaagttcggcaaggagtgggcccatgccactatcattccgaaagtcctggccatgagcggagatcctaactatttacacagaatgacgacgctcttttgtatcaacgtcctaagcgaggtgtgtggtcaagatatcaccactaagcatatgctgcctaccgttttaagaatggctggtgaccccgtcgccaatgtgagattcaacgtggcaaaaagcttgcagaaaatcggccctatcctggacaattccaccctgcaatccgaggttaagcctatactggagaaactcacgcaggaccaagacgtcgacgtaaagtatttcgcccaagaggccctgacagtgcttagtcttgcctag

SEQ ID NO: 30330 - DNA, 471 bp, Artificial Sequence
  Description of Artificial Sequence: Synthetic coding sequence
atggcagccgcagacggggacgatagtttatacccaatagcggttcttattgatgaattacgcaatgaggatgttcagctccgcctaaactctaacctgaagaaattagtggagaagttcgggaaggaatgggcccatgctactatcattcccaaggtcctggcaatgagtggggatccaaattatcttcacagaatgaccaccctattttgcattaatgtcttaagcgaggtttgcggccaggacatcaccacaaagcacatgctgccaaccgtgctgcgaatggcaggagatcccgttgccaatgtgaggttcaatgttgcaaaatcgttgcagaaaatcggacctattcttgataatagtaccctgcaatccgaggtgaagcctatcctcgaaaaacttactcaggaccaggatgtggatgttaaatattttgcgcaagaagcattaacagtcctctccctggcctag

SEQ ID NO: 30331 - DNA, 1605 bp, Artificial Sequence
  Description of Artificial Sequence: Synthetic coding sequence
atgcgaacgttctcatttgcaagtacagccagccgaagctgtccgccatctccttggcccttgggactgaagggccctgaagtctcgttctgtcttagccttcagccccctctggaaagtctggccacagttgaggaaaccgtggtgagagataaagccgttgagtctctgagagcaatatcacatgagcacagtccatctgatcttgaagctcatttcgtacccctcgttaagagactcgcgggaggagactggtttacctcacgtacgtcagcctgtgggctgttcagtgtttgttaccccagggtgagctctgccgtcaaggccgagctgcggcaatatttccgcaatctctgttcagatgacacacccatggtcaggagggccgctgcaagcaagctgggtgagttcgctaaagtgctcgaactggacaacgtgaaatctgaaattatcccaatgttcagtaacctggcaagcgatgaacaagactcagtgagactgcttgcggttgaggcctgtgttaatatcgcccagcttctgcctcaggaggatctggaggcattggtcatgcccactctgcgacaggcagcagaggataagagctggcgtgtgagatacatggtggcagacaagttcactgagttgcagaaggctgtgggccctgaaataactaaaactgatctggtccccgcttttcaaaacctcatgaaggattgcgaggcggaggtcagagcagctgcatcccacaaggtaaaagagttctgcgagaacttatctgcggattgtcgggaaaacgtcatcatgtcacagatcctcccttgcattaaagagctcgtgagtgatgcaaatcagcatgttaagtcagcactggcgtcagttattatggggctgtctcctatcctagggaaggacaacacaatcgaacatctgctgccattgtttcttgcccagcttaaagatgagtgcccagaagtgagactaaatatcatctcaaatttggactgtgtcaatgaggtgatcgggatccgacaactcagtcagtccctgctccccgctattgtggaactggcagaggatgccaaatggagggtgcgcctcgcgattattgagtacatgcccttgttagcaggtcaacttggggtcgaatttttcgacgagaaacttaattccctttgtatggcttggctggtggatcacgtttacgcaataagagaggccgcaacttccaacttgaaaaagctcgtagaaaaattcggaaaggagtgggcacacgctacaattattcccaaagtgctggccatgtcgggggacccaaattacctgcacaggatgactacgttattttgtataaatgtgcttagcgaagtatgcggtcaggacattacgaccaaacacatgctgccgacagttctgcgcatggcaggagaccctgttgctaatgtgcgcttcaacgtggctaaaagcttacagaaaattggaccaatcctggacaacagcaccctccagtctgaggtgaagcctatcctcgaaaagctcacacaggaccaggacgtggacgtgaagtacttcgcccaagaggccttgaccgtcctttccctcgcatag

SEQ ID NO: 30332 - DNA, 2004 bp, Artificial Sequence
  Description of Artificial Sequence: Synthetic coding sequence
atggccggagcaagcgaactgggaaccggccctggtgccgctggcggtgatggagatgattctctgtatcccattgccgtcctgattgacgagctgcggaacgaagacgtacagttgagacttaacagcatcaagaaactgagcacaatcgccttggcgctgggggtggaaagaacgcgctctgaactgcttcccttccttaccgatacaatttacgacgaggatgaagtgctcctggcgctggccgagcagctgggtaacttcacgggtctggtgggaggacccgactttgctcattgtttgctacccccacttgagaacctggccaccgtggaagaaaccgtggtgcgggataaggccgtcgaatcgctcagacagattagtcaggaacatacgcccgtagccctggaagcatattttgtgcccctcgttaagcgcctagcaagcggcgattggttcacaagcaggacatctgcctgcggactgtttagtgtttgctacccgagagcaagcaatgccgtaaaagctgagattcggcaacaattccgctctctctgttcagacgatacacctatggtgaggcgagccgctgcttcaaagcttggcgaatttgcaaaagtgcttgaacttgactctgtcaaatctgagatcgtacccctttttacaagcttggccagcgatgagcaggacagcgtcagactgctcgctgtggaggcctgcgtgtccatcgcccaactgttgtcccaagacgatctagaaaccttggtcatgcccacccttcgacaggccgctgaggataagagctggagagtgcggtatatggtcgctgatagattcagcgagctccagaaggcaatgggccctaagattaccctgaacgatctgatcccagccttccaaaatttgctcaaagactgcgaggccgaagtgagggctgccgctgctcacaaagtgaaagaactgggggagaatctccctatagaggacagagagaccattattatgaatcagattttgccgtatattaaggagttagtctcagacacgaatcagcacgtcaaaagcgccctggcatccgtgatcatggggctgtccacaattctgggaaaagagaataccattgagcatttgctccccctgttcttggctcagcttaaggacgagtgtcccgacgtccgactaaatataatttctaacctagattgcgtgaacgaggtcatcggtatacgccagctatctcaatctttattgcctgcaatcgtcgaactcgctgaagatgccaaatggcgcgtacggctggcaattatcgagtatatgcctctcctcgcaggtcaactgggtgtggaatttttcgatgagaagctgaacagcctctgcatggcatggcttgttgatcatgtgtatgctattcgcgaagcagccaccaacaatttgatgaagcttgtccaaaaatttgggaccgagtgggcccaaaatacgattgtgccaaaggttttagtgatggctaatgaccctaattatttgcatcgtatgaccaccctcttttgcattaacgcactaagtgaggcatgcggccaggaaatcactactaagcagatgctgcctatcgttctaaaaatggccggagatcaggttgccaatgtcaggtttaacgtagccaagagtctgcagaaaatcggacctattctcgataccaatgcactgcagggcgaggtgaagcccgtgctccagaaactaggccaggacgaggacatggatgttaagtatttcgcccaagaggcaataagcgtggtagcccagcggcttcggaagctggagtttcctgtcaaagactccggcgagccaagtgtgccccgagccgataaaaaccactttcccagacccactgtccccggagaggatatgggaaaagggcctgtttaccagctgcggggtgacacccgagatacacttgcccagctcggcatcgccgagctggtgcactttagccagtcgaccgactag

SEQ ID NO: 30333 - DNA, 1425 bp, Artificial Sequence
  Description of Artificial Sequence: Synthetic coding sequence
atggccggtgcctctgagctcgggaccggccctggagccgctggcggagatggtgatgactcactttaccccatagctgttctgatcgacgagctccggaacgaggacgtgcagttgagattaaacagtattaagaagctttccactatagcacttgcgctcggggttgaacgcaccagaagtgaattgctcccatttctcactgacacaatctatgatgaggacgaggtactcttagcgttagcagagcaactggggaacttcacagggctggtaggcggtccagacttcgcccactgccttttggactccgtacggctcctcgccgtggaggcctgcgtgagcatcgcacaattactgtcccaggacgacctggagaccctggtgatgcccacattacgccaagccgctgaagacaaatcatggcgggtgcggtacatggtcgccgatcggttttcagagctgcagaaggccatgggacccaagattacactcaatgacctcatccctgcgtttcaaaatctcttgaaagactgcgaggccgaggtacgggcagctgccgctcacaaagtgaaggaacttggcgagaatctcccaattgaggaccgggaaacaatcataatgaatcagattctcccctacatcaaggagctcgtgtctgatactaaccagcatgtaaaaagcgctctggccagtgtaatcatgggcctgtccacaatcctggggaaggaaaacaccatagagcatttgctgcccttgtttcttgcccagctgaaggatgagtgcccggatgtgcgcctgaacatcataagcaacctggattgtgtgaatgaggtgattggtatacggcaactttctcaatctctgcttccagccatcgtggagctggcagaggatgctaaatggcgtgtaagattggcaatcattgagtatatgcccttgttggcgggtcagttgggcgtggagttcttcgacgaaaaattaaactcactctgtatggcttggcttgtggaccatgtctatgccattcgagaagcagccaccaataatcttatgaaactagtacagaagttcggaactgagtgggcccagaatacaatcgtgcccaaggtattggtaatggcaaacgatcctaactatcttcatcggatgacaacgctcttctgtataaacgctttgagtgaggcgtgtgggcaggaaattaccactaagcagatgctgccaatagtgctcaagatggcaggcgaccaggtcgcgaatgtccgtttcaacgtggccaagtcactccaaaaaattggcccaatactcgacacaaatgccctgcaaggggaggttaaacccgttctgcagaagctgggacaggacgaagatatggatgtcaaatactttgcccaggaggctattagcgtgctggcgctggcttag

SEQ ID NO: 30334 - DNA, 1365 bp, Artificial Sequence
  Description of Artificial Sequence: Synthetic coding sequence
atggcgggagcctccgagttaggcacggggccaggcgctgccggtggagatggagatgattctttatatcccatcgccgtgttaattgatgagctgcggaacgaggacgtccagcttcggctgaatagtatcaagaaactgtccaccatagcattggccttgggagtcgaaagaactagatcggaattgttaccctttctgactgataccatttatgatgaggacgaagtgctcttggctctcgccgagcagcttggcaatttcactgggctggtaggtgggcctgatttcgcgcactgtctactggactccgtacggctgcttgctgtggaggcctgcgtctcgatcgcccagctgctcagtcaggacgatctcgagaccctagtgatgcctaccttgcgtcaggccgcagaggacaaatcctggcgggtgaggtatatggtagccgaccgcttctctgaactccaaaaggctatggggccaaagattactttgaacgacctgatcccagcttttcaaaacctgcttaaggactgtgaggctgaggtgcgggctgccgcagcacataaagtcaaggaactcggcgagaatctcccaattgaggaccgcgaaaccataatcatgaatcagatcttaccctatatcaaggagcttgtgagcgacactaaccagcatgtcaaaagcgcactggccagtgttataatggggttgtccactatcctaggaaaagagaacaccatcgagcatctgctcccgctgtttctggcacagttgaaggatgagtgtcccgacgtcaggctgaacataatatctaacttggattgcgtgaatgaggtaatcggtattagacagctgtcccagtctctgcttcccgctattgtagaactcgctgaagacgcaaagtggagggtgagattggcaataatcgaatacatgcctttgctagcaggccagttgggggttgagttttttgacgaaaagttaaacagtctatgtatggcctggttggtggaccatgtgtatgccattagggaggccgcaaccaacaatctcatgaagctggtgcagaaattcggaactgaatgggcccagaatactattgtgcccaaagtactggttatggcgaacgatccaaactacctccatcggatgactacactcttttgcattaacgctctgagcgaggcctgcggccaggaaatcactacgaagcagatgcttcctattgtcaagaatggcagaaggcccagtagtaaatgctctctgcagtgcggacaaatttcgactaaggactggactaatagtcgataccaatgctttaccggccgatccgaggccagcaccaccgaagtgcgttcgcgttag

SEQ ID NO: 30335 - DNA, 1812 bp, Artificial Sequence
  Description of Artificial Sequence: Synthetic coding sequence
atggcaggcgcttccgagctgggaaccggccctggtgccgctggcggtgatggggatgattctctttatcctatcgccgtgctaattgacgagctgcgcaacgaggatgtacagcccccactggaaaatcttgcaaccgtggaagagaccgttgtcagagataaggccgtggaatcgctgcgccagatctcacaggaacacacccccgttgcccttgaggcttacttcgtccctttggtgaagagactggcaagcggcgactggtttacatcacgtactagtgcatgcggcctgttctccgtgtgttacccccgtgcgagcaacgccgtaaaggccgagattcgccaacagtttcgctccttatgcagcgacgatacccctatggtgcggagagccgcagcttccaagctgggcgagttcgccaaggtactggaactggacagcgttaagtcggagattgtgcctcttttcacgagcctggcaagcgacgaacaggactcagtgagactgctagcggttgaagcttgtgtgagcattgcgcaactgctgtcccaagacgacctcgagaccctcgtgatgccaactctcaggcaggcagctgaagacaaatcctggcgagtgcgttacatggtggccgataggtttagcgagctccagaaggccatgggcccaaagatcacactcaacgatttgatcccagcattccagaacctgctgaaggactgcgaagccgaggtgcgcgcagccgctgcccataaggtcaaggaactcggggaaaatctgcctatcgaggacagggagacaataatcatgaaccagatcctgccttatataaaggagctcgtgagtgacacgaatcagcatgtgaagagcgccttggcaagtgtgattatgggcctctctacaattctaggaaaagagaacaccatcgagcacttactgcccttgttcctcgcccaattgaaggacgagtgccctgatgtgcgactgaacattatatccaatctcgattgcgtcaatgaagtgattggaatccgacagctgtcacagtccctactgccggcaatagtcgaactcgctgaggatgccaagtggagggtccggcttgcgatcatcgagtatatgcctctgctggcgggtcagctgggcgtcgaatttttcgacgagaaactaaattctttgtgtatggcctggttggtggatcacgtatatgccattagggaggctgcaactaacaaccttatgaagctggttcaaaaatttgggacggaatgggcccagaacactattgtgccaaaagtcttggtaatggccaatgaccccaactatctgcatagaatgaccacactgttctgtattaatgccttgtccgaagcttgtggtcaagagatcaccactaagcagatgttgcccatcgtgctgaaaatggcgggagatcaggtggcaaacgtccggtttaacgtggccaagtccctgcagaagattggacctatcttagatactaacgccctgcagggtgaagtgaaacctgtgctgcagaaactgggccaggacgaggatatggatgtgaagtacttcgcccaggaggccattagcgtggttgctcagaggctgcgaaagctcgaattccctgtaaaagactctggtgaaccctctgtcccaagggcggacaagaatcactttccacgcccaacagttccaggggaagatatggggaagggcccagtgtatcagctaaggggagacactagagatactctggcccagctcggcatcgctgagctcgtccatttttctcagagcaccgattag

SEQ ID NO: 30336 - DNA, 1323 bp, Artificial Sequence
  Description of Artificial Sequence: Synthetic coding sequence
atgatgcagctcacattctggctgcgagtccctcccccatttagtcacttcaaacggcagtttagatccctatgttccgatgacaccccaatggtgcggagagccgcagccagcaagctgggggaatttgccaaagtcctcgaactcgattctgtcaaatcagaaattgttcccctgttcacgagtctggcctctgatgagcaggattcggtccggttgctggcagtggaggcctgtgtgagcatcgcacagctactgtctcaggacgatctggagactctggtgatgccaaccctgcggcaggcagctgaggacaagagctggcgggtaaggtatatggtagctgatcggtttagtgaactgcagaaagcgatgggcccaaagatcactttaaatgatctcatcccggcatttcaaaacctcctgaaagattgcgaggctgaggtgagagctgccgcagcccacaaggtcaaggagctgggagagaaccttccaattgaggacagggagactatcattatgaaccagattctgccctatatcaaagagctggtgtcggatactaatcaacacgttaagtcggctctggccagcgttattatgggactctcgacaattctagggaaggagaacaccatcgaacacctgttaccactcttcctcgctcaactcaaggatgagtgtcccgatgtccgcctgaatatcatttcaaatctcgattgcgtaaatgaagttatcggaatcaggcaactctcccagtcactgctcccagctatcgtagaattagcagaggatgctaaatggagggtccgcttggccataattgaatatatgcctctcttggccggtcaactgggtgtggaatttttcgacgagaagcttaattcgttgtgcatggcttggctggtggaccacgtatatgccatccgggaggccgcaaccaacaatctcatgaagcttgttcagaagttcgggacggaatgggcacagaacacaatcgtacctaaagtgctcgtgatggccaacgatccaaattacctgcacagaatgacaaccctgttctgtatcaatgcactgagcgaagcctgtggacaagagatcaccacaaaacagatgttacctatcgtgctgaagatggcaggagaccaagtcgctaatgtgaggttcaatgtggctaagagccttcagaagatagggcctatcctggatacaaacgccttacagggtgaggtcaaaccagtgctgcagaagctgggtcaggacgaagatatggacgtcaagtactttgcccaggaggccatcagtgtgttggccctggcctag

SEQ ID NO: 30337 - DNA, 1806 bp, Artificial Sequence
  Description of Artificial Sequence: Synthetic coding sequence
atggcaggcgcttcagagctgggcacgggaccgggagctgcaggcggagacggtgacgattctctgtatcctattgcagtcctgatcgatgaattacggaacgaggacgtgcagctccgcctgaacagtatcaagaaactgtcaacgatcgcactcgcgttgggagtggagagaaccaggagcgagctgttgccgttcctgactgacactatctacgatgaggacgaagtcttgctcgccctcgcagagcagctagggaacttcactggtttggtgggcggaccagattttgcgcactgcctactccctcctctggagaacctcgccacggtggaggaaacagtcgtcagagataaagcagttgaatccctccgccaaatctcacaggagcacacacccgtggcgctggaggcgtactttgtcccactggtgaagcggttagcttctggagactggttcacaagcagaacctccgcctgtgggctgttcagtgtctgctatccaagagcctccaatgctgtgaaggccgaaattcggcagcaatttcgctctttatgttctgacgacacgcctatggtacggagggcagcagcatctaagctcggtgagttcgccaaggtactggaactagacagcgtcaagtccgagatcgtgccactgttcaccagtctggcatcagacgaacaggactctgtcagactcttggccgtggaggcttgtgtgagcattgctcagctgctatctcaggatgatcttgagaccctggtgatgccaacactcaggcaggccgctgaagataagagttggcgtgtccggtatatggtagcggatcggttcagcgagctacagaaggcaatgggacccaaaattacactaaatgatctaattcctgcctttcagaatctactgaaggattgcgaggctgaagttcgagccgctgctgcacataaagtgaaagagctgggagaaaatctgccaatcgaagatcgtgagacaataataatgaaccagattctgccttacatcaaggagctggtgagcgacactaatcagcacgtgaagagcgctcttgcttctgtcatcatggggctgtctaccattttggggaaagaaaataccatcgaacacctgctgcccctttttctcgcccagctgaaggatgagtgccccgacgtcaggctcaacatcataagtaatcttgactgcgtcaacgaagtaatcggcataaggcagttgtcccagtcactgctgccagcaattgtggaactcgcggaagatgccaagtggcgggtccggcttgcgattatcgagtacatgccgcttctcgctggtcagctcggcgtggagttttttgacgagaagctaaacagcttatgcatggcctggctagtggatcatgtgtacgccattagggaggctgccactaacaacctgatgaaactcgtacagaagtttgggacagaatgggcccaaaataccattgttccaaaggtgctcgtgatggccaacgatcccaattatctgcataggatgacaactctgttctgtattaacgctctatccgaagcctgtggtcaagagatcaccaccaaacagatgctcccgatcgtattaaaaatggccggagaccaggtagctaacgtgcgttttaacgtcgctaaaagcctccaaaaaattggacctatcttggacacaaatgctttgcagggcgaggtgaagcctgtccttcagaaactggggcaggatgaggatatggatgtgaagtactttgcccaggaggccatatctgtgttggcactggcctag

SEQ ID NO: 30338 - DNA, 1566 bp, Artificial Sequence
  Description of Artificial Sequence: Synthetic coding sequence
atgagtgggagaagatttcatctgtcaactacagaccgggtgatcaaggctgtccccttcccccctacccaaaggttgactttcaaagaggtgtttgagaacggaaagcccaaagtcgatgtgctaaaaaatcacttggtcaaggaaggccgactggaggaagaagttgcgctaaaaatcattaacgatggtgccgcaatcctgcgacaagaaaagaccatgattgaagtcgatgccccaataaccgtttgtggagatattcacgggcagttctttgatctcatgaagcttttcgaagtaggaggatccccttctaacactagatacttatttctcggggattatgtagaccgtggttacttttcaatagaatgtgtgctctatctgtggagcctaaaaataaatcacccaaagaccctgtttctcctccggggaaatcacgaatgtcgccacctaactgactactttacgttcaaacaagagtgcaggattaagtattctgagcaggtgtatgacgcctgcatggaaaccttcgattgcctgccactggcagctctgttgaaccaacagtttttgtgcgtccacggaggtatgagccccgaaattacttccctggacgacattaggaaattggacaggttcacagaacctccagcatttgggcctgtctgtgacctcctgtggtctgatcccagcgaggactacgggaatgagaagactttagagcactacacccacaataccgtcagaggctgtagctacttttattcctaccctgcggtgtgtgaattcctgcagaataacaacctgttgtccattatcagggcacatgaggcgcaggatgccggataccgtatgtatcggaaatcccaagcaacgggattcccaagtctgattactatattttctgccccaaactacctagatgtatacaacaacaaggccgcagtgcttaaatacgaaaataacgttatgaatattaggcagtttaattgttcgccccacccgtactggttacccaacttcatggatgttttcacctggtccctgcctttcgtgggagagaaggttacagagatgcttgtgaatgtcctgaacatttgctcggacgacgaactgatctctgatgacgaagccgaggatcactatattcccagctaccaaaaaggcagcactacagtgaggaaggaaattatccggaataagataagggccattggaaaaatggcaagagtgtttagtattctacgccaggagtcagaaagtgtcttaactctcaagggacttacccctactggtactctgccgctaggagtgttatctggcggtaagcagaccattgagactgctacagtcgaagcagtggaggctagagaagccattcgtggtttttccctgcagcacaaaattaggagcttcgaggaagccagaggcctagatcggattaatgaaaggatgccccctcgtaaggatagcatccacgcagggggacctatgaaaagtgtcacaagtgcccatagtcatgccgctcatcgctcagaccagggtaagaaagcccattcatag

SEQ ID NO: 30339 - DNA, 1410 bp, Artificial Sequence
  Description of Artificial Sequence: Synthetic coding sequence
atgtccgagcctaaagcaatcgacccgaagctaagcactaccgatcgagtggtgaaggcagttcctttccctcctagtcatcgactcacagctaaagaggtcttcgataacgatggtaagccccgagtggacatactgaaagctcatctcatgaaggaggggaggctggaggagtctgtggctttaagaatcatcaccgaaggcgcatcaatcctgcgccaggaaaagaatctgcttgacatcgacgcaccggtgacggtttgcggggatatacacgggcagttcttcgatctgatgaagctatttgaggtgggcggaagccctgccaacacaagatacttgttcctaggggactacgtggatcgcggatacttctcaattgagtgtgtcctgtacctgtgggcactcaaaatcctctacccaaaaaccctgttcctcctcagaggcaaccacgagtgccggcacctgactgagtacttcacgtttaaacaggagtgcaagatcaaatattcagagcgcgtatacgatgcctgcatggatgcctttgattgcttgccactcgcagccttgatgaatcagcagtttctctgtgttcatggcggtctatcccccgaaatcaacacactggatgatatccggaagttagaccggttcaaagagcctcctgcctatggaccaatgtgtgatatcttgtggagcgacccgttagaggatttcgggaacgagaaaacacaggaacactttactcacaatacagttcgcggatgtagctacttttattcataccctgccgtgtgcgagtttttgcagcataataatttattgtccattctccgtgcacacgaggcccaggacgctggataccggatgtataggaagagtcagacaaccggattccccagccttattacaatattcagcgccccaaactatctggatgtatacaataataaggtgactgaaatgctcgtgaatgtgttgaatatttgttcagatgacgaactgggatccgaagaagacggttttgatggcgctacagccgctgccagaaaggaggtgatacggaataagattagagctatcggtaaaatggcaagggtgttctcagtattacgcgaggaatcggaatctgtattgaccttgaagggtctgacccctaccggtatgctgccatccggagtcctgtctggcggaaagcaaactctgcagtctgcaatcaaaggattttcccctcagcataagataacttcattcgaggaagccaagggtctggatcggattaacgagcgaatgccccctcgcagggacgcaatgccttcagacgcgaacttaaattccataaataaagccttaacctctgagactaacggaacagattctaatggctctaattccagcaacattcagtag

SEQ ID NO: 30340 - DNA, 1536 bp, Artificial Sequence
  Description of Artificial Sequence: Synthetic coding sequence
atgtccgaacccaaagccattgaccctaaactgagtacgactgatagggtcgtcaaggcggtgccctttcccccaagccaccgtcttacagcaaaagaggtgttcgacaatgatggaaagcctagagtcgatatcctaaaggctcacctcatgaaggagggcagactcgaggagtcggtagctctgagaattatcacagagggcgcatctatattacggcaagaaaaaaatctgctggatatcgatgccccagtaacggtctgcggcgacatacatggccagttcttcgatctgatgaagttgttcgaagtgggtggctcacccgctaacacgaggtacctcttcctcggtgactatgttgatagggggtacttctctatcgagtgtgtcctctacttgtgggctctgaagatcctctacccgaaaacactgtttttgctgaggggaaatcatgaatgccggcatttgaccgagtactttacattcaaacaggagtgcaagataaagtattccgaaagagtctacgacgcgtgcatggacgcttttgactgccttccacttgccgctcttatgaaccaacagtttctgtgtgtccatggagggctgagccccgaaatcaatactcttgacgatataaggaagctcgaccggtttaaagagcctcctgcctacggacccatgtgtgacatcttatggagcgaccccctcgaggactttggcaatgagaagacccaggaacactttacacataataccgtgcggggatgctcttatttctatagctacccagctgtgtgtgaattcctccagcataataatttgctatccatcctgcgcgcacatgaggcccaggacgcagggtatagaatgtatagaaaaagtcagactacaggttttccctcgctaatcaccatttttagcgcacccaactatttagatgtgtacaataacaaagctgccgtcctgaagtacgagaacaatgtgatgaacatcaggcagttcaattgttcgccacatccctattggctgccaaactttatggacgtgtttacttggtctctgccttttgtgggagagaaagttacagaaatgctggttaatgttctgaatatctgcagcgacgatgagcttggatcagaagaagatggcttcgatggagccactgcggcagccaggaaggaggtgattcgaaataagattagggccatcgggaagatggccagagtgttcagtgtgctgagagaagagtccgaatccgtgctcaccctgaagggactgacacccacagggatgttaccaagcggcgttctctctggcggaaagcagacactgcagagtgctattaagggattcagcccgcagcacaaaatcaccagctttgaggaagcaaagggattagaccgaattaatgagcgcatgcccccaagaagagatgccatgcctagtgacgcaaacctgaattccatcaataaagccctaacgagtgaaacaaacggcactgatagcaatggatccaattcttccaacattcagtag

SEQ ID NO: 30341 - DNA, 1566 bp, Artificial Sequence
  Description of Artificial Sequence: Synthetic coding sequence
atgagtgagcctaaggctatcgaccccaagttatccacaactgatagagtggtcaaagcagtcccatttccgccttctcaccgcttgactgccaaagaggtcttcgacaacgatggaaagccaagggttgatattctgaaagcccatttgatgaaggagggccgtctggaagagtcagtcgccctgcgcattatcacggaaggggcttccattctgcggcaagagaaaaatctgcttgacattgacgcgccagtgaccgtgtgcggggacatacatggacagttctttgacctaatgaagttattcgaggtcggtggctcccccgcaaatacaagatatctgttcctcggtgattacgtggataggggttactttagcatcgagtgcgtgctgtatctttgggcgcttaaaattctttaccctaagaccttatttctgctgcgtggaaaccatgaatgtcgacacctgactgaatactttacgtttaagcaggaatgtaaaattaagtattctgagcgtgtgtacgatgcctgcatggacgcattcgactgtctacctctagccgctcttatgaatcaacagtttctgtgcgtacatggcggactgtctcctgaaatcaatacgctcgacgatattagaaaactggatagattcaaggagcctcctgcctacggacctatgtgcgatatactctggtctgacccgttagaagactttgggaacgagaagacacaagagcactttactcataacaccgtccggggatgttcctacttctattcctacccagcggtttgtgaattcttgcaacataataacctgctcagcatcctgagagctcacgaggcccaagatgccggatataggatgtacagaaaaagccaaaccacaggctttcccagtctcattaccattttctcagcgccaaattatctggatgtatataataataaggctgccgtgctcaagtatgagaacaacgtcatgaatataagacagtttaattgctccccccacccatactggctccctaattttatggacgtgtttacttggagcctcccttttgtgggcgagaaggtgacagagatgttagtgaacgttctgaacatatgtagtgatgacgaactgggctctgaggaggacggtttcgatggtgccaccgccgctgctagaaaagaagtgattcgcaacaaaattcgcgctatcggcaaaatggccagagtctttagcgtgctaagagaagagtctgagagtgtcctcaccctaaagggactcactcccacaggcatgctgccttctggggtcctcagtggaggtaagcagaccctacagtcagctaccgtggaggcaattgaagctgacgaggctattaaggggttctctccacagcacaagattacaagcttcgaggaggcgaagggcctggaccgcatcaacgagcgcatgccgccacgcagggacgctatgcctagcgacgccaaccttaactctattaacaaggccctcaccagcgaaactaatgggacagattccaacggatctaattcgtcaaacatacagtag

SEQ ID NO: 30342 - DNA, 1272 bp, Artificial Sequence
  Description of Artificial Sequence: Synthetic coding sequence
atgaagctgttcgaggttgggggtagccctgctaatacaaggtacctgttcctcggggattatgtggacagaggctatttttccatcgagtgcgttttgtatttatgggccctaaagatcctctaccctaagaccctgtttctgttgagaggaaatcatgaatgccgtcatttaactgagtatttcactttcaaacaggagtgcaaaattaaatacagtgaacgggtgtacgacgcctgcatggacgcatttgattgcctgcccctggctgctctcatgaatcagcagttcctttgcgtgcatggcggattgagccccgagattaacacattagatgatatccgcaaactcgatcggtttaaagagccccctgcctatggacccatgtgcgatattctgtggtccgacccactcgaagacttcggcaacgagaaaacccaagaacactttacccacaacacagttcgtgggtgctcctacttctactcttaccccgcagtgtgcgaatttctccaacacaacaatttgttgtctatactgcgggcacacgaggcccaagacgccggttaccgaatgtataggaagagccagaccactggatttccctctctcataaccatcttcagcgctcctaactaccttgacgtgtacaacaacaaggcagctgtgctgaaatatgagaacaatgtcatgaatatacgtcagtttaactgcagtccccacccgtattggctgccgaactttatggatgtcttcacctggtctctccccttcgtgggcgagaaggtgacagagatgttagtaaatgtcctaaacatttgtagcgacgatgaactggggtccgaagaagatgggtttgatggggctacagctgccgcaagaaaagaagtgattcgcaacaaaattcgggcaattggcaagatggctcgcgtgttcagtgtgttgcgcgaagagtcggaatcggttctcacccttaaaggacttaccccgaccggaatgctacctagcggcgttctgtccgggggaaagcagactttgcagtcagccacagtggaggccattgaggcagatgaggccatcaagggattttcaccccagcataagattacctcgttcgaggaagcaaagggcctggacagaatcaacgagaggatgcccccacgtagagacgccatgccatccgatgctaatttgaattcaatcaacaaggccttgacatctgaaacgaacggtaccgactctaatggaagcaacagctccaacatccaatag

SEQ ID NO: 30343 - DNA, 870 bp, Artificial Sequence
  Description of Artificial Sequence: Synthetic coding sequence
atgagcgagccaaaagcaatcgatccaaagctgtccaccaccgatagagtcgtcaaggctgtaccatttcctccatcacacaggctgacggcaaaggaggtgtttgacaacgatggtaagcccagggtggacatcctcaaggcccatctaatgaaagaaggaagattggaagagtccgttgcccttagaattattacagagggggcttcgatcttgagacaagagaagaacctgcttgatattgatgcaccagtcactgcggcagtgctgaaatacgagaacaatgtgatgaatattaggcaattcaactgctccccgcatccgtattggctgcccaacttcatggatgtcttcacctggagcctgcctttcgtaggcgagaaggttacagaaatgcttgtgaatgtgctgaatatctgtagcgatgatgagctggggtccgaggaagacgggtttgacggggcaactgctgcggctaggaaggaagtgataagaaataaaatccgcgctataggaaagatggcacgcgtattttcagtgctgcgcgaagaaagtgaatccgtgctgaccctgaaaggactcacgcccaccgggatgctgcccagcggagtgctgagtggaggtaaacaaacgctacagtccgctacagtggaagctatcgaggccgacgaagccattaagggattcagcccccagcacaaaatcactagcttcgaagaggccaagggcctagatcgcatcaacgagaggatgcccccaaggcgggatgccatgccttccgacgccaatctgaattcgattaacaaagccctgacctctgaaaccaacggtacagactcaaatgggtctaatagctccaatatacaatag

SEQ ID NO: 30344 - DNA, 1365 bp, Artificial Sequence
  Description of Artificial Sequence: Synthetic coding sequence
atgtcggagccaaaagccattgatccaaagctttccacaaccgatagggtagtcaaggtatgtggagacattcatggtcagttctttgacctgatgaagctgttcgaggtgggcggttctcccgcaaacacacggtacctgtttttgggcgactacgtcgatcggggatattttagtatagaatgcgtcctctacctgtgggctttgaaaatcctctatcctaaaaccctcttcctgctacgcggaaaccatgagtgtcggcacctgacagaatacttcacgtttaaacaagaatgcaagatcaagtatagcgaacgggtgtacgatgcttgcatggacgcttttgactgtctgcccttggcggctctgatgaatcagcaattcctctgcgtgcatgggggtctttcaccagagataaacacattggatgatattcggaagctcgacagattcaaggagcctccagcctacggcccaatgtgcgatatcttatggtccgatcccctggaggattttggtaacgagaaaacacaggagcatttcactcacaacactgtacggggttgttcttacttctacagctacccggcagtctgtgagtttttacagcacaataacctgctcagcattttgagggcccatgaggcccaggacgcaggttatcggatgtacaggaaatcccagaccaccgggttcccttctctcattacgattttttctgctcctaattatttagacgtgtacaacaacaaagctgctgtgctcaagtacgagaataatgtgatgaacatcaggcagtttaattgtagcccccacccctattggttacccaatttcatggacgttttcacctggagcctcccttttgtgggagagaaggttacagaaatgctggtgaatgtcttaaatatctgcagtgatgatgagctgggttccgaggaggatggatttgacggtgccacagctgccgcacggaaagaggttattcgaaacaaaatacgggctattgggaaaatggcccgagtattcagcgtactccgtgaggaatctgaaagtgtattgacgctcaaaggcctgactcccaccggaatgttgcccagcggcgttctgagcggcggaaaacagacactgcagagcgccactgttgaggcaatcgaggctgatgaggcaattaagggtttttcaccgcaacataagatcacgagctttgaagaagccaagggccttgataggataaacgagaggatgccccctcgccgtgatgccatgccgtctgacgccaacttgaatagtattaataaggccctgaccagcgagacaaacggcaccgactcaaacgggtccaacagctccaatatccagtag

SEQ ID NO: 30345 - DNA, 399 bp, Artificial Sequence
  Description of Artificial Sequence: Synthetic coding sequence
atgaaggagggacggctggaggaatctgtcgcattgagaattatcaccgaaggggcatcgattctcaggcaggaaaagaatctcttggacattgatgcacccgttaccgtctgcggcgacatccacggccagttcttcgatctcatgaagctgtttgaggtcggcggttcccccgcaaacacccgctatctgtttttaggagattatgtcgaccggggatattttagcattgaatgcgtgttgtacttgtgggccctgaagatactatacccaaagaccctgtttttgttgcggggaaatcacgaatgcagacacctaactgaatactttaccttcaaacaggagtgtaagataaaatactctgagcgggtgtatgatgcctgcatggacgccttctag

SEQ ID NO: 30346 - DNA, 444 bp, Artificial Sequence
  Description of Artificial Sequence: Synthetic coding sequence
atgaaagaggggcgtctggaggagagcgtggccctgaggatcatcaccgagggggcttcaattcttagacaggagaagaatcttctggacattgacgctcctgtgaccgtgtgcggggatatccacggtcaattctttgatctaatgaagctctttgaagtggggggtagccccgcaaatacgagatacctgtttctcggggattatgtggacaggggctacttctcaattgagtgtgtgctatacctgtgggccctgaagatcctctatcctaaaacgttattcctcctccggggaaatcacgagtgccgtcatttaacagagtacttcacattcaagcaggagtgcaagattaagtattctgagagagtctatgacgcctgtatggatgctttcgactgcctgccactagccgcactgatgaatcagcaatttctgtgctag

SEQ ID NO: 30347 - DNA, 1491 bp, Artificial Sequence
  Description of Artificial Sequence: Synthetic coding sequence
atggcagcacccgagcccgcaagggctgctccccctccccctcctccaccgcctccccctccaggagccgatagagtcgtgaaggccgtgccatttccccctacacacaggctaacatctgaggaggtgtttgacctagatgggatacccagggttgatgtcctcaaaaaccacctggtaaaagagggcagagttgatgaagagattgccctgcgaatcatcaatgagggggctgcaattctaaggagggagaaaacgatgattgaagttgaggccccaataaccgtctgcggtgatatccatggccagttcttcgacctaatgaagctcttcgaggtgggcggaagccctgccaatacgcgctacctctttcttggtgattatgttgacagaggctacttctcaattgagtgcgtcctttatttatgggtgctaaaaattctctatccctccacattgtttctgcttaggggcaatcacgagtgtcggcatctgacggaatacttcactttcaaacaggaatgtaaaatcaaatacagcgaacgagtctacgaggcctgcatggaggcttttgattccctccccctggctgctcttttaaaccaacagtttctctgcgtgcacggcggattgtcgcctgaaatccatactctcgatgatataaggcgtctcgacagattcaaagagcctccggctttcggacctatgtgtgatttgctgtggtctgacccaagtgaggacttcggtaacgagaagagccaggagcatttttctcacaatactgtcagggggtgttcctatttttataattatcccgcagtatgtgagttcctgcagaataacaacctgcttagcatcataagggcacacgaggctcaggacgcgggttaccgtatgtatcgtaaatcccagaccaccggctttcctagccttattactatattctcagcccctaattaccttgacgtttataataacaaggctgctgtgctgaaatacgaaaataacgttatgaatatccgacaatttaattgctccccccacccgtattggctcccgaactttatggacgtcttcacctggtctctgcccttcgttggggagaaagtgacagaaatgctggtgaacgtgcttagcatctgttctgacgatgagctaatgactgaaggagaggaccagtttgacggaagcgctgcagccaggaaggaaataatccggaataaaatccgagctattggaaagatggccagagttttttctgtgctgcgagaggagagcgagagcgtgctgacactgaaggggctcacacccacaggaatgcttcctagcggcgtgctcgccggtggccgacagaccctccagagcgggaatgatgtgatgcagctggcagttccgcagatggattggggtactccccattcctttgccaataattctcacaacgcttgcagagaattcctcctgtttttctcatcctgcttatcgtcatag

SEQ ID NO: 30348 - DNA, 1575 bp, Artificial Sequence
  Description of Artificial Sequence: Synthetic coding sequence
atggctgctccagagccagcacgcgctgctccaccacccccaccgccaccgccaccccctcctggtgccgatcgcgtggtgaaagctgtgccttttcccccaactcatcggctaaccagcgaggaggtattcgacttggacggtatacccagggtagacgtactgaagaaccacctggttaaagagggcagagtggacgaagagatcgcactgagaattatcaatgaaggggctgcaattctacggagagaaaaaactatgatcgaggtggaggctcctatcaccgtatgtggtgacatccatggacagttcttcgacctgatgaaactgttcgaggtgggcggatctcccgctaatactagatacctgttcctgggggactacgtggatcgtggctattttagtatcgagtgtgtgctgtatctgtgggtgctgaaaatcctgtatccatcaacgttattcctcctccgcggtaatcacgagtgcagacacctgacggaatatttcacattcaaacaggagtgcaaaatcaagtattctgagagagtgtatgaggcctgcatggaggcattcgacagcctgcctctggctgctctgttaaatcaacagtttctatgtgtccacggcggactctctccggaaatccacaccctcgatgatatcaggcgactggatcgttttaaggagccgcctgccttcgggcctatgtgcgacttactctggtctgacccctcagaagatttcggtaatgagaaaagccaggaacatttttctcataacacagtgcggggatgctcttatttttataactatcccgcagtgtgcgagtttttgcaaaataacaatctcctgtccatcatccgcgctcacgaagctcaggatgccggttacagaatgtacagaaaaagccaaactaccggcttcccttccctgatcactatatttagtgcccctaattatcttgatgtgtacaacaacaaagctgccgtgcttaagtatgagaacaacgttatgaacataagacaatttaattgtagtccgcacccctactggctgcccaactttatggacgtgttcacttggtcactgcctttcgtaggtgagaaggtgactgagatgctcgttaacgttctgtccatttgctcagatgacgagcttatgactgagggcgaagaccagttcgacggttccgccgcagcgaggaaagagataattcggaacaagatccgagccatcggaaagatggcaagagtgttcagtgtgttgcgggaggagtccgagagcgtgctaacactcaagggactgaccccaacaggaatgttgccatccggggttttggcgggaggccgacagactttacagagcgcgacggtcgaggccatcgaggccgagaaagctatccggggtttttcgccgcctcaccgcatttgtagtttcgaggaagccaagggattagaccgtataaatgagcgaatgccccctaggaaggacgctgtgcaacaggacggatttaacagtctgaataccgctcacgccacagagaatcacggcacaggaaatcacaccgcccagtag

SEQ ID NO: 30349 - DNA, 1545 bp, Artificial Sequence
  Description of Artificial Sequence: Synthetic coding sequence
atggccgcacccgagcctgcacgtgccgcaccacccccaccccctcctcctcctcctcccccaggggcagatagggtggtgaaggcggtacccttcccccctacccacagactcaccagcgaagaggtttttgatttagacggcatcccccgtgtcgacgtgctcaaaaaccacttagtaaaagaagggagagttgatgaagagattgccctgagaattattaatgagggggcagctatccttcgcagggaaaagactatgatcgaagtggaggcccctatcactgtatgtggggacatccatgggcaattcttcgatctcatgaaactgttcgaggtggggggatcaccggctaatacccgttacctttttttaggagactacgttgacagaggatacttttcaatcgagcatgtgttggggacagaagatatctctatcaacccacataataacatcaacgagtgtgtgctctacctctgggtgctgaaaatcctttatcccagcaccttgttcctcctgcggggaaaccacgagtgccgtcacctgacagaatattttacctttaagcaagagtgtaaaattaagtacagcgaacgcgtgtatgaagcatgcatggaagcattcgactcacttccgttggcggctctgctgaatcaacagtttctgtgcgtgcacgggggactgagccctgagatacacactcttgacgatattagacgactcgaccgcttcaaggagccacccgcattcggtccaatgtgcgatctgctgtggtctgacccatctgaggactttggaaacgaaaaatcccaagagcatttcagtcacaacactgtccggggatgcagttatttctacaattaccctgctgtgtgtgagtttttgcaaaataacaacctgctctctatcatccgggcacatgaggcacaggacgccggatacaggatgtatcgtaagtcacagaccaccggatttccttcactcatcaccattttcagcgcccctaactacctggatgtgtataacaacaaagcagctgtgcttaaatatgagaacaacgtgatgaacattagacaattcaactgttctccacacccctactggctgccaaacttcatggacgtgtttacttggagcctgccatttgtcggagaaaaggtcaccgaaatgcttgtgaatgtccttagtatctgttctgatgacgaattaatgacagaaggtgaagaccagtttgatgggtctgcagccgcacgaaaagagattatcaggaataagatccgagctatcggtaagatggccagagtcttctctgtgttaagagaagaatctgagtcagttctcacgttgaagggactgactccaacaggcatgctgccaagcggagtgctcgcgggagggagacagacacttcagagcggcaacgacgttatgcagctcgccgttccacagatggactgggggactccccacagctttgccaataacagtcataatgcctgtcgtgaatttttgctctttttctcgtcttgcctgagttcatag

SEQ ID NO: 30350 - DNA, 591 bp, Artificial Sequence
  Description of Artificial Sequence: Synthetic coding sequence
atgaatatccgccaatttaattgtagcccacacccgtactggctccccaacttcatggacgtgttcacatggagccttccttttgttggcgagaaagtgaccgagatgctggtgaacgtgctgtccatttgtagcgatgacgagttgatgacggagggggaggaccagtttgatgagcgcctaatctacgggaacaaaaaaggctcagctgcagcccgaaaggagatcatacgcaacaaaattcgggctataggcaagatggctcgagttttctctgtgttgagagaagaaagcgagtccgtgttgactctcaaggggctcacccctacaggcatgctgcccagtggagtcttagctggcggacggcagacccttcagtctgccaccgtcgaggccattgaggctgagaaggcaatccggggattttcgccgcctcaccgaatttgctccttcgaggaggcaaaagggctcgatagaatcaatgagcgcatgcctcctagaaaagacgccgtccagcaggacggttttaattctttgaacacagcccatgctacagagaaccacggtaccggaaaccacaccgcccagtag

SEQ ID NO: 30351 - DNA, 1548 bp, Artificial Sequence
  Description of Artificial Sequence: Synthetic coding sequence
atggccgcaccggaaccagctcgggctgctccccctccacctccacctcctcctccaccgcctggcgctgaccgcgtggttaaagcggtgcctttcccccctacacatcgcctgacctcagaggaggtgtttgacctggatggcattcccagggtcgatgttttaaagaaccacctggtaaaagaggggagagtagatgaggaaattgccttacgaattattaatgagggcgctgcaatacttcggagagagaagaccatgattgaggtggaagctcctattacggtgtgcggcgacattcacggacaatttttcgacctgatgaaattgttcgaggtgggcggaagtccggctaatacgcggtacctgttcctgggtgattatgtggacagagggtactttagcatagagtgcgtgctctatctgtgggttctcaagatcctatacccaagcacactgttcctcctgagaggcaatcacgagtgtcgacatttaactgaatattttaccttcaaacaggagtgtaaaattaaatacagtgagcgggtctacgaagcatgtatggaagccttcgatagcctgccactggctgcactgttaaaccagcaatttttgtgcgtgcacgggggactgagtccggagatccacactctggacgatattcgaagactggatcggttcaaggaaccgcctgcattcggcccaatgtgtgatttgctgtggagcgatcccagtgaagactttgggaacgaaaaaagccaggaacatttttctcataacacggtgcggggttgtagctatttctataattacccagcggtttgtgagttcctccaaaataataatctgttatccatcattcgagcacatgaggctcaggatgctggttatcggatgtacaggaaaagtcagaccacgggattccctagtctgatcaccatcttctcagctcccaactaccttgatgtgtataacaataaggctgcagtcctgaaatacgaaaacaatgtgatgaacatcaggcaatttaactgttcccctcatccttactggctgcctaatttcatggacgttttcacgtggtccttaccattcgtaggcgagaaagttaccgaaatgctcgtcaatgtattgtctatttgctccgatgatgaactcatgacagaaggagaagaccagtttgacgttggaagtgcagccgcaaggaaagagattattcgaaataaaatccgggcaatcggaaaaatggcccgagtcttcagtgtcctgcgcgaagagagtgaatcagttctgacacttaagggcttgactccaaccggaatgttgccctctggagttctcgctgggggaagacagaccctgcagtccgccatccgaggtttttcaccccctcaccgaatctgcagtttcgaggaggccaaaggcctggataggattaatgaaagaatgccaccaagaaaagacgcagtgcaacaagacggatttaactccctgaatactgcgcatgctacagagaaccacggcactggtaatcacactgcacagtag

SEQ ID NO: 30352 - DNA, 1578 bp, Artificial Sequence
  Description of Artificial Sequence: Synthetic coding sequence
atggccgctcctgaaccagcgagagcagcacctccccctccgcctcctccgcctccaccacccggtgcagaccgtgtcgtgaaggctgttcctttccctcctacacaccgcctgacaagcgaagaggtgttcgatctcgacgggattccgagagtggatgtgctgaaaaatcatctggtcaaagagggaagagtcgacgaggagattgccttgaggataataaacgagggggctgccatcttgcgccgtgaaaagaccatgattgaagtcgaagcgcctatcacggtttgtggcgatattcacgggcagttcttcgatctcatgaagctctttgaggtcggcggatcccccgctaacacccgctatctgtttttaggggactacgtggatcggggttacttttccatcgagtgtgtgctctacctgtgggttctcaagatcctctaccccagtacgctattcctactgaggggaaatcacgagtgtaggcacttaactgaatatttcacattcaaacaggaatgtaaaataaagtatagcgagcgtgtctatgaagcctgcatggaggcctttgacagtctccctctggcagccctgcttaatcagcagtttctctgcgttcatggcggtctatcccccgagatacatactctcgacgatattcgcaggctcgacagattcaaggagccccctgctttcggacccatgtgtgacttgctgtggtccgacccaagcgaagattttggcaatgagaagtctcaggagcacttttcccacaatactgtgcggggttgtagctacttttacaattacccagccgtttgcgaattccttcagaacaacaatctcttgtccatcattagagcccacgaagctcaagatgctggatatagaatgtaccgcaagtcacagactacagggtttccctcacttattaccatcttcagtgcccctaattatttagacgtatataacaataaagctgctgtgctgaaatatgagaataacgtcatgaacatacgccagttcaactgctcgcctcacccctattggttgccaaattttatggacgtctttacctggtccctgcctttcgtcggggaaaaggtcacagagatgctggtgaatgtgcttagtatctgttctgacgacgaactgatgaccgagggagaggaccaatttgacgtgggatcagccgcagctcggaaagagattatcaggaataagattagagccatcggaaagatggcaagagtcttttcagttctcagagaggaaagcgagtccgttctgaccctgaagggacttaccccaacgggtatgctaccatctggtgtgttggctgggggaagacagaccctccagtctgctacggtggaggccatagaagctgagaaagccatacggggattctctccacctcacagaatctgttctttcgaggaggccaagggtctggatcgcattaacgagaggatgcctccgagaaaagacgctgtccagcaggatggttttaacagcctaaacaccgcacatgccacggagaatcatggcacagggaaccacacagctcagtag

SEQ ID NO: 30353 - DNA, 561 bp, Artificial Sequence
  Description of Artificial Sequence: Synthetic coding sequence
catccttactggcttccaaattttatggatgtcttcacttggtctctcccttttgttggcgagaaagttactgagatgctagtcaacgtactctcgatttgttccgatgatgaactgatgaccgagggcgaagatcagttcgacgagcgcctgatctacgggaataaaaaggggagcgccgcagcgaggaaggaaatcataaggaataagatccgcgcaatcggtaaaatggctcgcgtgttctcagtcctgagggaggagtcagaatccgtgctcacgttgaaggggctgacaccaacaggcatgctcccgtcaggggtgctcgctggagggagacagaccctgcagtctgcaaccgtggaggccatagaagccgagaaggccatccggggattttccccccctcaccgcatatgttcctttgaagaggcgaaaggtttggatcgcattaacgagcgcatgcccccaaggaaagatgcagttcagcaggatggctttaactccttgaacactgcacacgccaccgaaaaccatggtactggtaatcatactgcccagtag

SEQ ID NO: 30354 - DNA, 459 bp, Artificial Sequence
  Description of Artificial Sequence: Synthetic coding sequence
atgctagtgaacgttctcagcatctgcagtgacgacgagctgatgactgaaggcgaagatcagttcgacggaagcgctgccgcacggaaagaaattattcggaataagattcgagcaatcggcaagatggctagagtgttctctgtgctgagggaggaaagtgagagtgtgctcactctcaagggattgacaccgacagggatgttgccttcaggcgttctcgccggtgggcgacaaacgcttcagtctgccactgtagaggctatcgaagcagagaaggcaatcagggggtttagcccaccccaccgtatatgctctttcgaagaggcaaagggactggaccgcatcaacgaacgcatgccccctaggaaggacgctgtccagcaggacggctttaactcgctcaatactgcacatgccaccgaaaatcacggaacagggaaccacactgctcagtag

SEQ ID NO: 30355 - DNA, 1236 bp, Artificial Sequence
  Description of Artificial Sequence: Synthetic coding sequence
atgatagaagtcgaagcgcctattacagtgtgtggtgacatacacggccagtttttcgacctgatgaagctgttcgaggtaggcggttcacccgctaataccaggtacttattcttgggggactacgtagaccggggatatttctccatcgagtgcgtgctctatctctgggtgctaaagattctctacccttccaccctgttcctgctccgtggaaaccatgagtgtcgccaccttacagagtatttcacttttaaacaagaatgcaaaattaaatatagcgaaagagtctacgaagcctgtatggaagcctttgacagtctccctctcgccgctctgctcaaccagcagtttttgtgcgtgcacggcggactcagtccagagattcatacattagatgacatccggaggctggatagatttaaagagcctcccgcattcggccctatgtgtgaccttctctggtcagaccccagtgaagattttggcaatgaaaaaagccaggagcatttttcccacaatacagtacgcggatgctcctatttttataattacccggctgtgtgtgagttcctccaaaacaataatttgctctcgattatccgggctcatgaggcccaggatgctggctaccggatgtaccggaagtcccaaaccacaggttttccaagcctgatcactatattttccgccccaaactatctggatgtctacaataataaggccgcagtgttaaagtatgaaaacaacgttatgaacattcgacagttcaactgctccccacatccctactggctgccaaatttcatggatgttttcacctggtctctgccctttgtcggggagaaagtgaccgaaatgctggtcaatgtgctttccatttgtagcgatgacgagctgatgacggagggtgaagaccagttcgatgttggctccgccgctgctagaaaggagatcatcaggaacaagattcgtgcaattggtaaaatggctagagtcttctccgtcctgcgggaggaaagcgagagcgttctcactctgaaaggtctcacacctaccgggatgctgcccagtggcgtgctcgccggaggacgccagaccctgcagtccgggaacgacgtgatgcagctggctgtcccccagatggattggggaacaccgcactcttttgcgaataattcccacaatgcttgccgagagttcttactttttttctcatcctgtctgagctcctag

SEQ ID NO: 30356 - DNA, 1539 bp, Artificial Sequence
  Description of Artificial Sequence: Synthetic coding sequence
atgtccgggcgtcgtttccacctgagcaccactgaccgggtgattaaagcagtgccgtttcctccaacacagagactgaccttcaaagaggtcttcgagaatgggaagcccaaagtagatgtcctgaaaaaccatctcgttaaggagggcaggctcgaggaagaggtcgccctgaagattatcaatgatggagcagcaatactgcgccaagagaagacaatgatcgaagttgatgcccctattactgtctgtggagatattcatggacagttcttcgacctaatgaagctttttgaggtcggtggttcccccagcaatacccgctacttatttcttggcgattacgtggacaggggttatttctcaattgaatgtgtgctgtacttatggtctctgaaaattaatcacccaaaaaccctgttcctgcttcgagggaaccacgaatgccgccacttgaccgattacttcacctttaaacaggagtgccgcattaagtactcagagcaggtgtacgacgcatgcatggagaccttcgattgtctacccctcgctgcactgctcaaccagcaatttctgtgcgttcacggtggaatgagcccagaaatcacatccctggacgacatcagaaagctggatcggtttactgaaccaccagccttcggccctgtgtgtgacctactgtggtccgacccgtctgaggattacgggaatgagaagacattggagcactacacacacaacaccgtacgcggatgttcttatttctactcttatcctgcggtttgcgaatttctgcagaataataacttgctgagcatcattcgtgcccacgaggcacaggatgccggatataggatgtatagaaagtcacaggccaccgggttccctagcctaatcacaattttcagcgcacctaattatctggacgtgtataataataaagcagcagtactcaaatacgagaataacgtcatgaacatacgccagttcaactgcagccctcacccttactggttacccaatttcatggatgttttcacttggagtctgccattcgtgggtgagaaagtcacggagatgctcgtgaacgtcttgaacatatgttcggatgatgagctgataagtgacgacgaggcggaagggagcactaccgttcgaaaagaaattatccggaataagatccgcgcaattggtaagatggcacgcgtgttcagcatcttgcggcaggagagtgagtcggtgttaacactcaaaggactcacgcctactggaaccctgcccctgggcgtcctgtcaggtggaaagcagaccatcgaaactgctaccgttgaagccgtcgaggctagagaagctataaggggattctctttacagcataaaatcaggtccttcgaggaagcgaggggtcttgatagaattaacgaacggatgccgccacggaaagatagcatccatgccggaggacccatgaagagcgtgacaagcgcgcactcccacgctgcccaccgatccgatcaggggaagaaagctcatagttag

SEQ ID NO: 30357 - DNA, 1509 bp, Artificial Sequence
  Description of Artificial Sequence: Synthetic coding sequence
atgagcgggagacgatttcatctgtccaccacagaccgggtgataaaagctgtgcctttccctcccacccagcggctaaccttcaaagaggtgtttgagaacgggaagcccaaggtcgatgtgttgaagaaccatctcgtaaaggagggtaggctcgaagaggaggtggccctgaagatcattaacgacggtgccgctattctgcgacaggaaaaaactatgattgaagtcgatgcccctattactgtatgcggtgacatccacggtcagttcttcgacttgatgaagctgtttgaggtcggaggatctccttctaacactcggtatctgttcttgggtgattatgttgatcgtggctactttagtattgagtgtgtcctatatctttggagtctcaagattaaccaccccaaaactctgttcttgttgcgcggtaaccacgagtgtcggcatcttacggactactttacttttaagcaggagtgcagaattaaatactccgagcaagtatatgatgcctgtatggagaccttcgactgtttgccactagccgcactactgaatcagcaattcctgtgtgtgcacggcggtatgtcccccgaaatcacttctctggatgacattaggaagctggataggtttaccgagccaccggctttcggccctgtgtgcgacttgttgtggtccgacccttccgaagattatggaaacgagaaaacgctggaacactacacgcacaatacagtgcgcggatgctcctacttttatagctaccccgctgtttgcgaattcctgcagaacaataacctgttgagtatcattcgcgctcatgaggcccaggacgctgggtaccggatgtatcgcaagagccaggcaacaggattccctagcttgatcacgatcttttcggctccaaattacctggatgtatataataataaggcagccgtccttaagtacgaaaataacgtgatgaacatccgtcagtttaattgcagcccacatccatactggctgcccaactttatggacgtgttcacttggagtcttccatttgtcggcgaaaaggtgactgaaatgttggtgaatgtcctgaatatctgttccgatgacgaattgatcagcgacgatgaggccgaggggtcaaccactgtgaggaaggagattatccggaataaaatccgtgctataggtaaaatggcacgcgttttctccatcctccgacaagagtccgagagtgtgctgaccttgaaaggcctaacccccaccggtaccctgccactaggagttctcagtggcggaaaacaaaccatcgaaacagccattcgcggtttcagcctgcagcataagatccgctcctttgaagaagcacgaggcctggatcggattaatgagcgaatgcctccgaggaaagacagcatccacgcaggcggacccatgaaaagcgtaaccagtgctcactcacacgctgcccaccgatctgatcagggaaagaaagcccatagctag

SEQ ID NO: 30358 - DNA, 345 bp, Artificial Sequence
  Description of Artificial Sequence: Synthetic coding sequence
atgtactataagttttcaggtttcacccaaaaacttgcgggtgcctgggcgtcagaagcctactccccgcagggcctgaaacctgttgtgtctaccgaggctcccccaatcatattcgcaaccccaacgaaattaacgtccgatagtacagtgtatgattacgctggcaagaataaagttcccgagcttcagaaattctttcaaaaggcagacggcgtcccagtatatctgaagaggggtctgccggaccaaatgctgtaccgaaccactatggctctcactgtgggcggtaccatttattgccttattgccctgtacatggcatcccagcccaagaataaatag

SEQ ID NO: 30359 - DNA, 522 bp, Artificial Sequence
  Description of Artificial Sequence: Synthetic coding sequence
atgtctacgatgggcaatgaggcttcttaccccgcagagatgtgctctcatttcgataatgatgagattaagcgattgggacggcgttttaaaaaacttgacctggacaagtccgggagcctctcggtggaggaatttatgtcgctaccagaactccggcacaatcctctagtgaggcgtgtcatcgacgtttttgacacggatggtgatggtgaagtggactttaaggaatttattctgggaactagccagttttctgtaaagggagatgaagagcagaaactgcgatttgctttttccatctatgacatggataaggacggttacataagtaacggcgagctctttcaggtgctgaagatgatggtcgggaacaacctaactgactggcagctgcagcagttggtagacaaaacgattataattctcgacaaagatggcgatggcaaaatctcctttgaggaatttagcgcggtggttcgcgacctggaaatccacaaaaaactggtcctgatcgtgtag

SEQ ID NO: 30360 - DNA, 420 bp, Artificial Sequence
  Description of Artificial Sequence: Synthetic coding sequence
atgtcaaccatggggaacgaggccagctatcctgccgagatgtgcagccactttgataatgatgagatcaaacggttgggtaggcgcttcaagaaactggatctggataagagcggatctctgtcagtcgaagagttcatgtctcttcccgagctccgtcacaatcctctggtgaggcgtgtgatcgatgtcttcgatactgacggcgatggggaagtcgactttaaggaattcatccttgggacatctcaattcagcgtcaaaggtgacgaggagcagaagttaagatttgcgttttctatctacgacatggacaaagacggctatatatccaatggggagttgttccaagtcctgaagatgatggtgggaaataatctcaccgattggcagctgcaacagttggtgcttatagtgtag

SEQ ID NO: 30361 - DNA, 1818 bp, Artificial Sequence
  Description of Artificial Sequence: Synthetic coding sequence
atggcgggactttactcactcggcgtcagtgtattttccgatcagggtggtagaaagtacatggaggatgttactcagattgttgtagaacctgaacccaccgctgaggaaaagcctagtccaaggagatcgctctctcagccccttccaccacggcctagtcccgcagccctcccgggtggggaggttagcggtaaagggccagcagtagccgcaagggaagcgagggaccccctgcccgacgccggagcatctcctgcccctagccgatgttgcaggaggagaagctcagtggcctttttcgctgtttgtgacggacacggcggacgagaggctgctcagtttgcgagggaacatttatggggctttatcaaaaagcagaagggcttcacgtcatccgagccagccaaggtttgcgccgcaatccgaaagggatttctggcctgccatcttgctatgtggaagaaactcgctgaatggccaaaaacaatgacgggcctacccagtaccagcgggacaaccgcctccgtcgtcattatccggggaatgaagatgtacgtcgcccacgtaggcgattcaggcgtggttttggggatccaggacgaccccaaggacgattttgtccgtgcagtggaggtgacacaagaccacaaacctgagctccccaaggagcgcgaaagaatagaaggactgggcggttcagtcatgaataagtcaggggtgaatcgcgtcgtttggaagagacctaggctgacacataacgggcctgtcagaaggtccactgtcattgatcagattcctttcctcgccgtcgcccgtgccctgggcgatttgtggagctacgactttttctctggcgagtttgttgtaagtcctgaacccgatacttctgtgcacacgctggacccccagaagcataagtatatcatactcggcagcgacggcctctggaatatgataccaccccaggatgccatttctatgtgccaggaccaggaggagaagaaatacttgatgggtgaacacgggcagtcctgcgctaagatgctagtcaatagggccctggggagatggcgacagcggatgcttcgcgcagacaacacaagcgcgattgtcatttgtatttccccagaggtggataaccagggcaacttcacaaatgaagacgagctgtatttgaacctgaccgattccccttcgtataatagccaggagacatgcgtaatgaccccatccccttgtagtactccaccagtgaagtctctagaggaggatccttggccaagggttaactccaaggaccatatccctgcattggtgaggtcaaatgcgttctctgagaacttcctcgaagttagtgctgagatagcaagagaaaacgtgcagggcgtagtcatcccttcaaaagaccctgagcccctagaggaaaactgtgccaaagctcttaccctgcgtatacacgatagcctaaacaatagcctgccaataggcctcgtgcccacgaatagcacaaatacagtgatggatcagaaaaacctgaaaatgtccacacctgggcagatgaaggcccaggaaatcgaacgtacacctcccaccaacttcaagaggacattggaggaatccaactctggacctctgatgaagaaacacagaagaaacggattaagtcgttctagcggagcacagcccgcaagcctcccaaccacctctcaacggaagaactccgtcaaactcacgatgcggagacgcttgaggggtcagaaaaaaatcggaaatcctttgctgcatcagcaccgcaaaaccgtgtgtgtgtgttag

SEQ ID NO: 30362 - DNA, 1293 bp, Artificial Sequence
  Description of Artificial Sequence: Synthetic coding sequence
atggcaggtctttactcgctaggcgtgagtgtcttcagcgaccagggaggtaggaagtacatggaggatgtgacgcaaatcgtggtggagcccgagccaaccgctgaggaaaagcctagccccaggcgttcactttcccagccgctgccacctcgcccatctccggcagccctgcctggtggagaggtgtccggaaagggtcccgcagtcgccgctagggaggccagggatcccctgcctgacgccggtgcatcacccgctcctagtcgttgctgtcggaggaggagcagcgtagcttttttcgcagtgtgcgatgggcacgggggacgggaggccgcacagttcgcgcgagagcacctgtgggggtttattaagaagcagaagggctttactagttctgagccagccaaggtctgcgcggcaatccggaagggcttcttggcttgtcatctggctatgtggaaaaagcttgccgaatggcccaagactatgactggtttgcccagcacaagtgggaccaccgccagcgtggttattatcagaggcatgaagatgtatgtggctcatgttggagattccggcgtggtgcttgggattcaagacgaccctaaggatgacttcgtccgggcagttgaggttacacaagatcataagcccgagctaccgaaagagcgcgagaggatcgaagggctgggaggcagcgtgatgaataaatccggggttaaccgggtggtttggaaacgccctagactgacccataacgggcctgtccgtaggagcacagtgattgatcaaataccgtttctcgcagtcgctagagccttaggagacctctggtcttacgatttcttttccggggagtttgtggtctccccggagccagacacctcggtgcacacactcgatcctcagaagcacaagtacatcattctgggctctgacggcctctggaatatgataccgcctcaagacgctatatccatgtgtcaggaccaagaggagaaaaagtacctgatgggagagcatggacagtcgtgtgctaagatgttggtgaatagggccttgggcagatggcggcagagaatgttgagagcagataacacaagcgccatcgtgatctgtatttcgccagaggttgacaatcaggggaattttacgaacgaagatgaactatatttgaacctgacagatagcccgagctataacagtcaagagacctgcgtcatgacaccttccccatgttcgacaccccctgtgaaagactttggatttgagctggactctcgcaagtag

SEQ ID NO: 30363 - DNA, 837 bp, Artificial Sequence
  Description of Artificial Sequence: Synthetic coding sequence
atgtggaagaaactggccgaatggccgaagacaatgacaggactgcctagcaccagtggcacgaccgctagtgtcgttattattaggggaatgaaaatgtacgtcgcccatgtcggcgatagcggagttgtgctgggcatccaggacgaccccaaggacgattttgtgagagcagtagaagtgactcaggaccacaagcccgagctgcccaaggaacgcgaaagaatcgaaggcttaggtggaagcgttatgaataagagtggggttaaccgcgtcgtgtggaaacgccctagattgactcacaacggacccgttcgccgatccaccgtgatcgatcaaataccatttctggccgtcgcaagagctttgggggatctctggtcgtatgatttcttttcgggagagttcgtcgtaagtcctgaacctgatactagcgtccatacactggatcctcagaagcacaagtacattatcttaggaagcgacggtctctggaatatgattccaccccaagacgctatttctatgtgccaggatcaagaggaaaagaaatacctcatgggggaacatggccagagctgtgccaagatgctggtgaacagagccctagggagatggcgtcagcgcatgctgcgggctgataatacctccgccatcgttatatgtatatcccccgaagtcgacaaccagggcaactttacaaatgaggacgagctatatctaaatctgacagactcgcccagctacaattcccaagaaacctgcgtcatgaccccatctccatgcagcactcccccagtgaaggacttcgggtttgagctggattctcgcaagtag

SEQ ID NO: 30364 - DNA, 3432 bp, Artificial Sequence
  Description of Artificial Sequence: Synthetic coding sequence
atgtacctgtggctgaagcttctggcctttggcttcgctttcctggacacggaagtgtttgtaaccggacagagccctacacccagcccaactgacgcctatctcaacgccagcgaaaccacaacgctgtcgccatctgggtcggcggttatttccacaaccactattgctacaacaccctccaaacctacatgcgatgaaaaatacgcaaacattactgtggactacctgtacaacaaggagaccaagctctttacagcgaagttgaatgtcaacgagaacgtcgaatgcggcaataacacttgcaccaacaatgaggtccataacctgaccgaatgtaagaatgccagcgtgtccatttcccataatagctgcactgctcctgataaaaccttaattttggacgtgcctcccggagtagaaaagtttcaattgcatgattgcactcaagttgagaaagcggacaccactatatgtctgaaatggaagaacatcgagacttttacatgcgacacacagaacattacataccggttccagtgcggcaatatgatcttcgataataaggagatcaagctggaaaacctggagcccgagcatgagtataaatgtgacagcgaaatcctttacaacaatcataagttcactaatgctagtaaaataatcaaaaccgactttgggtcccctggggaaccccagatcatcttctgtaggtcagaagccgcacatcagggtgtcataacatggaatccccctcagcggtcatttcacaacttcaccttgtgttacatcaaggagactgaaaaggattgtctgaatttggataaaaatctgatcaaatacgacctgcagaatcttaagccctacaccaaatacgtgctgtctctgcatgcatatattattgctaaggtgcaacgaaatggctccgcagcaatgtgccacttcacaacgaagagtgccccacccagtcaggtgtggaacatgacagtgagtatgacaagtgataattccatgcacgtgaagtgtagaccccctagggaccgaaatggtcctcacgaacggtaccatcttgaggtggaggcgggtaatacactcgtgcggaatgagagtcataaaaactgtgacttcagggtcaaggacctacagtactcaactgattacacatttaaagcctatttccataacggagattaccccggtgagccattcatcctccaccacagcacctcatacaactccaaagccttgattgcctttctggcattcctgatcatcgtcacatccattgcactcctagtggttctgtacaaaatttacgacctgcataaaaagaggtcatgcaacctggacgagcaacaggagctggtggagcgtgatgacgagaagcagttgatgaatgtggagccaatccatgccgacatcttgcttgagacctataaacggaaaattgccgatgagggcaggcttttccttgccgagtttcagtcaatccccagagtcttcagcaagtttcccatcaaagaagcacgaaaacccttcaatcagaacaaaaacagatacgtggacatattgccctacgactataacagagtggaattgagtgagatcaacggggacgctgggtccaactacattaacgcctcatatatcgacgggttcaaggagccaaggaaatacatcgctgcccagggaccacgagacgagacagttgatgatttctggcggatgatctgggagcagaaagccactgtgatcgtgatggtgaccagatgtgaagagggtaatagaaataaatgcgctgagtattggccgtctatggaggagggtacaagagccttcggggatgtcgtagtgaaaatcaatcagcataagcggtgccctgactatatcatccagaagctaaacatagtgaacaagaaggaaaaagctactggcagggaggttactcacattcagttcacatcctggccagaccatggtgtgccagaggacccacaccttttgctgaaactgcggcgacgagtgaacgcattctccaattttttctcgggtccaatagttgtgcactgtagcgccggagtcggcaggacaggaacgtacatcggcatagatgcaatgttagagggtctggaagctgagaataaagtcgacgtatatggctatgtggttaagctgcgcagacagcgctgtttaatggtacaggtagaagcccagtatatccttattcaccaggccctcgtggagtataatcagtttggggagacagaggtgaacctctccgagctgcacccgtacctacacaacatgaaaaaacgagaccctccatcagagcccagcccactggaagccgaattccagaggcttccatcatatcgttcttggcggactcagcacatcggcaaccaggaggaaaacaaatccaaaaatcggaactcaaatgtcattccatatgactataaccgcgtccccttaaagcatgagctagaaatgtcgaaagagtccgagcatgatagcgatgagtctagtgacgatgatagcgatagcgaagaaccctccaagtacatcaatgcttccttcatcatgtcttactggaagccagaggtaatgatagcggctcaagggccactcaaggagaccatcggggacttttggcagatgatctttcagcgaaaagtgaaggtgatagttatgttgactgaactgaagcatggcgaccaggagatttgcgcccagtattggggcgaaggcaagcaaacttacggggatatcgaagtcgaccttaaggatacggacaaaagcagcacctataccctgcgcgttttcgagctgagacactctaagagaaaagactcccggacagtgtatcaatatcagtatacgaactggagcgtggaacaactgcctgcagagcctaaggagttaatttctatgatccaagtggtgaaacagaaactgcctcaaaaaaatagttcagaaggcaataaacatcataagtctactccactcttaattcattgcagggatgggtctcagcagactggtatcttctgcgccttgctgaatctgttggaatcagcagagaccgaagaagtggtggacatcttccaagtggtgaaagccctgagaaaggctcggcctggaatggtctccacatttgagcagtaccagttcctttatgatgtgatcgcaagcacctacccagcacagaacggtcaagtgaagaaaaataatcatcaggaggacaagattgaattcgacaatgaggttgataaagtgaagcaagacgcaaattgcgtgaatcctctaggcgctccagagaaactgccagaggccaaggaacaagcggaaggtagtgagcccacctctggtaccgaggggcctgaacatagcgtgaacggacccgcaagcccagccttgaatcagggtagctag

SEQ ID NO: 30365 - DNA, 105 bp, Artificial Sequence
  Description of Artificial Sequence: Synthetic coding sequence
atgtacctttggctaaaactcctggcgttcggcttcgctttcttggatacagaagtattcgtaactgggcaaagcccaaccccgagtcctaccggcaagaactag

SEQ ID NO: 30366 - DNA, 447 bp, Artificial Sequence
  Description of Artificial Sequence: Synthetic coding sequence
atggctaggatgaaccgccctgcccctgtggaggtaacgtataaaaacatgcggttcctgatcactcacaacccaaccaacgccacgctgaataaattcattgaggaacttaagaagtatggagtgactacaatcgttcgcgtttgcgaagcgacttacgacaccaccttggttgagaaggaaggcatacacgtgctcgactggcccttcgacgacggcgctcccccatctaaccagattgtcgatgattggttgagtctcgtgaagattaagtttcgggaagaacctgggtgttgcatcgccgttcattgtgttgctggacttggcaggaagcgcagaggcgcatttaacagcaaacagttgctctatcttgagaaatatcgcccaaagatgcgcctccgcttcaaggactccaacggtcaccgaaacaactgttgcatccagtag

SEQ ID NO: 30367 - DNA, 447 bp, Artificial Sequence
  Description of Artificial Sequence: Synthetic coding sequence
atggctaggatgaacaggccagcgccagtcgaggtcacatataaaaacatgcgattcctgatcactcacaacccaactaacgccaccttgaacaaattcatagaagagttaaagaagtatggtgtcaccaccatagtacgcgtgtgtgaagccacctatgacacaaccctcgtcgagaaggaagggatccacgtcttggactggccctttgacgatggcgcaccgccatcaaaccaaattgtagatgactggctgtcactcgtgaagatcaagtttcgggaagagccaggctgttgcatagccgtacactgcgtggctggactgggcaggaaaaggagaggcgctttcaactcaaagcagcttctgtacctagagaagtataggccaaagatgcgactccgctttaaggactctaacggtcacagaaacaactgctgtattcaatag

SEQ ID NO: 30368 - DNA, 522 bp, Artificial Sequence
  Description of Artificial Sequence: Synthetic coding sequence
atggctaggatgaaccgaccagccccagtggaggtaacctataagaacatgcgctttctgatcacccacaatcccacaaacgccactcttaacaagtttattgaagagttaaagaaatacggggtgaccacaatcgtgagggtgtgtgaggcaacctatgatactacactcgtggaaaaggagggcattcatgtcttggactggccgttcgatgatggcgctcctccatccaaccagatcgtggacgactggctatcactcgtgaaaatcaaatttcgcgaagagcctggatgttgcatagcggtacattgtgtggccggactggggagagcccctgtcctcgtcgcactggctttgattgagggagggatgaagtatgaagacgccgtgcagttcattcgccagaagcggcgaggcgcatttaactccaaacagttgttgtacctcgaaaagtacagacccaaaatgagactgcgatttaaggattctaacggccacaggaacaactgttgtatacagtag

SEQ ID NO: 30369 - DNA, 1308 bp, Artificial Sequence
  Description of Artificial Sequence: Synthetic coding sequence
atggagatggagaaggagttcgagcaaattgataaatcaggctcttgggccgcaatataccaggatatcaggcatgaggcttccgatttcccatgtcgagtggccaaactacctaagaacaaaaacaggaatcggtaccgtgacgtgtcaccctttgatcactctcgaattaaactgcaccaggaagataatgactacatcaatgcatctctcattaagatggaagaggcccagaggtcatacatcctaacacaaggcccattgcctaatacatgcgggcatttttgggagatggtttgggaacagaaaagcagaggtgttgtcatgctgaatcgggtgatggaaaagggttcactcaagtgtgcccagtattggccccagaaagaggagaaagagatgatcttcgaggatacaaacctgaagctcactctaatctcagaggatatcaagagctactatacagtccgacagctggagctcgaaaatctgactacacaggaaacccgcgagatcctccacttccactatacaacgtggcccgatttcggcgtgcccgaatcacccgcatctttcctcaactttctgttcaaagtgcgagagtctggtagcctgagcccagagcatgggccagtggtggtccactgctcagccggtatcggacgttccggaaccttttgtttggcagatacttgtttgctgctcatggataaaagaaaagaccccagctctgtcgacattaagaaggtgctgttggaaatgcgcaagttccgaatggggttgattcagaccgcagaccagctacgcttttcctatctggcagttatcgaaggagcaaagtttatcatgggggacagcagtgtgcaggatcaatggaaagagctgagtcatgaggatctcgagcctccacccgagcacatcccgccacccccaagacctccaaagcggatcttggagccccataatggaaaatgtagggaattctttccgaaccaccaatgggtgaaggaagaaacacaagaagacaaggactgtccaattaaggaggaaaaagggtcaccactgaatgcagccccttatggaattgagtcgatgagtcaagatacagaggtgagatctcgagtggtaggcggttctttgaggggagctcaggcggcttcacccgctaagggagaaccttccctacctgaaaaagatgaagatcatgccctgtcttactggaagccattcctcgtaaacatgtgtgtggcaactgttctaactgcaggggcatacctgtgttatagatttcttttcaactctaacacctag

SEQ ID NO: 30370 - DNA, 1089 bp, Artificial Sequence
  Description of Artificial Sequence: Synthetic coding sequence
atggaggaagctcaacgctcatacatcctaacccagggccctctgcctaatacctgcggacacttctgggaaatggtgtgggagcagaaatctcgaggggtcgtgatgctgaacagggttatggaaaagggcagtttgaaatgcgctcagtattggccccagaaagaggagaaggagatgatttttgaggacaccaatttgaaactcaccctcattagcgaagacatcaaaagctactatactgtccgtcagctagagcttgaaaatctcactactcaggaaactcgggagattttacatttccactacacgacttggccagatttcggtgtcccggaatcacctgcaagtttcttgaattttctctttaaggtaagagagtcaggatctctgtcccccgagcacgggccagtggtggttcactgttctgcaggcataggtagaagtggcacattttgcctcgctgatacgtgtcttctgcttatggacaaacgcaaggatccatcctccgtcgacatcaagaaggtcctgctagagatgaggaagttcaggatggggctgattcagacagccgaccaattaagattttcatatctggcagttatcgaaggcgctaaattcataatgggcgattctagcgtccaagaccagtggaaggagttatctcacgaggacctcgagcctcctcctgagcatataccgccacctccgagaccccctaaaagaatcctcgagccccacaatggcaaatgcagggagtttttccccaaccatcagtgggtcaaagaggaaacacaggaggataaggattgccctatcaaggaggagaaagggagccccctcaacgccgcaccctacgggatcgagtctatgtcccaggacacagaagtgcggagccgcgtggtgggcggaagccttagaggtgcccaggccgcatctccggctaaaggcgaaccaagcctgccagagaaagacgaagaccacgccctgagctattggaaaccgtttctggtgaacatgtgcgtcgccaccgttctgaccgccggagcttacttgtgctatagattcctatttaatagtaacacatag

SEQ ID NO: 30371 - DNA, 1782 bp, Artificial Sequence
  Description of Artificial Sequence: Synthetic coding sequence
atgacaagccgacgttggtttcaccctaacattaccggagtagaagcagagaacctcctcctaactcggggagtggacggctctttcttagccaggccttccaagagcaaccccggtgacttcacactgtccgtgagaaggaatggagccgtcacacacattaagatccagaatacaggagattactacgacctttatggcggagaaaagttcgcaacacttgcagagctggtgcaatattatatggaacatcacggacaactgaaagagaagaacggtgacgtaatcgagttaaagtaccctctcaattgtgcagatcccacatcagaacgatggtttcatgggcatttaagcggaaaggaggcggaaaagctcctgacagaaaaaggaaaacacggaagtttccttgtgcgggagtcacagtctcatcccggagacttcgtgttgtcagtgcgtactggcgacgataaaggagaaagtaatgacggcaaatctaaagtgacccatgttatgattcgttgtcaggagctgaaatacgacgtgggcggtggtgagcgtttcgatagtttgacagatcttgttgaacactataaaaagaatccgatggtggaaacactcggcacagtgcttcagctaaagcagccactgaatactaccagaatcaatgccgctgaaatcgaatctcgagtccgggagctgtccaaactggccgagaccaccgacaaggtgaagcagggcttctgggaagagtttgaaaccctacagcagcaggagtgcaaacttctatattctcgcaaggagggccagcgccaggagaacaaaaataagaatcggtataaaaacatattaccgtttgaccacaccagagtagttctgcatgatggagaccccaatgaacctgtttctgattatatcaatgccaacatcattatgcctgagtttgagaccaagtgtaacaacagtaaacccaaaaagtcatacattgccacgcaaggctgtttacagaacaccgtcaatgatttctggaggatggtgttccaggagaactctcgtgtgattgtcatgactactaaagaggtggagcgcggtaaatctaagtgtgtgaaatactggccagacgaatatgcgctgaaagaatacggagtgatgcgggtcaggaacgtgaaggagtctgctgcacacgactatacgctccgggagctgaagctgagcaaagtgggccaggggaatacagaacgcaccgtgtggcagtatcacttccggacctggcccgatcatggtgtgccttcagatcccggaggagtactggacttcctcgaggaagtgcaccacaagcaagaatctatcatggacgcaggcccagtggttgtgcactgtagtgccggaattggacgtaccggtactttcatcgtgatcgacattcttatcgatatcatcagggaaaaaggtgtcgattgcgacattgacgttccaaaaacgattcagatggtgcgtagtcagagaagcgggatggttcagactgaagcacagtacaggtttatttacatggcagttcagcactacatcgagaccctacagcggcgaatagaagaagaacagaaatccaaaaggaaggggcacgaatacaccaacattaagtattccctcgccgaccaaacctccggagatcagtcacctcttccgccatgcacaccaacacctccgtgcgcggaaatgcgcgaagactctgccagagtttacgagaacgtcggcctcatgcagcaacagaagtcttttaggtag

SEQ ID NO: 30372 - DNA, 651 bp, Artificial Sequence
  Description of Artificial Sequence: Synthetic coding sequence
atgacaagccggagatggtttcatcccaacattacaggagtggaagccgaaaacctgttgctgactcgcggagtcgatggttctttcctcgccaggccttcgaaaagtaatcctggcgattttacactctccgtgcgaagaaatggagctgtcacacacatcaaaattcaaaacactggagactactacgatctgtacgggggagagaagtttgccaccttggccgaactcgtgcaatattatatggaacaccatggccagctcaaagagaaaaacggagacgtgatcgaattaaaatacccactcaattgtgccgaccctacttctgagagatggttccacggccatcttagcgggaaagaggctgagaagctcttaacagagaaaggcaaacacgggtcattcttggtcagggagagtcaaagccatcccggtgatttcgtgctaagtgtgagaacaggagatgacaagggagagagtaacgacggaaaatcaaaggtgacccacgtgatgattaggtgccaggagctcaagtacgatgtcggaggtggggaacgctttgatagccttaccgacctcgttgagcactataaaaagaacccaatggtcgagaccctcggcacagtgttgcagctgaaacagcccctgtag

SEQ ID NO: 30373 - DNA, 1383 bp, Artificial Sequence
  Description of Artificial Sequence: Synthetic coding sequence
atgaccagcaggcggtggtttcaccctaacatcacaggagtggaagctgagaacctgctcctgactcggggtgtggacggctctttcctggctcggccttctaagagcaacccaggagacttcaccctgagtgtccggagaaatggggctgttactcatatcaaaatccagaatacgggggattactacgacctctatggcggagaaaagttcgcaacactggctgaactggtgcagtactacatggaacatcacggccagctgaaagagaaaaacggtgacgtgatcgagctgaagtaccccctgaattgtgcggaccctactagtgagcgatggttccacggtcacctatcaggcaaagaggccgagaagctactaactgaaaagggtaaacacggttcatttcttgtcagggaatcacaatctcatcccggagactttgtgctgtcagttcgtaccggcgacgacaagggtgagagcaatgacgggaagtcgaaagtgacccacgtaatgataaggtgtcaggaactgaagtacgatgtcggaggcggagagaggtttgactctctgactgacctcgtggagcactataaaaaaaatcctatggttgaaaccctaggcaccgtcctccagctaaagcagcccctaaataccacccggataaacgcagctgagatagagagcagagtccgtgaattaagtaagttggccgagaccaccgataaggtgaagcagggcttctgggaggaatttgagaccctgcagcagcaagagtgtaaactgctgtactcccgcaaggaggggcagcggcaggagaacaagaataaaaatcggtataagaatattctcccttttgaccatacaagagtggttttgcacgatggggaccctaacgagccagtgagcgattacatcaacgcgaatatcatcatgcctgagtttgaaacaaaatgcaataactcaaaaccaaagaagtcatatatcgccactcaaggttgcctgcaaaacaccgtgaacgatttttggcgaatggtcttccaggagaatagccgggtaatcgtaatgaccaccaaagaagttgaaaggggcaagagtaaatgcgtgaagtactggccagacgagtacgccttgaaggagtacggcgtgatgcgcgttcgcaacgtgaaggaatctgcagcgcacgactatactctccgagagcttaagctgagcaaggtcggacagggtaacaccgaaagaaccgtctggcagtaccacttcaggacctggccagaccacggggtgccgtccgaccctggtggcgtcctggatttcctcgaggaggtccaccacaagcaagagtcaataatggatgctggcccagtggtcgtccactgccggtag

SEQ ID NO: 30374 - DNA, 723 bp, Artificial Sequence
  Description of Artificial Sequence: Synthetic coding sequence
atgtatctttggctaaagctgctggctttcggctttgcatttctggacaccgaggttttcgtcaccggccaatcccccactccttcaccaaccggccatcttcaggctgaagagcagggcagccaatctaaatcccctaatctgaagagcagggaggctgattctagtgcttttagttggtggccaaaagccagagagcccctgacgaaccattggcgactgacaaccgccaagatgcctagcgtgccactgtcgtccgatcctcttcccacgcacactactgccttcagtccagcttctacatttgaacgtgagaatgacttcagcgagacgactacaagcctcagcccagacaatacttccacgcaagtgtccccagacagtctggacaatgcctctgcttttaatacaacaggggtgtcctccgtgcagacgccacacctcccaacccacgccgacagccagaccccctcagccggtacagacacgcagacatttagcggctccgcagctaacgccaaactgaatccaacacccggatctaatgccatctctgacgtgccgggagaacggagtacagcctcgactttccccaccgatccggtctccccactgaccacaaccctgtcactcgcccatcactctagcgcggctttgccggcacggacctccaataccaccatcacagcaaacacttctgacgcttatttgaatgcttcttag

SEQ ID NO: 30375 - DNA, 3432 bp, Artificial Sequence
  Description of Artificial Sequence: Synthetic coding sequence
atgtacctgtggctaaagctgctggcttttggatttgcattcttggatacggaagtattcgtgacaggccagtctccaacgccatcacctaccgatgcgtacctcaacgcttcggaaactacaacactatcccccagtggttccgcggtcatctcaacaactactattgctacaacaccctcaaaacctacatgtgacgaaaaatatgctaacatcacagtggattatctctacaacaaggaaaccaagctgtttacggccaaactgaatgttaatgagaacgttgaatgtggtaataacacttgtaccaacaatgaggtgcacaatctgaccgaatgcaagaacgctagtgtgagcattagccacaactcatgcacagcaccagacaagactctgatcctagatgtacccccaggggtggagaagttccagctgcatgattgcacacaggtagagaaggcagacactaccatatgcctgaagtggaaaaatatagaaacattcacctgtgacactcagaacattacatataggtttcagtgtggtaatatgatttttgataataaagagattaagctggagaacctggaacctgagcacgagtacaaatgcgactccgaaatcttatataacaatcacaagttcaccaatgccagcaaaatcatcaaaacggactttggctctcccggagagccacaaataatcttctgtagaagtgaggccgcacaccaaggcgtcatcacgtggaatcctcctcagcgctcctttcacaactttacactgtgttacatcaaggagactgagaaagattgcctcaatttggataaaaacctcattaagtacgacctgcagaatctcaaaccttatacaaagtatgtgctgagtcttcatgcttacatcatagccaaggtccagagaaatggctccgcggctatgtgtcatttcacaacaaaatcagcaccgccaagccaggtttggaatatgacagtttctatgacttccgacaactctatgcacgtgaaatgtcgtccccctcgtgaccggaatgggcctcatgaacggtaccacctggaggttgaagctggcaataccctggtcagaaatgaatcacataaaaattgcgacttcagggtgaaggacttacagtactcaaccgattatacattcaaggcttattttcataatggcgattaccctggagaacctttcatcttgcaccatagcacctcatacaactcgaaagctttaatcgcttttctagcatttctgataatcgtgacttccattgctctgctggtcgtgctttacaaaatctatgacctgcataagaagcggtcttgtaaccttgacgaacagcaggagctggtggaaagagacgatgagaagcagctcatgaacgttgagcctatacacgccgatatcctcctcgaaacatacaaacggaagatcgctgatgaaggccgattattcctcgcggagttccaaagcatccctcgagtgtttagcaaattccctattaaggaagcgaggaaacccttcaaccagaacaaaaaccggtatgtggacatccttccctatgattataaccgcgtggagttaagtgagatcaatggcgacgctggcagcaactatatcaatgcctcatacatagacggttttaaggagccaaggaagtacattgccgctcaagggcctcgcgatgagacggtggatgatttttggagaatgatttgggaacagaaggctaccgtgattgtaatggtgacacgttgtgaggagggcaataggaataaatgcgccgagtactggccttctatggaggagggaacccgtgcattcggagacgtcgttgtgaagatcaatcaacacaaaaggtgccccgactacattatacagaagctgaatattgtcaataagaaggaaaaagctactggcagggaggtgacccacatccaatttacatcttggccagaccatggggtgcctgaagatcctcacctgctcctcaagctgcgacggcgtgtgaatgctttctccaactttttctccgggccaattgtagtgcattgtagtgctggcgtcggacggacaggtacctatattgggatcgacgcaatgctagaggggctagaggcagagaacaaggtggacgtgtacggatatgtggtgaagttacggcgtcagcgctgcttgatggttcaggtggaagcacagtatatcctgattcatcaggctctggttgaatataaccagttcggcgagaccgaagttaacctgtctgagttacatccttatttgcacaatatgaaaaagcgtgaccctccctcggagccatccccactggaggccgaatttcagcgacttcccagctacaggtcctggaggactcaacacattgggaaccaggaagagaacaaaagcaaaaacaggaactctaatgtgattccttatgactacaacagagtaccccttaagcatgaattggaaatgagcaaggaatcagaacatgacagtgacgagagttctgatgatgattctgactcagaggaaccctccaagtacataaacgcttcttttataatgagttattggaagccagaggtgatgatagctgctcagggcccactgaaggaaacaatcggggatttttggcaaatgatttttcagaggaaggttaaggtgatcgtgatgctcaccgaactgaaacacggagatcaagaaatttgtgcgcaatactggggggaaggaaagcagacctacggcgatattgaagtcgacctgaaggacacagacaaatcctctacatacacgctgcgggtttttgaactgagacacagcaagcgcaaggactctcgcaccgtgtaccagtaccagtacacaaattggagcgttgaacagcttcctgctgagcctaaggagctgatcagcatgattcaagttgttaaacagaagctgccgcaaaaaaattcctccgaaggcaataaacatcataagagcacacccctcctgatacattgtagagatggcagccagcagacaggtatattctgtgcactcctgaaccttctggaatctgccgaaacagaggaggtcgtggacatctttcaagttgttaaggccttgcggaaggcccgaccaggcatggtgagtacattcgagcagtatcagttcttgtatgacgtgatagcttcaacctatcccgcacagaacggccaggttaagaagaacaatcaccaggaagataagatcgagttcgacaatgaggtcgataaggtgaagcaggatgcgaattgcgtgaacccgctgggagcgcctgaaaaacttccagaagccaaggagcaggccgaggggtcagaaccgaccagcggcactgaaggaccagaacatagcgtgaatggccctgcttcccccgctctgaatcaggggtcttag

SEQ ID NO: 30376 - DNA, 3771 bp, Artificial Sequence
  Description of Artificial Sequence: Synthetic coding sequence
atgtacctgtggctgaaattgttggcattcggctttgctttcctcgacacagaggtttttgtgactggacagtctcccacaccttcccccactggcctgacaaccgcgaaaatgccctccgttcctttgtctagcgatccactgcctacccacaccaccgctttctcacctgccagcacttttgaacgtgagaatgatttttccgaaacgactacatccctgtcacccgacaacacatccacacaggtatctccagactctcttgataacgcatccgcctttaatactaccggcgtctccagtgtgcagacccctcacctgccgacccatgcagactcccagaccccatccgctggaaccgacactcagacatttagtggttcagccgcaaacgctaaactgaaccctactcccggatcgaacgccataagcgatgcctacctgaacgctagtgaaacgactaccctgagtccaagcggctctgccgtcattagtaccactacaatagccacgactccatctaagcccacatgtgacgagaaatatgccaatattacggtggactatctgtacaacaaagagacgaaactgtttacggccaaactcaatgtgaatgaaaatgtggaatgtggtaacaacacctgtaccaacaatgaggttcacaatctgactgagtgtaagaacgcatcggtgagcatttcccacaatagctgcacagcacccgacaagactctcatattggatgtgcctcctggcgtagaaaagtttcagctgcatgactgtactcaggtcgaaaaggctgatacaactatttgcctgaagtggaagaacatcgagacgttcacttgtgacactcagaatatcacatatcggtttcagtgtggcaacatgatctttgataataaagaaatcaaactggagaacctagaaccagagcatgaatacaaatgtgacagtgagatcctatacaataatcacaaatttaccaatgcgtcaaagatcattaagacggacttcggaagccccggagagcctcaaattatattttgtagatctgaggccgctcaccagggggttattacctggaatccacctcagaggagttttcacaatttcaccctctgttatattaaggaaacagaaaaagactgtctcaacttggacaagaacttgatcaaatacgacctacagaacttaaaaccatatacaaagtatgtgctgagtctgcacgcttacattatcgccaaggttcagcgaaatggttccgccgctatgtgccactttactaccaaatccgctccgccttcacaggtgtggaacatgaccgtcagtatgacctcagacaactcaatgcacgtgaagtgccgcccaccacgcgaccgcaacggaccacatgaacgctatcacctagaggtggaggctggcaacacgctagtgagaaacgaatcccataagaattgcgatttccgtgttaaagaccttcagtatagcactgactacacatttaaggcatacttccataacggtgattaccccggagagcccttcatcctgcaccatagcacctcctataatagcaaagccttaatcgcttttctcgctttcttaattatcgtcaccagcatcgccttgttggtggtcttgtataaaatctacgatctccacaagaagcgtagctgcaacctggatgaacagcaggaacttgtggaacgcgacgatgagaaacagttaatgaacgtcgagcctattcatgcggacattctgctggaaacatataagcgaaaaattgcagacgaggggcgtctctttctggccgaattccagagcattcctagggtgttctctaagtttccaatcaaagaagcgaggaaaccgttcaatcagaataaaaacaggtatgtggatattttgccgtatgattacaaccgagtggagctctccgaaatcaatggagatgcaggcagcaactatattaacgcttcctacatcgacggctttaaagagccccgtaagtacatagctgcacaagggcctcgcgacgagaccgtggacgacttctggcgaatgatttgggaacagaaagcaacggtcattgtcatggtgactaggtgtgaagaagggaaccgaaacaaatgtgctgagtactggccctccatggaggagggcacccgggcattcggcgacgtggtcgtgaagatcaaccagcacaaacgctgtccagattacattatccagaaacttaacattgtcaataagaaggaaaaggctactggcagggaggtgacccacattcagttcacttcttggcctgatcacggcgtgcccgaggatccccacctacttctgaagctcagaagacgcgtgaatgccttcagtaacttctttagtggcccaatcgtggtccattgcagcgctggggtgggcagaacaggaacctatattggcatcgatgcgatgctcgagggactcgaagctgagaacaaagtagacgtgtatggctatgtagttaagctgaggcggcagcgttgtctgatggtgcaggtcgaagcccagtacatactaattcaccaggcactggtggaatataaccagttcggagaaacagaagtgaatctatccgaactgcacccttatctccacaatatgaaaaagcgggacccaccaagcgagccaagtcccttggaggccgagtttcaaagacttccttcataccgttcctggcgaacccagcacatcggtaaccaagaggaaaacaagtccaagaatcgtaatagcaacgtgatcccatacgattacaaccgcgtccccttgaagcatgagctagagatgtccaaagagtccgaacacgatagtgacgaaagctcagatgatgacagtgacagcgaggaaccatccaaatatattaatgcaagctttataatgtcctattggaagccagaagtgatgatagcagcccagggacccctgaaggagacgatcggcgatttttggcagatgatctttcaacgcaaggtcaaggtaatcgtcatgttgaccgagttgaagcatggcgatcaggagatttgtgcccaatactggggggagggtaagcagacctacggcgatattgaggtagacttgaaggatacagacaagtcctccacgtacacactcagagtgttcgagctacgccactccaagcggaaagactcccgcacagtgtatcaatatcaatacacgaactggagcgtcgaacaacttccggcagagcccaaggagctcatttccatgattcaggtggtgaagcaaaagcttccacagaaaaatagctcagaaggtaacaagcatcacaagagcacacccttactcattcattgtcgcgatggtagccaacagactggaattttctgtgctttgctaaatctactggagagcgccgaaactgaagaagtggtagatatttttcaggtcgttaaggctctgaggaaagccaggccaggaatggtctcaaccttcgaacagtatcagtttctgtatgatgttatcgcgtctacctacccagcccagaacggtcaagttaagaaaaataatcatcaggaagacaaaattgagtttgataatgaggttgacaaggtaaagcaagacgcaaactgcgtgaatcccctcggcgcaccggagaaattgccggaggcaaaggagcaggcagaaggtagcgagccgacatctgggaccgagggtcctgagcactctgtgaatggaccagctagccctgccttgaatcaaggcagttag

SEQ ID NO: 30377 - DNA, 2208 bp, Artificial Sequence
  Description of Artificial Sequence: Synthetic coding sequence
atgaccatgtacctctggctcaaacttctggcattcggatttgcatttctggacaccgaagtttttgtgaccggacagtctccaacaccctcacccacaggcgtgtccagcgttcagacaccccacctcccaacacacgctgattcccaaaccccgagtgctgggacagatacacagacatttagtggctcagctgcaaacgctaagctcaaccccacccctgggagcaatgcaatctccgatgtgccaggagagagaagcacagcctcaacctttcccaccgatccagtgagccccctcactaccactctctctctcgctcaccattcttcagcggcattacccgctaggacgtctaataccaccattacggcaaacacttcggatgcctacctgaatgcttctgagacaaccactctctctccgagcgggtcagcagtcatctctaccaccactattgccactacaccttccaaaccgacctgcgacgagaaatatgccaacataacggttgactacctttacaacaaagagaccaagcttttcaccgcaaaactgaacgttaacgagaacgttgaatgcggcaacaacacctgtaccaacaacgaggtacacaatctgacagagtgtaagaacgcctctgtgtcaatcagtcacaatagttgtaccgctccggacaagaccctgatcctagatgtcccaccaggtgtggagaaattccagctgcacgactgcacacaggtggagaaggccgataccactatttgtctcaaatggaagaacatcgaaaccttcacctgtgacacccaaaatataacctataggtttcagtgcggtaatatgattttcgataacaaggaaattaagctggagaatctggaacccgaacatgaatacaagtgcgactcagaaatcctgtacaataatcacaaatttacgaacgcgtcgaaaatcatcaagaccgactttggcagccctggagaaccacaaattatcttttgccggtctgaggccgctcatcagggcgtgattacttggaatcccccacagcgaagctttcataacttcacgctttgttatatcaaagagaccgagaaggactgcctgaacctcgacaagaatttaattaagtacgatctgcaaaacctgaaaccctacaccaaatatgtcctgtctcttcatgcctatattatagccaaagttcagcgaaatgggagcgccgctatgtgccatttcacaactaagagtgcgccaccatcacaagtgtggaatatgactgtctcaatgaccagtgacaactccatgcacgtgaaatgtaggccaccaagagacagaaacgggcctcacgaacgctatcacttggaggtagaagccggaaacaccctcgtacgaaatgaatctcacaaaaattgtgactttagagtgaaagatctccagtacagcacggactacacatttaaggcctatttccacaatggcgattatcctggagaaccatttatcctccatcactccacttcttacaactccaaggccctgattgccttccttgccttcttgattattgtcaccagtatcgccctgctggtggtgctgtataagatttacgatctgcacaaaaaaaggagttgtaatttagacgagcagcaggaactggtagagagagacgatgagaagcagctgatgaacgtagaacccatccacgccgacattttgctggagacctacaagcgcaagatcgctgacgagggcaggctctttctcgcagaattccaatccattccgagggttttctctaaattccccatcaaagaggctaggaaaccattcaatcaaaataaaaaccgctatgtcgatatacttccttatgattacaatagggtcgaattatcggagatcaacggcgacgccggatcgaactatattaatgcgagctacatagacggctttaaggaacctcgaaaatacatcgccgctcaaggacctcgcgacgaaactgttgacgatttttggcgtatgatttgggagcagaaggcgacagtgatcgtgatggtgaccagatgcgaagagggaaaccggaataaatgtgcagaatattggccttctatggaagaaggaacaagagccttcggagacgttgtcgtgaagatcaaccagcacaagcgttgcccagactacattattcagaagcttaacatagtaaattag

SEQ ID NO: 30378 - DNA, 2202 bp, Artificial Sequence
  Description of Artificial Sequence: Synthetic coding sequence
atgtatctgtggttgaagctgctggcatttggttttgctttcctcgatactgaagtgttcgtgactggccaatctcctaccccaagtcctacaggggtgtcttccgtgcagacgccacacttaccaacccatgcagacagccagacaccttctgccggaacagacactcaaaccttttctggcagtgctgccaatgccaaactaaacccgacccccggaagcaacgcgatctccgatgtgcctggggagagaagcactgcctctacattcccaaccgaccctgtctcccccctcactacgacgctaagcctggctcaccattcatcggccgctctgccagctagaaccagcaacaccaccatcaccgccaatacttccgatgcttacctgaatgcctctgagaccaccacattgtcaccctccggaagcgccgtgatttccacaaccaccatagccacgacgcccagcaagcccacttgtgacgagaagtatgctaacattacagtggactacctctataacaaagaaaccaagctctttacagctaagctaaacgtcaacgagaatgtagaatgtggcaataacacctgtacaaataatgaggttcataatcttaccgagtgcaaaaacgcttcagtgtctatctcccacaactcttgcaccgcccctgataagaccttaatactcgacgtcccccctggtgtagagaagttccagcttcacgactgcactcaggtggaaaaagccgacacaacaatttgtctgaaatggaagaatatcgaaactttcacatgcgacacccaaaatataacttatcgctttcaatgcgggaacatgatctttgataataaggagatcaagctggagaacctggaacctgaacatgagtacaagtgcgatagtgagatcctctacaacaatcacaagtttacgaatgcgtccaagattattaagactgacttcgggtctcccggagagcctcagatcatcttctgtcgctcggaggctgcgcatcaaggggtcattacctggaacccaccacaaagaagcttccataacttcactctgtgttatatcaaggagaccgagaaagactgcctcaatctggataagaatctgataaagtacgacttgcagaatctcaagccgtacacaaagtacgttttgtctcttcacgcctatattatagcgaaggtgcaacgcaatggcagcgccgctatgtgccactttaccacaaagagtgctcctccttcacaggtatggaatatgaccgtttccatgacgagcgacaactctatgcatgtcaaatgtagaccacccagggatagaaatggccctcacgagcgataccatctagaagttgaggccggaaataccctggttcgtaacgagagccataagaattgcgattttcgggtgaaggacctccagtattccaccgattatacatttaaggcctacttccataacggcgattaccctggcgagcctttcatactgcaccactcgacatcgtacaactctaaagccctgatagctttcctggccttcctcataattgtcacctcaattgcattactggtggtgctctacaaaatatatgatttgcataaaaaacggtcttgtaaccttgacgagcagcaagagctcgtcgaaagagacgatgagaagcagctcatgaacgtggaacctattcacgccgacattctgcttgagacctacaagagaaagattgccgacgagggcagactgttcctcgctgagttccagagtatcccaagagtctttagtaagttccctatcaaggaagctagaaagccatttaaccagaataaaaatcggtatgtggatatcctcccctatgattacaaccgagtggagctctctgaaatcaacggggatgcgggatctaactatataaatgcatcctatatcgacggattcaaggaaccacgcaagtatattgccgcacaggggccacgcgacgagaccgtagatgatttctggcgaatgatctgggaacagaaagcgacagtgattgtcatggtcacacgatgtgaggaggggaacaggaataagtgcgccgaatactggccaagcatggaggagggcacccgcgcttttggagacgtcgtggttaaaataaaccaacacaagagatgccctgactacattatccaaaagcttaatattgtaaactag

SEQ ID NO: 30379 - DNA, 3921 bp, Artificial Sequence
  Description of Artificial Sequence: Synthetic coding sequence
atgacgatgtacctgtggttaaaactattagcattcggcttcgcatttcttgacactgaagtttttgtcacaggccagtctcccacaccaagtcctactggcctcacaaccgcgaaaatgccgagtgtgccactgagttctgatccacttcctacacacactactgccttctcacctgcctctacttttgaacgcgagaacgacttctccgaaacaacaacatccctaagtcctgataatacctctacacaggtttctccggatagtcttgacaacgcaagcgccttcaacactacaggggtgtccagcgtccagacccctcaccttccaacccatgccgacagtcagactcccagcgcagggacggacacccaaaccttttccggttctgctgctaacgcaaaactcaatccaactcccggtagtaacgctatttcagacgtacccggtgagagaagcaccgcttccaccttccctactgatccggttagtccccttactaccaccctaagccttgctcaccattcttctgctgccttacctgcacggacatccaacacgaccatcactgctaatacttccgatgcatatctcaatgccagtgagactaccacactaagccctagcggaagtgctgttatctctactacaaccatcgccaccacaccatcgaaaccgacatgcgatgaaaaatacgctaatataacagttgattacctgtataataaggaaaccaagctctttaccgctaagcttaacgtgaacgagaatgtggaatgcgggaacaatacatgtactaataacgaagttcacaacctcaccgagtgcaagaatgcaagtgtcagcatcagccacaacagttgcacagcccctgataaaacccttatactggatgtgccacctggggtggaaaagttccagctacacgactgtacccaggtggagaaagctgataccacaatctgtctcaaatggaaaaacatcgaaacatttacttgtgacacccagaatataacttatcgcttccagtgtgggaatatgattttcgataataaagagattaaattagaaaacctagagcccgagcacgagtacaaatgcgatagcgaaattctctataacaaccataaattcacaaacgcctctaaaatcattaagactgacttcgggtcccccggagaacctcagataattttctgtaggagcgaagctgcacaccagggagtgattacttggaaccccccacaacgatccttccacaatttcactttgtgttacataaaggagaccgaaaaggattgcctgaacctggacaaaaacctgatcaagtatgacctgcagaatcttaagccctatacaaagtatgttttgtcactccatgcttacataatcgctaaagtccaacgtaacggctctgccgctatgtgccatttcacaacgaagagcgctccgccttcacaggtgtggaatatgactgtgtccatgacttctgataatagcatgcacgtcaaatgcagaccacctagagatagaaacggcccacacgagaggtaccaccttgaggtcgaggccggaaataccctagttcgcaatgagagccacaaaaattgtgactttagggtcaaagacttgcaatactccactgactatacattcaaagcctatttccacaatggcgattatcccggagaaccttttatccttcaccacagtacatcctacaacagcaaagcccttattgcttttttggcattccttattattgtgacgtctatcgctctgctggtggtattgtataaaatctatgacctacataaaaagcggagctgtaacttggatgagcagcaggaactggtggaacgcgatgatgaaaagcagttgatgaatgtagagcccatacatgccgatatattgttggagacctacaagaggaagattgcagatgaggggagattgtttctagctgaattccaatctatccctagggtcttcagtaagttcccgattaaggaggcccgaaagccttttaatcaaaacaaaaatcgctacgtggacatccttccatatgattataatagagtggagctgtccgagattaatggcgatgccggtagcaactacatcaacgcaagttacatcgacgggttcaaggagccaagaaagtacatcgccgctcaaggccctagggacgagacagtcgacgatttctggcggatgatctgggagcaaaaagccaccgtgattgtgatggtgaccagatgcgaagaagggaatcggaacaaatgtgcagagtactggccttccatggaggaaggcaccagggcctttggcgatgttgttgttaagatcaatcaacacaagcgctgtcctgactacataatacagaaactcaacatagtaaacaaaaaggagaaggctaccgggagagaagtcactcatatccagtttacctcttggccagaccacggggtaccagaggatccacaccttttgctgaagttacgcaggagggtcaatgcattttccaactttttttccggccctattgtggtccactgctccgccggagtgggtaggacagggacctacatcgggattgacgctatgctggaggggctggaggcagagaataaagttgatgtgtatggctacgtggttaaattaaggcggcaaagatgtctcatggtccaggtagaagcgcagtatatcctcatccaccaggccctggttgaatacaatcagtttggcgagactgaggtgaatctgtctgagctgcatccctacctgcacaatatgaagaagcgagatccccctagcgaaccaagccccctggaagccgagttccagagactgccttcctataggtcctggcgcacacaacacatcggcaaccaggaagaaaataagagcaaaaacaggaattccaacgtgatcccatacgactataatcgagtcccactgaaacatgagcttgaaatgtcaaaggaatccgaacacgacagcgacgaatccagcgatgacgactcggactctgaagaaccctccaagtatataaacgcctccttcatcatgtcttattggaagcccgaagtcatgatcgccgcacagggcccattgaaagagactattggggatttttggcagatgatattccagagaaaagtgaaagtgatcgttatgttaaccgaactgaaacatggagatcaagagatctgcgctcaatattggggtgaaggcaagcagacatatggagatatcgaagtggatcttaaggatactgataagtcctccacctacacactccgcgtgtttgaactccggcacagcaagagaaaagatagccgaactgtgtaccagtaccaatacacgaactggtctgtggagcaacttcccgcagagcccaaagagctgatctctatgatccaggtggtaaagcagaagctacctcaaaaaaacagcagcgaaggcaataaacaccataaaagcacgcctttgctcatccattgtcgggacggctcccaacagaccggaattttttgcgccctcctgaacctcctcgaatcagctgagactgaggaggtggttgacatctttcaggtggtgaaggcactaagaaaggcaaggcctggtatggtgagtacctttgaacagtatcaatttctatacgatgtaatcgcatcgacatatcctgcccaaaacggccaagtgaaaaaaaataaccaccaagaggataagatcgaattcgataatgaggtggacaaggtcaaacaagacgcaaactgcgtcaaccccctgggcgctcccgagaaactcccggaggctaaagaacaagcagagggctctgaacctactagcgggactgaaggtcctgaacactccgtgaacggccctgcatcgcccgcattgaaccagggctcctag

SEQ ID NO: 30380 - DNA, 441 bp, Artificial Sequence
  Description of Artificial Sequence: Synthetic coding sequence
atgtatctgtggttgaagctgctggcattcggatttgccttcctggataccgaggttttcgttaccgggcagagccccactccttctcccactgatgcctatctcaacgcttccgaaacaacaacacttagtccttccgggagtgccgtcatttcaaccaccaccatagccaccactccatcaaaacctacttgtgacgagaagtatgcaaacatcaccgtggactacctctacaataaagagacaaagctattcactgctaagctcaacgtcaacgaaaacgtggaatgcggaaacaacacgtgtaccaataatgaagtgcacaatctgaccgagtgcaaaaacgcttctgtgtccattagtcacaatagttgtactgccccagataaaacgctcatcctcgacgtgccaccaggcgttgagaagttccagttgcactag

SEQ ID NO: 30381 - DNA, 351 bp, Artificial Sequence
  Description of Artificial Sequence: Synthetic coding sequence
atgtatctgtggctcaaactcctggctttcggtttcgcatttttagacacggaggtattcgtgaccggacagagtcccaccccaagccccaccggacttaccaccgccaagatgcctagcgtgccgctgtcttcagacccattaccgacacatactaccgcctttagtccggcttctaccttcgagcgggagaacgacttctccgaaaccacaacaagtctgagcccagataacacctctacacaggtaagtccagatagccttgataatgcatcggcgtttaacacaacaggtgtcagctctgttcagacaccccatctgcccacgcacgctgattcacagacgccatag

SEQ ID NO: 30382 - DNA, 3915 bp, Artificial Sequence
  Description of Artificial Sequence: Synthetic coding sequence
atgtacttgtggctcaagctgcttgcttttggatttgcattcctggacaccgaggtgttcgttacggggcagtccccaaccccttctcccaccggtcttacaaccgccaagatgcccagcgtgcctctgagctccgaccctctccctactcatacgaccgcatttagcccagcttccacttttgagcgagaaaatgatttttctgagactacaactagtctctcacctgacaatacctccacacaggttagccctgattctctggataatgcgtcagcctttaacaccacaggcgtatcctctgtgcagacaccccacctgcccactcacgcggatagccaaacacctagcgccggtaccgacactcagacgttcagcgggtcagcagcaaacgcaaagcttaaccccacgcctgggagtaacgcgattagcgatgttcccggagagcggagcactgcatcaaccttccctaccgatcccgtctctccactgaccaccacgcttagtttagctcatcattcctctgccgcactgcccgcaagaacctcaaataccacaataacggcaaacaccagtgatgcatacctgaacgcgtctgaaacaacaacactctcgccaagcggttcggctgttatttccaccactaccatagccacgaccccgtcaaagcccacatgcgatgaaaaatatgccaatatcaccgtggactatctatataataaagaaacaaagttatttacggcaaaactcaacgtcaacgagaatgtggagtgcggcaataatacttgcacaaacaacgaagtgcataatcttaccgaatgcaagaacgcttccgtttccatcagtcacaactcatgtactgctccggacaaaactttgattcttgatgtccccccaggcgtggagaagttccagctgcacgactgcactcaggtggagaaggccgatacaactatttgcctcaagtggaagaacatcgaaacatttacttgtgatacacagaacattacgtaccgatttcaatgcggtaatatgatctttgataataaggagataaaacttgagaacctcgagccagaacacgagtataagtgtgactcagaaattctgtacaacaaccacaagttcaccaacgcctcgaagattatcaagactgattttggctctcccggtgagccgcagatcatcttctgtcgcagcgaagctgcccaccagggcgtgatcacgtggaacccccctcagaggtcattccacaacttcactttgtgttacataaaggaaacagagaaagactgtcttaacctggacaagaatctgatcaagtacgatctgcagaatctgaagccatatacaaagtacgtcctttcccttcatgcctacattattgccaaggtgcagcgaaatggttccgcagcaatgtgtcacttcacaaccaagagcgcccctccatcccaggtgtggaacatgacagtgtctatgactagtgacaacagcatgcatgtcaagtgccgacctccccgtgatcgcaacggcccacatgaaaggtaccatctggaggtcgaggccggtaataccctggttcgtaatgagtctcacaagaactgtgactttagagtgaaggacttgcagtattctactgattacacttttaaggcctactttcacaacggcgattatcccggagagccctttattttgcaccattccacttcatataactcgaaggcacttattgctttcctcgccttcttgatcattgtaacatccatcgcgttgctggtagtactgtacaagatctacgacttacataagaaacgctcctgcaatttagacgagcagcaggaactcgtggagagagatgacgagaaacaactcatgaatgtggaaccaattcacgctgatattctcctcgagacctacaagcggaagattgccgacgaaggcaggctgttcctcgccgaattccagagcattcccagagtgttctccaaattccccattaaagaagctcgaaagccctttaaccaaaacaaaaatcggtatgtagatattcttccttatgactataatcgggtcgaattgtccgagatcaacggcgacgctggaagcaactatattaacgcctcgtacatagacggttttaaagagcccaggaagtatattgcggcacagggtcccagggacgaaacagttgacgatttttggagaatgatctgggagcaaaaggctaccgtaatcgtcatggtcactaggtgcgaggagggcaaccggaataagtgtgccgaatattggccctctatggaggagggtactcgcgctttcggggatgtcgttgttaagatcaaccagcacaagaggtgcccagattacatcatccaaaagctaaacatcgtgaataagaaggagaaagctactggtcgcgaagttacgcatattcagttcaccagctggcctgatcatggggtgcccgaggatccacacctgctgctaaagctgagacgtcgagttaatgcgtttagcaactttttcagtggacctatagttgtccactgttctgcaggagtcggcaggaccggcacctatatcggaattgatgccatgttagaggggctcgaagcggaaaacaaggtagatgtgtacggctatgtggtcaagttaaggagacagaggtgtcttatggtgcaggtcgaggcgcaatatatcctcattcatcaggccctcgtcgaatataatcaatttggagaaaccgaggtgaacctgtcagagctccatccctacctgcataatatgaaaaaaagagaccctccatccgagcccagtcccctcgaagccgaatttcagaggctgccttcatataggtcttggcggacacaacatatcgggaaccaggaagaaaacaaaagtaagaataggaattcaaatgtgatcccatacgactacaaccgggtccctctgaaacatgaattagagatgagcaaagaatctgagcacgactcagatgagtctagcgacgatgattcagatagtgaggaaccaagcaagtatattaacgcctcgttcatcatgtcgtactggaaacctgaagtgatgatcgcggcacaaggccctctcaaggagacaataggcgacttttggcagatgatttttcagaggaaggtgaaggtcatcgtcatgctaacggaactcaagcacggcgaccaggagatttgtgctcagtactggggagagggaaaacaaacttacggtgatatcgaagtggatctgaaagacacagacaagagtagcacgtatacactaagagtgtttgaattgaggcacagcaagagaaaggacagcaggaccgtctatcagtaccaatatacaaattggtcggtcgagcagctgcccgctgagcccaaggaactgattagcatgatacaagtcgtcaagcagaagctacctcagaagaatagtagtgagggcaacaaacaccacaaatctacacctttactgatacattgccgggatggtagccagcagactggtatcttctgtgctcttctgaaccttctagagagcgctgagacagaggaagtcgttgatatttttcaagtggtcaaggccttacgcaaggcccgtcccggaatggtgagcactttcgaacagtaccaattcctgtacgatgtgatcgccagcacctaccccgctcagaatggccaggtcaaaaaaaacaatcatcaggaggataagattgagttcgataatgaggttgataaggttaaacaggacgcgaactgcgtaaacccactgggagcgccagaaaagttgcctgaagccaaagaacaggctgaaggctctgagcccaccagcggcacagagggtccagagcacagcgtcaatgggcctgccagtccagcactgaaccaaggcagctag

SEQ ID NO: 30383 - DNA, 1797 bp, Artificial Sequence
  Description of Artificial Sequence: Synthetic coding sequence
atgtatctgtggctgaagttactggcctttggattcgcgttccttgataccgaagtattcgtcaccggtcagtccccaacccctagcccaactggggtctcaagtgtgcaaaccccccatctgcccacccacgctgattctcaaactccctcagctggcacagacacgcagactttttccggtagcgctgctaatgccaagctgaatcccacacccggatcaaatgcaatttctgacgcatacctaaatgcctcagaaacaactaccctttctccgtcaggatctgcagtgattagcacaaccaccatagcaacaaccccttctaagcccacttgcgatgagaaatatgcaaatataacagttgactatctgtacaacaaggaaacaaagctgtttaccgccaagctaaacgtgaacgaaaacgtcgaatgtggtaataatacgtgtacaaataacgaggtacataacttgacagagtgcaagaatgcctcagtcagcatttcccacaatagctgcaccgcccctgataagacacttattttggatgtccctccgggagtggagaagttccagctgcacgattgcacgcaggtagagaaggcagacaccaccatctgcctgaaatggaagaatatagaaacctttacatgtgatactcagaacattacatatagattccagtgcggtaatatgatatttgataacaaagaaatcaagctggagaacctggaaccagagcacgagtataagtgcgattccgagatcttatataataaccataaattcacaaacgcgtctaagattataaagacagattttggctcacccggagagcctcagattattttttgtcggtctgaagcagcccaccagggcgtgatcacctggaatcccccacagaggtcatttcacaatttcactttgtgttatattaaagagacagaaaaggactgcttgaacctcgacaagaaccttatcaagtacgacctgcaaaaccttaaaccctacacaaaatatgtcctatctcttcatgcctatatcatcgccaaggtgcagaggaatggcagtgctgccatgtgtcactttacaaccaaaagcgctcctcctagtcaggtctggaacatgaccgtttcaatgacttcggataattctatgcacgtgaaatgccgtccgcctcgggacaggaacggccctcacgaaagatatcatctcgaggtcgaggccggaaatactctcgtccggaacgagagtcataaaaactgtgactttagagtgaaagaccttcaatactccaccgactatacgttcaaggcctatttccacaacggggactatccaggtgaaccctttatccttcaccatagcacttcctacaactccaaagcccttatagcctttttggccttcctcatcattgtgacctctatcgccctgctggtggtgctctataaaatttatgatctccacaagaagcggtcctgtaatcttgacgaacagcaggaactggttgaaagagacgacgagaaacagctgatgaatgtggagccgatccatgccgacatcctcttggaaacctacaagcgcaaaattgccgacgagggcaggttgtttctggccgagtttcagtctatccctcgggtgttcagcaagttccctattaaagaagccaggaagccttttaaccagaataaaaatcgctacgtcgacatcctcccctatgactataaccgcgttgaactgtccgagataaatggggacgcgggatccaactatatcaatgcttcctatatcgattag

SEQ ID NO: 30384 - DNA, 2271 bp, Artificial Sequence
  Description of Artificial Sequence: Synthetic coding sequence
atgtacctttggctgaaactgctagcttttgggtttgcttttctcgacacagaagttttcgttaccgggcagtcccccaccccaagtcccacgggcctgactacagctaagatgccaagcgtgcctttgtcaagcgatcccctccccacgcacacaactgccttcagcccagctagcacgtttgagcgcgagaacgacttctcagagaccaccacttcactgtcccctgacaatactagcacccaggtctcccctgactccctggataacgctagtgcttttaacacaacgggtgttagcagcgtgcaaacaccccaccttcctacccacgcagactctcagacaccttcggccggtaccgatacacagaccttctcagggagcgcggctaatgccaaattgaaccccaccccgggaagtaatgcaatttccgatgcttatctgaacgcaagcgagaccaccacgctgagtccctcaggatcggcagtcatttcaacaacaacgattgcgactacgccaagtaagcccacatgcgacgagaaatatgcaaacataaccgtggactacctgtacaataaggagaccaagctgttcacagctaagctgaacgttaacgagaacgttgagtgcggcaacaatacttgcacgaacaacgaggtgcataatttaaccgagtgcaaaaatgcctccgtaagcatcagccataattcgtgcacagccccagacaaaacactgatcttggatgtgccccctggcgtggagaaatttcaactgcacgattgcacacaagtagagaaggccgatacaaccatctgcctgaaatggaagaacattgagacttttacttgtgacacccagaacattacttatcgctttcagtgtggcaacatgattttcgacaacaaggaaataaaactggaaaatcttgagccagaacatgagtataagtgcgactcagagatactgtataataatcacaaatttacaaacgctagtaagattattaaaacagatttcggctcaccgggagagccccagataattttctgccggtcagaggctgcccaccaaggagtaatcacatggaatccgccacagaggtctttccataactttactctgtgctatatcaaagagacagagaaggactgccttaacctggataagaatctcattaagtacgacctgcagaacctgaaaccatacactaagtacgttctcagcctgcacgcctatatcattgccaaagtccagaggaatggcagcgcagctatgtgtcatttcaccacaaagagcgccccaccttcccaggtctggaacatgactgtttctatgacgtcagataacagcatgcacgtgaagtgtcggcctcccagggacagaaatggaccgcacgaaaggtaccacttggaagtggaggctgggaacacccttgttaggaacgaaagccacaagaattgtgatttccgcgtgaaagatctccagtacagtactgactatacctttaaagcctatttccacaacggcgattaccctggcgaacccttcatactgcatcactcgacctcctacaattctaaggccctcattgcgtttctggcattcttaattatcgtaactagcattgcccttttggtggttctctacaaaatatacgaccttcataagaagcgcagctgtaaccttgatgagcagcaggagctggtcgagcgagacgatgaaaaacagctgatgaacgtggagccaatccacgcagacattctgctcgaaacatataagcgcaagattgccgatgagggccgtctatttctcgccgagttccagagtattcctcgggtgttcagcaaatttcccataaaggaggccagaaagcccttcaatcagaataagaataggtatgttgatatcttgccatatgactacaatcgcgtcgaacttagcgagatcaatggcgacgctggaagtaactacattaacgctagctatattgatggatttaaggaaccacgtaaatacatcgccgcacagggaccgagagatgagactgtggatgacttttggcgcatgatctgggaacagaaggccaccgtgattgtgatggtaacccggtgtgaggagggcaatcgcaataaatgcgctgagtactggccctcaatggaagagggtacacgagccttcggcgatgtggtggtcaaaatcaaccaacataagcggtgcccagactacatcattcagaaactgaacatcgtcaacaagcaaaagtctaagtag

SEQ ID NO: 30385 - DNA, 1662 bp, Artificial Sequence
  Description of Artificial Sequence: Synthetic coding sequence
tctgactatatgatcattaaaaagaagtccaattatgaggtgctggagaaagatgtgggtctgaaaaggttctttcccaagtcactgcttgatagtgtgaaggccaagactttgaggaagttgattcagcagaccttccgccagttcgctaacctcaaccgagaagaaagcatccttaaattcttcgagattctaagtcccgtgtaccgcttcgacaaggaatgttttaaatgcgccctcgggtccagctggataatcagtgtcgaactagccatcggccctgaagagggcatatcttatttaaccgacaaggggtgtaatcctacccacctcgccgactttactcaggtccagacgatacagtactcgaattctgaagataaagatcggaagggcatgctccagcttaaaattgccggtgctccagagccactgaccgtgaccgcaccctctctgactattgcagaaaacatggctgatctaattgacgggtactgtaggttggttaacggtacctctcagagcttcattatcaggccgcagaaggagggggagcgggctctaccttcaatccccaagctggcaaatagcgaaaagcaggggatgcgaacccacgcagtgagcgtgtctgaaaccgatgactacgccgagatcatcgatgaggaagacacatacacgatgccttctacgagggattacgagattcaacgcgagcgcatagagctcggtagatgtataggcgaggggcaattcggagatgtccaccagggtatttacatgtctcccgagaatccggctctggcagtggcaataaagacctgcaagaattgtaccagtgacagtgtgcgtgagaagttcctccaggaagcctgccattacacgtctttacactggaactggtgtaggtacatatcagaccccaacgtcgactgccccgatccacgcaacgcagaggtgacaatgagacagtttgaccatcctcacatagtgaagttaatcggagtaatcacagagaatccggtctggataatcatggaactctgtactctgggtgaactgagaagttttttgcaggtgcggaaatattcccttgatctggcaagtctgattctctatgcctatcagctgtctacagcgctagcctacctcgagagtaagaggtttgtgcacagagatatcgcagcgagaaatgtcttagtttcaagcaacgactgtgtgaagcttggcgactttggtctctccagatacatggaggattccacctactataaagcaagcaagggcaaactcccaatcaaatggatggcccctgagtccataaacttccgcaggttcacgtccgcctctgatgtgtggatgttcggggtctgtatgtgggaaattttaatgcatggggtgaaacctttccagggggtgaaaaacaatgacgtgatcggacggatcgagaacggagagcgactgccgatgcctccaaactgcccgccaaccttgtactcactcatgaccaaatgctgggcctacgatccatccaggcgcccacggtttactgagctaaaggctcagctgtcttttcaaaacccagcccagatgctcccagcctcaggcagactgccaaaccagccatgcccggagcgggaaaactactcatttgcgaccttttag

SEQ ID NO: 30386 - DNA, 2931 bp, Artificial Sequence
  Description of Artificial Sequence: Synthetic coding sequence
cggagctttatcatacttaaagcaatcgttagccagccaccagggcctgtcctgagcggaatggaaatgcttctgatgagtggctacgaattgcggattcggtatttgcctaaaggttttctgaaccaattcaccgaggataagcccacgctgaattttttttaccagcaggtaaagtctgattacatgctggagatcgccgaccaggttgatcaggagattgctctcaagctggggtgtctggagatccggcgatcttactgggaaatgaggggcaacgcactcgaaaagaagagcaattacgaagttcttgaaaaggacgtcggactcaaacggttttttccgaagtctctgttagactcagttaaagccaaaactttgcggaagctgatccagcagacattccgacagtttgctaacttaaatcgagaggaatcaatcctgaagtttttcgagatcttgtctcctgtatatcggttcgacaaagagtgttttaagtgtgccctaggcagctcttggatcatctcggtggagctggccatcggaccagaagagggaatatcgtatttaacagataaagggtgtaatccaacacacctcgcagattttacacaggttcagacaatccagtatagcaacagcgaggacaaagatcggaaggggatgcttcagctcaagatcgctggcgctccagaacccctgaccgtgacagccccttccctgaccattgcggaaaacatggcagatctgatcgatggatattgtcggctggtcaacgggacatcacagagtttcattattcgcccacagaaagaaggagagcgcgctctgccttccattccaaaactggctaacagtgaaaagcagggcatgagaacccacgctgtctctgtatccgacgaaattcccggtgctgaaactgacgactacgccgaaataattgacgaggaggatacatacaccatgccgagtattaagtcctactgtatcgatgtggccagagactacgaaattcaacgggagcgcattgagctgggccgatgtatcggagagggtcagttcggggatgtacaccaaggtatatatatgtccccagagaatcctgcgctagccgtcgctatcaaaacatgcaaaaactgtacatccgatagcgtcagggaaaagtttctgcaagaggccctcacgatgcgacaatttgaccatccgcacatcgtgaaactcatcggcgtaattactgaaaatcccgtgtggataattatggagttatgtactctgggcgaactgagaagctttctgcaagtccggaagtactctctcgacttagcttccctcatcctgtacgcctaccagctgagtactgccctggcctatcttgagagcaaaagattcgttcatagagatatcgccgcacgcaacgtactcgtcagcagcaacgattgcgttaagctcggagactttggactgtctcgctatatggaggacagtacatattataaagcttccaaggggaagctgccgatcaaatggatggccccagaatctatcaatttccgtagattcactagtgccagtgatgtttggatgtttggggtttgcatgtgggagattcttatgcatggcgtaaaacccttccagggcgtcaagaataatgacgtcatcgggagaatcgaaaatggcgagaggctgcccatgccacccaactgtccgccaaccctatactccctgatgaccaaatgctgggcttatgacccaagtaggaggcctcggtttacggaactgaaagcccagctgtcgaccatccttgaggaagaaaaggcccagcaagaggagcgaatgcggatggaatcacgtcgacaggctactgtgtcatgggattccggtgggagtgacgaggcccctccgaagccatcccggcctggctatcccagccctcggagttccgaaggcttttacccatccccccagcacatggtgcagacaaaccactaccaggtgtccggctaccccggatctcatggcatcaccgccatggcgggatcgatatatcctgggcaagcatctctcctggatcaaaccgactcctggaatcatcgacctcaggaaatcgcaatgtggcagcccaacgtggaagacagcaccgtgttagacctgcgcggaatcgggcaggtcctgccaacgcacctgatggaggagaggttaattcgacaacagcaggaaatggaggaggatcaaagatggctcgagaaggaggaaaggtttcttaaaccagacgtccggctctctcgaggatcaattgacagagaagacggcagcctgcaggggccaataggaaatcaacatatttaccagccagtggggaagcccgatccggcagcccctcctaagaagccacccagaccaggggcacctggccatttaggctcgctcgccagcctctcaagcccagcagattcatacaacgagggcgttaagcctctccgccttcagccacaggagataagccccccacccacagccaacttggatagaagcaacgataaagtttacgaaaacgtcaccgggttggtgaaagccgtgatcgagatgtcttctaagatccaacctgcaccacctgaggagtacgtccccatggttaaggaagtcggacttgcgctcagaaccctgttagccactgttgatgaaaccatcccattactacctgcatccacccaccgagagatcgagatggcccagaagttgctcaacagtgacttgggcgagctgatcaataagatgaagctcgcccagcagtatgtcatgacaagcctccaacaggaatacaaaaaacagatgctcacggctgcacatgccttggctgtagacgctaagaacctgctggatgtgattgaccaggccagactgaagatgttgggccaaacgcgcccacattag

SEQ ID NO: 30387 - DNA, 3024 bp, Artificial Sequence
  Description of Artificial Sequence: Synthetic coding sequence
aaagctgaatatgatcggtatctggcatcaagtaagatcatggccgcagcatatctcgatccaaatttgaatcatacccccaaagaatggaagtacgaactgcgcatcagatatctgcctaaaggttttctcaaccagtttacagaagacaagcctactcttaacttcttttatcagcaggtgaaatcagattatatgctggaaattgctgaccaggtcgaccaagaaattgccctcaagttaggctgcctggagattcgccgaagttactgggagatgcggggaaacgccctggaaaagaaatccaactacgaggttttggagaaggatgtcggccttaaaagattctttcccaagtctctgttggatagtgtaaaggcaaagacgttgcgaaagctaatccagcaaacgtttaggcagttcgccaacctgaaccgggaggagtccatcctaaaattttttgagatattatcacccgtgtaccgttttgataaagagtgtttcaagtgcgccctgggatcctcctggataatctcggtggaactggctattggtcctgaagaaggaatctcctacctgaccgataagggttgcaaccctacccatctggctgacttcacgcaggtccagacgatccaatatagtaactcagaagacaaagataggaaaggaatgcttcagttgaagattgctggcgcacccgaacccctcaccgtgacagcaccttctctcactatagctgagaacatggccgatttgatcgatggttactgcagactggttaatggtaccagccaatcctttatcattagaccgcagaaagagggggaacgtgccctgccaagcattccaaaacttgctaactccgaaaagcaggggatgcggacccacgccgtctccgtgagtggggttagccactgccagcacaaggttaagaaggctcggaggtttctgcccctggttttttgttcccatgacccaccatctacagacgagatcagtggcgacgagactgatgactacgctgagatcatagacgaggaggatacatacacaatgccgtcaattaagagctattgcattgatgtggcccgagactatgagatccagcgcgagcgaattgagctgggaagatgcattggagagggtcagtttggagacgttcaccaggggatttatatgagtcctgagaatccagccctggctgtggcaattaaaacctgtaagaactgtacctccgactccgtacgggagaagtttttgcaggaggctctgactatgagacaatttgaccacccccacatcgtgaagctgattggagtcattactgaaaaccctgtttggattattatggagctctgcactttgggagagttgagatcattcttacaggtgcggaagtattccctggatctcgcgtcactgatactgtatgcatatcagctgtcaacagcccttgcctacttggagagtaagcggtttgtgcacagggacatcgccgcacgcaacgtgctggtgtctagtaacgactgtgtgaaactgggcgatttcggcctttctcgctacatggaggactcaacctattataaggcctccaaagggaaactccccattaaatggatggctcctgaaagcattaatttcagacggtttacatctgcgagcgatgtttggatgtttggcgtgtgcatgtgggagattctaatgcatggcgtaaaacccttccagggcgtaaagaataatgatgtgatcggcagaatcgaaaacggggagagattgcccatgcccccaaactgtcctcccacactgtatagtctgatgacaaagtgttgggcctatgatccaagcaggcgaccacggtttacagaactcaaagcccaactttccactattctcgaggaggagaaggcccaacaggaagagagaatgcggatggaaagtaggcgtcaggcgacggttagctgggactcaggcggatccgatgaggcacctcccaagccttcgcgtcccggataccccagcccacggtcctccgaaggattttatccttcgccccagcatatggtgcagacaaaccactaccaagtttctggctaccccggaagccatggcattactgcaatggcaggctcaatctatccaggacaggcctcacttctggatcaaacagattcctggaaccaccgaccccaagaaatcgcaatgtggcagcccaacgtagaagactcgacagttctggacctccgtggaattggccaggtgttgcccacgcatctcatggaggagcgactcattaggcaacagcaagagatggaagaggaccagaggtggcttgagaaggaggagcgttttcttaagcccgacgttagactgagtagaggctcgatagatagggaggatggatctctgcagggccctatcgggaatcagcacatttatcagccagtgggcaagcccgaccctgccgcacctcctaaaaaacccccaaggccaggggcacccggtcacttagggtccctcgcttccttaagttctcccgcagatagttacaatgaaggcgtaaagcccctgcggctccaaccacaggagatctctcccccaccaaccgccaatttagaccggtccaacgataaagtctacgaaaatgtgaccggcctcgtgaaagcagtgattgaaatgagttcaaaaatccagcccgctccgcctgaggagtacgttcctatggtgaaagaagtcggattagcattgcgcaccctattggccactgttgacgagacaatccctcttcttcccgcaagcacccacagggagatcgagatggcccaaaaattgctcaactccgatctcggcgagctgatcaataagatgaaactggcccagcagtatgtaatgaccagcctgcagcaggagtacaagaaacaaatgttgacagctgcccacgccctcgctgtcgacgccaaaaatctcctcgatgttatcgaccaagctagattaaagatgctggggcagaccagaccgcattag

SEQ ID NO: 30388 - DNA, 3198 bp, Artificial Sequence
  Description of Artificial Sequence: Synthetic coding sequence
atggctgcagcctaccttgatccaaatctgaaccacaccccaaatagctcgactaagacccacctgggtaccgggatggaacgatctcccggtgcaatggaacgcgtgctaaaagtctttcactattttgaatccaattccgagcccaccacgtgggcttccataataaggcatggggacgcaactgacgtgaggggaataattcagaaaatcgtggacagccacaaggtcaaacacgtggcctgctacggctttcgcctgtctcatcttcgctccgaggaggtccattggctgcatgtcgatatgggagtgtcgtctgtccgggaaaagtacgagcttgcccatcctcctgaagagtggaagtatgagttacggattcggtatctgcccaagggattcctcaatcagtttaccgaggataaaccaacgctgaatttcttctatcaacaggttaaatcagactacatgcttgagatagctgatcaagtggaccaggagattgccctcaaattggggtgcctcgaaatacggaggtcttactgggaaatgcgcggaaatgcgttagagaaaaagagcaattatgaagtgcttgagaaggacgtcggcttaaagcgcttctttccaaaatcactgctcgacagcgtgaaagcgaagactttgcggaaactaattcaacaaacctttcgtcaattcgccaaccttaaccgggaggagagcattttgaaattcttcgagattcttagcccggtgtacagattcgataaggagtgttttaagtgtgcccttggcagttcttggattatatccgtcgaactggctatcggtcccgaggaggggatctcatacctgacagacaagggatgcaatcctacacaccttgcagattttactcaagtccagaccattcagtacagcaactccgaggacaaagaccgcaaagggatgttacagcttaagattgcaggtgccccagagccacttacggtcactgccccatcacttaccatagcggaaaatatggctgatctgatagatgggtactgccgcctcgtaaacggtactagccagtcctttataattcggcctcagaaagagggtgagagggccctgccaagtatcccaaaattagccaattccgagaaacagggcatgcgcactcacgccgtctcagtgtccgagacagatgattacgctgagataattgatgaagaggatacatataccatgccgagcaccagggattacgaaatccagagggagcggattgagctgggtaggtgcataggtgaaggacagttcggagatgtccatcagggcatttatatgagccctgaaaacccagctttagccgtagccatcaaaacatgtaaaaattgcacctcggactccgtccgagagaaatttctgcaagaggcgctgactatgagacagtttgaccacccccatattgtgaagctgataggggtcattaccgagaacccagtgtggataatcatggagctctgcacgctgggagagctgcgctcattcctgcaggtgcgcaagtactcccttgatctggctagtctgatcttgtatgcataccaactgagcacagctcttgcctatttagaatcaaagaggtttgttcaccgggatatagccgctcgaaacgtattggtttcttccaacgattgcgtgaagcttggcgacttcggactgtccaggtacatggaagactccacatactataaagccagcaaaggtaaactgccaattaaatggatggcacctgagtccatcaatttccgcagatttacctcagcttccgacgtgtggatgttcggcgtgtgcatgtgggagattctgatgcacggagtgaagccattccaaggcgtaaaaaataacgatgtgattggtcgcatcgaaaatggtgaaaggcttcccatgccccctaactgccctccgaccttgtacagtcttatgaccaagtgctgggcatatgaccccagcagacggccacggttcaccgaactgaaggcgcagctttctacaatcttggaggaagaaaaagcccagcaagaagagaggatgcgcatggaatcgagaaggcaggctacagtctcctgggactccggcggatcagacgaggcaccccctaaaccctcacgccctggctacccatcacctagatcatctgaagggttttatccttccccgcaacacatggtgcaaaccaatcactatcaggtgtctggctacccaggatctcacggaatcacagctatggcgggttccatctacccaggccaggctagtcttttggatcaaaccgattcctggaatcatagaccacaagagatagctatgtggcagcctaacgttgaggatagcactgtgttagatcttagaggaatagggcaggtgctccctacacatctgatggaggagcgacttatccgacaacagcaagaaatggaagaggatcagcgctggttggagaaggaggaaaggttcctcaagcccgacgtgcggcttagtcggggaagcatagatcgcgaggacggctccctacaaggaccaataggaaaccagcatatctaccagccggtgggtaagcctggaaaggaagagaaaaattgggccgaacggaaccccgctgccccacctaagaaacctccacgcccaggagcaccgggtcaccttggcagcctggcctcgctatcatcccctgccgatagctacaacgaaggcgtgaagcctaaccagctccagccacaggagatctcccccccaccaactgctaatctggatagaagcaacgacaaggtctatgagaacgtcactgggctggtgaaagcagtgatagaaatgagcagcaagatacagccagcacccccagaggagtacgtacctatggtcaaggaagtaggcctggctctgcgcaccctgctcgctaccgtggatgaaaccatccctttactgccagcttccacacaccgagagatcgagatggcccagaaactactgaactccgaccttggcgaactcattaacaaaatgaaattagcacagcagtatgtcatgacatccctgcaacaggagtacaagaagcagatgcttactgccgcacacgcactggcggttgatgccaaaaacctgctggatgtgattgatcaggcaaggctcaagatgctggggcaaacaagaccacattag

SEQ ID NO: 30389 - DNA, 2253 bp, Artificial Sequence
  Description of Artificial Sequence: Synthetic coding sequence
atggccgatctgatagacggatattgtcgcctcgtgaacggcactagccagtccttcattattaggcctcaaaaggagggcgagcgcgcactgccttctattcctaaacttgcgaatagtgaaaaacagggaatgcgtacacatgctgtgtccgtctctggggttagccactgtcagcataaggttaaaaaagccaggaggttcctgcctctggttttttgttcccacgatcctccctcaaccgacgagatcagcggtgatgaaacagacgactatgcggaaattatcgatgaagaggacacctataccatgccaagcacacgcgactacgagattcaaagagagaggatagagctgggccgatgcattggtgagggccagtttggcgacgtgcaccagggtatttacatgtcaccagagaaccccgcattggcagtcgcgataaagacatgcaaaaactgcacaagcgacagcgtgcgtgagaaatttttgcaggaggcgttgaccatgcgtcaatttgaccacccacatatcgtcaagctgatcggcgtcatcacggaaaatccagtctggatcatcatggaactctgcaccctgggggagctgcggtctttcctgcaggtacgaaaatatagtctggacctggcttccttaatattgtacgcttaccagttgagtacagctctggcttacctggagtctaagcggttcgtgcaccgcgacatcgcagcacggaatgtgttggtgtcgagcaacgattgcgtcaaattgggcgacttcggcctctcaagatacatggaagactctacatactacaaggcgagcaaggggaagctccccatcaagtggatggctccggaaagtatcaactttcgacggttcacatctgcctcagacgtgtggatgttcggagtgtgtatgtgggagatattaatgcatggagtgaaaccatttcagggcgtcaagaataacgacgtcattggtcggattgaaaatggcgagaggctcccaatgccccctaactgtccccctactctgtactctctcatgactaagtgctgggcttacgacccctctaggcgacctaggtttacagagctcaaagcacagctgtctaccatccttgaagaggaaaaagcccagcaggaagagaggatgagaatggagagccgacgccaagccactgtctcctgggactcggggggatcagacgaagcacccccaaagccaagtcggcctggatacccatccccacgcagctccgagggattctatccctccccacagcacatggtccagaccaatcactaccaggtgtcgggctaccccggttcccatggcatcaccgctatggcgggatccatttatcccggacaggcatccctgctggaccagacagacagctggaatcaccgccctcaggaaatagcgatgtggcaacccaacgtggaggactcaaccgtgttagatttgcgcggtataggtcaggtactgcctactcacctcatggaggaaagactcattagacaacagcaagagatggaggaggaccaacggtggctcgagaaagaggagcgatttctgaaaccggacgttagattatccagggggagcattgaccgcgaagatggctctctccaaggccctatcggtaaccagcacatctaccagcccgtggggaaaccagatcctgctgccccacctaagaagcctcctcgacctggggcaccagggcacttgggttcactggcaagcttaagttcacccgctgacagttataacgaaggggttaaaccatgtcgactgcagccacaggaaatttcaccacctccgacggccaatttagacaggagcaacgataaggtttatgaaaacgtgacaggtctggtaaaggccgtgatagaaatgagcagtaaaatccaacccgctcctcctgaagagtacgtgccaatggttaaagaggttggtttggccctgcgaacattactcgcaaccgtggacgaaaccatccccttactgccagcttccacacatagagaaatagagatggcacagaagttactgaacagtgatcttggggaactgataaacaaaatgaagctggctcaacagtatgtgatgacctcgctgcagcaggaatacaaaaaacagatgctgaccgccgcacatgctcttgctgtggatgcaaagaatttacttgacgtgatcgatcaggctaggctgaaaatgctggggcagactagacctcactag

SEQ ID NO: 30390 - DNA, 1089 bp, Artificial Sequence
  Description of Artificial Sequence: Synthetic coding sequence
atgagaatggaatcaagacgtcaagccactgtgtcctgggacagcgggggtagtgacgaagcccctcctaagccctcgcgcccaggataccctagtccaaggtcatcagagggcttttacccatccccccagcatatggtgcagacaaaccattatcaggtgtccggctaccccggttctcatggcattacagctatggccggaagtatttaccccggacaggcaagtttgctggatcaaaccgattcctggaaccatcgcccacaggagatcgcaatgtggcagcccaatgtggaagactcaacagtgctggatctgcgcggaatcgggcaagttctgcctacccacctgatggaggaaaggctaattcgccagcaacaggagatggaagaggaccagcgttggctcgagaaagaggagaggttcctgaagcctgacgtgagactgagtcggggaagtatcgacagggaggacggatctttacaggggccaatagggaaccagcacatatatcagcccgtaggcaaacccgatcctgctgccccaccaaagaagcctcccaggccgggagcacctgggcacctgggaagtttggcttccttgtctagtcccgctgattcctacaacgagggagtgaagttgcagcctcaggagatctccccccctccaaccgcgaatcttgacagaagtaatgacaaagtgtacgagaacgttaccggcctggtaaaagctgtcattgaaatgtcaagcaaaattcaacctgctcctcccgaagagtatgtgccaatggtgaaggaagtcggcctcgctcttagaactcttctggccacagttgacgagactatcccactcctgcccgcatccacccaccgggaaattgagatggcacagaaactgctgaacagcgatctgggagagcttattaacaagatgaagctggcacagcaatatgtcatgacatccctgcagcaggagtacaaaaagcagatgctcacagcagcgcacgccctcgctgtggacgcaaagaatctgctggatgtcatcgatcaggcgcgtctgaaaatgctgggccagacacgcccacattag

SEQ ID NO: 30391 - DNA, 354 bp, Artificial Sequence
  Description of Artificial Sequence: Synthetic coding sequence
atggcagctgcatatctggatcccaacctcaaccacactccaaatagctctaccaagacccacctaggcaccggtatggaaagaagtcctggcgcaatggagagggtgctcaaggtgttccactacttcgaatctaatagcgagcctaccacatgggctagcatcattaggcacggcgacgcaaccgacgtgagggggatcattcagaagattgtggactctcacaaagtgaaacacgtcgcatgctatggattccggctctcccatctcagaagcgaggaggtccattggctacatgtcgacatgggagtgagttctgtgcgggaaaagtacgagctggctcaccctccctag

SEQ ID NO: 30392 - DNA, 3291 bp, Artificial Sequence
  Description of Artificial Sequence: Synthetic coding sequence
atgctgctggagctagcaggccaggaagcccttaagcctgctggggctatatatatggagaaatctgggtgttcgcctttcccggtatgttgggccaaagagtatgaccgctacctggcctcatctaaaattatggccgcagcttacctggatccaaacctgaaccatacgccaaacagcagcacgaagacacatctgggcaccggcatggaaaggtccccaggggctatggagagagtgctgaaagtgtttcattacttcgaatctaatagcgagcctaccacctgggcctccattattaggcatggggatgcaaccgacgtgcgaggcatcatccagaagatcgtggactctcataaggtgaagcatgtggcatgctacggattcaggctttcacacctccggagtgaggaggttcactggttacacgtagatatgggagtttcctctgtgcgagaaaaatatgagctggcccacccgccagaggagtggaaatatgagctcaggatccggtacctgcctaagggctttctgaatcaattcacggaggacaagccgactctgaattttttttaccaacaggtcaagagcgactatatgctggaaatcgctgatcaggtggaccaggagattgccctgaagctaggttgtctcgagatacgcaggtcctattgggaaatgagaggaaatgccctggagaagaaatctaactatgaggtcttggaaaaagacgttgggctgaaaagattcttccctaagagccttctggattcagtgaaggccaaaacactgcgcaagttgattcagcagacatttcgtcagttcgctaacctgaaccgcgaagaatcaattctgaagttctttgaaattttatccccggtgtacaggtttgacaaagagtgttttaaatgtgcgctggggagcagctggatcattagcgttgaactcgcaatcggtccagaggagggcatcagctatttgacagataaagggtgtaaccccactcatctggctgatttcacacaggttcagaccatccagtacagtaacagtgaagacaaagacagaaaaggcatgcttcagctgaagattgccggagcccctgagccactcacagtgaccgccccttctctgaccatcgccgagaatatggccgacctgatcgatggatattgtagactggttaacgggacatcgcagagctttattattagaccacagaaggaaggagaacgcgctctccccagcatcccaaagctggccaatagtgaaaagcagggtatgagaacccacgctgtgtctgtctcagagacggatgattacgctgaaatcattgacgaggaggacacatacactatgccctctacgcgtgattacgaaatccaacgggagcggatcgaactgggacgctgcattggagagggtcaatttggcgatgttcatcaaggcatctatatgtccccagagaatcccgctctggctgtagccatcaagacatgcaaaaactgtacctccgatagtgtccgggagaagtttctgcaggaggcactgactatgagacagtttgatcatcctcacatcgtgaagctgattggcgtgattacagagaatcccgtatggataattatggaactttgcaccctaggggagttgaggtcgtttctacaggtaagaaagtactccctggatttagcctccttgattctctatgcatatcagctatccactgccttagcctatctagagtctaagaggtttgtgcatcgggacatagctgccagaaatgttctagttagcagcaatgattgtgtgaagttgggcgattttggattgagtcggtatatggaagactctacttactacaaagccagcaagggaaagctgcccattaagtggatggccccagaatcaattaatttcaggagattcaccagcgccagtgacgtgtggatgttcggcgtttgcatgtgggagatactgatgcacggcgttaagcctttccagggcgtgaagaataatgacgttatcgggagaatcgagaatggggaacggctccccatgcctcccaactgccctccaactctgtacagtcttatgacaaaatgctgggcctacgatcctagcagacgacctaggtttactgaattaaaggcccagctgtcaaccattctggaggaggagaaggcccaacaagaagagcgcatgagaatggagagtcgtcggcaggcgactgtctcatgggactcgggcggttctgacgaggccccacccaagcccagtcgccctggatatccgagcccaagatcctccgaagggttttatccatccccccagcacatggtgcagacaaatcattatcaggtctccggttatcccggatcccatggaatcaccgctatggcaggatcaatatatcctggacaagcatcattgcttgatcaaacagacagctggaatcatcggccacaggagattgcaatgtggcagccgaacgtggaggatagcactgtgctggatctgaggggcatcggccaggtactcccaacacatctgatggaggagcgtctgattcgacagcagcaggagatggaagaggaccagcggtggctggagaaggaagagaggttcttgaagcccgacgtcaggttgtcccggggatccattgatcgcgaagatggcagcctgcaagggccaatcggtaaccagcatatctatcagcccgtcggcaaacctgatcctgccgcaccccctaaaaagcctcctagaccgggagcgccaggtcatctggggtctctcgcctctctgtcatcaccagccgactcttacaatgagggtgtgaaactccaaccgcaggagatatccccaccacctacagccaaccttgaccgtagcaacgataaagtctatgagaatgtgaccgggctggtgaaggcagtcatcgaaatgagctccaagattcagcccgctccccctgaggaatatgtgcccatggtgaaggaagtagggcttgcgttgcgaactctccttgctactgtggacgaaactattcccctgctgcctgcgtctacccaccgggaaatagagatggcccagaaacttttgaactcagacttgggtgagctaatcaacaaaatgaagcttgcacagcaatatgttatgacatccctacagcaggaatacaaaaagcaaatgctgacggctgcacatgccctggccgtggatgcgaagaacctgcttgatgtgattgaccaggccaggctgaagatgttggggcagacaagaccacattag

SEQ ID NO: 30393 - DNA, 3291 bp, Artificial Sequence
  Description of Artificial Sequence: Synthetic coding sequence
atgctgcttgaattagccggtcaagaagctttaaagcccgctggggctatttatatggagaagtccggatgtagcccttttcctgtgtgctgggccaaagaatacgataggtacctggcatcttcaaaaatcatggccgcagcttatctggaccctaacctgaatcatactccaaactcgagcaccaaaacccacctgggcaccgggatggagcgatccccaggagccatggaacgggtcttgaaagtgttccactatttcgaatccaattccgagcccaccacctgggccagcatcattcgccatggcgatgccaccgacgtccgagggatcattcagaaaatcgtggatagccataaagtcaagcatgtcgcctgctacggattcaggttatcccacctgcggtctgaggaggtacattggttacatgtcgatatgggagtatccagcgtacgagagaagtatgagctggcacacccccctgaagagtggaaatacgaactgcgcatcagatatctgccaaagggattcctgaaccaattcaccgaagataaaccgacactaaattttttttaccaacaagtgaaatctgactatatgctggagatcgctgatcaagtggaccaagaaatcgctctgaagttgggttgcctcgaaattcgaaggtcgtattgggagatgcgcggaaacgccctggagaagaaaagcaattacgaagttcttgaaaaggacgttggcctgaagcgctttttccctaaaagcctgctcgactccgtgaaggcaaagactttgcgcaagttaattcaacagacttttcgccagttcgctaacctaaacagggaagagagcattctgaagttttttgagatactgtctccggtgtaccgctttgataaggaatgtttcaaatgcgcgctcggctcaagctggataatctccgtggagcttgcaatcgggcctgaggaaggcatttcttacctgactgacaaaggatgcaaccccactcacttagcagattttactcaggtgcaaactatccagtactctaatagcgaagataaagatcgcaagggcatgctgcaattaaagattgccggagccccagagccactcaccgtcacagctccatcactgacaatcgcggaaaatatggccgacctgatcgacggatactgccgtctggtgaacggtactagccaatcttttatcatccgtccacaaaaggaaggagaaagagctttgcccagtatacccaaactggctaatagcgagaaacaagggatgcggacccatgcggttagcgtgtccgaaaccgatgattacgctgagatcatcgatgaggaggacacctacaccatgccatcgacccgggattatgagattcagagagagagaatcgaactgggcagatgcattggagagggtcagttcggagatgtgcaccagggtatttatatgagcccagagaaccctgctctggccgttgctataaagacatgcaagaattgcacttctgactccgtccgcgaaaagttcctccaagaggccctcactatgcgacagtttgatcacccccatatagtaaaattaatcggggtgattacagaaaatccggtctggatcatcatggaactatgtaccctcggtgagcttcgatccttcttgcaagtacgcaaatacagcctagatctggcctcactgatcctttatgcttaccagctgagtaccgctttggcctatcttgagagcaaacgattcgtacaccgggacattgccgctcggaatgtcctggtgagttccaatgactgcgtcaaactgggtgactttgggctgagtaggtacatggaagactccacatactataaggcatccaaaggcaagctgccaattaagtggatggcccctgagagcatcaattttcggagattcacctctgcctctgatgtgtggatgtttggagtgtgtatgtgggagatcctgatgcacggagtgaagcccttccaaggggtgaaaaacaacgatgtgatagggagaatcgaaaacggtgagcgactgcctatgcctcccaactgcccgccaaccctgtatagcctcatgaccaaatgttgggcctacgacccatcccgcagaccacggttcacagagctgaaggcccaattaagcactattctggaagaggagaaagctcaacaggaggagcgcatgcgaatggagagccgaaggcaagcaacagtctcatgggacagcggtgggtccgacgaggctcccccaaagccttctcgaccagggtaccctagccctcgatcttcggaaggtttctacccgagtcctcaacacatggtgcaaacgaaccattaccaggtttcgggttatcccggaagccacgggattaccgcaatggccggttctatctaccccggacaagcatctctgcttgaccaaacggattcatggaatcatcggcctcaggagatcgctatgtggcagcctaatgtagaggactccactgtcctagatctgcgaggcatcggacaggttctgcctacccacctgatggaagaaagactgatccggcagcagcaggaaatggaagaagatcagagatggttggaaaaggaggagaggttcctgaaacctgatgtccgcctctctagagggtcaatcgacagagaagacgggtcacttcaagggccaatcgggaaccagcacatctaccagccagtcggcaagcctgatccagccgctccgcctaaaaagcctccacgccctggcgcaccaggtcatctgggctccctggccagtctcagctcccctgcggactcctacaacgaaggcgtgaagctgcagccacaagagatctctccacccccaacggcaaacctcgacaggagcaacgataaggtgtatgagaatgtcacagggctcgtgaaggcggttatcgagatgagtagcaaaattcaacctgctccacctgaagaatatgttcctatggtcaaagaggtcggactagcgttgcgcacacttctcgccacggtagatgagacaataccgctcctgcccgcaagtacacatagggagatcgaaatggcccaaaagctgctgaatagtgatctaggggaactgattaacaagatgaagcttgcccaacagtatgtgatgacctcgctgcagcaggagtacaagaagcagatgctcacagctgctcacgcactggccgttgacgctaaaaacctactcgacgtcatagatcaggccagactgaaaatgcttggccaaacgcggcctcactag

SEQ ID NO: 30394 - DNA, 2043 bp, Artificial Sequence
  Description of Artificial Sequence: Synthetic coding sequence
atgaaataccaggaagtgaggtgtctgacctcattcaacataagtgtgagttttcccgctgaaactgatgactatgctgagatcattgatgaagaggacacctacaccatgccctctacgcgggattatgagatacagcgagagcgcatcgagctcggccgttgcataggagagggacagtttggtgatgtccatcagggcatttacatgtcaccagaaaacccagccctcgcggttgcaattaagacgtgtaaaaactgtacctcggactccgtgcgggagaaattcctacaagaggcactgaccatgcgacagttcgaccacccgcacatcgtgaaattaattggggtaatcacggagaatcccgtctggataattatggaactgtgcaccctcggggaactgaggagctttctgcaggttagaaagtattctctggacttggcctccctgatcctttacgcctaccagttatcaactgctttagcttatctcgagagcaagcgattcgttcatcgcgacattgcggcaagaaatgttctggtgagttccaacgactgtgtgaaactgggcgatttcggactatcaaggtacatggaggactctacttactacaaggctagtaagggcaagctaccgattaagtggatggcgccagagtcgattaacttccgccgtttcaccagcgcaagcgacgtctggatgtttggagtctgcatgtgggaaatacttatgcacggagtgaaaccattccaaggcgtgaaaaataatgatgtgattggacgcatcgaaaacggtgaaaggctgcccatgccaccaaactgtccacctactctttacagtctgatgacgaagtgctgggcttacgacccaagccgacgaccaaggttcacagagttaaaagcacagctgtcaaccatactcgaagaggaaaaagcacaacaagaggagcggatgcgaatggagagtcggcgacaggcaaccgtgtcttgggatagcgggggatcagacgaggcaccgccaaagcctagtagacctgggtatcccagcccacggagctctgaaggcttctacccctccccccagcatatggtacagaccaaccattaccaggtgagcgggtatcctggatcccatggcatcaccgcaatggcaggctcaatttatcctgggcaggcctcactcctcgaccaaaccgattcatggaaccataggcctcaggaaattgccatgtggcagccaaacgtggaagatagcactgtcctcgatcttagggggatcgggcaggttctgcccacacatttaatggaagagcggctcattcgtcagcagcaagagatggaggaggatcagaggtggctggaaaaagaagagcggttcctgaagcctgatgttcgcctgtctagaggcagtattgaccgggaagatggctccctccagggtccaattggaaatcagcatatttaccagcccgtaggcaaaccggaccccgcagctccaccaaaaaaaccccctagaccaggagccccaggccacctgggctcactcgcctccctgagcagccctgcagattcctacaacgaaggggtgaaactccagcctcaggaaatctcaccgccacccactgctaatttagacaggtctaacgacaaagtgtatgaaaacgttaccggcctggtgaaggcggtgattgagatgagttccaaaatacaacccgcaccccctgaggagtacgtccctatggtgaaagaggtggggttagcccttaggacactcttagctactgtggatgaaaccatccccctgctaccggcaagcactcacagagagatcgaaatggcacaaaagcttcttaattccgacctcggcgaactgattaataagatgaaattagcccagcagtatgtgatgacttccctgcaacaggaatataagaagcaaatgctgactgcagcccatgctctggcagttgacgccaagaacctgttggacgtcatcgaccaggccagactcaagatgctaggtcagacccgcccacactag

SEQ ID NO: 30395 - DNA, 3054 bp, Artificial Sequence
  Description of Artificial Sequence: Synthetic coding sequence
tgatatgaccgctatctcgcctctagcaagattatggcggcagcctaccttgatcccaacttgaaccacacaccaaactcttctaccaaaactcatctcggaacaggcatggagcgcagtcccggagccatggagcgcgtcttaaaggttttccactactttgaaagcaacagcgaaccaaccacatgggccagcataatccgtcatggcgatgcaaccgacgtgcggggtatcatccagaaaattgtggattctcataaggttaagcatgtcgcctgctatggctttcgtttatctcacctgcgcagcgaagaagtccattggctgcacgttgatatgggcgtgagtagcgtgagggagaaatatgaactcgctcaccccccagaggaatggaagtacgaactccgtatacggtacctgccaaaaggattcctgaaccagtttacagaggacaaaccaacattgaactttttttaccagcaagtgaaatctgactacatgctggaaatagccgatcaggtggaccaggaaatcgcgcttaagttgggctgcctggagatccggaggagctactgggagatgcgcggaaacgcactcgagaaaaagtcaaattacgaggtactcgaaaaggacgtgggccttaagcgctttttccccaaaagtttattagactccgtcaaagccaaaacacttcgcaagttgatccaacagactttccggcagtttgcaaacctaaaccgggaagaaagcatcctcaaattttttgagatcctgtccccagtctaccggttcgataaggaatgtttcaagtgtgcactgggttctagttggattatcagcgtggagctggcgattgggccagaggaggggattagctacctgactgacaaggggtgcaatcccacgcacctggccgactttactcaagtccagaccattcaatattctaacagcgaagacaaggacagaaagggaatgctgcagttgaaaattgctggggcaccagagcctttgacagtgactgccccatcactgacaatagcggaaaatatggcggatctgattgatgggtactgcagacttgtgaacggcacttctcagtctttcatcattcggccacagaaagagggtgaacgcgcactgccaagtatccccaagctagccaattctgagaagcagggaatgcgcacccacgcagtttctgtgtctgaaactgacgattatgctgagatcatcgatgaggaagatacttatacgatgccatccacgagagattatgagatccagcgagaaaggatcgagttgggacgctgtatcggcgagggtcagtttggagatgtccaccagggcatttatatgtctcctgagaatcccgctttagccgtggctataaagacctgtaagaactgtacaagtgactcagttagagagaaattcctccaggaagctctgacgatgagacaattcgaccatccacatatcgtcaagcttattggggtgatcaccgaaaatccggtgtggattattatggagttgtgcacacttggcgaacttcgaagcttcctgcaagtgcgtaaatacagcttagacctggcatccctgattctttatgcatatcaattgtccacggcgctggcatacctggaaagcaaaaggttcgtccatagagatatcgctgccaggaacgttctggtttcctccaacgactgcgtcaagctaggagactttggcctctccaggtacatggaggattccacctattataaggcttcaaaaggcaaactgccaattaaatggatggccccagaatctatcaattttcgcaggttcacgtctgctagcgatgtttggatgttcggagtatgcatgtgggagatattgatgcacggggttaaaccatttcaaggcgttaaaaataatgacgttattggcagaatcgaaaatggtgagagactgcctatgcctccaaactgtcccccaactctttattcccttatgacgaagtgttgggcttatgacccgtcacgaaggcctagatttacagagctgaaagcccagctgagcactattttggaggaagaaaaggcacaacaggaagaacgtatgcgcatggagtcacgcagacaggccactgtgtcctgggattccggtggaagcgacgaggcaccccctaaaccctctaggccaggttaccctagtcccagatcatctgaaggtttttacccttccccacaacatatggttcagaccaaccactaccaggactccaccgttcttgatctgaggggcattgggcaggttcttcccactcatctgatggaggagcgccttatccgccaacagcaggaaatggaggaggaccagcggtggttggagaaggaagaaaggtttttaaagccggacgtgcgactctctcgaggatctattgaccgggaggacggttctttacagggaccaatcggaaaccagcatatctatcagcctgtgggaaaacctgatcctgctgcccctcccaagaagcccccacgcccaggcgcacctggccacctcggctctttggccagcctgagtagtcccgctgattcctacaacgagggcgtcaaattgcagccgcaagaaatctccccccctcctaccgccaatctggatcgatcaaacgacaaagtttatgaaaatgttacaggactagttaaggccgtgattgaaatgtcttccaaaatacagccagccccacccgaggagtacgtgccaatggtgaaggaggtgggccttgcactccgcaccttattagcaactgttgatgagaccataccattgttacccgctagcacccacagggagattgagatggcccagaagctgctcaattctgatctgggtgagttaattaacaagatgaagcttgctcagcagtacgttatgacatccttacagcaggagtataagaagcagatgttgacagctgcccacgccctcgccgtcgatgctaaaaacttactggatgtcatcgaccaggctcgcctgaagatgttgggccagaccaggccccactag

SEQ ID NO: 30396 - DNA, 354 bp, Artificial Sequence
  Description of Artificial Sequence: Synthetic coding sequence
atggccgctgcgtacctcgatcctaacctgaaccacacaccgaatagctctacgaaaacccatctagggactgggatggaaaggtcaccgggagccatggaacgggtgttaaaggtcttccattatttcgagtctaatagcgagcctaccacatgggcttccataatacggcatggcgacgctaccgatgtccgtggcataatccaaaagatcgtggactcacacaaagtgaaacatgtcgcgtgctatggcttcaggctcagccatctcagatccgaagaggttcactggcttcacgtcgacatgggagtctcatccgtgcgcgagaagtatgaacttgcccatcctccatag

SEQ ID NO: 30397 - DNA, 471 bp, Artificial Sequence
  Description of Artificial Sequence: Synthetic coding sequence
atggctgccgcatacctggacccgaatctcaaccataccccaaattcgtccaccaaaacgcacctgggtacgggcatggagcgtagccccggagccatggaacgggtgctgaaagtcttccactacttcgaatcaaattctgagcccactacttgggccagcattattcggcatggggatgccaccgacgtcagaggaataattcagaaaattgtagacagtcacaaagtgaaacatgtcgcttgctatggcttccggctgtcccacttgcgcagtgaagaggtccattggctacatgtggacatgggcgtgagcagtgtccgcgaaaaatatgaactggctcacccgccagaggaatggaagtacgagcttagaattagatatctgccaaaagggttcctaaaccaatttaccgaagacaaacctacactcaactttttctaccaacaagtgaaaagcgactacatgtag

SEQ ID NO: 30398 - DNA, 3159 bp, Artificial Sequence
  Description of Artificial Sequence: Synthetic coding sequence
atggcagccgcttacctcgatcccaatctcaatcatactcccaatagcagcactaaaacccacctggggaccggcatggaaaggagccctggcgcaatggagagggtgctaaaggtgtttcactatttcgagtcgaattccgagcctaccacatgggcctcaatcatcaggcacggagatgcaactgatgttcggggaatcatccagaaaatcgtcgatagtcacaaggttaagcatgtggcgtgctacgggtttaggctgtcccatctcagatccgaagaagtgcattggctacacgtggatatgggagtgagtagcgtgagagagaagtacgagctagcccaccctccagaagagtggaagtacgaactgagaattcgttacctccctaaaggtttcctgaatcagttcaccgaggacaagcccacactgaacttcttctaccagcaggttaagtcagattatatgttagagattgctgaccaggtggaccaagagattgccttaaaactcggttgcctggagatccggaggtcctactgggagatgcgaggcaacgccctggaaaaaaaaagtaattacgaggtgctcgagaaagacgtggggctgaaacgtttttttccaaaaagtctgttggattctgtcaaggcgaagacgcttcggaaactgatccagcaaacgttccgacagttcgcaaacctgaatcgcgaagagtccatacttaagttctttgaaattctatccccggtgtacaggttcgacaaagagtgttttaagtgtgcactggggtcttcgtggattatttccgttgagctggctatcggaccggaagagggcatcagctatctgaccgacaaagggtgtaacccgactcatcttgccgactttactcaagtgcagacaatacaatattctaactcagaagacaaggatcggaagggcatgttgcagctcaagattgcgggagccccagaaccactcaccgtcacagccccaagtctcacaattgccgagaacatggccgaccttattgacgggtactgtcgcctcgtaaatggaacaagtcagagtttcatcattcggcctcagaaggagggggagcgcgctttaccgagtattcccaaacttgctaattcggaaaagcagggtatgcggacccacgcagtgtccgtctctgagacagatgattatgccgagataatcgacgaagaggatacttatacaatgccttccactcgtgactatgaaatacaacgggagaggatagagctgggccgatgcatcggcgagggacagtttggggatgtacatcagggtatctatatgtcccccgagaacccagctctggccgtggcaattaagacttgtaagaactgtaccagtgatagtgtgcgagaaaaattcctccaggaagcacttaccatgcggcagtttgaccatccccacatcgtgaaactgatcggtgtgattaccgagaatcctgtttggataatcatggaattatgcacgctaggagagctgcgcagcttcctgcaggtccgcaagtactcactggatcttgcatcactgattctgtatgcgtaccagctgtcgacagctctggcttacctggagagcaagcggtttgtgcaccgcgacatagctgccagaaatgttctggtttcatctaatgattgcgtgaagctgggcgatttcggactctccagatatatggaagactccacatactacaaggcgagcaaaggaaaacttccaatcaaatggatggctccagaatctatcaactttagacgattcacctcagcttcagacgtctggatgttcggagtatgcatgtgggagattctgatgcatggcgtgaaaccttttcagggagtaaagaataatgatgtcattggcaggatcgaaaacggagaacggctaccaatgccaccgaactgtccccctaccctttacagcctgatgacaaagtgttgggcctacgatccttcgcgcagacctcggtttactgaattaaaggcacagctgagcacaatcctggaagaagagaaagcccagcaggaggagaggatgaggatggagtcaaggagacaggcaacagtaagttgggactctggaggctctgatgaggcacctcccaagccctcccgcccaggctatccatcccctcgctctagtgaaggtttttacccaagtccacagcatatggtccagaccaatcactaccaggtgagcgggtatcccggaagccatggaattaccgctatggccggatccatttaccccggacaggctagcttattggatcagacagattcctggaaccatcggcctcaagaaatcgccatgtggcagcccaatgtggaggatagcactgtactcgatctccgcggaattggacaggtactccccacgcatctcatggaggaaaggctgattcggcagcaacaggaaatggaagaagatcagaggtggctggaaaaggaggagcgctttcttaagcccgatgttagattatcgcgaggatccatcgacagggaagatggttctttgcagggacctattggaaaccagcacatctaccagcctgttggcaaacccgacccagctgctccccctaagaagcctccacggcctggggcacccggacacctcggatcattggcctcactgtcgagccccgcagatagctataacgaaggggtaaaactccagccgcaggagatttccccgcctcccacagctaatctggaccggtctaacgacaaggtgtacgagaatgtcaccggcctcgttaaagccgtgatcgaaatgtctagcaagattcagcctgcgcctcctgaagagtatgtgccgatggtaaaggaggtggggctggctctgcgcaccctgttagccaccgtcgacgagactatacccctacttccagcttctacacatagagaaatagaaatggcccagaagctcctgaactccgacctcggcgaattaataaacaaaatgaagctggcccaacagtacgttatgacaagcctgcaacaggagtataaaaagcagatgctcacggcggctcatgccttggctgtggatgctaaaaatctgttagatgtcatagaccaagccaggctgaagatgctgggccagacaaggccacactag

SEQ ID NO: 30399 - DNA, 198 bp, Artificial Sequence
  Description of Artificial Sequence: Synthetic coding sequence
atggccgctgcctatctggaccccaatctcaaccacactcccaactcctctactaagacacacctaggtactggaatggagcgctcccctggcgcaatggagagggttctgaaagtgttccattactttgaaagtaattctgagcctaccacctgggcttccattattcgccacggcgacgccaccgacgtgcgctag

SEQ ID NO: 30400 - DNA, 324 bp, Artificial Sequence
  Description of Artificial Sequence: Synthetic coding sequence
atggcggcagcctatctcgatccaaatttaaatcatactccaaattcttccacaaagacccacttgggaactggcatggaacgctcaccaggagctatggagagagtgttgaaggtattccattattttgaatcaaatagcgagccaacaacctgggcatctatcatccgccacggagacgccactgatgtcagagggattattcagaagatagtggatagccataaggtgaaacatgtcgcatgttacggtttcagactgtcacacttgagaagcgaagaggtgcactggctgcacgtagatatgggtgtgtctagtgtgtag

SEQ ID NO: 30401 - DNA, 360 bp, Artificial Sequence
  Description of Artificial Sequence: Synthetic coding sequence
atggccgctgcatatctagaccccaatcttaaccacacgccaaactcatcgactaagacccacctggggacggggatggagaggtctcccggagccatggagcgggttctcaaagtcttccactattttgagtccaattctgaaccaacgacatgggccagcattattcgccacggtgacgccacggacgtcagagggatcatacagaagatcgtagacagccacaaagtgaaacatgtcgcatgctacggattccgtctaagccaccttaggtcagaagaagttcactggttgcatgtggacatgggtgtcagctcggtacgggagaagtacgagcttgctcaccctcctgaggagtag

SEQ ID NO: 30402 - DNA, 2262 bp, Artificial Sequence
  Description of Artificial Sequence: Synthetic coding sequence
gcagagaacatggcagatcttatcgatggctattgccgtctggtcaacggaacaagtcagagctttattatcagaccccagaaagaaggcgagcgtgcactcccaagcatccctaagctggccaatagcgaaaagcagggtatgcgaacccacgctgtgagcgtcagcggagtgtcacactgccagcataaagttaaaaaagctagaagatttttgcccctggtcttttgcagtcatgacccaccatcgaccgatgagatctcaggcgacgaaacagatgactacgctgaaattatagacgaggaggacacttatacgatgccgtccactcgagactacgagatccagcgcgagagaatcgagctcggcagatgtatcggtgagggtcagttcggggatgttcaccagggaatatacatgtctcctgaaaatcctgccctggctgtagccattaaaacttgtaaaaactgcacgtctgactcagtgagagagaaattcttacaagaggctctcaccatgcgacaattcgatcacccgcatatagtaaagctgatcggagtaatcactgaaaatccagtatggattataatggagttgtgcactctaggggagctgaggagctttttgcaggtgcggaagtattccctggatcttgcatcgttaatcctatacgcctatcagctttcgacagcgcttgcctatttggagagtaaacgcttcgtgcatagggatatcgctgctcgaaatgtcttggtgagctctaatgactgtgtaaaacttggcgacttcggcctttcgaggtacatggaagactccacctactacaaggcatcaaaagggaagttgcctataaagtggatggccccagagtcgatcaatttccggaggtttactagcgcaagcgatgtgtggatgttcggcgtgtgtatgtgggagatccttatgcatggggttaaacctttccaaggggtaaaaaacaacgacgtgattggccgtatagagaacggcgagagactgccaatgcctccaaattgtcctccaacactctattctctgatgacaaaatgctgggcatacgacccatcgcgacggccaaggttcacagaattaaaggctcagctatccactatcctcgaggaggagaaagcgcagcaggaggagcgaatgcgcatggagagcaggaggcaggcaacggtaagctgggacagcggcggatctgacgaggcacctccaaaaccatctagaccgggatacccctcgccgaggagttcggagggcttttaccctagccctcagcatatggtccagactaatcattatcaggtgtcgggctacccaggcagtcacgggatcacagccatggcgggatccatctatcccggacaggccagcttactggatcagacggattcctggaatcacaggcctcaggagatcgccatgtggcaacccaatgttgaagacagtacagtgctagacttgcgcggaatcggtcaggtcctacccacccacttaatggaagagagactgatcaggcaacagcaggagatggaagaggaccaacgctggctcgagaaggaggagagattcttgaagcccgatgtacggctgagccgaggtagcatcgaccgcgaggacggaagcctgcaaggcccaatcggcaatcagcacatataccagcccgtagggaaacccgacccagcagcgccacccaagaagccacccagacctggagctcccggacacctggggtctctggcctctctgtcctcccctgccgattcttacaacgagggggttaagccatggaggctgcagccccaggaaataagtccgccacctacagcaaatctagacaggtccaatgacaaggtctacgaaaacgtaaccggcctggtgaaggccgtcatagagatgtccagcaagatccagcccgctccccctgaggagtatgttcctatggtgaaggaggttgggctcgctctgcggaccctgcttgccacagtggacgaaacaatcccactcttgccggcttctacacatagagagatagagatggctcaaaaacttctgaactcagacttaggcgaactgattaataagatgaagctcgcccagcagtatgtgatgacatctcttcagcaggaatacaaaaagcagatgttgactgccgcacacgccctggctgtcgacgcaaagaacttactggacgtgatcgatcaggccagactgaagatgcttgggcagactaggccgcactag

SEQ ID NO: 30403 - DNA, 3159 bp, Artificial Sequence
  Description of Artificial Sequence: Synthetic coding sequence
atggctgctgcctacctggatcctaatttgaatcacacacccaactcgtccactaagactcatctcggcaccggaatggagcggtctccgggagccatggagcgagtcttgaaagtatttcactattttgagtcaaactctgagccgaccacatgggccagcatcatcagacacggagatgccactgatgtacgtgggattattcagaaaatcgtggattcacacaaggtgaagcacgtagcttgttatgggttccggctgagtcacctccggtccgaagaagtccactggcttcacgtcgatatgggggtgtcatcagtgagagagaagtatgagcttgcacatccccctgaagagtggaagtatgaactgcgaatcagatacctgccgaaagggtttctaaaccaatttaccgaggataaaccgaccctgaacttcttctaccagcaggtgaaatctgactatatgctggaaattgcagaccaggtggatcaagagatcgccctcaagctcgggtgcctggagattcggcgatcctactgggaaatgcgcggaaatgccttagaaaagaaaagcaactatgaggttctggaaaaggacgtgggcctgaagcggttctttccaaagtctctactagacagcgttaaagccaagacactgcgaaaactaatacagcagacctttaggcagtttgcaaatctgaatcgcgaggaatcgatactgaaattttttgaaattttgtctcctgtgtaccggttcgataaagagtgctttaagtgcgccttaggatcttcctggataatcagcgttgagctcgctataggccctgaagagggcatttcctatctaaccgataaggggtgtaatccaacccacctagcggatttcactcaggtacagaccatccagtactcaaacagcgaagacaaggacaggaaaggaatgcttcagctgaagattgcaggagcgcctgaacctttgaccgtcactgcgcctagtttgactattgcggaaaacatggctgacctaattgatggctactgcaggctggttaatgggacgtcccagtccttcataattcgccctcagaaggagggagaaagagccctgccaagcatccccaagctcgctaattctgaaaaacagggtatgcgtacacatgcagtgagcgtgtcagagaccgacgactacgcagagatcatcgacgaggaagacacttacactatgcctagcacgagggactacgagatccaacgagaaagaatagaactaggacggtgcattggagaaggtcaatttggagatgtgcaccaggggatctacatgtctcccgaaaatccggcactggcagtggctatcaagacgtgcaagaattgcacctccgacagtgttcgagaaaagtttctacaggaggccctcaccatgcgacaattcgaccaccctcacatagtgaaactgatcggtgtgatcaccgagaatcctgtgtggattataatggagttgtgcacactgggggaactccgttcattcctgcaggttcgtaagtattcacttgacctggcgtctctgatcctgtacgcctatcagttatctacagctctggcctatctcgaaagcaaaagatttgtccaccgggacattgcagcaagaaatgtgctagtgtcctcaaatgactgcgtcaaattgggtgatttcggcctgagccggtacatggaggattccacttattacaaagcttctaaagggaaactccccataaagtggatggcccctgaaagcatcaatttcagacgttttacgtcggcctccgatgtgtggatgtttggagtgtgcatgtgggagattttgatgcatggcgtcaagccatttcaaggggtgaaaaacaacgacgtgataggtcggatagagaatggagaacgtctccctatgcctcccaactgtcctcccaccttgtatagcctcatgacgaaatgctgggcctatgacccttcgagacggcctcgcttcacggaactcaaggcacagctgagcacaattctcgaagaggaaaaggcccagcaggaggaacgcatgcgaatggaatcccggaggcaggcgacagtctcctgggattctgggggatctgatgaagctcctccgaaacctagtaggccaggctacccaagtccgagaagctcggagggcttctaccctagccctcaacacatggtccagaccaatcattaccaggttagcgggtacccgggtagtcacgggatcacagccatggcaggctccatctatccgggtcaagcctctctgctcgaccagacagacagctggaatcacaggccccaggagatcgctatgtggcagcccaatgttgaggactccaccgtgctggacttgagaggtattggtcaggtgctgccaacccatttaatggaggaaaggctgatcaggcagcagcaggagatggaggaggatcagcgttggcttgagaaggaggaaaggttcctcaaacctgacgttagactgtcccgagggtctatcgatcgcgaagatgggtcactgcaggggcctattggcaaccaacatatctaccagcccgttggaaaacctgaccctgctgcaccacctaagaaacctcctcgaccaggcgcaccagggcatctgggcagcctcgcttccctgtctagtcctgcggatagctacaatgagggcgtgaagctgcaaccacaggagattagtccaccacctaccgcgaacctggacaggtcaaacgacaaagtgtatgagaacgtaacaggtctcgtcaaggctgtgatcgaaatgtcttcgaagattcaacccgctcccccagaagagtacgtcccgatggtcaaggaggtagggttagcactgcgcacgctcctggctacagtagatgagacaattccgttactgcccgcttcaactcatagagaaattgagatggctcaaaaacttctgaactctgacttaggtgagttgatcaacaaaatgaaactcgcccagcagtacgtgatgacatctctccagcaggagtataaaaagcagatgcttacagcagcccacgctttggccgtcgacgccaagaatttactcgatgtgattgatcaggctagattgaagatgctgggtcagactaggccccactag

SEQ ID NO: 30404 - DNA, 2175 bp, Artificial Sequence
  Description of Artificial Sequence: Synthetic coding sequence
atcgccgagaatatggccgatcttatcgacggttattgtaggctggtgaacgggacatcccaaagctttatcatacgaccccagaaagagggggagcgcgcactccccagcatcccaaaactcgcaaactccgaaaagcaaggaatgcggacgcacgcggtatcagtatccgagacagacgactacgctgaaatcatagatgaagaggatacctacaccatgcctagtaagtcttacggaatcgatgaggcaagagattacgaaatccagcgagagcgcatagagctaggcagatgtatcggggaagggcagttcggtgatgttcaccaaggcatttatatgtcgcccgagaacccagctctcgcagtcgcaatcaagacctgcaagaattgcacctccgattcggttcgggagaaattcctacaggaggccctcactatgcgacagttcgatcatccccacatagtgaaattaatcggggtaataaccgagaatcctgtttggattattatggagctgtgtacgctgggagaacttcgatccttcctgcaagtgcggaagtacagcctcgatcttgcgtccctgatcctctatgcttaccagctgtctactgccttagcataccttgagtcaaagagatttgtgcaccgggacatcgccgctcgcaacgtactcgttagcagtaacgactgtgtgaaactcggcgattttgggctgagcaggtacatggaggattctacctattataaggccagcaaggggaagctcccaatcaaatggatggcgccagagtccattaatttcagacgatttacatccgcaagcgacgtgtggatgttcggcgtgtgcatgtgggagattttgatgcatggggtgaagccattccagggagtgaaaaataatgacgtaattggccgaattgagaatggggagcggcttcctatgcctccgaattgtcctcctaccctgtattctcttatgacaaagtgttgggcctacgacccctctcggaggcccagattcaccgaacttaaggcccagctgtctacaatcctggaggaggaaaaagcccagcaagaggaaagaatgaggatggagtcgcggaggcaagcgacagtatcttgggacagtggtggctcagacgaggcccctcctaaacctagtcgcccagggtaccctagccccagatcatctgaagggttttatccatctccccaacacatggtccaaaccaaccactaccaggtgtcagggtatcccggatcccacgggataaccgcgatggctggttcaatctatcccggacaggcttcattgctcgaccagactgattcctggaaccacagaccccaggagatagccatgtggcagccgaatgtggaagactcaacagtacttgacttgcggggaataggccaagtcctcccaactcacctgatggaagagaggctgatcaggcagcagcaggagatggaggaggatcagcgatggctcgagaaagaagagcgcttccttaaacctgacgtgcggttgtcaagagggagtatcgacagggaggacggctcgctgcagggtcccatcggaaatcagcatatctaccagccagttggtaagcccgaccctgcggcaccacccaaaaagcctccccgtcctggagcaccaggacacttgggttccttagcatcgctatctagtcctgcagacagctacaatgagggggtgaaacttcagccccaggagatctctccacctccaaccgccaacctggatcggtctaacgataaggtatatgaaaatgtcactggactggtgaaggcggtaattgagatgtcctcaaaaattcagccagcaccacctgaagagtacgtaccaatggtgaaggaggtcggactggcactccgtactctgttggcaacggtagatgaaacgattccgctattgccggcatccacacaccgcgagatcgagatggcccaaaagcttctgaactcagacctaggagagctgataaacaagatgaaactcgcccagcagtacgtcatgacaagcttacaacaagaatataagaaacagatgctaactgccgctcacgccctggcagttgatgcaaaaaacctcctggatgtgatcgatcaagcaagactcaagatgctggggcaaacacgtccacactag

SEQ ID NO: 30405 - DNA, 363 bp, Artificial Sequence
  Description of Artificial Sequence: Synthetic coding sequence
atggcagccgcttatcttgacccaaacctcaatcacacacccaacagcagcacgaagacccatttgggcaccggcatggagcggtctccgggagctatggagcgggtgctgaaagtgtttcactatttcgaatcaaattctgaacccacaacctgggcctccattattaggcacggtgatgccacagacgtcaggggtatcatccaaaaaattgtcgatagccataaagtcaaacatgtagcttgctacgggtttaggctgagtcacttgcggtctgaagaagtccactggctgcacgtcgatatgggtgttagcagcgttagggaaaagtacgaattggcgcaccctcccgaggagtggtag

SEQ ID NO: 30406 - DNA, 156 bp, Artificial Sequence
  Description of Artificial Sequence: Synthetic coding sequence
atggcggctgcctatctagatccaaacctaaatcatacgcctaattcatcgactaaaacacatctcggtaccggcatggagcggagccccggtgccatggagagggtcctcaaagtgtttcattatttcgaaagcaactccgagccaaccacatag

SEQ ID NO: 30407 - DNA, 3021 bp, Artificial Sequence
  Description of Artificial Sequence: Synthetic coding sequence
atggcggcagcatatctcgatccaaatctgaatcacacacccaattcctcaacaaagacccatcttgggaccggaatggaaagatcccctggggcaatggagagggtccttaaggtgttccactattttgaaagcaactctgaacccacaacttgggccagcatcatcaggcatggggacgccacagatgtgagagggattatccagaagatcgtggacagtcacaaggtaaagcacgtggcctgctacgggtttcgccttagccatctgcggagtgaggaagttcactggctccatgtcgatatgggcgttagctccgtgagggagaaatacgagcttgcccaccccccagaggaatggaagtatgagctacgtattcggtatctgcccaaaggctttctgaaccagtttaccgaggacaagcctaccctcaattttttctaccagcaagtgaaaagtgactacatgttagaaatagccgaccaggttgatcaagaaatcgcgctcaagctaggttgcctggagattcgacgatcatattgggaaatgaggggaaacgccttggagaaaaaatccaactatgaggtactggaaaaagatgttggcctgaagcgcttctttcctaagtctctactggattcagtcaaagctaagacactccgcaagctgatccagcagacctttaggcagtttgcaaacctgaaccgcgaggagtcaatcctaaagttcttcgagattctcagccccgtgtataggtttgataaggagtgtttcaagtgcgctttggggagctcttggattataagcgtcgaactcgccataggccctgaagaggggatcagctacctgactgataaaggctgcaatcccacacatttggctgatttcacacaagtgcagactattcagtattccaactccgaggacaaagataggaagggaatgttacagctcaagattgccggtgctccagaaccccttacagtgactgccccatctctcacaattgcagagaacatggcagacctgatcgatggatactgtaggctggtaaacggcactagtcagtccttcattataaggcctcagaaagagggagaaagagctttgccatccataccgaaactggctaactctgagaaacagggtatgcggacgcatgccgtgtcagtctcagaaacagacgactacgcggagattatcgacgaggaagacacatacactatgccaagtacacgcgactatgaaatacagagagaacggatcgagctgggcagatgtatcggagaaggccaatttggggacgtgcaccaggggatatacatgagtccggagaacccggctctggccgtcgctataaaaacttgcaaaaactgtacatcagattcagtccgcgaaaagtttctacaagaggcactgaccatgaggcagttcgatcacccgcacatcgttaagctgatcggcgtgattacagagaaccctgtgtggattatcatggaactgtgtaccttaggcgagctgagatctttcctccaggtcagaaaatatagcctcgatttggcttccctaattctgtatgcgtatcagttgtctacagccctggcatatctggaatccaagaggtttgtgcatcgggacatcgctgccagaaatgtcctcgtgtcctcaaacgactgcgtcaaactgggggactttgggctcagtcggtatatggaagatagcacgtattacaaagcgagcaagggtaaactacccatcaaatggatggcacccgagagtattaactttagacggtttacatctgcttcagatgtttggatgtttggagtgtgtatgtgggagattttgatgcacggggtcaagccattccaaggggtgaagaacaacgacgtaataggtcgcattgaaaatggtgagcgtcttcccatgccccctaattgcccgccaacgctgtactcattaatgacaaagtgttgggcttatgatccctcaagacgccctcgcttcacagagttgaaagcccaattaagtaccatattggaagaggaaaaggcccagcaagaagagagaatgagaatggaatccaggcgtcaggcaaccgtgagttgggacagcggcggttctgacgaggcccctcccaaaccgtcaagaccgggatacccgtccccaaggtcttcagagggcttttacccttctccccagcatatggtgcagaccaaccactaccaggacagcaccgtcttagatctgaggggtattggacaggtcctgcctactcacctgatggaagagcgccttattcgacaacagcaagagatggaggaggaccagagatggctggagaaggaggaaaggtttctcaaaccggacgtcagattgagcagaggaagcattgatcgcgaggatgggtcactccaagggcctataggcaatcagcatatctaccagcctgtgggtaaacctgatcccgctgcccctccgaagaagccgcctagacctggcgctccaggccacctggggtcattggcctctctgtcatctccggctgacagctacaacgagggtgtgaaactgcagccccaggaaatttccccccctccaacagcaaatctagatagatcaaacgacaaagtgtacgaaaatgtcacggggctggtaaaagcagtaatcgaaatgtcatcaaaaatacagcctgctccgccagaagaatacgttccgatggtgaaggaagtcgggcttgcccttaggacactgctggccacagtggacgaaacgattccattgcttcccgctagtacacaccgggagattgagatggcccaaaagttgctgaactccgacttgggcgaactgataaacaagatgaaactggcccaacagtatgtcatgacatctctacagcaggaatataaaaaacagatgctcactgcagcgcacgcactggccgtggacgctaagaatctgctggatgtcatagatcaggctagacttaagatgctcggacaaacacgaccccattag

SEQ ID NO: 30408 - DNA, 2163 bp, Artificial Sequence
  Description of Artificial Sequence: Synthetic coding sequence
atggcagacctgatagacggatactgtaggctggtcaatggcaccagccagtcgttcataattagacctcaaaaggagggcgagagggcacttcccagcatccccaagctggctaacagcgagaaacagggaatgagaacacatgccgtttctgtgtccgaaactgatgattatgccgagatcattgacgaagaagatacttacaccatgcctagcaaaagctacgggattgacgaagccagagattacgagatccagcgcgagagaatcgagttgggccgatgcatcggggagggccaatttggagatgtgcatcaaggaatatatatgtcccctgagaatcccgctctcgctgtcgcgataaaaacgtgcaaaaactgcacctcagatagcgtccgagaaaagttcctccaagaagctttgacaatgaggcaattcgatcacccacacattgttaaattgatcggagttataactgaaaacccagtgtggatcatcatggagttgtgtacattgggagagctgcgctcttttcttcaggttcgtaagtattctttggacctggcatctctgattctgtatgcctaccagctgagcactgcgctagcgtacctggagtctaaaagatttgtgcacagagatatagcagcacgcaacgtcctggtatcttccaacgactgcgtcaaattgggggacttcgggctgtcccgctatatggaggactccacctattataaagcttccaaaggcaaattgcccattaagtggatggcgcctgaaagcatcaattttagacggtttacatccgcttctgatgtgtggatgttcggcgtctgtatgtgggaaatactaatgcacggcgtgaaaccatttcagggtgtcaagaataacgatgtgattggcagaattgagaacggcgaaaggttgccaatgcccccaaattgcccccctaccctttactctttgatgacaaaatgctgggcctacgatccctcccgtcggcctcgcttcaccgaactgaaggcccagctgagcacgattctagaagaggaaaaggctcagcaagaggagcggatgcgaatggagtctcggagacaggcaactgtatcctgggacagcgggggtagcgatgaggcacctccaaaaccgtctcgcccaggttacccaagccctcgcagctcagaggggttctacccctccccccagcacatggttcaaaccaaccattatcaagtcagtggttatccaggtagccatgggattacggcgatggcgggatccatctatcccggacaggccagcctcctggatcagacagatagctggaatcatagaccgcaggagatcgcaatgtggcagccaaacgtggaggacagtaccgtgttagacttgagaggcatcgggcaggtgttgcccactcacctcatggaagaaagactgatcagacagcagcaggaaatggaagaggaccaacgctggctggaaaaggaagagcggtttctcaagcctgatgtgcgactgagtcgtggttccattgacagagaagacggatcactccagggcccaattggaaatcagcatatctatcagcccgttgggaaacctgaccctgccgcaccccctaaaaagccgcctaggcctggagcacccggtcatcttggctcacttgccagcttgtccagtcccgcagacagctataatgagggagtgaagttgcagccccaggagatcagcccgccacctaccgctaacctagaccgttccaatgataaagtttatgagaacgtcacgggtctggttaaagcagtaatcgagatgagctcaaaaatccaaccagcgccaccagaggaatacgtgcctatggtcaaagaggtggggctcgcgttgaggaccctcctggcgactgtggatgaaacgatcccgctccttccagcatctacacaccgtgaaattgaaatggctcaaaagttattgaatagcgatctaggtgaactcattaacaaaatgaagcttgcccaacagtatgtgatgacctcactccaacaggagtataaaaaacaaatgctgaccgccgctcacgctctggcagttgatgcaaagaacctgctggacgtgatcgaccaggcaagactaaaaatgctaggacagacccgaccgcactag

SEQ ID NO: 30409 - DNA, 3198 bp, Artificial Sequence
  Description of Artificial Sequence: Synthetic coding sequence
atggcagctgcttaccttgatccaaatctgaaccacactccaaattcctctacgaaaacacacctcggaaccgggatggagcgaagccccggagctatggagcgcgtgctcaaagtgttccactacttcgaaagtaactctgaaccaaccacctgggccagcatcatcaggcatggcgacgccacagatgtaagggggattattcagaaaattgtagatagccacaaggtgaaacacgtggcctgttatggtttcaggctgagccatcttcggtctgaagaagtccactggctccatgttgatatgggtgtcagttcggttcgcgagaaatatgagttggctcatcctcccgaagaatggaagtacgagctgcgcatccggtatttgcccaagggatttctcaatcagttcaccgaagacaaaccgactttaaactttttttaccagcaagtgaagtccgactacatgctagaaatcgctgatcaagtggaccaggagattgctttaaagcttggctgcttagagatccggagatcttattgggaaatgcgaggcaacgcgcttgaaaagaagtctaattatgaggtactagaaaaggatgtgggcctgaagcgcttcttcccaaaaagcttgctggactctgtgaaggctaaaacactccgcaagctcatccagcagacgtttcgccagtttgctaatctgaaccgggaggaatccatcctgaagttctttgaaatactctcccccgtttatagatttgataaagaatgttttaagtgtgcgctcggtagtagctggataattagcgtggagctggcaatcggacccgaagagggcatttcgtatctaacggacaagggctgcaatcccacacatctggctgactttactcaggtccagaccattcagtatagcaattctgaggacaaggataggaagggaatgttgcaactgaagatagctggtgccccagagccactgactgttaccgcgccaagccttaccatcgcagagaatatggccgacttaatagatggctactgtaggctggtcaatggaacctcacaatccttcattatccgtccacagaaggagggcgaaagagcccttcctagcatacctaaactggccaattctgagaaacagggtatgagaacacatgccgtctcagtgagtgagacagatgactacgctgagatcatcgacgaagaagatacatacactatgccttccaccagggattatgagattcaacgagagagaatcgaactcggcaggtgtatcggtgaaggccaatttggggacgtacatcagggcatctacatgtctcctgagaacccagccctcgccgtggctattaaaacctgcaaaaattgcacgtccgattccgtgcgtgagaagtttctccaggaagctctgaccatgcgacaattcgaccacccacacatagtgaagttgattggcgtgatcacagaaaatcccgtttggataattatggagctgtgtacactcggcgagttgagatctttcctccaggtaaggaagtattcactggacctggcgtctctgatcctgtacgcttaccagttatctaccgccttggcttacttggaaagcaagcgtttcgttcaccgcgacatcgccgctcggaatgtgttagtgagttctaatgattgcgttaagctgggggacttcggactttcccgatacatggaggatagcacctactacaaagcatccaaagggaagctaccgatcaaatggatggcgcctgagtccattaattttaggcgcttcacatccgccagcgacgtgtggatgttcggcgtgtgcatgtgggaaatcttaatgcacggagttaaacctttccagggtgttaagaataatgacgtaatcggcagaattgagaacggtgaacgcctcccaatgccacctaattgccccccaacactttacagcttaatgacgaaatgctgggcctacgacccttctaggagaccacgatttactgagctaaaagctcagctgagcactatcctcgaagaggagaaggcccagcaggaagagaggatgcgtatggagtccaggcggcaggctacagtaagttgggattccggcggtagcgacgaagccccacctaaaccttctcgcccagggtacccgagcccaagaagctccgaagggttttatccatctcctcagcatatggttcaaactaatcactatcaggtgtcgggctacccagggtcccacgggattactgccatggcagggagtatctacccaggacaggcttccctgctcgatcagacagattcttggaatcaccggccacaggagattgcaatgtggcaacctaacgtggaagacagtaccgtgttggacctacgcggtatcggccaggttctaccgacacacctgatggaagaaaggcttatccggcaacagcaggagatggaagaggaccagcggtggctggaaaaagaagagaggtttcttaagcccgacgttagattatcgaggggctccattgatagagaagacggctcgcttcagggcccaattggtaaccagcacatctaccagcccgttggcaaaccaggcaaggaggaaaagaactgggccgaacgtaatccggctgctccaccgaagaaaccaccacggccaggggcaccaggacacctcggatcactggcatccctgtccagtccagcagattcttataatgagggcgtaaaaccatggcgccttcagccgcaggaaatctctccgccacctaccgcaaacctagaccggagcaacgacaaagtttatgagaacgtgacaggcttggtgaaggccgttatagagatgtcctcaaagatccagcctgccccacccgaggaatacgtccctatggttaaggaggtggggctcgctttgagaacactgcttgccaccgttgacgaaacaattccactgctccctgcctcaacgcatcgcgaaatcgagatggcccaaaagctactgaattcggaccttggcgaactaattaataagatgaaacttgcccagcagtatgtaatgacctccctgcagcaggagtacaaaaaacaaatgttaacagctgcgcatgcactggccgtagatgcgaagaatttactggatgtgatagatcaagccagattgaaaatgctcgggcagacgaggccacactag

SEQ ID NO: 30410 - DNA, 2904 bp, Artificial Sequence
  Description of Artificial Sequence: Synthetic coding sequence
atgagtggcgttagtgagccactgtcaagagtcaaactgggcactctacgcagacctgaaggacctgccgagcctatggttgtcgttccagtggacgtggagaaggaggatgtgaggattctgaaggtgtgtttctatagcaattccttcaacccaggaaagaatttcaagctagtcaagtgtaccgtgcaaacggagataagagaaattattacatcaatcctgttgtccggtcggattggaccaaacatccggctggctgaatgttatggccttcgactcaagcatatgaaatccgacgaaatacactggcttcatccccagatgaccgtgggagaagtccaggataagtacgaatgcctgcacgtggaagcagaatggagatacgacctccaaattagatacctgccagaggacttcatggagtccttaaaagaggaccggactacactcctgtacttttatcagcagttgaggaacgactatatgcagaggtacgcctcgaaggtctcggagggtatggccctgcagctgggttgcttagagctgcgacgcttttttaaggatatgcctcataatgctctggataagaagtccaattttgagctgcttgagaaggaggtcggcttagatctattctttcctaagcagatgcaggaaaatctcaagcccaagcagtttcgtaagatgatccagcagaccttccagcagtacgcatctctgcgcgaggaggagtgcgtgatgaagttctttaacaccctcgccggatttgcgaacatcgaccaggagacctaccggtgcgaactgatacagggatggaatattactgttgacttggttattggtcccaaaggcatcaggcaactgacaagtcaggatgctaagccgacatgcctcgctgaatttaaacagataagatcaataaggtgcctgcctctcgaggaaggccaggcagtcctgcagctcggaatagagggtgctccgcaggccctttcaattaaaacttcctcacttgcggaggcggaaaatatggccgatctgatcgatgggtattgccggctccagggcgagcaccagggctccctgatcatccatcctagaaaggatggagagaagaggaacagcctgccccaaatcccaatgctgaatctggaggctagaagatcccacctgtcggagtcttgtagcatcgaatccgatatctacgccgaaattcctgatgagacgttgcggagaccaggcggacctcagtatggtattgccagagaggacgtcgtcttgaatagaatcctgggggagggcttcttcggggaagtgtacgagggtgtctacacaaaccacaagggagaaaagattaatgtggcagtcaagacatgcaaaaaagattgcacactagacaacaaagagaaattcatgtccgaggctgttattatgaagaacctcgatcacccgcatattgttaaactgatcgggatcattgaagaggagccaacgtggatcattatggagctgtatccatacggagaacttggccattacttggagaggaataaaaacagtctgaaagttcttactctggttctgtactctctacaaatctgcaaagcaatggcgtaccttgagtctattaattgcgtacaccgggacatcgctgtaagaaacatactggtggcttcacccgaatgtgtgaaattaggcgacttcggactgagccgatatatcgaggatgaagactattataaggccagcgtgacccggttaccaataaaatggatgtcgcctgagagtatcaactttaggcgtttcactaccgcctcagatgtttggatgttcgccgtgtgcatgtgggagatactttctttcggcaaacagcctttcttttggctggagaacaaggatgtgatcggggtgcttgagaagggcgaccggctgcccaaacccgacttatgccctcctgtgctgtataccctgatgacaaggtgctgggattacgacccaagcgaccgacctcgcttcacggagctggtgtgttccctgtctgacgtgtatcaaatggaaaaggacatagcaatggagcaggaacgaaatgcacgctatagaacaccaaagattttggaaccaacagcatttcaggagccaccacccaagccctctcggccaaagtaccgacctcctccgcagaccaaccttcttgcccctaagctccagtttcaggaggaagactttatccaaccttcatccagggaagaggctcagcagctgtgggaggctgaaaaggttaaaatgcgtcaaattctggacaagcagcagaaacagatggttgaggattaccaatggttgaggcaggaagagaagtctttagatcccatggtctatatgaacgataagagtcctcttacccccgagaaggaggttggctatctggagttcactggccctccccaaaagcctccccgtctgggggctcagagtattcaacccactgctaatctggacaggactgacgacctggtgtacttaaacgtgatggagttggtgagagctgtccttgagctgaagaatgaattatgccagctcccgcctgaggggtatgtggtggtggttaaaaacgtcggcctgactcttcgcaagctgataggaagcgtggatgatttgttaccatccttgccatcttcctctcgtacagaaatcgaaggaacgcagaagctgcttaataaggacctcgcagaactgattaacaagatgcgtctcgcccagcagaatgccgtgacctcgctcagcgaggagtgcaaacgacagatgctaaccgcctcgcataccctggctgtggacgctaagaaccttctggacgccgtggaccaagctaaagttctcgccaatctcgctcacccccctgctgagtag

SEQ ID NO: 30411 - DNA, 3030 bp, Artificial Sequence
  Description of Artificial Sequence: Synthetic coding sequence
atgagcggtgtgtccgagcccctctctagggtgaagctcggtaccctgagacgaccagaagggcctgcagaacctatggtggtggtcccagtagacgttgagaaggaggacgtaaggattctgaaggtgtgcttctattctaactctttcaatccaggcaagaattttaaactcgtgaagtgtaccgttcagacagaaattcgagagattattacgtcaatactgcttagtggacgcattggaccaaacatccgtttggccgagtgctacgggctgcgcttgaaacacatgaaatctgacgagatacactggttgcatcctcagatgacagtgggggaggtgcaggacaagtacgagtgtctgcatgtagaggctgaatggcgctacgatttgcagatccggtacctacctgaagatttcatggagagcctcaaagaggataggacaactcttctctatttttatcagcagttgaggaacgattacatgcagcgctatgcttcgaaagtatcagaggggatggccttgcagctggggtgtttggagctgcgaaggttctttaaggatatgccgcataacgctctggataagaagagtaattttgaactgctggaaaaagaggtggggcttgatcttttcttccccaagcaaatgcaggaaaacttgaaacctaagcagttcagaaagatgatccagcagaccttccagcagtatgcttcactgagggaagaggagtgcgtgatgaaattcttcaacacgctagcgggattcgccaatatagaccaggagacttacagatgcgaactgatacagggatggaacatcaccgttgatttggtgatcgggcctaagggaatcagacaacttacatcacaggatgccaaacccacatgcctcgcagaattcaagcagattcgaagcatccggtgcttgccgctggaagaaggccaggcggtcctgcagctgggtattgagggggctccacaggccctctccattaagacgtcaagcctggcggaagctgagaatatggcagacctgatcgatggatactgtcggctccaaggagaacaccaaggatccctgatcatccatccaagaaaagacggggagaagagaaattctctgcctcaaatacccatgttgaaccttgaggccaggcgatcacacttgagcgaatcatgtagcatcgagtccgatatctatgctgaaattcccgatgagacactcaggaggccaggtggccctcagtatggcattgctagggaggatgttgtgctcaatcgaatccttggtgagggttttttcggcgaggtgtatgagggcgtgtataccaatcataaaggcgaaaaaatcaatgtggccgtgaagacctgtaagaaagattgtactctggataataaagagaagttcatgtctgaggccgtcatcatgaaaaacctggaccatccacatatcgttaaactgatcgggatcattgaagaggaacccacgtggatcatcatggaattatacccctatggggagcttggccattatctcgaacggaataaaaacagtctcaaggtcctgaccttggtgctgtattcccttcagatttgtaaggctatggcatacctcgagtccataaactgcgttcaccgagacattgcggtacgcaacatcctcgtggcgagccctgaatgcgttaaactgggggattttgggttgagccgctatatcgaagatgaggattactacaaggctagcgtaacaagacttccaatcaaatggatgtcacctgagagcatcaactttcgccgatttactacagcatcagatgtgtggatgtttgccgtgtgcatgtgggagattcttagttttggaaagcagcccttcttctggctggagaataaggacgtgattggagtgctggagaaaggcgataggttgcctaagccagacctgtgtcctcccgttctttacacactgatgactcgctgctgggattatgaccctagcgaccgcccaaggttcacggagcttgtgtgttcactgtctgatgtataccagatggaaaaggatattgctatggagcaggagaggaacgcccgatatagaacgccgaagattctagagccaaccgcctttcaggagcccccaccaaagccgagccgtcccaagtacagacccccacctcagaccaatctgctggccccaaagctgcaattccaggtgcccgagggactctgcgctagctccccaacactgacatcccctatggaatacccaagcccagtcaactccctccatacgcctccccttcatcgccacaatgtgttcaagcgccactcgatgcgtgaagaagacttcattcagccttctagtcgagaggaggcccagcagctttgggaagccgagaaggtgaaaatgcggcagattcttgacaagcaacagaagcagatggtggaagattaccagtggcttcggcaggaggagaagtcactcgatcccatggtttatatgaacgacaaaagtcctctgacaccggaaaaagaagtgggctacctggagtttacagggccaccacagaaaccaccgcgtctgggcgctcagtctattcagcccactgcgaacctagacaggaccgacgaccttgtgtacctaaatgtcatggagctggtaagggccgtgctggaattgaaaaatgaactgtgtcaattgccacctgagggctatgttgttgtggtaaaaaatgtgggactgactctccgtaagctcattggtagcgttgatgatctgttacctagcctaccatcctctagtcgaactgagatcgaaggcacacaaaaactgctcaataaggatctggccgaattaatcaacaagatgcgcttagcccagcagaatgccgtgaccagccttagcgaagaatgcaagcggcagatgctgactgctagtcacactctagccgtcgacgcaaaaaatcttctcgacgccgtggaccaggccaaggtcttagcaaatctagctcacccgccagccgagtag

SEQ ID NO: 30412 - DNA, 3030 bp, Artificial Sequence
  Description of Artificial Sequence: Synthetic coding sequence
atgtcaggagtgtccgagccactatctagggtgaagcttgggaccctacgcaggcccgaggggcctgccgaacccatggttgtggtgccggttgatgtggagaaagaagacgtgcgcatactcaaggtgtgtttttattcaaacagtttcaatcctggaaagaacttcaagctggtgaagtgtaccgtgcagacagagattcgagaaataatcacgtcaattttacttagtggccgaattggtccaaatattagacttgccgagtgttatggcctaaggttgaagcacatgaagtccgacgagatccactggttgcacccacaaatgactgtaggggaagtgcaggacaaatacgaatgtctacatgtcgaggctgaatggcggtatgatctgcagatccgctatctgccagaagatttcatggaatctctgaaggaagaccgcaccacgctcctatatttttaccagcagctgagaaatgactacatgcagcgctatgctagtaaggtttctgagggcatggctctacaactcggctgcttagagttgaggcgtttctttaaggatatgcctcataatgccctggacaaaaagtcaaatttcgagctgctcgaaaaagaggtggggctggatctcttcttcccaaaacagatgcaggagaacctcaagcctaagcagtttagaaaaatgatccagcagacgtttcagcagtatgcctctctgcgggaagaagaatgtgtgatgaaattttttaacactctcgccggattcgctaatatagaccaggagacctatagatgtgagctgatccagggctggaatattacagtcgatctggtcattggcccaaaaggcattaggcagttaacttcgcaggacgccaaacccacctgcttagctgagttcaagcaaatacggagcatccgctgtctcccactcgaagaaggccaagccgtgctgcaactgggtatcgagggggcacctcaggcactctccattaaaaccagctctctggcagaggcagagaacatggccgatctcatcgacggttattgtcgcctgcaaggtgagcaccaaggttctttaatcattcaccctcgaaaggacggggagaagagaaatagcctgccccagattccaatgctaaatctggaggccagacgctcccaccttagcgaaagctgttctattgagagcgacatctacgccgaaattccggatgaaactctgagaagacccggaggcccacagtatggcatcgcccgagaggatgtggtgctcaaccggattctcggagagggatttttcggtgaggtctatgagggcgtctacaccaatcataagggcgagaagataaacgtggccgtcaaaacctgcaaaaaggactgcacattggacaataaagaaaagtttatgagtgaagctgttatcatgaagaatctggatcacccacacatcgtgaagcttatcggtataatcgaagaagagcctacatggattatcatggagctgtatccctatggggaactgggacactatttggaacggaacaagaactcactaaaggtgctaactctggtactgtattctctgcaaatttgcaaagcaatggcctacctggagtccataaactgcgtgcaccgagacattgcggtgcgcaacattcttgtggcatcccctgaatgcgttaaattgggggattttggtctgagcagatatatcgaggatgaggattattataaagctagcgtgacgcgcctgcccattaagtggatgtctccagaatcaattaattttcgcaggtttacgactgcgagtgacgtctggatgtttgctgtatgtatgtgggaaatactgtccttcgggaaacaaccctttttctggttggagaacaaagatgtcataggcgtgctggagaaaggcgatcgcctgccaaaaccagacctctgcccccctgtgctttacactctaatgaccagatgctgggattatgacccatccgatagaccacggtttactgaactggtgtgtagcctgtctgatgtgtaccaaatggaaaaagatattgccatggaacaggaacgcaatgccaggtaccggacaccaaagatactggaaccgactgcatttcaggagcccccaccaaaacccagccggccaaagtacagaccgccaccccagactaacctgctggctcctaaactgcagtttcaagtgcctgaggggctttgcgcgtctagccccacactgacatctcctatggaatacccgtctccagtcaactccctgcatacacccccattacataggcataatgtattcaagaggcacagcatgagagaagaagacttcatccagccaagtagccgcgaggaagcccagcagctgtgggaggctgaaaaagtgaagatgcggcagatacttgacaagcagcagaagcaaatggtagaagattatcagtggttgcgtcaagaggagaagtctttagacccaatggtttacatgaacgacaagagcccattgactccagagaaggaggttggttatctcgaatttacgggacctccccagaagccgcctcgactgggtgcacaatctattcagcctacagccaacctggatcgcaccgacgatctcgtatatcttaacgtcatggagctcgttcgcgctgtgcttgaactgaaaaatgaattgtgtcagctgccacccgaggggtatgtcgtcgtggtcaagaatgtgggattgacccttagaaaactgataggctcggtggatgacttactgccttctctcccttcatcaagccggactgagatcgaaggaactcaaaaattactgaataaagacctcgccgagctgattaacaagatgcgactcgctcaacagaacgccgtcacatctctctctgaggagtgcaagaggcagatgctgactgcctcccatactctggctgtggacgccaagaatctactcgacgcagtggaccaagccaaagtcctggctaacctggcgcatcccccagcggagtag

SEQ ID NO: 30413 - DNA, 2904 bp, Artificial Sequence
  Description of Artificial Sequence: Synthetic coding sequence
atgagcggggtgagcgaacccctgagtcgggtgaaacttggcaccctgagacgaccagaagggcctgccgagcccatggtggttgtgcctgtggacgttgagaaggaagatgtgaggattctgaaggtgtgcttttactccaactccttcaatccaggaaagaatttcaaattagtcaagtgcacggtgcagaccgaaatccgggaaatcatcacatctattttactgtcgggcaggattgggcctaatattcgcttggcagaatgttacggtctcagactgaagcatatgaagtcagatgagatccactggctacaccctcagatgacagtgggcgaggtccaagataagtatgagtgccttcacgtggaagcggagtggcgctacgatttgcagatccgttatctgcccgaggattttatggagtccctgaaagaagatcgcacgacattactgtacttctaccagcagctccggaatgactatatgcagagatacgcttcaaaggtgagcgagggcatggccctgcaattggggtgtctggagctccgcaggttcttcaaggatatgccccacaatgccctggataagaagagcaactttgaactcctggaaaaagaggtggggcttgatctcttcttcccgaaacagatgcaggaaaatctgaagccaaaacaatttcgtaagatgattcagcagaccttccagcagtacgccagcctgagggaggaggagtgtgtcatgaagttcttcaatacactggcgggattcgcaaatatagaccaggaaacatacagatgcgaattaatccagggctggaatatcacagtggacctcgtgatcggaccaaaaggaatacgacagttaacctcccaggatgctaagccaacttgcctggccgagtttaagcagataagatccattagatgtcttccactcgaggaagggcaggctgtgctgcagctggggatcgaaggtgctccccaggccctgagcattaagacatcctccctggccgaggctgaaaatatggccgacctgatcgacggctactgccgtctgcaaggtgagcatcagggttcccttatcatccacccacgcaaagacggggagaaacggaatagtctgcctcagatacctatgctgaatcttgaggctagacgatcgcacctcagtgagtcttgcagtatcgaatccgacatttatgctgaaattccagatgaaactttacgcaggcccggtgggcctcagtatggtatcgcacgagaagatgtggttctgaaccggattttgggagagggtttcttcggtgaggtgtacgaaggcgtgtacactaatcataaaggtgagaagatcaacgtcgccgttaagacctgcaagaaagattgtacccttgacaataaagagaaattcatgtctgaagctgtaatcatgaagaacctggaccatccacacattgtcaagctcattgggatcattgaggaagagccaacctggattatcatggagttgtacccttatggcgagctaggtcactatttagaacgtaataaaaattcactcaaggttcttactttggtcctatacagtttacagatatgtaaagcaatggcctatctggaaagtatcaattgcgttcatcgcgacatcgctgtgcgcaatattctggtggcatcaccggaatgcgtgaaactgggtgattttggtctgtctcgctatattgaagacgaggactattacaaggcatctgtgaccagactgcccatcaaatggatgagccctgagtctatcaatttcagacgtttcaccacagccagtgacgtttggatgtttgccgtatgtatgtgggagatcctcagctttgggaagcagcctttcttttggctagagaataaggacgtaattggagtgcttgaaaaaggagacagattaccaaagcccgatctctgccctccagttctttacaccctgatgactcggtgttgggattatgacccaagcgaccgccctcggttcacggagctcgtttgcagtctgtctgatgtgtaccaaatggaaaaagacattgccatggagcaggaacgtaatgccaggtaccgaacccccaaaatcctcgagcctacagccttccaggagcctccccctaagccaagtagacccaagtatagacctccgccacagactaacctcctggctcctaaattacagttccaggaagaggatttcattcaaccgagcagtcgggaggaggcccaacaactgtgggaggctgagaaggtgaaaatgagacagattttggataaacagcagaagcaaatggtcgaagactaccagtggttaaggcaggaagagaaatcgctggacccaatggtgtacatgaatgataaaagtcctcttactcccgagaaagaagtaggatatttagagtttaccggcccaccacaaaagccccctaggctaggtgcccagtcaatccaaccgacagcaaacctggaccgcactgatgacctagtttatcttaacgtaatggaactcgtcagagccgtgttagaactaaaaaacgagctctgccagctgccaccggaggggtatgtcgtagttgtgaagaatgtgggtctcaccttgaggaagttgattggaagcgtagatgacctgcttccttcgctgcctagctcctccaggacagagattgaaggcacccagaagctgctgaataaagaccttgcagaattgattaacaagatgcgactggctcagcagaacgcggtgaccagcctcagcgaggaatgcaaaagacaaatgttgacggccagtcacacgctggccgtggatgccaagaaccttctagatgccgtggaccaagctaaagtgttggcgaatttagcccatcccccagctgagtag

SEQ ID NO: 30414 - DNA, 2904 bp, Artificial Sequence
  Description of Artificial Sequence: Synthetic coding sequence
atgagcggcgtctctgaacctctctccagagtaaagcttgggacccttcgacgacccgagggacccgctgagccaatggttgtggtgccagtggatgtggagaaagaggatgtccgtattctgaaggtctgcttctactccaacagtttcaaccccggaaaaaatttcaagttagtgaagtgtaccgtgcagaccgagatccgagaaattattacaagcattttactgtccgggcgaattgggccaaacatcagactggcagagtgttacggccttcgcctaaagcatatgaaatcagacgagatccactggttgcacccccaaatgacggtcggagaggtgcaagacaagtacgaatgccttcacgtagaggcagaatggcggtacgaccttcaaatcagatacctgccggaagatttcatggaatccttaaaggaggatcgcaccaccctactgtatttttaccagcagctcagaaatgactacatgcagagatacgcatccaaggtgtctgaagggatggcccttcagcttgggtgtctcgagcttcgcagattcttcaaggacatgcctcataatgcgctcgacaagaagagcaattttgaactcttggaaaaagaggtgggactcgacctctttttcccaaagcagatgcaggaaaatttgaaacctaagcagtttagaaagatgattcagcagaccttccagcagtatgctagtttacgggaggaagagtgtgtcatgaaattctttaacacactcgcgggattcgccaacatcgatcaggaaacataccgctgcgaattgattcagggctggaacatcactgtagatctcgtgattggcccaaaagggatccgtcagctgacaagccaggacgccaagcctacctgcctggctgagtttaagcagattaggtctatcaggtgtcttcctctcgaagagggacaggctgtcttgcagctgggcatcgaaggcgctccacaggctctgtcaataaagaccagctcactggcggaggccgagaacatggctgatctgatagacgggtattgtaggctccaaggtgaacatcaaggctctctaatcatacacccaagaaaggacggcgagaaaaggaattcccttccacagattcccatgctgaacctggaagcaaggcggtcccacctgtccgagtcctgctcaatcgagtccgacatttatgcagaaattcccgacgagaccttgaggaggccaggcggacctcagtacgggattgcccgagaggacgtggtgctgaataggatcctcggcgaagggttttttggtgaagtatacgaaggcgtttataccaaccataagggagaaaaaataaatgtggccgtcaagacctgcaagaaagattgcacattagacaacaaagaaaaattcatgtcagaggcggtgatcatgaagaacctggatcatccacacattgtcaaacttattggcataatcgaagaagaacccacctggatcattatggagctctatccttatggtgagctgggccactacctggagcggaacaaaaacagcctcaaagttctcacactggtcttgtacagtctgcagatttgcaaagctatggcctaccttgagagcataaactgtgtgcacagggacattgccgttcggaatatcctggtagcctccccggagtgtgtaaagttaggggactttggcctctcacgctacatcgaagatgaagattattacaaggcatcagttacaagactccccattaagtggatgtcacccgaatcgatcaatttcagacgcttcactactgccagcgatgtctggatgtttgccgtctgcatgtgggagattctgtcctttggaaaacaaccctttttttggctcgaaaataaagacgttattggcgttcttgagaagggcgatcggctgccaaaacctgacctctgtccccctgtgctatataccctgatgaccagatgctgggactacgatccaagtgatagacctcgcttcacagaattagtttgctctctgtccgacgtctatcaaatggaaaaagatattgccatggaacaagagcggaatgctaggtataggactccaaaaatcctagagcctaccgccttccaggagcctccaccaaaaccctcccgacctaaatacagaccccctcctcagaccaacctcttggcacccaagctacagttccaagaagaagacttcatccaaccatcctcccgagaggaggcgcagcagctctgggaagcagagaaggtgaagatgaggcagatcctggacaaacagcagaaacagatggtagaagattatcaatggctgcgccaggaggagaagagcctggacccgatggtctacatgaacgacaaaagcccattgaccccagagaaggaagtgggctatctcgagtttactggtccaccacagaagcctcccaggctcggggctcagagcatccagcccaccgcaaacctagaccgaaccgacgatctcgtgtaccttaacgttatggaactggtgcgcgcagtgctagaattaaagaatgagttgtgccagctgccaccagaagggtatgtcgtcgtggtcaaaaacgtcggtctcactttgcggaagctgatcggatccgttgacgacctgttgccaagtctgcccagctccagtcgaaccgaaatcgaaggcacccagaagctgttaaataaagacctcgccgagctcattaacaagatgagactagcacaacaaaatgcggttactagtttgagcgaggagtgcaaaagacaaatgttaaccgcttcgcataccctggctgtggacgccaaaaatctgttagacgcagtcgaccaggcgaaggttctcgccaacctggcgcatcctccggctgagtag

SEQ ID NO: 30415 - DNA, 2409 bp, Artificial Sequence
  Description of Artificial Sequence: Synthetic coding sequence
ctcctgccggaacggatgtcaggcgtcagtgaaccgttgtcaagggtgaaactgggaaccctgcggagacctgagggaccagctgaacccatggtggtggtccccgtcgatgttgagaaggaagacgtccgcatactgaaagtatgcttttattctaactcttttaatcctggaaagaactttaaactggtgaagtgcaccgtccagactgagatccgtgagatcattacaagtattctcctctctggcagaatcggccctaacatcaggttggctgagtgctacggtctgagactcaagcacatgaagagtgatgaaatccactggctacaccctcagatgactgtgggcgaagtgcaagataagtatgaatgcctacacgtggaagctgagtggagatacgatttacagattcgttatcttccagaagactttatggagtctttaaaggaggatcgtacgactctgctctatttttaccagcagctaagaaatgattatatgcaacgctatgctagtaaagtctctgagggcatggccttgcaactaggttgcttagagctcaggcggttcttcaaagacatgccgcacaatgccctagacaagaagagcaacttcgagctcctggaaaaggaggtgggattggacttgttcttcccaaaacagatgcaagagaatctgaagcccaagcagttccgaaaaatgatacagcagacttttcagcagtacgcttcgttgcgcgaggaagagtgcgtgatgaagttcttcaatacactggcaggctttgcaaacattgaccaagagacataccggtgcgagctgatacaggggtggaacatcaccgttgacctggtcattggccctaagggaatacgtcagcttacctcgcaggacgcaaagccgacctgcctcgcagagttcaagcaaattcgatccatacgatgcttaccattggaagaaggccaggctgtgttgcagctgggaattgagggcgcaccacaggccctcagtatcaagacttcgagcctagcagaggcagaaaacatggcagatctgatagacggatactgtcgtctgcagggtgagcatcaaggctctctcatcatccacccgagaaaagacggagaaaagcgcaattccctgccacaaattcctatgcttaacctggaagcgagacgaagtcatctgtctgagagctgttcaatcgagtcagacatttacgctgaaattccggacgagacactaagaaggccaggcggaccccagtatggcatcgctagagaagatgtcgtactgaatcgcatacttggcgaaggcttctttggggaagtgtacgagggggtttacacgaatcataaaggggagaaaattaatgtagccgtcaagacatgcaaaaaggactgcaccctggacaataaagagaagttcatgtccgaggctgtcatcatgaagaaccttgaccacccccatatcgtaaagctcatcgggattatcgaagaggaacccacttggatcatcatggaactgtacccatatggagagctaggccactatctcgaacgaaataaaaacagccttaaggtgctaactcttgtgctgtacagtctgcagatttgtaaagcaatggcatatctcgaatcaatcaactgcgtgcacagagacatcgctgtgcgcaatattcttgtcgcaagcccagagtgcgttaagttgggagatttcgggctttcccggtatattgaggacgaggattactacaaagcttctgttactaggctgcccatcaaatggatgtcccctgagtctatcaactttcgaaggttcacgactgctagcgacgtttggatgtttgctgtctgcatgtgggagatcctgtcctttggaaagcagccgtttttctggctggagaataaagatgtgattggagttctcgaaaaaggcgatcgcctccctaagcccgacctctgccctcccgtgctttacaccttgatgacccgctgttgggattatgatccaagtgatcgacctaggtttaccgagctggtgtgtagcctgtcagacgtctatcaaatggagaaggacattgctatggagcaggagaggaatgccaggtacaggacccccaaaattctggagcccacagcctttcaagaacctccgccaaagccaagcagaccaaaatatcggcctccgccacagacgaatttgcttgccccaaagctgcaatttcaggttcccgaggggctgtgtgcatcctctcctactttgacgtctcccatggagtacccttcgcccgtcaacagcctccataccccgccactgcacaggcataacgtgtttaaacgccacagcatgcgtgaggaagacttcattcagccatccagtagggggcctgccgctgtgggcggatag

SEQ ID NO: 30416 - DNA, 3030 bp, Artificial Sequence
  Description of Artificial Sequence: Synthetic coding sequence
atgagtggggtgtctgagcccctctctagggtcaaactcgggaccctgcgccgtccggaagggcctgctgagcccatggttgtggttccagtggatgtagagaaggaagatgtcaggatactgaaggtatgcttctactctaatagctttaatcccggtaaaaacttcaagttagtgaagtgtacagtgcagactgagattagagaaattattacgtccatcctattgagcgggagaatcggtccgaacatacgcctcgcagaatgctacgggctccggctaaaacacatgaaatcagacgaaatccattggctgcaccctcaaatgacagtgggggaagtgcaagacaaatatgagtgtctgcatgtcgaggccgagtggagatacgatctgcaaatacgatatctacccgaagatttcatggaatccctaaaggaggacaggacgaccctactgtatttctaccaacagttgagaaacgattatatgcagcgttatgcatcaaaggtctccgagggaatggcactgcagctgggttgcctcgaattgcgcagatttttcaaggacatgccccacaacgcgttagacaagaagtccaacttcgagctgctcgagaaagaggtcggtttagacctgttctttccgaagcagatgcaggagaatcttaaaccaaagcagttccgaaaaatgatccaacagacgttccagcagtacgcatcccttcgcgaggaggagtgtgtgatgaagttctttaacacgctggccggatttgctaatattgatcaggaaacgtaccggtgtgagctcattcaagggtggaatatcacagtggacctggttatcgggcctaaggggatcaggcagctcacctctcaggatgccaagccaacatgcttggccgaattcaaacaaattagatcaatacgctgcctaccactggaggaaggccaggctgtgctgcagctggggatcgagggggcaccacaggcacttagtatcaaaacatcaagccttgcagaagctgagaacatggctgatctgattgacgggtattgtagacttcagggagagcaccaagggtcattgattatacacccgaggaaggacggcgagaagcggaatagccttcctcaaattcccatgctgaatcttgaggcgaggcgctctcacctatccgaatcgtgttcgattgaatccgacatttacgctgagattcctgacgagaccctcagacgtcccggagggcctcagtatgggatcgctcgagaggatgtcgtcctcaaccgcattctgggggagggattttttggagaggtatacgagggcgtttacaccaatcataaaggtgaaaagattaacgtcgctgtgaagacatgtaaaaaggattgtacactggacaacaaagagaaatttatgtcagaggccgtgattatgaaaaacctagaccaccctcacatcgtgaaactgatcggtatcatcgaagaggaaccaacatggataatcatggaactctatccatacggagaacttgggcattacctggaacgcaataagaattctctgaaggtgctgaccctggtgctgtactccctccaaatatgcaaggctatggcttacctcgaatcaattaattgtgtccatagagatattgctgttcgcaacatcctcgtggcaagcccagagtgcgtcaaacttggcgatttcgggctgtccagatatattgaggacgaggattattacaaggcctccgtgactcgtctccccattaagtggatgagccctgagtctattaactttcggcgttttacaaccgcctccgatgtgtggatgtttgctgtttgtatgtgggagatccttagtttcggcaagcaaccttttttttggctggagaataaggatgtgattggagtgctagagaagggagacagactgcccaaacccgatctctgcccgccagttctgtacacattaatgacacggtgctgggactatgaccccagcgaccgccctaggtttaccgagttggtctgctcactgtctgatgtataccaaatggaaaaggatattgcaatggagcaggagcgaaacgcccgataccgcacacctaagatcctggaaccaactgctttccaggagccaccacccaagcccagtaggccaaaataccggccaccacctcagaccaacctccttgcacccaagctgcagtttcaggtgcctgaaggcctttgcgcttcttctcctacgctgacgtctcccatggagtatccaagtcccgtgaactcattacacacgcctccgcttcaccggcataatgtatttaagagacactcaatgagggaggaggacttcattcagccttcgtctagggaggaagcccagcagctatgggaggctgaaaaggtgaaaatgcggcaaatactcgataagcaacagaaacagatggttgaggactatcaatggttgaggcaggaagagaaaagtttagaccctatggtttatatgaacgataagtcacctctgactcctgagaaggaagtgggttacctagaatttaccggtccgcctcaaaaacccccaagattgggggctcagtcaatccaaccgactgccaatctagaccgtaccgacgacttagtgtacctgaacgtgatggagctggtgcgagcagtcctggaactgaaaaacgagctttgccaattgcctccggagggctacgttgtcgttgtgaaaaatgtgggtctgacactgaggaagcttattggcagcgtggatgacctattaccatctctcccctcatcctccagaacagagatcgaagggactcaaaagctgctcaataaagacttggctgaactgattaacaagatgaggttggcccagcagaatgcagtgacgagtctgagtgaagagtgtaaacgacagatgctaacagcctcacatactttagccgtggacgctaagaatctgctggatgctgtcgaccaagccaaggttctcgccaatctcgcgcatcctccagcagagtag

SEQ ID NO: 30417 - DNA, 969 bp, Artificial Sequence
  Description of Artificial Sequence: Synthetic coding sequence
atggccgatagagactccgggtcggagcaaggtggggctgctttggggagtggcggttccctcggacaccctggaagcggaagtggcagcggaggagggggaggaggtgggggtgggggaggcggatccggcggagggggaggcggagcgccagggggtttacaacatgaaacacaggaactcgcttcaaagcgagtggacatccagaacaaacgcttctatctggacgttaagcaaaacgccaaagggcgttttcttaagatcgccgaagtcggcgcaggagggaacaaatctcgcctgaccttgagtatgtctgtcgccgtcgaattccgagactatttgggagattttatcgagcactacgcccagctgggcccaagtcagccgcctgacctggctcaggcccaggacgagccgcgacgtgccttgaagagtgagtttttagtgagggaaaacagaaaatattacatggatttgaaggaaaatcagaggggcagattcctgagaattagacagacagtgaatagaggtcctgggcttgggagtactcagggacagaccatcgctttgcctgcccaaggacttattgaattccgggatgcactggctaagctgatcgatgactatggggtggaagaggagcccgcagaactgccagaaggcacatctctcacggtcgataataaacgtttttttttcgacgttggaagcaataaatacggagtgttcatgcgcgtgtctgaggtgaaaccaacctacagaaactctattacggtcccatacaaagtctgggccaaattcggacatacgttctgcaagtactcggaagaaatgaagaagatccaggaaaagcagcgtgagaagcgagcagcctgtgagcagttgcatcagcagcagcagcagcaacaagaagagaccgcagcagctacactgttgctgcagggggaggaagagggcgaggaagactag

SEQ ID NO: 30418 - DNA, 588 bp, Artificial Sequence
  Description of Artificial Sequence: Synthetic coding sequence
atgggtcgagcacgcgacgccatcctcgacgctctggagaacctgacagcagaggagttaaaaaaattcaagttgaaactgttgtccgtgccattgcgcgaaggttacgggaggatacccaggggtgcactgctgagcatggatgcgctcgacttgacagacaagcttgtgagtttttatctggagacatacggcgcagagctcactgccaatgtcctgcgagacatgggactccaggaaatggctggtcagctccaagcagccacacatcaaggaagtggcgctgctcctgcagggatccaggcacctcctcaatccgctgctaaaccaggtctccatttcattgatcagcatcgagcagccctaattgcaagggtaacaaatgtggaatggttgctcgatgctctgtacggtaaagttctcaccgatgagcagtaccaagcagtcagggccgagccaactaaccccagcaagatgcgcaagctctttagttttactccagcttggaactggacctgcaaagacttgttactccaagcgctcagagagagtcaatcttacctagtggaagaccttgagcgctcctag

SEQ ID NO: 30419 - DNA, 531 bp, Artificial Sequence
  Description of Artificial Sequence: Synthetic coding sequence
atgggcagggccagggatgctattctggacgctctggagaatcttacagccgaggagctgaaaaagttcaagcttaaactcctgagcgtccccctccgcgaaggctacggtaggatccccagaggagccctcctgtcaatggatgccctggatctcaccgacaagctggtcagcttctacctcgagacctatggggctgaactgaccgcaaacgtgctgagggatatgggcttgcaggaaatggctggacaacttcaggccgctacccaccagggcctgcattttattgaccaacatagagccgctctgatcgcaagggtgaccaatgtggagtggctcctcgatgcattatacgggaaggtgctgacagatgagcagtatcaggcggtccgtgcagagccgacgaatcctagtaagatgaggaagttgttctccttcacaccagcttggaactggacatgcaaagacctgcttctgcaagcactgagagagtctcaatcgtaccttgtggaggaccttgagcgttcatag

SEQ ID NO: 30420 - DNA, 408 bp, Artificial Sequence
  Description of Artificial Sequence: Synthetic coding sequence
atgggtagggctagagatgccatcctggatgctctggagaacttaacagcggaggagttaaaaaaattcaagttacaagcagctacacatcaggggagcggggcagctcccgctggaattcaagccccacctcagtcagccgcaaaacctggcctgcattttatcgaccagcacagagccgctttgattgctcgcgtgacgaacgtcgagtggctgctggacgcgctgtacggtaaagtgctgactgatgagcaatatcaagccgtacgcgcagaacccactaatccctctaagatgcgcaagctgttctcgttcactcctgcgtggaattggacgtgcaaggacctcctgctccaggcgcttagggagagtcaatcttatctggtcgaagacctggagcgtagctag

SEQ ID NO: 30421 - DNA, 1311 bp, Artificial Sequence
  Description of Artificial Sequence: Synthetic coding sequence
atgaggctggcccgtctgctccggggagcagccctcgccggtccaggacccggtctgagggctgctggattttcgcgttcatttagttcagactccgggagcagtcctgcgtccgagcgaggtgtacctgggcaagtagacttttacgccaggtttagcccctcgccgctctctatgaagcagtttctggacttcggatccgtcaacgcatgtgaaaagacgagtttcatgtttcttcgccaggaactgcctgttcgtctagccaacattatgaaagagatttctcttttgcctgacaacctgctgcgcaccccctcagtgcagctggttcagtcctggtatatacagtctctgcaagagctgttggatttcaaggataagtccgccgaggatgcaaaggcaatttatgattttactgacacagtcatccggatacgcaacagacataatgatgtgataccgactatggcacagggggtcatcgagtacaaggaaagcttcggcgttgaccctgtgaccagccagaacgtccaatactttctagaccggttttacatgtctagaatttccattcggatgttgctgaatcagcactctctgctgtttggtggcaaggggaaggggtctccctcgcatcggaagcacatcggatccatcaatcctaattgcaacgttctcgaggtgattaaggatggctacgagaacgctagaaggctgtgcgacctctattacattaacagcccagaacttgaacttgaggaactgaacgccaaaagtcccggtcagcctatccaggttgtgtatgtaccctcccacctctatcatatggtgttcgagctctttaagaacgccatgcgagccacgatggagcatcatgctaaccgcggtgtctaccctcccattcaggtgcacgtcactctggggaatgaagacctcactgtcaagatgtccgaccggggtggtggagtgccgttgagaaagattgaccgtctgttcaactacatgtactcaactgcgcctcggccaagagtggaaacatcgagggccgtcccactagctggatttgggtatggcttacccatttcgaggctctacgctcagtacttccagggagatctgaaattgtactccctggaaggctacggcacagacgcagtgatttatattaaagctctttctacagattcaatcgaaagattacctgtctataataaggcagcttggaaacactataacactaaccatgaggccgacgattggtgtgtgccttctcgggagcccaaggacatgactacttttcgcagcgcatag

SEQ ID NO: 30422 - DNA, 1371 bp, Artificial Sequence
  Description of Artificial Sequence: Synthetic coding sequence
atgaggcttgcgcgactcttgcgcggagcagcactcgctggtcctggccctgggctcagagccgcaggattttccaggtctttctcctcagatagcggctcctctcctgcgagcgaaagaggagtgcctggacaagtagatttctacgctaggttctccccaagtcctctctctatgaagcagttcttggattttggatcagttaatgcatgtgaaaagacgtcgttcatgttcctgcgacaagaactgccagtcagacttgcaaacattatgaaagagatctctctattgcctgacaacctcctccggacaccaagcgtccagctcgtacagtcttggtatatccagtctctgcaggagttattagatttcaaggacaaatcggccgaagacgctaaagccatctatgagcggcctagacgaacgtggctccaggtctcttcgctttgttgtatggcctgcaaaatgatatttaccgacacagtaattcggattaggaaccgccacaatgatgtcattccaacaatggctcagggcgtgatcgaatacaaagaatcctttggcgtggaccctgtaaccagccagaacgtgcagtattttcttgacagattttatatgtcccgaattagcatacgcatgctgctgaaccagcactccctgctgtttggaggcaagggaaagggctcgccctcccataggaaacacattggctccatcaatcctaattgcaatgtcctggaagtgataaaggacggctacgagaatgcccgtaggttatgcgatctttactacataaacagtcctgaactagagctagaggaactcaatgccaaaagcccgggacagcccatccaggtggtgtacgtcccctcccacctttatcatatggtgttcgaactttttaaaaatgctatgcgcgctaccatggagcatcacgcaaacagaggcgtatacccccctatccaggtccacgtaacactcggcaacgaagatctgactgttaagatgagcgatcgcggagggggagtgcctctccgaaagatagacaggttgttcaattacatgtattctactgctccgagacctcgggtggagactagccgggcagtgccgctcgcaggattcggctacggtttacctatctctagactctatgcacagtatttccaaggcgacctcaagctttacagcctggagggatatggcactgatgccgtcatttacatcaaagcacttagcacagacagtattgagcggctgcctgtgtacaataaggctgcctggaagcattacaatactaaccacgaggccgacgactggtgcgtgcctagcagagaacctaaggatatgactaccttccgcagcgcttag

SEQ ID NO: 30423 - DNA, 1311 bp, Artificial Sequence
  Description of Artificial Sequence: Synthetic coding sequence
atgaggttggcgaggctgctccgcggagcagctttggcagggccaggaccaggtttgagagccgcaggcttcagcaggagtttctcctctgattctggttcttccccagcttcagagcgtggcgtgccaggacaggtggacttctacgccaggttcagtccttcgccactatccatgaagcagtttctagatttcggatccgtgaatgcctgcgaaaaaacgtcattcatgttcctgaggcaggaattacccgtccgactagccaacatcatgaaggaaatttctctcctgcccgacaacctcctgcgaacaccgtcggtccagctggtacagagttggtatatccagagtctccaagaactgctagacttcaaggataagtcagctgaggatgctaaagccatctatgatttcaccgatacggtcatcagaatcagaaacaggcacaatgacgtcattccaactatggcacagggggtcatagaatacaaggagtcattcggggtggacccagttactagtcaaaacgtccagtacttcctcgaccgtttttacatgtccaggatcagtatcagaatgttgctgaaccagcacagcctgctctttggagggaaaggcaagggctccccttctcataggaagcacattggatccattaatcctaactgcaatgtattggaagtaataaaggacggctacgaaaatgcaaggaggctttgcgatctctactacattaacagccccgagctggaactagaagagctaaacgcgaagtcgccagggcagccgatccaggtggtgtacgtgccatctcatctctaccacatggtgtttgaattgttcaagaatgctatgagggcaactatggaacaccatgccaacaggggagtctatcccccaatccaggttcatgtcactctaggcaatgaagacctcacagtcaaaatgtcagaccggggtgggggagtacctttgcgcaagatagacagactatttaattacatgtactccacagccccaagaccgagagtggagacctcccgcgctgtccctctagcagggtttggatacgggctgccgataagccgcctatatgctcaatatttccagggtgacctgaagttatattcactcgaggggtacggaactgacgctgtgatttatatcaaagcgctcagcactgatagtatcgagagactccctgtgtataataaggctgcttggaagcactacaataccaatcacgaggccgacgattggtgcgtgccatctagggaaccgaaggatatgacaacttttcgttcggcatag

SEQ ID NO: 30424 - DNA, 1083 bp, Artificial Sequence
  Description of Artificial Sequence: Synthetic coding sequence
atgtttctaaggcaggaactgcctgtccgcctggcaaatatcatgaaggaaatttcccttctccccgacaaccttctcagaactccaagtgtccaactcgtgcagtcctggtacatccagagtctgcaagagctgctggacttcaaagataaatctgcagaggatgccaaagcgatctacgattttacagacaccgtgatacgcataagaaaccggcataatgatgtgatcccaactatggcacagggagtgatcgagtacaaggagagttttggagtggatcccgtcacatctcagaacgtgcagtatttcctcgataggttctatatgtccagaatcagtatcagaatgctcttgaatcaacacagcctattattcgggggtaagggtaaaggctcgccctcgcatagaaagcacatcgggtcgattaaccctaactgcaatgttctcgaggttatcaaagatggttatgagaatgcaagacgcttatgcgacctgtactatatcaactcccccgagctggaacttgaagagctcaatgccaagagccccggtcagccaattcaagtggtatacgtgccgtcccatctctatcacatggttttcgagttgttcaagaacgctatgcgcgcaacaatggagcaccacgcaaatcgtggagtatatccgcctatccaagtgcatgtaacgctgggcaacgaagatctgaccgtgaagatgtccgacagaggaggaggtgtccccctgagaaagatcgaccgactgttcaactacatgtattctaccgctccaagacccagagtcgaaacatcacgcgcagtgcctcttgcaggattcggctacggcctccctatcagtagactttatgcccagtattttcagggggatctgaaactgtattctttggagggctacggtactgacgcagtcatctacatcaaggccctgagcaccgactcaatcgaacggctccccgtctataacaaagcggcttggaagcattacaacacaaaccacgaggctgacgattggtgtgtgccttcaagggagccaaaggatatgaccacattcagatccgcctag

SEQ ID NO: 30425 - DNA, 846 bp, Artificial Sequence
  Description of Artificial Sequence: Synthetic coding sequence
atggcccagggagttatcgagtacaaggagtcttttggagttgatccggttactagtcagaatgtgcagtactttctagacagattctatatgtccagaataagtatccgaatgcttctgaaccagcatagtctgctgtttggaggtaaaggcaaaggatccccttctcaccggaagcacattgggtctataaacccaaattgcaatgtgctcgaagtgatcaaagacgggtacgagaatgccagaaggttgtgtgacctctattacatcaattcccctgagctggaactcgaagaactcaatgctaagagccccggacaacccattcaggtggtctacgtccccagccatctttatcacatggtgtttgagctctttaagaacgcaatgcgcgcaaccatggaacaccacgcgaaccggggtgtataccctccgatacaggtccatgtgaccttggggaacgaggatctgaccgtgaaaatgtccgaccggggaggcggagtccctttgcgcaagatcgatcgtctgtttaattatatgtactccacggccccaaggccaagggtggagacatcaagagctgtgccactggccggattcggctatggtctgcctatttcccgactgtatgcacaatactttcagggagatttaaagctctacagccttgagggatacggaaccgacgccgtgatctacattaaggctctcagtacagattctatcgaacggctgcctgtctacaacaaggcggcttggaagcattacaacacaaatcatgaggctgacgactggtgtgttccctccagagaacctaaggacatgaccactttcagatcagcttag

SEQ ID NO: 30426 - DNA, 1032 bp, Artificial Sequence
  Description of Artificial Sequence: Synthetic coding sequence
atgaaagagatcaatcttctccccgaccgggtgctcagcactcctagcgtgcaacttgtacaatcctggtatgttcagtcattgttggatattatggagttcctggataaggaccctgaggaccaccgcactttaagccagttcacggatgctctcgttaccatccgtaataggcacaatgacgtggtgccaaccatggcccaaggggtccttgagtacaaagacacctacggagatgatcctgtaagtaaccaaaacatccagtatttcttagaccggttttatctgtctagaattagtatcaggatgctcataaaccagcataccctcatatttgacgggtctacgaacccagcacaccccaagcacatcggttccatcgaccccaattgtaacgtctcagaagtagtaaaagacgcttatgatatggccaagctcctgtgtgataaatattatatggcttctccagatctggagatacaggaaatcaatgccgcaaactctaaacagcccatccacatggtgtatgttcccagccatctctaccatatgctgttcgagttgttcaagaacgccatgcgcgctaccgtcgagtcacacgagtccagccttatactcccaccaatcaaggtaatggtcgccctgggcgaagaagatctgagcattaaaatgtccgacaggggagggggagtgcccctcaggaaaatagagcgtctgtttagttatatgtactcaaccgcccctactccacaaccagggactgggggaactcccctcgctggctttggctacggcctgccaatcagccgtctgtacgcgaagtactttcagggagacctgcagctcttctctatggaaggtttcggcacagatgcagtcatttatttgaaggctctcagcaccgacagcgttgagcgtctgcccgtctataataaaagcgcctggaggcattaccagacaattcaggaagccggagattggtgtgtgcccagtacagagcccaagaatactagcacctatcgggtctcttag

SEQ ID NO: 30427 - DNA, 1224 bp, Artificial Sequence
  Description of Artificial Sequence: Synthetic coding sequence
atgcgttgggtgtgggcgctactgaagaatgcttctcttgccggagccccaaaatacatagagcacttctcaaagttcagtccgagccctctgtcgatgaagcagttccttgattttggatccagcaatgcgtgtgagaaaacttctttcactttcctccgccaggaattgccagtaagactggctaatatcatgaaggagattaacctccttcccgatagggtgctctcaacaccaagcgtccagttggttcagtcatggtatgtccaatctctgctggacatcatggagttccttgacaaagatcctgaggaccaccggacactaagccaatttaccgatgcgctggtgacgattcgaaaccgtcataatgacgttgtgcccaccatggcccaaggagtgttagagtataaagatacctatggggacgatccggtcagtaaccaaaacatccagtacttcctggaccgtttttaccttagcagaatatctatccgcatgctgatcaaccagcacacactgatctttgacggttctacaaatcccgctcatccaaagcacattggctctatcgatcccaactgcaatgtgagtgaggtggtcaaggatgcctacgacatggctaagctgctttgcgataagtactatatggcctccccagacctggagatccaggagatcaatgccgctaacagcaagcaacctatccacatggtctacgttccgagtcacctttatcatatgctctttgaattatttaaaaatgccatgagggctaccgtagagtctcatgagagcagtctgatcttacccccaattaaggtgatggtggcgttgggagaggaagacctttccattaagatgagcgaccgcggtggaggcgtgccattaaggaaaatcgagaggctcttctcgtatatgtattctactgcccctaccccacaaccagggacaggcggtactccactagcgggatttggctatgggctgcccatctctcgattatacgctaaatatttccagggagatctccaacttttttcaatggagggattcggtaccgatgcagtgatctacctgaaggccctgagtaccgatagcgtagagaggctgccagtgtataataaatcagcctggagacactaccagactatccaggaagcgggagactggtgtgtcccctccacggagccaaaaaatacaagcacctatcgggttagctag

SEQ ID NO: 30428 - DNA, 849 bp, Artificial Sequence
  Description of Artificial Sequence: Synthetic coding sequence
atgcctctgctgacacagcagatacaagacgaggacgaccagtattctcttgttgccagcctcgacaacgtcagaaacttatccacaatactgaaggccatacattttcgagaacacgctacctgcttcgctaccaaaaatggcatcaaagtgactgtcgaaaacgcaaaatgcgtccaggctaatgcttttatccaggccggaattttccaggagttcaaagtgcaggaggaatcggtaacattccgcatcaacctgactgtgctgttggactgcttgagcatcttcggctcgtcaccaatgccagggacgctgaccgcattgagaatgtgttaccagggatatggatatccccttatgctcttcttggaggaaggcggagtcgtgacagtgtgcaaaatcaacacacaggagccagaagagaccttagacttcgacttctgctctaccaatgtgatcaacaagatcattttgcaatccgagggtcttcgcgaggcgttttcggagttggacatgacctcggaagtgctccaaatcactatgtctccggacaagccgtactttaggttgtccacattcggtaatgctggctccagccacctcgactaccctaaggattccgatctgatggaggcgttccattgcaaccaaactcaggtgaaccgctataagatctccctcttaaaaccaagcacaaaagccctggtgctgtcttgtaaggtgagcatccgaacagataacagaggatttttgagcctgcagtatatgattcgtaacgaagacggccagatttgctttgttgagtactattgttgcccagacgaagaggtgcctgaaagcgagtcatag

SEQ ID NO: 30429 - DNA, 849 bp, Artificial Sequence
  Description of Artificial Sequence: Synthetic coding sequence
atgccccttttaacacaacagattcaggacgaggacgatcagtactcgctggtggctagcctagataatgtgcggaaccttagtacgattctgaaggcgattcattttagagagcacgccacctgttttgccaccaagaacggaattaaagtcacggtcgagaacgcgaagtgtgtccaggcgaacgccttcattcaagcaggtatattccaggagttcaaggtccaggaggagagcgtgaccttccgcataaacctaaccgttctccttgattgcctgtcgatttttgggagctccccaatgcctggcaccctgaccgcccttcggatgtgctaccagggctacggatacccacttatgctgtttctggaggaaggcggtgtagtgacggtctgcaagatcaacacccaggaacctgaggagaccctggattttgatttttgcagtaccaacgtgatcaacaaaataatcctccagagcgaaggtctgcgagaggcattctcggaattggatatgactagtgaagtgctccagattaccatgtctccagataaaccttactttcggctctccactttcggaaacgccggaagcagtcatctggactacccaaaggactccgatctgatggaggcttttcactgcaatcaaacccaggtcaacaggtataagatatctttactcaaaccgagcaccaaagccctagtgctgtcctgtaaagtttctatacgcactgataatcggggattcctatccttgcagtacatgatcagaaatgaggacgggcagatttgtttcgtagagtattactgttgtcccgatgaagaggttcccgagagtgaaagctag

SEQ ID NO: 30430 - DNA, 741 bp, Artificial Sequence
  Description of Artificial Sequence: Synthetic coding sequence
atgccgctgctaactcagcagattcaggatgaagacgaccagtacagcttagtagcttccctcgataatgttcggaatctgagcacaatcctaaaagctatacatttccgggaacacgccacatgcttcgccactaagaacggaattaaggtcaccgttgaaaacgccaagtgtgtgcaggccaatgctttcatacaaggaacgctaactgctttgcggatgtgttaccagggctacggctatccattgatgctctttctagaggaaggaggggtggtgactgtctgcaaaatcaatacacaagaaccggaagaaacattagattttgacttttgttccacaaatgtaattaataagatcattttacagtcagaagggcttcgcgaggccttcagcgagttggacatgaccagtgaagtgttgcagatcaccatgagtcccgataagccctatttcaggctctcaactttcggaaatgcgggttccagccatttggactatcccaaagactccgacttaatggaggctttccactgcaaccagacacaggttaatagatacaaaatttctctgttaaagccaagtactaaggctctggttcttagctgcaaggtgagtattcgaaccgacaatagggggttcttgagcctgcagtacatgattagaaatgaggatggacaaatctgttttgtggagtactattgttgtcccgatgaagaggtaccagagagcgagagttag

SEQ ID NO: 30431 - DNA, 1755 bp, Artificial Sequence
  Description of Artificial Sequence: Synthetic coding sequence
atgaatcagcacgagctggctgtgcacaagaagaagattgaagaagtcgagacatggctcaaagcccaggtgctggaaagacagcccaagcagggcggatccatattactgattacagggccaccaggctgtgggaagactactaccctcaaaatcctttctaaagaacacggcatacaagttcaggagtggattaacccagtgttacctgatttccagaaagatgacttcaagggaatgtttaacacagagagcagcttccatatgtttccttaccagagtcagattgccgtttttaaggagttcttgctgagggccactaaatataataaattgcagatgcttggcgacgaccttaggactgacaagaagataatccttgtggaggatctgcctaatcaattttatcgcgattcccacaccctgcatgaggtcctcaggaagtatgtgcgcatcgggcgttgtcccctgatctttatcatatctgattcactgagcggagataacaaccagagactcctgttccccaaggagattcaggaagaatgttccatttccaacatcagtttcaatcccgtcgcaccgacaatcatgatgaagtttctcaaccggattgtgacaattgaggcgaacaaaaacggagggaagattacggtgccagataagacttcactggagttactctgtcagggctgttcaggtgatatcagaagtgccattaactcactgcagtttagctctagtaagggcgagaataatctgagaccgcgaaagaagggaatgtctctgaaaagcgatgccgtcctgagcaagtctaagagaagaaaaaagcctgaccgagtgttcgaaaaccaggaagtgcaggctattggcggaaaagacgtgtccttgtttctgtttagagcacttggaaagatactatactgtaagcgggcaagcctcacagaactagacagcccccgtctgccttctcacttatcagagtacgagagagatacgctgttagtcgaaccagaggaggtagtggaaatgagtcacatgcccggagacctctttaacttgtacttacatcagaactatatcgacttcttcatggaaattgatgacattgtccgcgctagcgaattcctgtcatttgccgacatactgtccggagactggaataccaggtctctgctccgggagtacagtacatcgatagccacaagaggtgtcatgcactcaaataaagccagggggtatgcgcattgccagggagggggatctagtttccggccactacataagccacagtggttcctgataaataagaaatatagagaaaattgcctggccgctaaggccctattcccggacttttgccttcctgccctgtgcctccaaacgcagttgctgccttacttagccttgctcacaataccgatgagaaaccaggctcagataagctttatccaggacattgggagactgccccttaaacgacacttcgggcgactcaagatggaggcgctgaccgaccgggagcacggtatgatagaccccgactcaggcgatgaggcccagttgaatggtggacactcagcagaagaaagtcttggcgaaccaacccaagccactgtccccgagacttggtccttacctctgtcacagaatagcgcctctgagctgcccgctagtcagcctcaaccattttccgctcagggcgatatggaagaaaacattattatcgaagactatgaaagcgatggaacatag

SEQ ID NO: 30432 - DNA, 2013 bp, Artificial Sequence
  Description of Artificial Sequence: Synthetic coding sequence
atgaatcaggtcaccgattgggttgacccaagctttgacgactttttagaatgctccggcgtatctaccattacagccacctcgttgggtgtgaataactcttcccaccgcagaaaaaacggccctagcacactggaaagctcacgctttccagcaagaaagcgcggtaacttgtcttctcttgaacaaatttacggactggagaattcaaaagagtacctgtccgagaacgagccatgggttgacaaatataaacccgagactcagcacgagctcgcggtccataagaagaaaattgaagaggttgaaacctggcttaaggctcaggttctcgagcggcagcccaagcagggaggcagcatcttgctgataacaggcccacctggatgcggaaagacaactaccttgaaaatcctttcaaaagagcacgggatccaggtccaggagtggattaatcctgttttgccagactttcaaaaggacgactttaaaggcatgttcaacacggaatcgagctttcacatgtttccatatcagtcacagatcgccgtgttcaaagagtttctactcagagcaactaagtataacaaattacagatgttaggtgacgatttacgaacagacaaaaaaataattcttgtggaggatctcccaaatcagttctaccgcgattcccacactctgcatgaggtgttacgaaagtatgtgagaattggaagatgtccactgatatttatcattagtgattcgctgagcggcgacaacaaccagcggctgctgtttcccaaagaaattcaagaggagtgtagcatcagtaatatcagtttcaacccagtcgcaccgaccattatgatgaaattcctaaaccggattgtcacaattgaggcaaataaaaacggtgggaagattaccgtcccagataaaacaagccttgaactgttgtgtcagggctgttctggcgatatacggtctgcaattaatagtctgcaattctcaagtagtaaaggtgaaaacaatctccgtcccaggaagaaaggcatgagccttaagagtgacgccgttttgtcaaagagtaagaggcggaaaaaacccgacagggtgttcgagaaccaggaggttcaggctatcggtgggaaagacgtttcactcttcctctttagggcccttggaaagattttgtactgtaaacgggcatccctgactgagctggatagcccacgactcccctcccacctgtcagaatacgagagggataccctgctggtggagcctgaggaagtcgtggagatgagtcatatgcctggtgacctgttcaacctgtatcttcatcaaaattacattgacttttttatggaaattgacgacatcgtccgagcgtcagaattcctatctttcgccgacatcttatccggcgactggaatacaagatctcttctcagggagtacagtacctctatcgccacacgaggggtgatgcactccaacaaggctcgcggatatgcccactgccagggtggaggctcttccttccggcctctccataaaccacaatggttcctgatcaataagaaataccgagaaaattgtctggcagcgaaggccctgttccccgacttttgtctcccggctttgtgccttcagacccagttactcccttatttggcccttttgacaattcccatgcgcaatcaggctcagatctccttcatacaggatattggacgcctgcctttgaaacgacacttcggcaggctgaaaatggaggccctgactgaccgagaacatggtatgattgatccagatagtggcgacgaagcccagctgaacggcggacactccgcggaggaaagcttgggcgagcccacacaggccacagtgcctgaaacgtggtccctgcccctcagtcagaatagcgcgtcggaactgcctgcgagccaaccccagcccttttctgctcagggcgatatggaagaaaacatcataatcgaggactacgaaagcgacggcacctag

SEQ ID NO: 30433 - DNA, 2013 bp, Artificial Sequence
  Description of Artificial Sequence: Synthetic coding sequence
atgaaccaggtgacggattgggtcgatccaagttttgatgacttcctggagtgctctggggtttctaccataacagctacatccctgggagtgaataacagcagccataggcgcaaaaacggtccttcaacactggaaagtagccgcttccccgctcggaagagaggcaacttgagcagcctggaacagatctacggattggagaactccaaggagtacctgagcgaaaatgagccatgggtcgataagtacaagccggagactcagcacgaactggcagtccataagaaaaagattgaggaggttgaaacatggcttaaggcacaggtgttagaacggcagccgaagcaaggaggctccatacttctgatcaccggccctccaggttgtggcaagacaactactttaaagatcctttccaaagagcatgggatacaggtccaggagtggatcaatcctgtgcttcccgacttccagaaggatgattttaaaggaatgttcaatacagagtcctccttccacatgtttccatatcagagccagatcgccgtttttaaggaattcttattacgggctacaaaatataacaaattacagatgctcggcgacgacctgcggacagataagaagatcatccttgtggaagatctcccaaaccagttctacagggactctcacaccctgcacgaagtactcagaaagtatgtcagaatcgggaggtgtccccttatcttcattatttcagacagcctgtccggagataacaatcagcgcctactctttccaaaggagattcaagaggaatgctccatatccaacatttcttttaatcctgtcgctcccacaattatgatgaagttcttaaatcgaatcgtaaccatagaagcaaataaaaatggcggtaaaatcaccgtcccagataaaaccagcctggagctgctgtgtcagggatgcagtggtgatatcaggtccgcgatcaatagcctgcagttctcctcatccaaaggagaaaataacttgcgccctcgcaagaagggaatgtccctgaagtcagacgcggttctgagcaagtcgaagaggagaaagaaaccagatcgtgtgtttgagaaccaagaggttcaggcaatcggcggaaaggacgtatcgttgttcctgttcagggcactgggcaaaatcttgtactgtaaacgggcttctctcacggagctggactccccaaggctcccctctcacctgtctgagtatgagcgtgataccctgctagtggaaccagaagaggtggtggagatgagccatatgcccggagacctgtttaacctctatcttcaccaaaactatattgacttcttcatggagattgatgatattgtgagggcaagcgagtttcttagtttcgccgacatcctttctggggactggaatacccgatcattattgagggaatattcaacatcaattgccacaaggggcgtaatgcattctaacaaagccagaggctacgcccattgtcagggtggaggcagcagcttcaggcctttacataaaccacaatggtttctgatcaacaagaagtatcgcgagaattgtttggcggcaaaggccctgttccccgacttctgtctgcctgcgctatgcctgcagacacaactgttgccctatctggctctcctgaccattcctatgagaaatcaggctcagatttcctttattcaagacattgggagactccctttaaagaggcatttcggtcggttgaaaatggaagccctaaccgaccgcgagcatgggatgatcgatcccgacagtggagatgaagctcagctgaatggcggacactcggctgaggagtcattaggcgagcctacccaggctactgtgccagaaacctggtcactcccattgtcacaaaattcagccagcgaattgcccgcttcccagccccagccctttagcgcccaaggggacatggaagaaaacatcatcatcgaggattacgaatcggacgggacctag

SEQ ID NO: 30434 - DNA, 2013 bp, Artificial Sequence
  Description of Artificial Sequence: Synthetic coding sequence
atgaatcaggttacagactgggtcgatccttcttttgatgacttcctcgaatgttcaggggtttccactattacagccacgagcttgggagtcaacaactctagccaccgccgaaaaaacggtccctcgacgctggagtcctctcggtttcccgctcgaaagaggggaaatctgagttctctcgagcagatatatggtctggagaacagtaaggagtatctgtccgaaaatgagccctgggtggataagtacaaaccagagacacagcacgagctggccgtccataagaagaagatcgaggaagtggaaacatggctgaaggctcaggtcttagaaagacaacctaaacagggtggctccattctacttataacgggtcctcccggatgcggaaaaaccactacattaaagatcctgagtaaagaacacggaatccaggtgcaggagtggattaaccccgtgctgccagactttcagaaggatgactttaaaggcatgtttaacacagagagtagctttcacatgttcccctaccagtctcagattgcagtgttcaaggagtttctattaagggcaacaaaatacaataaactgcagatgttgggcgatgatctgagaacggataagaaaattatacttgtggaggatttgccgaatcaattttaccgtgacagccatacgctgcacgaggtattgcggaaatatgttagaatcggcaggtgcccactgatattcattattagtgactctctctccggtgacaacaaccagaggctgctgttccccaaggagattcaggaggagtgctcaatctcaaatatcagtttcaacccagtggcacctaccatcatgatgaagtttctgaacagaattgtgacgatcgaggccaacaagaatggcggtaagatcaccgtaccagacaaaacctcgctggagcttctgtgtcaaggctgctccggggacattaggagtgccataaactcactacagttttcatcgtccaagggcgagaacaatcttagacctcgtaaaaagggtatgagtctgaagagcgacgccgtcctaagcaagtcaaaaaggcgcaaaaaaccagaccgggtgtttgaaaatcaggaggtccaggcgattggaggaaaagatgtttcactgttcctgttccgggctttagggaaaatcttgtactgcaaacgggcatcgctcaccgagttggattccccgcgtctcccgtctcacttatccgaatatgagagagatacattgcttgttgagccagaggaagttgtggagatgtctcacatgcctggagacctatttaatttgtatctgcaccagaactacatagactttttcatggaaattgatgacatcgttagagcttccgagttcctgagtttcgcagacatactgagcggagattggaatacgcggagtctgcttcgggaatacagtacatctattgccacccggggtgtaatgcattccaacaaggcgaggggatacgcccactgccagggcggagggagcagctttcggcctttacacaagccgcagtggttcctgattaacaagaaatacagagagaattgcttagccgctaaagccctatttcctgacttttgtctgccggcattgtgcctccagactcagctgcttccatacctggcactgttaactatacctatgagaaaccaagctcagatttcattcatccaagatattggccgtctccctcttaagaggcacttcggaagattgaagatggaggcacttaccgatcgcgagcatggaatgattgatcctgattccggagatgaagcacaattgaacggaggtcatagtgcagaagagtcactgggtgaaccgacccaagcaaccgttcctgaaacatggagcctgccactgtcccagaactcggcctcagagcttccagcttcacaaccacagccttttagcgcccagggggacatggaggaaaacatcataattgaagactatgagtccgatgggacatag

SEQ ID NO: 30435 - DNA, 2013 bp, Artificial Sequence
  Description of Artificial Sequence: Synthetic coding sequence
atgaaccaggtgaccgactgggtcgatccttcgtttgatgactttctggagtgctctggcgtgtccacaattaccgctaccagcctgggggttaataactccagtcaccgacgtaagaacgggcctagtacgttggaaagcagccgcttcccagcacgcaagaggggcaacctgagttccctcgagcagatttatggccttgaaaacagcaaggaatatctgtccgagaatgagccctgggtggataagtacaaacccgagactcagcacgagcttgcggtccataagaagaagatagaagaagtggaaacttggctgaaagcccaggtgctcgagagacagcccaaacaggggggatcaatcctcctcatcactggtccaccgggttgtggaaaaaccacgacactgaagatcctgtctaaggagcatggcattcaggtacaggagtggatcaaccctgtgctgcccgatttccagaaggacgattttaaggggatgttcaacacggaaagctcctttcatatgttcccctaccaaagccagattgccgttttcaaagagtttcttctccgagccaccaagtacaacaaactgcaaatgctgggcgacgacctgcgcactgataagaagatcatcctggtagaagatctgcccaaccagttttatagagacagtcacaccctccacgaagtgctacggaaatatgtgcgaatcgggagatgtccgctgatcttcataatttccgatagcctaagcggagacaataaccaacgcctgctgtttcccaaggagatccaagaggaatgctccatctctaatattagctttaaccctgtagcacctactatcatgatgaaattcctcaatagaatcgtgactattgaagccaataaaaatggtggcaagattaccgtgccagataaaactagcctggaactgctttgccagggatgttccggcgacatccggtccgctattaatagcctgcagttttctagttccaagggtgaaaataacctaagacctagaaaaaaaggcatgtccctgaagagtgatgccgtcctgtccaaaagcaagaggcgcaaaaaacccgatcgggtcttcgaaaatcaggaagtacaggccataggtggcaaagatgtgtcattatttctgtttcgagccctcggcaagatcctgtactgcaaacgcgcatctctcacagaactggattcaccacgtcttccttcccatctcagcgagtatgaacgtgacaccctcctggtggaaccagaagaggtggttgaaatgtcccatatgcccggagatctctttaatctgtatcttcaccagaactacatcgacttctttatggagatagatgacattgttagggcatccgaatttctgagtttcgcagacatccttagtggagactggaacacccggtccctgttacgggagtacagcactagtattgcaactcggggagtcatgcactcgaataaggcacgcggatatgctcactgccaagggggtggatcctccttcaggcctttacacaagccgcaatggttcctgattaataagaaataccgggaaaactgtctcgcggctaaagcactttttcccgatttctgtttgcccgctctctgtttgcagacccagctactgccgtacttggccctgctgacaattcctatgcggaaccaagcccagatctctttcatacaggacatcggcaggctacccctgaaacgccatttcggcagattaaaaatggaggccctgacagacagggaacatggcatgattgatcccgactccggggatgaagcacaattgaacggtgggcatagcgccgaagagtcactgggagaacctactcaagccactgtacctgaaacttggagtcttccgctgtctcagaactctgctagtgagctgcctgcctcacagcctcaacctttttcagcacagggtgatatggaggaaaacatcattatcgaggactatgaatccgatggtacttag

SEQ ID NO: 30436 - DNA, 1518 bp, Artificial Sequence
  Description of Artificial Sequence: Synthetic coding sequence
atgttcaacaccgaaagttcttttcacatgttcccatatcagagccagatcgcggttttcaaggaatttctgcttcgagccacaaagtacaataaacttcagatgttgggagacgacctgagaaccgataaaaagatcatcctggtggaagatttgcccaatcagttttatagggactcccatactctgcatgaggtgctgagaaagtatgttaggatagggcgttgcccactgatctttattatctcagactctttatccggtgacaataaccaacggctcctctttccaaaagagatccaggaggaatgttccatctcaaacatctctttcaacccggttgctccgacgatcatgatgaagtttcttaaccggatagtaaccattgaggcgaataaaaatggaggaaagatcaccgtacccgacaaaacctcattggaacttctgtgtcaaggctgctctggggacatacgctccgcaataaattctcttcagttttcatcttccaagggcgaaaataacttacgtcctagaaagaagggcatgtcgctgaaatccgatgccgtgctgtccaaaagtaagagacggaagaagcccgaccgcgtgttcgaaaatcaggaagtgcaagcaatcggaggcaaagacgttagcctgtttctgttccgcgcactcggcaagatactgtattgcaaaagagccagtctgacggaactggactcgcctaggttaccaagccacctgtccgagtacgaacgagacacattactcgtcgagcctgaggaagtagtggaaatgtcacacatgcctggagatttatttaacctgtatctccaccagaattatatagactttttcatggaaattgatgacattgtgagggcaagtgaattcttatctttcgctgacatcctgtcgggggattggaacacgcggtctctgttgcgcgagtactctaccagtatcgcgacccgtggtgtgatgcattcgaacaaggcacgaggatatgctcattgccagggaggaggcagtagctttcgacccctgcacaagccccaatggtttctgatcaacaagaagtacagggaaaattgtctggcagccaaggcactattccctgacttctgcctcccagccctctgtctacagacgcaactgctgccgtacttggccctgttgacaattcctatgaggaatcaagctcagattagttttatacaggacatagggagactcccactaaaaagacacttcggtcgactcaagatggaggctctcacggacagagagcatggaatgatagaccctgactcaggcgacgaggcccagctgaacggaggacatagcgccgaggaaagtcttggtgaaccaacacaggctaccgtcccagaaacatggtctctgccgctttcccagaattccgccagcgagctccctgcctcacagcctcagccgttcagtgcccaaggagacatggaagagaacatcatcattgaggattacgagtcagacggcacatag

SEQ ID NO: 30437 - DNA, 2013 bp, Artificial Sequence
  Description of Artificial Sequence: Synthetic coding sequence
atgaatcaggtaaccgactgggtggatccctcatttgatgattttctcgagtgttccggagtgagcaccatcacagcaacatctctcggcgtcaataattcctcacatcgcaggaagaacgggcctagcaccctcgaatccagtaggttcccagcgagaaaacgcggaaatctcagctccctggagcagatctatgggctggagaactccaaggagtatttaagcgaaaacgaaccctgggtcgacaagtataaacccgaaacccagcatgaactggccgtccataaaaaaaaaatcgaagaggtagagacctggcttaaggcccaggtgctcgagcgccagccaaagcagggcggttccatcctgcttattactggccctccaggttgtggcaagactacaaccctgaagatcctctcaaaggaacacgggattcaagtacaagagtggattaacccagttctgcctgactttcaaaaggacgatttcaagggcatgtttaacacagagtcatcattccacatgttcccatatcagtcacaaatagctgtgttcaaggagttcttgctgcgggctactaaatataacaagttgcagatgctgggcgatgatttgcggacggacaagaagatcatcctggtggaggatttgcctaaccagttctatcgcgatagtcatactttacacgaagttttgcgcaagtatgtccggatcggccgatgcccactgattttcatcatttctgactccttgagtggcgataataatcagagactgctgtttcccaaagagattcaggaggagtgttctatttctaacattagctttaaccctgtcgcccctaccattatgatgaaattccttaatcggattgtgaccatagaggcgaataagaacggcggaaaaataaccgtgcccgacaaaacatcactggagctactctgccagggatgttctggcgacatcagatcagctatcaattcactccagttctctagctccaagggagagaataacttgagaccgagaaaaaagggcatgagtctcaagtccgatgcagttctatcaaagtccaaaaggcgaaaaaagcccgatagggtgttcgaaaaccaggaagtgcaagctattggcggaaaagatgtaagcctttttctgtttcgagctctgggaaagatactgtattgcaaaagagcttccctgactgagctggatagccccaggttaccctcccacctcagcgagtacgagcgtgacaccctgcttgtggagcccgaggaggttgtggaaatgtcacacatgcctggagatctattcaatctctacctccaccaaaattacatcgacttttttatggagatcgacgatatagtgagagccagtgaattcctgagttttgctgacattctgagcggggattggaacactcggtctctcctccgcgagtacagtacctcgatcgctacacgtggagtcatgcacagcaataaagccaggggttatgcccattgtcagggcggagggagctctttcaggccgcttcacaagccacagtggtttctgattaacaagaaatatcgggaaaactgcttagccgctaaagctctttttcctgatttttgtctgcccgctttatgtctccaaacacagcttctcccttacctggcattgctgaccatacccatgcgtaaccaggcccagatcagctttatacaggacattggccgactgccactgaagcgccacttcggtagactcaaaatggaagcacttacagatcgagagcatggtatgatagacccggattctggcgacgaggcccaactgaacggaggccattcagccgaggagtctttgggtgaacctactcaggcgaccgtacccgagacttggtccttacccttgtcgcagaacagtgcttcagagctgccggcatcccagccccagcccttctctgcccaaggagacatggaagaaaacattattatcgaggattacgagtcggatggcacttag

SEQ ID NO: 30438 - DNA, 2046 bp, Artificial Sequence
  Description of Artificial Sequence: Synthetic coding sequence
atgtcgaagacttttctaaggcctaaggtgagttccaccaaggtgaccgattgggtggacccctcttttgatgatttcctggaatgcagcggtgtgtctaccatcaccgctacctccctgggggtgaataactcctcacatcgcaggaaaaatggacccagcacgctagagtcatctcgatttcccgctcggaagcgtggcaatctctcaagcttagaacagatttatgggcttgaaaattctaaagagtacttgtctgaaaatgaaccctgggtggacaaatataagcccgagacacagcacgaattagccgttcataagaagaagatcgaagaggtagagacctggctcaaggcacaagtcctggaacgccagcctaagcagggaggctccattctgctgattactggtcccccaggttgtggaaagaccacaacccttaagattttgagtaaagaacacggaatacaggtgcaggaatggatcaaccccgttttgcctgattttcagaaggacgactttaagggaatgttcaataccgagagtagctttcacatgttcccgtatcagtcccagatcgctgtgttcaaggaatttttgctgcgagccaccaagtacaataaattgcagatgcttggagacgacctcaggacggataagaaaatcatcctcgtggaggatctgccaaatcagttctaccgcgacagccacactcttcatgaggtccttcgtaaatacgttagaattggcaggtgtcccctgatatttatcatttctgacagcctatctggagataataatcaacggctgctctttccaaaagagattcaggaagaatgctccattagcaacatatcctttaacccagtggctccaaccatcatgatgaagtttttaaacaggattgtgacaattgaggccaacaagaacggtggtaagattaccgtgcccgacaaaacttctctagagctgttatgtcaggggtgctccggggacatacggtccgcaatcaactccctgcagttcagcagctccaaaggcgaaaacaacctcaggcctcggaaaaagggcatgtcgctgaaatccgatgcagtgctgtctaagagcaagagaaggaaaaagcccgatcgtgtctttgaaaatcaggaggtgcaggcgattgggggaaaggatgtatctctctttctgttcagggctttaggcaagatcctgtattgtaaacgagcgtccctcacagagctggacagtccaaggctgcctagccacctaagcgagtatgagagggatacactcctggtcgaaccagaagaagtggttgagatgagtcatatgccaggagatctttttaatctgtacctccaccagaactacattgactttttcatggagatagatgatattgtgcgtgcttctgaatttcttagcttcgctgatatcctatcgggagactggaacactcgatctctgctgcgcgagtacagcacttcaatcgctactcggggagtgatgcactcgaacaaagcccgagggtatgcccactgtcagggcggaggttccagcttccgcccattacacaaaccccagtggttcctgattaacaaaaagtatagagaaaattgtcttgccgctaaggctttatttcctgatttctgcctgcctgctctctgcctgcagactcagctgcttccatatttagctttactcaccatcccaatgcgcaatcaggcccagatttctttcatccaagacatagggaggctgcccttaaagaggcattttggcaggcttaagatggaggccctgacagacagagagcatgggatgatcgaccctgactctggtgatgaggctcagctgaacggaggccattctgcagaggaatcactaggggaacctacccaagccacagtaccggagacatggtcgctgcctctgtctcagaactctgcttccgagctccctgcaagtcagccccagcccttcagcgcccagggagatatggaggagaatattatcatcgaagattatgagtccgatgggacctag

SEQ ID NO: 30439 - DNA, 510 bp, Artificial Sequence
  Description of Artificial Sequence: Synthetic coding sequence
atgaatcaggtgactgactgggtggaccccagttttgacgacttcctggaatgttccggggtgagcacgattaccgctacgagcctgggtgtgaacaactcttctcacagacgtaaaaacggcccttcaaccctggaatcttcacggttccctgcccgaaaaagagggaacctgtcatcactggagcagatttatggtctcgaaaatagtaaggaatacctgtctgagaatgagccatgggtagataagtataagcccgagacacagcacgagttggctgttcacaagaaaaaaatcgaggaggtcgagacatggcttaaagcccaagtgcttgaacggcagcctaagcaggggggtagcattctgctcatcacagggcctcctggctgcggaaagactacaacactcaagatcctgtctaaggaacatggcatccaagtgcaagaatggatcaatcccgtgttacccgatttccagaaagacgacttcaagggaatgtttaatacttag

SEQ ID NO: 30440 - DNA, 66 bp, Artificial Sequence
  Description of Artificial Sequence: Synthetic coding sequence
atgaatcaggttactgactgggtggacccgagctttgatgacttcctggaatgctctggtgtgtag

SEQ ID NO: 30441 - DNA, 2046 bp, Artificial Sequence
  Description of Artificial Sequence: Synthetic coding sequence
atgtccaagacattcctcagacccaaggtgagctctactaaagtgacagactgggttgacccaagcttcgacgatttcttggagtgctccggcgtgagcacaataaccgcaactagtttaggtgtgaataactcttctcatcgacggaagaacggaccttctactctggagtctagcagattccccgcaaggaaacgagggaacctgagttctctggagcagatttacggactggagaattcaaaggagtaccttagtgaaaatgaaccttgggtagataagtataaaccagagacacagcacgagctggcagtgcataaaaaaaagatagaagaggtggagacgtggcttaaagcccaggtcctggaacgccagccgaagcagggaggaagcatcctcttaattacaggaccccctggctgcggtaagaccacaactttgaaaatcctctccaaggaacacggaatacaggtgcaggagtggattaaccccgtgctccctgatttccagaaagatgatttcaagggaatgtttaataccgagtcaagcttccacatgttcccctatcagtcacagattgccgtgttcaaggaatttttactgcgggcaacgaaatacaataagttgcagatgcttggggacgatctgagaactgataagaagatcatccttgtcgaagacctgccaaatcagttctatcgcgacagccataccttgcacgaagtgctgagaaagtacgtccgcattgggagatgcccactaatcttcattatctccgactctctgagtggggataacaaccagcggctgctttttccaaaggaaatccaggaggagtgctccattagcaacattagcttcaaccccgtggcacccaccatcatgatgaagttcctgaatagaatcgtgaccatcgaagccaataaaaacggagggaagatcaccgtaccagataaaaccagtctggagctgctctgccagggatgctcaggagacatcagaagcgctataaatagcctgcaattcagctcttctaaaggtgaaaacaacctgaggcctagaaagaaggggatgagcctgaaatctgatgccgtcctttcaaagagtaaaaggcgcaagaagcccgacagggtgttcgagaatcaggaggtgcaggccatcgggggaaaagatgtcagcctgttcttgttccgggctcttgggaaaatcctgtactgtaaacgcgctagcttgaccgagctagattctcccaggctgccctcccatctgtctgaatacgagcgcgataccttgctggtggaacctgaggaggttgtagagatgagtcatatgcctggggatctgtttaacctctatctgcaccagaactacatagacttcttcatggagattgacgatatcgtccgggcaagcgaatttctctcgttcgccgacatcctatctggcgactggaatacccgaagcctactgagagaatacagcacatccattgcaaccaggggagtgatgcattccaataaggcccgaggatacgcacattgtcaggggggtggctcctctttccggcctctacacaagccgcaatggttcttaatcaataagaagtatagggaaaattgtctggccgcaaaagccttattccccgacttctgtcttcctgccctgtgtctacaaacacagcttctgccttatctggcactgttaactataccgatgcggaatcaggcgcagatctcttttatccaggatattggcagacttccccttaaacgccattttgggaggttgaagatggaggctctgacagatcgtgaacacgggatgatcgaccctgattcaggggatgaggcacagttaaatgggggtcacagtgccgaagagtctctaggagaaccgacccaagccaccgtccccgagacttggtccctcccgcttagccaaaactctgcaagtgaactcccagcctctcagccacaaccatttagtgcccagggtgacatggaggaaaatataattatcgaagactatgaatctgatggcacttag

SEQ ID NO: 30442 - DNA, 1518 bp, Artificial Sequence
  Description of Artificial Sequence: Synthetic coding sequence
atgttcaacaccgagtccagctttcacatgtttccatatcaatcgcagattgcagtgtttaaggagtttcttctcagggccacaaagtataataaattgcagatgttgggagatgatctccggaccgacaagaaaataatcttggttgaggacctgccaaatcaattctatcgtgacagtcacacactgcatgaggtgctgcggaagtacgtgcggattggaaggtgtcctctcatcttcattattagcgactcactgtcaggggacaacaatcaaaggcttctgtttccgaaagaaattcaagaagagtgtagcattagcaacattagctttaatcctgtggcacccacaattatgatgaagttcctcaaccgcattgtgactatcgaagcaaacaaaaatggaggcaagatcactgtccctgataagacttcactcgagcttctgtgccagggatgttccggcgacatcagatcagccattaattctcttcaattcagctcctccaaaggggagaataatctgagacccaggaagaagggaatgtctctcaaatctgatgctgtactgagcaagtccaagcgaaggaagaaacctgatagggttttcgagaaccaggaagtccaagctattgggggaaaggacgtgtcgctctttctgttcagagccctcgggaagattctttactgcaagagagcctctctcaccgaactggattctcctcgactcccatcccatttaagcgaatacgagcgggacactctgctcgtggagcccgaggaagttgtcgagatgtctcacatgccaggcgatctgtttaacctctatctacaccagaattatattgacttcttcatggagatcgatgacatcgtgagagcgagtgaattcctgtctttcgccgatattctgagcggagactggaatactaggtccctgcttagggaatacagcacgtccatcgcgacccgaggtgtaatgcacagcaataaggcacgcggttacgcccactgccagggtggtggatcaagtttcaggccactgcacaagccgcagtggttcttgatcaacaagaaatatagggaaaactgtttagctgcaaaggcgctgtttccagacttctgcctgccagcactgtgccttcagacacagctgctgccctacttggctttgctcacaatacctatgagaaatcaagcccaaatttcttttattcaggacattggtcgtctgcctcttaaacgtcacttcggcagactgaagatggaagcactgaccgatcgcgaacacggcatgatcgacccggacagcggtgacgaggcacagctgaatggcggacattctgccgaagaaagcctcggtgaacccacccaggccaccgtacccgagacctggagtctaccactctcccagaacagtgcatcagagcttcccgcttcccaacctcagcctttctcagctcagggagatatggaggagaatattatcattgaagactatgaaagcgatggaacctag

SEQ ID NO: 30443 - DNA, 1488 bp, Artificial Sequence
  Description of Artificial Sequence: Synthetic coding sequence
atggactccctcgctgaatcacgctggcctcccggactggcggttatgaagactatcgacgacttgctccgatgcggaatctgctttgagtacttcaatattgcaatgatcatcccgcagtgttcgcacaattattgctcattgtgcatccggaaatttctatcatataaaacccagtgcccgacttgctgcgtcactgtgacagagcctgatttgaaaaataacagaatccttgatgaactcgtgaagagtctgaattttgctcggaaccacctcctacagtttgctctcgagagccccgctaaatccccagcgagttcttctagcaaaaacctggccgtgaaagtgtacactccagtggcatcaagacagtcactgaagcagggatcaagactgatggataatttccttatccgtgaaatgtccggttccacatccgagctcttaatcaaggaaaacaagagcaagttcagcccccagaaagaggcctctcctgccgctaagaccaaggaaacgcgcagtgtggaagaaattgcaccggacccatctgaggccaagcggccagaacccccaagcacaagcacccttaagcaggtaaccaaggttgactgccccgtttgtggtgttaacattcccgagtcacacattaacaagcacctggactcatgcctgagccgcgaggaaaaaaaagagtccctgcgctcctccgttcacaaacgtaagcccctcccaaagaccgtgtataacctcctgtcggaccgcgacttaaagaagaagctgaaggaacatggcttgtctatccaggggaacaagcagcagctaataaagcggcaccaggaattcgtgcatatgtacaacgcacagtgcgatgcactacaccctaaatccgccgcagagatagtccgcgaaatcgagaacattgagaagacaagaatgagattggaggcatctaaacttaatgagtctgtgatggtatttaccaaggaccaaacagaaaaggaaatagatgaaattcatagtaagtacaggaaaaagcataaaagtgagttccagttgttggtcgaccaagcccgaaaaggctataaaaaaatcgctggcatgtcacagaagaccgtaaccatcaccaaggaagatgaatctactgaaaaattgagttccgtatgcatgggccaggaagataatatgacatccgtgaccaaccacttcagtcagtccaagttagactcccctgaggagttggagcctgatcgcgaagaggattccagctcctgtatcgacatccaagaagtgctctcctcctctgagagcgactcatgcaattcgtccagttccgacattattcgggatctgctagaggaggaagaggcctgggaagcctctcataagaatgacctccaggacaccgaaatcagcccgagacagaaccgacgcacgcgagctgccgaaagtgcagagatcgagccaaggaacaagcgcaatcgcaactag

SEQ ID NO: 30444 - DNA, 279 bp, Artificial Sequence
  Description of Artificial Sequence: Synthetic coding sequence
atggactcccttgctgaatctagatggccacccggattggctgtgatgaagacaatcgacgaccttctgagatgcggcatctgtttcgagtactttaacattgcaatgattatacctcagtgttcccacaactattgtagcttatgcataaggaagtttctctcatataaaacgcagtgcccgacctgttgtgtgactgtaaccgagcccgatcttaagaataatcgcatcctggatgagctggtgaaatcattaaacttcgcgaggaaccatttgtag

SEQ ID NO: 30445 - DNA, 1092 bp, Artificial Sequence
  Description of Artificial Sequence: Synthetic coding sequence
atggctgtgacaattacactgaagaccctgcaacagcagacctttaaaatccgcatggaaccagacgagactgtcaaagtcctgaaagagaagatcgaagcggagaaaggacgggatgcgttccccgtggctggacaaaagctcatctacgccggaaagatcctatctgatgatgtcccaatccgggactatagaattgacgaaaaaaatttcgtggttgtcatggtgacaaaaacgaaggcagggcaaggaacttcagccccacccgaagcttcaccgacagcagcgccagagtcatctacctcattccccccagcccctacttccgggatgtctcatcctcctcccgctgctcgggaggataaatctccctccgaggaatccgcccctacaacgagccccgagtcagtgtccgggtctgtgccatccagtgggtcctccgggcgtgaggaagatgctgcatccacgctggtcacaggctcagaatacgaaacaatgctgaccgagatcatgtccatgggctatgagagggagagagtggtggcggctcttcgggcttcctataataacccccacagagctgtcgaatatctgcttacgggtattcccggaagtcctgaacctgagcatggatctgtgcaggagtctcaggtctctgagcaaccagctaccgaggccgcaggagagaacccccttgaattcctacgggatcagccgcaattccagaatatgagacaggttattcagcagaatcctgcacttctgcctgccttactgcagcagttggggcaggagaacccacagctgctgcagcagattagtcgacatcaggaacagttcatccagatgctcaacgaaccacctggggaactcgccgacatcagtgatgtagaaggagaggtcggagccataggggaagaggcaccgcaaatgaattatatccaggtgaccccgcaggaaaaggaggctattgagagactgaaggctctgggatttcctgagtccctcgtgatccaggcttactttgcatgtgaaaagaacgaaaacctggccgctaattttctgctgtcccagaattttgacgacgagtag

SEQ ID NO: 30446 - DNA, 597 bp, Artificial Sequence
  Description of Artificial Sequence: Synthetic coding sequence
atgttgacagagattatgtccatgggttatgagcgcgaacgcgtcgtggcggcactgcgcgcttcctacaacaatccccatcgggctgtggaatatcttctaacaggaatccctggttcacctgaacctgagcatggcagcgtccaggagagccaagttagcgagcagcctgccacagaggccgcaggcgagaatccgctcgaatttctccgcgaccagcctcagtttcagaatatgcgtcaggttatccagcagaacccggcattgctgcccgctctgctgcaacagctggggcaggaaaatccacagctcctgcagcagatttctagacaccaggaacaatttattcaaatgctgaacgagcctcccggagaacttgccgatattagcgacgtggagggggaagtcggcgctattggtgaagaggccccacagatgaactacattcaggtgactccacaggaaaaagaagccatcgagaggctgaaggcacttggttttcctgaatccctcgtaatacaggcctattttgcttgcgagaaaaacgagaacttggccgcaaatttcttgctctctcaaaattttgatgacgagtag

SEQ ID NO: 30447 - DNA, 1092 bp, Artificial Sequence
  Description of Artificial Sequence: Synthetic coding sequence
atggcagtcactataacgctgaaaacactgcaacagcagacattcaagatcaggatggaacctgatgagaccgtgaaggtgttgaaggaaaaaatcgaagcagaaaaaggaagagacgcgtttcccgtggccggtcaaaagctcatttacgccggtaaaatcctgagcgatgacgtgccaatacgcgactatcgtattgatgagaagaattttgtggtcgtgatggtcacaaagactaaagctggtcaggggacctccgcccctccagaggcgtcacctacggcagcccctgagagctccacttcctttccacccgctcccactagcgggatgtctcacccgccacccgcagccagggaagataagtctccctccgaagagagtgcccctaccacaagtcctgaaagcgtaagcggtagtgtgccaagcagtggaagcagtgggagagaagaagatgccgctagtacactcgtgactggctcagagtacgaaaccatgttgactgaaatcatgtctatgggatacgagagggaaagagtggtggcggcactgcgcgctagctacaataatccccatagggccgtagaatacctgcttaccgggatccccggaagccccgaacctgaacacggatccgttcaagagtcacaggtctcggaacaaccagccaccgaagcagctggagaaaaccccttggagtttcttagagaccaaccacagtttcagaatatgagacaggtaatccagcagaatcccgcacttctgccagccctcctgcagcaactcggtcaggagaatccgcaactgctgcagcagatctcccgtcatcaggagcagttcattcaaatgctgaatgaacctccgggtgagttagccgacatctcagatgtggaaggcgaggttggggctatcggggaggaagctccacagatgaattacatccaggtgacaccgcaagagaaggaagctatcgagaggctgaaggcgcttggttttcctgaatcattggtcatccaggcgtattttgcttgtgagaagaatgagaatctcgcggctaactttttactgagtcagaactttgatgacgaatag

SEQ ID NO: 30448 - DNA, 927 bp, Artificial Sequence
  Description of Artificial Sequence: Synthetic coding sequence
atggctgtgacaattaccctgaaaactctccagcagcaaacatttaaaataaggatggaaccagatgagacggtgaaggtgctcaaagagaagattgaggcagagaaaggaagagatgcctttcctgtagctggacagaagcttatatatgcaggaaagattctcagtgatgatgtcccaattcgcgattaccggatagatgaaaaaaactttgtggtcgtgatggtgactaagacgaaggcgggacagggaacgtccgctccaccagaggcatcccctacagctgcacctgagtcctctaccagctttccccctgccccaacgtcaggaatgagccaccctccgccagccgcacgggaggataaatctccaagcgaggaaagcgctcccacgacatcgcccgaaagtgtgtcaggatctgttccatcatccggctcatcaggccgagaagaagacgcagcttctacactggttacaggatcagaatacgagactatgctgacagagatcatgtccatgggctatgagcgtgaaagagtcgtggctgcactgagggcttcttataataaccctcaccgcgctgtggagtacctgctcacggggatccctggttccccggagcctgagcatgggtccgtccaggaaagtcaggtgtcagagcaacccgctacagaggcggctggtgagaacccgcttgagtttttgcgagatcagccccagttccagaacatgcgacaggtaatacagcagaatcccgcacttcttccggcattactacaacagttaggccaggaaaaccctcagttactgcagctaaaggccctcggattccccgaaagcctcgttatccaagcttacttcgcctgtgaaaagaacgaaaatttagctgccaattttctgcttagtcagaactttgacgatgagtag

SEQ ID NO: 30449 - DNA, 1230 bp, Artificial Sequence
  Description of Artificial Sequence: Synthetic coding sequence
atgcaagtgactttgaagaccctacagcagcagacattcaagatcgatatcgaccctgaggagaccgttaaagctctcaaggagaaaattgagtctgaaaaaggcaaagacgcattcccagtagctggacaaaaactgatatacgccggaaaaattctgaacgatgacacagccctgaaagagtacaagatcgacgagaagaactttgttgtggttatggttacaaagcccaaggctgtgtctaccccagcacctgccaccacccagcagtctgcgcctgcctccaccacagcagtgacgtcgtctaccacaaccacagtggcccaggctcctacgccagtgcccgctctggccccaacaagcacccccgcttcgatcacacctgcatccgcaaccgcatccagtgaaccggcacctgcctcggctgccaaacaggagaaaccggctgagaagcccgctgagacacccgtcgcgacaagtccaacagccaccgactcaacgagcggagactcatccagatccaacctgtttgaagacgccacttctgctctcgttaccggccagagttatgaaaatatggttacagagattatgtctatgggttatgagagagaacaagttatagcagcactgagggctagttttaacaaccccgacagggctgtggagtatctgctgatgggcattcccggtgatcgggagtcacaggcagtggtggatcctcctcaagctgcatctacaggcgctccccagtcttcagccgtcgcagccgcagccgcaacgaccactgccacaacgacaaccacaagttcaggaggacaccctctcgagtttctgcgcaatcagccacaattccagcagatgcgtcagataatccagcagaatccaagtctccttcctgcattactgcaacagattggcagagaaaacccacagctgttgcagcagatcagccagcatcaagagcactttattcagatgttgaacgaaccagtgcaagaggcaggcggacagggagggggaggcggtggcggatcgggcggaattgccgaagcagggagcggtcatatgaattatatccaggttacaccccaggaaaaagaggcaatcgaaaggctaaaagcgttgggttttcccgagggactcgtaattcaggcctacttcgcgtgcgaaaaaaacgaaaacctcgcggcaaattttctattgcagcagaatttcgatgaggactag

SEQ ID NO: 30450 - DNA, 519 bp, Artificial Sequence
  Description of Artificial Sequence: Synthetic coding sequence
atggttactaaacccaaggccgtcagcactcctgcccctgcaacgacacagcagagcgccccagcttcaactacggctgtcaccagttcgacaactactacggtagcacaggccccaacaccggtcccagctctggctcccacctccacacctgcaagtatcacccctgctagcgccacagcgagctctgaacctgctcctgcttcagccgcaaaacaagagaagccggcagagaagccagccgagactcccgtagctacctccccaacagcaactgatagtaccagtggagactccagtcgctcaaacctgtttgaagatgccacatcggccctcgttactggacagtcatatgaaaacatggtgacggaaattatgagtatgggctacgagagagaacaggtgattgcagcgcttagagcatcatttaacaaccctgatcgggctgtggagtacctgcttatgatcatcgttaagaccggtaacaaaaagaaaaagcagccgctattagggaagtag

SEQ ID NO: 30451 - DNA, 1014 bp, Artificial Sequence
  Description of Artificial Sequence: Synthetic coding sequence
atggtcacaaagccaaaggctgtgtcaactcctgcaccagctaccacgcagcagtctgccccagccagcactaccgccgtgactagcagtacaacgacaaccgtcgcccaggcacccacccccgtccccgcactggctccgacctcaactcctgcttctatcactcctgcatcggccacagcatcatctgagcctgcacccgcttctgccgctaagcaggagaaacccgctgagaaacccgctgagactcccgttgctacatcgccaactgctactgacagtacatccggagactcatcgcggtcaaacctctttgaggacgccacttctgcgttagtaacaggccagtcatatgagaatatggttacggaaatcatgtcaatgggctatgagcgggagcaagtgattgctgctctgcgggcatccttcaacaaccctgatagagcggttgagtaccttctaatgggcatcccaggggaccgggaatctcaggctgttgtagacccacctcaggccgcttccactggagctcctcagtctagtgcagtcgcagctgctgctgccaccaccaccgccaccaccaccacaacgagctccggtggccatcctctagagttccttcggaatcagcctcagtttcagcagatgcggcagatcatccagcagaatccctccctactgcccgcattgctgcaacaaatcggcagagagaacccgcaactgctgcagcaaatatcccagcaccaagagcattttatccagatgctcaatgagccagtgcaggaggcaggcggtcaaggcggaggtgggggtgggggatctggcggtatcgccgaggccggttctggacacatgaactatattcaggtcactccccaggagaaagaggctatcgagcgcctgaaggctctgggtttccctgagggactcgttatccaggcatacttcgcgtgtgagaagaatgaaaacctggctgccaatttcttactgcagcaaaattttgacgaggactag

SEQ ID NO: 30452 - DNA, 441 bp, Artificial Sequence
  Description of Artificial Sequence: Synthetic coding sequence
atgcaagtgaccctgaaaacactccaacagcagaccttcaagatagacattgacccagaagaaaccgtaaaagccttgaaggaaaaaatcgaatcagaaaaaggtaaggacgcgtttcctgtcgctggccagaaattgatctacgctggaaaaattttaaacgatgatactgctctgaaagagtacaagattgatgagaaaaatttcgtagtggtgatggtgacaaaacccaaggccgtgtcaacgcccgcacctgcgaccacacagcaaagtgctcctgccagcacgactgccgtgacttcttctactacaacaacggttgcgcaggctcctactcccgtgccagcgcttgcacccacaagcacgcccgctagcattactccggcaagcgcgaccgcatcctccgagcccgctcctgctagcgccgctaagcaggaatag

SEQ ID NO: 30453 - DNA, 243 bp, Artificial Sequence
  Description of Artificial Sequence: Synthetic coding sequence
atggtgaaggccctcaaagagaagatcgagtcagagaagggtaaagacgcttttccagtggctgggcagaagcttatctatgccggaaagattctcaatgatgataccgctctgaaagagtataagattgatgaaaaaaacttcgtggtcgtaatggttacaaagcccaaagccgtgagtaccccagctccagccactacacaacagtccgcccctgcaagtaccaccgctgtcacgagttag

SEQ ID NO: 30454 - DNA, 345 bp, Artificial Sequence
  Description of Artificial Sequence: Synthetic coding sequence
taaactgcgtctagtgagccagccccagcttccgcggcaaaacaggagaaacctgccgagaagcctgccgaaactccggtggcaactagcccgactgccaccgatagcacctccggagactcttctcggtcgaatctctttgaagatgccacaagtgcgctggttacaggacaaagttatgaaaacatggtgacagagattatgagcatgggctatgagagagagcaggttattgccgcactgcgggcaagtttcaacaatcctgatagagcagtggagtacttacttatgatcatcgttaaaactggcaacaaaaaaaaaaagcagccccttctggggaaatag

SEQ ID NO: 30455 - DNA, 3939 bp, Artificial Sequence
  Description of Artificial Sequence: Synthetic coding sequence
atgagcagaatagaaaaaatgtcaatcctgggagttagatctttcggaattgaggataaagacaaacagattatcacattttttagccctttgactatacttgtggggccaaatggggcaggaaagacaaccattatcgagtgtttgaagtatatctgtacaggggactttccaccgggaacgaagggaaatacctttgtgcatgaccctaaggtagcccaggagactgatgttcgagcgcaaattaggctgcagttcagagacgtcaacggagaactgattgctgtacagcgatccatggtgtgcacgcagaaaagcaagaagactgagttcaagacactggagggcgtaatcacacgaaccaaacatggggagaaggtgtccctgtcatccaaatgtgcagaaattgaccgtgaaatgatatcctcccttggagtttctaaagctgtgctcaacaacgtgatcttctgccatcaagaagactccaactggcccttgtctgaaggaaaagcccttaagcagaaattcgacgaaattttctcggccacgagatatatcaaggccttggaaaccctgcgccaggttcgccaaacccagggacagaaagtgaaggagtaccagatggaattaaagtatctgaagcaatacaaagagaaggcctgcgaaatcagggaccaaattactagtaaggaagctcaactgacatcctcaaaggaaatagtgaaaagctacgaaaatgaactggacccgttgaagaatcggctgaaggaaattgagcataatctgtcaaagattatgaaactggataacgagatcaaggctctagactcgagaaaaaagcagatggagaaagacaacagtgagctggaagaaaagatggaaaaagtcttccagggcactgatgagcagctcaacgacctctaccacaaccaccagaggactgttagagaaaaagaacggaaactggtcgattgtcatcgcgaactcgagaaactcaataaggagagccgactgcttaaccaggagaagtctgaactgctggtggaacagggacgattacaactgcaagccgacagacatcaagaacatatcagagccagggattctctcattcagagccttgccacgcaacttgaactggacgggttcgagcgaggaccattttccgagcggcagataaagaacttccataaattggtcagagaacggcaggagggggaagccaagaccgccaatcagttaatgaatgattttgccgaaaaggagaccttgaaacagaagcagattgatgaaatcagggacaaaaagactgggttgggccgaattattgagctcaagtcagagattctgtccaagaagcagaacgaactcaagaacgtgaaatatgagctgcagcagcttgagggtagcagcgaccggatactcgaactggaccaagaattgattaaagctgagcgggagctgagcaaagcagaaaagaatagtaacgtggaaaccttgaagatggaggtgatctccctgcagaacgaaaaggctgacttggataggactctgcgaaaactggaccaagagatggaacagctgaatcaccatacaaccactcgtacccagatggaaatgctgacgaaggataaggcagacaaagatgaacagatccggaaaattaagagccgccacagtgatgagcttacttctctgctgggctattttccgaataagaaacagctcgaagattggctgcactctaaatccaaagagataaaccagacacgcgacagactggctaagctcaataaggagctggcttcatccgaacagaataagaatcatatcaacaatgagctgaagcgtaaggaagaacagttatctagctacgaagataaactgttcgatgtctgtggttcacaggacttcgaatctgacttggatcgcctgaaggaagagatcgagaagtcctctaagcagcgcgcaatgctggccggagcaactgctgtttattctcagtttattacccaattgactgacgagaatcagtcatgttgtcccgtttgccagagggtttttcaaacagaggccgaacttcaagaggtgataagcgatttacaatccaagctgaggctggcacctgataagctgaaatctactgaatccgaactgaaaaagaaggaaaaaaggcgggacgagatgttaggcctcgtgcccatgcgccaatctattatcgacctcaaggagaaagagatacccgagctcagaaacaaactgcaaaacgtgaatagggacattcagcggttgaagaacgatattgaggagcaggaaacgctgctggggaccatcatgcctgaagaagagtcagcaaaagtgtgcctaaccgatgttaccataatggagaggtttcagatggaactgaaggatgttgagcggaagattgcccagcaagcagccaaactccagggaatcgacctggaccggacagtccagcaagtcaaccaggagaaacaggaaaagcagcacaaattggacacagtgtccagcaagattgagctgaatagaaaactgatccaagatcagcaggagcagatccagcatctgaagagcacaaccaacgagcttaagagtgagaagcttcagatctcaactaatttacaaagaagacagcagcttgaagaacaaactgtagagctgtccaccgaggtgcagagcctgtacagagagataaaggacgcaaaggagcaggtctctccccttgaaaccacgctggagaaattccaacaggagaaggaagaacttatcaacaagaagaatacctcaaacaagatcgctcaagacaaactgaacgacataaaggaaaaagtcaagaatattcatggatacatgaaggacatcgaaaactacattcaggacgggaaggacgactataaaaagcagaaggagacagaactaaacaaggtcatcgctcaactctccgaatgtgagaaacacaaggaaaaaatcaatgaagacatgcgcttaatgcgtcaggacattgacacacaaaagattcaggagcgctggcttcaagacaacctgacattgaggaagagaaacgaggagctgaaggaggtggaggaggaacggaagcaacacctgaaagagatgggacagatgcaggtcctgcagatgaagagtgagcaccaaaaacttgaggagaatatagataacatcaagagaaaccacaacctcgcacttggacgacagaagggctatgaggaagaaatcatacatttcaagaaggagctgcgcgaaccccagttccgggatgccgaggaaaagtatagagagatgatgatcgtcatgcgcaccactgaactggtgaacaaggacctcgatatttattataaaacacttgatcaagctataatgaaattccattcaatgaaaatggaggagataaacaagattatccgtgatttatggagatccacttaccggggacaggatatagaatacattgaaatccgaagtgatgcggacgagaatgttagcgcgagcgacaagaggaggaattacaactatcgcgtggttatgcttaaaggcgatacagccttggatatgagagggcgttgtagcgcagggcagaaagtccttgcttctcttataataagactggccttagctgaaactttttgcctaaattgcggcataattgccttagatgagcctacaacaaatttagatcgtgaaaacattgaaagccttgcccacgccctagttgagatcatcaagtcacggtctcaacagaggaattttcagttgctggtgattacacacgacgaagacttcgtggagcttctcgggcgttcagagtacgtggagaaattttaccgaatcaaaaaaaatatcgaccagtgctctgaaatcgtaaagtgttcagtttcttcactcgggtttaatgtgcactag

SEQ ID NO: 30456 - DNA, 3522 bp, Artificial Sequence
  Description of Artificial Sequence: Synthetic coding sequence
atgatctcaagcctcggagtctccaaggcggtccttaataacgttatcttctgtcaccaggaagactctaattggccattgtccgagggcaaggccttgaaacagaagttcgatgagattttctcggccaccaggtatatcaaagccttagaaacattaaggcaggtgcggcagacacaggggcagaaggtgaaggaataccagatggaacttaagtatcttaaacagtacaaggaaaaagcctgtgaaataagagaccagattactagtaaggaggcccaattgacctctagtaaggaaatcgttaaatcatacgaaaatgagctggatccactgaaaaatcggttaaaggagattgaacacaacctaagcaagatcatgaagctggataatgagattaaagcgcttgactcacgcaaaaagcagatggaaaaggataatagtgagttggaagagaagatggagaaagtgtttcaggggaccgacgaacagctgaatgatctgtatcataaccatcaacgtacggtgcgggagaaagaacgaaaattggtagactgccatagggagctggaaaaattaaataaagaaagtcgtttactcaaccaggaaaagtctgaactcttggttgaacagggaaggctccagttgcaagccgaccggcatcaggaacatattcgcgcaagagacagtctgatccagagcctggctacacaactcgaactggatggattcgaaagagggccattctctgagaggcagatcaagaactttcacaaattggtgcgcgagagacaagagggtgaggccaagacagcaaatcagcttatgaacgacttcgctgagaaggaaaccctcaaacagaaacagatcgacgagattagggacaagaagaccggattggggagaattatcgagttaaaaagcgagatactcagtaagaagcagaatgaactgaagaacgtcaaatatgaactccagcagctcgaaggcagtagcgacaggatattggaactggatcaggaactcattaaagccgagagggagctttccaaggctgaaaaaaattccaacgtggagaccctcaagatggaagtgatctccctgcagaatgaaaaggccgatttggatagaacattgagaaaactggaccaggagatggagcagttgaaccatcacaccacaacccgtacacagatggagatgctaaccaaggacaaagcggataaagatgagcagataaggaagataaaatcgcgtcattctgatgagttgacctctttactaggctacttccccaacaaaaagcagcttgaagactggctacattccaaatccaaggagattaaccagactcgagacagattagccaaattgaataaggaactcgcctccagtgaacaaaacaaaaaccacattaacaatgagctcaaaagaaaggaggaacaactaagtagctacgaggataaattatttgatgtctgcgggtcccaggacttcgagagcgatctggacagactgaaggaagagatagagaagtcttccaagcagcgcgcaatgctcgccggagccacagctgtatacagccagttcatcacgcagctcactgacgagaaccaatcttgctgtcctgtgtgtcagagggtgtttcagacggaggctgaattacaggaggttatttccgatctccagtccaagttacggctggcaccggacaaattaaaaagtacagagtctgaactcaagaagaaagaaaaacgtcgggatgagatgcttggtcttgtgcccatgaggcagagcattatcgatctgaaagaaaaagagatccccgagttgcgaaacaagctgcagaacgtcaatagagacatccagcgactcaagaatgatatcgaggaacaggagacgctcctgggcacaatcatgcccgaggaagaaagcgccaaggtatgcctcacagacgtaaccattatggagcgatttcagatggaattgaaggacgtggaacgcaaaatcgcccaacaagctgctaagctccagggaatcgatttagatagaactgttcagcaggtgaaccaggaaaagcaggaaaagcagcacaagctggacacggtgtcttcaaagattgagcttaacagaaagctgatccaggatcagcaggagcaaatccagcacctgaagtctaccaccaacgaactgaagtccgagaagctgcagatcagtaccaatctccagaggcgccaacagctggaggaacaaactgtggaactgtccacagaggtccaatcattgtacagagagattaaggacgccaaggaacaggtaagtcccctggagaccaccctggaaaaattccagcaggagaaagaggagctgattaataagaagaacacgtctaataaaattgcacaggataagttgaatgatataaaggagaaggttaagaacatccatgggtacatgaaggacattgaaaactatattcaggacggtaaggacgattacaaaaagcaaaaggagactgagctgaataaggtgatcgcccagctgagcgagtgcgaaaaacataaagagaagattaacgaagacatgagactcatgcgacaggatattgatacgcagaagatccaggaacggtggctgcaggacaacctcacactgcgcaagaggaacgaagaacttaaagaggtagaagaagagcggaaacagcaccttaaagagatgggccaaatgcaagtcctccagatgaagtctgagcatcagaagctagaggagaacattgataacattaagcggaatcacaaccttgctctggggagacagaagggatacgaagaagagatcatccatttcaagaaggagttgcgggagccacagttcagggatgctgaggagaagtacagagagatgatgatcgtcatgagaacgacagaactggtgaataaagatctcgacatctactataagacgttagatcaggccattatgaaatttcactccatgaaaatggaggagatcaacaagatcatccgcgatctctggagatcaacctacaggggacaggatattgagtatatcgaaatccgttccgacgctgatgagaacgttagcgcctcagacaagcgcagaaactataattatagggttgtcatgctaaaaggtgatacggcactggacatgaggggccgatgttcggcaggacagaaagttctggcctctctcattattcgcctcgccctggctgaaaccttctgcctgaattgtggtatcattgcattagacgaacccacaaccaatctggaccgtgagaacatcgagtccctcgcccatgctctggtggagatcataaagtcgcgtagccagcagcggaactttcagctgctggttattactcacgacgaagacttcgtagagcttctggggcgatccgagtatgtggagaagttctatcgcatcaaaaagaatatagaccagtgctccgagatcgtcaaatgttctgtctcctcacttgggttcaatgtgcactag

SEQ ID NO: 30457 - DNA, 1020 bp, Artificial Sequence
  Description of Artificial Sequence: Synthetic coding sequence
atggccatgcagatgcagcttgaggcaaatgccgatacctcagtggaggaggaaagcttcggccctcagccaatctctcgcctggaacagtgtggtatcaacgctaacgatgtgaagaagctagaggaggcgggatttcacactgtggaagctgtggcctacgctcctaagaaagaattaatcaacatcaaagggatcagcgaggccaaggccgacaaaattctggcagaagcagctaagttagttccaatgggatttacaacggcaactgagttccaccagagacgcagtgagataatccagataaccacaggctctaaagaactggataaactgctccagggaggaatcgaaactggcagcattacggagatgtttggtgaatttagaaccgggaagacccagatctgccacactctcgcggtgacttgccagttacccattgaccgtggcggaggggagggtaaggctatgtacattgacacagaagggacattccggccagagcgtctgttagctgtggccgaacggtacggcttgtccggttctgacgtgctcgacaatgtagcgtacgcacgtgcctttaataccgaccatcagacccaactgctgtatcaagctagtgccatgatggttgagtctagatacgccttgctcatagtcgattcagctactgcactgtatcggaccgactacagcggaagaggggagctgtcggccaggcagatgcacctggccaggtttttgcgaatgttgttacggttagccgacgaattcggagtggcagttgtgataacgaatcaggtggttgcccaagttgatggggctgcaatgttcgctgccgatcctaagaaacccatcggaggaaacattattgcccacgcctcgactacgaggctctatcttagaaagggcagaggcgagacccgcatttgcaaaatatatgactcaccctgtctccccgaagcagaggccatgtttgcaataaacgccgacggggttggagatgctaaggactag

SEQ ID NO: 30458 - DNA, 729 bp, Artificial Sequence
  Description of Artificial Sequence: Synthetic coding sequence
atggccatgcagatgcagctggaggcgaatgcagatacctccgtcgaagaggagtcttttggaccgcaaccaatctcgcggttggaacaatgtggcatcaacgcaaacgacgtgaaaaaactcgaggaggccggtttccacactgtggaggcagttgcatacgcccctaagaaggaactcattaacataaagggaatcagcgaagccaaagccgacaaaatcttgttactgagccataggtatggactttccggctcagatgttttggacaacgtggcatatgcgagagcgtttaataccgaccaccagacacagttgctttatcaggccagcgccatgatggtagagtcccggtatgccctcctgatcgtggacagcgccaccgctctgtacagaacggactatagcggacgcggtgagcttagcgcgcgtcagatgcacctcgcacgattcctccgtatgctgctccggttagccgacgagttcggcgtagccgttgtaatcacgaaccaagtagttgcccaggtcgatggggctgcaatgtttgccgctgatcctaagaaacccattggaggcaacatcatcgcacacgcctctacaacgaggctgtatctgcgcaagggccgaggtgagactcggatttgcaagatctacgattctccctgtttacctgaggccgaggccatgttcgccatcaatgcagacggcgtcggggacgccaaggattag

SEQ ID NO: 30459 - DNA, 1023 bp, Artificial Sequence
  Description of Artificial Sequence: Synthetic coding sequence
atggcaatgcagatgcagctggaagccaatgccgacacctctgtggaggaagaatctttcggccctcagcctatctctaggcttgaacaatgcgggatcaacgcaaacgacgtgaagaaactcgaggaagcagggttccataccgtggaggccgtcgcatacgcaccgaaaaaggaattgatcaacataaaaggtatcagcgaggcaaaggccgacaagatcctaacggaatcacggtccgttgcacgattggaatgcaacagcgtgatcctggtctactgcacactgcggctcagcggcagtagtgactcgcccgctagtgccagcagggtggttggaactactggaggcatcgagactgggtctatcactgagatgttcggagagttccgaactggcaagacacagatttgccacacacttgcagtgacatgccagttgcccatagatcggggtgggggagaaggcaaagccatgtacattgacacggagggaactttccgccctgagcgactcctcgctgtagcagagcgatacgggctcagtggctccgacgtcctggataacgttgcctatgcccgagccttcaataccgatcaccagacgcagctcttgtaccaggcctcagctatgatggtcgagtcgcggtatgcacttctcattgtggattctgcaacagcactttatcggaccgattactctggtcggggtgagctatccgccaggcaaatgcacctggcgaggtttttacgcatgctgctgaggctcgcggatgaatttggtgtagccgtggtgatcaccaaccaagtcgtggcgcaggtcgatggggctgcaatgttcgccgcagaccctaagaagccaatcggcggaaacattatagcacatgctagcactacgagattgtaccttcgcaagggcagaggcgaaactcgcatctgcaaaatttacgatagtccttgtttgcctgaggccgaggctatgttcgcgatcaacgctgacggagttggcgatgccaaggattag

SEQ ID NO: 30460 - DNA, 843 bp, Artificial Sequence
  Description of Artificial Sequence: Synthetic coding sequence
atggccatgcagatgcagctggaggcaaatgctgatacctctgtggaagaggagtcttttggacctcagccaatctcacgtctggagcagtgcgggataaacgccaacgatgtaaagaagctcgaggaggcagggtttcatacagttgaggcggtcgcatacgctcctaaaaaggaactgataaacattaaaggaatttcagaggcaaaggccgacaaaattctggctgaggcagctaagcttgtccctatggggttcacgaccgcaacagagttccaccagcgccgatctgaaatcattcagattactactggttccaaagaactggataagctcttgcagggtggtattgagaccggcagcattacagagatgttcggcgagtttcgtactgggaaaacccagatctgtcacaccctggcggtgacttgtcagttacctattgaccggggtgggggagaggggaaggcaatgtacatcgatacagaaggtacctttagacccgagcgcttattagctgttgccgagagatacggactttccggaagcgacgtcctggataatgtggcctatgctcgagcttttaatacagaccaccaaacgcaattactctaccaggcctcagcaatgatggtggagtcgagatacgcactattgatcgtcgacagcgcaaccgcactgtataggaccgactacagcggacgcggagagctgagcgcacgacagatgcatttagctcgatttctgaggatgctgctgaggctcgctgacgaaatcgtgagtgaagaaaggaaaagaggcaaccagaacctgcaaaatctccgcctgtcgctgtcctcgtag

SEQ ID NO: 30461 - DNA, 456 bp, Artificial Sequence
  Description of Artificial Sequence: Synthetic coding sequence
atggcgatgcaaatgcagctggaagccaacgctgatacgagtgtggaagaagagtccttcggacctcagccgatcagtcgcctcgaacaatgtgggatcaacgccaacgatgttaagaaattggaagaagctggtttccatactgttgaggccgtggcctatgcaccaaaaaaagagctaataaacattaaagggatttctgaggccaaggctgataaaatcctcgccgaagccgcaaagctggtgccaatgggcttcacaaccgctactgagttccaccaacggcgttcagaaatcatccagatcactaccggcagcaaagagctggataagcttctacagggcggaattgaaaccggttccattaccgagatgttcggtgaattccgcaccggaaagacccagatctgccacactctggcggttacctgtcaggtgtggagcctgtggcagtag

SEQ ID NO: 30462 - DNA, 228 bp, Artificial Sequence
  Description of Artificial Sequence: Synthetic coding sequence
atggccatgcaaatgcagttagaggctaatgctgacacctcggtggaggaggaatcctttgggccacaaccaataagtcggctggagcagtgtgggatcaatgcaaatgacgttaagaaattggaggaggccggtttccatacagtggaggctgtggcatacgcccctaagaaagaattgattaatatcaagggtatcagcgaggccaaagctgacaaaattctgtag

SEQ ID NO: 30463 - DNA, 519 bp, Artificial Sequence
  Description of Artificial Sequence: Synthetic coding sequence
atggcgatgcagatgcagctagaggccaacgccgatacttctgtcgaggaggaatccttcggacctcagcccattagtcgactggagcaatgtggaatcaatgccaatgatgtgaaaaaactggaggaggcaggatttcatactgtcgaggcggtggcctacgcacctaagaaggaactgatcaatatcaaaggtatttccgaggccaaagccgacaaaattcttgctgaggccgctaagttggttcctatgggatttactacagccacggagtttcatcagcggagatccgagattatccagatcaccaccggatccaaagagctcgataaactgctccagggaggaatcgaaacaggatcaatcactgagatgttcggcgaatttaggacgggaaaaacccagatttgccacactctcgcagttacctgccagctgccaatcgacaggggtgggggagagggcaaggccatgtacatcgacactgaaggtacatttagacctgaacggctgttgtag

SEQ ID NO: 30464 - DNA, 303 bp, Artificial Sequence
  Description of Artificial Sequence: Synthetic coding sequence
atggccatgcaaatgcaactcgaggccaatgccgacacctcggtggaggaggagtcattcggccctcagcccattagtcgcctggagcagtgcggtatcaacgcgaacgacgtgaagaagctcgaagaagccggatttcacaccgtggaggcggtggcgtacgctcccaagaaagaactcatcaatataaagggaatcagtgaagccaaggcagataaaattctggtcgagttgaggttggacctgtcacagaaatgcctggagaatagcgaattgggacggcctcgttctgtcatccgctag

SEQ ID NO: 30465 - DNA, 1023 bp, Artificial Sequence
  Description of Artificial Sequence: Synthetic coding sequence
atggccatgcagatgcagctggaggccaacgcagacacctcagttgaagaggagagcttcggcccacagccaatctcccgactggagcagtgtggaattaacgccaatgacgtcaaaaagctcgaggaggccggtttccatactgtggaagcagtcgcatacgccccaaagaaagagttgatcaatattaaggggatctccgaagcgaaagccgacaaaatactcaccgaatcgagaagtgtcgctagactggagtgcaactccgttatcctggtctattgcactctacgtctaagcggcagctcagactctccggcaagcgcatcccgcgtggtaggtacgacaggcggaatcgaaaccggctcgattactgagatgtttggtgagtttaggaccggcaagactcagatctgccacaccctcgctgtcacatgtcaactgccaatcgatcgaggcggtggcgaaggcaaggcaatgtacatcgatacggagggaacatttcggcctgagcgcctcttagctgtggcagaaaggtacggtctttcaggctctgatgtgctggacaacgtggcttatgcacgcgcttttaacactgatcaccaaacacagttattgtatcaggcaagcgcaatgatggtagaatcacgctatgcccttttgattgtggactccgctaccgccctgtaccgcactgattattccggcaggggcgaactctcagcgaggcagatgcatctcgcacgcttcctgagaatgctgctgcgcctggctgacgaatttggtgtggccgtcgtgataacaaaccaggtggttgcccaggtcgacggcgcagctatgttcgctgcggaccccaagaagcccatcggaggcaatatcattgcgcacgcctccacgacccgactctacctgagaaaaggaagaggtgagacgcggatctgcaagatctacgattctccctgcctgccggaggccgaggctatgttcgctattaatgctgatggagtgggcgacgccaaggactag

SEQ ID NO: 30466 - DNA, 729 bp, Artificial Sequence
  Description of Artificial Sequence: Synthetic coding sequence
atggccatgcagatgcaattagaagccaatgcagatacctcagtagaagaagagtccttcggcccacagcccatcagccgcctggaacagtgtgggattaacgccaacgatgtgaagaaactcgaggaagcagggttccacaccgtcgaagctgtcgcttacgcccctaagaaagaactcattaacatcaaaggaatttccgaagctaaagctgacaaaatcttggcagttgccgaaagatatggtctctccgggagcgacgtcttggacaatgtggcttacgccagagcatttaacaccgatcatcagacccaacttctgtaccaagcctccgctatgatggttgagtccagatatgccctgctcatcgtggattctgccacagcactgtatagaactgactactcaggaaggggtgaactttctgctcgccagatgcacctcgcaaggtttctgcggatgttactcagactcgctgatgagttcggcgtcgccgtagtgattactaatcaagttgtcgctcaggttgacggcgcagccatgtttgcagctgaccctaagaaacccataggagggaatatcatcgctcatgcctccaccactcggctttatttaaggaagggtcgaggggaaacccgcatatgtaaaatctacgattccccctgcctccctgaagctgaggcaatgttcgcaattaatgctgacggcgtgggcgacgccaaagactag

SEQ ID NO: 30467 - DNA, 1053 bp, Artificial Sequence
  Description of Artificial Sequence: Synthetic coding sequence
atggggagcaagaaactgaagcgggtgggtctgagccaagaactgtgtgatagactgagccgacaccagattcttacgtgtcaggactttctttgcctgtccccgctcgaacttatgaaggtgaccggtctttcttaccgcggagtgcatgagttgctttgcatggtgagcagggcctgcgctccgaaaatgcagactgcttacggaatcaaggcccagcgaagtgccgatttctcaccggctttcctgtcgacaaccctgtctgccctcgatgaggcacttcatgggggtgttgcatgtggtagcctgactgaaattaccggaccccctggctgtggaaagacgcagttttgcatcatgatgagtatcctagccactttacctaccaatatggggggactcgagggagctgtcgtttatatcgatacggaatcggccttctctgccgaacgactagtggaaatagctgagtcaaggttccctcggtactttaacactgaggagaagctgcttctgacttcttcaaaggtccacctgtacagagaacttacttgtgatgaggtgttgcagaggatcgagtccctcgaggaagaaatcatcagcaaaggaataaagctcgtaatcctggattccgtggcttcagttgtgcgaaaggaattcgacgcacagctgcagggtaacttaaaggaacggaacaagttcttagcgagggaagctagttcgctgaagtaccttgccgaggagttcagtattccagtgatcctcactaaccaaattacaacacacttgagcggggctttggcctcacaagccgatctggtatcccctgccgatgatctgtctctgtctgagggtacaagcggctctagctgtgtgattgctgcgctggggaacacatggtcacattctgtgaacacaaggcttattctacagtatctggattcagaacgaagacagattctgattgcaaagagtccgctggccccttttacctctttcgtttatacaattaaggaagagggactggtgctgcaggcatacgcacagtgctag

SEQ ID NO: 30468 - DNA, 1101 bp, Artificial Sequence
  Description of Artificial Sequence: Synthetic coding sequence
atgggctcaaagaagcttaaacgggttggcctgtctcaggaactctgtgatcgtctcagtagacaccagatcctaacctgtcaagacttcctctgcctaagtccgctggaacttatgaaggtgactggcctgtcttacagaggagtgcacgagctgctgtgcatggtctcccgagcctgtgccccaaagatgcagacagcatatgggattaaagcacaaagatccgctgacttttcacccgcattcctgtccacaaccttgtccgccctggacgaggctctgcacggcggtgtggcatgcgggtcactgactgagattaccggtccccctggctgcggcaaaacccagttttgcattatgatgtccattctggccaccttgccgactaatatgggaggactggaaggcgcagtcgtatacatagatactgaatccgctttttccgctgagcggctggtcgagattgcagagagtcgattcccacggtactttaacactgaagagaagctcctgttgacatcatctaaggtgcatctgtaccgcgaactgacgtgcgacgaggtgctgcagcgtattgaatctctggaagaggaaatcatcagcaaagggatcaaattggtgatcctggactccgtagcaagcgtggtgaggaaggaatttgacgctcagttacagggaaacctcaaagaacgcaacaaattccttgcgagagaggcctcttctttgaaatatttggcagaggaattctcgattcctgtaatattaactaatcagattacgacccacttaagtggagctctggcctctcaagccgacctggtgtcccccgctgacgatctgagcctgagcgaaggcacctccgggagctcctgtgtcattgcagctctgggcaacacgtggtcccactccgtcaacacccgcctgatcctccaatatctggattcggagcggaggcagattttaatagctaaatcccccctcgcgccttttacaagctttgtgtatacgattaaagaggagggactcgtgctccaggagttttggcacatctgtattagtggcttctccatccagaaccgcctgaaggagaacgagtcatag

SEQ ID NO: 30469 - DNA, 1053 bp, Artificial Sequence
  Description of Artificial Sequence: Synthetic coding sequence
atgggttctaagaagcttaaacgagtcggacttagtcaggaattatgcgaccgactgagtcggcaccagattttgacttgccaggattttctgtgtctcagtccgctcgagcttatgaaagtgaccggcctgtcataccgaggagtccacgagctgctgtgcatggtgtccagggcgtgtgccccaaaaatgcagaccgcctatggcatcaaagcgcaacggtccgccgattttagcccagccttcctgtccaccacactgtccgctttagatgaggcactgcacggcggagtggcatgcggcagcttaacggaaatcaccggaccccctgggtgcggcaagactcagttctgcattatgatgagcatactggcaacgcttcccactaatatgggaggactcgagggtgctgtcgtgtatatagataccgaaagcgccttctctgccgagcgcctggtcgaaatcgccgagtcccggtttcctaggtatttcaacaccgaggaaaaactactgctgacaagttccaaggtgcacctttaccgggaactcacttgtgatgaggtgttgcagcgaatagaatctctggaggaagaaatcatcagtaaaggtattaagctcgttatcttagatagtgtggcctcggtcgtgagaaaagagttcgatgctcagctccaagggaatcttaaagagagaaacaaatttctcgctagagaggcatcatctctgaagtacctcgcagaggaattctccatccccgtcatcctcaccaaccaaattactacccacctgtccggcgctctggcgagccaggccgacctggtgagtcccgcagacgatctgtcactgtcagaaggtactagtggctccagttgtgtgatcgccgcactgggaaacacttggtcccacagcgtgaacacacggttaattcttcagtatttggactcagagaggcgccagatccttatcgcaaagtcccctctggcaccttttactagctttgtctatactataaaggaggaggggttggtgcttcaagggcaggagacgccctag

SEQ ID NO: 30470 - DNA, 1053 bp, Artificial Sequence
  Description of Artificial Sequence: Synthetic coding sequence
atgggctctaaaaaattaaaacgcgttggcctgtcccaggaattatgcgaccgtctgagtcggcaccagattctgacctgtcaggactttctgtgtctgagcccactcgagctcatgaaagtgacaggactgtcgtacaggggggtccacgaactgctgtgcatggtctcccgagcatgcgctcctaaaatgcagaccgcctacggaataaaggcccaaaggagcgccgacttttcacccgctttcctgtctacaaccttgagcgcacttgatgaggccctgcacggtggggtggcttgcggcagtctcacagaaatcacaggaccaccgggttgtggcaagacccagttttgtataatgatgtccatcctggccacccttcctaccaatatgggaggtttggagggcgctgtcgtgtacattgacaccgagagcgccttttccgcagagcgcctggtggagatcgctgagtctagatttccgagatactttaatacagaggaaaagctgctgttgacaagttcgaaggttcatctttacagggagttgacatgtgatgaggtcctgcaacggattgagtcactggaggaggagataatatctaaggggatcaagctagttattctagatagtgtggcgtctgtggtgagaaaagagtttgacgcccagctgcagggtaacttgaaggaaaggaacaagttcttggctcgggaggcctcgtctctgaagtatctggcagaggaattctctatccccgtgatcctcaccaaccagattacaacccatttaagtggggcactggcctctcaggccgacttggtttccccagcagatgatctgtccctgtccgaaggaacgtccgggtctagctgtgttatcgcagcgttaggcaatacctggagtcactcggtgaacacgcggctcatcttacaatatttagactctgagcgacgtcagatcctaatcgctaaaagcccactggccccatttacctcatttgtctacaccatcaaggaggagggactcgtactgcagggacaggaaaaaccctag

SEQ ID NO: 30471 - DNA, 402 bp, Artificial Sequence
  Description of Artificial Sequence: Synthetic coding sequence
atgggaagcaaaaagttaaagagggtggggctttcacaagaactctgtgatagactctctcggcaccagattctcacctgccaagattttctgtgtctgtcccctctggaacttatgaaggtgacaggactcagctaccggggagtccacgaactcctgtgtatggtctcgcgggcatgtgctccaaaaatgcagaccgcctacggcatcaaggcacaaagaagcgccgatttttcacccgcttttctgtccaccacgttatccgccctcgacgaagcattacacgggggagtcgcttgtggatccctcaccgaaatcacaggtccacccggttgcggaaagacccagttttgcatcatgatgtctatcttggccaccctgcccaccaacatggggggatag

SEQ ID NO: 30472 - DNA, 1155 bp, Artificial Sequence
  Description of Artificial Sequence: Synthetic coding sequence
atgggaagcaagaagctgaagagagtaggacttagccaggagctgtgcgatcggctaagccggcatcagatattaacttgtcaggactttttatgcttgagccccctggagttgatgaaagtgactgggctgtcctatcgcggtgtccatgagttactatgcatggtaagtagagcttgcgcccctaaaatgcagaccgcatatggtattaaagcacagagatcagctgacttctctccggcatttctgtccacgacactcagcgccctggacgaggcgctccacggtggggtcgcatgcgggtctcttactgaaatcacgggtcctcctggctgcggcaaaacgcagttctgcattatgatgtctatcctggcaacccttccaacgaacatgggagggctcgaaggagcagtggtgtacatagataccgaatcggccttctccgctgagcgattggtggaaatagcggagtcaaggtttcctcggtatttcaacacggaggaaaaactgctcttgacctcaagcaaagtccatctgtatcgtgaacttacatgtgacgaggtactccaacgcattgagagccttgaagaagaaataatttctaaaggcatcaagctggtcatcctcgatagcgtggcttccgtggtgcggaaagagtttgatgcccagctgcagggcaacctgaaagaaagaaataagttcttggcccgagaagcctcatcactgaaatacttagctgaagaattctcgatccccgtgatactgactaaccagatcactacacatctgagcggcgcactggccagccaggccgatctcgtgtccccggcagacgatctaagtctaagcgaagggacaagcggctcctcctgtgtgatagccgcactgggtaacacctggtcccactcagtgaacacgcggttgatccttcagtaccttgacagcgagaggagacagatcctgatcgccaagtctcctttagctccctttacgtctttcgtctacacaatcaaggaagaagggctggttttgcaggagaccaccttttgctcagttacccaggccgagctgaactgggccccagaaattttgccccctcaacctcctgagcagttggggctgcagatgtgtcaccatactcagctcattttttag

SEQ ID NO: 30473 - DNA, 1101 bp, Artificial Sequence
  Description of Artificial Sequence: Synthetic coding sequence
atggggtccaaaaagttgaaaagggtcggcctctcccaggagttgtgcgacaggctgtcaaggcaccagatcctcacttgccaggatttcctctgtttatctcctctggaactaatgaaagtcaccggactatcttacagaggagtacacgagctgttgtgtatggtgtctcgcgcttgcgccccaaagatgcagacggcgtacggtatcaaggcgcagaggtccgccgacttttcccccgcattcctatccacaaccctaagtgcactggacgaagccttgcacggcggtgtcgcatgcggcagcctgaccgaaatcaccggtccaccgggttgcggaaagacccagttttgtattatgatgtccatccttgctaccctcccgactaatatgggtggacttgagggagctgtcgtgtatatcgatactgagagcgccttctctgcagagagactcgtggagatcgccgaatctaggttccctagatatttcaatacggaggagaagctgctgctgacaagttcgaaagtgcacctctatagggagttgacttgtgatgaggtcttgcaaaggattgaaagcctcgaagaagagatcataagcaaaggcattaaactggtgatcttggactcagtagcttcagtggtcaggaaggagttcgacgcccagttgcaggggaacctgaaggaacgtaataagtttctggctcgggaagcatcttctctgaaatacctcgccgaggagtttagcatccctgtgatccttaccaaccagatcaccacccatctgtcgggagccctagcttcgcaagctgacctggtctcccctgctgatgacctctcgctgtccgaggggacatccggaagctcctgcgttattgctgccctaggtaatacttggtcccacagtgttaatactcggctaattctgcaatatttggactccgagcgacggcagatcttgattgcaaaaagccctctggcgccatttacgtctttcgtatatactatcaaagaggaagggctcgtgctgcaagagttttggcatatttgcatttccgggtttagcatccagaatcgtctgaaggaaaacgagtcttag

SEQ ID NO: 30474 - DNA, 228 bp, Artificial Sequence
  Description of Artificial Sequence: Synthetic coding sequence
atgggtagtaagaagctcaagcgagttggactctcgcaggagttgtgcgatagactctcaagacaccagatccttacctgtcaggatttcctttgcttatcacccttggaattgatgaaagttacaggcctgtcttatcgtggcgtgcacgagttactttgcatggtgtctcgggcttgtgctccgaagatgcagaccgcctatgggataaaggcacagaggtcttag

SEQ ID NO: 30475 - DNA, 1131 bp, Artificial Sequence
  Description of Artificial Sequence: Synthetic coding sequence
atgagagggaaaacctttaggttcgaaatgcagagagatcttgtgagttttcccctgagtcccgctgtgcgagtcaagttggtaagcgccggtttccagacggccgaagagctgcttgaggttaagccttctgagctctctaaggaggttggcatctccaaggccgaggctcttgagactctccagataatccgcagggaatgcctgactaacaaaccacgctacgctggcacgagtgaaagccacaagaagtgcacagccctggaactgttggagcaggaacacacccaggggtttattataaccttttgctccgctctcgacgacatccttggcggtggggtgccattaatgaagaccacagagatctgcggggcaccaggcgtggggaagacacagctgtgcatgcagctcgctgtcgatgtgcagatccccgaatgttttggcggagtggccggagaggccgtcttcattgatacggagggtagcttcatggtggaccgcgttgttgacctggctaccgcatgtatccagcatctgcaactgattgccgaaaaacacaagggcgaggagcacaggaaggcgctcgaagattttaccctggacaacatcctgtcccacatatattacttcaggtgcagagattataccgaactcctggcccaggtatatttattgccggactttctgtccgagcattccaaagttcggctggtgatcgtagatggcatcgcctttccattccgtcacgatctagacgatctgagcctcaggactcggttattgaatggactggcccagcagatgatctcacttgcaaataatcaccgactggctgtaatcttaaccaaccagatgaccacaaagatcgaccgcaatcaggcacttctggtgcctgctctgggggaaagctgggggcacgccgctacaatccggctgatctttcactgggaccgtaagcagcgcctcgccaccttgtacaagagcccaagtcagaaagagtgcaccgtactgtttcagatcaagcctcagggatttagggatactgttgtgacgagcgcgtgttctctgcagaccgagggtagcctctctacccgcaagaggtctagggatccagaagaggagctgtag

SEQ ID NO: 30476 - DNA, 987 bp, Artificial Sequence
  Description of Artificial Sequence: Synthetic coding sequence
atgggcgtcctgcgcgtcgggttgtgccccggtcttactgaggaaatgatccagctgttacggagccacagaatcaagacagtcgtcgaccttgtcagtgccgatctggaagaggtggcgcaaaaatgcggtctgtcctataaggctcttgttgccctgaggcgcgtactgctcgcacagttttccgcgttccctgtcaatggggctgacctctacgaggaactaaaaacctctactgcaattctctcaacaggcatcggtcggatcagactcagtggcaatgccagatggctgatgccaaaggttacagagattgtggggggacccggttccggtaaaacgcaggtgtgtctgtgcatggccgcaaacgtggctcatggcttgcagcagaatgttctgtatgtggactcgaatggagggctcaccgcgtcacggttattgcagcttctgcaggcgaaaacccaggatgaagaagagcaggccgaagctctaagacgcatccaggttgtgcacgcgttcgacatatttcagatgttagacgtgcttcaggaacttcgtgggaccgtcgctcagcaggtgaccggctcctccggcaccgtgaaggtggtggttgtcgactccgtaaccgcagtggtcagtccactgctgggaggacagcagcgagaagggctagcgttgatgatgcagttggcccgagaacttaaaaccctagcacgtgacctgggcatggctgtagtagtgacaaatcatataacaagggaccgggactctggtcgcctcaagccagcactgggcaggtcctggtcttttgtcccaagcacacggatcttgttggacaccattgaaggggcaggggcatctggaggtcgcaggatggcttgtctcgctaagagctcccggcagccgaccggcttccaggaaatggtggacattggcacatggggaacttccgagcaaagcgccactctgcagggggaccaaacctag

SEQ ID NO: 30477 - DNA, 987 bp, Artificial Sequence
  Description of Artificial Sequence: Synthetic coding sequence
atgggggttttgcgcgtggggctgtgtcccggtctcacggaggaaatgatacagctcttgcgcagccatcgaatcaaaacagtagtggacctggtgagcgccgacctggaagaggtggctcagaagtgcggcctgagctacaaggcactggtggccctgaggagggtgttgctcgcacaatttagcgctttccctgtgaatggcgctgacctgtacgaagaacttaaaacctccactgccatcctcagtacgggaataggctcactcgacaaactgcttgacgccggtctctacaccggcgaagtgacggaaattgtgggcggacccggtagcggcaagacccaggtatgtttatgcatggccgcaaacgttgcacacggcttgcagcagaatgtactgtatgtggatagcaacggcggtcttacagcttctagactgctgcaacttcttcaggcaaaaacacaggatgaagaagagcaggcggaagcactgaggagaattcaggtggtgcatgctttcgatatattccagatgctggatgtgcttcaggaattacgaggcaccgtggctcagcaggtgaccggctcttccggcacggtgaaagtggtcgttgtggacagcgtgactgccgtggtctctcccctgcttggtggacagcagcgagaaggactcgctctgatgatgcagctggcaagggaactcaaaactctcgcacgagacctgggcatggctgtagtggtcacaaatcacattactagggacagagatagcggcaggctcaagcccgcactaggacgttcgtggtcatttgtcccaagtacaaggatcctgttagataccatcgagggcgcaggcgctagcggaggacggcgaatggcatgcctcgccaagagctccaggcaacctacaggatttcaggaaatggtggacataggaacgtgggggacatcagaacagtcagcgacattgcaaggtgatcaaacttag

SEQ ID NO: 30478 - DNA, 651 bp, Artificial Sequence
  Description of Artificial Sequence: Synthetic coding sequence
atgggagtgctcagagtgggtttatgtcctggcctcactgaggaaatgatccagcttctcaggagtcaccgtataaagaccgtggtcgatctggtatcagcggacctggaggaagtggcccagaagtgtggcttatcttacaaggccgaggccctccgtcggatccaggttgtacacgcattcgatatcttccagatgctggatgtgttacaggagctgagagggaccgtggcccagcaggtaacaggatccagtggaacggtaaaggtggttgtcgttgattcagtaacagctgtcgtaagccctctgctgggtggccagcaacgcgaaggcttggcgctgatgatgcagcttgcacgggagctgaagactctggccagggatctgggaatggccgttgtggtgacgaaccacattacaagagatagagacagcgggcgattaaagcctgcactcggacgctcatggtccttcgtaccctccacacgaattctactggatactattgagggagcaggagcttcaggtggcaggcggatggcctgcctggccaagtcttcccgacagccgacaggtttccaagaaatggtggatattggtacctggggtacttccgaacagtcagcaacactgcagggcgatcaaacatag

SEQ ID NO: 30479 - DNA, 357 bp, Artificial Sequence
  Description of Artificial Sequence: Synthetic coding sequence
atgggagtcttgagggtgggactgtgccctggccttaccgaggagatgattcaactcctgcggagccacagaattaaaaccgtggtcgatctcgtctctgccgacctggaggaggtggcccagaaatgcgggctgtcatataaagcacttgtggcactaaggcgcgtgctgttggctcaattttccgcgtttccagttaatggggctgacctctacgaggaattaaaaacgtcaacagccattctgagcaccggaattggacgtcatggcggtcgtactcaggtgggtacgtgggaagattgtagttgcctccgtagtccccagggcgataggggcgtgggaagcggtatgctttag

SEQ ID NO: 30480 - DNA, 852 bp, Artificial Sequence
  Description of Artificial Sequence: Synthetic coding sequence
atgggcgtgctgagagttggcctgtgtcccggtttgaccgaggaaatgatccagctactgagatcccaccggatcaagacggtggtggatctagtttctgccgatctggaagaggtcgctcagaagtgcggattatcatataaagccctggtagctctgcgccgtgtgctcctggcacagttctctgccttcccagtgaacggggcagacttgtacgaggaactaaagacatccacagcaatcctcagcaccggcataggttcacttgacaagttactggacgcgggtctgtacaccggagaggttacggagatcgtgggaggaccgggatcggggaagacacaagccgaagcattgcggagaattcaggtcgtacatgcatttgatatctttcaaatgttggatgttctgcaggaactgagaggtactgtagcccaacaggttacaggaagctctggtacagtgaaagtggtggtagtagactcggtcactgctgtggtgtccccactgttagggggacagcagagggagggcctggccctgatgatgcaactggctcgagagctgaaaacacttgcaagggacttgggcatggcagtggttgtgactaatcacattactcgcgacagagacagcgggcgactgaagcctgcccttggcagatcgtggagctttgtgccaagtactcgaattctgctcgacaccatcgaaggcgcaggggctagcggtggacgacgaatggcctgcctggctaaatcttcgcgccaaccaactggcttccaggaaatggttgacatagggacttggggcacatctgagcagtccgcgactttacaaggcgaccagacttag

SEQ ID NO: 30481 - DNA, 1047 bp, Artificial Sequence
  Description of Artificial Sequence: Synthetic coding sequence
atgggagtcctccgggtgggcctctgcccagggctgacagaggaaatgatacagctcctgaggtcccatcgcattaagacagtcgtggacctggtttctgccgatctggaggaggtggcccagaaatgtggcctcagttacaagacgtggcgcgctcactctagtggcaacctgggaggcctgcagctgccacaagtcccagcaggcaggagctggagtggcgtgcgcaatgccctgaaaaaggcaggcctcggccatggaggtacagatgggttatctctcaacgcttttgatgagagaggaaccgcagtttcaaccagtaggttggacaagctgctggacgcaggcctatacaccggcgaggtgaccgagattgtgggtggacctggctccggaaagactcaggtgtgcctgtgtatggccgctaatgtggcccacggactccagcagaatgtcctttatgtggacagcaacggtggccttacagccagccgtctactgcagctcttgcaggccaagactcaggacgaagaggaacaggcagaagccctcagacgaatccaggttgtgcacgcatttgacattttccaaatgctcgacgttctacaagagctcagaggcacagttgcacagcaggttactggtagttctgggaccgtgaaggtggtggtggtggattcagtgacagccgtggtttcaccccttctcggcggtcagcagagagagggcctcgccttgatgatgcagctggctagagagcttaaaactctggcccgtgacctggggatggcagtcgtcgtaacaaaccatatcacccgggacagggatagtggcaggcttaagccggctttgggtagaagctggagcttcgtgccctcaactcgtatcctgctcgatacaatcgaaggtgccggtgctagcgggggtcgcaggatggcatgcctggccaagtcatcgagacagcctacagggtttcaggagatggtggatataggcacctggggaacttccgagcagtctgcgactctccagggcgaccagacatag

SEQ ID NO: 30482 - DNA, 648 bp, Artificial Sequence
  Description of Artificial Sequence: Synthetic coding sequence
atggtgatggcggcactccccttcagcgaggacctgaagatgccagatacatgcgtactgccccactgccctgggaaggaaaacaaggatgtggtcgacctggttagtgcggatctagaagaggttgctcaaaagtgcggactgagctacaaagcactggtggccctgcggagagtcctgctcgcccagttttccgccttcccagttaacggggctgacctctatgaagaactgaaaaccagcactgccatattgtcaactggcataggctcacttgacaagctcttggacgcaggactttataccggcgaggtgactgagatagttggagggcctgggtcaggaaaaacacaggtgtgtctttgtatggccgcaaatgtagcacatggcctgcaacagaacgtgctgtatgtagatagtaacggaggcctgacagctagcagactgttacagctcctgcaggccaagacccaagacgaggaggaacaggctgaagcactgcggagaattcaggttgtgcacgccttcgacatcttccagatgttggacgtactgcaggagctgcggggaactgttgcccagcaagacggcattcccgagcatctgaaccatattccacactgtctgcatgttcatctgccatgctag

SEQ ID NO: 30483 - DNA, 711 bp, Artificial Sequence
  Description of Artificial Sequence: Synthetic coding sequence
atgggcgttctgagggtgggtctttgcccaggtcttactgaggaaatgattcagctcctgcggtcccaccgaattaaaactgttgtggaccttgtgagcgccgacctagaggaggtggctcaaaaatgcgggctatcctacaaagcgctggtagctctgcggagagtgctgctagcacagttcagtgcttttccggtgaacggagcggatctgtatgaagaactcaagacctcaacagccattttgtctacagggatcggctcactggataaattactcgacgcaggcctttacaccggggaggtgaccgagatcgtcggaggtccagggagcggaaagacccaggtctgcttgtgtatggctgctaacgtggcccatgggctgcagcaaaacgtcttgtacgtcgacagcaatggcggtttgactgcctccaggctgctacaactgctccaggcgaagacacaggacgaagaagaacaagctgaggcattacgaagaatccaggtggtccacgctttcgatattttccaaatgctcgatgtcttgcaggagctgcggggaaccgtggctcaacaggttacaggaagctccggcaccgttaaggttgtcgtcgtggattctgtgacggccgtggtgtcacccttactcggcggacaacagcgagagggacttgcccttatgatgcagctagctcgagagctgaaaacatag

SEQ ID NO: 30484 - DNA, 1047 bp, Artificial Sequence
  Description of Artificial Sequence: Synthetic coding sequence
atgggtgttttgagggtgggactgtgccccggtctgactgaggaaatgatacaactgctgaggagccaccgcatcaagactgtagtagacttggtgagcgccgacttagaagaggttgcccagaagtgcggcctgagttacaaaacctggagagcacatagctctgggaatctcggcggactgcagctgccccaggtgcctgctgggagatcttggtccggcgtgagaaatgcgctcaagaaggcgggactagggcatgggggaacggatggtctgagtctgaatgcatttgatgagcgaggcaccgccgtgtcaacttcccggttagataagctgcttgacgccggtttatatactggtgaggtgaccgagatcgtcgggggtcctggtagcggcaaaacccaggtttgtctgtgcatggcagccaatgtcgcccacgggcttcaacagaatgtcctgtatgtcgactctaacgggggactgaccgccagtagactcctgcagctgctacaggctaaaacccaggacgaggaggaacaagccgaagcgctgagaaggattcaggtggttcacgcctttgacatcttccagatgctggatgtactccaagaactgagaggtactgtcgcccagcaggtaacaggctcctctgggactgtgaaggtagtggtcgtggacagcgtgacggccgtggtctccccgctgcttggaggtcagcagcgagagggcctggcattgatgatgcagctggccagggagcttaaaaccctggctagagacctagggatggctgtggtggtgactaatcacattacaagggaccgggacagtggccgactgaagcccgcactggggagatcgtggagcttcgtgccctcgacgagaattttactcgacaccattgagggagctggagcatccggtggtcgccgaatggcctgtttggccaaaagctcgagacaacctaccggctttcaggagatggttgatataggcacttggggtactagcgagcaatctgctaccctccagggcgaccagacctag

SEQ ID NO: 30485 - DNA, 1257 bp, Artificial Sequence
  Description of Artificial Sequence: Synthetic coding sequence
atgagcgggactgaagaggctattctgggcggtagagattctcatccagcagccggtggaggttccgtgttgtgttttggccagtgccagtacacagccgaggaataccaggcaattcaaaaggccttacgtcaacgactaggacctgaatacattagcagccgtatggcagggggtggccagaaagtgtgctacattgaagggcaccgcgtgatcaatcttgccaacgaaatgttcggatataatggctgggcccattccatcacccagcaaaacgtggactttgtggatctcaacaacgggaaattctacgtcggagtgtgcgcattcgtgcgagtgcagttgaaagatggttcctaccacgaggacgtcgggtatggagtgagcgaaggcctgaagtctaaggccttgagcctggaaaaggcgagaaaggaggctgtgactgatgggctcaaacgggcactcagatcgtttggaaatgccctagggaactgtattctggacaaagactatctaaggagcctgaacaaactgccacggcagctccctctcgaggtggacctgactaaagcaaagcgccaggatctggaaccatctgtggaagaggcaaggtacaactcatgtcgccctaacatggccttagggcaccctcaactgcagcaagttacctccccgtcacggccaagtcacgcagtaattcctgccgatcaggattgttcaagcaggtctttatcctccagtgccgtggaatctgaagcgacccaccagcggaaactaaggcagaagcaactgcagcagcagtttcgtgagaggatggaaaagcagcaggtgagagtgtcaacccctagcgcagagaaaagtgaggccgctccccctgcccctcccgttacccatagtactccagtgaccgtctcggaacctcttctggaaaaagattttctggcaggggtgacccaggagctcatcaaaactctcgaggataactccgagaagtgggcagttactcccgacgccggagatggcgtcgttaagccatcctctcgagcagatcctgcacaaacgagtgacactctggcgctgaacaatcagatggtgactcagaacaggacgcctcattctgtgtgccatcagaagcctcaggcaaaaagcggctcctgggacttgcagacatactcagcagatcagaggacaacaggcaattgggaaagtcacaggaaatcacaggacatgaagaaaagaaaatatgaccccagctag

SEQ ID NO: 30486 - DNA, 1257 bp, Artificial Sequence
  Description of Artificial Sequence: Synthetic coding sequence
atgagtggaacagaggaagctatactcggcggaagggacagtcatccagccgctggcggtggaagcgtcctctgtttcggccaatgccagtatactgcagaggaatatcaggcaatacagaaagccttgagacagcgattgggtccagagtacatttcctcacgtatggcgggaggtggacaaaaagtatgttacattgaaggacatcgtgtgatcaatttagccaacgaaatgtttggctacaatggctgggcccacagcataacacaacagaatgtggatttcgtcgacctgaataacgggaagttctacgtgggcgtttgcgcttttgttcgcgtgcagcttaaggacggaagttaccatgaagatgtgggatatggcgtttcagaggggcttaagtccaaagcacttagcctggaaaaagccaggaaggaggcagtcacggacgggctcaaacgagccctgcggtcattcggcaacgccctaggaaactgcatattagataaagattacctgcgttctctgaacaaactgccccgtcaactgcccctggaagtggacctgacaaaagcaaagaggcaggatctagagccctctgtagaagaagcgagatataatagttgccggccaaatatggctctcggacaccctcaactgcagcaggtgacatcgccatcacggccatctcatgccgtgatcccggcagaccaggattgtagtagcaggtctctctcttcaagcgcagtcgagtccgaggcaacacaccagagaaagcttcgacagaaacaactgcaacagcagtttagggagagaatggagaagcagcaggttagggtgtccacaccctccgccgaaaaatccgaggctgccccaccggcacctccagtcactcactccacccccgtgacagtctcagaacccttgttagagaaggacttcctggctggtgtcacccaggagctgatcaagactctcgaagataactcagagaaatgggctgttacaccggacgccggtgacggcgtcgtgaagccatccagtagagccgatccagcgcagaccagcgacacccttgccctgaataaccaaatggtgacacagaaccgcacgcctcactcagtttgccaccagaaaccccaggccaagtccggatcttgggatctacagacatatagtgccgatcagcgaactactggcaactgggagtcacaccgaaagagccaggacatgaagaagcgcaagtacgatccctcctag

SEQ ID NO: 30487 - DNA, 1026 bp, Artificial Sequence
  Description of Artificial Sequence: Synthetic coding sequence
atgttcggctataacgggtgggctcattctatcacacagcaaaacgttgatttcgtggatctgaataatggaaagttttacgtgggcgtgtgcgcattcgtgcgtgtacagctgaaagatggatcctaccacgaggatgtgggttatggtgtgagcgaaggcctgaaatctaaggcgctgagcctggagaaggcacgaaaagaggccgtgacagacgggctgaagcgcgcactccgatccttcggcaacgccttaggcaattgtattctggacaaggattatctcaggtcattgaacaagctgccccgacagctgcccttggaggtagacctgacgaaggccaaacgacaggatctagaaccatctgtcgaagaggcacgctacaacagttgccgccctaatatggccctgggtcacccccagttgcagcaggttacgagtccgagtcgcccttctcatgccgtgatccccgctgaccaagactgctccagtaggtctttaagttcttccgccgtggagagcgaggcgacacaccagcgcaagctaagacagaagcagctgcagcagcagtttcgtgaacgcatggagaaacagcaagtccgcgtttcgactccttctgccgagaagtctgaggccgcaccaccagcacctccagtgactcactcgactccagtcacagtatcagagccccttctagaaaaggactttcttgctggcgtgacgcaggaactcataaaaaccctggaggacaattccgagaaatgggctgtgactccagacgctggggacggcgttgtgaagccatcctcacgtgccgaccccgctcagacatctgacacacttgctttgaataatcagatggtcacgcagaataggactcctcacagcgtgtgccatcagaagccccaggccaaatctggaagttgggatttgcagacatactccgcagatcagcggacaaccggaaactgggagagccaccgcaagagccaggacatgaagaagcgcaagtacgacccttcatag

SEQ ID NO: 30488 - DNA, 681 bp, Artificial Sequence
  Description of Artificial Sequence: Synthetic coding sequence
atgtctggcacagaagaggctattctgggtggtcgcgactcccatcccgctgccggtggaggctccgtgctgtgttttgggcagtgccagtatactgccgaagagtatcaggccatacaaaaagccctgcgacaacgcttgggtcccgagtatatcagtagcagaatggcaggaggcggacagaaagtgtgttatattgaaggccaccgcgtgattaacctcgctaacgaaatgtttggatacaacggttgggctcacagcatcactcaacaaaatgttgattttgttgatctcaataatggtaaattctacgtgggtgtgtgtgcattcgtgcgcgtgcagctgaaggatggttcctaccacgaggatgtcggatacggtgtaagcgaaggcctcaagtccaaagcactgtccctggaaaaagctaggaaggaggccgttactgatgggctgaaacgggctttgaggctgccactgctgggtgtctcaggacgcatactctatagtctcttctccgtacattccgtaatgtgcgctgggggtctgcccacaccgacggcttctgcccagaccgccccatcaagtccatgctcatcagctgttttacggtatgcacaggaattttgggagtgtacttggaagctgtactctggccaacgcttgccagaaattacaaaatag

SEQ ID NO: 30489 - DNA, 2244 bp, Artificial Sequence
  Description of Artificial Sequence: Synthetic coding sequence
atgcggagaagtctcgcgcctagccagctggctaaaaggaaacctgaggggagatcctgcgacgacgaagattggcagcccggacttgttacaccacgcaaacgtaagtcctcatcagagactcagattcaggagtgctttctgtcccccttccggaagcccctctctcagttaacaaatcaacccccttgcctcgattcctcccagcacgaagccttcatcaggtccatcctttctaagcctttcaaagtgccgatccctaattatcagggccctctcggatctagggctctggggctcaagagagctggcgtgcgcagggcactacacgaccctttggaaaaggatgccctcgtcctttatgagccaccccctttgtctgcacacgaccagctgaagctcgataaggagaagctacctgtccatgtggtagtcgatcctatactcagcaaggttctgcgaccacaccagcgggagggggtgaaatttttgtgggaatgcgtgacctcccgtcgcatccccggatcccacgggtgcatcatggccgacgagatggggcttgggaagacattgcaatgtattacccttatgtggaccctgttgcggcagtcccccgaatgcaaaccggagatcgataaggccgttgtggtatcccctagctccctggtgaaaaactggtataacgaggtagggaaatggctaggcggacggatccaaccgctggccatagacggcggatctaaagatgagattgatcagaaattggaaggttttatgaaccagagaggcgcacgggtgagctccccgatcttgataattagctacgagacatttagactccatgttggcgtgcttcaaaagggtagtgtggggctggttatttgtgatgagggccaccgcctgaagaacagcgaaaaccaaacataccaggctctggacagtcttaacacgagtaggcgcgtgcttatctctggcacgcccattcaaaatgacctgcttgaatacttctcgctcgtacattttgtgaacagtggcatcctaggtacagctcacgagttcaagaagcatttcgaactccctatcctgaaagggagggacgcggctgcatctgaggcagatcggcaactaggggaggaacggctccgagaactcacatccattgttaacaggtgcctcatcagacggacatccgatattctgtctaagtacctgccggttaagatagaacaagtcgtgtgttgccgtttgacccccctgcagactgagctgtacaaaagattcctgaggcaagccaagcctgccgaggagttgttagagggcaagatgtctgtctcttcgttgtcttcaatcacatcgctgaaaaagctgtgcaaccatcctgcattgatttacgataagtgtgtcgaagaggaagacggtttcgtgggcgcactggacctcttcccacccggttattcatctaaagcgttggaaccccaattgtctggcaaaatgttagtgttggattacattcttgccgtgacacgtagtaggtctagcgacaaagtcgtgctggttagcaattatacccaaaccctggacctctttgaaaagctatgtcgggctagacgttacttgtatgttcggctcgacggcacaatgagtatcaagaagcgggcaaaggttgtcgagagatttaattcacctagcagtccggactttgtgtttatgctgagctcaaaagccggtgggtgcgggctcaatctgatcggggcaaataggctggttatgtttgatcctgactggaatcccgcaaatgacgagcaggccatggcccgagtgtggagggatggccaaaagaaaacgtgttacatttaccggctactgagtgctggtactatcgaggaaaagatctttcagagacaaagccacaagaaagcactttcatcttgcgtggtcgacgaggagcaagacgttgaacgccatttcagcctgggcgagcttaaggaactgtttatactggacgaggcgagcctcagtgacactcatgatcggctacattgccgtagatgcgttaactcccggcagattcgtccccctcccgacggcagcgattgtacgtccgacttggcgggatggaatcactgtaccgataaatggggacttcgtgatgaagtcttgcaggccgcatgggacgccgcatccacagccattacctttgtgtttcaccagcgctctcacgaagagcagagaggcttgaggtag

SEQ ID NO: 30490 - DNA, 2244 bp, Artificial Sequence
  Description of Artificial Sequence: Synthetic coding sequence
atgcgtagaagtctggcccctagccaactggcgaaaagaaagcccgaggggaggtcctgcgatgatgaggactggcagccagggctggtaactccgagaaagcgcaagtccagctcagaaacgcaaattcaggagtgttttctgtctcctttccgcaaaccgctgtcccagctgaccaatcagcccccatgcttggattcttcccagcacgaggcattcatcagatctatcctgtctaagccctttaaagtgcctattcctaactaccaaggacccctgggctcaagagccctgggccttaagagggcaggggtgcgtcgcgctctacacgacccgctggaaaaagacgccctggtactctacgaacccccaccgctgagtgcacacgaccaactcaaattggacaaagagaagttgcctgtgcatgtggtcgtcgatcccatcctgtcaaaagttttaaggccccaccagagagagggcgtcaagtttctctgggagtgcgtgactagcagacggatccccggaagtcacggttgcatcatggcagatgagatgggcctcggaaagacccttcagtgtatcacccttatgtggaccctcctcaggcagagcccggagtgcaaaccggaaattgacaaagctgtggtggtgtcgcctagttccctggtgaaaaactggtacaatgaggtgggcaagtggctgggcggacggatacagcccttagctatcgacggaggttctaaagacgaaatagaccagaagctggaaggcttcatgaatcagaggggagctcgagtgtcatctccgatcctcataatcagctatgagacgttcagactgcacgtcggcgtgctgcagaaggggagcgttgggctcgtgatctgtgatgaagggcatcgtctgaagaatagtgagaatcaaacataccaagccttggatagcctgaacacctcccggagagtgctgatttctggcactcctattcagaacgatcttctggagtatttttctctcgtgcactttgtgaattcaggcatcctggggaccgcacatgaatttaagaaacactttgaactgcccattctcaagggtagggacgcagccgcttctgaagccgaccgccagctgggtgaggagaggctgcgtgaactgacaagcatagttaataggtgcctgatccggcgaacctccgacatactcagcaagtatttaccagtgaagatagaacaggtagtgtgctgtcgcctgacaccattacagacagaactgtataagcgctttttgaggcaggcgaagcctgccgaggagctgctcgagggaaagatgtctgtttctagtctgtcctctattactagcctcaagaaactctgcaatcatccagcgttgatttacgacaaatgcgtagaagaggaagatggattcgtgggcgctctcgacctattccctccgggatactccagtaaagccctggaacctcagctttctggaaagatgctggtgcttgactatatcctggccgtgacaaggtcccgaagctcggacaaggtcgttctcgtgagcaactacacgcagaccctggatctctttgaaaagctatgtagagccaggcggtatctgtacgtcaggctcgacggcacaatgtccattaagaaaagagctaaggttgtcgagcgttttaattcaccatcaagtccagacttcgtgttcatgctgagtagtaaagccggtgggtgtgggctaaatctgataggcgctaaccggttggtcatgtttgatcctgattggaaccccgcaaatgatgaacaggctatggcaagggtatggcgagacgggcagaagaaaacatgttacatctaccgtctgctgagtgccggaaccattgaggaaaagatttttcagcgtcaatctcataaaaaggccctgtcaagctgtgtggtggacgaagagcaggacgtggaaaggcatttctccctgggagagctgaaggagctcttcatcctcgacgaggcctccttgagcgacacgcatgacaggttgcactgtcggcgatgcgtgaactccagacaaatcaggccccctccagatggaagcgattgcactagcgatttagctggctggaaccactgcaccgacaagtggggactgcgcgatgaagttttgcaggcagcgtgggacgctgccagtaccgccatcaccttcgtcttccatcagcgcagccacgaggagcaacggggtctgaggtag

SEQ ID NO: 30491 - DNA, 1704 bp, Artificial Sequence
  Description of Artificial Sequence: Synthetic coding sequence
atggctgatgagatggggctgggtaaaaccctgcagtgcatcactctgatgtggactttactgaggcagtcgcctgagtgtaagccagagatagacaaagccgtggtggtttcaccaagctcccttgtaaaaaattggtacaatgaagtcggaaagtggctcggcggtcgcatccagcccctcgctattgatggaggatccaaagacgaaatcgaccagaagcttgagggttttatgaaccaaagaggcgcacgcgtttctagcccaatccttatcatcagttacgagaccttccggcttcatgtgggcgtgctgcagaagggcagcgtgggtttggtgatctgcgatgagggtcatagactgaagaatagtgaaaaccagacctatcaggctctggatagtcttaacaccagtagacgagtcttgatttccggaactcccattcagaatgatttactcgagtacttctccttagtccatttcgtgaacagtgggatactaggtaccgcccacgagttcaagaagcattttgagctgcctatcctgaaaggcagagacgctgctgcgagcgaggctgatagacaattgggcgaggagcgtcttagggaactgacaagcatagtcaaccggtgcctcatcaggcgcacctcagacattctgagtaagtacctgcctgtgaaaattgaacaggtggtctgctgtaggctgacgccattgcagacagaattatataagcgcttcctgaggcaggcgaagccagcagaagagctgctcgagggaaagatgtcagtgtcttcactgagctccataacttccctaaaaaaactctgcaaccacccagctctgatttacgacaagtgtgtggaagaggaagatgggtttgtcggggcactcgacctgtttcccccaggatactcgtcaaaggcacttgagcctcagctgtctggaaagatgctggtcctggactacattctggctgttacaagaagcagatcctcagataaggtggtgttggtgagcaattacacacagacactggatttatttgaaaaactttgccgggctaggaggtatctctacgtgaggctggacgggacaatgagtatcaagaagcgagcaaaagtggtggaaaggttcaactccccctcctcccctgactttgttttcatgttaagttccaaggccggagggtgtggactcaacctcatcggcgctaaccgactcgtgatgtttgatcccgattggaacccagctaatgatgagcaggctatggcacgagtgtggagggacgggcagaaaaagacatgctatatatatcggttactgagtgcgggaactatagaggagaagatctttcagcggcagagccataagaaagcgctcagtagctgtgtggttgatgaggagcaggatgtggagaggcatttttcgctgggagagcttaaagaactgtttatcttggatgaggcgtcattatccgacacccatgacagactgcactgtcggagatgcgttaattcacgacaaataaggccaccaccggacggcagtgactgtacttctgatctagctgggtggaatcactgtactgataagtggggcctccgcgatgaagtgctgcaagccgcttgggacgccgcaagcaccgccataacctttgtcttccaccagcgcagccacgaggagcagagagggctgagatag

SEQ ID NO: 30492 - DNA, 1176 bp, Artificial Sequence
  Description of Artificial Sequence: Synthetic coding sequence
atgaaatgcctcgtgaccggaggaaacgtgaaggtcctggggaaagccgttcattccctcagccggatcggagatgaactgtacttggagccccttgaagacggattatccttaagaactgtcaacagctcgcgctccgcttatgcttgttttctgttcgctcccttgttttttcagcagtatcaggccgcaacccctgggcaggaccttctccgctgtaagatcctgatgaagagttttctgtccgtctttcggtccctggctatgctggagaaaacagtggaaaagtgttgcatatctcttaatgggaggtccagcagactcgttgtgcagttgcactgtaaattcggagtgcgcaagacacacaacttatcattccaagactgtgagtccctgcaggctgtgtttgacccagcttcatgtccccacatgctgagggcccctgcaagagtacttggggaagccgtcctgccgttctcccctgcgctggcagaagttaccctgggcatcggaagggggcgacgagttatacttcgttcctaccatgaagaggaggctgattctactgccaaggcaatggttaccgaaatgtgcctgggcgaggaggactttcagcagcttcaggcccaggagggggttgcaattaccttttgcctcaaggagttcagaggactcctaagctttgctgagtccgccaacctgaacctctcaatacactttgatgctccaggccgtccggcaattttcaccattaaggatagtctgctggatgggcacttcgtgctggcaacactctctgacactgacagccatagtcaggacttagggtcccccgaacggcatcagcccgtgccccaactccaagctcacagcactccccatccagacgatttcgctaacgatgacatagactcatacatgatcgctatggagacaacaattggcaacgagggatcgcgcgtgctcccttcaattagcctgtctcctggcccacagccaccgaagagcccagggccacactccgaggaagaggatgaggccgagccaagcacggtccctggaacacctcctcctaaaaagtttcgtagtcttttcttcgggtcaatcctggccccagtgcgctcccctcaaggtccttctcccgtgctggcagaggactcagaaggcgagggctag

SEQ ID NO: 30493 - DNA, 1752 bp, Artificial Sequence
  Description of Artificial Sequence: Synthetic coding sequence
atgcctaaacctatcaatgtcagagttaccacaatggatgcggaattagaattcgcaatccagcctaatacaacaggaaaacagctgtttgaccaagtcgtgaaaactgtgggactacgtgaggtgtggttttttggactgcaatacgtcgatagcaaagggtactctacatggctgaagctgaacaagaaggttacacagcaggacgtcaaaaaggaaaacccactccagttcaagttccgggcaaagtttttcccagaagacgtgagtgaggaactcattcaggaaatcacacagaggcttttcttcctccaggttaaagaagcgattctgaatgatgaaatttattgcccccctgagaccgctgtacttctcgccagctacgcagtgcaggcgaagtatggagactacaacaaggaaattcacaaacctggatatctggccaatgatcgtctcttaccccagcgagtgctcgaacagcacaaattaaccaaggagcagtgggaggaaagaatccagaactggcatgaggaacacaggggcatgctgagggaagactctatgatggaatatcttaaaatcgcccaggacttagaaatgtacggcgtcaactatttcgaaataaagaacaaaaaagggaccgaactatggctgggtgtggatgccctggggctcaatatctacgagcatgatgataagctcacaccaaaaataggcttcccttggtccgaaatacgaaatataagtttcaacgacaagaagttcgtaataaaaccaattgataaaaaggccccagactttgtcttttatgctcccaggctgagaatcaacaagagaatactggccctctgcatggggaaccatgaactctatatgagacgtcgaaaaccagacaccattgaggtgcagcaaatgaaagcccaggcacgcgaagagaaacatcagaaacagcttgagcgggcacaacttgaaaacgaaaagaaaaaacgcgagattgcggagaaggagaaagaacgaattgaaagggaaaaagaggaactgatggagaggctcaagcagattgaagagcagaccattaaagcacaaaaagaattggaggagcagacaagaaaggcattggaactggatcaggaaaggaaaagggccaaggaagaggctgaacgactggagaaagagaggagagccgctgaggaggctaaaagtgccatagccaagcaggcggctgaccagatgaagaatcaggagcagcttgctgccgagctggccgagtttaccgcaaaaattgcactgctggaggaggcaaagaagaaaaaggaggaggaggccaccgagtggcaacacaaagcttttgctgctcaggaagacttagaaaagacaaaggaggagttaaaaaccgtgatgagtgcccctccacctcccccacctcccccagtgattccacctactgagaatgaacatgacgagcacgatgaaaacaacgccgaggccagcgcagagctttctaatgagggcgtgatgaaccaccggtctgaggaagagcgggtaacagagacgcagaagaatgaaagggtaaagaaacagctccaggcactgagtagtgagctcgcacaggccagagacgagaccaagaagacgcagaacgacgtgctgcatgctgagaatgttaaagctggcagagataaatacaagacactacggcagattagacaggggaataccaagcaaaggatcgacgagttcgaagctatgtag

SEQ ID NO: 30494 - DNA, 1815 bp, Artificial Sequence
  Description of Artificial Sequence: Synthetic coding sequence
atgcctaagccaatcaatgttagggtcactaccatggacgccgagctggaatttgcaatacagcccaacacaaccggaaagcagctgttcgatcaggtcgtgaaaacggtggggctgcgggaagtgtggttctttgggctgcagtatgttgactccaagggatactcaacctggctgaaattaaataagaaggttactcagcaagacgtgaagaaggagaatcctctgcagttcaagtttcgtgctaagttttttccagaagacgtatctgaggagctcatccaggaaatcacccaaaggctcttttttcttcaagtgaaagaggctatcctcaacgacgagatctattgtccacccgagaccgctgttctacttgctagctacgccgtgcaggccaagtacggagactacaataaggagattcataagcccggttacctggcaaatgacagactgctcccacaaagagttctggagcagcataagctgactaaggaacagtgggaggagagaatacagaattggcatgaggagcacagaggaatgctgcgcgaggatagcatgatggagtatctgaagatagctcaagacctggaaatgtacggcgttaactacttcgaaatcaaaaataaaaaaggcacagaattgtggttgggtgtggatgccctcggtctcaacatatacgagcacgacgacaaactgacccctaagattggtttcccttggtccgaaattaggaacatcagtttcaacgacaaaaagttcgttattaagcccatcgataaaaaagctcctgatttcgtcttctatgctcctcgtttgcggatcaataagaggatcttagctctatgcatgggcaatcatgagctatatatgaggcgtaggaaacccgacactattgaagtccaacagatgaaggcccaagctagagaggagaaacatcagaaacaactcgagagagcccaactcgaaaatgaaaaaaagaaacgggagatcgctgagaaagagaaagaacgcatcgaacgtgaaaaggaagagctcatggagcgtttaaagcaaatagaagagcagacaatcaaggcacaaaaggagcttgaggaacagacgcgcaaagcactggagctggatcaagagcgtaaacgggctaaagaggaggccgaaagactcgagaaagagcggagagccgctgaagaggccaagtccgccatcgctaagcaagccgcagatcagatgaagaaccaagagcagctggccgctgagttagccgaattcaccgccaagatcgccttactggaggaagccaagaaaaaaaaggaagaggaagccactgagtggcagcataaggccttcgcggcacaggaagaccttgaaaagacaaaggaggaactgaagacagtgatgtcagctccacctcctccccctcctccgcctgtcattcccccaaccgaaaatgagcatgatgagcacgatgaaaacaacgccgaagccagtgcggagttgtcaaatgagggggtcatgaaccatcgcagcgaagaagaacgggtaactgaaacacagaaaaacgaacgcgttaaaaagcagcttcaagccctctcaagcgagcttgcccaggcccgtgacgagactaagaaaacccaaaatgatgtcctgcacgcagaaaacgtcaaagcgggtagggataagtacaaaacactgcgtcagatcaggcagggcaacaccaaacagcggattgatgagttcgaagcaatgtggggacccaaactgtacgcattgtttcagatgcgcagttgtcaatccagcattaaacagatgtag

SEQ ID NO: 30495 - DNA, 1020 bp, Artificial Sequence
  Description of Artificial Sequence: Synthetic coding sequence
ccccaccccaagattaacgttagagtgacaacaatggacgcagaattggagttcgctatccagcccaacactaccggaaagcagctgtttgaccaggttgtgaagacagtgggtttgagggaggtatggtttttcgggctgcagtacgtcgattctaaaggttactcaacttggcttaaactgaataagaaggtgacccagcaggatgttaagaaggaaaatcccctccagttcaagttcagagccaaattctttccagaggacgttagcgaagagttgatccaagaaatcacccagaggctgttctttctgcaggttaaggaggccatactgaacgatgaaatatattgccctccagaaacagccgtgctattagcctcgtatgcagtgcaggcgaaatatggggattataataaagagatccacaagcctggctatctggctaatgaccggctcctcccccagagggtcctggaacaacacaaattaacgaaggaacaatgggaggagcgtatccagaattggcatgaagagcaccgtggcatgctcagggaagacagcatgatggagtacctgaaaatcgctcaggatctggaaatgtacggcgtgaactattttgaaataaagaataaaaaaggaaccgaactgtggcttggagtggatgcccttgggctgaatatttacgaacacgatgataagctgacaccaaaaatcgggttcccctggtctgaaatccgaaacataagttttaacgacaaaaagttcgtgataaaacctatcgataaaaaagcacccgactttgtcttttatgcccctcgactccggattaacaagcggattctggcactctgcatgggaaatcatgaattgtatatgcgacgccgtaaacctgatactattgaggtccagcagatgaaggctcaagccagagaagagaagcatcagaaacagttggagcgctcccgcctgagtaagatcaagaagaaaaagaggaagaagaagaaaaaaaagaagaagtag

SEQ ID NO: 30496 - DNA, 1815 bp, Artificial Sequence
  Description of Artificial Sequence: Synthetic coding sequence
atgcctaaaccaattaacgttcgggtcaccaccatggatgccgagttagagttcgccattcaaccaaatactactggcaagcaactgttcgatcaagtcgtaaagacggtggggcttagagaagtatggttctttggactccagtacgtggattctaaaggatattcgacttggctgaaactcaataagaaggtcacccagcaagacgtcaagaaagaaaacccccttcaatttaagtttagggctaaattttttcctgaagacgtcagtgaagagctcattcaggagattactcaaaggctgtttttcttacaagtgaaagaagcgattctcaatgacgagatttattgtcctcccgagaccgcagtccttcttgcgtcatatgcagttcaagctaaatatggagattacaataaggaaatccacaaacctgggtatctggccaacgacaggctgcttccacagcgcgttctggagcaacataaacttaccaaagaacagtgggaggaacgcatccaaaattggcatgaagagcatcggggaatgctgcgcgaggacagcatgatggaatacctgaagatcgcccaggacttggagatgtacggcgttaactattttgagattaagaacaagaagggaactgaactgtggcttggggttgacgccctcggcttaaacatctacgaacacgatgacaagctaactcctaaaatcggatttccgtggagcgaaatccgtaacattagcttcaatgataagaagtttgtaattaagcctatcgacaagaaggcccctgattttgtgttttatgctccacgcctccgcatcaacaaacgtattctggctttgtgcatgggcaaccatgagctttacatgcggaggcggaaaccggatactatagaagtgcagcagatgaaggcacaggccagggaagagaaacaccaaaaacagcttgagagggcccagctggagaacgaaaagaaaaagagggaaattgcagagaaggaaaaggagagaatcgaaagagaaaaagaagagttgatggaaagactcaagcagatcgaggagcagacaattaaagcccagaaggaactggaggaacagacccgtaaggctctcgagttggaccaagaacggaaacgcgctaaagaagaggctgagagactcgaaaaggagaggagggctgctgaggaggccaagtctgccattgccaaacaggcagccgaccagatgaaaaatcaggaacagctggctgctgagctggcagagttcactgcgaagatcgccctcctggaggaggctaagaagaaaaaggaggaagaggctaccgagtggcaacacaaggcgttcgcagctcaggaagaccttgaaaagaccaaagaggaactcaaaaccgtgatgtctgcacctccccctcctccgcctccacctgtcatccctcccacagagaatgagcacgacgagcatgatgaaaataatgccgaggcgtctgcagaactgtcgaatgagggagttatgaaccacaggtccgaggaggaacgggtaacagagacgcaaaaaaacgagcgagttaagaagcagctgcaagccctgtcgtcagagctcgcccaggctcgagacgaaactaagaaaactcaaaatgatgtgctgcatgccgaaaacgtgaaggccggaagagataagtacaagaccttgcgacagattcggcaaggcaacaccaagcagcggattgacgagttcgaggctatgtggggccctaaactttacgccttattccagatgagatcctgccagagcagcatcaaacagatgtag

SEQ ID NO: 30497 - DNA, 774 bp, Artificial Sequence
  Description of Artificial Sequence: Synthetic coding sequence
atggaacgcctcaaacagattgaagaacaaaccattaaggctcagaaggaacttgaggagcagacacgtaaggccctcgaactggatcaggaacgtaagcgggctaaagaggaggcagagcggcttgaaaaggaacggagggctgcagaggaggccaagtccgctatcgccaagcaggctgccgatcagatgaaaaaccaggaacaactcgccgcagaactggccgaatttaccgcaaaaatcgcactgctggaagaagctaagaaaaaaaaggaagaggaggcaaccgagtggcagcacaaagcttttgctgcacaggaagacttagaaaagaccaaggaggaactgaaaacggtgatgtcagctcctcctccacctccacccccacccgtgatcccacctacagagaacgagcacgatgaacatgacgagaataatgctgaagcctctgccgaactgtccaacgaaggagtgatgaatcaccgctccgaggaggaacgagttaccgagactcaaaaaaacgagcgcgttaagaaacaacttcaggctctcagctccgagctcgcccaggccagggatgaaaccaaaaagacgcagaatgacgtgctgcacgccgaaaatgtgaaagccggtcgggataagtataaaaccctccgccaaatcaggcagggaaacacaaagcagcgtatagatgaatttgaggcgatgtggggaccgaagctgtacgctctttttcaaatgaggtcatgccaatcttccattaaacagatgtag

SEQ ID NO: 30498 - DNA, 762 bp, Artificial Sequence
  Description of Artificial Sequence: Synthetic coding sequence
ggaggcaggattgctcgtgcccacgagtttgaagccgcagtttcattctgcacgtcggcgtgggctacagagcgcgacccagtcagcaggaagcaaagagagctggaggagcagacaagaaaagccttggagctagaccaggagaggaaaagagccaaagaggaggccgagaggctggaaaaggagaggcgagcagccgaggaagcaaaaagtgccatcgccaagcaagctgcagaccaaatgaagaaccaggaacagctagcagccgagctcgccgagtttaccgcaaagatcgcccttcttgaagaggccaagaaaaaaaaggaagaagaggctacagagtggcagcataaggcttttgctgcacaggaggacctcgaaaaaacaaaggaggagttgaaaacagtgatgtctgcgcctccacctccaccacccccacctgttatccctcctactgagaacgaacacgacgagcatgacgaaaacaacgcagaggcctccgccgagttatcaaacgagggagtgatgaaccaccgctccgaagaggagagagtcactgagacccaaaaaaacgaacgcgttaagaagcagctgcaggccctcagttccgaactggcccaagcacgggatgagactaaaaagacccaaaacgatgtacttcatgccgagaatgtgaaggcaggcagagacaagtataagacactgcgtcagataagacagggtaacaccaaacaacggatcgacgaattcgaggcaatgtag

SEQ ID NO: 30499 - DNA, 603 bp, Artificial Sequence
  Description of Artificial Sequence: Synthetic coding sequence
atgcctaagcccataaatgtacgagtgaccaccatggatgcggagctggaattcgcaatacagcccaatacaacaggcaaacagctctttgatcaggtgactcagcaggacgtaaagaaggagaatcccctgcaattcaaatttcgtgcaaaattctttcctgaagacgtgtctgaggagctcatccaagagatcactcagcgcctctttttcttgcaggtaaaggaggcaattttgaatgatgaaatctactgccctcccgagaccgctgtgctgctggctagttacgcagtgcaggccaaatacggtgattacaataaagaaatccataaaccaggttacctggccaatgatcggctgcttccccagcgggttcttgagcaacataaattgacaaaagagcaggatgagactaagaaaacacaaaatgatgtactccacgcagaaaatgttaaggcgggaagggacaaatataaaactctgcgccagatccggcagggaaatactaaacagagaattgacgaattcgaggccatgtggggccctaagctctacgcactgttccagatgaggtcatgtcagagctccattaaacaaatgtag

SEQ ID NO: 30500 - DNA, 1815 bp, Artificial Sequence
  Description of Artificial Sequence: Synthetic coding sequence
atgccaaaacccataaatgttcgggtgacaaccatggacgcagaacttgagtttgctattcaaccaaacactaccggcaagcagttgttcgaccaggtggtcaagaccgttggcttgagggaagtgtggttcttcggtctgcagtatgttgacagcaagggctatagcacgtggctcaagttgaacaagaaggtgacacagcaggacgttaagaaggagaatcccttgcaattcaagtttagagccaaattcttcccagaagatgtgtcggaggaacttattcaggaaattacccaacgtcttttcttcctccaggttaaagaagctattctcaacgatgaaatctattgccccccagaaaccgctgtacttttggccagctacgctgtgcaggccaagtacggcgattataacaaagagatacataagcctggttatcttgcgaatgatcggctgttaccccaacgcgttttagaacaacacaaactcacgaaagaacagtgggaggagcgaattcagaactggcacgaagagcataggggcatgcttagagaagatagcatgatggagtatttgaagattgcacaagacctggagatgtatggcgtgaattactttgagattaaaaacaagaagggcactgaactgtggctcggcgtggatgcactagggttaaatatctacgaacatgatgataagttaactccaaagatcggctttccctggagcgaaatcagaaacatatctttcaatgacaagaagttcgtcatcaaacccatcgacaagaaagctcccgactttgtgttctacgctcccaggctaagaatcaataaacgtatccttgccctttgcatgggaaaccacgagctgtacatgagacgccgaaagcccgacactatcgaggttcagcagatgaaggctcaggccagggaggaaaagcaccaaaagcagctcgaaagagcccagttggagaatgaaaaaaagaaaagggaaatcgccgagaaagagaaggaacgtattgagcgtgaaaaggaagagctaatggaacgcctaaaacagattgaggaacaaacgattaaggcacaaaaggagctcgaggagcagaccaggaaggccctggaacttgatcaggagaggaaacgggctaaggaggaggcggagcggctggagaaagaaagaagggctgccgaggaagcaaaatctgccattgctaagcaggcagcagatcaaatgaaaaatcaggagcagctggccgctgaactggccgagtttacggcaaagatcgcacttctggaggaggccaaaaagaagaaggaggaagaggcaacagagtggcagcacaaagctttcgcagcccaggaagaccttgagaaaacaaaggaggaactgaaaactgtgatgagtgccccaccaccgcctcctccaccacccgtgatcccacccacagaaaatgaacacgacgaacacgatgaaaataatgccgaagcttctgcggagttatctaatgaaggcgtgatgaaccaccgctcagaggaagagcgggtgacggagacccaaaagaacgagcgggttaagaaacagctgcaagctctgtcatccgaactcgcccaagcacgagatgaaacaaagaagactcaaaacgacgtgctgcacgctgaaaatgtaaaagctggcagggataagtacaagaccttgcgacagatccggcaaggtaatactaagcagaggatagacgagttcgaagcaatgtgggggccaaagctttacgccttattccagatgaggagttgtcagagctctattaagcagatgtag

SEQ ID NO: 30501 - DNA, 1344 bp, Artificial Sequence
  Description of Artificial Sequence: Synthetic coding sequence
atgctgtcatggaaccttcccttctcacccattcagctggcaaataattttctgacgtcggtgctggaacagcataagttaactaaggaacaatgggaggaaaggatccagaattggcacgaagagcataggggaatgctaagagaagattcgatgatggaatacctcaagatcgcccaagatttggagatgtacggtgtgaattacttcgagatcaaaaataaaaaggggacagagttgtggttgggtgtcgacgctctgggcctgaacatctacgaacatgacgacaagcttacacctaagatagggtttccttggtcagagatccgtaatatctcattcaatgataaaaaattcgtgatcaagcccatcgacaagaaggccccagatttcgttttttacgcacctaggctccggatcaacaaacgcatattagctctctgcatgggaaatcacgaactttacatgcgacgaagaaagccagatactatagaggtgcagcaaatgaaggcccaggccagagaggaaaagcaccagaaacagctcgaaagagcccagcttgagaacgagaaaaaaaaacgcgagattgctgagaaggagaaggaacgaattgagcgagaaaaggaggagctgatggaacgattgaagcaaatcgaggagcaaactataaaagcgcaaaaggagctagaagagcaaaccagaaaggcactggagctggaccaggaacgcaagcgcgcaaaggaagaggcagagcggctggagaaagagcggagagctgctgaagaggccaaatcagcaattgctaagcaggcagccgaccagatgaagaaccaggagcagctggcagccgaattggccgagttcactgccaaaattgcactgctggaagaagccaagaaaaaaaaggaagaggaagctaccgagtggcaacataaagcctttgcagctcaagaagacctcgagaaaaccaaagaggaactaaagaccgttatgagcgctccccctccccctccgccaccccctgttataccccctaccgaaaatgagcatgacgaacatgacgagaataacgctgaagcttccgctgagctgtccaatgaaggagttatgaaccacaggagcgaggaagaacgagtgaccgaaacacagaaaaacgaaagggtaaagaaacagctgcaggccttgtcatcagaactagcccaggccagagatgaaacaaaaaagacccaaaacgacgtgcttcatgccgaaaatgttaaagcaggccgtgacaaatataaaactttgcgtcagatcagacaagggaacaccaagcagaggatagacgagttcgaagccatgtag

SEQ ID NO: 30502 - DNA, 3234 bp, Artificial Sequence
  Description of Artificial Sequence: Synthetic coding sequence
atggataccgactctcagcgcagccacctgagctctttcactatgaaactgatggataaattccatagtccaaagatcaagcgcactcctagtaaaaaggggaagcctgccgaggtatccgtcaaaatccctgagaagccagtgaacaaagaagccactgaccgcttcctgccagaggggtatcccctgcctctcgaccttgaacagcaggctgtggaattcatgtcaacctccgccgtggcctcaagatcccagagacagaaaaacctctcatggctggaggagaaggagaaagaggttgttagtgctctcaggtattttaaaactatcgtggacaagatggcaatcgataagaaagtactagagatgctgcccggatctgctagtaaagttctagaagccatccttcccctcgtgcaaaacgatcctcggattcaacatagttctgcccttagctcctgttactccagggtctaccagtctctggccaacctgataagatggagcgaccaggttatgctcgagggcgtgaattcagaagataaagagatggttactaccgtgaaaggagtaatcaaggctgtacttgacggcgtcaaggaactcgtccgtctcaccatcgaaaagcaaggtaggccttcacctacatcccccgtaaaaccttctagtcccgcttcaaagcctgacggtcccgctgagttacccctgacagaccgcgaggtagagattctcaacaagaccacaggcatgagccaatccacagaattactgcccgacgccaccgacgaagaggtggccccacccaaaccaccgctgcccggaatccgcgtcgtggacaattcccccccacctgccctcccaccaaagaagcgccagtcagctccatcacctactcgtgtcgccgtggtcgcaccgatgtctagagccacgagtgggagcagcctgccggttggaatcaaccgtcaggactttgacgtggattgttacgcccagagacgactgtccggcggttcacactcttacggcggtgaatcccctcggctttctccatgttcctcaatcgggaaattgagcaagtccgatgaacagctcagttctttagacagggattctggacaatgttcgagaaatacttcatgcgagaccctcgaccattacgatcccgattacgagtttttgcaacaagatctgagtaatgcagaccagattccgcagcagacagcttggaatctgagtcctctgccagagagcctgggggagagcggttctccgttcctgggtccacccttccagctgcctctcggtggccaccctcaaccagatggcccactggcaccaggccagcagaccgacacacccccagccctccccgaaaagaagcgcaggtcagctgcatcacagaccgctgatggttcaggatgcagagtatcatacgagagacaccccagccagtatgataacattagcggagaggacttgcagagcacagctcccatccccagcgtgccctacgcacctttcgcggctattctgccttttcagcacgggggatcatcagctccggtagaatttgtcggtgacttcaccgcccctgaaagcaccggcgatccagagaagcccccaccactgcccgagaaaaaaaacaaacacatgctcgcctatatgcagcttctggaggattactccgagcctcaaccaagtatgttttaccagacgccccagaatgagcatatctaccagcagaagaataagctcttaatggaggtctacggcttcagtgacagctttagcggagttgactcggtgcaggagttagcgcctccaccagccctgccgcctaagcaacgccagctggagccacctgcagggaaggatgggcatccaagagacccaagtgcagttagtggagtgcccggaaaggactcccgagatggctctgagcgagctccaaaaagcccagacgccctcgaaagtgctcagtccgaggaagaggtggatgagctgagcttgatcgaccataacgagatcatgtctaggctcaccttgaagcaggagggcgatgacggccctgatgtgcgcggaggtagtggggatattcttctggtccacgcaaccgagaccgatcgcaaagaccttgtcctgtattgcgaagccttcctgacgacctaccgtacttttatttccccagaagaacttatcaagaaactgcagtatcggtatgaaaaattttcccccttcgccgatacattcaagaagcgcgtctcaaagaacacatttttcgttctggtgcgagtggtagacgaactctgcctggtggaattaacggaagaaatcttaaaactgttgatggaactcgtgtttcgattggtgtgcaatggcgagctaagcctggcccgagtcctgagaaagaacattctggataaagtcgaccaaaagaagctgctccggtgcgctacttcctctcagcctctcgcggctcggggagttgccgctcgccctgggacacttcatgattttcactctcacgaaatagcagagcagcttactctgctcgatgccgagctgttctataaaattgagatacctgaggttctgctttgggctaaggaacagaatgaggagaaatccccaaacctaactcaattcactgaacactttaataatatgtcttactgggtccggagcatcattatgcttcaggagaaagctcaggatagggagcggctgttactaaagttcataaaaattatgaaacatctgcggaagctgaataactttaacagctacctggctatcttaagcgcactggattcggccccaatccggaggctcgaatggcagaagcagaccagtgagggactggccgaatactgcacactgatagactcttcgtcatctttccgggcttacagagctgctctcagcgaggttgagccaccatgcattccttaccttggactgatcctacaagacctgacattcgtccatctgggcaaccccgattatatcgatggcaaagtaaacttctccaagaggtggcagcaattcaacattttggattcaatgcgttgttttcaacaagctcactatgacatgaggaggaatgacgacatcatcaatttcttcaacgatttttcagaccacctggctgaggaggccctgtgggaactgagtctgaagatcaaaccccgtaatataaccaggcgaaagactgaccgcgaggaaaagacctag

SEQ ID NO: 30503 - DNA, 3168 bp, Artificial Sequence
  Description of Artificial Sequence: Synthetic coding sequence
atgtcaacaagcgccgtggcaagtagaagtcaaagacaaaagaacctctcttggctggaggagaaggagaaagaagttgtcagcgctttgcggtactttaaaaccatagtcgacaagatggccatcgataaaaaggtcctcgaaatgctaccaggttcagctagcaaagtcctggaggccattctccccttagtgcagaatgatcctcgcattcagcactccagcgcccttagcagttgctacagcagggtttatcaaagcctggcaaacttaatacggtggagtgaccaggttatgctggagggcgtgaatagtgaagataaggagatggtgactaccgtgaaaggggtgattaaagccgtgcttgacggcgtcaaggagctcgtgcgtctgaccattgagaagcagggccgtccctctcccacctctccagtgaaaccttcatcacctgcgagcaagcccgacggcccagccgagctaccactcacagatcgagaggtggaaatccttaacaaaactaccggaatgtcacagtccactgagctactccctgatgctacggatgaggaagtcgcacccccaaagccgccattgcccggtattcgtgtagtggacaattctccacccccagccctgcctcccaagaaacgccaaagcgcaccctcaccaacaagagtggcagttgttgccccaatgagccgggctaccagcggatcctccctgcctgtagggattaataggcaagattttgacgtggactgctatgcccagcgccgtctttcaggaggctctcactcttatggaggcgaaagccctcgcctgagcccatgctcaagtatcggcaaacttagcaaatcggatgagcagctgagttcactcgaccgcgatagcggccagtgtagtcggaacacttcttgtgagactttggatcattacgacccagactacgaattccttcagcaggatctgagtaatgctgatcagatcccacagcagactgcttggaatctgagccctctgccagaatcccttggagaaagcgggagccccttcttgggccctcccttccagcttcctttaggaggacacccccagccagatggtcccctggcgccaggacagcagaccgatacccccccagccctgcctgaaaaaaaaaggcgcagcgccgcatcccagacagccgatggtagcggctgtcgagtctcatacgagcgccacccaagtcagtacgataacatcagtggcgaggacctgcagtcaacggcgcctatcccgtctgttccatacgcccctttcgctgcaatcctgcctttccagcacggaggctcttctgctcccgtcgagtttgtgggcgacttcacggcgcctgagtctacaggggatcctgaaaaaccacctccccttccggaaaaaaagaacaaacacatgctggcatacatgcagctgttggaagactatagtgagccgcagccaagcatgttttatcagaccccgcagaacgagcatatataccagcagaaaaataagttgctcatggaggtgtatggcttttccgactctttttccggggtcgacagcgtgcaggagctggccccacctcctgcattgccaccaaagcagcggcagttggcttcatgtgccgcttcctccttctcctcagttagccattgtgtacagcagactaaggtagctttcacccccgaggacggatctgccgctcagggactttccgtttccgtcagcaattcattcctcagtcggcatggttctctccccgtaccgagtgagcccccagccggaaaggatggacacccacgggacccctccgcggttagcggtgtgcctggaaaagactccagagacggcagcgaacgcgctccgaagtctcctgatgcattggagtcggcacagagcgaagaagaggtcgacgagctgtccctcatcgatcacaatgaaattatgagtcggctcaccctgaagcaggaaggcgacgacggtcctgacgtacgcggaggctctggtgacatcctactcgtacatgccaccgagactgacaggaaagacttggtactgtattgtgaggccttccttaccacgtacagaacattcatttcacctgaagaactaataaagaagttgcagtataggtacgagaaattttccccatttgccgacacctttaagaagcgtgtaagtaaaaataccttttttgtgttggtgcgggtggtggatgaattgtgcctggtagagctcaccgaggaaatcctgaaactcttgatggagctggtgttcaggttggtgtgtaacggggagctgtctttagcccgagtattaagaaaaaatatcctggacaaagtggaccagaaaaaactactgagatgcgctacatcctcacagcccctcgccgcaagaggggtggcagctaggcccggtactttacatgatttccacagccacgagatcgccgaacagctgacacttctagatgccgagctgttttataaaatagaaattcccgaagtcttactctgggcaaaggaacaaaacgaagagaaatctcccaatctgacccaattcactgaacacttcaataatatgtcttactgggttagatcgatcatcatgctgcaagaaaaagcccaggaccgcgagagactcctgctgaaattcatcaaaatcatgaagcacctgaggaaattaaataactttaattcctacctcgctattctctccgctctggactccgctcccatcagacgccttgagtggcagaagcagaccagcgagggtcttgcggaatactgcacactgatcgacagttcctccagtttcagagcctatcgcgcagccttaagcgaggtcgaacctccatgcatcccctatcttggattgatccttcaggatctgacttttgtgcatttgggcaatccagattacatcgacgggaaagtgaacttcagcaagagatggcagcaatttaatatcctggattccatgaggtgtttccaacaggcccattacgatatgagacggaacgacgacattatcaattttttcaatgatttttccgatcatctagcagaggaggccctgtgggagctcagcctcaagattaaaccccgaaacatcacgcgcaggaagaccgatcgcgaggaaaagacctag

SEQ ID NO: 30504 - DNA, 3285 bp, Artificial Sequence
  Description of Artificial Sequence: Synthetic coding sequence
atgtccggcggactggggctccggaggagccctgagatgtcaggaaaaatcgagaaagcggactcacagcgctcccacctctccagcttcaccatgaagctaatggataaatttcatagcccaaagataaagcgtaccccctccaagaagggcaagccagccgaagtgagcgtgaaaattcctgagaagccagtgaataaggaggcaacggatagattcctcccagaggggtacccactgccgcttgacttggaacagcaggccgtggaatttatgagcacttccgcagtggccagccgcagccaaaggcagaaaaacctgtcctggctggaggaaaaagaaaaggaagtggtttccgctctacggtactttaaaactatcgtggacaaaatggctatagataagaaggtcttggagatgttgccagggtcagcatccaaggtgcttgaagccatcctccccctggtccagaacgatccaagaatccagcattctagtgcccttagctcgtgctactccagggtgtaccagagtctggcaaacctgattagatggtctgatcaggtgatgctggaaggagtgaatagcgaggacaaggaaatggtaactaccgtaaaaggggtgattaaggctgttctggatggagttaaagagctcgtgcggttaacaattgaaaagcaagggagacctagtccaaccagtccagtgaaaccgtcaagccccgcatctaagccagatggacccgcagagcttccactgacagatcgcgaggtcgaaatcttgaataagacaactgggatgtcacagtcgaccgagctcctgcctgacgctactgacgaggaggtcgcaccgcctaaaccccctctgccgggaattcgcgtggtcgataatagccccccaccagcactgcctcctaagaagcggcagtcggctccatccccgacgcgggtggcagtggtcgctcccatgtcacgggcaacatccgggtctagtctgccagttggtataaataggcaggacttcgacgtagactgttatgcacagagaagactgtccggcggatcccactcgtacggaggcgaaagcccacgcctaagtccgtgtagctctattggcaaactgagcaagtcagatgagcagctgtccagtctggaccgagattctggacaatgtagccggaacacttcttgtgagactttggaccactatgatccggattacgaattcctgcaacaggatctctcaaacgcagatcagatcccgcagcagaccgcctggaacctgtcacctctgcccgaatccctaggggaatccggaagccccttcctcggaccacccttccagctacctctgggtggacatccccaaccagacggtcccctggcaccgggtcagcagacagacactcccccagcactccctgaaaaaaagcgcagaagcgcagcatcacagactgccgatggatccggctgccgcgtttcgtatgagcggcacccctcccagtacgataacatcagcggggaagaccttcagtccactgctcctatcccatctgtgccctacgcaccctttgccgctatccttccatttcaacacgggggtagcagtgcacccgtcgaatttgtcggggattttactgcgccagaatcaacaggcgacccagaaaaaccaccccctctcccggaaaaaaaaaacaagcatatgcttgcgtatatgcaactgcttgaggactactcggagcctcagccctctatgttctaccaaacaccccagaacgaacacatttaccagcagaagaataaactgctaatggaggtttacgggttctctgatagctttagtggagtggacagcgtccaagaactggccccaccgccagcccttccgcctaaacaaagacagctagagccacccgcaggcaaggatggtcaccccagagacccctccgccgtcagtggtgttcccggtaaggacagccgagacggctcagagagagctccaaaaagtcccgacgctctcgagagcgctcagagtgaggaagaagtggatgagctctcactcatagaccacaacgaaatcatgagcaggctgacccttaaacaggagggcgacgatggacccgacgtgcggggtggcagcggggacatcttgctggtgcatgccacggagactgacaggaaagaccttgtgctctattgcgaagcctttctcacaacgtataggaccttcatctcccccgaagagctgatcaaaaagctccagtacagatatgagaaattctcacccttcgctgatacatttaagaaaagggtatcaaaaaatacattctttgtgcttgtgcgagtggtggacgagctgtgccttgtggaactcacagaggaaatactgaagcttctgatggaacttgtgttcaggttagtttgcaatggagagctctccttggcaagagtcctccggaagaatatactggacaaggttgaccagaagaagttgctaaggtgtgcaacgagctcccagcccttggccgcacggggagtcgccgcacggcctggaacactgcacgattttcacagccacgagattgcagagcagctgaccttgctggacgctgaactgttttataagattgagatcccggaagttctactatgggccaaggagcagaacgaggaaaaatctcctaaccttactcagttcaccgaacattttaataacatgtcctactgggtaaggtccattatcatgttgcaggagaaagcccaggatcgggagcgcctcctgctgaaattcattaaaattatgaaacatctgaggaagctgaataacttcaattcttatcttgccatactcagcgccctggactccgctccaattagaaggctcgaatggcaaaagcaaacatcagagggcctggcggaatattgcacactgattgattcaagtagtagcttcagagcgtaccgcgctgcactctccgaggtggagcctccttgtatcccctaccttgggctcatcctgcaagatctgacttttgtacacctgggaaaccctgattacattgacggaaaggttaatttttccaagcgctggcagcagttcaatattttagacagcatgaggtgctttcagcaagcccactatgatatgaggcggaatgatgacattatcaattttttcaacgatttcagcgaccatctcgcagaagaagcgctgtgggagttatcacttaaaataaaaccacggaatatcacgcgtcggaaaacagacagggaggaaaaaacctag

SEQ ID NO: 30505 - DNA, 3234 bp, Artificial Sequence
  Description of Artificial Sequence: Synthetic coding sequence
atggataccgactctcagcgaagccacctctcctctttcaccatgaagttgatggataaatttcacagtcctaagatcaagcggaccccttctaaaaaaggaaaacccgcagaggtttctgtgaaaattcccgagaaacccgtgaacaaagaagccactgacagattcttgcctgaaggttacccactgcctttggacctggaacagcaggccgtagagttcatgagcacaagcgctgtggcgtcaagaagccagaggcagaagaatttgagttggttagaggaaaaagagaaagaagtagtatctgctctccgatatttcaagactattgtcgacaaaatggctattgataagaaggtgctagagatgctgcctggcagtgctagcaaggttctggaagcgatcctgcctcttgtccagaatgacccacgcattcaacactcctcggcgctatcttcttgctattcccgggtgtaccaatctctggcgaatctgataagatggtccgaccaggtgatgttggagggcgtgaactccgaggataaagagatggtaacaacagtcaaaggcgtgatcaaagcggtgctggatggcgtcaaggagctagtacggctgaccatcgaaaaacagggaagaccatcgcccacatcccctgtgaaaccatcatctccggcttccaaaccagatggtccagcagaactccccctgacagaccgtgaagtggagattctaaataagaccaccggcatgtcgcagtccacggagctgctacccgacgccaccgatgaggaagtggctccgccaaaaccccctctgcccggaataagggtggtggataatagtccacccccagctctgcctcccaaaaagaggcagtccgctccctcccctacccgagttgctgttgtcgccccaatgtcccgagcaaccagcggatctagcctgccagtgggaataaatcgccaggacttcgacgtagattgctacgcacagcgtcgcctcagcggcggatcccacagctatggaggcgagtcgccacggctctcaccctgcagttctatcgggaaactcagcaaatctgatgagcagctgtcaagtttagatcgggactccggacaatgttctcgaaacacctcctgcgagacactggatcactacgatccagattacgagtttctgcagcaagatctgtcgaatgctgatcagatcccacaacagactgcatggaacttatctccccttcctgaatcactgggtgagtccggctccccctttcttggacccccttttcagctgcctctgggaggtcaccctcagcccgacggacccctcgccccaggacagcagaccgacacccccccagcccttccagaaaagaagaggcgctcggccgcttcccaaaccgccgacggctctggatgcagagtctcttacgagcggcacccctctcagtacgacaatattagcggggaggacctgcagtcgacagcccctattccaagtgtcccctatgcaccttttgccgctatccttccttttcagcatggcggatcctccgcaccggtggaattcgtgggcgactttacggcgccagagtcaaccggggatccagaaaagccaccgcctcttcctgaaaaaaaaaacaaacatatgctggcctatatgcagctcctggaagactacagcgagccccaaccctccatgttctaccagacacctcagaacgaacatatataccagcaaaagaacaaactactgatggaagtctacggtttctccgatagtttctcaggcgtggacagtgtgcaggagcttgccccacctcccgctcttccgcctaagcaacggcagctcgagcctcccgctggcaaggatggccacccccgagacccatctgctgtcagcggtgtgcccggtaaagactccagggatggctccgaacgtgcaccaaagtcgcccgacgcgctcgaatcagcgcagagtgaggaggaagtggatgagttgtcccttatcgaccataatgaaattatgagccgtttgacattgaaacaagagggcgacgacgggcctgacgtccggggaggttcaggtgatatcctgttggtgcacgctactgaaactgaccggaaagacctcgtgctgtactgtgaggcattcttgacaacctatcgtacttttatctcgcccgaagaactgatcaagaaactgcaatatcggtatgaaaagttctcaccatttgccgacaccttcaaaaaaagagttagcaagaatacattcttcgtgctggtacgagtggttgacgaactgtgcctggtcgaactcactgaagagattctgaaactcttgatggaactggtgtttcgcctggtatgcaacggtgagttgagtctcgcccgagtgctcaggaagaatatacttgacaaggttgaccagaagaagctgctccgctgcgccacaagctcccaaccactagctgctcgcggagtggctgccagacctggcacactacacgatttccacagccacgaaattgccgagcagctaactttgctcgacgccgagctattctacaaaatagaaatacctgaggtcctgctctgggctaaggagcagaacgaagagaagtcccccaatttgactcagtttaccgagcattttaacaatatgtcctattgggtgcggtccatcattatgctccaagagaaagctcaggaccgagagcgtcttctgctaaaatttatcaagattatgaagcacctgcgcaaactcaacaacttcaattcctatttggcaatcctcagcgctctggattcagctcctattcggagattggagtggcagaagcagacgagcgaaggattagctgagtactgtacattgatcgattccagcagcagctttcgtgcttatcgcgctgcattgtctgaggttgagcctccctgcatcccgtaccttggacttattttgcaggaccttaccttcgtgcaccttgggaatccagattatattgatggtaaagtgaactttagtaagcgctggcaacagttcaacatactggattcaatgaggtgcttccagcaggctcactacgatatgcggagaaatgacgacatcataaactttttcaacgattttagtgaccatctggccgaggaggccttgtgggaactgagtctgaagatcaagcccaggaacataacacgtaggaagactgatagggaggagaagacttag

SEQ ID NO: 30506 - DNA, 3288 bp, Artificial Sequence
  Description of Artificial Sequence: Synthetic coding sequence
atgggcaacgccatagagaaacagaagcctctaaaacgctcacacttatatccctggaaacaggactcccagcggtcacacctgtctagtttcacaatgaagcttatggacaagttccacagccccaagatcaaaagaactccctccaaaaaaggaaaaccagcagaggtgtcagttaagataccagagaaacctgtaaacaaggaagccacggacagattcctgcccgagggataccccctgcccttggatctggagcagcaggcagtggaattcatgagtacatccgcagtggcctcaagaagccagcggcagaagaatctgtcatggctggaggagaaagagaaggaggtcgtgagtgccctcaggtactttaagaccatagtggacaagatggcaattgacaagaaagttctcgagatgctacctggaagcgccagtaaggttctggaggccattttgcctctggtgcagaatgatcccagaatacagcactcctccgccctctcaagctgctatagcagagtctaccagtccctggcaaacctcatccgatggagcgatcaggtgatgctcgaaggcgtgaactctgaggacaaagagatggtgacaacagtgaagggcgtaataaaggccgttctggacggagtgaaagagctggtccggctgaccattgagaagcagggtcggccatcccccacaagcccagtgaaaccatcgtcgcccgcatccaaacccgacggcccagccgagttgccacttacagatcgcgaagtggaaattctgaataagacaaccgggatgtcacagtccaccgagctgctgcccgatgccactgatgaagaagtggcacctccaaagcccccattacctggcatcagagtcgtggataactcccctccacccgcactgcccccaaaaaagagacagagcgcgccttcgcctacccgggtggcggttgtggccccaatgtcccgcgctaccagcggaagctccctgccagtcggcattaatcgtcaggactttgacgtcgactgttacgcccagcggcgattgagcggcggatcacattcttatgggggagagagcccccgactttccccttgtagcagcatcggtaagttatcgaaaagcgatgaacagctatccagtctggatcgagattccggacagtgctccagaaatacttcatgtgaaactctggatcactacgatcctgattatgagttccttcagcaagatcttagcaatgctgaccaaatacctcagcagaccgcctggaatctcagccccctcccagagagtctgggtgagagcggatcgcctttcctgggcccaccatttcaactgcctttaggtgggcatcctcagccagatggcccactggccccaggacagcagaccgacacacctcccgctctacccgagaagaagcggaggtcagcggcttctcagacggcagatggatccggttgtagagtgagttacgagagacatccgtcacagtatgacaatatctcgggggaagacctccaatctactgcccctattccctcggtgccctacgcacccttcgccgctatcctgccttttcagcatggcggatccagcgcacctgtggagtttgtcggagatttcaccgccccagaaagcactggcgaccccgagaagccccctcctctcccagagaagaagaacaagcacatgcttgcctacatgcagctcttagaggactactcagaacctcagccatctatgttttatcagacacctcaaaacgagcatatatatcaacagaagaacaaattgctgatggaagtgtacggtttcagcgatagtttttccggggtggactctgtacaggaattagcaccgcctccagccctgccgcctaagcagcgccagctggagcccccagccggaaaagacggacacccacgcgatcccagtgcggtctccggagtgcccggaaaggatagcagagatgggagtgagagagcacccaagtcacctgacgccctcgaaagtgcacagagcgaggaggaggtggatgaactgagtctcatagaccataacgagattatgtcacgcctgactcttaagcaggaaggggacgatggccctgatgtcagaggtggatcaggagatatcttgctggtccacgccaccgagaccgaccgtaaggatctcgtactctactgtgaggccttcctcaccacatacagaacatttatctccccggaagagttgataaaaaagctccaatacaggtacgagaaattttctcctttcgccgataccttcaaaaagcgggtcagcaagaacaccttcttcgtgttagttcgcgtcgtagatgaactgtgtttggtcgagttaactgaggagatattaaagttactgatggagctcgtgttccggttagtttgcaacggagagctgagtctcgctcgagtattacgcaagaatattctagataaagtggatcaaaaaaagctgttgagatgcgctaccagtagtcagccccttgccgcaagaggggtagcggctagaccagggacattacacgattttcatagccacgaaattgctgagcagttgaccttgctggacgccgaactgttttataaaattgaaatacccgaggtacttttatgggctaaagaacaaaatgaggaaaaaagccccaacttaacgcagttcacagaacatttcaataacatgagctactgggttagatctataattatgttacaagagaaggctcaggatagggaacggctgctgctcaaattcatcaagatcatgaagcatctgagaaaattgaacaacttcaactcgtaccttgcaattctgagcgcactggacagcgcccctattaggcgcttagagtggcagaagcagacctccgaaggattagctgagtactgcaccttgattgattcctcgagctcttttcgagcttatagagcagctctatccgaagttgagcccccttgcatcccatatctggggttgatcctgcaagatctcacatttgttcacttgggcaaccccgactatattgatggcaaagttaatttctccaaaaggtggcagcagtttaatatccttgactccatgcggtgttttcaacaagctcactatgacatgcggaggaacgatgatattatcaacttctttaacgatttttcagaccatctcgcagaggaggccctgtgggaactctccctgaagatcaaacctagaaacatcactcgtcggaagaccgatagggaagagaagacctag

SEQ ID NO: 30507 - DNA, 1395 bp, Artificial Sequence
  Description of Artificial Sequence: Synthetic coding sequence
atgagtagggctacatctggctcctctctgcccgtcgggattaaccgacaagatttcgatgtcgattgctacgctcagcggcgactctcggggggatcacacagttacggcggtgagagcccaagactaagtccctgcagttctattggcaagcttagtaagtcggacgaacagctgagtagcctggatagagactctggccagtgtagccgcaatacatcttgcgagactctggaccactatgaccccgactatgagtttctgcagcaggacttgtccaacgcagatcagatcccgcagcagaccgcatggaatttgtctcctttacccgagtcattaggggaaagtggatcgcccttccttggcccacctttccagctgcctcttggcggtcatccccagcctgacggcccactcgcccctggacaacagactgacactcccccagccctgcccgagaagaagagaaggtctgctgctagccagactgccgacggatccggctgcagagtttcatatgaacgccatcccagccaatatgacaatattagcggggaggaccttcagagtactgctccaataccatccgtgccctatgccccattcgctgctatcctccctttccaacatggtggctcaagtgccccagttgaattcgttggtgacttcactgcaccagagtctaccggagacccagagaagcctcctcccctgccagagaagaagaataaacatatgcttgcttatatgcagttgctggaggattactccgagccacagcccagtatgttttaccaaacaccccagaacgagcatatataccaacaaaagaacaaactcctgatggaggtctacggattcagtgatagcttcagcggggttgactctgtgcaagaactcgcccctcccccagccttaccccctaaacagaggcagctgcaagcgagctgtgctgcttcttctttctctagcgtgagtcactgtgtgcagcagacgaaggtcgccttcaccccagaggacggaagcgcagctcaagggctttcagtgtccgtgtctaactcattcctttctcggcacgggagcctgccggtgccttcctacaagtctgtttttcgcagctacagtcaagacttcgtgccacatcatcaagcttcggtgcctcctttcctaccccctacgagttcttcatcccctcacttccctcccgcacaccagagtcagagctctgatttggccgttcccactatggcgggtccccctcctagcaccgttgatgggcctcttagtgcatcccaagagtcctcattccatggcaatacagtctgcctgccatccgagacaagttttacggatagcgaacccccagcaggcaaggacggacacccacgggactag

SEQ ID NO: 30508 - DNA, 3285 bp, Artificial Sequence
  Description of Artificial Sequence: Synthetic coding sequence
atgagcgggggactaggcctgagacggtctcccgagatgagtggcaaaattgaaaaggcagactcccagcggtcacacctgtcatcattcactatgaaactgatggacaagttccattcacccaagatcaagaggaccccctccaagaaagggaaaccggcagaagttagcgtgaagatcccagagaaaccagtgaacaaagaagccacagaccggtttctcccggaaggctatcccctgccccttgacttggagcagcaagcggtcgagtttatgtcaacaagcgctgtggcgtccaggtcccagaggcaaaagaacctgtcttggcttgaggaaaaggaaaaggaggtggtgtcagcccttaggtacttcaagacgatcgtggacaagatggccatcgacaaaaaggtgcttgaaatgctgccaggaagtgcttcaaaagtactggaggccattctgccactggttcagaatgaccctcgtatacagcacagcagtgctctctccagttgctactctcgcgtgtaccagtctttggccaatctgattcgctggtcggatcaagtgatgctggaaggtgtgaacagtgaggacaaggaaatggtgaccacagtgaaaggagtgatcaaggcagtgctcgacggcgtcaaagagcttgtgcgcctaactatcgagaagcagggcagaccgtcacctacctcccctgtcaagccttccagcccagcgtcaaaacccgatggacctgccgagctaccgctcaccgaccgagaggttgaaatattgaacaaaaccacagggatgagtcaatctactgagctgctacctgacgctaccgacgaagaggttgcgccacctaagccacctctccctgggatccgggtggtggataactcccctcctccggctctgcccccaaaaaaaaggcagagtgcgccatcccctactagagtagcagtagtggcacccatgtcacgagctacctctggttcatctctcccggtcggaattaataggcaagacttcgatgttgactgctatgctcagaggcgactcagcgggggaagccattcttacggtggggaaagcccacgattatccccatgctcctccattggtaagctgagtaagagtgacgaacaactctcatcgctggacagggactccggacaatgctccagaaatacatcttgtgaaacactagatcattacgaccctgattatgagttcttgcagcaggacttgagtaacgctgaccagataccacagcagacagcctggaacctgtcgcccctgcctgagtcactgggggaatctggatccccatttctcgggccaccattccaactgccccttgggggacaccctcagcccgacgggcctcttgcaccaggtcagcagaccgatacaccaccagccctgcccgaaaagaagagaagatccgctgcctctcagacagctgacggcagcggctgtcgggtatcgtacgagaggcacccatcccagtatgacaatatctcaggggaagaccttcagtccactgctccaatccctagtgtcccctacgctccattcgccgcaatcctgccattccagcacggaggcagcagcgccccagtggaatttgttggggacttcaccgcgccagagagcaccggagaccctgaaaaacctccccctcttccagagaagaagaataaacatatgctcgcatatatgcagctgttagaagattactccgagccccagccaagtatgttctaccagacacctcagaatgagcacatctatcagcagaagaataaacttctaatggaggtgtacggttttagtgatagcttctcaggcgtcgactcagtgcaagagctcgccccaccccctgcacttcctccaaaacagagacagctggaacccccagccggaaaagatggccaccccagggacccgagtgcagttagcggagtcccgggaaaggattccagagacggttcagagagggctccaaaaagtcccgatgccctggaatctgcacagtccgaggaggaagtcgacgagctgtcgttgatagaccacaacgagatcatgtccaggctgacgctgaagcaggagggcgatgacgggccagatgttaggggcggatccggagacattcttctggtacacgcaaccgagacagatcggaaagaccttgtgttgtactgtgaagcctttctgaccacttataggaccttcatttccccagaggagctgatcaaaaagttacagtaccggtacgaaaagttcagcccttttgcagacactttcaagaaaagggtgagcaagaacacctttttcgtactcgtgcgcgtggtcgatgagctgtgccttgtggagttaacagaggagatactgaagctgctcatggaacttgtatttaggctcgtgtgcaacggggaactttctctcgcgagggtgttgcggaagaatatcctggataaggttgaccagaaaaaactcctgcggtgcgcaaccagttcacagcccctggctgcaaggggcgtggctgcacggccaggcaccctgcatgacttccattcccatgaaattgcggagcagctgacactgttggacgctgaattattttacaagatcgaaattcccgaagtgctcctctgggcgaaagagcagaacgaagagaaatcaccaaacctgacccagttcaccgagcactttaataacatgtcatattgggtgaggtccataattatgctgcaggagaaggcccaggatcgcgagaggcttttactaaagtttattaaaatcatgaaacatctacgaaaacttaataattttaattcctatctggctatcctgtctgccctcgactctgcccctataaggcgcctggaatggcagaagcaaacgtcggaaggattagctgaatactgcaccctaattgacagttcttcttccttccgcgcatacagagccgctctgagcgaggtcgagcccccatgcatcccttatctggggctgatacttcaggacttgaccttcgtgcatttgggcaacccagactacatcgacggcaaggtcaacttctccaagagatggcaacagtttaatatcctggattcaatgaggtgcttccagcaagcccactacgatatgaggcgcaatgacgacatcataaacttttttaacgactttagcgatcacttggctgaggaggccctttgggaactgtccctaaagatcaaaccaagaaacatcacaaggcgcaagacagaccgggaagagaaaacgtag

SEQ ID NO: 30509 - DNA, 1011 bp, Artificial Sequence
  Description of Artificial Sequence: Synthetic coding sequence
atggaggtttacggattcagtgatagcttcagtggagtcgatagtgtgcaggaactcgcgcctcccccagcactgccccctaagcagcggcagttgtccgagaatgcttccgaagaagccggtgaaggcgaatatgtcaacctgtactcgtccgggcagtcttctgaggaattggctccgtcgaggggcgagccacctgcaggtaaggacggtcatcctcgcgacccatcagccgttagcggcgtacccggaaaggactctagggatggctctgaaagggcccctaagagcccggatgccctggagtccgcccagagcgaggaagaggtcgacgagttgagtctgatcgatcataatgaaatcatgtcccggctcaccctcaaacaggaaggagatgatgggcctgatgtgaggggtggatccggagacatcctgctggtacatgcgactgaaaccgatagaaaagacctagtactctattgtgaggccttcctcactacctataggacatttatatctccagaggaactgatcaagaaactacagtacagatacgaaaagttttctccttttgccgatacattcaaaaagcgagttagcaaaaacacctttttcgtactcgtgagagtggtggatgaactatgcttagttgaattaactgaagaaatcctcaagcttctgatggagttggtgtttagattggtgtgcaacggagagctcagcttggccagggtccttcgtaaaaatatcttggataaggtggatcagaaaaaactgctgcgatgcgccacctcctctcaacctctcgcagctagaggcgtcgcagccagaccaggaactctgcacgactttcatagtcatgaaatagcagagcaattaacccttctggatgcagagctgttctacaagattgaaatcccagaggtgctgctgtgggcgaaagagcagaacgaggaaaagtctcctaatctgactcagtttacggaacactttaataatatgtcttattag

SEQ ID NO: 30510 - DNA, 3174 bp, Artificial Sequence
  Description of Artificial Sequence: Synthetic coding sequence
atgggaaacgccatcgaaaagcaaaaaccgctcaaaagatcccatctctacccttggaaacaggattctcagcggtcccatctctcctcattcacaatgaagctcatggataaatttcacagcccaaaaataaagcggaccccatcaaaaaagggtaaacctgcagaggtgtctgtgaaaatcccagagaaaccagttaataaaaatctgtcctggttggaagagaaggaaaaagaggtcgtctccgccttacggtactttaaaaccatcgtcgataaaatggctatcgacaaaaaggtacttgaaatgctgccagggtcggcctctaaggtgcttgaggctatcctgccactagtccagaatgacccgaggattcagcactcttcagctctcagctcctgctactccagagtctaccagtctctggctaatctgattagatggtcagatcaggttatgctcgaaggagtgaacagtgaggacaaagaaatggttacaacggttaagggagtcattaaagcagtcctcgatggagtgaaggagttggttaggttgaccatcgaaaagcagggtcgaccctccccaactagtcccgtgaagcccagttcgccagcgagtaagcctgacggaccagcagaactgcctctgaccgacagagaggtcgaaatcctcaacaagacaaccgggatgagtcagtccaccgagctgctgccagacgctacggacgaggaagtcgcaccaccgaagcctcctcttcctggtatccgagttgttgataattcgcctccaccagctctgccaccaaaaaagcgacagtccgccccttcacctaccagggtggccgtggtggccccaatgtcacgggcaacttcggggtcatccctgcctgtcgggattaataggcaagatttcgacgtggactgctatgcccagcggcgactttccggcggtagtcatagttacgggggagagtcaccgagactcagcccgtgctcctctattggaaagctgtccaagtctgacgaacagctctcaagtctagatcgtgactccggacagtgctcaagaaatacctcctgcgaaactctcgatcattacgatccagattacgaattcctgcagcaggaccttagcaacgctgatcaaattccccagcaaacagcctggaacctatctcccctgcctgagagcctgggtgaatccggatcacccttcttggggccacctttccaacttcccctcgggggacatccacagcccgatggacccctcgcacccggacagcagaccgacaccccacctgccctgcccgagaaaaaaaggcgttcagcagccagtcagacagcagacggatctggctgtagagtatcctatgagcgccatccttctcagtacgacaacatctcaggggaagatcttcagtctacagctccaattccatccgtcccttatgctccatttgccgcaattctgccttttcagcatggaggctcaagcgctccagtagagtttgtcggagactttacggcccctgagagcacgggcgatccagaaaaaccgcctccactgcctgagaagaagaacaaacacatgcttgcttatatgcagctgctggaggactactccgagccccagcccagtatgttctaccagacgccacagaacgagcacatttaccagcagaaaaataagttactcatggaagtctacggattctccgatagcttttctggtgtggatagtgtgcaggaactcgccccacctccggcactgccccctaaacagcgacagctggagcctcccgcaggtaaggacggtcacccgagggatccttccgcagtatcaggggtacccggtaaagattcgcgagacggcagtgaaagagctcccaaatcccccgacgccctcgaaagcgcccagtctgaggaggaagtagatgaactgtcactgatcgaccacaacgagattatgtcacgtctcacactgaaacaggaaggagacgatggccctgacgtgagggggggaagcggcgatatattgctggttcacgctactgagaccgacagaaaagatctggttctgtactgtgaggcatttctgaccacataccgcactttcattagtcctgaagagctcataaaaaagctgcagtaccgatacgagaagttttcccccttcgcagacacgttcaaaaagcgcgtgtctaagaacaccttcttcgtgttagttcgagtggtcgacgaactgtgcttggtagaactgacggaagagatcctaaagctgctgatggagctggtctttagactggtgtgcaacggggagctgtccctggccagggtgttacgcaaaaacattttggacaaggtggaccagaaaaagctgctgagatgcgctacatcttctcagcctttagccgctaggggggtggccgctcgccctggaaccctgcatgactttcactctcatgaaatcgccgaacagctgaccttgctcgacgcagagctattctacaaaatcgagatccctgaagtactactgtgggcgaaagaacagaacgaggaaaaaagccctaatctcactcaatttactgaacatttcaataatatgagttattgggtgaggagcatcattatgctccaagaaaaagcccaagaccgcgagcgtttgctcttaaagttcatcaagatcatgaaacaccttaggaaactgaacaatttcaactcttacctggccatcctgtccgcattggattcagccccaatccggaggctggaatggcagaagcagacgagcgagggcttagcagaatactgtacacttatcgactcctcaagcagcttccgcgcttatagagctgctctctcggaagtggaacctccttgcattccctatctgggtttgattcttcaggatctgacctttgtgcacctggggaaccctgactacattgatggcaaggtcaacttcagcaagaggtggcagcaatttaatatccttgattcaatgcggtgctttcagcaggcgcattatgatatgaggaggaacgatgacattattaacttcttcaacgatttttcagatcatctggctgaggaagccctctgggagctctcattgaaaataaaaccacgtaacataacacgcagaaagactgacagggaggagaagacctag

SEQ ID NO: 30511 - DNA, 960 bp, Artificial Sequence
  Description of Artificial Sequence: Synthetic coding sequence
tagttggcaccgcctcctgcacttccaccgaaacagaggcagctgtctgagaacgcaagcgaagaggccggtgagggtgagtatgtcaatctttactctagcggacagagcagtgaagaactagccccatctagaggagagccccctgccggtaaggacgggcatcccagggaccccagtgctgtgagtggagttccaggcaaggactcccgggacggtagtgagagagcgcctaaatctccggacgcgctggagagtgcacagagcgaggaggaagtggacgagctcagccttattgatcataacgagatcatgtcaaggctgacactaaagcaagagggcgacgacggcccagatgtgcgaggcggaagtggcgacattctgctggtacatgccactgaaaccgaccgcaaggatctggtgctgtactgtgaggcgttcctgaccacttatagaacgttcatttctcccgaagagttgatcaaaaagttgcagtacaggtacgaaaagtttagcccttttgccgacaccttcaaaaagcgcgtgtcgaagaacacctttttcgtgctcgtccgcgtggtggacgagctctgtctggtggaactcacagaagaaatcctcaagctactgatggaactcgtctttcgcctagtgtgtaatggcgagctgtctctcgcaagagtattgaggaagaacatcctggacaaggttgatcaaaagaagctactccgctgtgcaacctcctctcagccactcgccgctagaggcgtagccgcacggccaggaacactacacgatttccactcacacgaaattgccgaacagctgactctcctggacgccgaactgttttataagatagagattcccgaggtcctactgtgggccaaggagcagaatgaagaaaagtcccccaatttgacccagtttaccgaacactttaacaatatgagttactag

SEQ ID NO: 30512 - DNA, 687 bp, Artificial Sequence
  Description of Artificial Sequence: Synthetic coding sequence
tagttgcccgagaagaagaataagcacatgttggcgtatatgcaactgctggaggattacagcgagccacagccttccatgttttatcagacaccgcagaacgagcacatttatcagcagaagaacaagttactgatggaagtgtacgggtttagtgactcttttagtggcgtagatagcgtgcaggagctggctcccccaccggcactacccccaaaacagaggcagctacaagcttcatgcgccgcatcttccttttcgagcgtttcccactgcgtgcagcagacgaaggtggcctttacccccgaggacggttccgccgctcagggactgtccgtctcggtcagtaactcatttctgtctcgccatggatctctgccagtgccatcctataaatccgttttccgctcttattcccaggacttcgtgcctcaccaccaggcttcagtccctcccttcctgcccccaactagttcttcaagtccccactttccccctgcccaccagtcccagtccagcgatttggctgtgcccacgatggcagggccacctccatccacagtcgacgggcctctgtcggcctcccaggaaagttctttccacggcaacactgtgtgtctcccaagcgagacctccttcaccgatagcgagcctcccgcaggaaaggatggtcatcctagagactag

SEQ ID NO: 30513 - DNA, 582 bp, Artificial Sequence
  Description of Artificial Sequence: Synthetic coding sequence
atgggcaatgccatagagaagcagaaaccccttaagcgctcccacctgtatccgtggaagcaggactcacagaggtctcacttgtcctcattcaccatgaagctcatggacaagtttcactctcccaagattaagaggacacctagtaagaaagggaagccggctgaagtcagcgtgaagatccccgaaaagccagtaaataaagaggccacggataggttcctgccggagggctatcctctccctctggatctcgagcagcaggctgtggaatttatgagcaccagtgccgtcgccagtagatctcagagacaaaagaatctgagttggctggaggaaaaggagaaagaagtagtctccgcgctacggtactttaagacaattgtggacaaaatggccattgataagaaggtattggagatgctcccaggctccgcaagcaaggtgctggaggcaattctgcccctggtacagaacgatcctcgcattcaacacagtagtgctttgtcctcatgctattctcgcgtctaccagagcctggccaacctaatacgctggagcgaccaagtaatgctggaatag

SEQ ID NO: 30514 - DNA, 3072 bp, Artificial Sequence
  Description of Artificial Sequence: Synthetic coding sequence
tttaaaactatcgtagataaaatggcaatagacaaaaaggtcctggagatgttacctggatccgcatcaaaagttctcgaggcaatactcccactggtgcagaatgacccaaggatacaacacagcagcgcgctctccagttgttatagccgcgtgtatcagtcactggctaacctgatacgctggtctgaccaggtgatgctggaaggcgtaaattcagaagataaagaaatggtgacaactgtaaagggcgtcattaaagctgtacttgacggcgtgaaggagcttgtgcgcttaacaatcgagaaacagggccgaccatctcccaccagcccagtgaagccctccagccccgcaagcaagcctgacggcccagccgagctgccactcaccgaccgtgaggtcgaaattctcaacaaaacaactggaatgtctcagagtaccgaactccttccagacgccaccgatgaggaggtagctcctcctaagcctcccttgccaggaattagagtggtggacaactcacctccccctgctctcccccctaaaaagcgccagtctgcgccatcacctacacgggtggccgttgtggctcctatgagtagagccacatctgggtcctcactgccagttggcattaaccggcaggacttcgatgtggactgctatgcgcagcgtaggttgagcgggggaagccacagttacggcggagagtcccctcgactgagcccatgctcctctataggtaaactcagtaagtcggacgaacagctgtcatccctggacagagattccggccagtgctccagaaacacgtcatgcgagactctcgatcactacgaccccgattatgaatttcttcagcaggacctttccaacgccgaccagatcccccagcagactgcctggaacctgtctccgcttcccgaaagccttggagagtctggtagtccatttctgggacccccatttcagctgccccttgggggacaccctcagccggatggaccactggccccagggcagcagaccgacacgccgccagccttgcccgagaaaaaaaggcggtctgccgcaagccagaccgccgatggtagtggatgtagggttagctatgagcggcatccctcacagtacgacaacatctccggcgaggatctgcagtccaccgctcctatccctagtgtcccatatgcccctttcgcggctatcctaccttttcaacatggcggatccagcgcccctgtcgagttcgtgggcgacttcaccgccccagaaagcactggggaccctgaaaaaccaccaccgctgcccgagaaaaagaacaaacacatgctggcatatatgcagttattagaggattattctgaaccacagcctagcatgttctaccagaccccgcagaacgagcatatttaccagcaaaaaaacaaactcctcatggaggtctatggatttagcgatagctttagcggcgtggactccgtgcaggagctagcaccccctcctgccctgccgcctaaacaacgccagttggcctcctgtgcggctagcagctttagcagtgtgtctcactgcgtccaacagacaaaagttgcctttacaccggaagacggaagtgcggcacaaggcctcagtgtcagcgtgagcaactcctttctgagccggcatgggagcctccccgtgccctccgaacccccagccggaaaagacggccaccctagagatccatctgccgtgagcggcgtacccggtaaagattccagagacgggtcggaacgggcacccaaatctcctgacgcactcgagtcagctcagtcagaagaggaggtggatgagctgagcttaatcgaccacaacgaaattatgtctaggctgacgcttaaacaggagggagacgacggacctgacgtcagagggggttccggggatattctcctggttcacgcgacagaaactgatcgcaaagacttggtgctgtattgcgaggcattcttaactacataccgcacttttataagtccagaggagctgattaagaagttgcagtatagatatgagaaatttagcccgtttgccgatacattcaagaagagggtgtccaaaaatactttcttcgtcctggttcgtgttgttgacgagttgtgtctggtagagctgactgaagaaattttgaagctgctcatggagctcgtgtttaggttagtgtgtaacggggagttgtcgctggcacgcgtcctgaggaagaacatccttgacaaggtggaccagaagaagctgctccgctgcgcgacctcttctcaacccttagccgctcggggtgtagcggctcggccaggcactcttcacgattttcacagccatgaaatcgccgaacagctgactcttctggacgcagagctcttttacaagattgaaatcccagaagttctgctctgggctaaagagcagaacgaggaaaagtctccgaacttgacacagtttacagagcatttcaacaacatgagctattgggtgaggtctatcataatgttgcaggagaaagcccaggatagggaaagactcctgctcaagtttatcaaaattatgaaacacctgcgcaaactcaataatttcaattcctacctcgctatcctgagcgcactggattcggcccctatcaggcgcctggaatggcagaaacaaacctccgaaggactggccgaatactgcactctcattgattccagtagcagcttccgagcctatcgtgcagccctgtccgaagtggagccaccctgcattccctacttgggtctaatattgcaagatctcacctttgtgcacctggggaacccagactacattgacggcaaggtgaactttagtaaaaggtggcagcagtttaacatactggatagcatgcggtgctttcagcaggctcactatgatatgcgaagaaacgacgacattatcaatttcttcaacgactttagcgaccatctggctgaggaggccctctgggagctcagcctgaagatcaaaccacgtaatatcaccaggaggaaaaccgaccgggaagaaaaaacatag

SEQ ID NO: 30515 - DNA, 480 bp, Artificial Sequence
  Description of Artificial Sequence: Synthetic coding sequence
atggaggtctacggcttttccgatagcttctccggcgtagattcagtccaggagctcgctcctcctcccgctctgccacctaagcagaggcaattatacaaaagcgtgttccgtagctatagccaggatttcgttcctcatcaccaggccagcgtgccccctttcctccccccaacttctagttcaagtccacattttccgccagctcatcagagccagagttccgatctggctgtcccaactatggctggcccacctccaagcactgtggacggtcctttgagtgcgtctcaggagagcagctttcatggtaacacagtgtgcctgccctccgagaccagctttaccgactccgaacctccagccggaaaagacggccatcccagagatccgtcagcagtgagcggtgtgcctggaaaagatagccgcgacgggagtgaacgagcacctaagtctcccgacgcgctggaatctgcatag

SEQ ID NO: 30516 - DNA, 696 bp, Artificial Sequence
  Description of Artificial Sequence: Synthetic coding sequence
atggaggtgtacggattctcggacagtttttcaggcgttgatagcgtgcaggagctggcacctccccctgctctccctccaaagcagagacaactgcaggcttcatgcgcagccagcagtttctccagcgtgtcccactgcgttcagcagacaaaggtggccttcactccggaagatggttcagccgcacagggcctcagcgtgtccgtgtccaactcctttttgagccgccacggatccctgcccgtgccctcttacaaatctgttttcagatcctatagtcaggatttcgtaccacatcaccaggcaagcgtgccaccattcttgccaccaacttcttccagtagtcctcacttcccacctgcccaccagagtcaaagttccgatctggctgtgccaactatggcaggcccacccccatcgacggtagacggacctctgagcgccagtcaagagtcatcgtttcacggtaatacagtgtgtttaccctcggagacgagctttacagattccagtgagaacgcctctgaagaggctggtgagggcgagtacgtcaacctttattcatctggccagagctctgaggaactggctccctctagaggcgagccaccggctgggaaagacgggcaccctcgggacccctctgctgtctcaggcgttcccggaaaagattccagagacggcagcgagtag

SEQ ID NO: 30517 - DNA, 477 bp, Artificial Sequence
  Description of Artificial Sequence: Synthetic coding sequence
atgtcagggggactggggctccgacgcagcccggaaatgtctggaaagatagagaaagctgacagccagagatcacatctgagctcctttaccatgaaactgatggataagtttcacagtcccaaaattaagcgcacgcccagcaagaagggaaagcctgcggaagtgtccgtgaagattcccgagaagcctgtgaacaagaacctttcctggctggaagaaaaagagaaggaggtggtgtctgccttacggtacttcaaaaccatcgttgacaaaatggctattgataagaaagtgctcgaaatgttgccaggttccgcgtccaaagtactcgaggcaatcctgcctcttgtccagaacgatccaagaatccagcatagcagcgctctctcttcctgttactcacgtgtatatcagtctcttgctaatctgatacggtggtctgaccaagtcatgcttgaaggggttaattcttag

SEQ ID NO: 30518 - DNA, 261 bp, Artificial Sequence
  Description of Artificial Sequence: Synthetic coding sequence
atggaggtttacgggttttcagactcattttcaggagtcgactcggtgcaagagctggcccctccgcctgctcttccccctaaacagcgccaattggaaccacctgcaggcaaagatgggcacccacgcgatccaagcgccgttagcggagttccaggcaaggactctcgagacgggtccgagagtggaatcacatcagtctatcgctggaatatccagcggcagcagcggctttcctacgggcacacggctagccagtag

SEQ ID NO: 30519 - DNA, 7419 bp, Artificial Sequence
  Description of Artificial Sequence: Synthetic coding sequence
atgactgctcggggacagtctcccctggctcccttgcttgaaacactggaagatccttctgcttctcacggaggtcaaacggatgcctatctgaccttgacctcccggatgacaggtgaggagggcaaggaagtgattacggaaattgagaagaagctccccaggctctacaaggtcctgaagacccacattagtagccagaactcagagctgtcatctgccgcattacaggccctcgggttctgcttatataatcctaaaatcaccagcgagctgagcgaggccaatgctctggaactcctgtcaaaactgaatgacaccattaaaaacagtgacaaaaacgtgagaacgagagcattatgggttatatccaaacagacttttcccagcgaagtggtgggaaaaatggtaagtagcattatcgactccctcgaaatcctgttcaacaaaggagagacacacagcgccgtggtggactttgaggccctgaacgtcatcgtacgcctgattgaacaagctccgattcagatgggggaagaggctgtacgctgggccaagttagtcatacctctagtagtccacagcgcacaaaaagtccacctcaggggcgcaacggccttggaaatgggcatgcctctgctcctccagaagcagcaggaaattgccagcattaccgaacaacttatgactactaagttaataagtgaactgcagaagctttttatgagcaagaacgagacctacgtgctcaagctgtggcccttgtttgtcaagctactgggtcggacactccaccggagtggttccttcatcaactctctgctgcagctcgaagagctggggttcaggtctggagcgcctatgatcaagaaaattgcctttatcgcatggaagagtcttattgacaacttcgccctgaatcctgacatcttgtgtagtgctaagcggctcaaacttttgatgcagcctctgagtagtatccatgttcgcaccgaaacacttgcgttgaccaaacttgaggtgtggtggtatctgctcatgagactcggtccccacttaccagctaattttgagcaagtgtgcgtaccactcattcagagtacaatcagtatcgacagcaacgccagtccacaagggaactcatgccacgtggccactagccccggactcaatcctatgactccggtccataaaggagcatcctcaccctacggagcaccaggcaccccccgaatgaacctgtcaagcaatcttgggggaatggccacgattcccagcatacagctgttgggtctggagatgctgcttcactttctgctcggcccagaggccctgagcttcgccaagcaaaacaaactggtgctgtcattagaacccttggagcatcctctgatctcgtccccctccttcttcagtaaacatgctaatactctgatcacagctgtccacgattcctttgtcgctgtagggaaggatgcacccgatgtggtagtaagcgcgatttggaaagagcttatctcactcgtcaaatctgtgaccgaaagtgggaacaagaaggagaaaccagggagcgaggtccttacacttttgctcaaatcacttgagtctattgtgaagtctgaagtgttccccgtcagtaagacactggtgctcatggagattacaatcaagggcttgccacaaaaagtacttgggtcgcctgcctatcaggtagcaaatatggatattctcaacggaactccagctctgtttcttattcagctcatcttcaacaactttctcgagtgcggcgtctccgatgagcggttttttctcagcctggagagtctggtgggctgtgtgctcagtgggcctaccagtccgctggccttctcggatagcgtgttgaatgtgataaatcagaatgcaaaacagcttgagaacaaggagcacctgtggaagatgtggtcagtgatcgtgacccctctgactgaactgataaaccaaaccaatgaagtgaatcagggtgatgctctcgaacacaacttttccgccatatatggagcccttactctccccgttaaccatatcttctcagagcagagattcccggtcgcaactatgaaaaccttattgagaacttggagcgaactttatcgagccttcgcacgctgcgctgcccttgtggctaccgccgaggagaacttgtgttgcgaagaactctcaagtaaaatcatgtcctccctggaggatgaaggattcagcaatctgctgtttgttgacagaattatatatatcatcacggtcatggtggactgtattgacttttcaccgtacaatatcaaatatcaacccaaggtcaagtcacctcagcggcctagcgactggtctaagaagaagaatgagcctctgggcaagctcaccagtttgtttaagttgatcgttaaggtgatttactctttccatacgttgtcttttaaagaggcccactctgacactctgtttacaataggtaacagcattaccggaattatttcatctgtcctgggccatatttcccttccttctatgattagaaaaatcttcgccacattaaccaggccactcgccttattttatgagaattcaaagctggacgaggtccccaaggtttatagctgccttaataataaactagagaaactgctgggtgaaattatagcgtgcctccagttctcatacacaggcacgtacgattctgaactgcttgaacagctttcgccactgttgtgcattatctttctccacaaaaataagcagattcgcaagcagagcgcccagttctggaacgcaacttttgccaaagtcatgatgcttgtgtacccagaggagctcaagcccgtcctgacacaggctaagcagaaattccttctcttgcttcctggcctggagacagttgagatgatggaggaaagcagcgggccttattccgatggtacagaaaatagtcagcttaatgtgaaaatctcaggtatggagaggaaatccaacggaaagcgcgacagttttcttgctcagactaaaaacaagaaggaaaacatgaagcccgcagcaaagctgaaattagagagctcaagcctgaaagttaagggcgagatccttctggaggaagaaaagagcaccgattttgtcttcatcccaccagagggcaaagacgctaaggaaagaattctcactgaccatcagaaggaagtgctgaagactaagaggtgcgacattcccgctatgtacaacaacctggacgtatctcaggatacactgtttacacagtattctcaggaggagcctatggagattccgaccttaaccagaaaacccaaagaggacagcaagatgatgatcactgaagaacagatggacagtgatatcgtgatacctcaggacgttaccgaggattgtggaatggcagagcacctggagaagtctagtctgtcaaacaatgaatgcggttctttggataaaacctctcccgagatgtccaattctaacaacgacgagcggaagaaggctctaatcagcagtcgcaagaccagcacagagtgcgccagctctactgaaaactctttcgtggtgtctagctcttccgtgtccaatactacagtggccggaacccctccatatcctacctcgcgcagacagacatttatcacactcgagaagttcgatggaagcgagaacaggcctttcagcccgtcccccctgaataacatctcaagtactgtgacagtcaagaacaatcaggaaaccatgatcaagaccgatttcctgccaaaagcaaagcagcgcgaaggaacattctccaagagcgatagcgaaaagattgtgaacggtactaagcgttcatcccgacgggcaggaaaagctgagcagactggcaacaaacgctctaagccactgatgagatcagagcccgaaaaaaataccgaagaatcggtggaaggtatcgtggtgctggaaaacaaccctcccggattgctaaatcagaccgaatgtgtctctgataaccaagtgcacctgtccgaatccactatggagcacgataacacgaaactaaaggctgccaccgtcgagaatgccgtcttactggagactaacaccgtggaggaaaagaatgtagagatcaacctggagtccaaggaaaatacaccacctgtggtcatctctgcggaccaaatggtgaacgaggatagccaggtccagatcacacctaaccagaagacacttcgcaggtcttcacggaggcgcagcgaggtcgtagagtctaccactgagagtcaggataaagagaactcccaccagaagaaagaacgccgaaaagaggaggagaagccattacagaagagccctctgcatattaaagacgatgtcctgcccaagcagaagctgatagcggagcaaacgcttcaagaaaatctcatcgaaaagggatccaatttacacgagaaaacactcggtgagacatcggccaatgcggagactgaacaaaacaaaaagaaagccgatcccgagaacataaagtcagaaggagatggcacccaggatatagtggacaaatccagtgagaagctggtccgtggacgcacaaggtaccagacccgcagggcctctcaaggccttctctcttccatcgaaaatagcgagtctgatagctccgaagccaaggaggagggcagtagaaaaaaacggtctggcaagtggaaaaacaaatcaaatgagagcgtcgacatccaggatcaggaggaaaaggtcgtcaagcaggagtgcattaaggccgagaatcaatcccatgactataaggctacatcggaggaggacgtatcgataaaatcgccgatctgcgagaaacaggatgaatcaaacacagtgatctgtcaagacagcaccgtgacatcagacctcctacaggtgcccgacgacctccctaatgtttgcgaggagaaaaacgagacgtccaaatatgccgaatattctttcacttccttgccggttcccgaatctaatctgcgcacgcggaatgccattaaacgactccacaagagagattctttcgataactgtagcctgggcgagtcctccaagataggcatttcagatatctccagcctgtcagaaaaaacattccaaacgctcgagtgtcagcacaaacgctcccgccgagtccgccgaagcaaagggtgtgattgttgcggcgagaagagtcagccacaggagaaatctctgattgggttaaaaaatacggagaataatgacgttgaaattagcgagactaaaaaagcagatgtgcaagctccggtgagtccttcagagaccagccaggcaaatccgtattcagaaggccaatttttggacgaacatcattctgtgaacttccacctcggacttaaggaagataacgataccattaacgacagcctaattgtgagcgagaccaagagcaaagagaatacaatgcaggagtcattacccagcggtatcgtcaacttccgcgaggaaatttgcgatatggatagcagtgaagcaatgtcgttggaatctcaggagtctcccaatgaaaattttaagacagttggcccttgcctcggagactctaaaaacgttagccaggagtccctggagaccaaagaagaaaagcctgaggagacaccgaaaatggaactcagcttggaaaatgtgaccgtagaaggcaacgcgtgtaaagtgacagagtctaatctggagaaggctaaaaccatggagctgaatgttggtaatgaggcttcatttcacgggcaagagagaactaaaactgggatatctgaggaagccgctatcgaagagaacaaacgcaatgacgattccgaagccgataccgcaaaactcaatgcaaaagaggtcgcaaccgaggagttcaacagcgatataagcctatcagataacacaaccccagtcaagctgaacgctcagacagaaatctctgaacaaactgcagcaggtgaactcgacggcggaaacgacgtgagtgacctccactcctctgaggagaccaacaccaagatgaaaaacaatgaggagatgatgattggagaggccatggctgagaccgggcatgacggagaaactgaaaacgagggcataacaaccaaaacctctaagcccgacgaggccgaaaccaacatgctcacggccgaaatggacaatttcgtgtgcgacaccgtagagatgtcaacagaagaggggattatcgacgccaacaaaactgagactaataccgagtactcgaagagcgaagaaaaactcgacaacaaccaaatggtcatggaaagtgacatactgcaggaagaccatcatacctcacagaaggttgaggagccttcccagtgccttgccagtggcacggccatatcagagctgattatcgaggataacaatgcaagccctcaaaagttgagggagctagatcccagcttggttagcgcaaacgattcgccctccgggatgcagacaaggtgcgtgtggtcaccgctggcttctccatctacctctatcctaaagcgcggactcaagaggtctcaagaggacgagatctctagccccgtcaataaagtgaggagagtgtcttttgcagaccccatttaccaagccggactagcggacgacatagatcgcagatgttccatcgtgcggtcccacagctctaacagcagccccatagggaagtccgttaaaacatcccccaccactcagtccaaacacaatactactagtgcaaagggattcctttccccaggtagcagatctccaaagtttaagtcttcaaaaaagtgcctgattagcgagatggcaaaggaatctattccttgtcccaccgagtcggtttacccccctctggtgaattgcgtggctcccgttgatataatccttcctcagatcacctctaacatgtgggcgagagggctgggtcaactcatcagggctaagaacatcaagacaattggtgacctcagcactctaactgcctctgagatcaaaacgctccctattcgctctcccaaggtgtccaacgtgaaaaaggcacttagaatctaccacgagcaacaggtgaaaacaaggggcctcgaagaaatccctgtatttgacataagcgaaaagaccgtgaatggaatcgaaaacaagagcttgagccctgatgaagagcgcctggtgagcgacatcattgaccctgtggcgctcgaaattcccctttctaaaaatctgctggctcaaataagcgcactggccttgcaactcgacagcgaagacctgcacaattattctggctcgcagctgttcgagatgcacgagaagttgagctgtatggcaaattctgtgatcaaaaacctccagagtaggtggagatccccctcgcatgagaactcaatctat

SEQ ID NO: 30520 - DNA, 264 bp, Artificial Sequence
  Description of Artificial Sequence: Synthetic coding sequence
atgaccgccagagggcagtcacctctggcccctctgctcgaaacactggaggatccttcggcatctcacggtggccagacggatgcttatctgactctgacctcacgtatgaccggggaagaaggcaaggaggtcatcactgaaatagaaaaaaaactgcccagattatacaaggtgctcaagacccatattagttcccaaaacagcgaactcagctccgccgcattgcaggctctggggttttgcctgtacaacccaaagtag

SEQ ID NO: 30521 - DNA, 7340 bp, Artificial Sequence
  Description of Artificial Sequence: Synthetic coding sequence
atgaccgctaggggacagtccccgctcgcacctctgttggaaactttggaggatccttcagcgagccatggaggacagaccgatgcatacctgacattgacatcgcgcatgacgggagaggaaggtaaggaggtcatcactgagattgagaaaaagctgcctagactttacaaggtattgaaaacccacatctcttcccaaaattcagagctgagtagtgccgctctgcaggcattgggattttgtctgtataacccaaagatcaccagcgagctcagcgaggcaaacgcattagaactgcttagtaagcttaacgacactattaagaatagcgataagaacgtaaggacacgcgctctctgggtgatctcaaaacagacgttccctagcgaagtcgtaggtaaaatggtgtcctcgatcatcgatagcttagaaattctctttaacaagggagaaacacattccgcggttgtagatttcgaagccttgaacgttatcgtcaggctgattgagcaggcaccaatacagatgggggaggaggctgtaagatgggccaaactagtgattccactggtggtccactcagcccagaaggtgcacttacggggtgctactgctctcgagatgggcatgccgctgctgctgcagaaacagcaggagatcgcctctattacagagcagctaatgacaacaaaactcatctctgagttacaaaagttgttcatgtccaaaaacgaaacctatgtgctgaagctttggcctttattcgtcaagcttctcggtaggaccttgcatcgatcaggttcatttataaacagcctgctgcagctggaggaattggggttcaggtccggcgctcctatgatcaagaagattgcttttattgcgtggaagtccttgatagacaacttcgcattgaaccctgatatcttatgctcggccaagcggttgaagctcttgatgcaaccactgtcctctattcacgtaagaactgaaacactggccttaaccaagttagaagtctggtggtaccttctgatgcgcctcggccctcacctgccagccaacttcgagcaggtgtgcgtacccctgatccagtcaacaatttctattgactctaacgccagtccccaaggaaatagttgccacgtagcaacctctcctggtctcaaccctatgactcccgtccataaaggcgcttcatcaccttatggtgccccagggacaccgaggatgaatttatcatcgaaccttggcggtatggcaactattccttctatccagcttcttgggctggagatgttgcttcattttttattaggacctgaagcactgtcgtttgccaaacagaataaactggttctcagtctcgagccactggaacacccactgatctcatccccatcctttttcagtaagcatgccaatacacttattaccgcagttcacgatagttttgtggcagttgggaaggatgcccctgacgtcgtggttagcgccatctggaaagaattgatttctctcgtgaaaagcgttactgagtccggtaataagaaggaaaagcccggtagtgaggtattgactctgctgcttaagtctcttgaaagtatcgtcaagtcagaggtattcccggttagtaagacattggttttaatggagataaccattaaaggcctaccgcaaaaggttcttggttcacccgcttaccaggtggctaatatggatattctcaatgggacacctgccctgttcctgatccagctgatattcaacaacttcctggagtgtggtgtgtccgatgaaaggtttttcctatccctggagtcactggttgggtgcgtgctgtccggcccaacgtcacccttagcattctctgactccgtcctgaacgtgatcaatcagaatgcaaagcagctggagaataaagaacacctgtggaaaatgtggagtgtgatagttacgccattgacagagctcataaaccagaccaacgaggtgaatcaaggcgacgctctcgagcataacttctcggccatatacggggcattaacgctgcctgtgaaccacatattttctgaacagcggtttcctgtggccactatgaaaacattgctccgcacatggtcagaactgtaccgcgcatttgctcggtgcgcggcactggttgccaccgcggaagaaaatctatgctgtgaagaattgtcttctaagataatgtcctccctggaggatgaaggcttcagtaacctcctgttcgtagaccggattatttacatcattaccgtgatggtggactgtatcgacttctcgccatataatattaaatatcagccaaaggtgaagtccccccagcgtccgagtgactggagcaagaagaaaaacgaacctctgggaaagctgacctctctgttcaaacttatcgtgaaggtgatctactcgtttcatactctgtccttcaaggaggctcacagtgataccctgttcacaattggcaactccattaccggcataatttcctctgtgctggggcatatctcccttccgagcatgattcgcaaaatatttgcgaccttaactcggccactggccttattttacgagaactccaagttggacgaggtgccaaaagtttattcctgtctaaataataaattggagaagttgcttggtgagatcatcgcatgcctccagttttcttacacaggcacttatgattccgagctcctcgaacagttgagtcctcttttgtgcattattttcctgcacaaaaataagcagatccgtaaacaatccgcgcagttttggaacgccacattcgccaaagtgatgatgctagtgtatccagaagagctgaagcccgtgctgacacaagccaagcagaagttcttactcctgctgccagggcttgagaccgttgagatgatggaagagtcctcaggaccatactccgacggcacagaaaacagtcagctgaatgtgaagataagtggaatggagcggaaatccaacggtaaacgcgattccttcctggcccagaccaagaacaaaaaggagaacatgaagcccgctgccaaactgaagctcgagtcttcttccctgaaggtgaagggcgaaatactgctggaagaggagaaatccaccgattttgtgtttatacctccggagggcaaggatgctaaggagaggatcttaaccgatcatcagaaggaagtgctcaagactaagcggtgtgatattcccgctatgtacaataatcttgacgtatctcaagacacgcttttcacacagtactcccaggaggaaccaatggaaataccaaccctaaccagaaagcccaaagaggactcaaaaatgatgataacagaggagcaaatggattccgatatcgtgatccctcaggatgtgactgaagactgtggcatggctgagcatctcgagaagtcaagtttgagcaataacgaatgcggaagtctggataagacatcccccgagatgagcaatagtaataacgacgaacgtaaaaaagcacttatctcgtctagaaaaacaagcaccgagtgtgcaagcagcaccgagaatagttttgttgtaagctcctcaagtgtgtcaaataccactgtcgccggtacccctccatacccgacctcacgtcgtcagacctttatcacgcttgaaaagtttgatgggagcgagaacaggcccttttccccaagtccactcaataacatatcctccacagtgactgtaaaaaataaccaggagactatgattaaaactgatttcctgccaaaagcaaagcagagagaggggactttctccaaatccgactctgagaaaatcgtcaacgggaccaagagaagttccagacgcgcaggcaaggccgaacagaccggaaacaaacgttcaaagcctctgatgcgctcagagcctgagaagaatactgaggaatcagtggaggggattgtagttcttgagaacaatcctccaggcctcctgaatcaaacagagtgcgtgtcagacaaccaagtccacctatctgaatcgaccatggaacatgacaatactaagttgaaagcagctaccgtcgagaacgctgtgctcttggaaactaacactgtcgaggagaagaatgttgagatcaaccttgagtcgaaagagaacacaccacccgttgtgatctccgccgatcagatggttaatgaagattcacaggtacagatcacgcccaaccagaaaacgctgcggcgaagctcacgtagaaggtctgaagttgtggagagtactaccgaaagccaggataaagagaactcgcaccagaaaaaggagagacggaaggaggaagagaagcctctgcagaaaagtccactgcacataaaagacgacgtgctgcctaagcaaaagctaatcgcagaacagacccttcaagaaaacctgatcgagaagggaagcaatcttcatgagaagacgctgggagaaacttcggccaatgccgagacagaacaaaacaagaaaaaagccgatcccgaaaatattaagagcgagggtgatggaactcaggacatcgtcgataagtcctctgaaaagctcgtaagagggaggaccagataccagactcgcagagcctcccagggattactttcctccatagagaactccgaaagcgactcaagcgaagccaaggaagaggggtcaaggaaaaaacgatcaggcaagtggaaaaacaagtccaatgaaagtgtcgatattcaagatcaggaagagaaggtggtgaaacaggagtgcatcaaggcagagaaccagtcgcacgactataaggcaacctcggaggaagacgtgagcataaagagcccgatttgcgagaagcaagatgaatctaacactgtgatttgtcaagacagcaccgtgacaagtgatttgctacaggtgccagacgaccttcctaacgtgtgcgaggaaaagaatgagacttcgaaatacgccgaatactcttttacttcattaccggttcctgagtccaacctcaggacccgcaatgcaatcaaacgtctgcacaagagggactctttcgataattgcagcctcggtgagtcgtcaaaaatagggatatctgatataagttcgctgtccgaaaaaacctttcaaactttggagtgccagcacaaaagaagtcgaagagtgagaagatccaaaggctgcgattgttgtggggagaaatcacaaccacaggagaagagcctcattggccttaaaaatacagagaataacgatgtggagatttcggagaccaagaaagctgacgtacaggcgcctgttagcccaagtgagacctcgcaggctaatccatactcagagggtcagttcctggatgaacatcattcggttaattttcatctcggacttaaggaggataacgacaccatcaatgattccttgatcgtgtcggagactaaaagcaaggaaaacaccatgcaggagagtctccctagcgggattgttaatttcagagaagaaatttgcgacatggacagttcagaggcaatgtcattggaaagtcaggagagcccgaatgagaactttaagacggttggaccttgtctgggtgattctaaaaatgtctcgcaggaaagcctggaaaccaaagaggaaaaacctgaggaaactcctaaaatggaactatctctcgaaaatgtcactgtggagggcaatgcctgcaaagtaactgaaagtaatctagagaaggcaaagaccatggagctgaatgttggcaatgaggctagtttccacggacaagagcgaaccaagacaggcatctcagaggaagctgccatcgaggagaataagaggaacgacgacagcgaggccgataccgccaaactaaacgcaaaagaggtggccactgaagagttcaatagcgacatttcgttgtcggataatactactcctgtgaaactgaacgcgcagaccgaaataagcgagcagaccgccgcaggagagcttgatgggggaaacgatgtatctgacctccactcaagcgaggaaaccaacactaaaatgaaaaataacgaagagatgatgattggtgaggccatggccgagaccgggcatgatggagaaacagaaaacgaaggcattacgaccaaaacaagcaaacccgacgaggctgagacaaatatgcttactgctgaaatggataacttcgtgtgtgatacggtggagatgagcactgaggaggggattattgacgctaataagactgagaccaacacagaatatagcaagagtgaagagaagctggacaacaaccagatggtgatggagtcagatatccttcaggaggatcaccacaccagtcagaaagtggaggaacccagccagtgcttagctagcggtacagctatttcagagctgataatagaggataacaatgccagcccgcagaaactgcgtgaactggacccaagcctcgtctctgccaatgacagtccctccggcatgcagacccgctgtgtgtggtcccctctagctagtccttcaactagcattctgaaacggggactgaagcgttcccaggaggacgagataagttctccagtgaacaaagtccgcagagtctcctttgccgacccaatatatcaggccggactggccgatgatatagaccggcgttgtagcattgtgcgctcccattcatccaattctagcccaatcggtaaatctgtgaagacctctccgacaacacagtctaaaatatccgagatggcaaaagaatctattccgtgccccactgagtcagtgtaccccccattagtgaactgtgtggcccctgtggatattattctgccacaaatcacttcaaatatgtgggctcggggactgggccagctgattcgggctaagaacatcaaaactattggggatcttagcactctgaccgctagtgagatcaagacattaccaatccggtcccccaaggtatctaacgtcaaaaaggctctgcggatataccacgaacagcaggtgaagacgaggggattggaagagattccggtgttcgatattagcgaaaaaaccgttaatggaatagagaataaaagtctaagtcccgacgaagaaaggctggtgtcagatattatcgaccccgttgccctggaaatcccattgagtaagaacctgcttgcgcagatttctgcccttgctctgcagctcgattcagaggacctccacaattactccggatctcaactcttcgaaatgcacgaaaagttatcatgtatggctaattctgtgattaagaacctgcagagcagatggagaagcccttcacacgagaacagcatcta

SEQ ID NO: 30522 - DNA, 7340 bp, Artificial Sequence
  Description of Artificial Sequence: Synthetic coding sequence
atgaccgctagggggcagagtcctcttgccccacttttggagactttagaagatccatcagctagccacggtgggcagacagatgcatatctgactctgacatccaggatgacaggcgaggagggtaaagaagtgataaccgaaatcgagaagaagctgcccaggctatataaggtgttgaaaactcacattagtagccagaacagcgagctgagttccgctgccttacaggcgctggggttctgcttgtataaccctaagatcacttccgaactgtcagaggctaacgcactcgagttgttgtctaaactaaacgatactatcaaaaattcagacaagaatgtgaggactagggccctatgggttatttcaaagcaaacattccctagcgaagtggtgggaaagatggtgtcctccattatcgactctctcgagatactgtttaacaagggggaaactcacagtgcggtcgttgactttgaggctttaaacgtgattgtgcggttaattgagcaggcaccgatccagatgggggaggaggcagtgcggtgggccaagctcgttattccgctggtagttcacagcgctcagaaggtccatctgagaggagcaactgccttggagatgggcatgcctctgctcctgcagaagcagcaagagatcgcatccattacagaacagctgatgaccacgaagttaatcagcgagttgcagaagttgttcatgtctaaaaacgagacttatgtactgaagctgtggcccctattcgtcaagttgttaggcaggactctccatagatcaggaagtttcatcaacagtttgcttcagttagaggagctgggcttcagaagcggcgcaccaatgatcaaaaagatcgcatttatagcttggaaaagtctgatcgataacttcgccctaaacccggacatcctttgtagtgcaaaaaggctgaaactgcttatgcagcctttaagtagcatccacgtacgcactgagactctggcactgaccaagctggaagtgtggtggtatctgttgatgaggctcgggcctcatctgcctgcgaactttgagcaggtctgtgtacccctgatacaaagcacaatctctattgactcgaatgccagcccacagggcaactcatgccatgtcgctacatctccgggtcttaatccgatgacgccagtacataaaggcgctagtagcccctatggggcacccggaacaccccgtatgaatctgtcatctaatctggggggtatggcaaccatcccgtctatccagctcttgggactggaaatgcttttgcacttcctgctgggaccagaggcgctctcattcgcaaagcagaacaaactggtgctctcactggagcctcttgagcatcccctgatctcttccccaagcttcttttctaagcacgccaatactctgatcactgccgttcatgatagttttgtagccgtggggaaggacgctcccgacgtcgttgtatcagctatttggaaagagctcatctctctggttaagtccgttacagagtccggcaacaaaaaggaaaagccaggatccgaggtgctgactctactgctgaagtctctcgagagtatcgtgaaatcggaagtgttccccgttagtaaaactcttgtcctcatggagatcaccattaaggggttgccccagaaagtgctgggctcgcctgcataccaagtggcgaatatggacattctcaatggtacccctgctctgtttcttattcagctgattttcaacaatttcctcgagtgtggtgtgagcgatgaacgattttttctgtctctggagtctctcgtcggctgcgtcctgagcggacccacatcgccgctcgcctttagcgactccgttctcaatgtgataaaccaaaatgctaagcagttggagaacaaggagcacctgtggaagatgtggagtgttatagttacacccctcaccgagctcataaaccagactaatgaggtgaatcagggagatgcactggaacacaattttagtgcaatttacggggctttgacgctcccagtcaaccacattttctcagagcagcgctttcccgtggctacaatgaagacattgctgcggacgtggagcgagctgtaccgggcttttgcacggtgtgccgcactcgtggctaccgccgaagagaatctctgctgcgaggagctcagcagtaaaattatgtccagcctggaagacgagggcttttccaatctgctgttcgtggaccgcataatctacataatcacggtcatggttgattgtatcgacttttccccctataacatcaagtaccaacccaaagtgaagtccccccagcggccttccgactggtccaaaaagaagaatgagccgctgggaaaattgacttccctttttaaactgatcgtgaaagttatttatagctttcacacattaagctttaaggaggcacactctgatacactgtttacaatcggcaatagtattacagggattatatcatccgtgctaggacatatcagcctgccatcgatgatccgaaaaattttcgctactctgacaagacctcttgccctattttacgaaaacagtaagcttgatgaggtcccgaaggtctacagctgccttaataacaagctggagaagctgctgggggaaattatcgcctgtctgcaattttcctacactggaacatacgattcagaactacttgagcagctcagccctcttctttgcattatcttccttcataagaacaagcagatcagaaagcaaagcgcccagttctggaacgcaactttcgctaaagtgatgatgttggtctacccggaagaattaaaacctgttttaacacaggccaaacagaaattcttgctcctcctgcccggactggaaaccgtggagatgatggaagaatcgtcggggccttattcagacggcacggaaaattcccagctgaatgttaaaatatccgggatggagaggaaatcaaatggcaagagagactcatttctggctcagaccaagaacaaaaaggaaaacatgaaaccagcagcgaagttaaagctggagtcaagcagcctgaaggtgaaaggcgagatcctgctggaggaggagaagtctactgacttcgtgtttattcctccggaaggaaaagatgcaaaggagcggatcctaactgaccaccagaaggaggtgctcaagaccaaacgatgtgacattcctgcgatgtataacaacctcgacgtgagccaagacactctgttcacccaatactcgcaggaggagcccatggaaatccccactctaacacgaaagcccaaagaggactctaagatgatgataaccgaagagcagatggattccgatattgtgatacctcaggatgtgaccgaggattgcggaatggctgaacatctcgagaaatcctcgctcagtaataacgaatgtggatcactggataaaacatctccagaaatgagcaacagtaacaatgacgagcgaaaaaaagctctgatcagtagtcgtaaaaccagcaccgagtgtgcgagcagtaccgagaactcctttgtggtgtcctccagtagcgtcagtaacactacagtggctggcaccccgccatatccaacaagccgtaggcagacgtttatcacactggagaagttcgatggtagtgagaaccggccattcagcccttctcccctcaataacatctcctctacggtgaccgtcaaaaacaaccaggagacaatgatcaaaaccgattttctccctaaagcaaagcaacgggagggcacctttagcaaaagcgatagtgagaaaatcgtgaacggcacaaagcggtccagccgtcgagctggcaaggcggaacagacgggcaacaagagatcgaagccactaatgcggtccgagcctgagaagaatactgaagagagtgtcgaggggatcgtcgtgttggagaataatcctcctggcctgctgaaccagactgaatgcgtgagcgacaatcaggtacaccttagtgaatctaccatggaacacgataatacgaaattaaaggccgcaacagtagagaatgctgtgctcctggagaccaatactgttgaagagaaaaacgtggagatcaatcttgaatctaaagaaaatacaccaccagtcgtcatctccgcagaccagatggtaaacgaggattctcaggttcagattactccaaaccaaaaaaccctcagaaggtcttcccggaggcgttccgaggtagtggagagcactaccgagtcacaggataaagagaattcacatcagaagaaggaacggagaaaggaggaggagaagccactgcagaagagtccgctgcacataaaagatgacgttctgcctaaacagaaactcattgctgagcaaactctgcaggaaaacctcattgagaaaggaagcaatttgcacgagaagaccttaggcgaaacctccgccaatgccgagaccgaacagaataaaaaaaaggcggaccccgaaaacattaaaagtgagggcgacgggactcaggacattgtggacaaatcttccgaaaagttggttagggggaggacaagataccagacaaggcgcgcttcccagggactcttaagttcaatagaaaattcggagagtgattcatccgaggctaaagaagaggggtctaggaaaaagcgttccggcaagtggaaaaataaatctaacgagtcggtggacattcaggaccaagaggaaaaggttgtcaagcaggaatgcatcaaagccgaaaaccagagccacgattataaagcaacaagcgaggaagatgtgtccatcaagtccccaatatgcgagaaacaggacgagagcaacactgtcatctgtcaggattctactgtgaccagcgatttgcttcaggtccctgatgatttacccaacgtctgcgaggaaaagaatgagacctctaaatatgccgaatatagctttacatctcttcctgtgcccgagtcaaacttgcgcacccggaacgccatcaagaggcttcacaagcgggatagctttgacaactgtagcttaggcgaatcgtctaaaatcggaatttcggacattagcagcctgtctgaaaagaccttccaaactcttgagtgtcagcataagagatcacgaagagtccgaaggtccaaggggtgtgattgttgcggcgagaaatctcagcctcaggaaaagtccctgattggcttaaaaaacaccgaaaacaacgacgtggagatttccgagaccaaaaaggccgacgtccaggccccagtgtctcctagcgagacaagtcaggctaatccttattccgagggtcagtttctggacgagcaccacagcgtcaacttccatctgggcctgaaagaagacaacgatactatcaatgattctctgatcgtcagcgaaacaaaaagcaaggaaaacaccatgcaggagagcctgccctccgggatcgtgaatttcagagaggagatatgcgacatggactctagtgaagccatgagtctagagtcacaggagtccccaaacgagaacttcaaaaccgtgggaccgtgtctgggagacagcaagaacgtttctcaggaatccttggagaccaaagaagagaagccagaggagacaccaaagatggagctgtctcttgaaaatgtaaccgttgagggcaatgcctgtaaagtaactgaaagcaatctcgagaaagctaaaactatggagctgaacgttggcaacgaggccagcttccacggccaggagcgtaccaaaactggcatttctgaagaagccgctattgaggagaataagcgaaacgacgactcagaagccgataccgccaaactcaacgccaaggaagtggctacagaagaatttaattcagacatctccctatctgacaatacaacccccgtaaagctgaacgctcagaccgagatctccgagcaaacagcagccggagagctggatggaggcaacgatgttagtgacctgcacagctccgaggaaacaaacaccaaaatgaagaataacgaagagatgatgattggcgaagcgatggccgagaccggccatgacggggagacggaaaatgagggcatcactaccaagacctcaaagcccgacgaagctgaaacgaacatgctaacagctgaaatggataacttcgtctgcgatactgtcgagatgagcaccgaagagggcatcatcgacgccaacaaaaccgagaccaacaccgagtactctaaaagcgaggaaaaacttgacaataaccaaatggtcatggaatccgacatcctgcaggaggaccaccacacatcacaaaaggtggaggaaccaagccagtgtctagccagtggcaccgctatttcagagctgattattgaagacaacaacgcgagccctcagaagctgcgagagctcgacccttctctggtgtctgccaatgactcgccaagcggtatgcagacacggtgtgtgtggagccccctggcaagtccatctacttcaatcctcaagcgaggactgaaaaggagccaagaggacgaaattagctctccagtgaataaggtgcggcgtgtgtcctttgcggacccgatctaccaggctgggctggccgacgacattgacagacggtgttctattgtgagatctcacagttccaactcatcacctataggcaaaagcgtcaaaacgagccctacgacccagtctaaaatttctgagatggctaaagaaagtatcccgtgccccacagaaagcgtttaccctcctttggttaattgtgttgcgccagtcgacatcattctccctcaaattacatccaacatgtgggccagaggcctaggacagttgattagagctaaaaatatcaagacaatcggcgacctgtccacattgacagcatcagagatcaagaccctcccgatccgctcaccaaaagtatcaaatgtgaaaaaagccttacgaatatatcacgagcaacaggtaaaaacacgtggactcgaggagatacctgtgttcgacattagcgagaagacggtcaacgggatagagaacaagtcactgtcccctgacgaggaacggctggtaagcgacatcattgaccccgtcgcccttgagataccactctcaaagaatcttctcgcccaaatatctgctcttgccctgcagttagatagtgaggatcttcataactatagcgggtctcagctctttgaaatgcacgaaaaattgtcttgcatggccaactctgtcatcaagaacctccaatccagatggcgttcaccttcccacgagaactccattta

SEQ ID NO: 30523 - DNA, 1026 bp, Artificial Sequence
  Description of Artificial Sequence: Synthetic coding sequence
atgacggctcggggtcagtcccccctagcccctctgctggaaacactggaggacccatccgcctctcacggcggacagacagacgcttacctgaccctgacatcccgcatgaccggggaagaaggtaaagaagtgatcacagagatcgaaaagaaattacccagactgtacaaggtgcttaaaactcacatcagctcccaaaattctgagctgtcctcggcggctctgcaggcgctcggtttttgcctttacaatcccaaaattacgtcagaactgtctgaggccaacgccctcgaattactgtcaaagcttaatgatactatcaaaaattcagacaaaaacgtgcgcactagagccctctgggttattagcaaacaaacatttcctagcgaggtagtgggaaaaatggtgagtagcataattgattcattagaaattctgttcaataagggggagacgcattcagcagttgttgactttgaagctctcaatgtgattgtgagactcatcgaacaggcgccaatacaaatgggtgaggaggccgtgagatgggccaagctggtgataccactggtggtccattcagcacagaaagtccatctgcgcggtgcaacagccctggaaatgggcatgccattactgttacaaaagcagcaggagatcgcctccattaccgagcaattaatgacaacaacactccaccgaagcggttctttcattaacagcctactgcaactagaagagcttgggttcaggtccggagccccaatgatcaagaaaatcgcctttatcgcctggaagtctctcatcgataatttcgcactgaatccggacattctgtgtagtgctaaaagactgaagcttcttatgcaacccttgagttctattcacgtgcgtactgaaaccctggccctcactaagcttgaggtttggtggtacctcctgatgagactaggcccacacctccccgctaactttgaacaggttctgcctcctagaacggagcctagggaactccctgagtag

SEQ ID NO: 30524 - DNA, 7418 bp, Artificial Sequence
  Description of Artificial Sequence: Synthetic coding sequence
atgacagcaagaggtcagtccccgctggcccctctgctcgagaccctcgaagacccatcagcatcacacggcggacagacggacgcatatctcacactcaccagccgcatgacaggcgaggagggtaaggaagtgataaccgagatcgaaaaaaaactccctagattgtacaaggtgttaaaaactcacatttcatcccagaactctgagctctcctccgccgcactgcaggccctgggattttgtctgtataacccaaagatcacctcggaattaagtgaagctaacgccctggaattactgtccaagctcaacgataccataaagaattcggacaagaacgttcgaacgcgggctctgtgggttatctccaagcaaacgtttccttctgaggttgttggaaagatggttagtagtataatcgacagcctggaaatactgttcaacaaaggtgaaactcattccgcagtggtcgacttcgaggctcttaacgtcattgtgcgattgatcgagcaggcgccaatccagatgggagaagaagccgtacggtgggcaaagctggtaattcccctggtggtgcactccgctcaaaaagtgcatctgcggggtgcaactgcactggagatgggaatgcctctcctgctgcagaagcagcaggagatcgcttccatcacagaacagcttatgaccaccaaactgataagtgagcttcagaaactctttatgagtaagaacgagacttatgtgttgaagctgtggccactgttcgtgaaactcctgggcaggactttgcacagatctggctccttcattaattcgctgttgcaacttgaagagctaggatttaggtccggagccccaatgatcaaaaaaatagcctttatcgcgtggaaaagtctcatcgacaactttgcccttaaccccgacattctatgctcagccaagaggcttaaattactgatgcaacccttgtcgtccatccacgtgaggactgaaacgctcgcacttacaaagctcgaagtttggtggtaccttctcatgcgtctgggtccacatctgcctgccaactttgaacaggtctgtgtgcccctgattcaaagtacaatctcaattgactccaacgcttcaccacagggtaactcgtgccatgtcgccacctcgccgggtctgaatccaatgacaccagttcacaagggtgcgtcgagcccctacggtgccccaggtacgcctcggatgaatttgagctcgaatttgggaggcatggcaactattccaagtatccagctgctgggtctggaaatgcttctgcacttcctgctaggtcctgaagctctaagtttcgccaaacagaataaactggtactcagcttggagccacttgagcaccctctgatctcatcccccagttttttcagcaaacacgcaaatactttaattacggccgtgcacgacagctttgttgctgtaggaaaggacgccccagatgtcgtggtatccgccatctggaaagaattgatcagcctagtgaagtcagtgaccgagtcgggtaacaagaaggagaagcctggcagtgaggtccttacccttctgctgaagagccttgagagcattgtgaagagcgaagtttttcccgtgagcaagacactagttctcatggaaataacaatcaaaggtctgccgcaaaaggtcttgggctcacccgcttaccaggttgccaacatggatattctgaatggcacccctgccttgttcctgattcagctgattttcaataactttctggaatgcggagtctctgatgaacgcttttttctgagcctcgaatctctggtgggctgcgtcctgtctggccctacctccccactggccttcagcgattccgtgcttaatgttatcaaccaaaacgccaaacaacttgagaataaggaacatctgtggaagatgtggtctgtgattgttacccccttgaccgagctcatcaaccaaacaaacgaggtcaaccagggagacgctctcgagcataatttctcagcgatctacggcgctctgactttacccgtgaaccatatcttctctgagcagcggttcccagtggcaaccatgaaaacacttttgcggacatggtctgagctgtacagggctttcgctcggtgcgctgccctggtggccaccgccgaggaaaatctgtgttgtgaggagctcagctcaaagattatgtcctcactcgaggacgagggattctctaatctgctcttcgtcgataggattatctacattatcacggttatggttgattgtattgatttttcgccatacaatatcaaataccaacccaaggtgaaaagccctcagcgtccttccgactggagtaagaagaaaaatgagcccttgggcaagctgacctcactgttcaagctgatcgtaaaggttatctactccttccacacactgagcttcaaagaggcgcactcagatacgctcttcactatcggtaattccatcacaggcataatctccagcgttttaggccatatctctctaccctctatgattcgtaagatcttcgccacccttaccaggccactcgcattgttttatgaaaattccaaattagacgaggtccctaaggtttattcctgcctcaacaacaaacttgagaaactgctcggagaaatcatcgcatgcctacagtttagctataccgggacctacgattcagaactgctggaacagctaagcccgttgctctgtattatattcttgcataaaaacaaacaaatccgaaagcagagtgcgcagttctggaacgccacgtttgcaaaagtcatgatgctggtatatcccgaagaactcaaacctgtcctaacacaggcaaagcagaagtttttgctgctgctccctggacttgaaacagtggagatgatggaggagtcctccggcccttatagcgatggtactgagaacagtcaacttaacgtcaagattagtgggatggagaggaaatccaacggaaaaagagattccttcctggcacagacaaaaaacaaaaaggagaacatgaagccagctgccaagctgaagctggagagctcaagcttaaaggtaaagggagagatccttctggaagaagaaaaatctaccgatttcgtgtttatccccccagaaggaaaggatgcgaaagaaaggatcctgacagaccaccagaaggaggtgctcaagaccaagcgctgtgacatcccagcaatgtataataaccttgacgtgtcccaggatacactgttcacacagtacagtcaggaagagcccatggagatccccacattgactcgcaagcctaaagaagactcgaagatgatgattacggaggaacagatggactcggacatcgtgataccccaggacgtgactgaggattgcggaatggccgagcacctggagaagtccagcctgtcgaacaacgagtgtggtagcctggacaagacctcacctgaaatgtctaactctaataacgatgaacggaagaaggccctgatctcatctagaaaaacatccactgagtgtgctagcagcaccgagaatagttttgtggttagttcctcatctgtgtcgaatacaacagtagccggaacaccaccatacccaacgagcagacggcagactttcatcacactcgaaaaattcgacgggagcgaaaaccgtccattctccccgtccccactaaacaatatctcctccacagttaccgtcaaaaataatcaggaaaccatgatcaagaccgatttcctccctaaagctaagcagagggaaggcacatttagcaagtccgatagcgagaagatcgtgaatggaacgaaaaggtcctccagacgtgcgggaaaagctgaacagaccggtaataaacggagtaagcctctgatgcgctccgaacccgagaaaaataccgaggaatccgttgagggaattgtagtgctggagaataacccaccagggcttctgaaccagaccgaatgcgtgagcgacaaccaggtgcacttgagcgaaagcactatggaacacgacaacaccaagctgaaggccgcaacagtggaaaatgcagtcctgctggagacaaataccgtggaggagaaaaacgtcgagattaatcttgagagtaaggagaacacgcccccagtggtgatctcagctgaccagatggtgaatgaggattctcaagtgcagataaccccaaatcagaagacactccgtcgttcaagccgacggaggagtgaggtggtggagtcaacgacggagagccaggataaagagaatagtcaccagaaaaaggagcggagaaaagaggaggagaaacccctccagaaatctccgctgcacatcaaggatgatgtcctgcccaagcagaaactcatagccgagcagactctccaggaaaaccttatcgaaaaggggtcaaatctccacgagaaaaccctgggtgaaacgtctgccaacgccgaaacggagcaaaacaagaaaaaagctgatcctgaaaacattaaatctgagggggacggtacccaggacatcgtcgacaagagttcagaaaagcttgtgcgaggcagaactcgctaccagactagacgagccagtcaaggtttgctcagcagcatcgaaaacagcgagagtgactcctccgaggcaaaagaggaggggtccaggaagaagcgcagcgggaaatggaagaataagtccaatgaaagtgttgatatccaagatcaagaggaaaaggtggttaagcaggaatgtatcaaggccgagaaccagtcgcacgactataaagccacttctgaagaagatgttagtattaagagccccatatgtgaaaaacaggacgaatccaatacagtcatctgccaggatagcactgtgacatccgacctgctccaggtgcccgatgatctgcccaatgtgtgcgaggagaagaacgagacaagcaaatacgccgaatattcttttaccagcttaccggtgccagaatccaacctcagaacaaggaacgccattaagagacttcataaacgagactcattcgataattgttcattgggcgagagtagcaaaattgggatctctgatatcagcagcctgtctgagaagactttccaaaccctggagtgccagcacaagagatcgagaagagtgcggagaagtaagggatgtgattgctgtggagaaaagtcccagccccaggagaagtcactcatcggcctcaaaaatacagagaataacgacgtcgagatctccgaaacaaaaaaggcagacgtacaggccccagtgtccccaagcgagacaagtcaggcaaacccttacagcgagggccagttcctagatgagcaccactcagtcaacttccacttgggcctcaaggaggacaatgacactattaatgactccctcatagtttctgagactaagtcgaaagagaataccatgcaggaaagcctcccctccggtattgtgaattttcgtgaggagatttgcgacatggattctagcgaagctatgtctctggaaagtcaggagtctcccaacgaaaatttcaagacagttgggccatgtctgggtgattccaagaatgtcagtcaggagtcacttgaaactaaagaggagaagccagaagaaacacccaaaatggaactatccctcgaaaacgtcacagtggaaggcaacgcctgcaaggtgacagagtcgaacctcgagaaggccaagactatggagcttaacgtcggaaatgaggcgtctttccatgggcaggagcgaactaaaacagggatttctgaggaagccgcaattgaggagaataagcggaacgacgacagcgaagcagatactgcaaaactcaacgccaaggaggtcgccacagaagagtttaactccgacatcagtctgagcgacaataccacgcctgttaagctcaacgctcaaaccgagatctctgagcagaccgcagccggagaactagatggaggcaatgatgtaagcgacctccatagcagcgaagaaacaaataccaagatgaagaacaacgaggaaatgatgattggcgaggccatggcagaaaccggtcatgacggcgagactgaaaatgagggcattacaacaaaaacctccaagcctgacgaggcagagacaaatatgctgaccgccgagatggataactttgtgtgcgatacggtggaaatgtcgacagaagagggaatcatcgatgctaataagacagaaacgaacacagaatattctaaatcagaggagaagctggataacaaccagatggtgatggagtctgatatactgcaagaggaccaccacaccagtcagaaggttgaggagccgtcccagtgtctggcctctggcactgccatctcggagctgataattgaagacaacaacgcgagtcctcaaaaactgcgtgagttggacccctccctggtctccgccaacgatagcccttccggaatgcagaccaggtgcgtttggagccccctcgcctccccttccacctctattttaaagaggggcttgaagcgatcacaagaagacgaaattagctctccagttaataaggtcaggcgtgttagcttcgctgaccccatttatcaagctgggctggctgatgacatcgaccgcagatgctcaattgtgcgtagccactcttctaatagttctcctatagggaagtccgtgaagacttcgcccaccacgcagagcaagcataatactacatcagccaaggggttcctgagcccaggttcaaggtccccaaagtttaaaagttctaagaagtgtcttatctcagaaatggcaaaggagtccattccctgccccacagaaagcgtctaccccccacttgtgaattgcgtggcacccgtggacataattctgcctcaaattacaagcaatatgtgggccaggggcttaggtcagttgatccgcgctaagaatataaagaccattggggatctatcaaccctgacagcttcggaaatcaagactctgcctatccgatctccgaaagtgagcaatgtaaagaaggcgctccggatctaccatgagcaacaggtgaagactcggggacttgaagagatccccgtttttgatatctccgaaaaaacagtgaatgggatagaaaacaagagtctgtcacctgatgaggagaggttggttagcgatataatagaccccgttgcccttgagattcctctaagtaagaacctcctggcccagatttcggctcttgccttgcagttggattccgaagaccttcacaattattccggatcgcagcttttcgaaatgcatgagaagctgtcctgcatggcaaacagtgtgattaagaacctccagtccaggtggcgtagcccctcacacgaaaattccatcta

SEQ ID NO: 30525 - DNA, 7340 bp, Artificial Sequence
  Description of Artificial Sequence: Synthetic coding sequence
atgaccgcgcgtggtcagtccccactagcccctctgctagaaaccttggaggacccttcggcctcacacggcggtcagaccgacgcgtacctaactctgacatcccgcatgaccggtgaggaagggaaggaggttatcactgaaatcgagaagaagcttccacggctctacaaagtgctgaagacccatataagctcccaaaatagcgagctgtcaagcgcagccctgcaggccctgggattctgtctttataaccccaaaataacttcagaattgtccgaggcaaacgctctggagttactgagcaaactgaatgatacaatcaagaattcagacaagaatgtccgtactcgcgctctctgggtgataagtaagcaaacttttcctagtgaggtggttggcaagatggtctcctctataatcgattctttggagatcctgttcaacaagggagaaacccacagtgccgtggtggacttcgaggcgctgaatgtgattgtgcgattgattgaacaggcccctatccagatgggcgaagaggcggttcgctgggcgaagctcgttataccactcgtcgtgcatagcgctcagaaagtccacttgcggggtgcaactgcgcttgaaatgggcatgcccctgcttcttcaaaaacagcaggagatagccagcattacagaacaattaatgacgactaaactcatctcggagctgcagaagctctttatgtctaagaatgaaacatacgtgctcaagctgtggcccctcttcgttaagttactggggaggactttacatagaagcggcagctttatcaactcactcctccagctagaggagttgggcttccgctcaggagccccaatgatcaagaagattgcctttatcgcctggaaatctctcatcgataacttcgccctaaatccagacatcctctgctccgccaagcgactcaagctgcttatgcagccactgtcatctattcacgtgagaaccgagaccctggccctcaccaaactcgaggtgtggtggtatctgctgatgaggctgggaccccacttacccgcaaacttcgaacaggtgtgcgttcccttaattcagtcgaccatctcgattgatagtaacgcctccccacaggggaattcctgccatgtggccacctcacctgggctcaatcctatgacaccagtgcacaaaggggcatcatctccatacggtgcacctggaacgcctaggatgaatttgtcttccaatctggggggtatggctaccataccgtcaatccagctgctcggcctggaaatgctgcttcactttttgctgggaccggaagcactgtccttcgcgaaacagaataaactggttctaagccttgaacctcttgagcatcccttaatcagttcaccttcctttttttccaaacatgcaaacacactgatcaccgctgtgcatgattcatttgttgccgtgggcaaagacgctcccgatgtggttgtgagcgcgatctggaaggagctgatttccctggtgaagagcgtaaccgaatctggcaataagaaggagaaacccggttctgaagtgttgacccttctgttaaagtcactcgagtcaattgtcaagagcgaagttttccccgtgagcaagacattagtgctgatggaaataacaataaagggtctcccgcagaaggtcctggggtcacccgcttatcaggtggccaatatggacattctcaatggtactcctgcactcttcctgattcagttgattttcaacaatttcctggaatgcggcgtatctgacgaacggtttttcctgtccttggaatccctggtgggatgcgtgttgtctggccctacttccccactcgctttctccgatagtgtcctgaacgttattaaccagaacgctaagcaactggagaacaaggaacatctatggaaaatgtggagtgttatcgttactcccctgacggagttgattaatcagaccaacgaagttaaccaaggggacgcattagagcataattttagcgcaatctacggcgctctgactttgcctgtgaaccatatcttttcagagcagcgatttcccgtggctaccatgaaaacactactgaggacctggagtgagctctacagggccttcgccaggtgtgcggctcttgttgcaacggctgaggaaaatctatgttgcgaagaactcagcagcaagatcatgtccagcctggaagacgaaggcttttctaacctgctcttcgtggatcggatcatctacattattactgtgatggtggattgcattgatttctcaccctataacattaagtaccagccaaaggtgaaatccccccagcggccttccgattggagcaagaaaaaaaatgaaccactgggaaagctcacctctctgttcaaactgatcgtgaaggttatctattccttccacactttatccttcaaagaggcccactcagacaccctattcacaataggaaactctataaccggtattatctcaagcgtgctgggccacatcagtttgccctcaatgatccggaaaatttttgccacactaacccggccactggctctgttttacgagaactccaagctcgatgaggtgccaaaggtgtactcttgtctcaataacaaactggagaagctgctaggggaaatcattgcatgtctgcagttttcatatacagggacatacgactcagaattgttggaacagctttctcccctactttgcatcattttcctccataaaaacaagcagattaggaaacagtcagctcagttctggaacgctacttttgctaaggtgatgatgttggtgtacccagaggagctgaagcctgtgttgactcaggccaaacagaagtttctgctacttttgccgggtctggagactgtcgaaatgatggaagagagtagcggaccgtactcggacggaaccgaaaactcccagttgaatgtcaagatctcaggcatggagcgcaagtccaacggcaaaagggatagttttttggcccagacgaaaaacaaaaaggagaatatgaagcctgctgccaaactgaagctggagagtagttcactgaaagtgaagggtgagatccttctggaagaagagaaaagtacagatttcgtatttattccgcctgaggggaaagatgcaaaagaaaggatcctgacagatcatcagaaggaagtccttaaaacaaagcgttgtgacatccccgcaatgtacaataacctggatgtgtcacaggatactctattcacccaatattcacaggaggaaccaatggagataccgaccttaaccagaaagccgaaagaggactccaaaatgatgattactgaggagcagatggatagcgacattgtcataccacaagacgtgaccgaagactgtggtatggcagaacaccttgaaaagtcatcactctcaaataatgagtgcgggtctcttgacaagacctccccagagatgagtaacagcaacaacgatgagaggaaaaaagccctgatcagtagccgcaagacgagtacagagtgtgccagctcgacggaaaatagctttgtggtatccagctcctccgtcagcaacaccacagtggcaggcacccccccatacccaacaagtcgtaggcagacatttattacacttgaaaagtttgatgggtctgagaatcggccattctccccatccccccttaataatatcagcagtacggttaccgttaagaacaatcaggagacaatgattaagacggatttcctgcctaaggccaaacagcgggaaggtaccttttccaaatctgatagcgagaagatagtgaacggaacaaagaggagtagcagaagggcagggaaggccgagcaaacaggtaacaaaaggtcgaaacccctaatgcgcagcgagcctgagaagaacactgaagagtccgttgagggaattgtcgtgttggaaaacaaccccccagggttgttgaatcaaacagaatgcgtgtcagacaatcaggtccacttatcagagagtacgatggagcatgataacaccaagctcaaggccgctactgtcgagaacgctgtgttactggaaacgaatacagtcgaggaaaagaatgtcgaaattaacttggagagcaaggagaatactccccctgtggtcatctctgccgatcagatggtgaacgaggatagccaggtacagattacccccaatcagaagacactgcgacgctcctccagacggcgatctgaagtggtggagtcaacaacggaatcacaggataaagagaactcacaccagaagaaagagagacggaaggaggaggagaaaccactccagaaaagcccactgcacattaaggatgacgtgctccctaagcagaaactcatcgctgagcaaacattgcaagagaacctaatcgaaaaaggatccaatctgcatgaaaagacgttgggcgagacaagtgccaatgctgagaccgagcagaacaagaagaaagcagatcccgagaatatcaaaagtgaaggcgacggcacccaagacatcgtcgataaaagcagcgagaagcttgtcaggggtcggacacgatatcagacaaggcgcgctagtcagggtctgctttctagcattgaaaatagtgaatccgacagttctgaggcaaaggaggagggttctcgcaagaaaaggtctggcaagtggaaaaataagagcaatgaatccgtggatatccaggatcaggaagagaaagtagttaagcaagagtgtatcaaagctgagaatcagtcccacgattacaaggctacatctgaggaggacgtgtccatcaagagtcccatctgtgagaaacaggacgagtctaacactgttatttgtcaagattctaccgtgactagcgatctcttgcaagtaccggatgacctacccaacgtgtgcgaggagaagaacgagacgtccaagtacgctgaatactccttcaccagcctaccggttcctgagtccaacctccgcacacgcaatgcaatcaagcggctccataagagagactcctttgacaattgttccctgggagagagcagtaaaattggaatctccgatatctcgagcctcagcgagaaaacctttcaaacgctggaatgtcaacataaacgctccaggcgggtgagacgctcgaaaggctgcgactgctgtggcgaaaaaagccagccacaggagaagtcactcataggtctgaaaaacacagaaaacaacgacgtcgagattagcgaaacaaagaaggctgatgtccaagctccagtttccccctctgagaccagtcaggctaacccatattccgagggccagtttctggacgagcatcatagcgtcaacttccatctcggtctgaaggaagataacgacacaatcaatgattctttgattgtgtccgagactaaaagcaaggaaaatacgatgcaagaatccctcccttccggtatcgtcaattttagggaagaaatctgtgacatggactcatctgaggctatgtctctggagtcccaggagagccccaatgagaactttaagacagtcggcccatgtcttggagattcgaagaacgtgagccaagagagccttgagacaaaagaggagaaaccagaggagactccaaagatggagctttccttggaaaatgtaacagttgaggggaacgcatgtaaggttacagagagtaatctagaaaaagcgaagacaatggagcttaatgtcggcaatgaggcatcttttcacggtcaagagcggactaagaccgggataagcgaagaggccgcaatcgaagaaaataaaagaaacgatgattccgaagctgacactgcaaagctgaacgcgaaagaggtggccacagaggaattcaacagcgacatctcactgagtgacaatacaactcccgtcaagctgaacgcccaaactgaaatctcagagcagaccgcggctggggaactggacggaggcaatgacgtgtccgatctgcactcttccgaagagactaatactaagatgaagaacaacgaggaaatgatgatcggagaggctatggccgagacagggcatgatggcgagaccgagaatgagggaattactacgaagacatcaaagcccgacgaagccgaaactaacatgttgactgcagagatggataactttgtgtgcgacaccgtagaaatgtccacagaagaaggcataatagacgccaataaaacagaaaccaatactgagtactccaaatcagaagagaaactggacaacaatcagatggtgatggaatcagatatcctgcaagaagatcaccatacttctcagaaggtcgaggaaccctcccagtgcctagcctcaggcaccgcgataagcgaactgattatcgaggataataatgcctctccacagaaactgcgggagctcgacccatcgctcgtatcagctaacgactcccccagcggcatgcagacacggtgcgtgtggagtccactcgcttccccgagcaccagtatcctaaaacgaggactcaaacggagccaggaggatgaaatctcgtcacccgtaaacaaagtccgaagggtgagctttgctgaccccatataccaggccggactggcagatgatatcgacaggcggtgttcaatcgtcaggagccactctagtaattcttccccaatcggaaagtctgtgaaaacatcacctacaacacagagcaagatctccgagatggccaaagaaagcattccatgccccaccgagtccgtctatccaccactcgtaaattgtgtcgctcccgttgacatcatcctgccacaaattacctcgaatatgtgggctcgaggcctcgggcaattgattagggccaagaacattaagactattggggatctgagcactttgaccgcttctgagataaaaacactcccaatccgttcaccaaaggtgagcaatgtgaaaaaggctctacgcatctatcacgagcaacaagtgaaaacacgtggcttggaggaaatccccgtttttgatatctcagagaagaccgtaaacggcatcgaaaacaaatccctttcccccgacgaagaaagattggtgtcagacatcattgatccggtggctctggagatccctctgtccaagaatcttctagcccagatcagcgctcttgccctccagctcgattctgaagacctgcacaactattcagggtcccagctcttcgaaatgcatgaaaagctgagctgcatggccaactccgtgatcaagaatctacaaagcagatggaggagcccctctcacgagaattccatcta

SEQ ID NO: 30526 - DNA, 555 bp, Artificial Sequence
  Description of Artificial Sequence: Synthetic coding sequence
atgcgcgaatacaaactggtggtactggggtcggggggagttggaaagtcagccctgaccgttcagttcgtccaggggattttcgtcgagaagtatgacccgaccattgaagactcctacagaaagcaggtcgaggtcgattgccaacagtgcatgttagagatcttggatacagccggtactgaacagtttacagccatgcgtgatttgtatatgaaaaatggacagggctttgccctcgtgtactccattaccgcacaatctacattcaatgatctccaagatttgcgggagcagatactacgggtgaaagacacagaggacgtgccaatgatcctcgtcggtaacaaatgcgatctagaggatgaacgggtcgtgggcaaggaacagggtcaaaatttagccaggcagtggtgcaactgcgccttcctggagtctagtgccaagtcaaagatcaacgttaacgagatattttacgatctcgtgaggcaaattaacaggaagacacctgtagagaagaagaaacccaagaagaaatcttgcctgctgctctag

SEQ ID NO: 30527 - DNA, 555 bp, Artificial Sequence
  Description of Artificial Sequence: Synthetic coding sequence
atgcgggagtataagctagtggttctaggttctggcggagtaggcaaatctgcgctgacagtgcagttcgttcaggggatatttgtggagaagtatgaccccaccatcgaagattcgtatcgaaaacaggttgaggttgattgccagcaatgcatgcttgagatcttggacacggcaggcacggaacagttcactgcgatgagagacctctatatgaaaaatgggcaggggtttgctctggtgtactctatcactgcccagtctaccttcaatgacttacaggacctgcgtgaacagattctcagagtgaaagacactgaagatgtccccatgatcctggtgggcaacaagtgtgatcttgaggatgagcgggtcgtgggaaaggaacagggccagaatctggcacgacagtggtgtaactgtgccttcctcgagtcatctgccaagtcaaaaattaatgtgaacgaaattttttatgacctcgtcagacagattaatagaaagacgcctgtcgagaagaaaaaacctaagaagaagtcctgcctgctcctgtag

SEQ ID NO: 30528 - DNA, 390 bp, Artificial Sequence
  Description of Artificial Sequence: Synthetic coding sequence
atgcgggaatacaaactcgtggttctaggttccgggggagtcggtaaatccgcactgaccgtccaattcgtgcagggtatcttcgtggagaagtacgatcccaccattgaagactcttacaggaaacaagtggaggtggactgtcagcaatgcatgctggaaattcttgacacggcaggcaccgaacagtttacagcgatgcgcgacctgtacatgaaaaatggccaaggcttcgcgcttgtgtacagcataaccgcgcagagcactttcaatgacttgcaagacctgcgagaacagatcctccgtgtgaaggataccgaggatgtgcccatgatcttggtcggcaacaaatgcgatttggaggatgagcgagtcgttggtaaagagtag

SEQ ID NO: 30529 - DNA, 555 bp, Artificial Sequence
  Description of Artificial Sequence: Synthetic coding sequence
atgagagagtataaactggtggttctgggaagcgggggtgtgggcaaatctgccttgacagtgcaattcgtgcaggggatttttgtggaaaagtatgatcccaccattgaagatagctacaggaaacaggttgaggttgattgtcagcagtgtatgttagaaattttagacaccgccggaacagagcagttcaccgccatgcgggatctttacatgaagaatggccagggcttcgctcttgtgtactctattacagcccaatccacctttaatgatcttcaggatctccgggaacagattctcagagtaaaagacaccgaggacgtcccaatgattctggttggaaataaatgtgaccttgaagatgagagagtggtgggcaaggaacaggggcaaaacctagcccgtcagtggtgcaattgtgcttttttggagagttccgccaagtccaagatcaatgttaatgagatcttctatgacctggtgcggcaaatcaatcgaaagacacccgtggagaaaaaaaagccgaaaaagaagtcgtgtctacttctctag

SEQ ID NO: 30530 - DNA, 555 bp, Artificial Sequence
  Description of Artificial Sequence: Synthetic coding sequence
atgagagagtataagctcgtagtcctcggctctggcggagtggggaagtccgctctgacggtgcagttcgtccaagggattttcgtcgagaagtatgatccaaccattgaagatagctatagaaaacaggtcgaggttgattgccagcagtgtatgctggagatcctcgacaccgcgggaactgaacagtttaccgccatgagagacttgtacatgaaaaacggccaggggtttgcactcgtgtacagcatcacagctcagtcgacatttaatgatctgcaggatttaagggagcaaatccttagagttaaagacacggaggatgtcccaatgattctggtggggaacaaatgcgacttagaggatgagagagtcgtgggcaaggagcagggccagaacctggcgcgacagtggtgcaattgcgctttcctggagagctccgccaagagcaagataaacgtgaatgagattttttacgacttggtgcggcagataaatcggaagacacccgtggagaagaagaagccaaagaagaagtcttgtttactgctctag

SEQ ID NO: 30531 - DNA, 1380 bp, Artificial Sequence
  Description of Artificial Sequence: Synthetic coding sequence
atgcgcgcacagatcgaagtcattccatgcaagatctgtggggataagagctctggcatacattatggagtcataacttgtgaagggtgcaaagggtttttcagacgctctcagcagaacaatgcgagttacagttgtccgagacagaggaactgcttgattgatagaaccaatcggaatcgctgtcaacattgccggctgcaaaagtgcctggcccttggaatgagtagggatgctgtgaaatttggacgaatgagtaagaagcaacgtgactccctctacgcagaggtgcagaagcaccagcagagactgcaggagcaacgccagcaacagagcggggaggccgaagctctggcgagggtgtatagctcttccattagcaacggactgtccaacctgaataatgaaaccagtggtacctatgcaaatgggcacgtgatcgatttgccaaagtccgagggctactacaacgtcgattccggacagcctagcccagaccagtccggattggacatgaccggtattaagcagattaaacaggaacccatttacgacctgacgtcagtgcctaatctgttcacgtatagcagtttcaataatgggcagctggcacccggtatcacgatgaccgaaatcgaccgaattgctcagaatattataaaaagccacttagaaacctgccagtatactatggaagaacttcaccagcttgcctggcagacgcatacttatgaagaaattaaggcataccaaagtaagtctagggaggccctgtggcagcaatgcgcaattcagatcactcacgcaatacaatatgtggtggaatttgccaagcgcatcactggatttatggagctctgccagaacgaccagatcttgctgcttaagtccggatgcctggaagtggttcttgtgcgcatgtgtcgcgcatttaaccctttgaataataccgtcctgttcgaaggtaaatatggcggaatgcaaatgttcaaagctctgggttccgacgacctggtgaatgaggcttttgatttcgcgaaaaacctgtgttctctacagctgactgaagaggagatcgccctatttagttccgcagtgctgatctcacctgatagagcctggttgattgaacctaggaaggtacagaaattgcaggagaagatatacttcgcgctccaacacgtgatacagaagaaccacttagatgacgagacactcgcaaagctgattgccaaaatccccacaattaccgcggtgtgtaatctgcatggagagaagctgcaggtttttaagcagtctcacccagagatcgtgaacactctcttccctcccttatataaggaactttttaaccccgattgcgccaccggctgcaagtag

SEQ ID NO: 30532 - DNA, 1413 bp, Artificial Sequence
  Description of Artificial Sequence: Synthetic coding sequence
atgtgcgaaaaccagctgaagactaaggctgatgcaacagctcaaatcgaggtgattccatgcaaaatctgcggcgacaaatcctcaggcattcattacggagtgatcacttgcgaaggttgtaagggtttttttcggagatcccaacagaacaacgcctcctattcttgccctagacagcggaattgcctgattgatcgcactaatagaaatcggtgccagcattgccggctgcagaaatgcctggccctggggatgtctagagatgccgtgaagtttggacgaatgagtaaaaaacagagagactcactgtacgcagaagtgcagaagcatcagcagaggcttcaggagcaacgacaacagcagtcaggagaggctgaggccctcgcgagggtgtacagttctagtatctctaatggtctgtctaatctgaacaatgagacatctggaacatatgctaatgggcatgttatagacctcccgaagagcgagggttactacaatgtcgattccgggcagccttctccagaccagagtggactggatatgacaggaatcaagcaaataaagcaggaacccatttatgacctgacatcagttcctaacctgttcacgtactcctcctttaataacggacagctggctcctggcatcactatgacggagattgaccggattgcgcagaatatcataaaatcccacctcgagacctgccagtacaccatggaagagctgcatcagttggcctggcagacacatacatacgaggagattaaggcctaccagtcaaaaagccgggaggctttatggcagcaatgcgctatccagattacccacgccatccagtacgtggtggagttcgctaagaggataacaggctttatggagttgtgtcagaatgaccagatactgcttctcaaaagcgggtgtctggaagtggtcctggtgcgcatgtgcagggccttcaatcccttaaataataccgtcttgttcgagggtaaatacgggggtatgcagatgtttaaggcccttggatctgacgacctagtaaacgaggcttttgattttgcaaagaatctgtgttcgttacaattaacagaagaagagatcgcactgttctcttccgctgtgctgatctccccagaccgtgcatggctcatcgagccccgtaaggtgcagaaactgcaggagaagatctatttcgcccttcagcacgtgatacaaaagaaccatctggacgatgagactctcgcgaaactgattgcgaagatcccaacaattaccgccgtttgcaatttgcacggagagaagctacaggtcttcaaacagtcccacccagaaatagtgaacacactgtttcccccactgtacaaggaactgttcaaccccgattgcgccaccggctgtaagtag

SEQ ID NO: 30533 - DNA, 813 bp, Artificial Sequence
  Description of Artificial Sequence: Synthetic coding sequence
atgggggaggctgaggctccgagctttgagatgacttggtcttcaaccacttcctccggctactgttctcaggaagattctgacagcgaactggaacaatatttcactgcacgcacatcactcgctcgaaggccacggcgtgaccaggatgaacctgtggagtgggagactccagacctgtctcaggccgagatcgaacagaaaatcaaggaatataacgcacagattaacagtaacctgttcatgtcattgaacaaagatggttcatatacggggtttatcaaagtgcaacttaaactggtgcggccagtgtcagtgccctcttccaagaaaccgcctagcctgcaggacgctcggcgtggcccagggcgtggtacttctgttcgaaggcggaccagcttttacctgccaaaagatgcggtgaagcacttgcatgttctctccagaactagggctagagaagttatagaagcactactgcgtaaatttctggtcgtggatgatccacgtaaattcgctctgtttgagcgggctgagaggcacggccaggtttatcttagaaagctgttggatgacgaacagcctctgaggctgcggctgttggccggaccttccgacaaagccctcagcttcgtactgaaggagaacgactccggggaggtaaattgggacgccttctctatgccagagctccacaactttctgaggattctgcagcgtgaggaggaagaacacttaagacagatcctgcagaagtattcctactgcaggcagaagatccaggaagcgttgcacgcttgtcctctaggctag

SEQ ID NO: 30534 - DNA, 1035 bp, Artificial Sequence
  Description of Artificial Sequence: Synthetic coding sequence
atgtccggagagccggaactgattgaactccgcgagctagcaccagctgggagagcgggtaaaggccgaaccaggctcgaacgagcaaatgctctgaggatagccagggggacagcctgcaatccgactcgtcagttggtgcccggtagaggacacagattccaacctgccggaccggcaacacacacttggtgcgatctgtgtggagatttcatttggggggtggtgcggaaaggtcttcagtgcgctaggctgtccgcagactgcaaatttacctgccactacaggtgccgggctctggtctgtctggattgttgtggccctcgtgacctcggctgggagcctgccgtggagagggacacaaacgtcgatgaacctgtggagtgggaaacaccggatctttctcaagctgagatcgaacaaaagattaaggagtataatgctcaaattaactcaaatctgtttatgagcctgaacaaagacggttcttacacgggattcatcaaggttcagctgaaactggtccggcctgtctcagtaccatcctcaaaaaagcccccatcacttcaggacgccagaaggggaccaggacggggtacctccgttcgtcgccgaacatctttttatctgcctaaagatgccgtgaaacaccttcatgtgctttcccggacacgagcgagggaggttatcgaagccctcctcagaaaatttctcgtcgtcgatgacccgaggaaattcgcccttttcgagcgcgctgagcggcatggacaggtgtacctgcgtaaactacttgatgacgagcagccgttgaggctccgattactcgcagggccttccgacaaggccctgtcattcgtcctgaaagagaacgacagcggcgaagtgaactgggacgccttttccatgccagagttgcacaactttctgaggattctgcaacgggaggaggaggagcaccttcgacaaatactacagaaatacagctattgtaggcaaaaaatccaagaggcgctgcacgcctgtccccttggttag

SEQ ID NO: 30535 - DNA, 1023 bp, Artificial Sequence
  Description of Artificial Sequence: Synthetic coding sequence
atgagcggggaacctgaactgatagagcttcgtgagctggcacccgcaggacgtgctggaaaggggagaacaaggctcgagcgcgctaatgccttgagaatcgcacgcggtactgcctgtaatcctacccgtcagctggtgcctggacggggacatagatttcagccagccggtcccgctactcatacttggtgcgatttgtgcggggattttatctggggtgtggttagaaaaggtcttcagtgtgcacactgcaagtttacctgtcactacagatgtagggccctggtgtgcctggactgctgtggacctcgcgacctgggctgggaaccagccgttgagcgagacaccaacgtcgatgagcccgtcgagtgggaaactcctgatctcagccaggcagagatcgagcaaaaaatcaaagaatacaacgctcaaattaattccaatctctttatgtctttaaataaagatggctcttacactgggttcatcaaggtgcagttgaagctcgttcggccagtgagcgtaccgtccagtaagaaaccccctagcctccaggatgcacggagaggcccaggccgaggaaccagtgtccgccgacggacatcgttctacttaccgaaagatgccgtcaaacacctgcatgtcctcagccgaactcgcgctagagaagtgatagaggcactcctaagaaaatttctcgtcgtcgacgacccacgaaaatttgcgctgttcgaaagagctgagaggcatggccaggtctatctgcggaaattacttgatgacgaacagccgctgcgcctccgactgctggcaggcccttctgacaaagccctttccttcgtgctcaaggagaatgacagcggggaggttaattgggacgcttttagtatgcccgagcttcacaattttctgaggatccttcagcgggaggaagaagaacacctgcgacagattctccagaagtattcttactgcagacagaagatccaggaagcattacacgcttgtccccttggctag

SEQ ID NO: 30536 - DNA, 570 bp, Artificial Sequence
  Description of Artificial Sequence: Synthetic coding sequence
atgtccctgaacaaggacggcagctacacaggctttataaaagttcaactaaagctggtgcgcccagtgagcgtgccctcgagcaagaaaccacccagcttgcaagatgctaggcggggtcccggtagggggacctccgttcggcgaaggacgtctttttatttgccaaaagatgctgtgaagcacctgcatgtattgagtcgaacgagggcacgggaggttattgaggcactgctcagaaaattcttggtcgtggacgaccccagaaagtttgcccttttcgaacgcgcagagcggcatggccaggtgtacctcagaaagcttctggatgacgagcagccccttaggctacgactgctggctggtcctagcgataaagccttatcgtttgtactgaaagagaatgactcgggtgaagtaaattgggatgccttcagtatgccagagcttcacaacttcctgcggattcttcagcgcgaggaagaggaacatctgcgtcagatcctgcaaaagtactcttattgcagacaaaaaatacaagaagctctgcacgcttgtcctctaggttag

SEQ ID NO: 30537 - DNA, 981 bp, Artificial Sequence
  Description of Artificial Sequence: Synthetic coding sequence
atggactattcacaccaaacaagcctggttccatgcggtcaagacaaatacatcagtaaaaacgagctccttctgcatctgaaaacttacaacctttactacgagggtcagaatttacagttacggcaccgagaggaggaggatgaattcatcgtggagggtctgctcaacatttcgtggggactgagaagaccaattcgcctccagatgcaggacgacaatgagagaatccgtccccctccttcctctagttcctggcacagcggatgcaatcttggcgctcagggaacaaccctcaaaccattgacggtgccaaaagtgcaaatttcagaagttgatgcaccacctgagggggaccaaatgccctccagcacagacagtcggggactgaagccactccaggaagacacaccgcagttgatgcgcacacggagcgacgtcggcgttagaagacgaggcaacgtccggaccccgtccgatcaacggcgtattcggagacacaggttcagcattaatggccatttttataatcacaagacatcagtttttacacccgcttacggttctgtcaccaatgtgcggattaattctacaatgacaacaccccaggttctgaagctactcctcaataaattcaagatcgaaaatagtgccgaggaatttgctctctacgtggtgcacactagcggcgaaaagcagaagctgaaggcaacagactacccactcatcgcgcgtattctgcagggcccatgcgaacagattagcaaggtgttcctgatggagaaagatcaggtggaagaggtgacctatgatgtcgctcaatatatcaaatttgaaatgcccgtcctgaagtcttttatccagaagctccaggaagaagaagatcgcgaggtcaagaaactgatgagaaaatacacagtcctgcgcctgatgattagacagcggcttgaagagatcgccgaaacacctgcaacaatttag

SEQ ID NO: 30538 - DNA, 981 bp, Artificial Sequence
  Description of Artificial Sequence: Synthetic coding sequence
atggattattcccatcagacctctcttgttccatgtggccaagacaagtatatctctaagaatgagctcctgctgcacctgaaaacttacaatctgtactacgagggtcagaatctacaattgcgacatagagaggaggaggatgagttcatcgttgaagggttactgaacatcagctggggtctgaggagacccatcagattacagatgcaggacgataatgaaagaattaggcccccaccctcctcctctagttggcacagcgggtgcaaccttggggctcagggcaccacactcaaacctcttacagtgccaaaggtgcagatttcagaggttgatgcccctcctgagggtgatcagatgcccagctccaccgatagcaggggtttgaagcccctccaggaagacacacctcagctgatgcgaacaagatcagacgtgggcgtacgtaggcgaggtaacgttcggactccgagtgaccagcggaggattaggcggcaccgattctccatcaacggacatttttacaatcataagacaagcgtgttcacaccagcgtatggctccgtaactaacgtgaggattaactcaacaatgactacacctcaagttttaaagctgcttttgaataaatttaagatagagaacagcgccgaggaatttgcactctatgtggtgcacactagcggtgagaaacagaagctgaaggcaacagactatccactgatagcccgaatcctccagggcccatgtgagcaaatctccaaggttttcctgatggagaaggaccaggtcgaggaagtcacatatgatgtggcacagtatattaagttcgagatgcctgtgcttaagagctttatccagaagctgcaggaagaggaggatcgagaggtcaagaagctgatgagaaaatacacggttctccgtctcatgatcagacagcggctcgaagagatcgcggagacaccagcgacaatctag

SEQ ID NO: 30539 - DNA, 993 bp, Artificial Sequence
  Description of Artificial Sequence: Synthetic coding sequence
atgaaggaggactgtctgccctcctcccacgtgcccatcagtgacagcaagtctattcagaagcgcgacgtgcaggggcttagtgaagaaggtacccttattattgagggattgctgaatattgcatggggcctgagacgcccaattagactccagatgcaagatgatagggagcaagtgcatctgccatccactagctggatgcccaggcgaccgtcttgccctctcggctgttggtccctactactggggctatcgagcctctcgctgccagctgccatatccgcactccagctcagcgtgttcagaaaggaaccctccccacagaacggcaacatcaccgctcagggacccagtatccaacccgttcataaggcagaatcctccactgattctagcgggcctcttgaagaggctgaagaagcccctcagctgatgcggactaagagtgacgcgtcttgtatgtcgcaaaggagacccaaatgccgagccccaggcgaggcgcagcgtatcagacggcataggtttagtattaatggccacttctataaccacaaaactagtgtgttcacacctgcctacggcagcgtgactaacgttcgcgtgaattcgaccatgactaccttgcaggtattaactctcctcctgaacaaatttagggtggaagatggccctagcgagttcgctctctatatagttcatgagagtggtgagcggactaagctcaaggattgtgaataccccctgatcagccggatcctgcacggaccctgcgagaaaatcgcgcgaatattcctcatggaagccgatttgggcgtggaggtaccacatgaggtggcacagtacatcaaattcgaaatgccggtcctcgactcatttgttgagaagttaaaagaagaagaagagagagaaatcattaaactgacaatgaagtttcaggcactgcgattaaccatgctgcagagactcgaacagctggtggaagctaagtag

SEQ ID NO: 30540 - DNA, 966 bp, Artificial Sequence
  Description of Artificial Sequence: Synthetic coding sequence
atgaaggaggactgtctacccagttcgcacgtcccgatcagtgacagcaagagtatacaaaagtctgagctcctgggtctcctcaaaacctataactgctaccacgagggaaagtccttccagctcaggcaccgcgaggaggagggtacgctaatcattgagggactgctgaatatcgcctggggcctgcgcagaccgattagacttcagatgcaagacgatcgggagcaggtgcatttaccctccacatcctggatgcctcgtcgacccagctgtcctctaaaagaaccatcaccccaaaacggaaacataaccgcccagggaccctcaatccagcctgtccacaaagccgagtccagtacggactctagcggacccctggaggaggcagaagaagcccctcagcttatgaggacgaaatcagatgcttcttgtatgtcacagagacgcccaaagtgtagggcacccggtgaggcacaacggatccgtagacaccggttttccatcaatggccacttttacaatcataaaacatccgtgttcactcctgcttacgggagtgtgacgaacgtcagggtgaattctactatgacgacgctccaagtgctgacgcttcttctcaacaagttcagagtggaggatggcccatccgaattcgcactgtatatcgtgcacgaatcaggcgagcgcactaagctgaaagactgcgaataccccctcatctccaggattctgcatggtccctgtgagaagatcgccaggatatttctgatggaggctgacctcggcgtggaggtgcctcacgaagtggctcagtacattaagttcgagatgcctgttttagatagctttgtggagaaactcaaggaagaggaggaacgagaaattataaagctcacaatgaaatttcaggcccttcggctcacaatgctccaaagactggagcagcttgtagaagctaagtag

SEQ ID NO: 30541 - DNA, 1239 bp, Artificial Sequence
  Description of Artificial Sequence: Synthetic coding sequence
ggttccaatgccggaggcggacaaggtggttgtcaaggccttacttgcgatagtgagtctgttggcacactggacatactggaccagacccaggcttgtcctgtaagcctcgcctccagtagtgctaggcccccatgcccgccacccggaccatgtgccgaaccttctggttgtattgctatggctgtctggtcccctcttgttatgccaggcagacgcgaaggttgctgccatacccccgttacaaacgaggaaacagaagctagagaggccaaaggccagaagttacgtccttgccacaccctcggagtgcatgtgtgtctaagtctattccggtctgaactgctggggctgctaaagacgtataactgctatcatgagggaaaaagttttcagcttaggcatcgagaagaggaaggaaccctgatcattgagggcttactgaacatcgcctggggactgcggaggcccatcaggttacagatgcaggacgacagggagcaggtgcacctgccctccaccagctggatgcctcggaggcccagttgccctctgaaggaaccgtcaccccagaacggtaacatcaccgctcagggcccaagcattcagcctgtgcataaagcagagtcttctaccgatagctccggtccactggaggaagccgaagaagcccctcaattgatgaggacaaagtctgatgcctcttgtatgtcgcagcgacgccctaagtgtagagcgcctggagaggcacagaggattcggaggcacagattttctatcaacggacatttctacaatcacaagacctcagtcttcactcctgcttacggcagcgtgaccaacgtcagggtcaattccactatgaccaccctccaggtgcttaccctcctgctcaataagtttagagttgaggacggcccatctgaattcgctttgtatatagtccatgagagcggggaacgcacgaaactgaaagattgcgagtatccactgatttctagaatccttcacggaccttgtgagaaaatcgccaggattttcctgatggaagccgaccttggagtggaggtgccacatgaagtggcccaatatattaagttcgaaatgccggtgctggatagctttgtggaaaagctgaaagaagaagaagaaagggagatcataaaacttactatgaaattccaggccctcaggctcaccatgctgcagagactcgagcagctggtagaggccaagtag

SEQ ID NO: 30542 - DNA, 393 bp, Artificial Sequence
  Description of Artificial Sequence: Synthetic coding sequence
atgaaagaggactgcctgcctagctcccatgttccgatctctgatagtaagtccatccagaagtctgagttactcggactcctcaagacatacaactgctaccatgaggggaagagtttccaactgcgtcaccgcgaggaggaagggacccttatcattgagggactgctcaatatcgcctggggactgcgcagaccgattcggctccagatgcaggacgacagggaacaggtgcaccttccttcaacttcctggatgcccagaagaccttcctgtcctctacacctggctggaaagaagggccgacttcaaccaggagggctcccaacgcctatgcaggctgagcacgtgagtccctccctggtgttaagtttgaaatttacacgaatctag

SEQ ID NO: 30543 - DNA, 381 bp, Artificial Sequence
  Description of Artificial Sequence: Synthetic coding sequence
atgaaagaggattgtttgccctcaagccacgtccccatcagcgactccaagtccatacagaaatctgagctgcttggcctgttaaagacctataattgctaccatgaaggcaagtctttccagctccgtcatagagaggaggagggcacccttatcatcgaaggactgctgaatattgcttggggtctgcgcagaccaatccgcctgcaaatgcaagatgacagagaacaggtgcacctcccaagcacgtcatggatgcccagacgtccctcctgccctcttgctccagggggagggaggggcggacctccagctgacgcggaccaagagcgcaggcagctgcacgaaccagaggaggcacaagtccccaggccaagatag

SEQ ID NO: 30544 - DNA, 456 bp, Artificial Sequence
  Description of Artificial Sequence: Synthetic coding sequence
atgaaagaggactgtctgcccagcagccatgtccctattagtgattctaagagtatacagaagagcgaactgctgggactgctgaagacatataactgttatcatgaaggtaagtcatttcagctccggcaccgggaagaggagggcaccttgatcatagaaggcttactcaatatcgcatggggattgcggcgacccatcagattgcaaatgcaagatgatcgggaacaagtacatctaccgagcacctcctggatgccgaggcgtccttcctgcccactgggttgctggtcacttctactgggcttatcctcactgtccctccccgctgctatttcagctctgcagctttctgttttcagaaaggaacccagcccgcagaatggaaacatcactgcccaagggcctagtatccagcccgttcacaaagccgagagcagcacggacagtagctag

SEQ ID NO: 30545 - DNA, 372 bp, Artificial Sequence
  Description of Artificial Sequence: Synthetic coding sequence
agcagccacgtcccaatttcggattcgaagtcaattcagaagtcagaattgctgggcctgttaaagacgtataactgctatcacgaaggaaagagctttcagctgcggcatcgagaggaagaaggcaccctcatcatcgaaggcctgctcaacattgcatgggggctccggaggccaattcgtctgcagatgcaggacgaccgagaacaggtccatcttccgtcgacatcatggatgcctagacggccatcttgtccccttcatctcgcaggaaagaaaggtaggctgcagccgggaggcctgcccacacccatgcaggctgaacatgtgtctcccagcctggtgctcagcttaaaattcaccaggatttag

SEQ ID NO: 30546 - DNA, 798 bp, Artificial Sequence
  Description of Artificial Sequence: Synthetic coding sequence
atgaccgttgacagctcgatgtcaagtggatactgttcactggatgaagagttggaggactgtttctttaccgccaagaccaccttctttaggaatgcccaatccaaacatcttagtaagaacgtgtgcaagcccgttgaagagacccagagaccccctacacttcaggagattaaacagaaaatcgacagttacaatacgcgagaaaaaaattgcctgggaatgaaactttcagaggacggcacctatacagggtttattaaggtgcacctcaagctacgaaggcccgtaacggtgcccgcaggcattcggcctcaaagcatatatgatgcaataaaagaggtcaatctagccgcaactaccgacaagcgtacctctttctacctcccacttgacgcaattaaacaactgcatatatcatcaaccacaacagtctccgaggtgatccagggtcttcttaaaaaatttatggtggttgataacccccagaaattcgccctctttaagcgaattcataaggatggccaagtgctgtttcagaagctttccatcgctgatagaccattatatttacgcctgctggccggaccagatactgaagtgctgtcatttgtcctgaaggagaacgaaactggggaggtggagtgggatgctttttcaatcccggagttgcagaatttcttaaccatcctcgagaaggaggaacaggacaaaatacagcaggtgcaaaaaaaatacgacaaattccgccagaagcttgaagaagctcttagggagtctcagggtaaaccaggctag

SEQ ID NO: 30547 - DNA, 1179 bp, Artificial Sequence
  Description of Artificial Sequence: Synthetic coding sequence
atggctatggcatccccggcaattggccagcggccataccccctcctgctagacccagaacctcctaggtatcttcagtccttatccggcccagaactgccccctccaccacccgaccgaagctctcggctatgcgtccccgctcccctgagtacggcccctggagcccgagagggcagaagcgcgaggcgtgcagcccgaggcaacctggagcctcctccgagagcaagccgacccgctaggccattgcgccctggactgcagcagcgactgagacgtcgcccaggcgcacctagaccaagggatgtgcgaagcatttttgaacagccacaggacccgagagtgcccgcagagagaggggaggggcactgttttgccgagttggtcctgcctggaggacccggttggtgcgacttgtgcggaagagaagtcttaaggcaggctctgcggtgtactaactgtaagtttacttgccatcctgagtgccggtctctgatccagttggactgttcccagcaggaggggctgagtagagacaggccatcacctgagtctactctaacagttacctttagccagaatgtatgcaagcccgtggaggaaacacagcggcctccaaccctgcaggagatcaagcaaaagattgactcgtataacactagagagaagaattgcctcgggatgaagctcagcgaggatggaacctacactgggttcatcaaggtgcatctgaaactgagaaggcctgtgaccgtaccggctgggattaggcctcaatccatttacgacgcgatcaaggaggtcaacctggccgcaacgacagacaagcgcacatcattctacctgccacttgacgcaatcaagcaactgcatatatcctcaaccaccactgtgagcgaagtcatccaaggtctactcaaaaaattcatggttgtggataatcctcagaaatttgctctttttaaaagaatccacaaggacggacaggtgctattccagaagctgtccatcgcggatcggccactgtacttacgtctcttggcaggcccagacacagaggttctgtcattcgtactaaaggagaatgaaacgggagaggtcgaatgggacgccttttccatacccgagctacagaactttctgtctagttggtgtatacagatctatctgtactactag

SEQ ID NO: 30548 - DNA, 1257 bp, Artificial Sequence
  Description of Artificial Sequence: Synthetic coding sequence
atggccatggcttctcctgctatcggtcagcgaccctaccctctactcctggaccccgaaccaccccgttatctacagagcctgtctggccctgagttgccccctcctcctcccgatcgcagttctagactctgcgttcccgcacctttatcaacggccccaggagcccgtgagggacggtccgcccgtcgcgcagcccgtggaaatctggagcctcccccaagggcaagtaggcccgcacggcctcttaggcccggtcttcagcagaggttaaggcgaaggcccggtgcccctaggcctcgcgatgttcgctctatattcgagcaacctcaggaccctcgggtgcctgccgagaggggcgagggacactgcttcgcagagctggtgctgcctggtggcccaggctggtgtgatctgtgcggaagagaggtgctgcgccaggcgctgagatgcactaactgtaaatttacctgtcaccccgaatgtcggtccctgatccagcttgattgcagccagcaggaggggctgagtcgggaccggccttcccctgaaagcaccttgacagttaccttcagtcaaaacgtttgtaagcccgtagaagaaacccagcgtcctcctacactacaggaaattaagcagaagatcgattcttacaacacaagggaaaaaaactgcctgggaatgaagctgtcagaagatggaacgtacaccggttttattaaagtccatctcaagctgcgcagaccagtcaccgtcccagccggtatccggccacaaagtatctatgatgctatcaaagaagtgaacctcgccgctactactgacaaaaggacctctttttatctgcccctcgatgcaatcaaacagttgcacatatcaagcacaaccacagtgagcgaagtcatccagggcctgctcaagaaattcatggtggtggataacccacagaagttcgccctgtttaaacgaatccacaaggacggccaagtgctcttccaaaaactgtctattgctgaccggcctctgtacttgcggcttctcgcagggcctgacaccgaggtgctgagcttcgttctgaaagaaaacgaaactggggaggtcgagtgggatgctttcagtatccccgagctccaaaacttcctgactatactggagaaagaagaacaagacaagattcagcaggtgcagaaaaagtatgacaaatttcgtcagaaattggaggaagcgctcagggagtctcagggaaagccaggctag

SEQ ID NO: 30549 - DNA, 1011 bp, Artificial Sequence
  Description of Artificial Sequence: Synthetic coding sequence
atggccatggcatccccagcaatcggtcaacgcccttaccctctgttgttggacccagaacctccacgctacctccagtccctctctggtccagagttgccccctcccccaccagatagatcatcgaggctttgtgtgcccgctcctttatcaacagctcctggcgcaagagaggggagaagcgctcgaagagcggctagaggcaatcttgagcccccacccagagcctccaggcctgccagacccttaaggccaggcctccagcagaggctacgacggcgacccggtgcccctagaccaagagacgtcaggagtatttttgagcagccccaggatccacgcgtcccagccgagcgcggagagggccattgcttcgccgagctggtcctccccggaggacctgggtggtgcgatctctgcggacgggaagtcctgcgacaggccctgaggtgtactaactgcaagttcacctgccaccctgagtgcagaagtcttattcagctggactgctcacagcaggaaggcctgtcacgcgaccgtccctcacccgaatcaacccttactgtgacattctctcagaacgtctgtaagccggtggaggagacgcaacgccctcccacccttcaggagatcaaacagaaaattgatagctacaacacccgggagaaaaattgcctgggtatgaagctctccgaagacggcacttacactggcttcataaaagtccaccttaagcttcgacgccctgttactgtccccgctggtattcggccacagtcaatctatgacgcaataaaggaagtgaatctggccgctaccactgacaagcgaactagcttctatctacccctagatgcgattaagcagctgcacatatcctcaactactactgtctccgaggtgatccagggtttattaaaaaagtttatggtagtggacaatcctcaaaaatttgcactcttcaaacgcatccacaaggacggccaggtgggttgtctcttgcacccgtag

SEQ ID NO: 30550 - DNA, 1182 bp, Artificial Sequence
  Description of Artificial Sequence: Synthetic coding sequence
atggcaatggcttctcctgcaatagggcagcgcccttatcctctgcttctcgaccctgaaccgcctcgctacctccagtctctgagtggcccagagttgccccctccaccccctgatcgctctagtaggttgtgtgtgcctgctcctcttagtacagccccaggagcaagagagggaaggtccgcgaggagagctgctaggggcaacctcgaacccccaccaagagcttctcgccctgccagacctttaagacctggactccagcagaggctccggaggcgcccaggcgctccgaggccacgggatgtacggtccattttcgagcagccccaggatcctagagtccctgctgagcgtggggagggacattgctttgccgagctggtgcttcccggagggccagggtggtgcgatctgtgtggacgcgaggtgttaaggcaggcactgcgctgcactaattgtaagttcacctgccatcccgaatgccgcagcctcatacagctggactgtagccagcaagagggactgtcacgggacaggccgtcaccagagagtacgctcacagttaccttttcacagaacgtctgtaagccagtggaagaaacccaaaggccacctaccttgcaagagattaaacagaaaatcgactcttacaatacacgggagaagaactgcctagggatgaaactctctgaggacggcacctacactggttttatcaaggtgcatttgaaacttaggagacctgtgacagtgcctgccggaattcgcccacagagtatttacgacgctataaaagaggtcaacctcgcagcaaccaccgataagaggacctcattttacctaccactggatgctatcaagcaactgcacattagttccaccacaacagtgagcgaagtgatacaggggttacttaagaagttcatggtcgtggacaatcctcagaagttcgctctattcaaacggatccataaagacggacaggtcctgtttcagaagctcagcatcgccgatcgtccgctttaccttcgtcttctagccggacccgataccgaagtgttaagttttgtcctaaaagaaaacgagacaggcgaggtcgagtgggacgctttctccatccctgagctgcagaatttctttctgagctcatggtgtatccagatctacctgtactattag

SEQ ID NO: 30551 - DNA, 555 bp, Artificial Sequence
  Description of Artificial Sequence: Synthetic coding sequence
atgccacagtccaagagccgaaagatcgcaattcttggataccgttctgtgggcaagtcctcactgactatccagttcgttgaaggccagttcgttgacagttacgatccaacaatagaaaatacctttaccaaactgattaccgtgaatggacaggaatatcatctacaactcgtggacaccgctgggcaggacgagtattccatctttcctcaaacctatagcattgatattaatggctacatcttggtatatagcgtgacgtcaattaaatcgttcgaggtcattaaagtgatccacggaaagctgttggatatggtcggcaaggtgcagatccctatcatgttggtcggcaataaaaaagacctgcatatggagcgcgtgataagctacgaagaaggcaaagctctggctgaaagctggaatgcggcttttctcgagtctagcgctaaagagaatcagaccgctgtggatgttttcagacggatcatcctggaggctgaaaagatggacggggctgccagccagggaaaatcttcatgctctgtcatgtag

SEQ ID NO: 30552 - DNA, 582 bp, Artificial Sequence
  Description of Artificial Sequence: Synthetic coding sequence
atggcagcaattaggaagaagttggtgatcgtgggcgatggtgcttgcgggaagacctgccttctcattgttttttctaaggatcaatttccagaggtgtatgtccctacagtgttcgaaaattacgtggccgatatagaagtggatgggaagcaggtggagttagccctgtgggacaccgccggtcaagaggactacgatcgcttgagaccactgagctacccagatactgatgtgatcttgatgtgttttagcattgattcccctgattcacttgaaaacattcctgagaaatggacaccagaggtgaaacacttctgtccgaacgtgcctattatccttgtaggaaataaaaaggacttgcgcaatgatgaacacactcgcagagaactggccaagatgaaacaggagcctgtgaagcccgaagagggacgggacatggcaaataggatcggagcgttcgggtatatggagtgcagtgcaaaaaccaaagatggcgtccgcgaagtctttgagatggcaaccagggcagctctccaggcgcgaagaggcaaaaaaaaatctgggtgcctcgtgctttag

SEQ ID NO: 30553 - DNA, 591 bp, Artificial Sequence
  Description of Artificial Sequence: Synthetic coding sequence
atggctgccatccgtaagaaattggtcgttgtaggtgatggggcatgtggaaagacctgccttctgattgtcttctctaaagatgagtttcccgaggtttacgtgcccactgtgttcgagaactatgttgctgatatcgaggtggatggtaagcaagtagagttagctttgtgggacaccgctggacaggaagattatgatcgtttaaggcctctcagttaccctgatactgatgtgatccttatgtgcttcagcgtagattcacccgattcactggagaacatacccgagaagtgggtgccggaagttaagcacttctgcccaaacgtccctatcattctggtggccaacaaaaaagacctgcgatccgacgaacacgtgcgcactgaactggccagaatgaagcaggagccagtgaggaccgatgatggcagggccatggctgtgcgtatccaagcatacgattatctggaatgtagcgctaaaaccaaggagggcgttcgagaggtgttcgaaacggccaccagggctgcgctgcagaaaagatacgggtcacaaaatggctgcattaattgttgcaaggtgctgtag

SEQ ID NO: 30554 - DNA, 582 bp, Artificial Sequence
  Description of Artificial Sequence: Synthetic coding sequence
atggcagcaatcagaaaaaagttagtaatagttggggatggcgcatgcggtaaaacctgtttgttgatcgtattctctaaggatcagtttcccgaggtatatgtgcccaccgtgttcgagaactatatcgcggatatcgaggtggacggtaagcaagtggagctcgccctgtgggacactgcaggccaagaggactatgaccgtctgaggcccctgtcctatccagacacagatgtgattctcatgtgtttctctatcgattcgccggacagtctggaaaatatcccagaaaaatggacaccagaagtgaagcacttttgtcccaatgttcccattatcctcgtgggaaacaagaaggatctgagacaggatgagcatactaggcgcgagctcgcgaagatgaaacaggaaccagttcgctcagaggagggccgagacatggctaaccggatttcagctttcggatacctcgagtgtagtgccaaaactaaagagggtgtgagggaagtttttgaaatggctactagagccggactgcaggtgcgtaaaaacaagagacgacgcggatgtccgattctgtag

SEQ ID NO: 30555 - DNA, 582 bp, Artificial Sequence
  Description of Artificial Sequence: Synthetic coding sequence
atggccgctatacgcaagaagctcgttattgtgggagatggcgcttgcggaaaaacatgtcttctgattgtctttagcaaagatcagtttcccgaggtgtatgtgccgaccgtgttcgagaactacattgctgatatcgaggtagatggaaagcaggttgaactggccctgtgggacaccgccggacaggaagactacgatagactcaggcctctcagttatcctgacaccgatgtcatcttaatgtgcttcagcatcgatagcccagactccttagagaatatccctgaaaagtggactccagaggtgaaacacttttgtcctaatgtacccatcatattggtgggcaataagaaagacttacgacaggacgaacatacaaggcgcgaactcgcaaaaatgaagcaggagcccgtcaggtccgaggaaggcagagacatggcgaacaggatctcagccttcggctaccttgagtgttcggccaaaacaaaagagggagtgcgcgaggtatttgagatggcgacccgggcagggctgcaagtgagaaaaaacaagagacggagaggctgtccgatcctctag

SEQ ID NO: 30556 - DNA, 582 bp, Artificial Sequence
  Description of Artificial Sequence: Synthetic coding sequence
atggctgcaatccgaaagaaactagtaatcgtgggagacggcgcatgcggcaagacatgcctgttgattgtgttcagtaaagatcaattccccgaggtttatgtgcccaccgtgtttgaaaattatatcgctgatatagaggtggacggtaagcaggtggagcttgcactgtgggatactgccggacaggaggattacgatagactacggcctctgagctaccccgatacagatgtaattctgatgtgtttcagtatcgacagtcctgattccctcgaaaacattccagaaaagtggacccctgaggtcaaacatttttgtccaaatgtgccgatcatactcgtcgggaacaagaaggacctacgacaagatgaacacactcgcagggaacttgccaaaatgaagcaagagccagtccgcagcgaggaggggagagacatggccaaccgcataagcgccttcggttacttggagtgctccgcgaagacaaaggagggcgttcgcgaggtgttcgaaatggctactagagctgggctgcaggttcgcaagaataaaaggaggcgcggatgtccaattctttag

SEQ ID NO: 30557 - DNA, 582 bp, Artificial Sequence
  Description of Artificial Sequence: Synthetic coding sequence
atggccgcaatacggaaaaagctagtgatcgtcggggacggtgcctgcggcaagacctgtttgcttatagtgtttagcaaggaccagttccccgaagtgtatgtccccaccgtcttcgaaaattacattgccgacattgaggttgatgggaagcaagtggagctggccctctgggacaccgcaggacaggaggactatgacaggctgagaccactgagctatcctgataccgacgttattcttatgtgcttctcaatcgatagccccgactcgctggagaacattccggagaagtggacaccagaagtgaagcatttctgccctaacgtgcccatcatcctggtggggaataaaaaggatctgagacaggatgagcatacccgacgggaactcgccaaaatgaaacaggagcctgtgaggtcagaagagggaagagatatggccaatcgaatcagcgccttcggctacctcgaatgctctgctaaaactaaagaaggagtccgcgaagtgttcgagatggccacccgagctggccttcaggtgcggaagaacaagagacggaggggctgccccattctgtag

SEQ ID NO: 30558 - DNA, 600 bp, Artificial Sequence
  Description of Artificial Sequence: Synthetic coding sequence
atggctgcgataagaaagaaactagtgatcgtaggtgatggtgcctgcggcaagacgtgcttgctgatcgtattttctaaggaccaattcccagaggtatatgtgcccaccgtgtttgagaattacatcgccgacatcgaggtcgacggcaagcaggtagaactcgcactctgggacaccgccggacaggaagattatgatagattaaggcccctctcatatccggatacggacgttattctaatgtgcttctcaattgactctcccgacagcttggaaaatatcccagaaaaatggactcctgaggtcaagcatttttgtcccaatgtgcccatcattctggttggtaacaaaaaggatctgcgcaaagccggaacctggaggacaggcagcgtcccactcgcgaccctatccgcacagcctcgccctaggcgggaatgtggcagatgtttgcggtggcccctgggacttgcctcaagaagtgccaggacatccgtcgggggagccgtaccattctcggagattcctaaagcttttccgacatgccctttaccaagtcagggttaccgcaattatcccccaacaacccccgctagttag

SEQ ID NO: 30559 - DNA, 582 bp, Artificial Sequence
  Description of Artificial Sequence: Synthetic coding sequence
atggcagctatccgcaagaagctcgtgatcgtgggggacggggcatgcgggaaaacgtgtctgttgattgtgtttagcaaagatcagtttccagaggtgtacgtgcctaccgtttttgaaaattatattgccgacattgaggtggatggtaagcaagtagagctcgccttgtgggacactgctggacaggaagactacgataggctccggccactgtcttaccccgatacggatgtgattctcatgtgttttagcattgattcccctgacagcttggaaaacattcccgagaagtggacgcccgaagtgaagcacttctgtcctaatgttcccatcattctggtgggaaataagaaagacctgaggcaagacgagcacacacggcgagagctggcgaagatgaagcaggagccagtgcgctccgaagagggacgcgacatggcgaacaggatcagcgctttcggatacttagagtgcagcgccaagacaaaggaaggggtaagggaggtgttcgagatggcaactagggcgggactgcaggtgaggaagaataaaagacgtagaggatgccctatcttgtag

SEQ ID NO: 30560 - DNA, 582 bp, Artificial Sequence
  Description of Artificial Sequence: Synthetic coding sequence
atggctgctattcgtaaaaagctggtgattgtcggggatggtgcatgtggaaaaacgtgcctcctgatcgtgtttagtaaagatcagttcccagaggtttatgtgccaacagtgttcgaaaactacattgccgatattgaagtggatggtaagcaagtcgagcttgcattgtgggataccgccggacaggaagactatgatcgcttacgaccattgtcttatccagatacggatgtgattctgatgtgtttcagtatcgattccccggattccctcgagaatatccctgaaaagtggacacccgaggttaagcatttttgtcctaacgttcccattattctggttggcaacaagaaggacctgcgacaggatgagcacactaggcgggagttagccaaaatgaaacaggagcccgtacgcagcgaagagggacgagatatggccaacagaatttcagccttcggctatctcgagtgcagcgctaagacaaaagaaggggttagagaggttttcgaaatggccactcgtgccggtttgcaggtgaggaagaataaaagacggaggggctgtccaatactctag

SEQ ID NO: 30561 - DNA, 582 bp, Artificial Sequence
  Description of Artificial Sequence: Synthetic coding sequence
atggctgccataagaaagaaactcgtcatcgtcggggacggagcctgtggtaagacctgccttctcatagtcttctctaaagaccagtttccggaggtgtacgttcccactgtcttcgagaattatatcgccgatattgaggtggacgggaaacaggttgaattggccctgtgggacactgctgggcaagaagactacgatcggctcaggcccttaagttacccagataccgacgtaatccttatgtgcttctcaattgactctcccgattccttggaaaacattcctgaaaagtggacccctgaagtgaagcacttctgtcctaatgtgcccatcatcttggttgggaataagaaggacctgcggcaagatgagcacacacgccgtgagcttgccaagatgaaacaggagccagtcagatcagaggaaggacgcgatatggccaatcgaatatccgcttttggatatctggaatgctctgccaagactaaggagggagttcgcgaagtgttcgagatggccactcgcgctggacttcaggtcaggaagaataaacgcaggcggggatgtcccatcctctag

SEQ ID NO: 30562 - DNA, 279 bp, Artificial Sequence
  Description of Artificial Sequence: Synthetic coding sequence
atggcggctatccgaaaaaagctagtcattgtcggcgacggggcatgtggaaaaacctgtctgctgatagtcttctccaaggatcagtttcccgaagtctacgtgcccacagtcttcgagaattacatagctgatatcgaggtcgacgggaagcaagtcgaactcgccctgtgggatacagccggacaggaagactatgatagactcagaccattgtcttaccccgatacggatgtgatcctaatgtgcttttccattgatagccctgatagcctgtag

SEQ ID NO: 30563 - DNA, 570 bp, Artificial Sequence
  Description of Artificial Sequence: Synthetic coding sequence
atggccgctatcagaaaaaaattggtgatagtgggagacggggcatgtggaaaaacttgccttcttattgtgttctcgaaggaccagtttccggaggtatacgtccctacagtttttgagaactacatagcagacatcgaagtcgatggaaagcaggtggaattggccctgtgggacactgccggacaggaagactatgacaggctgaggccactgagttacccagatactgacgtaatcctcatgtgcttctccatagactctcccgatagcctcgagaatatcccagaaaagtggacgcctgaagtaaagcatttctgtcctaacgtgcctatcatcctcgtggggaataagaaggacttgaggcaagacgagcatactcggagggagctcgctaagatgaaacaggaacctgtaagatccgaggagggaagggatatggccaaccgcatatctgcgtttgggtatttggaatgctccgcaaaaactaaggagggcgtcagagaggtgtttgaaatggccacgcgtgccggtcttcaggttcggaaaaacaagaggcggagaggatag

SEQ ID NO: 30564 - DNA, 384 bp, Artificial Sequence
  Description of Artificial Sequence: Synthetic coding sequence
atggcggcaattcgcaagaaactagtgatcgtgggcgacggcgcttgcggcaagacatgcctgctgattgttttcagtaaggaccagtttcctgaggtgtacgtgcctacagtctttgagaactatatcgccgatatcgaggtggacggaaaacaagtggaattggctttatgggatactgctgggcaggaggactacgatcgcttacgtccgctgtcctatccagacaccgacgtcatcctgatgtgctttagcattgactctcctgacagcctggagaatattcctgagaagtggacccccgaggtgaaacatttttgtcctaatgtcccaatcattttggtgggaaataagaaggacttgcggcaagatgagcatacatag

SEQ ID NO: 30565 - DNA, 690 bp, Artificial Sequence
  Description of Artificial Sequence: Synthetic coding sequence
atggtatccatatccggcggagatcttcccacaggactggacttcatatcagccccagagccggctctgtccagctgttctctggggacgagcgctggctggtctccaacaatggctgctattcgcaagaaactggtcatcgtgggggatggggcatgcggcaaaacctgcctccttatcgtctttagcaaggaccaattccccgaagtgtacgtgccgactgtttttgagaattacattgcagacattgaagtcgacggcaaacaagtggagttggctctgtgggataccgccggacaggaggactatgaccggctgcgtcctctgtcataccccgatactgacgttatcttgatgtgcttctccattgacagtcccgatagcttggagaacatacccgaaaaatggacgcctgaggtcaaacacttctgtcctaatgtgcctatcatcctggtgggcaataagaaagacctccggcaagacgaacacaccagacgcgagcttgccaaaatgaagcaggagccagtcagatcagaggaaggcagagacatggcaaatcgcatctcagccttcggctacttagagtgttctgccaaaaccaaagaaggcgtgagagaagttttcgaaatggccacccgggctggacttcaggtgaggaagaataaacggaggagagggtgtcccatctag

SEQ ID NO: 30566 - DNA, 510 bp, Artificial Sequence
  Description of Artificial Sequence: Synthetic coding sequence
atggcagctatccggaagaagttagtgattgtgggtgacggagcctgcggcaaaacctgtctgctgattgtattctccaaggatcagtttcctgaagtgtacgtgccaacggttttcgagaattatattgccgacattgaagtggacggcaagcaggtggaattagctctttgggatacagccggacaggaggattatgatcgcctgcgccctctcagctatccggacaccgacgttatcctgatgtgtttttctatcgacagccccgactccctggagaatattcctgaaaaatggacacccgaggttaagcacttctgcccaaatgtacctattatactagtggggaacaagaaggacttgaggcaggatgaacacaccagacgggagctggccaaaatgaaacaggagcccgtacgttcagaagaaggcagagatatggctaataggataagtgcattcggatacttggagtgcagtgcaaagacaaaagagggggtgagggaatag

SEQ ID NO: 30567 - DNA, 3144 bp, Artificial Sequence
  Description of Artificial Sequence: Synthetic coding sequence
atgatggccgcagaggctgggtcagaggaaggaggccctgtcaccgccggagcagggggtgggggagcggctgctggatcctcggcctaccctgccgtatgtcgtgtcaagattccagccgcactgcccgtcgcggctgcgccttatccaggactggtagagaccggggtggccggtactctggggggaggagccgctttgggtagcgagtttctaggcgcagggtcagtggcaggagcccttgggggagctggactgactggaggcggtaccgcagctggggtagcgggagctgcagccggagtggccggagctgcggtagcgggtccgtccggcgatatggccctgaccaagttgccgacatcacttctggctgaaacacttgggccaggtggcggattccctccactcccccctcctccgtatcttcccccactgggggctggactgggcacagtcgacgaaggagattcattggatgggcctgagtatgaggaagaggaggtggcgatcccactgacagccccacctacaaatcagtggtatcacggaaagctcgatagaaccatcgcagaggaaaggctccggcaggccggaaagtccggatcatatctgatacgtgaatctgacagaaggccgggatccttcgtgctgtcctttcttagccagatgaacgtagtgaaccattttagaattattgcgatgtgcggagattattacatcggaggacgaaggtttagttcactgagcgatctgatcggctactattctcacgtcagttgtctgcttaagggtgagaaacttctctacccagtggcaccacccgaaccagttgaggatcggcgacgagtgcgggcaatcttgccctatacaaaggtccccgatacggatgagataagtttccttaagggcgatatgttcatagtccacaacgagctggaggacggctggatgtgggtgaccaaccttagaaccgacgagcagggccttattgtagaggatttggtggaagaggttggacgtgaagaggatccccacgaggggaagatctggtttcacggcaaaattagcaaacaggaggcatataatctactgatgaccgtgggtcaggtatgtagcttcctggttagaccgtccgataacactcccggagactattccctgtacttccgcactaacgaaaacattcaacggtttaagatctgtccaacgccgaataatcagttcatgatgggaggcagatactataattctatcggtgacatcattgatcactacaggaaggagcaaattgtggaggggtactacctcaaagagccagtccctatgcaggaccaggaacaggttttgaacgatacagtcgacgggaaagagatctacaacacaatccggagaaagaccaaggatgccttctataagaacattgtgaagaagggctacctgctgaaaaagggaaagggcaagcggtggaagaatctatactttattctcgaggggagcgatgctcagctgatctattttgagtcagagaaacgtgccaccaagcctaaaggcctaatcgatctatccgtttgctccgtgtacgttgttcatgatagtctgttcgggagaccaaactgttttcagattgtggtgcagcacttttcagaggagcattacatcttctacttcgctggtgagaccccggagcaggcggaggattggatgaaggggctccaagctttttgtaatttgcggaagagctctcctgggacctccaacaaaaggttacggcaagtctccagcctggttctgcatattgaggaggcccacaagctgcctgtcaagcactttaccaatccatattgcaatatttacctcaacagtgttcaagttgcaaagacacacgcacgcgaaggccagaacccagtgtggtcagaggagtttgtgtttgacgacttacccccagatatcaatcggttcgaaattacactgtccaataaaacaaagaagagtaaggatcccgacatcctctttatgcgctgccagctcagcaggctgcagaagggccacgccacggatgaatggtttctgctgtccagtcacattcctcttaaaggcatcgaacccggatctctccgggtcagagcaagatactccatggaaaagatcatgcccgaggaggaatactccgaattcaaggagctgattcttcagaaagagctacacgtggtatatgccctctcacacgtttgtggacaggatcgaactttgcttgcctcgatcttgctgcgcatctttcttcacgagaagctggaaagcctactgctgtgcaccctgaatgatcgcgaaatcagcatggaggacgaggccaccactttattccgcgcaacaactctagcatccactttgatggagcagtacatgaaggccaccgccactcaattcgtgcaccacgccctcaaggactcgattctgaagatcatggagagtaaacagtcctgcgagctctccccctcaaagctcgaaaagaacgaggacgtgaacacgaatctgacccaccttctcaatatcttatccgaactagtggaaaagatctttatggcttccgaaattctgccccctacattgaggtacatttatgggtgcctgcagaagtctgtccaacacaagtggcctactaataccacgatgaggactagagtcgtgagcggattcgtgttcttacggctaatatgtcccgctatcctgaatccgagaatgttcaatatcatatcagatagcccttcccctatcgccgctagaacactgattttggtagccaagtccgtccagaacctggcaaatctggtggagttcggtgcaaaagagccgtacatggaaggggttaaccctttcatcaagtccaacaaacacaggatgataatgttcctggacgaactcggaaacgtgccagaactcccagatacgacagaacattcgcgaactgacctgagcagggatctggctgctctgcatgaaatctgcgtggcgcactccgatgaattgcgaacccttagtaacgagaggggcgcacagcagcacgtgttaaagaaacttctggccataacagaactactgcaacagaagcaaaaccagtacaccaagacaaacgacgtccggtag

SEQ ID NO: 30568 - DNA, 2613 bp, Artificial Sequence
  Description of Artificial Sequence: Synthetic coding sequence
atgaaagggtggtatcacgggaagttggacagaacaattgcggaggaaagattgagacaagcgggtaaaagcggttcatatctaataagggagtccgacaggcgtcccggatcatttgtgctgagcttcctcagccagatgaacgttgtcaaccactttaggattatcgccatgtgcggggattactatatagggggtcggcgattcagctccctttccgatctgattggatactactcgcacgtttcttgcttgcttaaaggcgagaagctgctatatccagtggctcccccagagcctgtcgaggaccgacgacgtgtccgggctatactcccatatacgaaagtccctgacactgacgaaatctccttcctgaagggtgacatgtttatagtgcacaacgagttggaagatggctggatgtgggtgaccaacctcagaacggacgagcagggactcatcgtcgaagacctggtggaggaagtgggacgcgaggaggatccacacgagggcaagatttggttccacggaaagatcagcaagcaggaggcttacaatctgcttatgactgtgggccaggtctgttcgttcctggttcgcccttcagataatactccaggggactattccctgtacttccggacaaacgaaaatatccagcgatttaagatatgcccaacacccaacaatcagttcatgatgggtggacgctactacaatagcatcggcgacataatcgaccactataggaaggagcaaattgttgaagggtactatcttaaggagcccgtgcctatgcaggaccaggagcaggtgctaaacgatactgtggacggcaaggaaatctacaatactattcgtaggaagaccaaagacgccttctataaaaatattgtgaagaagggctacctgctcaagaaaggtaagggcaagagatggaaaaacctgtacttcatactcgagggttctgacgcccagctaatctacttcgagagcgagaagcgcgctacaaaaccaaagggcctgattgatctgtctgtgtgtagtgtttatgtggtgcacgacagcctgtttggacgcccaaattgctttcagattgtggtgcaacacttttctgaggagcactacatcttttactttgctggtgagactcctgaacaggccgaggactggatgaaaggcctccaggccttctgtaatctgagaaaatcttcccccggtaccagtaataagcggcttcgccaggtcagctccctggtgctccatatcgaagaagcccacaaattgccagtgaagcacttcaccaacccttattgtaacatatacttgaattcagtgcaggttgccaagacacacgccagggaaggccagaaccccgtctggagcgaggaattcgtctttgacgatctgcccccagacataaatcgtttcgagattacactgagcaataagaccaaaaagtcaaaggaccccgacattttgttcatgaggtgtcagctgtctcggctgcaaaagggccatgcgaccgacgagtggtttctactctcatcccacattcctctgaaagggattgaaccaggttcattgcgggtgagggccaggtactcaatggagaaaattatgcctgaggaagagtattctgaatttaaagagctcatcctacagaaagaactgcacgtcgtttacgctttaagtcacgtgtgtggccaggatcgcacactgctcgctagcattctgttacgtatctttctccacgagaaacttgagtccctgcttctttgcaccttgaacgacagagaaatctcaatggaagatgaggcaaccacgctgtttagggccacaactctggcaagcactctgatggagcagtacatgaaggctactgccacccagttcgtgcatcacgcattgaaggattctatcctcaagatcatggagtctaaacagtcgtgcgagttaagcccgagcaagttagagaaaaacgaggatgtgaataccaatctaacccatctcctcaatattctgagtgagttggtggagaaaatcttcatggccagtgaaattctaccgcctactttaaggtatatttacggctgccttcagaagtccgtgcagcacaaatggccaacaaacacaacaatgcggactagagtggtttcaggattcgtgtttctgcgacttatttgccctgcaatactgaatcccaggatgttcaatatcatcagcgactcaccatcccccattgctgctcggactttgattttggtagccaagtcagtacaaaatctggcaaatcttgttgagttcggcgcaaaggaaccatatatggagggagtcaatcccttcattaagagtaataagcataggatgatcatgtttcttgacgaactgggtaatgtgccagagcttccagacaccaccgaacatagccgcactgacctgtcacgggatcttgctgccctccatgaaatctgcgttgcccattccgacgagcttcggacactgtctaatgagcggggagcacagcagcacgtcctgaagaagctattggcaatcaccgagcttctccaacagaaacaaaaccagtacacgaaaaccaacgacgtaagatag

SEQ ID NO: 30569 - DNA, 2646 bp, Artificial Sequence
  Description of Artificial Sequence: Synthetic coding sequence
atgtgtcttgtgaagagctggtttctgtcaatcaggtctcgctggtaccatggcaagctagacagaacgatagccgaagaacgacttcggcaagccggtaagtctggctcctacctgattagggaatcggatagacgcccaggttcctttgtactgtcattcctctcacagatgaatgttgtgaatcacttcagaatcatcgcaatgtgcggggattactacatcggcggaagaagattttcttcgctgtccgacttaatcggatattattctcacgtttcctgcctacttaagggtgagaaactgctttaccccgttgcacccccagagcccgtggaagatcggcgacgggttcgcgctatcttaccatacacaaaagttcccgatacggacgagatctcgttcttgaagggggatatgttcattgtgcataacgagttggaagacgggtggatgtgggttacaaatctgaggaccgacgaacaagggctcattgttgaggatctcgttgaggaagtaggacgcgaagaggatccccatgagggcaagatctggttccacggcaagatttcaaagcaggaggcttacaacctactgatgactgtcgggcaagtgtgctcttttctcgttaggccgtccgacaatacacctggagattattcactgtattttcgcaccaacgagaatatccagcgcttcaagatatgtccgacacctaacaaccagtttatgatgggagggagatattacaactcgatcggtgacatcatcgaccactaccgtaaagagcagatagtggagggctattatctgaaggagcctgtgcccatgcaggaccaggagcaagtactgaacgacacagtcgacggtaaggagatttataacaccatccggcgaaaaacaaaagatgccttctataagaacatcgtgaagaagggctatctcctcaagaaaggcaaaggcaagcgctggaaaaacctgtatttcatccttgagggttctgacgcacagctaatttactttgaaagcgagaaacgcgcaactaagccaaaaggacttattgacttgtctgtgtgctccgtgtatgtggtgcatgacagcctcttcggcaggccaaactgttttcaaatcgttgtgcagcatttctctgaggagcactacattttttatttcgcaggagagactccagagcaagccgaggactggatgaaggggctccaggccttttgcaacctcaggaagagctcgcccggaacatctaataagagactacgccaggtcagctcccttgttctccacatcgaagaggcgcacaagctccctgtaaagcatttcacaaacccttattgtaatatctatctgaatagtgtgcaggtggctaaaacgcatgccagagaaggacaaaaccccgtttggtcagaagagttcgtgttcgacgatctccccccagacatcaaccgctttgagatcactttgtcaaacaaaaccaaaaagtccaaggacccagacatcctcttcatgagatgccagctgtcgaggttacagaaaggccatgctactgacgaatggtttctgctatccagccatatcccactcaagggaatcgagccaggatccctgagggttagggccaggtactcgatggagaaaatcatgcctgaagaggagtacagtgaattcaaggagttaatccttcagaaggagttacacgtagtatacgccctctcacatgtgtgcgggcaggaccgcacccttctcgccagcattctgttacgtattttcctacacgaaaaactggaatcccttcttttatgcaccctgaacgaccgcgaaattagcatggaagatgaggctacgacacttttccgggctaccaccctggcatctacccttatggaacagtacatgaaagcaaccgctacccaatttgtgcaccacgccctgaaggatagtattctcaaaattatggagagtaaacagtcctgcgagctttctccatccaaactggagaaaaatgaggacgtcaacacaaatctgacgcacctgctgaatatactgagtgaactcgtcgaaaaaatatttatggccagtgaaattctaccccctaccttaagatacatttacggctgtctgcagaaatctgttcagcataagtggcccactaatacgaccatgcgcacaagagtggtgagcggattcgtttttctgcgtcttatatgtcccgctatacttaacccacgaatgtttaacatcataagtgactccccaagcccaatcgctgcacgtacgcttatactggttgccaaatccgtgcagaaccttgctaatctagtcgagttcggtgccaaagagccgtacatggagggcgtcaatccctttatcaagtcaaacaagcatagaatgataatgtttctggatgagcttggaaacgttccagagcttcctgatacaaccgagcactctcggaccgatctgtcacgcgatctggctgccctccacgagatctgtgtggcacactcagatgagctcagaaccttaagcaacgagcggggtgcacaacagcatgtcctgaaaaagctgctagctatcactgaactgctccaacagaagcagaatcaatatacgaagacaaacgacgtgcgttag

SEQ ID NO: 30570 - DNA, 2643 bp, Artificial Sequence
  Description of Artificial Sequence: Synthetic coding sequence
atgcggaccggatattcaagcgtacccagcaaactgcggtggtaccacgggaagctggacagaaccatcgcagaggagaggctgagacaggccggaaaaagcggatcctacctcattagagaatcagacagacgtcccggttcctttgtactgtcatttttatctcagatgaacgttgttaatcacttccgcataattgctatgtgcggagactattacattggcggacggaggttcagcagcttgtccgatctgattggttattactcccacgttagctgcctgcttaagggggaaaagctcctgtaccctgtggcccctccagagcctgtcgaggataggaggagagttcgcgcaattctcccttatacaaaggtacctgataccgacgagatctcattcctgaagggcgatatgtttatcgtccacaatgaattggaggacgggtggatgtgggtaacaaacttgcgaacagacgagcagggtctaatcgtggaggacctggtagaggaggtaggcagagaggaagaccctcacgaaggtaagatctggtttcacggaaagatttcaaagcaagaagcctacaaccttttgatgacagttggccaggtttgctctttcttagtgcgtccttcagataatacccctggtgactatagtctttacttccgtacgaatgagaatatacagcgtttcaagatctgtcccacccctaataatcaattcatgatgggcggacgctattataactccatcggcgacataattgatcattacagaaaggagcaaattgtcgaaggctactatctgaaagagccagttcctatgcaggaccaggagcaggtcttgaacgacacagtcgacggaaaggagatttacaatacgatcagaagaaaaactaaagatgctttttataaaaatatcgtcaagaaaggatacctcttaaaaaaggggaagggcaagaggtggaagaacctgtatttcattcttgagggaagtgatgcacagctaatctatttcgagtcggaaaagcgggcaacaaagcctaagggactcatcgacctgtccgtgtgctcagtgtacgtggttcacgacagtttgtttggccgtccaaattgcttccagatcgtggttcagcacttcagtgaagagcactacatattttactttgcaggcgaaaccccagaacaggcggaggattggatgaagggtctgcaggctttctgcaatttacggaagagcagccctggcacctccaataaacgcttaagacaggtatcgtccctggtgttacacatcgaagaggcacataaactgccagtaaaacatttcacaaatccttattgcaatatctacctgaactctgtgcaggttgctaagacacatgcacgcgaagggcagaatcctgtttggtccgaggagtttgtttttgacgaccttccacctgacataaaccgctttgagatcacactcagcaataaaactaaaaagtctaaggatcctgacatattattcatgcgctgtcagctgtctagactgcagaagggccacgccaccgacgagtggtttttattgagttcccacatacccctcaagggtatcgagccgggatccctgagggtccgagcacgctattcaatggagaaaattatgcctgaagaagagtacagcgagttcaaagaattgatcctgcagaaagaattgcatgtggtgtacgcattgtcacacgtgtgtgggcaagatcgcaccctgttagcttcaatactgctgagaatattcctgcacgagaaacttgaatccctgcttttatgtacgctgaacgaccgtgaaatctctatggaggatgaggccaccacactgttccgggcaactaccctcgcctccaccctcatggagcagtatatgaaggccaccgctacgcagttcgtgcatcacgccctgaaagactcaattctgaagattatggaatctaaacagagttgtgagctttcaccctccaagctggagaagaacgaggatgtgaacacaaatctgacccacctgctgaacatactctccgagttggtggagaaaatttttatggccagtgagatcttaccacctactctaaggtacatttatgggtgcctgcagaagtccgttcagcacaagtggcccaccaacaccaccatgcgcacccgagtcgtgtctggattcgtgttcctgagactcatctgccctgcaatactcaatcctcgtatgtttaacatcatctcagactccccctcacccatagcggctagaacattgatactcgtcgctaaatctgtccagaatttggcaaacctcgttgagttcggcgcaaaagaaccctacatggagggcgtgaacccttttattaagagtaacaaacatcgtatgatcatgttcctagacgaactgggcaacgttcctgagctccctgataccactgagcactctcgcacagacctgagccgggacctcgccgcattgcatgagatctgcgtagcccattccgacgagctccgaaccctctctaacgagcgaggagcgcagcagcacgtgctgaaaaagctgctggcaatcactgaattactgcaacaaaagcagaaccagtacacgaaaacaaacgacgtcaggtag

SEQ ID NO: 30571 - DNA, 2616 bp, Artificial Sequence
  Description of Artificial Sequence: Synthetic coding sequence
agaggagacgccagcggttgggggtgcagcgaacctgggcctggtggcccttgggggtcgcgggctggcagggtagggcaatcaagggctggatttaacatgatggcggcagaggctggctccgaggagggcggacccgtgacagccggagcgggaggagggggtgccgcagcgggaagctccgcttatccagccgtgtgtagagttaagatacctgcggctctacctgtcgccgcagccccttaccctgggctcgtggagactggtgtggctggtactctggggggtggagcggcactggggagtgagttcttaggcgcaggctcagttgccggagctctcggtggtgccggtctgaccggagggggaacggccgcaggtgtcgccggagcggcagcaggagtggctggggctgccgtagctgggccaagcggagatatggctcttactaaactgcccactagcctgttggctgagactctggggccagggggaggatttcccccattaccgcctccgccatatcttccaccactcggggcaggactcggcactgtagatgagggagacagtcttgatggcccagagtatgaggaagaggaagtggccattcccttaactgccccacctaccaatcagtggtaccacggcaagttagatagaaccatcgccgaggagcggcttagacaagctggtaagtccggaagctacctgatccgagagtctgaccggagaccagggtcattcgtgctttcctttctcagccagatgaatgtggtgaatcatttcagaattattgcaatgtgcggggattattatattggagggcgaaggttttcatctctcagcgacctcatcggttactacagccacgtgagctgcctcttgaaaggcgagaagctgctttaccccgtcgcccctcccgagccggtggaggatcgcaggagagtgcgagctatcttgccctatacaaaggtgccggatacagacgaaatttcgttcttgaagggagacatgttcatcgtgcataacgaactggaggatggttggatgtgggtaactaacctgcgtaccgacgagcagggtttgattgtagaagacctggtggaagaggtaggcagggaggaggacccacacgaaggaaagatctggttccacggcaagatatccaaacaagaggcctacaatctgctgatgaccgttgggcaagtctgttccttcctggtgaggccatccgacaatacccctggtgattatagcctgtactttcgcaccaacgagaatatccagcgcttcaaaatatgccccacccctaacaaccagttcatgatgggtggacgctattacaatagtattggagacattatcgaccactaccgaaaggaacagattgtagaaggctattatctcaaggaacccgtccccatgcaggaccaggagcaggttctgaacgacacagtggacggtaaggagatatacaatacaatccgtcggaagactaaggacgcattttacaaaaacatcgtaaaaaagggctatctcctgaagaaagggaaaggcaaaagatggaaaaatctttacttcatcctggaaggttccgatgctcagctcatttacttcgagtccgagaaacgcgctacaaagccaaagggattgatcgatctcagcgtgtgctctgtgtacgtggtgcacgatagcctgtttggtcggcctaactgcttccaaattgtagtgcaacactttagcgaggagcactatattttctactttgccggtgaaacccctgaacaggctgaagactggatgaaaggactccaggctttttgcaacctgcgaaagtcgagccccggtacctccaataagagactccgccaagttagcagtctggtactccacattgaagaagcacacaaactgcctgtaaaacactttacaaacccgtattgcaacatctaccttaactccgtccaagtggccaaaactcacgctagggaaggacagaaccccgtgtggtccgaggaattcgtgttcgatgacctgcccccagatatcaatcgttttgagatcactctgagcaacaaaacaaaaaagagcaaagacccagacatcctgtttatgcggtgccagctgagccgtttgcagaaggggcatgccactgacgagtggtttttgctctcttcacatattccactgaagggcatagagcctggaagtctgcgggtgagagcccgttattccatggagaagattatgccagaagaggaatattcagaattcaaagaattaatcctgcaaaaagaactccacgtggtctacgctctgtcccacgtgtgcggtcaggatagaacactcctcgcgtcaatcctgctcagaatcttcctccacgagaaacttgaaagcctcctcctgtgcaccctgaatgacagagagattagcatggaggatgaggcaaccacactgttccgcgctaccacacttgcaagcacgctcatggagcaatatatgaaagctactgcaacgcagtttgttcatcatgcactgaaggactctatcctgaaaatcatggagtctaagcaatcttgcgagctcagcagcagcaagctgcagaaggcatag

SEQ ID NO: 30572 - DNA, 1161 bp, Artificial Sequence
  Description of Artificial Sequence: Synthetic coding sequence
atgaatccacagatccgaaatccaatggagagaatgtacagggacaccttttatgataacttcgaaaatgaacctatcttatacggaagatcatatacatggctctgttacgaggtgaaaataaagcgaggcagaagcaatctgttatgggacactggagtttttcgtggccctgtgctgcctaaacgtcaatctaaccaccggcaggaagtgtactttaggttcgaaaaccacgctgagatgtgttttctgtcctggttttgcgggaaccggctcccggctaacagacggtttcagattacatggttcgtatcttggaatccctgcctgccatgcgttgttaaagttaccaaatttcttgcagagcacccaaatgtgaccctaacaattagcgccgctcgtttatattactaccgcgatagagactggcgctgggttctgttacgcctacacaaggccggagccagggtcaaaatcatggactatgaagattttgcctactgctgggaaaatttcgtgtgcaacgagggtcaaccttttatgccttggtacaagttcgatgataactacgcttcactacaccgaacactgaaagagatcctgagaaatcctatggaggctatgtacccacacatcttctacttccacttcaaaaacctgctgaaagcatgtggaagaaatgagagctggctttgctttaccatggaagttactaaacatcatagcgctgtgtttagaaaacgaggagtatttaggaatcaggtggatccggagacacactgccacgctgaaaggtgttttctcagttggttttgcgacgacattctgagccctaacaccaattacgaagtgacctggtacacttcctggtctccatgtcctgaatgcgcgggtgaagtggctgaatttctcgctcgccactccaatgttaatttgaccatctttaccgccaggctgtgttacttttgggatacggactaccaggaaggtctgtgctccctcagccaggaaggggcttcagtgaagataatgggatacaaggatttcgtgtcatgctggaagaatttcgtctactctgacgacgagccttttaaaccttggaagggtcttcaaacaaactttaggctgttaaaaaggaggctccgggagattctgcagtag

SEQ ID NO: 30573 - DNA, 348 bp, Artificial Sequence
  Description of Artificial Sequence: Synthetic coding sequence
atgggcggttcactgcgagtagccgttcttggggctcccggtgtgggaaagaccgccattataagacaatttctgtttggtgactatccggagagacatcggcctacagatggaccaaggctgtaccgcccagcagtgctgctcgacggagctgtctacgatctatctataagagacggggatgtggctggaccgggatcaagccccggaggtccagaagagtggccggatgcaaaagattggagcctccaggacaccgacgcattcgtcttagtgtatgatatctgcagccccgattcgttcgattatgttaaggcactgaggcagaggatcgcggaaacacggtag

SEQ ID NO: 30574 - DNA, 579 bp, Artificial Sequence
  Description of Artificial Sequence: Synthetic coding sequence
atgcaggctatcaagtgcgtggttgtgggagacggtgccgtaggcaagacgtgcctgcttatcagttacaccacaaacgctttccccggagagtacatcccgaccgtgttcgacaactactccgctaacgttatggtggatggcaagcccgtaaatctgggcctctgggacacggctgggcaggaggactatgacagactgcggccactttcgtatccccagacagatgtgtttctaatttgtttctccctggtgtctcccgcatccttcgaaaatgtacgggctaagtggtacccggaggtccgccaccactgccccaatacacccattattctcgtaggaacgaagttggatttaagagacgataaggataccattgagaaactgaaagagaagaagctaactcccatcacttatccacaggggctggccatggctaaagaaataggcgctgtgaagtacctggaatgttccgccctgacccagcgcggactgaaaaccgtgttcgacgaagccatccgtgccgtcctgtgtcctcctcccgtgaagaaacgaaagcgtaagtgtctgctcctgtag

SEQ ID NO: 30575 - DNA, 636 bp, Artificial Sequence
  Description of Artificial Sequence: Synthetic coding sequence
atgcaggctataaagtgtgtggtggtgggggacggagccgtcggcaaaacctgcctgcttatcagttacaccactaatgcattcccaggcgagtatatacctaccgtgttcgataattattcggcaaatgtcatggtggacggtaagcctgtcaacctaggtctttgggacaccgcgggacaagaggattatgacaggctcaggccgttaagttatccccagactgtcggggaaacctatggcaaagatataacgtccagggggaaggataagcctatcgctgacgttttcctgatctgcttcagccttgttagccccgcttcatttgagaacgtgagggccaagtggtatccagaggtaaggcatcattgtcccaataccccgatcatcctggtgggtaccaaactggatcttagagacgataaagacaccattgagaagctgaaggagaagaaactcaccccaataacctacccacagggtcttgctatggcaaaagagattggcgctgttaagtacctcgaatgcagcgctcttacccagagaggcttgaagactgtgtttgacgaggctatccgcgcagtactgtgccctcccccagtgaaaaagagaaaacgcaaatgcctgctgctctag

SEQ ID NO: 30576 - DNA, 579 bp, Artificial Sequence
  Description of Artificial Sequence: Synthetic coding sequence
atgcaggccatcaagtgtgtggttgttggcgatggcgctgtcggtaagacctgtctgctcatcagctataccaccaatgccttccccggagagtatattcctaccgtgttcgacaactatagcgctaacgtgatggtcgacagtaaaccagttaatcttgggctatgggacaccgctggccaagaggattatgatcgactgaggcccctgtcatatcctcagactgatgtgttcctgatctgtttctccttggtttccccagcatcttacgagaacgtgagggccaaatggtttccagaagtcaggcaccattgccccagcacccccatcatcctggtcgggaccaagctggacctgagagatgacaaagacactattgagaagctcaaggagaagaagttagccccaattacttatccccagggactggccttagcaaaagagattgactctgtgaagtacctcgaatgctccgctctgacccagaggggcctgaagacggtctttgatgaagccatcagggccgtcctgtgtccccagccaacacgtcagcaaaagagggcgtgttctctgctctag

SEQ ID NO: 30577 - DNA, 261 bp, Artificial Sequence
  Description of Artificial Sequence: Synthetic coding sequence
atgcaggccatcaagtgcgtggtcgttggtgacggggcagtgggtaagacatgtctgctgatctcctatactacaaacgcctttcccggagaatacattcctactgtgccgggaaggccatgtgccctgctgcaagatgcagaagccggattgtcatccgatgttgaaggcgcttgctggtgtcaaacacaggaaggacgcatgacaggtgaggcccctgcaccaccatggccagccctacggggaccgcatcactcttag

SEQ ID NO: 30578 - DNA, 558 bp, Artificial Sequence
  Description of Artificial Sequence: Synthetic coding sequence
atgcaagccattaaagccgtcggaaagacctgcctgctgatcagctacacgaccaatgcctttcccggtgagtacataccaacggtgttcgataactacagcgcgaatgtgatggtcgacagtaaacctgttaatcttggactctgggacaccgcagggcaggaggattacgacagattaaggccactgtcttacccccagactgacgtctttcttatttgtttttcgctggtctcaccagcatcatacgagaacgtgcgggcaaagtggttcccagaggtgagacaccactgccctagcacaccgattattctggtggggactaagctcgacctccgcgacgataaagatacaatcgagaaactgaaggaaaaaaagctggctccaatcacttaccctcaggggctcgctttggcaaaagagatagattcagtgaaatacctggaatgcagtgcgctcacacagagagggctgaaaaccgtttttgacgaagcgattcgggcagtgctctgcccccaacccacccgccagcagaagagagcgtgcagcctgctctag

SEQ ID NO: 30579 - DNA, 447 bp, Artificial Sequence
  Description of Artificial Sequence: Synthetic coding sequence
atggtagactccaagccagtcaatcttgggctgtgggataccgcagggcaggaagactatgatagactgagaccgctctcctatccccaaaccgacgtgttcctgatatgtttttcactggtgtccccagcctcttatgaaaacgtcagagccaaatggtttcctgaagtgagacatcactgcccttccacaccaataattcttgtcggtacaaagttagaccttagagatgacaaggacactatcgaaaagctcaaagagaagaaactggctccgataacttacccgcaaggactcgctttggcaaaagaaattgactccgtgaaataccttgagtgttcagctctgacacagcggggactcaagaccgttttcgatgaagctatcagggccgttctgtgtcctcagccgacccggcaacagaagagagcctgtagccttctctag

SEQ ID NO: 30580 - DNA, 501 bp, Artificial Sequence
  Description of Artificial Sequence: Synthetic coding sequence
atgcaagctattaagtgcgtcgtcgttggtgacggagccgtcggaaaaacatgcttactgatcagttacactacaaatgcctttccaggagagtatatacctacagtgtttgacaactatagtgcaaatgtcatggtcgactctaaacctgtcaacctgggactctgggacacagccggacaggaagattatgaccgcctaagaccactgtcgtatccccagaccgatgtgttcttgatttgtttttccctagtgagccctgcatcctacgagaatgtgagggccaaatggttccccgaagtccgccaccactgccctagcacgccgataattctcgtggggacgaagttagatctgcgggatgacaaagatacaatcgaaaagctgaaggaaaagaagcttgctccaattacgtatccccaggggttagcactcgctaaggagatcgattcagtgaaatatctagagtgctcagctcttacccagagaggtctaaagtag

SEQ ID NO: 30581 - DNA, 4785 bp, Artificial Sequence
  Description of Artificial Sequence: Synthetic coding sequence
atgaagctctatgtgtttctcgtcaataccgggacaacactgacttttgatacagaactgactgtgcagaccgtggctgatttgaagcacgctattcagtccaagtacaaaattgccatccagcaccaggtcctcgttgtgaatggcggagagtgcatggcggctgacagacgggtgtgcacttatagcgctggaacagacactaatcctatctttttgtttaacaaggaaatgatcctgtgcgaccgtcctcccgcaatccctaagactactttttcaacggagaatgacatggaaatcaaggtggaggagagcctaatgatgcctgctgtgttccatacagtcgcctcgcgtacacagcttgcgttagagatgtacgaggtggccaaaaaactctgtagtttttgcgaagggttggtgcatgacgaacacctgcaacatcagggttgggcagccataatggctaatttagaggattgcagtaattcgtaccaaaaacttctattcaagtttgagtccatctacagtaattacttacagtcaattgaggacattaaattgaaactgacacacctgggcaccgccgtgagtgttatggctaaaataccgttacttgaatgcctcaccagacattcttaccgtgagtgcctgggcagactcgacagcctgccggaacacgaggacagtgagaaagctgagatgaagaggagcacggaactggtgctgtccccagatatgccaagaaccacaaatgaaagccttctcacatccttccccaagagcgtggagcacgtatcgccagacaccgctgatgccgagtccggaaaggagattagagagtcttgccagtccaccgtacaccagcaggacgagactaccattgatactaaagacggggacctgccatttttcaacgtatccctcttggattggatcaacgtgcaggatcgccctaacgacgttgagtcattggtacgcaagtgctttgactcaatgtcccgcctggatcctagaatcattcggccattcatcgcagagtgtaggcagaccattgccaagctggacaatcagaatatgaaggctattaaaggtcttgaggacagactctacgctctggaccaaatgattgcctcatgcgggaggctcgttaatgagcagaaggaactggcccaaggcttccttgccaaccagaaacgggctgaaaacctgaaggatgcctcggtgcttccggacttatgcctttcacacgctaatcagttaatgataatgctacagaaccacagaaaactactcgacattaaacagaaatgcactactgctaagcaggagctggcaaacaatctacacgttagactgaagtggtgttgcttcgtgatgctgcatgcggaccaagatggagagaaattgcaggccttgttgcggcttgttatcgagctgctggaaagggtcaaaattgtggaggccctttcgactgttccgcagatgtattgcctcgcggtcgttgaagtggttaggcggaagatgttcatcaaacactacagagagtgggccggtgcattggtgaaggacggaaagagactttatgaagccgagaaaagcaagagggaatccttcggaaaacttttcagaaagtcatttcttcggaatcgcctgtttagggggctggatagctggcctccgtctttttgcacccagaagcccaggaaatttgactgcgagctacctgatatttcactaaaagacttacagtttctccagtctttctgcccctccgaggtccagccattcctgcgggtaccactcctgtgtgacttcgaacctcttcaccaacacgtgctggctctgcacaatctcgtaaaggccgctcagtcactagacgagatgagccagaccatcactgacttgctgagtgagcagaaagcaagtgtatctcagactagccctcagagcgcgagtagtcccagaatggagtctacagcgggaataacaaccaccacaagtcccagaacccccccacccctgacggtccaagatccactgtgcccggctgtatgccctttggaggagctcagcccggatagcattgacgcacataccttcgattttgaaaccatcccgcatcctaatatcgagcaaacgatacaccaggtgtccctggatcttgacagtctcgctgaatcgcccgaatcagatttcatgagtgcggtgaatgaattcgtgatagaggaaaacttgtcgagccccaatccaatcagtgacccccaatctcccgagatgatggtggagtccttgtattcatccgtcattaatgccattgattcacggagaatgcaggacacgaacgtatgcgggaaagaggacttcggcgaccacacttcactgaatgtgcaacttgaacggtgcagggtggttgcccaggattcacacttctctattcaaacaattaaggaagacttgtgccactttagaacatttgttcagaaagaacagtgtgacttttccaacagtctgaaatgtacggccgtggaaattagaaatatcatcgaaaaggtgaagtgctcccttgaaatcactctgaaggaaaaacaccagaaggagctgcttagtttgaagaacgagtatgagggaaaactggatggtctcatcaaagaaactgaagaaaatgaaaataagattaaaaaattgaaaggcgagctagtgtgcctagaggaagtgttgcagaataaagataacgagttcgccctggtgaaacatgaaaaagaggcagttatctgtcttcagaatgagaaagaccagaagctgttagagatggagaatattatgcacagtcagaactgtgagattaaggagctaaaacagagtagagagatcgttctcgaagacctcaaaaaactgcacgtggagaatgatgagaaattgcagctactccgcgcagagttgcagtctctggagcagtctcaccttaaagagctggaggacaccctccaagtgagacatattcaggagttcgagaaagttatgaccgaccaccgggtaagtttagaagagcttaaaaaggaaaaccaacaaatcataaatcagatccaggaatctcatgctgagattattcaagagaaggaaaagcagctccaagaactgaaattaaaagtgtcggatctctcggatacccgctgcaagttagaagtggagctggctctgaaggaggctgaaacagacgagattaagattctcttagaggaatctagggcacaacaaaaggaaaccctgaaaagtctcctggaacaggagaccgagaacctgcgtacagaaatcagtaaactgaatcagaaaatacaggacaacaacgagaactaccaggtcggcctcgccgaactgaggaccctcatgactatcgaaaaggatcagtgtatctcagagctaattagcaggcacgaggaagaatccaatatactgaaggcagagctgaataaggtgacctctttgcacaaccaggcgtttgaaatcgagaagaacctgaaagagcagattattgaactgcagtcgaagctggactccgagctgtcagctctggaaagacagaaagatgaaaagataacccagcaggaagagaagtacgaagcgatcattcagaatctggaaaaggaccggcagaaacttgtgtcttcacaagagcaggaccgagagcagctgatccagaagttaaactgtgagaaggacgaggccatacagactgccttgaaagaattcaaactggagcgtgaggtggtcgaaaaggaactgctcgagaaggtgaagcatctggagaatcaaattgccaaaagtcctgccatcgattcaacacgcggtgatagcagttctctcgtggctgaactgcaagaaaaactgcaggaggaaaaagcaaaattcttggaacagctagaagaacaggagaaacgcaagaacgaagaaatgcagaacgtgcgcacttcgctgattgccgaacagcaaaccaattttaatactgtcctgacaagagagaagatgagaaaagagaatatcatcaacgatttaagcgacaaactcaaatccacgatgcagcagcaggaaagggataaggacctgattgagtcattgtctgaggacagggcacgactactagaggagaagaaaaagttggaggaggaagtttccaagctcaggagcagttctttcgtccccagtccttatgtggccacagctcccgagttatacggagcttgcgctcccgagcttcccggagaatccgaccggtccgcagtcgagaccgctgacgaaggcagagtggactctgctatggagacctcgatgatgagtgtgcaggaaaatatccacatgctttcagaagaaaagcagcgcattatgctactcgagaggaccctgcagctgaaagaagaggagaataaacggctcaaccaaaggctgatgagtcagtcaatgtcctcagtcagcagtagacactccgagaaaatcgccatccgcgatttccaagtgggcgacttggtactgattatcctggacgagagacatgataactacgtgctctttacggttagtcccactctgtatttcctgcatagcgagtccctgcccgctcttgatttgaaacccggagaaggggcttcaggcgcttccagacgtccctgggtcctgggaaaggtgatggaaaaagagtattgccaggctaagaaagcacagaacaggtttaaagtgccacttgggactaagttttatcgagttaaggccgtttcatggaataaaaaagtttag

SEQ ID NO: 30582 - DNA, 4776 bp, Artificial Sequence
  Description of Artificial Sequence: Synthetic coding sequence
atgaaactgtatgtttttctcgtcaatacaggaacgacattgacattcgacaccgaactgacagttcagaccgtggcagacctgaaacacgcgattcagtctaagtataagatcgccatccagcaccaagtcttggtcgtcaacggcggtgagtgcatggctgccgatagaagagtgtgtacatactctgccggaaccgacactaatcccatctttctcttcaataaagaaatgatcctatgtgatcggccacccgcaattcctaagactacattctcaacggagaacgacatggaaattaaggtagaagagagcttgatgatgcccgctgtctttcatacggtagcatcccggacccagctggcgcttgaaatgtatgaagtggccaagaagttatgttctttctgtgagggactggttcacgatgaacacctccaacaccagggatgggctgccatcatggcgaatctcgaagactgttcaaattcctaccagaaactcctgttcaagtttgaatccatctactctaactacctgcagagtatcgaggatattaagttaaagctgacacacctgggtacagcagtctccgtgatggctaagattcctctcctggaatgtctgacacgacactcttatagagagtgcctgggacgcctggattcacttcccgaacacgaggatagcgagaaagcagagatgaagaggagcaccgaactggtcctgtcgccagacatgcccagaacaactaatgagagtctgctgacatccttccccaaaagcgtcgaacatgtatcgcccgatactgccgacgccgaatccggcaaagagattcgggaatcatgtcaatctaccgtacaccagcaggatgagaccacgattgatactaaggacggcgaccttcctttttttaatgtctccctgcttgactggattaatgtgcaggaccgccctaatgatgtggagtccttggtccgtaaatgttttgattccatgtctcgattggacccacgtattatcagaccatttatcgccgagtgcaggcaaacgattgccaaacttgataaccagaatatgaaggccatcaaaggacttgaggacaggttgtatgcattggatcagatgatagccagctgcggcaggctggtcaatgagcagaaagagctggcgcaaggctttctggcgaaccagaagagagcagagaacttgaaagacgcatccgtgttgccggatctgtgtctctcacacgccaaccaactaatgatcatgctccagaaccaccgtaagctgctcgatataaagcagaagtgcacaaccgctaagcaagagctagccaataatctgcatgtgaggttgaagtggtgctgtttcgtcatgcttcacgccgatcaggatggagaaaaactccaggcactgcttcgtctcgtcatcgaattactggagcgagtgaagatcgtggaggccctaagtactgtgccccagatgtactgtctggctgttgtagaggtcgtgcggcgtaagatgttcatcaaacattaccgggaatgggccggagcgctcgtgaaggacggtaagagactgtatgaagcggagaaatccaaaagggagtcattcgggaagttatttcgtaaatccttcctgcgcaacagattatttagggggttagacagctggcccccttccttctgcacacagaaaccacgtaagttcgactgcgagctgcccgacattagtctgaaagaccttcagttcctccagagcttctgcccatctgaggtgcagccattcttgcgggtgcccctactctgcgattttgagccgctccaccagcatgttctggccctgcacaacctggtgaaagccgctcagtccctggatgagatgtcccagacgattactgaccttctttctgagcagaaggcatccgtaagtcagacaagcccccaaagtgcctcaagcccgaggatggaaagtacggcgggaatcaccactacaacatctcccaggacaccccctccgctgaccgtccaggatccgctgtgccccgcagtgtgtcccctggaagaactgtccccagactctatcgacgcgcatacctttgattttgagacaatccctcacccaaatattgaacaaactatccaccaagtcagccttgatctggacagtttagccgagtccccggaaagtgatttcatgagcgcagtcaacgagttcgtaattgaagagaacctgtcatcgcctaatcccatttccgacccccagtcgccagagatgatggtcgagagcctttattccagcgtcatcaacgcgattgactcacggaggatgcaggacactaatgtctgcggaaaggaggactttggggatcacaccagcttgaacgtgcagcttgaacgctgtcgggtggtggctcaggacagccacttcagtattcagactattaaggaggatctgtgccatttcaggacattcgtacagaaggagcagtgcgacttcagcaattctctgaagtgtacagccgttgagatccgaaacattatagaaaaggttaagtgtagtctcgagattacactgaaagagaagcaccagaaagagctattatccctcaaaaacgaatacgagggcaaactcgatggcctgatcaaggagacagaggaaaatgagaataaaatcaaaaagcttaaaggagaactagtctgtctggaagaggtgttacagaacaaagacaacgagtttgctctcgtgaaacacgagaaggaagctgtgatctgtcttcagaacgagaaggaccagaagctgctggaaatggaaaatataatgcactcacaaaactgtgagatcaaggagttgaaacaatctagagagattgtactggaagatctgaagaagctgcatgtcgaaaacgatgagaagcttcagcttctgcgcgctgagctacagtcgttagagcagtctcacctaaaggagttggaggacacgctgcaagtgcgacacattcaggagttcgagaaggttatgactgatcaccgagtgagcctggaggagctcaagaaagagaaccagcagatcataaatcagatccaggaatcccatgccgaaattattcaggagaaggagaaacaactacaagaactgaaactcaaggtgagcgacctctccgacacccgatgtaagctggaggtcgagctggccctcaaggaggccgaaactgatgagatcaagattctgcttgaggagtctagggcacagcagaaggaaactttgaagtctttgttggaacaggagactgagaatcttcgtacggagattagcaagctgaatcagaagatccaagataataatgagaactatcaggtgggactggcggaactgaggaccctgatgactattgagaaggatcagtgcatcagcgagctgatttctagacacgaggaggaatccaacatccttaaagctgagctaaataaggtgaccagcctccacaatcaggcgttcgaaatcgaaaagaatttgaaggaacagataatcgagctgcaatctaagttagattcggaactgtccgctctggagagacagaaagatgagaaaatcacacagcaggaggaaaagtatgaggctatcattcagaatctggagaaggacaggcagaaattggttagcagtcaggagcaagatagggaacagctgatacagaaactgaactgcgaaaaagatgaagccatccagaccgcgcttaaagagttcaaactggagagggaggttgtggagaaggaactgctggagaaggttaaacacttggagaatcagatcgcaaaatctccagcgatcgactcgacccggggagacagtagtagcctggtcgccgagctacaggagaaactgcaggaggaaaaggccaaatttctggaacaactagaagagcaagaaaaaaggaagaacgaggaaatgcaaaacgtccgtacaagtttaatcgcggagcaacaaacaaatttcaatactgtgcttactcgcgagaaaatgcgcaaagaaaacattattaacgatctgtcagataaacttaaaagtacaatgcagcaacaggaaagagacaaagacctgatcgaaagcttgtctgaagatagggccagactccttgaagagaagaagaagcttgaggaagaagtgtccaaactgaggtcatcctccttcgtgccatcaccttatgtggccaccgcacctgagctgtatggtgcttgtgctccagagttgcccggagaaagcgatcgatccgcagtggagacagccgatgaaggacgtgtggattccgcaatggaaacctctatgatgagtgttcaggagaacatacacatgctttctgaggagaagcaacgaatcatgttgctggagagaacgctgcagctgaaagaagaggagaacaagcggctcaaccaacgtctaatgagtcagagcatgtcttccgtcagcagcagacacagtgaaaaaatagccatcagagatttccaggtgggcgacctggtgcttattatattggacgaaaggcatgacaattacgtgctgtttaccgtttctcccactttgtacttcttgcattcagaaagcctgccggctcttgacctcaagcctgcgagtggcgcttctagacggccatgggtcctcgggaaagtaatggagaaggaatattgccaggcgaaaaaagcgcagaatcgattcaaagtccctctaggaaccaagttttaccgcgtgaaagccgtgagttggaacaaaaaagtgtag

SEQ ID NO: 30583 - DNA, 48 bp, Artificial Sequence
  Description of Artificial Sequence: Synthetic coding sequence
atgaaactttacgtgttcttagttaataccggcacaactttgacatag

SEQ ID NO: 30584 - DNA, 4776 bp, Artificial Sequence
  Description of Artificial Sequence: Synthetic coding sequence
atgaagctatatgttttcttggtcaacacggggactactctcaccttcgacaccgaactgacagtgcagactgttgccgatttgaagcatgcgattcagagtaaatacaaaatcgctattcaacatcaagtcctggtcgtcaatggcggagaatgcatggccgctgacaggagagtctgtacctactccgctggaactgataccaatcccatatttctttttaataaagagatgatcctatgtgaccggcctcctgctattcccaagacaacctttagcacagagaacgacatggaaatcaaggtcgaagaatctctgatgatgcccgctgtgtttcataccgtggcctcccgcacacagcttgctttggagatgtacgaggtcgccaagaagctgtgcagcttctgcgaaggcctggtacacgatgagcacttgcagcatcaaggctgggcggcaattatggctaacctcgaagattgctccaacagctaccagaagcttttgttcaaattcgagagcatatatagcaactacctccagagcattgaggacatcaaactaaagctaacccacttaggcaccgccgtgtccgtgatggctaagatccctctgctggagtgcctaacaagacattcttacagagaatgcttggggaggctggatagccttcctgagcacgaggattctgagaaagccgagatgaagaggagtacagaactcgtcctgtcgccggatatgccgaggactaccaacgaatctctcctgacttcatttcctaagtcagtggagcacgttagtcccgataccgctgatgccgagtctgggaaggagatcagggaaagttgccaatctaccgtccatcagcaggacgaaacaactatcgatacgaaggacggtgacttaccattttttaatgtctcattgctcgactggatcaacgtgcaggataggccaaatgacgtcgaatctctggtgcgtaaatgctttgattcaatgagcaggctggatccacgcatcatccggcctttcatcgctgagtgtaggcagaccattgccaaactggataaccagaatatgaaggctatcaaaggattggaggaccggctctacgccctggatcagatgattgcaagctgtggcagactagtcaacgagcagaaagaacttgcccagggcttcctagcaaaccaaaagagggccgaaaatcttaaagacgcctcggtcctccctgatctgtgcctgtctcacgccaatcagctgatgattatgctgcagaaccacaggaaactccttgatataaagcaaaagtgcactacggccaagcaggagctggcgaacaatctgcatgtcaggctaaagtggtgttgctttgtaatgctgcatgccgatcaggatggtgagaagctccaggcattacttaggctggttattgagctgctcgaacgggttaagatcgtggaggccctgtccactgtgccgcagatgtactgcttggccgtggtggaagtggtcagaaggaaaatgttcattaagcattacagggaatgggctggggctttggtgaaagacgggaagagattgtacgaagccgaaaagagcaaaagggaaagttttggaaaactgttccgcaagtccttcctgcgcaacagactgtttcggggtctggattcgtggcctccctccttctgtacacaaaaaccaagaaagttcgattgcgaactgcctgatatatcccttaaagacctgcagtttctgcaatcattttgcccatcagaggttcagccattcctgagagtgcctctgctgtgtgatttcgaaccacttcatcagcatgtacttgcactgcacaatcttgtgaaggctgcgcagagtctagacgaaatgagccaaacaataacagacctgttaagtgagcagaaagcatccgtaagccagacgagtccacaatctgcttcgagtcccagaatggaatccactgccggtattaccacgacgacgagtccacggacgccgccacccctgaccgttcaggatcctttgtgccctgcagtgtgccctctggaggagctgtcgcctgactccatcgacgcacacactttcgactttgaaacaatccctcaccctaacattgaacaaaccatacaccaggtatctctcgatctggattctctcgccgaaagccccgaaagcgacttcatgtctgccgtgaatgaattcgtcatagaggagaatttgtcctctcccaaccctatatctgatccacagtctcctgaaatgatggttgagtcgctgtatagctcagtgattaatgctatcgattcaaggaggatgcaggataccaacgtatgcggtaaagaggattttggagaccacacctctttaaacgtgcagctagagcgatgccgtgtggtggctcaagactcacacttcagtatccaaacaatcaaagaggacctttgtcattttcgaacatttgtacagaaggagcagtgtgacttttcaaattctttgaagtgtacagctgttgagatcagaaatattattgaaaaggtcaaatgctctctagagataaccctcaaggagaagcaccagaaagaattactcagcttgaaaaatgaatacgaggggaagttggacggcctaattaaagagacagaggaaaatgagaataagatcaaaaagctgaaaggagaacttgtgtgtctcgaagaagtgctgcagaacaaggacaacgaatttgctcttgtgaaacatgagaaggaggcggtgatttgcttacagaatgagaaagatcagaaactgttggagatggagaatattatgcactcgcagaattgtgaaataaaggaattgaagcagagtagagaaatcgttctggaggatttaaaaaagttacacgtggaaaacgacgaaaaactgcaactgttgagagctgagctccaatcccttgagcagagtcacctgaaggagctggaggacactttgcaagtaagacatatccaagagttcgagaaggtcatgaccgaccacagggtttctctggaagaactgaaaaaagaaaatcagcagattataaaccagatccaggagagtcatgcggagattatacaggagaaggaaaaacagcttcaagaattaaagctgaaagtgagcgatctttcagacactagatgtaagctggaggtcgaactcgcactgaaagaggcagaaacagacgagattaagatcttgcttgaggagagccgcgctcagcagaaggagacgctaaaatcactcttagaacaagaaactgagaatttaagaactgagatatcgaagcttaaccaaaaaatccaagataataatgagaactaccaggttgggttagctgagcttcgcaccctcatgaccatcgagaaagaccagtgcatatctgagctgatcagtcggcatgaagaggagagcaacattctgaaagcagaactcaataaggttacttctctccacaaccaggcatttgaaatcgagaaaaatttgaaagagcagatcattgagctgcagtccaagcttgacagcgaattgagcgccctcgaaagacagaaagatgaaaaaatcacccagcaggaagaaaaatatgaagctatcatacagaacctggaaaaagatcggcagaagctcgttagtagccaggagcaggaccgagaacagttaatccagaagctgaactgcgagaaagacgaggcaatccagacagctctgaaagaattcaaactcgagcgggaggtggtagagaaagagctcctagaaaaggtgaagcacttggagaaccaaatcgccaagtcaccagccattgactcaactcgcggtgatagttcctctctggtggccgaactgcaggaaaaactgcaggaggaaaaggccaagtttcttgagcaattagaggagcaggagaagagaaaaaatgaagagatgcaaaatgtgcgcacatctttgattgccgagcaacaaactaattttaacactgtgctgactcgggagaagatgagaaaggaaaacatcattaacgacctgtccgataaactgaagtcaactatgcaacaacaggaacgtgataaagatttaatcgagtctcttagtgaagacagagctcgattactcgaagaaaagaaaaagcttgaagaagaggtctcgaaactgagaagttcaagttttgtgccttctccttatgttgctactgctccagagctctatggggcatgtgcccctgaactgccgggagaatccgaccgatctgccgtcgagacagcagacgaaggcagagtcgactccgctatggagacctccatgatgtctgtgcaggagaacattcatatgttgtccgaggaaaagcagcgtatcatgttgctggagaggacccttcagctgaaggaagaagagaacaagagactaaaccagcgtcttatgtcccagagtatgtccagtgtctcctcgcgacactcagagaaaatcgcaataagagatttccaggtgggagacctcgtacttattatcctggatgagaggcacgacaattacgttcttttcactgtctctccaacactgtattttctgcatagcgaaagcctaccggctctggacctgaaacctgcgagcggagcatcacgcagaccctgggtgctggggaaggtaatggaaaaggagtactgccaggcaaaaaaggcgcagaaccgatttaaagtacccctgggcactaagttttacagagtgaaggcagtgagctggaataagaaggtatag

SEQ ID NO: 30585 - DNA, 6471 bp, Artificial Sequence
  Description of Artificial Sequence: Synthetic coding sequence
atgagcgataccccctccaccggtttctccatcatacaccccacaagctctgaggggcaggtgcccccacccagacatttaagcctgactcacccagtggtcgctaaacgcatcagcttctacaagtcaggtgaccctcaattcggcggtgtgagagtggtggtgaatcccagatcattcaaaagctttgacgccttgctggataacctttcacgcaaggtgcccctgccatttggagtcaggaacatttctaccccaagggggagacattcaatcacacgactcgaagaacttgaggatggtgagagttacctttgctctcacggccgaaaggttcagcccgtggacctggacaaggcccgaagacgacctaggccttggctctcctcacgtgctatcagcgctcactcacccccacatcctgtcgctgtggccgcacctgggatgcctcggccacccaggtccctggttgtgttccggaacggcgatcccaaaacacggcgagctgtgctgctctcaaggcgagtaactcagtcctttgaagctttccttcagcatctgacagaggtgatgcagagaccggttgtgaaactttatgccaccgatggaaggcgcgtcccgtcccttcaggcggtgattctgagctccggcgctgtggtagctgctggcagagagcccttcaagcccggtaactacgacatccagaagtacctgctgcctgccagacttccaggcatttctcagcgggtctacccaaagggtaatgcaaagtctgaatccaggaagatttcgacccacatgtcctcctcatctcgctcacaaatttactccgtgagtagcgaaaagacacacaacaatgactgctacctggattattccttcgtacctgagaagtaccttgcattagagaagaatgacagccagaacctcccgatatacccttccgaggacgacatcgaaaagtctatcatttttaatcaggatggcaccatgaccgtggagatgaaagtgagattccgcataaaagaggaggagaccattaagtggactactaccgtgagcaagaccgggccttcgaataacgacgaaaagtcagagatgtcattcccgggacgcactgagtcgcgctccagcggcctaaagctagccgcatgttctttctcagccgatgttagcccaatggagcgcagcagtaatcaggagggctccctagcagaggagatcaatatccaaatgacagaccaggtagccgaaacatgtagcagtgcgagttgggagaatgccaccgtcgacacagatattatacaaggcacgcaggaccaggctaagcacaggttctaccgcccaccaacccctgggctccgtcgcgtgcgccagaagaagtccgtcatcggcagcgtgactctagtatccgagaccgaggtccaggagaagatgattggtcagttctcttactcagaggaacgagagagcggggaaaacaagtcagagtatcacatgtttacgcactcctgctctaagatgtcctctgttagcaacaaacccgttcttgtacagatcaataataacgatcagatggaggagtcatcacttgagagaaaaaaggaaaattccctccttaagtcatcagccatttctgctggggtgattgagattaccagccaaaaaatgttggagatgtctcataacaacggtcttccaagcaccatcagcaacaactccattgttgaagaggatgtagtggattgtgttgtgctggataataagaccggaatcaagaatttcaagacttatggcaacacaaacgaccgtttttctcccatctccgcggatgctacacatttctcgagcaataacagcggtacagataaaaacatcagcgaggcacccgcatcggaggcctcatccacagtgaccgccagaattgacagacttatcaacgagttcgcgcagtgtggactcaccaaactccctaaaaacgagaagaaaatactctcttccgtggcgagtaagaaaaagaagaaaagtcgccagcaagccattaacagtcgttatcaggatggccagcttgccaccaagggcattctcaacaagaatgagcggattaacacgaagggacggattaccaaggaaatgatcgtccaggatagcgatagtccactcaagggcggaatcctttgcgaggaggacctgcagaagagtgacaccgttatcgaatccaacaccttctgttccaagagcaatctgaattccaccatatctaagaatttccacaggaataaattaaatacgacccagaatagtaaggtacaggggctgttgaccaagcgaaaatcccgcagtctaaataagatcagtctcggcgctcccaagaaacgcgagataggccagagagataaagtatttccacacaacgaaagcaagtattgcaagagcaccttcgaaaataagagccttttccacgtatttaatattctcgaacagaaacccaaagatttttacgcccctcagtcccaggccgaggtagcaagcggctacttacgagggatggcaaagaagtccttggtgtcaaaagttaccgatagccacattacactgaagagccagaagaagcgcaagggcgacaaggttaaggccagcgcaattttaagcaagcagcacgccacaactagggccaatagcttggcaagtcttaaaaaaccagacttccccgaggcaattgcccaccacagcatccagaattacatacagagttggctccagaatattaacccctatcctactctgaagcccattaagagcgctccggtctgccggaacgagacatctgtggtcaactgttccaacaactcattttccggcaacgacccccataccaacagcggcaagatctccaattttgttatggaatcaaacaaacacataaccaagatagcgggactgaccggcgacaacctgtgcaaggaaggcgacaagtcttttattgctaacgatactggtgaggaagatttgcacgaaactcaagtcggctctttaaacgacgcctatctcgtcccactgcacgagcattgcacactcagtcaaagcgccattaatgaccataatactaagtcccacattgcggctgagaagagtggcccagagaaaaaactggtctatcaggaaatcaaccttgcgagaaagaggcagagcgtggaggccgcaatacaagtcgatccaattgaagaggaaactcctaaggacctgctgccagtgctgatgctgcaccagctccaggcctctgttcccggaattcacaaaacgcagaacggagtggttcagatgcccggaagcctagcaggggtgcccttccatagtgcaatttgtaactcgagcaccaacttgttactagcctggctgctggtcctgaacctcaaaggtagcatgaatagtttctgccaggtcgatgcacataaggctactaacaagtcgagcgaaaccttggcactgctggaaattcttaaacacatagctattactgaggaggccgacgatctgaaggccgctgtcgcaaatctggtagagtccaccacgagccactttgggctgagcgaaaaggagcaggacatggtgcccatcgacctcagtgcaaactgttcaactgtgaacatccagagcgtccctaagtgcagtgaaaacgagcgtacacaaggtatttccagcttggacggcggatgcagtgcttctgaagcctgcgctcctgaagtatgtgtgctggaggtaacctgcagtccttgtgaaatgtgcaccgtgaataaagcctactcaccgaaggaaacatgtaaccccagcgataccttttttccctcggacggctacggagttgaccagacatcgatgaataaagcttgcttcttgggcgaagtgtgttctctcactgacactgtattttccgacaaagcctgtgcccaaaaggagaatcacacttacgaaggggcttgccctatcgacgagacctatgttccagtcaatgtttgtaacactatcgatttcctgaacagcaaagagaacacatatactgataacttggacagcacagaagagctggaacgcggtgacgatattcagaaggatctcaatatcctaaccgatccagaatataagaacggctttaacacacttgtgagtcaccagaatgtttcaaacctgagctcatgcggcttgtgtttatccgagaaggaagctgagctcgacaagaaacacagtagtctggatgacttcgagaactgctccctgcgtaaatttcaagacgagaatgcttacacgtcatttgacatggaagaaccaagaactagcgaggaaccaggatccatcacgaactcaatgacttcttcagagagaaacatatctgagcttgaatccttcgaggaacttgaaaatcacgatacagacatcttcaacaccgtggtaaatgggggagagcaggcaacagaggaattgattcaggaagaagtggaggctagtaagactctcgaactgatcgacattagcagcaagaacatcatggaggagaaaaggatgaacggaatcatctatgaaattatttcgaaacgcctagctaccccaccctcgttggacttctgttatgatagtaagcaaaactcagagaaggagacaaatgaaggagaaacaaaaatggtcaaaatgatggtgaagaccatggagacgggatcttatagcgaatcttccccggatctgaaaaagtgtatcaaaagtccagttacaagtgactggtctgattacagacctgacagcgacagcgaacaaccttacaagacaagcagcgacgacccaaatgatagcggagaattaactcaagagaaggagtataacattggattcgtcaagcgtgcaattgaaaagctgtacgggaaggcagacatcatcaagcccagcttcttccccggatctacgagaaagagccaagtttgcccttataattctgtggagttccagtgttctagaaaggcctccctctatgactccgaaggacagtctttcggttcaagcgagcaggtcagttccagtagcagcatgctccaggagtttcaggaagagaggcaggacaagtgtgacgttagtgccgtccgggataactactgtaggggcgacatagttgagcctgggaccaaacagaacgatgactccaggatcctgaccgacattgaagaaggggtcctgatcgataaggggaagtggctgctcaaagagaaccatctgttgcggatgtcctccgagaacccagggatgtgcggcaacgcagataccaccagtgtggacacgctcctcgacaacaactctagtgaagtgccttatagccatttcgggaatctggcacccggtcccacaatggacgagttgtcttcttctgagctggaagaactcactcaaccgttggagctgaaatgcaactactttaatatgccacacggttcggactctgagccgttccacgaagatttgctggacgtgaggaatgagacctgtgctaaggagagaattgccaatcaccacaccgaagagaaagggtctcaccaatcagagcgggtgtgcacttctgtgacgcactcatttatctcagcaggcaacaaggtttaccccgtatccgacgacgcaattaagaaccagcctcttccagggagtaacatgattcacggaacgctccaggaggctgattctctagacaagctctatgcgctgtgcgggcagcattgccctatactgactgtcatcatacaaccaatgaacgaggaggatcgaggcttcgcttataggaaagagtctgacattgagaattttctcggattctatctgtggatgaagatacatccctatctcttgcagaccgataaaaatgttttcagggaggagaacaacaaagcaagtatgcggcagaacctaatagataacgccatcggggatattttcgaccagttctacttctctaatacgttcgatcttatgggtaaaaggaggaagcagaaacggatcaactttctcggcctcgaggaagagggaaacctcaagaagttccagccagatttaaaggaacgattttgcatgaattttcttcacacatcacttttggtagtgggaaatgtggatagtaacacccaggacctgtctgggcagacaaacgagatcttcaaagccgtagacgagaacaacaatctgctgaacaaccgctttcaggggagtaggacgaacttgaaccaggtggtacgggagaatataaactgccattatttcttcgagatgctcggccaggcctgcctcctcgacatctgccaagttgaaactagcctgaacatttcaaaccgaaacatcttggaactgtgtatgttcgaaggggagaacctttttatctgggaagaggaagatatcttgaatttgaccgacctcgagagctcaagggagcaggaggacctgtag

SEQ ID NO: 30586 - DNA, 1212 bp, Artificial Sequence
  Description of Artificial Sequence: Synthetic coding sequence
atgactcctcctctgctgcatcatgatctgaaaacgcagaatattctcctcgacaacgaattccacgtcaaaatagcggactttggactctccaaatggaggatgatgagcctctctcaaagcagatcttcaaagtcagctcccgaaggcggtacgattatatatatgccaccagagaactacgaacccggacaaaaaagtagagcaagcatcaagcacgacatttactcttacgcggtgataacctgggaggtgctgtctcggaaacagccttttgaggatgtcactaatcctctccagatcatgtattctgtctcacagggccaccgacccgttattaatgaagaatctcttccctacgatatccctcatcgggcacgcatgatcagcctcatcgagtccggatgggcacagaatccagatgaacggccatcttttctaaaatgcttgattgaattagagccagtcttacgcacttttgaagagatcaccttcctggaggccgtcatacagctaaaaaaaactaaactgcaatccgtgtcgagtgcgattcacctctgcgacaagaaaaagatggagctctctctgaacattccagtaaatcacggcccacaggaagagtcatgtggtagttcccagttacacgagaatagcggaagcccagagacaagtagaagcctgcctgctccccaggataacgattttctctcaagaaaggcgcaggattgttattttatgaagttgcatcattgtcccggaaaccactcgtgggattctaccataagcggtagtcagagagccgcattttgtgatcataagacgacgccctgttcctctgcaatcataaatcctctgtccaccgcgggtaattctgagcggctgcaaccaggtattgcacagcagtggatacagtcaaagcgggaggatatcgtgaatcagatgacagaggcgtgcttgaaccagagtctcgacgcgctcctcagtagagacctgatcatgaaggaagactatgagttggtttctaccaagcctacacgcacgagcaaagtcagacagctgctcgataccaccgatattcagggcgaggaattcgccaaggtgattgtccaaaagctcaaggataataagcagatgggcctgcaaccctaccctgagattctcgttgtgtcaaggtcccccagcctcaatctattacaaaacaagtcaatgtag

SEQ ID NO: 30587 - DNA, 10377 bp, Artificial Sequence
  Description of Artificial Sequence: Synthetic coding sequence
atggagcggagcggttgggctcgccagactttccttctcgccctcttgctaggcgctactttaagagccagggcggcagccggatactatcctagattttccccgttcttctttctttgtacccatcatggggaactggagggggacggggaacagggcgaggttctcatctctctgcatattgcgggaaacccaacatattatgtgcctggccaagagtaccacgtgactattagcacgtctactttttttgacggtctgctggtcactgggctgtatacttcgactagtgtacaggcctcacagtcgattggcggttcttcagccttcggctttgggatcatgagcgaccatcagtttggtaaccagttcatgtgcagtgtggtcgcttcgcatgtatcccacttgccaaccactaatctgtctttcatctggatcgctccccctgcaggaactggttgtgtcaacttcatggcaacagccacacacagaggccaagtaattttcaaagacgcgctggcccagcaactgtgtgaacagggggcaccaactgatgtgaccgttcatccccacctagctgaaatccattcggactccatcattttgcgagacgactttgattcataccaccaattgcagttgaatcccaacatttgggttgaatgtaataactgtgagaccggagaacagtgcggggctataatgcacgggaatgcagtgacattttgtgaaccatatggtccccgagaacttatcactactggactgaacacgactaccgcctccgtgctgcagttctctataggttctggcagctgcaggtttagttacagtgatccctctattatcgtgctctacgctaagaataatagtgctgattggattcagctagaaaagattagagctccctcgaacgtgtctaccataatccacattctttacttgccagaggacgcaaaaggggagaatgtgcagtttcagtggaagcaggagaacctcagagttggcgaggtctatgaagcttgttgggcactggataatattctgattattaattcagctcacaggcaggtggtgctggaagatagtctggaccctgtggacactgggaactggctcttcttcccaggggctacagtgaaacacagctgccagtcagatggtaactcaatctacttccatggcaatgaagggtctgagttcaattttgcgaccacaagagacgtggacctatccaccgaagatatccaggaacagtggtccgaagaattcgaaagccaacccaccggatgggatgtgctaggcgctgtcatagggactgagtgcgggactatcgagtccgggctcagcatggtctttttgaaggatggggaacgcaaactttgtacccccagcatggacacaacagggtacgggaacctcagattctattttgtgatgggaggcatttgtgatccgggaaatagtcacgagaatgacatcattctctacgcaaagatcgaaggtaggaaggagcacatcacccttgacacgctgtcctattcatcatataaagttcccagcttggtctccgtggtgatcaacccagagctccagacacctgctactaaattttgccttaggcagaagaaccaccaaggacacaataggaatgtatgggcggttgacttcttccatgtccttcctgtgctaccaagcaccatgtcccacatgatccaattcagcatcaatctgggctgcgggacacaccaaccagggaattctgtgagtctggaattttcaacaaatcatgggaggtcttggagcttgctgcacacagagtgccttccagaaatctgtgccggacctcacctgccccattccactgtgtactctagtgaaaattacagtggttggaataggattacaatccctctccccaatgccgctcttacccgaaatacccgaatccgatggcggcagaccggtccaatcctgggcaacatgtgggcaatagacaacgtgtacatcgggccaagctgcctcaagttctgcagtgggcgagggcagtgtacacgccacgggtgcaagtgcgatcccggattttccggacctgcttgcgagatggcaagtcaaaccttcccaatgtttattagcgaaagtttcggctcaagtcggctttcctcctaccataatttttatagtattcgaggggctgaggtctcttttggctgtggcgtcctggcttctggcaaggccctagtattcaacaaagacggaaggcggcagctgattacatcattcctggacagctctcagagcagattcttacagttcacccttcggcttggaagcaaatctgtgctgtccacgtgtagagcacctgatcagccaggggagggagtgctcctgcactatagctacgataacggaattacctggaaactgctggagcattacagttatttgagctaccatgagccaaggattatctcagtagagctgcctggtgatgcaaaacagtttggcattcagttccgctggtggcagccctaccatagcagtcagcgcgaagatgtctgggccatcgatgagatcatcatgacatctgtcctttttaatagcatttctttggactttaccaacctggtcgaggtgacccagtctttaggcttttacctcggtaacgttcagccttactgtggacacgactggaccctctgtttcaccggtgacagcaaactggcaagcagtatgagatatgtagaaacccagagcatgcaaatcggcgcttcttacatgatacagttctctctcgtcatggggtgcggacagaagtacaccccacatatggacaatcaggtcaagttggaatatagcactaatcacggcttaacgtggcaccttgtgcaagaggaatgtctacctagcatgccctcttgccaagagttcaccagtgcttccatataccatgcttcagagtttacgcagtggcgtcgggtgatcgtgcttttgccgcagaaaacctggtccagtgctacccggttccgatggtcgcagtcctactacacagcccaggacgaatgggccctggattctatatacattgggcaacagtgcccgaacatgtgctctggtcatgggtcttgcgaccacggaatctgccgttgcgaccaaggctaccaggggacggagtgtcacccagaagccgcattgccctctaccatcatgtccgattttgagaaccaaaacggttgggagtctgattggcaggaggtcatcggaggagaaatagtcaaaccagaacagggttgtggcgtaatctccagcggtagctccctttacttctcaaaggcaggcaaacgacagcttgtctcttgggacctggacacctcctgggttgattttgttcagttctatatccagatcggtggcgaaagcgcaagttgtaataaacctgactcaagggaggaaggggtcctcctccaatacagtaataatgggggaatccagtggcacctgttagcggagatgtacttctccgatttttctaagccgaggttcgtgtacctggagctccctgctgctgccaagaccccatgtactcggttccgctggtggcagcctgtgttttcaggggaggactatgaccagtgggctgtagacgacataatcatcttgtccgagaaacagaagcagatcattcccgtcattaatcccacactgccccagaatttttatgaaaagcctgccttcgactatcccatgaatcaaatgagtgtgtggctgatgctggccaatgaggggatggtaaaaaacgagacgttttgcgctgcaactcctagcgccatgattttcgggaagtctgacggagaccgcttcgctgtgacccgggatctgaccctcaaaccaggatacgtcctgcagttcaagctgaatatcggctgtgcaaaccagttttcatccactgccccagtgctcctgcagtactctcatgacgcagggatgtcctggttcctcgtgaaagagggctgttacccagcatcggctggtaagggctgtgaaggtaatagcagagagctgtccgagccaactatgtaccacaccggggatttcgaggaatggaccaggattaccattgtgatccctcgcagtctggcatcgtcaaaaacacgttttagatggatccaggagagttcttcccagaagaatgtacctccttttggattggatggtgtgtacatatccgagccctgcccctcatattgctctggacatggcgactgcatctctggggtatgtttttgcgatcttggatacaccgctgctcagggtacctgcgtcagcaatgtccctaaccacaacgagatgttcgaccgcttcgaggggaagctctctcctctgtggtacaagattaccggggcacaggtggggaccggttgtgggaccctaaatgatggcaaatcactgtactttaatggtcctggcaagagggaagctcgaaccgtcccactagacacacgcaacatccggctggtccagttttatatacagattgggtcaaagacaagcggaataacgtgcattaagcccaggaccagaaacgaagggctaattgtacagtatagtaatgataacggtatcttgtggcatctgcttcgggaactggatttcatgagctttctggaaccgcagattataagcatcgaccttcctcaagacgccaaaacccccgcaaccgcttttagatggtggcagccacaacacgggaaacatagtgcgcagtgggcactagacgatgtgctgatcggaatgaacgatagcagtcagacgggattccaggataaatttgacggcagcatcgacctgcaggcaaactggtaccgtatacaagggggacaggtcgacatcgactgtttgagcatggatacagctcttatcttcactgaaaatatcgggaaacccaggtacgcggagacttgggacttccatgtaagcgcctccacgttcctgcagtttgaaatgtcaatgggctgtagcaagcctttttcaaatagtcacagtgtccagctgcaatacagcctgaacaatggtaaggattggcatctcgtcactgaggaatgcgtaccacctacaatcggttgcctgcattatacagagtcatcaatctatacctccgagcggttccaaaattggaagcgtataactgtatacctccctctgtccacaataagccccaggacccgattccgatggatccaggctaactacaccgttggggctgacagctgggccatcgacaatgttgttctggcctcaggctgtccctggatgtgcagtgggaggggaatttgcgatgcaggacgctgtgtgtgtgacagaggcttcgggggtccttattgtgtccccgtcgtgccattgccctccatccttaaagatgattttaacggcaatttgcacccagatctttggcctgaggtctatggagccgaacggggaaatctgaacggtgaaacaattaagtctgggactagtctgatcttcaagggagagggcctgaggatgctaatctcacgggatcttgactgcactaacacaatgtatgtgcaattcagtttgcgctttatcgcaaaaagcacccctgaaaggagccactccatcctgctgcaattttcaatctccggcggtattacttggcacctgatggacgagttctacttccctcaaaccacgaatatcttgtttataaacgttccattaccttataccgcccagaccaatgccactaggttccgcctctggcagccatataacaacggcaaaaaggaggagatttggatcgtggacgactttatcatcgacgggaataatgtcaacaaccccgttatgttactggacaccttcgatttcggacccagagaagacaattggttcttttatcccggaggtaatatcgggctgtattgcccatactccagcaagggagcacccgaagaagactcagccatggtcttcgtgtccaacgaagtgggagagcattctatcacaacacgggacctgaatgttaacgagaacaccatcattcaatttgaaattaacgtgggatgttcaacagattcgagctcagctgatcctgtccgcttagagttcagcagagactttggcgctacatggcatttactcttgccgctgtgctaccatagctcatctcatgtatctagcctgtgctccacagagcaccacccatcttcaacttattacgcgggaacgatgcaaggttggcggagagaagtggttcatttcggtaagctgcatctctgtggatccgtgagattcaggtggtaccagggattctaccccgcaggcagccaacctgttacatgggcaatcgacaacgtgtacatcggccctcagtgtgaagaaatgtgcaacggacaggggtcgtgtatcaacggaacgaagtgcatatgtgaccccggttatagcggcccaacatgtaagatttcaacaaagaaccctgatttcctgaaggatgattttgaaggacagctcgagtctgatcgcttcctgctgatgagtgggggaaagccttcaagaaaatgtggtattctgagctcaggaaacaatctgtttttcaacgaggacggcctacgcatgctcatgactcgggacttggatttgtcgcacgcccgattcgttcagttctttatgaggctcggatgtgggaagggcgtccccgaccctagatctcagcccgtgctgctccagtactctttgaatggaggattgagctggtcattacttcaagaatttctgttttcgaatagctcaaacgtgggtagatatatcgctcttgaaatccctttgaaggccagatccggctctaccaggttgagatggtggcagccttccgaaaatggacatttttattcaccttgggtgatcgatcaaatactgataggtggcaacatcagtggcaatactgtactcgaggacgactttaccaccttagacagccggaagtggttactgcaccctggaggaactaaaatgcctgtgtgtggcagtactggggatgctctggttttcattgaaaaggcatcaacacgatacgttgtttccacagacgtcgctgtgaacgaagattcttttttacagattgattttgctgcttcctgtagcgtcactgacagctgttatgctatagagcttgaatactccgttgacctgggcttatcatggcatccactggtgagggattgcctccctacaaatgtcgagtgtagcagataccatctgcagaggatcctggtaagtgacacctttaataaatggactcgtattactctccctctacccccttatacacggtcacaggccacaaggtttcggtggcatcaacccgcacccttcgataagcagcagacctgggcaattgataatgtgtatattggcgacggttgcatcgacatgtgttctggtcacggcaggtgtatccaggggaactgtgtgtgtgatgagcagtggggtgggctgtattgtgatgatccagagacgagtctccccactcagctgaaggacaacttcaaccgggctccttcttcccagaattggcttaccgtgaatgggggaaaattaagcacagtgtgcggcgctgtggccagtggcatggcattgcacttctcaggagggtgttcaaggcttctagtcaccgtggacctaaatctgaccaatgccgaatttatccagttttatttcatgtacgggtgtctcatcacccccaataacaggaatcaaggcgtcctactcgagtattctgtcaacggcggtatcacgtggaacctcctgatggagattttctatgatcaatattctaagcccggttttgtcaatattttgttacctcccgacgcaaaagaaattgccacaagatttcgctggtggcaaccaagacatgatggactggatcagaatgattgggcgattgataatgtcttgatttcaggatccgccgatcaacgcacagttatgctggacactttttcatcggcacccgtccctcagcatgagcggtcgcctgcagacgccggtccagtcggaaggatcgcttttgatatgttcatggaagacaaaacctccgtgaatgaacattggttgttccatgacgactgcacagtcgaacgattctgtgattctcctgacggggtcatgctctgcgggagtcacgatggcagggaagtctacgctgtcacccacgatctgacccctacagagggctggattatgcaatttaaaataagcgtcggttgtaaagtttcggagaagatagctcagaaccagatccacgtgcaatattcgaccgactttggggtttcttggaattacctggttccccagtgcctccctgccgaccccaagtgctctgggtctgttagccagccaagcgtgttcttccctacgaaggggtggaagagaattacctaccccctccccgaatcgctcgtcggcaacccagtgagattcagattctatcagaagtatagtgacatgcagtgggctatagacaacttttatctgggacccggatgcttagataattgtcggggacacggcgactgtctgcgggaacagtgcatatgcgacccgggttacagcgggcctaactgttaccttacacacacactgaaaacattcttgaaggagagatttgatagtgaggaaattaaacctgatctgtggatgagtctggaaggaggtagcacttgtaccgagtgcgggatcctagccgaggataccgcgctatatttcggaggctcaaccgtccgacaggcagtcacgcaagacttggatttgcgtggcgctaagttcctgcagtattggggtcgaatcgggtccgaaaacaatatgaccagctgccaccggcctatctgtaggaaggagggcgtccttttggattacagtaccgatggtgggattacttggacactgctccacgagatggattatcagaagtatatcagcgtcaggcatgactatattcttctgcctgaagatgcccttacgaataccacgcggttgagatggtggcagccttttgtaatctcgaacggcatcgtagtgagcggagtggaacgggcacagtgggctcttgacaacattctcattggcggagctgagattaatccatcccagcttgtggatactttcgacgatgagggtacttctcacgaggagaactggagtttttaccccaatgctgttagaacagcagggttctgtggaaatccgtccttccacttgtattggccgaacaaaaaaaaggataagactcacaatgcattaagcagtagggaactgatcatacagcccggttacatgatgcagtttaagatcgttgtcgggtgtgaggccacttcttgtggagatttgcacagcgtcatgctagaatacacgaaggacgcacgctccgacagctggcagctggtgcaaacacagtgtctgccctcctcatctaactctatcggctgtagtcccttccagtttcacgaggcaactatctataattcggttaactcttcttcctggaagcggatcaccattcagctgccggatcacgtgtcctcctcagctacccagttccgctggattcagaaaggcgaggagactgaaaagcaatcttgggcgatcgatcatgtttatatcggcgaagcatgtccaaagctctgcagcgggcatggttactgcactaccggggcaatttgtatatgtgacgagtctttccagggcgacgattgctcagtgttctctcacgaccttccatcatatataaaggataacttcgagtctgctcgggtcacagaagcaaactgggaaactatccaaggaggagtgatcggcagcggctgtggtcagctggcgccttatgcccatggagattcactgtacttcaatgggtgtcagattagacaagccgctaccaagccgctggacctcactcgagcaagtaaaatcatgttcgtcctgcagataggatcaatgagtcaaacagattcttgcaacagtgatttgtccggtccgcatgccgtcgataaggcagtgctcctgcagtattctgtcaataacgggatcacctggcatgttatcgcacagcatcagcctaaggacttcacccaagcacagcgagtgagctacaatgtgccactggaagccagaatgaagggcgttctgctgcgctggtggcagcctagacacaacggcactggccacgaccagtgggcgctggaccacgttgaggtagtgcttactcgcaagcagaactatatgatgaacttctcgcggcagcacggcttacgccacttctataatcgcaggagaaggagtctgcggcgttacccctaa

SEQ ID NO: 30588 - DNA, 10383 bp, Artificial Sequence
  Description of Artificial Sequence: Synthetic coding sequence
atggagagaagtggatgggctcgccagacattcctgctggcattactgctgggcgcaaccttacgtgcacgcgcagccgcaggatactatccaagattttcccccttcttcttcctatgtactcaccatggagaactggagggcgatggcgagcagggagaagtgctcatttccctccacatagccggtaatcccacttactatgtgcccggtcaagagtatcatgtcaccatctctacctcaacatttttcgatggcttgttggtcaccggattgtatacttctacgtccgtccaagcaagccaaagtatagggggaagcagcgctttcgggtttggaataatgtcggaccaccagttcggaaatcaattcatgtgcagtgtggtcgcttcgcatgtttcacatctcccaactacaaatttatcatttatatggatcgcaccacccgcaggcacagggtgcgtgaatttcatggctaccgctacccaccgaggacaggtaatattcaaggatgccctcgctcaacagttatgcgagcagggggctcctaccgacgttacggtgcatccccacctggccgagatccacagcgattcgatcattctgagagatgacttcgactcctatcatcagttgcagctgaatcccaacatctgggtagagtgcaataattgcgagacaggtgagcagtgcggcgcaataatgcatggcaacgccgttaccttttgtgagccctacggacctagggagcttatcacaactggccttaacacaactacagcttctgtgttacagttctcaatcggctccgggtcctgtagattcagttatagcgatccgtcaatcatcgtactttatgccaagaacaacagtgccgattggatccagctggagaagataagagctcccagcaatgtgagcaccattattcatatcctgtatctgcctgaggacgcaaaaggagaaaatgtgcagtttcagtggaaacaggagaacctgagagtgggcgaggtgtatgaggcatgttgggctttagataatatcctgataatcaattctgcacacagacaggtggtacttgaggactcactggaccccgtcgacactggaaattggcttttctttcccggtgcaactgtgaagcactcttgtcaatctgacgggaattctatctattttcacgggaacgaaggttcggaatttaactttgctacaacaagagatgtggacctgtctacagaggatattcaggagcaatggagcgaagagtttgagtctcagcccacggggtgggatgttcttggagcagtgataggcacagaatgtggtactattgagtctggacttagcatggtgttcctgaaagacggcgaaaggaagctgtgtacaccgtcgatggacacgaccggatatggaaatttacggttttattttgtaatgggcggtatctgtgacccagggaatagccatgagaatgacataatcctatacgcaaaaatagaaggcaggaaagaacacatcacgcttgacactctgtcttactcctcttataaggttcccagccttgttagtgttgtgatcaaccccgaactgcagactcccgctaccaagttttgtctccgtcagaaaaaccaccaggggcacaaccgtaatgtgtgggccgtcgatttcttccacgtcttgcccgtgctgccatccaccatgtctcacatgatccagtttagtattaatctaggttgtggtacccatcaacctggtaattccgttagtcttgaatttagtacgaaccacggacgaagttggtctcttctccacacagaatgcttacctgaaatctgcgctgggcctcaccttccacactccactgtgtatagcagtgaaaattattccggttggaatcgaattacgatcccactgccgaatgccgctctgaccagaaacacccggataagatggcgacaaaccgggccaattctgggcaatatgtgggcaatcgataacgtttatatcgggccatcttgcttaaagttctgttcagggagaggccagtgcacccgccatggctgtaaatgtgatcctggattttctggaccggcttgcgagatggccagccagactttcccaatgtttataagcgagagcttcggctcttcccggctctcaagttaccataacttctattctatccgcggtgccgaggtatcatttggatgtggggtgttagcctccgggaaagcactggtgttcaacaaggacggaagaaggcagttgatcacctctttcctggattcaagccagtcccgttttctgcaatttacattgagactaggttcaaagtccgtgctttcaacatgtcgggcaccagaccagcctggtgaaggagtcttgctgcattattcatacgataacgggattacctggaagctgcttgaacactacagctatctgtcttatcatgaaccaaggattatctcagttgagctaccaggtgatgccaagcagtttggcatacagttccggtggtggcagccttatcacagttcacagcgggaggatgtctgggccatcgacgagataatcatgaccagtgtcctgtttaactccatctcactggacttcacaaatttagttgaggtaacccagtctctcggattttatctgggtaatgtgcagccatattgcgggcatgattggacactctgctttactggcgattccaagctcgcaagcagcatgcgttacgtcgagacacagagcatgcagatcggggcatcatacatgatccagttttcactcgtgatgggctgcggacagaaatacacaccccacatggataaccaggttaagctcgagtactctaccaatcatggcctgacttggcatctggtgcaagaggagtgcttgcccagcatgccatcctgccaggagttcacatccgcatctatatatcatgccagtgagttcacacagtggcgcagagtgatcgtcttgctgccacaaaaaacctggagttcagctaccagatttcgctggagccagtcttactacacagcacaggatgaatgggcacttgattcaatctacataggccaacagtgtcctaacatgtgctcgggtcacggttcctgcgaccacggcatctgcaggtgcgaccaaggttaccagggaactgagtgccaccctgaagccgcactcccgtcaactatcatgtccgattttgagaaccagaatggctgggagagcgattggcaggaggtgattggcggtgagatcgtcaagcccgagcagggatgcggagttatatcaagtggatcatccttatacttcagcaaagcagggaagcgacagctagtgagctgggacctcgacacatcttgggtagatttcgtacagttctacattcagataggcggagagtcggcttcctgcaataagccggacagccgggaggagggggtgctgctgcagtatagtaataatgggggtattcaatggcatctgctggcggagatgtacttttccgattttagcaagcctagattcgtatacttggagttgccagctgccgctaagacgccctgtactcgctttcggtggtggcagccggtgttcagcggagaagattatgaccaatgggccgtggatgacatcatcattctgtcagagaaacagaagcagataattccggtgatcaatccaacactgccgcagaatttttacgagaagcctgcctttgattaccccatgaatcagatgtcggtatggctgatgttagccaacgaaggcatggtgaagaacgagaccttctgcgcagccaccccttcagctatgattttcggcaaatccgatggagatcgtttcgccgtgacaagagatcttacactcaaaccgggatacgtgcttcagttcaagctcaatattggatgcgcgaaccagttttccagcacagcccctgtgctcctccagtattcccacgacgcaggaatgagttggtttcttgtgaaagaggggtgttatccagccagcgccggaaagggatgtgagggtaactcacgggagctttcggaaccaactatgtaccacactggtgactttgaggaatggacccgcattaccatcgttatccctaggtccctggccagctctaaaacacgcttcaggtggatccaggagtcctcatcacaaaagaacgtccctcccttcggccttgacggagtgtacatctcagaaccatgccccagctattgttcagggcatggggactgtatttccggggtatgcttctgcgacttggggtatacagctgcccaaggtacctgcgtgagcaatgtaccaaaccataatgaaatgtttgatcgattcgaggggaaactgtcgcccctgtggtacaaaatcactggcgctcaggttggaactggctgtggtactttgaatgacggtaagtcgctgtacttcaacggtcctggcaaaagagaggcaagaacggtcccgttggatactcggaacattcgattggtgcaattctacatacagataggatccaaaacgtcaggtattacttgtatcaagccgagaactaggaacgaggggctgatcgttcagtatagcaacgataatggtattctgtggcaccttcttagagagttggactttatgtcatttctggaaccccagatcatttcaatcgatctgcctcaggacgccaagaccccagccaccgcatttagatggtggcagccccagcatggcaagcactctgcccaatgggcactggatgatgtccttattggcatgaatgatagctctcagacaggatttcaggacaaatttgacgggtccatcgatttgcaggcaaattggtatcgcatccaggggggtcaggtggacattgactgtttgtccatggacactgcactcatctttacagagaacataggtaagcccaggtacgctgagacatgggactttcatgtgagcgcttccacgttcttgcaattcgagatgagtatgggatgttctaaacccttcagtaacagtcacagcgtccagctgcagtactccctgaacaacggtaaagactggcatctagtgacagaggagtgcgtcccccctacaatcgggtgcttgcactacaccgagtcttccatctatacatctgaacgatttcaaaactggaaacgcattacagtgtacctcccactgtctactatttctcccaggacccgatttagatggattcaggccaattacactgtcggcgcagatagctgggccatcgataacgtggtactcgcatccggatgcccctggatgtgttccggaagaggtatctgcgacgctggcagatgcgtgtgtgacaggggctttggtggcccttattgtgttcccgtggtaccactcccctctattcttaaggatgatttcaatgggaacctacatccagacctgtggcccgaggtgtacggtgctgagcggggaaacctgaatggcgaaaccatcaagtctgggacttctctcatattcaagggtgaaggtttgagaatgttgatctcgcgagatttagattgtactaatactatgtacgtgcagttcagcctgaggttcatcgcgaaatccacacccgagcgttctcatagtatcctcctgcaattctccatcagcggaggcatcacctggcatctaatggacgaattctattttccgcagactactaacatcctgttcatcaacgtccccctgccttataccgctcagacaaacgccacccgctttcggctctggcagccttataataacgggaagaaagaagagatatggatcgtggacgatttcattatcgatggtaacaacgtgaacaacccagtgatgctgctcgacaccttcgacttcggacctcgtgaagataattggtttttctaccccggagggaatattggactctactgtccatactctagcaaaggggctccagaggaagactccgccatggtattcgtttcaaacgaggtaggagaacatagtatcactactcgcgacctcaatgtgaacgagaacacgatcatccagttcgagattaacgtagggtgttctacggactccagttcagcagatcccgtgcgactcgagttcagccgagacttcggcgctacttggcatctgctgttgccactgtgttatcacagctctagccatgtctcttcactctgttcaactgagcaccatcccagcagtacatattacgccggtaccatgcagggctggcggagagaggttgtccattttggaaagttgcatctgtgtggcagtgttaggtttaggtggtaccagggattttacccagcaggctcccagcccgttacgtgggccattgacaacgtgtacatcggccctcaatgcgaggaaatgtgcaacggacagggatcatgtatcaatggaacaaaatgtatctgtgacccaggatattctggtcccacctgcaagatcagcactaaaaaccccgattttctcaaggacgatttcgaaggacagctggagtcagaccggtttctgttgatgagtggcggtaagccaagtaggaagtgtggaatcttgagcagcggcaataatctgttctttaatgaagatgggttaagaatgctgatgacccgggaccttgacctgtcccatgcacgcttcgtgcaattctttatgcggctgggatgcggaaagggagttcccgacccaagatcccagcccgtcctgctccagtacagcctcaacgggggactgagctggtctctgctccaggagtttctgttttcaaatagctctaacgtgggtagatacatcgctctggaaattcctttgaaagcacgttcaggcagtactcgactgcgctggtggcagccctccgaaaatgggcatttctactccccctgggttattgaccaaatcttaatcggcggtaatatttcaggtaataccgtgttggaggatgactttacaacactggatagtcgcaagtggctccttcaccccggaggtaccaaaatgcctgtttgcggatctaccggagatgctcttgtgttcatcgagaaggcatctaccaggtatgttgtctctacagacgttgctgtaaatgaagattccttcctgcagatcgattttgccgcatcctgttcagtgaccgactcctgctatgctatagaactggaatatagcgttgatctgggcttgtcatggcaccctctggtgagggattgccttcccactaacgttgaatgcagccgttaccacctccagcgtattctcgtgagcgatacattcaataaatggacacgtattaccctgcccctgccaccctatacccggagtcaggcgacccgtttccggtggcatcagccggcaccattcgacaagcaacaaacctgggctatcgataacgtttacatcggcgacggatgtattgatatgtgctctggtcacggccgttgtatccagggcaactgcgtctgtgatgaacagtggggcggactttattgtgacgatcctgaaacaagcttacccacccagctgaaagataactttaaccgggctcctagttcacagaattggctcacagtgaacgggggtaaactatctacagtgtgtggcgctgttgcttccgggatggccctgcatttctctggaggctgctcacggctcctggtaacagtggacctgaatctgactaatgctgaattcatccagttttatttcatgtacggctgcctaattactccaaataacagaaatcagggggtgctgttagagtacagcgtaaacggcggtatcacctggaatcttctgatggaaattttctatgatcagtactccaaacctgggtttgtcaatattctcctgcccccagacgccaaagaaatcgccactagattccgctggtggcagccaaggcacgacggattggaccagaatgattgggcaattgataatgtgttgataagcggcagcgccgaccagcgcactgtcatgctggacaccttctcctctgcaccggttcctcagcatgagcgctcaccagctgatgccggtcctgtcgggaggatcgcctttgacatgtttatggaggacaaaacctctgtgaacgaacactggctcttccatgacgattgtacagttgagcggttctgcgattctcctgacggagtaatgctctgcggatcacatgacggtagggaagtctatgcagttacccatgacctcactcctactgagggctggatcatgcagttcaagatctccgtgggctgcaaagtctccgagaagatcgcccagaaccagattcacgtgcagtatagcactgacttcggggtctcatggaattacctagtgccacaatgtctgccagctgatccaaagtgttccgggagcgtaagccagcctagcgtttttttccctaccaaagggtggaagcggatcacctaccccttaccagaatccctagtggggaaccctgtgcggtttaggttttaccagaaatattccgatatgcagtgggcaatcgacaacttttatctgggtccgggatgcttggacaactgtaggggacacggagattgtctgagggagcaatgcatctgcgaccctggatacagcggcccaaactgttatttgacccacacactgaagactttcctgaaggagagatttgatagcgaagaaattaaacccgatttgtggatgagccttgagggaggctctacatgtacagaatgtggtattctggcagaggacaccgccctgtacttcggcggttctaccgtcagacaggccgtgacacaggatctggacctcagaggcgctaaatttcttcagtactgggggaggattgggagcgagaacaacatgacaagttgtcatcgcccaatctgcagaaaagaaggtgtgttgctcgactatagcacggacgggggaattacctggacactgttgcacgaaatggactaccagaaatacatctccgtgagacatgactatattttactaccagaggatgccctcactaacacgacgaggctgcggtggtggcagccttttgtcattagcaatggaatagtagtgtctggcgtggaaagggcccagtgggccctggataatattctgataggcggagcagagatcaacccctcccagctggtggacacttttgacgacgaaggtacatcccacgaggagaattggtccttttaccccaatgctgttaggacggcaggattctgtggcaatcccagtttccatctctactggccgaacaagaagaaagacaaaacacacaatgcgctgagcagccgagaattaattatacagcctggatatatgatgcagttcaagatcgtggtggggtgtgaggctacatcgtgtggcgatctgcacagtgtgatgctagagtacacaaaagatgctcgttcagattcgtggcaactcgtgcagacccagtgccttccctcttctagcaactccattggatgcagtccgttccagtttcatgaggcgacaatttacaattctgtcaactctagttcctggaagcggatcaccatccaactaccagatcacgtgagcagcagcgctacacaattcaggtggattcagaagggggaggagacggagaagcagtcctgggctattgaccacgtctatatcggcgaagcgtgcccgaagctttgttctggacacggctattgcaccactggagccatttgcatctgtgacgaatccttccagggagacgattgtagcgtttttagccatgatctcccttcctacattaaggataattttgagtctgctcgggtgacagaagccaactgggagactattcaaggtggggtgataggcagtgggtgtgggcaactggctccctacgctcatggcgatagtttgtacttcaatggctgccagatcaggcaagcagccacaaagcctcttgacctgacacgggcttctaagatcatgtttgtactacagattgggtccatgtctcagaccgactcatgcaatagcgatctgagtggacctcatgctgtggacaaagctgtgttgttgcagtattcagtcaataatggaatcacctggcacgtgatcgctcaacaccagcctaaagacttcacacaagcacaaagggtctcatacaacgttcctttggaagcaagaatgaaaggtgtcttactgcgatggtggcagccgcgacacaatgggacgggccacgatcagtgggctctggatcatgtcgaagtggtattgttctcgacaaggaagcaaaactacatgatgaatttctcgcgacagcatggtctgcggcatttctataaccggaggagaagatctctgaggaggtatccttaa

SEQ ID NO: 30589 - DNA, 2934 bp, Artificial Sequence
  Description of Artificial Sequence: Synthetic coding sequence
atgtgctctggccatggtcgctgtatccagggaaattgcgtatgtgacgagcagtgggggggtctttattgtgacgacccagagacctctctgccaactcaactgaaagataactttaatagagccccatcgtctcaaaattggctgacggtgaacggaggtaaactatccacagtgtgcggagccgtggcttccggcatggcgttgcatttttccgggggatgttcccggctactagtgacggttgaccttaacttgactaacgcagagttcatacaattttatttcatgtacgggtgtctgattactccgaacaaccgaaatcagggagttctgctggaatactcagtgaacggcggtattacctggaacctcttgatggagatcttctatgaccagtatagcaagcccggattcgtaaacatattactgcctccagacgcaaaggagatagcaacccggtttcggtggtggcagccccgacacgacgggctggatcagaacgattgggccatcgacaacgtcttgattagtggctccgcagaccagaggactgtcatgttagacacattcagctccgcaccagttccccagcatgagagaagtcctgccgacgccggtcccgtgggcagaatcgcattcgacatgttcatggaagacaagacgtcagtcaacgagcactggttatttcacgacgattgtaccgtagagaggttctgcgatagcccggacggggtaatgttgtgcggttcccatgatggcagggaggtttacgcggtcactcatgacctgactcccacagagggatggatcatgcagtttaaaattagcgtcggttgtaaagtgtccgaaaagatagcgcaaaaccagatccacgtgcagtacagtacggatttcggagtgagctggaattacttggtgccccaatgtctgccagctgatcctaagtgttcaggcagcgtgtcacagccctctgtgttttttccaaccaaagggtggaagcggatcacctatccactgccagagtccttagttgggaacccggtgcggtttagattctaccaaaagtattctgatatgcaatgggctatcgacaatttctatctgggcccaggatgccttgacaactgccggggacatggagactgcctgcgcgagcaatgtatatgcgaccccggatacagtgggcctaactgctacctgacacatacactcaaaacattcctcaaagagcgattcgactcagaggagattaaacccgacctgtggatgtccttggagggcggatctacctgtactgagtgtggaattctagccgaagacactgcgttatactttgggggatctacggttagacaggcagtaactcaggacttagacctgcggggagcgaaattcctgcagtactggggacgtatcgggagtgagaacaacatgacttcttgtcacaggcccatctgtaggaaggaaggggtgttgctggattatagcacggacgggggaatcacttggacactcctacatgagatggattatcagaaatatatctcagtacgccatgactacatcttgctgccagaagatgcgctgacaaatacgacccggctgcgctggtggcaaccatttgtcatctccaacggcatcgtggtcagcggcgttgagagggcgcaatgggctctggacaatattctgatcgggggtgcggaaattaacccttctcagctcgtggacacatttgacgatgaggggacgtcccatgaggaaaattggtctttctaccctaatgccgtgagaaccgccggattttgcggcaatccgtcctttcatctttattggcccaacaagaagaaagataagacacacaacgccctttcttcacgggagctgattattcagccgggttacatgatgcaattcaagatcgtcgtaggatgcgaggcaaccagctgtggggatctgcactctgtgatgttagagtacaccaaagatgcacgcagcgacagttggcagctggtgcaaacacagtgtctgccctcctcgagtaacagcattgggtgcagtccctttcaattccatgaagctacgatttacaactctgtaaattcaagctcatggaagcggatcaccattcaactccccgatcacgtgtcaagctccgccactcagttccgctggatccaaaaaggcgaggaaacggaaaagcaaagttgggcgattgatcatgtatatattggagaggcttgccccaagctgtgttcagggcacgggtattgtacaaccggggcaatctgcatctgcgacgagtctttccagggagacgattgctcagtcttctcacatgacctgccaagctatatcaaggataattttgagagtgcgagagttactgaggctaactgggaaacaatccaaggaggcgttatcggcagcggatgtggacagttggctccctacgcccacggagattccctctattttaatggttgccagattagacaggcggctaccaagccactggacctgacaagagcatccaagataatgtttgttcttcagattggctctatgagtcagaccgattcttgtaacagtgatctgtccgggccacatgccgttgataaagcggtgctcctgcagtattccgtaaataacgggatcacctggcatgttatagcccagcaccagcctaaggattttacgcaggctcaaagagtttcttataatgtacccctggaggccagaatgaagggtgtcctgctgaggtggtggcaacctaggcacaatggcaccggacacgaccagtgggctcttgaccacgtggaggtggttttagtgaccacacgcaaacagaactacatgatgaatttctcacgacagcacggactgcggcacttctacaaccggaggaggagatccttgcgccgttacccttag

SEQ ID NO: 30590 - DNA, 10382 bp, Artificial Sequence
  Description of Artificial Sequence: Synthetic coding sequence
atggagagaagtggttgggcgaggcagaccttcctgctggccctcctgcttggtgctacgttgcgggctcgggctgccgctggctattaccctcggttttctccttttttctttctttgtacccaccacggtgagcttgaaggcgacggcgagcagggggaggtgctgatctccttacacatcgctggtaatccgacttactacgtgcccggtcaagagtaccatgtgacaatttccactagtaccttctttgatggattactggttactggtttgtacacaagtacctcggtgcaagcgagccagtcaatcggcggaagctccgccttcggattcggaatcatgagtgaccaccagtttgggaatcaattcatgtgtagtgtggtagcatctcacgtgtctcaccttccaaccacaaatctgtcgtttatttggattgcccctccagccggtacaggttgcgtgaatttcatggccactgcaacccatcgaggtcaggtgatcttcaaggatgccttagcccagcaactctgtgagcagggagcacctaccgacgtgaccgtgcacccacacctcgccgagattcattcagatagcatcatactaagagatgactttgattcctaccatcagttgcagctgaaccctaacatctgggtcgagtgtaacaactgtgaaacgggcgagcagtgcggtgccataatgcatggaaatgctgtgaccttttgcgagccgtacggtccaagggagctgatcacaactgggctaaacacaacaactgccagcgtgctgcagttcagcattggaagtggttcttgccgcttttcctactcagatccaagcatcattgttctctatgctaaaaataacagcgctgattggattcagctagaaaaaatccgtgctccaagcaatgtttcgacaatcatccacattctgtacctgcccgaagacgcaaagggcgagaacgtgcaattccaatggaagcaggaaaatctgcgtgtgggggaggtttatgaggcttgctgggcacttgacaacattcttatcattaatagcgcccatcggcaggtagtgttagaagactctctggatcctgtcgacactggcaactggcttttttttcccggtgctactgtgaagcactcgtgtcagagtgacgggaactccatatacttccacgggaatgaggggtctgagtttaacttcgcgactacaagggatgtggatctgtcgaccgaggatatccaggagcagtggtctgaagaattcgagagccaacccaccggatgggacgtgctgggagcggtgatcggaacggagtgtggcaccatagaaagtggactctcgatggttttccttaaagacggagagagaaagctgtgtaccccgtccatggataccacaggatacggtaatctgaggttttacttcgttatgggagggatttgtgatcccggtaactcccacgaaaatgatattatcctgtatgccaagattgagggccgaaaagaacatattaccctcgatacactgtcttactcgtcatacaaggtacccagccttgtgtccgtggtgatcaatcctgagctgcaaactcctgcaacaaaattctgcctgaggcagaaaaatcatcaaggacacaaccggaatgtctgggcggtagatttttttcacgtgctcccagtgctgccatctaccatgtcgcatatgatccagtttagtattaacctgggttgcggcacacaccaacccggaaacagcgtgtccctggaattctctaccaaccacggcaggagctggagtctattacacacagaatgtcttccagagatctgcgcaggtccccatctgccacattcaaccgtctattcatccgagaactacagtggttggaacagaattaccatccctttgcctaacgcagccctgacaagaaacacacgcatccgctggaggcagactggacccatccttggtaacatgtgggccatcgataacgtatacattggcccaagctgcctgaagttttgttctgggagagggcagtgcactcgtcatggatgtaaatgcgatccagggttttctggccctgcctgtgagatggcctctcagacctttcccatgtttattagtgagtcattcggctcctctcggctgtcttcttatcataatttttactcaattcgcggtgccgaagtttcgttcggttgcggcgtcctggctagtggcaaagcgttggtctttaataaagacggcaggaggcagctcataacatcctttctggatagctctcaatccaggtttctacagtttacactgcggctgggaagtaaaagcgtcctgtccacgtgcagagcacccgaccagccgggagagggggtgctgttgcattacagttacgacaatggaatcacttggaaactgctggaacattactcgtatttgagttaccatgaacctaggattatttcggtcgaactgccgggagatgccaagcagttcggaatccagttcagatggtggcagccatatcactcttcacagcgcgaggatgtgtgggcaatcgacgagatcattatgacgtccgtcttgttcaactccatcagccttgactttactaatcttgttgaagttacacagtccttgggcttctaccttgggaacgtgcagccttactgtggacacgattggacactttgttttactggcgattctaaactggcgagctccatgaggtacgtggagacccaatccatgcagatcggtgctagctacatgatccagttttcactggtgatgggctgcgggcagaaatacactccacatatggacaaccaggtgaagcttgagtacagtactaaccatggactcacctggcatctggtgcaagaagagtgtctgccatccatgcctagctgccaggagttcacgtccgcatctatttaccatgccagcgagtttacccagtggcggcgagtcatcgtgctgctgcctcagaagacatggtcaagcgccacaagatttcgctggagccagagctattacaccgcacaggatgagtgggcacttgatagcatctacatcggacagcagtgtcctaacatgtgcagtgggcacgggtcatgcgaccacggcatctgtcgctgcgaccaaggataccagggaacggaatgtcaccctgaagcagcattgccttccaccatcatgtcggacttcgaaaatcagaacggatgggagtccgattggcaagaggtgattgggggagagatcgtgaagcccgagcagggttgcggtgtgatatcctccggctcttctctctatttctccaaagctgggaagcgacagctcgtgtcctgggatttggacacttcctgggtggacttcgttcagttttatattcagattggcggtgagtcggctagctgtaacaagccagattcacgcgaggagggggtcttgctgcaatactccaacaatggcggaattcaatggcacctgctggcagaaatgtatttctccgacttctctaaaccgcgattcgtatacctggagctgccagcagccgcaaaaacgccatgcacgcgatttcgctggtggcagccagtgttctccggagaggactacgaccagtgggctgttgacgacataattattctgtctgaaaagcagaaacagataatccctgtcatcaatccaacgctgccccagaatttctacgagaaacctgcttttgattatccaatgaaccagatgagcgtgtggctgatgctagcaaatgaaggtatggtcaagaacgagaccttttgcgccgcaactccctcagcaatgattttcggcaagtctgacggagaccgatttgccgtaacaagggacctgaccctgaaaccaggctatgtgctacagttcaaactcaacattgggtgtgctaatcagttcagcagtactgctccagttctgctgcagtactcccacgacgctggaatgagttggtttttagtgaaggaagggtgctaccctgcctccgccggaaaaggttgtgagggcaacagcagagagctttcagagcccacaatgtaccacacaggggatttcgaagagtggactcgcataaccatcgtaatccctaggagcctcgcatctagtaagacacgatttcgttggatccaggagagctcttctcagaagaacgtacccccatttggactcgacggggtgtacatcagcgaaccctgccccagctactgctcaggacatggagactgtatttcaggcgtgtgcttttgtgaccttgggtacacagccgctcagggcacatgtgtaagtaacgtacctaaccacaatgagatgtttgataggttcgagggaaaactgtccccactgtggtataagataaccggagcccaagtcggaaccgggtgcggaacgttaaatgacggcaaatcactgtattttaacgggccaggcaagcgggaagctagaaccgtaccactcgacacacggaatattagactggtccaattctacatccagataggttccaagacatcaggtatcacgtgcataaagcctagaactagaaacgagggactgattgtccaatactctaacgacaacggcatcctctggcatttattgagggaactggactttatgagcttcctggaacctcagatcatcagtattgatctcccacaggatgccaaaacaccagctacagcattccggtggtggcagcctcagcacgggaaacattctgcccagtgggcactagacgacgtgctcataggtatgaatgattcctctcagactggcttccaggacaagtttgatgggtctattgacctccaggcaaattggtataggatacaggggggacaggtggacatcgactgtctctcaatggatacagctctgatttttaccgaaaatatcggaaaacctcgctacgcggaaacctgggactttcatgtttctgcatcaactttcctccagttcgagatgtcaatgggatgtagtaagccattttccaattcacacagcgtccagttacagtactcgctgaacaatggaaaggattggcacttagttacagaagaatgtgttcctcctactatcggatgtttgcattataccgagtcaagcatctataccagcgaacggttccaaaactggaagcgtattactgtgtacctacccctctccaccatatccccgaggacgcgcttcaggtggatacaggctaattatactgtaggggctgactcctgggccatcgataatgtggtcctcgccagtgggtgcccatggatgtgcagcggcagaggaatttgcgatgcgggaaggtgcgtgtgtgacagaggctttggcggtccttactgcgtgccagtggtccccttaccctctatcctgaaagatgatttcaacggtaacctccatcctgatctctggcccgaggtttatggggctgaaagaggcaacctcaacggagaaacgatcaagagcggtaccagcctgatctttaagggagaaggcctgagaatgctgatctctagagatctcgattgtaccaacaccatgtacgtacagttcagtctcagattcatcgctaagagcacgcccgaaagatcacacagtatcctgctgcagttttctatttccgggggaatcacatggcacctgatggacgaattctatttcccacagacaacaaacatcttgttcattaatgtgccgctgccctatacagcccaaacaaatgccacgcggttccgactctggcagccctataataacggcaagaaggaagaaatctggatcgtggacgacttcataatcgacggtaacaatgtgaataatcctgtgatgctccttgatacattcgactttggaccgcgagaggacaattggttcttctacccaggaggcaatataggactatactgtccatatagcagcaaaggggctcccgaagaggactcagctatggtgttcgttagcaacgaggtgggcgagcactccataacaacgcgcgaccttaacgtcaacgagaataccatcattcagttcgaaatcaacgtcggttgtagcactgacagctctagcgctgatcccgttcgactggaattttctagagacttcggcgctacttggcatctcctgctgccgttgtgttatcactccagtagtcatgtgtcttccttgtgttccacggagcatcacccttccagcacatactatgcaggcactatgcagggttggcggagggaggttgttcactttggcaagctgcacctttgcggtagcgtcagatttaggtggtatcagggtttttatccggctggcagtcaacctgtgacctgggctatagacaacgtgtacatcggaccccagtgcgaagaaatgtgtaacggtcagggttcctgtatcaacggcacaaaatgcatttgcgacccagggtacagcggcccaacatgcaaaattagcaccaagaatcctgactttctgaaggacgatttcgagggtcagcttgagtcagacagatttctgttgatgtctggaggtaagcccagtcgcaagtgtggtattctttcctcaggtaataatctgttctttaacgaggacggcttgaggatgctgatgacgcgggacctagacttgtcacacgctagattcgtccaattttttatgagactgggatgtgggaagggggtgcccgatcccagatcacagcctgtgctgctgcagtacagcctcaacggcggactgagttggagcttgctgcaggagttccttttctcaaactcctctaacgtcggacgatatatagcattggaaattccactgaaggcacgatcaggcagtacaagattgcggtggtggcaaccaagtgaaaacggccacttctactctccttgggtgattgatcagatcctgatcggaggcaacattagtggcaataccgtcctcgaagacgattttaccacattggattcaagaaaatggttgcttcatcccggagggaccaagatgcctgtgtgcggtagtactggcgatgcactcgtatttattgaaaaggctagtacgagatacgtagttagcacagacgttgcagtgaacgaggactcattcttgcagatagactttgctgcttcctgctcggttaccgatagctgttacgctattgaattggagtattctgtcgacctcgggctgtcatggcatcctctagtacgagattgcttgccgaccaacgttgagtgttcgaggtatcacttacagcgcatcctggtgtctgacaccttcaataaatggacaaggattactctgcctttgcccccatatactagatcgcaggcaacgcgctttcgttggcatcagcctgcaccgttcgacaaacagcagacctgggctattgacaatgtctacatcggagatggctgtatcgatatgtgttctggacatggtcgctgtatccagggcaactgcgtgtgtgacgagcagtggggcggtctgtattgcgatgaccccgagactagcctcccgacccaactgaaagataattttaaccgggcaccttcctcccaaaactggctcacagtcaatgggggaaagcttagcacagtttgtggcgctgtggcctctggcatggcattgcacttttctggcggttgcagccgcttgctcgttacagtggatttgaacctgaccaacgccgagtttatccagttctattttatgtatgggtgcctgattacaccaaataaccgtaaccagggggtgctgcttgaatactcagtgaacggaggcattacatggaatcttctgatggagatcttctatgaccaatacagtaagccaggattcgtgaatattctgctgccgccagatgctaaggaaatcgctacgaggtttagatggtggcagcctcgccacgacggcctggaccagaatgactgggccatcgacaacgtgctgatatccggaagcgctgaccaaaggactgtcatgctcgataccttctcttcagcacctgtcccacagcacgagcgctctcccgcagatgcgggaccagtgggacggatcgccttcgacatgtttatggaagacaaaacgtcggtcaatgaacactggctgttccatgacgactgtactgtggagcgcttctgtgatagtcctgacggagtaatgttatgcgggtctcacgacggcagagaggtctatgcagttactcacgatttaactcccaccgaaggctggattatgcagtttaagatctctgtagggtgcaaggtcagtgagaagatcgcacagaaccagattcatgtgcagtactctaccgacttcggcgtgtcttggaactatctcgtgccccagtgtctacccgcagatcccaaatgcagcggatctgtgtcccagccaagcgtattctttcctaccaaagggtggaaacggatcacttaccctttaccagaaagcttagtaggtaacccagtccgcttcagattttaccagaagtactcggacatgcagtgggcaatcgataatttttacttgggaccaggctgtctggacaactgccggggtcatggggactgcctgcgggagcagtgcatttgcgatccaggttacagcggtcctaactgttacctcacccacacgctgaaaacctttctgaaggagcgctttgattctgaagaaataaaacctgatctatggatgtccctggagggcggttctacttgcaccgagtgtggaatactcgcggaggacaccgctctgtatttcggcggttccacggtgcgtcaagcggtgacacaggacctagacctgcgtggtgctaagttcctgcagtattgggggcgtatcggaagcgagaataatatgaccagctgccacagacctatttgcaggaaggaaggcgtcttgctggactacagcaccgacggcggaatcacttggacgctccttcacgagatggattatcagaagtatatctctgttcggcatgactacatcttactccccgaggacgccctcactaatacaactcgccttcgatggtggcagcccttcgttatctcaaacggcatcgtcgtgtcaggggtggaacgggcacaatgggctctcgataacattctgataggcggtgcagagattaacccttcccaactggttgataccttcgatgacgagggcacaagtcatgaggaaaattggagcttctatcccaacgctgtgagaactgctggcttctgtggcaatccatctttccatctgtactggcccaacaagaaaaaggacaagactcataacgcgctgtccagccgggaactgataattcagccaggatacatgatgcagtttaaaattgtagttgggtgtgaagcgacgtcctgcggggaccttcactctgtgatgcttgaatacacaaaagatgcacggagcgattcgtggcaactcgtgcaaacacagtgtttacctagctcatccaacagcattggctgttcccctttccagtttcatgaggctaccatctataattccgtgaactctagttcatggaagaggattacgatccagctgcccgaccacgtatccagctccgcaactcagtttcggtggatacaaaagggggaggaaactgaaaagcaatcctgggcgatcgatcatgtttacataggcgaagcttgtccgaagctttgcagtggacacggatattgcaccacaggcgcaatctgcatctgtgacgaatcgttccaaggggacgattgcagtgtcttttcacatgatttgccctcgtatatcaaggataactttgaatccgccagggtcactgaagccaactgggagactatacagggtggggtgataggatctgggtgcggccagctggccccttatgctcatggtgactcgctgtatttcaacggctgtcagattaggcaagccgcaacaaagcctctcgatctaacaagagcctcaaagataatgttcgtcttgcagatcgggagcatgagccaaacagactcctgcaacagtgacctttctggcccacacgctgtggataaggccgtgttgctgcaatactcagtgaacaacgggatcacctggcatgttattgctcagcaccagccaaaagattttacccaagcccagagagtctcatacaacgtgcctctggaagcgagaatgaaaggtgtgctgctgcgctggtggcagccgcgtcataatggcaccggccacgaccagtgggctcttgatcacgtcgaagtagtactggtgagtacccggaaacagaactatatgatgaacttctcaaggcagcacgggttaagacacttttataaccgccgaagacgaagcctgcgccgataccccta

SEQ ID NO: 30591 - DNA, 10284 bp, Artificial Sequence
  Description of Artificial Sequence: Synthetic coding sequence
atggagcggagtgggtgggcccgtcagactttcttgctggctctcctcctgggggctacccttcgggctagagccgctgcaggctactatcctaggtttagcccctttttttttctatgtactcatcacggcgagttggaaggggacggggaacaaggcgaggtgctaatttccctgcatatagccggtaaccccacatattacgtacccggacaggaataccacgtcacgattagcacatctacattttttgacgggctactagtgacaggactgtacacaagcacctccgtgcaggcaagccaaagtattggcggaagctctgcattcggattcgggatcatgtccgatcaccagttcggcaaccaatttatgtgctcagtagttgcatcccacgtgtcccacctgccaactacaaacctctcgttcatctggatcgctccacccgctggcacaggctgcgtgaacttcatggcaacagctacacaccggggtcaggtcatttttaaagatgccctggctcaacagctgtgcgagcagggggcaccgacagacgtcactgtgcaccctcaccttgctgagatacactccgactccatcattctgcgggacgatttcgactcctaccatcaactgcaattgaatcctaatatatgggtggaatgtaataattgcgagactggagagcagtgtggcgctatcatgcacggaaatgccgttacattttgtgagccatacggacctcgcgaactgatcaccactggcctgaatactaccactgcatccgtgttgcaattcagcataggctctgggagctgtcgcttcagctacagtgacccaagcatcatcgtgctttacgcaaaaaataattctgccgattggattcaactcgagaagatcagggcaccgtccaatgtttctactatcatccatattctgtacctccccgaggacgccaagggcgagaatgtccagttccaatggaaacaggaaaaccttagagtcggcgaggtttacgaggcatgttgggctctggataatatcctcattatcaactctgcgcataggcaggtagtgctggaggactccctagaccctgtggatacagggaactggttgtttttccctggagccactgttaagcactcctgccagagcgacggaaattctatctacttccatggcaatgaggggtcggaatttaattttgctactacaagggatgtagaccttagtaccgaagacatccaggagcagtggtcagaagaatttgagtcccagcccaccgggtgggatgttttgggggcagtgatcggaaccgagtgcggtacaattgagtctgggcttagcatggtgttcctcaaggacggagagagaaagctttgtaccccaagcatggacacaacaggatatggaaacctcagattttacttcgtcatgggaggaatttgtgaccctggcaattctcacgaaaatgacattatcttatatgccaaaatcgaggggcgaaaggagcatatcaccttagacactttgagttattcttcttataaagtgccatccctggtcagtgttgtaattaatccagaactgcaaacccccgcaacaaaattctgcctgcgccagaaaaaccatcaagggcataatcgaaacgtatgggctgtcgacttcttccacgtactgcccgtgctaccaagcaccatgagccacatgattcagttttccattaacctggggtgtggcacgcaccagcccggaaactcagttagtctggagtttagtaccaaccatggcaggtcctggagtcttctgcatacagaatgcctccctgagatctgtgcaggaccccatttgccccatagcacggtgtacagctcggaaaattattcagggtggaatcggataaccatccctctgcccaatgcagcactcaccagaaatacaagaataaggtggcgccaaaccggtccaatactagggaacatgtgggccattgataatgtctacattggtccaagctgtctaaaattctgttctggtcggggtcagtgtacacgtcacgggtgtaagtgtgaccctggcttttcgggccctgcctgcgaaatggcaagccaaacatttcccatgtttatctcagagagcttcggatcttcccgactgtcatcctatcataacttttattccatacgcggagccgaggtgagcttcgggtgtggtgtcctggcctccggcaaagcactcgttttcaacaaagacggaaggcgccagctgatcacatcctttctggactctagtcagtctaggtttttgcaatttactcttaggctgggatctaagtctgtcctgtccacctgccgcgctcctgaccaaccaggcgaaggagtcctgcttcattatagctatgataatggcatcacttggaaactgctggagcattactcatatctctcttaccacgagccgaggataatatctgtggagttaccgggtgacgctaaacagttcggtatccagttccgctggtggcaaccttaccacagttctcagcgtgaggatgtttgggccattgatgaaattataatgacatcagtgctcttcaatagtatcagtttggatttcaccaatttggttgaggtcacccagtctctgggtttctatctgggaaacgttcagccatactgcgggcatgactggaccttatgctttaccggtgactccaaacttgcaagttcgatgagatacgtagagacccagtcaatgcagattggcgcatcttacatgatacagttctctctcgtgatgggatgtggacagaaatatactccacacatggacaatcaggtgaaactggaatactcgactaaccacggcctaacgtggcatttggttcaggaagaatgcctcccttctatgcccagttgtcaggaattcacctctgcctctatctatcacgcctctgaatttacccaatggcgcagagtgatcgtgctcctcccccagaaaacttggtcaagtgctacccggtttagatggtcccaatcctactatacagcgcaggatgagtgggcccttgactctatttacatcggacagcagtgccccaatatgtgttctgggcacggaagttgcgaccatggaatatgtcgatgtgaccagggataccaagggaccgaatgtcacccagaagcggcactgccctccactattatgagtgactttgaaaaccaaaatggatgggagtccgactggcaggaggtgattggtggtgaaatagttaagccagaacaggggtgtggcgtgatatccagcgggtcctctctgtacttctccaaagcaggaaagcgccagctagtttcttgggatctggacacctcatgggtcgatttcgttcagttctatatccagatcgggggtgagtctgccagctgcaacaagccagactcccgtgaggaaggagtgctcttgcagtactcaaataatggaggtattcagtggcatttattggccgagatgtatttttccgacttctccaagccacgcttcgtgtatctcgagcttcctgccgcagcaaaaaccccttgtaccaggttccgctggtggcaacccgtctttagtggcgaagactacgatcaatgggcagtggatgatatcatcatcctgagtgaaaaacagaagcaaatcatccccgtcattaaccctaccctcccccagaacttctatgagaaacccgcttttgactacccaatgaatcaaatgtcagtgtggctcatgctggcaaacgaggggatggtaaagaacgaaacattctgcgctgcaaccccttcggcgatgatctttgggaagagtgatggggacagatttgctgttactcgggacctgactctcaagcccggatacgtgctccaatttaagctgaatattgggtgtgccaaccagttctcttcgacagccccagtcttgctgcaatacagccacgacgcaggaatgtcttggttcctggttaaagaggggtgctacccggctagcgctggtaagggatgcgagggcaattcccgagagcttagtgagccaaccatgtaccataccggcgactttgaggagtggaccagaatcaccatagtgataccaaggtcactggcaagcagtaagacccgcttcaggtggatccaggagagttcatcacaaaagaatgtcccgcctttcggtctcgacggggtttatatctccgagccatgtccgagctactgttctgggcatggcgattgcatcagcggggtgtgtttttgtgatctgggttacaccgccgcacagggcacctgcgtctctaatgttcccaatcacaatgagatgtttgatcggtttgaaggcaaactttctcctctctggtacaagattaccggcgcacaagtgggcaccggatgcggcaccctgaacgatggaaaaagcctgtactttaatggacctgggaagagggaagcacggaccgtgcccctggatacccgcaatattcgcctggtgcagttctacattcagattggctctaagacctccggcattacctgcattaaaccccgtacacgcaacgaagggctcattgtacagtatagcaatgataatgggattctgtggcacctgcttagagaactcgatttcatgtcctttcttgaacctcagatcataagtatagacctgccccaagatgccaagacccccgctacagccttccgttggtggcagccccagcacggcaagcacagcgcacaatgggcactggacgacgtgctcattggtatgaatgatagcagccagacaggtttccaagacaaattcgatggaagcatcgacctgcaggcgaactggtataggatccagggtgggcaggtagacatcgattgcctgtccatggacactgcccttatttttactgagaacatcggaaaaccccgatacgcagaaacttgggacttccacgtgagcgcaagcacgttccttcagtttgagatgtctatgggatgctcaaaaccctttagcaactcgcattcagtccagctccagtactcgctgaacaacgggaaggattggcatctggtaacagaggaatgcgtgcctccaacaatcggttgtctgcactacactgagtcctccatctatacgtccgaaaggttccagaattggaaacgcataactgtgtacctgcctttgtccactatcagtcccagaacccgctttcgctggatccaggcgaattatacagtcggagccgattcgtgggcaatcgacaacgttgtgctggcatctggatgtccatggatgtgcagtgggaggggcatttgcgacgcagggaggtgcgtgtgcgatcgcggattcggcggtccctactgtgtgcctgtggtgcctttgccttctatactgaaagatgatttcaacggtaatctgcaccctgacctttggcccgaggtctatggagccgagcggggaaatctgaatggcgaaacaatcaaaagcggcaccagtcttatatttaagggcgagggactccgcatgctcatttctcgggacttagattgcaccaacactatgtatgtccagttctcgctccggttcattgcaaagagcacaccggaacggtctcatagcatactgttgcagtttagcatctccgggggtattacatggcacctgatggacgagttctactttcctcagaccacgaacatactctttatcaacgtccccctcccctatactgcccagacaaatgccactcgttttcgactatggcagccctacaacaacggtaaaaaagaggaaatttggatcgtcgatgatttcattattgatggcaataatgtgaataatcctgttatgctgttagatacctttgacttcggaccacgcgaggacaactggttcttctatcccggtgggaatattggactatactgtccttactcaagtaaaggagctcctgaggaggactcagcgatggtgtttgtctcaaatgaagtgggcgagcacagtattaccacgcgtgacctgaacgttaacgagaacacaatcattcagtttgaaatcaatgtcggttgtagcaccgacagttcctcagccgatccagtgcgccttgagttttcacgtgacttcggggctacctggcatttactgctgcctctatgctatcactcctcctcccatgtgagctcactatgtagcaccgaacaccaccctagtagcacgtattacgcgggaactatgcaggggtggagaagagaagtggtacacttcggaaaactgcatctgtgtgggtccgtgcggttccggtggtatcaagggttttaccctgctggctcacagcccgttacttgggcgatcgataatgtgtacattggccctcagtgcgaagaaatgtgtaatgggcaggggtcctgcataaatgggactaagtgcatctgtgatcccggttattccggtccaacatgtaaaataagtactaaaaatccggactttctgaaagatgacttcgagggccaactggagtctgacaggtttctgctgatgtctgggggtaagcctagccggaagtgcggcatcctgtcttccggtaataacttattctttaacgaggacgggttgaggatgttgatgactagggaccttgacctgtcccacgcgagattcgttcagtttttcatgagattgggctgtggcaaaggcgtgcccgatccaaggtcacagcctgtgctgcttcagtattctttgaatgggggtttatcatggtctttgctgcaggaattcctgttttctaatagctctaacgtaggcagatacatcgcactggagattcctctgaaggcccgttccggatctacacgcctcagatggtggcaaccatccgaaaatggccacttctactctccatgggtaattgatcagatcctaatcggcggtaacatttctgggaataccgtgctcgaggacgacttcacaacgcttgatagcaggaagtggctgctgcaccccggaggaactaaaatgccagtttgcggctccaccggggatgcactggtgtttattgagaaagcaagtactagatatgtcgtgtctaccgatgtggccgtgaatgaagatagcttcctccagatcgactttgctgcaagctgctcggtcacagactcctgttatgcaatcgagcttgaatactccgtcgacttaggcctgtcgtggcaccctctggtgagagattgcttacccactaatgtcgaatgttcgagataccatctccagcggatcttggtgtctgatactttcaataagtggacaagaattaccctccccctgccaccgtatacacggtcccaggcaaccaggttccgttggcatcagcccgctccattcgacaaacaacagacctgggctattgataatgtgtacattggagatggctgcatcgatatgtgtagtggccacgggagatgtattcagggtaattgtgtgtgtgacgaacagtgggggggactgtactgcgacgatcctgagacgagtctccccacacagctgaaagacaactttaatagagccccttccagtcagaactggcttaccgtcaacggcggaaagctctcaactgtttgtggagctgtggcaagcggtatggcactacacttcagcgggggttgcagcaggctgctagttacggttgatctgaacctgactaatgcagagtttatccagttctactttatgtacggctgtctgattaccccaaataataggaaccagggcgtgctcctcgagtactcggtgaatggcggaattacttggaacctcctaatggagattttttacgaccagtacagcaagcccggtttcgttaacatccttctgccgccagacgccaaagaaatcgccaccaggtttcggtggtggcagcccaggcatgatggattggaccaaaatgactgggccatcgacaatgtgctcatttctgggagtgctgatcagagaacagttatgctggacactttttcgtctgcgcctgtgccccagcacgaacgaagtcctgccgatgctgggccagtgggcaggatcgctttcgacatgttcatggaggataagactagtgtgaacgagcattggctctttcacgatgattgtacagtggaaaggttctgcgactcccccgacggagtgatgctgtgcggatcccacgacgggagggaggtgtatgcagtgactcacgacctgactcccaccgagggttggatcatgcagttcaaaatatccgtcggatgcaaggtgtcggagaagatcgcccagaaccagatccacgtccaatattccacagatttcggtgtcagctggaattatctcgtcccccagtgcctacctgctgaccctaagtgttccggtagcgtgtctcaacccagcgtcttcttccctacgaaaggctggaagagaataacttacccacttcccgaatccctcgtgggtaacccagtaaggtttaggttctaccaaaaatattccgacatgcagtgggcaatcgacaatttctatctgggccctggatgcctcgataattgccggggacacggcgactgtttgcgcgaacagtgcatatgtgacccgggatacagtggacccaattgttatctgacgcatactctcaagacctttttaaaggagagattcgattcagaagagatcaaacccgatctctggatgagtctggagggtggctccacctgcacggagtgtggcatcctagccgaggacaccgccctgtatttcggagggagcaccgttcgtcaagccgtcactcaggatctggacttgcggggagccaaattccttcaatactggggtcgtattggatcagagaataatatgacctcttgccaccgacccatctgtcggaaagagggggtgctgctcgactattctacagacgggggtataacatggacattgctccacgagatggattaccagaaatacattagcgtcaggcacgactacatcctgttacccgaggacgcgttaacaaatacaacacgcctgaggtggtggcagcccttcgtgatttcaaacggcatcgtagtttccggggtggaacgcgctcaatgggccttggataacatactgatcgggggagcagagatcaacccgtcccagctggtggacaccttcgacgatgagggcaccagtcatgaagaaaattggtcattctacccgaacgccgtgaggacagctgggttttgtggcaaccctagttttcatctgtactggccaaataagaaaaaggataagacccacaacgcacttagttccagagagctcatcattcaaccagggtacatgatgcaattcaaaattgtagtggggtgtgaagcaacatcgtgtggtgacctgcactccgttatgctcgagtataccaaagacgcccgaagtgattcatggcagctagtgcagactcagtgcttgccaagtagctcaaactccattggatgcagtccgttccagttccacgaggctacaatctacaactcagtgaactccagctcatggaaacggatcaccatccagctcccagaccatgtgagctcatctgcgacacagtttaggtggattcagaagggagaagaaaccgaaaaacagtcctgggcgatagatcatgtgtacatcggagaggcctgcccaaagctgtgcagcggacatggctattgcacgacaggcgctatttgcatttgcgatgagtctttccagggtgatgattgctcagtcttcagtcatgaccttccttcatatatcaaggacaacttcgagtccgcacgtgtcacagaggcaaactgggaaacaatccagggtggcgtgatcggctctggatgcggacagctcgctccatacgcccatggcgacagcctgtatttcaatggttgtcaaataaggcaggctgccacaaagcccctggatctgacgagagcctccaagatcatgttcgtcctccagatcggctctatgtcacagacagacagctgcaattcggacctgtccgggccacacgctgtggacaaagcagtactcctccagtattccgttaacaatggaattacctggcacgtaatcgcacagcaccaaccaaaagatttcactcaggcccagagggtctcatataatgttcctctagaagcacggatgaagggggtgcttctgcggtggtggcaacccaggcacaacggcactggccacgaccagtgggctctcgaccatgtagaggtcgtgctataa

SEQ ID NO: 30592 - DNA, 1668 bp, Artificial Sequence
  Description of Artificial Sequence: Synthetic coding sequence
atgaagaagcacgattttgcagaaaacctcccctctagcctcctgatcatcatcctcgttatctttaccctgtctgggagcaaattcggccgaggaacgggcctgacccagccctctcagcgtacttcggccaggagatcgttcgggagaagtaagagatttagcattactaggagcctcgacgacctcgagtccgcaacggtgagcgatggcgaactcaccggtgccgacctgaaggactgtgtgtctaacaatagcctgtctagcaacgcttctctgccgagcgttcagtcttgtcgcaggcttcgcgagaggagagtggctagctgggcggtgagcttcgagaggttgctgcaagaccctgttggtgtgcgttactttagcgatttccttagaaaggagttttcagaggagaacattctcttctggcaggcatgcgagtactttaaccacgtgcctgctcacgacaagaaggaactaagttacagggcccgagagatattcagcaaatttctgtgctccaaggccacaacccccgtcaacattgattcccaggctcagctggcagatgatgtactgagagctccacatccggatatgtttaaggaacaacagcttcaaatttttaacctgatgaagttcgatagctacactcggttcctaaagtcgccattataccaagaatgcatcctggccgaggtagagggacgagccctgcccgattctcagcaggtcccttccagccctgcatcaaagcactccttgggaagcgatcattctagcgtgagcacacccaagaagctgtctggcaagtccaagtctggtaggtctctgaacgaggagctcggagacgaagattctgaaaagaagcgcaaaggcgcattcttctcctggagtaggacccggagcactggcagatcccagaaaaagcgggagcacggtgaccacgcggatgatgctctacacgctaacgggggactttgtaggagagaaagccagggctcagtttcctctgccggatcactcgacctgtccgaggcctgtagaaccctcgctcccgagaaggataaggcaaccaaacactgctgtattcatttacccgacgggacctcatgtgtggttgcggtgaaggcgggattctctataaaggatatactgagcggcctgtgtgaaagacacgggattaacggcgctgccgctgacctttttctggttggtggagacaaacctctggtcctgcatcaggactccagcattctggagtctcgtgatcttcgacttgaaaagagaacactgtttcgcctggatcttgtgccgatcaacagaagtgtcgggctgaaagccaagcccacaaaacccgttaccgaggtactgcgccctgtcgtggccaggtacggcctggacctgagtgggctcttagtgcgcctgtccggagaaaaagagcctctagacctgggcgctcctattagcagccttgatggacaaagggtagttctcgaggaaaaggatcccagtcggggaaaagctagtgcagataaacagaagggtgtacctgtcaagcaaaacaccgctgtgaactccagtagccgtaaccattctgcaacaagtttcctgtctctgttcccaaagctcagggctaccgaacaaatgaccaatgtgggctgctag

SEQ ID NO: 30593 - DNA, 4131 bp, Artificial Sequence
  Description of Artificial Sequence: Synthetic coding sequence
atgttcagggcaggcgaagcctcaaaacggcctctacccggaccctcacctccacgtgtgcggtccgttgaagttgccagaggacgcgcaggatacggcttcacactgtcgggccaagcaccttgcgtgttatcgtgtgttatgaggggcagccccgcagactttgtaggtctgagagctggtgaccaaatcctggcagttaacgaaatcaatgtgaagaaggctagccacgaggatgtggtgaagctaatcggaaaatgctcaggagtgctgcacatggttatagccgagggcgtgggtcgtttcgagtcctgctccagcgatgaggaaggcggattgtatgagggtaagggttggctgaagcccaagctagattcaaaggccctgggtatcaatagagcggagagggtggttgaagagatgcaaagcggtggcatcttcaatatgattttcgagaacccaagtctgtgcgcttcaaactcagaacccctgaagctgaaacagaggtccctgagcgaaagcgccgctacacgatttgatgtgggtcatgagagcattaataatcccaatccaaatatgctgtccaaagaggaaatttccaaggtgatacacgatgattccgtgttctccatcgggctggaaagccatgatgactttgcccttgatgcctctatccttaatgtcgctatgatcgtcgggtaccttggttcaatcgaactgcctagcacctccagcaatcttgaatccgacagcctgcaggccatccgcggttgtatgcggaggctcagagccgagcagaagattcattcgctggtgacgatgaagatcatgcatgattgtgtgcagctcagcacagataaagccggtgtggttgccgaatatcccgctgaaaaactcgcttttagcgcggtctgcccggacgaccgacgtttctttggtctggtcactatgcagacaaacgatgacggtagcctggcacaggaagaggagggcgctctgcggactagctgccacgttttcatggtggaccccgacctctttaatcacaaaatacaccaggggattgctcgcaggtttggctttgaatgcactgcagacccggataccaacggctgcctggaattccccgcaagcagtctgccagttctacagttcatctcagtcctctaccgggacatgggtgaattgattgaaggcatgcgggctagagccttcctcgatggagatgctgacgcacatcagaacaattccacctccagcaattccgactctggaatcgggaacttccaccaggaggagaagtccaaccgcgtgctggtcgtggaccttgggggaagctcttcacggcacggacctggcggttccgcctgggacggagtggggggacgcggagcccagccctggggagcaccctggacagggccattttgtcccgatcctgaaggctctcctcctttcgaggccgctcaccagactgaccgattctgggatctgaacaaacacctcggaccagccagcccggtagaggtaccacctgcctcactgcgcagctccgtgccccctagcaagagggggacagtgggcgctggctgcgggttcaaccagcgctggctgccagtccacgtgctccgcgagtggcaatgcggccacacatctgaccaggactcatacactgattcaactgacggctggagctcaatcaattgtggtacgttaccacccccaatgagtaaaattcccgctgacagatacagggtagagggaagctttgcccagcccccactgaatgctccaaagcgcgaatggtcacgcaaagcttttgggatgcagtctatttttggccctcacagaaacgttcggaagacaaaggaggacaaaaagggctccaagtttggaagaggaactggtttgactcaacctagccaacgcacctccgccagaaggagttttgggaggagtaagcgtttttcaattacccgtagcttagacgacctggaaagcgcgaccgtgtcagatggggaactgactggggcagacctcaaggactgtgttagcaacaatagcttatccagtaacgcctccctgccatcagtgcagtcgtgccggagactgagagagaggcgagtggcctcatgggcagtgtcatttgagaggctgctgcaggatcctgtaggcgtgaggtacttctccgatttcctcagaaaagagtttagcgaagagaacatcctgttctggcaggcatgcgaatattttaatcatgtaccagcgcatgacaaaaaagagctgagctaccgtgccagggagatctttagcaagttcctgtgctccaaggctaccacccccgtgaacatagactcgcaggcccagctcgccgatgacgtgctacgggcaccacacccagatatgtttaaggagcagcagttgcaaatatttaatttgatgaaattcgacagctatacgcgcttcctgaaatcccctctgtaccaggaatgtattcttgctgaagtggaagggagggcactcccagactcgcagcaagtgcccagcagccccgcttccaagcactcactgggttccgaccatagcagtgtgagtactcccaaaaaactatctggcaagagcaagagtggacgatcgcttaatgaggagctgggtgatgaggattcagagaagaagagaaagggggctttcttttcatggtctcgaaccagatctactggcagaagtcagaaaaagagagagcacggggatcacgcagatgatgctctgcacgccaatggtggactatgccgccgagagagtcaggggagcgtaagcagtgccggaagtctggacctgagcgaggcatgtagaacactggccccagaaaaagacaaggctacaaagcactgctgtatccatctgccggacggcacaagctgcgttgtcgctgtgaaagcaggattctccattaaggacattctgtccggactatgcgagcggcacggaatcaatggggcagccgctgacctgttcctggtcggaggcgacaaacccctcgttctccatcaagactcttcaattctggagtcgcgcgacctgcggcttgaaaagagaactttgttcaggcttgatctggtacctattaataggtctgtcggcttgaaggctaagccgaccaagcctgtgacagaagtcctcagaccagtggtggcaagatatggattggatcttagcggcttgcttgtaagactgtcaggcgaaaaggagcccctcgatttaggtgcccctatatcctccctggatggccagagagtcgtgctggaagagaaagatcctagcagggggaaagcatctgcggacaagcagaagggagtgccagtcaagcagaacactgctgtaaatagctccagccgtaatcacagcgctactggggaagaaagaacactggggaaaagcaattccatcaagataaagggcgagaacggaaaaaacgcacgggatcctcggctttccaaacgggaggagagcatagcaaaaatcggaaaaaaaaaatatcagaagataaacctcgacgaagcggaggagttcttcgaactaatcagtaaggcccaatcaaatagagctgacgatcaaagaggcctgcttcggaaagaggacctggtcctgcctgaatttcttagactgccaccaggatcaaccgagttaactctgcccactccggctgcagtcgccaaagggttctcaaagagatccgcgacaggaaatggcagggagtccgcttcacagccaggtgagcagtgggagcccgttcaggaaagctccgattccccttcaactagccctgggtccgccagtagccctcccggtcccccaggaacaaccccaccaggacagaagagtccctctggcccattttgtacccctcagagcccagtgtcgctcgcacaggaggggaccgctcagatctggaagcgccagtcacaggaggtcgaggccggagggattcagaccgtggaggacgaacacgttgccgagttgaccttgatgggggagggtgatatttctagtccaaatagtacactgcttcctcctccatccacacctcaggaagttcccggtccctctcggccaggtacctcacgtttctag

SEQ ID NO: 30594 - DNA, 2400 bp, Artificial Sequence
  Description of Artificial Sequence: Synthetic coding sequence
atgaatctgggtaaagaactctcaaatgagacccacgtgagtaatgatcaacagagcgccaccgtctctgacggggagctgactggagctgatttgaaggactgtgtatcaaacaacagcctgtcctccaatgcaagcctgccatcagtccaatcatgtaggaggctccgcgaacgcagagtcgccagctgggcagtgagctttgagcggttgttgcaggatcccgtgggcgtgaggtattttagtgactttctgaggaaggaattttctgaagagaacattctattctggcaagcgtgcgagtatttcaaccacgtccccgctcacgataaaaaggagttgtcataccgggctagagagatcttctcaaagtttctgtgcagcaaagcgactacacccgttaacattgattcccaggctcagctggcagacgacgtcctgcgagcccctcacccggatatgttcaaggaacagcagctacagatcttcaacctcatgaaatttgacagctacacaagattcctaaagtcacccctgtaccaggagtgtatcttggcggaggtcgagggcagggccttacccgacagccagcaggtaccctcttccccagcttccaagcactcactgggatcggatcatagttctgtcagtacacccaagaaacttagtggtaagagtaagtcaggaaggtcactcaatgaagagttgggagacgaagattcagaaaagaaaagaaaaggcgcattcttttcttggagtagaacccggtccacaggtcgctctcagaagaagcgagagcacggagaccacgctgatgacgccctccatgccaacgggggtctttgtagacgggagtcacaaggtagcgttagctccgcaggatcactggacctttctgaggcttgtcgcacacttgcccctgaaaaggacaaagccaccaaacattgctgcatccatctccctgacggcacttcctgtgtcgtggccgtcaaagccggtttctctatcaaggatatactcagcggcctttgtgaaaggcatggcatcaatggtgccgcagcagacctctttctggttggtggtgataaaccattagttctgcaccaggattcttctatcctagaaagtcgggacttacggctagagaaaaggacactcttccggctggatctggttccaatcaatcggagcgtcggccttaaggctaaaccgaccaagcctgtgacagaggttctgcgccctgtggtagccaggtatggcctagacctgagtggcttactcgtcagactctccggagagaaagagccattggatttaggggcacccatatctagcctggacggccagagagtagtactcgaggaaaaagatccatccaggggaaaggcctctgcagacaagcaaaaaggcgtgcccgtgaaacagaacacggcggtgaatagcagctccagaaatcatagtgctactggcgaggagcggactcttggaaaaagcaactccataaaaatcaaaggcgaaaatgggaaaaacgccagagaccccagactgagcaaaagagaggagagcatcgcaaagattgggaagaagaaataccagaagatcaacttagacgaagcggaggagttcttcgagctgattagcaaagcccagagcaaccgagccgacgaccagaggggtttgctcagaaaggaagatctggttctgcccgagttccttcggctcccgcctggatccaccgagcttacactccctacacccgcagctgtggccaaagggtttagcaagagaagcgccactgggaacggtagggaaagcgcctcccagcccggagaacagtgggagccagtacaggaatcttctgacagtccgtccacatcacccggttctgcctctagcccacctgggcctccaggcaccactcctccgggtcagaagagcccctccggccctttctgtaccccgcaatcccctgtaagcttggcacaggaaggcactgcccagatatggaaaaggcagtctcaagaagtcgaggccggtggcatccagactgtagaggacgagcacgtcgcagaacttaccttgatgggagagggcgacatcagctcccctaattctacgctgctgcccccaccctccacccctcaggaggtccctggccctagtaggccagggagcgggacccatggctcccgtgatctgcccgtgaacaggataatcgatgtggacctagtcaccggtagcgccccaggtagagacggaggcattgctggagcacaggcagggccagggagatctcaggcctccgggggtcctccgactagcgatctgcccggtttgggtcccgttcccggagaacctgccaagcctaaaactagcgcacaccatgccacctttgtgtag

SEQ ID NO: 30595 - DNA, 4344 bp, Artificial Sequence
  Description of Artificial Sequence: Synthetic coding sequence
atgttcagggccggtgaggcaagcaaaaggccgctgcccggtcccagtcccccacgagtgaggagcgtggaggtggcgcgtggaagggccggatacggtttcactctgagcggccaggccccttgtgtacttagttgtgtaatgagagggtctcccgctgatttcgtgggtttgagggctggggaccagatcctggccgtgaacgagatcaatgtgaagaaggcctctcacgaagatgtcgtgaaattaatcgggaaatgcagtggcgtgctacatatggtgatcgcagagggagtcggtagattcgagagttgctcctctgacgaagagggtggtttgtacgaagggaaagggtggctgaaaccgaaactagattctaaagctttgggcataaatagagctgaacgagttgtagaggaaatgcagtccgggggaatatttaacatgatatttgaaaacccctccctctgcgcatcaaatagcgagcccctcaagctgaagcagcggtccctttcagaaagcgcggctacccgcttcgacgtggggcacgaatcaatcaacaatccgaaccctaatatgctgtccaaggaggaaatctcgaaagtcatccacgacgatagcgtcttttctatcggattggagagtcacgatgatttcgccttggacgcgagcattttaaatgtagcaatgatagtgggctacctgggatccatagaactgccctccaccagctccaatttggagtctgacagccttcaggctatccgaggatgtatgcggcgtttgcgggctgagcagaagatccattctctggttacaatgaaaatcatgcatgattgtgtgcaactctcaaccgataaagcaggagtggtggcggagtatccggctgaaaagctcgcatttagcgctgtgtgccccgatgaccggcgtttcttcggacttgtgaccatgcaaacaaatgatgacgggtccttggctcaggaagaagagggtgcactgagaacttcatgccatgtatttatggtagaccccgatttgtttaaccacaaaatccatcagggtatagcgagacggttcgggttcgagtgcacagccgacccagacacaaatggctgtttggaatttccggcatcctcgctgccggtgctgcaatttatttcagtcctgtaccgagacatgggcgaactgatagaaggcatgcgtgctcgcgctttcttagacggtgatgctgatgcacatcagaacaacagtacttcttcgaactcggattcaggaatcgggaattttcaccaggaggaaaaaagcaatagggtgctggtagtggacctcggtggatccagcagccgccatggccctggtggatcagcctgggacggggtgggtggccgaggcgcacagccgtggggcgcaccgtggacaggccctttttgtccagacccggaagggtcacctcccttcgaggccgctcaccagacagaccgtttctgggatctcaacaaacatcttgggccagcatccccagtcgaggtcccacccgcttcactacggtctagtgtgccccctagtaaaagagggaccgtgggagccggatgcggcttcaatcagcggtggctgccggtacatgtattgcgggagtggcagtgtggtcacacctctgaccaggatagctacaccgatagcaccgacggctggtcaagcattaactgcggtactctgccgcctcccatgtccaagatccccgctgatcgctatagagttgaaggctccttcgcccagccaccactgaacgctcctaaaagggagtggtctcggaaagcctttggcatgcagtcgatctttggacctcacaggaatgtgcgcaagactaaagaggacaaaaaaggcagtaaattcggacgcggtactggtctgacccagcccagccagaggacgagcgctaggcgctccttcggcagatccaaaaggttcagcattacgaggtccctcgatgatttggaaagcgccaccgtttcagacggggagctgaccggggctgatctcaaagattgcgtgagtaacaattcactctccagtaacgcctctttaccttcagtgcagtcttgcaggcgattgagagagcgacgcgtcgctagttgggctgtcagttttgaacggcttttgcaagatccggtgggcgttcggtacttttccgactttcttaggaaggagttctccgaagaaaacattttattctggcaagcctgcgaatatttcaatcatgtcccagcccatgataagaaagaactctcgtatagagctcgagagattttctccaagtttctgtgctccaaggccaccacacctgtgaacattgactcccaagctcaactcgccgacgacgtgttaagagcaccacacccagatatgtttaaggagcagcagctgcaaatttttaatttgatgaaatttgatagttacaccagatttctcaagagcccactctatcaggaatgtattctggcggaggtcgaaggtcgggcactccccgactcgcagcaggtccctagttcccccgcttctaaacactctctgggctctgatcactccagtgtgtctactcccaagaagctgtccggcaaatccaagtcagggaggagcttaaatgaggagttgggggacgaggattcggagaaaaagaggaaaggagcattcttctcgtggtctcggactcggtctacaggcagatctcagaagaagcgggagcatggggaccacgccgatgatgcgcttcacgctaacggaggactgtgcagaagggagagccagggctcagtgagctctgccggatcgttagatttgtcagaagcgtgtcgcacgctggcgcctgagaaagacaaggcaactaaacactgttgtatccacctgccggacggcactagctgtgtggtcgctgtcaaggcgggtttcagtattaaagatattctcagcggcctttgcgaacgacacggaattaacggcgctgccgctgacttgttcctagtcggtggcgataaacctctggtccttcaccaggactccagtatcctagaaagcagagatctgcgactggaaaagagaaccttatttcggctcgaccttgtgccgattaataggagcgttggactgaaggctaagcccactaagccagtaacggaggtgctgcgccctgttgttgcaagatatggtctcgatctaagtggtctccttgttagactaagcggagagaaggagccccttgacctcggagcacctatcagctctctggacggccaaagagtggtgcttgaggaaaaggatccaagccgagggaaggcctccgctgacaaacaaaagggcgtaccggttaaacagaatactgctgtgaacagttccagccggaaccacagtgctacaggggaggagcggacgcttggcaagtctaattcaatcaaaatcaaaggtgaaaatggcaaaaacgcacgggatcccaggttgtctaagagggaggagtccattgcaaagataggaaaaaagaagtaccagaaaattaacttggacgaggcggaagagttttttgagcttatcagcaaagcccaatccaatcgtgctgacgatcagcgaggcctgctgcgaaaggaagacttggtgctccccgagttcttgagactgccacccggttccaccgaattgacactgcctacccccgcagctgtggctaaaggcttcagcaaacggagcgccacgggaaatggtcgcgagtccgcctcacagcccggtgagcagtgggaaccagtgcaggaaagcagcgattcccccagcacatcccctgggtcggcatcttcaccaccaggacccccagggacaacaccccctggtcaaaagtccccaagcggacctttttgcactccccagtccccggtatcccttgctcaggaaggcactgcccagatttggaagcgtcaatcacaggaggtggaggccggagggatccagacagtggaggacgagcatgtggcggaactcacgttgatgggagagggagacatatcctcccctaatagcacgctcctgcctcccccttcaacaccgcaggaagtgcccggtcctagtcgaccaggctctggaactcacggatctcgggatttgcccgttaatcggattatcgatgtggacctcgttacaggatctgcaccaggtagggacggcggaatcgccggagcacaggcgggacccggaagaagtcaggctagcggtggcccaccaactagtgatctgccaggcctcgggccagtccccggagagcccgcaaagccaaagacttcagcccaccacgccacattcgtgtag

SEQ ID NO: 30596 - DNA, 4131 bp, Artificial Sequence
  Description of Artificial Sequence: Synthetic coding sequence
atgttccgagcaggggaagcatccaagcggcctcttccagggcctagtccaccacgcgtgaggtcggtggaggtggcacgcggacgagcaggttacgggttcacgctgtctgggcaggctccctgtgtgctatcatgtgtgatgcgaggctcacccgctgatttcgtgggtctcagagccggtgaccagattctggccgtgaacgagattaacgtcaagaaagcgagccatgaagatgtggtcaaattgataggcaagtgctccggcgtgcttcatatggtgatcgcggaaggagtcggaagattcgaaagctgtagctccgatgaggaaggtgggttgtacgagggtaagggctggctcaagcctaagcttgacagtaaggcactgggtataaaccgagctgaacgagtggttgaggagatgcagtccgggggaatttttaacatgattttcgagaacccatccctatgcgcttctaactccgaacccttgaaactgaaacagcggagtctgtctgagtctgcagctaccaggttcgatgtgggccatgagagtattaacaacccaaatcccaatatgctgagcaaggaggagatcagcaaggtgattcatgacgattctgtattctccatcgggctggagtcgcacgatgacttcgccctcgatgcctctatacttaatgtagccatgattgtggggtacctgggcagcatagagctgcccagcacttcatcgaacctcgagagcgattcactccaggccatacgcggttgcatgagaagactccgagctgaacagaagattcactcactcgtgacaatgaaaattatgcatgattgtgtccagctgtctaccgataaagcaggagtagttgccgagtacccagccgagaaacttgctttttcagctgtgtgcccagacgacaggcgcttctttggcttggtgactatgcagacgaacgatgatggctcgctcgcccaggaggaagaaggggctctcaggactagctgccacgtgtttatggtggaccctgaccttttcaatcataaaattcaccaaggtatcgctagaaggtttgggttcgagtgtaccgccgacccggataccaatggatgtctggaatttcccgcaagctcactcccagttctgcagttcatatccgtattgtatcgggatatgggagaattgatcgagggaatgcgcgctcgcgcattccttgacggcgatgcagacgcacaccaaaacaatagtacaagttctaacagtgacagtggaatcggaaatttccaccaggaggagaagtcaaaccgggtgttggtggtggacctggggggttcttcgtcccgtcacggccctgggggttctgcttgggacggcgtgggaggacgcggagcccagccttggggggctccatggaccggcccattttgccctgaccctgagggatcaccaccattcgaggcggcacaccaaactgatcgtttttgggacctcaataaacatctagggcctgcctccccagttgaggtgccaccggctagcctaagatcatcggtgccccctagtaaacgcggtaccgtgggggcagggtgtggcttcaatcaaagatggttacctgtccacgtcctgcgcgagtggcagtgtggtcatacctccgaccaagactcttatacggactccaccgacggctggtcatcaattaattgcggcacgctgccgccacccatgagcaagatacctgctgacaggtacagagtcgagggtagctttgctcaacctcccctcaatgcccctaagcgcgagtggtcaagaaaggccttcggaatgcagagcatctttggtccacacaggaatgtacggaaaacaaaggaggacaagaagggtagcaagttcgggagaggaaccggccttactcaaccctctcaaaggacaagtgctcgtcggagcttcggacggagcaaacgcttttccattacccggtcacttgatgatcttgagagcgcaaccgtaagcgatggggaattgactggcgctgacctgaaagattgtgtaagtaacaactccctctccagcaatgccagtctgcccagcgtccagtcttgcagacggttaagagaaaggcgcgttgcatcatgggccgtgtctttcgaacgactgcttcaggatcccgtgggagtgaggtatttctccgactttctaagaaaagaatttagtgaggaaaatatcctgttctggcaggcctgtgaatacttcaaccatgtgcccgcacacgataagaaagaattgtcgtatagggctagagaaatattctccaagtttctgtgttcgaaggcaacgacccccgtgaatatagattcacaagcccaattggccgatgatgtcctccgggctccacacccggacatgttcaaagagcagcagcttcagatctttaatttaatgaagttcgactcgtataccagattcttgaaatctccactataccaggagtgcatccttgccgaggtggagggcagagcccttccagactcccagcaagttccgtcatcgcctgcctctaaacattctctgggctctgatcactcaagcgtgtccactccaaagaagctatccggcaagtcaaaatctggacgctctcttaacgaagaactcggagatgaagactcggaaaagaaaaggaagggtgccttcttttcctggtctcggactcgtagcaccggtaggagccagaaaaagagagagcatggcgaccacgcagatgacgcgctgcatgccaacgggggactctgtcggagagaaagtcagggctcagtttccagcgctggttccctcgacctgtccgaagcctgtcgtaccctggctcccgagaaagataaggccaccaaacactgttgtatccatttacccgacggtactagttgtgttgtggctgtcaaggcagggttttctatcaaggatattttaagcggtctgtgtgagcgacacggcataaacggcgcagccgctgacctgtttttagtgggcggagacaaaccattggtgctgcaccaggactccagtatactggagtcaagagatttacggctagagaagagaacgctattcaggctggatttagtgcctattaaccgctcggttggcctgaaggctaagccgacgaaacccgtaactgaggtcctacgtcccgtagtagcacgatacggccttgacttgtccggactccttgtgaggctgtcaggcgaaaaggagccactggacctgggggcacctataagtagcctagacggtcagagggtcgtgctggaggaaaaggatccctctaggggtaaggctagtgccgataaacaaaagggggtacccgtgaagcagaacaccgctgtcaacagctcatcaaggaatcactcggctacaggtgaggagagaacacttgggaagagtaattccatcaagatcaaaggggaaaacggcaaaaacgccagggatcctagactgtccaagcgcgaagagtctattgctaagatagggaagaagaagtatcaaaaaatcaacctggatgaggcagaagaattttttgagctcatcagcaaagcacagagcaaccgagcggatgatcagcggggactgctcagaaaagaggacttggtgctccctgaatttttgcgccttccacctggctctactgagctgaccctgccaactcccgcagccgttgctaaaggatttagcaagaggtccgcaaccgggaacgggcgtgaatctgcttcgcagcctggtgaacagtgggagcccgtgcaggagtcttctgatagcccatccacttcaccaggaagcgccagctcccccccagggccaccagggacaaccccccctggccagaagtccccttcaggcccattttgtacccctcagagccccgtttcactcgctcaagaagggaccgcacaaatatggaaaaggcaatcacaggaggtggaggcgggtggcatccagaccgtggaagatgaacatgtcgctgagctcactctgatgggggagggagacatctcatctcctaactcaactcttctgcctcccccatcaactcctcaggaggtccccggaccctccagacctggcacttccagattctag

SEQ ID NO: 30597 - DNA, 1500 bp, Artificial Sequence
  Description of Artificial Sequence: Synthetic coding sequence
atgtcactctctctatttttccaatctgcaaccgtatccgatggcgaacttactggagccgatctcaaggactgcgtgtctaataatagcctgtcctcaaacgcaagcctcccttccgtgcagtcgtgccgcagacttcgggaacgtcgggtggcttcttgggccgtgagctttgagcggctgctgcaggatcctgtgggcgtgcggtatttctctgatttccttcgcaaggagttctcagaagaaaacatcctgttctggcaagcctgtgaatattttaatcacgtgccggctcatgataagaaagagttgagctatcgagccagggaaatattcagtaaatttctgtgtagcaaagccaccacgcccgtgaatatcgacagccaggctcagctggcagatgacgtgttgcgcgcaccccatcccgacatgttcaaagagcagcagctccagatcttcaatctcatgaaattcgactcgtacacccggttcttgaagagtccactttaccaagagtgcatcctggccgaagtcgaaggcagagccctgcccgattctcaacaagtcccaagttcgcccgctagtaaacactcattggggtccgatcattctagcgtcagcacccccaagaaactgagcggaaagagtaaaagcggtagaagccttaacgaggagctaggcgacgaagattcagagaagaagagaaagggagcttttttctcctggtccagaacgcgatcaacagggaggtctcagaagaagcgggaacacggggaccacgcagacgatgctctgcacgctaatggcggactatgcaggagggaaagtcagggttcagtgtcttcagccggtagtcttgatttatcagaagcttgtcgcaccctggctccagaaaaagacaaggctacaaagcattgttgtatccatcttcccgacggtacatcatgtgtggtggctgtcaaggcaggattctctataaaggacatcctcagtggtttatgtgaaagacacggtatcaacggagctgcagccgacctgttcctagtgggcggtgataagcctttagtgctccaccaggactccagcattctggaaagcagagacctgagactcgagaaacgtacactgttcagattagatcttgtccccattaatcggagcgtaggcctgaaggccaaacccacgaaacctgttacggaagttctgcggcctgtcgtggctcgatacgggcttgatctatctggtctgttggtgagactctcaggtgagaaagagcccctagatctgggcgctccaatctcttcattagatgggcagcgcgtggtcttggaggagaaggatccttctcgaggcaaggcgtctgccgacaagcagaaaggcgttcccgtgaagcagaacaccgcagttaactcatcatcccggaaccattctgccactagcttcctcagcctattccccaaactaagggccactgaacagatgacaaatgtgggttgttag

SEQ ID NO: 30598 - DNA, 2004 bp, Artificial Sequence
  Description of Artificial Sequence: Synthetic coding sequence
atgttcagggccggtgaagccagcaaacgaccgctcccaggtccatcacccccaagagtgcggtctgtggaggtcgcaaggggcagggccggatacggcttcacattatcaggccaggccccttgtgtgttgtcttgtgttatgaggggaagtccagccgattttgtcgggctgagggcaggggaccagattctggcggtgaatgagatcaatgttaagaaggcctcacacgaggatgtagtgaaactcatcggaaaatgttcgggcgttctacatatggtgatcgccgagggggtgggcagatttgagtcttgctcctcggatgaagaggggggtctttatgagggaaagggctggttgaaacctaaattggacagtaaggccctcggcattaaccgtgctgagagagtggtggaggaaatgcagtcgggaggtatattcaatatgatatttgaaaaccccagcctctgtgcttcgaactcagagcccctgaaattgaaacagaggtctctcagcgagagcgccgctactaggtttgatgtcgggcatgagtcaatcaacaatcccaatcctaacatgctgtccaaagaggagataagcaaagtgatccatgacgacagcgtgttttctatcgggcttgaaagccatgatgactttgctcttgacgcctctatactcaacgttgctatgatcgtagggtatctgggctccattgagctgccctccacttcttcgaatctggaaagcgacagtctgcaagctatccggggttgtatgagaagactccgtgcagaacagaaaatccattccctggtgacaatgaagatcatgcatgactgtgtacagctttccaccgacaaagctggggtggttgcggaatatcctgccgagaaacttgcattctccgcagtgtgtcctgatgaccggcgattcttcggtctcgttacaatgcagacaaacgatgacggtagcctagcccaggaagaggaaggcgctctgcgaacaagctgccacgtgttcatggttgatccagatctcttcaaccataaaatccaccaaggaattgctcggaggttcgggtttgagtgcaccgctgacccagacacaaatggctgtctcgaattccccgcatcgtccctccctgtactccagttcatcagcgtgctttaccgggacatgggcgagctcatagagggaatgcgcgctcgggcatttctcgacggagacgccgatgcccaccagaacaactccacgtcgtctaactcagactcgggaatcggtaatttccaccaggaggaaaagtcgaacagagttctggttgtggacttagggggttctagcagtcgacatgggccagggggttccgcttgggacggagtaggaggtcggggagctcagccatggggcgcaccttggaccggcccattctgcccagaccccgagggatcgcctccattcgaggctgcacaccagacggatagattttgggatctgaataagcacctgggccctgcgagccccgtggaggtaccacctgcatcccttagatcatctgtgcctccctccaaaagaggcacggtcggggctggatgtggattcaatcagcgatggctacctgttcatgtgctcagggaatggcagtgcggacacacttccgaccaggactcctatacagatagcactgatggctggagctccatcaactgcggaacactgccaccgcctatgtccaagatccccgcagacaggtaccgggttgaagggagctttgcacaacccccactcaatgcgcctaaaagggagtggtcgaggaaagcctttggaatgcagagcatcttcgggcctcatcggaacgtgcggaagacaaaggaggataaaaaaggatctaagttcgggaggggaaccggcctaacgcaacctagccagaggactagcgctagaaggtctttcggcagatctaaaaggtttagcatcactcgctccttggatgatctcgaatcgtag

SEQ ID NO: 30599 - DNA, 636 bp, Artificial Sequence
  Description of Artificial Sequence: Synthetic coding sequence
atgcagagcgccatgtttctggccgtgcagcatgactgccggccaatggacaagtctgcagggagcggacacaaaagtgaagagaaacgcgaaaagatgaagcgaactctgttgaaggattggaaaacacggctcagctatttcctacaaaactccagtacccctggtaagcccaaaaccggcaaaaagtccaaacaacaggcattcatcaagccctcaccggaggaggctcagctctggtccgaagcgtttgacgaactcctggcttctaaatacggcttggccgctttccgggcatttttgaaatcagagttttgtgaagagaacatcgagttctggcttgcctgtgaggattttaagaaaacaaagtccccccagaagcttagttccaaggcacggaaaatttacactgactttattgagaaggaggctccaaaagagattaatattgattttcagaccaagactttgatagcccagaacatccaggaggccacgtccgggtgcttcacaactgcccaaaagcgagtgtactctctgatggagaacaattcataccctcgtttcctggaatccgaattctatcaggacttatgtaagaagcctcagataaccacagagccacatgccacatag

SEQ ID NO: 30600 - DNA, 4203 bp, Artificial Sequence
  Description of Artificial Sequence: Synthetic coding sequence
atgcccaagatagtcctgaatggggtgacagttgattttccatttcaaccttataaatgccaacaggaatacatgaccaaagtcctagagtgtctccagcagaaagtcaatggcattttagaaagccccaccggtactggcaaaacgctttgcctgttgtgtacaacactggcctggcgcgagcatttaagagatggtattagcgctcgcaagatcgctgagcgagcccagggcgaactatttcctgatagagccctgtcttcctggggcaacgccgctgcagctgccggagatccaatagcctgctacactgacatcccaaagatcatatatgcttctcgcacacattctcaactgacgcaggttattaatgagctccggaatacttcctatcgcccaaaagtttgtgtcctggggagtagggagcagctgtgcatccacccagaagtgaagaagcaagagtccaaccacctccagatccatctgtgtcgcaagaaggtggcttcccggagttgtcacttttacaacaatgtggaggagaagagcttggaacaagagcttgcctcccccatccttgatattgaggatctcgtgaagtcaggaagtaaacaccgggtgtgcccatactatctgtcccgtaatctgaaacagcaagcagatattatattcatgccttacaattatctgctggatgcaaagtcgagaagagcccataacattgacctcaaagggaccgtcgtgatctttgacgaagctcataacgtggagaaaatgtgtgaggagagcgccagcttcgacctcacgcctcatgaccttgcctctggcctggatgtgatagaccaggtgctcgaagagcagaccaaggctgcgcagcagggagagccacaccctgagttctccgccgattcaccgtccccgggtctgaatatggagctagaggacatcgccaaactaaagatgatcctcctcagactggagggcgcaatcgacgcagtggaactgcccggagatgattcaggggttactaagcctggttcttacatttttgagttgttcgccgaggcacagataactttccagactaaaggatgtatcctcgacagcctggaccagattattcagcacctcgccggaagggcaggcgtgtttaccaacactgctggcctgcagaaactcgctgatatcatccagattgtgttcagtgtggacccttctgaaggcagtcccggatcaccagccggactgggagccctacagagttacaaggtacatatccatccagatgcaggccataggcgcactgctcagagatctgacgcctggtccaccacagccgcaaggaagaggggtaaagtcctgagctactggtgtttttcaccaggacactcaatgcacgaactggtgagacaaggtgtgaggagtcttatcctaacatcggggacacttgccccagtgagtagcttcgcattggagatgcaaattccttttcccgtctgtctggagaacccccacattatcgacaaacatcagatctgggtcggggtggtgccaaggggccctgatggggctcagctttcctccgcctttgaccgcaggttttcagaagagtgtctaagcagcctgggaaaggcactcggtaacatagcacgggtggtcccttatggtttgttgatctttttcccttcataccctgtgatggagaaaagcctggagttctggcgcgctcgcgatctggcacggaagatggaagcattgaagccgctgtttgttgagcccaggtctaaggggtcattcagtgagacaatatcggcttactacgcgagagttgcagcgccaggatccacgggggctacatttttggcagtgtgcagagggaaggcatccgagggattagatttctctgatactaatggcaggggtgttatcgttactggattgccttacccaccacgtatggatcctagagtcgtcctgaagatgcagttcttggatgaaatgaagggacagggtggcgcaggcggtcagtttctgtccgggcaggaatggtatcgccagcaggcctcgcgagctgttaaccaagccatcggccgagtgatccgccataggcaggactacggagccgtttttctgtgtgatcatcggttcgctttcgccgatgctagagcacagcttcccagctgggttcggccacatgtgagagtgtatgacaattttggacacgtgatcagggacgtggcgcaattcttcagagtggccgaaaggactatgcctgccccagcgccaagggccacagctccttcagtcagaggtgaggatgcggtgtcggaggcgaagtcaccagggccatttttctcaactaggaaggcaaagtctttagacctccacgttccttcactgaagcagcggtcttctggcagccccgcagctggcgacccagagtcctcactctgtgtcgagtatgagcaggaacctgtacccgcacgccagaggcccagggggctcttggctgcattagagcactctgaacagagggctgggagcccgggagaggagcaggcccactcctgctctacgctgtccctgctgtcggaaaaacgccctgccgaagagccacgaggcggtaggaagaagatccgccttgtgtcccaccctgaagaacccgttgccggagcacaaactgatcgagcaaaactgttcatggtcgctgtcaaacaggaactgagccaggcaaactttgctacattcacgcaagctttgcaagattacaagggtagtgacgattttgctgctttggccgcttgtcttggaccactcttcgcagaagaccccaaaaaacacaacctgcttcagggattttaccaattcgtgcggcctcaccataaacagcagttcgaggaggtgtgtatacagctcacaggacgcggatgtggctaccgacccgagcattcaattccacggagacagagggcccagcctgtgctggatccaaccggccgaaccgccccagatccaaagctcacggtctccacagccgctgcccagcagctggatcctcaggaacatctgaaccaaggacgaccacacttaagtcccaggccccctccaacaggcgatcctggcagccagccccaatggggaagtggtgtccctcgagcaggaaagcaggggcagcatgcagtttcagcataccttgccgatgctcggagggcacttggctctgctggctgttcccagttgctcgccgctttgaccgcttacaagcaggatgatgatctggacaaggtgttggccgtgctggctgctctcacaaccgctaaaccagaagatttcccgctgctacatcggttttcaatgtttgtgcgaccccatcataaacagagatttagccagacatgcactgacctgacagggaggccttaccctggcatggagcccccagggcctcaagaggagaggctagcagtgccgcctgtcctaacacatcgggctcctcagccagggccaagtcgatccgagaagaccggcaagacccagtctaaaatctccagttttctccgccagagaccagccggtacagtcggtgcgggtggggaagacgctggccctagccagtcgagcggccctccgcatgggcctgctgcctccgaatggggggaaccacacgggcgtgatatagccggtcagcaggcgactggcgctccaggcggtccactttcggccggatgcgtttgccagggatgcggcgctgaggatgtagtgcctttccagtgtccggcttgcgattttcagaggtgccaggcttgctggcagagacacctgcaggcctcacgcatgtgccctgcatgtcacacggctagtcggaaacaaagcgtcatgcaggtgttctggcccgaaccacataaggaccacgaaggagcagggggagcgagaccagttgccgctgtccccggagtaggcgctgcctgcccagcagctggggcaggatgtacccgctcagggaggaatacacatcttcctctggccggtaggagggacagaggagccgcaggagtacgtcccgtgccaccacgacatctgtgcgctgccgctgtgccgccacgacagcctcacgatgtgtggcctgtaagcacagcccctctgcatgcagtgcttgaactgccaagagcgctaccactgcttcaaagaccccttaggggagcatag

SEQ ID NO: 30601 - DNA, 1638 bp, Artificial Sequence
  Description of Artificial Sequence: Synthetic coding sequence
atgccagcacctgccccacgcgctacagctcccagcgtccgcggagaagacgccgtgagtgaagcgaaatcaccaggccctttcttctccacccgcaaagcaaaaagcttggacctccatgtcccttctttgaaacagcggagctcaggcagcccagcagccggagatccagagtcttcactctgtgtcgaatacgaacaggaaccagtgcctgccagacagagacccaggggattactggctgccctcgagcactctgaacagcgcgctggaagtcctggcgaggaacaagcccattcctgttcaactctgtcactcctaagtgaaaagcggccagcagaggagcccagagggggaagaaaaaaaattcgcttggtatcccatccagaagagccagtagcgggagcacaaacggacagggctaaactgttcatggtggccgtaaaacaggaattgtcccaagccaattttgccactttcacccaggccctccaggactacaagggaagcgacgatttcgccgctttggcggcatgcctcggcccactctttgcagaggacccaaaaaagcacaatttgctccagggcttttaccagtttgtcaggccccaccacaaacaacagtttgaggaggtatgcatccaactcacaggcagagggtgtggctaccggcctgaacacagcataccccgacgacaaagggcacaacctgttcttgacccaaccggacggacggcacccgacccgaaattaactgtgtccactgctgctgcacagcagttggacccccaagagcatctgaatcaggggaggccccatttgagtcccagacccccacctactggcgatcctggttcccagccccagtggggatccggggttccgcgtgccggtaagcagggccagcatgccgtgagtgcttatctcgctgacgcaaggagagcccttggatcagctggttgttcccaactattagccgctctcaccgcatataagcaagacgatgatcttgacaaggtgctcgccgttttggccgctctgactaccgctaagcccgaggatttccctttgttgcaccggtttagcatgtttgtccgcccacaccataagcaacgcttttcccaaacttgtaccgacctgacgggaagaccttatcctgggatggaacctcccggacctcaggaggaacggctggccgtcccaccggtcctcacgcatcgcgctccccagcccggaccaagccggagcgagaagacaggtaagacccagagcaaaatcagttcgttcctgaggcaacgaccagcaggtaccgtgggtgccggaggggaagacgcaggcccaagccagagcagcgggcctccccatggccctgctgcatccgagtggggcgaaccacatggccgagatattgccggacaacaggctacaggcgctcctggaggacctctaagtgccggttgtgtgtgtcagggatgtggtgcagaggacgtggtgcctttccagtgccccgcatgtgattttcaacggtgccaagcctgctggcagaggcacctccaagctagtaggatgtgtcctgcctgccacactgcaagccgaaagcagtccgttatgcaggtcttctggcccgagccccagtag

SEQ ID NO: 30602 - DNA, 3660 bp, Artificial Sequence
  Description of Artificial Sequence: Synthetic coding sequence
atgccgaaaatcgttctcaacggcgtcaccgtggactttccttttcagccatataaatgccaacaagagtatatgaccaaagtcctagaatgcctgcagcaaaaagtgaacggcattctggaatctccaactggaacgggtaagaccctttgtctcctatgcacaacgctggcttggagggaacatcttcgtgacgggatctcagctcgcaagattgctgagagagcacagggggagctcttcccagaccgggctctgagtagttgggggaatgctgccgctgctgccggtgaccccatcgcgtgttataccgacatacctaagataatctatgccagtcgcacacatagccagctgacccaagtgattaacgagctgcgtaataccagctacaggccgaaggtgtgtgtactcgggtcacgcgaacaactctgtattcatccagaagtcaaaaaacaggaatccaatcacttgcagatccatctttgtcgcaaaaaggtggcatctaggagctgccacttctacaataatgttgaggaaaaatctctcgagcaggagctggcatctccaatcctggatatcgaggacctcgttaagagcggttccaagcatcgtgtgtgtccatactacctaagtcgcaacctgaagcagcaggccgacattattttcatgccttacaactatttactcgacgctaaaagccgaagggcccacaatatagacctgaaggggacagtggtcatcttcgatgaggcccataatgtcgaaaagatgtgcgaagagtcagccagctttgatttaaccccgcacgatcttgcttccggactggatgtgatcgaccaagtccttgaggaacagaccaaggccgctcagcagggcgagccacacccagaattctctgcggacagccccagccctggtttaaacatggaacttgaggatattgcgaagcttaaaatgatccttttgagactggaaggcgcaatcgacgctgtggagctccccggagatgacagtggagtgactaagccaggcagttatatttttgagctcttcgccgaagctcaaatcacattccaaacgaagggatgtatcttggattctctcgaccaaatcattcaacatctcgcaggtcgagctggtgttttcaccaacacagccggattacaaaagctggccgatattatccagatcgtgtttagtgtggacccatccgagggctctcctggatcgcctgccggactcggtgccttgcaatcctataaggtgcatatccatccagacgccggacacagacgcactgcccagcgctccgacgcatggagcaccacggccgctaggaagcggggaaaggttctaagttattggtgcttttcccccggacacagtatgcatgagcttgtgaggcagggcgtgcggtctttgatcctcacaagcgggactcttgcaccagtgtcatcatttgcactggagatgcagattccctttccagtctgcttagaaaatcctcacatcattgacaagcaccaaatctgggtgggtgtggtccctagggggccagatggagcccagttgtcatcagcatttgaccgtcggttcagcgaggagtgtctgagttcattggggaaggctctgggaaatattgcaagagttgtgccttacggtctattaatattcttcccgagttaccctgtgatggagaagtccctggagttctggcgggcacgggacttggctagaaaaatggaagccctaaagccactgttcgtggaaccacgatcaaagggcagcttcagtgagaccatctccgcttactatgctagagtggccgcacctggcagcaccggcgcaacattcctggcagtttgtaggggcaaggcaagcgagggccttgacttctcggacacaaacggacggggagtaattgtgacggggctgccatatcctccacggatggatccacgggtcgtactgaagatgcagttcttagacgagatgaaaggacagggaggcgctggtggacagttcctgtcaggtcaggagtggtaccgacagcaggcttcaagggctgtgaaccaggcaatcggaagagtcatccgacaccgccaggattacggtgctgtgttcctctgtgatcacagattcgcattcgccgatgcccgtgcacagctgccgtcatgggtgagacctcacgttagagtctacgataatttcggccacgttattcgcgatgttgcccagttttttagggtagccgaacgtaccatgccagcccctgccccacgagccaccgcaccgagtgtccggggtgaagatgccgtcagcgaggcaaagagcccaggaccttttttctcaacccggaaagccaaatcattggacttacacgttccatcactgaaacaacgatcaagcggcagcccggctgccggagaccctgagtcttctctctgtgtggagtatgagcaggagccagttcctgcacgccaacggcctcgcggactcttagccgctctagagcactccgagcaacgggctggctcccctggcgaggagcaagctcacagctgttcaacattgtcactgctaagcgagaagcgacccgctgaggagcccagagggggacggaagaagattcgtctggtgtcacaccctgaagagccagttgctggcgctcagacagaccgtgccaaattgttcatggtggccgtgaaacaagaattgtcgcaggctaattttgccacgtttacccaggccctgcaggattataaggggtccgatgacttcgcagcactcgcggcttgtctcggtcccctgttcgccgaggaccctaagaagcacaatctgttgcaagggttttaccagtttgtaagacctcaccataaacagcaatttgaggaggtgtgcatacaactgacaggtcgcggttgcgggtaccggccagaacactccattccgagacggcagcgcgcacaaccagttctggaccccacaggcagaacagctcctgatcctaaacttactgtcagcaccgcggcagctcagcagctcgaccctcaggaacaccttaaccagggtcggccacacctgtcccctaggcctcccccaaccggggatccaggttctcagccccagtggggctcaggagtgccacgcgcaggcaagcagggccagcacgcagtgtccgcttacctggctgacgccaggcgcgcactcggttccgctggatgcagtcaattgctggcagctttgaccgcatacaaacaggacgatgacctggacaaagtgctggctgtgctcgccgctctcactacagccaagcctgaagattttcccctgctgcatagatttagcatgtttgttcgaccacaccataaacagagattcagccagacttgtactgatctgactggccgaccataccccggaatggaaccccctgggccacaagaggagcggttggccgtgccgcctgtgctcactcatcgggcaccacagccaggtccttcacgaagtgagaagaccgggaagactcagtccaagatcagctcttttctgagacaacgtcccgctggaacagtgggggctggtggggaggacgcagggccttcacagagctccggccctccacatgggccagccgctagtgagtggggcctgtag

SEQ ID NO: 30603 - DNA, 3732 bp, Artificial Sequence
  Description of Artificial Sequence: Synthetic coding sequence
atgccaaagatcgtactgaatggtgtgactgtggactttccatttcagccatataagtgtcagcaggaatacatgaccaaagtgctggaatgcttgcagcaaaaggtcaatggaatactcgagagtcccaccggtacaggcaagaccctgtgcctgctgtgtactaccctggcatggagggaacacctccgggatgggatctcggccaggaaaatcgccgaaagagctcagggtgaactcttccccgacagggcactgtcttcctggggtaacgccgcagcggcagccggtgatccgatagcttgttacactgacatcccaaagattatctacgcaagcagaacacactctcaactgacacaggtcataaacgagctgagaaatactagttaccgtagccgctgccgggcaacgctgtgggttctggagacggctcctcccagacccaccgtgctaagccctacgcgacccaaggtatgtgtgcttgggtctcgcgaacagctgtgcattcatcccgaggtaaagaagcaagagtctaaccaccttcaaattcacctttgtcggaagaaggtggcttccagatcatgtcatttctacaataatgtagaagaaaagtcactggagcaggagctggccagcccaattctcgacattgaggacctcgtgaaaagtgggtctaagcatcgggtttgtccttactacctttcccgaaacttaaaacagcaggcagatattatctttatgccgtacaactatttgcttgacgctaagtcgcgcagagctcacaatatcgaccttaaaggtactgtggttatttttgatgaagcccataacgtcgaaaagatgtgtgaagagtcggcttcctttgacttaacaccgcacgacctggcctctggactggacgtaatcgaccaggtgcttgaggagcagacaaaagcggcacaacagggcgaacctcatccggagttcagcgctgacagccctagtccaggcctcaacatggagctagaggatattgctaaactcaagatgatccttttgagactcgaaggtgcaatcgacgccgtcgagctgccaggcgacgatagtggagtgactaaaccaggatcctacatctttgaattgtttgcagaggcccagatcacatttcagaccaaagggtgtatactggattccctggaccagattatacagcacctggctgggagagcaggagtttttacaaatacggctggtttgcagaagctagccgatatcatccagatagtgttcagcgtggacccatctgagggatcacctggtagtcctgccggactgggggcactccagagttataaagtccatatacaccctgatgcaggtcacaggcgcaccgcgcaacgcagcgacgcctggtccacaactgctgcacgcaagcgaggtaaggtgctcagctactggtgttttagccctggtcattcaatgcacgagctggtgagacagggtgtgagatcgctgattctgacgtctgggacactagctcctgtgtccagctttgctctggaaatgcagattccatttcctgtatgtttggaaaatccccatataatcgacaaacaccagatatgggtcggcgttgtgcccagggggcctgatggcgctcagctgagtagtgcttttgaccggagatttagcgaggagtgtctctcctcacttggaaaggccctcggtaacatcgccagagtggtaccttacgggcttctgatattcttcccaagctacccagtaatggagaaaagcttggaattctggcgtgccagggacctggctagaaaaatggaggctctcaagcccctgttcgtggagccaagatccaagggctctttctctgagacgatcagtgcttactacgctagagtggctgctcccggttctacgggagccactttcctcgcagtgtgcaggggcaaagccagcgaaggtctggacttttccgacactaacggcaggggcgtgatagtaactggactcccataccctccgaggatggaccccagggtagtgctgaaaatgcagttcctagatgaaatgaaggggcagggcggagcaggcggacagtttctgagtggccaggaatggtatcgccagcaggctagtcgggctgtgaatcaggcaattggcagggttattcgacaccgccaggattacggggcagtgtttctttgtgatcacagattcgcttttgccgatgccagggcccagctgcccagctgggttagaccccatgttcgggtctatgacaatttcggtcatgtaatcagagacgtggcacagttttttcgagtcgctgagcgtaccatgccggctccggctcctcgggcaaccgccccaagcgtccgaggcgaggatgccgtgtctgaggccaagtctcccggtccattctttagtacacggaaggctaagagtctggatctccacgtgcccagcctgaaacagcgatcctctggtagccctgctgcaggcgatccagagtcttctttgtgcgtggagtacgaacaggagcctgtgcctgcacgacagcgtcccagagggctgctggctgcactcgagcattcagagcagagggccggtagccctggggaggaacaagcccacagctgttcaactttgagtttactgagcgagaagcgtccagccgaggagccaagaggaggacggaaaaagataaggcttgtcagccaccccgaggaacctgttgccggtgcacagactgatagagctaaattgttcatggtggccgttaaacaagagctgtcccaggccaattttgccacctttactcaggcgctccaagattacaagggatcagatgattttgccgctcttgcagcctgtctaggtcctttatttgccgaagatccaaaaaagcacaaccttctgcagggcttttaccaattcgtgcggcctcatcataaacaacagttcgaagaagtgtgtatacagctgacaggccgtggctgcggatacagacccgagcacagtatcccacggcgacagagagcccagcctgtcttagaccctacagggaggaccgcacccgacccaaaacttacagtgtctacagctgctgcccaacagctggaccctcaggagcatttgaatcagggaagacctcatctttccccaaggcctcctcccaccggagacccgggatcccaaccacagtggggatcgggagtgccacgggcaggtaagcagggacagcatgcagtctccgcgtacctcgccgatgcaagaagggccctgggatctgctggatgcagccagctgctcgccgctcttacagcctataagcaggatgacgatctggacaaggtgctggcagttctggctgcgctgaccacagcgaaacccgaagattttccattattgcatagcaatagtatgttcgtccgacctcaccataagcaaagattcagccagacctgtactgatctgactggacgcccttaccctggaatggaacctcccggaccacaggaggaacggcttgccgtgccgcctgtgctgactcaccgcgctccgcaacctggcccttcgaggagtgagaaaacaggaaaaacccaatccaagatttcctcgtttcttaggcagagaccagcaggtactgtcggagcaggcggtgaggatgccggacctagccagtcatctgggccaccacacgggcctgccgcaagcgagtggggtctgtag

SEQ ID NO: 30604 - DNA, 3444 bp, Artificial Sequence
  Description of Artificial Sequence: Synthetic coding sequence
atggatatccgcaaattcttcggagtcatcccttctggcaaaaagctagtatccgagacagtaaagaagaacgaaaagaccaagagcgacgaagaaacgctgaaagccaagaaaggaatcaaggagattaaagttaacagcagcagaaaagaagacgattttaaacagaagcagccatccaaaaaaaaaagaatcatctatgatagcgactccgagtccgaagaaactctgcaagtaaagaatgccaaaaagccgcctgagaaattgcctgtgagctcgaagcctgggaaaatcagccggcaggatccagtaacatacattagcgagacagatgaggaggacgatttcatgtgcaaaaaagccgctagcaaaagtaaagaaaatgggagatcaacaaattcccacctcggtacctctaacatgaagaagaatgaagagaacactaaaacaaagaataagcccctgtcccccatcaaacttaccccaacatccgtactcgactatttcggaaccggatcggtgcagcggtcaaacaaaaagatggtcgcctccaagagaaaagagcttagccagaataccgatgagagtggcctgaacgacgaggccatagctaaacagctgcagcttgatgaagatgccgagctagagaggcagttgcacgaggatgaagagttcgccagaacactcgctatgctggacgaagagcccaaaacaaaaaaagctcggaaagatacagaggcaggagagacattcagctccgtgcaggcaaacctgtccaaggcagagaagcacaaatatccacataaagtgaaaaccgcccaagtttcagatgagcggaagtcctacagcccaaggaagcagtccaaatatgaatccagcaaagaaagccagcagcattccaagtcctcggcagataagataggagaggtgtcttcccccaaagcctcaagcaaacttgccatcatgaagcgaaaggaggagtcaagctataaagaaatcgagcccgtggcaagtaaaagaaaagagaatgctatcaagctgaaaggagagacaaagacgccaaagaaaaccaagtcatctcctgctaagaaggagtcagtgtcacctgaagatagtgaaaaaaagagaacgaactaccaggcttaccgttcgtaccttaacagggaaggccctaaggcactgggaagcaaagaaatacccaagggagctgaaaattgcctggagggcctgatcttcgtgattaccggagtgctggagtctattgaaagagacgaagccaaatctctgatcgagcgatacggtggaaaagtcacagggaatgtttcaaagaaaacaaactacctggtcatgggcagagatagcggccagagcaaaagtgataaggctgcggctttgggtaccaaaattattgacgaagatgggctcttaaatcttatcaggacaatgccaggtaagaagtcaaagtatgagatcgccgttgagaccgagatgaagaaggagagcaagctggagaggaccccccaaaagaacgtgcagggcaagcggaagatctctccatccaaaaaagagagcgaatcaaagaagtcccgaccaacttccaagagggactctcttgccaagactattaagaaggaaaccgacgtcttttggaagtctttagatttcaaggagcaggtagctgaggaaacttcgggcgatagcaaggcgaggaatctcgctgacgattcatctgaaaacaaagtagagaacctcctgtgggtagataaatataagcctacttcattgaagacaataattgggcaacagggtgaccaatcatgtgccaataagctgttacgctggttacggaattggcagaagtcgtctagtgaagataaaaagcacgcgaagttcgggaagttctctgggaaagatgacggctcctccttcaaggccgcactgctgagcggtcctcctggagtcggtaagaccaccaccgcttccctcgtgtgtcaagaattgggctacagttacgtggagctcaacgcaagtgacacacgatcaaagagttccctaaaggcaattgtggctgaatccctgaacaatacttctattaagggattttactcaaatggtgctgcatccagtgtgagcacaaagcacgctctcatcatggacgaagtggatgggatggctgggaatgaggaccgaggcggaattcaggagctgattggtctgatcaaacacacaaaaattcctataatctgcatgtgtaatgatcgaaatcacccaaaaattcggtctctggtgcattactgctttgacctcagattccagcggcctagagtggaacagatcaaaggcgcaatgatgagcattgcttttaaagaagggcttaagatccctcctcccgcaatgaacgaaattatcctcggcgcaaaccaggatatccgccaggttttacataacttgtctatgtggtgtgcccgaagcaaagctctaacttacgaccaggccaaagctgatagccacagagcaaaaaaagacattaagatgggaccgtttgatgtggctcgtaaagttttcgctgctggtgaggaaaccgctcacatgagcctggtcgacaagagcgacttgttttttcacgactattccatcgcacccctgtttgtgcaggagaactacattcatgtcaaaccggtagccgcaggcggtgacatgaaaaagcacctgatgctgctgtcgcgcgctgcggatagcatctgcgatggcgatctggtggattctcagatcaggagtaaacagaattggtctctccttcccgctcaggccatttatgccagtgtactacctggggaactcatgcgcggatacatgactcaattcccaacatttccctcctggctggggaagcatagttcaactgggaagcacgaccgcatcgttcaggatctcgctttacacatgagtctgaggacgtacagttctaagagaacagttaacatggattacctctcactcttaagagatgccctggtccagcctttaacatcacagggcgtcgatggcgttcaggatgtggtcgctttaatggatacctactatctgatgaaggaagatttcgagaacataatggaaatttctagctggggaggaaagccgagccctttctccaaactggatccgaaggtgaaggctgcgttcactagagcctacaacaaggaggcacatctcacgccgtacagcttgcaggcaataaaggccagtagacattctacttccccaagccttgattccgaatacaacgaggaactcaacgaagacgactctcagtctgatgaaaaagatcaagatgccattgaaacggatgccatgattaaaaagaagacaaagtcaagcaagcccagtaagcctgagaaggataaagaacccaggaaaggcaaaggaaaaagctcaaaaaaatag

SEQ ID NO: 30605 - DNA, 3447 bp, Artificial Sequence
  Description of Artificial Sequence: Synthetic coding sequence
atggatatccgcaagttttttggcgtcattccctccgggaaaaaacttgtgtctgaaactgttaagaaaaatgaaaaaaccaaatctgatgaggaaaccctgaaagcaaaaaaagggatcaaagagataaaagtcaactcatccaggaaggaagacgacttcaagcagaagcagcccagcaaaaaaaagaggatcatatatgactcagattctgaaagtgaggagacactccaggtgaagaatgctaagaagcctcccgagaagttaccagtatcctctaaacctgggaagatttctcgccaagacccggtgacctacataagtgagacggatgaggaagacgatttcatgtgtaaaaaggccgcatccaaatccaaagagaatggaaggtccaccaattcccatttggggacctcaaacatgaagaaaaacgaggagaatacaaagaccaagaataagcctctgagtccaattaagcttacaccaacatctgtactggactattttggtacaggatccgtgcagagaagcaataagaagatggtggcctccaagcggaaggagctcagccaaaatactgacgagagcggtctcaatgatgaggccatcgcaaaacaattacagctcgatgaggacgcagaattggaacggcagctgcacgaagacgaggaatttgccagaacgctagccatgctggacgaggagccgaaaacgaagaaggccagaaaggacacggaggcgggagaaacattctcttctgtccaagccaacttgtcaaaagctgaaaaacacaaataccctcacaaagtgaaaaccgctcaggttagcgatgagaggaagtcgtactctccacgcaagcagtcaaagtacgaatcctccaaggagagccagcagcacagcaaatcaagtgcagataaaatcggagaggtgtcgtcaccaaaggctagttccaaattggcgatcatgaagcgcaaagaagagtcttcctacaaggagatagaacctgtggcaagtaaacgaaaagagaacgccatcaagcttaagggcgagactaaaacacctaagaagaccaaaagcagccccgcaaaaaaggagtcagtctcacccgaagatagcgaaaaaaagaggacaaattaccaggcataccgctcctatttgaacagagagggcccaaaagcgttaggctccaaagaaatcccaaagggcgcagaaaattgcctagaaggccttattttcgtgatcaccggggtcctggaatctatagagcgtgacgaagcaaagtcccttatagagcgatatgggggaaaagttaccggcaacgtgtccaagaagacaaattacctcgttatgggccgagatagtggccaatccaaaagcgacaaagctgcagcactaggaacaaagatcattgacgaagacgggttgctgaatctgatccgcaccatgcctggcaaaaagtctaagtacgagattgccgttgagacagaaatgaagaaagagtccaagctggaaagaacccctcagaaaaacgtgcagggtaaaaggaagatttccccgagtaaaaaagagtccgagagcaagaaaagtaggccaacctcgaaacgggactcccttgctaagactataaagaaggaaactgatgttttttggaagtccctggatttcaaagaacaggtggccgaggagacgagcggcgactccaaagcccgaaacctggctgatgattcaagcgagaataaagtggagaaccttctgtgggtggacaaatacaaacccacttcactaaagaccataataggacagcagggcgatcagtcctgtgcaaacaaactcctccggtggttgagaaattggcagaaatcaagcagtgaggacaaaaaacatgcggctaaattcggcaaattctctgggaaggacgacggctcaagctttaaggctgctcttttgagcggcccaccaggggttggcaagaccacgactgctagcctggtttgtcaggaactgggatattcttatgtcgagttgaatgcttcagataccagatctaaatcgagtcttaaagccatcgttgcagagtccttaaataatactagcatcaagggtttctattctaacggggctgccagcagcgtgtccactaagcatgctctgatcatggatgaggtggacggcatggccggaaacgaagatcggggaggaatacaggagctgattgggcttatcaagcacacaaagattcctatcatatgcatgtgcaacgaccggaatcaccctaaaatcaggagccttgtgcattactgcttcgatctcaggtttcaacgacctagggtagaacaaatcaaaggcgcaatgatgtctatcgcttttaaagaggggctgaagatacctcccccagcaatgaacgaaatcatcctcggcgcaaaccaggatattagacaggtgctgcataatctatcaatgtggtgtgctcgatccaaagctttgacatacgaccaggcaaaggcagactctcatcgcgcaaagaaagatattaagatgggaccttttgacgtagctcggaaagtatttgccgcaggcgaggagactgcacacatgtcactcgtggataagagcgacctctttttccatgactactccatcgcacctctgtttgtccaggagaactacatccacgtgaagccggtcgctgcaggcggagatatgaagaaacacttgatgttactgtctcgcgctgctgactctatatgtgacggcgacctcgtagactcacagattcggtctaagcaaaattggtcgttgctgccagcccaggccatctatgcttccgtactgcccggagagctgatgcgaggctacatgacacagtttcctacctttccttcttggttaggcaagcatagctccacaggaaagcacgatagaatcgtgcaggacttggcactacacatgagccttcggacctactcttcaaagaggaccgtcaatatggactacctttcattgctgagagacgcactggtccagcccctcacatctcaaggagtggatggcgttcaggacgttgtagccctcatggacacctactaccttatgaaagaggacttcgagaacatcatggaaattagctcttgggggggaaaacctagccctttttcaaagctggatccaaaggtaaaagccgcatttacccgagcatacaacaaagaggcacaccttactccttactccctgcaggcgatcaaagcgtcacgacattccaccagccccagcctggattctgagtacaacgaagagcttaatgaggacgactcacagtcagacgagaaagatcaagatgctatcgagaccgatgccatgattaaaaagaaaactaagtcttcaaagccatccaaaccagagaaggataaggagccgaggaagggcaaaggtaagtcctctaaaaagtag

SEQ ID NO: 30606 - DNA, 564 bp, Artificial Sequence
  Description of Artificial Sequence: Synthetic coding sequence
cctgaggacagcgaaaagaagagaactaactaccaggcataccggtcctatttgaatagggagggcccaaaagcccttggtagcaaggaaatacccaagggagccgagaattgtctggaaggcttgatcttcgtaattactggtgtcctggagtccatagagagggatgaggccaagtccctgatagaacgctacggaggaaaggtcacggggaacgtctccaagaaaactaactacctcgtgatgggtagagattcgggccaatccaaatctgacaaggcagccgcactagggacaaaaataatcgacgaggatggactgctcaatctgatccggacaatgcccggtaagaagtctaaatatgaaatagccgttgagacggaagaactgggctattcttatgtggagctgaatgcatcagacacacgaagtaagagttccctcaaagccatcgtcgcagaaagtctcaacaatacctctattaaaggcttttactccaacggagccgcttcatccgtcagtaccaaacatgcgctcataatggacgaagttgatgggatgtag

SEQ ID NO: 30607 - DNA, 1851 bp, Artificial Sequence
  Description of Artificial Sequence: Synthetic coding sequence
atggtgggtcagttgtcagagggcgcaattgctgccattatgcagaaaggggacacaaacattaagcccattcttcaggtcatcaatatcagaccaatcactactggcaacagccctccgcgttacagactgctgatgagcgatggactgaatacactgagctccttcatgcttgctacacagctgaacccactggtagaagaagaacaactcagcagtaactgcgtatgccaaattcaccggtttatcgtcaacacactgaaggatggacgccgagtagtgattctgatggaattggaggttctcaaaagcgcagaggctgttggcgtgaaaataggaaatccagtgccatataatgagggtctaggacagccccaggttgcaccacccgctcccgctgcaagcccagccgcttcatcccgtccgcagccccaaaatggtagctcaggaatggggtccaccgtctcaaaagcctacggagccagtaagaccttcggcaaagccgctggaccctcactgtcccacacgtctgggggtacacagtccaaggtagtgccgatcgcaagcctgacaccttaccaaagcaagtggaccatctgcgctcgagtgacaaacaagtcacaaattcggacatggagcaactcaaggggggagggcaagctgtttagcctggaacttgtggatgaaagcggggagattagagctactgccttcaatgagcaagtcgataaattctttccacttattgaagtcaataaagtttactacttctccaagggcacactgaagatcgccaataagcagtttaccgcagtgaaaaacgactacgagatgacttttaacaacgagacaagtgttatgccatgcgaggatgatcatcacttgccaactgttcagttcgatttcactggtattgatgatttggagaacaagagcaaagattcactggtggatatcatcgggatttgtaaatcatacgaagacgcgactaaaatcacagtcaggtcaaacaatcgggaggtggccaagcggaatatttatttaatggacaccagcggcaaagtggtgacagcaacgctctggggcgaggatgccgataaattcgacggatccaggcaaccggtcctggcaatcaagggagcaagagtctctgattttgggggtcggtcgttgtcagtcctgtccagctcgactataatcgccaatcctgatatccctgaggcttataaactgagagggtggttcgatgccgagggccaagcactggacggcgtttctatcagtgatttaaaaagcgggggtgtagggggttcaaataccaattggaagaccctgtacgaagtcaaaagcgagaacctcggccagggtgacaagcctgactatttcagcagcgttgctaccgtggtgtatttgagaaaggaaaactgtatgtaccaagcatgtcccacacaggattgtaacaagaaagtaatcgaccaacaaaacggattgtaccggtgtgaaaaatgtgatacagagttccccaactttaaatacaggatgatcttgtcagttaacatcgcggatttccaagagaaccagtgggtcacatgttttcaggaatccgccgaagccattctagggcagaacgcggcttacctgggggaactgaaagacaaaaacgaacaggccttcgaggaggtcttccagaacgcgaactttaggtcgtttatttttagagtgagggtgaaagtcgaaacttacaacgatgaatctcggatcaaggcaactgttatggacgtaaagcccgtggattaccgggaatacggaaggcgattggtgatgagcatcagacggtccgcactgatgtag

SEQ ID NO: 30608 - DNA, 2217 bp, Artificial Sequence
  Description of Artificial Sequence: Synthetic coding sequence
atgacgtcaagtggacctggacctcggtttctgttgttattgcccctccttctcccgccagccgcttcggcttcagacagaccacgaggacgcgatcccgtgaatccagagaagctgttggtaataacggtagcaaccgctgaaacagagggttacctaagattcctccgtagtgctgagttcttcaattacacagtgcggaccttgggattgggcgaagagtggaggggcggagatgtggcaaggaccgtgggcggagggcagaaggtgagatggctgaagaaagagatggaaaagtatgccgaccgggaggatatgattattatgtttgtcgattcatacgatgtgatacttgcagggtcacctactgagttactgaagaagtttgtgcagtcaggttcaaggctgctgtttagcgccgaatctttctgctggcccgaatggggcctagctgaacaataccctgaggtggggactggcaagagattcttgaactcaggaggctttatcggattcgctactaccatccaccagatcgttaggcagtggaagtataaagatgacgacgacgaccagctgttttatactcggctgtatctggatcctggtctgagggaaaagttgtcgttaaaccttgatcataaatcccggatttttcagaacctgaacggagccctggacgaggtggttctgaagtttgatcggaatcgagttaggatccgcaacgttgcctatgatacacttcccatcgtggtgcacggcaacggtccaacaaagcttcagctcaactacctggggaactacgtgccgaacgggtggactcccgaggggggttgtggcttctgtaatcaggaccgccgaacccttcccggaggccagcctcctcctagggtgttcctggccgtctttgtcgagcagccaaccccttttctgcccaggtttctccagagactactgttgctggactaccccccagaccgtgttactttattcctgcataataacgaggtgtttcatgagcctcatatcgctgacagttggccacaactgcaggaccatttctctgccgtgaagcttgtgggtcccgaggaggcgctttcacccggtgaagccagagacatggctatggacttatgcagacaggatcctgagtgcgaattttacttctcactcgacgccgacgccgtcctaactaacttgcaaaccttacgcattttgatcgaggaaaatagaaaggtcattgctccaatgttgagtcgacatggcaagctgtggtctaatttctggggtgctctctctccagatgagtactacgcgaggtccgaggattatgtggagctcgttcagcgcaagcgcgtgggagtgtggaacgtgccttatatctctcaggcgtatgtgattagaggtgacactctgaggatggagcttcctcagcgggacgtctttagcggttctgacaccgatcctgacatggccttttgcaagagttttagggacaaaggcatcttcctccacctttccaaccaacatgagttcggcaggcttctggctacctctagatatgacaccgagcaccttcacccggatctttggcaaatcttcgacaacccagttgactggaaggagcagtacatccatgagaactactcaagggccctcgaaggagaggggatcgtggagcagccctgtccggacgtctattggttcccactgctgagcgaacaaatgtgcgacgaacttgtcgccgaaatggaacattatggtcagtggtcgggaggaagacacgaggattctcgactcgctgggggatacgagaatgtgcctacagtcgatattcacatgaagcaagtgggatacgaggatcagtggctacaactccttaggacctatgttggtcctatgaccgaatccctcttccctggttatcatactaaggctcgtgctgtgatgaacttcgtcgtgaggtataggccagatgagcagccttcattgaggccccaccatgactcgtctacgttcacgcttaacgtagctctcaaccacaaggggctggattatgaaggcggagggtgccgctttctgcgatacgattgtgtgatctcttcacctcggaagggatgggccctgttgcaccctggaaggctcacccattaccatgagggcttgcccacaacatggggcacccggtatatcatggtgtcctttgttgacccatag

SEQ ID NO: 30609 - DNA, 366 bp, Artificial Sequence
  Description of Artificial Sequence: Synthetic coding sequence
atggtcgacatgatggatctgcctcggtcccgaatcaatgccggaatgctcgcccagttcatagataaacctgtttgttttgttggcaggcttgaaaagattcaccccaccggtaaaatgttcatcctttcggacggggaggggaagaatgggacaattgagttgatggaacccctagatgaagagatcagtggcatcgtcgaggttgtaggacgcgtgaccgccaaggccacaatcctttgcacctcttatgtgcagtttaaggaagatagccatcccttcgacctggggctctataacgaagccgtgaagattattcacgacttcccgcagttttacccattaggcattgtgcagcatgattag

SEQ ID NO: 30610 - DNA, 2787 bp, Artificial Sequence
  Description of Artificial Sequence: Synthetic coding sequence
atgcctccaaaaacccccagaaaaactgccgctacggccgcagcagctgccgcagaacctcccgcacctccccctccaccacctcccgaggaagaccccgaacaggatagcggcccagaagacctgccactcgtccggctcgaatttgaagaaaccgaagagcccgacttcacggccctgtgccaaaaactaaaaatccctgaccatgtgagagagagggcctggcttacatgggagaaggtctcctccgtcgacggcgtcctcggcggatacatccaaaaaaagaaggaactatggggaatctgcatattcatcgccgcagtggacctcgacgagatgtcctttaccttcacagagctgcagaaaaatatcgagataagcgtgcataagtttttcaatcttctgaaagagattgatacatcaaccaaggtcgacaatgcaatgtctcgtcttctcaaaaagtacgatgtcctcttcgctctgtttagcaagctggagcgcacatgtgaactgatatacctgacccagccctcgtcgtcaattagcacggaaatcaacagtgccctagtcctgaaggtgagctggatcacattcttgctggccaaaggcgaagtgttacagatggaggatgacctggttatcagctttcagctgatgctctgtgtgctggattacttcatcaaactgtctccaccaatgctcttgaaggagccatataagactgctgttattcccattaatgggagtccacgcactcccagacgcggtcagaaccggtcagcccgaatcgccaaacagttagaaaacgacacgagaatcattgaggtgctctgtaaggagcatgaatgcaatattgatgaggttaagaatgtatatttcaaaaactttatcccatttatgaactcactcgggctggttacgagcaatggtttgccagaagttgaaaacctgtccaagaggtacgaagagatctatctgaagaataaggacctggatgctagactgttcctggaccatgacaagactttgcaaaccgatagtatcgatagcttcgagacgcagcgcacacctaggaaatctaatttagacgaggaggtcaatgttatcccacctcacaccccagtcagaaccgtgatgaatacaattcaacagctcatgatgatccttaattccgccagcgaccagcctagcgaaaatctgattagttattttaataattgtacggtaaatccgaaggagagcatactgaagcgcgttaaggatattggatacatcttcaaggagaaatttgcgaaagcagtcggccaaggatgcgtggagatcggttcccagaggtataaactcggggtgaggctctactacagagttatggagtcaatgctgaagtcagaggaagagcgcctcagcattcagaatttcagtaaactcctgaacgacaatatttttcacatgtccctcctggcctgcgctctggaggtcgttatggctacgtacagtcgttccacatcacaaaatctcgattccggcacggatttatccttcccttggattctcaacgtgctgaacctgaaggctttcgatttttacaaagttatagagtcctttattaaggcggaaggcaacctgacgcgagagatgatcaaacacttggagcgttgtgagcaccgcatcatggaatctctcgcatggctgagcgactctccactgtttgatctgattaaacaatccaaggaccgggagggccctactgatcacctggagtcggcttgtccgctcaacctccctcttcagaataaccataccgccgcagacatgtatctcagccccgtccgttcgccaaaaaagaaaggctccacaacaagagtgaactcaacggctaacgcagagactcaagctacatccgccttccagacccaaaagccactgaaatcgacctccctcagtctgttttataaaaaagtttatagactcgcttatctgaggctgaacaccctgtgtgaacggctgctgtcggaacatccggaactggaacatataatatggaccttgtttcagcatactctgcagaatgagtacgagctcatgcgggaccggcacctggatcagattatgatgtgttcgatgtatggcatctgtaaggtgaagaacatagacctgaagtttaagattattgtcaccgcgtacaaagatctgccccacgcggtccaggaaaccttcaagcgagtgttgatcaaggaggaggagtatgacagcataatcgtgttctacaatagcgtctttatgcaaagactgaaaaccaatatccttcagtacgctagcactcgtcctccaacgctgtcaccaattccgcatatcccccgtagcccctacaagttcccttcatcacctctgcgtatccctgggggaaacatttacatctctccactgaaatccccctataagatcagcgaaggcctgcctacccctaccaaaatgactccacgctcaaggatcctcgtgtctattggcgaatcttttgggaccagcgagaagtttcagaagatcaatcagatggtttgcaacagtgaccgggtgctgaagcgatctgcagagggaagcaaccctccgaagccactcaagaagctgcgcttcgacattgaagggagtgacgaggcagatgggtccaagcacctaccgggagagtctaaatttcagcaaaagctagcagaaatgacatccacccggactcgcatgcagaagcagaaaatgaacgattctatggacacctccaacaaagaggaaaagtag

SEQ ID NO: 30611 - DNA, 162 bp, Artificial Sequence
  Description of Artificial Sequence: Synthetic coding sequence
atgcccccaaaaaccccaaggaagactgcggcaacagcagcggctgccgctgctgaaccacctgcacctcctccccctcctcctccagaagaggatccggagcaggattccggccctgaggacttgccactcgtccggggatccattaccaacggacgatag

SEQ ID NO: 30612 - DNA, 2724 bp, Artificial Sequence
  Description of Artificial Sequence: Synthetic coding sequence
atgccccctaaaacaccaccccctgaggaagatcccgagcaagactctggtcctgaggatctcccactggtcagactggagttcgaagaaaccgaagaaccagacttcaccgctctgtgtcagaaacttaagattcccgatcacgttcgggagcgagcgtggttgacgtgggaaaaagtttcatctgtggatggcgtgttggggggatacatacagaaaaaaaaggagctttggggcatttgtattttcatcgccgcagtcgacctcgatgagatgagctttacgttcactgaattgcagaagaatatcgaaatttctgtacacaagttctttaacttactgaaggagatcgacacctctacaaaggtggataatgcaatgagcaggcttctgaaaaaatacgacgttctgtttgcgctcttcagcaaattagagcgcacatgcgagctcatttacctcacacagccttcctcctctataagcacagagatcaactccgcacttgtgttgaaggtctcatggattacctttctgctggcaaaaggtgaagtgctacagatggaggacgacctggtcatctcctttcagctcatgctttgtgtgctcgactactttatcaagctttcacctcctatgcttctgaaggagccctataagaccgctgtcatccccattaatggatctcctcgaaccccacggagagggcagaatcgcagtgcacggatagctaaacaactggaaaatgacaccagaataattgaggtgctgtgcaaagagcacgagtgcaacatcgacgaagtaaaaaacgtttactttaagaactttattccattcatgaatagcttgggtttggtcacaagtaatggtctgccagaggtggaaaatcttagcaagaggtacgaagagatctacttaaagaataaagatcttgacgcacggctctttttagatcatgataagacactgcaaaccgattcaatcgacagcttcgagacacaacgtactcccaggaagtctaacttggatgaggaggtcaacgtgatccccccacatacgcctgtgcgcacagtgatgaacacgattcaacaactgatgatgatcctaaactctgccagtgatcagcctagcgagaacctgatctcctattttaacaattgcactgtcaaccccaaggagtctatacttaagagagtcaaagacattggttacatcttcaaagagaagttcgctaaagctgtcggccagggctgtgtggagattggctcacagcgctacaaactgggggtgcggctgtattacagggtgatggaaagtatgctgaagagtgaggaggaacggctgtccatccagaatttctccaaactgttgaatgataacatttttcatatgtcattgttggcatgcgcgctggaagtggtaatggctacatacagtcggtcaaccagccagaatttagactccgggaccgatctcagttttccgtggattcttaacgtcctgaatcttaaggcgtttgatttttacaaggtcatcgaaagttttatcaaggcggaggggaacttgacgcgcgagatgatcaaacacctggaaaggtgtgagcatagaataatggagagtttggcttggttgagcgactctccattgttcgacctgatcaagcagagtaaagacagggagggaccgactgatcatcttgagagcgcatgccccctcaaccttccgctgcagaacaatcatacagccgcagatatgtatctctcccccgttcgttcgcctaagaagaaaggctccacaacccgcgtgaatagcaccgccaatgccgaaacccaggcaacgagtgcgtttcagacccaaaagcctctgaagtctactagtctaagtctgttttacaagaaggtctacaggctggcctaccttcgtttaaatacactgtgcgagcgcttgctatcagaacaccctgagctcgaacatatcatttggacattgtttcaacacacactgcagaatgagtatgagctcatgagggacaggcacctggaccagatcatgatgtgttctatgtacgggatctgtaaagttaaaaacatcgatctcaagtttaagattatcgttacagcctacaaggacctgccacacgccgtgcaagaaaccttcaaaagagttcttatcaaggaggaagaatatgactctatcattgtcttttacaactccgtatttatgcagcgactcaaaactaacatcctccagtacgcctctactcggccaccgaccctgagcccgattccacatatccctaggtccccctataaatttccaagttccccgctgcgaataccagggggaaacatctacattagtcccctgaagagcccgtacaaaataagtgaaggcctgcctaccccgacgaagatgacaccgagatcaaggattctggtgagtattggtgaatccttcggaactagtgaaaagtttcagaaaattaaccaaatggtgtgcaactccgatcgtgtcttaaaacggtctgccgaaggttccaaccccccaaaacccctgaaaaagctgcgtttcgatatagaggggtccgatgaagcggacgggtccaagcacctgcccggagaatccaagttccaacagaaactggccgagatgacgagtacacgcacaagaatgcagaaacagaagatgaacgattctatggatacatccaacaaggaggagaaatag

SEQ ID NO: 30613 - DNA, 2694 bp, Artificial Sequence
  Description of Artificial Sequence: Synthetic coding sequence
atgaatatcagtggtagcagctgtggatcccctaatagcgccgatacttcctcggattttaaggacttatggaccaagctgaaggagtgtcatgatagggaggttcagggcctccaggttaaagtgactaaactgaaacaggagaggatcctagatgcacagcgcctggaggagttcttcacaaagaaccagcagcttcgagagcaacagaaagtattacatgaaactattaaggtgctggaggaccgactgcgcgcagggctctgcgacagatgcgcagtgacagaagagcacatgcggaaaaaacagcaggaatttgagaacatccgccagcagaacttgaagctgattaccgagctgatgaacgaacggaacaccttacaggaggagaacaaaaagctgtctgagcagttgcagcagaagattgagaacgaccagcaacaccaggccgctgaactggagtgtgaagaggatgtgataccagacagccctataacggcattctcctttagcggagttaatcggctcagacgcaaggagaatcctcacgtccgttatatcgaacagacccacactaaactggagcattcagtgtgcgcaaacgaaatgcgtaaggtcagtaaatcaagcactcatcctcagcacaaccctaatgagaatgaaattcttgttgcagatacctatgaccaatcccagagccccatggctaaggcccacggtactagtagttacaccccggataaaagctctttcaacttagccacggtggtcgcggagacgcttgggctcggcgtgcaggaagagtctgaaactcaggggccaatgtctcccctgggtgatgagttatatcactgtctcgaaggaaaccataaaaagcagccttttgaagaaagtacgcggaataccgaggactccctgcggttcagtgacagcacctcgaaaacacccccacaagaggagctcccgacccgcgtgtcctctcccgtgttcggcgcaacgagcagcattaagtcgggacttgacctgaacaccagcctgtccccgtcacttctccagcctggaaaaaagaagcaccttaagacactccccttctcaaacacctgcataagccgcctggaaaaaactcgctccaaaagtgaggacagcgcactgttcacacatcatagtctgggctcagaggtgaataaaatcatcatacagagtagcaataagcagattctaattaacaagaacattagcgaaagtctcggggagcagaatcggaccgagtacgggaaagacagtaacactgataaacaccttgaaccactgaaatccctgggtggacggacttcaaagcgtaagaaaactgaggaagaatcagaacacgaagtgtcctgcccgcaagcctcctttgataaagagaatgcctttccttttcctatggataatcagttcagcatgaatggggattgtgtgatggataagcctctggatctttccgaccgatttagtgcaatccagagacaagaaaaatcccagggttcagagaccagtaaaaacaaatttagacaggtaacactatacgaagccctgaagacaatccccaagggattttcctctagccgaaaagcctcagatggcaattgcactcttcctaaggatagtcctggggagccctgtagtcaggaatgtattatactgcagcctctgaataagtgttctccagacaacaagcctagtctgcaaattaaagaggaaaatgcagtctttaaaatccctctgcgtcctcgggagtccctggaaacggagaacgtcctcgacgacatcaagtccgctgggtcccacgagcccataaaaattcaaacaaggtctgaccacggcggatgcgagttggcgagtgtgctgcagctcaatccctgtcggacaggaaaaatcaagagtctccaaaacaaccaggacgtgagctttgagaacatccagtggtctatcgatccgggagctgacttaagccagtataaaatggacgtcacggtgatcgacaccaaggacggatcccagagcaagctggggggtgaaaccgtggacatggattgcacccttgtgtcggagacagttctgctcaagatgaagaagcaggagcagaaaggcgagaagtcctctaatgaagagagaaaaatgaatgattctctggaagacatgttcgaccggaccacacatgaagaatacgaaagctgcctagctgacagtttttctcaggcagctgacgaagaagaagaactgtccactgccactaagaaattacacactcacggagacaagcaggacaaggtcaagcagaaggcatttgtggaaccctactttaagggcgatgagagggagacttcactccaaaattttccgcatattgaggtggtgaggaaaaaggaggaaagacgaaagctgctaggtcacacctgtaaagagtgtgaaatttactacgcagatatgccggctgaagaaagagagaagaagcttgcctcctgcagtaggcaccggttccggtacattccacccaatacacctgagaatttctgggaggtggggttccctagcacccagacttgcatggagcggggatatataaaggaagatttggacccttgtccccgtccgaaaagaaggcagccgtacaacgctattttctctcccaaaggcaaagagcagaaaacctag

SEQ ID NO: 30614 - DNA, 2709 bp, Artificial Sequence
  Description of Artificial Sequence: Synthetic coding sequence
atgaacatcagcggatcatcatgtggaagccctaatagtgccgacacatcttctgattttaaagacttgtggactaaactgaaagagtgccacgatcgcgaagtgcaagggctccaagtgaaagtgaccaagttgaaacaggaaagaatcctggacgcccagcggctggaagaattttttacgaaaaaccaacaactgagagagcagcaaaaggttctgcacgagacaatcaaggttctcgaggaccggcttagagcgggactgtgtgaccgctgcgccgtgacagaagagcacatgcgcaaaaagcagcaggaattcgagaatatcagacagcagaatctgaagctcatcactgaactaatgaacgaaagaaatacacttcaggaagagaacaagaaactcagtgaacagttgcagcagaagatcgagaatgaccagcaacatcaggcagccgagctggagtgcgaagaggatgtgatccctgatagcccaattacagcgttttcatttagcggtgtgaaccgtcttcgtcggaaggagaatcctcacgtaaggtacattgagcagacccataccaaattggagcattcagtctgcgcaaatgaaatgaggaaagtgtccaagtcatccacacaccctcaacataatcccaatgaaaacgaaatcttggtggcggacacctatgatcagagtcagtctcccatggccaaggcacatggaacatcatcttataccccagacaaatcatcttttaatctcgccactgtcgtggctgaaaccctgggtctgggtgttcaagaagaatcagagacccaggggccaatgtcacctcttggggatgagctgtatcactgtttggaggggaatcataagaaacagccatttgaggaatctactcggaacacagaagattccttaagattttcggactcgacctcaaagacacctcctcaggaggagctgccgacaagagtgagttctccagtttttggcgctacatcatctattaaaagtggccttgacctgaacaccagcctcagtccaagcctgctgcagcctggaaagaagaaacacctcaagacactcccatttagcaatacctgcatctccagactggaaaaaacccgaagcaaatcagaagactcagccctgtttacacaccactctctgggcagcgaggtgaacaagataataatccagtcaagcaacaaacagattcttataaataaaaatatcagtgagagcctaggcgaacagaaccgcaccgagtacggaaaagattccaacactgataaacacctagagcccctcaagtccctcgggggacgcacgtcaaagaggaagaaaacagaggaggagtcggagcatgaagtcagctgtccgcaggcctcattcgataaagagaacgcttttccttttcctatggacaatcagttttctatgaatggagactgcgtaatggataaaccactggatctgagtgatcgattcagtgccattcagaggcaagagaaatcccaggggtctgaaacatccaagaataaatttaggcaggtgacgttatacgaggcactcaagacaattccaaaggggttctcctcttccagaaaggcctccgacggcaactgtaccttgcccaaagactctcccggagagccctgtagtcaggagtgtattatccttcagccacttaacaaatgctcccccgacaataagcccagtttgcaaatcaaagaagagaacgcagtgttcaaaattccattacgcccacgggaaagccttgagaccgagaacgtgcttgacgacattaagagcgcagggtcccacgagccaattaagattcagactcgctctgaccacggtgggtgtgagcttgcatcagtccttcagctgaacccatgccgaacaggaaaaatcaaatctttgcagaataatcaagacgtttcttttgaaaacatccaatggagtattgaccctggagcagatctatctcagtacaaaatggatgttaccgtcattgatacgaaagacggctcccaaagtaagctagggggtgagactgtcgacatggactgcacgcttgtgtccgagaccgtgctgctaaagatgaagaaacaggagcaaaaaggggagaagtcctctatgcttttctacatagacgaggagcggaagatgaacgattctctagaggacatgttcgaccgcactacccatgaggaatacgagtcctgcctggcggactcttttagtcaagcagcagacgaggaggaggaactttctactgcaactaaaaaactccacacgcatggggacaagcaagataaagtgaaacagaaagcctttgtggagccttatttcaagggcgatgaacgggagactagtttgcagaactttccccacatcgaggttgtccgtaaaaaggaggaaagacggaaactgcttggacatacgtgcaaagaatgtgaaatttactatgcagatatgccagccgaggagcgggagaaaaagcttgctagctgttcccggcacagatttaggtatatcccacccaacacacccgagaacttttgggaggtcggcttccccagcacacagacgtgtatggaaagaggatatatcaaggaagatctggacccttgtcctaggcccaagaggcggcagccgtacaatgccatcttctcacccaagggaaaggaacaaaagacgtag

SEQ ID NO: 30615 - DNA, 2598 bp, Artificial Sequence
  Description of Artificial Sequence: Synthetic coding sequence
atgaacatctcaggtagctcttgcggttcacctaactctgcagatacctcgagcgattttaaggatttatggactaaactgaaagagtgccacgacagagaagtccagggactgcaggtgaaagtgaccaaactaaagcaggaacggattcttgacgcccagagactggaggaatttttcactaagaaccaacagctacgcgagcaacaaaaggtcctccatgaaaccattaaggtactcgaagatcggttgcgggctggcctgtgtgacagatgtgcagtaacagaggagcacatgaggaagaaacagcaggagtttgaaaacatcaggcagcagaacctgaaactcattaccgagctgatgaacgagagaaatactcttcaggaggagaacaagaagctctcagaacagctccagcagaaaatagaaaatgatcagcagcatcaagcagctgaacttgagtgtgaggaagatgtgattcccgattctcctattaccgcattttcattttcgggcgtgaacaggctccggagaaaggagaaccctcatgtgcgttatatcgaacaaacccacaccaagctcgaacactcggtgtgcgccaatgaaatgcggaaagtctccaagagtagcactcaccctcagcataatcctaacgagaatgagattctggtggcagacacatatgaccagagccaaagccctatggctaaggcacacggaactagttcttatacacctgataaatcatcatttaacttggccaccgttgtcgcagagacactgggactcggggtgcaggaagaatccgagacgcaggggcctatgtctcccctaggagatgagttataccactgcttggagggtaatcacaagaaacaacctttcgaagagtccaccaggaacaccgaagatagcctgcggttcagcgattccactagcaagacacccccacaggaggaactaccaactcgggtttcatcaccggttttcggagcaacttcctctatcaagagcggactggatctcaatacctcactctccccgtcactgttgcaaccaggcaagaaaaaacacctcaagacccttccctttagcaatacctgtatcagtcggttggagaagactcgctccaaatctgaagattccgctttatttactcatcactcccttgggtcggaggtgaacaagattatcatccagtcctcaaataagcaaatcctgattaataaaaacattagcgaatcactgggcgagcagaatcgaactgaatacggcaaagacagcaatacagataagcatctggagcccctgaaatccctcggaggaagaacatcgaagcggaagaagacagaggaggaatccgagcatgaggtgagctgcccgcaggcttcctttgacaaagagaatgctttccccttccccatggacaatcagtttagcatgaacggagactgcgtgatggacaagcctttagatcttagcgataggttcagtgccattcaaaggcaggaaaaatcccagggtagtgagacctcaaaaaataaattcagacaggttacattgtacgaagctctgaaaactattccaaagggctttagctctagcaggaaggccagcgatgggaactgtacgctgccgaaagactccccaggggaaccttgtagccaggaatgcattatactgcagcctctcaataaatgctcccctgataacaagccttcattgcaaatcaaagaggaaaacgccgtgttcaagataccactgaggccacgggaaagtctcgagacagaaaacgtcctggatgacattaaatctgccggttcacacgaaccgattaagatacaaacacgatctgaccacgggggatgtgaactggccagtgtcttgcaacttaatccgtgcagaaccggcaaaatcaaatccttgcagaacaatcaggacgtgagcttcgagaacattcagtggagcattgaccctggagctgatctgtcccagtacaagatggatgtgactgtgattgacacgaaggacggttcacagagcaaactgggtggcgagacagttgacatggactgtacattagtgagcgaaactgttttactaaagatgaaaaagcaggagcagaaaggagagaagtcatccaacgaggagaggaaaatgaacgacagtctcgaagacatgtttgatcggaccacacatgaagagtatgagtcctgcctggccgatagcttttctcaagctgccgacgaagaagaggagttgtctacggcaaccaagaagctgcatacgcacggtgacaaacaagataaagtaaagcagaaagcctttgtggagccctacttcaaaggggacgagtccatcatgcagatttgccagcagaaaaaagaaaaacgaaactggcttcccgctcaggatacagattccgccacattccatccgacccaccagaggatcttcggaaagctggtgttccttcccttacgtttggtgtggaaggaggtgatccttcggaagattctgatcttggtgctcgtccagaaagacgttagtctcacgacacagtactttctgcagaaagcaaggtcaaggagacactag

SEQ ID NO: 30616 - DNA, 2694 bp, Artificial Sequence
  Description of Artificial Sequence: Synthetic coding sequence
atgaatatctcgggctcgtcctgcggaagccctaactcagccgacacctcaagtgactttaaggatttgtggaccaaattgaaggagtgccacgaccgggaggtgcagggactccaggtgaaggtaaccaaactgaaacaggagcgcattctggacgcccaaaggctagaggagttcttcaccaaaaatcagcagctcagggagcaacagaaggtgctgcacgaaaccatcaaagttttagaagatcgattacgagctgggctgtgcgacaggtgcgccgttacagaagagcacatgcgtaaaaaacaacaggagttcgagaacattagacagcaaaatctcaagctgattactgagctgatgaatgagaggaacaccctgcaagaagagaataaaaaactgagcgagcagctgcagcagaagattgagaacgatcagcagcaccaggcggctgagctggaatgtgaggaagatgtgattcccgatagccctataactgccttcagcttcagcggcgtgaacaggctccgcagaaaagaaaacccccacgtgcgatacatcgagcagactcacactaaactggaacacagcgtttgcgccaacgaaatgcgcaaggtgagcaagtccagcacacaccctcagcacaatcctaacgagaacgagatcctggtcgcagacacgtacgaccagtcccagtccccaatggcaaaggctcacggcaccagctcatacacccccgacaaatcttcctttaacctcgcgacagttgtcgccgagactcttgggcttggcgtgcaggaggagagcgaaacccagggccctatgtctccactgggcgatgagttgtaccattgcttagaggggaaccataaaaagcaaccattcgaggaatccacacgaaacaccgaggacagcttacggttctccgattcaacctcaaagaccccacctcaagaggagctcccaactagagtgtcatctcccgtattcggcgcaacatcatccataaagtctggtcttgatcttaacacaagcctgagtcctagcctcctgcagcccggaaagaaaaagcacctcaaaaccctccctttcagtaatacttgcatcagccgtctcgagaagacgagatccaagtctgaggattccgccctcttcacgcatcattccttgggtagcgaagtgaataagatcataatacagtcttccaacaagcagattcttatcaataagaatatcagcgaatccctgggagaacagaataggaccgagtacggaaaagattccaacacagataagcacctcgaaccactgaaatctctggggggtaggacctccaagcggaagaaaacagaggaggaatccgagcacgaagtctcatgtccacaggcgagctttgacaaggagaatgcctttcctttcccaatggacaaccagttttctatgaacggggattgtgtcatggataaacccctggatttgagtgaccgcttcagtgcgattcaacgtcaggagaagtcgcagggttcagagacttcgaagaacaagttcagacaggtcacgttgtacgaggctctgaaaacaattcccaaggggttttccagttccaggaaagccagtgatggaaattgtaccctccctaaagacagtccgggtgaaccttgctcgcaggaatgtattatcctgcagcctctgaataaatgctcccctgataacaaaccgagtctacagatcaaagaggagaacgccgtattcaaaataccactgcgccctagggagtccctggagacggaaaatgtcctggatgatatcaagtctgccggtagccacgaaccaattaaaatccagacacggtcggatcatggaggctgcgagctggcgtctgtgttgcagctgaatccatgtcgcactgggaaaattaagtcattgcaaaataaccaggatgtaagtttcgagaacattcagtggtctatagaccccggagcagacttatcgcagtataaaatggatgtcacagtgatcgatactaaagacggcagccagagcaaattggggggtgagacagtggatatggactgcaccctcgtaagcgagactgtattactaaaaatgaagaagcaagagcagaagggagaaaaatcaagtaacgaggaaaggaagatgaatgattcactggaagatatgttcgacagaactacccatgaagagtacgagtcctgcctcgcagacagcttctctcaggctgcagatgaagaggaagagttgagcaccgcaaccaaaaagctacacactcatggcgataaacaggataaggtgaaacaaaaggcgtttgtggagccctatttcaagggcgatgaacgcgaaacgtccctgcaaaactttcctcacatagaagtggttagaaagaaagaggagagacggaaattgctcggccatacgtgcaaggaatgcgagatctattatgccgacatgccagccgaagagagagagaagaagctggcatcttgttctcgacacaggtttcgttatattccgccaaatacacctgagaatttctgggaggtgggcttcccctcaacacagacatgtatggagaggggctacattaaagaagatctggacccctgtcctcggccaaagcggcgtcagccctataacgctatctttagcccaaagggaaaggaacagaagacctag

SEQ ID NO: 30617 - DNA, 2604 bp, Artificial Sequence
  Description of Artificial Sequence: Synthetic coding sequence
atgaacatctccggctctagctgtggttccccaaactccgccgacacgtcctcagatttcaaagacctgtggactaaactgaaagagtgccacgacagagaagttcaaggcttacaggtgaaagtgaccaagttgaaacaagagcgaatcctggatgctcagcggctcgaggaattttttaccaagaatcaacagctaagggagcaacagaaggtcctgcacgaaacaatcaaggtgctcgaagaccgattgcgggcaggcctgtgcgacaggtgtgccgtaaccgaggaacacatgaggaaaaaacagcaggaattcgaaaacattcgacagcagaatcttaaactgataactgagctaatgaatgagcgaaataccttgcaggaagaaaataaaaaactgagcgagcagcttcagcagaaaattgagaatgatcagcagcatcaggctgctgagctggaatgtgaggaggacgtaatcccggattcgcctattaccgcattctcttttagcggcgttaatcgcctacgccgaaaagagaatcctcacgtgaggtatattgagcaaacacacactaaactggaacacagcgtgtgcgccaacgagatgcgcaaagtgtccaagagtagcacccacccccaacataatcccaacgagaacgagatcttggtagcagacacctatgatcagtcccagtctcctatggccaaagcacatggtacctctagctatacccccgataagagctccttcaacctcgcaacagtagtagctgaaaccctgggtcttggagtgcaagaggagtccgagacgcaggggcctatgagcccactgggtgacgaactgtaccactgtttggagggcaatcataagaaacagccttttgaggagtccacccgtaatacggaggattccctcaggttttccgactcaacttcgaaaacaccgcctcaggaggaattgccaactcgtgtgagctccccggttttcggagccaccagctccatcaaatctggacttgacctgaatacctctctgtccccctctctgctgcagccagggaagaaaaagcacctcaaaaccctccccttttctaacacttgcatctccagattagaaaaaactagatctaagagtgaggactccgcattgttcacacaccactcacttggtagtgaagtgaacaagattattatacagtcgtctaacaagcaaatccttataaacaaaaatatcagcgagtcactaggggaacaaaaccggacagaatatggtaaagattccaataccgacaaacaccttgaaccattaaagtccttggggggacgcacctccaagcgcaagaagacagaagaggaaagcgaacacgaggtgagctgcccacaggccagcttcgataaagaaaatgcattcccattcccaatggataatcagttttctatgaacggggattgcgtgatggataagccgctcgacctatctgatagattttccgcaatccagcgccaggagaagtctcaaggtagtgagacatcgaagaataaattccgacaggtgacactttacgaggctctcaagacaattccaaaagggttctccagcagtcgtaaggcaagcgatggtaactgtaccctgcccaaggatagccctggagagccatgttcccaggagtgcatcatattacagccccttaacaagtgctctcccgataacaaaccctcactccagattaaggaggaaaacgctgtttttaaaattcctttaagaccacgagagtctctcgagacagagaacgtcctagatgacataaagtccgctggatcacacgaaccaattaaaattcagacacgcagcgaccatgggggatgcgaacttgccagtgtcctgcaattgaacccctgtaggactgggaagatcaagtcgctgcaaaataaccaggatgtgagtttcgaaaacatccagtggtcgatcgatccaggagctgatctttcccaatacaagatggacgttaccgtaatcgatactaaagacggtagccagagcaagctgggcggtgagaccgtcgatatggactgcacactagtttctgagaccgtgctgttaaaaatgaagaaacaggagcagaaaggcgaaaaatcctctaacgaggagaggaaaatgaatgattcactggaggatatgtttgataggaccacacacgaagaatatgaatcatgtctggctgactccttttctcaagccgcagatgaagaggaggaattgtccacagccacaaaaaagctgcacacgcacggggataaacaggataaagtgaaacagaaagcatttgtcgagccctactttaaaggtgacgagtcaatcatgcagatctgccaacagaaaaaagagaaaaggaattggctgcccgctcaggatacagatagcgcaacatttcaccccacgcatcagaggatatttggaaagctggtgttcctgcccctgaggctagtctggaaggaggtgattcttcgtaaaatcttgatcttagtgctagtgcagaaggatgtctccctgacaactcagtactttcttcagaaagccagaagcaggaggcaccggcgatag

SEQ ID NO: 30618 - DNA, 3045 bp, Artificial Sequence
  Description of Artificial Sequence: Synthetic coding sequence
atgtttgaagataaaccccacgccgagggggcagctgtagtggcggctgctggcgaggccctccaggctttatgccaagaacttaatctagacgagggatcagcagcagaagctctggatgactttacagccattcggggaaattatagcctggaaggcgaagtgactcactggctggcttgttccctgtatgtagcctgccgtaaatccatcataccaaccgtcggtaaaggaattatggaggggaactgcgtatctctgacccgcattctgagatcagcgaaactgtctctcatccagttcttctctaagatgaagaagtggatggatatgagcaatttgccccaggaatttagggaaagaatcgaaagactcgaaaggaacttcgaggtgtcaactgtgatattcaagaagtatgaaccaatctttttggatatcttccagaatccctatgaggaacccccaaaattgccaagatctcgcaagcagcgcaggatcccttgcagcgtgaaagacctttttaacttttgttggacactgttcgtgtataccaagggaaattttagaatgattggggacgacctggtgaacagctaccacctcctcctctgctgtttggacctaatattcgccaacgctattatgtgccccaaccgccaggacctgctgaatccctcgttcaagggacttccgagcgatttccacacagcagactttaccgctagtgaagagcctccgtgtatcattgctgtgctatgcgaactgcatgatggtctgttagtggaggctaagggtattaaggaacattatttcaagccatatatcagcaagctatttgaccgcaaaatcctaaaaggggagtgccttctagacctatctagctttaccgacaactctaaggcggtcaataaagagtacgaagaatatgtgctgacggtgggagacttcgatgagaggatcttcctcggcgctgacgccgaggaagaaatcggcacccccagaaagttcacccgagataccccgctcgggaagctaactgcccaggcaaacgtcgaatacaatctccagcagcactttgaaaaaaaacggagtttcgcaccctctacccctttgactggacggcgatacttgcgagaaaaggaagctgtcattacgccagttgcgtccgcaacacagagcgtctcccgccttcagtccattgtcgcgggattgaagaacgccccatccgaccaactgatcaatatttttgagtcttgtgtgagaaatcccgttgagaacataatgaagatactgaaaggcatcggagagacattctgtcagcactacacacagtctactgatgagcagccgggaagccacattgatttcgctgtcaatcgcctgaagttagctgagatcctgtactacaaaatactcgaaaccgttatggtgcaggaaactagaagattacacggaatggatatgagcgtcctactcgagcaggatattttccacagaagcttaatggcgtgttgtcttgaaatcgtattattcgcctattcctctcctagaacttttccatggatcattgaggtccttaatttgcagcccttttatttctacaaggtgatagaggtggtaattcgcagcgaagaaggcctgtcacgggatatggtgaagcacctaaatagcatcgaggagcagatcctcgaaagccttgcttggtcgcacgatagtgccctatgggaggctctccaagtaagcgcaaacaaggttccaacgtgtgaggaggtcatattccccaacaacttcgaaactggcaacgggggtaacgtgcagggccacctgcctttaatgcccatgtcccctctgatgcacccacgcgtgaaggaggtcaggaccgacagcggttccctgcgccgtgacatgcagcccttgagcccaattagtgtgcacgaacggtattcgtcaccgactgccggaagtgcaaagaggcgactgtttggagaggaccctcccaaggagatgctgatggacaaaataatcactgaagggaccaagctcaaaattgcaccctcaagctccatcactgcggagaatgtgtccattctccctggacagacactgctcactatggccacagccccagttacaggcactaccgggcataaagtgaccatcccactacacggagttgcgaatgacgccggagaaatcacccttatcccgctgagcatgaacactaaccaggaaagtaaggtcaaatctcccgttagcctcactgctcacagcctgataggggcatctccaaagcagaccaatctgactaaagcacaggaagtacactccactgggatcaaccgtccaaagcgtactgggagtcttgccctgttttaccggaaagtttaccatctggcaagcgtgcgtctgcgagacctgtgtctaaaactggacgtcagcaacgagctacggaggaagatctggacctgctttgagtttaccctcgtacactgtcccgatttaatgaaagatcgacacctggaccagctcctgctgtgcgccttctatatcatggccaaagtcactaaggaggagaggacatttcaggagattatgaaaagctatagaaatcagccacaggctaattcccacgtgtaccgatctgtgctgctgaagtcaatccctcgcgaagtggttgcatacaacaaaaatatcaatgacgatttcgagatgatcgattgcgatctagaggatgccaccaaaacccctgactgctcctcagggcctgtaaaagaagagagaggggacttaatcaagttttacaacacaatctatgttggacgcgtgaaatcatttgctttaaagtacgacctggcgaatcaagatcatatgatggacgcacctcctctgtcaccatttccacatataaagcagcagcctggttcccctcgtaggatctcccaacagcattcgatctacatcagtcctcataaaaatggcagtggcctcacaccccgttctgccctcctatacaagttcaatggatctccttcaaaagttcgctag

SEQ ID NO: 30619 - DNA, 3207 bp, Artificial Sequence
  Description of Artificial Sequence: Synthetic coding sequence
atgttcgaagacaagccacacgcagagggggcagccgtcgttgcggcagctggggaagctctgcaggctctgtgtcaggagctgaatctagacgagggatctgcagccgaggcactggacgattttactgcaatcaggggaaactattctctcgagggtgaagtcactcattggctcgcttgctcactgtatgtagcatgcagaaagtcgattattcctactgttggaaagggaatcatggaaggaaattgcgtgagtttgactcgaatcttaagaagcgccaaattatctctaatccagtttttcagcaagatgaagaaatggatggatatgtcgaatttgcctcaggaattccgggaacgaattgagcggctggagcggaacttcgaagtgtctaccgtgatctttaagaaatatgaacctattttcctcgacatcttccagaatccctacgaagagccaccaaagctgccgaggtctcggaaacaaagaagaataccttgcagtgtgaaagacctctttaatttctgttggaccctgtttgtctatactaaaggtaactttaggatgatcggcgatgatttagtaaactcatatcatcttttgctgtgctgtctcgatcttatctttgccaacgccataatgtgccctaacaggcaggatttgttaaacccatcctttaaaggactccccagtgacttccacacagccgattttacagctagtgaggaacccccttgtattattgccgtgctatgcgagctccacgatggcctactcgtggaggctaaaggaattaaagagcactactttaagccatatatttccaagcttttcgacagaaagatcctcaagggggagtgcctgctcgacctgtccagtttcaccgataattctaaagcagtgaacaaggagtacgaagaatatgtgctgactgttggagattttgacgaaagaattttcctcggggctgacgccgaggaagaaattggtacacccagaaaattcactagagacaccccactgggtaaactcacggcccaggcaaatgttgaatataatcttcagcagcacttcgaaaaaaagcgcagttttgccccttccaccccattaaccgggcgtcgctatctgagagagaaagaggcggtgattacacctgtcgccagtgccacacagtcagtcagccggttgcagtccattgtggcgggtctgaaaaatgcaccctctgaccagttgattaatatttttgaatcatgcgtaagaaacccagtggagaatatcatgaagatcctcaaggggatcggggagactttctgccagcattatacccagagcacagacgaacagcccggatcccacatcgacttcgcagtgaatcggctgaagctggccgagatattgtactacaaaatcctcgaaaccgtcatggttcaagagaccaggcgactccacggcatggatatgtctgtacttcttgagcaggacattttccaccgaagcctgatggcatgttgccttgaaattgtattattcgcttactcctctccacggactttcccatggatcattgaagtgctgaacttgcagcctttctatttctacaaagtgattgaggtcgtaattcgctctgaggaggggctctcaagggatatggttaagcatctgaactccattgaggagcagatcctcgaatcactggcatggagtcacgactctgccctgtgggaggcccttcaagtcagcgccaacaaggtacctacatgtgaggaagtaatcttccctaataattttgaaactggcaatggcggtaatgtgcaaggccacctaccgctgatgccaatgtctcccttgatgcacccgagagtgaaggaggtccgaactgactcaggttccctgagacgggacatgcaaccactgtctccaatcagcgtgcacgagcggtatagtagccctactgccggaagcgcgaaaaggagactttttggcgaggaccccccaaaggaaatgctcatggacaagatcattactgagggcacaaaactgaaaatagctccctcgtctagtattactgcggaaaatgtgagtattttgccagggcagaccctgctgaccatggccactgcccctgtgactggcactacaggtcacaaggtaacaattccactgcacggcgtggctaatgacgccggtgaaattaccctgatccccttatcgatgaacacaaaccaggagtctaaggtgaaatcccccgtctccctgacagcccattctctcattggcgcaagccccaagcagactaatctgactaaagcccaagaggtgcactccacaggtatcaaccggcctaagagaacgggcagcctcgctctgttctatagaaaagtgtatcatctcgcctctgttcgcctgagggacctgtgtctcaagctcgatgtatctaatgaactacgcagaaaaatctggacctgctttgagttcacgctggtacactgcccggatttgatgaaggacagacatcttgaccagctcctcctgtgcgccttttacatcatggcaaaggttaccaaggaagagcgtacatttcaggaaatcatgaagagctaccgcaaccagccccaggccaatagtcatgtgtacagaagcgtactcctgaaatccatcccaagagaggtggttgcatataacaagaatattaacgacgacttcgaaatgatcgattgtgacctcgaggacgccacgaagactcctgactgcagtagcggcccagtcaaagaggagaggggtgatctgatcaagttttataataccatctacgtcggtagggttaaatccttcgccctgaagtacgacctggctaaccaggaccatatgatggatgctccaccactgtctccgtttccgcacattaagcaacagcctggttccccgagaaggattagtcagcagcacagcatttacatttctccccacaaaaacggcagtgggctcacccctcggagtgcgcttctgtataagtttaacggtagtccgtcgaagtcccttaaggacataaacaatatgatacggcaaggcgagcagcgtaccaagaaaagagttatcgctattgactctgacgctgagtcccccgcaaagcgggtttgtcaggaaaacgacgatgttctgttgaagaggcttcaggatgtggttagcgaacgggctaatcactag

SEQ ID NO: 30620 - DNA, 3420 bp, Artificial Sequence
  Description of Artificial Sequence: Synthetic coding sequence
atgccgtcaggaggtgaccagagcccccctccaccaccccctcctcctgcagcggctgcttcagacgaagaagaagaggacgacggggaagctgaagatgccgctccccctgcagaatctcctactccacagatccagcagcggtttgacgagttgtgtagccgcttgaacatggatgaggcagcacgggctgaggcttgggattcctataggtctatgtctgagagctacacactagagggaaatgaccttcactggctggcgtgtgccctgtatgtggcatgccgcaagtcagtgccgaccgtaagtaagggtaccgtcgaagggaactacgtttccctgactaggattttaaagtgctccgaacagtcgctcatcgagttcttcaacaaaatgaagaagtgggaggacatggccaacttgccccctcacttccgcgaacgcacagagagattagagaggaacttcactgtgagcgccgtgatcttcaagaagtacgagcccatcttccaggacatatttaaatatccacaggaggaacaacctcggcagcagagaggcaggaagcagagaagacaaccatgcacggtgagcgagatttttcacttttgttgggtcctgtttatatacgccaagggcaactttcctatgatctccgatgacctggtaaattcttaccatctgcttctgtgtgctctcgatctggtgtacggtaacgcactccaatgcagcaacaggaaggaactggtaaaccccaattttaagggcttaagtgaggattttcacgcgaaggacagtaaacccagctcagaccctccgtgcatcattgagaaactctgctccctccatgatggactggtgctggaggccaagggcattaaagagcacttttggaaaccctacataagaaagctttacgaaaagaaactgctaaaaggaaaagaagagaatctgaccggcttcctggagcctgggaattttggagaatccttcaaagctatcaataaagcttatgaggaatatgtgctttctgtgggaaacttagatgagcgtatcttcctgggagaggatgcagaggaggaaatcggtacgctatctcgttgcctgaacgcaggtagtggcactgagacagcggagcgggttcagatgaagaatatcctgcagcagcacttcgataagagcaaggctcttaggatctccacccccctgacaggggtgcggtacatcaaggaaaacagcccatgtgtgacgcctgtgtccaccgccactcattccttatcccggctacacacaatgctgaccgggctcaggaatgccccaagtgagaagctcgagcagatcctaagaacttgcagccgggaccctactcaggccatcgcaaaccggctcaaggagatgttcgaaatttacagtcagcattttcaacccgacgaagacttttcgaactgtgcaaaggagattgcatccaagcactttagatttgcagagatgctctattacaaagtcctcgaaagtgttatcgagcaggaacagaaacggcttggggatatggacttgtccggaattctcgagcaagatgcttttcatcgttccttactagcgtgctgcttggaagtcgtcaccttttcatacaaaccacccggaaacttcccctttataacagaaatctttgacgtacctctttatcacttttataaagtgattgaagtgtttattcgtgctgaagacggcctttgccgtgaagttgtgaagcacctcaaccagatagaggagcagatacttgatcatttggcatggaaacccgaaagccctctgtgggagaagatacgcgacaatgagaacagagtgccaacatgtgaggaggtgatgcccccacaaaatctggagcgagcagacgaaatttgcatagcgggttcccccctgacccctaggcgggtgactgaggttagagccgataccggagggctgggccgaagtattacatcacctactacactgtatgacaggtatagctcaccaccagcatcgactacgcgcaggcggctgttcgtagagaatgacagccccagtgatggaggaacgcctggtcgcatgccaccccaaccattggttaacgccgtcccagtccaaaacgtcagcggagaaaccgtctccgtgaccccagtgccaggacagacattggtgactatggcgactgcgacagttactgccaacaatgggcagactgttacaatcccggtccagggcatagccaacgagaatgggggaatcacattttttcccgtccaggtgaacgtggggggacaggctcaggccgtgaccggatcgatccaaccactgtcagctcaggcgctggctggctctctgtcctcccagcaggtgacaggaactacactgcaggtccccggacaggttgccatccagcaaatcagccccggaggccagcagcagaagcagggccagagcgttacctccagcagcaaccggccacggaaaacaagcagcctgagtctgttcttccgcaaggtgtatcacctagcagcagtgcggttaagggacctgtgcgccaagctggatattagcgatgagctgaggaaaaaaatctggacgtgctttgaattttctattattcagtgtcccgaactaatgatggacagacatctggaccagctcctgatgtgtgcaatttacgtgatggcaaaggttaccaaagaagacaagtcatttcagaatataatgagatgttataggacgcagccccaggctaggtcccaggtctatcggtcagtcttgattaagggaaagcgtaaaaggcggaacagtggaagtagcgactcaaggagtcatcaaaactcccccacagagctgaacaaggataggacctcccgtgactcttcgccagtgatgaggtccagttccacactccccgtgccacagcctagctccgcccctccaactcccacccgcctgacaggggcaaattccgatatggaagaggaggagcggggtgaccttatccaattttacaataacatatacatcaagcaaatcaaaacctttgcaatgaagtattcgcaagcaaacatggacgcacctcccctttccccatacccctttgtccggactggctctcctcgtagaatccagcttagccagaaccatccagtgtatatttccccccataaaaatgaaacgatgcttagcccacgagagaagattttctactatttcagcaatagcccaagcaaacggctcagagagataaacagcatgataagaacaggggagacacccacaaagaagcgagggatactgttggaggatggcagcgaatcacccgctaagagaatttgtcctgagaatcactcagctcttctgagacggctccaggacgtcgccaatgacagaggttcccactag

SEQ ID NO: 30621 - DNA, 2550 bp, Artificial Sequence
  Description of Artificial Sequence: Synthetic coding sequence
atggaatccagatgtgttgcccaggccggtatgcagtggcatgacctcggaagcttgcagcctctgcctccccgttttaagcgctttttctgcctctccctcctctcgtcatgtgagtacagcaaggcaatcaacaaagcatatgaagagtacgtcctgagcgtgggtaacttggacgagcggattttcctgggggaggacgctgaagaagagattggcacgttgtcaaggtgcctgaatgccggatcaggcacagagacagctgaaagggttcaaatgaagaacatcctgcagcagcattttgacaagtctaaggcgctccggatctctacaccgctgacaggagtcagatacattaaggagaactctccgtgtgtaactccagtgagcaccgctactcacagcctgtcacgtctgcatactatgctgacaggactcagaaacgcaccctcagagaaactcgaacaaatccttagaacatgtagcagggaccccactcaggccatcgcaaacaggctgaaggagatgttcgaaatctactctcagcactttcagcccgacgaagatttctccaattgtgccaaggagatcgcttccaaacacttccggtttgcggaaatgctgtactacaaggtgctggagagcgtgatcgaacaggagcaaaaaagactcggggacatggatttgtctgggatacttgagcaggatgctttccaccgcagcctcctagcttgttgtctggaggtggtgacctttagctataaaccccctggcaacttcccgtttattaccgagattttcgatgtgccactctatcacttttataaagttatcgaggtgttcatacgagcagaggacggcctctgcagagaagtggtcaaacacttgaatcagattgaggagcagatcctagaccaccttgcatggaagcctgagtctcccctctgggaaaaaatcagggataacgaaaatcgggttcccacgtgtgaagaggtcatgccccctcagaaccttgaacgagctgacgagatctgcatagccggatcccctcttaccccacggagggttaccgaagtacgggctgatacagggggactcggcaggtctataacttctcccaccaccctgtatgaccggtactcaagcccacctgcctccactactcggagaaggcttttcgttgaaaacgacagcccatccgatgggggaactcccggtcggatgcccccacagccgctcgtcaatgcagtacccgtccagaatgtatccggggaaacggtctctgtgactccagtaccaggccagaccctggttactatggcgacggcaacagtgacggcgaacaatgggcagaccgtgacgataccagtccaggggattgctaatgagaatggaggcatcactttcttccctgtgcaagttaacgtgggaggccaggcacaggcggtcaccggtagcatccaacctctgtccgcacaggccttagccggatctctcagttcccaacaagtgactggaaccacactccaggtacctggtcaagtagctatccaacagataagccccggaggccagcagcagaaacagggccaaagcgtcacgagtagcagcaatagacccaggaaaaccagttccctgtccctttttttccgtaaagtgtaccacctggccgcagtgcgccttagagacctgtgcgccaagttggacatctctgatgagcttaggaagaagatctggacttgtttcgagttctccatcattcaatgcccggagctgatgatggacaggcatctggatcagttgctcatgtgcgcaatatatgtgatggccaaggtcaccaaggaggataagtctttccagaatataatgcgctgctaccggacacagccccaggcccgatcccaagtatacagatccgttctgattaaaggcaaaaggaagagacgcaattccggcagctctgattcgagatctcatcagaatagtcccaccgaactgaacaaagaccgcacaagtcgggacagttctcccgtgatgcggagcagttccacactacccgtcccccaaccctcatccgcaccgccaacccctacccggttaacaggcgcaaactcagatatggaggaagaggagcgcggagacctcatacagttttacaataatatttacatcaagcagattaaaacatttgctatgaagtactcccaggctaatatggacgcccctccgctgagtccgtaccccttcgtgcgtaccgggtcacctcgaaggattcagctatcacagaaccatcccgtgtacatcagtcctcacaaaaacgaaacaatgctgtccccccgtgagaaaatattctactatttctccaatagcccttccaaacgcttgagggagatcaacagcatgatccggaccggagagacacccacaaagaagcggggaattctgctggaggatgggtccgagagcccagctaaacggatatgccccgagaaccacagcgctctgctccgtaggctccaggatgtggctaatgatagaggctcacactag

SEQ ID NO: 30622 - DNA, 1668 bp, Artificial Sequence
  Description of Artificial Sequence: Synthetic coding sequence
atgcaatcactgaccaaaggcaatgacctgcactggctggcgtgtgccctttatgtggcctgtcgcaagtctgtacccaccgtgtcaaaaggtaccgtggagggaaactacgtaagcctaacgagaattctgaagtgttccgagcaatcactcattgagttttttaataagatgaagaagtgggaagatatggcgaatttacctcctcactttcgggaacgaacggagagactggaaagaaactttactgtcagtgccgttattttcaagaaatacgaacccatctttcaggatatattcaaataccctcaggaggaacaaccccgtcagcaacggggaaggaagcagagacgacagccatgtacagtgtctgagatttttcacttttgctgggtgctgtttatttatgccaaggggaatttcccaatgatctccgacgatctcgtgaacagctaccacctgctattgtgtgcgttagatttggtctatggaaatgcactgcagtgctccaatcgaaaggaacttgtcaacccaaatttcaagggtctgtctgaggacttccacgctaaggattccaagccatcatctgatccgccttgcataattgaaaagttatgctctctacatgatgggctagttctggaggccaaggggattaaagaacacttctggaagccttacatccggaaactgtatgaaaaaaagttgctcaagggtaaggaggagaatctgaccgggttcttggagcctgggaactttggtgaatcctttaaggccatcaataaggcctacgaggaatatgtattgagcgtgggcaatctcgatgagagaatcttcctgggggaagatgccgaggaggagataggaactctctccagatgcctcaacgcaggaagtggaacggagacagccgaaagggtgcaaatgaagaatattcttcagcagcatttcgacaagtcgaaggctctgagaatctccactcccctgacgggcgttagatacataaaggaaaatagtccctgtgtcactccggtttcgacagctactcatagtctgtcaaggctgcacaccatgcttactggactgaggaatgcacccagcgagaagcttgagcagattctgcggacctgttcgagggaccccacgcaggccatcgccaacaggctcaaggagatgttcgaaatctattctcagcacttccaaccagacgaagatttttctaattgcgccaaggagatcgcctcaaagcacttccggtttgctgagatgttatactataaagtactggagtccgtgatcgagcaggagcaaaaaaggctgggggacatggatctatctggaattttggaacaggacgcctttcatagatctctactggcatgttgcctagaggtggtgaccttctcgtacaagccgccaggaaacttcccatttattacagaaatattcgatgtaccgctctatcacttttataaagtgatcgaagtctttattcgcgctgaagacggactctgtcgagaagtcgtgaagcatctgaaccagattgaggaacagattctcgatcacttggcatggaaacccgaaagcccgctgtgggagaaaattcgcgacaacgaaaacagagttccaacctgcgaggaagtcatgccgccacagaacctggaatag

SEQ ID NO: 30623 - DNA, 1557 bp, Artificial Sequence
  Description of Artificial Sequence: Synthetic coding sequence
atgatttctgacgacctggtcaactcataccacctcctgctgtgtgccctggacctagtttatggcaacgccttgcagtgctctaaccgcaaggagctggtgaatcctaattttaaagggctgtccgaggattttcatgccaaagatagtaaaccaagctcagaccccccttgcataatcgagaaactgtgtagtcttcatgatgggctggtcctagaggctaagggcataaaggagcatttttggaagccctacattaggaagctatacgagaagaagctcctcaaaggaaaggaggaaaacttgactggatttctggagcccggaaattttggggagagtttcaaagctattaataaagcttacgaggagtatgtcctttccgtaggcaatctcgacgaaagaatatttctgggcgaggatgccgaagaggaaatcggcactctgtccagatgcctgaacgcaggctccgggactgagactgcggagcgcgttcaaatgaagaacatcctgcagcagcatttcgataaatcaaaggcacttcgcatctccaccccgctgaccggtgtgcggtatataaaagaaaattccccctgcgtcaccccagttagtacggccactcattctctctctcgcctccataccatgctcaccgggctccggaacgctccatccgagaaactcgagcagatactcaggacttgcagccgcgatcctacccaggcgattgcgaaccgactgaaggaaatgtttgaaatctactcgcagcattttcagcctgacgaggacttctctaattgtgcaaaagagattgcaagcaaacacttcagatttgctgaaatgctgtactacaaagtgctggagtctgtgatcgaacaagagcaaaagcgcttaggcgacatggatctttcaggtatcctagaacaagatgcatttcaccgcagcctcttagcatgttgcctggaggtggtcactttctcctacaagcctcccggaaattttccattcatcacagagatttttgacgttccactctaccacttctacaaggtcattgaagtgttcatacgcgcagaggatggcctgtgcagagaagtggttaagcacttgaatcaaatcgaagaacagattcttgatcacttggcgtggaaacccgaatcaccgctgtgggaaaaaatccgggataacgagaacagggtgccgacatgcgaggaagtgatgccgccacagaacctcgaacgcgctgacgagatctgcatcgcaggcagccccaggcggatccagctgagccagaatcaccccgtgtatatcagtccccacaaaaacgaaaccatgctttcaccaagagagaagatattctattacttttcgaacagcccctctaagcgactccgggagatcaatagtatgatccgaaccggcgagaccccaaccaagaagcggggaattttgctggaggatggaagtgaaagcccagcaaaaagaatttgtcccgaaaatcattctgctctcctcagaaggcttcaggacgtggccaatgataggggtagccactag

SEQ ID NO: 30624 - DNA, 1347 bp, Artificial Sequence
  Description of Artificial Sequence: Synthetic coding sequence
atgttcgactgtatggacgtgctgtcagtgtctccaggccagattttggatttctacaccgcatctccttcatcttgtatgctccaagagaaggctctgaaggcatgctttagtggcctgacccagactgagtggcagcatagacacaccgctcaatcaatagagacgcaatctacttcatcggaagagctggtgccgagtcctccatcacccctcccacccccacgggtctataaaccctgtttcgtgtgtcaggataaatcctcaggataccattatggagtatccgcttgtgagggatgcaagggattttttcgtagaagcattcaaaaaaatatgatttatacttgtcatagggacaagaactgtgtcattaacaaggtgaccagaaaccgctgccagtattgtcgtctgcagaaatgtttcgaggtcgggatgtccaaagagagcgtgcggaatgaccgaaacaagaaaaaaaaggagactagtaagcaagagtgtaccgaatcttacgagatgacagccgaactagacgatcttacggaaaaaattaggaaggcccaccaagaaacctttcccagcctgtgtcaacttggtaaatacaccaccaactcaagtgctgaccatagagtgagactggacctgggactctgggacaaattcagcgaactcgccactaaatgtatcattaaaatcgttgagttcgccaagcggctgccaggcttcacaggcctgaccatcgccgatcaaataaccctgctcaaggcggcatgcctcgacatacttatcctccgtatctgcacgcgctacacacctgagcaggacaccatgaccttcagcgatggcttaaccctcaaccgaacacagatgcacaatgcaggcttcgggcctcttaccgatcttgttttcacattcgccaaccaacttcttccccttgaaatggacgatactgagactggtcttttgtctgcaatctgcttgatctgtggagatagacaagaccttgaagaacctaccaaggtggacaaacttcaggagccactactggaagcattgaagatatacatccgaaagcggagacccagtaagccacatatgttccccaagatcttgatgaaaatcacagacctgcgctccatctcagctaaaggcgctgagagagtcataaccctaaaaatggagatccctggttccatgcctcctctgatccaggagatgctggagaattcggagggccatgagcctctaactccttcgagcagtggaaataccgctgaacattcaccttcaatcagtccttcgtccgttgaaaacagcggagtgtctcagagcccacttgtacaatag

SEQ ID NO: 30625 - DNA, 1368 bp, Artificial Sequence
  Description of Artificial Sequence: Synthetic coding sequence
atgacgaccagcggacacgcctgtcctgtccccgcagttaacggacacatgacacactaccctgccacaccataccctctcttgtttccccctgtcattggcggactgtctctccctccgttgcatggcctgcatgggcacccacctcccagcgggtgcagcactcccagcccagctacgatcgaaactcagagcacaagtagtgaagaactggttccctcccccccttcccccttgccaccacccagggtatacaagccatgcttcgtgtgccaagataagagtagtgggtatcactacggtgtgagtgcgtgtgaaggctgtaagggctttttcagacgttccatccagaaaaacatgatttacacttgtcaccgggacaagaactgcgttatcaacaaggtgactagaaaccggtgtcagtattgccggctccagaaatgcttcgaagtcgggatgtctaaggagtccgtccgcaatgaccgcaataagaagaagaaagaaacttcgaagcaggagtgcaccgagagctacgagatgacggccgaactggatgatcttactgagaaaattcgaaaggctcaccaggagacatttccctctctctgtcaattaggaaaatacaccacaaacagtagcgcagatcacagagtgagactcgatttaggactgtgggataaattttctgagctggcaacaaagtgtattatcaaaattgtggagtttgcgaaaaggctgcccggattcaccgggttgactatcgccgatcagattaccctactgaaagctgcctgtctggacattttgatcctcaggatctgcacacgttacacaccagagcaggataccatgacatttagtgacgggttaacactcaatagaacacagatgcataacgctgggttcgggcctttgacagatctggtttttacatttgccaaccagctccttcctcttgaaatggacgacactgaaaccggcttgttgagcgcaatttgccttatttgtggcgatcggcaggacctggaagagcctaccaaggtggacaagctgcaggaaccccttctggaggctctgaagatttacatacgtaagagacgcccttccaagccgcatatgttccccaagatacttatgaaaataacagacctcaggtccatcagtgctaagggtgctgagagagtgatcaccctgaagatggaaatccctggtagcatgcctccactgatacaggagatgctggagaattcggaaggccatgaacctctcactccctcttcgagtggcaatactgcagagcacagtcccagtatcagcccatcttcggtcgagaattcaggggtaagccagagtcctctggtgcagtag

SEQ ID NO: 30626 - DNA, 1011 bp, Artificial Sequence
  Description of Artificial Sequence: Synthetic coding sequence
atgatctatacttgccatagagataagaattgtgtgattaataaggttacacgcaatcggtgccaatattgcagactgcaaaagtgcttcgaagtgggaatgtcaaaggagagtgtccggaacgaccggaacaagaagaagaaggaaactagcaagcaggagtgtactgagtcatacgagatgaccgcggagctggatgacttgaccgagaagatccggaaggcccaccaggaaacattcccaagcctgtgtcagctcggtaaatatactaccaactcctccgctgatcaccgggtgcgcctggatctaggtctgtgggataaattctccgagctagctactaaatgtattattaaaattgtggagttcgccaaacgccttccaggctttacagggttaaccatcgccgatcaaatcacgctgctgaaagctgcttgcttggacatcctaatcctgaggatttgtactaggtacacccccgaacaggatactatgacctttagcgacggcctcaccctgaaccgtacccagatgcataatgccggattcggtcccctcacggatctagtttttacgtttgcaaaccaactgctgccactcgagatggatgacacagagactggcctcctgtcggcgatctgcctgatctgtggcgacagacaggatctggaagaaccgaccaaagtcgacaaactccaggagcctctgctcgaagctctcaagatctacatcagaaagagacgcccttcaaagccacacatgtttccaaagatcttaatgaaaattaccgacttgcggagcatcagtgctaaaggtgctgaacgtgttatcactctgaaaatggagataccaggctcgatgcccccactaattcaggaaatgcttgaaaacagcgaaggtcacgaacctttgactcctagctcttcagggaacacagccgagcacagcccgtccatatccccaagctctgtcgaaaactctggtgtgtcccagtccccgctggtgcaatag

SEQ ID NO: 30627 - DNA, 1011 bp, Artificial Sequence
  Description of Artificial Sequence: Synthetic coding sequence
atgatctatacttgtcatagagataagaactgtgttatcaacaaggtgacccggaatcgatgccagtactgcaggttgcagaaatgtttcgaagtaggaatgagcaaagagtcagtaaggaacgacagaaacaaaaaaaagaaggagacgtcgaagcaggaatgcacagagagttacgagatgacagcagagcttgacgatctcactgagaagatcagaaaggctcatcaggagaccttcccatccctttgccagctggggaagtacaccactaactccagcgctgatcaccgggtacggctggaccttggcctgtgggataaatttagcgagctggctactaagtgcattatcaagattgtcgagttcgccaaacgtctgcctgggttcactgggctcaccatcgccgaccagataacactgttaaaggccgcttgtctcgacatactgattttaagaatctgtacccgctacacgcccgagcaggacacaatgacttttagtgacggattgacactcaacagaactcagatgcataatgccggatttggacctttaactgatcttgtctttacgtttgcgaaccagctgcttccgctggagatggacgataccgaaactggcctactcagcgccatatgcctgatatgcggagatcgtcaggacctggaggaaccgacaaaggtagacaagctgcaggagccattacttgaggccctgaagatctacatcaggaagcggaggccgagtaaacctcatatgttccccaagattctcatgaagatcacagatttgcgctccatctctgcaaagggagcagagcgggtaattacactgaaaatggagattccagggagcatgccaccactaatccaggaaatgctcgaaaattctgaagggcacgaaccactcacccctagttctagcggcaacacagctgaacactcccctagcattagccccagcagtgtcgagaactcaggagtgtcccagtctcccctggtccagtag

SEQ ID NO: 30628 - DNA, 1326 bp, Artificial Sequence
  Description of Artificial Sequence: Synthetic coding sequence
atgacaaccagtggccatgcatgtcccgtgccggctgtgaatggacatatgacacattaccccgcaacgccttaccccctgcttttcccacccgtcatcgggggtctgtctctcccacctttacatggtcttcatggacaccctcccccatccggatgtagtacacctagcccagccaccattgagacacaatccactagttcagaagaactggtcccaagccctccatcaccactgccccctcctagagtgtataagccgtgctttgtgtgtcaggacaagtccagtgggtaccactatggagtgtcagcgtgcgagggatgtaaagggtttttcaggagatctatccagaagaacatgatctacacttgccaccgggataagaactgcgttattaataaggtgacacggaatagatgccaatattgccgcttacagaaatgcttcgaagttggtatgtccaaggaaagcgtccgaaacgacagaaacaagaagaaaaaggagaccagtaagcaggaatgtaccgaaagttacgaaatgacagcagaactcgacgacttaactgaaaaaatcagaaaagcacatcaggagaccttcccatcactctgccagctcggtaaatacacaaccaactctagtgccgaccatagagtgagactcgatctcgggctctgggataaattttccgaacttgcaaccaagtgcatcatcaagattgtagagtttgcaaaacgcctgcccggtttcaccggtcttaccattgcagaccaaatcacactgctcaaagccgcatgccttgatatccttatcctcagaatctgcacgaggtatacccccgagcaggacaccatgacattctcagatgggctgaccctgaatcgaacgcagatgcacaacgccggtttcggaccactgaccgatttagtgtttactttcgccaaccagttgctgccactggagatggatgacacagaaaccggtctgctgtccgctatctgtttgatctgtggcgatcgacaggacctggaggagcctactaaagttgacaagcttcaagagccactactggaagctctgaagatctatatcaggaagagaagaccttcaaaaccccacatgttcccaaagattctaatgaaaatcaccgacctgagatcaattagcgctaagggagctgagcgtgtgatcactctcaagatggagattcctgaaggccacgaacccctgacccccagctcttccggaaataccgcagagcatagcccttcaatctcaccatctagcgttgaaaattccggggtttctcagagccccttagtccagtag

SEQ ID NO: 30629 - DNA, 462 bp, Artificial Sequence
  Description of Artificial Sequence: Synthetic coding sequence
atggatccccctgccggtttcgttcgtgcaggaaacccggctgtggctgcaccgcagagccccctctcccccgagggcgctcatttccgggcagcccaccatccaagatctaccgggagtcggtgcccagggtcactacaaccgtccaggcctctggtggctaactggctccaatcgctcccagagatgcccgttgacttcactggatactggaaaatgctggtcaacgaaaacttcgaagagtacttgagggctctggatgtcaacgtggcattacgcaagattgcaaacctactgaagccagataaagagatcgtgcaggacggcgaccatatgataatccggaccctttccacattccggaattacattatggacttccaagtgggcaaagagtttgaggaggacttgacagggatagacgaccggaagtgcatgtccgagaccggtttcagctcatag

SEQ ID NO: 30630 - DNA, 405 bp, Artificial Sequence
  Description of Artificial Sequence: Synthetic coding sequence
atgacacgcgaccaaaacggcacctgggaaatggaatcaaacgagaacttcgagggctacatgaaggcccttgacatagattttgctactcgtaaaatagccgtgcgattgacccagaccaaagtgatcgatcaggacggtgataatttcaagactaagaccacctccaccttccgaaactacgatgtggattttacagtgggcgtggagtttgacgagtacacaaaaagccttgataatcgccatgtaaaggccctcgtgacttgggagggtgacgtcttggtgtgtgtccagaaaggcgaaaaggagaacagaggttggaaacagtggatcgagggtgacaaattatatctggagctgacatgtggtgatcaagtctgcagacaggtttttaaaaaaaagtag

SEQ ID NO: 30631 - DNA, 474 bp, Artificial Sequence
  Description of Artificial Sequence: Synthetic coding sequence
atggaccctcctgctggcttcgttagggcaggcaaccctgcagttgctgctccccaatccccattgagcccagaaggtgctcacttccgggcagcccaccacccccgttccaccggctcccggtgtccagggtcgcttcagccctctagaccactcgttgccaactggctccagagcttacccgagatgccagtggatttcactggatattggaagatgctggtgaacgagaattttgaggaatatcttcgagctctggatgtaaatgttgctctgcggaaaatagcaaacctgctaaagcccgacaaagagattgtgcaggacggagatcatatgattattcgaacactgagtacattcaggaactacatcatggacttccaggtggggaaggaattcgaggaggatcttacaggcatagacgacaggaagtgtatggcaggggtgcagagccgggatctcagttcgttgtag

SEQ ID NO: 30632 - DNA, 3756 bp, Artificial Sequence
  Description of Artificial Sequence: Synthetic coding sequence
atgagacggggtggatggcgcaaacgcgcagagaacgatggctgggagacatggggaggatatatggccgctaaggtgcagaagcttgaggaacagtttcgttctgacgctgctatgcagaaggacggcactagtagcactatcttttcaggtgttgctatatacgtgaatggatacaccgacccctccgctgaagagctccggaagctcatgatgctgcacggaggtcagtaccatgtatactactcccggtcgaaaaccacccacatcatagcaacaaacttgcctaacgccaagatcaaggaactgaaaggcgagaaggttatccgtcccgaatggattgtggagtccattaaggcaggcaggctcctatcatatatcccctatcaactgtacacaaaacagagtagcgtccagaaggggcttagtttcaatcccgtgtgccgtccagaagacccgctgccagggccttctaatattgctaaacaattgaataaccgggtcaatcatattgttaaaaagatagagaccgaaaacgaggtaaaagtgaacggtatgaattcctggaatgaggaagatgaaaataacgatttctcatttgtggatttagaacagactagtcccggacggaagcagaacggtatcccccaccccagaggcagtacagcgatttttaatggacacaccccatctagcaacggagcactgaaaacgcaggactgcctggtgccgatggtgaactccgtagcatctcgcctgagccccgcatttagccaagaagaagataaggcggagaagtcttccaccgatttccgcgactgtacacttcaacaactccaacaatccacgcgcaataccgacgcgctccgaaatcctcatcgcaccaacagttttagcctgtcccccttgcactcaaatacgaagatcaatggagcccaccacagcaccgtgcaggggccaagtagcaccaagtcgacaagctccgtatctaccttttctaaggctgcaccgagtgtaccaagtaaaccaagcgactgcaactttatctctaacttttacagtcactctcggctgcaccacatctccatgtggaaatgcgagctgaccgaatttgtgaatactcttcagaggcagtcaaacggtatcttcccaggcagggaaaagctgaaaaagatgaagaccggcaggtctgccctggttgtgacggatactggagatatgtccgttctcaattccccccgacaccagagctgcataatgcatgtggatatggattgctttttcgtttctgtgggcatccggaacagacccgatctgaagggtaaacctgttgccgtgacttcaaacagaggcacagggagagctcccctcagaccaggggctaatccccagcttgagtggcagtactatcagaacaaaatactcaaaggaaaagcagctgacatccctgactcgtctctatgggagaatcctgactctgcccaagcaaacggaattgactcagttctgtctagggctgaaatcgcatcctgcagctacgaggccaggcagctggggatcaagaatggaatgttctttggccacgcgaagcagctgtgtccgaatctgcaggcggtgccgtatgatttccatgcctataaagaagtcgcccaaaccctgtacgagaccttagcttcatatacccataacatcgaagccgtgagttgcgatgaagcactggttgacatcaccgaaattctggccgaaacaaaactgacccccgacgaattcgccaatgctgtgaggatggaaattaaagatcaaactaaatgcgccgctagtgtgggtattgggtctaatatactcctcgctaggatggcgactaggaaggccaaaccagacggccagtatcacctaaagccagaagaagtggacgattttatccggggacagcttgtgactaacctcccaggtgtaggacactcaatggagagcaagctggcttcactcggaatcaagacttgtggtgaccttcagtacatgaccatggctaaactgcagaaagaatttggacccaagaccggacagatgctgtacaggttctgccgaggactggacgatagaccagtgcggactgagaaggaaaggaagtcagtgtccgctgagattaactacggtatacggtttacacagccaaaggaggcagaagcctttcttctgagcctctctgaggagattcagcgcaggttagaagctactggcatgaagggaaagagactgacacttaagattatggtgcgtaagcccggagctccagtggaaacagctaagttcggaggtcacggtatatgtgacaacattgccaggactgtgactctggaccaagctacagataatgctaagataatcggcaaagccatgctcaacatgttccatacaatgaagctgaacatctcagacatgcggggagtgggcatccatgtcaatcagctggttccaaccaatttgaacccctcgacatgccctagcaggccttctgttcagtcgtcacacttcccctctgggtcctattccgtgagagacgtgtttcaggtgcagaaggccaaaaaatccactgaggaggagcataaggaagtgttccgggcagctgtggatcttgaaataagctccgcttcaaggacttgcacttttttgccgccttttcccgctcatctgcccacctcgcctgacactaacaaggccgagtcgtcaggcaaatggaatggcctgcacacccccgtttcagttcagtcccggctgaacctgagtattgaggtcccctcgccctcacaactggaccagtccgtgttggaagccctgcctcccgacctgagagagcaggtagaacaggtgtgcgcggtgcaacaggcggaaagtcacggagacaagaaaaaagaaccagtcaacggctgcaacacaggcatcttgcctcaacctgttggcactgtgctactgcaaattcctgagccacaggaatcaaactccgacgccggaatcaacttgattgccctgcccgctttttcccaggtcgacccggaggttttcgcggctctgccggctgaacttcaacgcgaactcaaggcagcttacgaccaacggcagcgtcaaggtgagaattccacccatcagcagagcgcgtccgcatcagtcccaaaaaaccccctgcttcatctgaaagcagccgtgaaggagaagaaacgaaacaaaaaaaagaagacaatagggtcaccgaagaggattcagtctcccctgaataacaagctgcttaattccccggcaaagaccctgccaggggcttgcggcagccctcaaaaattaatcgacggctttctcaagcatgaagggccacctgccgagaaaccccttgaggaactgagcgcgtccacctcgggagtgcctgggctctcctccctacagtccgatccagccggatgcgtaaggcctcctgccccaaacctggccggtgccgtggagtttaatgacgttaaaactttgctacgcgagtggataacaaccatctcagaccccatggaagaggacatcctgcaggtagtaaagtattgtaccgatttgatagaggaaaaagatttagagaagctggatctggtgatcaaatatatgaaaagattgatgcagcaaagcgttgagagtgtttggaatatggcattcgattttattcttgacaatgtgcaggttgtactacaacagacatacggttctacgttgaaggtcacttag

SEQ ID NO: 30633 - DNA, 3753 bp, Artificial Sequence
  Description of Artificial Sequence: Synthetic coding sequence
atgagaagggggggttggcggaagcgggcagagaatgatgggtgggagacctggggcggatacatggccgctaaagtgcagaagctcgaagagcaattccggtccgatgctgccatgcagaaagacggcacctcctcaactattttttctggggtggcaatttacgtgaacggctacaccgacccgagcgctgaggaactgcgaaagctgatgatgcttcatggtggccagtatcatgtctattacagtaggagcaaaacaacccacatcatagccactaatttgcccaatgctaagatcaaagaactcaagggcgagaaggtgatacggccagaatggatagtggaatcgattaaggccggtcgacttctctcttatatcccataccagttgtacacaaagcagagtagcgttcagaagggactgtcatttaatccagtctgccggcctgaagatcccttgccgggaccctccaacatagctaagcagctcaataaccgggtcaatcatatcgtcaaaaagatcgagacagagaatgaggtcaaggtgaatgggatgaacagctggaacgaagaggacgagaataacgatttctcatttgtcgacttggaacagacaagtcccggacggaagcaaaacggtataccccacccgaggggcagtaccgccatctttaacggccacactcctagttctaatggcgctctgaagacgcaggattgtcttgtcccgatggtgaactctgtagccagtcgcctgagccctgcattttctcaagaggaagacaaggcagagaagagcagcactgacttccgtgactgtacactgcagcaactacagcagtctacacgtaacactgacgcccttaggaatccccatcggaccaatagtttttctctttctccccttcacagcaatacaaaaataaatggtgcccaccacagcacagtacagggaccatcttctactaagagtacctcttctgtttcaaccttcagcaaggcagcaccatcagtgccaagtaagccatccgactgcaatttcatatccaatttttattcacattcccgactccatcacatctcaatgtggaagtgcgagcttaccgagttcgttaacaccctgcagaggcaaagtaacggaatttttcctggcagggaaaagctcaagaaaatgaagactggccgtagtgcgctggtggtgacggatactggagacatgagcgtcttgaattcccccagacaccaaagctgcatcatgcacgtagatatggactgcttttttgtatccgttgggatcaggaaccgccctgacctcaagggaaagcctgttgctgttaccagtaatcgtggcaccgggagggcccctctgaggcctggggctaatccccagctcgagtggcaatactaccaaaacaagatactgaaggggaaggcggatatacccgactctagtttgtgggaaaacccagatagcgcccaggccaacggcatcgattccgtgttgtcaagagccgaaattgcttcatgttcttacgaagccagacagctgggtattaagaatggcatgttcttcgggcacgccaaacagctgtgcccaaacctgcaggctgtcccatatgatttccacgcctacaaagaagtcgcccagaccctttatgaaaccttggcctcgtacacccacaacatcgaggccgtgagttgcgatgaggccctggtcgatattaccgagattctggcggaaacgaaacttactcccgacgagtttgctaacgccgtgcgcatggaaatcaaagaccagaccaagtgtgcagctagtgtggggataggctccaacattctgctggcaagaatggcaactcgtaaagccaagcccgacggacaataccacctgaagccagaggaggtagacgattttatccgagggcagcttgtaaccaatctccccggagtcggacacagcatggaatccaagctggcatcgctcggtatcaaaacatgtggtgatttgcaatatatgactatggcgaagctgcagaaggagttcgggcctaagacaggccagatgctgtatcggttctgccgtggcctggacgatcgacctgtgaggactgaaaaggagcggaagagcgtctcggccgaaattaactacggaatccggttcacccaacccaaagaggctgaggcgtttctgttatctctgagcgaggagattcagcgacgcctcgaggcaaccggtatgaagggcaaaagactgaccctgaaaattatggtgcgcaaaccaggtgctccagtcgagactgctaagttcggcggacacggcatttgcgacaatatcgctcgcacggtgactctcgaccaggccactgacaacgccaaaatcattggcaaagccatgctgaacatgtttcataccatgaagctaaacataagcgatatgaggggagtgggaatccatgttaatcagctggtacctacaaatttgaatcctagcacatgcccttctcgtccatctgttcaatctagccattttccatccggatcctattccgtgcgcgacgtcttccaggtgcaaaaggccaaaaagtcaactgaggaggagcacaaggaggtgttccgcgcagcggtcgatctggagatctccagtgctagcaggacctgtaccttcctccctccattcccagcccacctcccgacatcaccagacacaaataaggcagaatcgagcggaaagtggaatggtcttcacacccccgtctctgtgcaatccaggctgaatctttcgatcgaggttccgagccctagccagctcgatcagtctgtgctggaagctctaccacctgacctccgcgaacaggtcgagcaggtttgcgctgttcagcaggccgagtcacatggcgacaagaagaaagaacctgtgaacggctgtaatactggaatcctcccccagccagtcgggaccgtcctgctccagataccggagcctcaggagtccaactccgacgcgggaattaacctcattgccctgccagctttctctcaagtagaccctgaagtttttgctgccctgcctgcagagctgcagagggaattgaaagccgcatacgatcagaggcagcgccagggggagaactctacccaccagcagtcagcatccgcatcagttcccaagaatccacttctgcatctgaaggctgctgttaaagaaaaaaagagaaataaaaaaaaaaaaacaattgggtccccgaagcgcattcagtctcccctcaacaacaagttactgaactcaccagctaaaaccctgcctggcgcttgcggttctcctcagaaactgattgacgggttcctaaagcacgagggccctcccgctgagaaaccccttgaggagctttccgcttccacttcaggagtaccgggactgagcagcctgcagtctgaccccgcagggtgcgtgagacccccagccccaaaccttgcaggagccgtggagttcaacgatgtcaagaccttgctccgggaatggattactaccattagcgaccctatggaggaggatatcctccaggttgtgaaatactgcaccgacctgatcgaggaaaaggaccttgaaaagttagatctggtaattaagtatatgaagaggctgatgcagcagtctgtggaaagcgtgtggaacatggcttttgatttcattcttgataacgttcaggtggtactgcaacagacttacggatccaccctgaaagtgacctag

SEQ ID NO: 30634 - DNA, 2916 bp, Artificial Sequence
  Description of Artificial Sequence: Synthetic coding sequence
atggcaacagttagggcaagcctgcgcggagcactcctactgctcctcgccgtggctggggttgccgaggtggcaggcggtttagcacctggcagcgccggtgcgttgtgttgtaaccactctaaagacaaccagatgtgtcgggatgtgtgtgagcaaatattcagctcgaaaagtgagtcccgcctgaaacatttgttgcagagagccccagactactgccccgaaacgatggtggagatatggaactgtatgaacagttcgctcccgggtgtctttaaaaaatcagacggttgggtgggacttgggtgctgtgagctggctatagcactggagtgccgtcaagcctgtaaacaggcatcaagtaaaaatgacatctccaaggtttgtagaaaggagtacgagaatgccctcttctcctgcatcagccgcaacgagatgggttccgtgtgttgcagctacgccggacaccacactaactgccgcgaatactgccaggctatctttagaaccgacagctcccccggaccttcccagatcaaagccgtggaaaattattgtgcaagtatctccccgcagctaattcactgtgtgaacaactacactcagtcttacccaatgcgcaaccccacggactcactctactgttgtgaccgagcagaggaccatgcctgtcagaacgcatgtaagcggatcctaatgagcaaaaagacagaaatggaaattgttgatggactaatcgaagggtgcaaaacccagccgctaccgcaagatcccctctggcagtgctttctggagagttcccagtccgtccaccctggcgtaactgtgcaccctccaccttcaaccggattagacggcgcaaaactgcactgctgctcaaaggccaacacgagcacttgccgggagttatgcactaaactttatagtatgtcctggggcaacacgcagagttggcaggaattcgatagattctgtgagtataaccctgtggaggtgtctatgctgacatgcctagctgatgtaagagaaccctgccagctggggtgccgtaatctgacatattgcaccaatttcaataatcgacccacagagctgtttcgatcctgcaacgctcaatctgaccagggagccatgaatgacatgaaactgtgggagaagggtagcataaagatgccgttcataaacattccagtgctggatatcaaaaagtgccagcccgagatgtggaaggccatcgcctgctcattacagattaagccttgtcactcaaagagccgcggtagcattatttgcaagagtgactgcgtggaaatactgaaaaagtgcggggatcagaataaatttcccgaggatcataccgcggaatctatttgcgagctgctgagccctacggacgatctgaagaactgtattccccttgatacatatctgaggccgtctacactgggtaacattgtcgaggaggtgacccacccttgcaacccaaacccatgccccgcaaatgagttgtgcgaagtcaaccgaaagggctgtccctcgggtgatccttgtctcccttatttttgcgtccaagggtgtaaactgggagaagccagcgactttatcgtaagacagggcaccctgatccaggtgccttcttccgctggtgaagtggggtgctacaaaatctgttcatgcggccagagcgggctgctcgagaactgtatggagatgcattgcattgatctgcagaagagctgcatcgtgggaggaaagcggaaatcacacgggacgagcttttccatagattgcaatgtctgtagttgttttgccggaaatctcgtgtgttctacaagactttgtctaagtgagcattccagcgaagacgatcgaaggacattcaccgggctgccctgtaattgcgccgatcagttcgtcccagtttgcggccagaacggacgcacctatccttccgcctgtatcgcacgttgcgtaggcctccaggaccaccaatttgaattcggaagctgtatgtccaaggacccctgcaaccctaatccatgccagaagaatcaacggtgcatccctaagccccaggtgtgcctcaccaccttcgacaagttcggatgcagccagtacgaatgcgtcccacgccagctagcttgcgatcaggtgcaggaccctgtgtgtgatactgatcacatggaacacaataacctgtgcaccctgtaccagcgaggcaagtcactgagctataaggggccttgtcaaccgttctgtcgcgctacggaacctgtctgtggccataacggagagacttatagctcagtctgcgccgcttattcagaccgagtggctgtcgattattacggggattgccaggctgtgggagtgctatcagaacatagtagtgtcgccgagtgcgctagcgtgaagtgcccaagtctcttggccgctgggtgcaagcccataataccacctggagcgtgctgtcccctatgcgccggaatgctgcgggtgctcttcgataaggagaagcttgacaccatcgcgaaggtgacaaataaaaaacccattaccgtgctcgagatccttcagaagatacgaatgcatgtgtccgtcccgcaatgcgatgtattcgggtatttttccatcgaatctgagatcgtgattttgattatacccgtggatcactaccctaaagcactccaaattgaagcgtgtaataaggaagccgaaaagatcgaaagcctaattaatagcgactccccgacgttggcatctcacgtccctctcagcgctttgatcatctctcaggtccaagtctcctctagcgtgcccagtgccggagtccgggctagaccgtcctgtcactctctgctgttacctttaagcctcgggctggcattgcatttgttgtggacgtacaactag

SEQ ID NO: 30635 - DNA, 735 bp, Artificial Sequence
  Description of Artificial Sequence: Synthetic coding sequence
atgaaggaaagacgggcttcccagaaactgtcttctaagtccatcatggaccccaaccagaatgtgaaatgcaaaatcgtcgtggtcggagattctcagtgtggtaaaacagcgctcctgcatgtgtttgccaaggactgtttccccgagaactacgtaccgaccgtgttcgagaactacactgcttcttttgagatcgatactcagagaatcgaactcagcctttgggacaccagcggctccccctattacgacaacgtgagaccgctatcctaccctgatagcgacgccgtcctcatctgctttgatatctctcggccagaaacactggattctgtgctgaaaaagtggaagggcgaaatccaagaattctgtcctaataccaagatgttactggtaggctgcaaaagcgatcttcggacagacgtgagcacccttgtggagctgtcaaaccaccgacagactccggtgagttacgaccagggcgcaaatatggcaaagcagatcggcgctgccacctatatagaatgttcagcacttcagtcagagaactcagttagagacatttttcatgtagcaactttggcctgcgttaataagacaaacaaaaacgttaagcggaataagtcccagcgcgctaccaagaggatctcccacatgccctcccggccagagctgtcagccgtggccaccgacctgaggaaagacaaggcaaagtcctgcaccgtgatgtag

SEQ ID NO: 30636 - DNA, 735 bp, Artificial Sequence
  Description of Artificial Sequence: Synthetic coding sequence
atgaaggaacggagagctagtcagaagttatctagcaaatccataatggatcctaaccagaacgttaagtgtaagatagtggtggtaggcgactctcagtgcggcaagacggctctactccatgtatttgccaaggactgctttcctgagaattacgtgcccactgtttttgaaaattacacagcgagctttgagattgacacacagcggattgaactgtcactgtgggacacgtctggctctccgtactacgacaacgtccgacctttaagttatccggattcagatgctgttctaatatgctttgatatctctcggccagaaaccctggattcagtcctaaaaaagtggaaaggcgagatacaggagttctgtcctaacactaaaatgttgctcgtgggctgcaagtccgatctgcggacggatgtgagtaccctagtggaattgagcaaccaccggcagacacccgttagttatgaccaaggtgcaaatatggctaaacaaattggcgcagctacctacatcgaatgcagcgccctccagagtgagaattcggtgcgggacatattccacgttgccaccctcgcctgtgtgaataagactaacaagaatgtgaagcgtaataaatcacagcgcgcaacgaaaaggattagccacatgccatcacgcccagaactgtcggccgtcgccaccgatctccgcaaagacaaagctaagtcatgtacagtaatgtag

SEQ ID NO: 30637 - DNA, 348 bp, Artificial Sequence
  Description of Artificial Sequence: Synthetic coding sequence
atgctgttggtgggctgtaaaagcgacctccgcactgatgtgtctacactcgtggagctgagcaatcaccggcagaccccagtgtcttacgatcagggggctaacatggcaaagcagatcggcgcagctacctatattgagtgttcggccctgcagtccgaaaattcagttagggacatcttccacgtcgcaaccctggcgtgtgtcaacaagacgaataagaacgtgaagaggaacaaatctcaacgagctacaaagcgcatatctcacatgccatcccggcctgagctgagtgccgtggcgactgaccttaggaaggataaagccaagagctgcacagtcatgtag

SEQ ID NO: 30638 - DNA, 351 bp, Artificial Sequence
  Description of Artificial Sequence: Synthetic coding sequence
atgaaagaacgcagagcatcgcagaaattatcctctaaaagcattatggaccctaatcagaacgtgaaatgtaaaatcgtcgtcgtgggagactcccaatgtggcaaaactgcgttgctgcatgttttcgccaaggactgtttccctgaaaattacgtccccactgtgtttgagaattatacagcctcctttgagatagacactcagagaatcgaactatccctgtgggacacaagcggcagcccctactacgataatgtgcgcccactgagttatccagattctgatgctgtcttaatttgtttcgacatcagtcgcccagaaacgctcgacagcgttctcaaaaaatag

SEQ ID NO: 30639 - DNA, 351 bp, Artificial Sequence
  Description of Artificial Sequence: Synthetic coding sequence
atgaaggagagacgggcttcccagaaactctcttctaagtcgatcatggaccccaaccaaaacgtgaagtgtaagatagtggtggtcggcgactctcagtgtggtaagaccgcactcctgcacgtctttgccaaagactgttttcccgagaattatgttcccactgtgttcgaaaactacacagcgagcttcgagattgacacgcaacggatcgagctttccctttgggatacatcaggcagtccttactacgacaacgtgcgccctctgtcctatcccgatagcgatgcagttctcatttgcttcgatatcagccgtccagaaactctagacagcgtcctgaagaagtag

SEQ ID NO: 30640 - DNA, 615 bp, Artificial Sequence
  Description of Artificial Sequence: Synthetic coding sequence
atggccgagcaggaacctacagcagaacagttggctcagatcgcggctgagaacgaagaggatgagcatagtgtcaattataagcccccagctcagaaatcaatccaggaaatacaggagctggataaggatgacgaaagcctccgaaaatacaaagaggctctgctgggcagagtggcagtgagcgcagatcccaatgtgcccaacgtcgtagtcacagggcttacacttgtgtgctccagcgctcccggtcccctcgaactggatctcacaggcgacttagaatcctttaaaaagcaatcatttgtgttaaaggaaggcgtggaatatagaatcaagatatccttcagagtgaacagagagatagtctccggtatgaagtacatccagcacacttaccggaaaggcgttaagattgacaaaaccgactacatggtgggctcttatgggcctagagcggaggagtatgagtttctcaccccggtcgaagaagcgccaaagggtatgctggccagaggctcttattctatcaagtcgcgatttacggatgatgacaagacggaccatctgtcctgggagtggaatcttacaatcaaaaaagattggaaggattag

SEQ ID NO: 30641 - DNA, 537 bp, Artificial Sequence
  Description of Artificial Sequence: Synthetic coding sequence
atggccgagcaggagccaacggccgaacagctggcccaaattgctgctgagaatgaggaggacgaacactctgtcaattataagcccccagcacaaaaaagcatccaggagatacaagagttagataaggacgacgaatccctgcgaaagtacaaggaagctctcttaggcagagtcgcagtatcagctgacccaaacgtccccaatgttgttgtcacgggactgactttggtctgttcttctgcaccaggtccgctggagctggacttgactggcgatcttgagagttttaagaaacagtcattcgtgttgaaagagggggtggaatacaggatcaaaatatctttcagggtgaaccgagaaatcgtatccggaatgaagtacattcagcacacttatagaaagggagtcaagatcgacaagaccgactacatggtgggctcttacagtataaaatccaggttcacagacgacgacaagactgaccacctgagctgggaatggaaccttactataaaaaaggattggaaagattag

SEQ ID NO: 30642 - DNA, 615 bp, Artificial Sequence
  Description of Artificial Sequence: Synthetic coding sequence
atggctgagcaagaacccaccgccgagcaactagcacagatcgccgcagagaacgaagaagacgagcattccgtgaactacaaaccacccgctcaaaagtctatacaggaaattcaggagctggataaggatgacgagagcttgagaaaatataaggaggcgctcctgggccgagtggcagttagcgctgatcctaatgtaccaaacgtcgtagtaactggtctcactttggtttgcagctccgccccaggcccactagagttggatcttacaggcgacctcgagtctttcaagaagcagagcttcgtcttgaaggagggtgtagaatacaggattaagatcagtttccgtgtgaacagagaaattgtcagtggaatgaaatatatacaacatacttaccgtaaaggcgtaaagattgataagaccgactacatggtgggaagctacggaccgagagccgaagagtatgaatttctcaccccagtcgaggaggcgccaaagggaatgctcgctcgtggctcatactccatcaagtctaggttcaccgacgacgataaaactgaccatttgtcctgggagtggaatctgaccatcaagaaagattggaaagactag

SEQ ID NO: 30643 - DNA, 3576 bp, Artificial Sequence
  Description of Artificial Sequence: Synthetic coding sequence
atggaggccatgtctccacagcaggagactctgggtggccagccaggcaggagttcgtccctgacaggggtgagtcggttagcgggagggtcctgcactaaaaagaaaatgaagacgttggcagaacgaaggcggagcgcaccgtccctgattttagataaggccttgcagaagcggcctaccactcgcgatagcccatctgcctctgtggatacatgcacatttctgagtagtctggtgtgctcaaatcgaacactgctgatagacggcagagcagaactgaaaagaggccttcagagacaggagagacatctgttcctgttcaatgacctgtttgtggttgccaaaatcaaatacaacaacaacttcaagatcaagaacaaaataaaactgactgacatgtggacggcatcgtgcgtggatgaggtaggtgaaggcaacaccaatgctatgaagtccttcgtgctgggatggcccaccgtgaatttcgtggccactttcagttctcccgaacagaaggacaaatggctgagcttgcttcagcggtatatcaatctagaaaaggagaaggattacccaaaatccatccccctgaagatcttcgcaaaagatatcggcaattgtgcttactctaaaacgatcaccgtgatgaactccgatacagccaatgaggtgataaacatgtcgcttccaatgctgggcattactgggtcagaacgtgactatcagctctgggtcaattccgggaaggaagaagccccttaccccttgattggccacgagtatccttacggaattaaaatgtctcacttgagagacagtgccctcctgaccccgggatccaaagactcgacaacaccctttaacctgcaggagccattcctgatggagcagcttccacgggagatgcaatgccagtttattcttaaacccagtcggctggctgcggctcaacaactgtctgacagtgggcataagacattcaagaggaggcggagcataattaattgggccttttggagggggtcatcaacacatctagataacttgccctccagccccacatccccaatgccgggtcagctgttcgggatatcccttcctaacatttgtgaaaacgacaatcttcctaaaccggtcttagatatgttgttttttctgaaccagaaaggacctctgaccaaagggatattcagacagtccgcgaacgtgaaatcttgcagggaactgaaggagaaacttaactctggagtggaggtgcaccttgactgtgagagcatttttgtcattgccagcgtgctgaaggattttctgagaaacattcccggaagtattttttcgtctgacttatatgatcattgggtcagtgtgatggatcaggggaacgacgaagaaaagattaatacggtccagagactgttagatcagcttcctcgtgccaatgttgtgctgctaagatatctctttggtgtgttgcacaacatcgagcagcactcaagcagcaatcaaatgaccgccttcaacctggccgtctgcgttgctccttccatactctggcccccagcctctagctctcccgaactggagaacgagtttacaaaaaaggttagtctgctcatccagtttcttatcgagaactgcctgcggatttttggggaggaaataacgtctctgtttcgagaagtgagcgtgcgctgcgatacccgcgaaaacgcttctgacatatcctgtttccaactcaatgacagtagttacgattccttggagaacgagcttaatgaggatgtcgatgccccatgcagtgatcttgtgaaaaagcttggccagggttctcgctctatggatagcgtcctgacactgtccgactacgatcttgatcaacctgaggttgaaggtctcttgacactctccgattttgatctcgcccactctaaggatgaagatgtgcaaatgaagaggccactggaaagcaagccagtcaatattctagtgtataccaaaatccccttgcgagatcacgcacgcgctccgagcgctatgtgtaccccgtcttatctcagcaccgccgcagctaatgctgccaaatccctgaggcggcaccgcaggtgcagtgagccatctatcgactacctggactcgaaactgtcctacctgagggaattctaccagaaaaagctgaggaagtcatcttgtgacgcaattctaagtcaaaaagacgaagactacctaaagcagaaccaacccctgcaagaagaggggaagacatgcttcaagcagtctctggtgaccgggaccgacgtatcaaagaagaacgctacaacacagaataccaagaagaagtcattgtctggttccgagggtaatcacgtgaaactattccccaaatcaaagccagttgccatttccgttgcttcttacagccccatgtcgtctcaggatcactccaaaaatcagccatttgacgtgaatacctccggctattcgccgcctcacacagcagacgcactgaagggaccgagaacacatcgcaggtgcagtgaacctaacatagaagatcagaatcgcaaacttacttacctgagggggatttactccaaaaaacagcacaagactagctgcgaggccggtctcctgcatggcgaggaagattacctgaagagacacaaaagcctgcagatggaggggcagaagttaataaaccagagcttagtgatgggaatagaggtgggtaagagctctgccacaaatcagaacacagagaaggtgctgccacctagactcaatttatgtcccaggacttcttactccagcctgtcttcgccaggtacctcaccaagtggttcttccgtgtcgagccaggattcggcgttttctcagatatcagagcactcagtgttcacacctacggagacaagctcaccaattgactgcaccttccaggctcagagaaagagggaagatctcagtccagacttctccaatgcatctcatgtgtcaggtatgccaggtccttcttctggacaggcatgtagtagacccgcttataccaaaaaggacactatggagtggcatagccagatgcactcagtcacactgcaccctagtacatggctgaggaatggagttgcgtccctgaaaaactggtctctgaagaaaaaggccaaagcggcaagaccagaggaagagaaaatagcaagcccaaagggaccattagaacctccaccacatgcctccggcgtgcctgaagctaactctctccaagaggagcaaaaagatctgcctctgagggccgctgagggcctctctccggtgcagtccgcacagagatgcagctcctcccctttccaagattccgaaagacactgttcctctccctttagtctggtggagtcgaggttgaagctgtgcatgaagtcccatgaagagatcgagcctggaagccagtctagtagtggcagcttgccctgggagagggcctcagcctccagttggaccctggaggacgccacctccccagactccggtcccaccgtggtgtgtgatatagaggaccgctatctgaccaaggatatttag

SEQ ID NO: 30644 - DNA, 3498 bp, Artificial Sequence
  Description of Artificial Sequence: Synthetic coding sequence
atgactttttggattattattaataaaaaaatgaaaactctggctgaacgcaggcgttctgctccaagtctcatcctggacaaagccttgcagaaacggcctaccacccgcgacagcccatcagcaagcgtggacacgtgtacatttctctcttcgcttgtgtgcagtaatcgcactctcctgatcgacgggcgagctgaactgaagcgcggtcttcagaggcaggagcggcatctgtttctatttaacgacttatttgttgtggccaaaatcaagtacaacaacaactttaagattaaaaataagattaagttgactgatatgtggacagctagctgcgtggacgaggtgggtgagggcaatactaacgcaatgaagtccttcgtgctgggttggcccaccgtgaattttgttgccacgtttagctcgccagagcagaaggacaagtggctgagcctacttcagcggtacattaatcttgaaaaagaaaaagattatccgaagtcaatccctctgaagatttttgcaaaagacatagggaactgtgcctactcaaagactatcaccgtgatgaatagcgatacagcaaatgaggtgattaatatgtcactcccaatgctagggataacagggtctgagagagattaccagctgtgggtgaactcaggcaaagaagaggctccttacccgctgattggtcatgagtacccttacggtataaagatgtcccacctccgcgattcggctctgctaacacccggtagtaaggacagtaccactccttttaatctgcaggagccctttctgatggaacaattgcctagagagatgcagtgccagttcattctcaagcctagcagactcgctgctgcacagcagctttcggatagcggtcacaaaaccttcaaacgcagaaggtcaattattaactgggccttctggcgagggtcttcaacacatttagataatctgcctagctcacccacatctcccatgccaggacagctgtttggaatatccttgcccaacatctgtgaaaacgacaacctgccaaaacccgtgttggacatgttatttttcctcaatcaaaaggggccactaacgaaggggatcttccggcagagtgcaaatgtgaaatcgtgtcgtgagcttaaagagaagctaaattctggggttgaggtccatctcgattgtgagtccatattcgttatcgcctccgtgctgaaagatttcctcagaaatatcccaggctcaattttttctagcgatctatacgaccactgggtttccgtgatggaccaggggaatgacgaagagaagatcaacaccgtgcagcgcctcctcgaccagcttcctagggccaacgtggtgctactgagatacctctttggagtattgcataacatcgagcaacacagtagttcaaaccaaatgacagcatttaatctggccgtctgcgtggcaccatccatattgtggcccccagccagttcctcaccagaactggaaaacgagttcacaaagaaggtgtctctgctaatccaatttctgattgagaattgcttgcgcatttttggtgaggagatcacaagcctgttccgcgaagtcagcgtccggtgtgatactagagaaaacgccagtgatataagctgctttcagctcaacgactcgtcttatgatagcctggagaacgaattgaacgaggatgtcgatgcgccatgcagcgacctcgtgaagaaactcggccagggatctcgtagcatggacagcgtgttgacactttcagattacgacctggatcaacccgaagtggaagggcttcttactctctccgatttcgatctggctcacagcaaagatgaagacgtccaaatgaagagacccctggaaagcaagccagtgaacattctggtctacaccaaaatccctctaagagaccacgcacgcgctccctccgcaatgtgcactccttcctacttgagcaccgcagcagcaaacgctgccaaatcactcagacgacaccggcgatgcagcgaaccttctattgactatttggatagtaagctgagttaccttagagagttctatcagaaaaagctgcgaaaatcttcatgtgatgctattctgtcccagaaagacgaagattatctcaagcaaaaccagccgctacaagaagagggcaagacttgtttcaaacagagtctggttacgggcaccgacgtgagcaaaaagaatgcgacaactcaaaatacaaagaagaagagtctgtctggttcagaagggaaccatgtaaagctttttccgaagtcgaagcccgtagccatttcagttgcctcatactctccaatgtcgtcgcaggaccactcgaagaatcagcccttcgacgtaaacacatcaggatactcaccaccacacacggcagatgcactgaaaggccctagaactcaccgccgttgcagcgaacctaatatcgaagaccagaatagaaaactgacctacctcagaggcatttattcaaagaaacagcataaaacatcttgcgaggccggacttctgcatggagaggaggactatctgaagcgccacaagtctctgcagatggaggggcagaagttgatcaatcagtctcttgtgatgggtattgaggttgggaagtcctccgcaactaaccagaacaccgaaaaagtgctgccaccccgactgaatttatgtcctcgaactagctattctagtctgagctcccccggaacttctccctcaggctcctccgtgagcagccaggattcagccttttcccagatttccgaacattccgtgttcacacccactgaaacgagttctccaatagattgtacctttcaagctcaacgcaaaagagaagatctttctcctgacttcagtaacgcctctcacgtcagcggcatgcccggtccatcctccggtcaagcatgttccagaccagcctatacaaagaaagataccatggagtggcatagccaaatgcacagcgtaaccctgcacccatccacatggctcagaaacggcgtggcttcattaaagaactggtcactgaagaagaaggcgaaggctgcccgtcccgaagaggaaaagattgccagtccaaagggaccgttagagccacctccacatgcctctggtgtaccagaggccaactccttgcaagaggaacagaaagaccttcctctccgggcagcggaggggctgagtccagtccagagtgcacagaggtgttcctccagcccctttcaagactctgagcggcattgctctagccctttctcccttgtggagtcacgcctgaaactctgcatgaaatcccacgaggagattgagccaggcagtcaaagctcatcaggatcactgccttgggaaagggcgtctgccagcagctggacgctggaggacgctacctcaccagacagtggacccactgtcgtctgcgacatcgaagatagatatcttaccaaagatatttag

SEQ ID NO: 30645 - DNA, 3507 bp, Artificial Sequence
  Description of Artificial Sequence: Synthetic coding sequence
atgagcgctcgggaacggcagcccgcattgaagaagaagatgaaaacgcttgcagagcgcaggaggtctgccccttctctgattttagacaaagcactgcagaaaagaccgactactcgcgactccccttccgccagtgtcgacacttgtaccttcctgtcatctcttgtctgttctaatagaaccctgctcattgacgggagggccgaactgaaaagaggactgcagcgacaagagcggcacctgttcctttttaacgacctttttgtggttgctaaaatcaagtacaataacaactttaaaatcaagaacaagattaagttgaccgatatgtggacggccagttgtgtggatgaagttggcgagggcaatacaaacgctatgaaaagctttgtgcttgggtggcctactgtcaattttgttgcgaccttttccagcccagagcaaaaagataagtggctttccttactgcagagatacataaatctagaaaaggagaaggattaccctaagtcaattcctctgaagatcttcgcaaaggatattggcaactgcgcctatagcaaaaccatcactgtcatgaactctgacacagccaacgaggtcattaatatgtctttacccatgctggggataacaggctccgagagggactaccagttgtgggtgaattccgggaaagaagaagccccataccccctgattggtcacgagtacccctacggcattaagatgtcgcatttaagagatagcgcactcctgacacccggaagtaaggattccacaacaccgtttaacttgcaagagcctttcttgatggagcagttgccaagggagatgcagtgccaatttatactgaagccttcccgtctggccgctgctcaacagttgagcgactccggccacaagacattcaaaaggcggaggtcaataattaactgggctttctggaggggctcttcaacgcatctggacaacctgccttcaagtcccacgtcccctatgccaggtcagctgtttggcatctccctgcccaacatttgtgagaacgacaacctgccaaaacccgtgctggacatgctcttttttcttaatcaaaaggggcctttgactaaagggatcttcaggcaatcagctaacgttaagtcttgcagagagctgaaggaaaaacttaactcaggtgtcgaagtacatctcgactgtgaatctatcttcgtcattgcatccgtgctgaaggacttccttcgcaacattcccggtagtattttttcgagtgacctttacgaccattgggtctccgtgatggaccagggcaatgatgaggagaagattaatactgtacagcgcctcctcgaccaactgcctcgagctaatgttgttttacttcggtatctttttggtgttctgcacaacattgaacaacactcatcctctaatcagatgacagctttcaaccttgctgtctgcgttgcccctagtatactatggcctccggcttcgtccagtcctgaactggaaaatgagttcaccaagaaagtctccctccttatccaattcctcattgagaactgcttaaggatcttcggggaggagatcacatccctatttcgggaggtgagcgttaggtgcgatacaagggagaatgcaagcgatattagttgtttccaactcaacgatagctcatatgactctctcgagaacgaattgaacgaggatgtggacgctccctgctcagatctcgtgaaaaaactggggcaggggagccgatctatggatagcgtgctgaccctgagcgattatgatctcgaccaaccagaggtcgaaggactcctgaccttgagcgactttgatctggcgcactccaaggacgaggatgtccagatgaagagaccactcgagagcaaacctgtcaatattctggtttacaccaagattcctctccgtgaccacgcccgagccccatctgctatgtgcacccctagctacctcagcactgccgcagctaacgctgctaaatccctaagaagacacagaaggtgcagtgagcccagcatcgactacttggattcaaagcttagctacctaagagagttctaccagaaaaagctgcgcaaaagcagctgtgacgcgatcttatcccaaaaggatgaagactatctcaagcagaatcagccactgcaggaagaaggcaagacttgctttaaacagtctctcgttaccggcactgacgtgtctaagaaaaatgccactacgcagaacaccaaaaagaaatccctgagcggaagtgaaggcaaccacgttaagctgttcccaaagtcaaaaccagtagccatcagtgtagcttcatattcccccatgagctcccaggatcatagcaagaatcagccttttgatgtgaacacaagcggatactctccccctcataccgcagatgctttgaagggaccgagaactcacagaaggtgtagcgaacccaatatcgaagaccagaacaggaagctcacttacctgcggggaatctactctaagaaacagcacaagactagctgcgaggcgggattacttcatggagaagaagactatttgaaacggcacaagagcctccagatggaaggccagaagttgatcaaccagtcgctggtgatgggaattgaagtcgggaagagctccgccacaaaccaaaatactgagaaagtcctgcctcccagactaaatctctgtcctagaacaagttactcatctcttagttcccccggaactagtccaagcggcagcagcgtaagttcccaagatagtgcattctcgcagatttcggagcactctgtgttcactcccaccgagacttcctcacccattgactgcacttttcaagcccaacggaaacgggaagacctctccccggatttctccaatgctagccacgtgtcaggaatgccgggacctagttcgggacaggcctgctctcgcccagcctacaccaaaaaagatactatggaatggcactcccagatgcactctgtgaccctccatccttctacatggttgcgtaatggcgtggcctccctcaagaactggagcctgaagaaaaaggccaaggccgctagacccgaagaggaaaaaatagctagtccaaagggacccctggaaccaccacctcatgcctccggagtgcctgaagctaactccttgcaggaggaacagaaagacctgccactgcgggcagcagaagggctgtcccctgtgcagtctgcccagaggtgctccagcagtccatttcaggattccgagcgtcactgtagctcaccttttagcctggtggaaagtcgtctgaaactttgtatgaaaagccatgaggagatagagccgggttcacagtctagcagcgggagcctgccctgggaacgggcaagtgcgtcgagttggacattagaagacgcaacctcacctgattccggaccgactgtggtctgtgatattgaagacaggtacctgaccaaagatatttag

SEQ ID NO: 30646 - DNA, 3468 bp, Artificial Sequence
  Description of Artificial Sequence: Synthetic coding sequence
atgaagacactggcggagcggaggcgttccgccccttcactgattctggacaaagcacttcagaaaaggcccaccactagagactcgccgagtgcttccgtcgacacgtgcacttttttgtcatccttggtgtgcagtaaccgcacattgctgatagatgggagagccgaactgaaacggggtcttcagcgacaagagagacaccttttcctgttcaacgatttatttgtcgtggcaaagatcaaatataataataatttcaagattaaaaataaaataaaactaacagatatgtggaccgcgtcttgcgtggatgaggtaggggagggaaacactaacgctatgaaatcttttgtgttgggctggccaactgtaaattttgtagccacgttttcctcaccagaacagaaagataagtggttatcgctcctacagcggtacatcaacctcgagaaggaaaaggactatcccaagagtatccccctgaagatttttgccaaagacatcggaaactgcgcctactccaagaccattacagttatgaatagtgacacagccaatgaggtcatcaacatgtcccttccgatgttaggtataactggctccgaaagggactatcagctgtgggtcaactctgggaaggaagaagcaccgtatcccttaatcgggcatgagtatccttatggaattaaaatgagtcatctcagggactctgctctcctgacgccaggctctaaagacagcactactccattcaatctgcaagagccctttctcatggagcaactccccagagaaatgcagtgtcaatttattctcaagcccagccgacttgccgctgctcaacaactttccgactcgggacataaaactttcaaacggagacgatcaatcatcaactgggccttctggcgtgggtccagtacccacctggacaatctgccctcatcacctaccagcccaatgcctggacaactgttcggaatctctctgcctaatatctgcgagaatgacaatctgcccaagcctgtcctggacatgttgttttttcttaaccagaagggaccccttacgaaggggatcttcaggcaaagcgcgaacgtgaaaagttgtagagagctcaaggagaagttaaactctggggtagaagtgcatctggattgtgagagtatctttgtaatagcctcagtgctgaaggatttccttagaaacatccccggaagcatattttccagtgatctgtatgaccattgggtatccgtgatggatcaggggaatgacgaggagaagatcaacacggtccagcggctgttggatcaactgccacgagccaatgtggttttgctgcgctatctgttcggcgtgctccacaatattgaacagcattccagctccaaccaaatgacggccttcaatctggcggtatgcgtggctccgtctatcctttggcctccagccagctcctcaccagagctcgaaaacgagttcacaaaaaaggtgtccctgttgattcagttcctgattgagaattgcctccgcatcttcggtgaggagattacctctctcttcagggaagtctccgtcagatgcgacacccgcgaaaatgcaagtgacatctcctgtttccaactgaatgactcaagctatgatagtttggagaatgaactaaacgaggacgtggacgccccttgctcggacctagttaagaagctcgggcaagggtctcgatcgatggattcggtgctcactttgtctgactatgacttggatcagcccgaggtcgaggggcttttaacactaagcgattttgaccttgcccattccaaagacgaggacgtacaaatgaaacgtcccctggagtcaaaacctgtcaacatcttggtttacaccaaaatccctctgcgggatcatgccagggcgccaagcgcaatgtgcaccccctcttacctgtccacagccgctgccaacgcagctaagagtctccgacggcacaggcggtgctccgaaccgtcaatcgactacctcgattcaaagctcagttacctaagggaattttaccagaagaagctccggaaatctagctgcgatgctattctctcacagaaggacgaggactacctgaagcaaaatcagccgttgcaggaggagggcaagacttgcttcaaacagtctctggtgactggtactgacgtgtcaaaaaaaaatgctactacccagaataccaagaaaaaaagcctgtctggctcggaggggaatcacgtaaaactgttccctaaatcaaaacccgtggcaatatctgttgcctcatacagcccgatgagttcccaggatcattccaagaatcaacccttcgatgtgaatactagcggttactctcctccgcacacagccgacgctctcaaaggaccaaggacacatagaaggtgcagtgagcccaatatcgaagatcaaaaccgcaaactgacttatctaagaggcatatacagcaagaagcaacacaaaacatcatgcgaagccggactgcttcacggtgaggaggattacctgaagaggcacaagagtctccagatggagggtcagaagctcatcaaccagtcgctcgtaatgggcatagaagtcgggaaatctagtgctacaaatcagaatacagagaaggtgctgcccccacggctgaacctatgccctcgaacctcctacagcagcctgtcaagtcccggaacctcaccctctggatcatccgtgtccagtcaagattctgcattcagccagatttccgagcactccgtcttcactcctacagaaaccagctctcccatagattgtacctttcaggcccagaggaaacgggaggaccttagcccagacttcagtaacgcatctcatgtgagcggcatgccgggaccgtcctctggtcaggcctgctcaaggccggcatataccaagaaggatacaatggaatggcactcccagatgcactctgttactctccatcctagtacatggctgagaaatggcgtggcttcccttaagaactggtctcttaaaaagaaggccaaagcagctagacccgaagaagaaaagattgccagccctaaaggaccccttgaaccaccccctcacgcctctggagtacccgaggcaaacagcctccaggaggagcagaaggacttgcccttgagagctgccgaggggctgtctccggtgcagtcagcccagcggtgcagctcatcaccttttcaggacagcgagcggcactgctcaagtccttttagtctggttgagtcacgtctgaagctttgtatgaagtcacacgaggagatcgaacctgggtcacagagtagctcaggtagccttccatgggagcgggcatcagctagctcctggacactggaggacgcaactagccctgactccggtccgacagtggtttgcgacatcgaagatagatatctcaccaaagatatttag

SEQ ID NO: 30647 - DNA, 3468 bp, Artificial Sequence
  Description of Artificial Sequence: Synthetic coding sequence
atgaaaacactggcggagcgaagaagatctgccccatccttgattctagacaaggcattacagaagagaccaaccacacgcgattctcccagcgcttctgttgacacgtgtaccttcctttcatcgctcgtctgctcaaaccggacactgttaatagacgggagggcggagttaaagcgcggacttcagagacaagagaggcatctgttcctttttaatgacttgtttgtggtggccaaaattaagtacaataataactttaagattaaaaataaaatcaagctgaccgatatgtggaccgccagctgcgtggatgaggtgggagaaggaaacaccaatgccatgaaaagcttcgtgcttgggtggcccacagtgaattttgtagcgacattttcctctccagagcaaaaggacaaatggctgtcgctgctgcagcggtatataaatctggagaaggagaaagattatcccaagagtattcccttaaagatcttcgccaaagatattgggaactgtgcatattccaagacaattacagtaatgaacagtgacaccgccaatgaggtcataaatatgtctttacccatgttggggatcaccgggtccgagagagactatcaactgtgggtcaatagtggcaaggaagaggccccttatcccctaatcggacatgagtatccctatggcataaaaatgtcgcatctgcgcgacagtgcactgctgactccgggatctaaagatagtacaaccccatttaatctacaggaaccgttcctgatggaacagctccccagagagatgcagtgtcagtttattctgaagccttctagattggccgctgctcagcagctcagtgactcaggccataagacttttaagcgccgtcggtccattatcaactgggctttctggagggggagttccacccaccttgacaacttgccgagctctcccacatcccccatgcccggacagctatttggcatctctctgcccaatatctgtgagaatgataacctgcccaaaccagttttggacatgttattctttctaaaccaaaaaggcccattgaccaaagggatttttcgccagtcagccaatgtgaaatcctgcagagaattgaaggaaaaactgaacagtggagtggaggtgcaccttgactgtgaatcaatctttgtaatcgcctcagtccttaaagatttccttcggaatattccgggttctatctttagttcggacctgtacgaccattgggtatcagtcatggaccagggcaatgatgaagagaagattaacacagttcaacgactgcttgatcaactaccccgagccaacgtagtgctgctgaggtacctcttcggagttctgcataacattgaacagcactcttcaagtaatcagatgactgcgtttaatctagcagtttgcgttgctccatccatcttgtggccaccagcatccagtagtcctgagttagaaaatgagtttacgaagaaggtctcactcctgattcaattcttgatagagaattgtctgcgtatttttggtgaagaaatcacatccctgtttcgcgaggtgtccgtgaggtgtgacacccgagagaacgcttctgacatctcatgtttccaactaaacgatagctcctacgactctctggagaatgagcttaacgaggatgtggatgcaccatgttcagatctggtgaagaaattgggtcagggttccaggagcatggacagcgtcctcaccctaagcgactacgatctggaccagcctgaggtcgaagggcttcttaccctatcagacttcgatctagcacacagtaaggatgaggacgtccagatgaaaagaccactggagtctaagccagtgaatatcctggtttacactaagatccctctgcgagatcacgcccgagccccatccgccatgtgcactccaagttacctgagcaccgccgcagccaatgctgccaaatctttgagacgacacagacggtgttcagaaccttctattgattaccttgactcaaagctgtcctatctaagggagttttaccagaagaaacttcggaaatcctcatgtgacgccatcctgtcccagaaggatgaggattatctgaagcaaaaccaacctctgcaggaagaaggcaagacgtgcttcaaacagtcactcgtcaccggaactgacgttagcaagaaaaatgcaactacgcaaaacacaaaaaagaagagtctttcagggtccgaggggaaccacgtcaaattgttcccaaagtctaagccagtggcgatctcggtcgcctcttatagcccgatgtctagccaggaccactctaagaaccagccctttgacgtgaatacttccggatattcgcctccgcacaccgccgacgccctgaagggaccacggacgcatcgaaggtgttctgagccaaatatcgaagatcaaaaccgcaagctcacttatctccgtggaatatactccaagaagcagcacaagacctcttgtgaggcagggttgttgcatggagaagaagactatctcaagagacacaagtccctgcagatggaaggccagaaactaattaatcagtctcttgtcatggggatcgaggtgggaaagtccagtgcgactaatcagaataccgaaaaagtcctccctcccagattaaatctgtgtcctcggacatcgtacagcagtcttagctccccgggaacctccccatctggctctagtgtgagcagtcaagactctgcattttcccaaatctccgaacacagtgtgttcactccaacggagacatcgtcaccaatcgattgtaccttccaggcccagcgcaagagagaggatctgagtccggattttagcaacgcaagccacgtgtccgggatgcccggaccaagtagcggccaggcttgtagcagacccgcttatacaaagaaagatactatggagtggcattctcagatgcactcggtcactttacacccttcaacatggttgcggaacggtgtggccagcctgaagaactggagcctcaagaagaaagcaaaagcagccaggccagaggaggaaaagatcgcctcgccgaagggcccacttgagcctcctccgcacgccagtggcgtccccgaggctaactccctccaggaagagcagaaggaccttcctctgcgggctgctgaagggcttagtccagtgcaatcagctcaacgctgttctagttctcctttccaggatagcgaaaggcattgttctagcccctttagcctcgtggagagccggctgaaactgtgcatgaagagccatgaggaaatcgaacctggcagccagtccagctccggatcgctgccttgggagagagcatctgcgagttcatggactctggaagacgccacaagcccagacagcgggcctaccgtggtgtgcgacatcgaagataggtatctgacaaaggacatctag

SEQ ID NO: 30648 - DNA, 2196 bp, Artificial Sequence
  Description of Artificial Sequence: Synthetic coding sequence
atggaccaagggaatgatgaggaaaagatcaacacagtgcagcgactccttgaccagctcccacgggcaaacgtggtgctgttaaggtatttatttggggtcctacacaatattgagcagcattcgagctcaaatcagatgactgcattcaacctggcagtctgtgtagctccatctatcctgtggccaccagcaagctctagtcctgagcttgagaatgaattcactaagaaggtaagtctgctgatacaatttcttattgagaattgcctgagaatcttcggtgaggagataacaagcctgttcagggaagtgagcgtgcgctgcgatacacgggagaacgcctccgatatctcctgttttcaactgaacgactctagttacgacagcctggaaaacgagctgaacgaggacgtcgacgctccatgcagcgacctggtaaagaagctcggccagggaagccgcagcatggactcagtgctaaccctttctgattacgacctagaccaacccgaggtcgagggactgttgacgctgtccgacttcgatttggcccactctaaggatgaggatgtgcagatgaaaaggcccctggaatctaaaccagtgaacattcttgtgtatactaagatccccctgcgggaccatgcaagggccccttccgcgatgtgcacacctagttatctctctacagctgctgctaatgccgcaaaatcactgcggaggcaccgtcgttgtagcgagccttcgattgactacttagacagcaaactcagttacctccgcgaattttatcagaaaaaacttcgtaaatcgagctgcgatgctattctgtcccagaaagacgaggattatctgaaacaaaatcagcctcttcaggaagaaggcaagacttgctttaagcagtccttggtcacaggcaccgacgtgtcaaaaaagaatgctactacccagaatacaaagaagaaaagcctaagcggctccgagggcaaccacgtaaaactgtttccaaagagcaagccggtggcgatatccgtcgcgtcatacagtccgatgagttctcaggatcattcaaaaaatcagccttttgacgtcaataccagtggctattcaccaccgcacacagccgacgcacttaaaggcccaaggacacatagaaggtgttcggaacctaacattgaggaccagaacagaaaactcacgtatctcaggggtatctacagtaagaagcagcacaagaccagttgtgaagctggactcctccacggcgaagaagactatttgaaaaggcataagtctctccagatggaaggccagaagctgataaatcagtcactggtcatggggatcgaggtgggcaaatctagtgccactaatcaaaatacagagaaggtgctgccccctagactgaatttgtgtcctcgtacctcgtattcctccctaagtagccctggcacatcgccatcagggagttcagtctcttcccaggattccgctttcagccagataagtgagcacagcgttttcaccccaaccgaaacctcttctcctatcgattgcacgtttcaggcacagcgcaaacgggaggatctgtcaccagattttagcaatgcgtctcacgtaagcggaatgcccggaccaagctctggccaggcgtgtagcagacctgcctatacgaaaaaagatactatggagtggcacagtcaaatgcactcagtcactctccaccctagcacttggctccgtaatggagtggcatcactgaaaaattggtcgctaaagaaaaaggcaaaagcggcacgacccgaggaagaaaagatcgccagtcctaagggccctttagagccaccccctcacgcctcaggcgtccccgaagcaaactctttgcaggaggaacagaaagacctgcctctgcgcgcagccgagggactgtctccggttcagtccgctcagcggtgcagcagcagcccatttcaggattctgagcgccactgctcctcgcctttcagtttggtcgagtcccgccttaaactgtgtatgaaatctcacgaggagattgagcctggctcccagagtagctcaggaagcctcccgtgggaacgcgcaagtgcaagttcatggacattggaggatgctacatcgcccgactccgggccaaccgtggtctgcgatatcgaggatcgcaactgctgttag

SEQ ID NO: 30649 - DNA, 3498 bp, Artificial Sequence
  Description of Artificial Sequence: Synthetic coding sequence
atgaccttctggatcatcataaataagaagatgaagaccctcgccgaacgtaggagatccgccccttcccttattctggataaagccctccaaaagagacctacgacccgcgacagcccaagcgcctcagtggatacttgcacatttttgagtagcctggtctgtagtaaccgaactctcctgattgacggcagagccgaattaaaaagggggctacagcgacaagagcgacatctgttcctctttaatgacctgttcgtggtggccaaaataaaatataacaacaactttaaaattaaaaacaagatcaaacttaccgacatgtggaccgcctcttgcgtcgatgaggtgggcgaaggaaatacaaacgccatgaaatccttcgtccttggatggccaacagtgaacttcgtggccacattcagttctccggagcagaaggataagtggttgagtctgctgcagaggtatattaacctcgagaaggagaaggactatccgaaaagcattccgctcaaaatatttgctaaggacatagggaattgcgcatactctaagacaataaccgtgatgaacagtgacacggccaatgaagtcattaatatgagccttcccatgctaggtatcacgggatcggagcgggactatcaattgtgggtgaactctggcaaggaggaggccccatacccattaattgggcacgaatatccatacggaataaagatgtctcatttgcgagattctgccctgttgactcctggaagtaaggactccactacccctttcaacttgcaagagcccttcctgatggagcagctgcctagggaaatgcagtgtcagtttatactgaaaccctctcggctagctgctgcacaacagttgtccgacagcggccataaaacattcaaacgacggagaagtatcatcaattgggctttttggcggggtagtagtacccacttagataacttgcccagctcacccacctccccgatgccgggtcaactattcgggatatctctgcctaatatttgtgaaaatgacaatctccctaagccagtcctcgacatgctattctttctcaaccagaaggggccactgaccaaaggcatcttcagacagagtgcaaatgtcaagagttgccgtgagctcaaggagaagctgaactcaggggtcgaggtccatctagactgcgagagcatcttcgtgattgccagcgttttaaaggattttctacgcaacatcccaggctctatcttctcttctgacctctacgaccactgggtgagcgtaatggaccagggcaatgacgaggagaagataaataccgttcaaagattgttggatcagctgccgcgagctaatgtggtgctcctacgttaccttttcggcgtgcttcacaatattgagcagcatagctcttccaatcaaatgactgcctttaacctcgccgtgtgcgtggcaccgagtattctgtggccaccagccagtagctctccagagctggaaaacgaattcaccaagaaggtcagtctgttaatccaatttctgattgagaattgtcttcggatcttcggcgaggaaattaccagcctgttcagagaagtgtccgtgcggtgtgatactcgtgagaacgccagtgacatttcgtgtttccagctgaacgatagttcatatgactctctggaaaacgagttaaatgaagacgttgatgccccttgttccgacctcgtcaaaaagttaggtcaaggctccaggtccatggacagcgttctcaccctcagtgactacgatctggaccagcccgaggtcgaaggcctgctgaccctttcagatttcgacctggctcatagtaaggacgaggacgtccagatgaagcgtccactcgagagcaaacctgtgaatattttggtgtacacgaaaataccgctgcgcgatcacgcgcgagctcccagcgccatgtgcacaccatcgtacttgagcacagccgctgccaacgccgctaagagtctcagaaggcaccggcgatgttctgaaccgtcaatagactacctagactctaaactgagttatcttcgcgagttttatcaaaaaaagctgcgaaagtcaagctgcgacgccatcctgtcccagaaagatgaagactacctcaagcagaatcagccactccaggaagaaggcaagacttgcttcaaacagagcctagtgacaggcaccgatgtgagtaaaaagaacgctacaactcaaaacactaagaaaaagagtctgagtggctcagaagggaaccacgttaaattatttcccaagagcaagcctgtggcaattagtgttgcgtcatacagtccgatgagttcccaagaccatagcaagaatcaaccttttgatgtgaacactagtggctacagccccccacataccgccgatgcgctgaagggacctcggacccacagacgatgtagcgagcccaacattgaggatcagaaccggaaactgacttatctgcgtggtatctactcaaagaaacagcacaagacttcctgcgaagccggtttgctccacggtgaggaggactacctgaaacgccacaagtcattacagatggaggggcagaaactgattaaccagtcactcgtgatgggaattgaggttggcaaaagctcagctactaatcagaacactgagaaagtcctgccacccaggctcaacctgtgtccaagaaccagctatagctctttatcatctccgggaacgtccccatctggttctagtgtctccagccaggactccgctttttcacagatctctgaacatagcgttttcacaccaaccgagaccagtagccccattgattgcacttttcaggcgcagaggaaaagggaggatcttagccccgactttagtaacgcctcacacgtcagcggcatgccaggcccatcttccggccaagcctgttctcgtcccgcttatactaaaaaggacacaatggaatggcactcccagatgcactctgttactttacaccccagcacgtggctccggaatggcgtggcatcgcttaaaaactggagtctgaagaaaaaagccaaagctgcaaggcccgaggaggaaaagattgctagccccaaaggaccgctggagcctcccccacatgcctccggcgtacccgaagcaaatagtctgcaggaagaacagaaggaccttcctctgcgggcagcagagggcctctcacccgttcagtctgcccagagatgctctagtagcccctttcaagactccgagcgccactgttcatcacctttcagcctggtggagtcaaggcttaagctctgcatgaagtctcatgaggagattgagccgggaagccagtcctcaagtggctctctgccttgggagcgcgctagcgcttcatcttggactctggaggacgccacatctcctgatagtgggccaaccgtggtttgcgatatcgaagacaggtatcttacgaaagacatttag

SEQ ID NO: 30650 - DNA, 4542 bp, Artificial Sequence
  Description of Artificial Sequence: Synthetic coding sequence
atgatgatggcacgcaagcaggacgtccgcatcccgacttataacatctctgtggtgggcttatccggtaccgagaaggaaaagggccaatgcggcatcggcaaatcctgtctctgcaaccgattcgtacgccctagcgccgatgagtttcatctcgaccatacctcagttctcagtaccagcgacttcggcggaagagtggtgaataacgatcactttctctattggggagaggtatctagaagcctggaggattgtgtggagtgcaaaatgcatatcgtcgagcagaccgagtttattgacgaccagacatttcagccccataggagcactgccctgcagccttacattaagcgggcagcagcaactaaactagcctcagcagagaagctgatgtatttttgtacagaccaacttggattagagcaggacttcgaacagaagcagatgccagacggaaaactgctagtagacggctttctcttgggcatcgacgtgtcaagaggaatgaatagaaattttgacgaccagctgaagtttgtttccaacctttacaatcagcttgctaagaccaagaaacctatcgttgtggtgctgactaaatgcgatgagggggtggaaagatatatccgggacgctcatacttttgccctctccaagaaaaaccttcaggttgtagaaaccagtgcccgaagcaatgttaacgtggacctcgcattctcaactcttgtgcagctgattgacaagagtcgcggaaagactaaaataattccatactttgaggctcttaagcagcagagtcagcaaattgcaaccgccaaagataagtatgaatggctggttagtaggattgtcaagaaccataacgaaaactggctgtccgtgtctcggaagatgcaggcaagccccgaataccaggactatgtgtatctggaggggacacagaaggcaaaaaaactcttcttacagcacatccaccgtttgaaacatgagcatatagagcgcaggcgcaagctgtacctggccgcacttcccttggccttcgaggccctgatccctaatctcgacgagattgatcatttgagctgcattaaagccaaaaagttgctggagaccaaacctgagttcctgaagtggtttgtggtactcgaagagactccttgggatgccacgagccatattgacaacatggagaatgaaaggatcccatttgacctgatggacaccgtacctgccgagcagctttatgaagctcacctcgagaagcttcgcaacgaaaggaaaagggttgaaatgcgacgggcttttaaggaaaaccttgagacctcgccgttcatcacaccagggaaaccttgggaggaggcgagatccttcattatgaacgaagacttctatcagtggttggaggagagtgtgtacatggacatctacgggaagcatcagaaacagatcatcgataaagcaaaggaagaatttcaggagctgctgctggaatactcggagttgttctatgagctggaactggatgccaaaccatccaaagagaaaatgggagttatccaagatgtgttgggggaggagcagagatttaaagcccttcagaagctccaggccgagagagatgccctgattctaaagcacattcatttcgtttaccatcctacaaaggagacgtgcccgagttgtcccgcttgcgttgatgctaagatcgaacatcttatctcgtcgaggtttattcggccaagcgacaggaaccagaaaaacagcctgtccgaccccaacatcgatcggatcaatctggtgatcttaggcaaggacggcctcgccagagagctggctaatgaaatccgtgcactttgtaccaacgacgacaagtacgtaatagatgggaagatgtatgagctctcacttagaccaatagaagggaatgtacgcctaccagtcaacagcttccagactcctaccttccagccccatggttgcctgtgtctctataattcaaaagaatccttgagttacgtagtcgaatccattgagaagtctcgcgaatcaacattggggcgtcgtgacaatcacctggtgcatctgcccctgaccctgatactagtgaacaagcggggagatacctctggcgagaccctccattcactgatccagcaaggacaacagatcgcctcgaaactgcagtgtgtgttcttggatcctgcaagcgcaggaattggatatgggcgaaacatcaacgagaaacagatctctcaagtcttgaaagggctactggatagtaagcgtaacctgaatctggtctcctccaccgcaagcataaaggacttagccgatgttgatctgagaatcgtcatgtgcctgatgtgcggtgatccttttagtgccgacgatattcttttccctgttctgcaatctcagacctgcaagtcaagtcactgcggatcaaacaacagcgtcctgctggagctgcccattggactccataagaaacgcatcgagctgtccgttctgtcatatcactctagttttagcattcgcaaatcccgcctggttcacggttacattgtcttttattcagccaagcggaaggcctcactcgccatgctccgcgcatttctgtgcgaggtgcaagacattatccctattcagttggtggccctaaccgatggcgcagttgacgtgcttgacaacgacctttccagggaacagctcacggaaggggaggaaattgctcaagaaatcgacggtcgctttacaagcataccatgttcccagccacaacacaagctcgagatcttccaccccttcttcaaagacgtggtggagaagaagaacattatcgaggccacccatatgtatgacaacgcggcagaggcctgcagcaccactgaggaggtcttcaactcccccagggctggatccccgctttgtaactccaacctgcaagacagcgaggaggacattgagccctcctactccttgttcagagaagacacatctctgcctagcctgagtaaggaccactctaaactaagcatggaactcgaaggcaatgatggactgtccttcatcatgtctaacttcgaaagtaaacttaacaataaggttccgcctcctgtaaagcctaagccgcctgtgcattttgaaatcaccaaaggggatcttagctacctcgaccaaggacaccgtgatgggcaacggaagtctgtgtcgtcctctccctggctccctcaggacggtttcgaccctagcgactatgctgaacccatggacgccgtggtaaagccccgaaatgaagaagaaaatatctattctgtgcctcatgattccacccaagggaagataattaccattcgtaacatcaacaaagcacagtcaaacgggtccggcaacggctctgatagcgagatggatacaagtagcctcgaacggggaaggaaggtgtccatcgtttctaagcctgttttatatcgaacccgctgtaccaggttggggaggttcgccagctaccgcacatcattttccgtggggtctgacgacgagttgggcccaattcggaagaaggaagaagatcaagctagccagggctacaaaggcgataatgcagtgatcccgtatgaaacagacgaagatcctaggagacggaacattttacgctcactaagaaggaacaccaagaagcctaagcctaaacctcggcctagcattaccaaggccacatgggaaagcaactacttcggcgtgcctctgacgacagttgtaactccagagaaaccgattcctattttcatagagaggtgcatagaatacattgaggctacgggtctcagcacggaaggtatctaccgagtgagtgggaacaaatcagaaatggaaagcttgcagaggcagttcgaccaggatcataacttagacctggcggaaaaggattttacggtgaacactgtggcgggagctatgaagtcattcttctccgaattgcctgaccctctcgtcccctataacatgcagattgacctggttgaggcacataagatcaacgatagggagcagaaattgcatgcactgaaagaagtcctcaagaagttcccaaaggagaatcacgaggtttttaagtacgtcatcagtcacttgaacaaggtgagccataacaacaaagtgaatctaatgacctctgagaatttgtccatttgtttctggccgacactcatgcggccagacttttccacaatggacgcactgaccgctaccagaacttaccagactataatagagctcttcatccagcagtgcccctttttcttttataaccggccaattacagaaccaccaggcgctcgaccctcttctccttccgccgtggcctcgactgtgccctttctgacctccacccctgtgacatctcagccttctcctccccagtctccacctccaacacctcagtcccctatgcagcctctgctaccatcacctcttcaccctcatcgtcccactccccagccttctaggaacatcccttggcagaccaaagaacactag

SEQ ID NO: 30651 - DNA, 4499 bp, Artificial Sequence
  Description of Artificial Sequence: Synthetic coding sequence
atgatgatggcgcgtaaacaagatgtgcgcatccccacgtacaatattagtgttgtcggactgagcggaaccgagaaggagaagggtcaatgcgggatcgggaaatcctgcctctgtaaccgctttgtgcggccaagcgccgacgagtttcacttagatcatacttccgtcctttctacttccgattttggagggcgagtggtcaataacgaccatttcctctactggggagaggtatctaggagcttagaggattgtgtagaatgcaaaatgcacattgtcgagcagaccgagtttatagatgatcaaacctttcagccgcaccgtagtacagcactgcaaccctatatcaaaagagccgctgcgactaaactagcctctgcagaaaaattgatgtacttctgcacagatcaactaggtctggaacaggactttgagcaaaagcaaatgccggacggcaaactgcttgtcgatggcttcttacttggcatagatgtctctcggggaatgaacagaaattttgacgaccagctgaaatttgtatcgaacctgtacaaccagttagcaaaaaccaagaagcccatcgtcgtcgtacttacgaagtgtgacgaaggcgtcgaacggtatattagagatgcccacacttttgctcttagcaaaaaaaatctgcaagttgtcgaaacctcagcgcgtagcaatgtcaacgtggaccttgcattcagcactctagttcagcttatagacaagagtcgcggaaaaacaaagataatcccgtattttgaggcactgaagcagcagtctcaacagatcgctactgcaaaggataaatacgaatggctcgtgtctagaatcgtgaagaatcataacgagaattggctcagcgtctctagaaagatgcaagcaagccctgagtatcaggactacgtgtacctggaggggactcagaaggcgaaaaagttgtttctccagcatatccaccgacttaaacacgagcacatcgagagacggaggaagctttatctggctgcactgcctctggcttttgaggcactgatcccgaatcttgatgaaatcgatcacctaagctgtattaaagccaagaagctcctggaaaccaagccagagtttctgaagtggttcgtcgtcctggaggagacaccctgggacgcaacatcacacatagataacatggagaacgaacggatccctttcgacttaatggacactgtgcccgctgaacaactctacgaggcgcacctggagaaactgcggaacgagcggaagcgtgtggaaatgcgtcgggcatttaaagaaaacctggagacaagccccttcattacacccggtaagccatgggaggaggctcgctcctttatcatgaatgaggacttctaccaatggctggaggagagtgtttatatggatatttacggcaagcaccagaagcagatcatcgacaaagctaaagaagagttccaagaattactgctggaatattcagaattattttacgagctggagctcgatgctaaaccctcaaaggaaaaaatgggagtgatccaggacgtgctgggggaggaacagcgcttcaaggccctgcagaaactgcaggccgagcgggatgcactgattttgaaacacatccacttcgtgtaccaccctacaaaggaaacgtgcccctcttgcccggcttgcgtcgatgctaaaatagaacaccttattagctcgcggttcatccgcccaagcgatagaaatcagaaaaatagcctaagtgatcctaacatcgatcggatcaacctggtgatcctggggaaagatggtctggctagagagctggcgaatgaaatcagagcactttgcacaaacgacgacaagtacgtcattgacggcaagatgtacgagctgtcactgaggcctattgagggtaacgtgcggctgccagtcaattcttttcagacacccacattccagccccacggatgtctgtgcctgtataacagtaaagagtccctcagttacgtggtggaatcgattgagaaaagtcgggaatctacactgggcaggagggataaccacctagtgcacttgcctttgacactcatcctggtgaacaagaggggcgacaccagtggagagacactgcatagcctcatacagcaaggccaacagatcgcctcaaaactgcaatgcgtatttctggacccagccagcgccggaattgggtatggcaggaacatcaatgagaagcaaatctcgcaggtacttaaaggacttttggactctaaacgaaacctcaatctggtgagctctacagcgtccatcaaagatctcgcagatgtggacttacgcatcgtcatgtgcctgatgtgcggagacccctttagcgcagatgacattctctttcccgtcttacaatcacaaacatgcaagtcttctcattgtggatcgaacaacagtgttctcttggagctgcctatcgggctgcacaaaaaaaggatcgaattatccgtgttgagctaccatagcagtttcagtattcgaaagtcgcggctagtccacggatatatcgttttctactccgccaagcgcaaagcaagtttggctatgttgcgagctttcctgtgcgaggttcaagatattatccctattcagcttgtagccctgacagatggggctgtggacgtgctggacaatgacctgtctcgagagcagctgacagaaggagaagagatcgctcaggagattgatgggcgtttcacttccataccatgttcacagccccagcacaaattagagatctttcaccctttcttcaaggatgtggtcgagaagaaaaacattatagaggcaacccacatgtacgataatgcagcagaagcctgttctaccaccgaggaggtctttaatagccctcgcgcaggatccccactgtgcaatagcaatctgcaggactctgaggaagatattgagccatcctactcccttttcagagaggacacatcgctaccaagtctgtccaaagatcactcaaaactgagcatggagctggaaggtaacgatggactctcctttatcatgtccaatttcgagtcaaagctcaacaataaggtgccgcctcccgtgaagcctaagcctcctgtacacttcgagatcactaagggcgatctgtcctacctagaccagggtcacagagatggccagcggaaatcagtgagctcatcaccgtggctcccacaagacggcttcgatccgtccgattacgccgagccaatggatgccgttgtcaagcctcgcaatgaagaagagaacatttactcggtgccccacgactctacgcagggcaagatcataaccattcgtaatatcaataaggcccaatccaacggatcaggaaatggctctgactctgaaatggatactagcagcctcgagagaggcagaaaggtcagtatcgtctctaaacctgttttgtacagaactcgctgcacaaggttaggaagattcgcctcttatagaaccagctttagtgtggggtctgatgacgagctgggccctatacgtaagaaagaggaagaccaggcctctcagggatacaagggagataatgccgtcataccatatgagacggatgaagatccccgtagacgtaatatcctcagatcactgagaaggaataccaaaaaaccaaagcccaaaccccgtccaagtataacaaaggcaacttgggaaagcaactactttggagtgcccctgactacagtcgttactcccgagaagcccattcctatcttcatcgaacgttgcatagagtatattgaggctacaggactttctacagagggtatatacagggtgtccggtaataaaagtgagatggaatcattgcagagacagtttgatcaagatcacaacttggatctggcggaaaaggacttcactgtgaatacagtggcgggagccatgaagtccttctttagcgaactgccagaccctctagttccatataatatgcagattgacttagtggaggcacacaaaatcaatgatcgtgaacagaaactgcatgcactgaaagaagttttgaaaaaatttccaaaagaaaaccacgaagtgttcaaatacgtcattagccatctaaacaaagtgtcacacaacaacaaggtaaacctgatgacttctgagaacctcagcatatgcttctggccaaccctgatgaggcctgacttcagcacgatggatgccctgactgctacaagaacctatcagaccatcatagagttatttatccagcaatgcccctttttcttttacaatcgtccgatcacggaacctcctggagccagaccttctagtccatccgcggtagcaagcaccgtgccattcctcacctctaccccagtgacatcccagccctcccctccacaaagcccaccaccaacgcctcagtcccctatgcagcctctgctgcctagtcagctgcaggcagaacacactctgta

SEQ ID NO: 30652 - DNA, 2250 bp, Artificial Sequence
  Description of Artificial Sequence: Synthetic coding sequence
atgatgatggcccgtaagcaagacgtgcggattccaacttacaacatttccgtggtcggcctctccggcaccgagaaagaaaaagggcaatgcggcattggcaaaagttgcctgtgcaacagatttgttcggccatcagccgatgagttccacctagaccatacctctgtgctctcgacttcagattttggagggcgtgttgtgaataacgaccatttcctttactggggagaggtgagccgaagcctggaggattgtgttgagtgtaaaatgcacattgtcgagcagacagagtttattgacgatcagacgttccagccacatagatctacagcccttcagccgtacataaaaagagcagcggctaccaagctggcctccgctgaaaagctaatgtacttttgcaccgaccagttaggactcgagcaggactttgaacagaaacagatgcccgatgggaagctgctggttgacgggtttcttcttggaatcgatgtgtcaaggggaatgaacagaaattttgatgatcagctcaaatttgtatccaatctttataaccagctggccaagactaagaaaccaatcgtggtcgtgttgaccaagtgcgacgagggagtggaaagatatattagagatgcccacaccttcgccttgagcaagaagaacttacaggtagtggaaacatccgccaggagcaacgtaaacgtggacctggcctttagcactttggttcagctgattgacaagtccagaggaaagacgaaaattatcccctacttcgaagccctgaaacagcagtctcaacagatagcgacggccaaagataagtacgagtggctggtctcccggatagtgaaaaatcataacgaaaactggctgagtgtgagtagaaaaatgcaggcgtcacccgagtaccaagactatgtgtatctggaaggaactcagaaggcaaaaaaactcttcctgcagcacattcataggctcaagcacgagcacatagagcgcaggcggaaactctacctggctgcactcccacttgcttttgaggccctgatccccaacttggatgagattgaccacctgagttgtatcaaagctaaaaagcttctggagacgaaacccgagtttctcaaatggtttgtggttctggaagagaccccctgggatgccacctcccatatcgacaacatggagaacgaacgcatcccctttgacctcatggatacagttccggctgagcagctttacgaagctcacctcgagaaacttagaaacgagcgcaagcgggtagagatgcggagagctttcaaagagaacctagaaacgtcccccttcatcacaccgggtaagccatgggaggaggcacgaagctttataatgaacgaggatttctatcagtggttagaggagagcgtgtatatggatatttatgggaaacatcagaagcagatcatcgataaagcaaaagaggaatttcaggaattgctgctggaatactccgaactattttacgaattagaactggacgccaagccttcaaaggagaaaatgggagtgatccaggacgtgttgggcgaagagcagagattcaaggccctgcaaaaactgcaggcagagagggacgcactcattttgaagcacattcactttgtgtaccatccaacgaaggaaacatgcccatcctgtcccgcatgcgtagatgctaaaatcgagcaccttatttcaagccgcttcataaggccctccgatcggaatcagaagaacagtctaagcgacccaaacattgacaggatcaacctcgttatcctgggaaaggatggactggctcgggaactcgccaatgagatcagagccttatgtacaaacgacgataagtacgtgattgacggaaagatgtacgagctctctctccggccaatagaaggcaatgttcgccttcctgtaaattcatttcagaccccgacttttcagccacacggttgtctatgtctctataattctaaggagagtttgtcatatgtagtggaatcaatcgagaagagccgcgagtctaccctgggcaggcgcgacaaccatctggtgcatttacctctgaccctgatcctcgttaataagcggggtgacactagcggcgagacccttcattctctgatccagcagggacagcagattgcttcaaaactccagtgcgtctttcttgaccccgcaagcgctggagctgcagacctctcttggttgggtccaatttag

SEQ ID NO: 30653 - DNA, 978 bp, Artificial Sequence
  Description of Artificial Sequence: Synthetic coding sequence
atggatatgtggactgcactgttgatactgcaagcacttcttctcccgagcctggccgacggagctactcctgctctccgcttcgttgccgttggcgattggggcggtgtacccaacgctccctttcacaccgccagagagatggcaaacgcaaaggaaattgcacggaccgttcaaattctgggcgcagactttattttatctttaggcgacaatttctattttaccggtgtgcaagacataaatgataaacgatttcaggagactttcgaggatgttttctctgaccgcagcctgcgaaaagtaccatggtacgtcctcgctggcaaccatgatcacttgggcaacgtatctgcacagatagcctatagcaagatctccaagcggtggaactttcccagtcctttctatcgcctgcattttaaaattccgcagactaatgtttccgtggctatttttatgttagacaccgtgacactctgtggcaatagcgacgacttcctgagccagcaaccagagaggcccagggacgtgaaactggctaggactcagctttcatggctaaaaaaacagctggctgcagctcgggaggattatgtgttagtcgcaggtcattaccccgtgtggtccattgccgagcatgggccaacccattgtctggtcaaacagctccggcctttgttggctacctatggggtcactgcttacctctgcgggcatgaccataatctgcagtatctccaggacgagaacggagttggctatgtcctgtccggcgcaggaaacttcatggatccttctaaaagacaccagagaaaagtgcccaatggatatctgaggttccattatgggacagaagatagcctgggtgggtttgcttacgtagaaatcagttcgaaggaaatgaccgttacctacatcgaggctagtggcaaatccctgtttaagacccggctccctcggcgagcaaggccttag

SEQ ID NO: 30654 - DNA, 2349 bp, Artificial Sequence
  Description of Artificial Sequence: Synthetic coding sequence
atgaactcagccgagcaaaccgtcacttggttgatcacgttgggagttttagagagccccaaaaaaaccatcagcgaccctgaaggttttctgcaggctagtctgaaagatggagtggtgctctgtcggcttctcgagagactcttaccaggcacaatagagaaggtctatccagaaccaagaagcgaatcggagtgcctgagcaacataagggaatttctgcggggatgtggcgcaagcctgcggctcgaaacatttgacgctaacgacctctaccagggacagaacttcaacaaggtgctgtcttccctcgtgactctgaacaaagtgaccgcggatattggcctaggatctgactcagtctgcgcacgcccttcatctcaccgcatcaaatcatttgatagcctgggatcgcagagtctgcacactaggacatccaagctgtttcaaggacagtacagatctcttgatatgaccgataattctaacaaccagttggtggtgcgcgctaagttcaattttcagcagaccaacgaagacgagctctccttctctaagggggacgtgatacatgttacgcgagtggaggaaggcggatggtgggagggcaccttgaacggcagaactggctggttcccaagtaattatgtgcgagaggtcaaagcatcagagaagcctgtctcgccaaaatccggcactttgaagtcaccacctaaggggttcgacactacagcgatcaataagagttactacaacgtcgtgctccaaaatattctggagacagaaaacgaatactctaaggaactgcagacagtgctttccacctatcttcgcccattgcaaactagcgaaaagctaagcagcgctaatatctcatatcttatggggaatcttgaggaaatatgctcctttcagcaaatgcttgtgcagagcctggaggaatgtacaaaacttccggaggcacagcagcgcgtgggcggatgctttctcaaccttatgccccagatgaagaccctgtatctcacatattgcgctaatcacccttcagccgtaaacgtgctgaccgaacattctgaggagctcggagagtttatggaaactaagggagcctcctccccaggcattttagtgttaactacgggtctgtccaaaccctttatgcgcctggacaagtaccctacgctgctaaaggagcttgagcgacatatggaagattaccacaccgacagacaagacattcagaagtcgatggcagccttcaaaaacttatccgctcagtgccaggaggtgcgcaaacgaaaggagctggagctgcaaatccttactgaggccatcaggaattgggagggcgatgacatcaaaactctgggaaacgtaacctatatgtcacaagttctaatacaatgcgccggaagcgaagaaaagaacgaaagatacctgcttttgttcccaaatgtcctgctcatgctgtcagcctctccacgaatgagtggcttcatttatcagggtaaactgccaaccacagggatgacaattacaaagctggaagattccgagaatcaccgaaatgcctttgagatctcaggaagtatgattgagcgaattctggttagctgcaataaccaacaggacctgcaggaatgggtggagcacctgcaaaagcagactaaagtaacttcggtggggaaccctactattaaaccccattcagttcctagtcatacccttccttcacacccagttactccgagtagtaagcacgccgattctaaaccagccccactgacacccgcataccatacactgccccaccccagccaccacggaaccccccatacgacaattaattgggggccactggagccgccaaaaactcctaagccgtggtctctcagttgtctgagaccggcaccccctctgaggccctccgctgctctctgttacaaggaagacctgtcaaaaagcccaaaaaccatgaaaaagctgttgcctaagcggaagcccgaacggaagcccagcgacgaagaatttgcaagccggaagtccacagctgcactggaggaagatgctcaaattctgaaagtgattgaagcctactgcacgtctgcgaagactcggcagactctcaattccacatggcagggtaccgatctcatgcacaaccacgtgctcgcagatgacgaccaaccatctctggactctctgggcaggaggagctccttgagcaggctcgaaccaagcgatctaagcgaggattctgactatgactcaatatggaccgctcactcatatcggatgggtagtacatcccggaagtcgtgttgttcatacataagccatcagaattag

SEQ ID NO: 30655 - DNA, 2196 bp, Artificial Sequence
  Description of Artificial Sequence: Synthetic coding sequence
atgaattccgctgagcagaccgtgacatggcttattacactgggcgtgcttgagagccccaagaagaccatctcggaccccgagggattcctccaagcctcacttaaagacggtgttgtgctgtgccgtctgctagagagactactgcctgggaccattgaaaaggtgtacccagagcctcgctccgaaagtgagtgcttgagcaatattcgtgagttcctgaggggatgtggcgctagcctgcgtctagaagatatgaccgacaactctaacaaccagcttgtcgtccgtgccaaattcaacttccagcagaccaatgaagatgaactctcattctcaaagggcgacgtgattcacgttacaagggtggaagaagggggatggtgggaggggacactcaatggccgtacgggttggtttccaagtaactacgtgcgggaggtgaaagcatcagaaaaacccgtctcccccaagtccgggactctaaagagtcctcccaaaggattcgacacaaccgctatcaataaatcctattataatgttgtcttacaaaacatactcgaaacagagaacgaatacagtaaagagttgcagactgtactctctacctaccttagacccctgcagacaagtgagaagctgagttcagccaacatctcctatctgatggggaatctggaagagatctgttctttccagcagatgctggtccagagcctggaggagtgtaccaaattgcctgaagcccaacaacgtgttggcggttgtttcctgaatttgatgccacagatgaaaacgctgtatctgacgtattgcgctaatcacccaagcgcagttaacgttcttacagagcactcggaagagctgggagagtttatggaaaccaaaggcgcatcctccccgggaatactggtattgacaactggtctgagtaaaccatttatgcgtctggataagtatcctaccctactgaaggaactggagcgacacatggaggactatcatactgaccgtcaggatatccaaaagtccatggctgcgttcaagaacctgtctgctcagtgtcaggaagtgaggaaaagaaaggaactagaactgcaaattttaactgaggctattagaaactgggaaggtgatgacatcaagaccctggggaatgtgacgtacatgtcccaggtgctaatccaatgtgctggaagcgaagaaaagaacgagagatacctcctcctgttccccaatgtactcctgatgctttctgcctctcctagaatgtccgggttcatttaccagggcaagctgccaactacgggcatgactattaccaaactggaggatagtgagaatcacaggaatgccttcgagataagcggaagtatgatagaacgaatattggtctcctgtaataaccagcaggaccttcaggagtgggtcgaacacctgcagaaacagacgaaggtgacgtcagttggaaatcctacaataaagcctcacagcgtgccctcccatacccttccctctcaccctgtgacccccagctcaaagcatgcagactctaagcctgctcccttaacaccagcataccatactctcccccatcccagccaccatggcaccccgcacactacaataaactgggggccattggaaccaccaaaaacacccaagccatggagtctaagttgtctgcggcctgcacctccccttcggccatctgcagccctttgttataaagaagatttatccaagtctcctaagacaatgaagaagctcttgccaaagcgcaagccagagcggaaacccagcgacgaggaattcgccagtagaaagtctactgcggcactggaagaggacgcgcaaattctcaaggttatcgaggcgtactgcacatctgctaagacgaggcaaactctcaacagctcttcccggaaggagtccgcccctcaggtgctgctgcctgaagaagaaaagatcattgtagaggaaaccaaaagcaatgggcagaccgtgattgaagaaaagtcattagtggatactgtgtacgcacttaaagacgaggttcaagaattgaggcaggataacaagaagatgaaaaaaagtctggaggaggaacagagggctaggaaggatctagaaaaattggtaaggaaggtgctcaagaacatgaatgacccggcatgggacgagactaacctgtag

SEQ ID NO: 30656 - DNA, 1878 bp, Artificial Sequence
  Description of Artificial Sequence: Synthetic coding sequence
atgactgacaatagcaataatcaattggttgttcgcgcaaaattcaatttccagcagaccaacgaggacgagctttctttctcaaaaggagacgtaatacacgtcacacgtgtggaggaaggaggatggtgggaaggcacattaaatggtcgcaccggatggttccccagtaactacgtccgagaagtgaaagcctcagagaaacccgttagccccaagagcgggaccctgaagagcccgccaaagggattcgacaccaccgccattaataagagttactataatgtggtgctgcagaatatactggagaccgagaacgaatactccaaagagttacagactgtgctgtccacatacctgcggccacttcagacaagtgagaaactcagctctgccaacatctcttacttgatggggaacctcgaagagatttgttccttccaacagatgctagtgcagtctctggaagaatgtaccaagttgcccgaggcgcaacagcgcgtcggcggttgttttctgaacctgatgcctcaaatgaagaccctgtacctcacctactgcgcgaaccacccctccgccgtaaatgtgctcacagaacactcggaagaacttggcgagttcatggaaacaaagggcgcttcaagtcccggtatcctggtactgactacgggactctccaagccatttatgagactcgataaataccctaccctcctcaaggagctggagcggcacatggaagactaccacaccgaccggcaggacatccagaagtcaatggccgcttttaaaaacctatctgctcagtgtcaggaagtgaggaaaagaaaagagctggaactgcagatattaaccgaggccattagaaattgggagggcgatgatatcaaaactttggggaacgttacctacatgagccaggtgctgatccagtgtgccggaagtgaagagaaaaacgagcggtacctgctattgttccccaatgtgctcctcatgctttcagcttcccctcgcatgagcggcttcatctaccaagggaaactgccaactactggtatgacaatcactaagttagaggatagtgaaaatcaccgaaacgcctttgagatcagcggttcgatgattgaaaggatcctggtttcttgtaataaccagcaagacctccaggagtgggtagagcacctacaaaagcagaccaaggtcaccagcgttgggaatccaaccataaagccccattcggtcccgagtcatacgctcccatcccatccagtgactccctcttctaagcacgccgatagcaagcccgcacccctgacgccagcctatcacactctgccccatccctcgcatcacggcacacctcacactactatcaactggggacccctcgaaccaccaaagacccccaaaccctggtccctgtcatgtctacgtccggcaccacctttgcggcctagtgctgccctgtgttacaaagaagatcttagcaagtcaccaaagaccatgaagaagctgttacctaagcgaaaacctgagcgcaagcctagcgatgaggagtttgctagtagaaagtccacagccgcactggaggaggacgcacagattcttaaggtgatagaggcctattgcacttcggctaagacccgacaaactctcaattctacttggcaggggacggatctgatgcacaatcacgttctggctgatgatgatcaacctagcctagatagcctcggaagacgaagtagcctgtcgcggctcgaacccagcgatctctccgaggacagcgactatgactctatctggactgctcactcatatcggatgggtagtacatcaagaaaaagctgttgttcttatatttctcaccagaattag

SEQ ID NO: 30657 - DNA, 1941 bp, Artificial Sequence
  Description of Artificial Sequence: Synthetic coding sequence
atgacagataattcaaacaatcagctggtggtacgggcaaagttcaacttccaacagaccaatgaggatgagctctccttttccaagggtgacgtcatccacgtgacacgggttgaggagggtggctggtgggaggggacactgaatggaagaactggatggttcccgagtaactatgtgcgcgaagtgaaggcatccgaaaagccagtgagtcccaagtcaggcacacttaagtcccccccaaagggcttcgataccactgcaatcaacaagagttactataacgtggtgctgcagaacattctggagacggaaaacgaatattcaaaagagctgcagactgtgctatctacttacctgcgccctctccaaaccagcgaaaagcttagcagtgccaacatctcctacctgatgggtaacctggaagagatatgctctttccagcagatgctcgtccagagtcttgaggagtgtacgaaactgcctgaggcccaacaacgagttggcggttgtttcttaaatcttatgccacagatgaagacactttatctcacgtactgtgcgaaccacccctccgctgtgaatgtgttgacggagcatagcgaagaactaggagagtttatggagaccaagggcgcatcctccccaggtatactagttctcactacagggcttagcaagccgttcatgagactggacaagtacccaaccctgttgaaagaacttgaaagacatatggaagactaccataccgacagacaggacatacaaaagtccatggctgcattcaagaacctctcagcgcaatgccaggaagtccgtaaacgcaaagagctcgagctccagatcttgactgaggctatcagaaattgggagggggacgatatcaagaccctgggaaacgtgacatacatgtctcaagtccttatacagtgcgcagggtctgaggaaaaaaacgagcgctacttgctcttatttcctaacgtgcttttgatgctgagcgcaagcccacggatgtcaggctttatttaccagggcaagctaccgaccactggaatgaccatcaccaaactcgaggatagcgagaatcacaggaatgccttcgagatcagcggttctatgatcgagcggatcctggtctcctgcaataaccaacaggatctgcaggaatgggtggagcacctgcaaaagcagactaaggtgacatctgttggaaatcccactattaagccacattcagttccttcccacacactgccttctcatcctgtgacaccatctagcaagcatgcggactctaagcctgctcccctcactcccgcttaccacaccctgccccatccctctcatcacgggaccccgcataccactattaattggggcccactggaacctccaaagacccctaagccctggtccctttcttgccttcggcctgccccacctttgcggccatccgctgccctctgctataaagaggacctcagcaagagccctaaaacgatgaagaagctgctgcccaagaggaagccagagcgaaagccctctgacgaggagtttgcgtcacgaaagagcacagccgcactggaggaggatgcacagattctcaaggtcatagaagcatactgcacctccgccaagacgcgccagacgttaaactcttccagtcgcaaggagtctgctcctcaggttctccttccggaagaagagaagattatcgtggaggagactaagagcaacggccaaaccgtaatcgaggaaaagagcctggtggacacggtttatgctttgaaagacgaagtacaagaactaagacaagataacaaaaagatgaagaagtcactcgaagaggagcagagggctaggaaggacctggagaagttggtgcgaaaggtgttgaagaatatgaacgaccctgcctgggacgagaccaatctttag

SEQ ID NO: 30658 - DNA, 2166 bp, Artificial Sequence
  Description of Artificial Sequence: Synthetic coding sequence
atgaaaactttcgatgctaatgatctttaccagggccagaatttcaataaagtgctgtcaagtttagtcacactcaacaaagttacagcagatatcggcctgggtagcgactcggtgtgtgctcgcccaagtagtcacagaattaagtcattcgattctctgggttctcagtcactccacacccgcacaagtaagctcttccagggtcagtatcgcagcctggacatgactgataattccaacaaccaactggttgtgcgggcaaagtttaactttcaacaaacgaatgaggacgagctatccttttccaaaggggacgtaattcacgtgactcgtgtcgaggagggcggatggtgggagggcactctaaatgggaggactgggtggttccctagcaactacgttagggaagtcaaagctagtgaaaaacctgtctccccgaagtccggtacactgaagtctcccccaaagggctttgatactaccgccatcaacaaatcttattacaacgtcgtgttgcaaaacatcctggagaccgaaaacgaatacagtaaggaactgcagacagtgctcagcacctatctccgcccattacagaccagcgaaaagctgtcctccgcaaacatcagctaccttatgggcaatctggaggagatctgcagctttcagcagatgctggttcaatccttggaggagtgcacgaaactgcctgaggcccagcagcgagtgggaggctgctttctgaatttgatgcctcagatgaaaacactgtacctgacctattgtgcaaaccacccgtctgcggttaacgtcttaactgagcactccgaggagttgggcgagtttatggagacaaagggagcgagctctcctgggatcctggtcctgacaacaggcctatcgaaacctttcatgcgcctcgacaaatatcccactctgttgaaggagctcgagaggcacatggaagactaccacactgatagacaggacattcaaaaatcaatggcagcattcaagaatctgtctgcccagtgtcaagaagtaaggaagagaaaagaactagaattacagatactgaccgaggcaattcgcaactgggagggcgatgacatcaaaactctaggtaatgtgacatacatgtcacaggtgttgatacaatgcgctggcagtgaggagaagaacgagaggtatctgctgctgttccctaacgtgctgctgatgctgagcgccagcccaaggatgtccgggtttatataccagggtaaattgcccacaacagggatgaccatcacaaagttggaggattccgagaaccaccggaatgcgttcgaaatttcgggatccatgattgagaggatactcgtgtcatgtaacaaccagcaggacctgcaggagtgggtggagcatctccagaagcagaccaaggtgacgagcgtgggcaatcccaccattaagcctcattcggtaccatcccacaccttgccatcacacccagtgactccatcatcaaagcacgccgacagcaagcccgcacccctcaccccagcataccacactctgccgcatccctcccaccacggaacgccacatactactattaactggggccctcttgaaccccctaagacccccaagccttggtccctttcttgcttgcgaccagctccgcctctgagaccttccgccgcactgtgctataaggaagatttaagtaaatctccaaaaaccatgaaaaagcttctgcctaagcggaagccagagcgtaaaccttccgatgaggagttcgccagtagaaagtcaacagcagcactggaagaagatgcccaaatactgaaggtgattgaagcatattgtaccagtgccaaaacacgtcagactctgaactccagctcccggaaagaaagcgcccctcaggtgctgctccctgaagaagaaaagataatagtagaggagacaaaaagtaacggtcaaacagtgatcgaggagaagtctctggtcgatactgtctatgccctgaaggatgaggtccaggagttgcgccaagataacaagaagatgaagaagagcctggaagaggaacaaagggccaggaaggatctcgaaaagctagtgcgtaaggttctcaaaaatatgaatgatcccgcttgggacgagacaaatctctag

SEQ ID NO: 30659 - DNA, 2262 bp, Artificial Sequence
  Description of Artificial Sequence: Synthetic coding sequence
atgaacagcgccgagcagaccgtcacatggctgattaccctgggcgtgttagagtcacctaagaaaactatttcagaccctgagggatttctgcaagctagtctgaaggatggtgtggtgctttgccgactgctggagcgactcctgcctggtaccattgagaaaactttcgatgcgaacgacctttaccaggggcagaattttaacaaagtgttatcttcattagtgacactgaacaaggtaaccgctgacataggattgggctcagatagtgtgtgcgccaggccatcatcgcaccggataaagagttttgatagcttgggctctcagtccttgcatacccgcacctccaaactatttcagggacagtatcgctctctggatatgaccgacaattcgaacaatcaactcgtggtcagagccaagttcaattttcaacaaaccaatgaggacgaactctctttcagtaagggagacgttattcacgtcacgcgcgtagaggaaggcggatggtgggagggaaccctgaatggaagaacgggatggttcccaagcaattatgtgcgcgaggtgaaggctagtgagaaaccagtttcaccaaagtcaggcaccctcaagagccccccaaaagggttcgataccacggccattaacaaaagctattacaacgtggtgctccaaaacatcctggagacagagaatgagtacagcaaagagcttcagactgtgttatctacttacctgagaccactgcagacatctgagaaactgagtagcgcaaacatatcttacctgatggggaacctagaagaaatttgcagtttccaacagatgcttgtacaatctctcgaggaatgtaccaaactgccggaggcccaacaaagggtaggtgggtgttttcttaaccttatgccacagatgaagactctctacctcacttactgcgctaaccacccatcagctgtcaatgtcctgactgaacactctgaggaactgggtgagttcatggaaacaaagggagcctcaagtccaggaatcctggtgctcacaactggcctctccaagccttttatgaggctggacaagtaccctacactactgaaagagttggaacgccacatggaggactatcacacagataggcaggatatccagaaatctatggctgccttcaaaaatcttagtgcacagtgccaagaggttcggaagaggaaagagctggagctgcagatcctgaccgaagccataagaaactgggagggggacgacatcaaaaccctgggcaatgtgacttacatgtcccaggtgctgattcagtgcgccggtagtgaggagaagaatgagagatacctgttgttgtttcccaatgtcctgctgatgctttccgcgtccccacggatgagcggtttcatataccaggggaagcttccaacgacagggatgactatcaccaagttggaggacagcgaaaaccaccgcaatgccttcgagatctctggaagtatgatcgagaggattctggtttcctgtaataaccaacaggatctccaggaatgggtggaacacctccagaaacagacgaaggtgacaagcgtgggcaaccccactattaaaccacacagcgtaccttcccatactttaccatcgcacccagtgaccccatcttctaaacacgccgattccaagcccgctcctctgacacccgcttatcatactttgccccacccttctcaccacggcacgccgcacaccaccatcaactggggacccctcgagccccctaagactccaaagccttggtccctgagctgtctgaggcccgctccccctctacgcccatcggcagccctctgttacaaagaggacctgagcaagtcacctaaaactatgaagaagttgctccctaagcgcaaacctgagagaaagccgagcgacgaagaattcgctagccggaaaagcactgccgctctcgaggaagacgcgcagatcctgaaagtcatagaggcttattgtactagcgctaaaacaagacagacactgaatagcacatggcagggcacagatctgatgcataatcatgtgctggctgacgacgaccaacccagtctggatagcctggggaggagaagttctttaagtcggctcgagccatcggacttgtctgaagattcagactatgattccatttggactgcccacagctaccgaatggggtcgacttcccgcaagtcatgctgctcttacatctctcatcagaattag

SEQ ID NO: 30660 - DNA, 2412 bp, Artificial Sequence
  Description of Artificial Sequence: Synthetic coding sequence
atgaattccgccgagcagaccgtgacctggctaattacgctcggagtcctagaatccccaaagaaaactatcagcgaccccgaaggtttcctgcaggccagcctcaaagatggggtcgtattatgcagattgcttgagagactgctccccggtaccattgagaaggtctatccggaaccaaggagcgagagtgaatgtctgtctaacatccgcgaatttctcaggggctgtggagcatcactgaggctggagctgctattccctccttctcagcccccacagcacttggttaccaccatactgctgagtgcgagtacattcgacgccaacgacctctatcaaggacagaactttaacaaagttcttagttccctcgtgacacttaacaaggtgactgctgacataggcctgggttccgattctgtgtgcgccagacccagcagtcatagaatcaagtcgttcgacagcctaggatcgcagtccctccacacacggacaagtaagctcttccagggacaatacaggagcctcgacatgacagacaactcaaataatcagctcgtggtgagggcgaagtttaattttcaacagacgaatgaggacgaactttccttctctaagggggatgtcattcacgtcacacgagtcgaagagggaggttggtgggaaggaacgctcaatggaagaaccggctggttcccatccaattatgtccgagaggttaaggcaagtgagaaaccagtaagccccaaaagtgggacactcaagtctccacctaagggattcgacaccactgctataaataaaagctactataatgtcgtgctccagaacattcttgagactgagaacgagtacagcaaggaactacagactgtgctatcgacctatttacgcccattgcagacgtcagagaaattgagcagtgcgaacataagctacctcatgggaaacctggaggaaatctgttcttttcagcagatgctcgttcagtctctggaggagtgcacaaaattgcccgaagctcagcagagagtgggagggtgtttcctgaacctgatgccgcagatgaagaccctgtacttaacgtattgcgccaaccatccctctgccgtgaatgtgctgacagaacacagtgaggagttgggcgagtttatggagactaaaggcgcaagtagccccggaatactggtactcaccaccgggctttctaagccattcatgagactcgataagtatcctaccctcctgaaggagctggaacgccatatggaagactaccatactgatcgacaggacatccagaagtcaatggcggcttttaagaacctaagcgctcaatgtcaggaggtccggaaacgaaaggaactggagctccaaatcctgacagaggccatcaggaactgggaaggcgacgacattaagacactgggaaacgtgacttatatgtcgcaggtgttgatccaatgcgccggatctgaggagaaaaatgaacggtacttactgcttttcccaaatgtgctgctgatgctctctgcatctccacggatgtcaggtttcatatatcagggcaaacttcctacaaccggaatgaccattaccaagttggaagatagcgaaaaccatcggaacgcgttcgaaatatccggttccatgattgagcgaattttagtgagctgtaataaccagcaggatctccaggaatgggtggaacatctacaaaaacagaccaaagtgaccagtgtcgggaatccaacaatcaaaccacattctgtgccgtctcataccctgccatcccacccggtgacaccaagtagtaagcacgctgatagtaagccagcacctctcactcctgcttaccatacattaccgcaccctagccaccacgggacacctcacaccacaataaattggggacccctggagcctcctaaaactccaaaaccatggtcactgtcttgcttaaggcccgctccccctttacgaccaagtgccgcactatgttataaggaagacttatctaagagccccaagacgatgaaaaaacttctgccaaagcgcaaaccggaacgtaagcctagcgacgaagagttcgcctcccggaagagtaccgcagcattggaggaagatgctcagattttaaaggtcatagaggcatactgcacctccgcaaagacccgccaaacgttgaattctacttggcagggtacggacctgatgcataatcatgttctggccgacgacgaccagcctagtctggacagtctcggcagaagatcctctctatctagacttgagccttccgacctgtcagaagattctgactacgattctatttggactgcacacagttacaggatggggagcacaagtaggaaaagctgctgcagttatattagccaccaaaattag

SEQ ID NO: 30661 - DNA, 1941 bp, Artificial Sequence
  Description of Artificial Sequence: Synthetic coding sequence
atgactgacaattcgaataaccaactggtggtcagagccaagttcaactttcagcagacaaatgaggatgaactgtctttcagtaagggcgacgtgatccacgttacaagagtcgaggagggcggttggtgggaggggaccttgaacggcaggaccgggtggtttccttctaattatgtccgagaagtcaaggcctccgagaaaccagtaagccctaagtccggtactctcaaatctcctcccaaggggtttgacaccacagcgatcaataagagttattacaacgtggtgcttcagaacatactcgagacggagaacgagtatagtaaggaattacaaacggtcctgtctacgtacctccgccctctgcagacaagcgaaaaactcagctctgctaacatcagctaccttatgggtaatttggaggagatctgttcattccaacagatgttggttcaatctctggaagagtgtactaagctgcctgaggcgcagcaacgagttggcggatgcttcctgaacctgatgcctcaaatgaaaacactgtatctgacctactgcgccaatcacccttcagccgtgaacgtgctcactgaacattccgaagaactcggggagtttatggagactaaaggcgcttcttctcctggtatcctagttctgacaacgggcctctctaagcccttcatgaggttggacaaataccccactcttttgaaggaactggagcgccacatggaggattatcacacagacaggcaagatatacagaaaagcatggccgcattcaagaatctgagtgcacaatgtcaggaggtcagaaagcgcaaagagcttgagctgcagatcttgaccgaagctattaggaactgggaaggtgatgatataaagacactcgggaacgtgacttatatgtcgcaggttcttattcaatgcgcgggatccgaggaaaagaatgagcggtaccttcttctttttcccaacgtgctcctaatgctgtctgcatcccctcgcatgtccgggtttatataccagggtaaacttcccactaccggcatgacaatcacgaaactggaagattctgagaatcatagaaacgcttttgagatcagcgggtccatgatcgagaggatactagtctcttgcaataaccaacaggatcttcaagaatgggtggagcatctgcaaaaacagacaaaggtgacatcggtcggcaacccaaccatcaagccccacagcgtgccttctcataccctaccctctcacccggtgaccccgtcaagcaaacacgccgattctaagcccgcaccactgacccctgcttaccacactttgccacacccttcccaccatggcacaccacatactacgattaattggggccctcttgaaccgccaaaaaccccaaaaccatggtctttgtcgtgcctcaggcctgcgcctcccctcaggccttctgcagccctctgctacaaggaggatctgagcaagtctccgaagaccatgaagaagctgctcccaaaaaggaagcctgagcgaaagccgagtgacgaggaatttgcttctagaaaatctaccgcagctctcgaggaggacgcccaaatcctcaaggtgatcgaggcttattgtacctccgcaaagacgcgacagacactgaattcatccagccggaaagagtcagctccacaggtcctgctgccagaagaggagaaaattatcgtggaagagacaaaatcaaatgggcagactgtcatagaagagaagtcacttgtggatactgtctacgccctgaaggacgaggtgcaggaactgcgccaagacaataagaagatgaagaaatcacttgaggaggagcagcgagcgagaaaagatcttgaaaaactggtgcgcaaagtgctgaagaacatgaatgaccccgcttgggacgagaccaatttatag

SEQ ID NO: 30662 - DNA, 201 bp, Artificial Sequence
  Description of Artificial Sequence: Synthetic coding sequence
atgactgacaatagcaacaatcagctggtcgtgagggcgaagttcaacttccaacagactaacgaagacgagctctcattttccaaaggcgatgttattcatgtcacaagagtcgaggaagggggttggtgggaaggaacgctgaacgggaggaccgggtggtttccaagcaattatgtacgggaggtgaaggcatcatag

SEQ ID NO: 30663 - DNA, 1344 bp, Artificial Sequence
  Description of Artificial Sequence: Synthetic coding sequence
atgacagataacagcaacaaccagctggtcgtgcgcgcaaaattcaattttcaacaaactaacgaggatgagctgagcttcagcaaaggggacgttattcatgtcaccagagtcgaagaaggaggctggtgggaaggaaccctgaatggccgaaccggctggttcccaagcaactatgtgagagaggttaaagccagcgagaagcccgtgtcacccaaaagcggtacccttaagtccccgcctaaagggtttgacacgaccgccattaacaagtcatactacaacgtggtgctgcagaacattctggagactgagaatgagtactcaaaggagctgcagacagtactaagcacatacttaagaccgctccagacgagcgagaagcttagtagcgccaacatttcttacctgatggggaacctcgaggagatttgcagcttccagcagatgctggtgcagtccttagaggaatgtaccaagctgccagaggcccagcaaagggtgggaggatgctttctgaatctcatgccacagatgaaaactctctatctgacatactgcgccaatcatccgtcagccgtgaatgtgctcaccgaacatagtgaggagctgggcgaattcatggagactaaaggcgcatccagcccaggcattctggtcctcacaacaggtttgagcaagccatttatgaggcttgacaagtatccgactttgctcaaggaactggaacgccacatggaggattatcataccgataggcaagatatccagaaatcaatggccgctttcaagaaccttagcgcacagtgccaggaagtccgcaagaggaaagagttagaactccagattctgaccgaggcaattcggaattgggaaggcgatgacataaaaaccctcggcaatgtaacttacatgagccaagtgcttattcagtgcgccggtagtgaggagaaaaatgagcggtacctcctactatttcctaatgtcttgttaatgctgtccgcttctcccaggatgagtggctttatctaccagggtaagttgccaaccaccggaatgactattacgaagctggaagatagcgaaaaccatcgcaatgcatttgagataagcgggtctatgatagagaggattctagtctcatgcaataatcaacaagatctgcaagagtgggtggagcaccttcagaaacaaacaaaggtgacctcagtcggcaaccctacgattaaaccacactcagttccttcacacactctgcccagccatcctgtgaccccctcatcaaaacatgccgacagtaaacctgcaccattgactcctgcgtaccatacgctgccccactag

SEQ ID NO: 30664 - DNA, 186 bp, Artificial Sequence
  Description of Artificial Sequence: Synthetic coding sequence
atgacggacaactctaacaatcagcttgttgtgagggctaagtttaacttccagcagactaacgaggatgagctttccttctctaagggagacgtaatccacgtgacaagagtggaggaaggcggatggtgggagggtacacttaacggtaggactggttggtttccaagtaattatgtgagatag

SEQ ID NO: 30665 - DNA, 120 bp, Artificial Sequence
  Description of Artificial Sequence: Synthetic coding sequence
atgactgacaattccaacaatcagctagtggttagagctaaattcaacttccaacagactaacgaagatgaactgtccttctctaagggagatgtaattcatgtgaccagggttgaatag

SEQ ID NO: 30666 - DNA, 546 bp, Artificial Sequence
  Description of Artificial Sequence: Synthetic coding sequence
atgtgcttccctagatcgtcagttaccactgacgatcatcagctggatggtataaaaagcacaagggcaccagcccctggatgttgctgctgtccttccgagaccttgagaagcggagaagtggctcgatcttctgctgagtcccggagattactattcaaaccagatgccacggacgagaacccagtgcctcatgtactatgtcagtctcccttctgcagcgaatgcccccatggcacccaggactatcacacggataggcaagatatacagaagagcatggcagcctttaagaacctctcagcccagtgccaggaagtgagaaaaagaaaggaacttgagttgcaaatcctaaccgaggccattcgaaactgggagggcgacgatataaagactctaggaaacgtgacctatatgtcgcaagtactcatccagtgtgcgggatcagaggagaaaaatgaacggtacttgctgctctttccaaacgttctgctgatgctcagtgcatctccacgcatgagcgggttcatctatcaaggggcttag

SEQ ID NO: 30667 - DNA, 2070 bp, Artificial Sequence
  Description of Artificial Sequence: Synthetic coding sequence
atacccccatcaaaaccactcaggggatcctcgctgtggggttgctggagcagaccaaaaacaatatcagatcccgaaggcttcttgcaggccagtctgaaagatggtgtcgtcctttgtagattgctggaaaggctcctgcccggaaccatcgagaaggtctaccctgagcctcggtcggagagcgaatgcctcagtaacatacgcgagtttctccggggatgcggtgcctccctgaggttggagaccttcgacgctaacgacctgtaccaaggccaaaattttaataaagtgctctctagcttggttaccctcaacaaggttactgccgatattggtttggggagtgattccgtgtgcgcacgcccttcttcacacaggatcaaaagcttcgattctctaggatcccaatccttgcacacccggacatcaaagttgttccaggggcagtataggtcacttgatatgacggacaatagcaataaccagctcgtcgtgcgggcaaaatttaactttcagcagacgaacgaagatgagctgtccttcagtaaaggagatgtgatccacgtaactcgcgtcgaggagggcggatggtgggagggaaccctgaatggaaggacaggctggttcccatctaattatgtgcgggaagtaaaggcttcagagaagccagtctctccaaagtcgggaaccttgaagagccctcctaaaggttttgacaccactgcgattaataaatcatactataacgtggtgctgcagaacattttggagaccgagaatgagtatagcaaggagctccagactgtcctctcaacttacttgaggccattacagacaagcgagaagctcagtagcgcaaacattagctatcttatggggaatctcgaggaaatttgctcctttcaacagatgcttgtccagagcctggaggagtgtaccaagctgccagaggcacagcagcgcgtcggaggttgcttcctcaatctgatgccccagatgaagactctataccttacatattgcgcgaatcatccttctgccgtaaatgtactgacagagcactccgaggaattaggcgaatttatggagaccaaaggggctagctcccccggtatcctggtactgaccactggcctctctaagccctttatgagactagataagtaccccactctgctcaaagagctggaacgacatatggaggattaccataccgaccgacaggatatccagaaatcaatggccgcattcaaaaacctatctgcccagtgtcaggaggtacgcaagcgaaaagaactcgaactgcagatcttgaccgaggccattcgaaattgggaaggtgatgacataaaaactctgggtaacgtcacatatatgtcgcaggtcttgatccagtgtgccggaagtgaggaaaagaacgagcggtatctactgctgtttcccaacgtcttactcatgcttagcgccagccctcgcatgtctgggtttatctatcagggaaaattgcctaccacagggatgaccatcacaaagcttgaagactccgagaatcacagaaatgcctttgagatatctggatctatgatcgagcgcatattggttagctgcaataaccagcaagatctgcaggagtgggtggagcacttgcaaaaacagaccaaggtgacgtctgtcggcaatcctaccatcaagccacactctgttcccagccacaccctgcccagccaccccgtgacaccgtcttctaagcatgctgactccaagcctgcacccctcacccccgcataccacactttgccacacccatcccaccacggaactccccacacaaccatcaattggggcccattggaaccccctaagactcccaagccctggagtctgagctgccttcgtccagcccctcctctgcggcctagtgccgcattgtgttataaggaggatttatccaaaagccccaagacaatgaagaaactcctgcccaaaaggaaacccgagcgcaagcccatgaggtcttcccggcctgggaaagcccaattgctgtggaaaaaaatgcttagattctag

SEQ ID NO: 30668 - DNA, 4065 bp, Artificial Sequence
  Description of Artificial Sequence: Synthetic coding sequence
atgagcactggagatagtttcgagaccaggttcgagaagatggataacttgctccgcgacccaaagagcgaggtgaatagtgattgtctccttgatggactcgacgcgctggtgtatgatctggatttccctgctcttaggaagaataagaacattgacaattttctatctcgatataaagacactatcaacaagatccgcgacctgcggatgaaagctgaggattacgaagtcgttaaagtcatcgggaggggcgcttttggcgaggtacaattagtaagacacaagagcactcgcaaggtgtatgcaatgaagttgctctcaaaatttgaaatgatcaagcggtccgactcagccttcttttgggaagagcgcgacatcatggccttcgcaaatagcccgtgggtagttcagttgttctacgccttccaggatgaccgctacctgtacatggttatggagtatatgcccggtggggacctggtgaatctgatgagtaactatgacgtcccagagaaatgggcgcgattttacaccgccgaggtggttctggcactggacgccatccattctatgggcttcattcatagagatgtgaagcctgacaatatgctgcttgataagtcagggcacctcaagctggccgactttggcacgtgcatgaaaatgaacaaggaagggatggttagatgcgatacagccgtcgggacacccgactacatttctcctgaggtgttgaagagccagggcggagacggatattatggaagagaatgcgattggtggagcgtgggcgtcttcctgtacgaaatgcttgtgggcgatacccccttctacgcagattccctggtaggcacatacagcaaaatcatgaaccacaagaactccttaacctttcccgacgacaatgatatttctaaggaggccaaaaaccttatttgtgcttttttgactgatcgagaagtgcgactaggccgtaatggggtagaagagattaagaggcatctgttctttaaaaatgatcaatgggcctgggaaaccttgagggacacggtggccccagtagtgcctgatttatcaagtgacattgacacttccaactttgatgatttagaggaggataaaggagaagaggagacttttcccatccccaaggcgttcgtcggtaaccagctaccatttgtgggcttcacctactatagcaatcgccgatatctgtcttcagctaatccaaatgataaccggacaagctccaacgctgacaagtcactccaggaatcactccagaagaccatctacaaattggaggagcagctgcacaatgagatgcagctcaaggacgagatggagcagaagtgtagaactagcaacatcaagctggacaaaattatgaaggagctggacgaagaagggaatcagcgcaggaatttggaatctacggtgtcccagatagaaaaggagaagatgcttcttcaacaccgcatcaacgagtatcagagaaaagctgagcaggagaatgagaagcgcaggaatgtcgagaacgaggtcagcacacttaaggatcagctagaggatctgaagaaggtttcgcagaattcacagctggcaaacgagaagctctctcagctgcaaaagcaattggaagaagcaaatgacttgctgagaaccgagagcgacacagctgttcgtctgcggaagtcgcacactgagatgagtaagtctatcagtcaactggagtcccttaatagggagctgcaggagaggaatcggattctcgagaactcaaagtctcagacagacaaggattactaccaactgcaggcgatcttagaggcagagaggcgggaccgagggcacgacagcgagatgatcggggatctgcaggctcgcattacatccttgcaggaagaagtgaagcaccttaaacacaacctcgagaaagtcgaaggcgagagaaaagaggcacaggacatgcttaatcactcagaaaaggagaaaaacaacctggagatcgacttgaactacaagttgaagagcctgcagcagaggctggaacaggaagttaatgaacacaaggttaccaaggctaggttgactgacaagcaccaaagtatagaagaagctaagtctgtggcaatgtgcgagatggaaaagaaactcaaagaggaaagagaggccagagagaaagctgagaaccgcgtcgtgcagatcgagaagcagtgtagtatgctggacgtggatttaaagcagagccaacaaaagttggagcaccttacaggaaataaggaacgcatggaggacgaggtcaagaacttgacccttcaactggagcaagaatcaaacaaacggctgctcctccaaaacgagcttaagacccaggcgttcgaagctgataatctgaagggtcttgagaagcagatgaagcaggagatcaacacactgttagaagccaagcgtctcctggagtttgagctggcgcagttaacgaagcagtacaggggcaatgagggccaaatgcgcgagttacaggatcaactggaggccgaacagtatttctccacgctctacaaaacccaggttaaggagttgaaagaggagatagaagagaaaaacagggagaatctgaaaaagatacaagaactgcaaaatgaaaaggaaactttggcaactcagctcgatctggccgagaccaaagccgaatcagaacagctggcccgaggccttctcgaggaacagtactttgagctcacccaggagagcaagaaggccgcatcccggaatagacaagagataaccgacaaggatcacacagtgagccggctggaagaggcaaactcaatgttaacaaaagacattgagatcctgcgacgagaaaacgaggaactcaccgagaaaatgaaaaaagcagaagaggagtacaagctggagaaggaagaggaaatctcaaaccttaaagccgctttcgagaagaacattaataccgagagaacgttgaagacccaagcggtgaacaaactggccgagattatgaaccgaaaagattttaagatcgacaggaaaaaagccaacacacaggacttgagaaagaaggaaaaggagaatcgaaagctgcagctggagcttaatcaggagagggagaagtttaaccagatggttgtgaaacatcagaaagaactgaacgatatgcaggcccagttggtggaggaatgcgcccatagaaacgagctgcagatgcagctcgcttccaaagagagtgacatagagcaactcagagcgaaacttcttgatctgtcagattctacctctgtcgcctcttttcccagtgccgacgaaaccgatggtaacctgcccgagtcccgcatcgaaggatggctatctgtgcccaatagagggaacatcaaaagatatggttggaaaaagcaatacgtggtcgtgtcttccaaaaagatcttgttttataatgacgaacaggacaaggaacagtcaaatcctagcatggtcctagatatagataagctgttccacgtcagaccagtgacacagggtgatgtgtaccgcgctgagactgaggagatcccaaagattttccagatcctgtacgcgaacgaaggcgagtgcagaaaggacgtggagatggagccagtccagcaagcagagaaaacaaattttcagaaccataaaggacatgagtttataccgacactttatcactttcctgcaaattgcgatgcttgtgccaagcccctttggcatgtgtttaagcctcctcccgcattggagtgccgcagatgccacgtcaaatgtcatcgggatcacctagacaaaaaggaagacttgatctgtccctgtaaggtgtcatatgacgtgacttctgctagggacatgctgctccttgcttgctcccaggacgagcagaaaaagtgggtgacccaccttgtgaagaagattccaaaaaatcccccatcagggtttgtccgcgcttctcctcgcacactgagcacacgctcaaccgcaaatcagtcgttcaggaaggtcgttaagaatacctctgggaagacctcatag

SEQ ID NO: 30669 - DNA, 471 bp, Artificial Sequence
  Description of Artificial Sequence: Synthetic coding sequence
atggctccggcacgcgcaggcttttgcccgttgcttctgttgcttctcctgggcctctgggtggccgaaatacctgtgtcggcaaaacctaagggcatgacctcttcccagtggttcaagatacagcatatgcagccgtctccccaggcttgtaattcagcaatgaagaatattaacaaacacacaaaaaggtgcaaggacttgaatacttttctccacgaaccattctctagtgttgcggctacttgtcagacacccaaaatcgcttgtaaaaatggagataagaactgtcatcagtcgcatggtgccgtgagcctcacaatgtgcaagttgacctcaggcaagcatccgaactgcagatacaaagagaagcgacagaacaagtcttatgtggttgcgtgcaagcctcctcagaaaaaagattctcagcagttccatctagttcctgtgcatcttgatagagtcctatag

SEQ ID NO: 30670 - DNA, 471 bp, Artificial Sequence
  Description of Artificial Sequence: Synthetic coding sequence
atggccccagccagagctgggttctgccccctgttgctgttgttgctgctagggttgtgggtagccgagatccctgtgtctgctaaaccaaaaggcatgacttctagccagtggttcaagatccagcacatgcagcccagccctcaggcttgtaattccgctatgaagaatataaataagcatacaaagcggtgcaaagacctgaataccttcctgcacgaaccattttcgagtgtcgccgcaacttgtcagacccctaagatcgcctgcaagaatggggacaagaattgccaccaatctcacggtgctgtgtcactcaccatgtgcaagctgaccagcggtaaacaccccaactgtcggtataaggagaagagacaaaataaatcgtacgtcgtggcctgcaagcccccacaaaaaaaggattcccaacagtttcatctcgtccccgtgcatctggatcgagtcctgtag

SEQ ID NO: 30671 - DNA, 831 bp, Artificial Sequence
  Description of Artificial Sequence: Synthetic coding sequence
atgttgcagcaagactctaatgacgatacggaggacgtgtctttgtttgacgcggaggaagaaaccacaaatcggcctcggaaggccaaaataaggcatcccgtggcatctttttttcacctattctttagggtgagtgctataatcgtctgcctgctctgtgaattgcttagctcctcatttattacttgcatggttacgattatattgttgctatcctgcgacttctgggccgtgaaaaacgtaactgggaggctgatggtcggcctgcggtggtggaaccacatcgacgaggatggtaagagtcactgggtgtttgaatcacgcaaagagtcctcccaggagaataaaaccgtgtctgaagctgaaagccgcatcttctggctcggactgattgcctgttctgttctgtgggtcatctttgctttctctgcactattttccttcaccgtcaaatggctgaggaggtcccgccacattgctcagaccggactcaaagtgcttggttcccgagacccccctgctagcgcttttcagagtgccggaataactggcgtgagtagatgtcctggacacccgtcacgcaagttccaccaggttgacatcaattctttcacgcggatcacggatagagcactttattggaaaccagctccacggttatcatctccaccgctacgggctgctcctggtaactgtcagcagatggcaccagccagactcttcctgtcattgcggctctgggcttggagaggcggaggagagtcaccaaactccagggggactggtgagcccggaccaaaattccacctggccagtggcatgcattag

SEQ ID NO: 30672 - DNA, 1419 bp, Artificial Sequence
  Description of Artificial Sequence: Synthetic coding sequence
atggaccacggcggagtgggcccttacgagctaggtatggagcactgtgagaaatttgagatttcagaaacatctgtaaacagagggccagagaaaatccggcctgaatgcttcgagctgctccgggtgctgggcaagggaggctatggcaaagtcttccaggtccgcaaggttacaggggctaatacggggaaaatctttgccatgaaagtgctgaagaaagccatgattgtgcgcaatgccaaggatactgcacataccaaggctgagcggaacattctggaggaggtcaaacatcctttcatagtggacctgatttatgcgtttcagaccggcggaaaactttatctaatcctcgagtatctatctggcggtgagctcttcatgcagctggagagagaaggtatatttatggaagacaccgcctgtttctacctcgccgaaatttctatggccttaggacatctgcaccagaagggcatcatttatcgggatttgaagcctgagaatataatgctcaatcatcaggggcacgttaagctgacagactttggactgtgcaaggagtccatccatgatggaacagtgacacacacattttgcgggaccatcgagtacatggcccctgagattttgatgcggtcaggccataatagagctgtcgactggtggagtctgggcgcactcatgtatgacatgctcactggcgctcctccctttaccggcgagaataggaaaaaaaccattgacaaaattctgaaatgcaagttaaacctgcctccctatctcacacaagaggcgagagatttgcttaagaagcttttgaagcgtaatgccgctagccgactcggtgctgggcctggcgatgcaggagaggtccaagctcaccctttcttccggcatatcaactgggaggaactcttggcccgtaaagtcgagccaccttttaaaccgctgctccagtccgaagaagatgtgtcccaattcgactccaagtttaccaggcagacaccagtggattccccagacgactcgactctctcagagagcgctaatcaggtttttctgggtttcacctacgtcgcaccctccgtcttagaatccgtgaaggagaagttctcatttgagcctaaaattcggtctcccaggcggtttattggctcacccagaacgcccgtgtctcctgtaaagttctctccgggagacttttggggccgaggagccagtgctagtacggccaatccacagacccctgtggagtatccgatggaaaccagcggcattgagcagatggacgtgacaatgagcggtgaagcaagtgccccattgccaatacgccagcctaattctggaccttacaagaagcaggcctttcctatgatatcaaagagaccagaacatctgcgcatgaacttatag

SEQ ID NO: 30673 - DNA, 1356 bp, Artificial Sequence
  Description of Artificial Sequence: Synthetic coding sequence
atgcgtcggagaaggcgccgagatgggttttatccggctccggactttagagacagggaggccgaagatatggctggcgtattcgacatcgatctagaccagccagaggacgccggatccgaggacgagctggaggaaggaggccagctgaatgagtcaatggaccacggtggcgttggaccctacgagctgggcatggagcactgcgaaaagtttgaaatctcggagacaagcgtgaaccgcggaccagagaaaattaggcccgagtgctttgaactcctaagggtgctgggcaagggaggctatggcaaggtttttcaggtgaggaaagtaactggggctaacactgggaagatcttcgccatgaaggtgctgaaaaaagcaatgattgtgcggaatgcaaaggacacagctcacactaaagctgagcgcaatattcttgaggaagtgaagcatcctttcatcgtcgacctgatatacgccttccagactggcggtaaattgtatctaatcctcgaatatctgtccggcggagaactgtttatgcaacttgaacgcgaagggatcttcatggaggacactgcatgcttttacctggctgagatctctatggccctcggccaccttcaccagaagggaatcatttatagagaccttaagccagagaacattatgctgaatcaccaaggccatgtcaagttgacggacttcggactgtgcaaggagagtatccatgatggcacggtgacccacacgttttgcggcaccattgagtacatggccccagagattctgatgagaagcgggcataacagggctgtggattggtggtctctgggcgctctgatgtacgacatgttgaccggagcaccccctttcacaggcgaaaatcgcaaaaagacaatagataaaatcctgaagtgtaaactcaaccttccaccatacctgacacaggaggccagagacttgttaaaaaaactgctgaaacggaacgccgcttctcgactcggcgctgggccaggcgatgcaggcgaggtgcaggcacaccctttctttagacacatcaattgggaagagctcttggcgaggaaggttgagcctcccttcaaacctctgctgcagtcagaggaggacgtttctcagtttgacagtaagtttacacgtcagacccccgtggattcacctgacgacagtactctgtccgagagtgccaatcaggtgtttttgggttttacgtacgtggcaccgtctgtgctggaaagcgtcaaagaaaagttttctttcgaaccaaaaatccgcagcccacgccgtttcatcggatccccgagaaccccagtgtcaacagccatgtgctag

SEQ ID NO: 30674 - DNA, 1509 bp, Artificial Sequence
  Description of Artificial Sequence: Synthetic coding sequence
atgaggagacgacgaagacgggatggattctaccccgcacccgattttagggaccgagaggcagaggatatggctggcgtcttcgacatcgatcttgaccagcctgaagatgctggctccgaggatgagctcgaggaaggaggacagctgaatgaaagcatggatcacgggggagtggggccttacgaactggggatggagcattgcgagaagttcgagatttctgaaacctcggtcaataggggccctgagaagattaggcccgaatgttttgagctcctgcgagtgttgggcaagggtggctatggtaaggccatgatcgttcgaaacgcaaaggatacagcccacacaaaggccgaaagaaacatccttgaagaggttaagcatcctttcatagttgacctcatttatgcttttcagaccgggggaaagttgtatctgatcctagagtacctgtctggcggagagctattcatgcagctagagagagaaggaatctttatggaggataccgcatgcttctacttggccgagatatcgatggcacttggccatctgcaccagaagggtatcatctatagggacctcaagcctgagaatatcatgttgaaccaccagggtcacgtgaaactgacagatttcggtctgtgtaaagaatcaattcacgacgggaccgtgacacacaccttttgcggcacaatcgagtatatggctccggaaatcctgatgcgctcagggcataatagggctgtggactggtggtcattgggcgctctgatgtatgacatgcttacgggagcccctccattcaccggagaaaaccgcaagaaaactattgataagattttgaagtgtaagttaaatctgccaccgtacctgacgcaagaggctcgggaccttctgaagaaactcctgaagcggaacgccgcttcccgtttgggcgcagggcctggagacgctggcgaggtccaagcccacccgtttttcaggcacattaattgggaggaactgcttgccaggaaagtggagcctcccttcaagcccttgcttcagtcagaggaagacgtgtctcagttcgactctaaatttacacgtcaaaccccagtagactccccagatgattccacgctttccgaatcggcaaaccaagtatttctcggctttacctacgtagccccatccgttttagagtctgtgaaagagaagttcagcttcgagccgaaaattaggagccctaggcggttcattggaagccccagaacacccgtgagccccgtcaaattttcaccaggagatttttggggtcggggagcaagcgcctccacagccaaccctcagacacccgtcgaataccccatggaaacctccggcatcgagcagatggacgtgacaatgagcggagaggcttctgctcccttgcccatccggcagccaaattcaggcccttacaaaaagcaagcttttcccatgatctcaaaacggcctgaacacctacgaatgaatctgtag

SEQ ID NO: 30675 - DNA, 1932 bp, Artificial Sequence
  Description of Artificial Sequence: Synthetic coding sequence
atgaaggtcttgaagaaagcaacactaaaggtgcgtgaccgcgtccggactaagatggaaagagacatactcgccgatgtgaatcaccctttcgtggtaaaacttcattatgcttttcagacagaagggaaactctacctgattttagactttctgcgtggaggcgacctctttacaaggcttagcaaggaagttatgttcactgaagaggatgtgaagttctatttggctgagctcgcccttgggctagaccacctgcacagcctgggaatcatctaccgcgatctgaaacctgagaacatcctcctggacgaggagggacacattaagctcacagactttggattgtctaaggaggcaattgatcacgagaagaaggcctatagtttttgtgggactgtggagtatatggctcccgaggtcgtcaataggcagggacacagccatagtgctgactggtggtcatatggggtgttaatgttcgagatgctgaccggcagcttacccttccagggtaaggatcgaaaagaaactatgacgctgatcttaaaggcaaaattaggcatgccacagttcttatctacagaggcacagagcttgctgagggcgctctttaagcgcaaccccgcaaatagactgggcagcggccctgatggtgccgaggaaatcaagagacatgtcttctatagcacaatcgattggaataagctgtatcggcgtgaaattaagcctccattcaaacctgctgtagctcaacccgacgatacattctatttcgataccgagtttacctctcgaactcccaaggactcacccggaatcccaccctctgcgggtgctcaccagctatttcgagggttttctttcgtggccacaggcttgatggaagatgatggcaagccccgagccccacaggccccacttcactcggtcgtgcagcagctccacggtaaaaatctagtgttcagcgacggctacgtggtgaaagagactatcggggtgggatcatacagcgaatgtaagaggtgtgtgcataaagcaacaaatatggaatatgccgtcaaggtcattgacaagtccaaacgggatcctagcgaggaaatcgaaatccttctcaggtacggacagcatcctaatatcattaccctcaaagatgtctacgacgacggcaaacacgtgtacctggtcacagaactaatgcgcggtggcgagcttctggacaagatcctccgccagaaattcttttctgagcgagaagccagcttcgtgctccacaccattgggaagacggttgaatatctacactcccagggtgtggtacatcgggatttaaaacctagcaatattctctatgttgatgagtccggcaaccctgaatgtttacgcatctgcgacttcgggtttgctaaacagctgagggctgaaaacggcctgctaatgaccccctgctatacagcaaacttcgtggctcccgaggtgctgaaacgccagggatacgacgaaggctgtgatatatggtctttaggtatactgctttacaccatgctcgccggttacaccccattcgctaatgggccatcagacacacccgaggaaatcctcacccgtattgggtctggcaagttcaccctgagtggcggaaattggaacacagtttccgagaccgcaaaggacctcgtgtctaagatgctacatgttgaccctcaccagcgccttaccgcaaaacaagttctgcagcacccttgggtcacccaaaaagacaaattgccgcagtcccagctgtcgcaccaggacctacagctggtgaagggagctatggctgctacttactcagccctcaactcatctaagcctaccccacagttgaagcccattgaatcatccatcctagcccagagacgcgtgcggaaactgccttctactaccctctag

SEQ ID NO: 30676 - DNA, 687 bp, Artificial Sequence
  Description of Artificial Sequence: Synthetic coding sequence
atgccacagttcctctctactgaggcccaaagtttattgcgtgcgctgtttaaaaggaatcccgctaaccgcctgggctcaggaccagatggcgctgaagaaataaaacgccatgtcttttactccaccatcgattggaataaattgtacaggcgggagatcaagccccctttcaaacctgccgttgcacagcctgacgacaccttttacttcgataccgaatttaccagccgtaccccaaaggattcccccggaataccaccctcagctggggcacatcagctctttcgcggattttcgtttgtcgccacaggcttgatggaagacgacggtaaaccccgtgctcctcaggcaccactccactccgtggtccaagtgattgacaagagcaagcgcgacccgagcgaggagattgagatcttgctgcgttacggccaacatcctaatataatcacactaaaagatgtttatgacgatgggaagcacgtgtacctggtcaccgagctcatgagaggtggagaactgctggataagattctgaggcaaaagttcttcagcgagcgcgaagcctcttttgttctgcacaccatcggcaagacggtagaatatctccactctcagggcgtagtgcacagggatttgaaaccatccaatatcctgtatgtggacgagagcgggaatccctag

SEQ ID NO: 30677 - DNA, 2208 bp, Artificial Sequence
  Description of Artificial Sequence: Synthetic coding sequence
atgcctctcgcccagttgaaggagccatggcctctgatggaactggtgcctctggacccggagaatgggcagacttccggggaagaggccggactgcagcctagcaaagatgagggagtccttaaggagatctccattactcaccacgtcaaggcaggcagcgaaaaagccgatcccagccacttcgagctcctcaaggttctcgggcaggggtcctttggcaaggtgtttttagttcggaaggtgacccgccctgacagcggtcacctgtatgccatgaaggtcctaaagaaggctactctgaaggtgcgggacagagtacggacgaaaatggagcgggatatcctcgcagacgtgaatcacccatttgtcgtgaaactgcactacgctttccaaacagagggcaagctctacctcatcctggattttctccgcggtggggacctcttcactaggttatccaaggaggttatgtttacagaagaggacgtgaagttttaccttgctgaactggccctcgggttagatcacttacactccctgggaattatttacagggaccttaagccagaaaatatactcctcgacgaggagggccatatcaaacttacggattttgggctgtcaaaggaggctattgatcatgaaaagaaagcctacagtttctgtggcacggtggagtatatggcacctgaagtggtgaaccggcaagggcacagccattcagctgattggtggtcgtacggagtcttgatgttcgaaatgctgaccggctcactgccttttcagggcaaggacagaaaggaaacgatgacactgatcctgaaagccaaactggggatgcctcagtttctgtccaccgaagcacagtcgttacttagggccctattcaagaggaatccagcaaaccgcctggggtccggcccagacggggcagaagaaatcaaacgccacgttttctactccactatagactggaataaactatatagaagggagatcaaacctcctttcaaaccggctgtcgcacagcctgacgataccttttattttgataccgaattcacctcacgaacacccaaagactcacccggtataccacccagcgcaggggcacatcagctatttcggggattttcttttgtcgccaccggcttaatggaggacgatggaaagccgagagctccgcaggctccactgcactccgtggtacagcagctccatggtaagaacctggtcttttctgacggctacgtggtgaaagagacgatcggagtgggatcttattccgaatgcaaacggtgcgtccacaaagcaaccaatatggagtacgccgtgaaggtgatcgacaaatcaaagcgggatccaagcgaggaaattgagatcctgctgaggtacggccagcatcctaacatcatcactttgaaggatgtttacgatgatggtaaacacgtgtacctggtcacagagctgatgcgcggaggtgagttgttggacaaaattctgcggcagaagttttttagtgaacgcgaggcttccttcgttttgcacaccatagggaaaacggtggaatacttacactcccagggggtggttcacagagatcttaaaccaagtaacattctctatgtggacgagagtggaaatccggagtgtctacggatctgtgactttgggtttgccaaacaactgcgggctgagaacggcctgctgatgactccgtgttatactgctaatttcgtcgctcccgaggtgctgaaaaggcaaggttatgacgagggttgcgacatctggtcgctaggcattctgctgtatacaatgcttgcaggctacactccctttgcaaatggcccatccgacacacccgaagagatcttaactagaattggctccggaaaatttaccctgagcggtgggaattggaacaccgttagtgaaaccgccaaagatctggtctctaagatgctgcatgtggatccacaccagaggttgaccgccaaacaagtgttgcagcacccttgggtcacacagaaagacaaactcccacagagtcagctgtcacaccaggatttgcagctggtgaagggcgcaatggccgctacatattctgctcttaacagttccaagcctactccccaactcaaacccattgagagttcaatccttgctcagcggagagtgagaaaactgcctagtaccactctgtag

SEQ ID NO: 30678 - DNA, 501 bp, Artificial Sequence
  Description of Artificial Sequence: Synthetic coding sequence
gcccagcctgacgatacgttttactttgatactgaattcacctcacgtacccccaaggatagccccggtattccgccatccgccggagcacaccagctgttcaggggtttcagcttcgtggctaccggtctcatggaagatgacggtaagccccgagctccccaggcccctcttcacagcgtggtgcaagtgatagataagagcaaaagagaccctagtgaggagattgaaattctcctgcggtatgggcaacatcccaatatcattaccctgaaggacgtgtatgatgacggtaaacatgtgtacctggttactgagctcatgcggggtggtgaattattagacaagatattgcggcagaagttcttcagcgagcgagaggccagttttgtccttcatactatcggcaaaacagttgagtacttgcacagccagggcgtggtgcatagggatttgaaaccttcaaacattctctatgtcgacgagtctgggaatccatag

SEQ ID NO: 30679 - DNA, 2160 bp, Artificial Sequence
  Description of Artificial Sequence: Synthetic coding sequence
atgcagactcccgcagatttccctagggtagagcgcgatcttgtaccttgccccagaaaagatgagggcgtattgaaggagatctcgattacgcaccacgtgaaagctggcagtgagaaagcggatccgagccattttgagttgctgaaggtgctcggccaggggtcatttggcaaggtgttccttgtgagaaaagttacacgcccagattctggccatctttatgctatgaaagtgctaaagaaagcaacccttaaagtgcgggaccgggtcaggaccaagatggagagggacattctggcggatgttaaccacccgttcgtcgtaaaacttcactatgcatttcagacagaaggaaagctttatctaatcctggatttcttgcggggtggtgacctgtttactcgccttagcaaagaagtaatgttcacggaggaggacgtcaaattttatctcgcggaactggctctgggattagatcacctgcattctctcggaatcatttaccgggaccttaaaccagagaacatccttctcgatgaggagggccatataaagctcaccgattttggcctgtctaaagaggccattgatcatgaaaaaaaggcctattccttctgcggcactgtcgagtatatggcaccagaggtggtgaaccgccagggccactcccacagcgctgactggtggagttacggggtactgatgtttgagatgttaactggaagcttaccattccagggcaaggacaggaaggaaacaatgaccctcatcctgaaagcaaagctaggtatgccgcagttcctcagcaccgaggcccaaagcctgctgagggctctgtttaagagaaatcccgcaaatcgactggggtccggacccgacggggctgaagagatcaagaggcatgtattctacagcacaattgattggaacaaactgtatagaagggaaatcaagccaccgttcaagccagcagtggcccagccagacgacacattctactttgacaccgaatttacatcccggacacctaaggacagtccgggaattcctccctcagctggagcacaccagctgtttagaggtttctcttttgttgccaccggtctgatggaggacgatggcaagccacgcgcacctcaggccccactgcactcagtcgtgcagcagcttcacggaaagaaccttgtcttctcagatgggtacgttgtgaaagaaactattggagtaggttcgtacagtgagtgtaaaagatgtgtacataaagctacgaacatggagtatgccgtcaaagtgattgacaagtccaagagggacccctcagaggagatagagatcctgctcagatatggccaacaccccaacattattactctgaaggatgtgtatgacgatggcaagcatgtatatctagtaaccgagctaatgagagggggagaacttctggacaagatcctgcgccagaagttcttcagcgagcgcgaggcgtcattcgttctccatactattggcaaaactgtggaatacctgcacagccaaggagtggtccacagagacctcaagccctccaatattctgtacgtggatgaaagcggtaaccctgagtgcctcagaatttgcgatttcggatttgccaaacaactccgtgccgaaaacgggctgctgatgaccccctgttacacagccaacttcgtggcccctgaagtgctgaaaaggcagggttatgatgaaggatgcgacatttggtcgctgggcattttactttatacaatgctcgccggatataccccttttgccaacgggcctagcgatacccccgaggagattctgacacgcatcggcagcggcaagttcactttgtccggcggaaactggaataccgtgagtgagacagctaaagatctcgtgtcgaagatgctccacgtggatccacaccaacgtctgactgctaagcaagtactgcaacatccttgggtcactcagaaagacaagctgccccagagccagctaagccaccaagacctgcaacttgtgaagggggcaatggcggcaacgtattccgcactcaactcctccaagccgactccacaactgaagcctatcgaaagctctattctcgctcaaagaagggtcagaaaactgccatctacaaccctttag

SEQ ID NO: 30680 - DNA, 2202 bp, Artificial Sequence
  Description of Artificial Sequence: Synthetic coding sequence
atggacttgagcatgaaaaaattcgccgtgaggagatttttttccgtgtacctaagaaggaagagcaggtcaaaaagctcttccctcagccggttagaggaggaaggtgtcgttaaggagattgatattagccatcatgttaaagaggggtttgaaaaagcggacccctcccaattcgagttgctgaaggtgctgggtcagggctcttatggaaaggtcttcctggttcggaaggtgaagggcagtgatgcaggacagctctatgcaatgaaagtcctgaaaaaggcaacactcaaagtaagggaccgggtccggagtaaaatggagcgcgatattctggcagaagtgaatcatccatttattgtgaaactgcactacgctttccagaccgagggcaaactttatctaatactagattttttacgcggaggagaccttttcaccagactctccaaggaagtaatgtttaccgaagaggacgtgaagttttatttggctgaattggctctggctctggaccaccttcattctttaggtattatctatcgcgacctaaagccagagaacatactcctggatgaggaaggccacattaagattaccgattttgggttgtcaaaggaggccatcgaccacgacaaacgggcttattcgttctgtggcaccatagagtacatggcaccggaggttgtgaaccggaggggacatacccagtcagcagactggtggagctttggggttttaatgttcgaaatgctgacagggtccctcccattccaggggaaggaccgcaaagagaccatggcactcatcttgaaggccaaacttggaatgccacagttcctttccggggaggctcagagtctcctgagagccctattcaagagaaacccctgtaaccgactgggcgctggtattgacggagtggaggaaattaaacggcaccccttcttcgtaaccattgattggaatactttgtacagaaaagagataaagcccccttttaagccagccgtcggacggcctgaggatacgtttcacttcgaccccgagtttaccgccaggacgccaacagattctcccggagtgccacctagtgccaacgcgcaccacctcttccgcggtttttcttttgttgcctcctcgctcattcaagaaccatcccagcaggacctgcataaagtgccagtgcaccccatcgtgcaacagcttcacggcaataacattcatttcacagatgggtatgagatcaaggaggacatcggagtggggagctacagtgtgtgcaaaagatgcgtccacaaggcgactgatactgagtatgcagtaaagattatcgataaaagcaagagagacccgtctgaggagattgaaatcttactccgctatggtcaacatccaaatataattaccctaaaagatgtgtatgacgacggtaaattcgtgtacctggtgatggaactgatgagggggggagaattgctggacaggatcctgaggcagcggtatttttccgagcgggaagcctcagatgtcttatgtactatcactaagacaatggactacttacacagccagggtgtcgtgcaccgcgacctgaaaccatccaacatattataccgcgacgaatcaggttcacccgagagtatccgcgtgtgcgattttggcttcgctaaacaacttcgcgctggcaatggcctcctcatgaccccctgctacaccgcgaacttcgttgcaccggaagtcctgaaaaggcaaggttacgacgctgcgtgcgatatctggtcattaggaatattgctctacacgatgctggccggtttcactccctttgcaaatgggcctgacgataccccagaggagatactggccagaatagggtctggaaagtatgcacttagtgggggaaactgggatagcataagtgacgccgcaaaagatgttgtttctaagatgctacacgtggatccacatcagcgccttactgctatgcaggtgttaaagcatccttgggtggttaaccgggaatatctcagccctaatcagttatctcgccaggacgtccaccttgttaaaggagccatggcagccacttatttcgctctgaatcgaactcctcaggctccacgcctcgagcccgtgctctcgagcaacttagcgcagaggcgcggtatgaagaggttaaccagcacgcgcctttag

SEQ ID NO: 30681 - DNA, 501 bp, Artificial Sequence
  Description of Artificial Sequence: Synthetic coding sequence
atgtttactgaggaggacgtaaagttctacttggcagagctggccctcgctcttgatcatctacacagcctgggaatcatataccgggatctcaagcccgagaacatactgctggacgaagaagggcatataaagatcacggactttggcttgtcaaaagaagctattgatcacgataagcgggcatactccttttgcgggacaatcgaatatatggcacctgaggtcgttaaccggagggggcatacccagtcagccgactggtggtcgttcggcgtgcttatgtttgaaatgctgacaggatcactcccctttcagggcaaggatcgcaaagaaacaatggctttgatcctgaaggccaagctcgggatgcctcagtttttgtccggggaggcccagtcccttctccgcgcattgtttaagcgcaatccgtgtaatcgccttggtgagaagacggctctgtgccctcgtgtctcctgcagccggttactgggattttag

SEQ ID NO: 30682 - DNA, 1935 bp, Artificial Sequence
  Description of Artificial Sequence: Synthetic coding sequence
atgaaagtcctgaagaaggctacattgaaagtgagggatcgggtgcggagtaaaatggagagggatattctggcagaggtgaatcaccccttcatcgttaaactacactacgccttccagactgagggaaagttatatctcatccttgatttccttagaggtggagatttgtttacccgcctcagcaaggaggtgatgttcacagaagaggacgtcaagttctacctcgcagaactggccctggcacttgaccacctccactccctgggaattatctaccgggacttgaagcctgaaaacattctcctcgacgaggagggccatattaaaatcaccgatttcggcttgagcaaggaggccatcgatcatgataaacgcgcttacagcttctgcgggaccatcgagtacatggctcccgaggtggtcaacaggcgaggtcatacacagagcgcggactggtggtcgttcggggtgttaatgttcgagatgctgaccggttctctgcctttccagggaaaggaccgcaaagagaccatggctctgattttgaaggcaaaactgggcatgccgcagtttttgagtggggaagcacaatcattgctgcgcgcattgttcaagcgcaatccatgtaacagactgggggctggcatagatggcgtggaggagatcaagcggcatcctttcttcgtaacaatcgactggaatactctttaccggaaggaaataaagcccccttttaagccagcagttggcaggccggaggacacctttcacttcgatcctgagtttaccgctcgcactccaaccgactcgcctggtgttcctccctccgctaatgcgcaccatctgtttcggggattctcattcgtcgccagtagcttgatccaggagccctcgcagcaggatctacacaaagtgccagttcatcccattgttcagcagcttcatggaaacaatatccatttcacggatggctatgagataaaggaggacatcggcgtcgggtcttactctgtgtgtaaaagatgcgtccataaagccaccgatacagaatacgcggtaaagatcatcgataagtctaaaagggatccctcagaggaaattgaaatcctcctacggtacggccagcacccaaacattatcactttgaaagacgtgtacgacgacgggaagttcgtctacttggtcatggagcttatgagaggtggcgaactgctcgaccgaattctccgccagcgctacttcagtgaacgggaggctagcgacgtactgtgcaccatcacgaagactatggattatttacactcccagggcgtcgtgcatagagacttgaaacccagtaatatcctataccgagatgaatccggttccccagaatccatcagggtctgcgattttgggttcgcaaagcagctcagagctggaaacggactgcttatgacaccatgttacactgcaaatttcgtggcacctgaagttttaaaacggcaggggtatgacgctgcctgcgacatctggagcttaggcattctactatatacgatgctggccggttttacacctttcgctaatggacccgacgacacccctgaagagattctagccaggatcggcagcggaaagtacgcactgagtgggggtaactgggactctataagcgacgcagcaaaggatgtggtctctaagatgctccacgtggaccctcatcagcggctcaccgccatgcaggtactaaaacatccttgggtagtaaatcgcgagtaccttagccctaatcaactgtcccgacaggatgtacatcttgtcaaaggagctatggctgccacctatttcgccctcaacagaactccccaagcacccagacttgaaccggtattgtcctcaaatcttgctcagagaagggggatgaaaagactgaccagtacacggctgtag

SEQ ID NO: 30683 - DNA, 1935 bp, Artificial Sequence
  Description of Artificial Sequence: Synthetic coding sequence
atgaaagttctcaagaaggccaccctgaaagtgagagatcgcgtgagatccaagatggagcgagacatcctggctgaagtgaaccatccattcatcgtaaagttgcactatgcctttcaaactgagggcaagctctatctcatactagactttcttcggggtggggatctttttaccaggttgtctaaagaagtcatgtttaccgaggaagacgttaaattctatctggccgagttggccttggccttggaccacctgcactcattggggattatctaccgggatttgaaacctgagaatatcctcctcgacgaggagggtcacattaaaataacagacttcggcctttctaaagaagcgatagaccacgataaacgcgcatactctttttgtggtactatagagtatatggcccctgaagtcgtgaatcgacggggtcatacccagtcagcagattggtggagtttcggtgttttgatgtttgaaatgctgacgggcagcttacccttccagggtaaggataggaaagagactatggcgctgattctaaaagccaagcttggaatgccacagttcctcagcggcgaagctcagagtttgctgcgcgctttatttaaacgaaatccctgtaaccgtctaggcgcaggaatcgacggcgtggaggagatcaaacgccacccttttttcgtgactattgactggaacaccctatatcggaaagagatcaagcccccattcaagccggctgtgggaagaccagaggatactttccacttcgacccagagttcaccgcacgaacccctacagacagcccaggcgtccctcctagcgcaaatgcccaccacctgttcaggggcttcagtttcgtcgcatcttccctgatccaggagcctagccagcaggacctgcacaaggtcccagtgcaccccatcgtccagcagctccacggaaacaacattcatttcactgacgggtacgagattaaagaagacatcggcgtaggcagctatagcgtgtgtaagcgctgcgtccataaagccacagacacggaatatgcggtgaagatcattgacaagagcaaacgggacccctccgaggaaattgagatcttgctgcggtatggacaacatcccaatattataaccctcaaggacgtgtatgatgatggcaagttcgtttacctcgtgatggagttaatgcggggaggggagcttcttgatagaatcctgagacagagatatttttccgagagggaggctagcgacgttttgtgcaccatcacgaagaccatggattatcttcacagccagggggtggtgcaccgggacttaaaaccatcgaacattttatatcgcgacgaatcaggttcccccgaatccattcgggtgtgcgacttcgggttcgccaagcaactgcgtgcgggaaacggattactaatgactccatgttatacggccaattttgtggcgccagaagtgcttaaacgccagggatacgacgccgcttgtgacatttggagccttggaatcctgctgtacacaatgctggcaggcttcaccccctttgctaacggccctgacgatacaccagaagaaattctggccagaattggctcagggaagtatgctctctcgggaggcaactgggactcaatctctgatgccgcaaaagatgtggtgagtaagatgctgcacgttgatccgcatcagaggttaacagccatgcaggtgctcaaacatccttgggtggtgaatagggaatatctgtctcctaatcagctcagccggcaggatgtgcatctcgtgaagggcgcaatggcagccacatatttcgcccttaatcgcactcctcaggcgccacgtttggagcctgtgctgtcttctaacctggctcagcgtcgtggtatgaaacgcctgacatctacaaggctgtag

SEQ ID NO: 30684 - DNA, 2226 bp, Artificial Sequence
  Description of Artificial Sequence: Synthetic coding sequence
atgccaatagcccagctcctcgagctgtggaaaaagattgaggtggaacccatggagatcgagactaccgaggaggatttgaatttggacgtagaacccacgaccgaggacactgccgaagaggaggaaggcgtggtgaaggaaatagatatctctcatcatgtgaaggaagggtttgaaaaggctgatcccagccaattcgaactcctgaaagttctgggccaaggcagttacggaaaggtgtttctggtcaggaaagtgaaaggatctgatgcaggtcagttgtacgccatgaaggtcctcaaaaaagccacccttaaagtgagagatcgtgttcggagcaagatggaacgggacattctcgctgaggttaatcaccctttcatagtgaagttacactacgcttttcagacagagggaaaactgtaccttattctggacttccttagaggcggagacctgtttacacgattaagtaaggaggtcatgttcacagaagaggacgtgaaattttatctggcagaactagcgctagcactggatcacctgcactcccttggtatcatctaccgagatctcaaacctgaaaacatcctgctggacgaggagggtcacatcaagattaccgactttggactgtctaaagaagccatcgaccacgacaagcgtgcttatagcttttgtggcacaattgagtatatggccccagaagtggttaatcgcagaggccatacacaaagcgcagactggtggagcttcggagtgttgatgttcgaaatgctcacaggcagcttgccgttccagggaaaggatcggaaggagacaatggccttaatcctaaaggccaagttaggtatgccacagttcctgtcgggggaagctcagtctctcctgcgggcattgttcaagcgcaacccgtgtaatagattgggagccggaatcgatggtgtggaagaaatcaaaaggcacccctttttcgtgaccatagattggaacaccctatatcggaaagagatcaaacctccattcaaacctgctgttggcagaccagaggacactttccactttgaccccgagttcaccgcgaggactcccacagacagtcccggagtacccccaagtgcaaatgcccaccatctcttccgcggtttctccttcgtggcatcctccctgattcaggagccttcgcaacaggacttacacaaagtgccagtccacccgatagtgcagcagcttcacgggaataacattcacttcacagacggatacgagatcaaggaagatatcggcgtaggttcgtactctgtctgtaagcggtgcgtgcacaaggctacagacaccgaatatgctgtcaagattatcgacaagtccaaaagagaccccagcgaagaaatcgagatcctgctacggtatggtcagcacccgaacattattactctgaaggacgtttatgacgatggaaagtttgtgtacctcgtgatggaactgatgaggggcggagaacttcttgatcgaatactgcggcagcgctacttcagtgaacgggaggcgtccgacgtgctatgtaccatcaccaaaaccatggattacttgcactctcaaggcgttgtgcatagagacctaaagcctagcaacatcctctatcgggacgaatccggcagtcccgagagcattcgggtttgcgattttgggtttgccaagcaactgcgtgccggaaatggtctactgatgactccgtgctataccgccaatttcgtcgccccagaagtactgaagcgacaaggctacgacgcagcgtgcgatatatggagcctggggatactactgtataccatgcttgccggattcacaccattcgcaaacggacccgacgatacgcccgaggagattttggccagaatcggaagcggaaaatatgccttgtcaggaggaaactgggatagtattagcgacgccgcaaaggacgtcgtctcaaaaatgcttcacgtcgatcctcatcaacgcctgaccgctatgcaagtcctcaagcacccctgggtcgtgaatcgcgagtatttatctccaaaccaactcagtcgacaggacgtgcatctggtgaagggcgctatggccgctacctatttcgctcttaaccggaccccgcaagccccaagactggaaccagtgctaagctccaatttggctcagaggcgcggaatgaaaagactgacaagcacacggctgtag

SEQ ID NO: 30685 - DNA, 516 bp, Artificial Sequence
  Description of Artificial Sequence: Synthetic coding sequence
atgcccattgcgcagctactggaactctggaaaaagattgaggtggaacccatggagatcgagaccactgaggaagacctgaacctcgatgtagaacctaccaccgaggacaccgctgaggaggggaaatctgactccgctgcttgcaagaccaaggttgcaggtagcgtggaagaggagggtgtggtgaaggaaattgatatcagtcaccacgtaaaagaggggtttgaaaaagcagaccccagccagttcgaattgctgaaagttctggggcaggggagctacggcaaagtcttcttggtgcgcaaagtcaaggggtctgacgccggacaactctatgcaatgaaggtgctgaaaaaagctaccctcaaggtgcgggatcgggtgaggtcaaagatggaacgagatatcttggctgaagttaaccaccccttcatagttaagctgcactacgcatttcagacagagggaaagctctaccttatcctggactttttaagaggtggcgacttatag

SEQ ID NO: 30686 - DNA, 2277 bp, Artificial Sequence
  Description of Artificial Sequence: Synthetic coding sequence
atgccgatcgctcagttactggagctgtggaaaaagatcgaggtcgagcctatggaaatcgaaaccactgaagaggacctgaacctggacgttgaaccaactaccgaggacaccgctgaggaaggtaagtccgactcagccgcatgtaagactaaggtagccggatccgtggaagaagagggtgttgtgaaggaaattgacatcagtcaccacgtgaaggagggatttgagaaggccgatcccagccagttcgaattattgaaagtgcttgggcaggggtcgtatggcaaagtattcttggtgagaaaggttaagggctctgatgctggccagctgtatgccatgaaggtgctgaaaaaagccaccctcaaggtgagggaccgggtacgctcaaaaatggaacgagatatcctggcagaagttaaccacccatttattgtgaaactgcactacgcttttcagaccgagggcaagctgtacctcatcctagactttctccgcggaggtgacctgtttaccaggttgtcaaaggaggttatgtttactgaagaagacgtcaagttttatttggctgagctcgctctcgcgctcgaccatctgcatagcctggggataatttaccgcgatctgaaacccgaaaatatcctgctcgacgaggagggccacattaagataacagatttcggcctgtcaaaagaggccatagaccacgataaaagggcatactctttttgtggaactattgagtacatggcacctgaagtggtgaatagacggggacatacccagtcggccgactggtggtccttcggggtgctgatgttcgaaatgctgactggatctctgccctttcagggaaaggatcgcaaagaaacaatggccctaatccttaaggctaaactgggcatgcctcagttcctgagcggggaggcccagtctttgttgcgtgctctctttaaacgcaacccctgcaaccgccttggcgcaggaattgacggtgtagaggagattaaaagacaccctttcttcgtgactattgattggaataccctgtatcgaaaagagatcaaacccccttttaagccggctgtcgggaggccagaagacacatttcattttgatccagagttcaccgcccgaacacctactgactctccaggtgtgccaccttctgcaaacgcccatcatctgttccggggatttagttttgtagcttcttccctgattcaggaaccgtcccaacaggacctccacaaagtgcccgttcatcctatcgtccagcaactgcacggcaacaacatccattttacggacggctatgaaatcaaagaagatattggtgtcgggtcttatagcgtttgtaagagatgcgttcataaagccaccgacaccgaatacgccgttaagatcatcgacaagtccaaacgggatccaagcgaagagattgagatcctcctccgatacgggcagcatccgaacattattaccttgaaagatgtgtacgatgatggcaaattcgtgtaccttgttatggagctcatgaggggcggtgagctgctggaccgcatattaagacagagatacttttctgagagggaggcatctgatgtgctgtgcacaataaccaagacaatggattatcttcattcacaaggagtagttcatagggacctgaagccctcgaatatcctctatcgagatgagagcggctcacccgagagcatcagagtctgcgactttggatttgccaagcaattacgtgccggaaatggcctgctgatgaccccatgttacacagcgaacttcgtggctcccgaggttctgaaaagacaggggtatgatgcggcatgtgatatttggagtttagggatcctgctgtacactatgcttgcgggattcaccccgttcgccaacggtccagatgataccccggaagaaattttggcaagaatcggtagcggcaagtatgccttgtccggaggcaattgggatagtatctcagacgctgccaaagatgttgtatctaagatgcttcacgtcgatccgcaccaacgtcttacagctatgcaggtgctcaaacatccttgggtggtaaaccgggaataccttagcccaaatcagctttctcggcaggacgtgcatctggtgaagggagcgatggcggcaacatatttcgcactaaaccgaacaccacaagcaccacggctggaacctgtcctttcatcaaacttggcccaaaggcggggtatgaagaggttaacatccacacggctgtag

SEQ ID NO: 30687 - DNA, 888 bp, Artificial Sequence
  Description of Artificial Sequence: Synthetic coding sequence
atgagcggagccctggatgtactgcaaatgaaagaagaggacgtcctaaagtttttggctgctggcactcatctgggtggtaccaacctggatttccagatggagcagtacatctacaaaagaaagtccgatggaatctacataatcaacttgaagcggacttgggaaaagctgctccttgcagcgagagctatcgtcgccattgagaaccctgcagacgtaagcgtaatcagttctcgcaacaccggccaacgggctgtactcaagttcgctgctgctaccggtgcgactcccatagcgggacgattcacacctggaacgttcacaaaccagattcaggctgccttccgagagcccaggctcctggtggtgactgatccgagggctgatcatcagcccctgaccgaagccagctacgttaatttaccaaccatcgctctgtgtaatactgacagtccattacggtacgtggacatagccataccctgtaacaataaaggggctcattctgtgggtctgatgtggtggatgctggccagggaagtgttgcgtatgcgtgggaccataagccgggagcacccatgggaagtcatgcctgatctgtacttttaccgggatcctgaggagattgagaaggaggagcaggccgctgctgagaaggccgtgaccaaagaggaatttcagggcgagtggactgctcctgcacctgaattcacggccactcagcctgaggtcgcggactggtccgagggagtccaagtgccttccgtgccaattcagcagtttccaacagaagactggagcgcacagccagccactgaggattggagcgctgccccaactgcccaggctacggagtgggttggagctaccacggattggtcttag

SEQ ID NO: 30688 - DNA, 795 bp, Artificial Sequence
  Description of Artificial Sequence: Synthetic coding sequence
atgtccggcgctctggacgtcctacagatgaaagaagaggatgtgctcaaatttcttgcagccggtacccatttgggaggcacgaatcttgatttccaaatggagcagtacatatataagcggaagagtgatggaatctacattatcaatctgaaacgcacatgggagaagctcttactagccgcacgcgctattgtagccatcgaaaatcccgctgatgtttcagtaatttcgagcagaaacactgggcagagggctgtcctgaagttcgcagcggcaaccggcgcaacccctatcgccggtaggtttacgcccggaacttttaccaatcagatccaagccgctttccgcgaaccacggttgctcgtggtcacagaccctagggccgaccatcagcccttaacagaagctagttatgttaaccttcctaccattgcgctgtgcaacactgacagtcctttaaggtatgtggacattgctattccttgcaataacaagggcgctcatagcgtagggctgatgtggtggatgctggcccgtgaagtactaaggatgcgcggtactattagccgcgaacacccttgggaggtgatgcccgacctgtatttttacagggatcctgaggagatcgagaaagaggagcaggctgccgcagagaaggcagtcactaaggaagaattccagggggaatggactgccccagctcctgagttcacagccacacagcccgaggtcgctgattggtccgaaggagtgcaagttccgagcgttcccatccagcagtttccgacctag

SEQ ID NO: 30689 - DNA, 1458 bp, Artificial Sequence
  Description of Artificial Sequence: Synthetic coding sequence
atgggagaacctggcttctttgtaactggcgaccgagccggaggcaggagttggtgtttgagaagagtaggcatgtctgcaggctggctactcctagaagacgggtgtgaagtgactgtgggacgtggatttggagtgacataccagttagtgagcaagatttgtcctctaatgatttcaaggaaccattgcgtgctgaaacagaaccccgaaggccagtggacaataatggacaataagtctttaaatggagtgtggctgaacagagcgagactagagccacttcgggtttattccattcaccagggcgattatatccaacttggggtgcccttagagaacaaggaaaacgcagagtacgaatacgaagttacagaggaggactgggagaccatttatccctgtctctctccaaagaatgatcagatgatcgagaagaataaggagctaaggactaagcgtaagttctcactggatgagttggccggaccaggagcagaggggccaagcaatctgaagtccaagattaacaaggtttcgtgcgaatctgggcaacccgttaaaagccagggtaagggggaggtggcctctacgccgtctgataacttagacccaaagctgacagccctagagccttccaagactaccggcgcaccaatctaccctggctttccaaaggttaccgaagtccatcacgaacaaaaagctagtaactccagcgctagccagaggtccctgcagatgtttaaggtcacaatgtctagaatactgcgtctgaagattcaaatgcaagaaaagcatgaagctgtcatgaacgtgaagaagcaaactcagaaagggaactccaaaaaggtcgtgcagatggagcaggagcttcaggatcttcaatcccaactgtgcgccgagcaggcacagcagcaggctagggtggagcagctggaaaagacatttcaggaggaagaacagcacctgcaagggctggagatcgctcaaggcgagaaggacctcaagcagcagttagcccaggccctgcaagaacattgggcccttatggaggagctgaatcgctcaaagaaggactttgaggctatcatccaagcgaagaacaaagagttggaacaaacaaaggaagagaaggagaagatgcaagcacagaaagaggaagtcctgtcccacatgaatgacgtacttgaaaacgaacttcagtgcattatctgctctgagtactttattgaagccgtgacactgaactgtgcgcattctttctgcagctattgcattaatgaatggatgaagaggaagattgagtgccctatttgtagaaaggacattaaaagtaagacctactcactggtcctcgacaactgcattaacaaaatggtcaacaacctgagcagcgaggttaaagaacgccgaatcgtgctcattcgcgagagaaaagctaaacggctcttttag

SEQ ID NO: 30690 - DNA, 297 bp, Artificial Sequence
  Description of Artificial Sequence: Synthetic coding sequence
atgggagaacctgggttctttgtgaccggcgatagggctggcggacgttcttggtgtctgaggcgtgtgggaatgtccgccggatggcttctgctcgaagacggatgcgaggtgaccgtgggacgtggcttcggtgttacatatcagctggtctccaaaatttgcccactgatgatcagccggaaccattgtgtactgaagcagaatcctgaaggacagtggacaattatggataataagagcttcccgagtgagaaggcagaagatttcacggcagcaggtgagcggtttctgtag

SEQ ID NO: 30691 - DNA, 1347 bp, Artificial Sequence
  Description of Artificial Sequence: Synthetic coding sequence
atgggggaacctggcttctttgtgactggggatcgggcagggggtcgaagttggtgtctacgacgcgtcggaatgagcgcaggatggctcttgctggaggatggctgtgaggttactgtggggaggggattcggggtgacttatcagctagtctctaagatttgccctctgatgataagccggaatcattgcgttctcaagcagaacccggagggccagtggacgatcatggacaacaaaagcctgaatggcgtttggcttaatagagcacggctcgagccactgcgagtctatagtatccaccagggggattacattcaattgggcgttcccctcgaaaataaggagaacgcagagtatgagtatgaagtgaccgaggaggactgggagactatttacccctgtttgtctccgaagaacgaccagatgatagaaaagaataaggagctgcggactaagagaaaattctccttggatgaactggccggaccgggagccgaaggcccttcgaatttgaaatcgaagattaacaaagtgtcgtgtgagtccggccagcccgtaaaatctcaaggaaagggcgaggttgcgagcaccccatcagacaatctggatccgaagctcactgcacttgaaccctccaaaacaaccggagcacctatctaccctgggtttcctaaagtgaccgaagttcaccatgaacaaaaagcaagcaatagctctgccagccaacgatcactccagatgtttaaagtcacaatgagcaggatcctcaggctaaagatacaaatgcaggagaagcatgaagcggtgatgaacgtgaaaaaacagacccaaaaaggcaactctaagaaagtggttcagatggaacaggagctacaagacctacagagccagctctgcgcagagcaggcccagcaacaggctcgagtggagcagttagagaaaacattccaagaggaggaacagcatttacaggggctggaaattgctcagggggagaaggatctgaaacagcagctggcacaggccctccaggagcactgggctctgatggaagaactgaaccgctccaagaaagacttcgaagcaattatccaggccaaaaacaaggagttggagcagaccaaggaggaaaaggaaaagatgcaggcacaaaaagaggaagtgctcagtcacatgaatgacgtactcgaaaacgaactgcagtgtattatttgtagcgagtattttatagagcaaagagattgttccgaggaccgcgcactgcgagcctttgagcgactgcctggctctgcgagcttgaggtggagcggaggatttagtctggcagtgacaccccttctgtag

SEQ ID NO: 30692 - DNA, 1593 bp, Artificial Sequence
  Description of Artificial Sequence: Synthetic coding sequence
atggctgacgatattgatatcgaagcaatgctggaggctccttacaagaaagacgagaacaaactatctagcgccaacgggcatgaggagaggtctaaaaagcgcaagaaatcaaaatcccgtagcaggagccatgagagaaaaaggagtaaatccaaggagcggaagagaagccgggatcgagaaaggaagaagtcaaaatcacgtgaacgaaaacgcagcaggtcgaaggaaaggcggaggagcagatctaggagtcgggataggcgatttaggggcagatataggagcccctatagtggtcctaagttcaattccgctattaggggtaagataggactcccccacagtattaagctgagcagaagaagatcaagatcaaaatcaccattcaggaaggacaagagcccagtcagagaacccattgataatctaaccccagaagaaagggatgctcgtacagtgttctgtatgcagctggcagcccgaattcggcctagggacctggaggaattcttctctaccgtgggtaaagtacgggacgtgcgtatgatctcggatcgcaattccagaaggtcgaaaggaatcgcctacgtagaattcgtggatgtgtcctccgtccctctcgccatagggctgacggggcaacgcgtgctgggagtaccaatcattgtacaggcttcacaggctgagaagaatcgcgcagctgctatggctaacaacctgcagaagggttccgccggaccaatgaggctgtacgtcgggagcctgcattttaatatcaccgaagacatgcttcgcggaattttcgagcccttcgggaggatcgagtctattcagctcatgatggacagcgaaaccgggagatctaagggatatggcttcatcacattctctgactccgaatgcgccaaaaaagccctggaacaactgaatggtttcgaactggcgggaaggcccatgaaggtgggccacgttaccgaacggactgatgccagtagcgcgtcttcgttcctcgactctgatgagctagaaagaaccgggatcgatttgggaactaccgggaggttgcaactgatggccaggttagcagaaggaacaggcttgcagatccctccagccgcacagcaggctctgcagatgtccggatctctggcctttggcgcagtggcagagttcagtttcgttatcgacctgcagactcggttgtcccagcagacagaggcctcagccctggccgctgccgctagcgtgcaacctcttgctacgcagtgcttccagctaagtaatatgtttaatcctcagacagaggaagaggtcggctgggacactgaaattaaagatgatgtgattgaagagtgtaataaacatggaggagtgatccatatttatgtagataagaattctgctcagggtaatgtgtacgtgaagtgtccttctattgctgctgccatcgctgcagtcaatgccctccatggccgatggtttgccggaaagatgataaccgctgcatatgtcccattgcccacctaccataacttatttcccgacagcatgactgccactcaactgctggtcccctcacgcaggtag

SEQ ID NO: 30693 - DNA, 1272 bp, Artificial Sequence
  Description of Artificial Sequence: Synthetic coding sequence
atggcggacgacattgacattgaagccatgttagaggccccttataaaaaagatgaaaataagcttagttccgctaacggacacgaagagcggagcaagaagcgcaaaaagtctaaaagccgtagccggtcacatgagcgaaagagatccaaatctaaagaacgaaaacgcagcagagaccgcgagcgtaagaagagcaagagcagagagagaaaacgtagcaggtccaaggagcggagacggtccaggtctcgttcccgggaccgcaggtttagagggagataccgcagcccttatagcggccctaaattcaactctgcaattaggggaaagataggattgcctcacagtataaagttgagccgacggaggtcccgtagcaaaagccccttcaggaaggataaatctcctgtacgggaaccaatcgacaatctgactccggaggaacgggacgctcggacagtgttttgtatgcagctggccgctagaatacgcccacgggacctagaggagtttttctcaactgtgggaaaagtgagggatgttagaatgatctccgatcgtaattcccgaagatccaaaggcatcgcgtacgtggaatttgtcgacgtttcctccgtgccactggcgatcgggcttaccggccagagagtgttgggagtgcccatcattgtccaggcctcccaagcggaaaaaaatagggcggctgccatggctaataacctgcagaagggatcagccggacccatgagactatatgtggggtccctgcattttaacatcacggaggatatgttgagaggaatctttgagccatttggtcgtattgagagtatccagcttatgatggacagcgagaccggtcgatccaagggctatgggttcatcaccttctccgacagcgagtgcgcgaaaaaagcactcgagcagctcaacgggttcgaattagctggtcggccaatgaaagtgggacacgtgactgaaagaaccgacgcctcctcagcctccagcttcctcgatagtgacgagttggagcgtaccggaattgatctgggaacaacaggcagactgcaactcatggccagactcgcggaaggaaccgggctgcagattcctccagcagcgcagcaagccctacagatgagtggaagtctggcattcggcgcagtggccgacctccagactcgtctttcccagcaaacggaggcgctctttgttatcatgttttggaatgagatctggtccgacaacatgatcaccctgcagctgtag

SEQ ID NO: 30694 - DNA, 1575 bp, Artificial Sequence
  Description of Artificial Sequence: Synthetic coding sequence
atggctgacgacattgacatcgaggccatgctggaggccccatacaaaaaggatgaaaataagctgtccagcgccaatggacatgaggagaggagcaaaaagagaaaaaagagcaagagcagatctaggtcccacgaacggaaacggtctaaatccaaagagcgcaaaagaagcagggaccgagagaggaaaaagtcaaaatcaagggagagaaaaaggtcacgatctaaagagcgcaggcgatcccggtccagatctagggatcgtcgtttcagaggcaggtatagatctccatacagcggacctaagtttaactctgccattcgcggtaaaatcggcctaccccacagcatcaaactcagtagaaggaggtctcggtctaagtcccctttccgtaaagacaaatctccagtgcgagagcccatcgacaaccttactcctgaggagcgcgacgccaggaccgttttttgcatgcagttggccgctagaattcgcccaagggatctcgaggagttcttcagcaccgtgggcaaagtgcgtgacgtgaggatgatttctgaccgaaacagcaggaggtcaaagggcatagcctacgtcgaatttgtggatgtgtcatccgtgccacttgcgatcggattaactggccagagagtgctgggggtcccaatcattgtccaggcatcacaggctgagaaaaaccgtgcagccgctatggccaacaatcttcagaagggatccgctggtccaatgcgactgtatgtggggtcacttcattttaacatcacagaagacatgcttcgtggcatatttgaaccttttggacgcatcgagtcaattcagctcatgatggactcagaaacaggtcgctccaagggttacggctttattactttctccgacagtgagtgtgccaagaaggccctggagcagctgaatggctttgagcttgccggacgcccaatgaaggtgggtcatgtgaccgaaagaaccgatgctagcagcgcatcttcatttctcgatagtgacgagctcgaacgtaccgggatagatctggggacaacagggaggctgcaactcatggcccgactggcagagggcacagggctacagattccccctgccgctcagcaggcacttcagatgtcgggtagtcttgcattcggtgcagtggcagacctgcagacacgtctctcccagcaaacagaggcttccgcactggctgccgcagctagcgtccagccactcgcgactcagtgttttcagctcagtaatatgtttaatccacagaccgaagaggaggtgggctgggatacagagatcaaagacgatgtgattgaagagtgcaataagcatggtggggtcatacacatatacgtcgataaaaactcagctcaggggaacgtctacgttaagtgcccttcaattgctgctgctatcgcggcagtcaacgcccttcacgggaggtggtttgccggaaagatgatcacagcagcttacgtccctctgcctacatatcacaacctgtttccagactccatgactgccactcagctcttagtgccatctcggaggtag

SEQ ID NO: 30695 - DNA, 696 bp, Artificial Sequence
  Description of Artificial Sequence: Synthetic coding sequence
atggccgacgacatcgacatagaggcaatgctggaagccccttacaagaaagacgagaataagctcagttctgcaaatggacacgaggagcgctccaaaaagcggaagaaatctaagagtcggtcgcggtcccacgaacgaaagaggagtaagagcaaggaacgcaagagaagccgtgaccgtgagcgaaagaagtccaagtcccgggagcgaaagcggtcaaggtctaaggagaggcgcagaagccgaagtcgaagccgagacaggagatttaggggacggtacagatctccgtactcgggccctaaattcaattcagctattcggggtaaaattgggctcccccatagcattaagttgcgcagacgatctaggtctaagtccccctttcgtaaggacaagtcaccggtccgggaaccgattgacaacttaactccagaggaacgggacgctagaaccgtgttctgtatgcaactggccgctcgaatccgacctagggacttagaagaatttttcagcacagtgggaaaggtccgagacgtcagaatgatcagcgaccggaattccaggcgcagtaagggcatcgcttacgtcgagttcgtcgacgtgagcagcgtgcccctggccattggacttacagggcagcgcgttcttggcgttccaataattgtgcaggcaagccaggctgagaagtag

SEQ ID NO: 30696 - DNA, 1122 bp, Artificial Sequence
  Description of Artificial Sequence: Synthetic coding sequence
atgcagttggctgccaggataaggccccgtgacctggaggagttcttctctacagtaggcaaagtgagagacgtcagaatgatttcagaccggaacagcaggagatctaaaggtatcgcttatgtggagttcgtcgacgtgtcctctgttcctctcgccattggattgaccggtcagcgagttctcggtgtgcctattattgtgcaagcttctcaggccgagaaaaatagggccgcagctatggccaacaatctccagaaaggaagcgccggtccgatgaggctatacgtgggaagcctgcacttcaatataacagaagacatgttacgcggaatctttgaacccttcggccgaattgagtctattcagttgatgatggactcagagacgggcaggtctaagggttacggattcataacattctccgattctgagtgtgccaagaaggccctggagcagctgaacggatttgagcttgctggacggccaatgaaagtcggccacgtgacggagcgcacagatgcaagttctgcaagtagcttccttgattcagacgagctggagaggaccggtattgaccttggtactaccggcaggctccaattgatggctcgactggcagagggaaccgggctccagattccgcctgccgctcaacaggccctccagatgtcagggagcctcgcctttggagcagtcgccgagttctcttttgttattgacctccagacccgactcagccagcaaaccgaggcctcggccttagccgcagccgcaagcgtgcagcctctggcgacccagtgttttcagctgtcaaacatgttcaacccacagacagaagaagaagtgggatgggacacggagataaaagacgatgtaattgaggagtgtaataagcatggaggcgttattcacatttatgttgacaagaatagcgctcaaggcaatgtttacgtgaagtgtcctagcatcgcggctgccatagccgcagtcaatgccctccacggcaggtggtttgccggaaaaatgattactgctgcctacgtgcctttacccacctatcacaacttgttccccgatagcatgaccgctacacagctgctggtacctagcaggagatag

SEQ ID NO: 30697 - DNA, 582 bp, Artificial Sequence
  Description of Artificial Sequence: Synthetic coding sequence
atggccgacgatatcgatatagaagccatgctggaagccccatacaagaaagatgaaaataagctatcatcagcgaatggccatgaggaacgtagcaagaagcgcaagaagagtaaaagtcgcagcaggagccacgagcgcaagcgtagcaagtcaaaagaacgcaagcgaagtagagacagggagcgcaaaaagagcaaatcacgtgagcgcaagcgatctagatcgaaggagcgaaggaggagtcgttcccgctccagagatagaagatttagaggtagatatagaagcccttacagcggacctaaatttaactccgctatccggggaaagatcggactaccacactccatcaagttgtcacggagacggtccaggtctaagagcccttttcgcaaagataaatcacccgtaagggagcctattgacaatctaactcctgaggagagagacgcaaggacagtgttctgcatgcaactggccgctcgcatcagaccaagggacctcgaggaattcttcagcactgttggcaaggtacgggacgtcaggatgatttccgataggaactctcgcaggtcctag

SEQ ID NO: 30698 - DNA, 1014 bp, Artificial Sequence
  Description of Artificial Sequence: Synthetic coding sequence
tagagccctttcagaaaggacaagtctccagtacgcgaaccaattgacaacctcacaccagaagaacgcgatgctagaaccgtcttttgtatgcagttagccgctcgaataagaccgagagatcttgaagagtttttcagtactgttggaaaagttcgggacgtgaggatgatcagtgacagaaatagccgccgttcgaaagggatcgcctatgtcgaattcgtggatgtcagttcagtgcccttggccatcgggctcaccggacagagagtgctgggtgtgcccatcattgtccaagcatcccaggccgagaagaaccgggctgccgctatggccaataatctgcagaaagggagtgccggtcccatgcgcctctacgtcggtagcctgcactttaatattaccgaagacatgctgcgcggaatcttcgagcccttcggcaggttcagcgacagtgagtgcgcgaaaaaagccctggaacagctgaatgggttcgaacttgctgggaggcccatgaaggtcggccatgtcactgagcggaccgatgcgtctagcgcctcctctttcctcgattctgacgagctcgaaaggactggcattgacctcggcaccacgggacgcctccaactcatggccaggctggctgagggtacggggctgcagatcccaccagcagctcaacaagctttgcagatgtccggaagcttagcattcggcgcagtcgccgaattcagctttgtcatcgacctgcaaacccggttgagtcagcagactgaagcctccgctttggccgctgcagccagtgtgcagcctcttgcaacacaatgttttcagctgtccaacatgtttaatccccaaacagaagaagaagtgggctgggacacagagataaaggacgatgtgattgaggaatgtaataaacacggcggagttattcacatctacgtggacaagaattccgcgcaaggtaatgtatacgtgaaatgtccctccattgccgcagccatcgcctag

SEQ ID NO: 30699 - DNA, 1527 bp, Artificial Sequence
  Description of Artificial Sequence: Synthetic coding sequence
atggccgatgacattgacatcgaagctatgctggaggctccttacaaaaaagacgaaaacaaactatcttccgccaatggtcacgaggagaggagcaaaaagcgcaaaaagtccaagagtcgctctagatcccacgaaagaaagcgctccaagagcaaggagcgcaagcgttctcgagatcgcgaacgtaagaaaagtaaatcaagggagcggaaaagatcccgctctaaggagagacggaggtcgaggagtcgttcccgggacaggcgcttcaggggcagatacagatctccatatcggaggagatcccggtcgaagtccccatttcgaaaggataagtctcccgtgagagagcccattgataatttaactcccgaggagagagatgccagaacggtgttttgcatgcagttggccgcaaggatccgtccaagggacctggaagagttcttctccaccgtgggcaaagtccgtgacgtccgcatgatctcagatagaaactctaggcgctctaagggcatcgcctatgtggagtttgtcgatgtttcttccgtgcctttagcgattggcctgacagggcagagggtactgggcgtgcctatcatagtgcaggcttctcaggcagagaagaaccgagccgctgccatggctaataacctacagaagggcagcgcaggccctatgagattgtacgtaggcagcttacattttaacattacggaggatatgttgagaggcattttcgaacccttcggtaggattgagtccatccaactaatgatggacagtgagaccggacggtcgaagggctacggatttatcacattctcagattccgaatgcgcaaagaaggcccttgagcagcttaatggctttgagctcgctggcaggcctatgaaagtcggccatgtcacagaaagaaccgacgcaagctcagcaagtagctttttggatagtgacgaactcgagagaaccgggatagatctggggactaccgggaggttgcaactcatggctaggctcgccgagggaaccggtctgcagattccgcctgccgctcagcaggccctacagatgtctggctcactcgcctttggtgcggtcgccgagttttcatttgtgatcgatttgcaaactaggctgtcccagcaaacggaggctagcgctctggctgcggcagctagcgtccagcctctggcaacccagtgttttcaattatccaatatgttcaacccacagacagaggaggaagtgggatgggataccgagatcaaagacgacgtgatagaagagtgtaacaagcacgggggagtgatacatatctacgtagataagaatagcgctcagggcaatgtttacgtcaaatgtcccagcattgcggcagcaatcgccgctgtgaacgctctgcatggaaggtggttcgccggtaagatgattacagccgcatacgtgcccttacccacgtatcacaatctctttcctgactcaatgaccgcaacgcaactcctagtgccctctcggagatag

SEQ ID NO: 30700 - DNA, 1176 bp, Artificial Sequence
  Description of Artificial Sequence: Synthetic coding sequence
atggtggaagctgacaggccaggaaagctgttcatcggagggctaaacaccgaaaccaatgaaaaagccttggaggccgtgttcggaaaatatggcagaatcgttgaagtccttcttatgaaggatcgagagacaaataaaagtagagggtttgccttcgttacctttgagagccctgcggatgcaaaggatgcagcacgggatatgaatggcaagagcctcgacggtaaagctatcaaggtagagcaggcgacgaaaccaagcttcgagtccgggagacgcggtcctcctcctcctccccgaagccggggtccgccaaggggcctccgcggtggcagaggtggatctggaggtacacggggacctccatctcgcggtggacatatggatgatggcggttattcaatgaattttaacatgtcaagcagccggggacccttgccggttaagcgcggacctccgcctcgctccggtggaccacctcccaaacggagtgctccttcggggccagtccgctcttccagcggaatggggggacgggctcccgtgtcccgtggtcgggacagttatggagggcctccgagacgcgagcctctgccctccaggcgcgatgtatatctgagcccaagggatgatggttattccactaaagactcttatagttcgcgagactacccaagcagccgggatacacgtgactacgccccaccacccagagactacacctaccgtgattatgggcattcttctagtagagatgattaccccagtcgcggatactcagatcgcgatggatacggcagggatcgggactacagcgaccacccatcaggtggcagttatagagattcctatgagagttatggtaattcaagaagcgccccaccaactagaggacccccaccaagctatggcggaagtagtaggtacgatgattacagctcatcaagagatgggtacggcggatctcgggactcgtatagtagctctcgttccgatctctattcttcgggtcgagacagggtgggcagacaagagcgaggactgcctccctctatggaaaggggttaccccccaccccgtgattcctatagtagcagcagcaggggcgctccgagggggggtggacgcggtgggagtcgatccgatagggggggtggacgcagccgctattag

SEQ ID NO: 30701 - DNA, 309 bp, Artificial Sequence
  Description of Artificial Sequence: Synthetic coding sequence
tgaatgtttatttgcccccaggaaatgatgggaatacttctcaaaaccgctattcaggcggaaatcacccaggtgttagtgatccttgagattatgcatcaccatcatgaaataatattgacagtcatcatggtgattccagtgcacgtcatgactattcatcaagaagatatcgccattgagatggatatggtggtgattgtaacaattcagattatccaggtcgaggttcccaccgaaatccacatgagggtgatggtgggagactttgctcactacggacggggtgtgctgatcgattcccaatag

SEQ ID NO: 30702 - DNA, 591 bp, Artificial Sequence
  Description of Artificial Sequence: Synthetic coding sequence
atggtcgaggctgatagacccggaaaactgtttattggaggcttaaatactgagactaacgaaaaggcactagaggccgtcttcggcaaatatgggaggatcgtcgaggtgctgcttatgaaagaccgtgaaactaacaagagtcggggttttgccttcgtcactttcgaatctcccgctgatgctaaggacgccgctagagatatgaacgggaaattattgtaccacgtcgaggagatagtgatggaggtgcaccttgagggtaaccgctgtcctttagttgagatgttcatctgccctcaggaaatgatgggaattctcctgaaaactgcgattcaagcagagatcacccaggtgttggttattctcgaaatcatgcaccaccatcacgaaatcatcctgaccgtgatcatggtcattccagtgcacgtgatgacaattcatcaggaagacatcgctatcgagatggatatggtcgttattgtgacaatacagatcatacaggtcgaagtgccaaccgagattcatatgcgcgtaatggtgggagactttgcccattatggtcggggtgttctgattgactcacagtag

SEQ ID NO: 30703 - DNA, 1137 bp, Artificial Sequence
  Description of Artificial Sequence: Synthetic coding sequence
atggtcgaggccgacaggccgggtaaattgttcattggtgggctgaatacggaaacgaacgaaaaagcactggaagctgtgttcgggaagtatggccgaatcgtagaagtgctgctcatgaaggacagagagtcaccggcagatgcaaaagatgctgcgagagacatgaatggcaagagcctagatggtaaagctataaaagtcgagcaggccaccaaaccatcgttcgaaagtggtcgaagaggcccaccacctccaccgagaagtagggggcctcccagaggcttgagaggcggtagaggtggttccggcggaactcgcggaccacctagcagggggggacatatggacgatggaggctacagcatgaactttaacatgtccagctctcgcggtccccttccagtaaagaggggaccacctccccgatctggcggacccccacctaaaagaagcgctccctctggcccagtgcgtagcagtagcggcatgggcggtagggccccagtgagcaggggcagagattcttatggtggaccaccccgaagagaacccttaccaagccgcagggacgtttatctgtcgcccagggacgacgggtactctacaaaagactcctattcttcacgagactacccaagttcaagggatacccgagactacgcccctcccccacgtgattatacatacagagattatggacatagctcctctcgcgatgactatccctctcgcggttattctgacagagatggatatggcagagatcgcgattacagtgaccatcccagcgggggaagctaccgggacagctacgagtcctacggaaacagcaggtccgcacctcccacgcgcggtcctcctccaagctacggtggctcatccagatacgatgactatagcagctcacgcgacgggtacggtgggagcagagactcgtattcgtcatccaggagcgatctgtactcgtccggaagagacagggtcgggcgacaagagcgcggtctgcctcctagtatggagcgcggttatccccctccacgggatagctactcctcaagtagtcgtggagctcctcggggtggcggtcgaggtggctctcggtccgaccgcggtggaggtcgatctcgctattag

SEQ ID NO: 30704 - DNA, 1443 bp, Artificial Sequence
  Description of Artificial Sequence: Synthetic coding sequence
atggctagcgactcaatatttgagagtttcccctcataccctcagtgctttatgcgcgagtgcatcctgggaatgaatccctctcgcgacgtgcatgacgcatccaccagtcgtcggttcacccctccatctactgcactgagtcccggaaaaatgagcgaggccctgcccttaggagctcccgatgccggtgctgcgctcgcagggaaattacgatcaggagatcgttctatggtggaagtgcttgccgatcatcccggtgagcttgtgcgcactgacagccccaattttctgtgttccgtcctgccaactcattggcgctgcaataagacacttcccatagcatttaaagtcgttgctctgggggacgtgcccgacggaacactggtgactgtcatggcaggcaacgacgagaactactccgccgagctgaggaacgctacggcggctatgaaaaatcaggtggctaggtttaacgatttgcggttcgtgggcaggtctggcaggggcaaaagctttacactgacgattaccgtcttcacaaaccccccacaagtggccacgtaccatcgggctattaagattacagtggatggcccaagagagccgaggcggcatcgccagaaactggacgatcaaaccaagccaggttccctgtcgttcagcgagcggcttagtgagttggagcagctgcgcagaacagccatgagagtgtcccctcaccacccggcaccaacccctaaccctcgagcctcactgaatcatagcacagcatttaacccccagccccaatctcagatgcaggatacccgccagattcagcctagtccaccgtggtcttacgatcagagctatcagtacttggggtctattgcctccccgagcgtacatcctgctactcctatctccccgggacgagcttctggaatgacaaccctgtccgctgaactttcaagcaggctttcaacagcgcctgatctaacggccttctctgatccacgacagttccctgctctgcccagcataagcgacccacgcatgcactaccccggagcctttacttactccccaactcccgtgacatcaggaataggcatcgggatgagcgctatgggcagtgcaaccagataccacacgtatctgcctcctccctaccccggatcttctcaagctcaggggggaccattccaggcatcttccccatcataccacctgtattacggcgcttccgcgggaagctatcagttctctatggtgggcggagaaaggtctccacctagaatcttgccaccctgtaccaatgcttcgaccggttctgctttgttaaacccttcactcccgaaccagtctgacgtcgtggaggcagaggggtcccactctaattctcccactaacatggcccctagcgcgcgactcgaggaagctgtgtggcgcccatattag

SEQ ID NO: 30705 - DNA, 1407 bp, Artificial Sequence
  Description of Artificial Sequence: Synthetic coding sequence
atgccggcagctccccgaggccctgcccagggcgaggccgctgcccgtacccgatccagggatgcttccacgtctaggcggttcacaccaccttccactgcactttctcccggtaagatgtcagaagcactgcctctcggagcccctgacgccggagcagcattggccggaaaactgcggtcaggcgatagaagcatggtggaggtactggctgatcatccgggtgagctcgtacgcactgactcacctaactttctgtgcagtgttctgcccactcactggcgctgcaacaaaaccctccccatcgcctttaaggttgtggccctaggggatgtccccgacgggaccctcgtcacagtgatggcaggtaacgacgaaaactactccgccgagctgcggaacgctactgcagccatgaaaaaccaagtggctagattcaatgacttgcgctttgtgggccgttccggacggggaaagagcttcacattaactattactgttttcactaaccctcctcaggtagcgacctaccatagagcgatcaagataacagtagacgggcctcgcgagccgagacggcataggcagaaactggatgatcagacaaagcctgggtccttgagcttcagtgagcggttatctgaactggaacaactccggagaaccgccatgagggtgtctccccatcacccagctcccactcccaacccacgggctagcctgaatcatagcacggcgtttaacccccagccacagtctcagatgcaagatactcggcagatccagccctcccctccctggtcatacgaccaatcgtatcagtatctgggctctatagctagtccttccgtgcacccggctactccaatttctcctggcagagcgtccggcatgactactctgtctgccgaactgtcctctaggctgagcaccgcacccgatctgaccgcattcagtgacccgaggcagtttcccgctctgccttccatctctgatcccagaatgcactatcctggcgcattcacctactcccccacgcctgtgacctctggaataggtattggaatgtccgccatgggcagtgcgacccggtatcacacctacctaccccctccatatcctggctctagccaggcccaaggaggtccgtttcaagcatcatccccatcgtatcatctgtattatggcgcaagtgctggctcctatcagttctcaatggtggggggagaacggtcccctccaagaattctccctccttgtaccaacgcatccaccgggagtgcattgctgaatccctcacttccaaatcaatccgacgtagttgaagccgagggaagtcacagcaatagcccaacaaacatggcgccatctgcccgtttggaggaggccgtatggcgaccgtactag

SEQ ID NO: 30706 - DNA, 1362 bp, Artificial Sequence
  Description of Artificial Sequence: Synthetic coding sequence
atgcgcatccccgtggatgccagtacctcacggagatttacacctccctctacagccctgagcccaggcaaaatgtccgaagccctgccactgggggctccagacgcaggcgctgccttagctggtaaactgagatccggcgacagatctatggtcgaagtgctggcggaccacccaggggagttggtgaggactgattcccccaatttcctgtgcagcgtcctgccgactcattggaggtgtaacaaaacgcttcccatcgctttcaaagtggtggctttgggggacgtacccgatggcacccttgtaaccgtcatggccggtaacgacgagaattactccgcagaattgaggaacgcaacagcagccatgaagaaccaggttgccagatttaacgacttgaggtttgtggggcgatcagggcgaggcaagtctttcacactgactataaccgtgttcactaatcctccccaagtagccacatatcaccgggcaattaagattaccgtcgacggcccacgcgagcctcgacggcaccgccagaaactagacgatcaaacgaagcccggtagtttgtcattctcagagcgcctttccgagctcgagcagctcagaagaacagctatgcgtgtgagccctcaccacccagcacctacaccgaatccaagggcctctctgaatcactctactgcattcaacccccagccccaaagccagatgcaagatacccggcaaatccagccgagccccccatggagctacgaccagtcctaccagtacctcgggtccatcgcctccccaagcgtgcacccagcaacccccattagccccggacgggcttcggggatgactaccctgtccgcagagctctcttcaagattgtcaacggcccctgatttgactgcgttcagcgatcccagacaattcccagctctgcctagcatcagcgatcctcgcatgcattaccctggagccttcacttatagtccaaccccagtcaccagcgggatcggaattgggatgtccgcgatgggctccgccaccaggtatcacacgtacctaccccctccatacccaggatcttcccaggcacagggcggacctttccaggcatcttccccttcgtaccacttgtactacggtgccagcgccggttcatatcagttctccatggtggggggtgaaagatcacctccaagaatcctgcccccttgcaccaacgcgtcaactggtagtgctctgcttaatccttcactccccaaccagagcgatgtagtggaggccgagggcagtcactctaattctccaacaaatatggccccatccgcacgcctggaggaggccgtctggcgcccttactag

SEQ ID NO: 30707 - DNA, 1428 bp, Artificial Sequence
  Description of Artificial Sequence: Synthetic coding sequence
atgaatcctagtcgggatgtccatgacgcatcgacatcgcgcagattcacccccccaagcaccgcgctatctcccggaaagatgagcgaagcactccctctgggggctcctgatgcgggagcagctctggcgggaaagctgagaagtggggatcggagcatggtcgaggtgctggcagatcaccccggagaattggtgcgcaccgactcccctaattttctgtgctctgtcttgccaacgcattggcgatgtaacaagacactgcctatcgcctttaaggtcgtggcactaggagacgttcctgatggcacattggttactgtgatggcgggaaatgatgaaaattattcagccgagctgaggaacgctaccgccgctatgaagaatcaggtggcaagattcaatgacctgaggtttgtcggaaggagtggaagaggcaaatccttcacactgaccataacagtgtttaccaatccacctcaggtagccacttatcaccgggctatcaagattacagttgacgggccacgggagcctcgcagacatcgacagaagctggacgatcagacaaaacccggatctctgtccttttcagagcgattgtccgagttggagcagttaaggcgtaccgccatgcgcgtcagtccccaccacccagcccctacacccaacccacgggctagcctaaaccattcaacagcttttaatccccagcctcagtcgcagatgcaagacactcgccagattcagccaagtccaccctggtcgtatgatcagtcatatcagtacctggggtccattgctagcccttcagtgcatcctgctacaccaatctctccaggacgtgccagcggaatgacaaccttgtccgctgagctgagttcgcgactcagtaccgcacccgacctgactgctttcagtgacccaaggcagtttccagcccttccgtccatctcggacccgcgtatgcattatcctggggctttcacgtatagccctacacccgtgacttccggtattgggatcgggatgtcagcgatgggcagcgcaaccagatatcacacgtatctgcccccaccttatccaggcagcagtcaggcccaaggtgggccattccaggccagctcgccatcataccatctctactatggagcctcggccggaagctatcagttctcaatggttggaggagaacggtctccacctcgtattttacccccttgcacaaacgcttctacaggcagcgcactgctgaacccttctctgcccaatcagtccgatgtggttgaggcggagggtagtcacagtaacagtccaacgaatatggccagggcgagttgctccaggcaagctagacgagatccaggaccctgggccaggccgccatcatggggtcggggaagaccaacagctagaatctcgctttag

SEQ ID NO: 30708 - DNA, 99 bp, Artificial Sequence
  Description of Artificial Sequence: Synthetic coding sequence
atggcttctgacagtatattcgagagcttcccctcctacccccagtgttttatgagggaatgtatcctgggaatgaatccctcccgggatgtccactag

SEQ ID NO: 30709 - DNA, 414 bp, Artificial Sequence
  Description of Artificial Sequence: Synthetic coding sequence
atgcaggatacgcggcaaattcagcctagtccaccatggtcctacgaccaatcatatcaatatttaggctccatcgcaagtccctcagtccatccagccacgccgatcagtcccggaagggcatcaggaatgaccacactctccgccgagctgtcctcccgcctctccaccgcacccgatctcaccgcattctcagacccgagacagtttcccgctctcccctccatctcagacccccgtatgcactacccaggcgcttttacatacagtcctacccccgtgacttctgggatcggcattggcatgtctgccatgggatctgccacacgctaccatacatatctcccacctccataccctggcagctctcaagctcaaggcggtccattccaagcctcatccccctcgtactag

SEQ ID NO: 30710 - DNA, 1443 bp, Artificial Sequence
  Description of Artificial Sequence: Synthetic coding sequence
atggccagcgattccatttttgagagtttcccaagctatccacagtgttttatgagagagtgtatcctcggcatgaaccctagccgtgatgtgcatgacgcaagtaccagccgccgatttacaccaccctccactgccctctccccaggcaagatgtctgaggccttgccactgggggcacccgacgccggagccgctctagcaggtaagctgcggtcaggggataggtcaatggtggaagttctcgccgaccaccccggagaattggtgcgtaccgatagccccaacttcctctgtagtgtgctacctactcattggcgctgcaataagacactgccgatagcttttaaggttgtggctttgggcgacgtgcctgatgggactctagtcactgtgatggctgggaatgatgaaaattactcagctgagctgcggaatgccacagccgcaatgaagaaccaggtggcccgtttcaacgatctccgattcgtgggacgatccggtaggggtaaatccttcacgctgacaatcacagtgtttaccaatccaccacaggtcgccacctatcacagggccattaagattacagtggacgggccacgagaaccgagacggcacagacagaaactggacgaccagactaagccaggctcattaagcttttccgaaaggctttcggaacttgagcagttaagacgcacagccatgcgagtcagccctcaccatcctgcccctacgcctaatcccagggcctccttgaaccactcgactgctttcaacccccagccacagtcgcagatgcaggacactcgccaaatccagccaagccccccatggtcttacgatcaatcttaccagtacctcggaagcattgctagccccagcgtccaccccgctaccccaatcagccctggcagggcctctggaatgacaacgctgtccgccgagctaagctcccggctttccacggctccagatctgacagcttttagcgaccctagacagttccccgctctgccttccatctctgatccaaggatgcactacccgggagcctttacctactccccaacccctgtcacttccgggattgggattggaatgagcgctatgggttctgcaacgcgatatcatacttacctgcctccgccttatccaggctccagtcaagcgcagggtggcccattccaagccagttccccttcctatcacctctattacggtgctagcgctggctcgtatcagttttctatggtgggcggtgagcggtcaccaccgagaattcttccaccatgcacaaatgctagtaccggctcagccttgctcaacccaagcctgcccaatcagagtgacgtggtcgaggccgaaggaagccatagtaacagcccaacgaacatggcacctagtgcgaggttggaagaagccgtatggcgcccatattag

SEQ ID NO: 30711 - DNA, 576 bp, Artificial Sequence
  Description of Artificial Sequence: Synthetic coding sequence
atgaatccaagtcgtgacgtgcacgacgctagcacaagtcgccgttttacccctccttcaactgctttgtcaccaggcaagatgtctgaggcacttccccttggagcaccagacgccggagccgcacttgcaggaaaactccgttcaggggatcggtcaatggtcgaggtgttggcagaccaccccggtgaactggtccgtaccgattcacccaacttcctgtgctctgtgctacccactcattggcggtgtaataagacactgccaatcgcttttaaagttgtggctttgggtgacgtccctgacgggactctggttaccgtcatggctggtaacgatgagaactactccgctgaactgcggaatgcaaccgcagccatgaaaaaccaggtggccaggtttaatgatctacggttcgtgggtcggagcgggaggggcaaatcttttacgctgacgattactgtgttcacgaatccgccacaagtggcgacctaccacagagctattaaaattaccgtagacggcccaagagagcccagaaattcacttacttggccccgataccctcacatatag

SEQ ID NO: 30712 - DNA, 753 bp, Artificial Sequence
  Description of Artificial Sequence: Synthetic coding sequence
atgcggattcctgtagacgccagtacctctagacgatttacgcccccttccacagctctctcccctgggaaaatgagcgaagccctgcctctcggggctcccgatgccggagctgctctggctggtaaactccgcagtggagacaggtctatggttgaagttctggccgaccatcctggcgagctcgttcgcaccgattctccaaacttcttgtgcagtgtgctgcctacacactggcggtgtaacaaaacactcccgatagcgttcaaggtggtggcactaggagatgttcctgacggaacattagtgacagttatggccggaaacgacgaaaactacagcgcagaattaaggaacgccacagccgctatgaagaaccaggttgctcgttttaacgacttgagattcgtcggaaggtctgggaggggaaagtcttttaccttgacaataactgtctttacgaatccacctcaagtcgctacctatcacagggctatcaaaatcactgtggatggaccgagagagcctcgcagacaccggcaaaagctggacgaccagacaaagccaggttcactttctttctccgaacgtctctccgagctggaacagctgaggaggaccgccatgagggtgtctcctcaccaccccgcacccacccccaaccctagagccagcctaaaccactccaccgcattcaaccctcagcctcagagccagatgcaagaagaggataccgctccgtggcgatgctag

SEQ ID NO: 30713 - DNA, 1770 bp, Artificial Sequence
  Description of Artificial Sequence: Synthetic coding sequence
atgctgcactccccccacaagcaaccacagaatcacaagtgtggagccaactttctgcaggaggatagcaaaaagagtcttgtctttaagtggctcatctcagctgggcactaccagccccctaggcctacagagagtttcaaggccgcatcctctatctacaatagaggttataagttctatttgaaaaaaaagggtggcactatggcatccaattcgctgttttcgactgttaccccatgtcagcagaattttttttgggatcccagcacaagccggcgatttagtccgccatcttccagtttgcagcccggtaagatgtcggatgtgagtccggtggtagctgcccagcagcaacagcagcagcaacaacagcaacagcagcagcaacagcagcagcaacagcagcagcagcaggaggctgccgcagccgctgccgcagctgcggctgctgccgctgccgctgccgctgtccctcgcctacgtccaccccatgacaaccgcaccatggtcgaaatcattgccgaccaccctgctgaactagttcgcacagattcgcccaatttcctctgctccgtgctaccaagccattggagatgtaataaaacacttccagttgccttcaaagttgtcgccctgggcgaagtgcctgacggtacagtggtcactgtgatggccggaaatgacgaaaattactcagcagaactgcggaacgctagcgcagttatgaaaaatcaggtcgctagatttaatgatttgagattcgtggggaggtcaggtaggggtaagagttttactttgacaatcaccgtgtttaccaacccccctcaggtagcaacgtatcacagagcaatcaaggtgactgtggacgggcctagggagccccgtcggcataggcagaaactggatgattccaagccatcactgtttagtgatcgcttgtcggatctgggacggatcccgcacccctccatgcgcgtcggcgtcccaccacagaatccacggccaagccttaacagcgccccttctccatttaatccccagggccagtcccaaatcaccgatccacggcaggctcaatcaagccctccctggtcctatgaccagtcttacccatcctatttgtctcagatgacctcgccttctatacactctaccacacccctatcaagcaccaggggaacaggccttcctgcaattacagacgtacccaggcgcatcagcgacgatgatacggccacatccgatttctgtctatggccgtccacgctgagcaagaagagccaggccggagctagcgaactgggccctttcagcgaccccagacaattcccctccatctccagcctgaccgagagcagattttctaaccccagaatgcattaccccgcaacatttacctatacccctcccgtcacctcgggcatgagcctcggaatgtctgcaacaactcactaccacacctacctgccgccaccctaccctggatcctcacaaagtcagtcaggaccatttcaaacaagctccaccccgtatctctattatggaacctcgagcggtagttatcagtttccgatggttcctgggggagaccgctctccatctcgcatgctgcccccatgtacaaccacatcaaatggcagcactcttctgaatcccaaccttcccaatcaaaacgacggcgtagacgctgacggctcccattcatctagtcctaccgtactaaattcctccggcaggatggacgagagcgtatggcgcccttactag

SEQ ID NO: 30714 - DNA, 1524 bp, Artificial Sequence
  Description of Artificial Sequence: Synthetic coding sequence
atgaggataccagtggaccccagtacaagccgccgattttcccctccttcgtcttccctccagccgggaaagatgtcagatgtgtctccagtcgtggcggctcaacagcagcagcagcagcagcagcagcagcagcagcagcagcaacaacagcaacagcaacagcaacaggaggcagccgctgcagccgctgcagctgcggcagccgctgccgcagcggctgcggtgcccagactcagaccaccccacgacaaccgtacaatggtggagataattgctgaccatccagctgagcttgttcgcacagattctcctaactttctctgtagtgtgttgcctagccactggcgctgcaataagaccttgcccgtggcttttaaggtcgtggccctgggggaggtcccggatggcacagtggtgactgtgatggctggcaacgacgagaactatagtgcagaactgcgtaatgcatcagcggtgatgaagaatcaggtcgcccgatttaacgatctccggttcgtgggtcgttcaggacgcggtaaatcctttactcttaccatcactgtgttcacaaatcccccacaggtggcaacgtatcaccgcgcaatcaaggtaacagtggatggccctagagagcccaggagacacagacaaaaattggatgattcaaagccaagcctcttctcagaccgcctgagtgacctaggtcggattccacatccttctatgagagtcggggtcccacctcagaaccctcgcccaagtttaaacagcgccccaagtccgtttaaccctcaaggacaaagtcagatcactgatcctcgtcaggcccagtcctcccctccttggtcctacgaccagagctaccctagctatcttagtcagatgacatcaccatccatccattcaaccacccccctgtcatccacccgcggaaccggccttccagccatcactgatgttccaaggcggatctccgatgacgacacggctacctccgacttctgtctttggccctccacgctgtcaaagaagagtcaagcgggtgcaagtgagttaggcccttttagtgatccaagacaattcccaagtatttcaagcttgaccgagagtcgcttctccaatcctcgcatgcattacccggcaaccttcacctacacgccccctgtgacgagcggcatgtctctcgggatgtcagccacaacgcattatcatacatacctaccaccaccctatccgggaagcagtcagagccagtctgggccttttcagacaagctccacaccctatctgtattacgggactagttctggatcttatcaattcccaatggtccctggtggcgaccgatccccttcccggatgctgccgccttgtactaccacctctaatggctcaacgctgttgaatccaaaccttcctaaccagaacgacggagtggacgccgatgggtcccatagctcttcaccaacagtgctcaactcctcaggcagaatggacgaatctgtctggaggccctactag

SEQ ID NO: 30715 - DNA, 1458 bp, Artificial Sequence
  Description of Artificial Sequence: Synthetic coding sequence
atgcgaatcccggtagacccttccacgtcaaggaggttctcccccccttccagcagtctgcagccgggaaaaatgtccgatgtttcaccggtggttgccgcacagcaacagcaacagcagcagcagcagcaacaacagcagcagcaacagcagcagcagcagcagcagcaggaagcagcagcagccgcagctgctgcggcagcagcagccgcagccgctgctgctgtgcctcggctgcggcctcctcacgacaaccggacaatggtggaaatcattgctgatcacccagccgagctggtcaggacggacagcccaaacttcctgtgctcggtactcccttcacactggcgctgtaacaaaacactgcccgtggcattcaaggttgtggcgctcggcgaggtcccagatgggacggtggtgacggtgatggcgggaaacgacgaaaattatagtgccgagctgaggaatgcttctgctgtcatgaagaatcaagtggctagatttaacgatttgaggtttgtgggtcggtcaggcaggggaaaatcgttcaccttaaccattactgtgttcaccaatcctcctcaggtggcgacatatcatcgggctatcaaagttacagtcgatggaccaagggagcctcgtcgacatagacagaagctcgacgattctaagccttcgctgttctccgacaggttgagcgacctgggaaggataccacacccaagtatgcgcgtgggagtgccccctcaaaatcctcgcccatcccttaatagcgcaccctccccctttaacccacaggggcaatcacagattactgaccccagacaggcccagtcttcacctccatggtcgtatgatcagtcctatccatcatacctcagccaaatgacatccccaagcatccattccaccacaccactttccagcactcggggtaccggcctccctgcaattacggacgtgccacgtcgtatctcaggcgcttccgagctaggccctttctcagaccctcggcagttcccatcgatctcaagcctgacggagtctcgcttcagtaatcccaggatgcactaccctgcaactttcacttatacaccacctgttacctctggaatgtcgctgggcatgagcgccacaacacactaccatacctatcttccaccaccctatccaggctcaagccagagccagagcggacctttccagacttcttcaactccatatttatactatgggacgtctagtggaagttaccagttccccatggtgccaggaggagatcgtagccctagccgaatgcttcccccatgtacaaccacgagtaatggctcaactttgctgaaccctaacctccccaatcagaacgatggcgttgacgccgacggatcacacagcagcagccctaccgtcctgaattccagcggaagaatggacgaaagcgtgtggcggccatattag

SEQ ID NO: 30716 - DNA, 1500 bp, Artificial Sequence
  Description of Artificial Sequence: Synthetic coding sequence
atggcctccaactctttgtttagtaccgttacaccatgccagcagaatttcttttgggacccttcaacctccagacgtttttccccaccatcaagctctctgcagccaggtaagatgtccgatgtctcccccgtcgttgccgctcaacagcagcagcagcaacagcagcagcagcaacagcagcagcagcagcaacaacagcagcagcaacaggaagctgcagctgcagccgcagctgcagctgccgcagcagcagccgctgcggcagtcccccgtctcaggcctcctcacgataatagaaccatggtcgagatcattgcagatcaccccgctgagctggtgcggacagactcccccaattttctgtgcagcgttctcccatcacactggcgctgcaataaaacactccctgtggcttttaaggttgttgcgctgggagaggttcccgatggcaccgtcgtgactgtgatggcgggaaacgacgagaactattctgccgagctgagaaacgcgagtgctgttatgaagaatcaggtggcgagatttaacgacctacggttcgtgggcaggagcgggagaggtaagtcttttacattgactatcacagtctttaccaatccgccacaggtggctacttaccacagggccatcaaagtgacagtcgacggcccacgcgaacccaggaggcataggcaaaagctggacgattctaagccctccttgttttcagacaggttatctgacctgggcaggatcccacacccctccatgcgtgtgggtgtaccacctcagaatccaagacccagtctgaacagtgccccatctccctttaatccacaaggccagtcccagatcaccgatcccagacaggcacagtcgtcacccccatggtcttacgatcagtcctacccatcttacctatcccaaatgacatccccttctattcatagtactacaccattgagcagtaccagggggacgggtctgcccgctattactgacgtgccaagacgtatctcaggagcttccgagttgggtcctttctccgatccgcgtcaatttcctagtatctcctcgctgacagagagcaggttctcgaatccacgcatgcactacccggcaacattcacatatactcctcccgtgacaagtgggatgagcctcggtatgtccgctaccacgcattatcacacgtatctgccccctccttatcccggtagctcacagagtcagtccggtccttttcaaactagcagtactccatacttgtactatggtaccagtagcggaagttatcagtttccaatggtgccagggggagaccggagcccatcccgtatgctgccaccttgtacaacaactagcaatggatcgaccctactcaaccccaatttgcctaatcaaaacgatggagtggacgccgacggtagccattctagttcccctaccgtgttgaatagcagtggcaggatggatgagtctgtctggcgcccatattag

SEQ ID NO: 30717 - DNA, 1566 bp, Artificial Sequence
  Description of Artificial Sequence: Synthetic coding sequence
atggcatccaacagcttattcagcacggtgactccctgccaacagaattttttctgggacccatctacttcacggaggttttctccaccatcaagctccctgcagccaggcaagatgagcgatgtgagccctgtagtagccgctcagcaacaacagcagcagcagcagcagcagcagcaacagcaacagcagcagcaacagcaacaacaacaggaagccgctgccgcagcggcagctgctgccgcagccgctgctgcagcggcagccgttccaagattaagaccgcctcatgataaccgcactatggtcgaaataatcgcagatcatcctgcagagctagtacgtactgactcgcccaacttcctctgcagcgttctgccctctcactggcgatgtaacaaaacattaccagttgcgtttaaggtcgtggccctcggagaggtacccgacggaactgtggtgactgtcatggccggtaatgatgagaactactctgcagaactgcggaatgcatcagcggtgatgaaaaatcaggtggcccgttttaacgatcttcgcttcgtcggacgaagtggaagagggaagagcttcaccctgaccatcactgtttttacaaacccaccccaggtggctacttaccaccgtgctatcaaggtgaccgttgatggcccacgagaaccacgccgacatagacagaagcttgatgattccaaaccgtcgctattcagtgaccggctgtcagaccttggaaggatccctcaccccagtatgagagtcggagtcccaccacagaatccaaggccttcattaaacagtgcaccctccccctttaacccacaaggccagagtcagatcacggatccaagacaagcccaatctagccctccctggtcctatgatcaatcgtacccctcctacctgtctcagatgacatcgccatcgattcacagtactactcctctgtccagcacaaggggaaccggccttccggcaatcacagacgtacccaggcgcatttctgatgatgacaccgcaacaagcgatttctgtctgtggccttccacactgtcaaaaaagtcccaggccggagcgtcagaattggggcctttttcagaccccagacagttcccctccatcagttcattgaccgaatcgcgtttcagcaatcccaggatgcactaccccgctacatttacttatacaccaccagtaacctcaggtatgtctctgggcatgtcagccactacccactaccatacctacctgcctcccccataccctggtagcagccagtctcaaagtggcccatttcagacaagtagtaccccctacctgtactatggaacttcaagtggatcttatcagtttcccatggttcctggcggtgatagatccccctccaggatgttgcccccttgcactacaactagcaatgggtcaaccctgttgaatccaaatctccctaatcagaacgatggagtcgatgcagatggatcacactccagctcccctactgtcttgaacagttctgggagaatggacgaaagcgtgtggagaccgtattag

SEQ ID NO: 30718 - DNA, 1566 bp, Artificial Sequence
  Description of Artificial Sequence: Synthetic coding sequence
atggcaagcaacagcctgtttagtacggtgacgccctgccaacaaaactttttctgggacccctccacttcccgacgtttcagtccacctagctccagtctgcaacctggcaagatgagtgatgtctctccggtagttgcagctcagcaacagcagcaacagcagcagcagcagcagcagcaacagcagcagcaacagcaacaacagcaacaggaagccgctgccgctgctgcggctgctgcggcagctgcagccgcagctgccgcagttccccgattgcgccctccacacgataatcgaacaatggtcgagattatcgccgatcatccggctgagctcgttcgcactgattccccaaatttcttgtgttccgtcctgccctctcattggagatgcaacaaaacgctgcccgtcgcatttaaggtggtggccctgggagaggtccccgatggtaccgtggttactgtcatggcgggtaacgacgagaattactcagccgaactgcgtaacgcttccgcagttatgaaaaaccaggtggcgaggtttaacgacctcaggtttgttggtaggtccgggaggggaaaaagttttactctcactatcactgtctttaccaatccaccacaggtggccacttatcatagggctatcaaagtgacagtggatgggcctagagagccccgacgccatcgccagaagctggacgatagtaagcccagtctcttcagtgaccggctgtccgatctggggagaatccctcatccttccatgcgtgtgggagtgccccctcagaacccaaggccctcactcaattcagccccttctccatttaatccacaggggcagagtcagatcacagatccacgacaggcacagtcctctcctccctggtcttatgatcagagctatccctcatacttgtcccagatgacaagcccaagtatacatagcaccacccctctcagcagcaccagggggaccggactgccagctatcacagatgttcccagaagaatcagcgatgacgacaccgccacatccgatttttgcctgtggcccagcactctttctaaaaaatcccaggcaggtgcgtcagagctcggtccatttagcgatcctcgtcaatttccatcaatctcttcacttaccgaatctcgcttctctaaccctcgcatgcattatcctgctactttcacttatactcctccagtgaccagtgggatgtctctaggaatgtctgcaactacgcattaccacacatacctgccgcctccctatcccggatcaagtcagagccagagcggaccttttcaaactagttctacgccatatttgtattatggtacctccagcgggagttatcagttccccatggtcccaggaggagatcgtagcccgagccggatgcttccaccttgcactacaacaagcaatgggagcactctgctgaatcccaatctacccaatcagaacgacggagttgacgccgatggctcgcatagttcatcaccgactgtgctgaacagtagcggaagaatggatgagtctgtttggagaccctactag

SEQ ID NO: 30719 - DNA, 1704 bp, Artificial Sequence
  Description of Artificial Sequence: Synthetic coding sequence
atgttgcatagcccccacaagcaaccccagaatcacaagtgtggcgctaattttttacaagaagacagcaagaaatcccttgtgtttaaatggctcatctcagcaggacactatcagccccctcggcctactgagtcctttaaggccgcttcctcaatatataaccggggttataaattctacctcaaaaagaaggggggaaccatggcttccaacagcctgttctctactgtcactccttgccagcagaactttttttgggatccatcaacctctaggcgtttcagcccaccaagcagcagtctccaacccggaaagatgtctgatgtgtctcctgtggtggccgctcaacaacagcaacagcagcagcagcaacaacaacaacaacagcaacagcaacagcagcagcagcaacaggaagcagccgctgctgctgctgctgcagctgctgccgctgccgctgcggcagccgtgcctcgcctgcgacccccacacgataaccgcactatggtggagattattgcagatcatcctgccgaactggtgcgtactgattcacccaatttcttatgttccgtgctcccttctcactggaggtgcaacaagaccctgccggtcgcatttaaggtggtggcattaggcgaggtaccagatgggacagtcgtgaccgtgatggcgggtaacgatgagaattacagtgcagagttgcggaacgctagtgccgtcatgaaaaaccaggtggcccgattcaacgacctgagatttgtcggtcgatccggcagggggaagagttttaccctgacaatcacggtatttacaaacccgcctcaggtcgctacttatcacagagccattaaagtaacggtggacggccctcgcgaaccaaggcgccatagacagaaactcgacgactctaaaccaagcctgttctccgacaggctgtccgatctcggccgaatcccacacccaagtatgagggttggtgtccccccacaaaacccacggcctagtctgaacagcgccccatccccctttaacccgcagggtcagtctcagattaccgacccgcgtcaggcccagagcagccctccttggtcgtatgatcagtcctaccccagctacctctcccagatgacctctccttctatacactcaaccacccccctaagctctacgcggggtaccggactgcctgcaattacggatgttcccaggagaatttctggggcaagtgagttggggccattctcggatccaagacagtttccgagcatctcctcacttacagaaagtcgcttttccaaccctaggatgcactacccggcaacttttacctacaccccgcctgtcacctcgggcatgtctctgggaatgtcggcaacaacacactatcatacctacctgccccctccgtatcccggatccagccaaagccagtccgggccttttcagactagcagtaccccctacctctactatggcacatcctctggaagctatcagttccctatggtgcctggtggtgaccgctccccctccagaatgcttccgccttgcaccactacatcaaatggttctactctgctgaatcccaaccttcccaatcaaaatgacggcgtggacgccgacggctctcacagttcatcccctacggtactcaattcttccgggaggatggacgagagtgtctggcgtccatattag

SEQ ID NO: 30720 - DNA, 1248 bp, Artificial Sequence
  Description of Artificial Sequence: Synthetic coding sequence
atgagaataccggtcgatcccagtacctcaagacgctttaccccccctagccccgcatttccatgtggtgggggaggaggcaagatgggagagaacagtggggcactgtcagctcaggccgctgtgggcccaggcggacgagctcgccctgaggtcaggtccatggtcgacgtactggcagaccacgctggagagttggtgaggaccgactcaccaaattttctctgtagcgtgctgccaagccattggcggtgcaacaagaccctgcctgtcgccttcaaggtcgtcgcgctcggtgacgtgccagatggcacagtcgtcacagttatggccggaaacgacgagaactactctgccgagctcaggaacgcctctgctgtcatgaagaatcaggttgccaggtttaatgatctgaggttcgtgggtcgctcaggaagaggaaaaagtttcacactgactatcacagtgtttacaaatcctacacaggtagcaacttaccatagggcgatcaaggttacggttgacggcccaagagagccacggaggcaccggcagaagttagaggaccaaactaagccctttccagatagatttggggatttggagcgcctcagaatgcgagttaccccgtcgaccccatcacctcgaggatcattaagtaccactagccacttcagtagccagccacagacccctatccaaggcacgagcgagcttaacccattctctgaccctagacagtttgataggtcatttcccactcttcccaccttaactgagtcccggtttcctgacccacggatgcactatcccggagccatgtctgcagcctttccctactcagccaccccctctgggacatctataagctcacttagtgtagcgggaatgcctgctacgtctaggtttcaccacacatacctcccaccaccctaccctggtgccccacaaaaccaaagtggcccatttcaggcgaatcccagcccataccacctttactacggaacgagctccggttcctatcagttttccatggtagccggatcgtccagtgggggagaccgttcccctacgcggatgctagcatcatgcacatcctctgctgccagcgtggctgctggtaatttgatgaacccatctctagggggacagagcgatggagtggaggctgatggaagccactctaatagccctaccgccctgtctacgcccggaaggatggacgaggcagtgtggcgcccatactag

SEQ ID NO: 30721 - DNA, 1290 bp, Artificial Sequence
  Description of Artificial Sequence: Synthetic coding sequence
atggcgagcaattctatctttgatagctttccaacttatagccctacattcatcagagatccgtccactagtagacgcttcacaccaccaagccctgcttttccatgcggaggagggggtggcaagatgggggaaaactccggcgctcttagcgcccaggccgcagtcggccctggcggtcgggcaagaccggaagtcagaagcatggtcgacgtgctcgcagaccacgcgggagaactcgtgcggacagacagtccaaattttctatgcagcgtgctaccctcccactggcgctgtaataaaactctgcccgttgctttcaaagttgtggccctgggagatgtcccggatggcactgtggtgacggtgatggcagggaacgatgaaaactactcagccgaactgcgaaacgcctcggcagttatgaagaaccaggtggcacggttcaatgacctccggttcgtcggacggagtgggagaggaaagagtttcacccttacaattacagtgtttactaacccaacacaggtggccacgtatcatcgtgcaataaaggtaacagttgatggcccacgcgagccaagaagacatcgacagaaactggaggaccagacgaaacccttccctgaccggtttggcgaccttgaacgcctgcggatgcgcgtgacgccgagcacacctagccccagaggatccctctccaccacttcacatttcagcagtcaaccccagactcctatacagggaacctccgaattaaaccctttttcagacccacgccagttcgatcgttcttttccaactcttcctacattgacggaatcccggtttccagatccgcgaatgcattacccgggtgctatgtccgcagcctttccatacagtgccacaccttctggaacctcaatcagttccctctccgtggccggtatgcccgcaacatctcgctttcaccatacatatctgccccctccctatccaggagcccctcagaaccagtccggaccatttcaggctaatccctccccctatcatctgtactacggaactagctcaggaagctaccagttttcaatggtcgcagggtcatccagtggcggtgaccggtcacctacacgaatgctggcctcttgcacttccagcgccgctagcgtcgccgctggtaacctaatgaaccctagccttggtggccaaagcgacggggtggaagccgatgggagccattcgaacagccctaccgctttgagcactcctggcaggatggacgaggccgtgtggcgaccctactag

SEQ ID NO: 30722 - DNA, 1290 bp, Artificial Sequence
  Description of Artificial Sequence: Synthetic coding sequence
atggctagcaacagcattttcgatagttttcctacttatagcccaaccttcatacgcgatccttccacctctcggaggttcaccccacctagtcccgctttcccatgcggaggaggcggaggtaaaatgggggaaaacagcggagcgctgagtgcacaggccgctgtagggccaggtggcagggcacggccagaggtgcggagcatggtggacgttctcgccgaccatgcaggggagctagtgcggaccgacagtccaaacttcctgtgttcagtgctcccctcccactggaggtgcaataaaactttgcccgtcgcttttaaagttgtggcgttaggcgatgtgccagatggcactgttgtgacggtgatggccggtaacgacgaaaactactcagctgagctgcgaaacgcctctgccgtcatgaaaaaccaagtagctagattcaatgatctaaggttcgtaggtagaagcggccgtggcaagtcatttacgctgacaataactgtcttcaccaaccccactcaggtggctacctatcatcgagctatcaaggtgacagtagatggaccaagagagccacgcaggcataggcaaaagctggaggaccagacgaagccatttcctgaccggtttggagacttggaacgtctgcgaatgcgcgtgacccctagtacaccaagtccgaggggaagcctctcgacgacatcacacttttcctcacagccccagaccccaatacaaggtacatctgagcttaaccctttctctgaccccaggcagtttgacaggagcttccctactctaccaacccttactgaatcccgcttccctgatcctaggatgcactaccccggagctatgtccgctgctttcccctattccgccacgccaagcggcactagcattagcagtctatccgtcgcgggtatgcccgctacctcacgattccatcacacctacctccccccaccctaccccggagcccctcagaatcaaagcgggccattccaggctaaccccagtccataccatctctattatggaacgtcttctggatcctatcaattttctatggttgcaggtagttcaagcggtggggaccggtcaccaaccaggatgctcgccagctgtaccagtagtgccgcaagcgtggctgcaggtaatctcatgaatcccagcttgggaggccaatccgacggcgtggaggccgatgggtctcatagtaactcacccactgcattgagcacaccaggcaggatggatgaagccgtctggaggccctattag

SEQ ID NO: 30723 - DNA, 1089 bp, Artificial Sequence
  Description of Artificial Sequence: Synthetic coding sequence
atgagaattcctgtggatccatccacttcccgtagattcacccccccttccccagctttcccatgtggagggggtggagggaaaatgggtgaaaatagcggagccttgtccgcgcaggctgccgtaggcccaggaggccgagcacggcctgaagtgaggagcatggtggatgttcttgcggatcacgccggtgagctggttcgcaccgactctccaaatttcctgtgctctgtgttgcccagccattggcggtgtaacaaaaccttgcccgtagccttcaaggtcgttgccctgggtgatgtgcccgatggcacagtggtaacagtaatggccggtaatgacgagaactactcagcggagctgcgcaatgcctcagctgttatgaagaaccaagtggcgcgattcaatgacttgagatttgtgggacggtcgggcagaggcaagtcattcaccttgactatcacagtcttcaccaatccaacgcaggtggccacgtatcaccgagctatcaaggtgactgtagacggcccaagagaacctcggagaacttctgagctgaatccattctccgacccacgacagttcgacagaagctttcccacgctccccacgttgactgaaagtcgcttccccgatcccaggatgcattaccctggggcaatgagcgccgcttttccctattcggccacgccttccgggacctccattagttcactgtcagtcgccggaatgccggctacttctaggtttcatcacacttatctgccgcctccatatcctggcgctccacagaaccagtctggaccattccaggccaacccaagtccatatcatctgtactatggcaccagctcgggatcttatcagttctccatggtcgcaggctctagttccgggggtgatcgcagccccacaagaatgctagcttcctgtacctcttcagcagctagcgtggcagccggaaacctcatgaatcctagcttggggggacagtcagacggcgtagaggctgatggcagccactccaattcccccacagctttgtctacgcccggacgtatggacgaagccgtgtggcgaccatattag

SEQ ID NO: 30724 - DNA, 969 bp, Artificial Sequence
  Description of Artificial Sequence: Synthetic coding sequence
atggtggttgctctgggggatgtgcccgatgggaccgtcgtaactgttatggccggtaacgacgaaaattatagtgcggaactgcgtaacgcttcagctgtcatgaaaaatcaggtcgccaggttcaatgatcttcggttcgtcggcaggagtggaaggggaaagtcttttacacttaccatcaccgtgttcactaatcccacacaggtggctacgtaccacagagcaattaaagtgactgtcgacggacctcgggagcctaggagacaccggcagaaactcgaggaccagacaaagcccttcccagaccggtttggcgacctggagcgattacgtatgagggtcaccccttctaccccgtcccctcgtggctcattgagtacaacatctcattttagttcacagccccaaactcctatacagggaacgtctgaactcaacccatttagcgatcctcgacagttcgaccgaagttttcctacactccctactctaactgaaagtcgattccctgacccacgcatgcattaccccggagcaatgtctgccgcttttccttatagcgcgaccccaagtggcacttctatttcatcgctgtctgtagccggaatgcctgccacctcccggtttcatcacacctatctcccacctccctaccccggagcccctcagaaccagagcggaccctttcaggcaaaccccagcccgtatcacctgtactatggcacatcaagtggctcatatcagttttccatggtggccggatcctccagcggaggcgatcggtcccctactagaatgttggcatcttgtacttcctctgctgcgagcgtggcagctgggaatcttatgaatcccagtctgggcggacagtccgacggggtcgaggctgacggatcccatagcaattctcctacagccctgtcaacacccggaagaatggatgaagccgtctggaggccttattag

SEQ ID NO: 30725 - DNA, 2439 bp, Artificial Sequence
  Description of Artificial Sequence: Synthetic coding sequence
atggacttcagccgactgcacatgtatagcccaccccagtgcgttcccgaaaacaccggatacacctacgcactttcatctagctatagctctgacgccttggatttcgaaacagaacataagctggaccccgtgtttgattcacctagaatgtccagacgttctttgcgtctagctacaacggcctgcactctgggtgatggtgaggcggtgggagctgattcaggcacctcgagtgccgtgagcctgaagaaccgcgcagctcggacaactaagcagagaaggtccaccaacaagtcagccttttcaatcaaccatgtgtctaggcaggtgacctcaagcggtgtgtcccatgggggtacagtgtctctccaagacgcagtgactaggagaccccctgtgttagacgagagctggattcgggaacagactacagtggaccatttttgggggctggacgatgacggtgatttgaagggcggaaacaaggcagccatacagggcaacggggacgtcggcgcagcggcagcgactgcacacaacggtttctcctgctcgaattgctccatgctctctgagaggaaagatgtgcttacggctcatcccgctgcgccagggccagtctctagagtctactcaagggatcgtaatcagaaatgtgatgactgcaaaggaaaacggcatctcgatgcccacccaggcagggccggtaccctctggcacatatgggcgtgcgcaggctattttttgctgcagatactcaggcgtattggtgccgttggacaggcagtgtccagaaccgcctggtccgccctctggctggcagtggtcgctccaggaaaagctgccagcggagtcttttggtggctgggcatcggatggtaccagttcgtgacgctgatcagctggctcaatgtgtttctcctgactcgttgcctgaggaatatatgcaaatttctcgtactcctgattcctctcttcctattgctcgccggtctgtccctgcggggacaaggaaacttcttctccttcctgcccgttctcaactgggcctccatgcacaggacccagcgggtggatgatccccaagacgtgttcaagccgacaaccagtcgcctgaagcaacctctgcaaggagatagcgaagccttcccgtggcattggatgtccggcgttgagcagcaggtagcttctctgtccggccaatgccaccaccacggagaaaatctgcgggagcttacgactctcctgcaaaagctgcaggctagagtcgatcaaatggagggtggagcggctggaccatccgcgtctgtccgcgacgcagttggtcaaccccctcgcgagacagatttcatggcatttcatcaagaacatgaagtgagaatgagccatctggaggatattttagggaagcttcgcgagaaaagtgaagccatacagaaagaactagaacaaactaaacagaagaccatttccgccgtcggagagcaacttctacccacagtggagcacctacaactggagctcgatcagctgaagtcggagctctcctcttggagacacgttaaaacgggttgcgagaccgttgatgccgttcaggagcgggtggacgttcaggtgcgtgagatggtcaaactcctcttcagtgaggaccagcagggaggtagtttggagcagttgctacagcgcttttcctcccaatttgtttctaaaggtgacctgcagactatgcttcgcgacttgcagctgcagatcctgaggaatgttacgcatcatgtgtcagtcaccaagcagctgccgacatcagaggctgtcgtatcagccgtcagcgaggcaggagcctccgggatcactgaagcacaggctagagccattgtgaactcagccctcaaactctatagccaggacaaaacaggcatggttgacttcgccctggaatccggcggaggctctatcctcagcactcgctgctctgagacgtacgagaccaagacggcacttatgtctctctttggcataccactgtggtatttcagtcagagccccagggtggttatccagcctgacatctacccaggaaactgctgggccttcaagggctcccaagggtacctggtggtccgcctctccatgatgatacatcccgctgcttttaccctggaacacatccctaagaccctgtcaccaacaggcaacatctcaagcgcccctaaggatttcgccgtttatggtctcgagaatgaataccaagaggaagggcagctgttaggtcagttcacctacgaccaggacggagagtccctgcagatgttccaggctctgaagcgacctgatgacaccgccttccagatcgtggaattgaggatcttctcaaattggggccacccagagtacacttgtctgtataggtttcgggtccacggtgagccagttaagtag

SEQ ID NO: 30726 - DNA, 2109 bp, Artificial Sequence
  Description of Artificial Sequence: Synthetic coding sequence
atgtcaagacgcagcctgcgactcgctaccacggcgtgcaccttgggagatggcgaagccgtgggggctgactctggcacatcatccgcagtgtctttgaaaaacagggccgcacgcacaactaagcagcgtcgcagcaccaacaagtcagccttcagcattaatcatgtctcccgacaggttacttcctcaggagtgtctcatggtggaacggtgtccctgcaggatgcggtaacccggaggcctccagtgctggatgagtcctggataagggagcagactaccgtcgaccatttctggggcctagacgatgatggagaccttaaaggcggtaacaaagccgctattcagggtaatggcgatgtcggcgctgccgcagccactgcccacaacggattctcatgttcaaactgcagcatgctgagcgagcgaaaggacgtcctcaccgcgcaccccgctgctccaggacccgtgtctcgagtgtactctagggataggaatcagaagtggaaggctgcctctggcgtcttttggtggcttgggattggttggtatcagttcgttactctgatcagttggttgaacgtgtttctgctgactcgctgtctgcggaacatctgcaagttccttgtgctcttaatacctctgtttctgcttttggcagggctgagtctgcggggacagggtaatttttttagcttcctgcctgttcttaactgggccagcatgcaccggacacagagagtggacgacccccaggatgtgtttaagccaaccacatcaaggctgaagcagcccctgcagggggacagcgaggcattcccatggcattggatgtcgggagtagagcagcaggtggcgtcactgagtggtcaatgtcatcaccacggagaaaatctgcgcgaactgacaaccctgttacagaagctgcaagcccgagtggaccagatggagggtggggctgctggcccttcagcctccgtgagagacgccgtgggacagcctcccagggagacggacttcatggcgtttcatcaggaacacgaagtgcggatgtcgcatttggaagacatcctggggaaactgcgcgagaaatcggaagcaattcaaaaggagttagaacaaactaaacagaaaaccatctccgctgtgggtgaacagttgttgccaactgtggagcatttgcagctggagctggaccagctcaagtcagagctcagcagttggcgtcatgtgaagaccgggtgtgagaccgtggacgccgtgcaagaaagagtagacgtgcaggtgagagagatggtgaagctgctcttttcggaggaccaacaggggggtagcctcgagcaactgctgcagcgctttagcagccaatttgtttctaagggcgatctgcagaccatgttgcgcgatctccagctccaaatcctcagaaatgtgactcaccacgtgagtgtgacgaagcagcttcctacgagtgaggctgtcgtgtctgccgtatccgaagccggagcatctgggattacagaggcacaggccagagccattgtcaactccgccctgaagctttatagtcaggataagacaggaatggtcgattttgcacttgagagtggagggggtagtatactgtccacaaggtgttctgaaacttatgaaactaaaacagccctcatgtcactgttcggaatcccactctggtactttagccagtcccccagggttgtcatccagccagacatttaccccggaaactgttgggcgtttaagggttcgcaaggctatctcgtagtgagactttctatgatgattcaccctgcagcattcacactcgaacatatacccaagactctgtcccctaccgggaacatttcttctgcgcctaaggacttcgcagtatatgggctggaaaacgaataccaggaagaagggcagcttctgggacaatttacctatgaccaagacggtgaatccctgcagatgttccaggcgctgaagcgtccagatgatacagcctttcagatcgtggagctccgcattttttcaaactgggggcatcccgagtacacttgcttgtatcgctttcgagtacatggagagcccgtgaagtag

SEQ ID NO: 30727 - DNA, 2358 bp, Artificial Sequence
  Description of Artificial Sequence: Synthetic coding sequence
atggacttttcccggcttcacatgtatagtccaccccagtgcgtgcccgaaaacaccggctatacatatgcactcagtagcagttatagtagtgacgccctggatttcgaaaccgagcacaagctggacccagtattcgacagtcctcgaatgagcaggagaagcctaaggttagccactactgcctgcaccctcggggacggtgaagctgtaggggctgattcgggcaccagctctgcagtctcacttaaaaatcgggcagctaggactacaaagcagcgacgatctacaaataagtccgcgttcagcataaatcacgtgtcccgccaggtgacatcctccggtgtcagtcacggcggtaccgtcagcctccaggatgctgtaacccgcagaccccctgtgttggacgaaagctggatacgggaacagaccactgtcgatcacttctgggggttggatgacgacggggacttaaaaggcggaaacaaggctgcaattcagggtaatggcgacgtgggagcagctgccgctactgctcacaatgggtttagctgctcaaattgtagtatgttgtccgaacgcaaagacgtgttgactgcgcaccctgctgctccgggtccggtctcgcgagtgtactcccgtgatcggaaccagaagtgctacttcttactccaaattctcaggcgcattggagctgtgggccaagcagtaagccggactgcatggtcagccctgtggctggcagtggtggcacctggcaaagctgcctctggggtgttttggtggcttggtatcggctggtaccagttcgtcacactgattagttggctgaacgttttcctcttaacccgatgtctgagaaatatttgcaaattcctcgttttgcttatacccctgttcctgcttctggctggactcagtttgcgtggccaaggcaatttcttttcttttctgccagtcctgaattgggcttctatgcaccggacccagagagtggatgaccctcaggacgttttcaagccaaccacatctcggttaaaacagccacttcagggcgatagcgaagctttcccgtggcactggatgtccggagtggagcagcaggtggccagtctgtccggccagtgtcatcaccatggcgaaaatctgagagagctgaccactctcctgcagaaacttcaagcccgagtggaccagatggagggcggagctgcaggaccttcggcctcagttcgggatgccgttgggcaaccccctcgagagaccgatttcatggcatttcaccaagagcatgaggtcagaatgtcacatttagaagacattctggggaagctccgggaaaaaagcgaggctattcaaaaggagttggagcagactaaacagaagacaatctcagccgtgggagaacagctacttccgactgtggagcacctgcaactggagcttgatcagcttaagagcgaactgagcagttggagacacgtgaaaactgggtgcgaaacagtggacgcagtacaggagagggttgacgtgcaggtccgcgagatggtcaagctgctcttcagcgaagatcagcaggggggtagcctggagcagctgctgcagcggttcagctcccagtttgtgagcaagggggacttgcagactatgttgcgagaccttcagctgcagatcctccggaacgtgacgcaccacgtttcagtcactaagcagctgcctacttccgaagcagtcgtctctgcagtctcagaagcaggggcatcggggatcacagaggcacaagccagagctattgtcaactccgccctcaagctctattcccaagataaaacaggtatggtggatttcgctctcgagagcggcggaggctctatactgtcaaccagatgttcagaaacatacgaaacaaagaccgcgttgatgagccttttcggcatcccgctctggtatttttcccagtcccctagggtggtgattcaacctgacatttatcccggtaactgctgggccttcaagggcagccaggggtaccttgtggtgaggctgtctatgatgatccacccagccgcatttacactggagcatattcccaaaaccctgagtcctacgggcaacatcagctccgccccaaaagatttcgccgtgtatggactcgagaacgagtaccaggaggagggacagctcctgggtcagtttacatatgatcaggatggcgaaagcttgcagatgttccaggctctcaagaggccggacgatactgcttttcagattgtagagctccgtattttttcaaactggggccaccctgaatacacatgcctctaccgcttcagggtgcacggcgagccggtgaagtag

SEQ ID NO: 30728 - DNA, 774 bp, Artificial Sequence
  Description of Artificial Sequence: Synthetic coding sequence
atggatttctcccgcctgcacatgtattctcccccacagtgcgtgccagaaaataccggctacacctacgcactctcttctagctactccagtgacgcactcgactttgagactgaacacaaactggacccggtgttcgatagtccaaggatgtctcgaaggtctctgcgccttgccacaacagcgtgcactttgggagacggtgaggcagtgggggctgactcaggcacaagtagtgcagtctctctcaaaaacagggccgcacggacaaccaagcagagacgcagcactaacaagagcgcctttagcattaatcatgtaagtcggcaggttaccagtagcggtgtgtcgcatggaggaaccgtgtctctgcaggacgcagtgacccggaggccacccgtgttggatgaatcctggattagggagcagactaccgttgatcatttctggggcctggatgatgacggggatctgaaggggggtaacaaagccgcaatccagggtaacggggacgtaggcgctgctgctgccaccgcacataatggcttcagttgctcaaactgcagtatgctctccgaaagaaaggacgtactgactgcccaccccgctgctcccggacccgtttcgagggtttacagtcgagatcggaaccagaagtgcaaatcgcaatcctttaagacacagaaaaaggtctgctttcccaatctgatcttcccgttctgtaaaagtcaatgtctccactatctctcatggcggctgaaaattatcccatag

SEQ ID NO: 30729 - DNA, 2469 bp, Artificial Sequence
  Description of Artificial Sequence: Synthetic coding sequence
atggactttagcaggctgcacatgtactcgcctcctcagtgcgtcccagaaaatacagggtatacctatgctttgtcctcttcttattcctcagacgccctggattttgagacagaacataagctggaccccgtgttcgattcgccgagaatgtcacggaggtcactccggctggcaacgacggcttgtactcttggagatggagaagcagtgggggctgattcaggaacctcctctgccgtcagcctgaaaaaccgggcagctaggacaacaaagcaaaggcgctccacaaacaaaagcgctttttctatcaatcacgtgtcacggcaggtgacatcatccggggtctcccatggtggaacagttagtttacaggacgccgtgacgcgccgacctccagtgctggatgaaagctggatacgggaacagacaaccgtcgatcacttttggggcttggatgatgatggcgatctgaaggggggaaacaaggccgctattcaggggaatggtgatgtcggtgcggctgccgcaactgctcataacgggttctcatgttcgaactgttctatgctgagcgaacgaaaggacgtcttaacggctcacccagcagctcctggcccagtatccagagtttactcacgggacaggaaccagaagtgcgacgattgcaagggtaagcgacatttagacgcccataccgccgctcatagccagagcccgaggttgccaggcagagcaggaactttgtggcacatctgggcctgcgccggatactttctcctacagatactgcgacggatcggcgcagtgggccaagctgtgagccgcaccgcttggagtgccctgtggttggccgttgtcgcacccggtaaagccgcaagtggtgtgttctggtggctgggcatcggctggtaccagtttgtgacactgatctcctggctcaacgtattcctgctaactaggtgcttgcgcaacatttgcaaattcctagtcctgttgattcctctgtttctccttttggctgggttatcactgcggggacagggcaactttttttcattcctgcctgtactgaattgggcctccatgcaccgtacccaaagagttgatgatccccaggacgtgttcaaacctaccacttctagactgaagcaacccctccagggggacagcgaagcattcccatggcactggatgtctggagtggagcagcaagttgcatccttatctgggcaatgtcatcaccacggcgagaatttgagagaactgaccaccctgcttcagaaactccaagcacgggtggatcagatggagggcggagccgctgggcctagtgcctctgtcagggatgccgttggccaacccccaagggagacagacttcatggcattccatcaggaacatgaagttcgtatgtcccacttggaagacatcctggggaaattgcgtgagaagagcgaagctatccagaaagagctggaacagacaaagcagaagacgatcagcgctgtaggcgagcagctactccctaccgtggaacacctgcaactggagctagatcaactgaagtcggagttgagcagctggcgccatgtgaagacaggctgtgagactgtggacgctgtgcaggaaagagtagacgtccaggttcgggagatggtcaagctcctgttttccgaggatcaacagggcggaagcctcgagcagctgttacagaggtttagcagccagtttgtgagcaaaggggatctgcagacaatgttgcgcgatctgcagctgcagattctcaggaatgttacgcaccacgtttccgtcacgaaacagttgcctacttccgaggcagtggtgtctgccgtctctgaagcaggcgcatcgggcatcactgaggctcaagccagggccatcgtgaactccgctctaaaactttattcacaggacaagactggaatggttgacttcgccttggagtccgggggaggatcgatcctcagcactcggtgcagtgaaacctacgagactaaaacagctttgatgtcactgtttggcattcccctctggtacttttcccagtctcccagagtagtgatccagcccgacatttaccccggaaactgctgggcctttaagggaagtcaagggtatctggttgtaagactttccatgatgatccatcccgctgcttttaccctggagcatataccaaagacgttaagtcctactggtaatattagttcagccccaaaagatttcgcagtgtacgggctggaaaacgaatatcaggaggagggacagttactggggcaattcacctatgatcaagacggtgaaagcctccaaatgttccaggctctcaaaaggccggatgacaccgccttccaaatagttgaactccgcatattcagtaattgggggcatcccgagtacacatgcctgtacaggtttagggtgcacggagagccagtgaagtag

SEQ ID NO: 30730 - DNA, 1752 bp, Artificial Sequence
  Description of Artificial Sequence: Synthetic coding sequence
atgaaattgagctacgaatcagagaattataaattgaaaactcatgagtccaaagactgcgaatctgaatcttacaagagcaagagtcacgaatctaaagcacatgccagctattatggacgcatgaatgttcgtgaagtgctacgcgaagatgggcatctctcagtgaatggtgaggccctttggaaagccgcatcaggcgtgttctggtggttgggcatcgggtggtatcagttcgtgactttaatttcttggctgaatgtcttcctgcttacccgctgtctaaggaacatctgtaagttcctggtccttttaatccccttgtttttgctgctggccggattgtctttaagaggacagggaaactttttctcatttctgccagtgctcaactgggcgtccatgcatcgtacacagagagtggacgatccccaagatgtgttcaaacccacaaccagtcgactgaaacaacccttacagggcgattctgaggcatttccctggcattggatgagcggagtagagcagcaggtggcatctctgagtggacagtgtcaccaccacggcgaaaatctacgggagctgaccacactgctccaaaaactgcaggcacgggtcgatcagatggaaggtggcgctgctggtccttccgcttccaccgatttcatggcttttcaccaggaacatgaggtccgaatgagtcacctcgaagacatcctcgggaaactgcgagaaaagtccgaggctatccagaaagaactggagcagacaaagcagaagaccataagcgcggtgggggagcagttgttaccaacagttgaacatctgcaactggaactagaccaactaaaatctgagttaagtagctggcggcacgtgaaaacaggttgtgaaacagtggacgctgtccaagaacgggtcgatgttcaggtcagagagatggtcaagttactgttttcagaagaccagcaaggcggttcactggagcagctgctacagcgtttctcctcgcagtttgtcagcaaaggtgatctgcagacaatgcttcgagacctccaattgcaaatcctgaggaacgtcacacaccacgtttctgtaacaaagcagcttccaacctccgaagccgtggtcagcgccgttagtgaagcaggggcatctggaatcactgaggcacaggccagggccattgtcaactccgcacttaagctgtacagtcaggacaaaacaggcatggtggacttcgccttggagagcggagggggaagtattctatccacaagatgttccgaaacttacgaaactaagacggcactcatgagccttttcgggatccccctgtggtatttcagccagtcgccgcgagtggtgatccagcccgacatttatccaggcaactgttgggcctttaaaggttctcaggggtatctggtagtgagactgtccatgatgattcaccccgcagccttcactctggagcacatacctaaaaccctgtcccccaccggcaatatctcctcagctcccaaggattttgccgtctatggcttggaaaacgaataccaggaagagggacagctgttgggacaattcacctacgaccaggatggagaaagtctgcagatgttccaggctcttaaacgtccagacgatactgcattccagattgtggagctgagaatctttagcaactgggggcatcccgagtacacatgtctataccgcttccgagttcatggagagcccgtgaagtag

SEQ ID NO: 30731 - DNA, 342 bp, Artificial Sequence
  Description of Artificial Sequence: Synthetic coding sequence
atggatttttcccgattgcatatgtatagtccccctcagtgcgtacccgagaatactggctacacgtatgccttgtcttcgagctactcatccgatgcactagactttgagaccgaacacaaattagatcctgtcttcgactcccccagaatgtctagaagaagccttcggctcgcaacaaccgcttgcactctgggcgatggagaagcagttggagccgactccggtactagttcggctgtttccctgaagaatagagccgcacggacaactaaacaacggcgatctactaataagagtgccttctctattaaccacgtttcaaggcaggtcacctcctag

SEQ ID NO: 30732 - DNA, 267 bp, Artificial Sequence
  Description of Artificial Sequence: Synthetic coding sequence
atggactttagtcgactccacatgtacagcccgcctcagtgtgtgccagaaaatacagggtacacatatgccctgagctctagctattcaagtgatgccctcgatttcgaaaccgagcacaaactcgacccagtgtttgacagcccccgtatgagcaggaggtctctgcgattggcaactactgcctgcacactgggcgacggggaggccgtgggtgcggactcaggcaccagcagcgctgtgagcttaaaaaatagagccgcttag

SEQ ID NO: 30733 - DNA, 2109 bp, Artificial Sequence
  Description of Artificial Sequence: Synthetic coding sequence
atgagcaggaggtccttgagactcgctactaccgcttgcacccttggtgacggagaagctgtgggcgcagactcgggtacatctagtgccgtatccctcaaaaacagagctgcacgcaccactaagcaacggcgttccacgaataagagtgcattcagcataaaccacgtgagccgacaggttacctcttcaggagtttcccatggaggaacagtgagcctccaggacgctgtaacacgacgcccaccagtactggacgagagttggatccgggagcaaacaaccgtggatcatttttgggggctcgacgatgatggtgacctgaaaggaggcaacaaggcggctatacaaggtaacggcgacgtgggagcagctgctgccaccgctcacaacggtttctcctgttctaattgctccatgctgtccgaacgaaaagacgtactgacagcgcatccagctgcgcctgggcctgtatctagagtttacagcagggacagaaatcagaagtggaaagccgcatcgggagtgttttggtggctcggtatcggatggtatcagttcgtcacacttatctcatggctgaatgtattcctcctgacgagatgcctgaggaacatttgtaagtttttggtcctcctcatccctcttttcttgctgttggccggactgtcccttcgtgggcagggaaactttttcagctttctgccggtacttaattgggcgtctatgcatcgaactcagcgcgtcgacgacccgcaagacgtgttcaagcctactacctcgcgactgaaacagccactgcagggcgactccgaggcgttcccttggcattggatgtcgggcgtggagcagcaggtagcatctcttagcggacagtgccatcaccatggcgaaaatctacgggaactgaccaccctgctgcagaaactgcaggcccgtgttgaccagatggaaggcggagcagctggaccctcagcctcagttcgagatgccgtcggtcagcctcccagagaaacggacttcatggcgttccatcaggagcacgaagtaagaatgtctcacctggaggatatactgggcaagctgcgggagaagtctgaagcgattcaaaaagagctagagcagactaagcaaaaaacgatttccgctgtaggcgagcaactactgcccacagtcgagcacttgcagctggagctggatcagctgaagtcagaactgtcctcttggcggcatgtgaagactgggtgcgagaccgtggacgctgtgcaggaacgggtagacgttcaagtccgagagatggtgaaactgctgttttcagaagatcagcagggagggtcccttgaacaattgctgcagcgatttagtagccaatttgtgtccaagggagatctgcagacaatgctgagggatctgcaactgcagatcctcagaaacgtgacccaccacgtgtctgtcacaaagcagctgccgacgtctgaggctgtggtgtctgcagttagtgaagccggtgcttccggaatcacagaggcccaggccagagcgatcgtgaacagcgcacttaagttgtattctcaggataagacggggatggtcgacttcgctctggaatccggtggcggttcgatactttccaccaggtgttctgagacatatgaaacgaagacagccttgatgagtttattcggaatccccctgtggtacttcagtcaatcaccccgagtcgttattcagcctgacatctatccagggaattgctgggcgtttaaaggctcccagggctacctagtagtgagactcagcatgatgattcatccagcggctttcactctcgagcatattcctaaaaccctaagtcctaccggaaacatctccagcgctcccaaggactttgccgtgtatggattggagaatgagtatcaggaagaagggcaactattgggccagttcacatacgatcaggacggagagtccttgcagatgtttcaggccttgaaaaggcctgacgataccgctttccagatcgtagaactcaggattttctccaactggggacaccccgagtacacctgtctatatcggttcagagtccacggggagcccgttaaatag

SEQ ID NO: 30734 - DNA, 525 bp, Artificial Sequence
  Description of Artificial Sequence: Synthetic coding sequence
atggactttagcagactgcatatgtactctccgcctcagtgtgtccctgaaaacacagggtatacatacgcactctctagctcatactccagtgacgcccttgactttgagactgaacacaaactcgatcctgtgttcgactctccacggatgtccaggaggtctctccgcttggcaaccaccgcctgcactctcggggacggagaagcggttggggcagactccggaacctcctccgccgtctccctgaaaaatcgtgctgcgaggaccaccaagcagcggcgatcaaccaacaaaagtgcctttagtatcaaccatgtgtcccggcaggtgacttctagcggggtatctcatgggggaactgtttcgcttcaggacgccgtgacccgcagacccccagtcctcgatgagtcatggatacgggagcagactacagtggatcatttttggggacttgacgacgatggtgacttgaagggaggtaacaaagcggcaatacaggggaacggcgacgtgggggcttag

SEQ ID NO: 30735 - DNA, 408 bp, Artificial Sequence
  Description of Artificial Sequence: Synthetic coding sequence
atggactttagcagattgcacatgtacagccccccacaatgtgtccccgaaaacactggatatacttacgccctgtcctccagctatagcagtgatgcactggactttgaaacagagcacaagctagaccccgtgttcgattctccgaggatgtctcggcgtagtctgaggctcgccaccaccgcttgtaccctgggagacggtgaggcagtcggcgcagattcaggcaccagctctgctgttagcctgaagaaccgcgcagctcggacgacgaagcaaaggcgctccacgaacaaatccgcgtttagtattaatcacgtctccaggcaagtcactagtagcggcgtcagccatggagggacagtgagtctgcaagacgccgtaacccgacggcctcccgtactgtag

SEQ ID NO: 30736 - DNA, 267 bp, Artificial Sequence
  Description of Artificial Sequence: Synthetic coding sequence
atggatttcagccggctccatatgtatagcccaccacagtgcgttcctgaaaatactggttatacatatgctctgtccagctcatatagtagcgatgcattggattttgaaaccgaacacaagttagacccagtgtttgactctccaaggatgagtaggaggtcactccgacttgcaacaacggcctgtactctgggcgatggtgaggcggtaggcgctgactccgggacatcctcagcagtatcgttgaaaaatagagcagcttag

SEQ ID NO: 30737 - DNA, 2049 bp, Artificial Sequence
  Description of Artificial Sequence: Synthetic coding sequence
atggacttcagtcggcttcatatgtactcccctccccagtgcgtgccagaaaacactggctatacctacgcactgtcgtcttcatatagcagtgacgcattggattttgaaactgagcacaagctggaccccgtgtttgactcacccagaatgtcacggaggagtctgagactggctaccacggcatgtactcttggtgacggcgaggccgtgggggcagactctggaacctcctcagctgtgtccctgaagaacagggccgcacgtactaccaaacagcggagaagcacaaacaaatctgctttctcaatcaatcacgttagccgacaggtaacctcctcgggggtgagccatggaggaacagtgtcccttcaggacgcagtgaccaggaggcctcctgtgctcgatgagagctggatccgagagcagaccaccgttgaccatttctggggcaaggctgcctcaggggtgttttggtggctcgggattggatggtatcagttcgtgaccctcatctcctggctcaacgtgtttctgctcactcggtgcctgcggaacatttgtaaatttctcgttctgctgatcccactgttcctgctcctgggcctcagccttcgcggtcaaggaaactttttcagcttcctcccagtgcttaattgggccagtatgcatagaacccagcgcgtggatgatcctcaagacgtgtttaagcccacaacaagccggttaaagcagcccctgcagggagactccgaggccttcccgtggcactggatgtctggggtggagcagcaggtggcctcccttagcggccagtgccatcaccacggggagaatctgcgcgagcttaccaccttactgcagaagctacaagccagagtggaccagatggaaggaggcgcagccggaccctcagcttccgtaagagacgccgtcggacagccacccagagagaccgacttcatggccttccaccaggagcatgaggtgcggatgagccatctcgaggatattttaggtaaactaagagaaaaatccgaagctatccagaaagagctggaacaaaccaaacaaaaaactatttccgccgtgggggagcagctcctgccaacagtggagcacctccaactggagctggatcagctgaagagcgagctgtcttcatggaggcacgtcaagacagggtgtgagacagtggatgcagtccaagaaagggtggacgttcaggtcagggagatggttaaacttctgttcagcgaggaccagcagggtggaagcctggagcagctgctgcagagattttcatcacagttcgtgtctaaaggggacctgcagaccatgctgcgcgacttgcaactgcaaatcctgcgcaacgttacacaccatgtcagcgttaccaaacagcttcctactagtgaagcggttgtaagcgcggtctccgaggcaggagcgtctgggatcaccgaggctcaagccagggcaatcgtcaactcagcactgaaactgtactcccaggacaagacggggatggtggacttcgcccttgaatctggcggtggctctatcctgagcactaggtgttcagagacctacgaaaccaagaccgctctgatgtccttattcggcatacccctgtggtacttctcccaatccccgagggttgtgatacaacctgatatatacccaggaaattgttgggccttcaagggaagccagggataccttgtggtgcgactttccatgatgatccatcctgccgcttttaccctggagcacataccaaagaccctcagcccaacaggtaacatttcctctgcgcctaaagactttgctgtgtacgggctcgagaatgaatatcaggaggagggacagttgcttggccagttcacctacgatcaggacggggaatcattgcaaatgtttcaagcattgaagcgcccagacgatacagcctttcagatcgttgagctgcgaatcttttcaaactgggggcaccccgagtatacttgtttataccgtttccgagtccacggtgaaccagtcaagtag

SEQ ID NO: 30738 - DNA, 2925 bp, Artificial Sequence
  Description of Artificial Sequence: Synthetic coding sequence
atgggtgacgtcagaaaagctaaggaagcccttgcagaggttcagatccctcctcctgacgctggcccatcccccagatgtaagcccccacctgctgaaaggctgctgggacctggcagaagacgccgaggacttagacgcagacgggaagctgtgtggttcgaagtggttaatatggacttcagtcgattgcatatgtacagcccacctcagtgcgtccctgaaaatactggctatacgtacgcactgtcctcttcatactctagcgacgcgctggacttcgaaaccgagcataagctggacccagtgttcgatagccccaggatgagcagaaggtctctccgcctggctactacagcatgtaccctcggtgatggagaggcggtgggtgcagatagcggtacatcttctgcagtgtctcttaaaaaccgagctgcccgaacaaccaagcaaaggcggtccacaaataaatctgccttctcaatcaaccacgtatcacgccaggtgacttcatccggcgtgagccacggcggaacagtatcactgcaggatgcagtcactagacggcctcctgttttggacgagagctggattcgggaacagaccaccgtggaccacttttggggcctggacgatgacggcgaccttaaggggggtaacaaagctgccattcagggaaatggggacgttggggcagccgcagccaccgcccacaatggcttctcctgcagcaattgcagcatgctctcggaaagaaaagatgtcctcacagctcaccctgcagctccgggtccagtgtcgagagtttactcacgcgatcgcaaccagaagtgtggagcatccttctacgttaatcgcatcctttggctggccaggtacaccgcttcctcattctcgtctttcctggtccaactgttccaggttgttttgatgaagctttcctacgagtcagagaattataagctgaagactcacgaatcaaaagactgcgaatctgagagctataaatctaagagccatgaaagcaaggctcacgcttcctactacgggagaatgaacgtgcgcgaggtcctgagggaagatggtcatttatccgtcaacggcgaggcactctgcgacgattgcaagggaaagaggcacctcgacgcccataccgccgcacattcacagtcaccgcgactacctgggagggccggtaccctgtggcacatatgggcatgtgcaggctatttccttctgcagattttaagacggataggcgcagttggccaggccgtgtcccggactgcctggtcagccctatggcttgcggtcgttgcccctggaaaggctgcttctggtgtcttttggtggctgggtattggttggtatcagttcgtgacgctgatctcctggctaaacgtgttcctgctgacccgctgtttgcgtaacatttgcaaattcctcgtgttgctaatccctctgttcctactactggccggactcagtttaagggggcagggtaatttcttctcttttcttcctgtcctcaactgggcctctatgcaccggacacagcgcgtggacgatccgcaggacgtcttcaagccaacaacttcccggctgaagcagcctctgcagggcgactcggaagcattcccttggcattggatgagcggagtggagcagcaagtggcaagcctgtcagggcagtgtcatcaccacggagagaatctgcgtgagttaacaactctcctgcagaagctccaggctagagtggaccaaatggagggaggagctgccggtccatccgcatccgtacgggacgctgtaggccaaccccctagggaaacggactttatggcttttcatcaggagcacgaagtgaggatgtctcatctcgaggacatcttgggaaagctgcgcgagaaatcggaagcaattcaaaaagagctagaacaaaccaagcaaaagactattagcgctgtgggggagcagttgttgccaacagtggagcacctccagcttgagcttgatcagctgaaaagtgaattgtccagctggaggcacgtgaagactggatgtgagacagtggacgccgttcaggagcgagtggatgtccaggttagagagatggtgaagcttctcttctcagaggatcagcagggtggatcactggagcagcttctgcaaagattcagcagtcagtttgtgagcaaaggagacttgcagaccatgctgagggacctacagctgcagatattgaggaatgtcacccaccacgtatccgttaccaaacagctgccaacttctgaggcagttgtttcagcggtgtctgaggccggtgcgtctggcataacagaagcacaggccagagccatcgtcaacagcgccctgaagttatacagccaggacaagacaggcatggtcgactttgcattggagtcgggagggggaagtatactttccactagatgctcagagacctacgaaaccaaaactgctttaatgtcattgttcgggatccctctgtggtacttctcccaatctcccagggtcgtaatccagccagacatctaccctggtaattgctgggcgtttaagggttctcagggatacctggttgtgcggctctcaatgatgattcacccagccgcttttacattggagcatattcctaagaccctcagtcctaccgggaacataagctctgccccaaaggatttcgcagtgtacgggctcgagaacgagtatcaggaagagggccaactgctggggcaatttacttatgatcaggatggagagagtctgcagatgttccaggcccttaaacgacctgatgatacggcatttcagattgttgagctacgcatattttccaactggggacatccagaatatacctgtctttacaggttccgagttcacggcgaacccgtgaaatag

SEQ ID NO: 30739 - DNA, 837 bp, Artificial Sequence
  Description of Artificial Sequence: Synthetic coding sequence
atggggcgtatttcacccggatcaccagggctccctaggactgtgtggttcgaagtggtgaacatggattttagcaggctgcacatgtactcaccgccacagtgcgtccccgagaatacaggctatacttacgccttatcctcatcctattcgagcgatgcacttgatttcgagacagaacataaactcgatcctgtcttcgatagccctagaatgagcagacgctcactgcgactcgcaactacagcttgcacactgggtgacggcgaggcagtaggggctgactcaggaacttcttctgccgtgagcctaaagaacagggccgcacgcacgactaagcaaaggaggtccactaacaagtccgctttttcaattaaccacgtgtcaagacaggtgactagctctggggtgtcccatggtggaacagtgtctttgcaggacgccgtcacccgcaggccgcctgtgctcgatgaatcctggattagagaacagacaaccgtcgatcacttctggggcttggatgatgatggcgatctcaagggcggtaataaagccgctatccagggtaatggagacgttggtgctgcggctgccactgcccacaacggattcagttgctcgaattgttccatgctgtccgaaagaaaagacgttctgactgcccacccagcagctccaggtcctgtgtcacgagtgtattcaagggatcggaaccaaaagtgcaagagccagtcttttaaaacccaaaaaaaggtctgttttcccaatcttatctttccattttgtaagagccagtgcctgcactacctgagctggagactcaaaattattccttag

SEQ ID NO: 30740 - DNA, 360 bp, Artificial Sequence
  Description of Artificial Sequence: Synthetic coding sequence
atggatttttcccgtctgcatatgtactcacctcctcagtgtgttcctgaaaataccgggtatacatatgcactctcctcgtcttactcaagtgatgccctagacttcgagacagaacataagctggatcccgtgttcgatagcccacgcatgtctcgtcgcagccttaggctggcaacgaccgcatgcaccctcggcgatggagaggctgtaggcgcagactctgggacatccagcgctgtgtccctgaagaaccgcgcagcccgaactaccaaacagcggagatcaaccaacaaatccgccttcagtataaaccacgtgtcaaggcaggtaacttcctccggggttagtcatggttag

SEQ ID NO: 30741 - DNA, 2352 bp, Artificial Sequence
  Description of Artificial Sequence: Synthetic coding sequence
atggtgatcatgtctgagttctctgcagaccccgctggtcaggggcaaggtcaacagaaacctctgagggtgggtttctatgatatcgagcgcaccttgggtaaggggaactttgcagtcgttaagcttgccagacatagagtaactaaaacgcaagtggcaatcaagatcattgataaaacccgcttagacagctctaacctagagaagatctaccgggaggtacagctcatgaaactgttaaaccaccctcacatcatcaagttatatcaggttatggagaccaaggatatgctttatatcgttacagaattcgcaaagaatggggaaatgtttgactatctcacaagtaacggtcatctgagcgagaacgaagccaggaagaagttctggcagatactcagcgccgtggagtactgccatgatcaccacattgtccatcgggaccttaaaaccgaaaaccttctcctggacgggaatatggacatcaaattggcagattttgggtttgggaacttttacaaatccggcgaacccctctctacttggtgcgggagccctccatacgccgctcctgaggtcttcgagggaaaggaatacgagggcccacagctggacatatggagtttgggtgtagtgctctatgtcctcgtgtgcgggtctttgccatttgacggcccaaacctcccgactttgcggcagagggtgctggagggacgcttcaggattcctttcttcatgtcccaggattgtgagtcgctaattcgccgtatgcttgtcgtagatcctgccaggcgcatcaccattgcccaaatccgacaacaccgctggatgcgcgctgagccttgtctaccagggcctgcttgccccgcatttagtgcccacagttatacaagtaatctgggcgactacgatgagcaagctttgggaatcatgcagactctgggagtggacaggcagcggacggtcgaaagccttcagaattcatcatacaatcacttcgcagcaatctattatctgttgcttgagcgtttaaaggaatatagaaacgcacagtgcgcccgtccaggccctgccagacagccaaggccacgctcatccgatctctccggcctcgaggttccccaagaggggctcagcactgatccattcaggccagcgttgctgtgtcctcagccccagacgctggtgcaatccgtgctgcaggctgaaatggattgcgagttacaaagctctctgcagtggcctctgttttttcctgtggacgcgagctgttcaggtgtgttccgacctaggcctgtgtcacccagctccctcctcgacaccgcgatatcggaagaggcacgccagggtcccggactcgaagaggaacaggatactcaggagtctctgcccagttcaacaggccgacgtcacaccctcgcggaagtgtcaacgcgcctttcccctctaaccgcaccgtgcatcgtcgttagccccagcaccaccgccagcccagcagagggtacatcctccgatagctgtcttactttttccgcttcgaagagccctgcagggctgtcagggacccctgcaacccagggcctgctgggggcttgttctccagtgcgtctggcgagtccctttcttggctcgcagtctgctacacccgtgctacaagcgcagggtggcctaggaggagcagtactgcttccagtaagtttccaggagggcaggcgagcctccgacacctcactcacacaggggctaaaggcctttaggcagcaactgaggaagacgacacgcacaaagggattccttgggctgaacaaaatcaaggggctggctcggcaagtctgccaggcacccgcatctagggcatctcgcggaggactcagtccctttcacgcacccgcacagtctcccggtctgcacgggggtgcagctggctcccgggagggttggagtctgttggaggaagtcctcgagcagcagagattgctacagctgcagcaccatccggctgctgcccctgggtgttcccaggccccacagcctgcacccgcaccttttgttatcgctccttgtgatggacccggagcagcgccactccctagcaccttattgacttccggactaccccttttgccacctcctctgctccagacaggcgcatctcctgtggcctcggccgctcaactgttggatacacacctacacatcggtacaggacctacagctctgcctgccgtgcctccccctcgcttagcgcgactggctcccggatgcgaacccctgggtctgctccaaggtgattgcgagatggaggatctgatgccatgctccttgggcacatttgtactggtccaatag

SEQ ID NO: 30742 - DNA, 3744 bp, Artificial Sequence
  Description of Artificial Sequence: Synthetic coding sequence
atggaggatgccggtgcagcgggaccagggcctgagcccgaacccgagcccgagcccgagccagagcccgcacctgagcctgaacctgaacccaaaccgggagctgggacaagcgaggcttttagccggctctggaccgatgttatgggaattttggacggatccctggggaatattgatgatttggctcaacaatacgcagactactataatacatgcttttccgacgtttgtgagaggatggaggagctgcgcaagagacgagtttctcaggacctggaggttgaaaagccagacgcctcccccacttcattgcagctccgctcccaaatcgaggaaagccttggcttttgtagtgctgtcagtacccccgaggtcgagcgtaagaatcccctacacaaatccaatagtgaagattctagtgtgggtaaaggcgattggaaaaagaagaacaagtacttctggcagaatttcagaaaaaaccagaaaggcattatgcgccagaccagcaagggagaagatgtcgggtacgtcgcgagtgagatcaccatgtccgatgaggagaggatccagctcatgatgatggtgaaggaaaagatgatcacgattgaggaggcgctggccaggttaaaggaatacgaggcccagcaccggcaatcggcggcattagacccagctgactggccggacggttcttacccaacatttgacggtagctcaaactgtaatagccgagagcagagcgatgacgagaccgaggagtcagttaagttcaagaggttgcacaaactggttaatagtacccgcagggtccgaaagaaactcatacgcgttgaggagatgaagaagcccagcaccgaaggtggtgaggaacacgtgtttgagaacagcccagtgctcgacgaaagatcagccctgtacagcggtgtgcacaaaaagccacttttcttcgacggcagtccagaaaagccacccgaggatgactccgattcccttacaacatctccttcctcctctagcctggatacgtggggcgcaggcagaaagcttgttaaaaccttcagtaagggtgaatcaagaggactcatcaagccccctaaaaaaatgggtactttcttcagctatcctgaggaggagaaagcacagaaagtgtcacgctccttaacggagggggaaatgaaaaaggggctggggtctttaagccacggccgtacatgttcgtttggaggcttcgatttgaccaatagaagcttgcacgttggatctaacaactcggatcctatggggaaagaaggggatttcgtgtacaaggaagtcatcaaaagccccacggccagccggatctccctgggtaagaaggtgaaatccgtgaaggagacgatgagaaaacgaatgagcaagaagtacagcagttctgtgagcgaacaagacagcggcctggacggtatgcccggttcacctccaccgtcacagcccgacccagagcacctcgacaagccaaaactcaaggccggtggcagcgtagagagcctccggtcaagcctttcaggacaaagtagtatgagtggacaaacagtgtcaaccacggactcatccactagtaacagagaaagcgtgaaatctgaggatggtgacgatgaggaacccccatataggggtcccttttgtggcagggctagagtgcatacagacttcactccgagtccctacgacacagatagcctgaaattgaagaaaggtgatataattgacataataagtaagcctcctatgggaacctggatgggactgctgaacaataaggtgggcacctttaaattcatctacgtagacgtgttaagcgaggatgaggagaagcccaaacgtcctacccggcgacgtaggaagggacggcctcctcagccaaaatccgttgaggatttactcgaccgcattaacctaaaagagcatatgcctactttcctgtttaacggctacgaggatttggacacatttaagctactcgaggaggaggacctggatgaactgaacatcagggatcccgagcatagggctgttctcctgaccgcagtggaactgcttcaagagtatgacagtaacagcgaccagtctggttcccaagagaagctgttagtagactcacagggactgagtggctgctcacccagagatagtggctgctacgaatcaagcgagaatctggagaatggcaagacacgcaaggcctctctgctcagcgccaagagctccaccgagccctctctgaagtctttttctcggaaccaactggggaattaccccaccctcccacttatgaaatccggagacgccttaaaacagggccaggaggaaggcaggctgggtggcggactggcacctgacacaagcaaaagttgcgacccaccaggagttaccggcctcaataagaataggcgctccctgccagtcagtatttgtcgtagttgcgaaaccctggaggggccacagaccgtggatacgtggcctaggtctcactctctcgacgatctgcaggtggaacccggagccgaacaggacgtgccaacagaagtgactgaaccacccccacagatcgtgcccgaggtgccccagaagaccacagcgagctccacaaaagcgcagccacttgaacaggatagtgcagtggataatgccttattactgacccagagcaagcgtttttccgagcctcagaaactgaccaccaaaaagttagaagggagcatagcagctagcggcagaggactgagcccccctcagtgcttacccaggaactacgatgctcagccacccggtgccaaacatggcctcgcgcgtacacccttagagggccaccgcaaggggcacgagtttgaaggaacccatcatcctctggggacaaaagagggagtggacgccgaacaacgaatgcagccgaaaatccccagccaacccccacctgttccagcaaaaaaatctagggagcgtctggccaatggacttcaccccgtgccaatgggcccttctggtgccctaccctctcctgatgcaccatgcttacccgtaaaacgcggaagcccagcatctccaacatctcccagcgactgcccacctgcgcttgccccaagaccgctgtccggacaggccccaggctctcctccttctacccgtcctcctccctggctcagcgaactcccagagaacacttccctgcaggagcacggcgttaagttagggcctgctctcacccggaaggtctcctgtgcaagaggcgtcgacctagagaccctgacagaaaacaagttgcacgccgagggtattgatctaactgaagagccgtactcagacaagcacggcaggtgcggcatcccggaggccttggtgcagcggtacgcagaagatttggatcagccggaacgggatgtggctgcaaatatggatcagatcagggttaagcagctacgcaaacagcacaggatggctattccttccggtggcctcaccgaaatttgtcgcaagcccgtctcgccgggttgcatcagtagcgtgagcgactggctcattagcattggtttgcccatgtacgctggcacccttagcacagctggcttttccacattgagccaagtcccctctctttcccacacatgcctgcaggaagccggtattaccgaggagagacacatccggaagttgttgagcgctgccaggctcttcaagctgccccctggacccgaggccatgtag

SEQ ID NO: 30743 - DNA, 255 bp, Artificial Sequence
  Description of Artificial Sequence: Synthetic coding sequence
atggaagaacaggattgtcgggatggcagtttaggaaatatcgacgatcttgcacagcagtacgcggactattacaacacctgcttcagtgatgtctgcgagaggatggaggagctccgtaagaggcgagtatcccaggacttggaggttgagaagccagatgccagcccaacttccctgcagctgagaagccaaatcgaagagtcactgggcttttgttcagccgtgagcactccagaggtggagaggaagtag

SEQ ID NO: 30744 - DNA, 249 bp, Artificial Sequence
  Description of Artificial Sequence: Synthetic coding sequence
caggctcaggatttcaaagatggttctctcggcaatatcgatgacttagctcagcagtacgccgactactataatacctgtttctcagatgtgtgcgagcgcatggaggaacttcggaaaagacgcgtgagccaagacctagaagtggagaagcccgatgccagtccaacctccctgcagctaagaagccagatagaggagagtctgggtttctgttctgccgtgagtacacctgaggtcgagcgctag

SEQ ID NO: 30745 - DNA, 2091 bp, Artificial Sequence
  Description of Artificial Sequence: Synthetic coding sequence
atgccaaagccttcccgcgagcagagcgatgacgagacggaggaatccgtcaaatttaaacgtctccacaagcttgtgaattctacgaggcgggtgaggaaaaagctgataagagtagaagaaatgaagaaaccttcaacggagggaggggaggaacacgtgttcgaaaacagccccgtgctggacgagcggagcgctctttactcgggtgttcacaagaaaccactattttttgatggaagccctgagaagcccccagaagacgatagtgacagcctaactactagcccatcgagcagcagtctagatacctggggagctgggaggaagctggtgaagactttctctaagggggaatcccgcggattgatcaagccccctaagaaaatgggtactttcttttcatacccggaggaggagaaggctcagaaggtaagcagatcattgacagagggcgagatgaagaagggcctgggatcactgtctcacggcagaacttgcagctttggcggattcgacctgacaaatagatcactgcatgtagggagtaacaacagcgatcccatgggaaaagagggcgacttcgtgtataaagaggtgatcaagtcgcctaccgcttctaggatctccctcgggaaaaaggttaagtccgttaaagaaacgatgcggaagcgaatgagtaagaagtacagctcttctgtcagcgaacaagacagtggtttggacggcatgcccggatccccaccaccttcccagcctgacccagagcatttggacaaacccaagttgaaggctggcggtagcgttgaaagcttgagaagtagcctgagtggccagtccagcatgagtggccagaccgtgtccaccactgatagcagtaccagcaaccgggaatccgtgaagtctgaggatggcgatgacgaggaacctccttaccgcggtcctttttgtggtagggctcgcgtgcacacagattttactccatccccgtacgatactgatagtctgaagctgaagaaaggggacattatagatatcatatctaagccacctatggggacttggatgggcctgctgaacaacaaggttggcaccttcaagtttatctacgttgacgtgttaagcgaagacgaggagaaaccgaagcggccaaccagacggcgtaggaagggacggcctccgcagccaaagtcagttgaagacttgctggatcgcatcaatcttaaagagcacatgcccacgttcctcttcaatgggtatgaggatctcgacaccttcaaacttctcgaggaagaagatctcgatgagctcaatattcgagatccagagcatagagcagtcttgttgacggccgtggaattattgcaggaatacgacagtaacagcgatcaatcgggttcacaggagaagctgcttgtggacagccaggggctgagcggctgctccccaagagacagcggctgctacgaatcctcagagaatttagagaacggtaagacccggaaggccagcttgttgtctgccaagagcagcactgaaccttcgctgaaaagcttctctagaaatcagctgggcaactatcccacactacccttgatgaagtcaggtgacgctctgaagcagggtcaggaagaaggcagacttggaggaggattggctcccgacacatccaagagttgtgatccacctggagtcaccggcttgaacaaaaatcgaaggtcattgcctgtgtccatatgtagaagctgcgagacactggaaggcccacaaacggtagatacctggccgaggtctcactcactcgacgacctgcaggtcgagcccggagcagaacaagatgttccaacagaagtgactgaaccaccgcctcaaatcgtgccagaggtcccacaaaagaccactgcaagctcaacaaaggcccaacccctggaacaggactctgcagtcgacaatgctctcctcctgacccagtcaaaacgattctccgagccacagaagctgacgacaaaaaaactggaaggctctatagcagcttccggcagaggcctgtcacctcctcaatgtctcccgaggaattacgatgctcagtag

SEQ ID NO: 30746 - DNA, 1974 bp, Artificial Sequence
  Description of Artificial Sequence: Synthetic coding sequence
atgggaacctggatgggactgttgaataacaaggttggcaccttcaaattcatttacgttgatgtgctatccgaggatgaggaaaaaccaaagcggccaacaagacggagacggaagggtagaccaccccaacccaaatccgtcgaagaccttctggatcgtattaatctaaaggaacatatgccaacatttcttttcaatggttacgaagatctagacacctttaagttactcgaagaagaggatctggatgaactcaatatcagagaccctgagcatcgtgcggtcttgctgactgccgtcgaactgctgcaggaatacgactccaatagtgatcaatctggttcccaggagaaactcctcgtggacagtcaggggctctctggctgcagccctcgcgattccggttgctacgagtcatctgagaatttagaaaatggcaaaaccaggaaggcatccctcctatcggccaaatcttctaccgaaccttccttaaaaagtttttcacggaatcaacttggcaattatcctacattacccctcatgaagagtggagacgccctgaaacaaggccaggaagaaggaaggttgggaggcggattggctccggataccagtaagtcctgcgatcctcctggggtcacaggacttaataagaataggaggagtctgcccgtgagcatctgtcgctcctgcgagacattggagggccctcagaccgtggatacttggcctagaagccatagcttggacgatcttcaggtagagccaggagccgagcaggatgtgccaactgaggtcacagaacccccacctcagatcgtgccagaggtgccgcagaagactaccgcatcctctactaaggctcaaccactcgagcaggatagtgccgtggataatgcccttctgctcactcagtctaagaggtttagtgagccacagaaactgactactaagaagctagaggggtctatcgccgcttccggtcggggtctgtctccaccgcagtgcctgcccaggaactatgatgcccaacccccaggggcaaagcacggactggccagaaccccactcgagggccacagaaagggacatgagttcgagggcacccatcaccctttaggaacaaaggaaggcgtggatgccgagcaaaggatgcagcccaaaattccctcccagccaccccctgtgccagcaaagaagtctagagagcgactggctaacggcctgcacccagtccccatgggtccttcaggcgctcttcccagccccgatgctccttgtctccccgttaaaagaggctcacccgcttctcccaccagcccctccgattgtcctcccgctcttgcaccacgtcccctctccggacaggctccagggtccccgccatccactaggccgccaccatggttaagcgaattaccagagaatacttccttacaagaacatggcgtgaagttgggacctgcattgacccggaaggtgtcctgcgctagaggagtcgatttggagacactcacagagaataaattgcacgcagagggtatagaccttacggaagagccttattccgacaagcacggccgatgtggaatccccgaagctctggtccaaaggtacgccgaagacctcgaccaacccgaacgcgacgtggctgcgaacatggaccaaatccgggtgaaacagctgcgtaagcaacaccgaatggcaataccttctggaggactgacagagatctgtcgtaagcctgtttctccaggatgtattagctcagtgtccgattggctgatctcaatcgggctgcctatgtatgctggcacgctgagcacagcgggttttagcactcttagccaggttcctagcctgtcacacacatgtcttcaagaggccggaatcaccgaggaaagacacatccggaagctgctgtcagccgctagactatttaaactacctcccggaccagaggcaatgtag

SEQ ID NO: 30747 - DNA, 621 bp, Artificial Sequence
  Description of Artificial Sequence: Synthetic coding sequence
atgttgccccctgcaatacatttctatctactccccctggcctgtattctgatgaagagttgtttagcatttaaaaacgatgctacagagatcttgtacagccatgtagtcaaacctgtgccagcccatccctcttccaactctactctgaaccaggctcgaaacggcggacggcacttcagtaatactgggctggatcggaatacaagagtccaggtgggctgtcgggagctgcggtcaacaaaatacatctctgacgggcagtgtacgagcatttccccactaaaggagctggtctgtgcaggcgaatgcttgccactgcccgtgctccccaattggattgggggtggatacggaacaaaatattggtccagaaggagctcccaggagtggcggtgtgttaacgataagactaggacacagaggatccagctccaatgtcaagatgggtcaaccagaacttacaagatcacagtagtcacagcctgcaagtgcaagaggtatacaaggcagcataacgagagttcgcataattttgagtctatgtcacccgctaaaccggtccaacaccaccgggaacggaaacgtgcttctaagtcgagcaaacacagtatgagctag

SEQ ID NO: 30748 - DNA, 693 bp, Artificial Sequence
  Description of Artificial Sequence: Synthetic coding sequence
atgctgcctccagcaattcacttttacttacttccattggcatgtattttgatgaagtcgtgcctggcttttaagaatgacgccactgagatcctgtacagtcacgtagttaagcccgtacctgcacatccttcttctaattcaactctgaaccaggccagaaacgggggaagacactttagcaataccggtttggataggaaccgcacagagtccctcacacgccagaactacttctggttatttccaggggcttttttacgacagctgcaggaggccagagttcaggtaggttgccgggagttgaggtctaccaaatacatctctgatggccaatgtacatccatctcccctctcaaagagctggtgtgtgccggagagtgcctccctttaccagtgctgccgaattggattggcggaggctacggcaccaaatattggtctcgtcgctcttcccaggagtggaggtgtgtgaatgacaagacccggacgcagcggatccaacttcagtgccaggacggcagcacccggacctataagattactgttgtaacggcctgtaagtgcaaaagatatactagacagcataatgaatcttcacataacttcgagagcatgagtcctgccaagccggtgcagcaccatcgggaacggaaacgcgcttcaaagtctagcaaacattccatgagctag

SEQ ID NO: 30749 - DNA, 2229 bp, Artificial Sequence
  Description of Artificial Sequence: Synthetic coding sequence
atggggagtgaaaattctgcactcaaatcctatacattacgtgagccaccgttcacacttccctctggtttagccgtgtaccctgcagtcttacaggacggcaagtttgcgtcggtctttgtctacaagagggagaacgaggataaggtgaacaaagcagcaaagcacttgaaaactctaaggcacccttgccttctgaggttcctttcctgtaccgtggaggccgacggaatccacctggtgactgaacgggtacagcccctggaagtggcactcgaaacactcagctcggctgaagtgtgtgccggtatttacgacattcttctggccttaatttttctgcatgataggggccaccttactcacaataacgtatgtctgtcttccgtgtttgtgtccgaagacggccattggaagctggggggaatggagacagtgtgcaaagtcagccaggccacacccgagtttctgaggtccattcagtctatccgggacccagcttcaatcccacccgaagagatgtcacctgagttcaccactctgcccgagtgtcacggccacgcgagagacgctttttcctttgggactctggtggagagcctgttaacaattctgaatgagcaagttagcgccgacgttctcagttcttttcaacagacccttcactctaccctcctgaacccaatccctaagtgtcgtcctgcgctgtgcacgttgctttctcacgacttctttcgcaacgacttcttagaagtggtgaacttcctgaagagcctgactctgaagtccgaagaggaaaaaacagagttcttcaagtttttgttagatcgtgtgtcttgcctctcagaggagttgatcgccagcaggcttgtgcctttactcctgaatcaattggtgttcgccgagccagtcgccgttaagagttttctcccctacctgttggggccaaagaaagatcacgcccagggcgaaacaccttgtctgcttagcccagctctcttccagtcgagggtgatccctgtgctcttgcagctgttcgaggtgcacgaggagcacgtacggatggttctactgagccatatcgaagcctacgtagagcattttacccaggagcagctaaagaaggttatcctcccacaggtcctcctcggcttaagggacacgagcgatagtatcgtagccattacccttcacagcctcgcggtgctggtgtctttgctgggcccagaagtcgtggttggaggggagcgtacgaagatttttaagcgcacggcgcctagttttactaagaatactgatttaagtctcgaagacagtccaatgtgcgtggtgtgctcgcatcactcacagatttctcctatcctggaaaacccttttagtagcatcttcccaaaatgtttcttctccgggtcaacccccattaattcaaagaagcacattcaaagggattactacaacaccttgttgcagacaggagatccttttagccaaccaatcaagttcccaattaacgggctgtctgacgtgaagaatacttcagaggattcagagaattttccttccagctctaagaagtccgaagagtggcctgattggtcagaacccgaggagcctgaaaatcagactgttaatatccagatttggcctcgagaaccttgtgatgatgtgaaatctcaatgcactacactggacgtcgaggagtcgtcatgggacgattgcgagccaagttccctagacacaaaggttaatccaggaggcggtatcactgccacgaaaccggtgacgtccggcgagcaaaagcctatcccagccctcctaagtttgactgaagaatccatgccgtggaagtcgtccctgccccagaagatctctctggttcagaggggtgacgatgcagaccagatagaaccacccaaagtttccagccaggagcgccctttgaaagtcccgtcagaactgggcctgggtgaggagttcacaatccaggttaagaaaaagccagttaaggatcccgaaatggattggtttgcagacatgattcctgagattaaaccctccgccgcatttttgattttacctgagctcagaactgagatggtgcctaagaaggacgatgtgagtccagtgatgcaattttcttctaagtttgccgcagccgagataactgaaggcgaagccgagggatgggaggaggagggcgaattgaattgggaggacaacaactggtag

SEQ ID NO: 30750 - DNA, 2067 bp, Artificial Sequence
  Description of Artificial Sequence: Synthetic coding sequence
atgggctctgagaatagcgccctgaaatcatatactctcagagagccccctttcaccctgccttcggggttagctgtctacccagcggtgctccaggacggtaaattcgcttctgtgttcgtttacaaaagggaaaacgaagacaaagtaaataaagcagctaagcaccttaagaccctcaggcacccttgtctgttgcgcttcttgtcctgtaccgtggaggccgacggcatccacctggtgactgagcgcgtgcagcctcttgaggtcgcgttagagaccctgagtagcgccgaggtgtgtgccggaatttacgacatactgttggccctcatatttctgcacgatagagggcacctgacccataacaatgtatgtctgagcagcgtcttcgtttctgaggacggccattggaaacttggcggtatggagactgtgtgtaaggtctcacaagccacacccgagtttctcaggtccattcagagcattcgcgacccagcatcaatcccccctgaggaaatgagcccagaattcacaaccctgcccgagtgtcatggacatgccagagatgccttttctttcgggactctagttgaaagcttgctaaccattctaaacgagcaagtgtccgcggatgtgctttcctcctttcagcagaccctgcacagtacactcctgaaccccatccccaaatgccggcctgccctctgcaccttactaagccacgacttttttcggaacgactttttagaagtggtgaactttctgaaaagcctgactcttaagagcgaggaagagaagacagaattctttaaattcttgctggatcgcgtttcctgtctgtctgaggagctgattgcgtcaaggctggttcccttgctgctgaatcaactagtatttgcggagccagtggcagtgaagtccttcttgccttatctgctggggccaaagaaagatcacgcgcaaggggaaactccgtgtctcctctcacccgcactgttccagagtcgcgttattcctgtgcttctgcaactcttcgaagtgcatgaggagcatgtacggatggtgctactatcacacatcgaagcctatgtagagcattttacccaggaacagctcaaaaaggtgatacttccacaggtgctgcttgggctcagagacacctccgattccattgtagctatcacccttcacagccttgcagtccttgtgtctctgctgggaccagaagtggtggtcggtggagagcgtactaagattttcaaaaggaccgctcctagcttcactaaaaacactgacttgtctctggagggcgatcctttctcacaacccatcaagtttcccattaatggtctcagtgacgttaaaaacacctctgaagacagcgagaactttccttcatcttcgaagaagagtgaggaatggccggactggtccgagcctgaggaaccagagaatcagaccgtgaatattcagatctggccacgggagccctgtgacgacgtgaaatcccaatgtacaaccctagacgtagaggaaagttcttgggacgactgcgagccctcctccctggacaccaaggtcaacccagggggtggtatcacagccaccaagccagtgacctcgggtgagcagaaaccaattcccgcattgctctcactgaccgaggaatcaatgccatggaagagttcccttccccagaaaatttccctggtacagaggggcgacgatgcagaccagattgagcccccaaaagtctcgtcccaggaaagacccctcaaagtgccatctgagctgggtctgggggaagagttcacaatacaggttaagaaaaagcccgtaaaagatcccgagatggactggttcgcggacatgatacccgagattaagccatccgccgcatttctgatattgccggagctgagaactgaaatggtccctaagaaagacgatgtctctccagttatgcagttctccagcaagtttgccgctgctgaaatcactgaaggagaggccgagggatgggaagaagaaggcgaattgaattgggaagacaacaactggtag

SEQ ID NO: 30751 - DNA, 2229 bp, Artificial Sequence
  Description of Artificial Sequence: Synthetic coding sequence
atggggagcgagaacagcgctctgaagagctatactttacgggaacccccttttaccctgccttctggactggccgtctaccccgctgtgcttcaggacggtaagttcgcctcggtctttgtttacaaaagagaaaacgaagacaaggtgaacaaagcagccaagcacctaaaaaccctgagacacccctgcttgctccgcttcctttcctgcactgttgaagcagatggtatacacctcgttactgagcgggtgcagcccctggaagtcgctctcgagacactctcaagtgcggaagtgtgtgcgggtatttacgatattctgcttgccctgatattcttgcacgaccgtggccacctgactcataataatgtgtgcctttcatctgtgtttgtttctgaggacgggcattggaagctcggcggaatggagacagtctgtaaggtgtctcaggccactcctgaatttcttaggtcaatccagtcaataagagatcccgctagcatcccgcctgaagaaatgagcccagagttcactacactccctgagtgccatggccacgccagagacgctttcagtttcggaactctggtagagagtctactgacaattctcaatgagcaggtgtccgcggatgtgctgtcttccttccaacagactctgcacagtaccctgctgaacccaatacccaagtgccggccagcactctgtaccctgctctcacacgatttcttcaggaatgactttctcgaggtcgtgaatttcttgaaatctctcacgctcaagtcagaagaggagaaaacggagtttttcaagtttctgctggatagagtcagttgcttgagcgaggagctgattgcgtcaaggcttgtgcctttgctgctgaatcagctagtttttgccgagcccgtggccgtcaaatcgttcctgccttatctgctgggaccaaaaaaagatcacgctcaaggcgaaaccccatgcctgctgtccccggctctttttcaaagcagagtgattcccgtcctactgcaactgtttgaggtacatgaggagcacgttcgaatggtgctgcttagtcatatagaggcctacgtagagcactttactcaggagcaactgaagaaagtgatcttgcctcaggtcctcctgggattaagggatacgtctgactcaattgtcgccatcactctgcacagcctggccgtgctggtgagcctgctgggacccgaggttgtggtgggtggggaacgcaccaaaattttcaaacgtaccgccccaagcttcacaaaaaacactgacctgtctctggaagacagccctatgtgtgtcgtgtgtagccaccattcgcagatctccccaattcttgagaaccctttttcatctattttccctaagtgttttttctccgggtctacccccataaactctaagaaacatatccagagggactactacaacactttacttcagaccggagacccgtttagccagccaattaagttccctatcaatggcctctcagatgtcaagaatacatcagaggatagcgagaattttcctagctcatccaagaagagtgaggaatggcctgactggtccgagcccgaagagcctgagaaccagacagtgaacatccagatatggcctcgtgaaccatgcgacgacgtgaaaagccagtgtaccactctggacgtcgaagaatcctcttgggatgactgcgaaccttcctcgctggatacaaaggtgaaccctggaggtggcattacagctactaagccggtgactagtggcgaacaaaagcccattccagccttgcttagtctcaccgaggaatccatgccctggaagtctagcctgccgcagaagatcagcctggtgcagaggggcgatgacgccgaccagatcgaaccaccaaaggtttcttcccaggaaagacctctgaaggtgccaagcgagctgggcctgggggaggagtttaccattcaggtgaagaagaagcctgtgaaagacccagagatggattggtttgccgacatgatacctgagattaagccttcagccgctttcttgatccttccagagttgcgtaccgaaatggtacccaagaaagatgatgtgtctcctgtgatgcaattctcttctaaattcgctgccgcagaaatcaccgaaggggaggccgaaggttgggaggaagagggtgagcttaattgggaagacaacaactggtag

SEQ ID NO: 30752 - DNA, 1767 bp, Artificial Sequence
  Description of Artificial Sequence: Synthetic coding sequence
atgggttccgagaacagtgcccttaaaagttatacactgcgcgaacccccttttactttaccgagcgggctggcagtatatcctgccgtgcttcaggacggaaaatttgcttctgttttcgtgtataagagggagaatgaggacaaggtgaacaaagccgcaaagcacctaaagaccctgcgccatccttgtttgctgcggtttcttagttgcactgtcgaggccgacggcattcacttggtgacggagcgggtgcagcccctcgaggtagccctggagactctgagcagcgccgaggtctgtgcgggaatttatgacatcctgctggcactgatcttcctgcacgacaggggacacctcacccataataatgtttgtctgagctctgtcttcgtgtcagaggatggacactggaaactgggcggaatggaaacagtgtgcaaggtgagccaggctacacccgaattcctgcggagtattcagtccataagggatccagcgtccattccccctgaggagatgagccccgagtttactactcttccagagtgtcatggccacgcaagagatgcctttagttttggcactctggttgagagcctgctaactattctcaatgaacaggtgtctgccgatgtgctgagtagcttccagcagactctgcattcaaccctcctcaatccaattccaaaatgccggccagccctttgcactttactgagccacgacttcttcagaaacgactttttggaagtggtgaatttccttaaatctttaactctcaagtctgaagaagagaagactgagtttttcaagtttctactggatagggtttcgtgcctgtctgaggagctgatcgcctccagactcgtgcccctccttctgaatcagctggtttttgccgaaccggtggccgtcaagagttttttgccatatctcctgggacccaaaaaggatcacgcacaaggcgagaccccgtgtctgttgagtcctgccctcttccagagtagggtcattcccgtccttctccagcttttcgaggttcatgaagaacacgtgagaatggtactgctctcacatatcgaggcttacgtcgagcattttacccaggagcagctcaaaaaggtcatacttccccaggtgctgctgggcctccgcgacaccagtgatagcatagtcgccatcacgctacattcgctagccgtgctcgtgtccctgctgggacccgaggttgtcgtggggggagagaggactaagattttcaagaggacagcgccatcttttacaaaaaataccgatctgagtctcgaaggcgacccattcagccagcccattaaatttcctatcaacggcctgagcgatgtgaaaaacaccagcgaagactcagaaaacttcccatctagcagcaagaagtctgaggagtggcctgactggagcgaacctgaagagcccgagaatcaaacagtcaatattcagatctggccacgggaaccttgcgatgatgtcaagagccagtgcacaacccttgacgtcgaggaatcgtcatgggacgactgtgagccaagctctcttgacacaaaagtcaatcctggcggaggaattacggctaccaaacccgttacttcaggcgaacagaaaccgattcccgcattgctgagcctgaccgaagaaagcatgccatggaagtcctctctgcctcagaagatcagtctggtgcagcgaggcgacgacgccgatcagattgagcctccaaaagtgagcagttag

SEQ ID NO: 30753 - DNA, 1008 bp, Artificial Sequence
  Description of Artificial Sequence: Synthetic coding sequence
atgaagctgccagcacgagtcttcttcacactcggcagcaggctaccttgtggtttggctcccagacgatttttcagctacgggactaagattctgtaccaaaataccgaggctctgcagagcaaattttttagccctttgcagaaggcgatgttacctcccaattcgtttcaagggaaggttgcgtttatcactggaggagggactggacttggaaaaggcatgaccactttattatcttcattaggcgcacagtgcgtgatcgcgagcaggaaaatggatgttttaaaggccactgctgaacaaatttccagtcagaccgggaataaggtgcacgctattcagtgcgacgttagggacccagacatggtgcagaatacggtgagcgaactgataaaagttgcaggccaccccaacatcgtcatcaataatgcagccggaaattttatttctcctacagagcggctgagcccaaatgcgtggaagacaatcactgacatcgtgctgaacggcactgccttcgtgacccttgagatagggaaacagctcatcaaagcccagaagggcgctgctttcttgtcaattaccacaatttatgccgagactggttccggcttcgtagtaccatccgcctctgcaaaagcgggagtcgaggcaatgtctaagtccctagcggcagaatggggcaagtacggaatgagatttaatgtaatccagcctgggccaatcaaaactaaaggcgcttttagccggttggatcctactggcacgtttgaaaaagagatgattggtaggatcccctgcgggagactaggtactgttgaggagctggccaacctcgccgcttttctgtgctctgactacgcttcttggatcaatggcgctgtgatcaagtttgacgggggagaagaagttttgatctcaggagagttcaatgatctgcggaaagttacaaaggagcagtgggatactattgaggagttgatcaggaagactaaaggcagctag

SEQ ID NO: 30754 - DNA, 945 bp, Artificial Sequence
  Description of Artificial Sequence: Synthetic coding sequence
atgggaatcggtcgaagtgaaggtggacgcaggggggctgccttgggagtactgctggcgcttggcgcagcactcctggctgtggggtcagcttccgagtatgattatgtcagctttcaatctgacattggcccatatcaatcgggacgcttttataccaaacctccccaatgcgttgatatacccgcagatttgcggctttgccataacgtgggatataaaaaaatggtgttgccgaacctgttggagcacgaaaccatggctgaagtgaagcagcaggcctcctcgtgggtgccactcctcaataagaattgtcacgccggtacgcaggtatttttatgctccctgttcgcccctgtatgccttgatagaccaatctacccttgtcgttggctttgcgaagcggtgcgagatagctgcgagcccgtgatgcaattttttgggttttattggcctgaaatgctgaaatgcgacaagtttcccgaaggcgacgtgtgtattgctatgaccccccctaatgccacggaggcctcaaagccccaagggaccaccgtgtgccccccttgtgacaatgagctgaagtcagaagctatcatcgagcatctgtgcgctagcgagtttgctcttcgcatgaagatcaaggaggtgaagaaagagaatggagataagaagattgttccaaaaaagaagaaaccactgaagttaggtccaatcaagaaaaaggacctgaaaaaactcgttctttaccttaagaatggggctgactgcccatgtcatcaactcgataatctctcccatcattttctaattatggggaggaaggttaagtcgcagtacctgctgaccgctattcacaagtgggataagaagaacaaagaattcaagaattttatgaagaagatgaagaaccacgaatgtcctacattccagagcgtgtttaagtag

SEQ ID NO: 30755 - DNA, 1041 bp, Artificial Sequence
  Description of Artificial Sequence: Synthetic coding sequence
atgttcctgtcgatccttgtggcactatgcctgtggctgcacctcgcactcggtgttcgaggcgcaccctgcgaagctgtcaggattccaatgtgtaggcatatgccgtggaacatcacaaggatgccaaatcacttgcatcactcgacccaggaaaatgcaattttagcaattgagcagtatgaggagttggtggatgtgaattgttccgcagttttgaggtttttcctctgcgccatgtatgctcccatttgtacactggagtttctacacgacccaatcaaaccttgcaaatccgtgtgtcagcgcgctcgggacgactgtgaaccactgatgaagatgtacaaccattcttggccagaatccttagcatgtgacgaattgcccgtctacgatagaggggtgtgcatctctcctgaggccatcgtgacagatctgcccgaggacgttaagtggatcgacataacaccagacatgatggttcaggaacggccactggacgtggactgtaaacgcctttcccctgatagatgcaagtgtaaaaaggtgaaacctacattggccacctatctatccaaaaactactcgtatgtgatccacgctaaaattaaggccgtgcaacgatctggttgtaacgaggtgaccacagtggtagacgtaaaagaaatattcaagagttcttcccctataccgaggacgcaggtacctttgatcacaaatagcagttgtcagtgccctcacattttgccacaccaggatgtgcttattatgtgctacgaatggcgttcgagaatgatgctgctggaaaactgcctggtcgaaaaatggcgcgatcaattaagcaaaagaagcatccaatgggaggagaggctacaagaacaacggcgaaccgtgcaggataaaaaaaaaacagccggtcggacctctagatctaatccccctaaacccaaaggcaagccaccagcacccaagcctgcttcacccaaaaagaatatcaagacaagatccgcccaaaagcggacaaacccaaaaagagtatag

SEQ ID NO: 30756 - DNA, 1032 bp, Artificial Sequence
  Description of Artificial Sequence: Synthetic coding sequence
atgcgtgtggccggacgtgagggcagatttctctcggccggtgtcgccgcaagagaaggatctgctatgttcttgtctatcctggtggccctgtgtctctggcttcacttagcactgggagtgcgcggtgccccttgcgaagccgtgcgcatacctatgtgccgacatatgccatggaatattacccgcatgcctaaccacctgcatcattctacacaggaaaatgccatgtacgccccaatctgtacgttggagtttctgcatgatcccatcaaaccctgcaaaagcgtttgccagcgcgcaagagacgactgcgaaccactgatgaaaatgtataatcacagttggcccgaatccctggcatgtgacgagctcccggtctatgaccggggtgtgtgtatttcccccgaagctattgtaaccgatctcccagaggacgtcaagtggattgacatcaccccagatatgatggtccaagagcgaccccttgacgttgactgcaagcgcctgtcgcctgataggtgcaaatgtaagaaggttaaacctacacttgccacatatctgagcaaaaattatagttacgttatccacgccaaaatcaaggccgttcagcgatccggctgtaacgaagtgacaacggtggtcgatgtaaaagaaatatttaaatccagctcgcccattcccagaacccaggtgcccctgatcaccaatagttcctgtcagtgtcctcacatcctcccacaccaagacgtcctcataatgtgttacgagtggcggagccggatgatgctgctcgagaactgtttagttgagaaatggcgcgaccaattgagcaaaagatcgattcaatgggaggagaggcttcaggagcaaaggagaacagttcaagacaaaaaaaagacggcaggccgtacctcccggtccaacccacccaaacctaagggcaaacctcctgctcctaagcctgcgtctcccaagaaaaatatcaagactcgcagtgctcagaagcgcaccaacccaaagcgtgtctag

SEQ ID NO: 30757 - DNA, 954 bp, Artificial Sequence
  Description of Artificial Sequence: Synthetic coding sequence
atgcgcgctgccgctgccggtggcggagtcagaaccgccgctttagctctccttctgggtgcccttcactgggctcccgctcgatgtgaggaatatgactactatggttggcaggcagaacccctccatgggcgaagctattctaagccgccacaatgcctggacattccagctgatctgcctctctgccataccgtcggttacaaaaggatgcgtcttcctaatctgcttgaacatgaatcactcgcggaagtgaaacagcaggccagtagctggttgcctctcctggctaaaagatgtcactccgacacccaggtgttcctctgcagcttattcgctcccgtgtgcctagatcgacccatctacccttgccggagtctttgcgaggcagtccgggctggatgcgcccctctgatggaggcgtatggcttcccctggcccgaaatgcttcactgccacaaatttccgttagacaatgatctttgtatcgcagtgcagttcggacatctgcccgctaccgccccaccagtgactaaaatctgcgcccagtgtgaaatggaacatagcgcagatggcctgatggaacagatgtgcagctctgattttgtagtgaaaatgcgaattaaggagatcaaaattgagaacggggataggaaactgattggtgcccagaaaaagaaaaagctgttaaagcccggacccttaaaaaggaaagatacaaaacgcctagtcctgcacatgaagaatggtgctgggtgcccctgtcctcagttagacagcttagctggttcattcctggtgatggggagaaaagttgatggtcaactgctcctcatggcggtgtaccggtgggataaaaaaaacaaggagatgaaatttgcagtgaagttcatgttctcctacccctgcagtctgtactaccctttcttctacggagccgctgaaccccattag

SEQ ID NO: 30758 - DNA, 903 bp, Artificial Sequence
  Description of Artificial Sequence: Synthetic coding sequence
atgagaatcgctgtgatttgcttctgcctgctgggcatcacatgtgctattccagtaaagcaggctgacagtggcagcagcgaagagaagcagctctacaacaagtacccagacgccgtcgctacttggctcaacccagacccttcccagaaacagaatctgctcgccccacaaacattaccttccaaatccaatgagtcccatgatcacatggacgacatggacgacgaggacgacgatgatcacgtggactcccaggacagtatcgacagtaacgatagtgatgacgtggacgatacagacgattcccaccagtccgacgagtcccatcactccgacgaaagcgatgagcttgtgacagacttcccaacggatctgcccgcaacggaagtgttcacccccgttgtacccactgtggatacatatgacgggagaggagatagcgtcgtgtacggtctgcgtagtaagtccaagaaattcagacgacccgatatccagtaccctgacgcaacggacgaggacatcacctcccatatggagtcagaggagctgaatggcgcttataaggccattccagtcgcccaggatctcaacgcccctagcgattgggacagccgcggtaaagactcatatgaaacatcacagttggatgaccagtcagccgaaactcacagccacaagcaaagtagactgtacaaacgcaaggctaatgacgagagcaacgagcactccgacgtgatcgattcacaggagctttcaaaggtgtctagggagtttcactcacacgaatttcacagccacgaggacatgctggtggtcgatccaaaatcaaaggaggaggacaaacatctcaagttcagaatctctcacgagctcgattctgcgtcttctgaggtgaactag

SEQ ID NO: 30759 - DNA, 879 bp, Artificial Sequence
  Description of Artificial Sequence: Synthetic coding sequence
atgcgcatcgctgtcatctgcttttgcctcttgggaattacctgtgcaattcccgtgaagcaggcagattccggatccagtgaagaaaagcagctttataataagtacccagacgccgttgccacttggttaaatcccgacccatcacagaagcagaacttactggcaccgcagaatgcagtcagctccgaggaaactaatgattttaagcaggagacactgccaagcaagtctaacgaatctcacgaccacatggatgatatggatgacgaagatgatgacgatcaccagtccgatgaatcacaccatagcgatgagtcagatgagcttgtgaccgattttcctaccgatttacccgcaaccgaagtatttacgcccgtggtccctactgtggatacttacgacggcaggggggactcggtagtgtatgggttacggtcaaagagtaaaaagtttagaaggccagatatccaatatccggatgctacggatgaggatatcacgtcccacatggagagcgaggagctgaatggcgcttacaaggcaattccagttgcacaagatctcaacgccccttccgattgggattcgagggggaaggattcatatgagacgagccagctggacgaccaatcagctgagactcactcccacaagcagtctcgcttgtacaagagaaaggctaatgacgagagcaatgagcacagcgatgtgatcgactcacaggagctgtccaaggtcagcagggaatttcactcccacgagtttcactcgcacgaggacatgttggtggtggatccgaagtctaaagaggaagacaagcatctcaagtttaggatttcacacgagctcgattccgcttcttcagaggttaactag

SEQ ID NO: 30760 - DNA, 864 bp, Artificial Sequence
  Description of Artificial Sequence: Synthetic coding sequence
atgaggatcgcagtgatctgtttctgccttctgggtatcacctgcgccataccagttaagcaggcagactccgggtccagtgaggagaaacaaaatgccgtgagttcagaggaaactaacgactttaaacaggagactctgccaagtaaatccaacgagagtcatgatcacatggacgatatggatgatgaagacgacgacgatcacgtcgactcacaagattctatcgactcgaacgattcagatgacgtggacgacacagacgactcccatcagagcgatgagagccaccactccgatgagtctgacgagctggttacagactttccaacagacttgcccgctaccgaagtgtttactccagttgtgcccacagtggacacttacgacgggagaggcgacagtgtggtatatgggttgcgatcaaagtcaaaaaagttcaggagaccagacatccagtacccagatgccaccgatgaggacattacttcacatatggaatctgaggagttaaatggcgcttacaaagcaattcccgtggctcaagatttaaacgctccctcagactgggattcccgaggtaaggatagctatgagaccagccaactcgatgaccagagcgcagaaactcactctcataaacagagcaggctgtataagcggaaggcaaacgatgaatccaacgagcactccgacgtgattgacagtcaagagctgagtaaggtctcaagagagtttcacagtcacgaattccacagtcacgaagatatgctggtcgtagacccaaaaagcaaggaggaggataagcatctgaagttcaggatctcacacgaactggattcagcatcctctgaggtgaattag

SEQ ID NO: 30761 - DNA, 945 bp, Artificial Sequence
  Description of Artificial Sequence: Synthetic coding sequence
atgcgcatcgcagtaatttgcttttgtctgttaggaattacctgtgctatacccgtaaagcaggctgactccggatcaagcgaagagaagcagctgtataacaaatatccagacgcggtcgctacatggctgaaccccgatccaagccagaaacaaaacctgttggctccccagaatgctgtttcttcagaagagacaaatgactttaagcaggaaacactcccttccaagagcaatgaatcgcacgaccatatggatgatatggacgacgaggatgatgatgaccacgttgactcacaggactctattgactctaacgattcagacgacgtagatgatacagacgactcccaccagtcggacgaaagtcaccactccgacgaatccgatgaactcgtgacagactttccaaccgacttaccagccacagaggtgtttaccccggtggttccaaccgtggacacctatgatggccgaggcgacagcgtggtgtatgggttgcgctctaaaagcaagaagttcagacggcctgacatccagtatcctgatgccaccgacgaggacatcacttctcacatggaaagcgaggaactaaacggagcctacaaagctataccggtggcccaggacctgaatgctccatccgactgggatagtcggggaaaggatagttatgagacttcccagttggatgaccagtcagctgaaacacacagtcataagcagagtcgcctctacaagagaaaggccaatgacgaatcaaatgagcattcagacgtcatcgactcccaagagctgagcaaagtaagccgtgagttccatagccacgagtttcactcacacgaagatatgttggtggtcgacccaaagtctaaagaggaggataagcatctaaaatttcggatctcacacgagttggatagcgccagttccgaggtgaactag

SEQ ID NO: 30762 - DNA, 822 bp, Artificial Sequence
  Description of Artificial Sequence: Synthetic coding sequence
atgagaatcgccgtgatttgtttttgcctcctcgggatcacatgcgctatcccagtgaaacaggccgattccggttctagcgaggagaagcagacccttccaagcaaatccaacgagtcccacgaccacatggacgatatggatgatgaggacgacgacgatcatgtcgattcccaagattctattgacagcaatgattcagacgatgtcgacgacaccgatgactcccaccagtccgacgagtctcaccacagtgatgaaagcgatgagctcgtcaccgactttcctaccgatctgccggcaactgaagtatttacccctgtggtgccgacagtcgacacctatgacgggcgtggtgatagtgtggtgtacggcctgcgttccaagtctaagaagtttcggaggcccgatatacagtacccggatgccactgatgaagacatcacaagccacatggagtccgaggaattaaacggtgcatataaggcgatcccggtggctcaggatctgaatgcacctagcgactgggattctcgcggaaaagactcatacgagacttcccaactggatgaccaatctgctgagacccactcccataaacagagcaggctttataaacggaaggccaacgacgagtccaacgaacacagtgatgtcatcgacagccaggagctgtccaaagtgtcccgggaatttcatagccacgagtttcattcacatgaagacatgttggtagtagatccaaagagcaaagaggaggacaagcacctgaaatttcgtatttcacatgaattggatagcgcctcatcggaggtcaattag

SEQ ID NO: 30763 - DNA, 2370 bp, Artificial Sequence
  Description of Artificial Sequence: Synthetic coding sequence
atgaggacctaccactacatcccgttgttcatctggacgtacatgtttcacaccgtggatactatacttttacaggagaagcctaattcttacctgtcctctaagaagatcgccggactcaccaaggacgatggcaaaatgttgaggcgtactaagcgaggctggatgtggaaccaattctttttgttggaagaatacaccggaactgatacacagtacgttggaaagcttcacaccgatcaggataagggcgatgggaatttaaaatacatcctcaccggcgatggggctggaagtctgttcgtgatcgatgaaaacactggggacattcatgccgctaagaagctggatcgggaagaaaagtccctctacattcttcgagccaaagcaatcgaccggaagacaggacgtcaggtcgaaccagagagtgagttcatcatcaagattcacgacatcaacgacaatgaacctaagtttacgaaggacctgtacaccgcatcggtccctgaaatgtccggcgtaggaaccagcgtgatacaggtcacagccacggatgccgatgacgccaattatggtaactcagctaaggttgtgtattcaattctccaagggcagccctattttagtgtagaccccgagtcaggaattatcaaaaccgccctgcccgatatgtctagggaaaatagagagcagtatcaggtagttatacaggcaaaggacatgggaggtcaaatgggaggtttatccggaactacgacagttaacatcaccttgacagacgtgaataacaatcctccccgattcccacagtccacctatcagttcaactctcccgagagcgttcccctgggcacgcatctcggtaggatcaaagctaatgatccagacgttggggagaacgcagagatggagtacagcattgctgagggcgacggtgccgacatgtttgatgtaatcacagacaaagacactcaggagggtattattacagttaaacagaatctggattttgaaaatcagatgctgtataccctacgagtcgacgcctccaatactcacccagaccctagattcttgcacctaggccctttcaaggacactgccgttgtaaaaatttccgtagaggatatcgacgaacctcctgtgtttacaaaagtcagttacctgatcgaagtcgacgaagacgtgaaggaaggctccatcattggacaggtgacagcatatgatccggacgcccgaaataacctaattaaatatagtgtcgaccgccacactgatatggacaggatctttgggatacacagtgaaaacggctcaatatttaccctaaaggctctcgacagggagagctcaccttggcacaatattacggtcacagccaccgaaattaacaaccccaaacagtcctcgcacattcccgtgttcatcagaatcctggacataaacgaccacgcacctgagttcgccatgtactacgagacgtttgtgtgtgaaaacgccaaacccggtcagctcattcagaccgtgtctgtcatggacaaagatgatcccccacgcggtcacaagttttttttcgagcccgtgccggagttcacgctcaacccgaactttaccatcgtcgacaacaaagacaatactgccggaattatgacacgaaaggatggctatagcagaaataagatgtccacttatctgcttccaatcctaatttttgataatgactatcctatccagtcgtctacaggcaccctcactattcgcgtctgcgcgtgcgacaaccaggggaatatgcagagctgcacggccgaggctctgatactgagtgcgggactgtctaccggagcgttagtggcaatcctgctgtgtgtgctgatcctgctaatcctggtggtgcttttcgccgctctgaaacgacaacgtaagaaggagcccttgataatctctaaggatgatgtgcgggataatatagtcacctacaatgacgaaggtggaggcgaggaggatacacaggccttcgatattggaacactcagaaaccctgaggcaagagaggactcgaaactcagacgcgatgtgatgcccgagaccatttttcaaatacgtcggacagtcccactctgggaaaacattgatgtccaagatttcatccatagacggctcaaggaaaatgatgcggatccctctgctcctccatacgattcactggccacttacgcttatgagggtaacgatagtatagccgactcactgtcttctctcgagtccctgaccgcggactgtaaccaagactatgactacctctccgactggggcccaagattcaagaagctggcggatatgtacgggggagacgactccgacagagattag

SEQ ID NO: 30764 - DNA, 162 bp, Artificial Sequence
  Description of Artificial Sequence: Synthetic coding sequence
atgcgggcatggatcttcttcctcctgtgtctggctggcagagcccttgcagcacctcaacaggaagccctgcctgatgagacggaggtggtagaagaaactgtcgccgaggtgacggaagtgtcggtgggggctaatccggtccaggtggaagtgggttag

SEQ ID NO: 30765 - DNA, 336 bp, Artificial Sequence
  Description of Artificial Sequence: Synthetic coding sequence
atgagggcttggatattcttccttctctgtcttgccggacgggcactcgccgctcctcagcaggaggcactgcctgatgaaaccgaggtggtcgaagaaacggttgctgaagtcactgaggtgtcagtgggtgcgaatccggttcaggtcgaagtgggtgagttcgacgacggggcagaggagacagaggaggaggtagtggccgagaatccttgccagaatcatcactgcaagcacggaaaggtctgtgagctggacgaaaacaatacacccatgtgtgtatgtcaggatcctacctcctgccccgcacctattggcgagtttgaaaaagtttag

SEQ ID NO: 30766 - DNA, 276 bp, Artificial Sequence
  Description of Artificial Sequence: Synthetic coding sequence
atgaagctggcagtgacgctgaccttggtgaccctggccttgtgttgctcaagcgcctccgcggagatctgcccatcatttcagagggtcatagagactctccttatggacacgccatcttcgtacgaggccgctatggagctgttcagtcctgaccaagatatgagagaggcgggagcacagctcaaaaaactggtggataccctgccccaaaagccccgtgaaagcatcattaaacttatggagaaaatcgcccaatcttccttgtgtaattag

SEQ ID NO: 30767 - DNA, 1380 bp, Artificial Sequence
  Description of Artificial Sequence: Synthetic coding sequence
atgatcaaaaggtttcttgaggataccaccgacgatggcgaactgtcaaaatttgtcaaggactttagcggaaatgctagctgtcatcctcctgaggctaagacgtgggccagccggcctcaggtgccggagccacggccacaagcccctgatctgtacgatgacgacttggagttcagaccaccatcgagacctcaatcctccgataatcaacagtacttctgtgccccagccccactctccccttctgcacgaccacgttcaccctgggggaagttggatccatacgactcgagtgaggatgacaaggagtacgttggctttgcaacactccccaaccaagtccacagaaagtccgtcaagaaggggttcgatttcaccctcatggtggcgggagagtcaggcttgggcaagtctacactcgtaaacagcctatttctgaccgatctgtacagggatagaaagctgttgggtgccgaagaacgcatcatgcagaccgtcgagatcaccaaacatgccgttgatatcgaagaaaaaggagtacgcctaagacttaccatcgtggataccccaggctttggagacgccgtcaataataccgagtgctggaaaccagtagctgagtacatcgatcagcagtttgaacaatacttccgtgacgagagtggacttaacagaaagaatatccaggataatcgagtgcactgttgcctttatttcatttctccatttggccatggattgagaccgctggatgtggaatttatgaaagcgctccatcaaagggtgaacatcgtgccgattttagctaaggcagacacgctgactcctcccgaggtggatcacaagaaacgtaagattcgggaggagatcgaacatttcggaatcaaaatctaccagtttcctgactgtgattctgacgaggacgaggattttaaactccaagaccaggcactgaaggagtccatcccattcgctgttatcgggtccaatacggttgtggaggcgaggggcaggcgcgttcggggacggctctacccttggggaatcgtcgaggtggagaacccaggacattgcgactttgtgaaattacggactatgctggtgagaacccacatgcaagatctgaaggatgtgacccgggagacacactacgaaaactatcgcgctcagtgtattcagtctatgacccgcctggtggtgaaagagcgcaatcggaataaactcacacgggagtcagggactgacttcccaattccagccgtgccccctggcacagatccagagactgaaaagttaattcgggagaaggatgaggaactgcggcgaatgcaggaaatgctgcacaagatccagaaacagatgaaggaaaactactag

SEQ ID NO: 30768 - DNA, 1437 bp, Artificial Sequence
  Description of Artificial Sequence: Synthetic coding sequence
atggaccgcagcctgggatggcaaggtaattctgtgcctgaggacagaacagaagcaggaataaaaaggttcctcgaggacaccaccgacgatggtgagctgagcaagtttgtgaaagacttcagcggcaacgcctcgtgtcatcctccagaggccaagacctgggcatcccggcctcaggttcctgagccccgtcctcaagcaccagacctgtacgacgatgacctcgaattccgccctcccagccgccctcaatcgtccgacaaccagcagtatttttgtgctcccgctcccctctctccaagtgcacgtcccagaagtccttggggcaagctagacccctatgatagttctgaagacgacaaggaatacgtgggatttgcaaccctgcccaaccaggtacaccggaaatccgtgaaaaagggcttcgatttcaccttgatggtggctggggagagcggtttgggcaaatcgactctggtcaacagtctgttcctgaccgacctgtatcgggaccgtaagctgctgggggcagaagaaagaataatgcagacggtggagataacaaagcatgcagtcgatatagaggaaaagggagtgaggctgcgcttaactatcgtggatactccaggtttcggtgacgcggtgaataataccgagtgttggaaaccagtggccgagtatatcgatcaacaattcgaacagtattttcgggatgagtccggcctgaataggaagaacatacaagacaaccgagtccactgttgcctgtattttatcagtcccttcggacacggattacgccctttagacgtcgagttcatgaaggcacttcaccaaagagtgaatattgttccaattctcgccaaggccgacacactgacgcctcccgaagtcgaccacaagaaaagaaaaatacgtgaagaaatagagcacttcgggattaagatctatcagttccctgattgcgacagcgatgaagacgaggacttcaagctgcaagatcaggccttgaaagaatccattccttttgcggtgatcggctctaacacagtggttgaggcccgaggtagacgtgttcggggtcggctgtacccatgggggatagttgaggtcgagaaccctggtcactgcgatttcgttaagttgcgcaccatgctggtgcgtacacacatgcaggaccttaaagatgtaacccgtgagacacattatgagaattacagggcgcagtgcatccagtctatgaccaggcttgtggtgaaagagcgaaatcgcaataaattaacccgtgaatctggaaccgacttccctatcccagccgtaccccctggaactgatcccgagaccgaaaagctcattcgcgagaaagatgaagaactaagacgaatgcaggaaatgctgcataagatccaaaagcagatgaaagaaaactactag

SEQ ID NO: 30769 - DNA, 1380 bp, Artificial Sequence
  Description of Artificial Sequence: Synthetic coding sequence
atgatcaagagattccttgaggatactacagatgacggggagctgtctaagtttgtgaaagatttcagcggaaacgcctcttgtcatccaccagaagcaaagacgtgggcctcacggcctcaggtgcctgagccaaggcctcaggccccagacctgtatgacgacgaccttgagttcaggcctccttctagacctcaatccagtgataaccagcagtacttttgcgctccagcccctcttagtccaagcgccagaccacgaagcccctgggggaagttagatccctatgatagttccgaggacgacaaggagtacgtgggcttcgccactctcccaaaccaagtgcatcgaaagtcagtcaagaagggtttcgactttacactcatggtggcgggtgagtccggactgggaaagagcacactcgtgaatagcttattcctgaccgacctgtatcgggatcgcaagctgctcggagccgaagagagaataatgcagactgtggagatcaccaagcacgcagtagacattgaagaaaagggagtcagactacgcttgacaatcgtcgatactcccggatttggcgacgcagtgaataacaccgagtgctggaagcccgtggccgaatatatcgaccagcagtttgagcagtatttccgggacgagagtggactgaaccggaagaatatccaggacaatagagtacactgttgcctctacttcatctcccccttcggacacggcctcaggccactggatgtagagtttatgaaagccttacaccagcgggtcaacatcgtgccaatcctggccaaggcagatacactcaccccacctgaagtggatcataaaaaaagaaagatccgcgaagaaattgagcacttcgggattaagatttaccagttccccgattgcgactccgatgaggacgaggattttaaactgcaggatcaggctctgaaagagtccataccttttgctgtgataggtagcaacaccgtagtggaggcccgagggagacgcgtgagaggcaggctgtacccttggggcattgtcgaggttgagaacccgggacactgcgactttgtgaagttaaggactatgctggtgcggacccatatgcaggacctgaaagatgtgacccgggaaacccattacgaaaactatagagcccaatgcattcaaagtatgacaagactggttgtgaaagagcggaataggaacaaattgacacgggaaagcggcactgattttcctatcccagccgtgcccccagggacagatcctgagaccgagaaactcatccgggaaaaggacgaagaattacgccgtatgcaggaaatgctccataagatccagaagcagatgaaagaaaattattag

SEQ ID NO: 30770 - DNA, 1413 bp, Artificial Sequence
  Description of Artificial Sequence: Synthetic coding sequence
atgcctggattctatagtgtcatgactgatgaggagattaagcgctttctggaggataccactgatgacggagagctgagtaaatttgtgaaggattttagcggtaatgcttcgtgccatcccccagaggccaagacatgggcctctaggccacaagtcccggagcctagaccacaggccccagatctctacgatgatgatctggagttccggcctccgtcccgaccacagtcctcagacaatcagcaatatttctgtgctccggcaccactctcccctagtgccagacctcgcagcccttggggcaagttggatccttatgactccagcgaagatgacaaagaatatgttggatttgccaccctgcccaatcaggtgcatagaaaatccgtcaagaaggggtttgatttcactttaatggtagctggcgagagcgggctgggtaaatcaacacttgtgaattcattattcctgacggacctgtatcgggacaggaaattactgggggctgaggaacggattatgcagacggtcgaaattacgaagcacgcggttgatatagaggaaaaaggggtccggctgagactgactatcgttgacacacctggctttggagacgctgttaataatacagaatgttggaagcccgtggcagagtatatcgatcagcagtttgagcagtatttccgcgatgagagcggcctgaatagaaaaaacatccaagacaatcgtgttcactgctgcctgtactttatcagtcccttcggccacggcctccggccactagacgttgaattcatgaaagctttacaccaaagagtgaacatcgttccgatccttgcaaaggcagacaccctgacaccgccagaagtggaccacaagaaaagaaaaattagagaagagattgagcacttcggcataaagatttaccagtttccagattgtgactccgacgaagacgaggatttcaagctccaagatcaggcactcaaagagagcatcccttttgccgtcatcggctccaataccgtggtggaggctcgtggcagaagagtccgcggacgtctgtacccttgggggattgtcgaagtcgaaaaccctggtcattgtgactttgtgaaattgcgtaccatgctggttcggacccatatgcaggacttaaaagacgtgactagggagacccactacgaaaattatagagcacagtgcatccaaagtatgacccggttagtggtgaaggaaaggaatagaaataagctcaccagagagtccgggaccgatttcccaattccagccgttcccccaggtactgaccccgagaccgaaaagttgattagagagaaagacgaggagcttcgacgcatgcaagaaatgctccataaaatccagaaacagatgaaggagaactactag

SEQ ID NO: 30771 - DNA, 825 bp, Artificial Sequence
  Description of Artificial Sequence: Synthetic coding sequence
atgataaaaaggtttctggaagataccacagatgacggagagctatccaaattcgtcaaagacttttcgggaaacgctagttgtcacccaccagaggccaagacgtgggcatccaggccccaggtgccagaaccgagacctcaggccccagatctgtatgacgacgacttggaatttcgcccaccgagtcgccctcaatctagtgataatcagcaatatttttgcgcgccagccccactttccccctctgcaaggcccagaagtccctggggcaagttggacccgtacgattccagcgaggatgacaaggaatatgttggcttcgcaactcttccaaatcaggtgcacagaaagagtgtgaagaaaggatttgactttacactcatggtcgctggcgaaagcgggctgggcaaatccacactggtaaactctttgtttctgaccgatctctaccgcgacaggaaattgttaggagctgaggagcgcattatgcagactgtggaaatcaccaagcatgctgtggacattgaagagaagggagtcaggttgcggctgactattgtggataccccaggattcggagatgccgtgaataatactgaatgttggaaaccggtcgccgaatacatcgatcagcagttcgaacaatattttcgtgacgagtccggattaaaccggaagaacatacaagataaccgtgttcactgctgtctgtacttcatatcacccttcgggcatggttatggcccttccctccggctccttgcgccacccggtgccgtcaaggggacaggccaagagcaccaggggcaaggctgccactag

SEQ ID NO: 30772 - DNA, 1479 bp, Artificial Sequence
  Description of Artificial Sequence: Synthetic coding sequence
tactcttccccggcactcttctcatcaagagcggctcctcagaagcctaggaaggagggatcccaggccgctgggttacttgtgtttagcgatagtctggagattaagcgattcctggaagacacaaccgatgacggggagttaagtaagttcgtgaaggatttttccgggaatgccagctgccatccacccgaagctaaaacttgggcgtcccggccacaggtccctgaacccagacctcaggcaccagacttgtacgacgacgatctggagttcaggccaccatcacgcccacagtccagtgataaccagcagtacttctgcgccccagccccactgtcaccatcggctcgcccaagatccccctggggaaagctcgatccatatgactcctctgaggatgacaaagaatatgtggggtttgctacgctgcctaatcaggttcatcggaaatctgtaaaaaagggttttgactttaccctgatggtggccggtgaaagtggacttggtaagagtaccctcgtgaattccctgtttctgacagatctgtaccgggaccgcaaactgttgggagccgaggaaagaatcatgcagacagtagagattacaaaacatgccgtggatatcgaggagaaaggcgtgcgcctccggttgaccatcgttgatacccctggcttcggagacgcagtgaacaacacggagtgctggaagcctgtggccgagtatatcgaccagcaattcgagcagtacttccgggatgagtccggtttgaataggaagaatatccaagataaccgcgttcattgctgtctgtattttataagcccattcggtcatggactccggccacttgatgttgaatttatgaaggcgcttcaccaacgagtgaatatcgttccaatcctcgccaaagcggatacccttactcctcccgaggtcgaccataaaaagcgcaagatcagggaggaaatagaacatttcggaatcaaaatataccagtttcctgactgtgactctgacgaggacgaggacttcaagttgcaggatcaagcgctcaaagaaagtattccgttcgcggtgatcgggtctaacaccgtcgtggaagcaagaggcaggagggtgagaggcagactgtatccttggggtatcgtcgaagtggaaaacccaggacactgtgactttgttaagcttcggacaatgctggtaagaactcacatgcaggatctgaaggacgtcacgagggagacccattacgagaattaccgcgctcagtgcatccagagcatgactcgacttgtggtaaaggagaggaatcgcaacaagctgactcgggagagcggaactgactttcccatacccgcagtgccaccgggaaccgacccagagacagaaaagctgatcagagaaaaggacgaggagctgcgcagaatgcaggagatgctgcacaagatacaaaagcaaatgaaggagaactactag

SEQ ID NO: 30773 - DNA, 996 bp, Artificial Sequence
  Description of Artificial Sequence: Synthetic coding sequence
atggtggcaggagaatccgggctgggcaaatctacactcgtgaactcactgtttctcactgatttgtatcgcgaccggaaactacttggggctgaagagcgcataatgcagactgtcgagatcacaaagcatgccgttgatattgaagaaaagggggtgcggttacgactcaccatcgttgataccccaggcttcggtgacgcagtgaacaataccgagtgttggaaaccagtggcagaatacatcgaccaacaatttgagcagtatttccgggatgaatctgggcttaacagaaagaatattcaagacaatagagttcactgttgtctctatttcatttctccctttgggcacgggcttaggccgctggatgttgaattcatgaaggctctacaccaacgcgttaatatcgtgcccattctggccaaggctgatactctaactccacctgaagtcgaccataagaaacgcaagatcagggaggaaatcgagcattttggcattaaaatctatcagttccccgattgcgactcagatgaagacgaggactttaagctgcaagatcaagctttgaaggagtcgattccatttgccgtgatcggatcaaacacagtagtggaagctcgcggtaggagggtacgcggtcgtctgtacccatggggaatcgtggaagtggaaaaccctggacattgtgatttcgtaaagttaagaactatgctggttaggacccatatgcaggatctaaaggacgtcacccgcgagacacactatgaaaactaccgagctcagtgtatacagtcaatgacacggctggtcgttaaggaaagaaatagaaataagctcactcgcgagagtgggaccgactttcccatcccagccgttccacctgggactgaccccgagaccgagaagttaatccgtgaaaaggatgaagaattaaggaggatgcaggagatgcttcataaaatccaaaaacagatgaaagagaattattag

SEQ ID NO: 30774 - DNA, 1311 bp, Artificial Sequence
  Description of Artificial Sequence: Synthetic coding sequence
atgtcagttagcgctagaagcgctgccgcagaagagcggagtgttaatagttccacgatgggccagcaaaagaatcttgagggctacgtagggtttgccaacttacccaaccaggtgtaccggaagtctgtgaagagaggattcgagttcaccctgatggttgtgggagagtcgggcctaggaaagtcaacgttgattaattccctgttcctgactgatttatacagtcccgagtacccgggtcctagtcacaggattaaaaagactgtgcaggtcgagcagtctaaagttttgatcaaggagggaggggttcagctgcttttaacaattgttgatacccctgggttcggagacgcagtcgacaactccaattgctggcagcctgtgatcgactatattgactctaagtttgaggattacctcaatgcagaaagtcgagtgaatcgcaggcaaatgccagataatagggtgcagtgctgcctatactttatagctccatcagggcacggactgaagccactggacatcgaatttatgaagagacttcacgagaaggttaatataatccccctaattgcgaaagccgatactttgactccagaggaatgtcagcagtttaagaaacagattatgaaagaaattcaggaacataaaataaagatatacgagtttccagaaacagacgacgaggaggaaaataagctcgtgaaaaaaattaaagaccgcctccccctcgccgttgttggctccaacacaataatagaggtgaacggcaaaagggtgcggggtcgccagtacccctggggtgtcgccgaagtcgagaacggcgagcactgtgatttcacaatcctgcgcaatatgctgataaggacccacatgcaggacctgaaggatgtcaccaacaacgtccactacgaaaactacagatccagaaagcttgctgctgtgacttacaacggggtggataacaacaagaataaaggccagctcacgaaatcccccctcgctcaaatggaagaggagagaagggagcacgtcgcaaaaatgaagaagatggaaatggaaatggaacaggtctttgagatgaaggtgaaggagaaggttcaaaagctgaaagattcagaggcagaacttcagcggaggcacgagcagatgaaaaagaatttagaggctcaacataaggagctcgaggagaaacgccgtcagtttgaggatgagaaggcgaactgggaggcccagcaacggattctcgaacagcaaaattcttctcggactctcgagaagaacaaaaaaaaaggcaagatcttctag

SEQ ID NO: 30775 - DNA, 1317 bp, Artificial Sequence
  Description of Artificial Sequence: Synthetic coding sequence
atgtctgtgtcggcaagatcagccgcagcggaggagcgttcggtgaacagtagcaccatggaagtggctcagcagaagaatctggagggctatgtcggcttcgccaatttacccaaccaggtgtaccgaaaatccgtgaagcgaggcttcgaatttactctcatggtcgtgggcgagtctggactggggaagtccaccctgattaacagcctcttcctcaccgatctgtattccccagagtatcccggtcctagccaccgcataaagaagacagttcaggtggaacagtcgaaagtgcttattaaggagggaggcgtgcaactactcctgactatagttgacacacccggattcggcgatgccgtagacaacagtaactgttggcaaccggtcatcgactatattgacagtaagtttgaagattaccttaacgcggagagtagggtgaaccgtaggcaaatgccagacaatagggttcagtgttgcctgtatttcatagcccctagtggccacggcctcaagcccctggacatagagttcatgaagcggttacatgagaaggttaatattattcctctgatcgcgaaagccgacacacttacccccgaagaatgtcagcagttcaaaaagcagattatgaaggagatccaggagcacaaaattaagatttatgagtttcccgagaccgatgatgaggaagagaacaagctcgtgaaaaagatcaaagaccgcttacctttggctgtggtagggtctaacactataatcgaggtgaacggaaagagggtgagggggaggcagtacccgtggggggtggccgaggtagaaaatggcgaacactgcgactttaccattcttagaaatatgctgattcggactcatatgcaggacctgaaagacgtaacaaacaacgtacactacgagaactatcggtcccggaaactcgctgcagtgacgtataacggcgtggacaataacaaaaacaaaggacagctgaccaagtcccctcttgcgcagatggaggaggaaaggagggagcacgtggccaagatgaagaagatggaaatggagatggaacaagtatttgagatgaaagtgaaggagaaggtgcagaagctcaaagactccgaggcggagctgcagaggagacatgaacaaatgaaaaaaaatctagaagcacagcacaaggagttggaagagaaaaggaggcagttcgaagacgagaaagccaattgggaggctcagcaaagaatcttggagcagcagaactcaagtcggactctagagaagaacaagaagaagggcaaaattttctag

SEQ ID NO: 30776 - DNA, 1311 bp, Artificial Sequence
  Description of Artificial Sequence: Synthetic coding sequence
atgagtgtatcggctcggagcgctgccgcagaggaacgttctgtcaactcctccaccatggtccagcaaaagaacctcgagggatacgtgggatttgctaacctcccgaaccaggtgtaccgtaaaagtgtaaaacgcggatttgaattcactttaatggttgtcggtgagtcagggctgggtaaatccactctgattaatagtttattccttaccgacttgtattcaccggaataccccggtccctcccatcgaatcaagaagaccgtgcaggtcgagcagtctaaagtgctaataaaggaaggcggtgttcaactgctgttgacaatagtcgataccccaggatttggagatgccgtagataactcgaactgctggcagcctgtaattgactatattgactctaagtttgaagactacctaaacgccgaaagtcgcgtcaacaggagacagatgccagacaacagagtccagtgttgcctgtatttcatagctccaagcggacacggcctgaaaccgctggacattgagtttatgaaaagactgcatgagaaagtgaatatcatccccctcatcgccaaggcagatactttaacccctgaagaatgccaacagttcaagaagcagatcatgaaggaaattcaggaacataagataaagatttacgagtttcccgagacagacgatgaggaagaaaacaaactggtgaaaaagatcaaggatcgactgcctctagccgtggtgggcagcaatactatcattgaagtgaacggcaaacgggttaggggcagacaatacccatggggtgtggcggaagtagaaaatggagagcactgcgacttcaccattttacggaatatgctgattagaactcacatgcaggatctcaaggatgtgacaaataacgtgcactacgagaactaccgctcacgaaagctagccgcagtgacttacaatggggtcgacaacaacaaaaacaagggacaactgactaagagccccctggcacagatggaggaggaacggagagaacacgtcgctaaaatgaaaaagatggagatggaaatggaacaagtgtttgagatgaaagtaaaagagaaggttcagaagcttaaggatagtgaggcagagttgcagcggagacatgagcaaatgaagaaaaatctggaagctcagcataaggaactggaagagaagcggaggcagtttgaggacgagaaagccaactgggaagcccagcagcggatcctggaacagcagaattctagccgcacactggagaagaataaaaaaaagggaaagattttctag

SEQ ID NO: 30777 - DNA, 267 bp, Artificial Sequence
  Description of Artificial Sequence: Synthetic coding sequence
atgaagaaaatggagatggagatggaacaggtgttcgagatgaaagttaaggagaaggttcaaaagctcaaggactctgaggcagagctccagcgaagacatgagcagatgaaaaaaaatctagaggcacagcataaagaactggaggagaaacgacgccagtttgaagacgagaaggcgaattgggaagcccaacagcggatcttggaacagcagaactcttctcgtaccctggagaagaataagaagaagggcaagatcttttag

SEQ ID NO: 30778 - DNA, 1155 bp, Artificial Sequence
  Description of Artificial Sequence: Synthetic coding sequence
atggtggtaggcgaaagtggcctggggaaatccactctgatcaattcactgttcctgacagacctgtattcccccgagtatcccggaccctcgcaccgcattaaaaaaaccgtccaggtcgaacagtccaaggtactgattaaggagggaggggtccagctgcttctgacaatcgtggatacccctgggtttggtgacgctgtggataacagtaactgttggcagccagttattgattacatcgattcgaaatttgaggactacttgaacgcagagtcccgggtgaaccgccgtcagatgccagataaccgagtgcaatgttgtttatatttcattgccccttccggacacgggctcaaaccattggacatagagtttatgaagcgcctccatgaaaaggtaaacatcatccctctcatagcaaaagccgacacgttgacaccggaagagtgtcagcagttcaagaagcagatcatgaaggaaatccaggagcacaagattaaaatttacgaatttcccgagacagacgatgaagaagaaaataagttggtcaagaagatcaaggataggctgcctttggctgtggtcggcagcaacaccattatcgaagtcaatggtaagagggtacgaggcagacagtacccttggggggtcgctgaggtggaaaatggggagcattgcgacttcaccatcttaaggaatatgcttataaggacccacatgcaagacctgaaagacgtcacaaataacgtgcactacgaaaattatcgctccagaaaattggcagcagttacgtataatggtgtagacaataacaaaaacaagggccagctaacgaagagtcctctcgctcagatggaggaagagcgacgggagcacgtcgcaaaaatgaaaaaaatggagatggaaatggaacaagtcttcgaaatgaaagtcaaggaaaaggttcagaaattgaaagactcagaagccgagctgcagaggaggcacgaacagatgaagaaaaacttagaggcccaacataaggaactcgaggaaaagcgcaggcagtttgaggacgaaaaagccaattgggaggctcaacagcggatcctggaacagcagaattccagccggacacttgagaagaacaagaagaaggggaaaattttttag

SEQ ID NO: 30779 - DNA, 708 bp, Artificial Sequence
  Description of Artificial Sequence: Synthetic coding sequence
atgagtgtgagtgcccgttctgctgcagctgaagaaagatccgtaaattctagcaccatgggccagcaaaaaaacctcgaaggatacgtggggttcgcgaacctacctaaccaggtttataggaaaagcgtcaaaagaggctttgaatttaccctgatggtggtgggcgaaagcgggctgggcaaatccaccttaatcaactctctcttccttacagatctctacagccctgagtacccaggaccaagtcaccgcatcaaaaaaaccgtgcaagtagaacaatccaaggtgctcattaaggagggcggtgtgcagcttttgctaacaatcgtggacacccctggcttcggagacgcagtggacaacagtaactgttggcaacctgtgattgactatatcgacagcaagttcgaggattatctcaatgcagaatcaagagtaaatcgacggcagatgccagataacagagtccagtgttgtctgtacttcatagcaccctccggccatggccttaaacctctagatatagaatttatgaagaggctacacgaaaaggttaacataatacccctgattgctaaggcggataccttaactcctgaagaatgtcagcagtttaagaaacagatcatgaaagaaatccaggagcacaagattaagatctacgaattccctgagactgccaagaagaaaaagaagaagaaatag

SEQ ID NO: 30780 - DNA, 1155 bp, Artificial Sequence
  Description of Artificial Sequence: Synthetic coding sequence
atggtcgttggggaaagcggcttagggaagtcgacactgattaacagcctttttctcaccgacttgtacagccctgagtatcctggacctagccacaggatcaagaagaccgtacaggtggagcagtctaaagtcctgatcaaggagggcggagtccagctgcttctgacaatcgtggacaccccagggttcggggatgccgtggacaactctaattgttggcagccagtcatcgactacattgactcaaaattcgaagactacctgaatgctgaaagcagagtcaacagaaggcaaatgccggacaaccgggtgcagtgttgtctgtactttatcgcgccttctggccacggacttaagcctcttgatatcgagttcatgaaacgcctccatgagaaagtcaatattatacctctcattgctaaggcggacactttgacccccgaggagtgccagcagttcaagaaacagattatgaaggagattcaggagcacaaaatcaagatttacgaatttccggagaccgacgacgaagaggagaacaagctggttaaaaaaataaaggatcggcttccgttagcagtcgttggatcaaatactatcatagaggtaaatggtaaaagagtcaggggaagacaatatccctggggagttgcagaggtcgaaaacggcgagcactgcgacttcacaatcctgcggaatatgctgatcagaacacatatgcaagacttgaaggatgtgaccaataacgtgcattacgaaaattatcgatcccggaagcttgctgcagtcacgtataacggggtggacaacaataaaaacaaaggtcagctgacaaagagccctctcgctcaaatggaagaagaacggagagagcacgttgctaagatgaagaagatggaaatggaaatggaacaggtgttcgagatgaaagtgaaagagaaggtccaaaagctgaaagactctgaggcagaactgcagagaagacacgaacaaatgaagaagaatctcgaggctcagcataaggagttggaggaaaagagaagacaatttgaggacgaaaaggctaattgggaagcccagcagagaatacttgagcaacagaactcgtcaaggaccttagaaaagaataaaaaaaagggaaaaatcttttag

SEQ ID NO: 30781 - DNA, 1146 bp, Artificial Sequence
  Description of Artificial Sequence: Synthetic coding sequence
gttacccatgaaaccattgtcgagcaacagaagaatttggaaggttatgtcgggtttgctaatttacctaatcaggtttataggaagagtgtgaaacgaggatttgaattcacccttatggtcgtgggggagtccggcttaggtaaaagcacccttattaactctctgtttctcactgacctgtactcccccgaatatccaggacccagccaccgaatcaagaaaactgtgcaagtcgagcagtcaaaggttctcatcaaggagggaggggttcaactcctgctcacaatcgtggacacacctgggttcggagacgccgttgataattctaactgttggcagcctgttattgattatattgactctaagtttgaggattatctgaacgccgagtccagggtaaaccgtagacagatgccagataatcgagtccagtgttgcctgtatttcatagccccatccggtcatgggctcaagcccctggatattgagtttatgaaaaggcttcacgaaaaggtgaatattatccccctgattgccaaagccgacactctcacacctgaggaatgtcaacagttcaaaaagcagatcatgaaggagatccaagaacataaaattaaaatttacgagttccccgaaactgacgacgaggaggagaataagctcgtcaaaaaaattaaggaccgacttcctctcgctgtggtgggatccaataccattatagaagtcaatggcaagcgcgtccggggacggcaatacccgtggggtgtcgctgaggtggaaaatggcgaacactgtgactttacgattttgagaaatatgctgattcgcacacatatgcaagacctgaaagatgtgactaataatgtacactacgaaaactaccggtcgcgtaagctggctgccgtaacctataatggggtcgacaataataaaaacaagggacagttaacgaagagtcctctcgcccaaatggaggaggaaaggcgggagcacgtggccaaaatgaagaaaatggagatggagatggagcaagtctttgagatgaaggtgaaggagaaggtgcagaaattaaaggattccgaagcagaagtcatctctcttatcagccacctgttagccgatattgtttttctcttcaagtag

SEQ ID NO: 30782 - DNA, 1149 bp, Artificial Sequence
  Description of Artificial Sequence: Synthetic coding sequence
atgggcgaatcggggctgggtaaatccacccttataaactctctgtttctgacagacctgtattcacctgagtatcccggaccaagtcataggatcaagaagactgttcaggtggagcagagcaaagttctgattaaagaaggaggagtgcaactcttgttaacgattgtagacacgccagggttcggcgacgccgttgataacagcaattgctggcaaccagtcatagattacatcgatagcaagtttgaggactatctgaatgctgaatctcgggtgaaccgccgtcagatgccggacaatcgagtccagtgctgcctctactttattgccccatccggacatggattaaagcccctcgacattgagtttatgaaacgactacacgagaaggtgaacattatccctctaattgccaaggctgacaccctcactccggaagagtgtcagcagttcaaaaagcagatcatgaaggaaatccaagagcataagataaaaatctacgaatttcctgagaccgacgacgaggaggagaataagctggtgaaaaaaattaaagataggctgccacttgccgtggtgggttccaacactataattgaagtgaatggaaagagagtgcggggtcggcagtacccttggggagtggcagaggtcgagaatggggaacactgtgacttcacaatcctgagaaacatgttgatccggactcatatgcaagatctgaaagatgtgaccaataacgtacactatgagaattatcggagccgcaagcttgctgcggtcacttataacggggtagacaataataaaaacaagggacaactaaccaaaagtcctctggctcagatggaggaagagcggagggagcatgtagcaaaaatgaagaagatggagatggagatggaacaggtattcgagatgaaagttaaggagaaggtgcaaaaactgaaagactccgaggctgagcttcagagaagacatgagcaaatgaagaaaaacttagaagcccagcacaaggaattggaggagaagcgcagacagttcgaggatgaaaaagcaaactgggaggcccaacagagaattttagaacagcaaaattcaagccggactctcgaaaaaaacaagaaaaagggcaagatcttttag

SEQ ID NO: 30783 - DNA, 1302 bp, Artificial Sequence
  Description of Artificial Sequence: Synthetic coding sequence
atggaagtcgtggaccctcaacagctgggaatgtttactgagggagaactaatgtccgtgggcatggatacctttatccatcgcattgactctaccgaggtcatctaccagccaaggcgtaaacgggcaaagcttatcgggaagtatcttatgggagacctgctgggagagggctcatatgggaaagtgaaggaggttctggattcagagactctttgtaggagggccgtgaaaatccttaaaaagaagaaactacggcgtatcccaaacggcgaggcaaatgtcaaaaaggaaattcagcttctgcgacgccttcggcataagaacgtcatacagcttgtggacgtcttatacaatgaggagaagcaaaagatgtatatggtgatggaatactgcgtgtgtggcatgcaggaaatgttagacagcgtgccagaaaagagatttccggtgtgccaggcccatggctatttttgtcagctgatcgacggactggaatatctgcatagccaggggatagtgcataaggatatcaagcctggaaacctgctgctcactaccggcggaaccttgaagattagtgatctgggagtggccgaagctcttcaccccttcgctgcagatgatacgtgtcggacatctcaggggtcccctgcattccagcctccagagatcgcgaacggtctcgacacattcagcggttttaaggtggacatctggtcggccggtgttaccctttataatattactacaggattatacccgtttgaaggggacaatatctacaaacttttcgaaaacataggtaaaggatcttatgccattccaggcgactgtggccctccactgagcgacttgctaaagggcatgttagagtatgaacccgcaaaacggttcagcatacgccagatcagacagcacagctggtttcgaaagaaacaccctccagccgaggctcccgtccctattccaccctctccagatacaaaggacagatggagatcaatgactgtggtcccttatctggaggatctgcatggagctgacgaggatgaggacctgttcgacattgaagatgatatcatttacacgcaggacttcaccgttccaggccaagtgcctgaggaagaggcaagccataatggccagaggcgaggcctaccaaaagcggtctgcatgaatggcactgaggccgcacagctctctaccaagtctcgcgcagagggtagggcccctaaccctgcccgtaaagcctgcagcgcaagcagcaaaattcgacggttaagcgcatgtaagcaacagtag

SEQ ID NO: 30784 - DNA, 1299 bp, Artificial Sequence
  Description of Artificial Sequence: Synthetic coding sequence
atggaggtggttgacccccaacagttggggatgtttaccgagggagaactcatgtcagtaggcatggataccttcatacataggatcgacagtactgaggtaatctatcagcccagaaggaaaagagccaagctgatcggtaagtacttgatgggagatctccttggcgagggctcatatggcaaagtcaaggaagtgctggattccgaaaccctctgccgcagagctgtaaaaattctgaagaagaagaaactgagacgaattccgaatggcgaggctaacgtgaaaaaagaaatacagttacttaggaggttaaggcacaaaaacgttatccagttggtcgacgttctgtacaatgaggagaagcaaaagatgtacatggtcatggagtattgtgtgtgtggtatgcaggagatgttggattccgtccctgaaaagcggtttccagtgtgtcaggcccatggctacttttgccagttaattgatggactggagtatctgcacagtcagggtattgtgcacaaggatatcaagcccggaaatttactgctgaccactggcggtacccttaaaatttccgacctgggagtcgcagaggccctccatccattcgcagccgacgacacgtgccggaccagccaaggctcccccgcattccagcccccagaaatcgccaatggacttgataccttttcagggttcaaggtcgacatctggtcggccggagtgactctttataatatcaccaccgggctctatccgttcgagggcgacaacatatacaagctatttgaaaatatcggcaagggatcctacgccatcccaggcgattgcggccctccattgagtgacctactgaaaggcatgcttgagtatgagccagccaagagattcagcatacggcaaatccgccagcattcttggttccgcaaaaaacatccaccagcagaagcgcctgtgccaattcctccttctcctgacaccaaagaccggtggagatcaatgaccgtcgtgccctacctggaagatctccacggcgctgatgaggatgaagacctcttcgatatcgaggacgatataatttatacgcaggacttcactgtgcccggacaggttccggaggaggaagcatcacacaacggccagcggcgaggcctgcctaaggcagtatgcatgaacggtaccgaggcagcacaactgtctaccaaatctcgggcagaagctggccctccaacactgccagccagaccagccgctagcagtaagataaggcggctcagtgcctgtaaacaacagtag

SEQ ID NO: 30785 - DNA, 1248 bp, Artificial Sequence
  Description of Artificial Sequence: Synthetic coding sequence
atggaggacctttgcgtggccaatacgctgtttgccttaaatctctttaaacaccttgcaaaggccagcccaacacaaaatttgttcttgtccccatggagcatctcctccactatggccatggtgtatatgggctctcggggatccaccgaggatcagatggctaaggttttgcagtttaacgaggtaggcgcaaatgcagtaactccgatgacccctgagaattttaccagctgtgggtttatgcaacagatccagaagggcagctacccggacgctatattgcaggcacaggcggctgataagattcattccagcttccgctccttatccagtgccatcaatgcatcaacaggaaattacttactcgaatcagtgaataaactgtttggcgaaaagtccgcctctttccgcgaggagtacatcagactgtgccagaaatattattccagcgaaccacaggccgtggacttccttgagtgtgccgaggaagcccgtaagaagatcaactcatgggtcaagactcagactaagggaaagatccctaacttgctcccagaaggctctgttgatggagatacaagaatggtcctggtgaacgcggtgtatttcaaggggaaatggaaaacacccttcgaaaagaaattgaacggcctctaccctttccgggtgaatagcgcccaaagaacgcccgtccagatgatgtacctgagagaaaagttaaatataggctatatcgaggatcttaaggcccagatcctcgaactcccatacgccggagacgtgtcgatgtttctgttgttacccgatgagatcgctgatgtaagcactgggctagaactcttagaatccgagataacatacgataaacttaataaatggacaagtaaggacaagatggccgaagatgaagtggaggtctacatccctcagttcaagctcgaggagcattatgagctccggtcaattctgcggtctatggggatggaagacgccttcaataagggcagagccaacttctctggcatgtccgaaagaaacgacctcttcctttccgaggtctttcatcaggcaatggtagacgtcaacgaggaaggaacagaggctgcagcaggaaccggaggagtgatgactggtcgcaccggtcacggagggccacaattcgtggctgaccacccgtttctgttcttgataatgcataagataaccaattgtatcctcttctttgggagattttcatctccctag

SEQ ID NO: 30786 - DNA, 342 bp, Artificial Sequence
  Description of Artificial Sequence: Synthetic coding sequence
atggaggacctctgcgttgcgaacaccttattcgctctgaatctctttaagcaccttgccaaagcttcacctactcagaatttgttcctctccccttggtctatctcttcaacgatggcaatggtgtacatggggtcacgcggatctacagaggatcaaatggcgaaagtacttcagttcaatgaggtgggagcaaacgccgtgacgccaatgacacccgagaacttcactagttgtggtttcatgcaacagattcaaaaggggtcataccccgacgccattctgcaggctcaggccgcagataaaatccacagtagttttaggagcctgtctagcgcctag

SEQ ID NO: 30787 - DNA, 486 bp, Artificial Sequence
  Description of Artificial Sequence: Synthetic coding sequence
atggaagacctgtgtgtcgcgaataccctcttcgccttaaatctgtttaagcaccttgccaaagcatctcccacacagaatttgtttttatccccctggagcatcagcagcactatggctatggtctatatggggtcccgagggagcacagaggaccagatggctaaggttctgcagtttaatgaggtgggcgcaaatgcagtgacgcctatgacacctgagaacttcacctcctgcgggttcatgcagcagattcagaagggcagctatcccgacgcaatcctgcaggcccaggcagccgacaagatccactctagttttcgcagcttatcctccgccataaacgcgagcactggaaactatcttctggagagtgttaataaactgtttggcgagaagtccgccagtttcagggaggaatacattcggttgtgtcagaagtattattctagcgagccacaagctgtggattttcttgaatgttag

SEQ ID NO: 30788 - DNA, 399 bp, Artificial Sequence
  Description of Artificial Sequence: Synthetic coding sequence
atggaggacttgtgtgtagccaacacgcttttcgccctcaacctgtttaagcacctggccaaagcatctcccacccagaatctgttcctttctccttggtcaatatcatctactatggccatggtttacatgggatcgcgtgggtccactgaagatcagatggcgaaggtactacagtttaacgaagtcggcgctaatgcggttactccaatgactccagaaaatttcacctcctgcgggtttatgcagcagatccagaaggggagttaccctgacgccattctgcaagcccaggccgcagacaaaatacatagttccttccgcagtctcagcagcgccattaatgcctcgaccggcaattacctgttggaatctgtgaacaagttattcggtgagtag

SEQ ID NO: 30789 - DNA, 1248 bp, Artificial Sequence
  Description of Artificial Sequence: Synthetic coding sequence
atggaggacctttgtgtagccaacacattgttcgctctgaatctgtttaagcacctcgccaaggcttctccgacacaaaatctcttcttatctccttggagtatctcctctaccatggccatggtttatatgggtagcaggggctccacggaggatcagatggcaaaggtgctgcaatttaatgaagtaggcgcaaatgcggtgaccccaatgacccccgaaaacttcacctcctgcggtttcatgcagcagattcaaaaggggtcataccccgatgccattctgcaagcacaggccgctgataaaatacactccagtttcaggtcgttatcgagcgcaattaacgcctcaacaggcaactatctccttgagtctgtcaataaattgtttggcgagaaaagtgccagcttcagagaggagtatatccggctatgtcaaaagtactacagttcagagcctcaggctgtagatttcctggagtgcgcagaagaggccaggaaaaaaattaactcctgggtaaaaacacaaactaagggaaaaattccgaacctcctgcctgagggatcagtcgacggtgatacccgaatggtgcttgtgaatgccgtgtactttaaagggaagtggaaaaccccattcgagaagaagctgaacggtctctaccctttccgcgttaacagcgcacagaggacccccgtgcagatgatgtatctgcgggaaaaactgaatatcggctatatagaagacctcaaagcgcagattctcgaactgccatacgcaggggatgtatcaatgttccttttactgccagacgaaatcgccgacgtatcgacaggactggaattactcgagtctgagatcacgtacgacaagctaaacaagtggacatctaaggataaaatggcagaagacgaggttgaagtgtatatccctcaatttaagttggaggaacactacgaactgcgcagcatcttgcgctcgatgggcatggaagatgcattcaacaaggggagagccaacttcagtggtatgtcggagcgcaatgatcttttcctgtctgaggtcttccatcaagctatggtcgatgtgaatgaagagggcactgaggctgccgctgggacgggaggagttatgacaggacggacaggccacggcggtcctcagttcgtggcagatcacccttttctatttctgatcatgcataaaatcacgaattgtattctcttctttggccgatttagctctccctag

SEQ ID NO: 30790 - DNA, 2280 bp, Artificial Sequence
  Description of Artificial Sequence: Synthetic coding sequence
atggctggactgaccctgtttgttgggagacttcctccgtccgccaggagtgagcaactcgaggaactgtttagtcaggtcggcccagtaaaacagtgcttcgtggtaacagagaagggtagcaaagcgtgtagagggttcggctacgttaccttttctatgctggaggatgtgcagagggcgctgaaagaaattacaacttttgaagggtgtaagatcaacgtgaccgttgccaagaaaaagctgagaaataaaactaaagaaaagggaaaaaacgagaactctgagtgccccaagaaagaacccaaagctaaaaaagcaaaagtggccgacaagaaagcgcgtcttataattcggaatttgtcctttaagtgctccgaggatgacctcaaaacagtgtttgcccagtttggcgcagttttagaagtaaatatccctaggaaacccgacgggaagatgcgaggtttcggcttcgttcaattcaaaaatctcctggaagcgggaaaggctctgaaggggatgaacatgaaggagatcaaaggaaggaccgttgctgtcgattgggccgttgcgaaagacaaatacaaggacacccaaagtgtctccgccatcggtgaggaaaagagccacgaatctaaacatcaggagtctgtcaagaagaaggggagggaagaggaggatatggaagaggaagaaaatgatgatgacgacgatgacgatgacgaggaggacggcgtctttgacgatgaagatgaggaagaggaaaacattgaatccaaagtgacgaagccggtgcagattcaaaaacgagcggtgaagcggcctgctccagccaaaagcagcgaccactcagaagaggacagtgacctagaggagagcgattctattgacgatggggaggagttggcccagtccgacacatccaccgaagaacaggaggacaaagccgtccaggtgagcaataaaaaaaagcgtaagctgccttccgatgtgaacgagggaaaaaccgtgttcatccgcaacctctcttttgacagcgaagaagaggagttgggagagctgttgcagcagtttggggaactaaagtatgttagaattgtgttgcatccagacacagaacatagcaaaggctgtgctttcgctcagttcatgactcaggaggcggcacagaagtgtctactcgccgcttcacccgagaacgaagctgggggtcttaagttagacggaagacagttgaaggtagatctagcggtgacccgcgacgaagccgctaagcttcagacaacaaaagtaaaaaagcccacagggactaggaatctgtacctcgcaagggagggcctgattcgggctggaacgaaagctgccgagggggtgagtgcggctgacatggccaagcgcgaaaggtttgagcttctgaaacaccagaagctcaaggatcagaatatatttgtgtcacggacgagactttgccttcacaacctcccgaaagccgtggatgataaacagctcaggaagttgctactgtcggcgacaagcggcgaaaagggcgtaaggataaaggaatgcagggtaatgcgggacctgaagggagttcatggcaacatgaagggtcaaagcctgggttacgccttcgccgaatttcaggagcacgagcacgcactgaaggccctacggctgatcaataacaaccctgagatttttggccctttgaaacggccaatcgtggagttttcactggaagaccgacggaagctgaaaatgaaggagcttaggatccagagatcactgcaaaagatgaggagcaagcctgcaacaggggagccgcagaaagggcagccagaacctgccaaggatcagcaacagaaggcagctcaacatcacactgaagaacagtcgaaagtgccccctgagcagaaaaggaaagctggctcgacttcttggacaggattccagaccaaggctgaggtcgaacaggtggagctcccagatggaaagaaacggaggaaggtgctcgctcttccctctcatcgtggacccaaaattcgacttagggacaaaggaaaagtgaagccggtgcacccaaaaaaacccaaacctcagattaaccaatggaagcaggagaagcagcagctcagctccgagcaggtgagtaggaagaaagcaaaaggaaacaaaacagagacccggttcaatcaacttgtagagcagtataagcagaagctgctgggcccttccaagggcgctcctttggctaagcgttccaaatggttcgactcatag

SEQ ID NO: 30791 - DNA, 1164 bp, Artificial Sequence
  Description of Artificial Sequence: Synthetic coding sequence
atgcaaatgagccctgccctcacatgccttgtcttggggctggccctggtgttcggagaagggtccgctgttcatcaccctcctagctacgttgcgcaggcgagcaaggatagaaatgtggtcttctcaccttatggcgtggcgagcgtgttagccatgttacagctcactaccggcggagaaacacaacagcaaattcaggcggcaatgggctttaaaatcgacgataaggggatggccccagcgctaaggcatctgtacaaggagttgatgggcccttggaacaaggatgaaatctcaaccacagatgccattttcgtgcagcgggacttaaagctggttcaagggttcatgcctcattttttcagactgttccggtccactgtcaagcaagtggattttagtgaggttgaacgggctaggtttattataaacgattgggtaaagacacacactaaaggtatgatttctaatctcttaggcaagggagccgtcgaccagttgaccagactggtcctggtgaacgcgttatattttaacgggcagtggaaaacgccctttccagactctagtacccacagacggttgtttcacaaatccgacggctccaccgtgagcgtgcctatgatggcccagaccaacaaattcaactataccgaattcacaacgcctgatggacattattacgacatcctcgaacttccttatcacggggacactttgtcaatgtttatcgccgcaccttacgagaaggaagttcctcttagtgcactcaccaacatcctaagtgcccaactgattagccactggaaggggaacatgacgcgcctccctcggcttctcgttctgcccaagttctctctggagacagaagtggatctccggaagccgctagagaacctgggcatgactgatatgttccgccaatttcaggccgatttcacctcattgtccgaccaggaaccccttcatgtggcccaggccctccagaaggtgaagatcgaagtgaacgagtcagggactgttgccagtagttctactgccgttatcgtgagcgctcggatggccccagaagaaatcatcatggataggccatttctcttcgtggtgaggcataatccgacgggaacagttctctttatgggccaggttatggaaccttag

SEQ ID NO: 30792 - DNA, 540 bp, Artificial Sequence
  Description of Artificial Sequence: Synthetic coding sequence
atgatggcacagaccaacaagttcaattatacagagtttaccacacctgatggccactattatgatatactggagcttccttatcacggtgataccttgtcgatgtttatcgctgcaccctatgagaaagaggtacctctctctgcactgacaaatatccttagcgctcagctcattagccattggaaaggaaacatgactcggctcccgaggctgcttgtgttacccaaattctctctggagactgaagtagacctgcgcaagcctcttgaaaacctgggcatgactgacatgtttcgccaatttcaagccgactttacctccctgtccgaccaagaacccttacatgttgcccaggccctgcagaaagtgaaaattgaggtcaatgagagcggcacagtggccagctcctcaactgctgtcattgtatctgcgcgaatggcacccgaggagatcataatggataggcctttcctgttcgtcgtgcgtcacaatcccacagggacagtcctcttcatggggcaggtgatggagccttag

SEQ ID NO: 30793 - DNA, 711 bp, Artificial Sequence
  Description of Artificial Sequence: Synthetic coding sequence
atgctttccaagggcctgaaaaggaagcgggaggaggaggaggagaaagaaccccttgcggttgattcctggtggctggacccgggacataccgccgtggcccaggcgccaccagctgtagcttcatcatccctgttcgatctcagtgttctgaagctacaccacagcttgcagcagagtgagccggatcttcgccacctggtgctggtcgtcaatacccttcggcgaattcaagcaagcatggctccagccgctgccctgcctcccgtcccttctcctccggcagccccatcagtggcggacaacttactggcctcctccgacgctgcgctgtctgcgagcatggcatcactgctggaagacctcagtcacattgaaggcctgtcacaagcccctcagccactggcagatgagggacccccaggaagatcaatcggaggggcagccccatcattgggtgcactggatttacttgggcctgccaccggttgtttgctggacgacgggctggaaggtctgttcgaggacattgacactagcatgtacgacaacgagctgtgggcccctgcaagtgagggcctgaagcccggtccagaggacgggccagggaaggaggaggctccagaactggatgaggctgagttggactatttgatggacgtgctcgtgggtacccaggctctcgaacggccaccgggacccggtcgttag

SEQ ID NO: 30794 - DNA, 1527 bp, Artificial Sequence
  Description of Artificial Sequence: Synthetic coding sequence
atgttgccgactcaggccggtgctgccgctgcacttgggagagggtccgcattgggaggttctctcaacaggacgcctaccggaaggcccggagggggaggcggaactagaggcgcaaacggaggacgagtgcctggcaatggggcagggttgggtccaggcaggctggagagggaagctgccgctgccgcagcgacaacaccagcccctacagctggagccctgtattcagggtcagagggcgattcggagtcaggtgaggaggaagagcttggggctgagcgtaggggcctaaagcgctcactcagtgaaatggaaattggcatggtggttggagggcctgaagcatcggcggcagctacaggtggatacggccctgtgtctggggctgtgtccggtgccaaaccaggcaagaagacacggggtagagttaaaatcaagatggaattcattgataacaaactccgaaggtacactacctttagtaaaagaaaaaccgggatcatgaaaaaagcctatgagctgagtacccttacgggcacacaggttcttctgctcgtcgcctctgagaccggacatgtttacaccttcgccacacgaaaactgcagccaatgatcaccagcgagaccggtaaggcccttattcagacatgtctcaattctccagatagcccacccaggagcgacccgacaactgatcaaaggatgagcgccaccggcttcgaggaaacggatctgacctatcaagtctccgagtcagactcctctggcgaaacgaaagacacacttaagcctgcgttcaccgttaccaatttgcccggtacaacctccaccattcagaccgcaccctctacatccacgaccatgcaagtgtcatctggcccttcatttcctatcacgaattacctggcccctgtgtccgcatctgtttctccctcagctgttagttccgcaaatggaactgtgcttaaaagcaccggatctggaccagtcagttcaggcggtctaatgcaacttcccaccagcttcacgctgatgcctgggggagcagtggcccaacaggttccggtccaggccatccaggtgcatcaagccccacagcaggctagcccctctcgggattctagcacagatctaacacagactagctctagcggcactgtaactctgccagcgaccatcatgacctccagcgtgccaaccacagtgggcggacatatgatgtacccgtccccccatgcagtaatgtatgccccaacctcgggactcggcgatgggtctcttactgttctgaacgctttcagccaggcaccctctactatgcaggtgtcccactcgcaggtgcaggaaccaggtggcgtcccgcaggtctttctgaccgcctcgagcggtacagtccagatccctgtctcagctgtccagctacatcagatggcagtaattggccagcaggcaggctctagtagcaatctgacagagttgcaggtggttaaccttgacacagcgcattccacgaagtcagagtag

SEQ ID NO: 30795 - DNA, 915 bp, Artificial Sequence
  Description of Artificial Sequence: Synthetic coding sequence
atgatcacatctgagaccggcaaagctctcatccagacgtgtctgaattcaccagactctccccctagaagtgacccaacaacagaccagcggatgagcgccacaggatttgaggaaaccgacctaacataccaggtgagcgagagcgatagctccggagaaacgaaggacaccttgaagccagccttcactgtcactaatctgcccggtacgaccagcactatccaaacagcgccatctacctctaccactatgcaggtgtcctctggtccaagtttccctataacaaattacctggctccggtcagtgctagcgtgtctcctagtgctgtatcgagcgccaatggcaccgtgcttaagtcaaccgggtctggccctgtgagctccgggggactgatgcagttgcctacctcttttactttgatgcctggaggggctgtggcacagcaggttcctgtgcaagctatccaggtgcaccaagcaccgcagcaggcgtctccctccagagattcctccaccgatctaactcagaccagctcgtccggcaccgtgacactccccgcaacgattatgacttcctccgtgccgacaacagtgggtggccacatgatgtatccttctcctcacgccgtaatgtatgcaccaacctcaggcttgggagatgggtctctgactgttctgaacgccttttcccaggctccaagcacaatgcaggtcagtcacagccaggttcaagagcccggaggggttccacaagtctttttgacggcctccagcggtacagtacaaatccctgtttctgccgtacaactccaccagatggcagttattggacaacaggctggatcaagttctaatttaaccgagctgcaagtagtgaaccttgacaccgcacattcaaccaaaagtgaatag

SEQ ID NO: 30796 - DNA, 834 bp, Artificial Sequence
  Description of Artificial Sequence: Synthetic coding sequence
atgtccgctcccgctgccaaagtctctaaaaaggaactgaatagcaatcacgatggagcagacgagacaagtgagaaagagcagcaggaggctatcgaacacatcgacgaagtgcaaaatgaaattgacaggctgaacgaacaggcctcggaagagattttgaaagtggagcagaaatacaataagctacggcaaccgtttttccagaaacgaagcgaattgattgccaagatcccaaacttttgggtaacgacctttgtcaatcatcctcaggttagcgccttgttgggcgaggaggatgaggaggcgctacattaccttacccgcgtcgaagtgaccgaatttgaagatatcaaatctgggtatcgcatcgacttctacttcgacgaaaacccctacttcgagaataaagtcttgagcaaagagttccacctgaacgagtcaggagacccttcctcgaagtccaccgagatcaagtggaaatctggcaaggaccttactaaaagaagttcacagactcagaataaggccagtcgcaaaaggcaacatgaggagcccgaatccttttttacttggtttaccgaccactcagacgccggtgctgatgaactcggtgaggtcattaaggatgacatctggcccaaccccctacagtactacttggtgccagatatggatgatgaggaaggggagggagaagaagacgatgatgacgacgaagaagaggagggtctggaagacatcgacgaggagggggacgaggatgagggagaggaagacgaggatgacgacgagggagaggagggcgaagaggatgagggagaggacgactag

SEQ ID NO: 30797 - DNA, 798 bp, Artificial Sequence
  Description of Artificial Sequence: Synthetic coding sequence
atgcctagaagccaccagccccctccaccaccccacgaaaaggagcaacaggaagcaatagaacacatagatgaagtccagaatgagattgacaggcttaatgagcaggcatccgaggaaattctgaaggtcgagcaaaaatacaacaagctgaggcagcctttttttcaaaagcggtcagaactaattgccaaaatccccaacttctgggttaccaccttcgtcaaccatccacaggtgagtgctctcttgggtgaggaggatgaagaggccctgcactatctcaccagagtggaggtcaccgagttcgaagatattaagagcggttaccgaatcgatttctattttgacgagaacccttacttcgaaaataaggtcttatccaaggagttccacctgaatgagtcaggggaccccagctcaaaatcaaccgaaatcaaatggaaaagcggaaaggacctaacgaagcgatcctcccagacccagaacaaagcaagccggaaacgccaacacgaagagccagagtccttttttacttggtttactgatcactctgacgcaggtgccgacgaacttggagaggtgatcaaagacgacatttggccaaacccactgcagtattacttagtcccagacatggacgacgaagagggagaaggagaggaagatgacgacgacgatgaagaggaagagggccttgaagatatcgacgaggagggcgacgaggacgagggagaggaagacgaggatgatgatgagggcgaggagggggaggaagacgagggagaggacgactag

SEQ ID NO: 30798 - DNA, 801 bp, Artificial Sequence
  Description of Artificial Sequence: Synthetic coding sequence
atgatgcccaggtcacatcaacctcctcctcccccacatgagaaagagcaacaggaggccatcgagcacattgacgaagtgcagaatgaaatcgaccggctgaacgaacaggcgagcgaggaaattctgaaggtcgagcaaaagtacaataagttacgacagccattttttcaaaaacggagcgagctgattgctaagattcctaacttttgggttacgacattcgtgaaccacccacaggtaagtgcgctgctgggagaagaggatgaagaagccttacactacctgacccgcgtggaggtaaccgaattcgaggatatcaaaagcggctatcgtatcgatttttactttgacgaaaacccttactttgagaacaaggtcctttccaaagaattccatctgaacgaatctggtgacccgagtagtaagagcacagagatcaagtggaaatctggtaaagatctcaccaagagaagctcccagacacagaacaaggcctctaggaagcgccaacatgaagagccggagagcttctttacatggttcaccgatcacagtgacgcaggcgctgatgaattgggcgaggtgatcaaagacgacatttggccaaacccactgcaatactacctggtacctgacatggacgacgaggaaggggagggggaggaggatgacgatgatgatgaagaggaggaaggtcttgaagatatcgacgaagaaggagatgaggatgagggtgaggaggatgaagatgacgatgaaggcgaggaaggcgaagaggatgagggcgaggacgactag

SEQ ID NO: 30799 - DNA, 873 bp, Artificial Sequence
  Description of Artificial Sequence: Synthetic coding sequence
atggcccctaagcgacagtcccctctaccgcctcagaagaagaaacccaggcccccacctgccttaggccctgaagagactagcgcttcggccggactgccaaagaaaggcgagaaagagcagcaggaggcaatcgaacatattgacgaggtacagaatgagatcgaccggctgaacgaacaggccagcgaggagattctgaaggtcgagcagaagtataacaagctgagacagcccttctttcagaaacggagcgaactgatcgcgaaaattccgaacttttgggttacaacatttgtgaaccatccccaggtgagcgccttgctcggcgaagaagacgaagaggcactgcattacttgaccagggtcgaggtgacggaatttgaggacatcaagagcgggtatagaatagacttctacttcgacgagaatccttatttcgagaacaaagtgctaagcaaagaatttcacctgaatgaatccggagatcccagcagtaagtcaactgagatcaaatggaaatctgggaaagatttaactaaacggtcaagccaaacccagaacaaggcatccagaaaacgtcagcacgaggaacctgagtccttttttacgtggtttacagatcactcagacgcaggcgcagatgagctgggcgaagtgatcaaagatgatatctggccgaaccccctccagtactacttagtgcctgatatggacgacgaggaaggagagggcgaggaggacgacgacgacgatgaagaagaagagggccttgaagacatcgatgaggagggagatgaggacgagggagaggaggatgaggacgatgatgagggtgaagaaggagaagaggatgaaggtgaggacgactag

SEQ ID NO: 30800 - DNA, 807 bp, Artificial Sequence
  Description of Artificial Sequence: Synthetic coding sequence
atgggctgccgagatcttttgccatctctcaagcccacactgcttgaaaaggaacaacaagaggccatcgagcacatagatgaagtccagaacgagatagaccggcttaacgagcaggcaagcgaggagattctgaaagtggagcagaaatataataagcttcggcagccattcttccagaaaagatccgaattgattgcgaagatcccaaacttttgggtgaccaccttcgtcaaccacccgcaggtaagcgcattgctgggggaagaagacgaggaagctctgcactatctgaccagggtcgaggtgaccgaattcgaagatattaagtctggttacagaatcgacttctactttgacgagaatccttacttcgagaataaagtcctgtcaaaagaattccatctgaacgagtctggggatccttctagcaagagcaccgagattaagtggaagagtgggaaagatcttaccaagcgttcctcacagacgcaaaataaagctagtaggaagcggcagcacgaggaaccagaaagcttctttacatggttcaccgaccattcggatgctggagccgatgagcttggggaagtcatcaaggatgatatttggcccaaccctcttcagtactatttggtgccggatatggatgatgaggaaggggaaggcgaggaggacgatgacgacgatgaagaggaggagggcctagaagacatcgatgaggagggagatgaggacgagggtgaggaggacgaggatgatgatgagggagaagaaggtgaagaagacgaaggggaagacgattag

SEQ ID NO: 30801 - DNA, 99 bp, Artificial Sequence
  Description of Artificial Sequence: Synthetic coding sequence
atggcgcctaagagacaatctccgcttccaccacagaaaaagaagccaagaccaccacctgccctgggacccgaagaaacttcggcctcagccggttag

SEQ ID NO: 30802 - DNA, 942 bp, Artificial Sequence
  Description of Artificial Sequence: Synthetic coding sequence
atgactggcaaggcaactcctccctccctctattcgtggcgaggcgtcctgttcacttgtttgccagccgcacggacccggaagcgaaaggaaatgagccggcagaccgcaacggccctaccaacgggtactagcaagtgtccgccatctcagcgcgtgccggcacttacagggaccactgcctccaataacgacctggcatcacttttcgagtgtcccgtttgttttgattacgtcctacctcctatcctacagtgccagtccggccacttagtctgctcaaactgtcggccaaagctgacctgctgcccaacgtgccgcggaccattgggctcaatcagaaatttagccatggagaaagtggctaactcagtgctgtttccttgtaagtatgcgagctcgggttgtgaaatcactttgccccatacagagaaagccgatcacgaggaactctgtgagtttaggccatactcctgtccatgccccggagcttcctgcaaatggcaaggcagtctggacgccgtcatgccacatctcatgcaccagcataagagcataaccacgctccaaggagaggatatcgtatttctcgccaccgacatcaacctccctggtgctgtcgattgggtcatgatgcagtcctgcttcggtttccacttcatgctcgtactggagaagcaagagaaatacgacggtcaccagcagttcttcgcgattgtccagctcattggcacccgtaagcaggccgaaaatttcgcgtatagactagagttaaatggacacagaagaagattaacctgggaggccaccccgagaagtatacacgagggaattgccacagccataatgaactcagactgccttgtctttgatacatctatcgcccaattatttgccgaaaacggaaacctgggtatcaacgtgacgatttccatgtgttag

SEQ ID NO: 30803 - DNA, 897 bp, Artificial Sequence
  Description of Artificial Sequence: Synthetic coding sequence
atggtcattatcattttccttctgcccccttacgtatttatctctgagatgagcagacagacagccactgccttacctaccggcacctccaaatgtcccccaagccagagagtgcctgctttaaccggcacaacggctagcaataacgatctggctagtctgtttgaatgtcccgtgtgcttcgactacgtgctgccaccaattttacagtgccaatctggacaccttgtgtgtagtaattgtagacctaaactcacctgctgccccacttgcagaggccctctcggttctataaggaacttggcgatggagaaagttgcaaattcagttttgtttccttgcaaatatgcatcaagtggctgcgagattactctgcctcatacagaaaaggcagaccatgaagagctgtgcgaattcaggccctatagttgcccctgccctggtgcaagctgcaagtggcaggggtcactggacgcggtgatgccccaccttatgcaccagcataaatcgatcacaacactacaaggtgaagacattgtctttctcgcaactgatatcaatcttcctggagccgttgattgggtgatgatgcagtcttgctttggtttccacttcatgctagttttggaaaagcaggaaaaatatgatggacaccagcagttttttgccattgtgcagcttattgggacgaggaaacaggctgagaacttcgcctacagacttgaactcaatggccatagaagaaggctgacctgggaggctacccctcgatctatccatgagggcatcgcgacggccataatgaatagcgactgcctggtctttgatacctccatcgcccagttattcgcagagaacgggaacctcggaattaacgttacaatttctatgtgctag

SEQ ID NO: 30804 - DNA, 849 bp, Artificial Sequence
  Description of Artificial Sequence: Synthetic coding sequence
atgagccggcagacggctactgccctgcccacgggcacatcaaagtgtcctccttcccagcgtgtgccggctctgactggtacaaccgctagcaacaacgacctggcgtccttatttgaatgccccgtatgttttgattacgtccttccacccatactgcaatgccagtctgggcaccttgtttgctccaactgcaggcctaagctcacatgctgccctacatgcagggggcctctcggatcaattcgaaatctcgcaatggaaaaggtcgcaaattctgttctatttccctgtaaatacgcttcttctggttgcgagattacgcttccacacaccgaaaaggcagatcacgaggagctctgcgaattccgcccatatagctgcccatgcccaggcgctagctgcaagtggcagggaagtctggacgcggtgatgcctcacttgatgcatcagcacaagtcaataaccaccctgcaaggtgaggacatagtgtttttggcaactgatataaatctccccggtgctgtggattgggtcatgatgcagtcttgctttggattccatttcatgctagtactagaaaagcaggagaagtatgacggccaccagcagttttttgcaatcgtgcagctgattggcacccgaaagcaagctgagaatttcgcttaccggctggaacttaacggacacaggcggaggttaacctgggaggctacccccaggtctattcatgaaggtattgctactgccattatgaacagcgattgccttgtctttgatacgagtattgcccagctgttcgccgagaacggcaacttgggtattaatgtcacaatctccatgtgctag

SEQ ID NO: 30805 - DNA, 708 bp, Artificial Sequence
  Description of Artificial Sequence: Synthetic coding sequence
atgacgttcgatctgaccaagatcactaagacttcttcctccttcgaggtgaggacctgggatccggaaggtgtgattttctacggggacacgaacccaaaagatgattggtttatgctggggcttagagacggcagaccggagatccaattacacaatcactgggcacagttgacagtcggagccggacccagactggatgacggacggtggcaccaagttgaggtgaaaatggaaggcgactccgtgctgttagaagtggacggggaagaggtcctgaggctgcgtcaggtaagcgggcctttaacaagcaagagacatcctataatgaggatagcactggggggtctactcttccccgctagtaatctgcgactccccttagtaccagcgctggatggatgtctccgtagagactcttggctggataagcaggccgaaatatccgcgagcgcgcctaccagtctgcgctcatgcgatgtagaatccaaccccggtatatttctgcccccaggcacacaagccgagttcaacttacgggacattccacagccgcatgcggaaccctgggcctttagtctggatcttggcctaaagcaggctgcgggaagcgggcatctgctagccttgggtacacctgagaatccttcctggttatctctccatttacaagaccaagaaaagactctaccacccctctttgcttag

SEQ ID NO: 30806 - DNA, 1209 bp, Artificial Sequence
  Description of Artificial Sequence: Synthetic coding sequence
atggagtcgcgcggtccccttgccaccagtcgcctgctcctcctattgctcctcctcctgctgcgccacacacgacagggctgggcactccgccctgtgctgcccacccagagcgctcatgaccccccagcagtgcatctatcaaatggtccaggccaagaacccatcgctgtgatgactttcgacctcacaaagatcactaagacttctagttcattcgaggtccgaacctgggatccggaaggcgtaattttctatggagacaccaaccctaaagatgactggtttatgctgggcctccgagatggaagacctgagattcagctccacaatcactgggcccagcttaccgtgggcgcaggccctaggctcgatgacgggcgttggcaccaggtggaggtgaagatggaaggagatagtgtgctcctcgaggtggacggagaggaagtgctgcggctccgccaggtttctggacccctgacctcaaagagacaccccatcatgagaatcgccctgggcggtctgctcttccccgctagcaatctgaggttgcctctagtacctgcccttgatggatgcttacgaagagatagctggttggataaacaggctgagatctctgccagcgccccaacgtcccttcgatcgtgtgatgtggaatccaatcctgggatcttcctaccgccaggcacccaagctgagtttaatctacgcgacatacctcagccccacgccgagccttgggcttttagcctggatttaggtctcaaacaagccgctgggtccggccacctgttggcccttggtacgcccgagaaccctagctggctaagcctacacctgcaggatcagaaagtcgtgctctcgtctggttcaggcccaggactagacctgcctctcgtgctgggcctcccgcttcagctgaaactgtcaatgtctcgggtggtactctctcagggctcaaagatgaaagcccttgcacttccacctttaggcctggcaccactgcttaatctctgggcgaaaccgcagggtaggctcttcctgggtgcactcccaggggaagactctagtaccagcttttgtctcaacgggttatgggcccaagggcagcgactggacgtggaccaagccctgaatcggtcccacgagatctggacacacagctgcccacagagcccgggtaacggcacggacgcatcacactag

SEQ ID NO: 30807 - DNA, 882 bp, Artificial Sequence
  Description of Artificial Sequence: Synthetic coding sequence
atggaatcgagaggccctctcgctacgtctcgactcttgttactgctgcttctgctgctgttgcggcatacccggcaagggtgggccctgcgcccagtgctgccaactcagagcgcccatgacccacctgccgtccatctctccaacgggcctggccaggaacctatcgcagttatgaccttcgacttaaccaaaattactaaaacctcctcatcttttgaagtgagaacctgggatccagagggagtcatcttctacggagataccaatcccaaagacgactggttcatgttaggcctgcgcgacggcagaccagagatccagctccacaatcactgggctcaactgactgtgggggctggcccacgtcttgatgatggaagatggcatcaggtagaggttaagatggaaggggactctgtgctgctggaggttgacggcgaagaggtgttgcggctacgtcaggtatccgggccacttacttcaaaacgccacccaattatgaggatcgctctaggcggactgctgttcccagcaagcaatctgcgcttacccttggtccctgccctcgacgggtgcctgagaagggactcttggttggataaacaggctgaaatctcagcgagtgccccaacatcactcaggtcctgcgacgtcgaatcgaaccccggtatatttctgcccccaggcacacaggcagaattcaacctcagagatattccacagccccatgctgagccttgggcattcagcctcgacctcggcctcaagcaagcggcaggatccggccacctacttgccttaggcacgccagaaaatccttcttggctctcactacatctgcaggaccaggagaaaacccttccacctctttttgcgtag

SEQ ID NO: 30808 - DNA, 720 bp, Artificial Sequence
  Description of Artificial Sequence: Synthetic coding sequence
atggaatcccggggtcccttggcaacgtctagacttttgctgctgctcttgctgctgcttcttaggcacactcggcagggttgggcgcttcgccctgttttacctacgcagtccgcacacgaccccccagctgtgcacctcagtaatggccctggtcaggagcccatagctgtgatgacctttgatctgaccaagattactaaaaccagctctagctttgaggtccgaacttgggatcctgaaggcgtgattttttacggcgacaccaaccctaaggacgactggttcatgttgggcctacgcgacggcagaccggagatccagttgcacaaccattgggctcaactcaccgttggggcagggcctcgccttgatgatggcagatggcatcagctagtacccgcactggatggctgcttgaggcgggactcctggctcgacaaacaggccgagattagtgcttccgccccaacgtccttgaggagctgtgacgtcgagtccaaccccggtatcttcctccccccaggaacgcaggctgaattcaacctacgcgacatcccacaacctcacgcagaaccgtgggccttctcccttgacctggggttgaagcaggccgcaggcagtggccatcttctggccctcggcacccctgagaatcccagttggctctctctccatttgcaggaccaggaaaaaaccttacccccattattcgcatag

SEQ ID NO: 30809 - DNA, 864 bp, Artificial Sequence
  Description of Artificial Sequence: Synthetic coding sequence
atggaaagcagaggtcccctggccacaagtcgcttactgctgttactcctcctcttactgctgagacatacaagacagggctgggccctgcgacctgtgcttcctacacaaagtgcccatgaccccccagccgtgcacttgtccaatgggcctggccaggagcctattgcagtaatgaccttcgacctaaccaagataacaaaaacttcaagctcttttgaggttagaacttgggatcccgagggtgtcatattctatggtgacactaaccctaaggatgactggtttatgttgggcttgcgtgatggtaggccagagatacagcttcacaatcattgggcccagttgacagtgggcgctggacccaggttggacgatggaaggtggcaccaggtggaggtgaaaatggagggcgacagcgtcctgttggaggtggacggggaagaggtgttacggctgaggcaagtgagcgggccactcacaagcaagcgacacccaataatgcggatagctctgggcggactgctgttccctgcatccaatctgcgactgcccctggtgccagctcttgatggctgccttagacgcgattcctggcttgacaaacaggcagaaattagcgcttcagcaccgacctccctgaggagttgcgacgttgaaagcaacccgggaattttcctcccccctggtacccaggccgagttcaatttgagaggcgaggactccagcactagcttttgcctgaatgggctgtgggcacaggggcagaggttggatgtggatcaggccctaaaccgctcacatgagatctggactcatagctgcccacagtctccgggaaacgggacagacgcctctcactag

SEQ ID NO: 30810 - DNA, 423 bp, Artificial Sequence
  Description of Artificial Sequence: Synthetic coding sequence
atggaatcaagaggacccttggccacctctagactgcttctccttctgctgctgctcctgttacgtcacactcgccagggctgggcactgcgccctgttctgccgacacagtcagcccacgatccacccgctgtgcacctgagcaatggtccaggccaggaacccattgccgtcatgacatttgatctcaccaagattactaagacctccagttctttcgaggttaggacctgggaccctgaaggggtcatattttatggcgacaccaatccaaaggatgattggtttatgctgggcctaagagatggtcggcctgagatccagctgcataaccactgggcacagctgactgttggagcaggacctagacttgacgatggacgatggcaccaggagaagacattacccccactgtttgcctag

SEQ ID NO: 30811 - DNA, 1155 bp, Artificial Sequence
  Description of Artificial Sequence: Synthetic coding sequence
atggaatcaaggggccctcttgccacatctagattactgctgctgctattgttactgttacttcgacacacccgacaggggtgggctctgcgccctgtgctcccaacacagtccgcccatgatcctcctgcagtacacctgagcaatggcccagggcaggaacctattgcggtcatgacattcgacctaactaagatcacgaagaccagcagctcgttcgaagtgcggacctgggatcctgagggcgtgatcttttacggggacactaatcctaaggacgactggttcatgctgggtttgagggacggtagacccgaaatacagctgcacaaccactgggctcaattaacggtgggggctggtccgcgtctggacgatggcagatggcaccaggtggaagtgaaaatggaaggagactccgttcttcttgaggtcgacggggaagaagtgttgcggctgcggcaggtgtcaggtcctctgacaagtaaacgccatccaattatgcgcatcgctctggggggactgctgtttcctgccagtaacctccgtcttcctgcagaaatctcagccagcgcaccaacaagtctgcggtcttgcgatgttgagagcaatccaggcatttttctgcctcccggaacccaggccgagttcaacctgcgggacatcccccaaccccatgccgagccgtgggcattcagcctcgacttggggctcaagcaagctgccggtagtggccacctcctcgcactcggcactcccgaaaatcccagttggctcagtctccatttacaggatcagaaagtggtcttgtcaagcgggtcaggacccggactggacctcccacttgtgctggggctgccactgcagctcaaactttccatgtcccgggtcgttctttcccaggggtcaaaaatgaaagctcttgcccttcctcctctgggactagctcctctcttgaatctgtgggccaagccccaaggaaggctgtttcttggggctctgccgggagaggactccagcacatccttttgcctgaacgggctctgggcgcagggccaacggctcgacgtggaccaggcacttaatcgcagccacgaaatttggacacattcttgcccccagagtcctggtaatggcactgacgccagccactag

SEQ ID NO: 30812 - DNA, 1116 bp, Artificial Sequence
  Description of Artificial Sequence: Synthetic coding sequence
atgtcaccctccaccttccagataaccgatatgactagaagatcgtgccagaatttgggctatactgccgcatcaccacaggcacctgaagcagcctccaataccgggaacgctgagcgcgcagaggaagtgccgggagagggctctcttttcctgcaggccgagaccagggcctggttccagaagactcaggcacactggctcctccagcacggggctgccccagcgtggtttcacggtttcataactagaagggaagcagagagactgttggagcctaaaccccagggatgctatctggttcgattttctgaatctgcagtgacctttgtgctcacatacaggtctaggacctgttgccgccactttctgttggcccagctgcgcgatgggcgtcacgtcgtgttgggggaggactccgcacacgccagattgcaggacctgctcctgcattacactgcacacccgctttcaccctatggagagaccttgactgagcccctagctcggcaaaccccagaaccggcaggactttcccttcgcaccgaagaatcaaattttggctctaaaagccaggatcccaatcctcagtatagccctataatcaagcagggtcaggcgccagtacctatgcagaaagagggggcaggcgagaaagaaccttcgcagttgctgcgccctaaacccccaattcccgcaaagcctcagctccctcccgaggtctatacaatacccgtgccaagacataggcccgctccccgtcccaagcccagcaatcctatttataacgaaccagatgaacccattgcgttctatgccatgggccgaggaagcccgggagaagccccttcaaacatttatgtcgaagttgaggatgaagggctccctgcaacccttgggcacccagtactgagaaagtcatggtcccgtccagtcccaggaggacagaacacaggtggaagccagctgcactcagagaattctgtgattggacagggcccaccgctgcctcaccaaccaccccctgcgtggcgccatacgctgccccataacctatccagacaggttctgcaagaccggggtcaggcttggctacccctggggcctccacagtag

SEQ ID NO: 30813 - DNA, 1170 bp, Artificial Sequence
  Description of Artificial Sequence: Synthetic coding sequence
atggagttccctctggcccaaatctgtccgcagggctcgcatgaggccccaattccaacattcagcacgtttcaaataaccgacatgacaaggagatcctgtcaaaacctgggctatactgctgcgtcacctcaagctcccgaggctgcatctaatacgggcaatgctgagcgagccgaggaggtgcctggggagggcagcttatttctacaggctgaaacacgagcgtggttccagaaaacccaggcccactggctgctccaacacggagctgcgcctgcctggttccatgggtttattactagaagggaggccgagcgcctgctggagccaaaaccccaggggtgctaccttgtgcgcttctctgagagcgccgtgacttttgtactcacttatagatcaaggacttgttgcagacactttctcttggcacagctcagagatggcaggcacgtcgtcctgggagaggattccgctcacgctagactacaggatttgctcttgcactatactgcccatcccctcagcccatatggggaaactctgacggaaccccttgcacgccagactcccgagcctgccggtctgagcctgaggaccgaggagagtaactttggttccaagagccaggaccctaacccccaatactccccaattattaaacaggggcaagctcctgtcccgatgcaaaaggagggagccggtgaaaaggagccctcccagttgttgcgtcctaagcccccaatcccagctaagcctcaacttcctccagaagtgtacaccatcccggtcccaagacaccggcctgccccacggcctaagccaagcaatcccatctacaacgaaccggatgagcctatcgccttctatgctatgggccgagggagccctggagaggccccaagcaacatttatgtcgaagtcgaagacgagggtcttccagccacgctggggcacccagtgctccggaagtcctggtcccggcctgttccaggcggacaaaacaccggaggcagtcagctgcactcggaaaactcagtgataggccaagggcctcccttaccccaccagcctccccctgcatggcgccacaccctacctcacaatcttagccgacaagtgctgcaagatagggggcaggcttggttgcctctaggaccaccccagtag

SEQ ID NO: 30814 - DNA, 1200 bp, Artificial Sequence
  Description of Artificial Sequence: Synthetic coding sequence
atggagttccccttagcccagatctgcccgcagggctcccatgaggctcctattcctaccttttcaacattccaaattactgacatgacccgacggtcttgccagaatctcggctacaccgctgcaagcccgcaggcccctgaagcggcatctaacacggggaatgccgagcgcgctgaggaggtgccgggagagggctctttgtttctacaagctgaaaccagggcatggttccaaaaaactcaggcgcattggcttttgcagcacggggcagctccagcttggttccatggctttattacgcgacgagtgcgaccccctctgtccgtgacccatcgggaggcggagaggctcctggagcctaaaccacagggttgctacctggtccggttcagcgagtctgcagtcacttttgtgttgacttaccgatctcgcacatgttgcaggcacttccttcttgcccaactccgagatggacgccacgtggtgctcggtgaagactccgcacacgcacgcttgcaagacctgttactgcactacacggctcaccccctgtcaccttatggggaaactctgacagagccactcgccagacagactccagaacctgccggtttgtccctgaggaccgaagaatccaatttcggaagcaaatcgcaggatcctaacccccagtattcacctattataaagcagggtcaagccccagtacctatgcagaaggagggggcaggcgaaaaggagccttcacagctgctaagaccaaagcctccaattccagcaaaaccacagttgcctcccgaggtttacacgataccagttccccgacaccgccctgcaccaagacctaagccatccaatcccatctacaacgagcctgatgagccaatcgcattctacgccatgggcagaggatcgccaggcgaagccccatccaacatctacgtggaggtggaagatgaaggtctaccagctactctggggcatccggtgcttagaaagagttggtcgcggcctgtgcccggtggccaaaacacaggaggcagtcaattgcattccgaaaacagtgttatcggccagggccctcctcttccgcatcagcctcctcctgcttggcgtcacactctcccccataatctgtcaaggcaagtcctgcaagaccggggtcaggcatggctgccattgggcccaccccaatag

SEQ ID NO: 30815 - DNA, 2823 bp, Artificial Sequence
  Description of Artificial Sequence: Synthetic coding sequence
atgattttagagcaatacgtcgtggtgagcaactataagaaacaggagaacagcgaactgagtttacaggcgggagaagtagtggacgtgatcgaaaagaacgagagtgggtggtggtttgtgagcacaagcgaagagcagggctgggtgccagccacgtatctcgaggcacaaaacgggactcgcgacgattctgatattaatacctcgaaaaccggagaagaggaaaagtacgtgaccgtgcagccctatacaagccagagcaaggatgagattggcttcgagaagggagttaccgttgaagtgattagaaaaaacctcgagggatggtggtacatcagatatctgggtaaagagggatgggcccctgcatcctacctcaaaaaggcaaaggatgatctgccgacccgcaaaaagaatctggcaggtccagtagagattatcgggaatatcatggaaatctctaacctattgaacaagaaagcttcgggggacaaagagacacctcccgctgaaggcgaaggccatgaggcgccaattgctaagaaagagatttccctgcctatcctatgtaatgcttctaacggatcagcggtaggagtgcctgacagaaccgtaagccggctggcgcagggaagtcccgcagtcgccagaatcgccccacagcgcgcacagatttcctctcccaatctgcgcacccgcccacctccgaggagagagtcctctctgggattccagctgcccaaaccaccagaaccccctagcgttgaagtcgagtactatacgatagcagaatttcaaagttgtataagcgacggaatcagcttccgcggtggccagaaggcagaagtcattgacaaaaattccgggggatggtggtacgtgcagattggtgaaaaagaaggctgggctcccgcatcctatatcgataagcgcaagaaacccaatctgtcccgcaggaccagcaccctcacccgccctaaggtcccacctccagcccctccctcgaagcctaaagaggctgaagagggacctaccggcgcatccgagagccaagattcaccgagaaaactcaaatacgaagagcccgaatatgatataccagcctttggattcgacagcgaaccagaactgtccgaagagcccgttgaggaccgggcttccggggagcggaggcccgcacaaccccatagacccagccctgccagctctcttcagcgagccagattcaaggtaggcgagtcaagtgaggacgtggcgctggaagaagaaaccatctacgagaatgagggattcagaccatatgccgaggacaccctgagcgctcgaggttcaagcggagacagcgacagccctggaagttcctctctctccctgactcgaaagaacagtcccaaaagtggtagcccaaaatctagcagtctgttgaaactgaaagcagagaagaacgcccaggctgaaatggggaaaaaccatagttcggcttccttttcaagtagtatcactattaatactacttgctgttcatcctcctcatcaagctcttcttctctttccaaaacgagcggggacttgaaaccacgatctgcttcagacgccggaataagaggaactcctaaagtcagggccaagaaggacgccgacgcaaatgctgggctcacgagctgtcccagagccaagccttcagtccggccaaaaccatttctcaaccgggctgagagccagtctcaggagaaaatggacatctccaccctccggagacagctgaggccgaccggacagttacggggtggattgaaggggagcaaatccgaagattcagagcttcccccacagactgctagcgaggcgccatccgagggaagcaggcgatcgagtagcgatttgattactctaccagccacaacacccccatgccccacaaaaaaagaatgggaaggtcccgctacctcgtacatgacctgctctgcataccagaaagtacaggacagtgaaatttctttcccggctggggtggaagtccaggtccttgagaaacaggaatcgggatggtggtatgttcgcttcggtgagttagaaggctgggctccctcacactaccttgtactggacgagaatgagcaaccagatccatcgggtaaggagcttgatactgtcccggcaaagggcaggcagaatgagggtaagagtgattctctggaaaagatcgaacggagagttcaggctcttaatacagtgaatcagtctaagaaagcaactcctccaattccaagcaaaccaccaggcggattcgggaagacttccggcacccccgcagtcaagatgcggaatggagtgcggcaagtcgctgttcgcccacagtcagtttttgtatcacccccaccaaaggacaacaatctgagctgcgctctgcggaggaacgaaagtctcacagctacagatggcctgcggggagtccgaagaaatagcagctttagtactgcacggtccgccgcagccgaagccaagggtagactcgccgaacgggcagcatcccaaggtagcgacagtcctctcctgcccgctcagcgcaactcgataccagtgagccctgtgcggcctaaacccattgagaagtctcagttcatacacaacaacttgaaggatgtgtatgtgtcaatcgccgactacgaaggggatgaagagacagcgggattccaggaaggcgtgtctatggaggtactagagcggaacccgaacggctggtggtactgccagatcctcgacggtgttaaaccttttaaaggatgggtcccaagcaattacctagagaagaagaactag

SEQ ID NO: 30816 - DNA, 3318 bp, Artificial Sequence
  Description of Artificial Sequence: Synthetic coding sequence
atgctggcctactgcgtccaggacgccacggttgtggacgtggagaaacggaggaatccctccaagcactacgtctacatcataaacgtgacttggtccgactccactagtcagactatttatagaaggtactccaagttctttgacctacagatgcagctgttggataaatttcctatcgaaggagggcagaaagatcccaaacagcgcatcataccgttcttaccgggaaaaatactcttccgcaggtctcacattagggacgtggctgtgaaaagactgaaacctattgacgagtactgtcgggctctcgtcaggttacccccacacatttcgcagtgtgacgaggtgttcagattttttgaggctaggcccgaagacgtgaacccccctaaggaggattacggttcttcgaagcgcaagtccgtgtggctctcatcctgggctgaaagtcccaaaaaggacgtgactggtgctgacgcaacagctgagcccatgatattagagcagtacgtcgtagtctcaaactataagaaacaggaaaattctgaactgagtttacaggccggagaggtggtggacgttatagagaagaacgagagcggatggtggtttgtatctaccagtgaggaacagggctgggtgccggctacctacctggaagcccaaaatggaacgcgcgatgactccgacatcaatacatctaaaactggcgaggaagaaaagtatgtgacggtgcaaccatatacaagccagtccaaggacgagatcggttttgaaaaaggggtgacagtggaggttattcgtaagaacctggaagggtggtggtacattcgctatctgggtaaggagggttgggcccctgcctcttatttgaagaaggctaaagatgatctgccgacgcgcaaaaagaatctggctgggccagttgagatcattggaaacatcatggagattagtaatttgctcaataaaaaggccagtggcgataaagagaccccacctgctgagggcgaagggcacgaggctccaatcgctaagaaggaaatatccttgccaattctttgtaatgcatccaatggaagcgctgtgggtgtgccagacaggaccgtctcccgcctagctcagggaagccccgcagtagcgaggattgcccctcagcgcgctcaaatcagttcaccgaaccttagaacacgacctccgcctcgtcgggaatcctccctgggattccaactccctaagcccccagagcctcccagcgtagaggtggagtattacacgatcgctgagttccagagctgtattagtgatggtatttctttccggggaggccaaaaggcagaggtgattgataagaactctggcggatggtggtacgttcaaattggggagaaggagggatgggcccctgccagctatattgacaagaggaaaaagcccaacttgtcccggaggacctctaccttgacccggccaaaggttccgcctccagcgcctccgtctaaaccaaaagaggctgaggagggtcccactggcgcaagcgagagtcaggatagccccagaaagctgaagtacgaggaacctgagtacgacatacccgcattcggtttcgatagtgaacccgaactgagcgaagaaccagtggaggatcgagctagcggcgaaaggaggcccgcacagcctcatagaccctccccagcgagtagcttgcagagagcaaggttcaaagtcggagagtcttccgaggacgttgccctggaggaggagaccatttacgagaatgaaggattccggccatacgcagaggatacacttagcgcaagagggtcatccggcgattcggacagtcccggttcgtcctctctttctctgacccggaagaattccccaaaaagtggtagccctaagtcgtcctctctgctcaagctgaaggcagaaaaaaatgcccaggcggagatgggcaaaaaccacagctcagcatcatttagtagttctatcaccatcaacaccacctgctgtagtagcagctcttctagctcatcctctttgtccaagacctctggcgacctgaaaccacgcagtgcaagcgacgccggaattcgcggaacaccgaaggtgagagcaaagaaagatgccgatgccaatgctggtctcaccagttgtccccgagcgaagccctccgtaagacctaagcccttcctgaatagggccgagagtcagtctcaggagaagatggacatctctacactgcggagacaattaagaccgaccggacagctgcggggaggcctgaaagggtctaaatccgaggattccgagcttccccctcagactgcctcagaggctcctagcgagggatccaggagatcgtcgagtgatctgatcaccctgcccgcaacaaccccgccttgtcccactaaaaaggaatgggaagggcctgccaccagctatatgacctgcagcgcataccagaaagtgcaggatagcgagatctcgttccctgcgggagtcgaagtgcaagtgttagagaaacaggaatctgggtggtggtatgtgaggttcggcgagctcgagggctgggccccaagccattacttggtgctggatgagaatgagcagcctgacccctctgggaaagagctcgacacagtgccagcgaagggcaggcagaacgagggcaaaagtgatagcctggagaagattgagcgacgagtccaggctctgaacaccgttaatcagtctaaaaaggcgaccccccctattccttcaaagcctccaggcggatttggtaaaacctccggaacacctgcagtgaagatgaggaatggtgtcagacaggttgcggtgcggcctcaaagcgtttttgtatccccgccaccgaaggataacaatctcagttgcgcactacgacggaacgagagtctgacagctacagatggactccgcggtgttagacggaattctagttttagcactgccagatccgccgcagcagaagctaaaggtaggctggctgaacgtgccgcttctcagggcagcgacagcccattgctacccgcacagcggaacagtataccagtttctccagtacggccaaagcccattgaaaaatctcagtttatccataacaatctcaaggacgtgtacgtgagtattgcagattatgagggagacgaagaaacagcgggattccaggaaggggtcagcatggaagttctcgagcggaatcctaacggatggtggtattgtcagattctcgatggggtgaaaccatttaaaggttgggtgccgagcaattatctggagaaaaaaaattag

SEQ ID NO: 30817 - DNA, 3402 bp, Artificial Sequence
  Description of Artificial Sequence: Synthetic coding sequence
atgctggcgtattgcgtgcaggatgctactgtggttgacgtggagaagcgcagaaatccgagcaagcattatgtatacatcatcaacgtgacttggtctgactctacttcccagacaatttacaggagatattcaaaattttttgacctacagatgcagctcctggataagtttcccattgaggggggtcagaaggaccccaagcagagaattattcctttcctcccagggaaaatcctctttcggcgaagtcacataagagacgtggcagtgaaaagattaaagcctatcgacgaatattgcagggcattggtcagactgccgccacacatcagccagtgtgatgaagtttttcggtttttcgaagctcgcccagaggacgtcaacccacccaaagaagactacggttcctcgaaacgaaaatcagtgtggcttagttcttgggccgaatctcctaaaaaggatgtaacaggagcagatgccaccgccgaacccatgatcctggaacagtacgtcgttgtttccaattacaaaaagcaagaaaactctgagctaagccttcaggcaggagaagtggtagacgttattgagaagaacgagtccgggtggtggttcgttagcacaagtgaggagcagggctgggtgcctgctacctacctagaggcccagaatgggacccgcgatgactctgacattaatacatctaagacaggcgaggtgtccaagcgtcgcaaggcccatcttcggagattagaccgcagatggactttggggggaatggtcaatcggcagcacagcagagaagagaaatacgtcactgtgcagccttacacatcccagagcaaggacgaaattggcttcgagaagggggtcaccgtggaagtgatacgaaaaaatcttgaggggtggtggtacatcaggtatctaggcaaagaaggttgggctcccgcaagttacctaaagaaggccaaggatgatcttcccaccaggaagaaaaatctggcaggaccggttgagatcataggcaacataatggagatctccaaccttctcaataaaaaagcaagcggcgacaaagagacccctccggctgagggtgagggacacgaggctcctattgccaaaaaagaaatctcactgccaatcctatgtaatgcttccaatgggagcgctgtgggtgtcccagataggactgtatcaaggttggcccaaggtagtcctgcagtggctaggatcgcccctcagagggcacagatctccagcccaaacttgcgaacgcgtccgccaccgcgtagggagtcttccctagggttccagttaccgaagcctcccgaaccaccctctgttgaagtcgaatattatactatagccgagtttcagagctgcatttcggatggaatttcattcaggggaggccagaaagccgaagtgattgacaagaactcgggaggatggtggtacgtgcagatcggcgagaaggagggctgggcgccagccagctatatcgacaagagaaagaagcccaatctttcccgacggacatccacattaacacggccaaaagtgccaccaccagccccaccatctaagcctaaggaggctgaggaggggccaacaggcgcttccgagtcccaggacagcccacggaaactgaaatatgaggaacctgaatatgatatccctgctttcggctttgactccgaacctgaactgtcagaagagcccgtagaagatcgcgctagcggcgagcggagacctgcacagccccatagaccttcccccgcatcctcattacagcgcgcacgcttcaaagtgggcgagagctcagaagacgtggcactggaggaagaaactatatatgagaatgaaggcttcaggccctatgcagaggatacactatccgctcgtggaagtagtggtgattccgattcacctggctcctcttccctctccctcactagaaaaaattcccccaagtcgggaagtcctaaatcaagcagtctgttgaaactgaaggccgaaaagaatgctcaggcagagatgggtaaaaatcattcctctgcctcgttcagtagtagcattaccattaatacgacatgttgttcatcttctagttcatcctcctcctccctgagtaagacctccggcgatctgaaacccaggtcagcttctgatgcgggaattcgaggtacccccaaggtgcgtgcgaagaaagacgcagatgccaatgcgggtctgacaagttgtcccagggcgaaacccagtgtgcgccctaagccgtttctgaatagggctgaatcccagtcccaggagaaaatggatattagcaccctgcgcaggcaactgcgcccaacagggcagctgaggggtggtctgaaaggcagcaaaagcgaagactccgagttgccaccccagacggcttccgaggccccttcagaaggcagccgacgcagctccagtgacctaatcacactgcccgctacaacacccccttgccccaccaagaaagaatgggaaggaccagccacatcatatatgacatgcagcgcatatcagaaagtacaggactccgagatatcattccctgccggagttgaggtccaagtcctggagaagcaggaatccggctggtggtacgttcgattcggggagctggagggttgggctccctctcactacctggtgctggatgagaacgaacaaccggaccccagtggaaaagagctggacaccgttcccgctaaggggagacagaatgagggaaaaagtgatagcttggagaaaatcgagagacgtgtgcaggcactgaacacagtcaatcagtctaaaaaggcaaccccacccattccctccaaaccacctgggggttttggcaagacctcaggcactcccgcagttaagatgagaaacggcgtccgtcaggtcgctgttcgtccccaatccgtgttcgtttccccaccacctaaggacaataatctcagttgtgccctgcgaagaaacgaatctctcaccgccactgatggcctgagaggcgtgcgtaggaactctagcttttcaaccgccagatctgctgccgctgaagctaaggggagactggccgagcgggctgcttcccaggggagtgattctcctctccttcccgcacagcggaactctataccagttagccctgtgcggccaaagccaatcgaaaagtcacagtttattcacaataacctgaaagatgtttatgtgtcaatagcagattacgaaggagatgaggagactgctggcttccaggaaggcgtctctatggaggtgctcgaacggaaccccaatggctggtggtactgccaaatcctggacggggttaagcccttcaaaggttgggttccgagcaattatttggaaaagaaaaactag

SEQ ID NO: 30818 - DNA, 3183 bp, Artificial Sequence
  Description of Artificial Sequence: Synthetic coding sequence
taattcttcgatttacaaatgcaactgctggataagttccctatcgaaggaggtcagaaggaccccaaacagaggatcattccctttctccccggaaaaatcctcttcagaaggtcacacatacgagacgtcgcggtcaaacgcctcaagcctatcgatgagtactgtcgcgctttagtgcgtcttccaccgcacatatctcagtgcgatgaggtctttcggttttttgaggctcggccagaggatgttaaccccccaaaggaggattacggatctagcaagcgcaaaagcgtctggctctcctcctgggcggagagtccaaaaaaagacgttactggcgctgatgctaccgccgagccaatgattcttgaacaatacgtcgtggtgagcaattacaaaaaacaggaaaacagcgagttatccttgcaggcaggcgaggtggtcgatgtgatcgagaaaaacgagagtggttggtggttcgtgtccactagcgaagaacagggatgggttcccgctacctacctcgaggcccagaacgggacaagggacgacagcgatataaacacgtccaaaacaggagaggaagaaaagtatgtgaccgtgcaaccttatacaagccagagcaaggacgagattggcttcgaaaagggggtaaccgtggaggtcatccgcaaaaacctggagggatggtggtacatcagatacctggggaaagagggatgggccccagcgtcctacctcaagaaagcgaaggacgacctgcctactcggaagaagaatctcgcaggcccagtggagatcatcggtaacattatggagatatccaacctactgaataagaaagcttcaggagataaggagaccccgcctgccgagggcgaaggacacgaagcacctattgctaagaaggaaatctccctcccaattctgtgtaacgcatctaacggatcagctgtcggcgtcccagaccgcacagtatcaagattagcgcagggctctcccgcagtggccagaatcgccccacagagggcgcagatttcctctccaaacctaaggactaggcctcctccaaggcgtgagtccagcttagggttccagctcccaaagccacctgagccccctagtgttgaggtcgagtactacactattgctgaatttcagagttgtattagtgacggtatctccttccggggagggcagaaagccgaagtcatcgacaagaattcgggtggatggtggtacgtacagattggcgaaaaggagggctgggccccagccagctacattgataaaagaaaaaagcctaatctgtctcggcgtaccagcacccttactcgcccaaaagtaccacctcctgccccaccctcaaagcccaaagaagccgaggaaggaccgacaggcgcaagcgagtctcaggatagcccccgtaaattgaagtacgaagagcctgagtacgacatcccagccttcggcttcgatagtgagccagaactctcggaggagcccgtagaagatcgtgctagcggcgagcggaggcctgcccaacctcataggccttcaccagcatcttctctccagcgtgcaaggttcaaagtcggagagtcaagcgaagacgtagcattggaggaagaaaccatctacgaaaacgagggctttaggccttacgctgaagacaccctgtccgcgcgaggatcgagtggggatagcgatagcccgggttcttcaagcctaagcctaacacggaagaacagtcccaagtccggcagcccaaagtcatcctcgctcctcaaactcaaggccgagaagaacgcccaagccgagatggggaagaaccatagcagcgctagctttagcagctccatcacaatcaacactacatgttgcagtagttcctctagctctagttccagccttagcaagacatctggggatcttaagccaagaagcgccagtgatgccggaatacggggtaccccaaaggtgcgtgccaaaaaggacgctgacgcaaacgcagggctgacatcttgccctcgggctaagccttcagtcagaccaaagccctttttgaatcgtgcagaatcgcagtcccaagagaaaatggatatcagcacattgcgcagacagctgcgacccaccggccagctccgtggaggcttgaagggctctaagtctgaagattcagaattgccacctcaaactgcatccgaagcaccaagcgaaggcagccggagatcaagttctgatttaataaccctgccggcaactacgccaccatgtccaactaaaaaagagtgggaaggacctgcaacctcctacatgacctgcagcgcatatcagaaggtacaagactctgagatctccttccctgctggtgtcgaagtgcaggtactggagaagcaggagagtgggtggtggtacgtccggttcggggagctggaagggtgggccccttcccattacctggttctggacgagaatgaacagccagacccctcagggaaggagctcgacactgtgcctgccaagggtcggcagaatgagggcaagtcagattccttggagaaaattgaacgcagggtacaagcgctgaatactgtgaatcaaagcaagaaggccacccctcctattccaagcaagcctccgggaggatttggtaagactagcgggacaccagcggtgaaaatgagaaacggtgtcaggcaggtcgccgttagaccacagtctgtctttgtttcccccccacctaaggataacaatctaagctgtgcactgagacgcaacgagtcgttaacagcaactgatggacttcggggagtaaggagaaacagctcctttagcacagcccgttccgctgccgcagaagccaagggcaggttggcagagagagccgcatcgcagggcagcgatagtccattgctgcccgctcagagaaattccattcctgtatcacctgtcaggccaaagcccattgaaaagagtcagtttatccataacaacctgaaggacgtgtacgtttcaatcgccgattacgagggtgatgaagaaactgccggattccaggaaggcgtctccatggaagtgcttgagagaaacccaaatggatggtggtattgtcaaatcttggacggagtcaaaccatttaaaggatgggttccttcaaactatctggagaagaagaattag

SEQ ID NO: 30819 - DNA, 1110 bp, Artificial Sequence
  Description of Artificial Sequence: Synthetic coding sequence
atgagcatatgttgttgctttttctttcgagactacggttctagcaaaaggaagagcggggctgatgcaaccgctgaaccaatgatcctggagcagtatgtggtggtcagcaactacaagaagcaagagaatagcgagctgtctttgcaggccggagaggtggtcgacgttatcgagaagaatgagagtggatggtggttcgtttcaacgtccgaggagcaaggctgggtgcccgcaacttatttggaagcacagaacgggacgagggacgattccgatatcaacactagtaaaactggtgaagtttctaagcgcagaaaagctcacctgagaaggctcgaccggcgttggaccctgggcggaatggtcaatcggcagcacagtcgcgaggagaagtacgtcaccgtccaaccatatacatctcagtcaaaggatgaaattggcttcgagaagggcgttaccgttgaggtcattagaaagaacttggaaggatggtggtatattagatatcttggcaaggaagggtgggcccctgcttcctatctgaagaaggcgaaggacgacctcccaactagaaagaaaaaccttgcgggtcccgtggagattattgggaatattatggaaatttccaatttgcttaataaaaaggcttctggcgataaggaaaccccaccggctgaaggagaggggcatgaggctccaattgccaagaaggaaatttctctgccaattctttgcaatgctagcaacggaagtgccgtaggcgtgcctgaccgcacagtgtcaaggcttgctcagggatcccctgccgtcgctagaatcgcccctcagagggctcagatctccagtccaaacttgcggactagaccacctcccagacgcgagtcatccctcaccgaaagtagatgtaggcaggcaggggtgcagtggcatgacctcggctctctccagagtccccacccacgattcaaaaggtttagttgtctctcactgttgagcagctgggaccaccggcacatgccaccccacccagcaaatttcctgatttttttaattgagactggcttccaccacgtaggtcaagacgggctgcacctgctgacatcctag

SEQ ID NO: 30820 - DNA, 2898 bp, Artificial Sequence
  Description of Artificial Sequence: Synthetic coding sequence
atgcccgtcactgcgaccggtaagattctgttcaggcggtcccatatcagggatgtggccgtgaaacggctgaaaccaatcgatgagtactgcagagcactagtgcgattgcccccacatatctcgcagtgcgatgaggttttccggttctttgaagccaggcctgaggacgtgaacccgcctaaggaggattatggaagttccaaacgcaagtccggcgcagacgctactgctgagcctatgattctcgagcaatatgtggtggtgagcaactacaaaaagcaggaaaactcagagctctccttgcaggctggggaggtcgtggatgttatagagaaaaacgagtcaggatggtggttcgtgagcaccagcgaggaacagggttgggttccagccacgtatctggaagcacagaatgggacgagggacgattccgatatcaacacctccaaaacgggagaagttagcaagagaaggaaggcacacctcaggcgactggatcgaaggtggaccctgggaggtatggtgaaccgccagcacagtcgcgaagagaagtacgtaacagtgcagccctacacctctcagtctaaggatgaaatcggctttgagaaaggcgtcacagtggaagtgatcaggaagaacctggaaggctggtggtacattcgttacctcggaaaggagggctgggcccctgccagttacctgaagaaagcaaaggacgacctccccacccgcaagaaaaacctggcagggccagtggaaattatcggtaatattatggaaatctccaatctgctgaacaagaaagctagcggcgacaaagagacaccacctgcagaaggggaagggcatgaggctcctatagccaagaaggagatcagcctccctatcctgtgcaatgcaagtaacggtagtgccgtgggcgtgcctgatcgtaccgtcagcaggctggcacagggaagccctgctgttgcacgaatcgcaccacagcgggcacagatctcgagccccaatttgagaacccgccctccccctcgacgggagtcatcattgggctttcagctcccaaagccccctgaacctccctccgttgaggttgagtattacaccatcgccgaattccagagctgtatcagtgatgggataagtttccgaggtgggcagaaggctgaagtgatagataagaactccggcggatggtggtatgtccagattggcgaaaaagaaggatgggcccctgcctcttacattgataagcggaagaagccgaatctatcacggaggacatctacattgacacggcctaaggtcccacctcctgcgcctccttcaaagccgaaggaagcagaggagggccctacgggtgcttccgagtctcaggactctccgcgaaagttgaagtacgaggagcctgagtatgacatccctgcgtttggcttcgattctgagccagaactttcggaggagccagtggaggaccgtgcaagtggggaacggaggccggctcagccacaccgcccttcccctgcttcctcactgcagagagctagattcaaggtaggcgaatcctcggaagatgtggccctggaggaagagactatctacgagaatgaagggttccgtccttacgcagaggatacattaagtgcccgaggatcctccggagactctgactccccagggtcttcctcactgtccttgacgcggaagaacagtcctaaatcgggctcccctaaaagttctagtcttctgaagttgaaagcggagaagaatgcccaggcggaaatggggaagaaccacagcagcgcctccttcagtagctcaatcactatcaacactacttgctgcagtagctcatcaagctcctcttcgtctctcagtaagaccagtggggacttgaagccacgttccgcaagtgacgcgggtatcaggggaacacctaaggtgcgtgccaaaaaggacgcagacgccaacgccggactgaccagctgccccagggcgaaaccctcagttcgaccaaaacctttcctgaacagggccgaatctcaaagccaggaaaagatggatataagtacattgagaaggcagcttcggcctaccggacagcttcgcggaggcctgaaagggtcgaaatctgaggactccgaactgcccccacagaccgcctccgaagccccatcagaaggcagcagaagaagctcttccgacctgatcactcttcctgcaacgacacccccttgcccgaccaagaaagagtgggaaggcccagctacatcttatatgacctgcagcgcataccagaaagtccaggacagcgaaatcagttttcctgcgggagtggaggtgcaggtgttagagaagcaggaatcaggctggtggtatgtgaggtttggcgaactcgaaggctgggctcctagccattatcttgtcctggatgaaaatgaacagccagatccctctggtaaggagctggacactgtacccgctaagggcaggcaaaatgaagggaagtcagattctctcgagaagatcgaacggagagtccaggctctgaacaccgtcaaccaaagcaaaaaggctacgccgcctatcccctccaaacctccagggggattcggtaaaacatccggaacccccgcagtgaagatgaggaacggcgtgcgccaggtcgccgttcgccctatcgaaaagtcacagttcattcataacaatctcaaagatgtgtatgtgtcgatcgccgactacgagggcgacgaggagacggccggattccaggagggcgtaagcatggaggtgcttgagagaaacccaaacgggtggtggtattgccagatcttagatggggttaagccctttaaaggatgggtgccttctaactatctcgaaaagaaaaactag

SEQ ID NO: 30821 - DNA, 2907 bp, Artificial Sequence
  Description of Artificial Sequence: Synthetic coding sequence
atgatcctcgaacagtacgtggtggtctctaattataagaaacaggagaattcagagctgtcacttcaggccggagaagtagttgatgtgattgagaaaaatgagtccggatggtggttcgttagcacctctgaagaacagggctgggtgcctgccacctatctggaggctcagaatgggacacgagacgacagtgatattaacacctccaagaccggagaagtttccaagagacggaaggcacacttacggaggctcgatagacgatggactctgggcggaatggtgaaccggcaacattcccgcgaggagaaatacgtgacagtgcagccctataccagccagagcaaagatgaaatcggctttgagaaaggcgtgacggtggaagtgatccggaaaaatttggaggggtggtggtatatccggtatctaggcaaagagggctgggctccggcttcttatctgaaaaaggctaaggacgacctcccaactcgcaagaagaacctggccggtccagtagagatcatcgggaacataatggagattagcaatttgcttaataaaaaggcatcaggcgacaaggaaacccctccagcggagggcgaaggccatgaggccccaatcgccaagaaggagatttccctgcccatactttgtaacgcctccaacggatcagcggttggggtgccagaccgcaccgtaagcagactcgcccaggggtcgccggctgtggcgaggatagccccacaacgggctcagatttccagtcctaacctgcgtactcgaccgcctccgcgaagggaatcctctctgggattccagctgcccaaacctccagagccgccttcagtggaggtggagtattatacaatcgctgagtttcaatcctgcatctcggacgggatctcctttcggggaggacaaaaagccgaagttatcgacaagaacagtgggggttggtggtacgtccagattggggaaaaggaagggtgggcaccagctagctatatcgataagagaaaaaagcccaatttgtcgcggcgaacgagcaccctgacgcgtcccaaagtccctcctccggctcctccctctaagcctaaggaagctgaggaaggacccacgggagcatcagagtcccaagacagccctaggaaacttaaatatgaggagccagaatacgacatacccgcttttggatttgattccgaaccagagctgtcagaggaaccagtggaggaccgggcatcaggcgagaggcgccctgcccagccccatcgcccttcccccgcatcgagtctgcagagagccaggttcaaagtgggggaatcaagcgaagatgtcgcactggaagaggagactatttatgagaatgaggggttccggccatatgcggaggacactctctctgctcgagggtctagcggggactctgactctcctggtagctctagcctgtctctgaccaggaagaactcccccaagtcaggttccccgaagtcatctagcctgttaaagcttaaggctgagaaaaatgcccaggccgagatgggaaaaaatcatagctccgcgtcctttagctcaagcatcacaattaatacaacatgttgttcatctagcagcagctcttctagctccctgtccaagacttccggcgatctcaaacccaggagcgcctccgatgcagggatccggggtaccccgaaggtaagagccaaaaaagatgccgatgccaacgctggactcacatcctgccctagagcgaaacccagcgtccgcccaaaaccatttctgaaccgcgctgaatctcagtctcaagagaagatggacatctcaactctccggaggcagcttagacccacaggacagctgagggggggacttaagggatcaaagtccgaagacagtgagctcccccctcagaccgccagcgaggcaccaagcgaaggcagcagacgcagctcatccgatcttattactcttcctgcaactacaccaccctgccccactaagaaagagtgggaggggcctgccactagctacatgacttgctctgcctatcaaaaggttcaggatagcgagatcagttttcccgctggtgtcgaggtgcaggttctggaaaaacaggaatcgggctggtggtacgtgcggtttggcgagctggagggttgggccccatcccactacctagtactcgatgaaaatgagcagccagacccctctggtaaggagcttgacaccgtgcctgccaagggtaggcagaacgaggggaagtctgatagccttgagaagattgagaggcgcgtgcaagcactgaatacggtcaaccagagtaagaaggccacccctcctatcccatcaaaacctcctggaggctttgggaagaccagcgggactcctgctgttaaaatgcgtaatggtgtacgccaagttgccgtaagacctcagagtgtcttcgtgagtcccccaccgaaagacaataacttgagttgcgcattgaggaggaatgagagcttaactgctactgacggccttcggggagtcaggcggaatagcagcttctccacggcacgttctgccgctgcagaggccaagggcaggctcgcagagagagccgcatcacaggggagcgatagcccactgctgccagcccagagaaatagcatccctgtgtctcccgtacgccctaaacccatcgaaaagtctcaattcattcacaacaatctcaaggatgtctacgttagcatagcagactatgaaggggacgaggaaaccgccggttttcaggaaggagtgagcatggaggtgctagagcgcaatccgaacggctggtggtattgtcagattctggacggagtcaagccttttaagggatgggtgcccagcaactacctagaaaagaaaaactag

SEQ ID NO: 30822 - DNA, 3003 bp, Artificial Sequence
  Description of Artificial Sequence: Synthetic coding sequence
atgaacggttcattcctgttgcggttgctatttcccgtcgctagtatcctgcccgagaccgtgctgcttagaggggcagacgcaactgccgagccaatgatattggaacagtatgtcgtggtgtccaactataagaaacaggaaaactctgaactttctctgcaagccggagaggtggtagatgtgattgaaaagaatgagagcggctggtggttcgtgagcactagcgaagagcagggatgggtgccagcaacatacctggaagctcagaatggcactagagatgatagtgatattaatacctctaagacgggcgaggtatcaaagagaaggaaagctcacctgcgcaggttggacagaagatggacgctggggggaatggtgaatcggcagcattctagggaagagaagtacgtgaccgtgcagccctacacatcgcagagcaaagacgaaattgggtttgaaaagggagtcacggtcgaagttattagaaaaaatttggaagggtggtggtacatcagatatctaggaaaggaagggtgggcccctgcgtcctacctcaagaaagcaaaggacgacttacctacacgaaagaaaaacctcgctggacctgtggagattatcggcaacatcatggagattagcaatcttctgaacaagaaggccagcggcgataaagagacgcctcctgctgagggtgaaggacacgaggccccaatcgccaaaaaagaaatttccttgcctattttgtgtaatgcctcgaatggctcagccgttggcgtgcctgacagaacagtgagtcgcctggcgcagggctcgccggcagtcgccaggatcgcgccacagcgcgctcagatctctagtccgaatctccgaactcgcccacctcctagaagggaaagcagcctaggttttcagttgccgaaaccacccgaaccgccttctgtggaggtcgaatactataccatcgctgaattccagagttgcatttcagacggaatttcttttcgaggtggccaaaaggccgaggtaatcgacaagaactcggggggttggtggtatgtgcagattggcgaaaaagagggatgggccccagcgtcatacattgataagcgaaaaaagccgaatctttccagacgcacatccacactgacccggccaaaggttccccctccagccccaccaagcaaacccaaggaggctgaggagggcccaaccggagcaagtgagtcccaggacagtcctaggaagctcaaatatgaagaacccgagtatgatatacccgctttcgggttcgactctgaaccagaactgtcagaggaaccagtcgaggacagagcatcgggagagcgtcggcctgcacagcctcacagaccctcgccagccagctcactccaacgcgctcgctttaaagttggagagtctagcgaggatgtggcactcgaggaagagacaatctatgagaatgaggggtttagaccatacgctgaggacacgctctctgctagaggaagcagcggagattcagactcgcccggaagttcatcactgtcgctgacacgtaagaactcccctaagagcggctcgccaaagtcatccagtctgctcaagctaaaggctgagaaaaacgcccaggcggaaatgggcaagaatcatagcagtgcgagcttctcttcatctataactatcaataccacatgctgttctagtagctcctcttccagcagctctcttagtaagacctccggagatctgaaaccccgaagcgcaagcgacgcaggaattcgcggtaccccaaaggtgagggccaaaaaagacgcggatgccaatgccggattaacttcttgcccacgagctaaaccatcagtgcgccctaaacccttcctcaaccgagccgagagtcagtctcaggaaaaaatggacatcagtaccctccgtagacagctcaggccaactgggcagttgcgtggtggactaaagggcagcaagtcggaagatagcgagctacctcctcagacagcttcagaggccccttcggagggctcaagacgatcctcttctgacctgatcacattgcctgcaaccacgcctccttgccccacaaagaaagaatgggagggacccgctactagctacatgacttgctccgcatatcagaaagtccaggactccgagatatcttttcctgccggtgttgaagtccaggtgctggaaaaacaagagtcgggctggtggtacgtgcgtttcggagagctcgagggatgggctccttcacattacttggttctggacgagaacgaacagcccgacccatctggcaaagaactggataccgtgcccgcaaaaggacggcaaaatgaggggaagagcgactcactcgagaagatcgaaagaagggtgcaggccctgaacacggtaaaccagtccaagaaggcaacaccccctatcccttctaagccccctggcggtttcgggaaaacaagtggcacccctgctgttaagatgcgcaatggcgttcgacaggttgcagtacggccacagagtgtgtttgtcagccccccacccaaggataataatctgtcctgtgcactgcgaaggaacgaatcgctcacagccacagatggcctccggggagtgagaaggaattcttcattcagtaccgcgaggtccgccgcagctgaggccaagggccgactagcggaacgggcagcctctcagggaagtgacagtcccctcctgcccgcacagcggaattccatcccagttagcccggtgaggcccaagccaatcgaaaagtcccagttcatccataacaacttgaaagatgtctatgtatccatcgcagattacgagggagacgaggagactgccggatttcaggaaggtgtctccatggaggtgctggagaggaatcccaacggttggtggtattgccagatcttggacggcgtgaaacccttcaaggggtgggtccccagtaactatctggagaaaaagaactag

SEQ ID NO: 30823 - DNA, 414 bp, Artificial Sequence
  Description of Artificial Sequence: Synthetic coding sequence
atgaacaagctgtctggtgggggtggacggcgaaccagggtggagggtggacagctagggggagaagagtggacaaggcacgggtctttcgttaataaaccaacacgtggctggttacatcccaatgacaaggtaatggggccaggcgtgtcatatctggttagatacatggggtgcgttgaggtgctccagagtatgagggctctcgacttcaatacccggacacaggtgactcgcgaggccatttctttggtctgtgaagccgttccgggagccaaaggcgctacaagacggaggaagccttgcagccggcctctgtcctctattctgggcagatcgaaccttaagttcgccggtatgcctataacactgaccgtcagtacaagctccctgaatctgatggcggcagactag

SEQ ID NO: 30824 - DNA, 918 bp, Artificial Sequence
  Description of Artificial Sequence: Synthetic coding sequence
atggcagggtttgatggaagcgcctgggacgaagaggaggaagagccacctgatcaccagtattacaacgacttcccaggcaaggagcccccactgggaggtgtggttgacatgagacttcgggaaggagcagcccctggtgccgctaggcccaccgcccctaacgctcaaaccccctcgcacctgggggcaactctgcctgtggggcagcccgtggggggagaccccgaggtgagaaaacagatgccaccaccacccccatgtccaggccgtgaactgtttgatgatccgtcgtacgtgaatgtccagaacctagataaggccaggcaagctgtgggcggtgccggacccccaaaccctgcaatcaatggttccgccccacgcgatctgttcgacatgaagccatttgaagatgccctgcgagttccccctcctcctcagagtgtgagtatggcggaacagcttagaggggagccatggtttcacggcaagctgagtaggcgggaagccgaggccctgctgcagctgaacggagatttccttgtccgagaaagcactaccacacctgggcaatacgttctgaccggccttcagtctgggcagcctaaacatctgttgctggtggatcctgagggggtgaggtggggatttgcaatgctgcccaagctgttccttaattcacgagcacaggtgatccgcctccctaggccgccaagagtgctaggactgcaggccaggacaaccatgccctccttacatatatttttttgtaccgtctacacactgctgcgccatgccaacttcttacaggtaaagaagggcgtgtattctagtcagcttcactccttcagggctgacgttgcttttgcgttttctcatttcacagacttatccattcccaccacagttagtttttag

SEQ ID NO: 30825 - DNA, 1563 bp, Artificial Sequence
  Description of Artificial Sequence: Synthetic coding sequence
atgagcaaccttcgcttagccaatcccgcaggaggccgtccagggtcaaagggagaacccggtagggccgcagatgatggcgaaggcatcgtaggcgctgccatgccagatagtggacctctgcctttgctccaggacatgaataaacttagcggcggagggggaagaaggacccgggtggagggcggacaactcggaggcgaggagtggactcggcacggctcatttgtgaacaaaccaaccaggggctggctccacccaaatgataaagttatgggccctggggtctcctatctcgtgcggtacatggggtgcgtcgaggtcttgcagtccatgagagctctggactttaacacccgaacccaggtgactcgcgaggcaatttcactagtgtgcgaggctgttccaggcgcaaaaggtgccaccagacgaagaaaaccctgcagccggccactgagctctatactgggaaggagcaatcttaaatttgcaggcatgccaattaccctgaccgtaagtacaagttctctgaatctgatggctgccgattgcaaacaaattatcgccaaccaccatatgcaatccatttcatttgcatcaggtggggatccagatactgctgagtacgtcgcatacgtggccaaggacccggtgaatcagagagcctgtcacatcctggaatgccccgaaggacttgcccaggatgtgattagcacaatcggccaggcttttgagctgagattcaagcagtacctccggaacccacctaagctggtgaccccccatgatcgcatggccggattcgacggaagtgcctgggacgaagaggaggaggaaccaccagaccatcaatattacaacgactttcccggtaaggagcccccactgggcggtgtggtggacatgagactgagggaaggagcagcacctggcgctgccaggcccactgcccctaacgcacagacaccatcacatctcggggcaacgctaccagtgggccagcccgtgggtggcgaccccgaggtcaggaaacagatgcccccacctccaccttgccccgctggtagggagttgttcgacgacccctcctatgtaaatgtgcagaatcttgacaaggctaggcaagcggttgggggagcaggtcctcccaacccggcaatcaatggttcagccccaagggatttgtttgacatgaagccttttgaagacgcattgcgggtcccacccccaccacagtcagtgtctatggcagaacagctcagaggtgagccttggttccacggcaagctatctaggcgtgaagcagaagcgcttttacagttgaacggcgatttcttggtccgtgaatctaccactacccctggccaatacgttctgacaggccttcagtctggccagcccaaacacttactcctggtggatccagagggcgtggtgcggaccaaggatcaccggtttgaatcagtctcacacttgatcagttaccacatggacaaccacctgccaattatcagcgctggatctgaactctgtctgcagcagcccgtggaaaggaaactctag

SEQ ID NO: 30826 - DNA, 1752 bp, Artificial Sequence
  Description of Artificial Sequence: Synthetic coding sequence
atggatttgttaccaccaaagcccaaatacaaccctctcaggaacgagtctctttcatccctcgaggagggggcttccggaagcacgccccctgaagagctacccagtccaagtgccagcagcctgggaccaatattgccacccttaccaggagacgacagcccgaccactctctgctctttcttccctcgcatgagcaatctgagacttgcgaatcccgctgggggtaggcctgggtccaaaggcgagcctggccgagcagcagatgatggagaggggattgtgggggcagctatgccagactctgggccactgccactgctccaggatatgaacaaattaagcggcggtggagggaggcgaacgagagttgagggtgggcagttgggcggagaggagtggaccaggcacggttcctttgtgaataagcccactcgagggtggctgcacccaaatgacaaagtgatgggacccggtgtctcatacctcgtcagatacatggggtgcgtggaggttctgcaatctatgagagcactggactttaatacaaggacccaggtgactagagaggctattagcctggtgtgtgaagccgtgccaggtgccaaaggcgcaacacgacggagaaagccttgttcccgccctctgtcctccattctgggaagatcaaacctgaagttcgcaggtatgcccattacgctcaccgtttccacatcatcgctgaatctcatggcagccgattgcaagcagatcatcgcgaaccatcatatgcagtccatctctttcgcctccgggggagatcctgatactgctgaatacgttgcatatgttgccaaggaccccgtaaatcagagagcatgccatatactcgagtgtccggagggtttagcccaggatgtcatctcaactataggacaagcgtttgagttacggtttaaacagtatctacgcaatcccccaaaactggtgactccgcacgatagaatggcaggcttcgacggtagtgcttgggacgaggaggaagaggagcccccagaccaccagtactataatgatttcccgggtaaggagcctcctctgggaggggtggtggacatgcgcctgcgagaaggagcagcacccggagcggctcggcctacagccccaaatgcacagactccttctcatttgggagcaaccctgcccgtggggcaacccgttggtggggacccagaggtcaggaagcagatgccacccccacccccttgtcccggaagggagttatttgacgatccctcatacgttaatgttcaaaatctcgacaaggctcggcaagccgtagggggagccggtccaccaaatcccgcaattaacgggtccgcccctcgcgatctcttcgatatgaaaccatttgaggacgctttacgtgtgccgccaccaccccaatccgtctcaatggccgagcagctgcgaggcgaaccttggttccacgggaaactcagccgacgcgaagccgaggccctcttgcagctgaatggcgattttcttgtaagagagtccacaactacaccgggacagtacgtccttacggggttgcagtcagggcagccgaaacacctgctgctagtagaccctgaaggcgtggtaagaaccaaggaccaccgttttgagagcgtgagccatctaatcagctatcacatggataaccatttgcccattataagcgcaggatcagagctctgtctgcagcagccagtagagcgaaagctttag

SEQ ID NO: 30827 - DNA, 1155 bp, Artificial Sequence
  Description of Artificial Sequence: Synthetic coding sequence
atggacctcctgccaccgaagcctaagtataatccactgcgaaatgaaagcctgtctattctggggaggagcaacctgaaattcgccggaatgccaattacgctcacggtctcaactagttcgctgaacttgatggcggcagattgcaagcagattatcgctaaccaccacatgcagtccatttcctttgccagcggcggtgacccagataccgccgaatacgtggcttacgttgctaaggaccccgtaaatcagagagcctgtcacatccttgaatgcccagaggggctggcccaggacgtgataagcaccattggccaggcctttgaactgaggttcaagcagtacctaagaaaccctcccaagctagtcaccccccacgaccgcatggctggatttgatgggtcggcctgggacgaggaagaagaggagcctcctgaccaccagtactataacgacttccctggaaaggaaccccctctgggaggcgtggttgacatgcgactccgcgagggggcagcgcctggcgcagctcggcctaccgccccaaatgctcagacgcccagtcacctgggagccacccttccggttgggcagcccgtggggggagaccccgaggtcagaaagcagatgcccccaccaccaccttgtccaggtcgggaactctttgatgatccttcttatgtcaatgtgcaaaacctggataaagccagacaggccgtcggtggcgctgggcctcccaatccagccatcaacggttccgcccctagagatctgtttgatatgaaaccattcgaggacgcacttcgggtccccccaccgcctcagagcgtcagcatggccgaacaactgcgaggcgagccatggttccacgggaagctctcacggagggaggccgaagccctgctgcagttgaacggagacttcttggtgagagaatcaaccacaacacctggacaatatgtcctgactgggcttcagagtggccagccgaagcaccttctgctcgtagacccggagggtgttgtccgcactaaggatcatagatttgaatccgtgtcccacttgatcagctaccacatggacaatcacttacccataatctccgctggctccgagctgtgtctgcagcagcccgtggaacggaaactgtag

SEQ ID NO: 30828 - DNA, 1422 bp, Artificial Sequence
  Description of Artificial Sequence: Synthetic coding sequence
atgaacaaactcagcggtgggggaggcaggcggacgcgggttgaaggtggacagctgggcggagaggagtggacccgccatggttcttttgtcaacaagcctactcgcggttggcttcatccaaatgataaggtaatgggacctggggtgagttatctggtgcgctatatgggctgtgtggaagtccttcagtctatgagggctcttgatttcaatacacgcacacaggtgactagagaagctataagcctagtttgtgaggctgtgccaggcgcaaagggggctactagacggagaaagccatgttcacgccctctatcaagtatcctaggcagatccaatttgaaattcgccggaatgcccattaccctgacagtgtctacttcgagccttaatcttatggcagccgactgcaagcagatcattgctaatcatcatatgcaatcaatctcctttgccagtggcggagaccccgatacggcggagtacgtggcatacgttgcaaaagatccagtgaaccaacgcgcatgtcatatcctggagtgtcctgaagggctcgcccaggatgtcattagcaccatcggccaggcctttgagttgaggtttaagcagtacctgcgcaaccccccaaaattagtgactccacacgatcgcatggctggatttgatggatccgcttgggatgaggaagaggaggaaccacccgatcatcagtattacaacgactttccaggcaaagagcccccactgggcggtgtggtggatatgcgcttaagggagggcgctgctcctggggcagcccgtcctactgccccaaatgcccagaccccgtcacacctcggcgctactctccctgtcgggcaacctgtgggaggagacccggaggttcgtaagcagatgcctcctccaccaccctgccctggcagggagctatttgatgatccatcctatgtgaatgtgcagaatttggacaaagctcggcaagcggtcggtggggcagggcctcctaatccggctattaacgggagcgccccaagggacctattcgacatgaagccgtttgaggacgcactaagagtgccaccacctccgcagagcgtgtccatggctgaacagctcaggggggaaccttggttccacggcaagctgagccgcagagaggcagaggcgctgctgcagctaaacggagattttcttgtgagggagtctacaaccacccctggccagtacgtgctgactgggctccagtcaggccagccaaagcacctcttgctcgtggacccagaaggggttgtcaggacaaaagaccacaggtttgaatctgtgtcgcacctcatcagttaccacatggacaaccaccttcctattatttccgcaggctctgaattgtgcttgcagcagcccgtggagaggaaactgtag

SEQ ID NO: 30829 - DNA, 1425 bp, Artificial Sequence
  Description of Artificial Sequence: Synthetic coding sequence
atgaataagttatctggcggaggtgggagacgaaccagagtggaaggcggacagcttggaggggaggagtggacccgccacggtagctttgttaataagcctactaggggctggttgcatccaaatgacaaggtgatggggcctggcgtatcgtacctagtgcgatacatgggatgtgtggaggtgttacagagtatgcgcgctctcgacttcaacacccgcactcaggtgacgagagaagctatttccctcgtatgcgaagccgtcccaggagctaaaggcgctaccaggcgacgtaagccttgtagtcgacccctcagttccattctcgggcgatcaaacctcaagtttgcaggcatgcccataacactcacggtgtccacatcttcattaaacttgatggcggctgactgtaagcaaatcattgccaaccatcatatgcagtcaatttcttttgcttcaggcggagaccccgacaccgcagaatacgtagcctacgtggccaaagatcctgtgaaccagcgcgcttgccacatcttggaatgtccggagggcctggctcaggacgtcatctccacgattggccaggcttttgagctccgtttcaagcaatacttgcgaaatccgccaaaactggtcactccccatgaccgaatggccggtttcgacgggtcggcatgggatgaggaggaagaagagccaccagaccatcaatattataacgacttccctgggaaggagccacccctgggcggagtagtggacatgaggttaagagagggggcagcacctggcgctgccagaccaaccgcacctaacgcgcagacaccatcacacctaggtgcaactctgcccgttgggcagcctgtggggggagaccctgaagtgagaaaacagatgcccccaccacctccctgtccagcagggagagaacttttcgatgaccccagctacgttaatgtacaaaacctcgacaaagcgagacaagctgttggcggagcgggtcctccaaacccagcaatcaacggctcagcgccacgagacctgtttgatatgaagccatttgaggacgcacttcgagttccaccaccccctcaaagcgtatcaatggccgaacagcttcgtggagagccatggttccacggaaagcttagcagacgtgaagcagaggccctcctacaattgaatggtgatttcttggtcagagagtctacaacaactccaggtcagtacgtccttacaggcttgcaatccggtcagccaaaacaccttctcttagtagacccagagggagtggtgaggactaaggaccatcgcttcgagtccgttagtcatttaatttcctatcacatggacaaccatttacccatcataagtgccggatccgagctgtgcctgcagcagccagttgagagaaagctctag

SEQ ID NO: 30830 - DNA, 603 bp, Artificial Sequence
  Description of Artificial Sequence: Synthetic coding sequence
atgaacaagctctctggtggcggtggacgaaggactcgggtcgaggggggacagctgggaggagaggagtggacaagacatggatcctttgtgaacaagcccactaggggctggctgcaccccaacgacaaagtcatgggccctggcgtgtcttatctggtcagatacatgggctgcgtggaggttcttcagtctatgcgtgctctggattttaacacaaggactcaggtgacccgtgaagcgatctctttggtgtgcgaggccgtgcccggagctaagggagcaacacgccgtcgtaagccttgctccaggccactgtccagtatattgggcagaagcaaccttaagtttgccggaatgccaatcaccctgaccgtgtctaccagtagcctaaacctcatggccgctgactgcaaacaggacactgcagaatacgtggcctatgtagctaaagatccagtgaaccagcgcgcttgccacattctagagtgtcctgaagggctggcccaagacgtaatcagcaccataggacaagctttcgagttgcgatttaagcagtacctcaggaacccaccaaagctggtaacccctcacgaccgctag

SEQ ID NO: 30831 - DNA, 603 bp, Artificial Sequence
  Description of Artificial Sequence: Synthetic coding sequence
atgccaataacactgacagtatccacttcaagccttaatctgatggctgcggattgcaaacaagacaccgccgagtatgtggcctatgtggccaaggaccctgtaaaccaacgtgcttgccacatcctggaatgcccagagggccttgctcaggacgtgatttccaccataggccaggcatttgagctgaggtttaagcagtatctgcggaacccgcctaaacttgttacacctcatgatcggatggcaggctttgacggctccgcttgggatgaagaagaggaggagccccctgatcatcagtattataacgactttcccggaaaggagccccctttagggggagtcgtcgatatgcggctccgagagggcgcagctccaggggcagcacgacccacagcccctaacgcacagacaccctctcacctgggggctaccctgcctgtgggacaaccagtgggtggagatcccgaggtgcgtaagcagatgccaccccctcctccgtgtccagctggcagggagctttttgacgaccccagttatgtcaatgttcagaacctggacaaagccaggcaggcagttggcggtgcaggcccaccttag

SEQ ID NO: 30832 - DNA, 393 bp, Artificial Sequence
  Description of Artificial Sequence: Synthetic coding sequence
atgccgattaccttgaccgtgagtacatccagtttgaacctgatggccgcagactgtaaacagatcattgccaatcatcacatgcagtccattagcttcgcttcagggggtgatccagacacggcagaatatgtggcatacgtggccaaagatccggtgaaccagagggcatgccatattctagaatgtcccgaaggcctggcccaggatgttataagcacaatagggcaggccttcgagttgaggttcaaacagtacctacggaatccaccaaagttagtcaccccacatgatcggatggcgggatttgacggtagtgcttgggatgaggaggaagaggagccaccggatcaccaatattataatgactttcctgggaaggagcctccgtag

SEQ ID NO: 30833 - DNA, 894 bp, Artificial Sequence
  Description of Artificial Sequence: Synthetic coding sequence
taggatgaggaggaagaagagcctcccgatcatcagtactataacgattttcccggaaaggagccccctctggggggagtggtcgacatgcggctgagagagggtgctgcaccgggagcggctagacccactgcgccaaacgcccagacacctagtcatttgggggcaacactgcccgtagggcagccagtgggtggggatcccgaggtacgcaagcagatgcctccccctccaccatgtcctggaagggagttgtttgacgaccctagttacgttaacgtgcagaatctagataaggcccgtcaagcagtcggtggagctggtccacccaaccccgctattaatggctctgcacctcgagatctcttcgatatgaagccattcgaggacgctctgcgggttccacccccaccccagagtgtgtccatggctgaacagttaaggggtgaaccttggtttcacggaaagctttctagaagagaggctgaagcactcctgcagctgaatggcgactttttagttagggaatcaaccacaactcctggacagtacgtgttaactggccttcagagtgggcagccaaagcatctactgcttgtggacccggagggtgtgagatgggggtttgcgatgttaccaaaactcttcttaaactcccgggctcaggtgatccggctgccgagaccacccagagtactagggctgcaggccagaacgacaatgccgagcctgcacatcttcttctgtaccgtgtacactttgctgcggcacgccaattttttacaggttaaaaaaggggtttactctagccagctccacagcttccgtgccgatgttgcattcgccttttcccacttcactgatctgtccattcccacgacagtttccttctag

SEQ ID NO: 30834 - DNA, 1755 bp, Artificial Sequence
  Description of Artificial Sequence: Synthetic coding sequence
atggatctgctgcccccaaagcctaaatacaacccactaagaaacgaaagtctgtcttctctggaggagggcgcttcaggcagcactccccctgaggagttgccctcccccagtgcttctagcctggggcctattctgcctcccctgcctggcgacgactcgcctacaaccctgtgtagttttttccctcgaatgtccaacttgagactagcaaatcccgctggagggaggccgggttcaaagggggagccaggtagagccgctgatgacggggaggggattgttggagcagctatgccagattccggccctctcccactactccaggacatgaataagttatccggaggtggtgggagaagaacacgcgtggaaggcggtcagctcggaggtgaagagtggactagacacggctcatttgtgaacaagccaaccagagggtggctgcatcctaacgacaaagtgatgggtcccggagtgtcctacctcgttaggtatatgggttgtgtggaggtgctgcagtcgatgagggctctcgacttcaacacacgcacccaagtgacaagagaggcaatttcactagtatgcgaagccgtgccgggagctaagggagccacaaggcgcagaaagccatgttcgcgtcccctctcttcgatcctcggccgatcaaatctgaagttcgcaggcatgcctatcacactgacagtgtcaacatcatccctgaacctgatggcggcagactgcaagcaaatcatagcgaatcaccacatgcagtcaatatcctttgcctctggaggggatccagacaccgcagagtatgtcgcatatgtcgccaaggaccccgttaaccagcgcgcttgtcacatacttgagtgtcccgaagggctcgcccaggacgtgatcagcacaatcggccaagcctttgagttgaggtttaaacagtacctccgcaatcctcctaagctggtaaccccgcacgacaggatggcgggttttgatggtagtgcttgggacgaggaagaggaagaaccacccgaccatcagtattacaatgattttccagggaaagaacccccacttggtggcgtcgtcgacatgaggctccgtgagggggcagccccaggggctgctaggcccactgctcctaacgcccagacaccttcacacctgggcgcaacactccccgtgggccaacccgtgggaggggatcctgaggtgcgaaagcaaatgcctcccccacccccttgtcccgctgggagggaattgtttgacgacccaagttacgtcaacgtgcaaaatctggataaggcccgacaagctgtcggaggagcgggtccacctaacccagcaatcaatggctccgctcccagagacttattcgatatgaaacctttcgaggacgcactgagagtgccacctcccccacaatcagtcagcatggccgagcagctgcgcggagaaccatggttccacggaaagctctcacgacgagaggcagaagcccttctacaacttaatggagattttcttgtgagagagtctaccacaaccccagggcagtatgtgctcaccggcctccagagcggccagccaaaacatctgctgctggttgacccggagggggtcgtcaggacaaaggaccaccggtttgagtccgtgagccatctcatttcatatcacatggataaccacctgcccattatcagcgccggttcggaactgtgccttcagcagcctgtagaacgaaagctgtag

SEQ ID NO: 30835 - DNA, 1749 bp, Artificial Sequence
  Description of Artificial Sequence: Synthetic coding sequence
atgactcagggaccgggaggccgagctccgcctgcccctcccgctccgccagagcccgaagcccctaccaccttttgtgcccttcttcctagaatgccccagtggaaattcgcagcaccaggaggatttctggggagaggtcctgcagctgcacgggctgcaggtgcttcaggaggggctgacccccagcccgagccagctggtccagggggagtgcccgctctagccgcagcagtattaggggcatgcgagcccaggtgtgctgcaccctgccctctccctgctctgtctcgttgtaggggcgctggatcccggggaagcagaggagggaggggcgcagcaggaagcggcgacgctgccgctgcagcagagtggatcagaaaggggtctttcatccacaagccagcgcacggatggttacaccctgacgccagggttctgggccctggggtcagttacgttgtgcggtacatgggatgtatcgaagttttgcggtcaatgagatctctggactttaatactcgcacacaagtgacgagggaggcaattaatcggctacatgaggcagtgccaggagttcgaggcagttggaagaagaaagcccctaataaagctctggcctctgttctgggcaagtccaacttaagattcgctggtatgtccatcagcattcacattagcacagatgggctatccctcagcgttcctgctacgcggcaggtgatcgccaatcaccatatgccttcaattagctttgccagcggtggcgacactgatatgacagactacgtagcgtacgtcgccaaagaccccatcaaccagcgtgcttgccacatcttagagtgttgtgagggcctagcgcagagcatcatcagcacagttggccaggccttcgagctgagattcaagcagtaccttcatagcccgccaaaagtggccctgccacctgaacggctcgccggacccgaggaatcggcctggggggacgaagaagatagcctggagcataattactacaactcaatccctgggaaggaaccaccactgggaggcctggtggattcccgactagccttgacgcagccttgcgcccttactgcactggatcagggtccctctccctcattacgggacgcctgttctctgccatgggacgtcggtagcacggggacagctccgccaggggacggatatgtgcaggctgatgccaggggtcccccagaccacgaggagcatctttatgtgaacacccagggcttggacgcgccagagcccgaagacagccccaaaaaggacctattcgacatgcggcctttcgaagatgctctgaagctgcacgagtgttctgtggcagccggagtcacagctgctccactgcccttggaggaccagtggccctcaccacccacccggagggctccagtggccccaacagaggagcagcttcggcaagaaccctggtatcacggcaggatgtctagaagagctgctgagagaatgctccgggctgacggtgactttctcgttagagactcagtcacgaatcccggtcaatacgttctcaccggaatgcatgccggtcagccaaaacatttactcctggtggacccagaaggtgttgtccggaccaaagatgtcttattcgagagcatctctcatctcattgatcatcatctccagaatggccagccgattgtagccgctgaatcagaactgcacctaagaggagtggtttctagggagccatag

SEQ ID NO: 30836 - DNA, 1833 bp, Artificial Sequence
  Description of Artificial Sequence: Synthetic coding sequence
atgcttgacttcttcactatattcagtaagggcggactggtgctctggtgcttccagggtgtctctgatagctgtaccggccctgtaaacgccctcataaggagcgtgttgttgcaggttggtttccaaaaaattctgaccttgacatatgttgataagctaatcgacgacgttcatcggctgtttcgggataaatatcgaacggaaatacagcagcagtccgcactaagcctcctgaatggtaccttcgactttcagaacgacttcctgagactgctgagggaagcggaagaatcctctaagatcagggcaccaactactatgaaaaagtttgaggatagtgagaaggcaaaaaagccggtgcgctctatgattgaaacaaggggggagaaacctaaagaaaaagcaaagaacagcaaaaagaagggagctaagaaagaagggagcgatgggcctcttgccacttcgaagcctgtgcctgccgagaagtccgggttgcctgtaggcccagaaaatggggtggaactgtctaaggaggaactgattaggagaaagagagaggaattcattcagaagcacgggcgaggcatggagaaatccaacaagagcaccaaatccgacgcacccaaagagaaaggcaagaaagccccaagggtgtgggagctgggtggttgtgccaacaaggaagtgctggactactcaaccccaaccaccaacgggactccggaggctgctctgtccgaggacattaacctgattagggggacgggctctggagggcagctgcaagatcttgactgttcctcttcggacgacgaaggggcagcacagaattccactaagccatcggctacaaagggcactctggggggtatgttcggaatgctgaaaggcctcgttggaagcaagagcctgagccgggaggacatggaatcggtgctcgacaaaatgcgggatcatctaattgctaagaatgtcgcggctgacattgcagtgcagctgtgcgagtccgtggccaataagctggagggcaaggttatgggcacttttagcacagtgacttccaccgtcaaacaagccctgcaggagagtctggtgcaaatactgcaacctcaacggagggttgacatgctccgagacattatggacgcccagcggagacagagaccttacgttgttacattttgcggcgtgaacggcgtgggaaaaagtactaatctggctaaaatctctttctggctgctggagaatggattctccgtgctgatcgctgcgtgtgatacattcagggccggagccgtagaacagctgaggacccacaccagaagactcagcgccttacatccgccagagaaacatggcggaagaactatggtccagttattcgagaagggatatggaaaagacgcagctggcatcgccatggaagctattgcctttgcgaggaaccaggggttcgacgtggtactggtggacactgcagggaggatgcaggataacgcgcctttgatgacggctctggccaaacttatcaccgttaacaccccagatctggtcttattcgtcggagaggctctggtcggaaatgaagccgtggaccagctcgtgaaattcaacagagccctagccgatcacagtatggcacagacaccaagattgatagatggaattgttctgactaagtttgacacgatcgatgataaagtaggtgccgctatcagtatgacatatatcacatcaaaacccatcgtctttgtggggaccggacagacatactgtgacttacggtctttgaatgcaaaggccgttgtagcagctttgatgaaggcctag

SEQ ID NO: 30837 - DNA, 2253 bp, Artificial Sequence
  Description of Artificial Sequence: Synthetic coding sequence
atgagtcagtggtacgagctgcagcagctcgacagtaagtttctggagcaggtgcaccagttgtatgacgattcatttccaatggaaattagacagtacctagcccagtggctggaaaaacaggactgggagcacgccgctaacgacgtgagtttcgctaccatacgcttccacgacctcctatcacagctcgatgaccaatactcgaggttttcattggaaaacaacttcctactccagcacaatatccgcaagagcaagagaaacctgcaagataacttccaagaagatcctattcagatgtcaatgataatctacagttgtctgaaggaagagaggaagatccttgagaacgctcagagatttaaccaggcccaaagtgggaacattcagtcaaccgtcatgcttgataaacaaaaggagctcgatagtaaggtccgaaatgtgaaagataaggttatgtgcattgaacatgaaattaaatcattagaagatttgcaggacgagtacgactttaaatgtaagactctgcagaaccgggaacacgaaacaaacggcgttgccaagtctgatcagaagcaagagcaactgctgctgaaaaagatgtatttgatgctggataataagcgcaaagaagtcgttcataagataatcgaactcctgaacgtgaccgaactgacccagaacgccctaattaatgacgagctcgtggaatggaaacgacgccagcagtctgcttgcatcggcggacccccaaacgcttgcttggatcagctgcagaattggtttacaattgtcgctgagtctcttcagcaggtccgccagcaactgaagaaactggaggaactggagcaaaaatatacatatgaacacgatcctatcacgaaaaacaagcaggtgctgtgggaccgcaccttctctttgttccagcagctaatacagtcttccttcgtagtcgaacgacagccgtgtatgccgacacaccctcaacgacctctggtactaaaaacaggcgtgcagttcactgtgaagctccggcttctcgtgaagttgcaggagttaaattacaacctgaaggttaaagtactgttcgataaggacgtcaatgaacgcaacaccgtgaagggctttcgcaagtttaacatattgggcacccacactaaggtgatgaacatggaggagtcaactaacgggtcattagccgctgagtttcggcacctgcagctgaaggagcagaagaacgcaggcacaaggactaatgaaggccctctaatcgttactgaggagcttcactctctcagctttgagacccaactctgccagccaggattggtcatcgatttagagaccacttcactgcctgtcgtggtcatttctaatgtcagccagctgccctccggctgggcttccattttatggtacaacatgctggtggcagaaccgaggaatctgagctttttcttgacccctccttgtgctcgatgggcccagctgtctgaggttctcagctggcagttctcttcggtgaccaagaggggcttaaatgtggatcagctgaatatgctcggagaaaaactgctggggccaaacgcctccccagacggcctgattccttggactcggttttgcaaggaaaatataaatgacaaaaattttcccttctggttgtggatcgagtccattttggaattgatcaaaaagcacctactgcctttgtggaatgatgggtgtattatgggttttatctcaaaagaaagggaaagagccctgctgaaggaccagcaacctgggacctttctgctgagatttagcgaatcaagtagagagggcgctatcacattcacctgggtcgaaaggagtcaaaacgggggtgagcctgattttcacgccgtagagccctatacgaagaaggaactttccgctgtcacatttcccgatatcattcgtaattataaagtgatggcagcagaaaatattcctgaaaatcctctgaagtatctttatcccaacatcgacaaggatcatgcatttggtaagtattactcacggccaaaggaagcacctgagccaatggaacttgatggccctaaaggcacagggtatatcaaaaccgaactgatctccgtctcagaagtccatccaagccggctgcagacaacggataatctattacccatgagtccagaagagtttgatgaggtgtcaagaattgtaggctcagtcgagtttgatagcatgatgaatactgtttag

SEQ ID NO: 30838 - DNA, 2139 bp, Artificial Sequence
  Description of Artificial Sequence: Synthetic coding sequence
atgtcgcagtggtacgaactacagcagcttgattccaagtttctggagcaggtgcatcagctctacgacgacagttttcctatggaaattcgtcaatacctcgcccagtggctggaaaagcaagactgggagcatgccgcaaacgacgtgagtttcgccaccattaggttccacgacctcttatcacaacttgacgaccaatactcacgctttagcttggagaacaattttctgctgcagcataacattcggaagagtaaacgcaaccttcaagacaatttccaggaagatccaatccaaatgagcatgatcatttattcgtgccttaaggaagaacgaaaaatacttgagaacgcccaacgatttaaccaggcccagagcggtaacatacaatccacagtcatgctcgataaacagaaggagctggattctaaggtcaggaacgtcaaagataaggttatgtgcatagagcatgagataaaaagtcttgaggaccttcaggatgagtatgactttaaatgcaagacccttcagaatcgcgagcacgaaaccaatggtgtcgccaaaagtgaccagaagcaagaacaactgctactaaagaaaatgtacttgatgctggacaataagcggaaagaagtcgtacacaagatcatagaactgctcaacgtcactgagcttacccaaaatgccctgattaatgacgagctggtcgagtggaagcgcagacagcaatccgcctgtattggtgggccacctaatgcctgcctggaccagcttcaaaactggttcacaatcgtggcggagagcttgcagcaggttagacaacaattgaagaagctcgaagaactggagcagaaatatacctacgagcacgatccgatcaccaaaaataaacaggtgttgtgggatcgtaccttttcgctgttccagcagcttatccagtcttcattcgtagtggagcgacaaccatgtatgcccacacacccccagagaccccttgtgctgaagaccggtgtgcagttcaccgtgaaactacgtctgctggtcaaacttcaggagttgaactataatctgaaggttaaagtgctatttgacaaggacgtaaacgaacgcaatacagtcaagggattcaggaagttcaacatccttggtacacacaccaaggttatgaacatggaggagagtactaatggatccctggctgcagagtttagacatctgcaactcaaggagcagaagaacgcaggaacccgtacgaacgaaggacccctgatcgtcactgaggaacttcactccttatccttcgaaacccaactgtgtcagcctggactcgtaatcgatctcgagactacttctctcccagtggtggtgatcagcaacgtgagccagttgccctctggatgggcctcgattctgtggtacaatatgctcgtggctgagcctcgtaatctgtcattctttttgaccccaccttgtgctagatgggctcaactttctgaggtgctgagctggcagtttagctctgtgacgaaacgtggtctgaatgtagaccaactgaatatgttgggagaaaaactgctcgggcctaatgcttcccccgacggactcatcccttggacacgcttctgtaaggagaacataaacgacaaaaattttcctttctggctctggattgagagcatcctggagctgataaaaaaacacttactgccgttgtggaacgacggatgcattatggggttcatcagcaaggagcgagagagagctttgttgaaagatcaacaacctggtacctttctccttcgtttcagtgagtcttctagagagggcgcaataacgttcacctgggtggaacgatcacagaacggtggcgaacctgatttccatgcagtcgagccctataccaagaaggagctgagtgctgtgacatttcccgatattatacggaattacaaggtgatggccgcagagaacattccagaaaacccattaaagtatttatatccaaatatcgataaggaccatgcatttgggaagtactatagccgacccaaggaagccccagagcccatggaactggacggccctaaaggaacaggctatatcaaaaccgagctgatctcagtaagtgaagtgtag

SEQ ID NO: 30839 - DNA, 2145 bp, Artificial Sequence
  Description of Artificial Sequence: Synthetic coding sequence
atgtggatgtcccagtggtacgagttgcagcagttggatagcaaatttttagaacaagtgcaccagttgtacgacgacagctttccgatggagatccggcagtacctggcacagtggctggagaagcaagactgggaacatgccgctaatgacgttagtttcgccacaatccgtttccacgaccttttatcccagctggatgaccaatattccaggttttcgttggaaaataacttcctgctgcaacataatattcgcaaatcaaagagaaacctgcaggacaacttccaggaagaccctatacaaatgagtatgattatttactcctgccttaaggaggagagaaagattctcgagaatgctcagcgcttcaaccaggcacagtccggcaacatccagtccaccgttatgctagataaacaaaaagagctcgattcgaaagtgcggaacgtgaaggacaaggtaatgtgtatcgaacacgagattaaaagcctggaggacctccaagacgagtatgactttaagtgtaagaccttgcagaatcgcgaacatgaaacaaacggcgtggcaaagagcgatcagaaacaggagcagctccttctgaagaagatgtacctgatgctcgataataagcggaaggaagttgtccacaagatcattgagctgttgaacgtaaccgagctcactcagaatgccctgattaacgacgaactggtggaatggaagcgccgtcaacaaagtgcatgtatcggcggaccacctaacgcatgcctcgatcagcttcagaactggttcaccattgtcgctgaatccctacaacaggtgcgccagcagctgaagaagttggaggagctcgaacagaagtacacgtacgaacatgacccaattacgaaaaacaaacaggtgctttgggataggactttctccctgttccaacagttaatacaatcatccttcgtggtcgagagacagccctgcatgcccacccatccgcagcgcccactcgtgcttaagactggcgtccaatttacagtcaaacttcgcctgcttgtcaagctgcaggagcttaactataacttgaaggtgaaggtgctatttgacaaggacgtcaacgagcgcaatacagtgaaaggttttcggaaattcaacatcctcggcacacacactaaggtcatgaatatggaggaatcaacaaatggatctctcgctgcagagtttagacatttacagctgaaagaacagaagaacgccggaacccgcaccaacgaggggcctctaatagtcacagaagagctgcattctctgtccttcgagacacaactgtgtcagcccggactggtgattgacctagagaccactagtctgccagtcgtggtgatttcaaacgtgtctcagctgccttccggctgggctagtattctctggtacaatatgctagtcgctgaacccaggaacctgtctttcttcctgactcctccgtgtgctcgctgggcacagctttccgaggtgctctcatggcagttctcttccgtcactaagcggggactgaatgtggatcagctgaacatgctaggggaaaaactactgggccctaatgcgtctcctgacggactgatcccatggacccgcttctgcaaggagaatatcaatgacaaaaattttcccttttggctctggattgagtcaattctcgaactcattaaaaagcatcttctgcctctttggaacgacggatgtatcatgggattcatttctaaggagcgggagcgtgcgctactgaaggatcagcagcccggtaccttcttgctgagattctctgagtcctctcgcgagggcgctatcacttttacatgggtggagagatcccaaaacggcggtgaaccggatttccatgccgtggagccatatacaaaaaaggaactttcggcggtcacattccccgatatcatcagaaattataaggtcatggccgctgagaacataccagagaatcctttgaaatacttgtaccccaacatcgataaggaccacgcgtttgggaaatattatagtcggcctaaggaagcgcctgaacccatggagctggatgggcctaagggaacggggtacatcaaaactgagctgatttccgtatccgaggtgtag

SEQ ID NO: 30840 - DNA, 2253 bp, Artificial Sequence
  Description of Artificial Sequence: Synthetic coding sequence
atgtcgcagtggtacgagttgcaacagctggattctaagttcctggagcaagtgcaccaattatacgacgactctttccccatggagatccggcagtatctcgcacagtggttggaaaaacaagattgggagcacgccgctaacgatgtcagcttcgcaacaattagatttcacgacctgctgagccagcttgacgaccagtattccaggttctccctcgaaaacaacttcctgctgcagcacaacattcggaagtccaagcgcaacctccaggataacttccaggaagaccccatccagatgtccatgattatctactcgtgtttgaaggaagaacgcaagatacttgaaaatgcacagcgctttaaccaagcacagagtggaaacatacagagtacagtgatgctggacaagcagaaggagcttgatagcaaagttaggaacgtgaaggataaagtcatgtgcatagagcatgagataaagtcactcgaggacctgcaggacgaatacgacttcaaatgcaagacgctgcagaaccgcgagcatgaaactaacggggtggctaagtctgaccagaaacaggaacagctcctgttgaagaagatgtacctgatgctcgacaacaaacggaaggaggttgtgcacaaaataattgaactgctgaacgttactgaactgactcaaaatgcgctgataaatgacgagcttgttgaatggaagcgccgacagcagtcagcatgtatcgggggaccacctaatgcctgtctggaccagttacagaactggttcaccattgtggccgaaagcctccaacaagtccgccaacagctgaagaaactcgaggaacttgaacagaagtatacatatgaacatgaccctatcacaaagaataaacaggtcttgtgggatcgtaccttctccctctttcagcagctcattcagtcaagcttcgttgtcgaaaggcagccctgcatgcctacccatccccagagacctctggtcctgaagacgggcgtgcagtttacagtgaagctgcgccttcttgtcaaattgcaggagctgaactacaatttgaaagtcaaggtgctgtttgataaagatgtgaacgagagaaacactgtgaaaggcttccggaaatttaatatcttaggtacacatacaaaggtcatgaatatggaggagagcacaaacgggtcgctcgcggcagagtttcggcaccttcagcttaaggagcaaaaaaacgcaggtactcgcactaatgagggaccacttattgttacagaggagctgcactccctcagctttgaaacgcagctctgtcaaccgggtctcgtgatcgacttggagactacgagcctgcccgtggttgtcattagcaacgtatcgcagctccccagcggctgggcaagcattctatggtacaacatgctcgtggcagaaccaagaaatcttagctttttccttactcctccatgcgcaaggtgggcacagctgagtgaggtgctgagttggcagtttagctccgtgactaaaagagggctcaacgtagaccagcttaacatgctgggggagaaactgctgggacccaacgcttcacctgacggcctcatcccatggaccaggttttgtaaggaaaatatcaatgataaaaattttcctttctggctgtggattgagtctattcttgagcttatcaagaagcatttgcttccactctggaatgatgggtgcataatgggctttataagcaaggaacgggagagagccttgcttaaggatcagcagcccggaactttcctgttgaggttttccgagtccagcagggagggcgcaataactttcacttgggttgaacgttcgcaaaatgggggtgaaccggactttcacgctgtagaaccttatactaaaaaagaactttcggccgttaccttccctgacattattaggaactacaaggtcatggcagctgagaatatcccagagaatcctttgaagtatttataccccaatatagataaagatcatgcgtttggcaaatattattcccgaccgaaagaagccccagagcctatggagcttgatggcccaaaaggcaccggctatataaagaccgaacttatttcagtgtcagaagtgcacccgtctcgtctacagacaaccgataacctgctgcctatgtcacccgaggaattcgacgaggtgagcaggattgtggggtccgtcgagttcgatagtatgatgaacacagtctag

SEQ ID NO: 30841 - DNA, 543 bp, Artificial Sequence
  Description of Artificial Sequence: Synthetic coding sequence
atgtcccagtggtatgaactgcagcagctggactcaaagtttctcgaacaggtgcaccagctatacgacgattcttttcctatggagatccgccagtacctggcgcagtggctggagaaacaagactgggagcacgcggcaaatgacgttagtttcgcaactattcggtttcatgatctactgagtcagctggatgatcaatattcgcggtttagcctcgagaataacttcttactgcagcataatattcggaagagcaagagaaatctgcaagacaactttcaggaggacccgatccagatgtccatgatcatatacagttgcctgaaggaggagcgtaaaattctggaaaacgctcagcggtttaatcaggcccagagtggcaacatccagtctacggtcatgctggataagcagaaagaactggatagcaaggtgcggaacgtgaaagacaaggtgatgtgcatagaacacgagatcaaaagtctggaagatctgcaggatgaatatgattttaaatgcaagaccctgcagaaccgttag

SEQ ID NO: 30842 - DNA, 213 bp, Artificial Sequence
  Description of Artificial Sequence: Synthetic coding sequence
atgtcacagtggtacgaattgcaacagttggattcaaagttcttggaacaggtgcatcagctctatgacgactcattccctatggaaattcggcagtacctggcccagtggctcgaaaagcaggattgggagcacgctgccaatgatgtgtctttcgctaccattcgcttccacgacctgctatcacagctcgatgatcagtactctaggtag
